United States Patent 7,374,927 (METHODS OF ANALYSIS OF DEGRADED NUCLEIC ACID SAMPLES) - sequence listing, part 6

SEQ ID NO: 200159 - DNA, 25 bp, Homo sapien
gaagggaagctgagtaactccaaca

SEQ ID NO: 200160 - DNA, 25 bp, Homo sapien
ggaagctgagtaactccaacagcaa

SEQ ID NO: 200161 - DNA, 25 bp, Homo sapien
ctgagtaactccaacagcaaagatg

SEQ ID NO: 200162 - DNA, 25 bp, Homo sapien
atgcagactgcaaagccttccgcta

SEQ ID NO: 200163 - DNA, 25 bp, Homo sapien
agactgcaaagccttccgctatgaa

SEQ ID NO: 200164 - DNA, 25 bp, Homo sapien
caaagccttccgctatgaaggtggg

SEQ ID NO: 200165 - DNA, 25 bp, Homo sapien
gaagctggccacaaagtcttctcca

SEQ ID NO: 200166 - DNA, 25 bp, Homo sapien
tggccacaaagtcttctccagtgaa

SEQ ID NO: 200167 - DNA, 25 bp, Homo sapien
gccacaaagtcttctccagtgaaag

SEQ ID NO: 200168 - DNA, 25 bp, Homo sapien
aaagtcttctccagtgaaagtaggg

SEQ ID NO: 200169 - DNA, 25 bp, Homo sapien
gggagaagcggaaagctgctgatga

SEQ ID NO: 200170 - DNA, 25 bp, Homo sapien
ctaaattgtgtcgtaattaagatta

SEQ ID NO: 200171 - DNA, 25 bp, Homo sapien
tatacaatgacttatttttggtggc

SEQ ID NO: 200172 - DNA, 25 bp, Homo sapien
tacaatgacttatttttggtggcaa

SEQ ID NO: 200173 - DNA, 25 bp, Homo sapien
ttttggtggcaaatactttaggagc

SEQ ID NO: 200174 - DNA, 25 bp, Homo sapien
tttggtggcaaatactttaggagca

SEQ ID NO: 200175 - DNA, 25 bp, Homo sapien
ggtggcaaatactttaggagcaata

SEQ ID NO: 200176 - DNA, 25 bp, Homo sapien
ctttaggagcaataatgccttatgg

SEQ ID NO: 200177 - DNA, 25 bp, Homo sapien
aggagcaataatgccttatggtaat

SEQ ID NO: 200178 - DNA, 25 bp, Homo sapien
gagcaataatgccttatggtaatta

SEQ ID NO: 200179 - DNA, 25 bp, Homo sapien
ataatgccttatggtaattattgat

SEQ ID NO: 200180 - DNA, 25 bp, Homo sapien
gtcaaatttgtataaattctcttaa

SEQ ID NO: 200181 - DNA, 25 bp, Homo sapien
gaattagcatacactgtgtgccagg

SEQ ID NO: 200182 - DNA, 25 bp, Homo sapien
gtttcaacgaatcacagcaaggctt

SEQ ID NO: 200183 - DNA, 25 bp, Homo sapien
ttttgtgccttgcactccatgcatt

SEQ ID NO: 200184 - DNA, 25 bp, Homo sapien
ccatgcattctgataacggcagctt

SEQ ID NO: 200185 - DNA, 25 bp, Homo sapien
gataacggcagctttcctaaaaaga

SEQ ID NO: 200186 - DNA, 25 bp, Homo sapien
gggacatttaatttggtatagctga

SEQ ID NO: 200187 - DNA, 25 bp, Homo sapien
gctgattattggctttatttgatga

SEQ ID NO: 200188 - DNA, 25 bp, Homo sapien
atttgatgaatattgctttgtagct

SEQ ID NO: 200189 - DNA, 25 bp, Homo sapien
gtagctttgaaatacgacagtgttc

SEQ ID NO: 200190 - DNA, 25 bp, Homo sapien
atacgacagtgttccaaatcccatc

SEQ ID NO: 200191 - DNA, 25 bp, Homo sapien
caaatcccatcaacaaaatgctgtg

SEQ ID NO: 200192 - DNA, 25 bp, Homo sapien
ccttgagtgaacatcactggtggta

SEQ ID NO: 200193 - DNA, 25 bp, Homo sapien
catcactggtggtaacatggaggga

SEQ ID NO: 200194 - DNA, 25 bp, Homo sapien
gggaagacaacaagagcctttgcct

SEQ ID NO: 200195 - DNA, 25 bp, Homo sapien
acaacaagagcctttgcctggtaat

SEQ ID NO: 200196 - DNA, 25 bp, Homo sapien
aagaccaccaagacaatacttctac

SEQ ID NO: 200197 - DNA, 25 bp, Homo sapien
agacaatacttctacaagtctgcaa

SEQ ID NO: 200198 - DNA, 25 bp, Homo sapien
gaaccagagcattactgggctttga

SEQ ID NO: 200199 - DNA, 25 bp, Homo sapien
attactgggctttgagtccccacta

SEQ ID NO: 200200 - DNA, 25 bp, Homo sapien
gagtccccactaatgcagatacaga

SEQ ID NO: 200201 - DNA, 25 bp, Homo sapien
gcagatacagatgcagtgactaaaa

SEQ ID NO: 200202 - DNA, 25 bp, Homo sapien
gattacaacattcaagtgctttcaa

SEQ ID NO: 200203 - DNA, 25 bp, Homo sapien
tggaagaaccactgactgtgtggat

SEQ ID NO: 200204 - DNA, 25 bp, Homo sapien
ggaagaaccactgactgtgtggatg

SEQ ID NO: 200205 - DNA, 25 bp, Homo sapien
gaagaaccactgactgtgtggatgg

SEQ ID NO: 200206 - DNA, 25 bp, Homo sapien
tgtgtggatggccagcttttcccct

SEQ ID NO: 200207 - DNA, 25 bp, Homo sapien
gtgtggatggccagcttttcccctg

SEQ ID NO: 200208 - DNA, 25 bp, Homo sapien
tgtggatggccagcttttcccctgt

SEQ ID NO: 200209 - DNA, 25 bp, Homo sapien
gtggatggccagcttttcccctgtc

SEQ ID NO: 200210 - DNA, 25 bp, Homo sapien
tggatggccagcttttcccctgtct

SEQ ID NO: 200211 - DNA, 25 bp, Homo sapien
ggatggccagcttttcccctgtctc

SEQ ID NO: 200212 - DNA, 25 bp, Homo sapien
aacagcagcattttcagtaattcct

SEQ ID NO: 200213 - DNA, 25 bp, Homo sapien
gcagcattttcagtaattcctacaa

SEQ ID NO: 200214 - DNA, 25 bp, Homo sapien
cctggtgctgctaattgtgttcatg

SEQ ID NO: 200215 - DNA, 25 bp, Homo sapien
gctaattgtgttcatggtttccttt

SEQ ID NO: 200216 - DNA, 25 bp, Homo sapien
catggtttcctttgattggctattg

SEQ ID NO: 200217 - DNA, 25 bp, Homo sapien
tcctttgattggctattgaaccctt

SEQ ID NO: 200218 - DNA, 25 bp, Homo sapien
gagaagttgattgtcccttaaatgt

SEQ ID NO: 200219 - DNA, 25 bp, Homo sapien
gtgtttgaaacttcttagctgtcac

SEQ ID NO: 200220 - DNA, 25 bp, Homo sapien
gaaacttcttagctgtcactttgga

SEQ ID NO: 200221 - DNA, 25 bp, Homo sapien
ttagctgtcactttggaatcacccc

SEQ ID NO: 200222 - DNA, 25 bp, Homo sapien
ttggaatcaccccaagccaattctc

SEQ ID NO: 200223 - DNA, 25 bp, Homo sapien
cccgtctgtgactgaaggcccggtg

SEQ ID NO: 200224 - DNA, 25 bp, Homo sapien
tgggaaaagaccacgatcctccttg

SEQ ID NO: 200225 - DNA, 25 bp, Homo sapien
ggaaaagaccacgatcctccttgac

SEQ ID NO: 200226 - DNA, 25 bp, Homo sapien
tcccaccgggtctacactagaggat

SEQ ID NO: 200227 - DNA, 25 bp, Homo sapien
gtctacactagaggatcgaggcttg

SEQ ID NO: 200228 - DNA, 25 bp, Homo sapien
gcttgtgatgccttgtgagaaataa

SEQ ID NO: 200229 - DNA, 25 bp, Homo sapien
tgccttgtgagaaataagggcctta

SEQ ID NO: 200230 - DNA, 25 bp, Homo sapien
aagggccttaatttgtactgtctgc

SEQ ID NO: 200231 - DNA, 25 bp, Homo sapien
aatttgtactgtctgcggcattttt

SEQ ID NO: 200232 - DNA, 25 bp, Homo sapien
ctgtctgcggcattttttataatat

SEQ ID NO: 200233 - DNA, 25 bp, Homo sapien
catagagagacaggtgggcattttt

SEQ ID NO: 200234 - DNA, 25 bp, Homo sapien
gggagagatgttcatgtaacctcaa

SEQ ID NO: 200235 - DNA, 25 bp, Homo sapien
aggaatggctggtccagaggctttt

SEQ ID NO: 200236 - DNA, 25 bp, Homo sapien
atggctggtccagaggcttttgtcc

SEQ ID NO: 200237 - DNA, 25 bp, Homo sapien
tggtccagaggcttttgtccactcc

SEQ ID NO: 200238 - DNA, 25 bp, Homo sapien
agaggcttttgtccactccctctca

SEQ ID NO: 200239 - DNA, 25 bp, Homo sapien
gaagtggttgatctccagggaatcc

SEQ ID NO: 200240 - DNA, 25 bp, Homo sapien
agggaatccccaaggttagcctgct

SEQ ID NO: 200241 - DNA, 25 bp, Homo sapien
atccccaaggttagcctgcttaggg

SEQ ID NO: 200242 - DNA, 25 bp, Homo sapien
ggtacctggaatgtaggatctcccc

SEQ ID NO: 200243 - DNA, 25 bp, Homo sapien
tggcctaccaccctaatgtgtctgg

SEQ ID NO: 200244 - DNA, 25 bp, Homo sapien
ctaccaccctaatgtgtctggaatt

SEQ ID NO: 200245 - DNA, 25 bp, Homo sapien
gagagtttggcttgtcctgcatggc

SEQ ID NO: 200246 - DNA, 25 bp, Homo sapien
gcatggccaatccagtgggtgcatc

SEQ ID NO: 200247 - DNA, 25 bp, Homo sapien
ggtgcatccctggacatcagctctt

SEQ ID NO: 200248 - DNA, 25 bp, Homo sapien
tcttcattatgcagcttccctttta

SEQ ID NO: 200249 - DNA, 25 bp, Homo sapien
ttcccttttaggtctttctcaatga

SEQ ID NO: 200250 - DNA, 25 bp, Homo sapien
aggagctttctatcctgaactcttc

SEQ ID NO: 200251 - DNA, 25 bp, Homo sapien
ttcttacctgctttgcggtgcagac

SEQ ID NO: 200252 - DNA, 25 bp, Homo sapien
tttgcggtgcagaccctctcaggag

SEQ ID NO: 200253 - DNA, 25 bp, Homo sapien
aagactcagagcaagtcaccccttt

SEQ ID NO: 200254 - DNA, 25 bp, Homo sapien
aagtcacccctttgtactgaattgt

SEQ ID NO: 200255 - DNA, 25 bp, Homo sapien
gtactgaattgtcctcatcttgtgg

SEQ ID NO: 200256 - DNA, 25 bp, Homo sapien
tgttggaatttattcccttctgttt

SEQ ID NO: 200257 - DNA, 25 bp, Homo sapien
aacttaatttacaagtgctggtaca

SEQ ID NO: 200258 - DNA, 25 bp, Homo sapien
aatttacaagtgctggtacatcttt

SEQ ID NO: 200259 - DNA, 25 bp, Homo sapien
ttacaagtgctggtacatctttttt

SEQ ID NO: 200260 - DNA, 25 bp, Homo sapien
acaagtgctggtacatcttttttct

SEQ ID NO: 200261 - DNA, 25 bp, Homo sapien
caagtgctggtacatcttttttctt

SEQ ID NO: 200262 - DNA, 25 bp, Homo sapien
aacattgatgttaaccagtttatta

SEQ ID NO: 200263 - DNA, 25 bp, Homo sapien
tgatgttaaccagtttattagttta

SEQ ID NO: 200264 - DNA, 25 bp, Homo sapien
aatcagtactttgcatataataagc

SEQ ID NO: 200265 - DNA, 25 bp, Homo sapien
atgcatgtgtatgaacttgtttttc

SEQ ID NO: 200266 - DNA, 25 bp, Homo sapien
tgcatgtgtatgaacttgtttttct

SEQ ID NO: 200267 - DNA, 25 bp, Homo sapien
aacacagcccttcgagacaacgaaa

SEQ ID NO: 200268 - DNA, 25 bp, Homo sapien
aacgaaattcgcagcatgttccgga

SEQ ID NO: 200269 - DNA, 25 bp, Homo sapien
gcatgttccggaagctacacaactc

SEQ ID NO: 200270 - DNA, 25 bp, Homo sapien
tacacaactcctacacagacgtgat

SEQ ID NO: 200271 - DNA, 25 bp, Homo sapien
acacagacgtgatgtgcaacccctt

SEQ ID NO: 200272 - DNA, 25 bp, Homo sapien
atccagtccagcagggcctttgata

SEQ ID NO: 200273 - DNA, 25 bp, Homo sapien
gcctttgataacatggtgacgtcga

SEQ ID NO: 200274 - DNA, 25 bp, Homo sapien
gtgacgtcgatgatgatacaggtgt

SEQ ID NO: 200275 - DNA, 25 bp, Homo sapien
atgatacaggtgtgctgagtgagct

SEQ ID NO: 200276 - DNA, 25 bp, Homo sapien
aggagcccgcgcacgactgtggtgg

SEQ ID NO: 200277 - DNA, 25 bp, Homo sapien
cgtcggtctgttctggttgcctctt

SEQ ID NO: 200278 - DNA, 25 bp, Homo sapien
gtaccacctgacgatgaagactgtg

SEQ ID NO: 200279 - DNA, 25 bp, Homo sapien
gactgtgtgtctgagaagctcctga

SEQ ID NO: 200280 - DNA, 25 bp, Homo sapien
gggaatctccactggtgcctatagg

SEQ ID NO: 200281 - DNA, 25 bp, Homo sapien
gtagcagcatacaggatttaccggc

SEQ ID NO: 200282 - DNA, 25 bp, Homo sapien
atttaccggctgaggtctcgtggtt

SEQ ID NO: 200283 - DNA, 25 bp, Homo sapien
tcgtggttccaccaagatgtccata

SEQ ID NO: 200284 - DNA, 25 bp, Homo sapien
agatgtccatacacctgattcacac

SEQ ID NO: 200285 - DNA, 25 bp, Homo sapien
gattcacacccgagtggcagcgcag

SEQ ID NO: 200286 - DNA, 25 bp, Homo sapien
aggcctgtgcagtgggtgcaatcat

SEQ ID NO: 200287 - DNA, 25 bp, Homo sapien
gtacacaatgtacagcgattacgtc

SEQ ID NO: 200288 - DNA, 25 bp, Homo sapien
ttacgtcaagaggatggcacaggat

SEQ ID NO: 200289 - DNA, 25 bp, Homo sapien
ataaagcttcgtgtaccttatcttg

SEQ ID NO: 200290 - DNA, 25 bp, Homo sapien
agcttcgtgtaccttatcttgatga

SEQ ID NO: 200291 - DNA, 25 bp, Homo sapien
gtgtaccttatcttgatgaaatcaa

SEQ ID NO: 200292 - DNA, 25 bp, Homo sapien
aatagcagcaaataccttgccacat

SEQ ID NO: 200293 - DNA, 25 bp, Homo sapien
ataccttgccacataattctcccta

SEQ ID NO: 200294 - DNA, 25 bp, Homo sapien
aatatcacagcaactcaattcaaga

SEQ ID NO: 200295 - DNA, 25 bp, Homo sapien
aaggacatactatttgagtttttgg

SEQ ID NO: 200296 - DNA, 25 bp, Homo sapien
atatttgagaacgttcacctcagaa

SEQ ID NO: 200297 - DNA, 25 bp, Homo sapien
gaacgttcacctcagaaaatggcat

SEQ ID NO: 200298 - DNA, 25 bp, Homo sapien
ggcatttaaaggacttcggtaacat

SEQ ID NO: 200299 - DNA, 25 bp, Homo sapien
acatagttttattcttgttcagcta

SEQ ID NO: 200300 - DNA, 25 bp, Homo sapien
gaactgtatgccaatgatcctgagt

SEQ ID NO: 200301 - DNA, 25 bp, Homo sapien
gtatgccaatgatcctgagtttgca

SEQ ID NO: 200302 - DNA, 25 bp, Homo sapien
tcctgagtttgcagcttttgtgaga

SEQ ID NO: 200303 - DNA, 25 bp, Homo sapien
tgcagcttttgtgagagagcaacaa

SEQ ID NO: 200304 - DNA, 25 bp, Homo sapien
gagcaacaagtggaagaggtttaac

SEQ ID NO: 200305 - DNA, 25 bp, Homo sapien
aaccaaaactcctgttctgaaactg

SEQ ID NO: 200306 - DNA, 25 bp, Homo sapien
ctgaaactgattagaagcctggaga

SEQ ID NO: 200307 - DNA, 25 bp, Homo sapien
gaagatggagattacttgttactta

SEQ ID NO: 200308 - DNA, 25 bp, Homo sapien
gagattacttgttacttatgtcata

SEQ ID NO: 200309 - DNA, 25 bp, Homo sapien
atgtcatataattaacctggatttt

SEQ ID NO: 200310 - DNA, 25 bp, Homo sapien
aaaattaaatatagggcacactgtt

SEQ ID NO: 200311 - DNA, 25 bp, Homo sapien
tctagggaggttgttcaggagctca

SEQ ID NO: 200312 - DNA, 25 bp, Homo sapien
aggagcagtgatttccctccccact

SEQ ID NO: 200313 - DNA, 25 bp, Homo sapien
actccttctccttctagatggtaac

SEQ ID NO: 200314 - DNA, 25 bp, Homo sapien
ttctccttctagatggtaaccacag

SEQ ID NO: 200315 - DNA, 25 bp, Homo sapien
ttctagatggtaaccacagcctcga

SEQ ID NO: 200316 - DNA, 25 bp, Homo sapien
gatggtaaccacagcctcgaccatg

SEQ ID NO: 200317 - DNA, 25 bp, Homo sapien
tgacccagcttcacctcatggacaa

SEQ ID NO: 200318 - DNA, 25 bp, Homo sapien
tcatggacaacccttcttggttcat

SEQ ID NO: 200319 - DNA, 25 bp, Homo sapien
atggacaacccttcttggttcatct

SEQ ID NO: 200320 - DNA, 25 bp, Homo sapien
ttttaatatgcttgttcagctctaa

SEQ ID NO: 200321 - DNA, 25 bp, Homo sapien
aatatgcttgttcagctctaataaa

SEQ ID NO: 200322 - DNA, 25 bp, Homo sapien
ttcttttttactttgcacatcagtg

SEQ ID NO: 200323 - DNA, 25 bp, Homo sapien
acatcagtgttagcctttccctatt

SEQ ID NO: 200324 - DNA, 25 bp, Homo sapien
ctttccctatttcagcacaatctta

SEQ ID NO: 200325 - DNA, 25 bp, Homo sapien
agcacaatcttagactcatatttgc

SEQ ID NO: 200326 - DNA, 25 bp, Homo sapien
atatttgcacacttttgtgtcgtga

SEQ ID NO: 200327 - DNA, 25 bp, Homo sapien
acttttgtgtcgtgaagttctagac

SEQ ID NO: 200328 - DNA, 25 bp, Homo sapien
aagagcatttacagcagaggttaat

SEQ ID NO: 200329 - DNA, 25 bp, Homo sapien
gtatttggtctggttcatatggtca

SEQ ID NO: 200330 - DNA, 25 bp, Homo sapien
tatggtcaaatattactgccttggt

SEQ ID NO: 200331 - DNA, 25 bp, Homo sapien
actgccttggtagcatttatttaag

SEQ ID NO: 200332 - DNA, 25 bp, Homo sapien
tgcaggacctaactcgttttttcct

SEQ ID NO: 200333 - DNA, 25 bp, Homo sapien
aacgagtattcagctcttcacaggg

SEQ ID NO: 200334 - DNA, 25 bp, Homo sapien
gacaacgttgcagtcattggagaaa

SEQ ID NO: 200335 - DNA, 25 bp, Homo sapien
gaagaaacagattctgcgcttgatt

SEQ ID NO: 200336 - DNA, 25 bp, Homo sapien
gggaatattcgagcagaacctttaa

SEQ ID NO: 200337 - DNA, 25 bp, Homo sapien
ttaaattctgtagcacactgaggaa

SEQ ID NO: 200338 - DNA, 25 bp, Homo sapien
aaactacatacttggacatctgtaa

SEQ ID NO: 200339 - DNA, 25 bp, Homo sapien
cttggacatctgtaaatctttgtac

SEQ ID NO: 200340 - DNA, 25 bp, Homo sapien
gaaactgattattctgaggatgata

SEQ ID NO: 200341 - DNA, 25 bp, Homo sapien
gagtttttatgagtgtgtctctgga

SEQ ID NO: 200342 - DNA, 25 bp, Homo sapien
tctctggattttgaccccttattga

SEQ ID NO: 200343 - DNA, 25 bp, Homo sapien
gaccccttattgattcattgtaata

SEQ ID NO: 200344 - DNA, 25 bp, Homo sapien
aatccaggttgttggttggactgtt

SEQ ID NO: 200345 - DNA, 25 bp, Homo sapien
tggactgttaatacctttgatgaaa

SEQ ID NO: 200346 - DNA, 25 bp, Homo sapien
gagttactacgaatcccatcttggt

SEQ ID NO: 200347 - DNA, 25 bp, Homo sapien
gaatcccatcttggttccagctata

SEQ ID NO: 200348 - DNA, 25 bp, Homo sapien
gttccagctatatcactgacagcat

SEQ ID NO: 200349 - DNA, 25 bp, Homo sapien
tggtagaagactgcgaacctcactt

SEQ ID NO: 200350 - DNA, 25 bp, Homo sapien
atgatggacattttgctcgattgga

SEQ ID NO: 200351 - DNA, 25 bp, Homo sapien
gctcgattggagcatgcataatatc

SEQ ID NO: 200352 - DNA, 25 bp, Homo sapien
aatatcttgtggtacctgtgtggaa

SEQ ID NO: 200353 - DNA, 25 bp, Homo sapien
ggaatttcagctttcctcatgcaaa

SEQ ID NO: 200354 - DNA, 25 bp, Homo sapien
tatccccggcctacttgaagaagtg

SEQ ID NO: 200355 - DNA, 25 bp, Homo sapien
tggctggactgtgaccatccctgat

SEQ ID NO: 200356 - DNA, 25 bp, Homo sapien
gctggactgtgaccatccctgatgg

SEQ ID NO: 200357 - DNA, 25 bp, Homo sapien
ctggactgtgaccatccctgatggg

SEQ ID NO: 200358 - DNA, 25 bp, Homo sapien
tgaccgcgggagctgaggaagcgcc

SEQ ID NO: 200359 - DNA, 25 bp, Homo sapien
tgccctccaaggacccgcatggagg

SEQ ID NO: 200360 - DNA, 25 bp, Homo sapien
ccaaggacccgcatggaggcagtgg

SEQ ID NO: 200361 - DNA, 25 bp, Homo sapien
ctgctgctccctgtcagagtcaaag

SEQ ID NO: 200362 - DNA, 25 bp, Homo sapien
gctgctccctgtcagagtcaaagca

SEQ ID NO: 200363 - DNA, 25 bp, Homo sapien
ttcctgaggttggtgcccactggct

SEQ ID NO: 200364 - DNA, 25 bp, Homo sapien
tcctgaggttggtgcccactggctg

SEQ ID NO: 200365 - DNA, 25 bp, Homo sapien
aggttggtgcccactggctgggacc

SEQ ID NO: 200366 - DNA, 25 bp, Homo sapien
gtcccggcacagtgtcagcgaggct

SEQ ID NO: 200367 - DNA, 25 bp, Homo sapien
ttctctcagctcgttccagtgtgga

SEQ ID NO: 200368 - DNA, 25 bp, Homo sapien
cagtgtggactttcaggcctttgga

SEQ ID NO: 200369 - DNA, 25 bp, Homo sapien
aatgagtacttctgctgagggatat

SEQ ID NO: 200370 - DNA, 25 bp, Homo sapien
tgagggatatgcctccgcaactcac

SEQ ID NO: 200371 - DNA, 25 bp, Homo sapien
ttctttagctctgacacctgagtac

SEQ ID NO: 200372 - DNA, 25 bp, Homo sapien
tgagtacacgatcacccactcttac

SEQ ID NO: 200373 - DNA, 25 bp, Homo sapien
gggtacctgcttactcagatactta

SEQ ID NO: 200374 - DNA, 25 bp, Homo sapien
agatacttacacacaacaacagcag

SEQ ID NO: 200375 - DNA, 25 bp, Homo sapien
cagcaagctgctactgcaacaaccg

SEQ ID NO: 200376 - DNA, 25 bp, Homo sapien
gcaacaaccgctaacacttgttaag

SEQ ID NO: 200377 - DNA, 25 bp, Homo sapien
tgatagctttcatcattgaacttaa

SEQ ID NO: 200378 - DNA, 25 bp, Homo sapien
cattgaacttaataaactgacctta

SEQ ID NO: 200379 - DNA, 25 bp, Homo sapien
cttggaggatgctggaaacaacgtg

SEQ ID NO: 200380 - DNA, 25 bp, Homo sapien
acaacgtggaggtagatgagtcttt

SEQ ID NO: 200381 - DNA, 25 bp, Homo sapien
gatgatccagactataatcctgctg

SEQ ID NO: 200382 - DNA, 25 bp, Homo sapien
agactataatcctgctgacccagag

SEQ ID NO: 200383 - DNA, 25 bp, Homo sapien
gagagtgactcagctgactaatgga

SEQ ID NO: 200384 - DNA, 25 bp, Homo sapien
tcagctgactaatggactgtcccca

SEQ ID NO: 200385 - DNA, 25 bp, Homo sapien
ctaatggactgtccccatctgcaga

SEQ ID NO: 200386 - DNA, 25 bp, Homo sapien
catctgcagagaggcttgactgcca

SEQ ID NO: 200387 - DNA, 25 bp, Homo sapien
aggcttgactgccacagcatctgtg

SEQ ID NO: 200388 - DNA, 25 bp, Homo sapien
gcagccgtagacaccagctccgaaa

SEQ ID NO: 200389 - DNA, 25 bp, Homo sapien
cagccgtagacaccagctccgaaat

SEQ ID NO: 200390 - DNA, 25 bp, Homo sapien
agccgtagacaccagctccgaaatc

SEQ ID NO: 200391 - DNA, 25 bp, Homo sapien
gccgtagacaccagctccgaaatca

SEQ ID NO: 200392 - DNA, 25 bp, Homo sapien
ccgtagacaccagctccgaaatcac

SEQ ID NO: 200393 - DNA, 25 bp, Homo sapien
gtagacaccagctccgaaatcacca

SEQ ID NO: 200394 - DNA, 25 bp, Homo sapien
tagacaccagctccgaaatcaccac

SEQ ID NO: 200395 - DNA, 25 bp, Homo sapien
agacaccagctccgaaatcaccacc

SEQ ID NO: 200396 - DNA, 25 bp, Homo sapien
atcctgctgacggaacacgttcggg

SEQ ID NO: 200397 - DNA, 25 bp, Homo sapien
tgctgacggaacacgttcgggtttt

SEQ ID NO: 200398 - DNA, 25 bp, Homo sapien
tttggttttgtttcgttcacctctg

SEQ ID NO: 200399 - DNA, 25 bp, Homo sapien
tttgtttcgttcacctctgtctaga

SEQ ID NO: 200400 - DNA, 25 bp, Homo sapien
ttcgttcacctctgtctagatgcaa

SEQ ID NO: 200401 - DNA, 25 bp, Homo sapien
gttcacctctgtctagatgcaactt

SEQ ID NO: 200402 - DNA, 25 bp, Homo sapien
gtctagatgcaacttttgttcctcc

SEQ ID NO: 200403 - DNA, 25 bp, Homo sapien
tagatgcaacttttgttcctcctcc

SEQ ID NO: 200404 - DNA, 25 bp, Homo sapien
tgccctgtcctcgtggtgagtcgct

SEQ ID NO: 200405 - DNA, 25 bp, Homo sapien
tgtcctcgtggtgagtcgctgacca

SEQ ID NO: 200406 - DNA, 25 bp, Homo sapien
tggtgagtcgctgaccacggcttcc

SEQ ID NO: 200407 - DNA, 25 bp, Homo sapien
cctattccttggttctgtcagagaa

SEQ ID NO: 200408 - DNA, 25 bp, Homo sapien
gtcagagaacctaataagtgctact

SEQ ID NO: 200409 - DNA, 25 bp, Homo sapien
gctactttgccattaaggcagacta

SEQ ID NO: 200410 - DNA, 25 bp, Homo sapien
taaggcagactagggttcatgtctt

SEQ ID NO: 200411 - DNA, 25 bp, Homo sapien
attttcgacgtttgactagccatct

SEQ ID NO: 200412 - DNA, 25 bp, Homo sapien
gactagccatctcaagcaactttcg

SEQ ID NO: 200413 - DNA, 25 bp, Homo sapien
gcaactttcgacgtttgactagcca

SEQ ID NO: 200414 - DNA, 25 bp, Homo sapien
tgactagccatctcaagcaagttta

SEQ ID NO: 200415 - DNA, 25 bp, Homo sapien
tcatctcacgctgatcattggatcc

SEQ ID NO: 200416 - DNA, 25 bp, Homo sapien
acgctgatcattggatcctactcaa

SEQ ID NO: 200417 - DNA, 25 bp, Homo sapien
aagggtggtcagaagtacattaaag

SEQ ID NO: 200418 - DNA, 25 bp, Homo sapien
caaggccttgcgcatgaccgacgca

SEQ ID NO: 200419 - DNA, 25 bp, Homo sapien
aggccttgcgcatgaccgacgcaca

SEQ ID NO: 200420 - DNA, 25 bp, Homo sapien
ttgcgcatgaccgacgcacaggtca

SEQ ID NO: 200421 - DNA, 25 bp, Homo sapien
gcgcatgaccgacgcacaggtcaaa

SEQ ID NO: 200422 - DNA, 25 bp, Homo sapien
gcatgaccgacgcacaggtcaaaac

SEQ ID NO: 200423 - DNA, 25 bp, Homo sapien
accgacgcacaggtcaaaacgtggt

SEQ ID NO: 200424 - DNA, 25 bp, Homo sapien
gacgcacaggtcaaaacgtggttcc

SEQ ID NO: 200425 - DNA, 25 bp, Homo sapien
cgcacaggtcaaaacgtggttccag

SEQ ID NO: 200426 - DNA, 25 bp, Homo sapien
cgacgcaccaagtggcggcgccaga

SEQ ID NO: 200427 - DNA, 25 bp, Homo sapien
tgcatctgcagcaggacgcgttgcc

SEQ ID NO: 200428 - DNA, 25 bp, Homo sapien
gtccgggctcgcctcggtggtgtga

SEQ ID NO: 200429 - DNA, 25 bp, Homo sapien
ataaaagggctcttcgactgcgact

SEQ ID NO: 200430 - DNA, 25 bp, Homo sapien
gactgcgactgaatggcttgtttta

SEQ ID NO: 200431 - DNA, 25 bp, Homo sapien
tatggcttacttaccctgggatgga

SEQ ID NO: 200432 - DNA, 25 bp, Homo sapien
aatgactctttaatttcctcttatt

SEQ ID NO: 200433 - DNA, 25 bp, Homo sapien
tcctcttattatggatagctgggta

SEQ ID NO: 200434 - DNA, 25 bp, Homo sapien
gagtgagagatcatctctgactccc

SEQ ID NO: 200435 - DNA, 25 bp, Homo sapien
gactcccctttttgctcttgtgtaa

SEQ ID NO: 200436 - DNA, 25 bp, Homo sapien
aaatgggctctttggctggatctgc

SEQ ID NO: 200437 - DNA, 25 bp, Homo sapien
caaactaaattgacaccaggcatat

SEQ ID NO: 200438 - DNA, 25 bp, Homo sapien
tatacatcatcgacgtgttcatggg

SEQ ID NO: 200439 - DNA, 25 bp, Homo sapien
gaatccgaggaagtaaccacagcaa

SEQ ID NO: 200440 - DNA, 25 bp, Homo sapien
gcatcatagtgatttatctgagctt

SEQ ID NO: 200441 - DNA, 25 bp, Homo sapien
atttatctgagcttagtgaccccca

SEQ ID NO: 200442 - DNA, 25 bp, Homo sapien
ccccatcttgtaacctgttgcaaga

SEQ ID NO: 200443 - DNA, 25 bp, Homo sapien
gtaacctgttgcaagagtgaatgta

SEQ ID NO: 200444 - DNA, 25 bp, Homo sapien
gtggcattttaaaaggtcgcctttg

SEQ ID NO: 200445 - DNA, 25 bp, Homo sapien
ttaaaaggtcgcctttgatgcagat

SEQ ID NO: 200446 - DNA, 25 bp, Homo sapien
gatgcagatgcatctttttcttgct

SEQ ID NO: 200447 - DNA, 25 bp, Homo sapien
agatgcatctttttcttgcttctaa

SEQ ID NO: 200448 - DNA, 25 bp, Homo sapien
tattttacctgaaactgttaagccg

SEQ ID NO: 200449 - DNA, 25 bp, Homo sapien
aactgttaagccgaccaagatccct

SEQ ID NO: 200450 - DNA, 25 bp, Homo sapien
cctgcaagacagatgggaatgtgta

SEQ ID NO: 200451 - DNA, 25 bp, Homo sapien
aggaccagcccgttcaggactttga

SEQ ID NO: 200452 - DNA, 25 bp, Homo sapien
gttcaggactttgaatgccagccaa

SEQ ID NO: 200453 - DNA, 25 bp, Homo sapien
aaggccacgtctgacttgggaggca

SEQ ID NO: 200454 - DNA, 25 bp, Homo sapien
gagggcagctactgcaggtttccga

SEQ ID NO: 200455 - DNA, 25 bp, Homo sapien
ctgcaggtttccgagcagagggtca

SEQ ID NO: 200456 - DNA, 25 bp, Homo sapien
gggtcatacacagggctggacctca

SEQ ID NO: 200457 - DNA, 25 bp, Homo sapien
tggacctcacgcagactggcatggc

SEQ ID NO: 200458 - DNA, 25 bp, Homo sapien
catggccatgggtccagaggatact

SEQ ID NO: 200459 - DNA, 25 bp, Homo sapien
ggatggcagctactgccaccttcca

SEQ ID NO: 200460 - DNA, 25 bp, Homo sapien
tggttccatggagttctgatctttg

SEQ ID NO: 200461 - DNA, 25 bp, Homo sapien
taggagttgaaatgggtcagacccg

SEQ ID NO: 200462 - DNA, 25 bp, Homo sapien
agctcagaataaactcaggtaaaga

SEQ ID NO: 200463 - DNA, 25 bp, Homo sapien
gctcagaataaactcaggtaaagag

SEQ ID NO: 200464 - DNA, 25 bp, Homo sapien
ctcagaataaactcaggtaaagagt

SEQ ID NO: 200465 - DNA, 25 bp, Homo sapien
tcagaataaactcaggtaaagagta

SEQ ID NO: 200466 - DNA, 25 bp, Homo sapien
aagagtaaagaggagggtgggcaca

SEQ ID NO: 200467 - DNA, 25 bp, Homo sapien
agagtaaagaggagggtgggcacag

SEQ ID NO: 200468 - DNA, 25 bp, Homo sapien
gagtaaagaggagggtgggcacagt

SEQ ID NO: 200469 - DNA, 25 bp, Homo sapien
agtaaagaggagggtgggcacagtg

SEQ ID NO: 200470 - DNA, 25 bp, Homo sapien
gtaaagaggagggtgggcacagtgg

SEQ ID NO: 200471 - DNA, 25 bp, Homo sapien
taaagaggagggtgggcacagtggc

SEQ ID NO: 200472 - DNA, 25 bp, Homo sapien
aaagaggagggtgggcacagtggct

SEQ ID NO: 200473 - DNA, 25 bp, Homo sapien
attggagctttcaacacagcccggg

SEQ ID NO: 200474 - DNA, 25 bp, Homo sapien
agcccgggagctgttccttatattc

SEQ ID NO: 200475 - DNA, 25 bp, Homo sapien
ttcttcaaggacttagacatccacc

SEQ ID NO: 200476 - DNA, 25 bp, Homo sapien
agacatccaccctggagctactgga

SEQ ID NO: 200477 - DNA, 25 bp, Homo sapien
gagctactggacctttgtccatgtc

SEQ ID NO: 200478 - DNA, 25 bp, Homo sapien
gtccatgtctggttttgaatcttct

SEQ ID NO: 200479 - DNA, 25 bp, Homo sapien
ctggttttgaatcttcttccattcc

SEQ ID NO: 200480 - DNA, 25 bp, Homo sapien
tgggtttagctggtttggattttag

SEQ ID NO: 200481 - DNA, 25 bp, Homo sapien
atcaaatacaggaattgggctcaat

SEQ ID NO: 200482 - DNA, 25 bp, Homo sapien
ggctcaatgagcgtactgcaagcac

SEQ ID NO: 200483 - DNA, 25 bp, Homo sapien
gagcgtactgcaagcacttactaag

SEQ ID NO: 200484 - DNA, 25 bp, Homo sapien
gatagcaagcattcttttcctgaaa

SEQ ID NO: 200485 - DNA, 25 bp, Homo sapien
attggtcatgtagcttttctgcgaa

SEQ ID NO: 200486 - DNA, 25 bp, Homo sapien
ggtcatgtagcttttctgcgaaata

SEQ ID NO: 200487 - DNA, 25 bp, Homo sapien
tgtagcttttctgcgaaatagtatt

SEQ ID NO: 200488 - DNA, 25 bp, Homo sapien
taaaccctaaatcttgccagactgc

SEQ ID NO: 200489 - DNA, 25 bp, Homo sapien
gccagactgcattagtattttggca

SEQ ID NO: 200490 - DNA, 25 bp, Homo sapien
gtattttggcattgaaacttgtgca

SEQ ID NO: 200491 - DNA, 25 bp, Homo sapien
aacttgtgcaatatctgtgtaatgt

SEQ ID NO: 200492 - DNA, 25 bp, Homo sapien
gtgcatgcagatgtctggtactgga

SEQ ID NO: 200493 - DNA, 25 bp, Homo sapien
atgtctggtactggagtaagctgaa

SEQ ID NO: 200494 - DNA, 25 bp, Homo sapien
gtaagctgaaggtatgtgcagtatt

SEQ ID NO: 200495 - DNA, 25 bp, Homo sapien
gtagtttattagaagctcttaagtc

SEQ ID NO: 200496 - DNA, 25 bp, Homo sapien
gctcttaagtctttaatagacctgc

SEQ ID NO: 200497 - DNA, 25 bp, Homo sapien
agacctgcatatttccttcccttat

SEQ ID NO: 200498 - DNA, 25 bp, Homo sapien
tttccttcccttatgatttcctata

SEQ ID NO: 200499 - DNA, 25 bp, Homo sapien
catatgtaaataactcttgacagga

SEQ ID NO: 200500 - DNA, 25 bp, Homo sapien
taatgtagtatttgccccctatcag

SEQ ID NO: 200501 - DNA, 25 bp, Homo sapien
atttgccccctatcagtgagctgaa

SEQ ID NO: 200502 - DNA, 25 bp, Homo sapien
atcagtgagctgaacaaatacatca

SEQ ID NO: 200503 - DNA, 25 bp, Homo sapien
tcatttaaatctatgctgcactttg

SEQ ID NO: 200504 - DNA, 25 bp, Homo sapien
atgctgcactttgagttgctacaaa

SEQ ID NO: 200505 - DNA, 25 bp, Homo sapien
gagttgctacaaatatggttcgatt

SEQ ID NO: 200506 - DNA, 25 bp, Homo sapien
acagccaccgcacgtcacagtacat

SEQ ID NO: 200507 - DNA, 25 bp, Homo sapien
ccgcacgtcacagtacatgccagct

SEQ ID NO: 200508 - DNA, 25 bp, Homo sapien
ggcgtacccagactacgcagaccag

SEQ ID NO: 200509 - DNA, 25 bp, Homo sapien
cgtacccagactacgcagaccagag

SEQ ID NO: 200510 - DNA, 25 bp, Homo sapien
cagactacgcagaccagagcacata

SEQ ID NO: 200511 - DNA, 25 bp, Homo sapien
gactacgcagaccagagcacataga

SEQ ID NO: 200512 - DNA, 25 bp, Homo sapien
tacgcagaccagagcacatagaggg

SEQ ID NO: 200513 - DNA, 25 bp, Homo sapien
cgcagaccagagcacatagagggca

SEQ ID NO: 200514 - DNA, 25 bp, Homo sapien
gaccagagcacatagagggcagcat

SEQ ID NO: 200515 - DNA, 25 bp, Homo sapien
agagcacatagagggcagcatttgg

SEQ ID NO: 200516 - DNA, 25 bp, Homo sapien
atgtgctggtcaataaatgtgtcag

SEQ ID NO: 200517 - DNA, 25 bp, Homo sapien
aagcaagttactgtccagccaggta

SEQ ID NO: 200518 - DNA, 25 bp, Homo sapien
cagccaggtagtcggacacggacca

SEQ ID NO: 200519 - DNA, 25 bp, Homo sapien
gacacggaccaaagctggcagagga

SEQ ID NO: 200520 - DNA, 25 bp, Homo sapien
attctgaatttctagggtccaaaag

SEQ ID NO: 200521 - DNA, 25 bp, Homo sapien
gggtgggccatgttcattaagccat

SEQ ID NO: 200522 - DNA, 25 bp, Homo sapien
gttcattaagccatagtggtcccta

SEQ ID NO: 200523 - DNA, 25 bp, Homo sapien
agtggtccctagttcattgttgagc

SEQ ID NO: 200524 - DNA, 25 bp, Homo sapien
gttgagcaagttttagccctgcagt

SEQ ID NO: 200525 - DNA, 25 bp, Homo sapien
agttttagccctgcagttttcacca

SEQ ID NO: 200526 - DNA, 25 bp, Homo sapien
cccagcattctggtttttatgtttt

SEQ ID NO: 200527 - DNA, 25 bp, Homo sapien
tttatgatctatgcagacaactgtg

SEQ ID NO: 200528 - DNA, 25 bp, Homo sapien
agtcactctgccgaaggcgctgacg

SEQ ID NO: 200529 - DNA, 25 bp, Homo sapien
gtcactctgccgaaggcgctgacgg

SEQ ID NO: 200530 - DNA, 25 bp, Homo sapien
tcactctgccgaaggcgctgacggc

SEQ ID NO: 200531 - DNA, 25 bp, Homo sapien
actctgccgaaggcgctgacggcat

SEQ ID NO: 200532 - DNA, 25 bp, Homo sapien
cgaaggcgctgacggcatcgcggcc

SEQ ID NO: 200533 - DNA, 25 bp, Homo sapien
aggcgctgacggcatcgcggccgga

SEQ ID NO: 200534 - DNA, 25 bp, Homo sapien
gcgctgacggcatcgcggccggaac

SEQ ID NO: 200535 - DNA, 25 bp, Homo sapien
atcgcggccggaacctctgggcccg

SEQ ID NO: 200536 - DNA, 25 bp, Homo sapien
aaacttcgctggaaatgagtagcca

SEQ ID NO: 200537 - DNA, 25 bp, Homo sapien
aacttcgctggaaatgagtagccag

SEQ ID NO: 200538 - DNA, 25 bp, Homo sapien
gctggaaatgagtagccaggaagtt

SEQ ID NO: 200539 - DNA, 25 bp, Homo sapien
tcgagatctctcttcggggggtcaa

SEQ ID NO: 200540 - DNA, 25 bp, Homo sapien
ggtcaagctgagtctgagcggagga

SEQ ID NO: 200541 - DNA, 25 bp, Homo sapien
tctgagcggaggagggcccgagttc

SEQ ID NO: 200542 - DNA, 25 bp, Homo sapien
tgccacgtctttgtctcccaggagt

SEQ ID NO: 200543 - DNA, 25 bp, Homo sapien
gtctttgtctcccaggagtccatga

SEQ ID NO: 200544 - DNA, 25 bp, Homo sapien
aggagtccatgaggccggtggcgca

SEQ ID NO: 200545 - DNA, 25 bp, Homo sapien
gcgccttcctggagtactaccaaga

SEQ ID NO: 200546 - DNA, 25 bp, Homo sapien
gagtactaccaagagcacctggcgt

SEQ ID NO: 200547 - DNA, 25 bp, Homo sapien
accaagagcacctggcgtacgcctg

SEQ ID NO: 200548 - DNA, 25 bp, Homo sapien
cccacggaggacatctacctggagt

SEQ ID NO: 200549 - DNA, 25 bp, Homo sapien
cacggaggacatctacctggagtag

SEQ ID NO: 200550 - DNA, 25 bp, Homo sapien
tttaatactgtggatcaaggaaaga

SEQ ID NO: 200551 - DNA, 25 bp, Homo sapien
gatagcaagcattcttttcctgaaa

SEQ ID NO: 200552 - DNA, 25 bp, Homo sapien
gcaagcattcttttcctgaaattgg

SEQ ID NO: 200553 - DNA, 25 bp, Homo sapien
aacttgtgcaatatctgtgtaatgt

SEQ ID NO: 200554 - DNA, 25 bp, Homo sapien
gtgcaatatctgtgtaatgtagaat

SEQ ID NO: 200555 - DNA, 25 bp, Homo sapien
gtgcatgcagatgtctggtactgga

SEQ ID NO: 200556 - DNA, 25 bp, Homo sapien
atgcagatgtctggtactggagtaa

SEQ ID NO: 200557 - DNA, 25 bp, Homo sapien
atgtctggtactggagtaagctgaa

SEQ ID NO: 200558 - DNA, 25 bp, Homo sapien
gtaagctgaaggtatgtgcagtatt

SEQ ID NO: 200559 - DNA, 25 bp, Homo sapien
tgaaggtatgtgcagtatttaagaa

SEQ ID NO: 200560 - DNA, 25 bp, Homo sapien
aattcacttataaaaccatttacat

SEQ ID NO: 200561 - DNA, 25 bp, Homo sapien
cgctccgggctgcagtaggaagtgg

SEQ ID NO: 200562 - DNA, 25 bp, Homo sapien
agtaggaagtggacagagcgcccct

SEQ ID NO: 200563 - DNA, 25 bp, Homo sapien
taggaagtggacagagcgcccctcc

SEQ ID NO: 200564 - DNA, 25 bp, Homo sapien
cgcggagcccttggcccctcggaca

SEQ ID NO: 200565 - DNA, 25 bp, Homo sapien
ggacagcccatctgcctgttctgag

SEQ ID NO: 200566 - DNA, 25 bp, Homo sapien
cagcccatctgcctgttctgaggat

SEQ ID NO: 200567 - DNA, 25 bp, Homo sapien
agcccatctgcctgttctgaggatt

SEQ ID NO: 200568 - DNA, 25 bp, Homo sapien
cccatctgcctgttctgaggattca

SEQ ID NO: 200569 - DNA, 25 bp, Homo sapien
ggtgctggatggacagtgggcatca

SEQ ID NO: 200570 - DNA, 25 bp, Homo sapien
ctggatggacagtgggcatcagcag

SEQ ID NO: 200571 - DNA, 25 bp, Homo sapien
atcagcagcagggttttgggttgac

SEQ ID NO: 200572 - DNA, 25 bp, Homo sapien
ttcacagtaggtaatggctccggcc

SEQ ID NO: 200573 - DNA, 25 bp, Homo sapien
tcacagtaggtaatggctccggccc

SEQ ID NO: 200574 - DNA, 25 bp, Homo sapien
acagtaggtaatggctccggcccgg

SEQ ID NO: 200575 - DNA, 25 bp, Homo sapien
taggtaatggctccggcccgggtgt

SEQ ID NO: 200576 - DNA, 25 bp, Homo sapien
ccgggtgttcgctgtccacggaaca

SEQ ID NO: 200577 - DNA, 25 bp, Homo sapien
gggtgttcgctgtccacggaacatg

SEQ ID NO: 200578 - DNA, 25 bp, Homo sapien
gtgttcgctgtccacggaacatggc

SEQ ID NO: 200579 - DNA, 25 bp, Homo sapien
gttcgctgtccacggaacatggcag

SEQ ID NO: 200580 - DNA, 25 bp, Homo sapien
tcgctgtccacggaacatggcagag

SEQ ID NO: 200581 - DNA, 25 bp, Homo sapien
cgctgtccacggaacatggcagagg

SEQ ID NO: 200582 - DNA, 25 bp, Homo sapien
cggcccggaaagacgccagagccag

SEQ ID NO: 200583 - DNA, 25 bp, Homo sapien
gcaggtgcaagtggactgccacttt

SEQ ID NO: 200584 - DNA, 25 bp, Homo sapien
tgccactttctgcagctctacctgt

SEQ ID NO: 200585 - DNA, 25 bp, Homo sapien
agctctacctgtggcgttttgtggc

SEQ ID NO: 200586 - DNA, 25 bp, Homo sapien
gttttgtggccgacgaagaactcgt

SEQ ID NO: 200587 - DNA, 25 bp, Homo sapien
aagaactcgtgcacttgctgctgga

SEQ ID NO: 200588 - DNA, 25 bp, Homo sapien
agcccagtgtggttgaggtcatctg

SEQ ID NO: 200589 - DNA, 25 bp, Homo sapien
ttgaggtcatctgcgagcgcggcta

SEQ ID NO: 200590 - DNA, 25 bp, Homo sapien
atggcacccaggatctggtctcggt

SEQ ID NO: 200591 - DNA, 25 bp, Homo sapien
acccaggatctggtctcggtggtcc

SEQ ID NO: 200592 - DNA, 25 bp, Homo sapien
gtccttccccgcaggcaggtgtcag

SEQ ID NO: 200593 - DNA, 25 bp, Homo sapien
caggaccggcctaataaacatgtgt

SEQ ID NO: 200594 - DNA, 25 bp, Homo sapien
gccatgctcaggagccaccagcaaa

SEQ ID NO: 200595 - DNA, 25 bp, Homo sapien
gagccaccagcaaagcgcagaaagg

SEQ ID NO: 200596 - DNA, 25 bp, Homo sapien
ccagcaaagcgcagaaagggttcca

SEQ ID NO: 200597 - DNA, 25 bp, Homo sapien
caaagcgcagaaagggttccaaagg

SEQ ID NO: 200598 - DNA, 25 bp, Homo sapien
ttccaaagggccggaaggctagatg

SEQ ID NO: 200599 - DNA, 25 bp, Homo sapien
ggcctccctgtgactacctcaaagg

SEQ ID NO: 200600 - DNA, 25 bp, Homo sapien
aggcacccccaaatcaagcagtcag

SEQ ID NO: 200601 - DNA, 25 bp, Homo sapien
aatcaagcagtcagtttgcacaaca

SEQ ID NO: 200602 - DNA, 25 bp, Homo sapien
cagtcagtttgcacaacaagatggg

SEQ ID NO: 200603 - DNA, 25 bp, Homo sapien
atattgagggagacagcgctaagga

SEQ ID NO: 200604 - DNA, 25 bp, Homo sapien
agacagcgctaaggatggttttatc

SEQ ID NO: 200605 - DNA, 25 bp, Homo sapien
tggccaggcagtacaggctgatcgt

SEQ ID NO: 200606 - DNA, 25 bp, Homo sapien
aggcagtacaggctgatcgtccaca

SEQ ID NO: 200607 - DNA, 25 bp, Homo sapien
agtacaggctgatcgtccacaacgg

SEQ ID NO: 200608 - DNA, 25 bp, Homo sapien
aggctgatcgtccacaacggttact

SEQ ID NO: 200609 - DNA, 25 bp, Homo sapien
tgatcgtccacaacggttactgcga

SEQ ID NO: 200610 - DNA, 25 bp, Homo sapien
gtccacaacggttactgcgatggca

SEQ ID NO: 200611 - DNA, 25 bp, Homo sapien
acaacggttactgcgatggcagatc

SEQ ID NO: 200612 - DNA, 25 bp, Homo sapien
gaaaccttttgtagcaatatcaaga

SEQ ID NO: 200613 - DNA, 25 bp, Homo sapien
caagaatctagtttcatctgagaac

SEQ ID NO: 200614 - DNA, 25 bp, Homo sapien
ctagtttcatctgagaacttctgat

SEQ ID NO: 200615 - DNA, 25 bp, Homo sapien
gaacttctgattagctctcagtctt

SEQ ID NO: 200616 - DNA, 25 bp, Homo sapien
ctgctccaagcagccttcggaggta

SEQ ID NO: 200617 - DNA, 25 bp, Homo sapien
agcagccttcggaggtaagtgccag

SEQ ID NO: 200618 - DNA, 25 bp, Homo sapien
gaggtaagtgccagcacagcgtcct

SEQ ID NO: 200619 - DNA, 25 bp, Homo sapien
cagcacagcgtcctgggcgacttca

SEQ ID NO: 200620 - DNA, 25 bp, Homo sapien
gggcgacttcaagccttacaagcca

SEQ ID NO: 200621 - DNA, 25 bp, Homo sapien
tacaagccaggccaaacctacattc

SEQ ID NO: 200622 - DNA, 25 bp, Homo sapien
tacttcatccacgtgctcaagagga

SEQ ID NO: 200623 - DNA, 25 bp, Homo sapien
agaggacagactgagtgtggcctca

SEQ ID NO: 200624 - DNA, 25 bp, Homo sapien
gcactgctaggctctgtctggaaga

SEQ ID NO: 200625 - DNA, 25 bp, Homo sapien
agggccagcctctagagcagactac

SEQ ID NO: 200626 - DNA, 25 bp, Homo sapien
gcctctagagcagactacagctggg

SEQ ID NO: 200627 - DNA, 25 bp, Homo sapien
tggctgtcctagcagttgtggtcat

SEQ ID NO: 200628 - DNA, 25 bp, Homo sapien
tagcagttgtggtcatcggagctgt

SEQ ID NO: 200629 - DNA, 25 bp, Homo sapien
gtctctcacagcttgaaaagcctga

SEQ ID NO: 200630 - DNA, 25 bp, Homo sapien
cctgagacagctgtcttgtgaggga

SEQ ID NO: 200631 - DNA, 25 bp, Homo sapien
ctgagacagctgtcttgtgagggac

SEQ ID NO: 200632 - DNA, 25 bp, Homo sapien
cagctgtcttgtgagggactgagat

SEQ ID NO: 200633 - DNA, 25 bp, Homo sapien
agctgtcttgtgagggactgagatg

SEQ ID NO: 200634 - DNA, 25 bp, Homo sapien
gctgtcttgtgagggactgagatgc

SEQ ID NO: 200635 - DNA, 25 bp, Homo sapien
ctgtcttgtgagggactgagatgca

SEQ ID NO: 200636 - DNA, 25 bp, Homo sapien
tgtcttgtgagggactgagatgcag

SEQ ID NO: 200637 - DNA, 25 bp, Homo sapien
acctgaatgtgtctgcgtccctgtt

SEQ ID NO: 200638 - DNA, 25 bp, Homo sapien
gaagcattatctgtagttgtaaaac

SEQ ID NO: 200639 - DNA, 25 bp, Homo sapien
aaacattattaatagcagccatcca

SEQ ID NO: 200640 - DNA, 25 bp, Homo sapien
attaatagcagccatccaattgtat

SEQ ID NO: 200641 - DNA, 25 bp, Homo sapien
gcagccatccaattgtatgcaacta

SEQ ID NO: 200642 - DNA, 25 bp, Homo sapien
gccatccaattgtatgcaactaatt

SEQ ID NO: 200643 - DNA, 25 bp, Homo sapien
atgtatcaatatttaagcaggttta

SEQ ID NO: 200644 - DNA, 25 bp, Homo sapien
gtttataatataccagcagccacaa

SEQ ID NO: 200645 - DNA, 25 bp, Homo sapien
tataccagcagccacaattgctaaa

SEQ ID NO: 200646 - DNA, 25 bp, Homo sapien
gcagccacaattgctaaaatgaaaa

SEQ ID NO: 200647 - DNA, 25 bp, Homo sapien
catgatttctatgttgatagtacta

SEQ ID NO: 200648 - DNA, 25 bp, Homo sapien
gatagtactatattattctacaata

SEQ ID NO: 200649 - DNA, 25 bp, Homo sapien
tgtatgtctgtgtgggtgctctgtc

SEQ ID NO: 200650 - DNA, 25 bp, Homo sapien
ctgtccctgtggttgtcatagccag

SEQ ID NO: 200651 - DNA, 25 bp, Homo sapien
ggttgtcatagccagtcagacttga

SEQ ID NO: 200652 - DNA, 25 bp, Homo sapien
tcagacttgatcactgacaccccgt

SEQ ID NO: 200653 - DNA, 25 bp, Homo sapien
gacaccccgtacaacatattgcata

SEQ ID NO: 200654 - DNA, 25 bp, Homo sapien
tattgcataggtaagatcctcgatc

SEQ ID NO: 200655 - DNA, 25 bp, Homo sapien
aagatcctcgatctggtgttctctg

SEQ ID NO: 200656 - DNA, 25 bp, Homo sapien
ctctgcgtggctgttagggactgta

SEQ ID NO: 200657 - DNA, 25 bp, Homo sapien
gctgttagggactgtatatcttgta

SEQ ID NO: 200658 - DNA, 25 bp, Homo sapien
gaacacttgtcacatgcttgatcag

SEQ ID NO: 200659 - DNA, 25 bp, Homo sapien
gcttgatcagttacagcaatagctg

SEQ ID NO: 200660 - DNA, 25 bp, Homo sapien
aaggtcaacgtgaaactgaagccga

SEQ ID NO: 200661 - DNA, 25 bp, Homo sapien
gaaactgaagccgatgctagattca

SEQ ID NO: 200662 - DNA, 25 bp, Homo sapien
gccgatgctagattcagtagctaca

SEQ ID NO: 200663 - DNA, 25 bp, Homo sapien
gggaagagctacaccaaaaacgact

SEQ ID NO: 200664 - DNA, 25 bp, Homo sapien
aaaaacgactgctggcctcaactgc

SEQ ID NO: 200665 - DNA, 25 bp, Homo sapien
cccctgccagtgttatggtagccaa

SEQ ID NO: 200666 - DNA, 25 bp, Homo sapien
tggtagccaaggaagacaggaacta

SEQ ID NO: 200667 - DNA, 25 bp, Homo sapien
aggaagacaggaactaaacctccag

SEQ ID NO: 200668 - DNA, 25 bp, Homo sapien
gctcagaaagacctaacatctcaag

SEQ ID NO: 200669 - DNA, 25 bp, Homo sapien
catctcaaggatgcactgggaacca

SEQ ID NO: 200670 - DNA, 25 bp, Homo sapien
caaggatgcactgggaaccatgcct

SEQ ID NO: 200671 - DNA, 25 bp, Homo sapien
ttattgttcagccttatcccttggc

SEQ ID NO: 200672 - DNA, 25 bp, Homo sapien
tcagccttatcccttggcacgtaaa

SEQ ID NO: 200673 - DNA, 25 bp, Homo sapien
gcacgtaaacagactactagactta

SEQ ID NO: 200674 - DNA, 25 bp, Homo sapien
agacttattgtaggttcgtttgagc

SEQ ID NO: 200675 - DNA, 25 bp, Homo sapien
taggttcgtttgagctttgtgttgt

SEQ ID NO: 200676 - DNA, 25 bp, Homo sapien
gcttctataaagttttcaaggtagg

SEQ ID NO: 200677 - DNA, 25 bp, Homo sapien
caaggtagggagtgattttattatt

SEQ ID NO: 200678 - DNA, 25 bp, Homo sapien
gtgatactaaggtttgactgctata

SEQ ID NO: 200679 - DNA, 25 bp, Homo sapien
aattatttgtactgttgatcacatg

SEQ ID NO: 200680 - DNA, 25 bp, Homo sapien
actgttgatcacatgtacttaaaac

SEQ ID NO: 200681 - DNA, 25 bp, Homo sapien
aacatctgatactgtattctaagac

SEQ ID NO: 200682 - DNA, 25 bp, Homo sapien
gaatcaaatacttcatcactaaaga

SEQ ID NO: 200683 - DNA, 25 bp, Homo sapien
taatgaaacagcagtcacttctagt

SEQ ID NO: 200684 - DNA, 25 bp, Homo sapien
gcagtcacttctagttcattaccat

SEQ ID NO: 200685 - DNA, 25 bp, Homo sapien
tagttcattaccatttcttgtagct

SEQ ID NO: 200686 - DNA, 25 bp, Homo sapien
catttcttgtagctgttgtttttag

SEQ ID NO: 200687 - DNA, 25 bp, Homo sapien
gttgtttttagatatagtccactgc

SEQ ID NO: 200688 - DNA, 25 bp, Homo sapien
agtccactgcattcttataagttct

SEQ ID NO: 200689 - DNA, 25 bp, Homo sapien
gtttattataatgcatttcttgtgg

SEQ ID NO: 200690 - DNA, 25 bp, Homo sapien
tcttgtggaatcttagtgttttaac

SEQ ID NO: 200691 - DNA, 25 bp, Homo sapien
acatttgaaatccacttaaactgca

SEQ ID NO: 200692 - DNA, 25 bp, Homo sapien
attgaatgctttctaacaaaacaga

SEQ ID NO: 200693 - DNA, 25 bp, Homo sapien
gacaacaggaatgtgcagctactat

SEQ ID NO: 200694 - DNA, 25 bp, Homo sapien
gtgcagctactatgaaatgctccaa

SEQ ID NO: 200695 - DNA, 25 bp, Homo sapien
gctccaagcaggatggatgccttca

SEQ ID NO: 200696 - DNA, 25 bp, Homo sapien
caaaagctatcaggtcactaaaact

SEQ ID NO: 200697 - DNA, 25 bp, Homo sapien
aactgaccagtgtctaatcctttcc

SEQ ID NO: 200698 - DNA, 25 bp, Homo sapien
cagtgtctaatcctttcctcctctt

SEQ ID NO: 200699 - DNA, 25 bp, Homo sapien
actacagactgagttacctagggaa

SEQ ID NO: 200700 - DNA, 25 bp, Homo sapien
aaatacgatgtctctttgaagtcct

SEQ ID NO: 200701 - DNA, 25 bp, Homo sapien
aagtcctcagattcaggtactgttt

SEQ ID NO: 200702 - DNA, 25 bp, Homo sapien
gattcaggtactgtttttccaccgt

SEQ ID NO: 200703 - DNA, 25 bp, Homo sapien
caggtactgtttttccaccgtcaca

SEQ ID NO: 200704 - DNA, 25 bp, Homo sapien
cctggattctgctggtgagacctcc

SEQ ID NO: 200705 - DNA, 25 bp, Homo sapien
tggattctgctggtgagacctcctg

SEQ ID NO: 200706 - DNA, 25 bp, Homo sapien
gagacatatagctggagaccattct

SEQ ID NO: 200707 - DNA, 25 bp, Homo sapien
atatagctggagaccattctttcca

SEQ ID NO: 200708 - DNA, 25 bp, Homo sapien
cttacctcttgccaaaggccattta

SEQ ID NO: 200709 - DNA, 25 bp, Homo sapien
tacctcttgccaaaggccatttata

SEQ ID NO: 200710 - DNA, 25 bp, Homo sapien
cttgccaaaggccatttatattcat

SEQ ID NO: 200711 - DNA, 25 bp, Homo sapien
ggccatttatattcatatagtgaca

SEQ ID NO: 200712 - DNA, 25 bp, Homo sapien
attcatatagtgacaggctgtgctc

SEQ ID NO: 200713 - DNA, 25 bp, Homo sapien
atagtgacaggctgtgctccatatt

SEQ ID NO: 200714 - DNA, 25 bp, Homo sapien
attttacagtcattttggtcacaat

SEQ ID NO: 200715 - DNA, 25 bp, Homo sapien
ttaagccactaagttgtttaataat

SEQ ID NO: 200716 - DNA, 25 bp, Homo sapien
aatgtacaggcaaacttggaagata

SEQ ID NO: 200717 - DNA, 25 bp, Homo sapien
atgtacaggcaaacttggaagatac

SEQ ID NO: 200718 - DNA, 25 bp, Homo sapien
tgtacaggcaaacttggaagatact

SEQ ID NO: 200719 - DNA, 25 bp, Homo sapien
gtacaggcaaacttggaagatactg

SEQ ID NO: 200720 - DNA, 25 bp, Homo sapien
tacaggcaaacttggaagatactgt

SEQ ID NO: 200721 - DNA, 25 bp, Homo sapien
aagatactgtgggttgggttccaga

SEQ ID NO: 200722 - DNA, 25 bp, Homo sapien
aaagttatgttgggccggcatggtg

SEQ ID NO: 200723 - DNA, 25 bp, Homo sapien
gggccggcatggtggctcgggcctg

SEQ ID NO: 200724 - DNA, 25 bp, Homo sapien
gagaccaaccttggtaacatggtaa

SEQ ID NO: 200725 - DNA, 25 bp, Homo sapien
agaccaaccttggtaacatggtaag

SEQ ID NO: 200726 - DNA, 25 bp, Homo sapien
ggtcatcactaaccagatttacttg

SEQ ID NO: 200727 - DNA, 25 bp, Homo sapien
atcactaaccagatttacttggagt

SEQ ID NO: 200728 - DNA, 25 bp, Homo sapien
ctaaccagatttacttggagtacat

SEQ ID NO: 200729 - DNA, 25 bp, Homo sapien
cagatttacttggagtacatgtgaa

SEQ ID NO: 200730 - DNA, 25 bp, Homo sapien
tgaaagaaaacgtcagtctgcctgt

SEQ ID NO: 200731 - DNA, 25 bp, Homo sapien
aagaaaacgtcagtctgcctgtaaa

SEQ ID NO: 200732 - DNA, 25 bp, Homo sapien
gaaaacgtcagtctgcctgtaaatt

SEQ ID NO: 200733 - DNA, 25 bp, Homo sapien
aaacgtcagtctgcctgtaaatttc

SEQ ID NO: 200734 - DNA, 25 bp, Homo sapien
acgtcagtctgcctgtaaatttcag

SEQ ID NO: 200735 - DNA, 25 bp, Homo sapien
tcagtctgcctgtaaatttcagcaa

SEQ ID NO: 200736 - DNA, 25 bp, Homo sapien
tacacttgtataagtaccgtttact

SEQ ID NO: 200737 - DNA, 25 bp, Homo sapien
agttatgagcctgtgggaacttcag

SEQ ID NO: 200738 - DNA, 25 bp, Homo sapien
agtattatacaactgctgtgaccag

SEQ ID NO: 200739 - DNA, 25 bp, Homo sapien
actgctgtgaccagacttgtatact

SEQ ID NO: 200740 - DNA, 25 bp, Homo sapien
agacttgtatactggctgaatatca

SEQ ID NO: 200741 - DNA, 25 bp, Homo sapien
ggctgaatatcagtgctgtttgtaa

SEQ ID NO: 200742 - DNA, 25 bp, Homo sapien
ttttcactttgagaaccaacattaa

SEQ ID NO: 200743 - DNA, 25 bp, Homo sapien
gagaaccaacattaattccatatga

SEQ ID NO: 200744 - DNA, 25 bp, Homo sapien
attccatatgaatcaagtgttttgt

SEQ ID NO: 200745 - DNA, 25 bp, Homo sapien
ttattgagcatctcttctccataag

SEQ ID NO: 200746 - DNA, 25 bp, Homo sapien
gcatctcttctccataagatagtgt

SEQ ID NO: 200747 - DNA, 25 bp, Homo sapien
gtgtgataaacacggtcatgaataa

SEQ ID NO: 200748 - DNA, 25 bp, Homo sapien
atggccagccaacttttgcatgttt

SEQ ID NO: 200749 - DNA, 25 bp, Homo sapien
gccagccaacttttgcatgttttgt

SEQ ID NO: 200750 - DNA, 25 bp, Homo sapien
aattgtgagccaccacgtggagctg

SEQ ID NO: 200751 - DNA, 25 bp, Homo sapien
acgtggagctggaagggtcaacatc

SEQ ID NO: 200752 - DNA, 25 bp, Homo sapien
gagctggaagggtcaacatctttta

SEQ ID NO: 200753 - DNA, 25 bp, Homo sapien
ggaagggtcaacatcttttacattc

SEQ ID NO: 200754 - DNA, 25 bp, Homo sapien
ggtcaacatcttttacattctgcaa

SEQ ID NO: 200755 - DNA, 25 bp, Homo sapien
acatcttttacattctgcaagcaca

SEQ ID NO: 200756 - DNA, 25 bp, Homo sapien
tacattctgcaagcacatctgcatt

SEQ ID NO: 200757 - DNA, 25 bp, Homo sapien
tgcaagcacatctgcattttcaccc

SEQ ID NO: 200758 - DNA, 25 bp, Homo sapien
tccttctccctttttatatcccatt

SEQ ID NO: 200759 - DNA, 25 bp, Homo sapien
attcctcatgattttagggttatcc

SEQ ID NO: 200760 - DNA, 25 bp, Homo sapien
gggttatcctcattcagatctactc

SEQ ID NO: 200761 - DNA, 25 bp, Homo sapien
tcctcattcagatctactctagtta

SEQ ID NO: 200762 - DNA, 25 bp, Homo sapien
tagtactttaaacagagcacagaat

SEQ ID NO: 200763 - DNA, 25 bp, Homo sapien
aaaccattagtatgtgaatctgcaa

SEQ ID NO: 200764 - DNA, 25 bp, Homo sapien
gaacttgttttagactcttctacag

SEQ ID NO: 200765 - DNA, 25 bp, Homo sapien
gactcttctacagtttagacttcaa

SEQ ID NO: 200766 - DNA, 25 bp, Homo sapien
tagacttcaatgtgcatactaaatg

SEQ ID NO: 200767 - DNA, 25 bp, Homo sapien
acaaaacttctactactgctataat

SEQ ID NO: 200768 - DNA, 25 bp, Homo sapien
tgaaaacatttaacccactagcaag

SEQ ID NO: 200769 - DNA, 25 bp, Homo sapien
actagcaagaggtaagacagcactg

SEQ ID NO: 200770 - DNA, 25 bp, Homo sapien
gtgttatctggaccagttccttcat

SEQ ID NO: 200771 - DNA, 25 bp, Homo sapien
gttccttcattttcaggtgggactc

SEQ ID NO: 200772 - DNA, 25 bp, Homo sapien
caggtgggactcttgatccagagaa

SEQ ID NO: 200773 - DNA, 25 bp, Homo sapien
tccagagaagacaaagctcctcagt

SEQ ID NO: 200774 - DNA, 25 bp, Homo sapien
ctcagtgagctggtgtataatccaa

SEQ ID NO: 200775 - DNA, 25 bp, Homo sapien
gtataatccaagacagaacccaagt

SEQ ID NO: 200776 - DNA, 25 bp, Homo sapien
ctatgccctctatcctatcatagat

SEQ ID NO: 200777 - DNA, 25 bp, Homo sapien
atagataacattctccacagcctca

SEQ ID NO: 200778 - DNA, 25 bp, Homo sapien
cttcattccacctattctctgaaaa

SEQ ID NO: 200779 - DNA, 25 bp, Homo sapien
agaatgaaattccagccttgacttt

SEQ ID NO: 200780 - DNA, 25 bp, Homo sapien
gcacctgatgggagggtaatgtcta

SEQ ID NO: 200781 - DNA, 25 bp, Homo sapien
taatccctttaaattttatctgttg

SEQ ID NO: 200782 - DNA, 25 bp, Homo sapien
ttatctgttgctgttacctcttgaa

SEQ ID NO: 200783 - DNA, 25 bp, Homo sapien
gttgctgttacctcttgaaatatga

SEQ ID NO: 200784 - DNA, 25 bp, Homo sapien
tagattgctaatcccactcattcag

SEQ ID NO: 200785 - DNA, 25 bp, Homo sapien
taatcccactcattcaggaaatgcc

SEQ ID NO: 200786 - DNA, 25 bp, Homo sapien
gaaatggtgcctcttacagtgtaaa

SEQ ID NO: 200787 - DNA, 25 bp, Homo sapien
tcttacagtgtaaatttttcctcct

SEQ ID NO: 200788 - DNA, 25 bp, Homo sapien
tcctcctttacctttgctaatatca

SEQ ID NO: 200789 - DNA, 25 bp, Homo sapien
agaatttttcttatcccttgtgagg

SEQ ID NO: 200790 - DNA, 25 bp, Homo sapien
agtttttcatccttacaatcctgtc

SEQ ID NO: 200791 - DNA, 25 bp, Homo sapien
acaatcctgtcccatggtatttaac

SEQ ID NO: 200792 - DNA, 25 bp, Homo sapien
taatccctttaaattttatctgttg

SEQ ID NO: 200793 - DNA, 25 bp, Homo sapien
ccctttaaattttatctgttgctgt

SEQ ID NO: 200794 - DNA, 25 bp, Homo sapien
tttagattgctaatcccactcattc

SEQ ID NO: 200795 - DNA, 25 bp, Homo sapien
tagattgctaatcccactcattcag

SEQ ID NO: 200796 - DNA, 25 bp, Homo sapien
taatcccactcattcaggaaatgcc

SEQ ID NO: 200797 - DNA, 25 bp, Homo sapien
gaaatggtgcctcttacagtgtaaa

SEQ ID NO: 200798 - DNA, 25 bp, Homo sapien
aaatggtgcctcttacagtgtaaat

SEQ ID NO: 200799 - DNA, 25 bp, Homo sapien
aatggtgcctcttacagtgtaaatt

SEQ ID NO: 200800 - DNA, 25 bp, Homo sapien
atggtgcctcttacagtgtaaattt

SEQ ID NO: 200801 - DNA, 25 bp, Homo sapien
ggtgcctcttacagtgtaaattttt

SEQ ID NO: 200802 - DNA, 25 bp, Homo sapien
tcttacagtgtaaatttttcctcct

SEQ ID NO: 200803 - DNA, 25 bp, Homo sapien
gagttctttttcactctgtgtctaa

SEQ ID NO: 200804 - DNA, 25 bp, Homo sapien
aagtgtggcatagctacctgcccat

SEQ ID NO: 200805 - DNA, 25 bp, Homo sapien
tctggtaattttgggtttccgctct

SEQ ID NO: 200806 - DNA, 25 bp, Homo sapien
tctgggctctggcaagttgaacaat

SEQ ID NO: 200807 - DNA, 25 bp, Homo sapien
gcaagttgaacaatcctagccattg

SEQ ID NO: 200808 - DNA, 25 bp, Homo sapien
aatcctagccattgacaatcgtgat

SEQ ID NO: 200809 - DNA, 25 bp, Homo sapien
aatcgtgatagttattattttccca

SEQ ID NO: 200810 - DNA, 25 bp, Homo sapien
tattttcccatttgctgtctttttg

SEQ ID NO: 200811 - DNA, 25 bp, Homo sapien
ccatttgctgtctttttgtatctaa

SEQ ID NO: 200812 - DNA, 25 bp, Homo sapien
aaagtcttcctattgtactgcacaa

SEQ ID NO: 200813 - DNA, 25 bp, Homo sapien
tgtactgcacaaaccatggattgta

SEQ ID NO: 200814 - DNA, 25 bp, Homo sapien
tcctctccagagatgccaggggggc

SEQ ID NO: 200815 - DNA, 25 bp, Homo sapien
gggggcgtgtatgctctgccccttc

SEQ ID NO: 200816 - DNA, 25 bp, Homo sapien
gctctgccccttccctcagacaggg

SEQ ID NO: 200817 - DNA, 25 bp, Homo sapien
tgggtggggaggctctttaggctca

SEQ ID NO: 200818 - DNA, 25 bp, Homo sapien
ctgccgcccgcattataaacacagg

SEQ ID NO: 200819 - DNA, 25 bp, Homo sapien
tgccgcccgcattataaacacagga

SEQ ID NO: 200820 - DNA, 25 bp, Homo sapien
gccgcccgcattataaacacaggag

SEQ ID NO: 200821 - DNA, 25 bp, Homo sapien
ccgcccgcattataaacacaggaga

SEQ ID NO: 200822 - DNA, 25 bp, Homo sapien
cgcccgcattataaacacaggagaa

SEQ ID NO: 200823 - DNA, 25 bp, Homo sapien
gcccgcattataaacacaggagaat

SEQ ID NO: 200824 - DNA, 25 bp, Homo sapien
cccgcattataaacacaggagaata

SEQ ID NO: 200825 - DNA, 25 bp, Homo sapien
gaagaggcaacggaagacatttatt

SEQ ID NO: 200826 - DNA, 25 bp, Homo sapien
agaaccaagccctggtagggaagag

SEQ ID NO: 200827 - DNA, 25 bp, Homo sapien
ggatgattcacctccatatttccta

SEQ ID NO: 200828 - DNA, 25 bp, Homo sapien
attcacctccatatttcctaagcag

SEQ ID NO: 200829 - DNA, 25 bp, Homo sapien
tcctaagcaggttgtatagggagcc

SEQ ID NO: 200830 - DNA, 25 bp, Homo sapien
caggaggaaggctgttttcacaaat

SEQ ID NO: 200831 - DNA, 25 bp, Homo sapien
aaggctgttttcacaaatgacttgt

SEQ ID NO: 200832 - DNA, 25 bp, Homo sapien
caaatgacttgtaatgtcgtgatta

SEQ ID NO: 200833 - DNA, 25 bp, Homo sapien
tcctatattcttctgcaaatcaaac

SEQ ID NO: 200834 - DNA, 25 bp, Homo sapien
gcaaatcaaacgttctttcccaatc

SEQ ID NO: 200835 - DNA, 25 bp, Homo sapien
ttcccaatccaatccagccttggtt

SEQ ID NO: 200836 - DNA, 25 bp, Homo sapien
tgcttaatgccacctggctggtgaa

SEQ ID NO: 200837 - DNA, 25 bp, Homo sapien
ctggctggtgaacagtgctgcccac

SEQ ID NO: 200838 - DNA, 25 bp, Homo sapien
acctcttcggatatcgtccttatga

SEQ ID NO: 200839 - DNA, 25 bp, Homo sapien
atcgtccttatgacaagaacattag

SEQ ID NO: 200840 - DNA, 25 bp, Homo sapien
gaatatcctggtttcacttggagct

SEQ ID NO: 200841 - DNA, 25 bp, Homo sapien
tgggtgagggcttccacaactacca

SEQ ID NO: 200842 - DNA, 25 bp, Homo sapien
ttccctatgactactctgccagtga

SEQ ID NO: 200843 - DNA, 25 bp, Homo sapien
tgactactctgccagtgagtaccgc

SEQ ID NO: 200844 - DNA, 25 bp, Homo sapien
gtgagtaccgctggcacatcaactt

SEQ ID NO: 200845 - DNA, 25 bp, Homo sapien
ggaagaaagtctccaaggccgccat

SEQ ID NO: 200846 - DNA, 25 bp, Homo sapien
gccaggattaaaagaaccggagatg

SEQ ID NO: 200847 - DNA, 25 bp, Homo sapien
aagtcgggagaccattgaaatgtag

SEQ ID NO: 200848 - DNA, 25 bp, Homo sapien
actcaatactgaactccccaatgtt

SEQ ID NO: 200849 - DNA, 25 bp, Homo sapien
gaactccccaatgttaatttggcat

SEQ ID NO: 200850 - DNA, 25 bp, Homo sapien
ggcattgtcttgtgattagatcctg

SEQ ID NO: 200851 - DNA, 25 bp, Homo sapien
ttagatcctgtcctcctttagcctc

SEQ ID NO: 200852 - DNA, 25 bp, Homo sapien
ttagcctcactaatcaagttgggtc

SEQ ID NO: 200853 - DNA, 25 bp, Homo sapien
aagttgggtcctatcttcccagatg

SEQ ID NO: 200854 - DNA, 25 bp, Homo sapien
ttcccagatgtctagttttctactg

SEQ ID NO: 200855 - DNA, 25 bp, Homo sapien
gttcatcttgtaataactggacact

SEQ ID NO: 200856 - DNA, 25 bp, Homo sapien
actggacactacatactacacttat

SEQ ID NO: 200857 - DNA, 25 bp, Homo sapien
ttcaacactgtttaggcaagggttt

SEQ ID NO: 200858 - DNA, 25 bp, Homo sapien
gtggtcgtgcctgtgtgtatcagaa

SEQ ID NO: 200859 - DNA, 25 bp, Homo sapien
agggataggtatcttgcctcctttc

SEQ ID NO: 200860 - DNA, 25 bp, Homo sapien
tcctttctctcaggcagtgcaaatc

SEQ ID NO: 200861 - DNA, 25 bp, Homo sapien
ggcagtgcaaatcaccctgtggaaa

SEQ ID NO: 200862 - DNA, 25 bp, Homo sapien
tcaccctgtggaaaaccgatggaca

SEQ ID NO: 200863 - DNA, 25 bp, Homo sapien
tggacaggaaggagtgttacacact

SEQ ID NO: 200864 - DNA, 25 bp, Homo sapien
tacacactgcttaccctgatttatt

SEQ ID NO: 200865 - DNA, 25 bp, Homo sapien
ggaaccatactatcaaatggcgaca

SEQ ID NO: 200866 - DNA, 25 bp, Homo sapien
aatggcgacagactgttccgttcca

SEQ ID NO: 200867 - DNA, 25 bp, Homo sapien
gaagagtaatcatgcaccgtgtgaa

SEQ ID NO: 200868 - DNA, 25 bp, Homo sapien
atgcaccgtgtgaatagtatcaagc

SEQ ID NO: 200869 - DNA, 25 bp, Homo sapien
ggaataacatactggccgttctgac

SEQ ID NO: 200870 - DNA, 25 bp, Homo sapien
acatactggccgttctgacctgttg

SEQ ID NO: 200871 - DNA, 25 bp, Homo sapien
gttctgacctgttgccagcagatac

SEQ ID NO: 200872 - DNA, 25 bp, Homo sapien
tgttgccagcagatacacaggacat

SEQ ID NO: 200873 - DNA, 25 bp, Homo sapien
gtttcttcctgtagtactcctcttt

SEQ ID NO: 200874 - DNA, 25 bp, Homo sapien
gtagtactcctcttttagatcctaa

SEQ ID NO: 200875 - DNA, 25 bp, Homo sapien
tcttttagatcctaagtctcttaca

SEQ ID NO: 200876 - DNA, 25 bp, Homo sapien
gtctcttacaaaagctttgaatact

SEQ ID NO: 200877 - DNA, 25 bp, Homo sapien
accagatgttttgatgttatcgctt

SEQ ID NO: 200878 - DNA, 25 bp, Homo sapien
gcttatgttaatagtaattcccgta

SEQ ID NO: 200879 - DNA, 25 bp, Homo sapien
ttcagccatgtatcaatattcactt

SEQ ID NO: 200880 - DNA, 25 bp, Homo sapien
gaaatagtatagatgaatgccctga

SEQ ID NO: 200881 - DNA, 25 bp, Homo sapien
tgtgaacaagctctgcccctcttag

SEQ ID NO: 200882 - DNA, 25 bp, Homo sapien
agctctgcccctcttaggaaatcaa

SEQ ID NO: 200883 - DNA, 25 bp, Homo sapien
tctgcccctcttaggaaatcaatgg

SEQ ID NO: 200884 - DNA, 25 bp, Homo sapien
ggtcaagattaagaggcagggtcac

SEQ ID NO: 200885 - DNA, 25 bp, Homo sapien
cagggtcacccagggaatggtttag

SEQ ID NO: 200886 - DNA, 25 bp, Homo sapien
gaatggtttaggtcctggcaactct

SEQ ID NO: 200887 - DNA, 25 bp, Homo sapien
ggtttaggtcctggcaactctgaag

SEQ ID NO: 200888 - DNA, 25 bp, Homo sapien
tttaggtcctggcaactctgaaggg

SEQ ID NO: 200889 - DNA, 25 bp, Homo sapien
gttggaagggctggcaggaggcact

SEQ ID NO: 200890 - DNA, 25 bp, Homo sapien
gtgcatgggatcaatgggacccaat

SEQ ID NO: 200891 - DNA, 25 bp, Homo sapien
aaatcatggtgcataagtatttatg

SEQ ID NO: 200892 - DNA, 25 bp, Homo sapien
gtatttatggtttcttacaaagtat

SEQ ID NO: 200893 - DNA, 25 bp, Homo sapien
atgaaaaggtaagggcaatccttgt

SEQ ID NO: 200894 - DNA, 25 bp, Homo sapien
atgagtgagcagaacatatgtaacc

SEQ ID NO: 200895 - DNA, 25 bp, Homo sapien
gtgagcagaacatatgtaaccagaa

SEQ ID NO: 200896 - DNA, 25 bp, Homo sapien
gtaaccagaaggacaaatccaccct

SEQ ID NO: 200897 - DNA, 25 bp, Homo sapien
aaggctgtttattcacttgagtgca

SEQ ID NO: 200898 - DNA, 25 bp, Homo sapien
acttgagtgcaagtgggctgagtct

SEQ ID NO: 200899 - DNA, 25 bp, Homo sapien
gtgcaagtgggctgagtctgaaaac

SEQ ID NO: 200900 - DNA, 25 bp, Homo sapien
caagtgggctgagtctgaaaacaga

SEQ ID NO: 200901 - DNA, 25 bp, Homo sapien
gagtctgaaaacagagtcagtgaag

SEQ ID NO: 200902 - DNA, 25 bp, Homo sapien
caatgaaaccttcctcttgagggtc

SEQ ID NO: 200903 - DNA, 25 bp, Homo sapien
cttgagggtcattttcctttctgta

SEQ ID NO: 200904 - DNA, 25 bp, Homo sapien
gggtcattttcctttctgtattaat

SEQ ID NO: 200905 - DNA, 25 bp, Homo sapien
gacatagataagaactttgcacact

SEQ ID NO: 200906 - DNA, 25 bp, Homo sapien
tttgcacacttcaaatcagagcagt

SEQ ID NO: 200907 - DNA, 25 bp, Homo sapien
ccccttttccttcagagtgaatcat

SEQ ID NO: 200908 - DNA, 25 bp, Homo sapien
agtgaatcatccagactcctcatgg

SEQ ID NO: 200909 - DNA, 25 bp, Homo sapien
actcctcatggataggtcgggtgtt

SEQ ID NO: 200910 - DNA, 25 bp, Homo sapien
attatgtaccttttgatagatccac

SEQ ID NO: 200911 - DNA, 25 bp, Homo sapien
tactatcttttcatttatcaagcag

SEQ ID NO: 200912 - DNA, 25 bp, Homo sapien
tatcaagcagagacctttgttggga

SEQ ID NO: 200913 - DNA, 25 bp, Homo sapien
acagtgatgcaatagacatgtctaa

SEQ ID NO: 200914 - DNA, 25 bp, Homo sapien
tccttttgaaagctcagtgtctgtg

SEQ ID NO: 200915 - DNA, 25 bp, Homo sapien
agtgtctgtgctatgacttgctctc

SEQ ID NO: 200916 - DNA, 25 bp, Homo sapien
gctatgacttgctctcatcacaata

SEQ ID NO: 200917 - DNA, 25 bp, Homo sapien
cttgctctcatcacaatattgttga

SEQ ID NO: 200918 - DNA, 25 bp, Homo sapien
gttgaattccacaatgtatggacat

SEQ ID NO: 200919 - DNA, 25 bp, Homo sapien
gtatggacattaaacactggcagac

SEQ ID NO: 200920 - DNA, 25 bp, Homo sapien
actggcagactgttcactttttctt

SEQ ID NO: 200921 - DNA, 25 bp, Homo sapien
tggcagactgttcactttttctttt

SEQ ID NO: 200922 - DNA, 25 bp, Homo sapien
ctgaaatccctctaggttatctata

SEQ ID NO: 200923 - DNA, 25 bp, Homo sapien
atccctctaggttatctatactgta

SEQ ID NO: 200924 - DNA, 25 bp, Homo sapien
aaaggagttagggtctcagtgcctc

SEQ ID NO: 200925 - DNA, 25 bp, Homo sapien
gagttagggtctcagtgcctccagc

SEQ ID NO: 200926 - DNA, 25 bp, Homo sapien
agactggagagcaagcccagcccag

SEQ ID NO: 200927 - DNA, 25 bp, Homo sapien
cgtggctcgattcccgggattcatt

SEQ ID NO: 200928 - DNA, 25 bp, Homo sapien
attcccgggattcattcctcagcct

SEQ ID NO: 200929 - DNA, 25 bp, Homo sapien
tgcttctcccttttatcccaataag

SEQ ID NO: 200930 - DNA, 25 bp, Homo sapien
ttattgctactgctgtgaggccata

SEQ ID NO: 200931 - DNA, 25 bp, Homo sapien
ctactgctgtgaggccataggtact

SEQ ID NO: 200932 - DNA, 25 bp, Homo sapien
tgtgaggccataggtactagacaac

SEQ ID NO: 200933 - DNA, 25 bp, Homo sapien
ggtactagacaaccaatacatgcag

SEQ ID NO: 200934 - DNA, 25 bp, Homo sapien
accaatacatgcagggttgggtttt

SEQ ID NO: 200935 - DNA, 25 bp, Homo sapien
tagtctatgaaaggttctcttaaaa

SEQ ID NO: 200936 - DNA, 25 bp, Homo sapien
ggttctcttaaaattctatcgaaat

SEQ ID NO: 200937 - DNA, 25 bp, Homo sapien
cttcatgcagagatattcagggttt

SEQ ID NO: 200938 - DNA, 25 bp, Homo sapien
tcagggtttggattagcagtggaat

SEQ ID NO: 200939 - DNA, 25 bp, Homo sapien
aagagatgggcattgtttcccctat

SEQ ID NO: 200940 - DNA, 25 bp, Homo sapien
atgggcattgtttcccctataattg

SEQ ID NO: 200941 - DNA, 25 bp, Homo sapien
cattgtttcccctataattgtgctg

SEQ ID NO: 200942 - DNA, 25 bp, Homo sapien
ttataacttatccatatgcatgatg

SEQ ID NO: 200943 - DNA, 25 bp, Homo sapien
tagccatcttttcccatgtaatagt

SEQ ID NO: 200944 - DNA, 25 bp, Homo sapien
atcttttcccatgtaatagtattga

SEQ ID NO: 200945 - DNA, 25 bp, Homo sapien
caaaatttgctttgtggaggcatgt

SEQ ID NO: 200946 - DNA, 25 bp, Homo sapien
tgcacaggcacttgccaaggtggct

SEQ ID NO: 200947 - DNA, 25 bp, Homo sapien
caggcacttgccaaggtggctcaca

SEQ ID NO: 200948 - DNA, 25 bp, Homo sapien
actcacgcacactcgtactgagact

SEQ ID NO: 200949 - DNA, 25 bp, Homo sapien
acgcacactcgtactgagactcaag

SEQ ID NO: 200950 - DNA, 25 bp, Homo sapien
tactgagactcaaggccgtctccac

SEQ ID NO: 200951 - DNA, 25 bp, Homo sapien
tccacaactccaaccagtgcaaatg

SEQ ID NO: 200952 - DNA, 25 bp, Homo sapien
ctccaaccagtgcaaatgacttagt

SEQ ID NO: 200953 - DNA, 25 bp, Homo sapien
atgacttagtgcaaattaaattcag

SEQ ID NO: 200954 - DNA, 25 bp, Homo sapien
gaaacagagtcgtggaggctttgaa

SEQ ID NO: 200955 - DNA, 25 bp, Homo sapien
agtcgtggaggctttgaatctctca

SEQ ID NO: 200956 - DNA, 25 bp, Homo sapien
ggaggctttgaatctctcagaaaaa

SEQ ID NO: 200957 - DNA, 25 bp, Homo sapien
ggaaccagtggacagaggtatcatt

SEQ ID NO: 200958 - DNA, 25 bp, Homo sapien
gaggtatcattaaatatgtccatgt

SEQ ID NO: 200959 - DNA, 25 bp, Homo sapien
tatgtccatgtattgtgaagtctga

SEQ ID NO: 200960 - DNA, 25 bp, Homo sapien
gaagtctgaggaaactcaagctcct

SEQ ID NO: 200961 - DNA, 25 bp, Homo sapien
actcaagctcctccagtccttttaa

SEQ ID NO: 200962 - DNA, 25 bp, Homo sapien
agatagtcacagtaatccccactct

SEQ ID NO: 200963 - DNA, 25 bp, Homo sapien
agtaatccccactcttctgggataa

SEQ ID NO: 200964 - DNA, 25 bp, Homo sapien
tcttctgggataaatttccacttta

SEQ ID NO: 200965 - DNA, 25 bp, Homo sapien
atttccactttacttgtcatcccca

SEQ ID NO: 200966 - DNA, 25 bp, Homo sapien
ttgcacaatgaattgggcgccccaa

SEQ ID NO: 200967 - DNA, 25 bp, Homo sapien
ccccaaggacagtggatatcatgga

SEQ ID NO: 200968 - DNA, 25 bp, Homo sapien
gtggtgcagtctcgactcattgcac

SEQ ID NO: 200969 - DNA, 25 bp, Homo sapien
tggtgcagtctcgactcattgcacc

SEQ ID NO: 200970 - DNA, 25 bp, Homo sapien
ggtgcagtctcgactcattgcaccc

SEQ ID NO: 200971 - DNA, 25 bp, Homo sapien
gtgcagtctcgactcattgcaccct

SEQ ID NO: 200972 - DNA, 25 bp, Homo sapien
tgcagtctcgactcattgcaccctc

SEQ ID NO: 200973 - DNA, 25 bp, Homo sapien
actcattgcaccctccatctttggg

SEQ ID NO: 200974 - DNA, 25 bp, Homo sapien
cattgcaccctccatctttggggtt

SEQ ID NO: 200975 - DNA, 25 bp, Homo sapien
accctccatctttggggttcaagtg

SEQ ID NO: 200976 - DNA, 25 bp, Homo sapien
gtgcctggcctaaaagattatttag

SEQ ID NO: 200977 - DNA, 25 bp, Homo sapien
tgcctggcctaaaagattatttaga

SEQ ID NO: 200978 - DNA, 25 bp, Homo sapien
gcctggcctaaaagattatttagag

SEQ ID NO: 200979 - DNA, 25 bp, Homo sapien
gggtaagactgtatcttacacaaat

SEQ ID NO: 200980 - DNA, 25 bp, Homo sapien
tttttaacttgctaaggcgcttaag

SEQ ID NO: 200981 - DNA, 25 bp, Homo sapien
taaggcgcttaaggatttgttttct

SEQ ID NO: 200982 - DNA, 25 bp, Homo sapien
tctaagttacatgtgtatcttcctg

SEQ ID NO: 200983 - DNA, 25 bp, Homo sapien
tcttcctgaaaactgtcttcccttt

SEQ ID NO: 200984 - DNA, 25 bp, Homo sapien
tgaaaactgtcttccctttttggtg

SEQ ID NO: 200985 - DNA, 25 bp, Homo sapien
aagagcaataatgtactaggtgaga

SEQ ID NO: 200986 - DNA, 25 bp, Homo sapien
tgtactaggtgagataatggtcagt

SEQ ID NO: 200987 - DNA, 25 bp, Homo sapien
aatgctcttagagttagtagatgag

SEQ ID NO: 200988 - DNA, 25 bp, Homo sapien
gtagatgagtcgaatcaacaagtat

SEQ ID NO: 200989 - DNA, 25 bp, Homo sapien
agtaattctgattctaactttagtc

SEQ ID NO: 200990 - DNA, 25 bp, Homo sapien
gttacattgtcttactctcttttac

SEQ ID NO: 200991 - DNA, 25 bp, Homo sapien
tactctcttttacttctcagacact

SEQ ID NO: 200992 - DNA, 25 bp, Homo sapien
tctcttttacttctcagacacttcc

SEQ ID NO: 200993 - DNA, 25 bp, Homo sapien
tttattccagacctttctgccactt

SEQ ID NO: 200994 - DNA, 25 bp, Homo sapien
tattccagacctttctgccacttag

SEQ ID NO: 200995 - DNA, 25 bp, Homo sapien
agacctttctgccacttagcacttg

SEQ ID NO: 200996 - DNA, 25 bp, Homo sapien
ctttctgccacttagcacttgtata

SEQ ID NO: 200997 - DNA, 25 bp, Homo sapien
ttctgccacttagcacttgtataat

SEQ ID NO: 200998 - DNA, 25 bp, Homo sapien
gccacttagcacttgtataatcaga

SEQ ID NO: 200999 - DNA, 25 bp, Homo sapien
acttagcacttgtataatcagactg

SEQ ID NO: 201000 - DNA, 25 bp, Homo sapien
ggatgagggtgtaaattgtattgaa

SEQ ID NO: 201001 - DNA, 25 bp, Homo sapien
cccagagtcctcaactggacctagg

SEQ ID NO: 201002 - DNA, 25 bp, Homo sapien
ggaagaaggagatatcccacattta

SEQ ID NO: 201003 - DNA, 25 bp, Homo sapien
agaaggagatatcccacatttaaag

SEQ ID NO: 201004 - DNA, 25 bp, Homo sapien
gaaacagatcagaagctggatgaga

SEQ ID NO: 201005 - DNA, 25 bp, Homo sapien
ggatgagagcagtcaccagtttgta

SEQ ID NO: 201006 - DNA, 25 bp, Homo sapien
atgagagcagtcaccagtttgtagg

SEQ ID NO: 201007 - DNA, 25 bp, Homo sapien
agagcagtcaccagtttgtagggca

SEQ ID NO: 201008 - DNA, 25 bp, Homo sapien
agcagtcaccagtttgtagggcagg

SEQ ID NO: 201009 - DNA, 25 bp, Homo sapien
cagtcaccagtttgtagggcaggag

SEQ ID NO: 201010 - DNA, 25 bp, Homo sapien
tcaccagtttgtagggcaggaggca

SEQ ID NO: 201011 - DNA, 25 bp, Homo sapien
gtttgtagggcaggaggcagctgac

SEQ ID NO: 201012 - DNA, 25 bp, Homo sapien
tgtactcttctcactgcctaagaag

SEQ ID NO: 201013 - DNA, 25 bp, Homo sapien
attctcatttttctcggcttacaaa

SEQ ID NO: 201014 - DNA, 25 bp, Homo sapien
tttctcggcttacaaatctggatgc

SEQ ID NO: 201015 - DNA, 25 bp, Homo sapien
aatctggatgctcttagcctggtga

SEQ ID NO: 201016 - DNA, 25 bp, Homo sapien
aatgcctcgtgtgctttgaaatcct

SEQ ID NO: 201017 - DNA, 25 bp, Homo sapien
taaggccttctatttatgtttactg

SEQ ID NO: 201018 - DNA, 25 bp, Homo sapien
atgtttactgtacactcaggcgttt

SEQ ID NO: 201019 - DNA, 25 bp, Homo sapien
actcaggcgtttggctgggaccacg

SEQ ID NO: 201020 - DNA, 25 bp, Homo sapien
gggaccacggcttattcctaagcag

SEQ ID NO: 201021 - DNA, 25 bp, Homo sapien
ggacattagcattacctgcccaaag

SEQ ID NO: 201022 - DNA, 25 bp, Homo sapien
aatgcatccaaacacagacccagct

SEQ ID NO: 201023 - DNA, 25 bp, Homo sapien
tccatcaaccttcttattaatgtca

SEQ ID NO: 201024 - DNA, 25 bp, Homo sapien
aataacattcgttactgttgtgaaa

SEQ ID NO: 201025 - DNA, 25 bp, Homo sapien
gttgtgaaaatctgtcatgagcatt

SEQ ID NO: 201026 - DNA, 25 bp, Homo sapien
tgagcatttgtttaataagcatacc

SEQ ID NO: 201027 - DNA, 25 bp, Homo sapien
gcataccattgaaacatgccacttg

SEQ ID NO: 201028 - DNA, 25 bp, Homo sapien
gaagatttctctgagatcatgagtt

SEQ ID NO: 201029 - DNA, 25 bp, Homo sapien
gagtttgtttacacttgtctcaagc

SEQ ID NO: 201030 - DNA, 25 bp, Homo sapien
acacttgtctcaagcctatctatag

SEQ ID NO: 201031 - DNA, 25 bp, Homo sapien
agcctatctatagagacccttggat

SEQ ID NO: 201032 - DNA, 25 bp, Homo sapien
gagacccttggatttagaattatag

SEQ ID NO: 201033 - DNA, 25 bp, Homo sapien
ctcagaggttatgtgttctaactat

SEQ ID NO: 201034 - DNA, 25 bp, Homo sapien
ggcaaggatcacctattctgtcact

SEQ ID NO: 201035 - DNA, 25 bp, Homo sapien
acctattctgtcactccagcagaaa

SEQ ID NO: 201036 - DNA, 25 bp, Homo sapien
gtttaccactgtagacacacatctg

SEQ ID NO: 201037 - DNA, 25 bp, Homo sapien
agacacacatctgtaaacttgcaca

SEQ ID NO: 201038 - DNA, 25 bp, Homo sapien
ggaatttcagtgtcttagtggtttt

SEQ ID NO: 201039 - DNA, 25 bp, Homo sapien
gatggttcaagcattgtatcctttg

SEQ ID NO: 201040 - DNA, 25 bp, Homo sapien
gcattgtatcctttgttctttaggg

SEQ ID NO: 201041 - DNA, 25 bp, Homo sapien
gttctttagggttaccatagcttat

SEQ ID NO: 201042 - DNA, 25 bp, Homo sapien
aatactcaatctcaaccttcaggtc

SEQ ID NO: 201043 - DNA, 25 bp, Homo sapien
tcaaccttcaggtcagtgtcagtag

SEQ ID NO: 201044 - DNA, 25 bp, Homo sapien
tcagtgtcagtaggtggcaaggatc

SEQ ID NO: 201045 - DNA, 25 bp, Homo sapien
gatggtccgagctcgtccgtagatt

SEQ ID NO: 201046 - DNA, 25 bp, Homo sapien
gtccgtagattggaatcgccctgaa

SEQ ID NO: 201047 - DNA, 25 bp, Homo sapien
tcgccctgaagatgtagaccctcaa

SEQ ID NO: 201048 - DNA, 25 bp, Homo sapien
tatgtcatatctgctccttccatct

SEQ ID NO: 201049 - DNA, 25 bp, Homo sapien
tccttccatctacgctcgggaggta

SEQ ID NO: 201050 - DNA, 25 bp, Homo sapien
gctcgggaggtagcgacgccccttt

SEQ ID NO: 201051 - DNA, 25 bp, Homo sapien
ttcctcgattctgtccgtgaaatga

SEQ ID NO: 201052 - DNA, 25 bp, Homo sapien
aaatgaattgggtagagtctctgga

SEQ ID NO: 201053 - DNA, 25 bp, Homo sapien
gtctctggaaggttttaagcccatt

SEQ ID NO: 201054 - DNA, 25 bp, Homo sapien
cattttcagttctaacttactttca

SEQ ID NO: 201055 - DNA, 25 bp, Homo sapien
ttactttcatcctattttgcatccc

SEQ ID NO: 201056 - DNA, 25 bp, Homo sapien
gtgcaggaagtgtaaaatgtatatt

SEQ ID NO: 201057 - DNA, 25 bp, Homo sapien
tgcaggaagtgtaaaatgtatattt

SEQ ID NO: 201058 - DNA, 25 bp, Homo sapien
ttttaaagaatgttgttagaggccg

SEQ ID NO: 201059 - DNA, 25 bp, Homo sapien
tttaaagaatgttgttagaggccgg

SEQ ID NO: 201060 - DNA, 25 bp, Homo sapien
ttaaagaatgttgttagaggccggg

SEQ ID NO: 201061 - DNA, 25 bp, Homo sapien
taaagaatgttgttagaggccgggc

SEQ ID NO: 201062 - DNA, 25 bp, Homo sapien
aaagaatgttgttagaggccgggcg

SEQ ID NO: 201063 - DNA, 25 bp, Homo sapien
aagaatgttgttagaggccgggcgc

SEQ ID NO: 201064 - DNA, 25 bp, Homo sapien
agaatgttgttagaggccgggcgcg

SEQ ID NO: 201065 - DNA, 25 bp, Homo sapien
gaatgttgttagaggccgggcgcgg

SEQ ID NO: 201066 - DNA, 25 bp, Homo sapien
aatgttgttagaggccgggcgcggt

SEQ ID NO: 201067 - DNA, 25 bp, Homo sapien
tgctgtggaacgtcggcctggcccc

SEQ ID NO: 201068 - DNA, 25 bp, Homo sapien
tggcttctccacaggttttccagcg

SEQ ID NO: 201069 - DNA, 25 bp, Homo sapien
ttctccacaggttttccagcggagg

SEQ ID NO: 201070 - DNA, 25 bp, Homo sapien
ggtggatggctctgtggacttctac

SEQ ID NO: 201071 - DNA, 25 bp, Homo sapien
tctaccgggactgggccacgtacaa

SEQ ID NO: 201072 - DNA, 25 bp, Homo sapien
acaagcagggcttcggcagtcggct

SEQ ID NO: 201073 - DNA, 25 bp, Homo sapien
agggaaccagcgagctccgtgtaga

SEQ ID NO: 201074 - DNA, 25 bp, Homo sapien
gacctggtggactttgaggacaact

SEQ ID NO: 201075 - DNA, 25 bp, Homo sapien
gaggacaactaccagtttgctaagt

SEQ ID NO: 201076 - DNA, 25 bp, Homo sapien
tacagatcattcaaggtggccgacg

SEQ ID NO: 201077 - DNA, 25 bp, Homo sapien
ccgacgaggcggagaagtacaatct

SEQ ID NO: 201078 - DNA, 25 bp, Homo sapien
atcagactgtgaactggatggtcac

SEQ ID NO: 201079 - DNA, 25 bp, Homo sapien
ggatggtcacgaagtcattccccaa

SEQ ID NO: 201080 - DNA, 25 bp, Homo sapien
attccccaactcctagcaagtttga

SEQ ID NO: 201081 - DNA, 25 bp, Homo sapien
gtttgactgaatatatcatgtccac

SEQ ID NO: 201082 - DNA, 25 bp, Homo sapien
tcatgtccacagtagattttcaaga

SEQ ID NO: 201083 - DNA, 25 bp, Homo sapien
aataggcttaaatcaattgcatcca

SEQ ID NO: 201084 - DNA, 25 bp, Homo sapien
aaatcaattgcatccatatttgctg

SEQ ID NO: 201085 - DNA, 25 bp, Homo sapien
ggattgctatcagtataccttttgc

SEQ ID NO: 201086 - DNA, 25 bp, Homo sapien
cagtataccttttgcgtttatagtc

SEQ ID NO: 201087 - DNA, 25 bp, Homo sapien
atagtcaacatgtatcatcctgaaa

SEQ ID NO: 201088 - DNA, 25 bp, Homo sapien
ctgaaatattctttctggacttata

SEQ ID NO: 201089 - DNA, 25 bp, Homo sapien
aacagttgtgctgtaaaaactcatg

SEQ ID NO: 201090 - DNA, 25 bp, Homo sapien
gtgctgtaaaaactcatggactttc

SEQ ID NO: 201091 - DNA, 25 bp, Homo sapien
ggactttctgggattctaaatatat

SEQ ID NO: 201092 - DNA, 25 bp, Homo sapien
atgttacactcttaataactggtag

SEQ ID NO: 201093 - DNA, 25 bp, Homo sapien
cactcttaataactggtagatataa

SEQ ID NO: 201094 - DNA, 25 bp, Homo sapien
ggagtagagctaaagatctgtatta

SEQ ID NO: 201095 - DNA, 25 bp, Homo sapien
gatctgtattatagtctcattagta

SEQ ID NO: 201096 - DNA, 25 bp, Homo sapien
gtattatagtctcattagtaccaga

SEQ ID NO: 201097 - DNA, 25 bp, Homo sapien
gtctcattagtaccagacagatgtt

SEQ ID NO: 201098 - DNA, 25 bp, Homo sapien
agtaccagacagatgttgttgagaa

SEQ ID NO: 201099 - DNA, 25 bp, Homo sapien
gtaatctagatatccttattatgta

SEQ ID NO: 201100 - DNA, 25 bp, Homo sapien
tgctggcatcttagaaccctcccta

SEQ ID NO: 201101 - DNA, 25 bp, Homo sapien
ccccactgtcagacgggctggcaaa

SEQ ID NO: 201102 - DNA, 25 bp, Homo sapien
acgggctggcaaatgccttgcagga

SEQ ID NO: 201103 - DNA, 25 bp, Homo sapien
aagccatttacagaaacccactcgg

SEQ ID NO: 201104 - DNA, 25 bp, Homo sapien
cccagtctaacaccacaactaattt

SEQ ID NO: 201105 - DNA, 25 bp, Homo sapien
acaccacaactaatttcacccaagg

SEQ ID NO: 201106 - DNA, 25 bp, Homo sapien
tcacccaaggttttaagcacgttct

SEQ ID NO: 201107 - DNA, 25 bp, Homo sapien
ttaagcacgttctttcatcagaccc

SEQ ID NO: 201108 - DNA, 25 bp, Homo sapien
agaccctggcccaatacctatgtat

SEQ ID NO: 201109 - DNA, 25 bp, Homo sapien
aatacctatgtatgcaatgctcctc

SEQ ID NO: 201110 - DNA, 25 bp, Homo sapien
tatgtatgcaatgctcctcagccct

SEQ ID NO: 201111 - DNA, 25 bp, Homo sapien
ggtcccccgtgctgtggaacgtcgg

SEQ ID NO: 201112 - DNA, 25 bp, Homo sapien
ccccgtgctgtggaacgtcggcctg

SEQ ID NO: 201113 - DNA, 25 bp, Homo sapien
cccgtgctgtggaacgtcggcctgg

SEQ ID NO: 201114 - DNA, 25 bp, Homo sapien
tgctgtggaacgtcggcctggcccc

SEQ ID NO: 201115 - DNA, 25 bp, Homo sapien
cctggcttctccacaggttttccag

SEQ ID NO: 201116 - DNA, 25 bp, Homo sapien
ctggcttctccacaggttttccagc

SEQ ID NO: 201117 - DNA, 25 bp, Homo sapien
tggcttctccacaggttttccagcg

SEQ ID NO: 201118 - DNA, 25 bp, Homo sapien
ggcttctccacaggttttccagcgg

SEQ ID NO: 201119 - DNA, 25 bp, Homo sapien
gcttctccacaggttttccagcgga

SEQ ID NO: 201120 - DNA, 25 bp, Homo sapien
cttctccacaggttttccagcggag

SEQ ID NO: 201121 - DNA, 25 bp, Homo sapien
ttctccacaggttttccagcggagg

SEQ ID NO: 201122 - DNA, 25 bp, Homo sapien
taaatatttgccatctaacagacca

SEQ ID NO: 201123 - DNA, 25 bp, Homo sapien
taacagaccaaaaagcctgaagctt

SEQ ID NO: 201124 - DNA, 25 bp, Homo sapien
taaagctcatgtgtatcatttgttc

SEQ ID NO: 201125 - DNA, 25 bp, Homo sapien
agttgcaacatgtcaagttaccaag

SEQ ID NO: 201126 - DNA, 25 bp, Homo sapien
aatatttatctctcttctgtggatg

SEQ ID NO: 201127 - DNA, 25 bp, Homo sapien
tttttccagaggcactcaattattt

SEQ ID NO: 201128 - DNA, 25 bp, Homo sapien
ttttctcctattcaacctataacct

SEQ ID NO: 201129 - DNA, 25 bp, Homo sapien
ataggaaatctactgcgctgctttg

SEQ ID NO: 201130 - DNA, 25 bp, Homo sapien
tactgcgctgctttgcagaatgagt

SEQ ID NO: 201131 - DNA, 25 bp, Homo sapien
ttaatggtcctgactcttaaggttt

SEQ ID NO: 201132 - DNA, 25 bp, Homo sapien
ctgactcttaaggttttactgtagt

SEQ ID NO: 201133 - DNA, 25 bp, Homo sapien
gagtggcagctgacatgttttctga

SEQ ID NO: 201134 - DNA, 25 bp, Homo sapien
agctgacatgttttctgacggcaac

SEQ ID NO: 201135 - DNA, 25 bp, Homo sapien
gacatgttttctgacggcaacttca

SEQ ID NO: 201136 - DNA, 25 bp, Homo sapien
cccttttctactttgccagcaaact

SEQ ID NO: 201137 - DNA, 25 bp, Homo sapien
actttgccagcaaactggtgctcaa

SEQ ID NO: 201138 - DNA, 25 bp, Homo sapien
accaaggtgccggaactgatcagaa

SEQ ID NO: 201139 - DNA, 25 bp, Homo sapien
gaactgatcagaaccatcatgggct

SEQ ID NO: 201140 - DNA, 25 bp, Homo sapien
accatcatgggctggacattggact

SEQ ID NO: 201141 - DNA, 25 bp, Homo sapien
atgggctggacattggacttcctcc

SEQ ID NO: 201142 - DNA, 25 bp, Homo sapien
acattggacttcctccgggagcggc

SEQ ID NO: 201143 - DNA, 25 bp, Homo sapien
ggctgttgggctggatccaagacca

SEQ ID NO: 201144 - DNA, 25 bp, Homo sapien
agcctgagacagctgtcttgtgagg

SEQ ID NO: 201145 - DNA, 25 bp, Homo sapien
gcctgagacagctgtcttgtgaggg

SEQ ID NO: 201146 - DNA, 25 bp, Homo sapien
cctgagacagctgtcttgtgaggga

SEQ ID NO: 201147 - DNA, 25 bp, Homo sapien
ctgagacagctgtcttgtgagggac

SEQ ID NO: 201148 - DNA, 25 bp, Homo sapien
cagctgtcttgtgagggactgagat

SEQ ID NO: 201149 - DNA, 25 bp, Homo sapien
agctgtcttgtgagggactgagatg

SEQ ID NO: 201150 - DNA, 25 bp, Homo sapien
gctgtcttgtgagggactgagatgc

SEQ ID NO: 201151 - DNA, 25 bp, Homo sapien
ctgtcttgtgagggactgagatgca

SEQ ID NO: 201152 - DNA, 25 bp, Homo sapien
tgtcttgtgagggactgagatgcag

SEQ ID NO: 201153 - DNA, 25 bp, Homo sapien
atcatatctgtatatatctgaacca

SEQ ID NO: 201154 - DNA, 25 bp, Homo sapien
atatatctgaaccaagttgtgtgca

SEQ ID NO: 201155 - DNA, 25 bp, Homo sapien
accaagttgtgtgcagagaggttga

SEQ ID NO: 201156 - DNA, 25 bp, Homo sapien
atagattttgccctgaatactggtg

SEQ ID NO: 201157 - DNA, 25 bp, Homo sapien
tttgccctgaatactggtgtgccca

SEQ ID NO: 201158 - DNA, 25 bp, Homo sapien
gaatactggtgtgcccaggtatgcc

SEQ ID NO: 201159 - DNA, 25 bp, Homo sapien
ggtgtgcccaggtatgccgtgctct

SEQ ID NO: 201160 - DNA, 25 bp, Homo sapien
caggtatgccgtgctctctctctgt

SEQ ID NO: 201161 - DNA, 25 bp, Homo sapien
ctctctctgtttccagtggtggtaa

SEQ ID NO: 201162 - DNA, 25 bp, Homo sapien
tccagtggtggtaattttaaggcct

SEQ ID NO: 201163 - DNA, 25 bp, Homo sapien
aattgattttgttctgtggtacaaa

SEQ ID NO: 201164 - DNA, 25 bp, Homo sapien
ttcagcatctgcacctgtagcagca

SEQ ID NO: 201165 - DNA, 25 bp, Homo sapien
tcagcatctgcacctgtagcagcag

SEQ ID NO: 201166 - DNA, 25 bp, Homo sapien
cagcatctgcacctgtagcagcagc

SEQ ID NO: 201167 - DNA, 25 bp, Homo sapien
agcatctgcacctgtagcagcagca

SEQ ID NO: 201168 - DNA, 25 bp, Homo sapien
acaaccttgacagatgctccagctg

SEQ ID NO: 201169 - DNA, 25 bp, Homo sapien
caaccttgacagatgctccagctgc

SEQ ID NO: 201170 - DNA, 25 bp, Homo sapien
aaccttgacagatgctccagctgca

SEQ ID NO: 201171 - DNA, 25 bp, Homo sapien
accttgacagatgctccagctgcaa

SEQ ID NO: 201172 - DNA, 25 bp, Homo sapien
tccagctgcaatccccagatgagca

SEQ ID NO: 201173 - DNA, 25 bp, Homo sapien
ccagctgcaatccccagatgagcag

SEQ ID NO: 201174 - DNA, 25 bp, Homo sapien
cagctgcaatccccagatgagcagc

SEQ ID NO: 201175 - DNA, 25 bp, Homo sapien
acagccattttgattatgtccacga

SEQ ID NO: 201176 - DNA, 25 bp, Homo sapien
tatgtccacgaccagaaccagaaga

SEQ ID NO: 201177 - DNA, 25 bp, Homo sapien
gagataaactcatgactgcactttg

SEQ ID NO: 201178 - DNA, 25 bp, Homo sapien
tctcttccattcaccttcatagttt

SEQ ID NO: 201179 - DNA, 25 bp, Homo sapien
tcaccttcatagtttcattgcattc

SEQ ID NO: 201180 - DNA, 25 bp, Homo sapien
cattgcattccatgaaaagtgtctt

SEQ ID NO: 201181 - DNA, 25 bp, Homo sapien
gaaaagtgtcttggcctcagatgga

SEQ ID NO: 201182 - DNA, 25 bp, Homo sapien
cttggcctcagatggatggatgtgt

SEQ ID NO: 201183 - DNA, 25 bp, Homo sapien
atggatgtgtttggacgagtgtctt

SEQ ID NO: 201184 - DNA, 25 bp, Homo sapien
acgagtgtctttaaggagtagtcct

SEQ ID NO: 201185 - DNA, 25 bp, Homo sapien
aggtgtttttggtgtccatgtaaat

SEQ ID NO: 201186 - DNA, 25 bp, Homo sapien
tacttctgtgcatcaagcatggccg

SEQ ID NO: 201187 - DNA, 25 bp, Homo sapien
acttctgtgcatcaagcatggccgg

SEQ ID NO: 201188 - DNA, 25 bp, Homo sapien
cttctgtgcatcaagcatggccggg

SEQ ID NO: 201189 - DNA, 25 bp, Homo sapien
ttctgtgcatcaagcatggccgggt

SEQ ID NO: 201190 - DNA, 25 bp, Homo sapien
tctgtgcatcaagcatggccgggta

SEQ ID NO: 201191 - DNA, 25 bp, Homo sapien
tgtgcatcaagcatggccgggtatg

SEQ ID NO: 201192 - DNA, 25 bp, Homo sapien
gtgcatcaagcatggccgggtatgc

SEQ ID NO: 201193 - DNA, 25 bp, Homo sapien
tgcatcaagcatggccgggtatgca

SEQ ID NO: 201194 - DNA, 25 bp, Homo sapien
tcaagcatggccgggtatgcactca

SEQ ID NO: 201195 - DNA, 25 bp, Homo sapien
atggccgggtatgcactcaacttcg

SEQ ID NO: 201196 - DNA, 25 bp, Homo sapien
gtatgcactcaacttcggcaaaggc

SEQ ID NO: 201197 - DNA, 25 bp, Homo sapien
ttctgaaggttggaactgctgccat

SEQ ID NO: 201198 - DNA, 25 bp, Homo sapien
gaactgctgccatgattttggccac

SEQ ID NO: 201199 - DNA, 25 bp, Homo sapien
gattttggccactttgcagacctgg

SEQ ID NO: 201200 - DNA, 25 bp, Homo sapien
gcagacctgggactttagggctaac

SEQ ID NO: 201201 - DNA, 25 bp, Homo sapien
tagggctaaccagttctctttgtaa

SEQ ID NO: 201202 - DNA, 25 bp, Homo sapien
aaccagttctctttgtaaggacttg

SEQ ID NO: 201203 - DNA, 25 bp, Homo sapien
aggacttgtgcctcttgggagacgt

SEQ ID NO: 201204 - DNA, 25 bp, Homo sapien
tgggagacgtccacccgtttccaag

SEQ ID NO: 201205 - DNA, 25 bp, Homo sapien
cgctgtgctgttgtctgccgtgaga

SEQ ID NO: 201206 - DNA, 25 bp, Homo sapien
gttgtctgccgtgagagcccaatca

SEQ ID NO: 201207 - DNA, 25 bp, Homo sapien
gtgagagcccaatcactgcctatac

SEQ ID NO: 201208 - DNA, 25 bp, Homo sapien
ccctcatcaggcaagacagactgaa

SEQ ID NO: 201209 - DNA, 25 bp, Homo sapien
gtgggtgattagctgctccttgaac

SEQ ID NO: 201210 - DNA, 25 bp, Homo sapien
agcaggcctcaagagcccctaattg

SEQ ID NO: 201211 - DNA, 25 bp, Homo sapien
gagcccctaattgtctcagggttca

SEQ ID NO: 201212 - DNA, 25 bp, Homo sapien
gcttcagggaagatcatagttaata

SEQ ID NO: 201213 - DNA, 25 bp, Homo sapien
gttaataacgtctctcaacaaatga

SEQ ID NO: 201214 - DNA, 25 bp, Homo sapien
tccttgtggcttcttgtctgtctga

SEQ ID NO: 201215 - DNA, 25 bp, Homo sapien
gcttcttgtctgtctgagtcaacga

SEQ ID NO: 201216 - DNA, 25 bp, Homo sapien
gtctgtctgagtcaacgaatacaca

SEQ ID NO: 201217 - DNA, 25 bp, Homo sapien
gaatacacagacttactggattata

SEQ ID NO: 201218 - DNA, 25 bp, Homo sapien
gaaaattcacatctgccttgttaat

SEQ ID NO: 201219 - DNA, 25 bp, Homo sapien
gccgtggtcgccgtctgtgaacaag

SEQ ID NO: 201220 - DNA, 25 bp, Homo sapien
gcagaccgagatgaatcctcaccat

SEQ ID NO: 201221 - DNA, 25 bp, Homo sapien
agatgaatcctcaccatatgctgct

SEQ ID NO: 201222 - DNA, 25 bp, Homo sapien
atcctcaccatatgctgctatgttg

SEQ ID NO: 201223 - DNA, 25 bp, Homo sapien
atgctgctatgttggctgcccagga

SEQ ID NO: 201224 - DNA, 25 bp, Homo sapien
gtgcaaggagctgggtatcaccgcc

SEQ ID NO: 201225 - DNA, 25 bp, Homo sapien
aaggagctgggtatcaccgccctac

SEQ ID NO: 201226 - DNA, 25 bp, Homo sapien
agctgggtatcaccgccctacacat

SEQ ID NO: 201227 - DNA, 25 bp, Homo sapien
aactccgggccacaggaggaaatag

SEQ ID NO: 201228 - DNA, 25 bp, Homo sapien
aataggaccaagacccctggacctg

SEQ ID NO: 201229 - DNA, 25 bp, Homo sapien
ataggaccaagacccctggacctgg

SEQ ID NO: 201230 - DNA, 25 bp, Homo sapien
ccaaggttgaagtcggtgtggccac

SEQ ID NO: 201231 - DNA, 25 bp, Homo sapien
tggccacggcgcttggaatcctggt

SEQ ID NO: 201232 - DNA, 25 bp, Homo sapien
cgcttggaatcctggttgttgctgg

SEQ ID NO: 201233 - DNA, 25 bp, Homo sapien
gaatcctggttgttgctggatgctc

SEQ ID NO: 201234 - DNA, 25 bp, Homo sapien
ctggatgctcttttgcgattaggag

SEQ ID NO: 201235 - DNA, 25 bp, Homo sapien
atgctcttttgcgattaggagatac

SEQ ID NO: 201236 - DNA, 25 bp, Homo sapien
cagccacaaaatcctgtgttagaag

SEQ ID NO: 201237 - DNA, 25 bp, Homo sapien
aatcctgtgttagaagcagctgtgg

SEQ ID NO: 201238 - DNA, 25 bp, Homo sapien
gggtcccagtggagatgagcctccc

SEQ ID NO: 201239 - DNA, 25 bp, Homo sapien
gtgccctgtctcaggcgttctctag

SEQ ID NO: 201240 - DNA, 25 bp, Homo sapien
tctcgctggcaaaagtatgatctaa

SEQ ID NO: 201241 - DNA, 25 bp, Homo sapien
taaaaaggcctaactgcttatggtt

SEQ ID NO: 201242 - DNA, 25 bp, Homo sapien
aggcctaactgcttatggttataaa

SEQ ID NO: 201243 - DNA, 25 bp, Homo sapien
gttagtcttacaaacgtaatgtggc

SEQ ID NO: 201244 - DNA, 25 bp, Homo sapien
gaaaccaagctacaaaactcctcag

SEQ ID NO: 201245 - DNA, 25 bp, Homo sapien
ccaagctacaaaactcctcaggaat

SEQ ID NO: 201246 - DNA, 25 bp, Homo sapien
aaatgtgaagtcctcaagcagctcc

SEQ ID NO: 201247 - DNA, 25 bp, Homo sapien
gtgaagtcctcaagcagctccatga

SEQ ID NO: 201248 - DNA, 25 bp, Homo sapien
aagcagctccatgagtagggatcat

SEQ ID NO: 201249 - DNA, 25 bp, Homo sapien
ataaacttcaggtagccatctttgt

SEQ ID NO: 201250 - DNA, 25 bp, Homo sapien
gtagccatctttgtacctagagtgt

SEQ ID NO: 201251 - DNA, 25 bp, Homo sapien
acctagagtgtatttgttccaagtc

SEQ ID NO: 201252 - DNA, 25 bp, Homo sapien
gataaggagacctgctttgccgagg

SEQ ID NO: 201253 - DNA, 25 bp, Homo sapien
aagtcaagctgccttaggcttataa

SEQ ID NO: 201254 - DNA, 25 bp, Homo sapien
ccttaggcttataacatcacattta

SEQ ID NO: 201255 - DNA, 25 bp, Homo sapien
atcacatttaaaagcatctcagcct

SEQ ID NO: 201256 - DNA, 25 bp, Homo sapien
taaaagcatctcagcctaccatgag

SEQ ID NO: 201257 - DNA, 25 bp, Homo sapien
gatcaaaagcttattcatctgtttt

SEQ ID NO: 201258 - DNA, 25 bp, Homo sapien
ttcgttggtgtaaagccaacaccct

SEQ ID NO: 201259 - DNA, 25 bp, Homo sapien
aaggcaacaaaagagcaactgaaag

SEQ ID NO: 201260 - DNA, 25 bp, Homo sapien
agagcaactgaaagctgttatggat

SEQ ID NO: 201261 - DNA, 25 bp, Homo sapien
gttatggatgatttcgcagcttttg

SEQ ID NO: 201262 - DNA, 25 bp, Homo sapien
gagaagtgctgcaaggctgacgata

SEQ ID NO: 201263 - DNA, 25 bp, Homo sapien
taaggagtcttttacccggtgtgct

SEQ ID NO: 201264 - DNA, 25 bp, Homo sapien
gtcttttacccggtgtgctttgccg

SEQ ID NO: 201265 - DNA, 25 bp, Homo sapien
ttttacccggtgtgctttgccgcag

SEQ ID NO: 201266 - DNA, 25 bp, Homo sapien
tacccggtgtgctttgccgcagtca

SEQ ID NO: 201267 - DNA, 25 bp, Homo sapien
ctttgccgcagtcatccaaaataaa

SEQ ID NO: 201268 - DNA, 25 bp, Homo sapien
gccgcagtcatccaaaataaattca

SEQ ID NO: 201269 - DNA, 25 bp, Homo sapien
tactgacagtattgttttgatacag

SEQ ID NO: 201270 - DNA, 25 bp, Homo sapien
tttgatacagaatgaaagtgcgtag

SEQ ID NO: 201271 - DNA, 25 bp, Homo sapien
aagtgcgtagtattttcattttgtt

SEQ ID NO: 201272 - DNA, 25 bp, Homo sapien
tgccttatacatatagcaagccctc

SEQ ID NO: 201273 - DNA, 25 bp, Homo sapien
atacatatagcaagccctcaataaa

SEQ ID NO: 201274 - DNA, 25 bp, Homo sapien
tattataggcttcaatgttttcatg

SEQ ID NO: 201275 - DNA, 25 bp, Homo sapien
gttttcatgaatgttacccaaaaag

SEQ ID NO: 201276 - DNA, 25 bp, Homo sapien
gaatgttacccaaaaagctgtgttt

SEQ ID NO: 201277 - DNA, 25 bp, Homo sapien
ctttggtcagaggtcaaaatttatg

SEQ ID NO: 201278 - DNA, 25 bp, Homo sapien
gctgtatgaatggaaatcattttgc

SEQ ID NO: 201279 - DNA, 25 bp, Homo sapien
cattttgcaattgagtgacacttca

SEQ ID NO: 201280 - DNA, 25 bp, Homo sapien
ttgagtgacacttcattgtaattca

SEQ ID NO: 201281 - DNA, 25 bp, Homo sapien
gtgacacttcattgtaattcacagt

SEQ ID NO: 201282 - DNA, 25 bp, Homo sapien
ttcacagtgtaaatttaatccaaac

SEQ ID NO: 201283 - DNA, 25 bp, Homo sapien
atcattagtaatatttcagttgggt

SEQ ID NO: 201284 - DNA, 25 bp, Homo sapien
tatttcagttgggtatctttttaag

SEQ ID NO: 201285 - DNA, 25 bp, Homo sapien
gaggatctagttcaagaggcaagaa

SEQ ID NO: 201286 - DNA, 25 bp, Homo sapien
gaggcaagaagatctggccctcaat

SEQ ID NO: 201287 - DNA, 25 bp, Homo sapien
gcaagaagatctggccctcaattag

SEQ ID NO: 201288 - DNA, 25 bp, Homo sapien
tagatgctgcctaacagttccctcc

SEQ ID NO: 201289 - DNA, 25 bp, Homo sapien
tgcctaacagttccctcctcaaagg

SEQ ID NO: 201290 - DNA, 25 bp, Homo sapien
ttcccttcccactggtgcattacaa

SEQ ID NO: 201291 - DNA, 25 bp, Homo sapien
ttcccactggtgcattacaaaacag

SEQ ID NO: 201292 - DNA, 25 bp, Homo sapien
taaaaaatgttgtgtatctgtatat

SEQ ID NO: 201293 - DNA, 25 bp, Homo sapien
tatagtattgtgatgtctgaatgac

SEQ ID NO: 201294 - DNA, 25 bp, Homo sapien
gtgatgtctgaatgacaatgtactg

SEQ ID NO: 201295 - DNA, 25 bp, Homo sapien
gacaatgtactgaatgcaaaaagga

SEQ ID NO: 201296 - DNA, 25 bp, Homo sapien
gcagaccgagatgaatcctcaccat

SEQ ID NO: 201297 - DNA, 25 bp, Homo sapien
cagaccgagatgaatcctcaccata

SEQ ID NO: 201298 - DNA, 25 bp, Homo sapien
agaccgagatgaatcctcaccatat

SEQ ID NO: 201299 - DNA, 25 bp, Homo sapien
gaccgagatgaatcctcaccatatg

SEQ ID NO: 201300 - DNA, 25 bp, Homo sapien
accgagatgaatcctcaccatatgc

SEQ ID NO: 201301 - DNA, 25 bp, Homo sapien
ccgagatgaatcctcaccatatgct

SEQ ID NO: 201302 - DNA, 25 bp, Homo sapien
cgagatgaatcctcaccatatgctg

SEQ ID NO: 201303 - DNA, 25 bp, Homo sapien
gccctacacatcaaactccgggcca

SEQ ID NO: 201304 - DNA, 25 bp, Homo sapien
ccctacacatcaaactccgggccac

SEQ ID NO: 201305 - DNA, 25 bp, Homo sapien
aggctgcttccggtagtccctgttt

SEQ ID NO: 201306 - DNA, 25 bp, Homo sapien
cctgtttttgcagtacatgggtgac

SEQ ID NO: 201307 - DNA, 25 bp, Homo sapien
agtacatgggtgactatctcccctg

SEQ ID NO: 201308 - DNA, 25 bp, Homo sapien
tgggtgactatctcccctgttggag

SEQ ID NO: 201309 - DNA, 25 bp, Homo sapien
aggtgagtggcctgtaagtccaagc

SEQ ID NO: 201310 - DNA, 25 bp, Homo sapien
tggcctgtaagtccaagctgtgcga

SEQ ID NO: 201311 - DNA, 25 bp, Homo sapien
tgctgtacaacttctgggcctctct

SEQ ID NO: 201312 - DNA, 25 bp, Homo sapien
ggcctctcttggaccctgggagtga

SEQ ID NO: 201313 - DNA, 25 bp, Homo sapien
agaggccttgggagctcatccctct

SEQ ID NO: 201314 - DNA, 25 bp, Homo sapien
cagaatccctctaacccttgggtgc

SEQ ID NO: 201315 - DNA, 25 bp, Homo sapien
tccgcctgtgtaaatgctccagcac

SEQ ID NO: 201316 - DNA, 25 bp, Homo sapien
ttaagccactaagttgtttaataat

SEQ ID NO: 201317 - DNA, 25 bp, Homo sapien
aatgtacaggcaaacttggaagata

SEQ ID NO: 201318 - DNA, 25 bp, Homo sapien
gtacaggcaaacttggaagatactg

SEQ ID NO: 201319 - DNA, 25 bp, Homo sapien
aagatactgtgggttgggttccaga

SEQ ID NO: 201320 - DNA, 25 bp, Homo sapien
atactgtgggttgggttccagacca

SEQ ID NO: 201321 - DNA, 25 bp, Homo sapien
gtgggttgggttccagaccactaca

SEQ ID NO: 201322 - DNA, 25 bp, Homo sapien
tataaaagttatgttgggccggcat

SEQ ID NO: 201323 - DNA, 25 bp, Homo sapien
aaaagttatgttgggccggcatggt

SEQ ID NO: 201324 - DNA, 25 bp, Homo sapien
tgggccggcatggtggctcgggcct

SEQ ID NO: 201325 - DNA, 25 bp, Homo sapien
gagaccaaccttggtaacatggtaa

SEQ ID NO: 201326 - DNA, 25 bp, Homo sapien
agaccaaccttggtaacatggtaag

SEQ ID NO: 201327 - DNA, 25 bp, Homo sapien
ctttcagcctctgttgcaactaaca

SEQ ID NO: 201328 - DNA, 25 bp, Homo sapien
tgttgcaactaacaactctcagtgg

SEQ ID NO: 201329 - DNA, 25 bp, Homo sapien
aggacacagctttggccttgggaat

SEQ ID NO: 201330 - DNA, 25 bp, Homo sapien
agctttggccttgggaattctggga

SEQ ID NO: 201331 - DNA, 25 bp, Homo sapien
gatacatatgcagctaggccacctc

SEQ ID NO: 201332 - DNA, 25 bp, Homo sapien
ttactgccataaacaccaaagtgat

SEQ ID NO: 201333 - DNA, 25 bp, Homo sapien
tatttgaaccacgacggaagggcca

SEQ ID NO: 201334 - DNA, 25 bp, Homo sapien
agagccacgaagatgccagttgcca

SEQ ID NO: 201335 - DNA, 25 bp, Homo sapien
atgccagttgccacattgttgagct

SEQ ID NO: 201336 - DNA, 25 bp, Homo sapien
ttgttgagctgctgacccaacacca

SEQ ID NO: 201337 - DNA, 25 bp, Homo sapien
ccattgcctgtctctaaacatctta

SEQ ID NO: 201338 - DNA, 25 bp, Homo sapien
atgtctttacctcccagtcgctcta

SEQ ID NO: 201339 - DNA, 25 bp, Homo sapien
agtcgctctaagatctgcttgaagt

SEQ ID NO: 201340 - DNA, 25 bp, Homo sapien
gatctgcttgaagtctcgtatttgt

SEQ ID NO: 201341 - DNA, 25 bp, Homo sapien
gaagtctcgtatttgtactgctttc

SEQ ID NO: 201342 - DNA, 25 bp, Homo sapien
gtctcgtatttgtactgctttctgc

SEQ ID NO: 201343 - DNA, 25 bp, Homo sapien
gtaacatctcagaaatttcatccag

SEQ ID NO: 201344 - DNA, 25 bp, Homo sapien
aatattgtcctgtccctgtctggga

SEQ ID NO: 201345 - DNA, 25 bp, Homo sapien
ccctgtctgggagttgtgttattta

SEQ ID NO: 201346 - DNA, 25 bp, Homo sapien
atattctgtatgttgtatcttttgc

SEQ ID NO: 201347 - DNA, 25 bp, Homo sapien
tatcttttgcatgtagcttccttaa

SEQ ID NO: 201348 - DNA, 25 bp, Homo sapien
gcatgtagcttccttaatggagaaa

SEQ ID NO: 201349 - DNA, 25 bp, Homo sapien
gacacagagggctggctgtacttta

SEQ ID NO: 201350 - DNA, 25 bp, Homo sapien
gggctggctgtactttatttcccta

SEQ ID NO: 201351 - DNA, 25 bp, Homo sapien
atgtatacgtttaaagccaactgtt

SEQ ID NO: 201352 - DNA, 25 bp, Homo sapien
aaacacagccttatatatttgggta

SEQ ID NO: 201353 - DNA, 25 bp, Homo sapien
tttttctgcccacatgttccgacta

SEQ ID NO: 201354 - DNA, 25 bp, Homo sapien
gttccgactagatcgatgcctttat

SEQ ID NO: 201355 - DNA, 25 bp, Homo sapien
gactagatcgatgcctttattaaat

SEQ ID NO: 201356 - DNA, 25 bp, Homo sapien
gattcaacttcagttttcatcatga

SEQ ID NO: 201357 - DNA, 25 bp, Homo sapien
tttgccataattgggttttcactat

SEQ ID NO: 201358 - DNA, 25 bp, Homo sapien
ttcactatttagattacaccccaaa

SEQ ID NO: 201359 - DNA, 25 bp, Homo sapien
gattacaccccaaatgacagttttt

SEQ ID NO: 201360 - DNA, 25 bp, Homo sapien
gtgaagtacaaaacactgagttaca

SEQ ID NO: 201361 - DNA, 25 bp, Homo sapien
aacactgagttacaggctgtgggaa

SEQ ID NO: 201362 - DNA, 25 bp, Homo sapien
aaggcagcaccaatggtggcacctt

SEQ ID NO: 201363 - DNA, 25 bp, Homo sapien
agcaccaatggtggcaccttctaat

SEQ ID NO: 201364 - DNA, 25 bp, Homo sapien
aatggtggcaccttctaatactggt

SEQ ID NO: 201365 - DNA, 25 bp, Homo sapien
ggtggcaccttctaatactggttgt

SEQ ID NO: 201366 - DNA, 25 bp, Homo sapien
tggcaccttctaatactggttgttc

SEQ ID NO: 201367 - DNA, 25 bp, Homo sapien
gcaccttctaatactggttgttcta

SEQ ID NO: 201368 - DNA, 25 bp, Homo sapien
gtacaaaagaattactctgatcgat

SEQ ID NO: 201369 - DNA, 25 bp, Homo sapien
gaattactctgatcgatattaaatc

SEQ ID NO: 201370 - DNA, 25 bp, Homo sapien
gcaaatactactctatgttggggtg

SEQ ID NO: 201371 - DNA, 25 bp, Homo sapien
aggacttacagggacagccggcaaa

SEQ ID NO: 201372 - DNA, 25 bp, Homo sapien
ggacagccggcaaaataagcagcat

SEQ ID NO: 201373 - DNA, 25 bp, Homo sapien
ataagcagcatcagccaaccaggaa

SEQ ID NO: 201374 - DNA, 25 bp, Homo sapien
tcacaaatgctaacaggaggctggt

SEQ ID NO: 201375 - DNA, 25 bp, Homo sapien
ggtttgatgcatgtggtccttccaa

SEQ ID NO: 201376 - DNA, 25 bp, Homo sapien
ggtccttccaacttgaacggaatgt

SEQ ID NO: 201377 - DNA, 25 bp, Homo sapien
ggaatgtactatccacagaggcaga

SEQ ID NO: 201378 - DNA, 25 bp, Homo sapien
taaatggtactactggaaaggctca

SEQ ID NO: 201379 - DNA, 25 bp, Homo sapien
gaaaggctcaggctattcgctcaag

SEQ ID NO: 201380 - DNA, 25 bp, Homo sapien
tcaggctattcgctcaaggccacaa

SEQ ID NO: 201381 - DNA, 25 bp, Homo sapien
aaggccacaaccatgatgatccgac

SEQ ID NO: 201382 - DNA, 25 bp, Homo sapien
atcgagttcacacgcatcctgaaac

SEQ ID NO: 201383 - DNA, 25 bp, Homo sapien
taaaatcttccagttacattgtctt

SEQ ID NO: 201384 - DNA, 25 bp, Homo sapien
gttacattgtcttactctcttttac

SEQ ID NO: 201385 - DNA, 25 bp, Homo sapien
tactctcttttacttctcagacact

SEQ ID NO: 201386 - DNA, 25 bp, Homo sapien
tctcttttacttctcagacacttcc

SEQ ID NO: 201387 - DNA, 25 bp, Homo sapien
tttattccagacctttctgccactt

SEQ ID NO: 201388 - DNA, 25 bp, Homo sapien
agacctttctgccacttagcacttg

SEQ ID NO: 201389 - DNA, 25 bp, Homo sapien
ctttctgccacttagcacttgtata

SEQ ID NO: 201390 - DNA, 25 bp, Homo sapien
gccacttagcacttgtataatcaga

SEQ ID NO: 201391 - DNA, 25 bp, Homo sapien
acttagcacttgtataatcagactg

SEQ ID NO: 201392 - DNA, 25 bp, Homo sapien
ggatgagggtgtaaattgtattgaa

SEQ ID NO: 201393 - DNA, 25 bp, Homo sapien
atgtctgtcttatcatgcaatggaa

SEQ ID NO: 201394 - DNA, 25 bp, Homo sapien
gcatcttaccaatgatgtaacggtt

SEQ ID NO: 201395 - DNA, 25 bp, Homo sapien
ttaataaccaagttgctgctgaact

SEQ ID NO: 201396 - DNA, 25 bp, Homo sapien
gttgctgctgaacttatactaaatc

SEQ ID NO: 201397 - DNA, 25 bp, Homo sapien
gggaccaaaaaacttgctcttatct

SEQ ID NO: 201398 - DNA, 25 bp, Homo sapien
tgctcttatcttctcaaattgtatt

SEQ ID NO: 201399 - DNA, 25 bp, Homo sapien
atccattaatgtatcagttatccca

SEQ ID NO: 201400 - DNA, 25 bp, Homo sapien
agttatcccaaagccttcaggtgga

SEQ ID NO: 201401 - DNA, 25 bp, Homo sapien
tcctaggtcgttcaaccaggttttg

SEQ ID NO: 201402 - DNA, 25 bp, Homo sapien
aaccaggttttgtgaggaatgcatt

SEQ ID NO: 201403 - DNA, 25 bp, Homo sapien
aggaatgcattcaaagtggctttat

SEQ ID NO: 201404 - DNA, 25 bp, Homo sapien
ttgtttcgggtctttacctcatagt

SEQ ID NO: 201405 - DNA, 25 bp, Homo sapien
tgtttcgggtctttacctcatagta

SEQ ID NO: 201406 - DNA, 25 bp, Homo sapien
gtttcgggtctttacctcatagtat

SEQ ID NO: 201407 - DNA, 25 bp, Homo sapien
tttcgggtctttacctcatagtatg

SEQ ID NO: 201408 - DNA, 25 bp, Homo sapien
ttcgggtctttacctcatagtatga

SEQ ID NO: 201409 - DNA, 25 bp, Homo sapien
tcgggtctttacctcatagtatgaa

SEQ ID NO: 201410 - DNA, 25 bp, Homo sapien
cgggtctttacctcatagtatgaaa

SEQ ID NO: 201411 - DNA, 25 bp, Homo sapien
gggtctttacctcatagtatgaaat

SEQ ID NO: 201412 - DNA, 25 bp, Homo sapien
ccagcctgtggaggttggtcaggtg

SEQ ID NO: 201413 - DNA, 25 bp, Homo sapien
tcctcatctaggaagtgagtctcca

SEQ ID NO: 201414 - DNA, 25 bp, Homo sapien
cgggcagaacccagggcatgaagat

SEQ ID NO: 201415 - DNA, 25 bp, Homo sapien
cagaacccagggcatgaagatccaa

SEQ ID NO: 201416 - DNA, 25 bp, Homo sapien
agggcctggttcagctttttctcca

SEQ ID NO: 201417 - DNA, 25 bp, Homo sapien
tttctccagggccatggcagctttc

SEQ ID NO: 201418 - DNA, 25 bp, Homo sapien
ctccagggccatggcagctttcatg

SEQ ID NO: 201419 - DNA, 25 bp, Homo sapien
agggccatggcagctttcatggcgt

SEQ ID NO: 201420 - DNA, 25 bp, Homo sapien
ccatggcagctttcatggcgtctgg

SEQ ID NO: 201421 - DNA, 25 bp, Homo sapien
gctttcatggcgtctggggttttac

SEQ ID NO: 201422 - DNA, 25 bp, Homo sapien
gtctggggttttaccccactcatct

SEQ ID NO: 201423 - DNA, 25 bp, Homo sapien
tgaaatcagaaaacctaccaaacaa

SEQ ID NO: 201424 - DNA, 25 bp, Homo sapien
aaaaacatcagaagctgctgccata

SEQ ID NO: 201425 - DNA, 25 bp, Homo sapien
gaagctgctgccataatgactattt

SEQ ID NO: 201426 - DNA, 25 bp, Homo sapien
aatgactattttctactgtaggctg

SEQ ID NO: 201427 - DNA, 25 bp, Homo sapien
ttctactgtaggctgctttggaaat

SEQ ID NO: 201428 - DNA, 25 bp, Homo sapien
attcccatatccttgctttgtaagt

SEQ ID NO: 201429 - DNA, 25 bp, Homo sapien
atccttgctttgtaagttggtaata

SEQ ID NO: 201430 - DNA, 25 bp, Homo sapien
gttggtaatatcactatgcatttct

SEQ ID NO: 201431 - DNA, 25 bp, Homo sapien
atcactatgcatttctacacatttt

SEQ ID NO: 201432 - DNA, 25 bp, Homo sapien
tgatttatgcagattttgatacact

SEQ ID NO: 201433 - DNA, 25 bp, Homo sapien
gtatatcttaattctgggttgcttg

SEQ ID NO: 201434 - DNA, 25 bp, Homo sapien
acaggtgctcgagtttggcttttca

SEQ ID NO: 201435 - DNA, 25 bp, Homo sapien
gagtttggcttttcattggtttcat

SEQ ID NO: 201436 - DNA, 25 bp, Homo sapien
gggtcacttattgcttccatgtgga

SEQ ID NO: 201437 - DNA, 25 bp, Homo sapien
ggtgcatatgttacccaaaatactg

SEQ ID NO: 201438 - DNA, 25 bp, Homo sapien
aatactgatgtttatccgggactag

SEQ ID NO: 201439 - DNA, 25 bp, Homo sapien
atccgggactagctgtgttttttca

SEQ ID NO: 201440 - DNA, 25 bp, Homo sapien
gcacttatattttttagcactctga

SEQ ID NO: 201441 - DNA, 25 bp, Homo sapien
gaaccgaagagctatggacctgaga

SEQ ID NO: 201442 - DNA, 25 bp, Homo sapien
taagtcacattttccttttgttata

SEQ ID NO: 201443 - DNA, 25 bp, Homo sapien
ataggttttttatctctcagtacac

SEQ ID NO: 201444 - DNA, 25 bp, Homo sapien
atctctcagtacacattgccaaatg

SEQ ID NO: 201445 - DNA, 25 bp, Homo sapien
aaccgtctcaactctctatgcattc

SEQ ID NO: 201446 - DNA, 25 bp, Homo sapien
ctcaactctctatgcattccttatt

SEQ ID NO: 201447 - DNA, 25 bp, Homo sapien
tatgcattccttattgctgctccta

SEQ ID NO: 201448 - DNA, 25 bp, Homo sapien
attccttattgctgctcctagacca

SEQ ID NO: 201449 - DNA, 25 bp, Homo sapien
ccacagtgctttggagacttagtaa

SEQ ID NO: 201450 - DNA, 25 bp, Homo sapien
gaaaatgaatgcactctcttgaatc

SEQ ID NO: 201451 - DNA, 25 bp, Homo sapien
tctcttgaatcacaatatcacctgg

SEQ ID NO: 201452 - DNA, 25 bp, Homo sapien
gaatcacaatatcacctggaaatgt

SEQ ID NO: 201453 - DNA, 25 bp, Homo sapien
tttataaggttaccttatctctggg

SEQ ID NO: 201454 - DNA, 25 bp, Homo sapien
gagaaaattggcttcacgggacata

SEQ ID NO: 201455 - DNA, 25 bp, Homo sapien
tggcttcacgggacataagggctct

SEQ ID NO: 201456 - DNA, 25 bp, Homo sapien
tagtcaggttgtgtccaggcatgcg

SEQ ID NO: 201457 - DNA, 25 bp, Homo sapien
gacacccaggaggagtttttacatt

SEQ ID NO: 201458 - DNA, 25 bp, Homo sapien
aaagctcttggattcatctcatctc

SEQ ID NO: 201459 - DNA, 25 bp, Homo sapien
atctcatctcatggaatgatcctgt

SEQ ID NO: 201460 - DNA, 25 bp, Homo sapien
atgatcctgtcggatgacgctgacg

SEQ ID NO: 201461 - DNA, 25 bp, Homo sapien
gacgctgacgtgattgcttcagact

SEQ ID NO: 201462 - DNA, 25 bp, Homo sapien
ggtcacagtcacgaagctcatggta

SEQ ID NO: 201463 - DNA, 25 bp, Homo sapien
gtagactgaggccactaaacacccg

SEQ ID NO: 201464 - DNA, 25 bp, Homo sapien
taaacacccgtctcctgattttcag

SEQ ID NO: 201465 - DNA, 25 bp, Homo sapien
ctgattttcagtggcgtcctcattt

SEQ ID NO: 201466 - DNA, 25 bp, Homo sapien
atttgcatacacctgggccatcttg

SEQ ID NO: 201467 - DNA, 25 bp, Homo sapien
cagcaaaatcatacgccatctaccg

SEQ ID NO: 201468 - DNA, 25 bp, Homo sapien
atacgccatctaccgtgatgactgc

SEQ ID NO: 201469 - DNA, 25 bp, Homo sapien
tgatgactgccaactccatggcaga

SEQ ID NO: 201470 - DNA, 25 bp, Homo sapien
atggcagaccctttctgggattcaa

SEQ ID NO: 201471 - DNA, 25 bp, Homo sapien
ctgggattcaaaaaccaattcatca

SEQ ID NO: 201472 - DNA, 25 bp, Homo sapien
aattcatcagatcgctgcctctgag

SEQ ID NO: 201473 - DNA, 25 bp, Homo sapien
cctctgagggatgtacagattggct

SEQ ID NO: 201474 - DNA, 25 bp, Homo sapien
gagctgagtgctacaataaaggagg

SEQ ID NO: 201475 - DNA, 25 bp, Homo sapien
gcaggaaagagatctgagctgcctg

SEQ ID NO: 201476 - DNA, 25 bp, Homo sapien
tgcggagtacaaagctttgcaaggg

SEQ ID NO: 201477 - DNA, 25 bp, Homo sapien
caaagctttgcaagggtgtggtttt

SEQ ID NO: 201478 - DNA, 25 bp, Homo sapien
atatgcatgctttaattgcatttcc

SEQ ID NO: 201479 - DNA, 25 bp, Homo sapien
gcatttccaaagtagcatcttgcta

SEQ ID NO: 201480 - DNA, 25 bp, Homo sapien
agtagcatcttgctagacctagatg

SEQ ID NO: 201481 - DNA, 25 bp, Homo sapien
ttgctagacctagatgagtcaggat

SEQ ID NO: 201482 - DNA, 25 bp, Homo sapien
gatgagtcaggataacagagagata

SEQ ID NO: 201483 - DNA, 25 bp, Homo sapien
aagtgacaattgtagagtcctcaat

SEQ ID NO: 201484 - DNA, 25 bp, Homo sapien
tcctcaattgtgtttacattaatag

SEQ ID NO: 201485 - DNA, 25 bp, Homo sapien
tacattaatagtggtgtttttacct

SEQ ID NO: 201486 - DNA, 25 bp, Homo sapien
aaatttagttgttctccccaatgtg

SEQ ID NO: 201487 - DNA, 25 bp, Homo sapien
tgttctccccaatgtgtattttaat

SEQ ID NO: 201488 - DNA, 25 bp, Homo sapien
tattttaatttggatggcagtctca

SEQ ID NO: 201489 - DNA, 25 bp, Homo sapien
gaatcattttatctttcagccaatc

SEQ ID NO: 201490 - DNA, 25 bp, Homo sapien
cagccaatcaagtcgttgtaaacgt

SEQ ID NO: 201491 - DNA, 25 bp, Homo sapien
tcaagtcgttgtaaacgtggctttt

SEQ ID NO: 201492 - DNA, 25 bp, Homo sapien
atgttttatgatgatgctgggtaag

SEQ ID NO: 201493 - DNA, 25 bp, Homo sapien
aaattccatagttctcagttattaa

SEQ ID NO: 201494 - DNA, 25 bp, Homo sapien
tttcttgttcgccaattttgtatta

SEQ ID NO: 201495 - DNA, 25 bp, Homo sapien
tcgccaattttgtattaagaatgct

SEQ ID NO: 201496 - DNA, 25 bp, Homo sapien
atgctattaagcctaattgattaaa

SEQ ID NO: 201497 - DNA, 25 bp, Homo sapien
ttttttattatcttacatgcttgta

SEQ ID NO: 201498 - DNA, 25 bp, Homo sapien
acatgcttgtatcttcagttggagg

SEQ ID NO: 201499 - DNA, 25 bp, Homo sapien
tcttcagttggaggtgtagtattca

SEQ ID NO: 201500 - DNA, 25 bp, Homo sapien
tgcttcctgacccttgttggccaag

SEQ ID NO: 201501 - DNA, 25 bp, Homo sapien
cttgttggccaagggcatctttgat

SEQ ID NO: 201502 - DNA, 25 bp, Homo sapien
ttggccaagggcatctttgatggta

SEQ ID NO: 201503 - DNA, 25 bp, Homo sapien
gccaagggcatctttgatggtacaa

SEQ ID NO: 201504 - DNA, 25 bp, Homo sapien
ggcatctttgatggtacaagcagag

SEQ ID NO: 201505 - DNA, 25 bp, Homo sapien
ctttgatggtacaagcagaggctcg

SEQ ID NO: 201506 - DNA, 25 bp, Homo sapien
aggctcgggagaggctcccgtcaca

SEQ ID NO: 201507 - DNA, 25 bp, Homo sapien
gagaggctcccgtcacacactacag

SEQ ID NO: 201508 - DNA, 25 bp, Homo sapien
tccttgaggggctcttctggtcagc

SEQ ID NO: 201509 - DNA, 25 bp, Homo sapien
aagggctgtcagttacattaaggtg

SEQ ID NO: 201510 - DNA, 25 bp, Homo sapien
ctgtcagttacattaaggtggttgt

SEQ ID NO: 201511 - DNA, 25 bp, Homo sapien
ttttttatctctcttgatgtcagat

SEQ ID NO: 201512 - DNA, 25 bp, Homo sapien
ttatctctcttgatgtcagatttta

SEQ ID NO: 201513 - DNA, 25 bp, Homo sapien
tctctcttgatgtcagattttatag

SEQ ID NO: 201514 - DNA, 25 bp, Homo sapien
cttgatgtcagattttatagtcttt

SEQ ID NO: 201515 - DNA, 25 bp, Homo sapien
aaatagattgcttagaatggttctc

SEQ ID NO: 201516 - DNA, 25 bp, Homo sapien
gattgcttagaatggttctcaagaa

SEQ ID NO: 201517 - DNA, 25 bp, Homo sapien
gcttagaatggttctcaagaattat

SEQ ID NO: 201518 - DNA, 25 bp, Homo sapien
aagagaaatgaactcacagtacaaa

SEQ ID NO: 201519 - DNA, 25 bp, Homo sapien
gtatttttacattgtagccaatcat

SEQ ID NO: 201520 - DNA, 25 bp, Homo sapien
tacattgtagccaatcattttatat

SEQ ID NO: 201521 - DNA, 25 bp, Homo sapien
gtcaatttaaatcttatgggtcttt

SEQ ID NO: 201522 - DNA, 25 bp, Homo sapien
gcagaaggcttgcacttgggccaaa

SEQ ID NO: 201523 - DNA, 25 bp, Homo sapien
aaagggcctaaggtccactggacag

SEQ ID NO: 201524 - DNA, 25 bp, Homo sapien
tccactggacagttgggaaaacacc

SEQ ID NO: 201525 - DNA, 25 bp, Homo sapien
ggaaaacacctgaccaccatttaag

SEQ ID NO: 201526 - DNA, 25 bp, Homo sapien
caccatttaaggactctaagccaga

SEQ ID NO: 201527 - DNA, 25 bp, Homo sapien
ggaaaattcaccaggactccattct

SEQ ID NO: 201528 - DNA, 25 bp, Homo sapien
ggactccattcttaagcctatgcga

SEQ ID NO: 201529 - DNA, 25 bp, Homo sapien
taagcctatgcgagtcccctagaga

SEQ ID NO: 201530 - DNA, 25 bp, Homo sapien
gtcccctagagagaggcattgtact

SEQ ID NO: 201531 - DNA, 25 bp, Homo sapien
gagaggcattgtactgatatataaa

SEQ ID NO: 201532 - DNA, 25 bp, Homo sapien
tacatgagacatactgacagaatct

SEQ ID NO: 201533 - DNA, 25 bp, Homo sapien
tgagaagccctttcagaagtccaag

SEQ ID NO: 201534 - DNA, 25 bp, Homo sapien
tccagctccggaaaaggctctgtgg

SEQ ID NO: 201535 - DNA, 25 bp, Homo sapien
aaaaggctctgtgggagttctgtcc

SEQ ID NO: 201536 - DNA, 25 bp, Homo sapien
gagttctgtccttgagtggccaaca

SEQ ID NO: 201537 - DNA, 25 bp, Homo sapien
tgagtggccaacaaacccgcaagct

SEQ ID NO: 201538 - DNA, 25 bp, Homo sapien
acccatacttctggcagtgtctaaa

SEQ ID NO: 201539 - DNA, 25 bp, Homo sapien
agtgtctaaagaacgccctggccac

SEQ ID NO: 201540 - DNA, 25 bp, Homo sapien
catgtggcctatagtcaggtgttca

SEQ ID NO: 201541 - DNA, 25 bp, Homo sapien
tcaaggaaacggtctagcccttctt

SEQ ID NO: 201542 - DNA, 25 bp, Homo sapien
aacacaactgcctagtttaccaagg

SEQ ID NO: 201543 - DNA, 25 bp, Homo sapien
gaggcctggctgtttaaattgtttt

SEQ ID NO: 201544 - DNA, 25 bp, Homo sapien
gaaagggccattgacatctgaattt

SEQ ID NO: 201545 - DNA, 25 bp, Homo sapien
gcctcagttgattttgagtcacgtg

SEQ ID NO: 201546 - DNA, 25 bp, Homo sapien
gagtcacgtgatgtttacccatatt

SEQ ID NO: 201547 - DNA, 25 bp, Homo sapien
ccatattttgtgaaacttgagctga

SEQ ID NO: 201548 - DNA, 25 bp, Homo sapien
gttagtcccaatctacatatcagaa

SEQ ID NO: 201549 - DNA, 25 bp, Homo sapien
ggctcaagcaggtaacatgtcacag

SEQ ID NO: 201550 - DNA, 25 bp, Homo sapien
catgtcacagtatttggcagaggct

SEQ ID NO: 201551 - DNA, 25 bp, Homo sapien
gcagaggctggactataaaccaagt

SEQ ID NO: 201552 - DNA, 25 bp, Homo sapien
aactcatactcttttaattacgcta

SEQ ID NO: 201553 - DNA, 25 bp, Homo sapien
tactcttttaattacgctacagcgc

SEQ ID NO: 201554 - DNA, 25 bp, Homo sapien
acgctacagcgcttccaggaaaggg

SEQ ID NO: 201555 - DNA, 25 bp, Homo sapien
caaacacatcctttcatcagaagcc

SEQ ID NO: 201556 - DNA, 25 bp, Homo sapien
acatcctttcatcagaagcccattc

SEQ ID NO: 201557 - DNA, 25 bp, Homo sapien
aagcccattccctctataaggcgtt

SEQ ID NO: 201558 - DNA, 25 bp, Homo sapien
attccctctataaggcgttactaca

SEQ ID NO: 201559 - DNA, 25 bp, Homo sapien
taaggcgttactacatttatgagaa

SEQ ID NO: 201560 - DNA, 25 bp, Homo sapien
gagaatggagtcctcatgacctaat

SEQ ID NO: 201561 - DNA, 25 bp, Homo sapien
tgacctaatcgtgaccttaaaggcc

SEQ ID NO: 201562 - DNA, 25 bp, Homo sapien
tttcaacaaaggttccagaggtgac

SEQ ID NO: 201563 - DNA, 25 bp, Homo sapien
aggttccagaggtgacattcgaatc

SEQ ID NO: 201564 - DNA, 25 bp, Homo sapien
cagaggtgacattcgaatcagcaat

SEQ ID NO: 201565 - DNA, 25 bp, Homo sapien
catagttaaatttggtattcgtggg

SEQ ID NO: 201566 - DNA, 25 bp, Homo sapien
ttgatatggagaaacaaaatcctca

SEQ ID NO: 201567 - DNA, 25 bp, Homo sapien
tttaataaactgcagggttacacca

SEQ ID NO: 201568 - DNA, 25 bp, Homo sapien
taataaactgcagggttacaccaaa

SEQ ID NO: 201569 - DNA, 25 bp, Homo sapien
ataaactgcagggttacaccaaaat

SEQ ID NO: 201570 - DNA, 25 bp, Homo sapien
taaactgcagggttacaccaaaatc

SEQ ID NO: 201571 - DNA, 25 bp, Homo sapien
aaactgcagggttacaccaaaatct

SEQ ID NO: 201572 - DNA, 25 bp, Homo sapien
aactgcagggttacaccaaaatcta

SEQ ID NO: 201573 - DNA, 25 bp, Homo sapien
actgcagggttacaccaaaatctag

SEQ ID NO: 201574 - DNA, 25 bp, Homo sapien
ctgcagggttacaccaaaatctagc

SEQ ID NO: 201575 - DNA, 25 bp, Homo sapien
caccaaaatctagctgatttaactt

SEQ ID NO: 201576 - DNA, 25 bp, Homo sapien
aaatctagctgatttaacttgtatt

SEQ ID NO: 201577 - DNA, 25 bp, Homo sapien
tgtagcgtggtcaggtctgctgtaa

SEQ ID NO: 201578 - DNA, 25 bp, Homo sapien
cgtggtcaggtctgctgtaacattt

SEQ ID NO: 201579 - DNA, 25 bp, Homo sapien
ttcatatggatctctaccatcccca

SEQ ID NO: 201580 - DNA, 25 bp, Homo sapien
gttccatttctctcattcacaagat

SEQ ID NO: 201581 - DNA, 25 bp, Homo sapien
tttctctcattcacaagatgctttg

SEQ ID NO: 201582 - DNA, 25 bp, Homo sapien
cacaagatgctttgaaggttctgat

SEQ ID NO: 201583 - DNA, 25 bp, Homo sapien
gaaggttctgattttcaactgatca

SEQ ID NO: 201584 - DNA, 25 bp, Homo sapien
aaagtatgtattcttcactactgag

SEQ ID NO: 201585 - DNA, 25 bp, Homo sapien
tgtattcttcactactgagtttctt

SEQ ID NO: 201586 - DNA, 25 bp, Homo sapien
ttcttctttggaaaccatcactatt

SEQ ID NO: 201587 - DNA, 25 bp, Homo sapien
ttggaaaccatcactattgagagat

SEQ ID NO: 201588 - DNA, 25 bp, Homo sapien
gcagtgtatttcatcatatgctgta

SEQ ID NO: 201589 - DNA, 25 bp, Homo sapien
gcagacttctgtggagggcccgata

SEQ ID NO: 201590 - DNA, 25 bp, Homo sapien
gagggcccgatagtaaccatttgaa

SEQ ID NO: 201591 - DNA, 25 bp, Homo sapien
tttgaagctttctggacctgtggtc

SEQ ID NO: 201592 - DNA, 25 bp, Homo sapien
gacctgtggtcttagtcccagcgat

SEQ ID NO: 201593 - DNA, 25 bp, Homo sapien
tagtcccagcgattctgcagagcgg

SEQ ID NO: 201594 - DNA, 25 bp, Homo sapien
ccatcggcagcatgtcaaccatttg

SEQ ID NO: 201595 - DNA, 25 bp, Homo sapien
caaccatttgcatggctgggctcca

SEQ ID NO: 201596 - DNA, 25 bp, Homo sapien
ggctgggctccagggaaactactga

SEQ ID NO: 201597 - DNA, 25 bp, Homo sapien
cctgtgctatgccagaatttctttt

SEQ ID NO: 201598 - DNA, 25 bp, Homo sapien
ctcctccctatgagtggacctaaat

SEQ ID NO: 201599 - DNA, 25 bp, Homo sapien
gatggtgaggagtctagccccacag

SEQ ID NO: 201600 - DNA, 25 bp, Homo sapien
agccagtatgctatctctattcaga

SEQ ID NO: 201601 - DNA, 25 bp, Homo sapien
tctattcagataactcccagctcac

SEQ ID NO: 201602 - DNA, 25 bp, Homo sapien
aggctctcacccactctgatgtttt

SEQ ID NO: 201603 - DNA, 25 bp, Homo sapien
cactctgatgttttcactcctgact

SEQ ID NO: 201604 - DNA, 25 bp, Homo sapien
ttcactcctgactcctaagaagcag

SEQ ID NO: 201605 - DNA, 25 bp, Homo sapien
gcaatttagtgtgagtctgtcagac

SEQ ID NO: 201606 - DNA, 25 bp, Homo sapien
gtctgtcagacagcctagagagtaa

SEQ ID NO: 201607 - DNA, 25 bp, Homo sapien
atttcctgtttattcaaaatcctga

SEQ ID NO: 201608 - DNA, 25 bp, Homo sapien
agcactatttgggaagggatgactg

SEQ ID NO: 201609 - DNA, 25 bp, Homo sapien
ggatgactgggaaccttgcaagaac

SEQ ID NO: 201610 - DNA, 25 bp, Homo sapien
gagagcagtaatccaaatctacagt

SEQ ID NO: 201611 - DNA, 25 bp, Homo sapien
ccaaatctacagtcacttctttcaa

SEQ ID NO: 201612 - DNA, 25 bp, Homo sapien
atgcattaccttcagcatcaaaggg

SEQ ID NO: 201613 - DNA, 25 bp, Homo sapien
gcatcaaagggatggtccacatcag

SEQ ID NO: 201614 - DNA, 25 bp, Homo sapien
agggatggtccacatcagaaaactc

SEQ ID NO: 201615 - DNA, 25 bp, Homo sapien
atcagaaaactcactaaatgtcatg

SEQ ID NO: 201616 - DNA, 25 bp, Homo sapien
taaatgtcatgttagaatcccacat

SEQ ID NO: 201617 - DNA, 25 bp, Homo sapien
gttagaatcccacatggactgcatg

SEQ ID NO: 201618 - DNA, 25 bp, Homo sapien
atggactgcatgtgaccacctacca

SEQ ID NO: 201619 - DNA, 25 bp, Homo sapien
cacctaccatccctttagtacaaat

SEQ ID NO: 201620 - DNA, 25 bp, Homo sapien
ttccgtaagtacatagtcaaaacac

SEQ ID NO: 201621 - DNA, 25 bp, Homo sapien
gtttttctgtgtcaatgtgatttat

SEQ ID NO: 201622 - DNA, 25 bp, Homo sapien
tatggtagtaccatcctttctcctt

SEQ ID NO: 201623 - DNA, 25 bp, Homo sapien
aagttgcagaacagacactttaaaa

SEQ ID NO: 201624 - DNA, 25 bp, Homo sapien
ttaaaagcttctgcaatattatttc

SEQ ID NO: 201625 - DNA, 25 bp, Homo sapien
atattatttctgtgcctagagtctt

SEQ ID NO: 201626 - DNA, 25 bp, Homo sapien
gcctagagtctttctccattataaa

SEQ ID NO: 201627 - DNA, 25 bp, Homo sapien
ggattttgaatatgccaaacacatt

SEQ ID NO: 201628 - DNA, 25 bp, Homo sapien
agcagagatgttcaccttttccttg

SEQ ID NO: 201629 - DNA, 25 bp, Homo sapien
ttttccttgctgattgctaatgctt

SEQ ID NO: 201630 - DNA, 25 bp, Homo sapien
gattgctaatgcttattatttctaa

SEQ ID NO: 201631 - DNA, 25 bp, Homo sapien
ataatcaatacaaaccagcaactaa

SEQ ID NO: 201632 - DNA, 25 bp, Homo sapien
cccactccataaagccattgtgcat

SEQ ID NO: 201633 - DNA, 25 bp, Homo sapien
aagccattgtgcataggtctcagac

SEQ ID NO: 201634 - DNA, 25 bp, Homo sapien
gtctcagacaccactggatagggct

SEQ ID NO: 201635 - DNA, 25 bp, Homo sapien
atagggctccaaagcaggactgcat

SEQ ID NO: 201636 - DNA, 25 bp, Homo sapien
aggactgcattacttctgaaacttc

SEQ ID NO: 201637 - DNA, 25 bp, Homo sapien
gtcaatgattcaccaacccttttaa

SEQ ID NO: 201638 - DNA, 25 bp, Homo sapien
taatctataatcacgcagtcttgca

SEQ ID NO: 201639 - DNA, 25 bp, Homo sapien
acgcagtcttgcattttgacagaaa

SEQ ID NO: 201640 - DNA, 25 bp, Homo sapien
ttttgacagaaatttgacccttatt

SEQ ID NO: 201641 - DNA, 25 bp, Homo sapien
ggaccattcatttttattggccttt

SEQ ID NO: 201642 - DNA, 25 bp, Homo sapien
tttattggcctttctctgcaaaata

SEQ ID NO: 201643 - DNA, 25 bp, Homo sapien
atggtatcaactggagtgcggcgaa

SEQ ID NO: 201644 - DNA, 25 bp, Homo sapien
agatgaaggtgcggcccgcctagac

SEQ ID NO: 201645 - DNA, 25 bp, Homo sapien
atgcacctgctagtggggaggccac

SEQ ID NO: 201646 - DNA, 25 bp, Homo sapien
acaagcgctgcgtcgtggaagtcac

SEQ ID NO: 201647 - DNA, 25 bp, Homo sapien
aagcgctgcgtcgtggaagtcaccc

SEQ ID NO: 201648 - DNA, 25 bp, Homo sapien
tgcgtcgtggaagtcaccccatttc

SEQ ID NO: 201649 - DNA, 25 bp, Homo sapien
ctcaccagagggagaattatgtttc

SEQ ID NO: 201650 - DNA, 25 bp, Homo sapien
atgggaccccatgagagctatgcca

SEQ ID NO: 201651 - DNA, 25 bp, Homo sapien
ggaccccatgagagctatgccaatg

SEQ ID NO: 201652 - DNA, 25 bp, Homo sapien
catgagagctatgccaatggtatca

SEQ ID NO: 201653 - DNA, 25 bp, Homo sapien
gagctatgccaatggtatcaactgg

SEQ ID NO: 201654 - DNA, 25 bp, Homo sapien
acaggaacttgaatactgggagaga

SEQ ID NO: 201655 - DNA, 25 bp, Homo sapien
tgattaagtggttactttgtgtttt

SEQ ID NO: 201656 - DNA, 25 bp, Homo sapien
actttttgtagagagagctgtatta

SEQ ID NO: 201657 - DNA, 25 bp, Homo sapien
ctgtattaagtgactgaccatgcac

SEQ ID NO: 201658 - DNA, 25 bp, Homo sapien
taagtgactgaccatgcactatatt

SEQ ID NO: 201659 - DNA, 25 bp, Homo sapien
tatatgttcatattggattgcgcct

SEQ ID NO: 201660 - DNA, 25 bp, Homo sapien
tcatattggattgcgcctttgtatt

SEQ ID NO: 201661 - DNA, 25 bp, Homo sapien
tggattgcgcctttgtattataaaa

SEQ ID NO: 201662 - DNA, 25 bp, Homo sapien
taaaagctcagatgacatttcgttt

SEQ ID NO: 201663 - DNA, 25 bp, Homo sapien
gatgacatttcgttttttacacgag

SEQ ID NO: 201664 - DNA, 25 bp, Homo sapien
tttttatgtgatgccaaagatgttt

SEQ ID NO: 201665 - DNA, 25 bp, Homo sapien
gaggctgaggcctggctgaattacc

SEQ ID NO: 201666 - DNA, 25 bp, Homo sapien
gaattacccatgctttaagaattgg

SEQ ID NO: 201667 - DNA, 25 bp, Homo sapien
atgggtccccagtgagctcctggat

SEQ ID NO: 201668 - DNA, 25 bp, Homo sapien
tggattctgctggtgagacctcctg

SEQ ID NO: 201669 - DNA, 25 bp, Homo sapien
gacatatagctggagaccattcttt

SEQ ID NO: 201670 - DNA, 25 bp, Homo sapien
gctggagaccattctttccaaagaa

SEQ ID NO: 201671 - DNA, 25 bp, Homo sapien
cttacctcttgccaaaggccattta

SEQ ID NO: 201672 - DNA, 25 bp, Homo sapien
cttgccaaaggccatttatattcat

SEQ ID NO: 201673 - DNA, 25 bp, Homo sapien
attcatatagtgacaggctgtgctc

SEQ ID NO: 201674 - DNA, 25 bp, Homo sapien
atagtgacaggctgtgctccatatt

SEQ ID NO: 201675 - DNA, 25 bp, Homo sapien
attttacagtcattttggtcacaat

SEQ ID NO: 201676 - DNA, 25 bp, Homo sapien
ccatgaacatgggctttcttcccct

SEQ ID NO: 201677 - DNA, 25 bp, Homo sapien
attaatcttatgtagttctcagtgt

SEQ ID NO: 201678 - DNA, 25 bp, Homo sapien
taatcttatgtagttctcagtgtag

SEQ ID NO: 201679 - DNA, 25 bp, Homo sapien
tcttatgtagttctcagtgtagaaa

SEQ ID NO: 201680 - DNA, 25 bp, Homo sapien
tttgatgctattgcacatgggaccc

SEQ ID NO: 201681 - DNA, 25 bp, Homo sapien
cagcaatctcacttccgagtatata

SEQ ID NO: 201682 - DNA, 25 bp, Homo sapien
atctcacttccgagtatatatccaa

SEQ ID NO: 201683 - DNA, 25 bp, Homo sapien
tcacttccgagtatatatccaaaca

SEQ ID NO: 201684 - DNA, 25 bp, Homo sapien
ttccgagtatatatccaaacacatg

SEQ ID NO: 201685 - DNA, 25 bp, Homo sapien
gtatatatccaaacacatgcacacg

SEQ ID NO: 201686 - DNA, 25 bp, Homo sapien
atatatccaaacacatgcacacgta

SEQ ID NO: 201687 - DNA, 25 bp, Homo sapien
gcaggtgccagagctaaaaggtacc

SEQ ID NO: 201688 - DNA, 25 bp, Homo sapien
gtgccagagctaaaaggtacctttg

SEQ ID NO: 201689 - DNA, 25 bp, Homo sapien
tgccagagctaaaaggtacctttgt

SEQ ID NO: 201690 - DNA, 25 bp, Homo sapien
gcagtgcaggacaacatcagctcac

SEQ ID NO: 201691 - DNA, 25 bp, Homo sapien
cagtgcaggacaacatcagctcact

SEQ ID NO: 201692 - DNA, 25 bp, Homo sapien
gggaagcaaggaaataagtcatctg

SEQ ID NO: 201693 - DNA, 25 bp, Homo sapien
ataagtcatctgtatgctgactggg

SEQ ID NO: 201694 - DNA, 25 bp, Homo sapien
gctgactggggataatggcatcaaa

SEQ ID NO: 201695 - DNA, 25 bp, Homo sapien
gggaacagcaggtgccagagctaaa

SEQ ID NO: 201696 - DNA, 25 bp, Homo sapien
ggaacagcaggtgccagagctaaaa

SEQ ID NO: 201697 - DNA, 25 bp, Homo sapien
acagcaggtgccagagctaaaaggt

SEQ ID NO: 201698 - DNA, 25 bp, Homo sapien
ttcagcatctgcacctgtagcagca

SEQ ID NO: 201699 - DNA, 25 bp, Homo sapien
tcagcatctgcacctgtagcagcag

SEQ ID NO: 201700 - DNA, 25 bp, Homo sapien
agcatctgcacctgtagcagcagca

SEQ ID NO: 201701 - DNA, 25 bp, Homo sapien
catctgcacctgtagcagcagcagt

SEQ ID NO: 201702 - DNA, 25 bp, Homo sapien
agcagtgcccaccagggagtccata

SEQ ID NO: 201703 - DNA, 25 bp, Homo sapien
ggagtccataaaagggtccctctct

SEQ ID NO: 201704 - DNA, 25 bp, Homo sapien
acaaccttgacagatgctccagctg

SEQ ID NO: 201705 - DNA, 25 bp, Homo sapien
aaccttgacagatgctccagctgca

SEQ ID NO: 201706 - DNA, 25 bp, Homo sapien
accttgacagatgctccagctgcaa

SEQ ID NO: 201707 - DNA, 25 bp, Homo sapien
tccagctgcaatccccagatgagca

SEQ ID NO: 201708 - DNA, 25 bp, Homo sapien
gctgcaatccccagatgagcagcta

SEQ ID NO: 201709 - DNA, 25 bp, Homo sapien
gctttgtatggctgtcatgcttaga

SEQ ID NO: 201710 - DNA, 25 bp, Homo sapien
gacagtgattcctgcaacttgacct

SEQ ID NO: 201711 - DNA, 25 bp, Homo sapien
gcaacttgaccttcaggctgggaga

SEQ ID NO: 201712 - DNA, 25 bp, Homo sapien
aggtggagagccatgcctgttctcc

SEQ ID NO: 201713 - DNA, 25 bp, Homo sapien
tgttctccttccttgctatggaatt

SEQ ID NO: 201714 - DNA, 25 bp, Homo sapien
atttgctgacacaatatcttccgcc

SEQ ID NO: 201715 - DNA, 25 bp, Homo sapien
ggtgctgggcatatcctaagaactt

SEQ ID NO: 201716 - DNA, 25 bp, Homo sapien
gtattatcctgtgtgagcagctgtc

SEQ ID NO: 201717 - DNA, 25 bp, Homo sapien
tgtgagcagctgtcaccttattggg

SEQ ID NO: 201718 - DNA, 25 bp, Homo sapien
gggcacttcaagtagatagcttcta

SEQ ID NO: 201719 - DNA, 25 bp, Homo sapien
gcttctatttcctatatttgtctta

SEQ ID NO: 201720 - DNA, 25 bp, Homo sapien
ctgaattacccatgctttaagaatt

SEQ ID NO: 201721 - DNA, 25 bp, Homo sapien
gaattacccatgctttaagaattgg

SEQ ID NO: 201722 - DNA, 25 bp, Homo sapien
atgctttaagaattgggatgggtcc

SEQ ID NO: 201723 - DNA, 25 bp, Homo sapien
tgctttaagaattgggatgggtccc

SEQ ID NO: 201724 - DNA, 25 bp, Homo sapien
tttaagaattgggatgggtccccag

SEQ ID NO: 201725 - DNA, 25 bp, Homo sapien
atgggtccccagtgagctcctggat

SEQ ID NO: 201726 - DNA, 25 bp, Homo sapien
tgggtccccagtgagctcctggatt

SEQ ID NO: 201727 - DNA, 25 bp, Homo sapien
gggtccccagtgagctcctggattc

SEQ ID NO: 201728 - DNA, 25 bp, Homo sapien
ggtccccagtgagctcctggattct

SEQ ID NO: 201729 - DNA, 25 bp, Homo sapien
gtccccagtgagctcctggattctg

SEQ ID NO: 201730 - DNA, 25 bp, Homo sapien
ccccagtgagctcctggattctgct

SEQ ID NO: 201731 - DNA, 25 bp, Homo sapien
gcacgatccggacaaaggacagagt

SEQ ID NO: 201732 - DNA, 25 bp, Homo sapien
aggacagagtctttgacagtatcag

SEQ ID NO: 201733 - DNA, 25 bp, Homo sapien
tcatcaaccaccacctagaaagcag

SEQ ID NO: 201734 - DNA, 25 bp, Homo sapien
tagaaagcagcctgcccattgtctc

SEQ ID NO: 201735 - DNA, 25 bp, Homo sapien
tgcccattgtctctgcagggagtga

SEQ ID NO: 201736 - DNA, 25 bp, Homo sapien
cagggagtgagctgtgtctccagca

SEQ ID NO: 201737 - DNA, 25 bp, Homo sapien
agctgtgtctccagcagccagtgga

SEQ ID NO: 201738 - DNA, 25 bp, Homo sapien
tccagcagccagtggagaggaagca

SEQ ID NO: 201739 - DNA, 25 bp, Homo sapien
gcactgcgcaccaggtcaggaggac

SEQ ID NO: 201740 - DNA, 25 bp, Homo sapien
gtggctcagagccttcttcaaaagc

SEQ ID NO: 201741 - DNA, 25 bp, Homo sapien
gcttcctttaaggtcaagtttcata

SEQ ID NO: 201742 - DNA, 25 bp, Homo sapien
attgctgacaacttaggctgacctt

SEQ ID NO: 201743 - DNA, 25 bp, Homo sapien
taggctgacctttatatacctattt

SEQ ID NO: 201744 - DNA, 25 bp, Homo sapien
ttccttcctaattcctcttaaaatg

SEQ ID NO: 201745 - DNA, 25 bp, Homo sapien
ggaagagcatgacccctggattcag

SEQ ID NO: 201746 - DNA, 25 bp, Homo sapien
gattcagatatccaatagttacaaa

SEQ ID NO: 201747 - DNA, 25 bp, Homo sapien
agttacaaatctcagcttcagcacc

SEQ ID NO: 201748 - DNA, 25 bp, Homo sapien
tcagcttcagcacctagcagttatg

SEQ ID NO: 201749 - DNA, 25 bp, Homo sapien
ttcagcacctagcagttatgtgaac

SEQ ID NO: 201750 - DNA, 25 bp, Homo sapien
ttatgtgaactttcttctctgcacc

SEQ ID NO: 201751 - DNA, 25 bp, Homo sapien
tgcacctcagtctcttcataataac

SEQ ID NO: 201752 - DNA, 25 bp, Homo sapien
aactactttgcagagttgctgtgaa

SEQ ID NO: 201753 - DNA, 25 bp, Homo sapien
atatgcatgctttaattgcatttcc

SEQ ID NO: 201754 - DNA, 25 bp, Homo sapien
gcatttccaaagtagcatcttgcta

SEQ ID NO: 201755 - DNA, 25 bp, Homo sapien
aaagtagcatcttgctagacctaga

SEQ ID NO: 201756 - DNA, 25 bp, Homo sapien
gtagcatcttgctagacctagatga

SEQ ID NO: 201757 - DNA, 25 bp, Homo sapien
ttgctagacctagatgagtcaggat

SEQ ID NO: 201758 - DNA, 25 bp, Homo sapien
gatgagtcaggataacagagagata

SEQ ID NO: 201759 - DNA, 25 bp, Homo sapien
aagtgacaattgtagagtcctcaat

SEQ ID NO: 201760 - DNA, 25 bp, Homo sapien
tcctcaattgtgtttacattaatag

SEQ ID NO: 201761 - DNA, 25 bp, Homo sapien
tacattaatagtggtgtttttacct

SEQ ID NO: 201762 - DNA, 25 bp, Homo sapien
tacaaaatggcaagtatggaaaacc

SEQ ID NO: 201763 - DNA, 25 bp, Homo sapien
tattttaatttggatggcagtctca

SEQ ID NO: 201764 - DNA, 25 bp, Homo sapien
ctcccaaccatgagatcccaaggat

SEQ ID NO: 201765 - DNA, 25 bp, Homo sapien
gccaacgccttgtgtgctggaatga

SEQ ID NO: 201766 - DNA, 25 bp, Homo sapien
gagggtcaccggatgtaacactgag

SEQ ID NO: 201767 - DNA, 25 bp, Homo sapien
gaggaggatactttccagaggccag

SEQ ID NO: 201768 - DNA, 25 bp, Homo sapien
ccagaggccagtccccagcagtgtg

SEQ ID NO: 201769 - DNA, 25 bp, Homo sapien
cagcagtgtggagatttttctggtt

SEQ ID NO: 201770 - DNA, 25 bp, Homo sapien
ggatatggaactcatgttggttaca

SEQ ID NO: 201771 - DNA, 25 bp, Homo sapien
atgttggttacagcagcagccgtga

SEQ ID NO: 201772 - DNA, 25 bp, Homo sapien
gataactgaggcagctgtgcttcta

SEQ ID NO: 201773 - DNA, 25 bp, Homo sapien
gctgtgcttctattctatcgttgag

SEQ ID NO: 201774 - DNA, 25 bp, Homo sapien
tgggagggaacccagacctctcctc

SEQ ID NO: 201775 - DNA, 25 bp, Homo sapien
tccacctggcattcctttagacagc

SEQ ID NO: 201776 - DNA, 25 bp, Homo sapien
tttagacagcccgacagaggtcctt

SEQ ID NO: 201777 - DNA, 25 bp, Homo sapien
gcagccccgggaaacctgaggacat

SEQ ID NO: 201778 - DNA, 25 bp, Homo sapien
tgaggacatgcaaacaaccagtcat

SEQ ID NO: 201779 - DNA, 25 bp, Homo sapien
caaccagtcatgttccaacttcaag

SEQ ID NO: 201780 - DNA, 25 bp, Homo sapien
tgttccaacttcaagccggtaactg

SEQ ID NO: 201781 - DNA, 25 bp, Homo sapien
ttcaagccggtaactgcacacaaca

SEQ ID NO: 201782 - DNA, 25 bp, Homo sapien
aactgcacacaacaggcctgggagc

SEQ ID NO: 201783 - DNA, 25 bp, Homo sapien
gaaggaccttaattcaaatcagaga

SEQ ID NO: 201784 - DNA, 25 bp, Homo sapien
atgtatcttaaaacgtgtgcccttt

SEQ ID NO: 201785 - DNA, 25 bp, Homo sapien
tatgccttaaatgttttcttcccca

SEQ ID NO: 201786 - DNA, 25 bp, Homo sapien
tctctacccttaacagctgcatcga

SEQ ID NO: 201787 - DNA, 25 bp, Homo sapien
ttaacagctgcatcgacccctttgt

SEQ ID NO: 201788 - DNA, 25 bp, Homo sapien
actttgtttcacatgatttcaggga

SEQ ID NO: 201789 - DNA, 25 bp, Homo sapien
gatcatgcaaagaacgctctccttt

SEQ ID NO: 201790 - DNA, 25 bp, Homo sapien
aagaacgctctcctttgccgaagtg

SEQ ID NO: 201791 - DNA, 25 bp, Homo sapien
tttgccgaagtgtccgcactgtaaa

SEQ ID NO: 201792 - DNA, 25 bp, Homo sapien
aaagcagatgcaagtatccctcacc

SEQ ID NO: 201793 - DNA, 25 bp, Homo sapien
gaaacactccaggaaatccagctct

SEQ ID NO: 201794 - DNA, 25 bp, Homo sapien
gaaatccagctcttactcttcaagt

SEQ ID NO: 201795 - DNA, 25 bp, Homo sapien
agctcttactcttcaagttcaacca

SEQ ID NO: 201796 - DNA, 25 bp, Homo sapien
caagttcaaccactgttaagacctc

SEQ ID NO: 201797 - DNA, 25 bp, Homo sapien
ggcgtggctggacccagtggatcga

SEQ ID NO: 201798 - DNA, 25 bp, Homo sapien
ctggacccagtggatcgagggtgat

SEQ ID NO: 201799 - DNA, 25 bp, Homo sapien
gaaggtgtggtctgcaagcaagtat

SEQ ID NO: 201800 - DNA, 25 bp, Homo sapien
ggtgtggtctgcaagcaagtattca

SEQ ID NO: 201801 - DNA, 25 bp, Homo sapien
ggtctgcaagcaagtattcaagaag

SEQ ID NO: 201802 - DNA, 25 bp, Homo sapien
tattcaagaaggtgcagtgaggccc

SEQ ID NO: 201803 - DNA, 25 bp, Homo sapien
atgaggcaaaaatgtccagccaccc

SEQ ID NO: 201804 - DNA, 25 bp, Homo sapien
aggcatctgttagcagagtctgtct

SEQ ID NO: 201805 - DNA, 25 bp, Homo sapien
atctgttagcagagtctgtctcttg

SEQ ID NO: 201806 - DNA, 25 bp, Homo sapien
gttagcagagtctgtctcttggctt

SEQ ID NO: 201807 - DNA, 25 bp, Homo sapien
agagtctgtctcttggctttgtcac

SEQ ID NO: 201808 - DNA, 25 bp, Homo sapien
tatacctttttagtacttgctgaag

SEQ ID NO: 201809 - DNA, 25 bp, Homo sapien
tcagggtaaatcacatactttgttt

SEQ ID NO: 201810 - DNA, 25 bp, Homo sapien
agtcacccagctggtctcatacata

SEQ ID NO: 201811 - DNA, 25 bp, Homo sapien
ggtctcatacatagacagcacttgt

SEQ ID NO: 201812 - DNA, 25 bp, Homo sapien
acagcacttgtgaaggattgaatgc

SEQ ID NO: 201813 - DNA, 25 bp, Homo sapien
gagggaagacgtggacaccatctcc

SEQ ID NO: 201814 - DNA, 25 bp, Homo sapien
agacgtggacaccatctccactgag

SEQ ID NO: 201815 - DNA, 25 bp, Homo sapien
tccactgagccatgcagacattttt

SEQ ID NO: 201816 - DNA, 25 bp, Homo sapien
caaaattgtgagaagacattggcca

SEQ ID NO: 201817 - DNA, 25 bp, Homo sapien
agtctttctttttccacgtgcttct

SEQ ID NO: 201818 - DNA, 25 bp, Homo sapien
ccacgtgcttcttattttaagcgaa

SEQ ID NO: 201819 - DNA, 25 bp, Homo sapien
ggcagggttcctctcaatcctgcaa

SEQ ID NO: 201820 - DNA, 25 bp, Homo sapien
ccagctgtcccaccggtggatgcag

SEQ ID NO: 201821 - DNA, 25 bp, Homo sapien
ggaatccgaggccatcaaccttggt

SEQ ID NO: 201822 - DNA, 25 bp, Homo sapien
caaccttggtgacagcagcgcagtg

SEQ ID NO: 201823 - DNA, 25 bp, Homo sapien
gtgacagcagcgcagtgccaatgct

SEQ ID NO: 201824 - DNA, 25 bp, Homo sapien
agcgcagtgccaatgctgatcacac

SEQ ID NO: 201825 - DNA, 25 bp, Homo sapien
gctgatcacactgcatgggagattt

SEQ ID NO: 201826 - DNA, 25 bp, Homo sapien
gagattttgttaacgtctgccaccc

SEQ ID NO: 201827 - DNA, 25 bp, Homo sapien
gggaggcctggactgtcttcctcat

SEQ ID NO: 201828 - DNA, 25 bp, Homo sapien
atctctgtagcaccaagcctgatag

SEQ ID NO: 201829 - DNA, 25 bp, Homo sapien
gtagcaccaagcctgatagatctgt

SEQ ID NO: 201830 - DNA, 25 bp, Homo sapien
agaagcatttccttcctgcgaccat

SEQ ID NO: 201831 - DNA, 25 bp, Homo sapien
aggacagcagcttccgctgtctcca

SEQ ID NO: 201832 - DNA, 25 bp, Homo sapien
tctccacagcagacacgggacggat

SEQ ID NO: 201833 - DNA, 25 bp, Homo sapien
gcagacacgggacggattccacaga

SEQ ID NO: 201834 - DNA, 25 bp, Homo sapien
cggattccacagacgggagcctcat

SEQ ID NO: 201835 - DNA, 25 bp, Homo sapien
ggagcctcattcgtaccatgccaaa

SEQ ID NO: 201836 - DNA, 25 bp, Homo sapien
taccatgccaaacgcattcactcgg

SEQ ID NO: 201837 - DNA, 25 bp, Homo sapien
gggcagtattaaccgttctagaaag

SEQ ID NO: 201838 - DNA, 25 bp, Homo sapien
taaccgttctagaaagccactgttt

SEQ ID NO: 201839 - DNA, 25 bp, Homo sapien
agaaagccactgttttatagcaaaa

SEQ ID NO: 201840 - DNA, 25 bp, Homo sapien
gaaaagctaccagttttttattcag

SEQ ID NO: 201841 - DNA, 25 bp, Homo sapien
atgactttaccattagctcttccac

SEQ ID NO: 201842 - DNA, 25 bp, Homo sapien
ccattagctcttccacttgggactg

SEQ ID NO: 201843 - DNA, 25 bp, Homo sapien
tgggactgaggaccatcacatgctt

SEQ ID NO: 201844 - DNA, 25 bp, Homo sapien
acatgcttctgcctgtcacggatac

SEQ ID NO: 201845 - DNA, 25 bp, Homo sapien
tgtcacggatactcagtctcctaca

SEQ ID NO: 201846 - DNA, 25 bp, Homo sapien
gtctcctacatcagatacattgttg

SEQ ID NO: 201847 - DNA, 25 bp, Homo sapien
tgaggtcaactgtgaatgggtattc

SEQ ID NO: 201848 - DNA, 25 bp, Homo sapien
gggtattcagaaccacagttgattt

SEQ ID NO: 201849 - DNA, 25 bp, Homo sapien
cattggtagcaaacatctctggtaa

SEQ ID NO: 201850 - DNA, 25 bp, Homo sapien
atctctggtaaggtgcatatattca

SEQ ID NO: 201851 - DNA, 25 bp, Homo sapien
attcccattcatttgagttgtgacc

SEQ ID NO: 201852 - DNA, 25 bp, Homo sapien
tagacttcacaaacactcggcatgc

SEQ ID NO: 201853 - DNA, 25 bp, Homo sapien
gttcctctgcccaaggccgatattg

SEQ ID NO: 201854 - DNA, 25 bp, Homo sapien
ggccgatattgctaactgatcacag

SEQ ID NO: 201855 - DNA, 25 bp, Homo sapien
aatcctccgaatgtgctccaggcga

SEQ ID NO: 201856 - DNA, 25 bp, Homo sapien
gaatgtgctccaggcgacaccattt

SEQ ID NO: 201857 - DNA, 25 bp, Homo sapien
aggcgacaccatttgccatcctgct

SEQ ID NO: 201858 - DNA, 25 bp, Homo sapien
gcaaacccctgacttcatggatgag

SEQ ID NO: 201859 - DNA, 25 bp, Homo sapien
ggaacctggagaccaaagagacaaa

SEQ ID NO: 201860 - DNA, 25 bp, Homo sapien
gggccagagatatgactaaaacctt

SEQ ID NO: 201861 - DNA, 25 bp, Homo sapien
taaaaccttatctccttgtgctcag

SEQ ID NO: 201862 - DNA, 25 bp, Homo sapien
ttgtgctcaggccagtgtcttccca

SEQ ID NO: 201863 - DNA, 25 bp, Homo sapien
atggccagccaacttttgcatgttt

SEQ ID NO: 201864 - DNA, 25 bp, Homo sapien
gccagccaacttttgcatgttttgt

SEQ ID NO: 201865 - DNA, 25 bp, Homo sapien
acgtggagctggaagggtcaacatc

SEQ ID NO: 201866 - DNA, 25 bp, Homo sapien
gagctggaagggtcaacatctttta

SEQ ID NO: 201867 - DNA, 25 bp, Homo sapien
ggaagggtcaacatcttttacattc

SEQ ID NO: 201868 - DNA, 25 bp, Homo sapien
ggtcaacatcttttacattctgcaa

SEQ ID NO: 201869 - DNA, 25 bp, Homo sapien
acatcttttacattctgcaagcaca

SEQ ID NO: 201870 - DNA, 25 bp, Homo sapien
ttttacattctgcaagcacatctgc

SEQ ID NO: 201871 - DNA, 25 bp, Homo sapien
cattctgcaagcacatctgcatttt

SEQ ID NO: 201872 - DNA, 25 bp, Homo sapien
tgcaagcacatctgcattttcaccc

SEQ ID NO: 201873 - DNA, 25 bp, Homo sapien
ctccttctccctttttatatcccat

SEQ ID NO: 201874 - DNA, 25 bp, Homo sapien
ctgagacagtcgtaggagccttatt

SEQ ID NO: 201875 - DNA, 25 bp, Homo sapien
gtaggagccttattcattcaaacca

SEQ ID NO: 201876 - DNA, 25 bp, Homo sapien
ttcaaaccatacgttttcctctgtg

SEQ ID NO: 201877 - DNA, 25 bp, Homo sapien
tttttcccatatcctagttccctag

SEQ ID NO: 201878 - DNA, 25 bp, Homo sapien
cctagctctcccatttttgaataca

SEQ ID NO: 201879 - DNA, 25 bp, Homo sapien
atttactatgaagtcctttgctgtg

SEQ ID NO: 201880 - DNA, 25 bp, Homo sapien
tggaggcaatgttgttccagagtca

SEQ ID NO: 201881 - DNA, 25 bp, Homo sapien
gaggtgctgtgtgtgagtcaaccac

SEQ ID NO: 201882 - DNA, 25 bp, Homo sapien
tgagtcaaccacttgtaccactata

SEQ ID NO: 201883 - DNA, 25 bp, Homo sapien
gggccccagtctaagctctgcttat

SEQ ID NO: 201884 - DNA, 25 bp, Homo sapien
agctctgcttatgcctatcttgaga

SEQ ID NO: 201885 - DNA, 25 bp, Homo sapien
atgtcaagatgctggactttgagac

SEQ ID NO: 201886 - DNA, 25 bp, Homo sapien
aagatgctggactttgagacgttct

SEQ ID NO: 201887 - DNA, 25 bp, Homo sapien
atgctggactttgagacgttcttgc

SEQ ID NO: 201888 - DNA, 25 bp, Homo sapien
gctggactttgagacgttcttgccc

SEQ ID NO: 201889 - DNA, 25 bp, Homo sapien
ggactttgagacgttcttgcccatc

SEQ ID NO: 201890 - DNA, 25 bp, Homo sapien
ctttgagacgttcttgcccatcctg

SEQ ID NO: 201891 - DNA, 25 bp, Homo sapien
gcacatttcccgcaacaaggagcag

SEQ ID NO: 201892 - DNA, 25 bp, Homo sapien
atttcccgcaacaaggagcagggca

SEQ ID NO: 201893 - DNA, 25 bp, Homo sapien
cccgcaacaaggagcagggcaccta

SEQ ID NO: 201894 - DNA, 25 bp, Homo sapien
gggtgctgagcttcggcacgtcctt

SEQ ID NO: 201895 - DNA, 25 bp, Homo sapien
gcacgtccttgccaccctgggagag

SEQ ID NO: 201896 - DNA, 25 bp, Homo sapien
gatgcagaaaaatgccactggtttc

SEQ ID NO: 201897 - DNA, 25 bp, Homo sapien
ggaatccccagacggaagctcatgt

SEQ ID NO: 201898 - DNA, 25 bp, Homo sapien
acggaagctcatgtaggtgctatga

SEQ ID NO: 201899 - DNA, 25 bp, Homo sapien
ggtgctatgaagctgatggtctatt

SEQ ID NO: 201900 - DNA, 25 bp, Homo sapien
tcatcctctacattccatattcagt

SEQ ID NO: 201901 - DNA, 25 bp, Homo sapien
atattcagttgctaccctggtccag

SEQ ID NO: 201902 - DNA, 25 bp, Homo sapien
agtatctccccttttatgcagggat

SEQ ID NO: 201903 - DNA, 25 bp, Homo sapien
aatccatttgtctgatttttgccac

SEQ ID NO: 201904 - DNA, 25 bp, Homo sapien
accctttactctccaggacattctg

SEQ ID NO: 201905 - DNA, 25 bp, Homo sapien
ggacattctgttctcattattatca

SEQ ID NO: 201906 - DNA, 25 bp, Homo sapien
gttctcattattatcacacatccta

SEQ ID NO: 201907 - DNA, 25 bp, Homo sapien
gaggtgggagaaaatctgggcacga

SEQ ID NO: 201908 - DNA, 25 bp, Homo sapien
aggtgggagaaaatctgggcacgat

SEQ ID NO: 201909 - DNA, 25 bp, Homo sapien
ggtgggagaaaatctgggcacgatc

SEQ ID NO: 201910 - DNA, 25 bp, Homo sapien
gtgggagaaaatctgggcacgatcg

SEQ ID NO: 201911 - DNA, 25 bp, Homo sapien
tgggagaaaatctgggcacgatcgg

SEQ ID NO: 201912 - DNA, 25 bp, Homo sapien
gggagaaaatctgggcacgatcggg

SEQ ID NO: 201913 - DNA, 25 bp, Homo sapien
gagaaaatctgggcacgatcgggcc

SEQ ID NO: 201914 - DNA, 25 bp, Homo sapien
gaaaatctgggcacgatcgggcccc

SEQ ID NO: 201915 - DNA, 25 bp, Homo sapien
aatctgggcacgatcgggccccctg

SEQ ID NO: 201916 - DNA, 25 bp, Homo sapien
atctgggcacgatcgggccccctgg

SEQ ID NO: 201917 - DNA, 25 bp, Homo sapien
gggcacgatcgggccccctgggcag

SEQ ID NO: 201918 - DNA, 25 bp, Homo sapien
ggtggcatcatgtaactgctaacct

SEQ ID NO: 201919 - DNA, 25 bp, Homo sapien
tgggtcaaaaatgtcttcccagttt

SEQ ID NO: 201920 - DNA, 25 bp, Homo sapien
ttctggaatgcaggtctgtcggctg

SEQ ID NO: 201921 - DNA, 25 bp, Homo sapien
aggtctgtcggctgggtgctctcca

SEQ ID NO: 201922 - DNA, 25 bp, Homo sapien
agctgctcctgcctgattcaactgt

SEQ ID NO: 201923 - DNA, 25 bp, Homo sapien
gcctgattcaactgtagcctgtaat

SEQ ID NO: 201924 - DNA, 25 bp, Homo sapien
gcctgtaatgggtaaaagccacatt

SEQ ID NO: 201925 - DNA, 25 bp, Homo sapien
acatttaggaggtggtctgatcata

SEQ ID NO: 201926 - DNA, 25 bp, Homo sapien
gtctgatcatagaacaccttaggaa

SEQ ID NO: 201927 - DNA, 25 bp, Homo sapien
gtccatgagactttctgactaggaa

SEQ ID NO: 201928 - DNA, 25 bp, Homo sapien
aaccatgtggtttgaacttgaagaa

SEQ ID NO: 201929 - DNA, 25 bp, Homo sapien
aaacataacttttactacagtagca

SEQ ID NO: 201930 - DNA, 25 bp, Homo sapien
actacagtagcatctaaggttttaa

SEQ ID NO: 201931 - DNA, 25 bp, Homo sapien
gagatatctatatccctacaaccta

SEQ ID NO: 201932 - DNA, 25 bp, Homo sapien
tatctatatccctacaacctaattg

SEQ ID NO: 201933 - DNA, 25 bp, Homo sapien
acctaattgtatattgagcagaaac

SEQ ID NO: 201934 - DNA, 25 bp, Homo sapien
aactgaattaatatgcttccttgca

SEQ ID NO: 201935 - DNA, 25 bp, Homo sapien
tatgcttccttgcaaatgggaaatc

SEQ ID NO: 201936 - DNA, 25 bp, Homo sapien
ggaaatcacatagcagttaccccat

SEQ ID NO: 201937 - DNA, 25 bp, Homo sapien
tagcagttaccccatggcattgtga

SEQ ID NO: 201938 - DNA, 25 bp, Homo sapien
gttaccccatggcattgtgactaat

SEQ ID NO: 201939 - DNA, 25 bp, Homo sapien
attgtgactaatggcatcagggcaa

SEQ ID NO: 201940 - DNA, 25 bp, Homo sapien
accagaccaatcttctcagaacttg

SEQ ID NO: 201941 - DNA, 25 bp, Homo sapien
ttgaatctgattgtatcccatccct

SEQ ID NO: 201942 - DNA, 25 bp, Homo sapien
ttacaatccttcagggacactccac

SEQ ID NO: 201943 - DNA, 25 bp, Homo sapien
acactccaccactgtcaggatgaag

SEQ ID NO: 201944 - DNA, 25 bp, Homo sapien
tttggtttcattaagtcggtctgca

SEQ ID NO: 201945 - DNA, 25 bp, Homo sapien
tcggtctgcaatctgcttgagcatt

SEQ ID NO: 201946 - DNA, 25 bp, Homo sapien
gagcatttcagcttaatcgccagag

SEQ ID NO: 201947 - DNA, 25 bp, Homo sapien
atcgccagaggattgcttccatatt

SEQ ID NO: 201948 - DNA, 25 bp, Homo sapien
ccctaaacatactttacccaagctg

SEQ ID NO: 201949 - DNA, 25 bp, Homo sapien
ttacccaagctgtaaggtcctacat

SEQ ID NO: 201950 - DNA, 25 bp, Homo sapien
agcagtgagcttcctggtagccgaa

SEQ ID NO: 201951 - DNA, 25 bp, Homo sapien
aactcttaagtctttgtgtctgcaa

SEQ ID NO: 201952 - DNA, 25 bp, Homo sapien
ctcttaagtctttgtgtctgcaatg

SEQ ID NO: 201953 - DNA, 25 bp, Homo sapien
taagtctttgtgtctgcaatgaaat

SEQ ID NO: 201954 - DNA, 25 bp, Homo sapien
gtgtctgcaatgaaattgtactcct

SEQ ID NO: 201955 - DNA, 25 bp, Homo sapien
atccctcaaacttgcattccactat

SEQ ID NO: 201956 - DNA, 25 bp, Homo sapien
ccctcaaacttgcattccactatat

SEQ ID NO: 201957 - DNA, 25 bp, Homo sapien
aaacttgcattccactatatttatt

SEQ ID NO: 201958 - DNA, 25 bp, Homo sapien
ttttttggcaaaagatgagctgtat

SEQ ID NO: 201959 - DNA, 25 bp, Homo sapien
atgcatcttgccttatcttttttta

SEQ ID NO: 201960 - DNA, 25 bp, Homo sapien
ttattactgtgtacaaagatttttt

SEQ ID NO: 201961 - DNA, 25 bp, Homo sapien
taaattcagtgtgtagcttcaattg

SEQ ID NO: 201962 - DNA, 25 bp, Homo sapien
ccgggaaagcgatggacagacagac

SEQ ID NO: 201963 - DNA, 25 bp, Homo sapien
aaagcgatggacagacagacgatgg

SEQ ID NO: 201964 - DNA, 25 bp, Homo sapien
cccaagctgggcacaaagtagtttt

SEQ ID NO: 201965 - DNA, 25 bp, Homo sapien
gctgggcacaaagtagttttttacg

SEQ ID NO: 201966 - DNA, 25 bp, Homo sapien
aaaatcttccttgtccctgggctct

SEQ ID NO: 201967 - DNA, 25 bp, Homo sapien
agaccagaaggatgtcccatctgaa

SEQ ID NO: 201968 - DNA, 25 bp, Homo sapien
cctcccatctacacttgactgtaga

SEQ ID NO: 201969 - DNA, 25 bp, Homo sapien
acacttgactgtagactggtctggc

SEQ ID NO: 201970 - DNA, 25 bp, Homo sapien
ttgactgtagactggtctggcctgc

SEQ ID NO: 201971 - DNA, 25 bp, Homo sapien
gcgtcagggcgcatcaataaagtac

SEQ ID NO: 201972 - DNA, 25 bp, Homo sapien
ggcgcatcaataaagtacttggacc

SEQ ID NO: 201973 - DNA, 25 bp, Homo sapien
gtgcaaggagctgggtatcaccgcc

SEQ ID NO: 201974 - DNA, 25 bp, Homo sapien
gcaaggagctgggtatcaccgccct

SEQ ID NO: 201975 - DNA, 25 bp, Homo sapien
caaggagctgggtatcaccgcccta

SEQ ID NO: 201976 - DNA, 25 bp, Homo sapien
aaggagctgggtatcaccgccctac

SEQ ID NO: 201977 - DNA, 25 bp, Homo sapien
aggagctgggtatcaccgccctaca

SEQ ID NO: 201978 - DNA, 25 bp, Homo sapien
ggagctgggtatcaccgccctacac

SEQ ID NO: 201979 - DNA, 25 bp, Homo sapien
gagctgggtatcaccgccctacaca

SEQ ID NO: 201980 - DNA, 25 bp, Homo sapien
agctgggtatcaccgccctacacat

SEQ ID NO: 201981 - DNA, 25 bp, Homo sapien
aataggaccaagacccctggacctg

SEQ ID NO: 201982 - DNA, 25 bp, Homo sapien
ataggaccaagacccctggacctgg

SEQ ID NO: 201983 - DNA, 25 bp, Homo sapien
taggaccaagacccctggacctggg

SEQ ID NO: 201984 - DNA, 25 bp, Homo sapien
taaggaatttttgcccagtcgttct

SEQ ID NO: 201985 - DNA, 25 bp, Homo sapien
gaatttttgcccagtcgttctggac

SEQ ID NO: 201986 - DNA, 25 bp, Homo sapien
tgcccagtcgttctggaccaaagga

SEQ ID NO: 201987 - DNA, 25 bp, Homo sapien
ggaccaaaggaacatagccctagtt

SEQ ID NO: 201988 - DNA, 25 bp, Homo sapien
gaacatagccctagtttaagagaac

SEQ ID NO: 201989 - DNA, 25 bp, Homo sapien
taagagaacgaagaccacagcaaga

SEQ ID NO: 201990 - DNA, 25 bp, Homo sapien
agagagagccagcagccaaccccta

SEQ ID NO: 201991 - DNA, 25 bp, Homo sapien
agccaacccctacgacttcaggagg

SEQ ID NO: 201992 - DNA, 25 bp, Homo sapien
gacttcaggaggctcctgcgcaaaa

SEQ ID NO: 201993 - DNA, 25 bp, Homo sapien
tcaggaggctcctgcgcaaaacctc

SEQ ID NO: 201994 - DNA, 25 bp, Homo sapien
tcgtccagcagtcctaaccgttcaa

SEQ ID NO: 201995 - DNA, 25 bp, Homo sapien
gtgtgattctgtataacaaggtgat

SEQ ID NO: 201996 - DNA, 25 bp, Homo sapien
aacaaggtgatgtctgtttcccagg

SEQ ID NO: 201997 - DNA, 25 bp, Homo sapien
cagggctcagacctaatccagttat

SEQ ID NO: 201998 - DNA, 25 bp, Homo sapien
ggctcagacctaatccagttataat

SEQ ID NO: 201999 - DNA, 25 bp, Homo sapien
agaatcgatctatgcccttgttaat

SEQ ID NO: 202000 - DNA, 25 bp, Homo sapien
gatctatgcccttgttaatctccat

SEQ ID NO: 202001 - DNA, 25 bp, Homo sapien
cttgttaatctccatccatatagga

SEQ ID NO: 202002 - DNA, 25 bp, Homo sapien
atccatataggagtcacgttcttta

SEQ ID NO: 202003 - DNA, 25 bp, Homo sapien
aggagtcacgttctttaagacagat

SEQ ID NO: 202004 - DNA, 25 bp, Homo sapien
taagacagatggtggtagttatttt

SEQ ID NO: 202005 - DNA, 25 bp, Homo sapien
ttttgtggcatggttagatttgact

SEQ ID NO: 202006 - DNA, 25 bp, Homo sapien
gctgttttgcgtagcatcgtgtgcc

SEQ ID NO: 202007 - DNA, 25 bp, Homo sapien
ctgttttgcgtagcatcgtgtgcca

SEQ ID NO: 202008 - DNA, 25 bp, Homo sapien
tgttttgcgtagcatcgtgtgccac

SEQ ID NO: 202009 - DNA, 25 bp, Homo sapien
gttttgcgtagcatcgtgtgccacc

SEQ ID NO: 202010 - DNA, 25 bp, Homo sapien
ttttgcgtagcatcgtgtgccaccc

SEQ ID NO: 202011 - DNA, 25 bp, Homo sapien
tttgcgtagcatcgtgtgccacccc

SEQ ID NO: 202012 - DNA, 25 bp, Homo sapien
ttgcgtagcatcgtgtgccacccct

SEQ ID NO: 202013 - DNA, 25 bp, Homo sapien
tgcgtagcatcgtgtgccacccctg

SEQ ID NO: 202014 - DNA, 25 bp, Homo sapien
tgatgagctgcacctagagatgaga

SEQ ID NO: 202015 - DNA, 25 bp, Homo sapien
gagctgcacctagagatgagagtgg

SEQ ID NO: 202016 - DNA, 25 bp, Homo sapien
aggtgtggtctgcaagcaagtattc

SEQ ID NO: 202017 - DNA, 25 bp, Homo sapien
agacaaccttgtcccaaccaatcag

SEQ ID NO: 202018 - DNA, 25 bp, Homo sapien
atgtgtgagccaggatccctctttg

SEQ ID NO: 202019 - DNA, 25 bp, Homo sapien
tgtgtgagccaggatccctctttgc

SEQ ID NO: 202020 - DNA, 25 bp, Homo sapien
gtgtgagccaggatccctctttgca

SEQ ID NO: 202021 - DNA, 25 bp, Homo sapien
caggatccctctttgcacagcatga

SEQ ID NO: 202022 - DNA, 25 bp, Homo sapien
gaggcaaaaatgtccagccacccct

SEQ ID NO: 202023 - DNA, 25 bp, Homo sapien
cacccctaggcatctgttagcagag

SEQ ID NO: 202024 - DNA, 25 bp, Homo sapien
agagtctgtctcttggctttgtcac

SEQ ID NO: 202025 - DNA, 25 bp, Homo sapien
tgcccttgactccacctatgttgga

SEQ ID NO: 202026 - DNA, 25 bp, Homo sapien
acctatgttggagccttagcccaag

SEQ ID NO: 202027 - DNA, 25 bp, Homo sapien
gttggagccttagcccaaggccatt

SEQ ID NO: 202028 - DNA, 25 bp, Homo sapien
aaggccattccttctgtgatgataa

SEQ ID NO: 202029 - DNA, 25 bp, Homo sapien
agcccagttctggaattggagccat

SEQ ID NO: 202030 - DNA, 25 bp, Homo sapien
aaggaatgattctcttccagcgctg

SEQ ID NO: 202031 - DNA, 25 bp, Homo sapien
gcagccaccacatgtctcagggcta

SEQ ID NO: 202032 - DNA, 25 bp, Homo sapien
tcagggctaccttctccgattggat

SEQ ID NO: 202033 - DNA, 25 bp, Homo sapien
ctccgattggatttgcatttgtggc

SEQ ID NO: 202034 - DNA, 25 bp, Homo sapien
catttgtggcactgtctttgatgca

SEQ ID NO: 202035 - DNA, 25 bp, Homo sapien
gtctttgatgcagtgatgtacttaa

SEQ ID NO: 202036 - DNA, 25 bp, Homo sapien
tttgaattaatagctctcctactat

SEQ ID NO: 202037 - DNA, 25 bp, Homo sapien
agctctcctactattaatttacatg

SEQ ID NO: 202038 - DNA, 25 bp, Homo sapien
tgctttttgtgtggcgctataagtg

SEQ ID NO: 202039 - DNA, 25 bp, Homo sapien
gtgtggcgctataagtgactatggt

SEQ ID NO: 202040 - DNA, 25 bp, Homo sapien
tgatgttaacatgcccaattattgt

SEQ ID NO: 202041 - DNA, 25 bp, Homo sapien
aacatgcccaattattgttctttta

SEQ ID NO: 202042 - DNA, 25 bp, Homo sapien
gttaaatataatactgccccacttt

SEQ ID NO: 202043 - DNA, 25 bp, Homo sapien
aatactgccccactttaatatatgt

SEQ ID NO: 202044 - DNA, 25 bp, Homo sapien
agcaacttcctacttatacacgacg

SEQ ID NO: 202045 - DNA, 25 bp, Homo sapien
atacacgacgtgttcctaaaacatg

SEQ ID NO: 202046 - DNA, 25 bp, Homo sapien
ggtgaatttctgaaagtctacaata

SEQ ID NO: 202047 - DNA, 25 bp, Homo sapien
tgtgattctgtataacaaggtgatg

SEQ ID NO: 202048 - DNA, 25 bp, Homo sapien
aacaaggtgatgtctgtttcccagg

SEQ ID NO: 202049 - DNA, 25 bp, Homo sapien
ccagggctcagacctaatccagtta

SEQ ID NO: 202050 - DNA, 25 bp, Homo sapien
gggctcagacctaatccagttataa

SEQ ID NO: 202051 - DNA, 25 bp, Homo sapien
ggctcagacctaatccagttataat

SEQ ID NO: 202052 - DNA, 25 bp, Homo sapien
atccatataggagtcacgttcttta

SEQ ID NO: 202053 - DNA, 25 bp, Homo sapien
catataggagtcacgttctttaaga

SEQ ID NO: 202054 - DNA, 25 bp, Homo sapien
taggagtcacgttctttaagacaga

SEQ ID NO: 202055 - DNA, 25 bp, Homo sapien
gagtcacgttctttaagacagatgg

SEQ ID NO: 202056 - DNA, 25 bp, Homo sapien
acgttctttaagacagatggtggta

SEQ ID NO: 202057 - DNA, 25 bp, Homo sapien
taagacagatggtggtagttatttt

SEQ ID NO: 202058 - DNA, 25 bp, Homo sapien
tttgaagagttaactcaccaagtgc

SEQ ID NO: 202059 - DNA, 25 bp, Homo sapien
aaaagattctttggcctcacagctc

SEQ ID NO: 202060 - DNA, 25 bp, Homo sapien
acgttgccatcgaacagcttctgaa

SEQ ID NO: 202061 - DNA, 25 bp, Homo sapien
gaactgttctaagttaccatgtctg

SEQ ID NO: 202062 - DNA, 25 bp, Homo sapien
taccatgtctgcaagtagggcgaac

SEQ ID NO: 202063 - DNA, 25 bp, Homo sapien
acaggaatgaagtcgcacctaccca

SEQ ID NO: 202064 - DNA, 25 bp, Homo sapien
gtcgcacctacccataaacaactga

SEQ ID NO: 202065 - DNA, 25 bp, Homo sapien
tgacctaaacagacttacttcgtat

SEQ ID NO: 202066 - DNA, 25 bp, Homo sapien
aacagacttacttcgtatgccctgc

SEQ ID NO: 202067 - DNA, 25 bp, Homo sapien
gtatgccctgccctttattggtctc

SEQ ID NO: 202068 - DNA, 25 bp, Homo sapien
ttattggtctcccagacatgcaaac

SEQ ID NO: 202069 - DNA, 25 bp, Homo sapien
gtttcactgtaccagctcctgtagt

SEQ ID NO: 202070 - DNA, 25 bp, Homo sapien
actgtaccagctcctgtagtgataa

SEQ ID NO: 202071 - DNA, 25 bp, Homo sapien
gataatactcattattttgtgtgtg

SEQ ID NO: 202072 - DNA, 25 bp, Homo sapien
ttattttgtgtgtgatggctggtat

SEQ ID NO: 202073 - DNA, 25 bp, Homo sapien
tttgtgtgtgatggctggtattatt

SEQ ID NO: 202074 - DNA, 25 bp, Homo sapien
tgcatgctgcctgtattgcctgcat

SEQ ID NO: 202075 - DNA, 25 bp, Homo sapien
atgctgcctgtattgcctgcatgct

SEQ ID NO: 202076 - DNA, 25 bp, Homo sapien
tgcctgtattgcctgcatgctgcct

SEQ ID NO: 202077 - DNA, 25 bp, Homo sapien
gctgcctgatcttgcgataaccggc

SEQ ID NO: 202078 - DNA, 25 bp, Homo sapien
cctgatcttgcgataaccggctgca

SEQ ID NO: 202079 - DNA, 25 bp, Homo sapien
atcttgcgataaccggctgcacctg

SEQ ID NO: 202080 - DNA, 25 bp, Homo sapien
acgtggtggcatttctcgcctcaca

SEQ ID NO: 202081 - DNA, 25 bp, Homo sapien
ggcatttctcgcctcacaccaagaa

SEQ ID NO: 202082 - DNA, 25 bp, Homo sapien
gagatttgggtcatgttactccatt

SEQ ID NO: 202083 - DNA, 25 bp, Homo sapien
atttgggtcatgttactccatttga

SEQ ID NO: 202084 - DNA, 25 bp, Homo sapien
gttactccatttgatgaagattctc

SEQ ID NO: 202085 - DNA, 25 bp, Homo sapien
atttgatgaagattctcactaccgc

SEQ ID NO: 202086 - DNA, 25 bp, Homo sapien
ataggagcctacactaagtccaagt

SEQ ID NO: 202087 - DNA, 25 bp, Homo sapien
actaagtccaagtgtgagccattca

SEQ ID NO: 202088 - DNA, 25 bp, Homo sapien
agtccaagtgtgagccattcacaga

SEQ ID NO: 202089 - DNA, 25 bp, Homo sapien
agtgtgagccattcacagactagaa

SEQ ID NO: 202090 - DNA, 25 bp, Homo sapien
gagccattcacagactagaacacaa

SEQ ID NO: 202091 - DNA, 25 bp, Homo sapien
tctacaaccacctgcgacgccacga

SEQ ID NO: 202092 - DNA, 25 bp, Homo sapien
ctacaaccacctgcgacgccacgaa

SEQ ID NO: 202093 - DNA, 25 bp, Homo sapien
caaccacctgcgacgccacgaactg

SEQ ID NO: 202094 - DNA, 25 bp, Homo sapien
cgggcaccgtctcctgcctgtgcgt

SEQ ID NO: 202095 - DNA, 25 bp, Homo sapien
gggcaccgtctcctgcctgtgcgtc

SEQ ID NO: 202096 - DNA, 25 bp, Homo sapien
gcaccgtctcctgcctgtgcgtccg

SEQ ID NO: 202097 - DNA, 25 bp, Homo sapien
ctgcctgtgcgtccgcccaccgctg

SEQ ID NO: 202098 - DNA, 25 bp, Homo sapien
caccgctgccctgtctgttgcgaca

SEQ ID NO: 202099 - DNA, 25 bp, Homo sapien
accgctgccctgtctgttgcgacac

SEQ ID NO: 202100 - DNA, 25 bp, Homo sapien
gctgccctgtctgttgcgacaccct

SEQ ID NO: 202101 - DNA, 25 bp, Homo sapien
tgccctgtctgttgcgacaccctcc

SEQ ID NO: 202102 - DNA, 25 bp, Homo sapien
gcttttggattatgtgtacagttgg

SEQ ID NO: 202103 - DNA, 25 bp, Homo sapien
tatgtgtacagttggttcatccctt

SEQ ID NO: 202104 - DNA, 25 bp, Homo sapien
tgtgtacagttggttcatccctttt

SEQ ID NO: 202105 - DNA, 25 bp, Homo sapien
tgtacagttggttcatccctttttc

SEQ ID NO: 202106 - DNA, 25 bp, Homo sapien
tacagttggttcatccctttttctg

SEQ ID NO: 202107 - DNA, 25 bp, Homo sapien
ttttctgctaattcgagtcatggct

SEQ ID NO: 202108 - DNA, 25 bp, Homo sapien
ctgctaattcgagtcatggctaatt

SEQ ID NO: 202109 - DNA, 25 bp, Homo sapien
gccctgccccagatttactaaatca

SEQ ID NO: 202110 - DNA, 25 bp, Homo sapien
ggtgatttgtatgctcattgaactt

SEQ ID NO: 202111 - DNA, 25 bp, Homo sapien
tgtatgctcattgaactttaagaag

SEQ ID NO: 202112 - DNA, 25 bp, Homo sapien
gaactttaagaagcagtgttttaga

SEQ ID NO: 202113 - DNA, 25 bp, Homo sapien
gtttcactgtaccagctcctgtagt

SEQ ID NO: 202114 - DNA, 25 bp, Homo sapien
tttcactgtaccagctcctgtagtg

SEQ ID NO: 202115 - DNA, 25 bp, Homo sapien
ttcactgtaccagctcctgtagtga

SEQ ID NO: 202116 - DNA, 25 bp, Homo sapien
tcactgtaccagctcctgtagtgat

SEQ ID NO: 202117 - DNA, 25 bp, Homo sapien
cactgtaccagctcctgtagtgata

SEQ ID NO: 202118 - DNA, 25 bp, Homo sapien
actgtaccagctcctgtagtgataa

SEQ ID NO: 202119 - DNA, 25 bp, Homo sapien
tcctgtagtgataatactcattatt

SEQ ID NO: 202120 - DNA, 25 bp, Homo sapien
gataatactcattattttgtgtgtg

SEQ ID NO: 202121 - DNA, 25 bp, Homo sapien
ttattttgtgtgtgatggctggtat

SEQ ID NO: 202122 - DNA, 25 bp, Homo sapien
attttgtgtgtgatggctggtatta

SEQ ID NO: 202123 - DNA, 25 bp, Homo sapien
tttgtgtgtgatggctggtattatt

SEQ ID NO: 202124 - DNA, 25 bp, Homo sapien
ttcaccaaaagtcacatccatccca

SEQ ID NO: 202125 - DNA, 25 bp, Homo sapien
ctgttcgctgcatctggactgcatg

SEQ ID NO: 202126 - DNA, 25 bp, Homo sapien
gctgcatctggactgcatgctaatg

SEQ ID NO: 202127 - DNA, 25 bp, Homo sapien
tggactgcatgctaatgccaatctt

SEQ ID NO: 202128 - DNA, 25 bp, Homo sapien
atgccaatcttagtgctgaccagtc

SEQ ID NO: 202129 - DNA, 25 bp, Homo sapien
aatcttagtgctgaccagtctccat

SEQ ID NO: 202130 - DNA, 25 bp, Homo sapien
tagtgctgaccagtctccatctgca

SEQ ID NO: 202131 - DNA, 25 bp, Homo sapien
catctgcactgagcgctggtaaaac

SEQ ID NO: 202132 - DNA, 25 bp, Homo sapien
ctgagcgctggtaaaactgcagtta

SEQ ID NO: 202133 - DNA, 25 bp, Homo sapien
aaaactgcagttaatgtcccacggc

SEQ ID NO: 202134 - DNA, 25 bp, Homo sapien
gttaatgtcccacggcagcccacag

SEQ ID NO: 202135 - DNA, 25 bp, Homo sapien
aaaggccagggttctctatgattat

SEQ ID NO: 202136 - DNA, 25 bp, Homo sapien
tctctatgattatgatgcagcaaac

SEQ ID NO: 202137 - DNA, 25 bp, Homo sapien
agtactgaattatcacttctggcag

SEQ ID NO: 202138 - DNA, 25 bp, Homo sapien
tgaattatcacttctggcagatgag

SEQ ID NO: 202139 - DNA, 25 bp, Homo sapien
ggtgatcactgtgttcagtgttgtt

SEQ ID NO: 202140 - DNA, 25 bp, Homo sapien
gaatggattcagactggctaatggg

SEQ ID NO: 202141 - DNA, 25 bp, Homo sapien
acacctgtaccatcagttttaccaa

SEQ ID NO: 202142 - DNA, 25 bp, Homo sapien
aaatgcgattggttcttctgccatg

SEQ ID NO: 202143 - DNA, 25 bp, Homo sapien
ccatggcttcaacaagtggcctagt

SEQ ID NO: 202144 - DNA, 25 bp, Homo sapien
aagtggcctagtaatcacctctcct

SEQ ID NO: 202145 - DNA, 25 bp, Homo sapien
gaccttaaggagtgtagtggcagca

SEQ ID NO: 202146 - DNA, 25 bp, Homo sapien
agctacacagaataggtgacttcat

SEQ ID NO: 202147 - DNA, 25 bp, Homo sapien
cattgatgtgagtgagggccctctt

SEQ ID NO: 202148 - DNA, 25 bp, Homo sapien
agggccctcttattccaagaacaag

SEQ ID NO: 202149 - DNA, 25 bp, Homo sapien
acaagtatttgtttccagtatgaag

SEQ ID NO: 202150 - DNA, 25 bp, Homo sapien
aagtgtcagcagttcacaatcttca

SEQ ID NO: 202151 - DNA, 25 bp, Homo sapien
acccagccaagtctcatacgaagat

SEQ ID NO: 202152 - DNA, 25 bp, Homo sapien
gtctcatacgaagattccagggtgt

SEQ ID NO: 202153 - DNA, 25 bp, Homo sapien
aagattccagggtgtgtctttacct

SEQ ID NO: 202154 - DNA, 25 bp, Homo sapien
gtgtgtctttacctgttcacttaag

SEQ ID NO: 202155 - DNA, 25 bp, Homo sapien
gttcacttaagagcacattttacaa

SEQ ID NO: 202156 - DNA, 25 bp, Homo sapien
taagctattggaaagatctcggaaa

SEQ ID NO: 202157 - DNA, 25 bp, Homo sapien
agtcccagctgttgttcccagcaac

SEQ ID NO: 202158 - DNA, 25 bp, Homo sapien
gttgttcccagcaacgtcgccactg

SEQ ID NO: 202159 - DNA, 25 bp, Homo sapien
ggctttgtcatttcaaggctgctga

SEQ ID NO: 202160 - DNA, 25 bp, Homo sapien
gccaccatggagcagccgttattta

SEQ ID NO: 202161 - DNA, 25 bp, Homo sapien
gccgttatttatagaactgcctgtt

SEQ ID NO: 202162 - DNA, 25 bp, Homo sapien
tccctccattcttgtccagaaaact

SEQ ID NO: 202163 - DNA, 25 bp, Homo sapien
agaaaactccttagctctcgcagtg

SEQ ID NO: 202164 - DNA, 25 bp, Homo sapien
cttagctctcgcagtgagccatgtt

SEQ ID NO: 202165 - DNA, 25 bp, Homo sapien
agccatgttcttagtctccagggat

SEQ ID NO: 202166 - DNA, 25 bp, Homo sapien
tggatggccttgtatatggacccct

SEQ ID NO: 202167 - DNA, 25 bp, Homo sapien
tatggacccctgagaatgagcaatt

SEQ ID NO: 202168 - DNA, 25 bp, Homo sapien
atctgtatgtcaccatcatcgagga

SEQ ID NO: 202169 - DNA, 25 bp, Homo sapien
tctgtatgtcaccatcatcgaggac

SEQ ID NO: 202170 - DNA, 25 bp, Homo sapien
ctgtatgtcaccatcatcgaggacc

SEQ ID NO: 202171 - DNA, 25 bp, Homo sapien
tgtatgtcaccatcatcgaggacca

SEQ ID NO: 202172 - DNA, 25 bp, Homo sapien
gtatgtcaccatcatcgaggaccaa

SEQ ID NO: 202173 - DNA, 25 bp, Homo sapien
tatgtcaccatcatcgaggaccaaa

SEQ ID NO: 202174 - DNA, 25 bp, Homo sapien
ttataaaaatcagagcgcttctccc

SEQ ID NO: 202175 - DNA, 25 bp, Homo sapien
tataaaaatcagagcgcttctcccc

SEQ ID NO: 202176 - DNA, 25 bp, Homo sapien
ataaaaatcagagcgcttctccccc

SEQ ID NO: 202177 - DNA, 25 bp, Homo sapien
ttctccccctccaaaggaccgcagc

SEQ ID NO: 202178 - DNA, 25 bp, Homo sapien
cccctccaaaggaccgcagctcctc

SEQ ID NO: 202179 - DNA, 25 bp, Homo sapien
atcgtggaggcatcattgcacaacc

SEQ ID NO: 202180 - DNA, 25 bp, Homo sapien
ggaggcatcattgcacaaccaatat

SEQ ID NO: 202181 - DNA, 25 bp, Homo sapien
gcacaaccaatatgcctggtggctg

SEQ ID NO: 202182 - DNA, 25 bp, Homo sapien
cctggtggctggagtatagactgct

SEQ ID NO: 202183 - DNA, 25 bp, Homo sapien
tagactgctaaatggtattcagcga

SEQ ID NO: 202184 - DNA, 25 bp, Homo sapien
gtattcagcgaagcaggtctatagt

SEQ ID NO: 202185 - DNA, 25 bp, Homo sapien
agtgacatgagatttcctggtactt

SEQ ID NO: 202186 - DNA, 25 bp, Homo sapien
aggtcagttccagttcttgctggga

SEQ ID NO: 202187 - DNA, 25 bp, Homo sapien
ttccagttcttgctgggaacaataa

SEQ ID NO: 202188 - DNA, 25 bp, Homo sapien
aacaacaaccgtaaagacttcagag

SEQ ID NO: 202189 - DNA, 25 bp, Homo sapien
cttcagagaacagaccgggcgtggt

SEQ ID NO: 202190 - DNA, 25 bp, Homo sapien
gcgttttttctgtgtaatctatttt

SEQ ID NO: 202191 - DNA, 25 bp, Homo sapien
tattttttcatacggctgcagcagc

SEQ ID NO: 202192 - DNA, 25 bp, Homo sapien
ggtgggagggccattttgtcacttt

SEQ ID NO: 202193 - DNA, 25 bp, Homo sapien
tcagttgagcatctaggaagtatta

SEQ ID NO: 202194 - DNA, 25 bp, Homo sapien
aaaactgtgaagctttctcagtgca

SEQ ID NO: 202195 - DNA, 25 bp, Homo sapien
tctcagtgcactttgaacctggaaa

SEQ ID NO: 202196 - DNA, 25 bp, Homo sapien
ggaaaacaatcccaacaggcccgtg

SEQ ID NO: 202197 - DNA, 25 bp, Homo sapien
caggcccgtgggaccatgacttagg

SEQ ID NO: 202198 - DNA, 25 bp, Homo sapien
catgacttagggaggtgggacccac

SEQ ID NO: 202199 - DNA, 25 bp, Homo sapien
atccaggaaccgtgacgtccaagga

SEQ ID NO: 202200 - DNA, 25 bp, Homo sapien
tgacgtccaaggaaccaaacccaga

SEQ ID NO: 202201 - DNA, 25 bp, Homo sapien
gacctgaacatattagtgcaatcca

SEQ ID NO: 202202 - DNA, 25 bp, Homo sapien
acatattagtgcaatccagtccaga

SEQ ID NO: 202203 - DNA, 25 bp, Homo sapien
agtgcaatccagtccagattggacc

SEQ ID NO: 202204 - DNA, 25 bp, Homo sapien
gtccagattggacctttgatcctat

SEQ ID NO: 202205 - DNA, 25 bp, Homo sapien
ttgatcctatgtggaagggctgttt

SEQ ID NO: 202206 - DNA, 25 bp, Homo sapien
gtataccaatatatgcatgttttgt

SEQ ID NO: 202207 - DNA, 25 bp, Homo sapien
tgttttgtgcatgagtagtacttgt

SEQ ID NO: 202208 - DNA, 25 bp, Homo sapien
gtagtacttgtgttgatactcctgt

SEQ ID NO: 202209 - DNA, 25 bp, Homo sapien
acttgtgttgatactcctgttgatg

SEQ ID NO: 202210 - DNA, 25 bp, Homo sapien
gttgatactcctgttgatgttaaat

SEQ ID NO: 202211 - DNA, 25 bp, Homo sapien
gttttactgctgttaagtttgttat

SEQ ID NO: 202212 - DNA, 25 bp, Homo sapien
agcctgaagagatgaatgtcaagat

SEQ ID NO: 202213 - DNA, 25 bp, Homo sapien
gcctgaagagatgaatgtcaagatg

SEQ ID NO: 202214 - DNA, 25 bp, Homo sapien
ttcttgcccatcctgcagcacattt

SEQ ID NO: 202215 - DNA, 25 bp, Homo sapien
tcttgcccatcctgcagcacatttc

SEQ ID NO: 202216 - DNA, 25 bp, Homo sapien
cttgcccatcctgcagcacatttcc

SEQ ID NO: 202217 - DNA, 25 bp, Homo sapien
ttgcccatcctgcagcacatttccc

SEQ ID NO: 202218 - DNA, 25 bp, Homo sapien
tgcccatcctgcagcacatttcccg

SEQ ID NO: 202219 - DNA, 25 bp, Homo sapien
gcccatcctgcagcacatttcccgc

SEQ ID NO: 202220 - DNA, 25 bp, Homo sapien
ctgagggcggagtctattttacgcg

SEQ ID NO: 202221 - DNA, 25 bp, Homo sapien
gagggcggagtctattttacgcgtc

SEQ ID NO: 202222 - DNA, 25 bp, Homo sapien
gggcggagtctattttacgcgtcgc

SEQ ID NO: 202223 - DNA, 25 bp, Homo sapien
ggagtctattttacgcgtcgcccaa

SEQ ID NO: 202224 - DNA, 25 bp, Homo sapien
gagtctattttacgcgtcgcccaat

SEQ ID NO: 202225 - DNA, 25 bp, Homo sapien
tctattttacgcgtcgcccaatgac

SEQ ID NO: 202226 - DNA, 25 bp, Homo sapien
tattttacgcgtcgcccaatgacag

SEQ ID NO: 202227 - DNA, 25 bp, Homo sapien
ttacgcgtcgcccaatgacaggacc

SEQ ID NO: 202228 - DNA, 25 bp, Homo sapien
gcgtcgcccaatgacaggacctgga

SEQ ID NO: 202229 - DNA, 25 bp, Homo sapien
gtcgcccaatgacaggacctggaat

SEQ ID NO: 202230 - DNA, 25 bp, Homo sapien
gcccaatgacaggacctggaatgta

SEQ ID NO: 202231 - DNA, 25 bp, Homo sapien
ataacatttcagtagggttcaaggt

SEQ ID NO: 202232 - DNA, 25 bp, Homo sapien
tcagtagggttcaaggtggtcccaa

SEQ ID NO: 202233 - DNA, 25 bp, Homo sapien
tggtcccaaaagttatataaaagat

SEQ ID NO: 202234 - DNA, 25 bp, Homo sapien
tataaacccttgtcttttactcaga

SEQ ID NO: 202235 - DNA, 25 bp, Homo sapien
acccttgtcttttactcagatccta

SEQ ID NO: 202236 - DNA, 25 bp, Homo sapien
gtcttttactcagatcctagcatcc

SEQ ID NO: 202237 - DNA, 25 bp, Homo sapien
tttactcagatcctagcatcccttt

SEQ ID NO: 202238 - DNA, 25 bp, Homo sapien
agatcctagcatcccttttcacatg

SEQ ID NO: 202239 - DNA, 25 bp, Homo sapien
tagcatcccttttcacatggtttct

SEQ ID NO: 202240 - DNA, 25 bp, Homo sapien
atggtttctccatgtatataacaga

SEQ ID NO: 202241 - DNA, 25 bp, Homo sapien
atctatatggaacaaacattcccaa

SEQ ID NO: 202242 - DNA, 25 bp, Homo sapien
tgggacatctgaggacatccgcaga

SEQ ID NO: 202243 - DNA, 25 bp, Homo sapien
acatccgcagattcttgtcagcctg

SEQ ID NO: 202244 - DNA, 25 bp, Homo sapien
ttgtcagcctgtgaactaggccctg

SEQ ID NO: 202245 - DNA, 25 bp, Homo sapien
tctgtcacctcattggtccatgaag

SEQ ID NO: 202246 - DNA, 25 bp, Homo sapien
gggtcagagattctgtcctgctcct

SEQ ID NO: 202247 - DNA, 25 bp, Homo sapien
gggatgcactggctactcccttagt

SEQ ID NO: 202248 - DNA, 25 bp, Homo sapien
gtcctcagcttcctccatcatggag

SEQ ID NO: 202249 - DNA, 25 bp, Homo sapien
agatgggatcatggattttctgggc

SEQ ID NO: 202250 - DNA, 25 bp, Homo sapien
ttttctgggcataagtggctgttct

SEQ ID NO: 202251 - DNA, 25 bp, Homo sapien
aagtggctgttctgggagtcattcc

SEQ ID NO: 202252 - DNA, 25 bp, Homo sapien
tgttctgggagtcattccaaagaga

SEQ ID NO: 202253 - DNA, 25 bp, Homo sapien
gaatatattgactgccactccgaat

SEQ ID NO: 202254 - DNA, 25 bp, Homo sapien
cactccgaatcctaacatgcaatgt

SEQ ID NO: 202255 - DNA, 25 bp, Homo sapien
acatgcaatgtctttcttcaaaaga

SEQ ID NO: 202256 - DNA, 25 bp, Homo sapien
agacagtgtcatgcattccttacag

SEQ ID NO: 202257 - DNA, 25 bp, Homo sapien
gtcatgcattccttacagtggattt

SEQ ID NO: 202258 - DNA, 25 bp, Homo sapien
aattaatgctgagtccccagccaag

SEQ ID NO: 202259 - DNA, 25 bp, Homo sapien
agtgataagtcataccatctctctt

SEQ ID NO: 202260 - DNA, 25 bp, Homo sapien
ataccatctctcttactcctttttt

SEQ ID NO: 202261 - DNA, 25 bp, Homo sapien
attaggtccgccctcagcctttata

SEQ ID NO: 202262 - DNA, 25 bp, Homo sapien
tcagcctttatattccaattcttca

SEQ ID NO: 202263 - DNA, 25 bp, Homo sapien
aattcttcattccacactcctgact

SEQ ID NO: 202264 - DNA, 25 bp, Homo sapien
aatttttagcacttgccaccatcta

SEQ ID NO: 202265 - DNA, 25 bp, Homo sapien
acttgccaccatctatttgttcatt

SEQ ID NO: 202266 - DNA, 25 bp, Homo sapien
tttactgattacattcctcccatta

SEQ ID NO: 202267 - DNA, 25 bp, Homo sapien
ctcccattagtatataagctccgtg

SEQ ID NO: 202268 - DNA, 25 bp, Homo sapien
agctccgtgataatagaaactttgt

SEQ ID NO: 202269 - DNA, 25 bp, Homo sapien
gaaactttgtccactattgtatatt

SEQ ID NO: 202270 - DNA, 25 bp, Homo sapien
aactcctaagacactattggcgtat

SEQ ID NO: 202271 - DNA, 25 bp, Homo sapien
ggatttctgtttgttcttactgagg

SEQ ID NO: 202272 - DNA, 25 bp, Homo sapien
cttactgaggtttgcaaagcttcat

SEQ ID NO: 202273 - DNA, 25 bp, Homo sapien
aaagattctcgttgttctgtgtgca

SEQ ID NO: 202274 - DNA, 25 bp, Homo sapien
acatggaacggaacttgtgttttct

SEQ ID NO: 202275 - DNA, 25 bp, Homo sapien
ggctggagactgagtcttgaaccac

SEQ ID NO: 202276 - DNA, 25 bp, Homo sapien
ggagactgagtcttgaaccacagaa

SEQ ID NO: 202277 - DNA, 25 bp, Homo sapien
tgagtcttgaaccacagaagggaat

SEQ ID NO: 202278 - DNA, 25 bp, Homo sapien
aattatacaccactgtcattctctc

SEQ ID NO: 202279 - DNA, 25 bp, Homo sapien
attatacaccactgtcattctctct

SEQ ID NO: 202280 - DNA, 25 bp, Homo sapien
ttttaccctctcttgtcttgccttt

SEQ ID NO: 202281 - DNA, 25 bp, Homo sapien
ttctccctctccttgtattgctttc

SEQ ID NO: 202282 - DNA, 25 bp, Homo sapien
tccctctccttgtattgctttcctt

SEQ ID NO: 202283 - DNA, 25 bp, Homo sapien
tagatttctagcttgccaccgttca

SEQ ID NO: 202284 - DNA, 25 bp, Homo sapien
gatttctagcttgccaccgttcatt

SEQ ID NO: 202285 - DNA, 25 bp, Homo sapien
tctagcttgccaccgttcattctct

SEQ ID NO: 202286 - DNA, 25 bp, Homo sapien
ggtgaacatgccgtaactctgtgac

SEQ ID NO: 202287 - DNA, 25 bp, Homo sapien
gccgtaactctgtgactgcattgta

SEQ ID NO: 202288 - DNA, 25 bp, Homo sapien
agcagtcctgtgagtggcgcatgaa

SEQ ID NO: 202289 - DNA, 25 bp, Homo sapien
atgaacgctggagcttattccgccg

SEQ ID NO: 202290 - DNA, 25 bp, Homo sapien
gggagatacctttaccatgaactta

SEQ ID NO: 202291 - DNA, 25 bp, Homo sapien
atggcccataaggaattccagacca

SEQ ID NO: 202292 - DNA, 25 bp, Homo sapien
cagaccaatatttcttcctgcggtt

SEQ ID NO: 202293 - DNA, 25 bp, Homo sapien
tcttcctgcggtttattctatgttt

SEQ ID NO: 202294 - DNA, 25 bp, Homo sapien
gctgtgtcatactcataatctggaa

SEQ ID NO: 202295 - DNA, 25 bp, Homo sapien
atacttggtgttgcttgtcatggac

SEQ ID NO: 202296 - DNA, 25 bp, Homo sapien
gcttgtcatggacaccggtgaacat

SEQ ID NO: 202297 - DNA, 25 bp, Homo sapien
gatactctaacaatccattaacatg

SEQ ID NO: 202298 - DNA, 25 bp, Homo sapien
gaggatcatgtgttgtattcgaaaa

SEQ ID NO: 202299 - DNA, 25 bp, Homo sapien
agggatgcttaattggccctcgctt

SEQ ID NO: 202300 - DNA, 25 bp, Homo sapien
aattggccctcgcttgctatttttt

SEQ ID NO: 202301 - DNA, 25 bp, Homo sapien
tcttcacaataggaccgtctttggc

SEQ ID NO: 202302 - DNA, 25 bp, Homo sapien
ataggaccgtctttggcagcagcaa

SEQ ID NO: 202303 - DNA, 25 bp, Homo sapien
ggcagcagcaaaatgtatttcagta

SEQ ID NO: 202304 - DNA, 25 bp, Homo sapien
tttcagtatggcagtctttcctctc

SEQ ID NO: 202305 - DNA, 25 bp, Homo sapien
gtctttcctctcttacattattggt

SEQ ID NO: 202306 - DNA, 25 bp, Homo sapien
tatactaacaaaatgtttccccttg

SEQ ID NO: 202307 - DNA, 25 bp, Homo sapien
gtttccccttgtacaattatgctgt

SEQ ID NO: 202308 - DNA, 25 bp, Homo sapien
ttgaattttttcaaaccagtggctg

SEQ ID NO: 202309 - DNA, 25 bp, Homo sapien
gctgatacctgccttgtacttagta

SEQ ID NO: 202310 - DNA, 25 bp, Homo sapien
gtaccttaataccaataacctaatg

SEQ ID NO: 202311 - DNA, 25 bp, Homo sapien
aggcgagtaccatttgcacaatcac

SEQ ID NO: 202312 - DNA, 25 bp, Homo sapien
gttttacttatgagcagatacagat

SEQ ID NO: 202313 - DNA, 25 bp, Homo sapien
gatacagatatatccaaacccttac

SEQ ID NO: 202314 - DNA, 25 bp, Homo sapien
ttacctactaggtatcctgctaggg

SEQ ID NO: 202315 - DNA, 25 bp, Homo sapien
atcctgctagggttttcaattccaa

SEQ ID NO: 202316 - DNA, 25 bp, Homo sapien
gggttttcaattccaattcttgtat

SEQ ID NO: 202317 - DNA, 25 bp, Homo sapien
agtaatcagtcaatccaatatcccc

SEQ ID NO: 202318 - DNA, 25 bp, Homo sapien
ctgttttaagacgtctacgttgaat

SEQ ID NO: 202319 - DNA, 25 bp, Homo sapien
aggagactgtggacctcatggttga

SEQ ID NO: 202320 - DNA, 25 bp, Homo sapien
ggagactgtggacctcatggttgag

SEQ ID NO: 202321 - DNA, 25 bp, Homo sapien
gagactgtggacctcatggttgagc

SEQ ID NO: 202322 - DNA, 25 bp, Homo sapien
agactgtggacctcatggttgagca

SEQ ID NO: 202323 - DNA, 25 bp, Homo sapien
gactgtggacctcatggttgagcac

SEQ ID NO: 202324 - DNA, 25 bp, Homo sapien
actgtggacctcatggttgagcaca

SEQ ID NO: 202325 - DNA, 25 bp, Homo sapien
ctgtggacctcatggttgagcacac

SEQ ID NO: 202326 - DNA, 25 bp, Homo sapien
tgtggacctcatggttgagcacacg

SEQ ID NO: 202327 - DNA, 25 bp, Homo sapien
accccgatttggagaaacgacgcat

SEQ ID NO: 202328 - DNA, 25 bp, Homo sapien
ggagaaacgacgcatccactactgc

SEQ ID NO: 202329 - DNA, 25 bp, Homo sapien
atccactactgcgattaccctggtt

SEQ ID NO: 202330 - DNA, 25 bp, Homo sapien
ctgcgattaccctggttgcacaaaa

SEQ ID NO: 202331 - DNA, 25 bp, Homo sapien
aaagtttataccaagtcttctcatt

SEQ ID NO: 202332 - DNA, 25 bp, Homo sapien
gtcttctcatttaaaagctcacctg

SEQ ID NO: 202333 - DNA, 25 bp, Homo sapien
aggttcgcgcgatcggatgagctga

SEQ ID NO: 202334 - DNA, 25 bp, Homo sapien
taccggaagcacacaggcgccaagc

SEQ ID NO: 202335 - DNA, 25 bp, Homo sapien
ggtgtgcaaccgcagcttctcgcgc

SEQ ID NO: 202336 - DNA, 25 bp, Homo sapien
ccctgcatatgaagaggcaccagaa

SEQ ID NO: 202337 - DNA, 25 bp, Homo sapien
cagaactgagcactgcccgtgtgac

SEQ ID NO: 202338 - DNA, 25 bp, Homo sapien
ttcctctcacggttttttgcagaag

SEQ ID NO: 202339 - DNA, 25 bp, Homo sapien
agaactgctgccgtcatgagctatg

SEQ ID NO: 202340 - DNA, 25 bp, Homo sapien
cgtcatgagctatgccgacagtcag

SEQ ID NO: 202341 - DNA, 25 bp, Homo sapien
agtcagcagctgatccccgacagaa

SEQ ID NO: 202342 - DNA, 25 bp, Homo sapien
tgatccccgacagaaacgcagcaga

SEQ ID NO: 202343 - DNA, 25 bp, Homo sapien
aacgcagcagatgcagacgctcctg

SEQ ID NO: 202344 - DNA, 25 bp, Homo sapien
gacgctcctgatgaaatcatccctg

SEQ ID NO: 202345 - DNA, 25 bp, Homo sapien
acagccttcagctccgacaaagaca

SEQ ID NO: 202346 - DNA, 25 bp, Homo sapien
gacaaagacacatcaccttgcaaat

SEQ ID NO: 202347 - DNA, 25 bp, Homo sapien
aaatgacactttgccgtctggtttc

SEQ ID NO: 202348 - DNA, 25 bp, Homo sapien
ctggtttctgtgttttgttgtaaca

SEQ ID NO: 202349 - DNA, 25 bp, Homo sapien
tactcactacctgttctttctgggt

SEQ ID NO: 202350 - DNA, 25 bp, Homo sapien
cactacctgttctttctgggtctgt

SEQ ID NO: 202351 - DNA, 25 bp, Homo sapien
ttctgggtctgtaccgggcactcta

SEQ ID NO: 202352 - DNA, 25 bp, Homo sapien
cgggcactctacctggctaactgga

SEQ ID NO: 202353 - DNA, 25 bp, Homo sapien
tggctaactggatcaggcggtacca

SEQ ID NO: 202354 - DNA, 25 bp, Homo sapien
ggcggtaccagactgagaatttcta

SEQ ID NO: 202355 - DNA, 25 bp, Homo sapien
atttctatgaccaaattgcagtcgt

SEQ ID NO: 202356 - DNA, 25 bp, Homo sapien
attgcagtcgtgtctggagtagtac

SEQ ID NO: 202357 - DNA, 25 bp, Homo sapien
ctggagtagtacaaaccatcttcta

SEQ ID NO: 202358 - DNA, 25 bp, Homo sapien
caaaccatcttctactgtgacttct

SEQ ID NO: 202359 - DNA, 25 bp, Homo sapien
cttcttctacttgtatgtgaccaaa

SEQ ID NO: 202360 - DNA, 25 bp, Homo sapien
tgtgttttcctggagggaccaagct

SEQ ID NO: 202361 - DNA, 25 bp, Homo sapien
gtggtggtgaccatcaacaagaaga

SEQ ID NO: 202362 - DNA, 25 bp, Homo sapien
aacaagaagaggaacctggtggtgt

SEQ ID NO: 202363 - DNA, 25 bp, Homo sapien
tgtctgtggacgacggtggcacctt

SEQ ID NO: 202364 - DNA, 25 bp, Homo sapien
gacggtggcacctttgaggttgttt

SEQ ID NO: 202365 - DNA, 25 bp, Homo sapien
aggttgttttgcaccgagtgtggaa

SEQ ID NO: 202366 - DNA, 25 bp, Homo sapien
gacttcctgggcttctatgtgctgg

SEQ ID NO: 202367 - DNA, 25 bp, Homo sapien
ggcttctatgtgctggacagtcatc

SEQ ID NO: 202368 - DNA, 25 bp, Homo sapien
gctggacagtcatcggatgtcagcc

SEQ ID NO: 202369 - DNA, 25 bp, Homo sapien
ccccatcggttttgaagtgtctgac

SEQ ID NO: 202370 - DNA, 25 bp, Homo sapien
ttgaagtgtctgacatccacccagg

SEQ ID NO: 202371 - DNA, 25 bp, Homo sapien
ttttctcagagtcttcatctacaag

SEQ ID NO: 202372 - DNA, 25 bp, Homo sapien
ttctcagagtcttcatctacaaggg

SEQ ID NO: 202373 - DNA, 25 bp, Homo sapien
tcagagtcttcatctacaaggggaa

SEQ ID NO: 202374 - DNA, 25 bp, Homo sapien
aattgaattaactgctctctctcgt

SEQ ID NO: 202375 - DNA, 25 bp, Homo sapien
attgaattaactgctctctctcgtt

SEQ ID NO: 202376 - DNA, 25 bp, Homo sapien
ttgaattaactgctctctctcgttc

SEQ ID NO: 202377 - DNA, 25 bp, Homo sapien
gaattaactgctctctctcgttcct

SEQ ID NO: 202378 - DNA, 25 bp, Homo sapien
tctcgttccttccagctcagaaatg

SEQ ID NO: 202379 - DNA, 25 bp, Homo sapien
tcgttccttccagctcagaaatgtt

SEQ ID NO: 202380 - DNA, 25 bp, Homo sapien
gttccttccagctcagaaatgttta

SEQ ID NO: 202381 - DNA, 25 bp, Homo sapien
ttccttccagctcagaaatgtttac

SEQ ID NO: 202382 - DNA, 25 bp, Homo sapien
atcggtaagaaatgcacctagcttt

SEQ ID NO: 202383 - DNA, 25 bp, Homo sapien
aaatgcacctagcttttcatattgt

SEQ ID NO: 202384 - DNA, 25 bp, Homo sapien
gcttttcatattgtgtttattctcc

SEQ ID NO: 202385 - DNA, 25 bp, Homo sapien
tgtttattctccaggctattgcttg

SEQ ID NO: 202386 - DNA, 25 bp, Homo sapien
attctccaggctattgcttgcttca

SEQ ID NO: 202387 - DNA, 25 bp, Homo sapien
aggctattgcttgcttcagctgcag

SEQ ID NO: 202388 - DNA, 25 bp, Homo sapien
gggtcgataggcttttgtcgtaata

SEQ ID NO: 202389 - DNA, 25 bp, Homo sapien
ggcttttgtcgtaataggcagagat

SEQ ID NO: 202390 - DNA, 25 bp, Homo sapien
agatgacttgcatcccagctttcca

SEQ ID NO: 202391 - DNA, 25 bp, Homo sapien
gctttccaccaaccaaattcaaaca

SEQ ID NO: 202392 - DNA, 25 bp, Homo sapien
aacattcactgcttatttgttacag

SEQ ID NO: 202393 - DNA, 25 bp, Homo sapien
ggttgaaactgttatcacttatata

SEQ ID NO: 202394 - DNA, 25 bp, Homo sapien
aaaccctggttgctgtatttgttca

SEQ ID NO: 202395 - DNA, 25 bp, Homo sapien
ctggttgctgtatttgttcagtgac

SEQ ID NO: 202396 - DNA, 25 bp, Homo sapien
tattgcctctgaaatgcctcttctt

SEQ ID NO: 202397 - DNA, 25 bp, Homo sapien
agattatttgcacgaactggactgt

SEQ ID NO: 202398 - DNA, 25 bp, Homo sapien
aactggactgtgtgcaacgcttttt

SEQ ID NO: 202399 - DNA, 25 bp, Homo sapien
ggagaatgatgtccccgttgtatgt

SEQ ID NO: 202400 - DNA, 25 bp, Homo sapien
gatgtccccgttgtatgtatgagtg

SEQ ID NO: 202401 - DNA, 25 bp, Homo sapien
ttgtatgtatgagtggcttctggga

SEQ ID NO: 202402 - DNA, 25 bp, Homo sapien
tgtcactttttaaaccactgtatag

SEQ ID NO: 202403 - DNA, 25 bp, Homo sapien
ccactgtatagaaggtttttgtagc

SEQ ID NO: 202404 - DNA, 25 bp, Homo sapien
cgtgctgggacctgcaccctggctg

SEQ ID NO: 202405 - DNA, 25 bp, Homo sapien
tgaccaggagcaggccagttctggc

SEQ ID NO: 202406 - DNA, 25 bp, Homo sapien
attcgaggagatggtagtggcttca

SEQ ID NO: 202407 - DNA, 25 bp, Homo sapien
ggagatggtagtggcttcagcctct

SEQ ID NO: 202408 - DNA, 25 bp, Homo sapien
gtcaggatgaagccccatgccactc

SEQ ID NO: 202409 - DNA, 25 bp, Homo sapien
atgccactccacactgctgggacat

SEQ ID NO: 202410 - DNA, 25 bp, Homo sapien
tgggacatggcagggacttcacagt

SEQ ID NO: 202411 - DNA, 25 bp, Homo sapien
gggtttttagctggctcacagggct

SEQ ID NO: 202412 - DNA, 25 bp, Homo sapien
tagctggctcacagggctccctcag

SEQ ID NO: 202413 - DNA, 25 bp, Homo sapien
agcctcccagttccaatgggctgtc

SEQ ID NO: 202414 - DNA, 25 bp, Homo sapien
cccagttccaatgggctgtctcagg

SEQ ID NO: 202415 - DNA, 25 bp, Homo sapien
gctacttttctggtaatttctcact

SEQ ID NO: 202416 - DNA, 25 bp, Homo sapien
ctggtaatttctcactatcagtgta

SEQ ID NO: 202417 - DNA, 25 bp, Homo sapien
gtgtaaagagcagcgtgatgcccat

SEQ ID NO: 202418 - DNA, 25 bp, Homo sapien
gcgtgatgcccatagatttgagaaa

SEQ ID NO: 202419 - DNA, 25 bp, Homo sapien
cattattaagcagttcaagctgagc

SEQ ID NO: 202420 - DNA, 25 bp, Homo sapien
tggctgcctctttccagagtatgga

SEQ ID NO: 202421 - DNA, 25 bp, Homo sapien
agtcaggaactctaacttcgctgct

SEQ ID NO: 202422 - DNA, 25 bp, Homo sapien
tgacatctttacatccaacacttat

SEQ ID NO: 202423 - DNA, 25 bp, Homo sapien
gatggttgtagtgtctgatccgtcc

SEQ ID NO: 202424 - DNA, 25 bp, Homo sapien
gtagtgtctgatccgtccattcctt

SEQ ID NO: 202425 - DNA, 25 bp, Homo sapien
agctactctgatcaacatccgcaat

SEQ ID NO: 202426 - DNA, 25 bp, Homo sapien
gggttcatgatcctaaaacatcact

SEQ ID NO: 202427 - DNA, 25 bp, Homo sapien
atcactttaatcctgtcttcccatt

SEQ ID NO: 202428 - DNA, 25 bp, Homo sapien
aaattctggcattaaaggcactcta

SEQ ID NO: 202429 - DNA, 25 bp, Homo sapien
gcactctacacttaggcctcaaatg

SEQ ID NO: 202430 - DNA, 25 bp, Homo sapien
aaatgcctttccttacttcctgtat

SEQ ID NO: 202431 - DNA, 25 bp, Homo sapien
gtattatctcctccattcagatcag

SEQ ID NO: 202432 - DNA, 25 bp, Homo sapien
agatcagaccgaactactcagtcac

SEQ ID NO: 202433 - DNA, 25 bp, Homo sapien
acttgtcagactcattcttctcttg

SEQ ID NO: 202434 - DNA, 25 bp, Homo sapien
ttctcttgccctttttctcaaggaa

SEQ ID NO: 202435 - DNA, 25 bp, Homo sapien
gaatccctctcttgacctgagaaat

SEQ ID NO: 202436 - DNA, 25 bp, Homo sapien
gaaattctacctctcacttaaaagt

SEQ ID NO: 202437 - DNA, 25 bp, Homo sapien
aaaccgggaggagctgtcataaaca

SEQ ID NO: 202438 - DNA, 25 bp, Homo sapien
gataccaagcggtgtctggagatga

SEQ ID NO: 202439 - DNA, 25 bp, Homo sapien
aggatcttttgggtagccacgtgct

SEQ ID NO: 202440 - DNA, 25 bp, Homo sapien
acgtgcttgtgctccagacctgtag

SEQ ID NO: 202441 - DNA, 25 bp, Homo sapien
tccagacctgtagcacgcaagtgtg

SEQ ID NO: 202442 - DNA, 25 bp, Homo sapien
atccagcacactgtcagagactggg

SEQ ID NO: 202443 - DNA, 25 bp, Homo sapien
caacagccagtgatcctcagatggt

SEQ ID NO: 202444 - DNA, 25 bp, Homo sapien
ggtgctggatctgggtcatcaattc

SEQ ID NO: 202445 - DNA, 25 bp, Homo sapien
gggtcatcaattcttgcaagtggaa

SEQ ID NO: 202446 - DNA, 25 bp, Homo sapien
agtggaatggcttctactcctaaca

SEQ ID NO: 202447 - DNA, 25 bp, Homo sapien
ctcccagcttctttctcaatgagaa

SEQ ID NO: 202448 - DNA, 25 bp, Homo sapien
aaaatcctatctaatcctactctcc

SEQ ID NO: 202449 - DNA, 25 bp, Homo sapien
atcctactctccactacacagaggt

SEQ ID NO: 202450 - DNA, 25 bp, Homo sapien
ttttggcatattattctccaggtgt

SEQ ID NO: 202451 - DNA, 25 bp, Homo sapien
ctccaggtgtttgcttatgcactta

SEQ ID NO: 202452 - DNA, 25 bp, Homo sapien
tgtttcataacctgcctcctttgct

SEQ ID NO: 202453 - DNA, 25 bp, Homo sapien
ctttgcttggccctttattgagata

SEQ ID NO: 202454 - DNA, 25 bp, Homo sapien
taagttttcctgtcaagaaagcaga

SEQ ID NO: 202455 - DNA, 25 bp, Homo sapien
accatctcatttctaacagctgtgt

SEQ ID NO: 202456 - DNA, 25 bp, Homo sapien
acagctgtgttatattccatagtat

SEQ ID NO: 202457 - DNA, 25 bp, Homo sapien
gtatgcattactcaacaaactgttg

SEQ ID NO: 202458 - DNA, 25 bp, Homo sapien
aaactgttgtgctattggatactta

SEQ ID NO: 202459 - DNA, 25 bp, Homo sapien
agatccaaccactgaggcccacaag

SEQ ID NO: 202460 - DNA, 25 bp, Homo sapien
agagggccatcagaatcatcctttc

SEQ ID NO: 202461 - DNA, 25 bp, Homo sapien
atcagaatcatcctttccttcttct

SEQ ID NO: 202462 - DNA, 25 bp, Homo sapien
attgcatcatttggtaatttcctac

SEQ ID NO: 202463 - DNA, 25 bp, Homo sapien
taatttcctaccaaaaaccaagatg

SEQ ID NO: 202464 - DNA, 25 bp, Homo sapien
gatggctaagatgattggcgaagta

SEQ ID NO: 202465 - DNA, 25 bp, Homo sapien
tgacaatgttttatcctgctggcca

SEQ ID NO: 202466 - DNA, 25 bp, Homo sapien
cagacatttgtagtgatgctccggt

SEQ ID NO: 202467 - DNA, 25 bp, Homo sapien
gatgctccggtgtgagtctggtcat

SEQ ID NO: 202468 - DNA, 25 bp, Homo sapien
gagtctggtcatctgaagcctggat

SEQ ID NO: 202469 - DNA, 25 bp, Homo sapien
aagcctggatccaagggacccattt

SEQ ID NO: 202470 - DNA, 25 bp, Homo sapien
ggctctggtattaattgcccaggct

SEQ ID NO: 202471 - DNA, 25 bp, Homo sapien
attgcccaggctaagacatttacag

SEQ ID NO: 202472 - DNA, 25 bp, Homo sapien
gacatttacagtgagatgcatcttt

SEQ ID NO: 202473 - DNA, 25 bp, Homo sapien
gtgagatgcatctttatggtaatga

SEQ ID NO: 202474 - DNA, 25 bp, Homo sapien
atttgcaaagcatcatattattgag

SEQ ID NO: 202475 - DNA, 25 bp, Homo sapien
gagataaatattccctagatgagag

SEQ ID NO: 202476 - DNA, 25 bp, Homo sapien
tccctagatgagagtgttagaacac

SEQ ID NO: 202477 - DNA, 25 bp, Homo sapien
gttagaacacatgtagctactggat

SEQ ID NO: 202478 - DNA, 25 bp, Homo sapien
atgtagctactggattaatgaatat

SEQ ID NO: 202479 - DNA, 25 bp, Homo sapien
acttcatagacattgaggtcataaa

SEQ ID NO: 202480 - DNA, 25 bp, Homo sapien
gtcataaatgcattgttgtgctctg

SEQ ID NO: 202481 - DNA, 25 bp, Homo sapien
gccaaggcccgatgtggtgtgcaga

SEQ ID NO: 202482 - DNA, 25 bp, Homo sapien
aaggcccgatgtggtgtgcagaggt

SEQ ID NO: 202483 - DNA, 25 bp, Homo sapien
agaatcttggaccaggtctctcttc

SEQ ID NO: 202484 - DNA, 25 bp, Homo sapien
ccctgccccgttggtgtgattattt

SEQ ID NO: 202485 - DNA, 25 bp, Homo sapien
ctgccccgttggtgtgattatttca

SEQ ID NO: 202486 - DNA, 25 bp, Homo sapien
tgccccgttggtgtgattatttcat

SEQ ID NO: 202487 - DNA, 25 bp, Homo sapien
gccccgttggtgtgattatttcatc

SEQ ID NO: 202488 - DNA, 25 bp, Homo sapien
cccgttggtgtgattatttcatctg

SEQ ID NO: 202489 - DNA, 25 bp, Homo sapien
gttggtgtgattatttcatctgtta

SEQ ID NO: 202490 - DNA, 25 bp, Homo sapien
gtgtgattatttcatctgttagatg

SEQ ID NO: 202491 - DNA, 25 bp, Homo sapien
gtgcgcgccccctctgcaatgtatg

SEQ ID NO: 202492 - DNA, 25 bp, Homo sapien
gttgtctaacgggttttctcactat

SEQ ID NO: 202493 - DNA, 25 bp, Homo sapien
gggttttctcactatagtttatcaa

SEQ ID NO: 202494 - DNA, 25 bp, Homo sapien
gtttatcaagtgagtcccacgtggg

SEQ ID NO: 202495 - DNA, 25 bp, Homo sapien
accttccagactacgctcattatta

SEQ ID NO: 202496 - DNA, 25 bp, Homo sapien
attattacaccattgggcccggcat

SEQ ID NO: 202497 - DNA, 25 bp, Homo sapien
attgggcccggcatgttcccgtcat

SEQ ID NO: 202498 - DNA, 25 bp, Homo sapien
gtcatctcagatccctagctggaag

SEQ ID NO: 202499 - DNA, 25 bp, Homo sapien
aggactgggctaagcctgggcccta

SEQ ID NO: 202500 - DNA, 25 bp, Homo sapien
tggtgaacaccctgcagcgccgcaa

SEQ ID NO: 202501 - DNA, 25 bp, Homo sapien
cctgcagcgccgcaaagagaagcga

SEQ ID NO: 202502 - DNA, 25 bp, Homo sapien
gagaagcgagaaccggaccccaacg

SEQ ID NO: 202503 - DNA, 25 bp, Homo sapien
gtgaagtacaaaacactgagttaca

SEQ ID NO: 202504 - DNA, 25 bp, Homo sapien
aacactgagttacaggctgtgggaa

SEQ ID NO: 202505 - DNA, 25 bp, Homo sapien
aaggcagcaccaatggtggcacctt

SEQ ID NO: 202506 - DNA, 25 bp, Homo sapien
agcaccaatggtggcaccttctaat

SEQ ID NO: 202507 - DNA, 25 bp, Homo sapien
aatggtggcaccttctaatactggt

SEQ ID NO: 202508 - DNA, 25 bp, Homo sapien
ggtggcaccttctaatactggttgt

SEQ ID NO: 202509 - DNA, 25 bp, Homo sapien
gcaccttctaatactggttgttcta

SEQ ID NO: 202510 - DNA, 25 bp, Homo sapien
taaaccaagcccctcatttcaatgt

SEQ ID NO: 202511 - DNA, 25 bp, Homo sapien
gtacaaaagaattactctgatcgat

SEQ ID NO: 202512 - DNA, 25 bp, Homo sapien
gaattactctgatcgatattaaatc

SEQ ID NO: 202513 - DNA, 25 bp, Homo sapien
aaagcaaatactactctatgttggg

SEQ ID NO: 202514 - DNA, 25 bp, Homo sapien
ggcggaggatgctttgttcttttct

SEQ ID NO: 202515 - DNA, 25 bp, Homo sapien
gcggaggatgctttgttcttttctg

SEQ ID NO: 202516 - DNA, 25 bp, Homo sapien
aggatgctttgttcttttctggttt

SEQ ID NO: 202517 - DNA, 25 bp, Homo sapien
ttctggttttggttcctctttcgcg

SEQ ID NO: 202518 - DNA, 25 bp, Homo sapien
ttcttcctctccagagatgccaggg

SEQ ID NO: 202519 - DNA, 25 bp, Homo sapien
gggggcgtgtatgctctgccccttc

SEQ ID NO: 202520 - DNA, 25 bp, Homo sapien
ggctctttaggctcaggagaagcat

SEQ ID NO: 202521 - DNA, 25 bp, Homo sapien
tgccgcccgcattataaacacagga

SEQ ID NO: 202522 - DNA, 25 bp, Homo sapien
gccgcccgcattataaacacaggag

SEQ ID NO: 202523 - DNA, 25 bp, Homo sapien
cgcccgcattataaacacaggagaa

SEQ ID NO: 202524 - DNA, 25 bp, Homo sapien
gcccgcattataaacacaggagaat

SEQ ID NO: 202525 - DNA, 25 bp, Homo sapien
ctagcaactgatgttatctatagat

SEQ ID NO: 202526 - DNA, 25 bp, Homo sapien
acattgtgaaacttcccggtctgtt

SEQ ID NO: 202527 - DNA, 25 bp, Homo sapien
attgtgaaacttcccggtctgttct

SEQ ID NO: 202528 - DNA, 25 bp, Homo sapien
gtgaaacttcccggtctgttctgtt

SEQ ID NO: 202529 - DNA, 25 bp, Homo sapien
ttctgttccactctgaccatcggtg

SEQ ID NO: 202530 - DNA, 25 bp, Homo sapien
tgttccactctgaccatcggtgcat

SEQ ID NO: 202531 - DNA, 25 bp, Homo sapien
tccactctgaccatcggtgcatgca

SEQ ID NO: 202532 - DNA, 25 bp, Homo sapien
cggctcttgagacagcagtcttgct

SEQ ID NO: 202533 - DNA, 25 bp, Homo sapien
gagacagcagtcttgctgatgctcc

SEQ ID NO: 202534 - DNA, 25 bp, Homo sapien
acagcagtcttgctgatgctcctgg

SEQ ID NO: 202535 - DNA, 25 bp, Homo sapien
tcctggccgaataaaccgcttcctt

SEQ ID NO: 202536 - DNA, 25 bp, Homo sapien
caccatctttctcatggcatcactg

SEQ ID NO: 202537 - DNA, 25 bp, Homo sapien
atggcatcactgaccaagcagatac

SEQ ID NO: 202538 - DNA, 25 bp, Homo sapien
agatacaacatcatagcactggtca

SEQ ID NO: 202539 - DNA, 25 bp, Homo sapien
gcactggtcactgcaatccaagcat

SEQ ID NO: 202540 - DNA, 25 bp, Homo sapien
atgaaagcgcgcttcactgccctga

SEQ ID NO: 202541 - DNA, 25 bp, Homo sapien
ctgaggtcccttgccgtcttattta

SEQ ID NO: 202542 - DNA, 25 bp, Homo sapien
tgtttacctcttactttctaaccat

SEQ ID NO: 202543 - DNA, 25 bp, Homo sapien
ttctaaccatactcatcaccattat

SEQ ID NO: 202544 - DNA, 25 bp, Homo sapien
gggaagcttttgtctatgctttcat

SEQ ID NO: 202545 - DNA, 25 bp, Homo sapien
aatgcattccacttcactgatgctg

SEQ ID NO: 202546 - DNA, 25 bp, Homo sapien
tgctgagcagccctacgttgaaaag

SEQ ID NO: 202547 - DNA, 25 bp, Homo sapien
ccagcctgtggaggttggtcaggtg

SEQ ID NO: 202548 - DNA, 25 bp, Homo sapien
gtggtcacccatcttcttgataagc

SEQ ID NO: 202549 - DNA, 25 bp, Homo sapien
ttcttgataagcttcacttcctcat

SEQ ID NO: 202550 - DNA, 25 bp, Homo sapien
tcctcatctaggaagtgagtctcca

SEQ ID NO: 202551 - DNA, 25 bp, Homo sapien
gggcagaacccagggcatgaagatc

SEQ ID NO: 202552 - DNA, 25 bp, Homo sapien
agggcctggttcagctttttctcca

SEQ ID NO: 202553 - DNA, 25 bp, Homo sapien
tttctccagggccatggcagctttc

SEQ ID NO: 202554 - DNA, 25 bp, Homo sapien
ctccagggccatggcagctttcatg

SEQ ID NO: 202555 - DNA, 25 bp, Homo sapien
agggccatggcagctttcatggcgt

SEQ ID NO: 202556 - DNA, 25 bp, Homo sapien
ccatggcagctttcatggcgtctgg

SEQ ID NO: 202557 - DNA, 25 bp, Homo sapien
gctttcatggcgtctggggttttac

SEQ ID NO: 202558 - DNA, 25 bp, Homo sapien
gtgggctcgctgataggcatgactt

SEQ ID NO: 202559 - DNA, 25 bp, Homo sapien
ggcatgactttccttaatgtttaaa

SEQ ID NO: 202560 - DNA, 25 bp, Homo sapien
atgaagactttcctacttttctcgg

SEQ ID NO: 202561 - DNA, 25 bp, Homo sapien
tcctacttttctcggtgttcttata

SEQ ID NO: 202562 - DNA, 25 bp, Homo sapien
gtgttcttatattacctactgttag

SEQ ID NO: 202563 - DNA, 25 bp, Homo sapien
ctgttagtatttattgtttaccact

SEQ ID NO: 202564 - DNA, 25 bp, Homo sapien
gtttaccactatgttaatgcaggga

SEQ ID NO: 202565 - DNA, 25 bp, Homo sapien
cagggaaaagttgcacgtgtattat

SEQ ID NO: 202566 - DNA, 25 bp, Homo sapien
gaaatcataccatgctactttgtac

SEQ ID NO: 202567 - DNA, 25 bp, Homo sapien
ttttattcctgctttcgtgttactt

SEQ ID NO: 202568 - DNA, 25 bp, Homo sapien
tcctgctttcgtgttacttttaata

SEQ ID NO: 202569 - DNA, 25 bp, Homo sapien
agtggttatgagaccagacggaaaa

SEQ ID NO: 202570 - DNA, 25 bp, Homo sapien
gatacacaaaatcagaatattactt

SEQ ID NO: 202571 - DNA, 25 bp, Homo sapien
gtgaaggaacgaccaacaaaatgaa

SEQ ID NO: 202572 - DNA, 25 bp, Homo sapien
acgaccaacaaaatgaagagcccag

SEQ ID NO: 202573 - DNA, 25 bp, Homo sapien
atgaagagcccagaaactaaacaaa

SEQ ID NO: 202574 - DNA, 25 bp, Homo sapien
gaaagctttctccactgagactatc

SEQ ID NO: 202575 - DNA, 25 bp, Homo sapien
aagctttctccactgagactatcag

SEQ ID NO: 202576 - DNA, 25 bp, Homo sapien
gctttctccactgagactatcagta

SEQ ID NO: 202577 - DNA, 25 bp, Homo sapien
tctccactgagactatcagtatcaa

SEQ ID NO: 202578 - DNA, 25 bp, Homo sapien
caggaaccagattttattgatgata

SEQ ID NO: 202579 - DNA, 25 bp, Homo sapien
aaaactcctattagtaatgaagtag

SEQ ID NO: 202580 - DNA, 25 bp, Homo sapien
actataattacttggctgttggaga

SEQ ID NO: 202581 - DNA, 25 bp, Homo sapien
acttggctgttggagatttgtactt

SEQ ID NO: 202582 - DNA, 25 bp, Homo sapien
gctgttggagatttgtacttgagta

SEQ ID NO: 202583 - DNA, 25 bp, Homo sapien
aatgtacaccagtttttgtatttgt

SEQ ID NO: 202584 - DNA, 25 bp, Homo sapien
caccagtttttgtatttgtgaactc

SEQ ID NO: 202585 - DNA, 25 bp, Homo sapien
tgtatttgtgaactcatctgtggga

SEQ ID NO: 202586 - DNA, 25 bp, Homo sapien
tacttatttggaatttacagagcac

SEQ ID NO: 202587 - DNA, 25 bp, Homo sapien
ggaatttacagagcacacctaagca

SEQ ID NO: 202588 - DNA, 25 bp, Homo sapien
ttacagagcacacctaagcaattag

SEQ ID NO: 202589 - DNA, 25 bp, Homo sapien
gagcacacctaagcaattaggatat

SEQ ID NO: 202590 - DNA, 25 bp, Homo sapien
ggatataacaaaactacttaaccat

SEQ ID NO: 202591 - DNA, 25 bp, Homo sapien
ctctgtgtgtgtccgtatcttgttc

SEQ ID NO: 202592 - DNA, 25 bp, Homo sapien
gtatcttgttcggtgtcctcgaggt

SEQ ID NO: 202593 - DNA, 25 bp, Homo sapien
ggtgtcctcgaggttgagcttcact

SEQ ID NO: 202594 - DNA, 25 bp, Homo sapien
gagcttcactccactgcggcagagg

SEQ ID NO: 202595 - DNA, 25 bp, Homo sapien
agaggcagcgtgcacactcggattt

SEQ ID NO: 202596 - DNA, 25 bp, Homo sapien
cactcggatttgctacgtttctata

SEQ ID NO: 202597 - DNA, 25 bp, Homo sapien
atttgctacgtttctatatatcttg

SEQ ID NO: 202598 - DNA, 25 bp, Homo sapien
gagtagtttgccatgagataacaca

SEQ ID NO: 202599 - DNA, 25 bp, Homo sapien
taaacagtagacacccagaaatcgt

SEQ ID NO: 202600 - DNA, 25 bp, Homo sapien
gaaatcgtgacttctgtgttctctc

SEQ ID NO: 202601 - DNA, 25 bp, Homo sapien
ttctgtgttctctccatttgagtat

SEQ ID NO: 202602 - DNA, 25 bp, Homo sapien
tcctgtttacccttcaagtttcaag

SEQ ID NO: 202603 - DNA, 25 bp, Homo sapien
gttcatgtcactgtctcagagaggt

SEQ ID NO: 202604 - DNA, 25 bp, Homo sapien
tcagagaggttttcctgtgctcgcc

SEQ ID NO: 202605 - DNA, 25 bp, Homo sapien
aggaagccttgctcttttccatcat

SEQ ID NO: 202606 - DNA, 25 bp, Homo sapien
catcatgcctctaatcacagcttat

SEQ ID NO: 202607 - DNA, 25 bp, Homo sapien
tatttctgtgtctacagtcttgccc

SEQ ID NO: 202608 - DNA, 25 bp, Homo sapien
tgccagactgtaagccccatgtggg

SEQ ID NO: 202609 - DNA, 25 bp, Homo sapien
ggcaggcgctcatgattgtttctga

SEQ ID NO: 202610 - DNA, 25 bp, Homo sapien
tttctgattgtttcacgcatgctgc

SEQ ID NO: 202611 - DNA, 25 bp, Homo sapien
gcatgctgctaacccagagcctggg

SEQ ID NO: 202612 - DNA, 25 bp, Homo sapien
cctgggcccaaagctagttagtact

SEQ ID NO: 202613 - DNA, 25 bp, Homo sapien
aaagagtttcctcggagcattcaac

SEQ ID NO: 202614 - DNA, 25 bp, Homo sapien
cggagcattcaaccgggcttctttg

SEQ ID NO: 202615 - DNA, 25 bp, Homo sapien
cttctttgtagggtatgtgtactgc

SEQ ID NO: 202616 - DNA, 25 bp, Homo sapien
tggagctacggaagaccacgtccta

SEQ ID NO: 202617 - DNA, 25 bp, Homo sapien
acgtcctagaagtgctgtgtccctg

SEQ ID NO: 202618 - DNA, 25 bp, Homo sapien
gaggcacacctatgtgtgttatctc

SEQ ID NO: 202619 - DNA, 25 bp, Homo sapien
gtgttatctctctggcatactttcc

SEQ ID NO: 202620 - DNA, 25 bp, Homo sapien
ggcatactttccaacaaggattctt

SEQ ID NO: 202621 - DNA, 25 bp, Homo sapien
caaggattcttttctagtctataca

SEQ ID NO: 202622 - DNA, 25 bp, Homo sapien
aactattctagagaggcttgtgcct

SEQ ID NO: 202623 - DNA, 25 bp, Homo sapien
ggcttgtgcctacgaagattactta

SEQ ID NO: 202624 - DNA, 25 bp, Homo sapien
aatccagtagcataacttatatctg

SEQ ID NO: 202625 - DNA, 25 bp, Homo sapien
gaactacagtttagcattcctcagg

SEQ ID NO: 202626 - DNA, 25 bp, Homo sapien
gcattcctcaggctactggtgaaaa

SEQ ID NO: 202627 - DNA, 25 bp, Homo sapien
ggtgaaaacacaaccgttatggtct

SEQ ID NO: 202628 - DNA, 25 bp, Homo sapien
aaccgttatggtctttgtctccatt

SEQ ID NO: 202629 - DNA, 25 bp, Homo sapien
gtttgttttattcaagactcattct

SEQ ID NO: 202630 - DNA, 25 bp, Homo sapien
aagactcattctacttgcaagcaaa

SEQ ID NO: 202631 - DNA, 25 bp, Homo sapien
tgtagtcctatgaacagtctcctcg

SEQ ID NO: 202632 - DNA, 25 bp, Homo sapien
tatgaacagtctcctcgtgtatctc

SEQ ID NO: 202633 - DNA, 25 bp, Homo sapien
gtatctccagagactgcatgtgcaa

SEQ ID NO: 202634 - DNA, 25 bp, Homo sapien
tgcttcatttgccacatagttgttg

SEQ ID NO: 202635 - DNA, 25 bp, Homo sapien
acagaaggccaaggcccgatgtggt

SEQ ID NO: 202636 - DNA, 25 bp, Homo sapien
aacagaatcttggaccaggtctctc

SEQ ID NO: 202637 - DNA, 25 bp, Homo sapien
tgccccgttggtgtgattatttcat

SEQ ID NO: 202638 - DNA, 25 bp, Homo sapien
catctgttagatgtggctgttttgc

SEQ ID NO: 202639 - DNA, 25 bp, Homo sapien
gctgttttgcgtagcatcgtgtgcc

SEQ ID NO: 202640 - DNA, 25 bp, Homo sapien
ctgttttgcgtagcatcgtgtgcca

SEQ ID NO: 202641 - DNA, 25 bp, Homo sapien
tgttttgcgtagcatcgtgtgccac

SEQ ID NO: 202642 - DNA, 25 bp, Homo sapien
gttttgcgtagcatcgtgtgccacc

SEQ ID NO: 202643 - DNA, 25 bp, Homo sapien
ttttgcgtagcatcgtgtgccaccc

SEQ ID NO: 202644 - DNA, 25 bp, Homo sapien
tttgcgtagcatcgtgtgccacccc

SEQ ID NO: 202645 - DNA, 25 bp, Homo sapien
tgcgtagcatcgtgtgccacccctg

SEQ ID NO: 202646 - DNA, 25 bp, Homo sapien
tgtgtccacagttcatttttttccg

SEQ ID NO: 202647 - DNA, 25 bp, Homo sapien
ggaataactccttttctacatccac

SEQ ID NO: 202648 - DNA, 25 bp, Homo sapien
tacatccacgctccatagagtctct

SEQ ID NO: 202649 - DNA, 25 bp, Homo sapien
catcctgggatgaaagaatttggct

SEQ ID NO: 202650 - DNA, 25 bp, Homo sapien
ttcactcttaggcttttaaacaata

SEQ ID NO: 202651 - DNA, 25 bp, Homo sapien
aatagttattgcttttatccctctc

SEQ ID NO: 202652 - DNA, 25 bp, Homo sapien
gcttttatccctctcagattctaat

SEQ ID NO: 202653 - DNA, 25 bp, Homo sapien
gggctatattgaatctctgtatgca

SEQ ID NO: 202654 - DNA, 25 bp, Homo sapien
ctctgtatgcactgagaactgagct

SEQ ID NO: 202655 - DNA, 25 bp, Homo sapien
cttattaaactgctggtctgacttt

SEQ ID NO: 202656 - DNA, 25 bp, Homo sapien
ctgactttatggattgacactgttc

SEQ ID NO: 202657 - DNA, 25 bp, Homo sapien
aagaccttgaccatgaatcagagat

SEQ ID NO: 202658 - DNA, 25 bp, Homo sapien
tatcatcatttttagaacgagccac

SEQ ID NO: 202659 - DNA, 25 bp, Homo sapien
gaacgagccactaacctattagaga

SEQ ID NO: 202660 - DNA, 25 bp, Homo sapien
ctcccatgtttctggtggactaaat

SEQ ID NO: 202661 - DNA, 25 bp, Homo sapien
tttctggtggactaaattgtgtatc

SEQ ID NO: 202662 - DNA, 25 bp, Homo sapien
aattgtgtatctgggagttctcact

SEQ ID NO: 202663 - DNA, 25 bp, Homo sapien
gagttctcactttctagccaggcct

SEQ ID NO: 202664 - DNA, 25 bp, Homo sapien
agccaggcctgatgagttaagttac

SEQ ID NO: 202665 - DNA, 25 bp, Homo sapien
gttacatgaccaggaaggttatgcc

SEQ ID NO: 202666 - DNA, 25 bp, Homo sapien
gttatgccactttgtggtcattcca

SEQ ID NO: 202667 - DNA, 25 bp, Homo sapien
ggtcattccatgcaagtcatggcgt

SEQ ID NO: 202668 - DNA, 25 bp, Homo sapien
gccgggcacccaaccctggatgcca

SEQ ID NO: 202669 - DNA, 25 bp, Homo sapien
ccccagcgggtaccagaggaaagct

SEQ ID NO: 202670 - DNA, 25 bp, Homo sapien
ctctgcaggtggagttactggccta

SEQ ID NO: 202671 - DNA, 25 bp, Homo sapien
ctgcaggtggagttactggcctact

SEQ ID NO: 202672 - DNA, 25 bp, Homo sapien
tgcaggtggagttactggcctactc

SEQ ID NO: 202673 - DNA, 25 bp, Homo sapien
caggtggagttactggcctactcct

SEQ ID NO: 202674 - DNA, 25 bp, Homo sapien
ggtggagttactggcctactccttc

SEQ ID NO: 202675 - DNA, 25 bp, Homo sapien
tctgcactgcccaggccagagggta

SEQ ID NO: 202676 - DNA, 25 bp, Homo sapien
actgcccaggccagagggtagagca

SEQ ID NO: 202677 - DNA, 25 bp, Homo sapien
tgcccaggccagagggtagagcaca

SEQ ID NO: 202678 - DNA, 25 bp, Homo sapien
gggtagagcacaggggtttccccat

SEQ ID NO: 202679 - DNA, 25 bp, Homo sapien
gctgtgttatgccaaagaatagtaa

SEQ ID NO: 202680 - DNA, 25 bp, Homo sapien
gagaatgtggcaacatgaccgtcac

SEQ ID NO: 202681 - DNA, 25 bp, Homo sapien
atgaccgtcacattacatgtttaat

SEQ ID NO: 202682 - DNA, 25 bp, Homo sapien
tctggaaaccaaagagaccctgaag

SEQ ID NO: 202683 - DNA, 25 bp, Homo sapien
gattcattttcagttctcaaattaa

SEQ ID NO: 202684 - DNA, 25 bp, Homo sapien
gaaaactgttagatgcacactgttg

SEQ ID NO: 202685 - DNA, 25 bp, Homo sapien
ttagatgcacactgttgattttcat

SEQ ID NO: 202686 - DNA, 25 bp, Homo sapien
ggtggattcaagaactccctagtga

SEQ ID NO: 202687 - DNA, 25 bp, Homo sapien
gctgaacttgctcaatctaaggctg

SEQ ID NO: 202688 - DNA, 25 bp, Homo sapien
tctaaggctgattgtcgtgttcctc

SEQ ID NO: 202689 - DNA, 25 bp, Homo sapien
tgtcgtgttcctctttaaattgttt

SEQ ID NO: 202690 - DNA, 25 bp, Homo sapien
ggagcacaccagaggacatggaccc

SEQ ID NO: 202691 - DNA, 25 bp, Homo sapien
acatggaccccacacttcagtacag

SEQ ID NO: 202692 - DNA, 25 bp, Homo sapien
acacttcagtacagctgggaagacc

SEQ ID NO: 202693 - DNA, 25 bp, Homo sapien
ggtagtaggttctttattgtctaag

SEQ ID NO: 202694 - DNA, 25 bp, Homo sapien
gatagaggctgggtcacaatttggt

SEQ ID NO: 202695 - DNA, 25 bp, Homo sapien
gggacaacagcactcaatgagggat

SEQ ID NO: 202696 - DNA, 25 bp, Homo sapien
tgagggattagactgtgacaacaac

SEQ ID NO: 202697 - DNA, 25 bp, Homo sapien
gaccatgggtcagggcatttaaatc

SEQ ID NO: 202698 - DNA, 25 bp, Homo sapien
atttaaatctaacttccctgcctca

SEQ ID NO: 202699 - DNA, 25 bp, Homo sapien
tgcctcaccatctaagtaaacagat

SEQ ID NO: 202700 - DNA, 25 bp, Homo sapien
gatgattacaatacagtgctcagtg

SEQ ID NO: 202701 - DNA, 25 bp, Homo sapien
tttctgcccctgctgacacagacat

SEQ ID NO: 202702 - DNA, 25 bp, Homo sapien
acacagacatcctctatgccagcag

SEQ ID NO: 202703 - DNA, 25 bp, Homo sapien
ggccaaccctttcattagaacttca

SEQ ID NO: 202704 - DNA, 25 bp, Homo sapien
agaacttcaagctctccaaaggctc

SEQ ID NO: 202705 - DNA, 25 bp, Homo sapien
aagctctccaaaggctcagattata

SEQ ID NO: 202706 - DNA, 25 bp, Homo sapien
atttatatgaggctgttgtcttttc

SEQ ID NO: 202707 - DNA, 25 bp, Homo sapien
aggagtatcctcttgccaaagcaaa

SEQ ID NO: 202708 - DNA, 25 bp, Homo sapien
gatacttgaaggtctaggtgcttta

SEQ ID NO: 202709 - DNA, 25 bp, Homo sapien
taggtgctttaacctcacataccct

SEQ ID NO: 202710 - DNA, 25 bp, Homo sapien
tcacataccctcacttaaactttta

SEQ ID NO: 202711 - DNA, 25 bp, Homo sapien
aaacttttatcactgttgcatatac

SEQ ID NO: 202712 - DNA, 25 bp, Homo sapien
acttttgcaacttcctatgagacta

SEQ ID NO: 202713 - DNA, 25 bp, Homo sapien
aaatcatggtgcataagtatttatg

SEQ ID NO: 202714 - DNA, 25 bp, Homo sapien
gtatttatggtttcttacaaagtat

SEQ ID NO: 202715 - DNA, 25 bp, Homo sapien
atgaaaaggtaagggcaatccttgt

SEQ ID NO: 202716 - DNA, 25 bp, Homo sapien
gtgagcagaacatatgtaaccagaa

SEQ ID NO: 202717 - DNA, 25 bp, Homo sapien
gtaaccagaaggacaaatccaccct

SEQ ID NO: 202718 - DNA, 25 bp, Homo sapien
tttgtcaagcacatctgtgtgaaga

SEQ ID NO: 202719 - DNA, 25 bp, Homo sapien
aaggctgtttattcacttgagtgca

SEQ ID NO: 202720 - DNA, 25 bp, Homo sapien
acttgagtgcaagtgggctgagtct

SEQ ID NO: 202721 - DNA, 25 bp, Homo sapien
tgcaagtgggctgagtctgaaaaca

SEQ ID NO: 202722 - DNA, 25 bp, Homo sapien
gagtctgaaaacagagtcagtgaag

SEQ ID NO: 202723 - DNA, 25 bp, Homo sapien
attatttttctcaggaatctggtta

SEQ ID NO: 202724 - DNA, 25 bp, Homo sapien
atttttctcaggaatctggttagga

SEQ ID NO: 202725 - DNA, 25 bp, Homo sapien
ctcaggaatctggttaggaattgca

SEQ ID NO: 202726 - DNA, 25 bp, Homo sapien
gaatctggttaggaattgcaggcaa

SEQ ID NO: 202727 - DNA, 25 bp, Homo sapien
attgcaggcaatgagattttttgcg

SEQ ID NO: 202728 - DNA, 25 bp, Homo sapien
cagggatgggaatgtttgttcataa

SEQ ID NO: 202729 - DNA, 25 bp, Homo sapien
tagatatttgacattctgcgaaagc

SEQ ID NO: 202730 - DNA, 25 bp, Homo sapien
atatttgacattctgcgaaagcaac

SEQ ID NO: 202731 - DNA, 25 bp, Homo sapien
gacattctgcgaaagcaacaagcaa

SEQ ID NO: 202732 - DNA, 25 bp, Homo sapien
ttctgcgaaagcaacaagcaaactg

SEQ ID NO: 202733 - DNA, 25 bp, Homo sapien
gaccaactcctatgagaaatattat

SEQ ID NO: 202734 - DNA, 25 bp, Homo sapien
gactgagttcaggttaccagaacca

SEQ ID NO: 202735 - DNA, 25 bp, Homo sapien
gaaccagtacctcagtattcttttt

SEQ ID NO: 202736 - DNA, 25 bp, Homo sapien
gtattctttttcaacatgtagggca

SEQ ID NO: 202737 - DNA, 25 bp, Homo sapien
tccccagcccaggaaaaactggaag

SEQ ID NO: 202738 - DNA, 25 bp, Homo sapien
taaaagcatattgtaccccctcatt

SEQ ID NO: 202739 - DNA, 25 bp, Homo sapien
tgctccgcatactgagaatctaggc

SEQ ID NO: 202740 - DNA, 25 bp, Homo sapien
atactgagaatctaggccaccccaa

SEQ ID NO: 202741 - DNA, 25 bp, Homo sapien
cccacccagttcttcatttggagga

SEQ ID NO: 202742 - DNA, 25 bp, Homo sapien
gttcttcatttggaggaatcacccc

SEQ ID NO: 202743 - DNA, 25 bp, Homo sapien
gaggaatcaccccatttcagagtta

SEQ ID NO: 202744 - DNA, 25 bp, Homo sapien
atcaccccatttcagagttatcaag

SEQ ID NO: 202745 - DNA, 25 bp, Homo sapien
ttttttctgtagctcaaaggtggag

SEQ ID NO: 202746 - DNA, 25 bp, Homo sapien
tttctgtagctcaaaggtggaggga

SEQ ID NO: 202747 - DNA, 25 bp, Homo sapien
tattagttaaccaaatatcgttgag

SEQ ID NO: 202748 - DNA, 25 bp, Homo sapien
taaccaaatatcgttgagaggaatt

SEQ ID NO: 202749 - DNA, 25 bp, Homo sapien
ttaaaatactgttactaccaaagat

SEQ ID NO: 202750 - DNA, 25 bp, Homo sapien
tactgttactaccaaagatttttat

SEQ ID NO: 202751 - DNA, 25 bp, Homo sapien
taaaggcttatattttggtaacact

SEQ ID NO: 202752 - DNA, 25 bp, Homo sapien
ggcttatattttggtaacacttctc

SEQ ID NO: 202753 - DNA, 25 bp, Homo sapien
attttggtaacacttctctatattt

SEQ ID NO: 202754 - DNA, 25 bp, Homo sapien
tttggtaacacttctctatattttt

SEQ ID NO: 202755 - DNA, 25 bp, Homo sapien
tttttactcacaggaatgtcactgt

SEQ ID NO: 202756 - DNA, 25 bp, Homo sapien
gtctatagcttgactccttggagaa

SEQ ID NO: 202757 - DNA, 25 bp, Homo sapien
atagcttgactccttggagaacaat

SEQ ID NO: 202758 - DNA, 25 bp, Homo sapien
aatattcatttggttgtggagactg

SEQ ID NO: 202759 - DNA, 25 bp, Homo sapien
tggagactgatttgctgggagaaat

SEQ ID NO: 202760 - DNA, 25 bp, Homo sapien
tgggagaaatctgtcctgttacttt

SEQ ID NO: 202761 - DNA, 25 bp, Homo sapien
aaatctgtcctgttactttctggtc

SEQ ID NO: 202762 - DNA, 25 bp, Homo sapien
gtcctgttactttctggtcatccca

SEQ ID NO: 202763 - DNA, 25 bp, Homo sapien
tggtcatcccaggttctgactttta

SEQ ID NO: 202764 - DNA, 25 bp, Homo sapien
tcccaggttctgacttttaccaggg

SEQ ID NO: 202765 - DNA, 25 bp, Homo sapien
gcaagagggagataaatcccatctg

SEQ ID NO: 202766 - DNA, 25 bp, Homo sapien
ttattggcgcctttttcctcagctg

SEQ ID NO: 202767 - DNA, 25 bp, Homo sapien
ggtcccagccccaatgtcagcagga

SEQ ID NO: 202768 - DNA, 25 bp, Homo sapien
ccagccccaatgtcagcaggatagg

SEQ ID NO: 202769 - DNA, 25 bp, Homo sapien
tgtcagcaggatagggagagcccca

SEQ ID NO: 202770 - DNA, 25 bp, Homo sapien
tgctgggctggtcctacttcctgcc

SEQ ID NO: 202771 - DNA, 25 bp, Homo sapien
cacccctagagtcccttctataggg

SEQ ID NO: 202772 - DNA, 25 bp, Homo sapien
cctagagtcccttctatagggaggg

SEQ ID NO: 202773 - DNA, 25 bp, Homo sapien
gggcaggagaccttccagacttcgg

SEQ ID NO: 202774 - DNA, 25 bp, Homo sapien
aggagaccttccagacttcggctga

SEQ ID NO: 202775 - DNA, 25 bp, Homo sapien
accttccagacttcggctgagcttg

SEQ ID NO: 202776 - DNA, 25 bp, Homo sapien
agacttcggctgagcttggagggtg

SEQ ID NO: 202777 - DNA, 25 bp, Homo sapien
gggaagggagccttctcagtcctct

SEQ ID NO: 202778 - DNA, 25 bp, Homo sapien
gctgcaccctggcattctcacagag

SEQ ID NO: 202779 - DNA, 25 bp, Homo sapien
ctggcattctcacagagctggctgc

SEQ ID NO: 202780 - DNA, 25 bp, Homo sapien
gggctatagcctcagagaccactca

SEQ ID NO: 202781 - DNA, 25 bp, Homo sapien
gagaccactcatcctctggaatcaa

SEQ ID NO: 202782 - DNA, 25 bp, Homo sapien
atcctctggaatcaacctctttcta

SEQ ID NO: 202783 - DNA, 25 bp, Homo sapien
ggaatcaacctctttctaataccct

SEQ ID NO: 202784 - DNA, 25 bp, Homo sapien
caacctctttctaataccctcttgg

SEQ ID NO: 202785 - DNA, 25 bp, Homo sapien
cttggaaaaagagcttgcccctcct

SEQ ID NO: 202786 - DNA, 25 bp, Homo sapien
ggaaaaagagcttgcccctcctcca

SEQ ID NO: 202787 - DNA, 25 bp, Homo sapien
acactagagctctggccttgtgtgt

SEQ ID NO: 202788 - DNA, 25 bp, Homo sapien
aaagatctgaatgatgcaccccacc

SEQ ID NO: 202789 - DNA, 25 bp, Homo sapien
cagtggagcaggaagccatgcagct

SEQ ID NO: 202790 - DNA, 25 bp, Homo sapien
tggaccctggagagcaggatgcata

SEQ ID NO: 202791 - DNA, 25 bp, Homo sapien
tgcagacccaagagcaagtcctccc

SEQ ID NO: 202792 - DNA, 25 bp, Homo sapien
agctctgcaaaggacttctggccaa

SEQ ID NO: 202793 - DNA, 25 bp, Homo sapien
gcaaaggacttctggccaaaaagcc

SEQ ID NO: 202794 - DNA, 25 bp, Homo sapien
gccagacatggtgccaagcagaaca

SEQ ID NO: 202795 - DNA, 25 bp, Homo sapien
atactgtcagtggtgtccgtgagct

SEQ ID NO: 202796 - DNA, 25 bp, Homo sapien
ctgtcagtggtgtccgtgagctctg

SEQ ID NO: 202797 - DNA, 25 bp, Homo sapien
ctgggccctgccaccagaaagtcga

SEQ ID NO: 202798 - DNA, 25 bp, Homo sapien
gaaagtcgagcactggtcctagtca

SEQ ID NO: 202799 - DNA, 25 bp, Homo sapien
actggtcctagtcaggctgtgatga

SEQ ID NO: 202800 - DNA, 25 bp, Homo sapien
aatttggtccaatctccagtatcga

SEQ ID NO: 202801 - DNA, 25 bp, Homo sapien
ggtccaatctccagtatcgatgcaa

SEQ ID NO: 202802 - DNA, 25 bp, Homo sapien
tctccagtatcgatgcaatgacaca

SEQ ID NO: 202803 - DNA, 25 bp, Homo sapien
tatcgatgcaatgacacagtgcctg

SEQ ID NO: 202804 - DNA, 25 bp, Homo sapien
ctgaggactttgagccattccggag

SEQ ID NO: 202805 - DNA, 25 bp, Homo sapien
ctttgagccattccggaggcagctg

SEQ ID NO: 202806 - DNA, 25 bp, Homo sapien
aggaggccaccagattcagaattca

SEQ ID NO: 202807 - DNA, 25 bp, Homo sapien
ggccaccagattcagaattcagaat

SEQ ID NO: 202808 - DNA, 25 bp, Homo sapien
tggagaccctgaggtctaagctaca

SEQ ID NO: 202809 - DNA, 25 bp, Homo sapien
tgaggtctaagctacagcccctcag

SEQ ID NO: 202810 - DNA, 25 bp, Homo sapien
caaggggtattactcaggcactaac

SEQ ID NO: 202811 - DNA, 25 bp, Homo sapien
gtattcattttataacactgttgac

SEQ ID NO: 202812 - DNA, 25 bp, Homo sapien
aacactgttgactaagaatcacaat

SEQ ID NO: 202813 - DNA, 25 bp, Homo sapien
ttttttctgtcgttggcatttgata

SEQ ID NO: 202814 - DNA, 25 bp, Homo sapien
gtcgttggcatttgatattaacagc

SEQ ID NO: 202815 - DNA, 25 bp, Homo sapien
gatattaacagctgtgctaacctta

SEQ ID NO: 202816 - DNA, 25 bp, Homo sapien
gaagtctttgtgtcatgttgtgtga

SEQ ID NO: 202817 - DNA, 25 bp, Homo sapien
aagtaccactgagaggctgttcttt

SEQ ID NO: 202818 - DNA, 25 bp, Homo sapien
ttggaataaccagtaaagtgtgagt

SEQ ID NO: 202819 - DNA, 25 bp, Homo sapien
agatttgttctgtctttcccttgtg

SEQ ID NO: 202820 - DNA, 25 bp, Homo sapien
gtctttcccttgtgtctgatgtctt

SEQ ID NO: 202821 - DNA, 25 bp, Homo sapien
gtgtctgatgtcttgtaatggaaca

SEQ ID NO: 202822 - DNA, 25 bp, Homo sapien
gagtccctggtgactccattctgag

SEQ ID NO: 202823 - DNA, 25 bp, Homo sapien
tccctggtgactccattctgaggtg

SEQ ID NO: 202824 - DNA, 25 bp, Homo sapien
ctggtgactccattctgaggtgtca

SEQ ID NO: 202825 - DNA, 25 bp, Homo sapien
gactccattctgaggtgtcacaagc

SEQ ID NO: 202826 - DNA, 25 bp, Homo sapien
tccattctgaggtgtcacaagcaat

SEQ ID NO: 202827 - DNA, 25 bp, Homo sapien
ctgaggtgtcacaagcaatgaagct

SEQ ID NO: 202828 - DNA, 25 bp, Homo sapien
aggtgtcacaagcaatgaagctatg

SEQ ID NO: 202829 - DNA, 25 bp, Homo sapien
gaagctatgcaaacaataggagggt

SEQ ID NO: 202830 - DNA, 25 bp, Homo sapien
atgcaaacaataggagggtgtgaca

SEQ ID NO: 202831 - DNA, 25 bp, Homo sapien
gtgacaggggaaccgtagactttat

SEQ ID NO: 202832 - DNA, 25 bp, Homo sapien
ggggaaccgtagactttatatatgt

SEQ ID NO: 202833 - DNA, 25 bp, Homo sapien
gtgtctctagagaaggattcctgga

SEQ ID NO: 202834 - DNA, 25 bp, Homo sapien
tggatctagctggtcacgacgatgt

SEQ ID NO: 202835 - DNA, 25 bp, Homo sapien
gtcacgacgatgttttcaccaaggt

SEQ ID NO: 202836 - DNA, 25 bp, Homo sapien
gtcacaggagcattgcgtcgctgat

SEQ ID NO: 202837 - DNA, 25 bp, Homo sapien
ggttcttgtttcagcccaatatgta

SEQ ID NO: 202838 - DNA, 25 bp, Homo sapien
gaaacagtctgcacctttgatacgg

SEQ ID NO: 202839 - DNA, 25 bp, Homo sapien
ttgatacggtattgcatttccaaag

SEQ ID NO: 202840 - DNA, 25 bp, Homo sapien
atttccaaagccaccaatccatttt

SEQ ID NO: 202841 - DNA, 25 bp, Homo sapien
gtgtctgtggcttaataatcatagt

SEQ ID NO: 202842 - DNA, 25 bp, Homo sapien
ataataccttttcctccattttgct

SEQ ID NO: 202843 - DNA, 25 bp, Homo sapien
cctccattttgcttgcaggaaacat

SEQ ID NO: 202844 - DNA, 25 bp, Homo sapien
catactaacatttctcctttggagg

SEQ ID NO: 202845 - DNA, 25 bp, Homo sapien
tttaatctacttcaggatgcatatt

SEQ ID NO: 202846 - DNA, 25 bp, Homo sapien
atactttcatatacaggatagccta

SEQ ID NO: 202847 - DNA, 25 bp, Homo sapien
atatgcttaatatgccccagattgc

SEQ ID NO: 202848 - DNA, 25 bp, Homo sapien
gccccagattgcaaatgcatccagt

SEQ ID NO: 202849 - DNA, 25 bp, Homo sapien
aaatgcatccagtcagtaatatcac

SEQ ID NO: 202850 - DNA, 25 bp, Homo sapien
aatatcactgtctgtatgtggagga

SEQ ID NO: 202851 - DNA, 25 bp, Homo sapien
acatgttcccatggatcatatgtga

SEQ ID NO: 202852 - DNA, 25 bp, Homo sapien
gtgaagatgtcaataagcttgcatt

SEQ ID NO: 202853 - DNA, 25 bp, Homo sapien
aagcttgcattaagccacctgcttt

SEQ ID NO: 202854 - DNA, 25 bp, Homo sapien
aagccacctgctttgtaagtggatt

SEQ ID NO: 202855 - DNA, 25 bp, Homo sapien
aggaggactggttcgccaagatccc

SEQ ID NO: 202856 - DNA, 25 bp, Homo sapien
gaggcagcagctgtataaactctac

SEQ ID NO: 202857 - DNA, 25 bp, Homo sapien
taaactctacgaggccgactttgtt

SEQ ID NO: 202858 - DNA, 25 bp, Homo sapien
aggccgactttgttctcttcggcta

SEQ ID NO: 202859 - DNA, 25 bp, Homo sapien
aaacctcctccgagactgaaagctt

SEQ ID NO: 202860 - DNA, 25 bp, Homo sapien
aaagctttcgcgttgctttttctcg

SEQ ID NO: 202861 - DNA, 25 bp, Homo sapien
tttttctcgcgtgcctggaacctga

SEQ ID NO: 202862 - DNA, 25 bp, Homo sapien
tgacgcacgcgcactccagtttttt

SEQ ID NO: 202863 - DNA, 25 bp, Homo sapien
gacctacgattttgcaatctgggct

SEQ ID NO: 202864 - DNA, 25 bp, Homo sapien
aatctgggcttcttgttcactccac

SEQ ID NO: 202865 - DNA, 25 bp, Homo sapien
actgcctctatccattgagtactgt

SEQ ID NO: 202866 - DNA, 25 bp, Homo sapien
ctgagagtttagtgttttcacagtg

SEQ ID NO: 202867 - DNA, 25 bp, Homo sapien
gagtttagtgttttcacagtgaagt

SEQ ID NO: 202868 - DNA, 25 bp, Homo sapien
gatttctttatgagttccctgtgtt

SEQ ID NO: 202869 - DNA, 25 bp, Homo sapien
gttccctgtgttagaaatggctata

SEQ ID NO: 202870 - DNA, 25 bp, Homo sapien
agcaccacttaccaaatctatcggc

SEQ ID NO: 202871 - DNA, 25 bp, Homo sapien
aggtaagtgagcatgtcaaacaaaa

SEQ ID NO: 202872 - DNA, 25 bp, Homo sapien
gtcaaacaaaataggagctcacatg

SEQ ID NO: 202873 - DNA, 25 bp, Homo sapien
aggagctcacatggatatatttatg

SEQ ID NO: 202874 - DNA, 25 bp, Homo sapien
gctcacatggatatatttatgtcac

SEQ ID NO: 202875 - DNA, 25 bp, Homo sapien
atggatatatttatgtcactgagtt

SEQ ID NO: 202876 - DNA, 25 bp, Homo sapien
gtttcatgacaaattatatagtcta

SEQ ID NO: 202877 - DNA, 25 bp, Homo sapien
aaccccaggccctcagaaaccagag

SEQ ID NO: 202878 - DNA, 25 bp, Homo sapien
agagccatgagacctaccataccac

SEQ ID NO: 202879 - DNA, 25 bp, Homo sapien
tggcagagtggtatgggcaccccac

SEQ ID NO: 202880 - DNA, 25 bp, Homo sapien
caaggctacataggggccccattca

SEQ ID NO: 202881 - DNA, 25 bp, Homo sapien
tcaggccaggccatgccaggctcag

SEQ ID NO: 202882 - DNA, 25 bp, Homo sapien
tcctccaaatctgggctgggtctag

SEQ ID NO: 202883 - DNA, 25 bp, Homo sapien
ccaaatctgggctgggtctaggtcc

SEQ ID NO: 202884 - DNA, 25 bp, Homo sapien
aatctgggctgggtctaggtccctc

SEQ ID NO: 202885 - DNA, 25 bp, Homo sapien
tgggctgggtctaggtccctcatta

SEQ ID NO: 202886 - DNA, 25 bp, Homo sapien
ctgggtctaggtccctcattaaaga

SEQ ID NO: 202887 - DNA, 25 bp, Homo sapien
ctaggtccctcattaaagaactgca

SEQ ID NO: 202888 - DNA, 25 bp, Homo sapien
tgtggaggtagagccagcccctcat

SEQ ID NO: 202889 - DNA, 25 bp, Homo sapien
atgttttgtgtctctccagctacat

SEQ ID NO: 202890 - DNA, 25 bp, Homo sapien
gtgtctctccagctacattgtaagt

SEQ ID NO: 202891 - DNA, 25 bp, Homo sapien
agctacattgtaagttccttgaggg

SEQ ID NO: 202892 - DNA, 25 bp, Homo sapien
ggcccattgctctgtgaatctcaaa

SEQ ID NO: 202893 - DNA, 25 bp, Homo sapien
tcaaatgcccataaaaggtgcccat

SEQ ID NO: 202894 - DNA, 25 bp, Homo sapien
aggtgcccataaaatgttttcttga

SEQ ID NO: 202895 - DNA, 25 bp, Homo sapien
ttgaatgtgctgttgtctggaaagg

SEQ ID NO: 202896 - DNA, 25 bp, Homo sapien
gtctttttggactatggtattgtta

SEQ ID NO: 202897 - DNA, 25 bp, Homo sapien
gttaaaaagactgcagccctctcag

SEQ ID NO: 202898 - DNA, 25 bp, Homo sapien
agccctctcagacttgagcgttaat

SEQ ID NO: 202899 - DNA, 25 bp, Homo sapien
atgtttagttttcagtcttattgga

SEQ ID NO: 202900 - DNA, 25 bp, Homo sapien
ttaaattgtatgttttcaggctgtt

SEQ ID NO: 202901 - DNA, 25 bp, Homo sapien
gaggggttatttgtcatttacagta

SEQ ID NO: 202902 - DNA, 25 bp, Homo sapien
attagcaagcttaatggttatcctt

SEQ ID NO: 202903 - DNA, 25 bp, Homo sapien
gcaagcttaatggttatccttactt

SEQ ID NO: 202904 - DNA, 25 bp, Homo sapien
ttacttgagtccacatgggttggac

SEQ ID NO: 202905 - DNA, 25 bp, Homo sapien
agtccacatgggttggacagtcccc

SEQ ID NO: 202906 - DNA, 25 bp, Homo sapien
acatgggttggacagtccccacaca

SEQ ID NO: 202907 - DNA, 25 bp, Homo sapien
gggttggacagtccccacacacatt

SEQ ID NO: 202908 - DNA, 25 bp, Homo sapien
cccacacacattaaattctgtaaat

SEQ ID NO: 202909 - DNA, 25 bp, Homo sapien
attctgtaaatgaaagccacctttt

SEQ ID NO: 202910 - DNA, 25 bp, Homo sapien
taagttctctggaaatatctacaac

SEQ ID NO: 202911 - DNA, 25 bp, Homo sapien
tatctacaactaataggacacatgt

SEQ ID NO: 202912 - DNA, 25 bp, Homo sapien
aggacacatgtaaatccttgaagac

SEQ ID NO: 202913 - DNA, 25 bp, Homo sapien
gacacatcctggaattcatacccca

SEQ ID NO: 202914 - DNA, 25 bp, Homo sapien
gaattcataccccacaaggacagtg

SEQ ID NO: 202915 - DNA, 25 bp, Homo sapien
tgcagagcatgacttttatatgtgt

SEQ ID NO: 202916 - DNA, 25 bp, Homo sapien
attgttacaagtctattctctatta

SEQ ID NO: 202917 - DNA, 25 bp, Homo sapien
tatattttatttactctgcggttat

SEQ ID NO: 202918 - DNA, 25 bp, Homo sapien
cggttataaaaatcacccttgcata

SEQ ID NO: 202919 - DNA, 25 bp, Homo sapien
atcacccttgcatacaagtttctag

SEQ ID NO: 202920 - DNA, 25 bp, Homo sapien
gtttctagttgccagtgatgttctg

SEQ ID NO: 202921 - DNA, 25 bp, Homo sapien
gagtaaacctggatttgcccaactg

SEQ ID NO: 202922 - DNA, 25 bp, Homo sapien
aaacctggatttgcccaactgccaa

SEQ ID NO: 202923 - DNA, 25 bp, Homo sapien
gatttgcccaactgccaagcccaga

SEQ ID NO: 202924 - DNA, 25 bp, Homo sapien
caagcccagactccgaattactgtt

SEQ ID NO: 202925 - DNA, 25 bp, Homo sapien
ccagactccgaattactgttcttcc

SEQ ID NO: 202926 - DNA, 25 bp, Homo sapien
cttccaagataacttgcacagccag

SEQ ID NO: 202927 - DNA, 25 bp, Homo sapien
tgcacagccagaggacagtcagtaa

SEQ ID NO: 202928 - DNA, 25 bp, Homo sapien
aaaatgtgatgagttgcatctcccc

SEQ ID NO: 202929 - DNA, 25 bp, Homo sapien
tctcctcccatacatgaagtctggc

SEQ ID NO: 202930 - DNA, 25 bp, Homo sapien
atacatgaagtctggccagcatgga

SEQ ID NO: 202931 - DNA, 25 bp, Homo sapien
cccagccactcgagaatcatttgaa

SEQ ID NO: 202932 - DNA, 25 bp, Homo sapien
ttaaatcttgtcgaaggctcacctg

SEQ ID NO: 202933 - DNA, 25 bp, Homo sapien
gtcgaaggctcacctgatggaaaat

SEQ ID NO: 202934 - DNA, 25 bp, Homo sapien
gatggaaaatggactgggctactga

SEQ ID NO: 202935 - DNA, 25 bp, Homo sapien
aatggactgggctactgagatattt

SEQ ID NO: 202936 - DNA, 25 bp, Homo sapien
ttgataacattctctaattctgtga

SEQ ID NO: 202937 - DNA, 25 bp, Homo sapien
gataattgggttttgtctattttca

SEQ ID NO: 202938 - DNA, 25 bp, Homo sapien
cttctccctaaataatcttcacaga

SEQ ID NO: 202939 - DNA, 25 bp, Homo sapien
aatcttcacagatattgtttgaggg

SEQ ID NO: 202940 - DNA, 25 bp, Homo sapien
atttgttaactcgtctgtgcacagt

SEQ ID NO: 202941 - DNA, 25 bp, Homo sapien
gcacagtattatttactctgtctgt

SEQ ID NO: 202942 - DNA, 25 bp, Homo sapien
ttactctgtctgtagttcctgaata

SEQ ID NO: 202943 - DNA, 25 bp, Homo sapien
ttgcactgatgttcctggggcttca

SEQ ID NO: 202944 - DNA, 25 bp, Homo sapien
gggcttcagagacggcaagcaccta

SEQ ID NO: 202945 - DNA, 25 bp, Homo sapien
gagacggcaagcacctacaggactt

SEQ ID NO: 202946 - DNA, 25 bp, Homo sapien
aagcacctacaggacttgggctgct

SEQ ID NO: 202947 - DNA, 25 bp, Homo sapien
acctacaggacttgggctgcttcag

SEQ ID NO: 202948 - DNA, 25 bp, Homo sapien
aggacttgggctgcttcaggctgaa

SEQ ID NO: 202949 - DNA, 25 bp, Homo sapien
acttgggctgcttcaggctgaacgc

SEQ ID NO: 202950 - DNA, 25 bp, Homo sapien
caggctgaacgctgggagaccactt

SEQ ID NO: 202951 - DNA, 25 bp, Homo sapien
tgaacgctgggagaccacttcctgt

SEQ ID NO: 202952 - DNA, 25 bp, Homo sapien
aagcgacatgagactactagaaaga

SEQ ID NO: 202953 - DNA, 25 bp, Homo sapien
gactactagaaagaaacgacaccct

SEQ ID NO: 202954 - DNA, 25 bp, Homo sapien
tgctgacacacagagctcccatctc

SEQ ID NO: 202955 - DNA, 25 bp, Homo sapien
atctccatgaagaccgcacagcgcg

SEQ ID NO: 202956 - DNA, 25 bp, Homo sapien
catgaagaccgcacagcgcgtgtaa

SEQ ID NO: 202957 - DNA, 25 bp, Homo sapien
atgaagaccgcacagcgcgtgtaag

SEQ ID NO: 202958 - DNA, 25 bp, Homo sapien
gcacagcgcgtgtaagccagcccag

SEQ ID NO: 202959 - DNA, 25 bp, Homo sapien
acagcgcgtgtaagccagcccagct

SEQ ID NO: 202960 - DNA, 25 bp, Homo sapien
ccagctgacctaaagcgacatgaga

SEQ ID NO: 202961 - DNA, 25 bp, Homo sapien
agctgacctaaagcgacatgagact

SEQ ID NO: 202962 - DNA, 25 bp, Homo sapien
cacagctactccaacccaaacaaca

SEQ ID NO: 202963 - DNA, 25 bp, Homo sapien
aacaacaaccaagccagtttaatgg

SEQ ID NO: 202964 - DNA, 25 bp, Homo sapien
caaccaagccagtttaatggtagga

SEQ ID NO: 202965 - DNA, 25 bp, Homo sapien
aaacccctcctgatgagataaagaa

SEQ ID NO: 202966 - DNA, 25 bp, Homo sapien
agaacagtgttctacccatggttta

SEQ ID NO: 202967 - DNA, 25 bp, Homo sapien
tacccatggtttacagagcactaga

SEQ ID NO: 202968 - DNA, 25 bp, Homo sapien
gcactagaagctccttccattcaga

SEQ ID NO: 202969 - DNA, 25 bp, Homo sapien
agatccaggagctctgtctaaacat

SEQ ID NO: 202970 - DNA, 25 bp, Homo sapien
tctgtctaaacatcattccaacctt

SEQ ID NO: 202971 - DNA, 25 bp, Homo sapien
ttccaacctttgcaaatcttataga

SEQ ID NO: 202972 - DNA, 25 bp, Homo sapien
aatcttatagactacccatccatga

SEQ ID NO: 202973 - DNA, 25 bp, Homo sapien
tacccatccatgaaaaacgctttga

SEQ ID NO: 202974 - DNA, 25 bp, Homo sapien
tacaaacatcttcccttgcggttcg

SEQ ID NO: 202975 - DNA, 25 bp, Homo sapien
tcccttgcggttcgtgtaaattcat

SEQ ID NO: 202976 - DNA, 25 bp, Homo sapien
agtccatttggttgatgagctttga

SEQ ID NO: 202977 - DNA, 25 bp, Homo sapien
tgagctttgactgcggttttggaac

SEQ ID NO: 202978 - DNA, 25 bp, Homo sapien
ctccttagcccaatatgctgtcttg

SEQ ID NO: 202979 - DNA, 25 bp, Homo sapien
tccttagcccaatatgctgtcttgg

SEQ ID NO: 202980 - DNA, 25 bp, Homo sapien
ttagcccaatatgctgtcttgggtc

SEQ ID NO: 202981 - DNA, 25 bp, Homo sapien
agcccaatatgctgtcttgggtcct

SEQ ID NO: 202982 - DNA, 25 bp, Homo sapien
tgctgtcttgggtcctattcaaata

SEQ ID NO: 202983 - DNA, 25 bp, Homo sapien
tgtgattttttacttccacttataa

SEQ ID NO: 202984 - DNA, 25 bp, Homo sapien
tccacttataatacttgtgattggg

SEQ ID NO: 202985 - DNA, 25 bp, Homo sapien
agtggcaaatacattccccagcagg

SEQ ID NO: 202986 - DNA, 25 bp, Homo sapien
ctgggaagtagagtccatttggttg

SEQ ID NO: 202987 - DNA, 25 bp, Homo sapien
tttcctcttgcctgttcatatcctt

SEQ ID NO: 202988 - DNA, 25 bp, Homo sapien
tgttcatatccttcagtgacattga

SEQ ID NO: 202989 - DNA, 25 bp, Homo sapien
tagttgtcaaccttcattcatctct

SEQ ID NO: 202990 - DNA, 25 bp, Homo sapien
ttcattcatctcttacatctctcac

SEQ ID NO: 202991 - DNA, 25 bp, Homo sapien
ccccttattgatgggactgatattc

SEQ ID NO: 202992 - DNA, 25 bp, Homo sapien
gaacatttggaaactgtcgggcttt

SEQ ID NO: 202993 - DNA, 25 bp, Homo sapien
ctttttattaaagctctgtagaatt

SEQ ID NO: 202994 - DNA, 25 bp, Homo sapien
aagccattcctaaacagcccaactg

SEQ ID NO: 202995 - DNA, 25 bp, Homo sapien
tcctaaacagcccaactggcattta

SEQ ID NO: 202996 - DNA, 25 bp, Homo sapien
ctggcatttaattacccaatactgt

SEQ ID NO: 202997 - DNA, 25 bp, Homo sapien
cccaatactgtatataaggcaaata

SEQ ID NO: 202998 - DNA, 25 bp, Homo sapien
acgcaacctttgtggagccatcgaa

SEQ ID NO: 202999 - DNA, 25 bp, Homo sapien
agccatcgaagcctgcctttagtta

SEQ ID NO: 203000 - DNA, 25 bp, Homo sapien
aagcctgcctttagttatatctgtg

SEQ ID NO: 203001 - DNA, 25 bp, Homo sapien
atatctgtggcgttctcttgtaagt

SEQ ID NO: 203002 - DNA, 25 bp, Homo sapien
atgtaattgtgtaccagtttcttaa

SEQ ID NO: 203003 - DNA, 25 bp, Homo sapien
acaaagcttcatactgtgacagatc

SEQ ID NO: 203004 - DNA, 25 bp, Homo sapien
gacagatctgtttcctatgaaaacc

SEQ ID NO: 203005 - DNA, 25 bp, Homo sapien
gaaaaccaaacaatgattccacagt

SEQ ID NO: 203006 - DNA, 25 bp, Homo sapien
gctacatttgagaatagctcaccaa

SEQ ID NO: 203007 - DNA, 25 bp, Homo sapien
gagaatagctcaccaagcaaaatat

SEQ ID NO: 203008 - DNA, 25 bp, Homo sapien
atgattgttgctaggctacagagtt

SEQ ID NO: 203009 - DNA, 25 bp, Homo sapien
taataactgtgctcacattgaaaaa

SEQ ID NO: 203010 - DNA, 25 bp, Homo sapien
aataactgtgctcacattgaaaaaa

SEQ ID NO: 203011 - DNA, 25 bp, Homo sapien
ataactgtgctcacattgaaaaaaa

SEQ ID NO: 203012 - DNA, 25 bp, Homo sapien
taactgtgctcacattgaaaaaaat

SEQ ID NO: 203013 - DNA, 25 bp, Homo sapien
aactgtgctcacattgaaaaaaatg

SEQ ID NO: 203014 - DNA, 25 bp, Homo sapien
attgaaaaaaatggcccaggcgcgg

SEQ ID NO: 203015 - DNA, 25 bp, Homo sapien
ttgaaaaaaatggcccaggcgcggc

SEQ ID NO: 203016 - DNA, 25 bp, Homo sapien
tgaaaaaaatggcccaggcgcggcg

SEQ ID NO: 203017 - DNA, 25 bp, Homo sapien
gcccaggcgcggcggcacatgcttg

SEQ ID NO: 203018 - DNA, 25 bp, Homo sapien
cccaggcgcggcggcacatgcttgt

SEQ ID NO: 203019 - DNA, 25 bp, Homo sapien
taaaatctagtccagttctctcatt

SEQ ID NO: 203020 - DNA, 25 bp, Homo sapien
aaatctagtccagttctctcattta

SEQ ID NO: 203021 - DNA, 25 bp, Homo sapien
gaagacactgaagtacagacttaaa

SEQ ID NO: 203022 - DNA, 25 bp, Homo sapien
tacagacttaaatagctcagatagc

SEQ ID NO: 203023 - DNA, 25 bp, Homo sapien
gctcagatagctaattaggaaattt

SEQ ID NO: 203024 - DNA, 25 bp, Homo sapien
gttggccaataatagcattctctct

SEQ ID NO: 203025 - DNA, 25 bp, Homo sapien
caataatagcattctctctgacatt

SEQ ID NO: 203026 - DNA, 25 bp, Homo sapien
acatgcataattgattttacacctc

SEQ ID NO: 203027 - DNA, 25 bp, Homo sapien
gattttacacctcattactggtgga

SEQ ID NO: 203028 - DNA, 25 bp, Homo sapien
acacctcattactggtggataattt

SEQ ID NO: 203029 - DNA, 25 bp, Homo sapien
atttatgtgatgtggattgctggtg

SEQ ID NO: 203030 - DNA, 25 bp, Homo sapien
gccagagtgacgaggaaaccgcaga

SEQ ID NO: 203031 - DNA, 25 bp, Homo sapien
aaaccgcagacgtgtcgccccagga

SEQ ID NO: 203032 - DNA, 25 bp, Homo sapien
gagacggctgaaaagtcttccacta

SEQ ID NO: 203033 - DNA, 25 bp, Homo sapien
aagtcttccactaagaaggcagtaa

SEQ ID NO: 203034 - DNA, 25 bp, Homo sapien
aaggcagtaattgaatgctgccctg

SEQ ID NO: 203035 - DNA, 25 bp, Homo sapien
cctggctcgtcctagaatcatttct

SEQ ID NO: 203036 - DNA, 25 bp, Homo sapien
atttctcctccatgatggaagccca

SEQ ID NO: 203037 - DNA, 25 bp, Homo sapien
ggaagcccagtgattgttcagttaa

SEQ ID NO: 203038 - DNA, 25 bp, Homo sapien
gttcagttaacgcattgtacagagt

SEQ ID NO: 203039 - DNA, 25 bp, Homo sapien
ttatatgtaaattcctgctgtaaaa

SEQ ID NO: 203040 - DNA, 25 bp, Homo sapien
agactgccttgaaaggtcgcagaaa

SEQ ID NO: 203041 - DNA, 25 bp, Homo sapien
tgcaccaaccagtcccgggttagat

SEQ ID NO: 203042 - DNA, 25 bp, Homo sapien
gttagatcccaaatgctagaagcca

SEQ ID NO: 203043 - DNA, 25 bp, Homo sapien
tgggtggccccagtcagaacctctg

SEQ ID NO: 203044 - DNA, 25 bp, Homo sapien
gaacctctgggatctcagtgaagct

SEQ ID NO: 203045 - DNA, 25 bp, Homo sapien
gctgcttttcaaccaagagccttgt

SEQ ID NO: 203046 - DNA, 25 bp, Homo sapien
aagagccttgtgagcctggtctgag

SEQ ID NO: 203047 - DNA, 25 bp, Homo sapien
tgagcctggtctgagccttgcacag

SEQ ID NO: 203048 - DNA, 25 bp, Homo sapien
tttgccttagccagtgtacctccta

SEQ ID NO: 203049 - DNA, 25 bp, Homo sapien
ctcctacctcagtctatgtgagagg

SEQ ID NO: 203050 - DNA, 25 bp, Homo sapien
tgtgtgtgcctgtgggtctctacaa

SEQ ID NO: 203051 - DNA, 25 bp, Homo sapien
gtgggtctctacaagtgacagatgt

SEQ ID NO: 203052 - DNA, 25 bp, Homo sapien
ttgcttgccttcataccctggaggt

SEQ ID NO: 203053 - DNA, 25 bp, Homo sapien
cttgccttcataccctggaggtggg

SEQ ID NO: 203054 - DNA, 25 bp, Homo sapien
gggaagttatccctcttccggtgct

SEQ ID NO: 203055 - DNA, 25 bp, Homo sapien
tcttccggtgctttcccatcctggg

SEQ ID NO: 203056 - DNA, 25 bp, Homo sapien
tgctttcccatcctgggccactgta

SEQ ID NO: 203057 - DNA, 25 bp, Homo sapien
ctgggccactgtatccaggacatca

SEQ ID NO: 203058 - DNA, 25 bp, Homo sapien
aagaatcatctctgccaggtcaact

SEQ ID NO: 203059 - DNA, 25 bp, Homo sapien
aatcatctctgccaggtcaactgga

SEQ ID NO: 203060 - DNA, 25 bp, Homo sapien
tcatctctgccaggtcaactggagt

SEQ ID NO: 203061 - DNA, 25 bp, Homo sapien
tgccaggtcaactggagtccctggt

SEQ ID NO: 203062 - DNA, 25 bp, Homo sapien
gactccattctgaggtgtcacaagc

SEQ ID NO: 203063 - DNA, 25 bp, Homo sapien
ggtccacatttgaagttcaaaacat

SEQ ID NO: 203064 - DNA, 25 bp, Homo sapien
gttcaaaacatgcatcaagaagcag

SEQ ID NO: 203065 - DNA, 25 bp, Homo sapien
aacatgcatcaagaagcagtgggct

SEQ ID NO: 203066 - DNA, 25 bp, Homo sapien
acatgcatcaagaagcagtgggctc

SEQ ID NO: 203067 - DNA, 25 bp, Homo sapien
catgcatcaagaagcagtgggctct

SEQ ID NO: 203068 - DNA, 25 bp, Homo sapien
atgcatcaagaagcagtgggctctc

SEQ ID NO: 203069 - DNA, 25 bp, Homo sapien
tgcatcaagaagcagtgggctctcc

SEQ ID NO: 203070 - DNA, 25 bp, Homo sapien
gcatcaagaagcagtgggctctcca

SEQ ID NO: 203071 - DNA, 25 bp, Homo sapien
catcaagaagcagtgggctctccag

SEQ ID NO: 203072 - DNA, 25 bp, Homo sapien
tcaagaagcagtgggctctccaggt

SEQ ID NO: 203073 - DNA, 25 bp, Homo sapien
agcagtgggctctccaggtgcagtg

SEQ ID NO: 203074 - DNA, 25 bp, Homo sapien
tcttccggtgctttcccatcctggg

SEQ ID NO: 203075 - DNA, 25 bp, Homo sapien
cttccggtgctttcccatcctgggc

SEQ ID NO: 203076 - DNA, 25 bp, Homo sapien
ggtgctttcccatcctgggccactg

SEQ ID NO: 203077 - DNA, 25 bp, Homo sapien
gtgctttcccatcctgggccactgt

SEQ ID NO: 203078 - DNA, 25 bp, Homo sapien
tgctttcccatcctgggccactgta

SEQ ID NO: 203079 - DNA, 25 bp, Homo sapien
gctttcccatcctgggccactgtat

SEQ ID NO: 203080 - DNA, 25 bp, Homo sapien
atcatctctgccaggtcaactggag

SEQ ID NO: 203081 - DNA, 25 bp, Homo sapien
tcatctctgccaggtcaactggagt

SEQ ID NO: 203082 - DNA, 25 bp, Homo sapien
tctgccaggtcaactggagtccctg

SEQ ID NO: 203083 - DNA, 25 bp, Homo sapien
ctgccaggtcaactggagtccctgg

SEQ ID NO: 203084 - DNA, 25 bp, Homo sapien
tgccaggtcaactggagtccctggt

SEQ ID NO: 203085 - DNA, 25 bp, Homo sapien
gtattacaaacaaaatcctcttgat

SEQ ID NO: 203086 - DNA, 25 bp, Homo sapien
atcctcttgatgagcaacacatttt

SEQ ID NO: 203087 - DNA, 25 bp, Homo sapien
tcagctgccagtcagaccaactgct

SEQ ID NO: 203088 - DNA, 25 bp, Homo sapien
tgccagtcagaccaactgctgtaaa

SEQ ID NO: 203089 - DNA, 25 bp, Homo sapien
ggcaactgagtgacagctcacccat

SEQ ID NO: 203090 - DNA, 25 bp, Homo sapien
tttcacaaacctgatttttcggaat

SEQ ID NO: 203091 - DNA, 25 bp, Homo sapien
gtagcctggaagaaaggatattctt

SEQ ID NO: 203092 - DNA, 25 bp, Homo sapien
aaggatattctttactaacatggtt

SEQ ID NO: 203093 - DNA, 25 bp, Homo sapien
ttactaacatggttacctgcagcca

SEQ ID NO: 203094 - DNA, 25 bp, Homo sapien
gttacctgcagccaggtgcatttca

SEQ ID NO: 203095 - DNA, 25 bp, Homo sapien
cagccaggtgcatttcaagtgaagt

SEQ ID NO: 203096 - DNA, 25 bp, Homo sapien
ttggcctggtcgagctttggtcagc

SEQ ID NO: 203097 - DNA, 25 bp, Homo sapien
ctggtcgagctttggtcagctgcgt

SEQ ID NO: 203098 - DNA, 25 bp, Homo sapien
catggttcttggcagcctggtgtcc

SEQ ID NO: 203099 - DNA, 25 bp, Homo sapien
ctggtgtccacacggtgcattcctg

SEQ ID NO: 203100 - DNA, 25 bp, Homo sapien
aggctggctcagctctccagtgctg

SEQ ID NO: 203101 - DNA, 25 bp, Homo sapien
tgcggcgctgtctttgcagcattgc

SEQ ID NO: 203102 - DNA, 25 bp, Homo sapien
ctttgcagcattgccatgtcaccgt

SEQ ID NO: 203103 - DNA, 25 bp, Homo sapien
ggcttcaaggtttattctggcaaga

SEQ ID NO: 203104 - DNA, 25 bp, Homo sapien
tttattctggcaagaacacctcgga

SEQ ID NO: 203105 - DNA, 25 bp, Homo sapien
ggagccactgcattgttttgccaaa

SEQ ID NO: 203106 - DNA, 25 bp, Homo sapien
ttgttttgccaaaaacttactgcag

SEQ ID NO: 203107 - DNA, 25 bp, Homo sapien
gggctgcttttaccacgcccgatca

SEQ ID NO: 203108 - DNA, 25 bp, Homo sapien
agcgtggcctcctctggcagtgagc

SEQ ID NO: 203109 - DNA, 25 bp, Homo sapien
agccggaacaccttccaggaggatg

SEQ ID NO: 203110 - DNA, 25 bp, Homo sapien
ggcagtggcatgaaagatgtgccct

SEQ ID NO: 203111 - DNA, 25 bp, Homo sapien
tcaagagcctccgtttgcacaagta

SEQ ID NO: 203112 - DNA, 25 bp, Homo sapien
gtttgcacaagtatgcagccctctt

SEQ ID NO: 203113 - DNA, 25 bp, Homo sapien
cctcttctcacagaatcagctttga

SEQ ID NO: 203114 - DNA, 25 bp, Homo sapien
gtacagtttttctcgctgttggaga

SEQ ID NO: 203115 - DNA, 25 bp, Homo sapien
gaagacttatttgttggagtttcac

SEQ ID NO: 203116 - DNA, 25 bp, Homo sapien
tggagtttcacttgtttaatggtct

SEQ ID NO: 203117 - DNA, 25 bp, Homo sapien
gtttaatggtctgggcttattttgg

SEQ ID NO: 203118 - DNA, 25 bp, Homo sapien
gcaaagttttggtcagtcatataca

SEQ ID NO: 203119 - DNA, 25 bp, Homo sapien
taaagaatcatctcaccccgaaatg

SEQ ID NO: 203120 - DNA, 25 bp, Homo sapien
tctcaccccgaaatgcaaattgcag

SEQ ID NO: 203121 - DNA, 25 bp, Homo sapien
aaattgcaggcccattgagatacac

SEQ ID NO: 203122 - DNA, 25 bp, Homo sapien
aggcccattgagatacacagcaagt

SEQ ID NO: 203123 - DNA, 25 bp, Homo sapien
agttagtttatactcttgatgtgaa

SEQ ID NO: 203124 - DNA, 25 bp, Homo sapien
gttagaattgcagtgtcataccaaa

SEQ ID NO: 203125 - DNA, 25 bp, Homo sapien
atgagccatcaagtgaagcttatga

SEQ ID NO: 203126 - DNA, 25 bp, Homo sapien
gtgaagcttatgaacctggaggtaa

SEQ ID NO: 203127 - DNA, 25 bp, Homo sapien
aaaaaatgcttatctgttaaactga

SEQ ID NO: 203128 - DNA, 25 bp, Homo sapien
tgttaaactgaggtttcattgacgt

SEQ ID NO: 203129 - DNA, 25 bp, Homo sapien
ggtttattgcaggtggacctgagca

SEQ ID NO: 203130 - DNA, 25 bp, Homo sapien
gtggacctgagcagcccttgcatat

SEQ ID NO: 203131 - DNA, 25 bp, Homo sapien
acctgagcagcccttgcatatggga

SEQ ID NO: 203132 - DNA, 25 bp, Homo sapien
tgagcagcccttgcatatgggaaca

SEQ ID NO: 203133 - DNA, 25 bp, Homo sapien
cagcccttgcatatgggaacaggat

SEQ ID NO: 203134 - DNA, 25 bp, Homo sapien
ccttgcatatgggaacaggatgatg

SEQ ID NO: 203135 - DNA, 25 bp, Homo sapien
tctggacaagggagcaggcagtcca

SEQ ID NO: 203136 - DNA, 25 bp, Homo sapien
ccacaggctgtgcttctaggactgt

SEQ ID NO: 203137 - DNA, 25 bp, Homo sapien
ccctgtgtggcccatgaagttgtga

SEQ ID NO: 203138 - DNA, 25 bp, Homo sapien
gtgtggcccatgaagttgtgaagtc

SEQ ID NO: 203139 - DNA, 25 bp, Homo sapien
ggcccatgaagttgtgaagtcaaat

SEQ ID NO: 203140 - DNA, 25 bp, Homo sapien
cagaatcagctttgagtaactgtac

SEQ ID NO: 203141 - DNA, 25 bp, Homo sapien
atcagctttgagtaactgtacagtt

SEQ ID NO: 203142 - DNA, 25 bp, Homo sapien
gtaactgtacagtttttctcgctgt

SEQ ID NO: 203143 - DNA, 25 bp, Homo sapien
actgtacagtttttctcgctgttgg

SEQ ID NO: 203144 - DNA, 25 bp, Homo sapien
gtacagtttttctcgctgttggaga

SEQ ID NO: 203145 - DNA, 25 bp, Homo sapien
gtttttctcgctgttggagaagact

SEQ ID NO: 203146 - DNA, 25 bp, Homo sapien
tcgctgttggagaagacttatttgt

SEQ ID NO: 203147 - DNA, 25 bp, Homo sapien
gaagacttatttgttggagtttcac

SEQ ID NO: 203148 - DNA, 25 bp, Homo sapien
gacttatttgttggagtttcacttg

SEQ ID NO: 203149 - DNA, 25 bp, Homo sapien
tggagtttcacttgtttaatggtct

SEQ ID NO: 203150 - DNA, 25 bp, Homo sapien
gtttaatggtctgggcttattttgg

SEQ ID NO: 203151 - DNA, 25 bp, Homo sapien
gtttctacacctgtgggttatgaca

SEQ ID NO: 203152 - DNA, 25 bp, Homo sapien
gggttatgacaaagacaactgccaa

SEQ ID NO: 203153 - DNA, 25 bp, Homo sapien
aggactgcaagtatatcgtggtgga

SEQ ID NO: 203154 - DNA, 25 bp, Homo sapien
ctgttctgtcagtgaatggataatc

SEQ ID NO: 203155 - DNA, 25 bp, Homo sapien
aatctaatgtgcttctagtaggcac

SEQ ID NO: 203156 - DNA, 25 bp, Homo sapien
atgtgcttctagtaggcacagggct

SEQ ID NO: 203157 - DNA, 25 bp, Homo sapien
ctggcctctaatagtcaatgattgt

SEQ ID NO: 203158 - DNA, 25 bp, Homo sapien
gttgtgatctttgccaccttcgtga

SEQ ID NO: 203159 - DNA, 25 bp, Homo sapien
accttcgtgactttatgcaatgcat

SEQ ID NO: 203160 - DNA, 25 bp, Homo sapien
aatgcatcatgctatttcataccta

SEQ ID NO: 203161 - DNA, 25 bp, Homo sapien
ttcatacctaatgagggagttccag

SEQ ID NO: 203162 - DNA, 25 bp, Homo sapien
ggtaacttcaatgtaatagcttcct

SEQ ID NO: 203163 - DNA, 25 bp, Homo sapien
gtaatagcttcctttaagagtacag

SEQ ID NO: 203164 - DNA, 25 bp, Homo sapien
caggaaaatgcattctgtaatgaag

SEQ ID NO: 203165 - DNA, 25 bp, Homo sapien
agtggggcccatgtaattgtttata

SEQ ID NO: 203166 - DNA, 25 bp, Homo sapien
gttttaagcaggtatagtgcaggct

SEQ ID NO: 203167 - DNA, 25 bp, Homo sapien
tatagtgcaggcttgttaggaatgt

SEQ ID NO: 203168 - DNA, 25 bp, Homo sapien
aaattcttcaaatatgccctagtta

SEQ ID NO: 203169 - DNA, 25 bp, Homo sapien
atatgccctagttaactatttcagc

SEQ ID NO: 203170 - DNA, 25 bp, Homo sapien
aactatttcagcataccatttttac

SEQ ID NO: 203171 - DNA, 25 bp, Homo sapien
tttttacttggttaacagtgtacat

SEQ ID NO: 203172 - DNA, 25 bp, Homo sapien
gtacattttgataacctatcaggaa

SEQ ID NO: 203173 - DNA, 25 bp, Homo sapien
gagaattctggttgtaatagatgac

SEQ ID NO: 203174 - DNA, 25 bp, Homo sapien
agatgacagtacatatgatctgcag

SEQ ID NO: 203175 - DNA, 25 bp, Homo sapien
gtacatatgatctgcaggtttgggc

SEQ ID NO: 203176 - DNA, 25 bp, Homo sapien
tatgctttcatcattaaattatctg

SEQ ID NO: 203177 - DNA, 25 bp, Homo sapien
gataaagttacaagtcacaaaggag

SEQ ID NO: 203178 - DNA, 25 bp, Homo sapien
catactatttacatatgtgtagctt

SEQ ID NO: 203179 - DNA, 25 bp, Homo sapien
gtagcttagtaaggcattaacataa

SEQ ID NO: 203180 - DNA, 25 bp, Homo sapien
aaacagatgcatatttcctcaacat

SEQ ID NO: 203181 - DNA, 25 bp, Homo sapien
atatttcctcaacatactgtgtcag

SEQ ID NO: 203182 - DNA, 25 bp, Homo sapien
actgtgtcaggtatactgttttata

SEQ ID NO: 203183 - DNA, 25 bp, Homo sapien
ttggttgttttagccttattgcaca

SEQ ID NO: 203184 - DNA, 25 bp, Homo sapien
ggattgtatttggacctacccttct

SEQ ID NO: 203185 - DNA, 25 bp, Homo sapien
ctacccttctgcgagctgaaaatga

SEQ ID NO: 203186 - DNA, 25 bp, Homo sapien
atggcgatccacatggtctaccaga

SEQ ID NO: 203187 - DNA, 25 bp, Homo sapien
ggtctaccagaaccagatagctgag

SEQ ID NO: 203188 - DNA, 25 bp, Homo sapien
atagctgagctcatgctgagtgagt

SEQ ID NO: 203189 - DNA, 25 bp, Homo sapien
agtacagtaagatcttcggctcaga

SEQ ID NO: 203190 - DNA, 25 bp, Homo sapien
gacaagacaagctactgaatacgtt

SEQ ID NO: 203191 - DNA, 25 bp, Homo sapien
tgaatacgttcacatctgtcttgat

SEQ ID NO: 203192 - DNA, 25 bp, Homo sapien
atctgtcttgatgcctaatattttt

SEQ ID NO: 203193 - DNA, 25 bp, Homo sapien
atattttttgcctttcaagcgacag

SEQ ID NO: 203194 - DNA, 25 bp, Homo sapien
agcgacagatgcctcattttgtgaa

SEQ ID NO: 203195 - DNA, 25 bp, Homo sapien
ggagcgcaggaagtcactaccattt

SEQ ID NO: 203196 - DNA, 25 bp, Homo sapien
gttcataggacttctgatgtgttca

SEQ ID NO: 203197 - DNA, 25 bp, Homo sapien
gatgtgttcagataggaatcctcat

SEQ ID NO: 203198 - DNA, 25 bp, Homo sapien
gatcattatgctttgtgccctggac

SEQ ID NO: 203199 - DNA, 25 bp, Homo sapien
tgccgctctgggttctcaggaggaa

SEQ ID NO: 203200 - DNA, 25 bp, Homo sapien
gcaagggcagcttcattctaagcct

SEQ ID NO: 203201 - DNA, 25 bp, Homo sapien
gcttcattctaagcctttccagtga

SEQ ID NO: 203202 - DNA, 25 bp, Homo sapien
tctcttctacaacactaaggctcct

SEQ ID NO: 203203 - DNA, 25 bp, Homo sapien
aacactaaggctcctctgtcagagg

SEQ ID NO: 203204 - DNA, 25 bp, Homo sapien
aggaggtcgtcttgtttttgcttca

SEQ ID NO: 203205 - DNA, 25 bp, Homo sapien
ttcattgcatgacataacccttccc

SEQ ID NO: 203206 - DNA, 25 bp, Homo sapien
tatgcaagtcgcctactctctgcta

SEQ ID NO: 203207 - DNA, 25 bp, Homo sapien
gctacctggacgttcattcttatgt

SEQ ID NO: 203208 - DNA, 25 bp, Homo sapien
agggaggctgcgctccttcagactt

SEQ ID NO: 203209 - DNA, 25 bp, Homo sapien
gacttgctgcagaatcattttgtat

SEQ ID NO: 203210 - DNA, 25 bp, Homo sapien
gtatcatgtatggtctgtgtctccc

SEQ ID NO: 203211 - DNA, 25 bp, Homo sapien
atggatggtgactgctggctctgtc

SEQ ID NO: 203212 - DNA, 25 bp, Homo sapien
gctctgtcacctcatcaaactggat

SEQ ID NO: 203213 - DNA, 25 bp, Homo sapien
aaactggatgtgacccatgccgcct

SEQ ID NO: 203214 - DNA, 25 bp, Homo sapien
atgccgcctcgttggattgtcggaa

SEQ ID NO: 203215 - DNA, 25 bp, Homo sapien
aattgctacttgataaggaccgaac

SEQ ID NO: 203216 - DNA, 25 bp, Homo sapien
ggaccgaacattattctagtttcat

SEQ ID NO: 203217 - DNA, 25 bp, Homo sapien
cagtgctgcaatgcccagacaaacg

SEQ ID NO: 203218 - DNA, 25 bp, Homo sapien
agcacacccaccagtttctaaaatg

SEQ ID NO: 203219 - DNA, 25 bp, Homo sapien
tatcatccctatctattgtaaccca

SEQ ID NO: 203220 - DNA, 25 bp, Homo sapien
aaaagacctaccatcgcatcagtga

SEQ ID NO: 203221 - DNA, 25 bp, Homo sapien
tcgcatcagtgaagtccgaacacat

SEQ ID NO: 203222 - DNA, 25 bp, Homo sapien
gaaaggcttgtcaatttcatattcc

SEQ ID NO: 203223 - DNA, 25 bp, Homo sapien
atattccttgaattggcttcttggt

SEQ ID NO: 203224 - DNA, 25 bp, Homo sapien
ggcttcttggtgaggattttctgac

SEQ ID NO: 203225 - DNA, 25 bp, Homo sapien
gagtgatacccatcaattttctatc

SEQ ID NO: 203226 - DNA, 25 bp, Homo sapien
gtgaagttcacagttgacaaacaac

SEQ ID NO: 203227 - DNA, 25 bp, Homo sapien
taatgtttcccttggatgttttgac

SEQ ID NO: 203228 - DNA, 25 bp, Homo sapien
gctgtctcagcagccaatcaactta

SEQ ID NO: 203229 - DNA, 25 bp, Homo sapien
gtctcagcagccaatcaacttatag

SEQ ID NO: 203230 - DNA, 25 bp, Homo sapien
gcagccaatcaacttatagtttatt

SEQ ID NO: 203231 - DNA, 25 bp, Homo sapien
gttttctttctaatcgaggtgtgaa

SEQ ID NO: 203232 - DNA, 25 bp, Homo sapien
ggtgtgaaaaagttctaggttcagt

SEQ ID NO: 203233 - DNA, 25 bp, Homo sapien
taggttcagttgaagttctgatgaa

SEQ ID NO: 203234 - DNA, 25 bp, Homo sapien
caattgagattttttcagtgataaa

SEQ ID NO: 203235 - DNA, 25 bp, Homo sapien
aaaatctgcatatttgtatttcaac

SEQ ID NO: 203236 - DNA, 25 bp, Homo sapien
caacaatgtagctaaaacttgatgt

SEQ ID NO: 203237 - DNA, 25 bp, Homo sapien
tctttatactatatgttccacgtgt

SEQ ID NO: 203238 - DNA, 25 bp, Homo sapien
atactatatgttccacgtgttaaga

SEQ ID NO: 203239 - DNA, 25 bp, Homo sapien
acgccttcttcaaagccatactatt

SEQ ID NO: 203240 - DNA, 25 bp, Homo sapien
atactatttatgtgctccggatcca

SEQ ID NO: 203241 - DNA, 25 bp, Homo sapien
aggaggactactcaaaaccatacct

SEQ ID NO: 203242 - DNA, 25 bp, Homo sapien
cattggcagcctagcattagcagga

SEQ ID NO: 203243 - DNA, 25 bp, Homo sapien
tttcctcacaggtttctactccaaa

SEQ ID NO: 203244 - DNA, 25 bp, Homo sapien
gtttctactccaaagaccacatcat

SEQ ID NO: 203245 - DNA, 25 bp, Homo sapien
aaagaccacatcatcgaaaccgcaa

SEQ ID NO: 203246 - DNA, 25 bp, Homo sapien
catatcatacacaaacgcctgagcc

SEQ ID NO: 203247 - DNA, 25 bp, Homo sapien
acaaacgcctgagccctatctatta

SEQ ID NO: 203248 - DNA, 25 bp, Homo sapien
tatctattactctcatcgctacctc

SEQ ID NO: 203249 - DNA, 25 bp, Homo sapien
gacaagcgcctatagcactcgaata

SEQ ID NO: 203250 - DNA, 25 bp, Homo sapien
ataagtgaaagttaatgccaataga

SEQ ID NO: 203251 - DNA, 25 bp, Homo sapien
atgtacaatgtcagaaaagggattc

SEQ ID NO: 203252 - DNA, 25 bp, Homo sapien
aaagggattctttatgtgtaaatgg

SEQ ID NO: 203253 - DNA, 25 bp, Homo sapien
gggataatacctatttcacaaggtt

SEQ ID NO: 203254 - DNA, 25 bp, Homo sapien
ctatttcacaaggttgttctgagga

SEQ ID NO: 203255 - DNA, 25 bp, Homo sapien
ggttgttctgaggattgatacgttt

SEQ ID NO: 203256 - DNA, 25 bp, Homo sapien
ttctgaggattgatacgttttgagt

SEQ ID NO: 203257 - DNA, 25 bp, Homo sapien
atgtatttgtacactatctggcaca

SEQ ID NO: 203258 - DNA, 25 bp, Homo sapien
tgtacactatctggcacatatgcgc

SEQ ID NO: 203259 - DNA, 25 bp, Homo sapien
actatctggcacatatgcgctcaat

SEQ ID NO: 203260 - DNA, 25 bp, Homo sapien
tatgcgctcaataaacgtgtttctc

SEQ ID NO: 203261 - DNA, 25 bp, Homo sapien
tttctcttacttccaaacttagtca

SEQ ID NO: 203262 - DNA, 25 bp, Homo sapien
ttctcttacttccaaacttagtcat

SEQ ID NO: 203263 - DNA, 25 bp, Homo sapien
tctcttacttccaaacttagtcatt

SEQ ID NO: 203264 - DNA, 25 bp, Homo sapien
ctcttacttccaaacttagtcatta

SEQ ID NO: 203265 - DNA, 25 bp, Homo sapien
tcttacttccaaacttagtcattat

SEQ ID NO: 203266 - DNA, 25 bp, Homo sapien
cttacttccaaacttagtcattata

SEQ ID NO: 203267 - DNA, 25 bp, Homo sapien
ttacttccaaacttagtcattataa

SEQ ID NO: 203268 - DNA, 25 bp, Homo sapien
tacttccaaacttagtcattataag

SEQ ID NO: 203269 - DNA, 25 bp, Homo sapien
acttccaaacttagtcattataaga

SEQ ID NO: 203270 - DNA, 25 bp, Homo sapien
gtcattataagaagatgtaggccag

SEQ ID NO: 203271 - DNA, 25 bp, Homo sapien
tcattataagaagatgtaggccagg

SEQ ID NO: 203272 - DNA, 25 bp, Homo sapien
acctctgccccgatggtgtgaaggg

SEQ ID NO: 203273 - DNA, 25 bp, Homo sapien
cgaggttccttagtggcagggcttt

SEQ ID NO: 203274 - DNA, 25 bp, Homo sapien
gtggcagggctttgctgttcttcac

SEQ ID NO: 203275 - DNA, 25 bp, Homo sapien
tctgctgttaacttctttcctactt

SEQ ID NO: 203276 - DNA, 25 bp, Homo sapien
tttcctacttttcttgcatccctct

SEQ ID NO: 203277 - DNA, 25 bp, Homo sapien
cttttcctgccgtctttcttgtaga

SEQ ID NO: 203278 - DNA, 25 bp, Homo sapien
ctgccgtctttcttgtagacatact

SEQ ID NO: 203279 - DNA, 25 bp, Homo sapien
gtagacatactagttgattgctgta

SEQ ID NO: 203280 - DNA, 25 bp, Homo sapien
gattgctgtatttgctgactttata

SEQ ID NO: 203281 - DNA, 25 bp, Homo sapien
tattttttcctctggccaaaattgt

SEQ ID NO: 203282 - DNA, 25 bp, Homo sapien
gaaaatgtcttgcttttgatcactt

SEQ ID NO: 203283 - DNA, 25 bp, Homo sapien
gcaatgatgggaagccggagcccgt

SEQ ID NO: 203284 - DNA, 25 bp, Homo sapien
agccggagcccgtgttgagttttct

SEQ ID NO: 203285 - DNA, 25 bp, Homo sapien
ggagcccgtgttgagttttctgccc

SEQ ID NO: 203286 - DNA, 25 bp, Homo sapien
cccgtgttgagttttctgccccaga

SEQ ID NO: 203287 - DNA, 25 bp, Homo sapien
ttctgccccagaaggactgcaccaa

SEQ ID NO: 203288 - DNA, 25 bp, Homo sapien
tgccccagaaggactgcaccaatgg

SEQ ID NO: 203289 - DNA, 25 bp, Homo sapien
aggactgcaccaatggcgtgagcct

SEQ ID NO: 203290 - DNA, 25 bp, Homo sapien
accaatggcgtgagcctgcacccta

SEQ ID NO: 203291 - DNA, 25 bp, Homo sapien
aggagctgggccttcccttgctctc

SEQ ID NO: 203292 - DNA, 25 bp, Homo sapien
acgtccaccttgaatgtcggcttca

SEQ ID NO: 203293 - DNA, 25 bp, Homo sapien
cctgatgatcaccagggcgagaaag

SEQ ID NO: 203294 - DNA, 25 bp, Homo sapien
cacaggccaaagcatcagcaccaga

SEQ ID NO: 203295 - DNA, 25 bp, Homo sapien
atcagcaccagaacgcacacccagc

SEQ ID NO: 203296 - DNA, 25 bp, Homo sapien
ggtgcttgcacaccgccttgcacat

SEQ ID NO: 203297 - DNA, 25 bp, Homo sapien
ttgcacaccgccttgcacatagcag

SEQ ID NO: 203298 - DNA, 25 bp, Homo sapien
tgcacaccgccttgcacatagcaga

SEQ ID NO: 203299 - DNA, 25 bp, Homo sapien
cacaccgccttgcacatagcagagg

SEQ ID NO: 203300 - DNA, 25 bp, Homo sapien
caccgccttgcacatagcagaggct

SEQ ID NO: 203301 - DNA, 25 bp, Homo sapien
aaggaagatgcctgtcctctccgtg

SEQ ID NO: 203302 - DNA, 25 bp, Homo sapien
aggaagatgcctgtcctctccgtgg

SEQ ID NO: 203303 - DNA, 25 bp, Homo sapien
ggaagatgcctgtcctctccgtgga

SEQ ID NO: 203304 - DNA, 25 bp, Homo sapien
ggctgtgttcttgctggtgagcaaa

SEQ ID NO: 203305 - DNA, 25 bp, Homo sapien
agtcccaagaccaaagtgaccacag

SEQ ID NO: 203306 - DNA, 25 bp, Homo sapien
accaaagtgaccacagtgacctctg

SEQ ID NO: 203307 - DNA, 25 bp, Homo sapien
tctgcccagaagtccagtcagattg

SEQ ID NO: 203308 - DNA, 25 bp, Homo sapien
cagtcagattggaagttctcagctg

SEQ ID NO: 203309 - DNA, 25 bp, Homo sapien
gaagagacatgtgcagcggacagaa

SEQ ID NO: 203310 - DNA, 25 bp, Homo sapien
gacagaagctgtgctgacccacaaa

SEQ ID NO: 203311 - DNA, 25 bp, Homo sapien
gctgacccacaaacaagctcaagtt

SEQ ID NO: 203312 - DNA, 25 bp, Homo sapien
tgtctactcttggtttcaccactag

SEQ ID NO: 203313 - DNA, 25 bp, Homo sapien
ttcaccactagaacagtcttgggct

SEQ ID NO: 203314 - DNA, 25 bp, Homo sapien
acagtcttgggctggatgggttata

SEQ ID NO: 203315 - DNA, 25 bp, Homo sapien
agagctgagcggctgtgatggttct

SEQ ID NO: 203316 - DNA, 25 bp, Homo sapien
aggtggggtttcatgtttcaccgtg

SEQ ID NO: 203317 - DNA, 25 bp, Homo sapien
ggtggggtttcatgtttcaccgtgt

SEQ ID NO: 203318 - DNA, 25 bp, Homo sapien
gtggggtttcatgtttcaccgtgtt

SEQ ID NO: 203319 - DNA, 25 bp, Homo sapien
tggggtttcatgtttcaccgtgttg

SEQ ID NO: 203320 - DNA, 25 bp, Homo sapien
ggggtttcatgtttcaccgtgttgt

SEQ ID NO: 203321 - DNA, 25 bp, Homo sapien
gggtttcatgtttcaccgtgttgtc

SEQ ID NO: 203322 - DNA, 25 bp, Homo sapien
ggtttcatgtttcaccgtgttgtcc

SEQ ID NO: 203323 - DNA, 25 bp, Homo sapien
gtttcatgtttcaccgtgttgtcca

SEQ ID NO: 203324 - DNA, 25 bp, Homo sapien
tttcatgtttcaccgtgttgtccag

SEQ ID NO: 203325 - DNA, 25 bp, Homo sapien
ttcatgtttcaccgtgttgtccagg

SEQ ID NO: 203326 - DNA, 25 bp, Homo sapien
cgcctcagcctcccagctacttagg

SEQ ID NO: 203327 - DNA, 25 bp, Homo sapien
tggctttcaattttttctcttactt

SEQ ID NO: 203328 - DNA, 25 bp, Homo sapien
tttctcttacttccaaacttagtca

SEQ ID NO: 203329 - DNA, 25 bp, Homo sapien
ttctcttacttccaaacttagtcat

SEQ ID NO: 203330 - DNA, 25 bp, Homo sapien
tctcttacttccaaacttagtcatt

SEQ ID NO: 203331 - DNA, 25 bp, Homo sapien
ctcttacttccaaacttagtcatta

SEQ ID NO: 203332 - DNA, 25 bp, Homo sapien
tcttacttccaaacttagtcattat

SEQ ID NO: 203333 - DNA, 25 bp, Homo sapien
cttacttccaaacttagtcattata

SEQ ID NO: 203334 - DNA, 25 bp, Homo sapien
ttacttccaaacttagtcattataa

SEQ ID NO: 203335 - DNA, 25 bp, Homo sapien
acttccaaacttagtcattataaga

SEQ ID NO: 203336 - DNA, 25 bp, Homo sapien
gtcattataagaagatgtaggccag

SEQ ID NO: 203337 - DNA, 25 bp, Homo sapien
ttataagaagatgtaggccaggcgc

SEQ ID NO: 203338 - DNA, 25 bp, Homo sapien
gagtactttctgcttaattaatttt

SEQ ID NO: 203339 - DNA, 25 bp, Homo sapien
ttaactcttcagtagaggtttacaa

SEQ ID NO: 203340 - DNA, 25 bp, Homo sapien
attacaaattcattcccagcctagg

SEQ ID NO: 203341 - DNA, 25 bp, Homo sapien
aattcattcccagcctaggctctgg

SEQ ID NO: 203342 - DNA, 25 bp, Homo sapien
atttcctgttcttgaattctgctcc

SEQ ID NO: 203343 - DNA, 25 bp, Homo sapien
aattctgctcctgaagagggtgaac

SEQ ID NO: 203344 - DNA, 25 bp, Homo sapien
ctgctcctgaagagggtgaacaaat

SEQ ID NO: 203345 - DNA, 25 bp, Homo sapien
ttcaagttgtgagctcagaattact

SEQ ID NO: 203346 - DNA, 25 bp, Homo sapien
gtgagctcagaattactttaaaagg

SEQ ID NO: 203347 - DNA, 25 bp, Homo sapien
aaaaggaggtaacagccagccatta

SEQ ID NO: 203348 - DNA, 25 bp, Homo sapien
acagccagccattacacctaaattt

SEQ ID NO: 203349 - DNA, 25 bp, Homo sapien
caaccacctggtgagtcagagcatt

SEQ ID NO: 203350 - DNA, 25 bp, Homo sapien
accacctggtgagtcagagcattat

SEQ ID NO: 203351 - DNA, 25 bp, Homo sapien
acctggtgagtcagagcattataaa

SEQ ID NO: 203352 - DNA, 25 bp, Homo sapien
aacattaatcagtatgctggccaga

SEQ ID NO: 203353 - DNA, 25 bp, Homo sapien
attaatcagtatgctggccagaatg

SEQ ID NO: 203354 - DNA, 25 bp, Homo sapien
ggccagaatgcttaaaatcctaact

SEQ ID NO: 203355 - DNA, 25 bp, Homo sapien
aatcctaactttccttaatgcttca

SEQ ID NO: 203356 - DNA, 25 bp, Homo sapien
ttaatgcttcaatagaattaagcca

SEQ ID NO: 203357 - DNA, 25 bp, Homo sapien
agccaaattaattgggtggattttg

SEQ ID NO: 203358 - DNA, 25 bp, Homo sapien
attttatgggtctttatgaggcttt

SEQ ID NO: 203359 - DNA, 25 bp, Homo sapien
ttatgggtctttatgaggctttaaa

SEQ ID NO: 203360 - DNA, 25 bp, Homo sapien
tgttccccccggcaggcagggacaa

SEQ ID NO: 203361 - DNA, 25 bp, Homo sapien
cagggacaagatggcatggcaagca

SEQ ID NO: 203362 - DNA, 25 bp, Homo sapien
gacaagatggcatggcaagcatggg

SEQ ID NO: 203363 - DNA, 25 bp, Homo sapien
gggagggatgctgcatttctcagct

SEQ ID NO: 203364 - DNA, 25 bp, Homo sapien
gagggatgctgcatttctcagctgg

SEQ ID NO: 203365 - DNA, 25 bp, Homo sapien
agggatgctgcatttctcagctggg

SEQ ID NO: 203366 - DNA, 25 bp, Homo sapien
gggatgctgcatttctcagctgggc

SEQ ID NO: 203367 - DNA, 25 bp, Homo sapien
tctcagctgggcagtaatcaattta

SEQ ID NO: 203368 - DNA, 25 bp, Homo sapien
ctcagctgggcagtaatcaatttaa

SEQ ID NO: 203369 - DNA, 25 bp, Homo sapien
ttaagaataccacactttaatatta

SEQ ID NO: 203370 - DNA, 25 bp, Homo sapien
gaataccacactttaatattaaata

SEQ ID NO: 203371 - DNA, 25 bp, Homo sapien
gcactgccactgtgctcggaggtgc

SEQ ID NO: 203372 - DNA, 25 bp, Homo sapien
cactgtgctcggaggtgccctggac

SEQ ID NO: 203373 - DNA, 25 bp, Homo sapien
gtgccctggactgtgtacatctgaa

SEQ ID NO: 203374 - DNA, 25 bp, Homo sapien
actgtgtacatctgaactttggtcc

SEQ ID NO: 203375 - DNA, 25 bp, Homo sapien
tgaactttggtccatcctttgatgt

SEQ ID NO: 203376 - DNA, 25 bp, Homo sapien
cctttgatgtgtggttcgttagcca

SEQ ID NO: 203377 - DNA, 25 bp, Homo sapien
gtgtggttcgttagccacaaagaga

SEQ ID NO: 203378 - DNA, 25 bp, Homo sapien
tatccagattattgtatgaagttgt

SEQ ID NO: 203379 - DNA, 25 bp, Homo sapien
gaaacacctgaaaaagcattctgga

SEQ ID NO: 203380 - DNA, 25 bp, Homo sapien
gcattctggagtgctgaatttttaa

SEQ ID NO: 203381 - DNA, 25 bp, Homo sapien
tattttgttaagcatattctctaaa

SEQ ID NO: 203382 - DNA, 25 bp, Homo sapien
gaactttctaagtctgtgatccccg

SEQ ID NO: 203383 - DNA, 25 bp, Homo sapien
tgtgatccccgtgctgactgtggaa

SEQ ID NO: 203384 - DNA, 25 bp, Homo sapien
gaatatatctggactggtaaaatct

SEQ ID NO: 203385 - DNA, 25 bp, Homo sapien
actggtaaaatcttgatgaggctca

SEQ ID NO: 203386 - DNA, 25 bp, Homo sapien
gtttgggaattgtgtatagctgatt

SEQ ID NO: 203387 - DNA, 25 bp, Homo sapien
atagctgattttttgtgggaaactg

SEQ ID NO: 203388 - DNA, 25 bp, Homo sapien
actgtttacttcattcaaaggttct

SEQ ID NO: 203389 - DNA, 25 bp, Homo sapien
attcaaaggttcttgagactcttga

SEQ ID NO: 203390 - DNA, 25 bp, Homo sapien
actcttgatatttctgtcttctcct

SEQ ID NO: 203391 - DNA, 25 bp, Homo sapien
ttagtttgttagacgtgagttatcc

SEQ ID NO: 203392 - DNA, 25 bp, Homo sapien
gacgtgagttatccaagtatttatt

SEQ ID NO: 203393 - DNA, 25 bp, Homo sapien
agctgaggttttatccactggacac

SEQ ID NO: 203394 - DNA, 25 bp, Homo sapien
tttatccactggacacatttgtgtg

SEQ ID NO: 203395 - DNA, 25 bp, Homo sapien
acatttgtgtgtgagaactaggtct

SEQ ID NO: 203396 - DNA, 25 bp, Homo sapien
aactaggtcttgttgaggttagcgt

SEQ ID NO: 203397 - DNA, 25 bp, Homo sapien
ggttagcgtaacctggtatatgcaa

SEQ ID NO: 203398 - DNA, 25 bp, Homo sapien
gtatatgcaactaccatcctctggg

SEQ ID NO: 203399 - DNA, 25 bp, Homo sapien
agctgtggaagctgctgcacttgtg

SEQ ID NO: 203400 - DNA, 25 bp, Homo sapien
gctgctgcacttgtgaagaatcctg

SEQ ID NO: 203401 - DNA, 25 bp, Homo sapien
tgagctttgattcctcttcagtcta

SEQ ID NO: 203402 - DNA, 25 bp, Homo sapien
ttcagtctacgcatttctctcttcc

SEQ ID NO: 203403 - DNA, 25 bp, Homo sapien
gataaggtcagtagagttccagaat

SEQ ID NO: 203404 - DNA, 25 bp, Homo sapien
gtgcaatatgacagcctgtcattga

SEQ ID NO: 203405 - DNA, 25 bp, Homo sapien
tgacagcctgtcattgaatctaaac

SEQ ID NO: 203406 - DNA, 25 bp, Homo sapien
gacagcctgtcattgaatctaaaca

SEQ ID NO: 203407 - DNA, 25 bp, Homo sapien
acagcctgtcattgaatctaaacaa

SEQ ID NO: 203408 - DNA, 25 bp, Homo sapien
cagcctgtcattgaatctaaacaac

SEQ ID NO: 203409 - DNA, 25 bp, Homo sapien
agcctgtcattgaatctaaacaact

SEQ ID NO: 203410 - DNA, 25 bp, Homo sapien
gcctgtcattgaatctaaacaactt

SEQ ID NO: 203411 - DNA, 25 bp, Homo sapien
cctgtcattgaatctaaacaactta

SEQ ID NO: 203412 - DNA, 25 bp, Homo sapien
gaatctaaacaacttaatttgcttg

SEQ ID NO: 203413 - DNA, 25 bp, Homo sapien
aacaacttaatttgcttgtattcat

SEQ ID NO: 203414 - DNA, 25 bp, Homo sapien
acaacttaatttgcttgtattcata

SEQ ID NO: 203415 - DNA, 25 bp, Homo sapien
aggtcacagactgtctcccggagtt

SEQ ID NO: 203416 - DNA, 25 bp, Homo sapien
gagttcatcggcagaggcatggcaa

SEQ ID NO: 203417 - DNA, 25 bp, Homo sapien
aggcatggcaatggcatccttctac

SEQ ID NO: 203418 - DNA, 25 bp, Homo sapien
cttctaccacgcaaggtgtcttcag

SEQ ID NO: 203419 - DNA, 25 bp, Homo sapien
ttcagcttggcttgggcatcaccag

SEQ ID NO: 203420 - DNA, 25 bp, Homo sapien
gggatgaaacaaccgctaaacacta

SEQ ID NO: 203421 - DNA, 25 bp, Homo sapien
taaagcttgtcgtctgaatcccgca

SEQ ID NO: 203422 - DNA, 25 bp, Homo sapien
gaatcccgcattggcagatgaactt

SEQ ID NO: 203423 - DNA, 25 bp, Homo sapien
agatgaacttcactccttacttatt

SEQ ID NO: 203424 - DNA, 25 bp, Homo sapien
agatcatcaatgctaacacctcaca

SEQ ID NO: 203425 - DNA, 25 bp, Homo sapien
tgtttggttattttgcacatcacaa

SEQ ID NO: 203426 - DNA, 25 bp, Homo sapien
gaatcaggatttcttaaatactcaa

SEQ ID NO: 203427 - DNA, 25 bp, Homo sapien
aatactcaacagagaggctgagcag

SEQ ID NO: 203428 - DNA, 25 bp, Homo sapien
aacagagaggctgagcagagcaaat

SEQ ID NO: 203429 - DNA, 25 bp, Homo sapien
gagactggaaactgccttcaaggcc

SEQ ID NO: 203430 - DNA, 25 bp, Homo sapien
gaaactgccttcaaggccacggctg

SEQ ID NO: 203431 - DNA, 25 bp, Homo sapien
tgccttcaaggccacggctggtcat

SEQ ID NO: 203432 - DNA, 25 bp, Homo sapien
aaggccacggctggtcatctgctga

SEQ ID NO: 203433 - DNA, 25 bp, Homo sapien
acggctggtcatctgctgaccacac

SEQ ID NO: 203434 - DNA, 25 bp, Homo sapien
aaaatcacttgcgtttttgaggctt

SEQ ID NO: 203435 - DNA, 25 bp, Homo sapien
cacttgcgtttttgaggcttaaatc

SEQ ID NO: 203436 - DNA, 25 bp, Homo sapien
gcgtttttgaggcttaaatcatcta

SEQ ID NO: 203437 - DNA, 25 bp, Homo sapien
acaaatttcatggagctgtgtacca

SEQ ID NO: 203438 - DNA, 25 bp, Homo sapien
agctgtgtaccatcgaagaaacctg

SEQ ID NO: 203439 - DNA, 25 bp, Homo sapien
ggtgtctggcatgaaattactgtaa

SEQ ID NO: 203440 - DNA, 25 bp, Homo sapien
atgaaaagcattggagcgtctgaat

SEQ ID NO: 203441 - DNA, 25 bp, Homo sapien
gaatgaaagacgtgacctcctgctg

SEQ ID NO: 203442 - DNA, 25 bp, Homo sapien
ctgggactctgatggtcttcagcat

SEQ ID NO: 203443 - DNA, 25 bp, Homo sapien
tgatggtcttcagcattcaccttcg

SEQ ID NO: 203444 - DNA, 25 bp, Homo sapien
agcattcaccttcgtgtgtcttcag

SEQ ID NO: 203445 - DNA, 25 bp, Homo sapien
gtgtcttcagtgtctcattgtcatc

SEQ ID NO: 203446 - DNA, 25 bp, Homo sapien
agtgtctcattgtcatccctgcttc

SEQ ID NO: 203447 - DNA, 25 bp, Homo sapien
cttctgtttggtcttagagtgtttg

SEQ ID NO: 203448 - DNA, 25 bp, Homo sapien
gatggtttggttggtcccagcaaag

SEQ ID NO: 203449 - DNA, 25 bp, Homo sapien
ggttggtcccagcaaagtatatgaa

SEQ ID NO: 203450 - DNA, 25 bp, Homo sapien
aaggaattgctgttactgtactgca

SEQ ID NO: 203451 - DNA, 25 bp, Homo sapien
tgcaaatatgctgtgggttctcggt

SEQ ID NO: 203452 - DNA, 25 bp, Homo sapien
ggttctcggtgttcaaactcttcta

SEQ ID NO: 203453 - DNA, 25 bp, Homo sapien
ggtgttcaaactcttctaaggaagg

SEQ ID NO: 203454 - DNA, 25 bp, Homo sapien
ggaaggacacacagtagctctctgc

SEQ ID NO: 203455 - DNA, 25 bp, Homo sapien
agtagctctctgcttgctgatagat

SEQ ID NO: 203456 - DNA, 25 bp, Homo sapien
ctgcttgctgatagatggtttccca

SEQ ID NO: 203457 - DNA, 25 bp, Homo sapien
gatggtttcccagtgtgagatttgt

SEQ ID NO: 203458 - DNA, 25 bp, Homo sapien
attttagtttagcttcctgatttat

SEQ ID NO: 203459 - DNA, 25 bp, Homo sapien
agcagtgtcactcccaaccccacca

SEQ ID NO: 203460 - DNA, 25 bp, Homo sapien
gcagtgtcactcccaaccccaccat

SEQ ID NO: 203461 - DNA, 25 bp, Homo sapien
cagtgtcactcccaaccccaccatg

SEQ ID NO: 203462 - DNA, 25 bp, Homo sapien
cctcagttgagagtgagcggggtac

SEQ ID NO: 203463 - DNA, 25 bp, Homo sapien
ctcagttgagagtgagcggggtaca

SEQ ID NO: 203464 - DNA, 25 bp, Homo sapien
cagttgagagtgagcggggtacagt

SEQ ID NO: 203465 - DNA, 25 bp, Homo sapien
agttgagagtgagcggggtacagta

SEQ ID NO: 203466 - DNA, 25 bp, Homo sapien
gttgagagtgagcggggtacagtaa

SEQ ID NO: 203467 - DNA, 25 bp, Homo sapien
ttgagagtgagcggggtacagtaag

SEQ ID NO: 203468 - DNA, 25 bp, Homo sapien
agagtgagcggggtacagtaaggca

SEQ ID NO: 203469 - DNA, 25 bp, Homo sapien
cggggtacagtaaggcagtgcttcc

SEQ ID NO: 203470 - DNA, 25 bp, Homo sapien
tgggcacgacgctggtcctgacctt

SEQ ID NO: 203471 - DNA, 25 bp, Homo sapien
gcacgacgctggtcctgaccttgtg

SEQ ID NO: 203472 - DNA, 25 bp, Homo sapien
acgacgctggtcctgaccttgtgcc

SEQ ID NO: 203473 - DNA, 25 bp, Homo sapien
cagaccttgatcctgtgcccagccc

SEQ ID NO: 203474 - DNA, 25 bp, Homo sapien
tgttctcccactcgtggcactgtca

SEQ ID NO: 203475 - DNA, 25 bp, Homo sapien
actcgtggcactgtcagcccagccc

SEQ ID NO: 203476 - DNA, 25 bp, Homo sapien
tccctaccggcgagagtccagagtg

SEQ ID NO: 203477 - DNA, 25 bp, Homo sapien
ccctaccggcgagagtccagagtgg

SEQ ID NO: 203478 - DNA, 25 bp, Homo sapien
ccggcgagagtccagagtgggtaca

SEQ ID NO: 203479 - DNA, 25 bp, Homo sapien
atggctgaaggagacgccggcatcc

SEQ ID NO: 203480 - DNA, 25 bp, Homo sapien
tggctgaaggagacgccggcatcct

SEQ ID NO: 203481 - DNA, 25 bp, Homo sapien
atgaaacgtcagtagagtcacactt

SEQ ID NO: 203482 - DNA, 25 bp, Homo sapien
tcacactttgtgtacagggatgtct

SEQ ID NO: 203483 - DNA, 25 bp, Homo sapien
agggatgtcttagtgcccagatgac

SEQ ID NO: 203484 - DNA, 25 bp, Homo sapien
agtgcccagatgacaagtgaatttt

SEQ ID NO: 203485 - DNA, 25 bp, Homo sapien
agaaatgcatagactgggattgggc

SEQ ID NO: 203486 - DNA, 25 bp, Homo sapien
gggcatgtggtaatcaataatcttt

SEQ ID NO: 203487 - DNA, 25 bp, Homo sapien
ataatggcagttccctttgtcagtg

SEQ ID NO: 203488 - DNA, 25 bp, Homo sapien
gttccctttgtcagtggttgttaca

SEQ ID NO: 203489 - DNA, 25 bp, Homo sapien
gtgtcatttgattactttgttccat

SEQ ID NO: 203490 - DNA, 25 bp, Homo sapien
gtcaaagacgtttattgggatacct

SEQ ID NO: 203491 - DNA, 25 bp, Homo sapien
gggataccttttacttggacaatat

SEQ ID NO: 203492 - DNA, 25 bp, Homo sapien
gactttcaaatctttggctgccttg

SEQ ID NO: 203493 - DNA, 25 bp, Homo sapien
ccagtaggaggcgacacgaaggatt

SEQ ID NO: 203494 - DNA, 25 bp, Homo sapien
gcgacacgaaggatttgctgctgcc

SEQ ID NO: 203495 - DNA, 25 bp, Homo sapien
atgggaaggaacctgaaggcatttt

SEQ ID NO: 203496 - DNA, 25 bp, Homo sapien
aaggcattttttccagagtggtgca

SEQ ID NO: 203497 - DNA, 25 bp, Homo sapien
ttttttccagagtggtgcagtacca

SEQ ID NO: 203498 - DNA, 25 bp, Homo sapien
tccagagtggtgcagtaccactgag

SEQ ID NO: 203499 - DNA, 25 bp, Homo sapien
ctgaggactgttgctgtattgatta

SEQ ID NO: 203500 - DNA, 25 bp, Homo sapien
gactgttgctgtattgattaggaaa

SEQ ID NO: 203501 - DNA, 25 bp, Homo sapien
gagacagagtaatttgcagtttgtt

SEQ ID NO: 203502 - DNA, 25 bp, Homo sapien
tatacttttgtttatctacaaccca

SEQ ID NO: 203503 - DNA, 25 bp, Homo sapien
gatgcagaggtggaaggccctgggc

SEQ ID NO: 203504 - DNA, 25 bp, Homo sapien
cacaggcgagagtgggcgtgtcacc

SEQ ID NO: 203505 - DNA, 25 bp, Homo sapien
acaggcgagagtgggcgtgtcacct

SEQ ID NO: 203506 - DNA, 25 bp, Homo sapien
gcccagggggcgtgctgtccagcag

SEQ ID NO: 203507 - DNA, 25 bp, Homo sapien
cgctcctgcctggtctgggctgtgt

SEQ ID NO: 203508 - DNA, 25 bp, Homo sapien
tgggctgtgtgtggcgccctttcct

SEQ ID NO: 203509 - DNA, 25 bp, Homo sapien
ctgtgttctgtgtgcgtcttaagca

SEQ ID NO: 203510 - DNA, 25 bp, Homo sapien
tgtgttctgtgtgcgtcttaagcaa

SEQ ID NO: 203511 - DNA, 25 bp, Homo sapien
ctgtgtgcgtcttaagcaataaagc

SEQ ID NO: 203512 - DNA, 25 bp, Homo sapien
gtgtgcgtcttaagcaataaagcgt

SEQ ID NO: 203513 - DNA, 25 bp, Homo sapien
gtgcgtcttaagcaataaagcgtgg

SEQ ID NO: 203514 - DNA, 25 bp, Homo sapien
gccactctgcaggtggagcgggtga

SEQ ID NO: 203515 - DNA, 25 bp, Homo sapien
cactctgcaggtggagcgggtgact

SEQ ID NO: 203516 - DNA, 25 bp, Homo sapien
actctgcaggtggagcgggtgactc

SEQ ID NO: 203517 - DNA, 25 bp, Homo sapien
ctctgcaggtggagcgggtgactct

SEQ ID NO: 203518 - DNA, 25 bp, Homo sapien
tctgcaggtggagcgggtgactctg

SEQ ID NO: 203519 - DNA, 25 bp, Homo sapien
tgcaggtggagcgggtgactctggg

SEQ ID NO: 203520 - DNA, 25 bp, Homo sapien
tgactctgggggaccattaagacct

SEQ ID NO: 203521 - DNA, 25 bp, Homo sapien
gggaccattaagacctccagaccgg

SEQ ID NO: 203522 - DNA, 25 bp, Homo sapien
ggaccattaagacctccagaccggg

SEQ ID NO: 203523 - DNA, 25 bp, Homo sapien
gaccattaagacctccagaccgggt

SEQ ID NO: 203524 - DNA, 25 bp, Homo sapien
accattaagacctccagaccgggtg

SEQ ID NO: 203525 - DNA, 25 bp, Homo sapien
gcatctgtggagaacgctgccgaag

SEQ ID NO: 203526 - DNA, 25 bp, Homo sapien
aacgctgccgaagaaaaaaggctcg

SEQ ID NO: 203527 - DNA, 25 bp, Homo sapien
aaaggctcgggagtccagccccaag

SEQ ID NO: 203528 - DNA, 25 bp, Homo sapien
agccccaagggagctggaacagcct

SEQ ID NO: 203529 - DNA, 25 bp, Homo sapien
agaagttagcgggaaacgccatcta

SEQ ID NO: 203530 - DNA, 25 bp, Homo sapien
aagccttcgttcagccaagagcata

SEQ ID NO: 203531 - DNA, 25 bp, Homo sapien
gagcataaggcagcagtctctgtgc

SEQ ID NO: 203532 - DNA, 25 bp, Homo sapien
tgcaaaagccctaccacaggtgaga

SEQ ID NO: 203533 - DNA, 25 bp, Homo sapien
ctaccacaggtgagagacagattga

SEQ ID NO: 203534 - DNA, 25 bp, Homo sapien
gacaacacacactatttccatttta

SEQ ID NO: 203535 - DNA, 25 bp, Homo sapien
aagtgcaaaggctagagttacaaat

SEQ ID NO: 203536 - DNA, 25 bp, Homo sapien
tgtgccaggcacactacaaagagta

SEQ ID NO: 203537 - DNA, 25 bp, Homo sapien
aagagtatcttgtgagcctcatcaa

SEQ ID NO: 203538 - DNA, 25 bp, Homo sapien
ttgtgagcctcatcaatgcccactc

SEQ ID NO: 203539 - DNA, 25 bp, Homo sapien
tggacccagccaccttgtatgaggt

SEQ ID NO: 203540 - DNA, 25 bp, Homo sapien
agacggccactgagcgctacctgca

SEQ ID NO: 203541 - DNA, 25 bp, Homo sapien
tggctggagaggatccccctgctta

SEQ ID NO: 203542 - DNA, 25 bp, Homo sapien
ttaccaggcccgcttgttacagaag

SEQ ID NO: 203543 - DNA, 25 bp, Homo sapien
ccaggcccgcttgttacagaagctg

SEQ ID NO: 203544 - DNA, 25 bp, Homo sapien
aagctgacagaagagatacccttgg

SEQ ID NO: 203545 - DNA, 25 bp, Homo sapien
gatacccttgggacagagtatcccc

SEQ ID NO: 203546 - DNA, 25 bp, Homo sapien
atggcctgctccctcaggaacagct

SEQ ID NO: 203547 - DNA, 25 bp, Homo sapien
gtgttagttattaaggcagccacaa

SEQ ID NO: 203548 - DNA, 25 bp, Homo sapien
ggcagccacaaagttctagctattt

SEQ ID NO: 203549 - DNA, 25 bp, Homo sapien
aagttctagctatttacatcttata

SEQ ID NO: 203550 - DNA, 25 bp, Homo sapien
ttacatcttataggactggaattat

SEQ ID NO: 203551 - DNA, 25 bp, Homo sapien
ggaggtggtagactaaaatactata

SEQ ID NO: 203552 - DNA, 25 bp, Homo sapien
gaaaaagagtgttgcaatttatcat

SEQ ID NO: 203553 - DNA, 25 bp, Homo sapien
tcaccaataattgctatatctataa

SEQ ID NO: 203554 - DNA, 25 bp, Homo sapien
taattttggttatgtctagctgtga

SEQ ID NO: 203555 - DNA, 25 bp, Homo sapien
tatgtctagctgtgaatatattctt

SEQ ID NO: 203556 - DNA, 25 bp, Homo sapien
gattattttatacagccctgaactc

SEQ ID NO: 203557 - DNA, 25 bp, Homo sapien
cagccctgaactcaataactgtttg

SEQ ID NO: 203558 - DNA, 25 bp, Homo sapien
aggatatatttacattttcactcat

SEQ ID NO: 203559 - DNA, 25 bp, Homo sapien
atatatttacattttcactcatcta

SEQ ID NO: 203560 - DNA, 25 bp, Homo sapien
ttacattttcactcatctaaaaagt

SEQ ID NO: 203561 - DNA, 25 bp, Homo sapien
aatgttcaagagcatcctatagtgc

SEQ ID NO: 203562 - DNA, 25 bp, Homo sapien
gttcaagagcatcctatagtgccaa

SEQ ID NO: 203563 - DNA, 25 bp, Homo sapien
aagagcatcctatagtgccaaataa

SEQ ID NO: 203564 - DNA, 25 bp, Homo sapien
aaaattcatatatactgcagggcag

SEQ ID NO: 203565 - DNA, 25 bp, Homo sapien
aattcatatatactgcagggcagac

SEQ ID NO: 203566 - DNA, 25 bp, Homo sapien
actgcagggcagacatacatatgat

SEQ ID NO: 203567 - DNA, 25 bp, Homo sapien
gacatacatatgatagcttgtgctg

SEQ ID NO: 203568 - DNA, 25 bp, Homo sapien
agcttgtgctgattaatttaacccc

SEQ ID NO: 203569 - DNA, 25 bp, Homo sapien
ccagcattgctggtggtcagggcag

SEQ ID NO: 203570 - DNA, 25 bp, Homo sapien
actggaggccggacagacaagcgcc

SEQ ID NO: 203571 - DNA, 25 bp, Homo sapien
acagacaagcgccagcgtgctccaa

SEQ ID NO: 203572 - DNA, 25 bp, Homo sapien
tgctccaacacatagggccaccagg

SEQ ID NO: 203573 - DNA, 25 bp, Homo sapien
aggaggtcccttctctgtgccctca

SEQ ID NO: 203574 - DNA, 25 bp, Homo sapien
acctgtcactgtgcttagggctgca

SEQ ID NO: 203575 - DNA, 25 bp, Homo sapien
tagggctgcaacatccctggagcag

SEQ ID NO: 203576 - DNA, 25 bp, Homo sapien
tggagcagcttccaacactacttca

SEQ ID NO: 203577 - DNA, 25 bp, Homo sapien
tccaacactacttcagggtggcagt

SEQ ID NO: 203578 - DNA, 25 bp, Homo sapien
gagcctgccggcctctagatggcct

SEQ ID NO: 203579 - DNA, 25 bp, Homo sapien
tagatggcctcatctcttccttcca

SEQ ID NO: 203580 - DNA, 25 bp, Homo sapien
ggcacactacaaagagtatcttgtg

SEQ ID NO: 203581 - DNA, 25 bp, Homo sapien
aagagtatcttgtgagcctcatcaa

SEQ ID NO: 203582 - DNA, 25 bp, Homo sapien
gagtatcttgtgagcctcatcaatg

SEQ ID NO: 203583 - DNA, 25 bp, Homo sapien
atcttgtgagcctcatcaatgccca

SEQ ID NO: 203584 - DNA, 25 bp, Homo sapien
tgtgagcctcatcaatgcccactcg

SEQ ID NO: 203585 - DNA, 25 bp, Homo sapien
tggacccagccaccttgtatgaggt

SEQ ID NO: 203586 - DNA, 25 bp, Homo sapien
cccagccaccttgtatgaggtggaa

SEQ ID NO: 203587 - DNA, 25 bp, Homo sapien
agacggccactgagcgctacctgca

SEQ ID NO: 203588 - DNA, 25 bp, Homo sapien
tacccttgggacagagtatcccccg

SEQ ID NO: 203589 - DNA, 25 bp, Homo sapien
gtatcccccgcaggcggaagtagct

SEQ ID NO: 203590 - DNA, 25 bp, Homo sapien
ccatggcctgctccctcaggaacag

SEQ ID NO: 203591 - DNA, 25 bp, Homo sapien
ggtataactcaaaatccaaagggat

SEQ ID NO: 203592 - DNA, 25 bp, Homo sapien
tattcctaccccatctattctctgt

SEQ ID NO: 203593 - DNA, 25 bp, Homo sapien
catctattctctgttggctccaaga

SEQ ID NO: 203594 - DNA, 25 bp, Homo sapien
tctgttggctccaagagctacccca

SEQ ID NO: 203595 - DNA, 25 bp, Homo sapien
agctaccccagagaccttaaacaga

SEQ ID NO: 203596 - DNA, 25 bp, Homo sapien
gaaacagtagctgaggcttcttcct

SEQ ID NO: 203597 - DNA, 25 bp, Homo sapien
aggcttcttcctagatacctgacta

SEQ ID NO: 203598 - DNA, 25 bp, Homo sapien
agggaagtttgtctctcctttcttg

SEQ ID NO: 203599 - DNA, 25 bp, Homo sapien
tcctttcttgcccaaccaggtcaaa

SEQ ID NO: 203600 - DNA, 25 bp, Homo sapien
tgtgagttgacagctcaaagcactt

SEQ ID NO: 203601 - DNA, 25 bp, Homo sapien
acctctactccccaaaatggaatca

SEQ ID NO: 203602 - DNA, 25 bp, Homo sapien
aggtaagtgagcatgtcaaacaaaa

SEQ ID NO: 203603 - DNA, 25 bp, Homo sapien
gcatgtcaaacaaaataggagctca

SEQ ID NO: 203604 - DNA, 25 bp, Homo sapien
gtcaaacaaaataggagctcacatg

SEQ ID NO: 203605 - DNA, 25 bp, Homo sapien
aggagctcacatggatatatttatg

SEQ ID NO: 203606 - DNA, 25 bp, Homo sapien
ggagctcacatggatatatttatgt

SEQ ID NO: 203607 - DNA, 25 bp, Homo sapien
gagctcacatggatatatttatgtc

SEQ ID NO: 203608 - DNA, 25 bp, Homo sapien
gctcacatggatatatttatgtcac

SEQ ID NO: 203609 - DNA, 25 bp, Homo sapien
tcacatggatatatttatgtcactg

SEQ ID NO: 203610 - DNA, 25 bp, Homo sapien
catggatatatttatgtcactgagt

SEQ ID NO: 203611 - DNA, 25 bp, Homo sapien
atggatatatttatgtcactgagtt

SEQ ID NO: 203612 - DNA, 25 bp, Homo sapien
gtttcatgacaaattatatagtcta

SEQ ID NO: 203613 - DNA, 25 bp, Homo sapien
gtgagacaatctctctatatgcaga

SEQ ID NO: 203614 - DNA, 25 bp, Homo sapien
tgcagagccctttcatgttaattag

SEQ ID NO: 203615 - DNA, 25 bp, Homo sapien
gatcacccatgattctgtttcactg

SEQ ID NO: 203616 - DNA, 25 bp, Homo sapien
gattctgtttcactgtttgctttct

SEQ ID NO: 203617 - DNA, 25 bp, Homo sapien
tttgctttctcctgtcatggttaag

SEQ ID NO: 203618 - DNA, 25 bp, Homo sapien
gtgcaattcgatcctcaatcagtgg

SEQ ID NO: 203619 - DNA, 25 bp, Homo sapien
gattcacttgtgtgcacttgtacag

SEQ ID NO: 203620 - DNA, 25 bp, Homo sapien
gcacttgtacagttgtagctgcgag

SEQ ID NO: 203621 - DNA, 25 bp, Homo sapien
tagctgcgagtccagaagtcctcta

SEQ ID NO: 203622 - DNA, 25 bp, Homo sapien
agtcctctagagcatgtgtactggc

SEQ ID NO: 203623 - DNA, 25 bp, Homo sapien
tgtactggcactgagttggtgagac

SEQ ID NO: 203624 - DNA, 25 bp, Homo sapien
gttgggtggaatcatagatccatgc

SEQ ID NO: 203625 - DNA, 25 bp, Homo sapien
tgtgtctgagatcccagtctttgag

SEQ ID NO: 203626 - DNA, 25 bp, Homo sapien
tgtactttgccaccccattattggg

SEQ ID NO: 203627 - DNA, 25 bp, Homo sapien
gagctgtcaccacgaatgttcccaa

SEQ ID NO: 203628 - DNA, 25 bp, Homo sapien
ttcccaaacttagcaacagcggcaa

SEQ ID NO: 203629 - DNA, 25 bp, Homo sapien
acagcggcaaactactgggccaaga

SEQ ID NO: 203630 - DNA, 25 bp, Homo sapien
gatgagcaaccccacatttttggga

SEQ ID NO: 203631 - DNA, 25 bp, Homo sapien
gggatttaaagctcctgatgttata

SEQ ID NO: 203632 - DNA, 25 bp, Homo sapien
tataccaggatcaaccatcacactc

SEQ ID NO: 203633 - DNA, 25 bp, Homo sapien
tttgcttcaaatggcgtctaccccg

SEQ ID NO: 203634 - DNA, 25 bp, Homo sapien
gcgtctaccccgtaagatcttgagg

SEQ ID NO: 203635 - DNA, 25 bp, Homo sapien
aaagccaagatttaggtaatgagtg

SEQ ID NO: 203636 - DNA, 25 bp, Homo sapien
gaggatgggagtcaaaatcagaatt

SEQ ID NO: 203637 - DNA, 25 bp, Homo sapien
aagaagtatttcctgtaactataga

SEQ ID NO: 203638 - DNA, 25 bp, Homo sapien
atatatccatagtggacttattcag

SEQ ID NO: 203639 - DNA, 25 bp, Homo sapien
ccatagtggacttattcagaacata

SEQ ID NO: 203640 - DNA, 25 bp, Homo sapien
ggacttattcagaacatagatatgt

SEQ ID NO: 203641 - DNA, 25 bp, Homo sapien
gatatgtattcagcttgtcttcaaa

SEQ ID NO: 203642 - DNA, 25 bp, Homo sapien
attcagcttgtcttcaaatacggcc

SEQ ID NO: 203643 - DNA, 25 bp, Homo sapien
tcagcttgtcttcaaatacggccaa

SEQ ID NO: 203644 - DNA, 25 bp, Homo sapien
aaatacggccaagcagaaaatgttt

SEQ ID NO: 203645 - DNA, 25 bp, Homo sapien
acggccaagcagaaaatgttttata

SEQ ID NO: 203646 - DNA, 25 bp, Homo sapien
atgactacttttgagtggaaacaaa

SEQ ID NO: 203647 - DNA, 25 bp, Homo sapien
gcatttacaaaacttccaggggaat

SEQ ID NO: 203648 - DNA, 25 bp, Homo sapien
gaatgtagagccacgtccagggtgc

SEQ ID NO: 203649 - DNA, 25 bp, Homo sapien
acgtccagggtgctcttttctgaga

SEQ ID NO: 203650 - DNA, 25 bp, Homo sapien
ccagggtgctcttttctgagagtat

SEQ ID NO: 203651 - DNA, 25 bp, Homo sapien
gtgctcttttctgagagtatttcga

SEQ ID NO: 203652 - DNA, 25 bp, Homo sapien
ctgagagtatttcgagttattttta

SEQ ID NO: 203653 - DNA, 25 bp, Homo sapien
aatattgtcacattactgctagatt

SEQ ID NO: 203654 - DNA, 25 bp, Homo sapien
tattgtcacattactgctagatttt

SEQ ID NO: 203655 - DNA, 25 bp, Homo sapien
aacagcctaccatgaaaatgtatct

SEQ ID NO: 203656 - DNA, 25 bp, Homo sapien
atgaactattttcttatgcataaag

SEQ ID NO: 203657 - DNA, 25 bp, Homo sapien
cgtgtcagggcggtgtctcaaagct

SEQ ID NO: 203658 - DNA, 25 bp, Homo sapien
cggtgtctcaaagctgggccacagg

SEQ ID NO: 203659 - DNA, 25 bp, Homo sapien
agcatccacggccaggccactgggt

SEQ ID NO: 203660 - DNA, 25 bp, Homo sapien
gggctgttcccttaggcagaacggc

SEQ ID NO: 203661 - DNA, 25 bp, Homo sapien
gaacggctcacctgtggtgtgcgca

SEQ ID NO: 203662 - DNA, 25 bp, Homo sapien
ccccttcattcatcagttacttgta

SEQ ID NO: 203663 - DNA, 25 bp, Homo sapien
ttctttgtatgaaacacctgccgat

SEQ ID NO: 203664 - DNA, 25 bp, Homo sapien
ggcatctactaacgtggcatctact

SEQ ID NO: 203665 - DNA, 25 bp, Homo sapien
atctactaggatgccacaaaacaga

SEQ ID NO: 203666 - DNA, 25 bp, Homo sapien
aaacagacaaatccttccacgtaag

SEQ ID NO: 203667 - DNA, 25 bp, Homo sapien
caaatccttccacgtaaggctggac

SEQ ID NO: 203668 - DNA, 25 bp, Homo sapien
atattaccctatttcactgttgttc

SEQ ID NO: 203669 - DNA, 25 bp, Homo sapien
ttaccctatttcactgttgttcaag

SEQ ID NO: 203670 - DNA, 25 bp, Homo sapien
ccctatttcactgttgttcaagtaa

SEQ ID NO: 203671 - DNA, 25 bp, Homo sapien
gtaaatctaaaccttgtagacaagt

SEQ ID NO: 203672 - DNA, 25 bp, Homo sapien
ccttgtagacaagtgagtcatctga

SEQ ID NO: 203673 - DNA, 25 bp, Homo sapien
gacaagtgagtcatctgatatgtat

SEQ ID NO: 203674 - DNA, 25 bp, Homo sapien
tctgatatgtatagaagctgtgata

SEQ ID NO: 203675 - DNA, 25 bp, Homo sapien
gaatataattgttcctgtgttttta

SEQ ID NO: 203676 - DNA, 25 bp, Homo sapien
tgttcctgtgtttttataagttggg

SEQ ID NO: 203677 - DNA, 25 bp, Homo sapien
tgttttacggcaacaaaatttattg

SEQ ID NO: 203678 - DNA, 25 bp, Homo sapien
tgtaatagaaatcacgcaaaatagt

SEQ ID NO: 203679 - DNA, 25 bp, Homo sapien
aaaggcgcctccttcgtggttcttg

SEQ ID NO: 203680 - DNA, 25 bp, Homo sapien
ggttcttgttggttgtgcttctgcc

SEQ ID NO: 203681 - DNA, 25 bp, Homo sapien
ttggttgtgcttctgcctctggacg

SEQ ID NO: 203682 - DNA, 25 bp, Homo sapien
tggacgccgcagtgcatgtggcttc

SEQ ID NO: 203683 - DNA, 25 bp, Homo sapien
tcctgaagcaccaggcggtcagcag

SEQ ID NO: 203684 - DNA, 25 bp, Homo sapien
gccctcagaagttgcgtaggagaca

SEQ ID NO: 203685 - DNA, 25 bp, Homo sapien
agttgcgtaggagacacagcgcctc

SEQ ID NO: 203686 - DNA, 25 bp, Homo sapien
tctctgggaataacgttccccagca

SEQ ID NO: 203687 - DNA, 25 bp, Homo sapien
gatttccagtcaattcagaagcatt

SEQ ID NO: 203688 - DNA, 25 bp, Homo sapien
agcattttaccagtgaagccctcat

SEQ ID NO: 203689 - DNA, 25 bp, Homo sapien
aagccctcattattccagttcactg

SEQ ID NO: 203690 - DNA, 25 bp, Homo sapien
aacttgtatttagtctgcttagagg

SEQ ID NO: 203691 - DNA, 25 bp, Homo sapien
tctgcttagaggactgtgacttgaa

SEQ ID NO: 203692 - DNA, 25 bp, Homo sapien
atgagctttttggtagcgtccacaa

SEQ ID NO: 203693 - DNA, 25 bp, Homo sapien
ggtagcgtccacaatgtttaaaata

SEQ ID NO: 203694 - DNA, 25 bp, Homo sapien
atttcataggcgagatccgtgttct

SEQ ID NO: 203695 - DNA, 25 bp, Homo sapien
gatccgtgttctccatttattaatg

SEQ ID NO: 203696 - DNA, 25 bp, Homo sapien
tgtagaccaatttaactgctgtgtt

SEQ ID NO: 203697 - DNA, 25 bp, Homo sapien
ttagtgcttaatctttgcctcatgt

SEQ ID NO: 203698 - DNA, 25 bp, Homo sapien
gttatgtaaaattagcctgcagata

SEQ ID NO: 203699 - DNA, 25 bp, Homo sapien
ttctctcaattctgtagactctcgc

SEQ ID NO: 203700 - DNA, 25 bp, Homo sapien
gtagactctcgcaagataaacattc

SEQ ID NO: 203701 - DNA, 25 bp, Homo sapien
agctaggaaagggttcctcgcggct

SEQ ID NO: 203702 - DNA, 25 bp, Homo sapien
gttcctcgcggctggtttagattgt

SEQ ID NO: 203703 - DNA, 25 bp, Homo sapien
gtttgttttgcttctactaagactg

SEQ ID NO: 203704 - DNA, 25 bp, Homo sapien
gtgtttgctgtctacgctggagtcc

SEQ ID NO: 203705 - DNA, 25 bp, Homo sapien
acgctggagtcctgaactgtgggta

SEQ ID NO: 203706 - DNA, 25 bp, Homo sapien
gaaaacacgacctggctttgtagaa

SEQ ID NO: 203707 - DNA, 25 bp, Homo sapien
gacacagggctgttttatgaactaa

SEQ ID NO: 203708 - DNA, 25 bp, Homo sapien
tgaggctcaggtggcggctctcaca

SEQ ID NO: 203709 - DNA, 25 bp, Homo sapien
agagcccctgatgctgttgttcttt

SEQ ID NO: 203710 - DNA, 25 bp, Homo sapien
gttgttctttgagggcttaaggcct

SEQ ID NO: 203711 - DNA, 25 bp, Homo sapien
ggcacgtgatgcgtaatagtcttca

SEQ ID NO: 203712 - DNA, 25 bp, Homo sapien
aatgtgacagtcagcttcagagaaa

SEQ ID NO: 203713 - DNA, 25 bp, Homo sapien
gacagtcagcttcagagaaactgag

SEQ ID NO: 203714 - DNA, 25 bp, Homo sapien
aggagaatgcagtctggattcgaat

SEQ ID NO: 203715 - DNA, 25 bp, Homo sapien
tgcagtctggattcgaattgcctgg

SEQ ID NO: 203716 - DNA, 25 bp, Homo sapien
cacaaagccaaaccagtacaaacct

SEQ ID NO: 203717 - DNA, 25 bp, Homo sapien
cagtacaaacctacctacgtggtgt

SEQ ID NO: 203718 - DNA, 25 bp, Homo sapien
tacctacgtggtgtactactcccag

SEQ ID NO: 203719 - DNA, 25 bp, Homo sapien
tggtgtactactcccagactccgta

SEQ ID NO: 203720 - DNA, 25 bp, Homo sapien
catgctgaggcgcaatacaccgctt

SEQ ID NO: 203721 - DNA, 25 bp, Homo sapien
tgaggcgcaatacaccgcttctggg

SEQ ID NO: 203722 - DNA, 25 bp, Homo sapien
cgcaatacaccgcttctgggtcagg

SEQ ID NO: 203723 - DNA, 25 bp, Homo sapien
agtgaatcgggccacatctgcagcc

SEQ ID NO: 203724 - DNA, 25 bp, Homo sapien
atctgcagccagatgttcgaaggcc

SEQ ID NO: 203725 - DNA, 25 bp, Homo sapien
gcagccagatgttcgaaggccagat

SEQ ID NO: 203726 - DNA, 25 bp, Homo sapien
tacgaccgggaccacgtggtgctat

SEQ ID NO: 203727 - DNA, 25 bp, Homo sapien
ccacgtggtgctatgggagccggat

SEQ ID NO: 203728 - DNA, 25 bp, Homo sapien
tgaggacagggcatcccagatctgg

SEQ ID NO: 203729 - DNA, 25 bp, Homo sapien
gacagggcatcccagatctggacta

SEQ ID NO: 203730 - DNA, 25 bp, Homo sapien
atcccagatctggactatccacgtg

SEQ ID NO: 203731 - DNA, 25 bp, Homo sapien
agatctggactatccacgtgctttg

SEQ ID NO: 203732 - DNA, 25 bp, Homo sapien
ggactatccacgtgctttgaaactt

SEQ ID NO: 203733 - DNA, 25 bp, Homo sapien
ggcttttgctgggatgaatgttttt

SEQ ID NO: 203734 - DNA, 25 bp, Homo sapien
ggtgtccaagccctgtgagactgaa

SEQ ID NO: 203735 - DNA, 25 bp, Homo sapien
ctgaaaaagcactttgaggaacctt

SEQ ID NO: 203736 - DNA, 25 bp, Homo sapien
tgaggaaccttaaagaccttgtttg

SEQ ID NO: 203737 - DNA, 25 bp, Homo sapien
gaccttgtttgtacataagaactgc

SEQ ID NO: 203738 - DNA, 25 bp, Homo sapien
gaactgctagcaaaagagacctcac

SEQ ID NO: 203739 - DNA, 25 bp, Homo sapien
tcttctcttgctttcgtgagaaagg

SEQ ID NO: 203740 - DNA, 25 bp, Homo sapien
gaaagcgaacacaaaacaacccaga

SEQ ID NO: 203741 - DNA, 25 bp, Homo sapien
gaatgactgattaagtgccttgcga

SEQ ID NO: 203742 - DNA, 25 bp, Homo sapien
agtgccttgcgaatctttattatta

SEQ ID NO: 203743 - DNA, 25 bp, Homo sapien
atgttcatactttcttgtgtacaga

SEQ ID NO: 203744 - DNA, 25 bp, Homo sapien
gtgtacagatggtgctagtcaagat

SEQ ID NO: 203745 - DNA, 25 bp, Homo sapien
acctgttgtatggtaactacccaag

SEQ ID NO: 203746 - DNA, 25 bp, Homo sapien
ctacccaaggactagtacaaggaag

SEQ ID NO: 203747 - DNA, 25 bp, Homo sapien
gaatttcctgttaagatcgtctcca

SEQ ID NO: 203748 - DNA, 25 bp, Homo sapien
gatcgtctccatttttatgcttttg

SEQ ID NO: 203749 - DNA, 25 bp, Homo sapien
aacgtttctttcaacaagctcctgt

SEQ ID NO: 203750 - DNA, 25 bp, Homo sapien
acaagctcctgttaaaagtatatga

SEQ ID NO: 203751 - DNA, 25 bp, Homo sapien
gaacctgagtactagtcttcttaca

SEQ ID NO: 203752 - DNA, 25 bp, Homo sapien
gtactagtcttcttacatttacaag

SEQ ID NO: 203753 - DNA, 25 bp, Homo sapien
aaattcgattaatggcttcttccct

SEQ ID NO: 203754 - DNA, 25 bp, Homo sapien
gcttcttcccttgtaaattttcttg

SEQ ID NO: 203755 - DNA, 25 bp, Homo sapien
tgaggcaaacagttctaagatcttt

SEQ ID NO: 203756 - DNA, 25 bp, Homo sapien
tgaagtgggaaccaaattaggtaat

SEQ ID NO: 203757 - DNA, 25 bp, Homo sapien
ggtaattttgggtaatctgtctcta

SEQ ID NO: 203758 - DNA, 25 bp, Homo sapien
ttgggtaatctgtctctaaaatatt

SEQ ID NO: 203759 - DNA, 25 bp, Homo sapien
ggtaatctgtctctaaaatattagc

SEQ ID NO: 203760 - DNA, 25 bp, Homo sapien
gtataattgccatataaatttcaaa

SEQ ID NO: 203761 - DNA, 25 bp, Homo sapien
aaattcaactggcttttatgcaaag

SEQ ID NO: 203762 - DNA, 25 bp, Homo sapien
tcaactggcttttatgcaaagaaac

SEQ ID NO: 203763 - DNA, 25 bp, Homo sapien
cattcttggttccagataaaatcaa

SEQ ID NO: 203764 - DNA, 25 bp, Homo sapien
ggttccagataaaatcaactgttta

SEQ ID NO: 203765 - DNA, 25 bp, Homo sapien
aactgtttatatcaatttctaatgg

SEQ ID NO: 203766 - DNA, 25 bp, Homo sapien
aacttattccagatgtagttccttc

SEQ ID NO: 203767 - DNA, 25 bp, Homo sapien
agtcacctgagtacggagtcccaat

SEQ ID NO: 203768 - DNA, 25 bp, Homo sapien
gtacggagtcccaatataaagtatt

SEQ ID NO: 203769 - DNA, 25 bp, Homo sapien
gaccacctccctaacaaagctgtta

SEQ ID NO: 203770 - DNA, 25 bp, Homo sapien
ttagggtaaattctgtgtgcacgcc

SEQ ID NO: 203771 - DNA, 25 bp, Homo sapien
gtaaattctgtgtgcacgcccaact

SEQ ID NO: 203772 - DNA, 25 bp, Homo sapien
gtcttccacagtctcctacaaaaaa

SEQ ID NO: 203773 - DNA, 25 bp, Homo sapien
aatgtctacatgcaattgtttttac

SEQ ID NO: 203774 - DNA, 25 bp, Homo sapien
atatcagttgtgcaatttcttccta

SEQ ID NO: 203775 - DNA, 25 bp, Homo sapien
atttcttcctacttgcctaggctct

SEQ ID NO: 203776 - DNA, 25 bp, Homo sapien
acttgcctaggctctaattagtcag

SEQ ID NO: 203777 - DNA, 25 bp, Homo sapien
gctctaattagtcagcaatcaggtt

SEQ ID NO: 203778 - DNA, 25 bp, Homo sapien
caccatttttttcttcataaccagg

SEQ ID NO: 203779 - DNA, 25 bp, Homo sapien
ccatttttttcttcataaccaggat

SEQ ID NO: 203780 - DNA, 25 bp, Homo sapien
ttcataaccaggattaaaattcata

SEQ ID NO: 203781 - DNA, 25 bp, Homo sapien
tcataaccaggattaaaattcatat

SEQ ID NO: 203782 - DNA, 25 bp, Homo sapien
cataaccaggattaaaattcatata

SEQ ID NO: 203783 - DNA, 25 bp, Homo sapien
tttcatttataagatggctcaatgt

SEQ ID NO: 203784 - DNA, 25 bp, Homo sapien
ttcatttataagatggctcaatgta

SEQ ID NO: 203785 - DNA, 25 bp, Homo sapien
tcatttataagatggctcaatgtat

SEQ ID NO: 203786 - DNA, 25 bp, Homo sapien
catttataagatggctcaatgtatt

SEQ ID NO: 203787 - DNA, 25 bp, Homo sapien
tttataagatggctcaatgtattgg

SEQ ID NO: 203788 - DNA, 25 bp, Homo sapien
ttataagatggctcaatgtattggg

SEQ ID NO: 203789 - DNA, 25 bp, Homo sapien
catagggataagacaattctgaaac

SEQ ID NO: 203790 - DNA, 25 bp, Homo sapien
atgattggatgttgaggaaagctgc

SEQ ID NO: 203791 - DNA, 25 bp, Homo sapien
gttgaggaaagctgcatttgaacca

SEQ ID NO: 203792 - DNA, 25 bp, Homo sapien
gcatttgaaccaaaacttgccaaga

SEQ ID NO: 203793 - DNA, 25 bp, Homo sapien
gaattctcttggcatctgacagaga

SEQ ID NO: 203794 - DNA, 25 bp, Homo sapien
gaccaaaacttggttgtatcatttt

SEQ ID NO: 203795 - DNA, 25 bp, Homo sapien
cttggttgtatcatttttgattggg

SEQ ID NO: 203796 - DNA, 25 bp, Homo sapien
gcggagggcgaagcatgtaacttaa

SEQ ID NO: 203797 - DNA, 25 bp, Homo sapien
gtaacttaatttgcagacatttttt

SEQ ID NO: 203798 - DNA, 25 bp, Homo sapien
tttttccccataagcctgaaggaat

SEQ ID NO: 203799 - DNA, 25 bp, Homo sapien
aggaatcatcacataagcttattaa

SEQ ID NO: 203800 - DNA, 25 bp, Homo sapien
agaaactcctccacaaagagccgag

SEQ ID NO: 203801 - DNA, 25 bp, Homo sapien
gagccgaggatcagagaagacccct

SEQ ID NO: 203802 - DNA, 25 bp, Homo sapien
ctgagatgaatcagggccctgccct

SEQ ID NO: 203803 - DNA, 25 bp, Homo sapien
actcttttctagcaatcatgtcctg

SEQ ID NO: 203804 - DNA, 25 bp, Homo sapien
tagcaatcatgtcctgcccaggctg

SEQ ID NO: 203805 - DNA, 25 bp, Homo sapien
ctgctgtcctccatgatgtgactag

SEQ ID NO: 203806 - DNA, 25 bp, Homo sapien
gtcctccatgatgtgactagcacaa

SEQ ID NO: 203807 - DNA, 25 bp, Homo sapien
gtgactagcacaaggtgtatatatg

SEQ ID NO: 203808 - DNA, 25 bp, Homo sapien
atatatgttttgtacctctgccgat

SEQ ID NO: 203809 - DNA, 25 bp, Homo sapien
atgttttgtacctctgccgatggct

SEQ ID NO: 203810 - DNA, 25 bp, Homo sapien
gtacctctgccgatggctgtacata

SEQ ID NO: 203811 - DNA, 25 bp, Homo sapien
atcgttagggtgaagcattatggtc

SEQ ID NO: 203812 - DNA, 25 bp, Homo sapien
gaagcattatggtctaatgattcaa

SEQ ID NO: 203813 - DNA, 25 bp, Homo sapien
ttttaaagtttaatgcctagcagag

SEQ ID NO: 203814 - DNA, 25 bp, Homo sapien
tgcctagcagagaactgccttaaaa

SEQ ID NO: 203815 - DNA, 25 bp, Homo sapien
aaagttcatgttggccatggtgaaa

SEQ ID NO: 203816 - DNA, 25 bp, Homo sapien
ttgatatggagaaacaaaatcctca

SEQ ID NO: 203817 - DNA, 25 bp, Homo sapien
ttaataaactgcagggttacaccaa

SEQ ID NO: 203818 - DNA, 25 bp, Homo sapien
taaactgcagggttacaccaaaatc

SEQ ID NO: 203819 - DNA, 25 bp, Homo sapien
ctgcagggttacaccaaaatctagc

SEQ ID NO: 203820 - DNA, 25 bp, Homo sapien
aaatctagctgatttaacttgtatt

SEQ ID NO: 203821 - DNA, 25 bp, Homo sapien
tataaatatcgttagggtgaagcat

SEQ ID NO: 203822 - DNA, 25 bp, Homo sapien
actttgctgcagagccactgccgcc

SEQ ID NO: 203823 - DNA, 25 bp, Homo sapien
ttgctgcagagccactgccgccctt

SEQ ID NO: 203824 - DNA, 25 bp, Homo sapien
tgcagagccactgccgcccttgagc

SEQ ID NO: 203825 - DNA, 25 bp, Homo sapien
acgttcccctcatagcagtgtcact

SEQ ID NO: 203826 - DNA, 25 bp, Homo sapien
gttcccctcatagcagtgtcactcc

SEQ ID NO: 203827 - DNA, 25 bp, Homo sapien
ctgtgctcatcacaggagcctcagt

SEQ ID NO: 203828 - DNA, 25 bp, Homo sapien
tgtgctcatcacaggagcctcagtt

SEQ ID NO: 203829 - DNA, 25 bp, Homo sapien
gtgctcatcacaggagcctcagttg

SEQ ID NO: 203830 - DNA, 25 bp, Homo sapien
tgctcatcacaggagcctcagttga

SEQ ID NO: 203831 - DNA, 25 bp, Homo sapien
gctcatcacaggagcctcagttgag

SEQ ID NO: 203832 - DNA, 25 bp, Homo sapien
ctcatcacaggagcctcagttgaga

SEQ ID NO: 203833 - DNA, 25 bp, Homo sapien
gggtcaaatttaccatatcttctgg

SEQ ID NO: 203834 - DNA, 25 bp, Homo sapien
ctggctaaccatattcaagattctt

SEQ ID NO: 203835 - DNA, 25 bp, Homo sapien
gaatccatttgatttggtcagcctg

SEQ ID NO: 203836 - DNA, 25 bp, Homo sapien
cagcctggcttttgtcgtggtggct

SEQ ID NO: 203837 - DNA, 25 bp, Homo sapien
ggctggctcggataaattttcccaa

SEQ ID NO: 203838 - DNA, 25 bp, Homo sapien
ttaaatcttgcctttacacacccaa

SEQ ID NO: 203839 - DNA, 25 bp, Homo sapien
tgcctttacacacccaaactttgta

SEQ ID NO: 203840 - DNA, 25 bp, Homo sapien
gaatttgttcctaccttgtcaagca

SEQ ID NO: 203841 - DNA, 25 bp, Homo sapien
agcaagaatgtcgtcttctcctatg

SEQ ID NO: 203842 - DNA, 25 bp, Homo sapien
ttctcctatggactcaattgctatt

SEQ ID NO: 203843 - DNA, 25 bp, Homo sapien
attttaaacctgcatgattgtacca

SEQ ID NO: 203844 - DNA, 25 bp, Homo sapien
agcaactactatgccttcttcaagc

SEQ ID NO: 203845 - DNA, 25 bp, Homo sapien
ttcttcaagctgctccgggaccgct

SEQ ID NO: 203846 - DNA, 25 bp, Homo sapien
tccgggaccgcttggtattgggcaa

SEQ ID NO: 203847 - DNA, 25 bp, Homo sapien
ggtattgggcaaggcctactcatac

SEQ ID NO: 203848 - DNA, 25 bp, Homo sapien
gcaaggcctactcatactctgctag

SEQ ID NO: 203849 - DNA, 25 bp, Homo sapien
cagagagacctggaccaccgtttct

SEQ ID NO: 203850 - DNA, 25 bp, Homo sapien
ggtcacctcagggacagcgtccagg

SEQ ID NO: 203851 - DNA, 25 bp, Homo sapien
ggacagcgtccaggcttcagccaag

SEQ ID NO: 203852 - DNA, 25 bp, Homo sapien
tcagccaagggctccctggcaaggg

SEQ ID NO: 203853 - DNA, 25 bp, Homo sapien
aaaaaatccaccagagctttgtatt

SEQ ID NO: 203854 - DNA, 25 bp, Homo sapien
ttttgttacgtactgtttctttgat

SEQ ID NO: 203855 - DNA, 25 bp, Homo sapien
tgccttgcaaggaacgtctcttccg

SEQ ID NO: 203856 - DNA, 25 bp, Homo sapien
gccttgcaaggaacgtctcttccgg

SEQ ID NO: 203857 - DNA, 25 bp, Homo sapien
ccttgcaaggaacgtctcttccggc

SEQ ID NO: 203858 - DNA, 25 bp, Homo sapien
cttgcaaggaacgtctcttccggcg

SEQ ID NO: 203859 - DNA, 25 bp, Homo sapien
ttgcaaggaacgtctcttccggcgg

SEQ ID NO: 203860 - DNA, 25 bp, Homo sapien
tgcaaggaacgtctcttccggcggc

SEQ ID NO: 203861 - DNA, 25 bp, Homo sapien
gcaaggaacgtctcttccggcggct

SEQ ID NO: 203862 - DNA, 25 bp, Homo sapien
caaggaacgtctcttccggcggctg

SEQ ID NO: 203863 - DNA, 25 bp, Homo sapien
aaggaacgtctcttccggcggctgg

SEQ ID NO: 203864 - DNA, 25 bp, Homo sapien
aggaacgtctcttccggcggctggg

SEQ ID NO: 203865 - DNA, 25 bp, Homo sapien
ggaacgtctcttccggcggctgggc

SEQ ID NO: 203866 - DNA, 25 bp, Homo sapien
taaatatcgttagggtgaagcatta

SEQ ID NO: 203867 - DNA, 25 bp, Homo sapien
aatatcgttagggtgaagcattatg

SEQ ID NO: 203868 - DNA, 25 bp, Homo sapien
atatcgttagggtgaagcattatgg

SEQ ID NO: 203869 - DNA, 25 bp, Homo sapien
atcgttagggtgaagcattatggtc

SEQ ID NO: 203870 - DNA, 25 bp, Homo sapien
gttttaaagtttaatgcctagcaga

SEQ ID NO: 203871 - DNA, 25 bp, Homo sapien
ttttaaagtttaatgcctagcagag

SEQ ID NO: 203872 - DNA, 25 bp, Homo sapien
tgcctagcagagaactgccttaaaa

SEQ ID NO: 203873 - DNA, 25 bp, Homo sapien
gcctagcagagaactgccttaaaaa

SEQ ID NO: 203874 - DNA, 25 bp, Homo sapien
cctagcagagaactgccttaaaaaa

SEQ ID NO: 203875 - DNA, 25 bp, Homo sapien
tataaatatcgttagggtgaagcat

SEQ ID NO: 203876 - DNA, 25 bp, Homo sapien
ataaatatcgttagggtgaagcatt

SEQ ID NO: 203877 - DNA, 25 bp, Homo sapien
gacgctgaagacctcgaagctggcc

SEQ ID NO: 203878 - DNA, 25 bp, Homo sapien
acgctgaagacctcgaagctggcca

SEQ ID NO: 203879 - DNA, 25 bp, Homo sapien
cgctgaagacctcgaagctggccaa

SEQ ID NO: 203880 - DNA, 25 bp, Homo sapien
gctgaagacctcgaagctggccaac

SEQ ID NO: 203881 - DNA, 25 bp, Homo sapien
ctgaagacctcgaagctggccaaca

SEQ ID NO: 203882 - DNA, 25 bp, Homo sapien
tgaagacctcgaagctggccaacat

SEQ ID NO: 203883 - DNA, 25 bp, Homo sapien
gaagacctcgaagctggccaacatg

SEQ ID NO: 203884 - DNA, 25 bp, Homo sapien
aagacctcgaagctggccaacatgg

SEQ ID NO: 203885 - DNA, 25 bp, Homo sapien
tagcaaggggaagatcatcagcggc

SEQ ID NO: 203886 - DNA, 25 bp, Homo sapien
agcagcggcagcctgctgtcttcag

SEQ ID NO: 203887 - DNA, 25 bp, Homo sapien
cagcggcagcctgctgtcttcaggt

SEQ ID NO: 203888 - DNA, 25 bp, Homo sapien
cgaggtctgatggagctgcgtttcc

SEQ ID NO: 203889 - DNA, 25 bp, Homo sapien
ggagctgcgtttcctgtgcatggac

SEQ ID NO: 203890 - DNA, 25 bp, Homo sapien
tgccctcagggtgcctgtccaggaa

SEQ ID NO: 203891 - DNA, 25 bp, Homo sapien
ctcagggtgcctgtccaggaagagc

SEQ ID NO: 203892 - DNA, 25 bp, Homo sapien
agctgtgtggcctggcaagcaagcc

SEQ ID NO: 203893 - DNA, 25 bp, Homo sapien
gtgccctgctcggtggcagtacaag

SEQ ID NO: 203894 - DNA, 25 bp, Homo sapien
ctgctcggtggcagtacaagctggc

SEQ ID NO: 203895 - DNA, 25 bp, Homo sapien
tcgtgcggaggatcctgtattgtgc

SEQ ID NO: 203896 - DNA, 25 bp, Homo sapien
gaggatcctgtattgtgcccgggcc

SEQ ID NO: 203897 - DNA, 25 bp, Homo sapien
gaggagatcctgttggacacccagt

SEQ ID NO: 203898 - DNA, 25 bp, Homo sapien
gatcctgttggacacccagtgccag

SEQ ID NO: 203899 - DNA, 25 bp, Homo sapien
tggcagtgcctacgctgtgccaact

SEQ ID NO: 203900 - DNA, 25 bp, Homo sapien
tgccaactaccctgtctggtacaga

SEQ ID NO: 203901 - DNA, 25 bp, Homo sapien
tacagaccacggctgggtaagcacc

SEQ ID NO: 203902 - DNA, 25 bp, Homo sapien
ggtaagcacccttaaaagcaacaga

SEQ ID NO: 203903 - DNA, 25 bp, Homo sapien
aaatgacgtctggaagctgaaatgt

SEQ ID NO: 203904 - DNA, 25 bp, Homo sapien
gaaactgtcaagatggcttaggaga

SEQ ID NO: 203905 - DNA, 25 bp, Homo sapien
ctggtctttggcattttgtatttag

SEQ ID NO: 203906 - DNA, 25 bp, Homo sapien
atacataatgtataggccgatcttt

SEQ ID NO: 203907 - DNA, 25 bp, Homo sapien
taggccgatcttttggaagggataa

SEQ ID NO: 203908 - DNA, 25 bp, Homo sapien
attcttgtgcaactcattattctca

SEQ ID NO: 203909 - DNA, 25 bp, Homo sapien
cattattctcattattggcctttta

SEQ ID NO: 203910 - DNA, 25 bp, Homo sapien
gactccacttaacatttatctcaga

SEQ ID NO: 203911 - DNA, 25 bp, Homo sapien
atctcagaatcatgagcctctctct

SEQ ID NO: 203912 - DNA, 25 bp, Homo sapien
gagcctctctctagttgacaattgt

SEQ ID NO: 203913 - DNA, 25 bp, Homo sapien
ccagccccaaattgaaccatacatt

SEQ ID NO: 203914 - DNA, 25 bp, Homo sapien
tttctgtaaacatatccgaccttca

SEQ ID NO: 203915 - DNA, 25 bp, Homo sapien
aaacatatccgaccttcaaaagaag

SEQ ID NO: 203916 - DNA, 25 bp, Homo sapien
ccttttatttgtcctaagattccag

SEQ ID NO: 203917 - DNA, 25 bp, Homo sapien
tgtcctaagattccaggaggctggc

SEQ ID NO: 203918 - DNA, 25 bp, Homo sapien
ttcctgcattcctactttgagggtc

SEQ ID NO: 203919 - DNA, 25 bp, Homo sapien
tttgagggtctcatcatgcccactg

SEQ ID NO: 203920 - DNA, 25 bp, Homo sapien
atgcccactgggtgttgttcctaag

SEQ ID NO: 203921 - DNA, 25 bp, Homo sapien
aacatctgaatgctgtgcaagcatc

SEQ ID NO: 203922 - DNA, 25 bp, Homo sapien
gtgcaagcatctgcagaacatcaga

SEQ ID NO: 203923 - DNA, 25 bp, Homo sapien
gacttcaacagttcttggagttcaa

SEQ ID NO: 203924 - DNA, 25 bp, Homo sapien
aactgtgttcattacactgctgata

SEQ ID NO: 203925 - DNA, 25 bp, Homo sapien
actgctgatacaactacagatggga

SEQ ID NO: 203926 - DNA, 25 bp, Homo sapien
gatgggacagtaaatgttcagcatt

SEQ ID NO: 203927 - DNA, 25 bp, Homo sapien
aatgttcagcattcttggatcagaa

SEQ ID NO: 203928 - DNA, 25 bp, Homo sapien
aattagatgcttcctttgtcgtggt

SEQ ID NO: 203929 - DNA, 25 bp, Homo sapien
gtggtggttgctttgaaaactatac

SEQ ID NO: 203930 - DNA, 25 bp, Homo sapien
ctgccttttctgtaccgattgcttt

SEQ ID NO: 203931 - DNA, 25 bp, Homo sapien
tctgtaccgattgctttttgtgtgt

SEQ ID NO: 203932 - DNA, 25 bp, Homo sapien
agttcatcatcttcaagtagtgagg

SEQ ID NO: 203933 - DNA, 25 bp, Homo sapien
aagattgcaaatcctctacttctga

SEQ ID NO: 203934 - DNA, 25 bp, Homo sapien
aatcctctacttctgatacagggaa

SEQ ID NO: 203935 - DNA, 25 bp, Homo sapien
tacagggaattgtgtctcaggacat

SEQ ID NO: 203936 - DNA, 25 bp, Homo sapien
attgtgtctcaggacatcctaccat

SEQ ID NO: 203937 - DNA, 25 bp, Homo sapien
gacatcctaccatgacacagtacag

SEQ ID NO: 203938 - DNA, 25 bp, Homo sapien
atgacacagtacaggattcctgata

SEQ ID NO: 203939 - DNA, 25 bp, Homo sapien
gatgccagtcataatagatttcgag

SEQ ID NO: 203940 - DNA, 25 bp, Homo sapien
agatttcgagacaacagtggccttc

SEQ ID NO: 203941 - DNA, 25 bp, Homo sapien
agtggccttctgatgaatactttaa

SEQ ID NO: 203942 - DNA, 25 bp, Homo sapien
agaaatgatttgcagctgagtgaat

SEQ ID NO: 203943 - DNA, 25 bp, Homo sapien
tgccaactttgctgcagagccactg

SEQ ID NO: 203944 - DNA, 25 bp, Homo sapien
tgagcctctcaccatgagtgagcca

SEQ ID NO: 203945 - DNA, 25 bp, Homo sapien
acgttcccctcatagcagtgtcact

SEQ ID NO: 203946 - DNA, 25 bp, Homo sapien
atggcccagggacccgtggacaggt

SEQ ID NO: 203947 - DNA, 25 bp, Homo sapien
catcacaggagcctcagttgagagt

SEQ ID NO: 203948 - DNA, 25 bp, Homo sapien
cggggtacagtaaggcagtgcttcc

SEQ ID NO: 203949 - DNA, 25 bp, Homo sapien
gtaaggcagtgcttcccacactgga

SEQ ID NO: 203950 - DNA, 25 bp, Homo sapien
cacactggacctctttcctggttct

SEQ ID NO: 203951 - DNA, 25 bp, Homo sapien
ttcctggttctcttttgcaatacat

SEQ ID NO: 203952 - DNA, 25 bp, Homo sapien
aacagaccctttatcaacataaaca

SEQ ID NO: 203953 - DNA, 25 bp, Homo sapien
cagaccctttatcaacataaacaat

SEQ ID NO: 203954 - DNA, 25 bp, Homo sapien
tgaacatacctatgccacttttggc

SEQ ID NO: 203955 - DNA, 25 bp, Homo sapien
gccacttttggctatgagtttttaa

SEQ ID NO: 203956 - DNA, 25 bp, Homo sapien
ttttcctaagcacagctatgtattt

SEQ ID NO: 203957 - DNA, 25 bp, Homo sapien
gatagtatgcaaattatcgcatgta

SEQ ID NO: 203958 - DNA, 25 bp, Homo sapien
cgaaacaatatttaggtagctgagt

SEQ ID NO: 203959 - DNA, 25 bp, Homo sapien
tattttttagactcttagcctctga

SEQ ID NO: 203960 - DNA, 25 bp, Homo sapien
tagcctctgaaagggcccaaagaat

SEQ ID NO: 203961 - DNA, 25 bp, Homo sapien
aaagaattcatataccatcctccca

SEQ ID NO: 203962 - DNA, 25 bp, Homo sapien
ataccatcctcccatctgatatagg

SEQ ID NO: 203963 - DNA, 25 bp, Homo sapien
atctgatataggaattgctcctgca

SEQ ID NO: 203964 - DNA, 25 bp, Homo sapien
gcattagtaatatatcatccagttt

SEQ ID NO: 203965 - DNA, 25 bp, Homo sapien
gagggtggctcaacctaatggaatt

SEQ ID NO: 203966 - DNA, 25 bp, Homo sapien
ttataatatcctcttgcgttttccc

SEQ ID NO: 203967 - DNA, 25 bp, Homo sapien
ttccctgtgggaatgcccagcatta

SEQ ID NO: 203968 - DNA, 25 bp, Homo sapien
cccagcattaattaagtccatttca

SEQ ID NO: 203969 - DNA, 25 bp, Homo sapien
gctttactttgcatttgattgctgt

SEQ ID NO: 203970 - DNA, 25 bp, Homo sapien
agcattagacttttatccccttcat

SEQ ID NO: 203971 - DNA, 25 bp, Homo sapien
tcatgtcacttcttcggcattatgg

SEQ ID NO: 203972 - DNA, 25 bp, Homo sapien
ggcattatggtttgcatctgaaagc

SEQ ID NO: 203973 - DNA, 25 bp, Homo sapien
atgagaatgacatacatcctttcca

SEQ ID NO: 203974 - DNA, 25 bp, Homo sapien
tacatcctttccatttagctcataa

SEQ ID NO: 203975 - DNA, 25 bp, Homo sapien
agctcataagcacggctatcttttt

SEQ ID NO: 203976 - DNA, 25 bp, Homo sapien
tatcctctgtatttgtcattcctct

SEQ ID NO: 203977 - DNA, 25 bp, Homo sapien
atcctctgtatttgtcattcctctc

SEQ ID NO: 203978 - DNA, 25 bp, Homo sapien
tcctgaggggtatcctcctaaagac

SEQ ID NO: 203979 - DNA, 25 bp, Homo sapien
tatggaagggtaaatactggtacct

SEQ ID NO: 203980 - DNA, 25 bp, Homo sapien
ccagctttccatctgaggaccagaa

SEQ ID NO: 203981 - DNA, 25 bp, Homo sapien
gaggaccagaaaagttgtgtctccc

SEQ ID NO: 203982 - DNA, 25 bp, Homo sapien
gttgtgtctcccttagatgagatct

SEQ ID NO: 203983 - DNA, 25 bp, Homo sapien
cccttagatgagatctagacgcccc

SEQ ID NO: 203984 - DNA, 25 bp, Homo sapien
tagacgcccccaaatccttgagatg

SEQ ID NO: 203985 - DNA, 25 bp, Homo sapien
tccttgagatgtgggtatagctcag

SEQ ID NO: 203986 - DNA, 25 bp, Homo sapien
tgggtatagctcagggtaagctgct

SEQ ID NO: 203987 - DNA, 25 bp, Homo sapien
aaagtttgtctgtctcttctgactt

SEQ ID NO: 203988 - DNA, 25 bp, Homo sapien
gggaaaagacaaaccagttagctgt

SEQ ID NO: 203989 - DNA, 25 bp, Homo sapien
aaccagttagctgtggtctggccag

SEQ ID NO: 203990 - DNA, 25 bp, Homo sapien
ggtctggccaggtcagtaagtggaa

SEQ ID NO: 203991 - DNA, 25 bp, Homo sapien
gggacttctatgatagacggacaac

SEQ ID NO: 203992 - DNA, 25 bp, Homo sapien
tagacggacaactaagcctgagttt

SEQ ID NO: 203993 - DNA, 25 bp, Homo sapien
gcctgagtttttgagacctggtcct

SEQ ID NO: 203994 - DNA, 25 bp, Homo sapien
gacctggtcctcgaaaaactgaaga

SEQ ID NO: 203995 - DNA, 25 bp, Homo sapien
gatacctacttcattagttctgcgg

SEQ ID NO: 203996 - DNA, 25 bp, Homo sapien
ttcattagttctgcgggaaaaccta

SEQ ID NO: 203997 - DNA, 25 bp, Homo sapien
ggaaaacctacaccaggcactcaag

SEQ ID NO: 203998 - DNA, 25 bp, Homo sapien
gtgccagtgattcgttgcctcagaa

SEQ ID NO: 203999 - DNA, 25 bp, Homo sapien
tgcctcagaaactgcatgacgcgca

SEQ ID NO: 204000 - DNA, 25 bp, Homo sapien
atgacgcgcaggagtcagacttccg

SEQ ID NO: 204001 - DNA, 25 bp, Homo sapien
gacttccgctgggacgtcaatagga

SEQ ID NO: 204002 - DNA, 25 bp, Homo sapien
gtatttgctctctagacgactgaat

SEQ ID NO: 204003 - DNA, 25 bp, Homo sapien
tagggaaccctgagaggtgcagccc

SEQ ID NO: 204004 - DNA, 25 bp, Homo sapien
gtgccccgccctgagagcagtgttt

SEQ ID NO: 204005 - DNA, 25 bp, Homo sapien
agcagtgtttccgacgctgggaagc

SEQ ID NO: 204006 - DNA, 25 bp, Homo sapien
ggaagcgcgctgtgcaaagcgctct

SEQ ID NO: 204007 - DNA, 25 bp, Homo sapien
cagcctcgaaaagtgggctctggaa

SEQ ID NO: 204008 - DNA, 25 bp, Homo sapien
ctctggaatccctttgtaaataggt

SEQ ID NO: 204009 - DNA, 25 bp, Homo sapien
gcctggcaagtgctgtgcccacgtc

SEQ ID NO: 204010 - DNA, 25 bp, Homo sapien
gcccaggacccagccgtgttgagtg

SEQ ID NO: 204011 - DNA, 25 bp, Homo sapien
ccagccgtgttgagtgaagctcttg

SEQ ID NO: 204012 - DNA, 25 bp, Homo sapien
agcgtgcgtcctgacgcacaggaga

SEQ ID NO: 204013 - DNA, 25 bp, Homo sapien
aggccagggtgtgaactttctccca

SEQ ID NO: 204014 - DNA, 25 bp, Homo sapien
tgaactttctcccatggtttagtct

SEQ ID NO: 204015 - DNA, 25 bp, Homo sapien
catggtttagtctctgacgcggcac

SEQ ID NO: 204016 - DNA, 25 bp, Homo sapien
tttagtctctgacgcggcactgggc

SEQ ID NO: 204017 - DNA, 25 bp, Homo sapien
ggcactgggccggaagttcaactga

SEQ ID NO: 204018 - DNA, 25 bp, Homo sapien
ggccggaagttcaactgagtgcagt

SEQ ID NO: 204019 - DNA, 25 bp, Homo sapien
tcaactgagtgcagtgcaggtggat

SEQ ID NO: 204020 - DNA, 25 bp, Homo sapien
gagaggctaaaatctatttatcgaa

SEQ ID NO: 204021 - DNA, 25 bp, Homo sapien
atttatcgaaaccagcatatttttg

SEQ ID NO: 204022 - DNA, 25 bp, Homo sapien
aagctaaatgtttcctcgatgactg

SEQ ID NO: 204023 - DNA, 25 bp, Homo sapien
tgtttcctcgatgactggcagcaaa

SEQ ID NO: 204024 - DNA, 25 bp, Homo sapien
atgactggcagcaaactcgtggccc

SEQ ID NO: 204025 - DNA, 25 bp, Homo sapien
cacctttgtatattcaggaaactta

SEQ ID NO: 204026 - DNA, 25 bp, Homo sapien
tatttaaatccagtgcgccgaaacg

SEQ ID NO: 204027 - DNA, 25 bp, Homo sapien
tccagtgcgccgaaacgtatttaat

SEQ ID NO: 204028 - DNA, 25 bp, Homo sapien
acgtatttaattccaggcctccgct

SEQ ID NO: 204029 - DNA, 25 bp, Homo sapien
ggcagccagttttaaccccagcctg

SEQ ID NO: 204030 - DNA, 25 bp, Homo sapien
cagccatgtaaatcctcctgtacaa

SEQ ID NO: 204031 - DNA, 25 bp, Homo sapien
tcggctcacatgttcacagtgcagc

SEQ ID NO: 204032 - DNA, 25 bp, Homo sapien
ctctttggtggtttctaaagtgcct

SEQ ID NO: 204033 - DNA, 25 bp, Homo sapien
gtgccttatctgcaaacaacttctt

SEQ ID NO: 204034 - DNA, 25 bp, Homo sapien
gtaaactagaagtccagggttgctt

SEQ ID NO: 204035 - DNA, 25 bp, Homo sapien
aagtccagggttgcttggtttactg

SEQ ID NO: 204036 - DNA, 25 bp, Homo sapien
gaaatctgaaagcacctctgacatt

SEQ ID NO: 204037 - DNA, 25 bp, Homo sapien
tgaaagcacctctgacattcctttt

SEQ ID NO: 204038 - DNA, 25 bp, Homo sapien
ccttttattaactcacctctcagtt

SEQ ID NO: 204039 - DNA, 25 bp, Homo sapien
cacctctcagttgaaagatttcttc

SEQ ID NO: 204040 - DNA, 25 bp, Homo sapien
gatttcttctttgaaaggtcaagac

SEQ ID NO: 204041 - DNA, 25 bp, Homo sapien
agtgttggcctttttgcgggaccag

SEQ ID NO: 204042 - DNA, 25 bp, Homo sapien
ttacattccagtgggtctaatgacc

SEQ ID NO: 204043 - DNA, 25 bp, Homo sapien
gggtctaatgaccatatcttaggac

SEQ ID NO: 204044 - DNA, 25 bp, Homo sapien
atcttaggacacagatgtgcccagg

SEQ ID NO: 204045 - DNA, 25 bp, Homo sapien
ggtggtgtcactgcacaggaagtat

SEQ ID NO: 204046 - DNA, 25 bp, Homo sapien
gaggactttagtgtcctgagttcaa

SEQ ID NO: 204047 - DNA, 25 bp, Homo sapien
atcctgattcaggaactcacaaagc

SEQ ID NO: 204048 - DNA, 25 bp, Homo sapien
aaagctatgtgaccttacaccagtc

SEQ ID NO: 204049 - DNA, 25 bp, Homo sapien
gaccttacaccagtcacttaacttg

SEQ ID NO: 204050 - DNA, 25 bp, Homo sapien
gtcacttaacttgttagccatccat

SEQ ID NO: 204051 - DNA, 25 bp, Homo sapien
tagccatccattatcgcatctgcaa

SEQ ID NO: 204052 - DNA, 25 bp, Homo sapien
agacacttggcacaaaacctggcac

SEQ ID NO: 204053 - DNA, 25 bp, Homo sapien
gcagaatgtgacttgtggccttacc

SEQ ID NO: 204054 - DNA, 25 bp, Homo sapien
gaatgtgacttgtggccttaccatg

SEQ ID NO: 204055 - DNA, 25 bp, Homo sapien
gtgacttgtggccttaccatggact

SEQ ID NO: 204056 - DNA, 25 bp, Homo sapien
acttgtggccttaccatggacttga

SEQ ID NO: 204057 - DNA, 25 bp, Homo sapien
tgtggccttaccatggacttgaatg

SEQ ID NO: 204058 - DNA, 25 bp, Homo sapien
gacttgaatgggacttggctggcct

SEQ ID NO: 204059 - DNA, 25 bp, Homo sapien
ttgaatgggacttggctggcctcag

SEQ ID NO: 204060 - DNA, 25 bp, Homo sapien
tgggacttggctggcctcaggatct

SEQ ID NO: 204061 - DNA, 25 bp, Homo sapien
aatagcctgaggtggctcaggaagc

SEQ ID NO: 204062 - DNA, 25 bp, Homo sapien
agaaagggtgccagaccattctctg

SEQ ID NO: 204063 - DNA, 25 bp, Homo sapien
aagggtgccagaccattctctggcg

SEQ ID NO: 204064 - DNA, 25 bp, Homo sapien
atttcttttccatacactgtgtgct

SEQ ID NO: 204065 - DNA, 25 bp, Homo sapien
tccatacactgtgtgctatttgtgt

SEQ ID NO: 204066 - DNA, 25 bp, Homo sapien
tttattaagctagcatctgccccag

SEQ ID NO: 204067 - DNA, 25 bp, Homo sapien
atctgccccagttggtgttcaaata

SEQ ID NO: 204068 - DNA, 25 bp, Homo sapien
aaatagcacttgactctgcctgtga

SEQ ID NO: 204069 - DNA, 25 bp, Homo sapien
gactctgcctgtgatatctgtatct

SEQ ID NO: 204070 - DNA, 25 bp, Homo sapien
tgtgatatctgtatcttttctctaa

SEQ ID NO: 204071 - DNA, 25 bp, Homo sapien
aaacctgctcagataggacaattaa

SEQ ID NO: 204072 - DNA, 25 bp, Homo sapien
ggacaattaagtgcactgtacaatt

SEQ ID NO: 204073 - DNA, 25 bp, Homo sapien
tacaattttcccagtttacaggtct

SEQ ID NO: 204074 - DNA, 25 bp, Homo sapien
cccagtttacaggtctatacttaag

SEQ ID NO: 204075 - DNA, 25 bp, Homo sapien
tgttcatatccttcagtgacattga

SEQ ID NO: 204076 - DNA, 25 bp, Homo sapien
ggagaatagttgtcaaccttcattc

SEQ ID NO: 204077 - DNA, 25 bp, Homo sapien
tagttgtcaaccttcattcatctct

SEQ ID NO: 204078 - DNA, 25 bp, Homo sapien
gattttcccccttattgatgggact

SEQ ID NO: 204079 - DNA, 25 bp, Homo sapien
gaacatttggaaactgtcgggcttt

SEQ ID NO: 204080 - DNA, 25 bp, Homo sapien
ctttttattaaagctctgtagaatt

SEQ ID NO: 204081 - DNA, 25 bp, Homo sapien
aagccattcctaaacagcccaactg

SEQ ID NO: 204082 - DNA, 25 bp, Homo sapien
tcctaaacagcccaactggcattta

SEQ ID NO: 204083 - DNA, 25 bp, Homo sapien
taaacagcccaactggcatttaatt

SEQ ID NO: 204084 - DNA, 25 bp, Homo sapien
ctggcatttaattacccaatactgt

SEQ ID NO: 204085 - DNA, 25 bp, Homo sapien
cccaatactgtatataaggcaaata

SEQ ID NO: 204086 - DNA, 25 bp, Homo sapien
tgctgctttcttctgtttcagattg

SEQ ID NO: 204087 - DNA, 25 bp, Homo sapien
gctgctttcttctgtttcagattga

SEQ ID NO: 204088 - DNA, 25 bp, Homo sapien
ctgctttcttctgtttcagattgat

SEQ ID NO: 204089 - DNA, 25 bp, Homo sapien
gctttcttctgtttcagattgatgt

SEQ ID NO: 204090 - DNA, 25 bp, Homo sapien
tttcttctgtttcagattgatgtac

SEQ ID NO: 204091 - DNA, 25 bp, Homo sapien
ttctgtttcagattgatgtacagct

SEQ ID NO: 204092 - DNA, 25 bp, Homo sapien
tgactacatggcagtgtaagtatct

SEQ ID NO: 204093 - DNA, 25 bp, Homo sapien
actacatggcagtgtaagtatctag

SEQ ID NO: 204094 - DNA, 25 bp, Homo sapien
acatggcagtgtaagtatctagttt

SEQ ID NO: 204095 - DNA, 25 bp, Homo sapien
atggcagtgtaagtatctagtttta

SEQ ID NO: 204096 - DNA, 25 bp, Homo sapien
ggcagtgtaagtatctagttttatg

SEQ ID NO: 204097 - DNA, 25 bp, Homo sapien
acacattcttatatggctttatgta

SEQ ID NO: 204098 - DNA, 25 bp, Homo sapien
tatctttaactccttttgcattttg

SEQ ID NO: 204099 - DNA, 25 bp, Homo sapien
aacagattgcttaacttctacttgc

SEQ ID NO: 204100 - DNA, 25 bp, Homo sapien
ttgcttaacttctacttgccaacat

SEQ ID NO: 204101 - DNA, 25 bp, Homo sapien
atgggattgtcttcttgatttgaat

SEQ ID NO: 204102 - DNA, 25 bp, Homo sapien
tcttgatttgaattgtaccgtcttt

SEQ ID NO: 204103 - DNA, 25 bp, Homo sapien
attgtaccgtctttgttgacacagt

SEQ ID NO: 204104 - DNA, 25 bp, Homo sapien
cacagtagggctgggcagtgtttaa

SEQ ID NO: 204105 - DNA, 25 bp, Homo sapien
gtgtttaatccttccattttataga

SEQ ID NO: 204106 - DNA, 25 bp, Homo sapien
taatcaggccttttggacttcattc

SEQ ID NO: 204107 - DNA, 25 bp, Homo sapien
taattttgcaataatctcttttccc

SEQ ID NO: 204108 - DNA, 25 bp, Homo sapien
cagggcagacctccttatgctgctt

SEQ ID NO: 204109 - DNA, 25 bp, Homo sapien
gcagacctccttatgctgcttcagc

SEQ ID NO: 204110 - DNA, 25 bp, Homo sapien
tggccaaagaacttaagtcaaaatc

SEQ ID NO: 204111 - DNA, 25 bp, Homo sapien
gggaatcgaagtcctctgctatgtc

SEQ ID NO: 204112 - DNA, 25 bp, Homo sapien
gaagtcctctgctatgtcttcagac

SEQ ID NO: 204113 - DNA, 25 bp, Homo sapien
gctatgtcttcagacgggtccctgg

SEQ ID NO: 204114 - DNA, 25 bp, Homo sapien
ggtccctggctgaaaacggagtgat

SEQ ID NO: 204115 - DNA, 25 bp, Homo sapien
aggagaagccggctccccagatgaa

SEQ ID NO: 204116 - DNA, 25 bp, Homo sapien
atgaacgggagcacgggtgacgcca

SEQ ID NO: 204117 - DNA, 25 bp, Homo sapien
ccagccactctgaaagtgccttgaa

SEQ ID NO: 204118 - DNA, 25 bp, Homo sapien
tgccttgaataatgactctaaaacg

SEQ ID NO: 204119 - DNA, 25 bp, Homo sapien
tggaccctggagagcaggatgcata

SEQ ID NO: 204120 - DNA, 25 bp, Homo sapien
tgcagacccaagagcaagtcctccc

SEQ ID NO: 204121 - DNA, 25 bp, Homo sapien
agctctgcaaaggacttctggccaa

SEQ ID NO: 204122 - DNA, 25 bp, Homo sapien
gcaaaggacttctggccaaaaagcc

SEQ ID NO: 204123 - DNA, 25 bp, Homo sapien
ggacttctggccaaaaagccagaca

SEQ ID NO: 204124 - DNA, 25 bp, Homo sapien
atactgtcagtggtgtccgtgagct

SEQ ID NO: 204125 - DNA, 25 bp, Homo sapien
ctgtcagtggtgtccgtgagctctg

SEQ ID NO: 204126 - DNA, 25 bp, Homo sapien
agtggtgtccgtgagctctgggccc

SEQ ID NO: 204127 - DNA, 25 bp, Homo sapien
gaaagtcgagcactggtcctagtca

SEQ ID NO: 204128 - DNA, 25 bp, Homo sapien
agtcgagcactggtcctagtcaggc

SEQ ID NO: 204129 - DNA, 25 bp, Homo sapien
actggtcctagtcaggctgtgatga

SEQ ID NO: 204130 - DNA, 25 bp, Homo sapien
cttagcctccattacttagtatctc

SEQ ID NO: 204131 - DNA, 25 bp, Homo sapien
agtatctcttacagtttgctctggc

SEQ ID NO: 204132 - DNA, 25 bp, Homo sapien
gtcccaaaattgattaggctgagcc

SEQ ID NO: 204133 - DNA, 25 bp, Homo sapien
taggctgagccttgggaatagtttg

SEQ ID NO: 204134 - DNA, 25 bp, Homo sapien
ggcaggtttaacatcccaaggctaa

SEQ ID NO: 204135 - DNA, 25 bp, Homo sapien
tcccaaggctaacctaacgtagttg

SEQ ID NO: 204136 - DNA, 25 bp, Homo sapien
tgaatgagacatgttttctgtgctt

SEQ ID NO: 204137 - DNA, 25 bp, Homo sapien
ttctgtgcttctaagtgttctgtcc

SEQ ID NO: 204138 - DNA, 25 bp, Homo sapien
tgttctgtcccttaggctgctattg

SEQ ID NO: 204139 - DNA, 25 bp, Homo sapien
gctgctattgcttcatgtttccatt

SEQ ID NO: 204140 - DNA, 25 bp, Homo sapien
gacttgcttgcctaaaactacagtg

SEQ ID NO: 204141 - DNA, 25 bp, Homo sapien
ttcactacctcgacttctctttctg

SEQ ID NO: 204142 - DNA, 25 bp, Homo sapien
atcatcgccgtcaggcagggaggcc

SEQ ID NO: 204143 - DNA, 25 bp, Homo sapien
agggaggccctcttcctgatctctt

SEQ ID NO: 204144 - DNA, 25 bp, Homo sapien
aggccctcttcctgatctcttacag

SEQ ID NO: 204145 - DNA, 25 bp, Homo sapien
tcagggacctgagagggcacattca

SEQ ID NO: 204146 - DNA, 25 bp, Homo sapien
acctgagagggcacattcacagcag

SEQ ID NO: 204147 - DNA, 25 bp, Homo sapien
acattcacagcagccctaggttttt

SEQ ID NO: 204148 - DNA, 25 bp, Homo sapien
cacagcagccctaggttttttcttc

SEQ ID NO: 204149 - DNA, 25 bp, Homo sapien
ttcttccccgtgaaaccagagatga

SEQ ID NO: 204150 - DNA, 25 bp, Homo sapien
tccccgtgaaaccagagatgatttg

SEQ ID NO: 204151 - DNA, 25 bp, Homo sapien
gtatgtggagctggtactgtctctg

SEQ ID NO: 204152 - DNA, 25 bp, Homo sapien
gtagttttcaacactgacagcactt

SEQ ID NO: 204153 - DNA, 25 bp, Homo sapien
aaaaatctttgcctgggcctcactc

SEQ ID NO: 204154 - DNA, 25 bp, Homo sapien
gggcctcactcttgagagattctca

SEQ ID NO: 204155 - DNA, 25 bp, Homo sapien
catttaatagttctgaggtgggtct

SEQ ID NO: 204156 - DNA, 25 bp, Homo sapien
gaggtgggtcttggatataactatt

SEQ ID NO: 204157 - DNA, 25 bp, Homo sapien
attcctctcatgtgcagacagggtt

SEQ ID NO: 204158 - DNA, 25 bp, Homo sapien
gacagggttgagaaccagtagacta

SEQ ID NO: 204159 - DNA, 25 bp, Homo sapien
gtagactaatggtcgtttttcctgt

SEQ ID NO: 204160 - DNA, 25 bp, Homo sapien
gagataactaatttgagctgaagca

SEQ ID NO: 204161 - DNA, 25 bp, Homo sapien
gaagcaatgcttcttaattagcttt

SEQ ID NO: 204162 - DNA, 25 bp, Homo sapien
ctgttggtggctttgttacaactga

SEQ ID NO: 204163 - DNA, 25 bp, Homo sapien
tcatgaccccattaggtatggagag

SEQ ID NO: 204164 - DNA, 25 bp, Homo sapien
gaccccattaggtatggagagctgg

SEQ ID NO: 204165 - DNA, 25 bp, Homo sapien
gggaggaggcattgtcacttcccac

SEQ ID NO: 204166 - DNA, 25 bp, Homo sapien
ggaggcattgtcacttcccaccagg

SEQ ID NO: 204167 - DNA, 25 bp, Homo sapien
ttgaggtgagtcatggcctcttgct

SEQ ID NO: 204168 - DNA, 25 bp, Homo sapien
gtgagtcatggcctcttgctggcaa

SEQ ID NO: 204169 - DNA, 25 bp, Homo sapien
gagtcatggcctcttgctggcaatg

SEQ ID NO: 204170 - DNA, 25 bp, Homo sapien
gtcatggcctcttgctggcaatggg

SEQ ID NO: 204171 - DNA, 25 bp, Homo sapien
tggaatgtgaagtgactccccaacc

SEQ ID NO: 204172 - DNA, 25 bp, Homo sapien
gaatgtgaagtgactccccaacccc

SEQ ID NO: 204173 - DNA, 25 bp, Homo sapien
tgtgaagtgactccccaaccccttt

SEQ ID NO: 204174 - DNA, 25 bp, Homo sapien
aggcctccagcgctgtcagctgcac

SEQ ID NO: 204175 - DNA, 25 bp, Homo sapien
gctgcaccctggcattctcacagag

SEQ ID NO: 204176 - DNA, 25 bp, Homo sapien
ctggcattctcacagagctggctgc

SEQ ID NO: 204177 - DNA, 25 bp, Homo sapien
gggctatagcctcagagaccactca

SEQ ID NO: 204178 - DNA, 25 bp, Homo sapien
gagaccactcatcctctggaatcaa

SEQ ID NO: 204179 - DNA, 25 bp, Homo sapien
atcctctggaatcaacctctttcta

SEQ ID NO: 204180 - DNA, 25 bp, Homo sapien
ggaatcaacctctttctaataccct

SEQ ID NO: 204181 - DNA, 25 bp, Homo sapien
caacctctttctaataccctcttgg

SEQ ID NO: 204182 - DNA, 25 bp, Homo sapien
cttggaaaaagagcttgcccctcct

SEQ ID NO: 204183 - DNA, 25 bp, Homo sapien
ggaaaaagagcttgcccctcctcca

SEQ ID NO: 204184 - DNA, 25 bp, Homo sapien
tcctccagcacactagagctctggc

SEQ ID NO: 204185 - DNA, 25 bp, Homo sapien
gacccaggaggctggaagtgtcccc

SEQ ID NO: 204186 - DNA, 25 bp, Homo sapien
tgaggacgaagcctccagtgacctg

SEQ ID NO: 204187 - DNA, 25 bp, Homo sapien
aagcctccagtgacctggacctgga

SEQ ID NO: 204188 - DNA, 25 bp, Homo sapien
cctggagcaactcatggaagatgtt

SEQ ID NO: 204189 - DNA, 25 bp, Homo sapien
agctgcagcacagcaacagtgatgg

SEQ ID NO: 204190 - DNA, 25 bp, Homo sapien
aacagtgatggcgaggacttccccg

SEQ ID NO: 204191 - DNA, 25 bp, Homo sapien
tccccgtggcgctgtttgggaagta

SEQ ID NO: 204192 - DNA, 25 bp, Homo sapien
tgggaagtagctggtgctcctctgc

SEQ ID NO: 204193 - DNA, 25 bp, Homo sapien
agttgctaagtgctgggtctgttca

SEQ ID NO: 204194 - DNA, 25 bp, Homo sapien
tgctgggtctgttcattggctatga

SEQ ID NO: 204195 - DNA, 25 bp, Homo sapien
atgaggttcaaatgtgtgtggtgca

SEQ ID NO: 204196 - DNA, 25 bp, Homo sapien
agtctttcattgttttcttctgtga

SEQ ID NO: 204197 - DNA, 25 bp, Homo sapien
gtgaagaatctgttgctatgtactg

SEQ ID NO: 204198 - DNA, 25 bp, Homo sapien
gaatctgttgctatgtactgtatat

SEQ ID NO: 204199 - DNA, 25 bp, Homo sapien
atgtactgtatattcagcatttata

SEQ ID NO: 204200 - DNA, 25 bp, Homo sapien
gaggtatttagatatgaacaactga

SEQ ID NO: 204201 - DNA, 25 bp, Homo sapien
gaaatagtgtgctggcttttgtagt

SEQ ID NO: 204202 - DNA, 25 bp, Homo sapien
tagtgtgctggcttttgtagttttg

SEQ ID NO: 204203 - DNA, 25 bp, Homo sapien
agttttgataaagaccattgcaggc

SEQ ID NO: 204204 - DNA, 25 bp, Homo sapien
gtgccagagaaatctgatttctagt

SEQ ID NO: 204205 - DNA, 25 bp, Homo sapien
agccagggcctcaagctcaagatac

SEQ ID NO: 204206 - DNA, 25 bp, Homo sapien
gggcctcaagctcaagatacttatt

SEQ ID NO: 204207 - DNA, 25 bp, Homo sapien
attctgctcttcaccaagaaaaccc

SEQ ID NO: 204208 - DNA, 25 bp, Homo sapien
ggacacttttgaaaacaggactcag

SEQ ID NO: 204209 - DNA, 25 bp, Homo sapien
tgaaaacaggactcagcatcgcttt

SEQ ID NO: 204210 - DNA, 25 bp, Homo sapien
aggactcagcatcgctttcaatagg

SEQ ID NO: 204211 - DNA, 25 bp, Homo sapien
gcatcgctttcaataggcttttcag

SEQ ID NO: 204212 - DNA, 25 bp, Homo sapien
ataggcttttcaggaccttcactgc

SEQ ID NO: 204213 - DNA, 25 bp, Homo sapien
gcttttcaggaccttcactgcatta

SEQ ID NO: 204214 - DNA, 25 bp, Homo sapien
ggaccttcactgcattaaaacaata

SEQ ID NO: 204215 - DNA, 25 bp, Homo sapien
ctgctgttattttctacatttgtat

SEQ ID NO: 204216 - DNA, 25 bp, Homo sapien
acatttgtattttatccatagcact

SEQ ID NO: 204217 - DNA, 25 bp, Homo sapien
tccatagcacttattcacatttagg

SEQ ID NO: 204218 - DNA, 25 bp, Homo sapien
gactcacagcagaatcattcagaga

SEQ ID NO: 204219 - DNA, 25 bp, Homo sapien
ataagtaatcccactgaattccaga

SEQ ID NO: 204220 - DNA, 25 bp, Homo sapien
aagccaggatctcagagctactgca

SEQ ID NO: 204221 - DNA, 25 bp, Homo sapien
agctactgcaaaagttccttctcca

SEQ ID NO: 204222 - DNA, 25 bp, Homo sapien
ttctccaccagacgagcaccaagaa

SEQ ID NO: 204223 - DNA, 25 bp, Homo sapien
gcaccaagaagctgagaatgctgtt

SEQ ID NO: 204224 - DNA, 25 bp, Homo sapien
gagaatgctgtttcctcaggtaaca

SEQ ID NO: 204225 - DNA, 25 bp, Homo sapien
aacagagattcaaaggtaccttcag

SEQ ID NO: 204226 - DNA, 25 bp, Homo sapien
gaaatctctctacacagatgagtca

SEQ ID NO: 204227 - DNA, 25 bp, Homo sapien
agaactgcaatcactactccaaact

SEQ ID NO: 204228 - DNA, 25 bp, Homo sapien
actccaaactttaagaagcttcatg

SEQ ID NO: 204229 - DNA, 25 bp, Homo sapien
ctccttagcccaatatgctgtcttg

SEQ ID NO: 204230 - DNA, 25 bp, Homo sapien
tccttagcccaatatgctgtcttgg

SEQ ID NO: 204231 - DNA, 25 bp, Homo sapien
ccttagcccaatatgctgtcttggg

SEQ ID NO: 204232 - DNA, 25 bp, Homo sapien
cttagcccaatatgctgtcttgggt

SEQ ID NO: 204233 - DNA, 25 bp, Homo sapien
ttagcccaatatgctgtcttgggtc

SEQ ID NO: 204234 - DNA, 25 bp, Homo sapien
tagcccaatatgctgtcttgggtcc

SEQ ID NO: 204235 - DNA, 25 bp, Homo sapien
agcccaatatgctgtcttgggtcct

SEQ ID NO: 204236 - DNA, 25 bp, Homo sapien
ttccacttataatacttgtgattgg

SEQ ID NO: 204237 - DNA, 25 bp, Homo sapien
tccacttataatacttgtgattggg

SEQ ID NO: 204238 - DNA, 25 bp, Homo sapien
ctgggaagtagagtccatttggttg

SEQ ID NO: 204239 - DNA, 25 bp, Homo sapien
tgggaagtagagtccatttggttga

SEQ ID NO: 204240 - DNA, 25 bp, Homo sapien
acactgagccagcaagtcctgctgt

SEQ ID NO: 204241 - DNA, 25 bp, Homo sapien
gagccagcaagtcctgctgtccaca

SEQ ID NO: 204242 - DNA, 25 bp, Homo sapien
cacacccacaagctacctggaggga

SEQ ID NO: 204243 - DNA, 25 bp, Homo sapien
cacaagctacctggagggacaggac

SEQ ID NO: 204244 - DNA, 25 bp, Homo sapien
catccttcggaaggccttcctggaa

SEQ ID NO: 204245 - DNA, 25 bp, Homo sapien
tcggaaggccttcctggaatcccac

SEQ ID NO: 204246 - DNA, 25 bp, Homo sapien
gatggcgtcagaggaggtgtggtca

SEQ ID NO: 204247 - DNA, 25 bp, Homo sapien
tggtcagaggtgacttgttcccacc

SEQ ID NO: 204248 - DNA, 25 bp, Homo sapien
gacttgttcccacctccagggagga

SEQ ID NO: 204249 - DNA, 25 bp, Homo sapien
acgcttcgtcttcggccagcgcaga

SEQ ID NO: 204250 - DNA, 25 bp, Homo sapien
ttcggccagcgcagacctggtgttt

SEQ ID NO: 204251 - DNA, 25 bp, Homo sapien
cattggttcatattcagaaagtgtt

SEQ ID NO: 204252 - DNA, 25 bp, Homo sapien
ctcattgattatattcttgttaagc

SEQ ID NO: 204253 - DNA, 25 bp, Homo sapien
atattcttgttaagcaaatctcctt

SEQ ID NO: 204254 - DNA, 25 bp, Homo sapien
gttaagcaaatctccttaagtaatt

SEQ ID NO: 204255 - DNA, 25 bp, Homo sapien
tatactcatacatctatatgtcact

SEQ ID NO: 204256 - DNA, 25 bp, Homo sapien
atgtcactgttttaaagagatattt

SEQ ID NO: 204257 - DNA, 25 bp, Homo sapien
taatgtgtgttacatggtctgtaaa

SEQ ID NO: 204258 - DNA, 25 bp, Homo sapien
aaatgccatgcattaggctttggaa

SEQ ID NO: 204259 - DNA, 25 bp, Homo sapien
tgccatgcattaggctttggaaatt

SEQ ID NO: 204260 - DNA, 25 bp, Homo sapien
ttcattcatacagttaagtttatct

SEQ ID NO: 204261 - DNA, 25 bp, Homo sapien
tacagttaagtttatctgacaataa

SEQ ID NO: 204262 - DNA, 25 bp, Homo sapien
aggggccacctgtagtatttgcctt

SEQ ID NO: 204263 - DNA, 25 bp, Homo sapien
atttgccttgatttggtggggtaca

SEQ ID NO: 204264 - DNA, 25 bp, Homo sapien
agtggatgtgaatactgtaaatagc

SEQ ID NO: 204265 - DNA, 25 bp, Homo sapien
gtaaatagcttgtgctcagactcct

SEQ ID NO: 204266 - DNA, 25 bp, Homo sapien
aaatagcttgtgctcagactcctct

SEQ ID NO: 204267 - DNA, 25 bp, Homo sapien
aatagcttgtgctcagactcctctg

SEQ ID NO: 204268 - DNA, 25 bp, Homo sapien
tagcttgtgctcagactcctctgcg

SEQ ID NO: 204269 - DNA, 25 bp, Homo sapien
ttgtgctcagactcctctgcgtgga

SEQ ID NO: 204270 - DNA, 25 bp, Homo sapien
tgctcagactcctctgcgtggagag

SEQ ID NO: 204271 - DNA, 25 bp, Homo sapien
tcagactcctctgcgtggagagggt

SEQ ID NO: 204272 - DNA, 25 bp, Homo sapien
gaatcagtgttactgcatctgatta

SEQ ID NO: 204273 - DNA, 25 bp, Homo sapien
aagaaggctctggatttaagcgggt

SEQ ID NO: 204274 - DNA, 25 bp, Homo sapien
aagcgggtggtcacctgtgagacca

SEQ ID NO: 204275 - DNA, 25 bp, Homo sapien
tgtgagaccaggtctaccttgggac

SEQ ID NO: 204276 - DNA, 25 bp, Homo sapien
ctaccttgggactgttatttaactg

SEQ ID NO: 204277 - DNA, 25 bp, Homo sapien
aatttcacagtagtgggtgggcctg

SEQ ID NO: 204278 - DNA, 25 bp, Homo sapien
gctctgacagataccacgaaacatg

SEQ ID NO: 204279 - DNA, 25 bp, Homo sapien
gaaacatgaagcacgtggaactaca

SEQ ID NO: 204280 - DNA, 25 bp, Homo sapien
gggtctttctgagtgcaaggctgaa

SEQ ID NO: 204281 - DNA, 25 bp, Homo sapien
aggctgaaatggacaagggctcctc

SEQ ID NO: 204282 - DNA, 25 bp, Homo sapien
ggagcctgccttgtgttcctttttt

SEQ ID NO: 204283 - DNA, 25 bp, Homo sapien
ttgacttgtgacatttttcaaacac

SEQ ID NO: 204284 - DNA, 25 bp, Homo sapien
aagaggtggaaggtactatggcaga

SEQ ID NO: 204285 - DNA, 25 bp, Homo sapien
ggtggaaggtactatggcagaggtt

SEQ ID NO: 204286 - DNA, 25 bp, Homo sapien
atggcagaggttacaaaaaccaggc

SEQ ID NO: 204287 - DNA, 25 bp, Homo sapien
ggcagaggttacaaaaaccaggcag

SEQ ID NO: 204288 - DNA, 25 bp, Homo sapien
agaggttacaaaaaccaggcagcaa

SEQ ID NO: 204289 - DNA, 25 bp, Homo sapien
gaggttacaaaaaccaggcagcaat

SEQ ID NO: 204290 - DNA, 25 bp, Homo sapien
ggttacaaaaaccaggcagcaattc

SEQ ID NO: 204291 - DNA, 25 bp, Homo sapien
gttacaaaaaccaggcagcaattca

SEQ ID NO: 204292 - DNA, 25 bp, Homo sapien
ttacaaaaaccaggcagcaattcag

SEQ ID NO: 204293 - DNA, 25 bp, Homo sapien
acaaaaaccaggcagcaattcaggg

SEQ ID NO: 204294 - DNA, 25 bp, Homo sapien
caaaaaccaggcagcaattcagggc

SEQ ID NO: 204295 - DNA, 25 bp, Homo sapien
cacactgagccagcaagtcctgctg

SEQ ID NO: 204296 - DNA, 25 bp, Homo sapien
tgtccacacccacaagctacctgga

SEQ ID NO: 204297 - DNA, 25 bp, Homo sapien
ggacaggacccacctccatccttcg

SEQ ID NO: 204298 - DNA, 25 bp, Homo sapien
tccatccttcggaaggccttcctgg

SEQ ID NO: 204299 - DNA, 25 bp, Homo sapien
ggccttcctggaatcccaccttggc

SEQ ID NO: 204300 - DNA, 25 bp, Homo sapien
gaccttggggcttgtgtcgagccct

SEQ ID NO: 204301 - DNA, 25 bp, Homo sapien
ggcttgtgtcgagcccttgggtggg

SEQ ID NO: 204302 - DNA, 25 bp, Homo sapien
gatggcgtcagaggaggtgtggtca

SEQ ID NO: 204303 - DNA, 25 bp, Homo sapien
gaggtgtggtcagaggtgacttgtt

SEQ ID NO: 204304 - DNA, 25 bp, Homo sapien
gggaggacgcttcgtcttcggccag

SEQ ID NO: 204305 - DNA, 25 bp, Homo sapien
acgcttcgtcttcggccagcgcaga

SEQ ID NO: 204306 - DNA, 25 bp, Homo sapien
ggagactatgaccaagccaataaaa

SEQ ID NO: 204307 - DNA, 25 bp, Homo sapien
ggcatttaaatcagccctgttagta

SEQ ID NO: 204308 - DNA, 25 bp, Homo sapien
atggctggtgcctcttctagtcaca

SEQ ID NO: 204309 - DNA, 25 bp, Homo sapien
gtgcctcttctagtcacaagtttgt

SEQ ID NO: 204310 - DNA, 25 bp, Homo sapien
ggtccagaagatcattcccttgcat

SEQ ID NO: 204311 - DNA, 25 bp, Homo sapien
cattcccttgcatagatttctcttt

SEQ ID NO: 204312 - DNA, 25 bp, Homo sapien
gcatagatttctcttttaccaattt

SEQ ID NO: 204313 - DNA, 25 bp, Homo sapien
taccaatttgagtgcctcctacatg

SEQ ID NO: 204314 - DNA, 25 bp, Homo sapien
tcctacatgggcagcagtggactaa

SEQ ID NO: 204315 - DNA, 25 bp, Homo sapien
tggactaagtgctgggtgtgataaa

SEQ ID NO: 204316 - DNA, 25 bp, Homo sapien
ggttaggacctgtggcagaccatta

SEQ ID NO: 204317 - DNA, 25 bp, Homo sapien
atgatttgcaaataatacccaactt

SEQ ID NO: 204318 - DNA, 25 bp, Homo sapien
gcaaataatacccaacttaatctgt

SEQ ID NO: 204319 - DNA, 25 bp, Homo sapien
tacccaacttaatctgtattgttat

SEQ ID NO: 204320 - DNA, 25 bp, Homo sapien
atttactgaggaaatgagacagcac

SEQ ID NO: 204321 - DNA, 25 bp, Homo sapien
atgagacagcacgtgacaaatcctt

SEQ ID NO: 204322 - DNA, 25 bp, Homo sapien
gagacagcacgtgacaaatccttaa

SEQ ID NO: 204323 - DNA, 25 bp, Homo sapien
gacagcacgtgacaaatccttaaag

SEQ ID NO: 204324 - DNA, 25 bp, Homo sapien
agcacgtgacaaatccttaaaggat

SEQ ID NO: 204325 - DNA, 25 bp, Homo sapien
cttaaaggatacacacatgacagga

SEQ ID NO: 204326 - DNA, 25 bp, Homo sapien
ggatacacacatgacaggaaggatt

SEQ ID NO: 204327 - DNA, 25 bp, Homo sapien
cacacatgacaggaaggattagaag

SEQ ID NO: 204328 - DNA, 25 bp, Homo sapien
agagaacacgtcttacaggatggaa

SEQ ID NO: 204329 - DNA, 25 bp, Homo sapien
aagtgtgtagctaggttatttcgga

SEQ ID NO: 204330 - DNA, 25 bp, Homo sapien
gtagctaggttatttcggagtgtta

SEQ ID NO: 204331 - DNA, 25 bp, Homo sapien
gtgttatttatcttcccacttgctc

SEQ ID NO: 204332 - DNA, 25 bp, Homo sapien
ccacttgctctctgtttgtattttt

SEQ ID NO: 204333 - DNA, 25 bp, Homo sapien
gtttttgattcttgagactgtgagg

SEQ ID NO: 204334 - DNA, 25 bp, Homo sapien
ggacttggttgacttctctgccctt

SEQ ID NO: 204335 - DNA, 25 bp, Homo sapien
gttgacttctctgcccttaaagtaa

SEQ ID NO: 204336 - DNA, 25 bp, Homo sapien
atattagtgaaattggttccatcag

SEQ ID NO: 204337 - DNA, 25 bp, Homo sapien
gttccatcagagataacctcgagtt

SEQ ID NO: 204338 - DNA, 25 bp, Homo sapien
acctcgagttcttggtgtagaaatt

SEQ ID NO: 204339 - DNA, 25 bp, Homo sapien
tcttccctgtattatagcaagttct

SEQ ID NO: 204340 - DNA, 25 bp, Homo sapien
cttccctgtattatagcaagttctt

SEQ ID NO: 204341 - DNA, 25 bp, Homo sapien
ttccctgtattatagcaagttcttt

SEQ ID NO: 204342 - DNA, 25 bp, Homo sapien
tccctgtattatagcaagttcttta

SEQ ID NO: 204343 - DNA, 25 bp, Homo sapien
ccctgtattatagcaagttctttat

SEQ ID NO: 204344 - DNA, 25 bp, Homo sapien
cctgtattatagcaagttctttatt

SEQ ID NO: 204345 - DNA, 25 bp, Homo sapien
ctgtattatagcaagttctttatta

SEQ ID NO: 204346 - DNA, 25 bp, Homo sapien
tgtattatagcaagttctttattaa

SEQ ID NO: 204347 - DNA, 25 bp, Homo sapien
attatagcaagttctttattaaaga

SEQ ID NO: 204348 - DNA, 25 bp, Homo sapien
ttaaagatttttgaggccgggcaca

SEQ ID NO: 204349 - DNA, 25 bp, Homo sapien
taaagatttttgaggccgggcacag

SEQ ID NO: 204350 - DNA, 25 bp, Homo sapien
gtggcacttgtctgtagtccagggt

SEQ ID NO: 204351 - DNA, 25 bp, Homo sapien
tggcacttgtctgtagtccagggta

SEQ ID NO: 204352 - DNA, 25 bp, Homo sapien
ggcacttgtctgtagtccagggtac

SEQ ID NO: 204353 - DNA, 25 bp, Homo sapien
gcacttgtctgtagtccagggtact

SEQ ID NO: 204354 - DNA, 25 bp, Homo sapien
cacttgtctgtagtccagggtactt

SEQ ID NO: 204355 - DNA, 25 bp, Homo sapien
acttgtctgtagtccagggtacttg

SEQ ID NO: 204356 - DNA, 25 bp, Homo sapien
cttgtctgtagtccagggtacttga

SEQ ID NO: 204357 - DNA, 25 bp, Homo sapien
ctgtagtccagggtacttgagggcc

SEQ ID NO: 204358 - DNA, 25 bp, Homo sapien
tgtagtccagggtacttgagggcct

SEQ ID NO: 204359 - DNA, 25 bp, Homo sapien
tagtccagggtacttgagggcctga

SEQ ID NO: 204360 - DNA, 25 bp, Homo sapien
ccagggtacttgagggcctgaggta

SEQ ID NO: 204361 - DNA, 25 bp, Homo sapien
ggctgccttctgcatttatttgcct

SEQ ID NO: 204362 - DNA, 25 bp, Homo sapien
ctgccttctgcatttatttgccttt

SEQ ID NO: 204363 - DNA, 25 bp, Homo sapien
ttctttttctcttgcttctaagggg

SEQ ID NO: 204364 - DNA, 25 bp, Homo sapien
ggtggccaccactgtttagaatgac

SEQ ID NO: 204365 - DNA, 25 bp, Homo sapien
ggccaccactgtttagaatgaccct

SEQ ID NO: 204366 - DNA, 25 bp, Homo sapien
gccaccactgtttagaatgaccctt

SEQ ID NO: 204367 - DNA, 25 bp, Homo sapien
accactgtttagaatgacccttggg

SEQ ID NO: 204368 - DNA, 25 bp, Homo sapien
tagcagagtttgtgaccaaagtcag

SEQ ID NO: 204369 - DNA, 25 bp, Homo sapien
aatttgtcttgttggagcctgctct

SEQ ID NO: 204370 - DNA, 25 bp, Homo sapien
atttgtcttgttggagcctgctctg

SEQ ID NO: 204371 - DNA, 25 bp, Homo sapien
tcttgttggagcctgctctgtgctc

SEQ ID NO: 204372 - DNA, 25 bp, Homo sapien
atctatgcagcatttaccagaaaag

SEQ ID NO: 204373 - DNA, 25 bp, Homo sapien
aagagtattcctgggatagcagaat

SEQ ID NO: 204374 - DNA, 25 bp, Homo sapien
gatagcagaatgcataacactgagt

SEQ ID NO: 204375 - DNA, 25 bp, Homo sapien
aataagctagactgccttctcttta

SEQ ID NO: 204376 - DNA, 25 bp, Homo sapien
gactgccttctctttaattagacat

SEQ ID NO: 204377 - DNA, 25 bp, Homo sapien
atagttgtcaactagtaactcaatg

SEQ ID NO: 204378 - DNA, 25 bp, Homo sapien
gaaaaagttgatgcccaagggagaa

SEQ ID NO: 204379 - DNA, 25 bp, Homo sapien
gaattagcttaattgctgcctttaa

SEQ ID NO: 204380 - DNA, 25 bp, Homo sapien
attgctgcctttaatgtgtttttga

SEQ ID NO: 204381 - DNA, 25 bp, Homo sapien
aattttctttcatgtcgctgatcca

SEQ ID NO: 204382 - DNA, 25 bp, Homo sapien
gtcgctgatccatattaccaagttc

SEQ ID NO: 204383 - DNA, 25 bp, Homo sapien
tctcccctgcaaaatatcccactgt

SEQ ID NO: 204384 - DNA, 25 bp, Homo sapien
tcccactgttgctaatctgtctgcc

SEQ ID NO: 204385 - DNA, 25 bp, Homo sapien
aatctgtctgcctcataatttccat

SEQ ID NO: 204386 - DNA, 25 bp, Homo sapien
gtctgcctcataatttccatgagat

SEQ ID NO: 204387 - DNA, 25 bp, Homo sapien
cttgtttgttttgtcaccactatat

SEQ ID NO: 204388 - DNA, 25 bp, Homo sapien
gttttgtcaccactatataacagca

SEQ ID NO: 204389 - DNA, 25 bp, Homo sapien
gtcaccactatataacagcatgttg

SEQ ID NO: 204390 - DNA, 25 bp, Homo sapien
gaaaaaccaagcgaatacactggat

SEQ ID NO: 204391 - DNA, 25 bp, Homo sapien
caagcgaatacactggattaaaaaa

SEQ ID NO: 204392 - DNA, 25 bp, Homo sapien
gctagtggatcatgtggccgagatc

SEQ ID NO: 204393 - DNA, 25 bp, Homo sapien
tagtggatcatgtggccgagatcgc

SEQ ID NO: 204394 - DNA, 25 bp, Homo sapien
ccagcaggtgggtgggactatgcca

SEQ ID NO: 204395 - DNA, 25 bp, Homo sapien
caggacgggatggtggctcagagag

SEQ ID NO: 204396 - DNA, 25 bp, Homo sapien
ggaggagaggcctgtagcacccatt

SEQ ID NO: 204397 - DNA, 25 bp, Homo sapien
gaggcctgtagcacccattggaggt

SEQ ID NO: 204398 - DNA, 25 bp, Homo sapien
acccattggaggtgtgtggtcgccc

SEQ ID NO: 204399 - DNA, 25 bp, Homo sapien
gtgtggtcgcccagcacaagaacaa

SEQ ID NO: 204400 - DNA, 25 bp, Homo sapien
ggtcgcccagcacaagaacaaggga

SEQ ID NO: 204401 - DNA, 25 bp, Homo sapien
gcccaggccacggagctttaattaa

SEQ ID NO: 204402 - DNA, 25 bp, Homo sapien
ttaattaaaacccgcccggagcatg

SEQ ID NO: 204403 - DNA, 25 bp, Homo sapien
ctgccatgcattcttcacttaattg

SEQ ID NO: 204404 - DNA, 25 bp, Homo sapien
gccatgcattcttcacttaattggg

SEQ ID NO: 204405 - DNA, 25 bp, Homo sapien
ttaaaaaagctcttgatgggccagg

SEQ ID NO: 204406 - DNA, 25 bp, Homo sapien
taaaaaagctcttgatgggccaggc

SEQ ID NO: 204407 - DNA, 25 bp, Homo sapien
aaaaaagctcttgatgggccaggct

SEQ ID NO: 204408 - DNA, 25 bp, Homo sapien
aaaaagctcttgatgggccaggctt

SEQ ID NO: 204409 - DNA, 25 bp, Homo sapien
aaaagctcttgatgggccaggcttg

SEQ ID NO: 204410 - DNA, 25 bp, Homo sapien
aaagctcttgatgggccaggcttgg

SEQ ID NO: 204411 - DNA, 25 bp, Homo sapien
aagctcttgatgggccaggcttggt

SEQ ID NO: 204412 - DNA, 25 bp, Homo sapien
gtgaaacgccatccctactaaggat

SEQ ID NO: 204413 - DNA, 25 bp, Homo sapien
gaaacgccatccctactaaggatac

SEQ ID NO: 204414 - DNA, 25 bp, Homo sapien
aaacgccatccctactaaggataca

SEQ ID NO: 204415 - DNA, 25 bp, Homo sapien
aacgccatccctactaaggatacaa

SEQ ID NO: 204416 - DNA, 25 bp, Homo sapien
attcctgaccgtccgtgttctcagg

SEQ ID NO: 204417 - DNA, 25 bp, Homo sapien
ctgaccgtccgtgttctcaggagtg

SEQ ID NO: 204418 - DNA, 25 bp, Homo sapien
gttctcaggagtggttgaggacaca

SEQ ID NO: 204419 - DNA, 25 bp, Homo sapien
ggttgaggacacagggccccagccc

SEQ ID NO: 204420 - DNA, 25 bp, Homo sapien
agcccctttggagcttttctcttgt

SEQ ID NO: 204421 - DNA, 25 bp, Homo sapien
cctctcactccttcccagaagtttt

SEQ ID NO: 204422 - DNA, 25 bp, Homo sapien
gtttttgcacagaacttcattttga

SEQ ID NO: 204423 - DNA, 25 bp, Homo sapien
ttttgcacagaacttcattttgaaa

SEQ ID NO: 204424 - DNA, 25 bp, Homo sapien
tgtttttctcattctccatacctcc

SEQ ID NO: 204425 - DNA, 25 bp, Homo sapien
tgtcctgagcgtctcctgggccaga

SEQ ID NO: 204426 - DNA, 25 bp, Homo sapien
gtctcctgggccagagagaggagat

SEQ ID NO: 204427 - DNA, 25 bp, Homo sapien
gatgactctaagtgtactgtttgca

SEQ ID NO: 204428 - DNA, 25 bp, Homo sapien
gggtgatactttcattttgcacatc

SEQ ID NO: 204429 - DNA, 25 bp, Homo sapien
ttttgcacatcatgcacatcatggt

SEQ ID NO: 204430 - DNA, 25 bp, Homo sapien
atcatgcacatcatggtattcaggg

SEQ ID NO: 204431 - DNA, 25 bp, Homo sapien
gattatctaaagttggatgcccaca

SEQ ID NO: 204432 - DNA, 25 bp, Homo sapien
ctaaagttggatgcccacactatga

SEQ ID NO: 204433 - DNA, 25 bp, Homo sapien
tatttgccttatagatatgctcaag

SEQ ID NO: 204434 - DNA, 25 bp, Homo sapien
ctcaaggttactgggcttgctacta

SEQ ID NO: 204435 - DNA, 25 bp, Homo sapien
gttactgggcttgctactatttgta

SEQ ID NO: 204436 - DNA, 25 bp, Homo sapien
gcttgctactatttgtaactccttg

SEQ ID NO: 204437 - DNA, 25 bp, Homo sapien
atacttgtttatcttgttgctgcaa

SEQ ID NO: 204438 - DNA, 25 bp, Homo sapien
gtttgttttaatgtattctttagca

SEQ ID NO: 204439 - DNA, 25 bp, Homo sapien
gatataacttttatcctccagatct

SEQ ID NO: 204440 - DNA, 25 bp, Homo sapien
tatcctccagatcttaagctttctt

SEQ ID NO: 204441 - DNA, 25 bp, Homo sapien
gctttcttttgctctcttcagcaat

SEQ ID NO: 204442 - DNA, 25 bp, Homo sapien
tttgctctcttcagcaatttaagag

SEQ ID NO: 204443 - DNA, 25 bp, Homo sapien
caatttaagagactattaagctgtc

SEQ ID NO: 204444 - DNA, 25 bp, Homo sapien
ctaaaagctattttggtatccactc

SEQ ID NO: 204445 - DNA, 25 bp, Homo sapien
gctattttggtatccactcttttta

SEQ ID NO: 204446 - DNA, 25 bp, Homo sapien
taaggtaatttgttagctctgcccc

SEQ ID NO: 204447 - DNA, 25 bp, Homo sapien
taatttgttagctctgcccctcatc

SEQ ID NO: 204448 - DNA, 25 bp, Homo sapien
gcccctcatcttctaaaacctttgt

SEQ ID NO: 204449 - DNA, 25 bp, Homo sapien
tgtccctgtcctcccctttacccag

SEQ ID NO: 204450 - DNA, 25 bp, Homo sapien
tgtcctcccctttacccagagggag

SEQ ID NO: 204451 - DNA, 25 bp, Homo sapien
ctttacccagagggaggtcgtgaag

SEQ ID NO: 204452 - DNA, 25 bp, Homo sapien
tttacccagagggaggtcgtgaagg

SEQ ID NO: 204453 - DNA, 25 bp, Homo sapien
ttacccagagggaggtcgtgaaggg

SEQ ID NO: 204454 - DNA, 25 bp, Homo sapien
tacccagagggaggtcgtgaagggc

SEQ ID NO: 204455 - DNA, 25 bp, Homo sapien
cagagggaggtcgtgaagggccccg

SEQ ID NO: 204456 - DNA, 25 bp, Homo sapien
ggaggtcgtgaagggccccggtgct

SEQ ID NO: 204457 - DNA, 25 bp, Homo sapien
gaggtcgtgaagggccccggtgctg

SEQ ID NO: 204458 - DNA, 25 bp, Homo sapien
aggtcgtgaagggccccggtgctgt

SEQ ID NO: 204459 - DNA, 25 bp, Homo sapien
ggtcgtgaagggccccggtgctgtg

SEQ ID NO: 204460 - DNA, 25 bp, Homo sapien
ttgctacatcataatgctggttttg

SEQ ID NO: 204461 - DNA, 25 bp, Homo sapien
taatgctggttttgctgactttttg

SEQ ID NO: 204462 - DNA, 25 bp, Homo sapien
ttggtgattgcattgggaaattccc

SEQ ID NO: 204463 - DNA, 25 bp, Homo sapien
attcccagggtattactggacctat

SEQ ID NO: 204464 - DNA, 25 bp, Homo sapien
ggtattactggacctatgtggtgta

SEQ ID NO: 204465 - DNA, 25 bp, Homo sapien
ctggacctatgtggtgtattgttaa

SEQ ID NO: 204466 - DNA, 25 bp, Homo sapien
gtattgttaaaccagtgtccttgtg

SEQ ID NO: 204467 - DNA, 25 bp, Homo sapien
taaaccagtgtccttgtgatactgt

SEQ ID NO: 204468 - DNA, 25 bp, Homo sapien
atacaggtaaggaaacagttggtca

SEQ ID NO: 204469 - DNA, 25 bp, Homo sapien
aaatcaaaccagcattccccattgt

SEQ ID NO: 204470 - DNA, 25 bp, Homo sapien
accagcattccccattgtgtaaata

SEQ ID NO: 204471 - DNA, 25 bp, Homo sapien
gttctcaggagtggttgaggacaca

SEQ ID NO: 204472 - DNA, 25 bp, Homo sapien
ttctcaggagtggttgaggacacag

SEQ ID NO: 204473 - DNA, 25 bp, Homo sapien
tctcaggagtggttgaggacacagg

SEQ ID NO: 204474 - DNA, 25 bp, Homo sapien
ctcaggagtggttgaggacacaggg

SEQ ID NO: 204475 - DNA, 25 bp, Homo sapien
tcaggagtggttgaggacacagggc

SEQ ID NO: 204476 - DNA, 25 bp, Homo sapien
tcttgtcctctcactccttcccaga

SEQ ID NO: 204477 - DNA, 25 bp, Homo sapien
ttgtcctctcactccttcccagaag

SEQ ID NO: 204478 - DNA, 25 bp, Homo sapien
tgtcctctcactccttcccagaagt

SEQ ID NO: 204479 - DNA, 25 bp, Homo sapien
gtcctctcactccttcccagaagtt

SEQ ID NO: 204480 - DNA, 25 bp, Homo sapien
tcctctcactccttcccagaagttt

SEQ ID NO: 204481 - DNA, 25 bp, Homo sapien
cctctcactccttcccagaagtttt

SEQ ID NO: 204482 - DNA, 25 bp, Homo sapien
gaagattctcttgaagttcctgtga

SEQ ID NO: 204483 - DNA, 25 bp, Homo sapien
agttcctgtgatcttttgaaactgc

SEQ ID NO: 204484 - DNA, 25 bp, Homo sapien
actgcattcctgagttctatcctta

SEQ ID NO: 204485 - DNA, 25 bp, Homo sapien
cctgagttctatccttacttcctta

SEQ ID NO: 204486 - DNA, 25 bp, Homo sapien
ttacttccttaaagcagcatgcact

SEQ ID NO: 204487 - DNA, 25 bp, Homo sapien
gcagcatgcacttttggtttgttgt

SEQ ID NO: 204488 - DNA, 25 bp, Homo sapien
aggtgatcacctgcaacaattcttc

SEQ ID NO: 204489 - DNA, 25 bp, Homo sapien
gagaccccacgaactagatgccaga

SEQ ID NO: 204490 - DNA, 25 bp, Homo sapien
gaaagttctgcagtcattgactgtt

SEQ ID NO: 204491 - DNA, 25 bp, Homo sapien
ttgactgttaactgcaattccaact

SEQ ID NO: 204492 - DNA, 25 bp, Homo sapien
aattccaactatacggtcagccctc

SEQ ID NO: 204493 - DNA, 25 bp, Homo sapien
gctctgcctgcctgtgtgcgccatg

SEQ ID NO: 204494 - DNA, 25 bp, Homo sapien
ggctggagctgcgtctcttcccggg

SEQ ID NO: 204495 - DNA, 25 bp, Homo sapien
gcgctggtgctgagttgcttagacc

SEQ ID NO: 204496 - DNA, 25 bp, Homo sapien
tggtgctgagttgcttagaccagaa

SEQ ID NO: 204497 - DNA, 25 bp, Homo sapien
gagttgcttagaccagaagactatt

SEQ ID NO: 204498 - DNA, 25 bp, Homo sapien
gaccagaagactattcagaccgtga

SEQ ID NO: 204499 - DNA, 25 bp, Homo sapien
agaagactattcagaccgtgagcct

SEQ ID NO: 204500 - DNA, 25 bp, Homo sapien
agactattcagaccgtgagcctgtt

SEQ ID NO: 204501 - DNA, 25 bp, Homo sapien
ctattcagaccgtgagcctgttttt

SEQ ID NO: 204502 - DNA, 25 bp, Homo sapien
gtttttgatttgagtgttccactaa

SEQ ID NO: 204503 - DNA, 25 bp, Homo sapien
ttgagtgttccactaaacaaacaac

SEQ ID NO: 204504 - DNA, 25 bp, Homo sapien
catctttttgagtaggagttttcca

SEQ ID NO: 204505 - DNA, 25 bp, Homo sapien
gagttttccaccagttgcagggatt

SEQ ID NO: 204506 - DNA, 25 bp, Homo sapien
agggattccctgagtctagagtaat

SEQ ID NO: 204507 - DNA, 25 bp, Homo sapien
agtaatgccacaatgctgctccctt

SEQ ID NO: 204508 - DNA, 25 bp, Homo sapien
ctttctaagcatttctgtcagggag

SEQ ID NO: 204509 - DNA, 25 bp, Homo sapien
gacttagattcagttgttcacttta

SEQ ID NO: 204510 - DNA, 25 bp, Homo sapien
acattttccttagatactctcttag

SEQ ID NO: 204511 - DNA, 25 bp, Homo sapien
gaaaagttgtattctgcgcacttct

SEQ ID NO: 204512 - DNA, 25 bp, Homo sapien
gtattctgcgcacttctgttatgaa

SEQ ID NO: 204513 - DNA, 25 bp, Homo sapien
gattgctgagatttgttaagttacc

SEQ ID NO: 204514 - DNA, 25 bp, Homo sapien
atatccaccatcacttcatttagct

SEQ ID NO: 204515 - DNA, 25 bp, Homo sapien
ggtatgcaatttgagccacaaggct

SEQ ID NO: 204516 - DNA, 25 bp, Homo sapien
ggctcgtatcgccaacagctatata

SEQ ID NO: 204517 - DNA, 25 bp, Homo sapien
atttttctgtcttacagagccatga

SEQ ID NO: 204518 - DNA, 25 bp, Homo sapien
tggagtaactactgtttttctcctt

SEQ ID NO: 204519 - DNA, 25 bp, Homo sapien
gtttctaaagttgcacctaaggaat

SEQ ID NO: 204520 - DNA, 25 bp, Homo sapien
gcacctaaggaatctgtcacatttt

SEQ ID NO: 204521 - DNA, 25 bp, Homo sapien
gtcacattttctgttgaatcatggt

SEQ ID NO: 204522 - DNA, 25 bp, Homo sapien
aacagatattccttctgatacggac

SEQ ID NO: 204523 - DNA, 25 bp, Homo sapien
gaggtgattacctctagccatcagc

SEQ ID NO: 204524 - DNA, 25 bp, Homo sapien
attacctctagccatcagccttact

SEQ ID NO: 204525 - DNA, 25 bp, Homo sapien
tactccatcccatgtttggtatgca

SEQ ID NO: 204526 - DNA, 25 bp, Homo sapien
aaggactgtgtagacccctgtggcc

SEQ ID NO: 204527 - DNA, 25 bp, Homo sapien
ggactgtgtagacccctgtggcccc

SEQ ID NO: 204528 - DNA, 25 bp, Homo sapien
ttcatcgtgaggctgccacagtgcc

SEQ ID NO: 204529 - DNA, 25 bp, Homo sapien
cccaacacaggaacgctcatggaca

SEQ ID NO: 204530 - DNA, 25 bp, Homo sapien
aacacaggaacgctcatggacacct

SEQ ID NO: 204531 - DNA, 25 bp, Homo sapien
acaggaacgctcatggacacctgca

SEQ ID NO: 204532 - DNA, 25 bp, Homo sapien
aggaacgctcatggacacctgcaca

SEQ ID NO: 204533 - DNA, 25 bp, Homo sapien
gaacgctcatggacacctgcacact

SEQ ID NO: 204534 - DNA, 25 bp, Homo sapien
cactccacagaagacgttggcatgt

SEQ ID NO: 204535 - DNA, 25 bp, Homo sapien
acagaagacgttggcatgtgaggcc

SEQ ID NO: 204536 - DNA, 25 bp, Homo sapien
gtgggcaccaaagaccaggcccaga

SEQ ID NO: 204537 - DNA, 25 bp, Homo sapien
gtaacagtgaacctacctgggtttg

SEQ ID NO: 204538 - DNA, 25 bp, Homo sapien
aggatttatgtagtgtctggctgta

SEQ ID NO: 204539 - DNA, 25 bp, Homo sapien
ttatgtagtgtctggctgtaagcaa

SEQ ID NO: 204540 - DNA, 25 bp, Homo sapien
gtagtgtctggctgtaagcaagaat

SEQ ID NO: 204541 - DNA, 25 bp, Homo sapien
gaagatttctctgttaaagtcacaa

SEQ ID NO: 204542 - DNA, 25 bp, Homo sapien
ttttataacatacttcaaggaagag

SEQ ID NO: 204543 - DNA, 25 bp, Homo sapien
gagtatcgaagtaagttgctttata

SEQ ID NO: 204544 - DNA, 25 bp, Homo sapien
taagactaaattcgtatggatgcag

SEQ ID NO: 204545 - DNA, 25 bp, Homo sapien
cgtatggatgcagaattcaattaat

SEQ ID NO: 204546 - DNA, 25 bp, Homo sapien
taaaatttgagcctgttacgtaaat

SEQ ID NO: 204547 - DNA, 25 bp, Homo sapien
gagcctgttacgtaaattgaatatt

SEQ ID NO: 204548 - DNA, 25 bp, Homo sapien
gggctgcttttaccacgcccgatca

SEQ ID NO: 204549 - DNA, 25 bp, Homo sapien
agcagcgtggcctcctctggcagtg

SEQ ID NO: 204550 - DNA, 25 bp, Homo sapien
agcgtggcctcctctggcagtgagc

SEQ ID NO: 204551 - DNA, 25 bp, Homo sapien
agccggaacaccttccaggaggatg

SEQ ID NO: 204552 - DNA, 25 bp, Homo sapien
ggcagtggcatgaaagatgtgccct

SEQ ID NO: 204553 - DNA, 25 bp, Homo sapien
tcatggctcaagagcctccgtttgc

SEQ ID NO: 204554 - DNA, 25 bp, Homo sapien
tcaagagcctccgtttgcacaagta

SEQ ID NO: 204555 - DNA, 25 bp, Homo sapien
agagcctccgtttgcacaagtatgc

SEQ ID NO: 204556 - DNA, 25 bp, Homo sapien
gtttgcacaagtatgcagccctctt

SEQ ID NO: 204557 - DNA, 25 bp, Homo sapien
gcacaagtatgcagccctcttctca

SEQ ID NO: 204558 - DNA, 25 bp, Homo sapien
cctcttctcacagaatcagctttga

SEQ ID NO: 204559 - DNA, 25 bp, Homo sapien
ccctgccccgtgctgaatgaatgta

SEQ ID NO: 204560 - DNA, 25 bp, Homo sapien
ctgccccgtgctgaatgaatgtaca

SEQ ID NO: 204561 - DNA, 25 bp, Homo sapien
atgaatgtacagagccagacaaagc

SEQ ID NO: 204562 - DNA, 25 bp, Homo sapien
agacaaagctgtgaatggcctaggg

SEQ ID NO: 204563 - DNA, 25 bp, Homo sapien
ggctgagtcccacaccagctgtgaa

SEQ ID NO: 204564 - DNA, 25 bp, Homo sapien
gagtcccacaccagctgtgaattct

SEQ ID NO: 204565 - DNA, 25 bp, Homo sapien
aggatccacctaactggcctggcac

SEQ ID NO: 204566 - DNA, 25 bp, Homo sapien
tggcctggcacctggtgccacgtgc

SEQ ID NO: 204567 - DNA, 25 bp, Homo sapien
aggatatgcgccttcccacaggtgc

SEQ ID NO: 204568 - DNA, 25 bp, Homo sapien
aggtgccctgcctgagttgtgtgca

SEQ ID NO: 204569 - DNA, 25 bp, Homo sapien
ctgcctgagttgtgtgcatccaggg

SEQ ID NO: 204570 - DNA, 25 bp, Homo sapien
atgtaaagacccacccagcttggtt

SEQ ID NO: 204571 - DNA, 25 bp, Homo sapien
tttttctcactgacgtataaccatc

SEQ ID NO: 204572 - DNA, 25 bp, Homo sapien
ctcactgacgtataaccatcagctt

SEQ ID NO: 204573 - DNA, 25 bp, Homo sapien
acttccattttcaggctcagacttt

SEQ ID NO: 204574 - DNA, 25 bp, Homo sapien
tcaggctcagactttgaatttaagg

SEQ ID NO: 204575 - DNA, 25 bp, Homo sapien
aagagtgacatcttgcatttttgca

SEQ ID NO: 204576 - DNA, 25 bp, Homo sapien
gcaaatctttttaatgcctggttta

SEQ ID NO: 204577 - DNA, 25 bp, Homo sapien
taatgcctggtttaatagaagattc

SEQ ID NO: 204578 - DNA, 25 bp, Homo sapien
gaagattctcagatctacgtcagac

SEQ ID NO: 204579 - DNA, 25 bp, Homo sapien
tacgtcagactgttgtggttagcac

SEQ ID NO: 204580 - DNA, 25 bp, Homo sapien
tggttagcacaccatgtaacctctg

SEQ ID NO: 204581 - DNA, 25 bp, Homo sapien
tagaagcagttctggtctcaaaacc

SEQ ID NO: 204582 - DNA, 25 bp, Homo sapien
tggtctcaaaaccatcaggatcctg

SEQ ID NO: 204583 - DNA, 25 bp, Homo sapien
cctgccaccagggttcttttgaaat

SEQ ID NO: 204584 - DNA, 25 bp, Homo sapien
gttcttttgaaatagtaccacatgt

SEQ ID NO: 204585 - DNA, 25 bp, Homo sapien
tagtaccacatgtaaaagggaattt

SEQ ID NO: 204586 - DNA, 25 bp, Homo sapien
tggctttcacttcatctaatcactg

SEQ ID NO: 204587 - DNA, 25 bp, Homo sapien
actgaattgtcaggctttgattgat

SEQ ID NO: 204588 - DNA, 25 bp, Homo sapien
caggctttgattgataattgtagaa

SEQ ID NO: 204589 - DNA, 25 bp, Homo sapien
ataagtagccttctgttgtgggaat

SEQ ID NO: 204590 - DNA, 25 bp, Homo sapien
taagttataatcagtattcatctct

SEQ ID NO: 204591 - DNA, 25 bp, Homo sapien
ctaattgtgtcatttgtactgtttg

SEQ ID NO: 204592 - DNA, 25 bp, Homo sapien
gtggaacacacactactccaatcaa

SEQ ID NO: 204593 - DNA, 25 bp, Homo sapien
acactactccaatcaaagctgaagg

SEQ ID NO: 204594 - DNA, 25 bp, Homo sapien
ggagaagtccaacatgactaggaac

SEQ ID NO: 204595 - DNA, 25 bp, Homo sapien
gactaggaacatgcatgccacagtt

SEQ ID NO: 204596 - DNA, 25 bp, Homo sapien
aggaacatgcatgccacagttattc

SEQ ID NO: 204597 - DNA, 25 bp, Homo sapien
ccagaaccagcaacaggcttttatt

SEQ ID NO: 204598 - DNA, 25 bp, Homo sapien
tcatgtttctgattagttgggtttt

SEQ ID NO: 204599 - DNA, 25 bp, Homo sapien
tttcatgttgcatagatttcaaaac

SEQ ID NO: 204600 - DNA, 25 bp, Homo sapien
catactcacatattatatcatggtg

SEQ ID NO: 204601 - DNA, 25 bp, Homo sapien
ggtgattatgatggttaaagccttt

SEQ ID NO: 204602 - DNA, 25 bp, Homo sapien
ggttaaagcctttacactgaatgta

SEQ ID NO: 204603 - DNA, 25 bp, Homo sapien
gcaagagtattgctattcgactaat

SEQ ID NO: 204604 - DNA, 25 bp, Homo sapien
ttcgactaattggtgaagctcttgg

SEQ ID NO: 204605 - DNA, 25 bp, Homo sapien
ctttatctttctacactacaattat

SEQ ID NO: 204606 - DNA, 25 bp, Homo sapien
ctttctacactacaattatgctttt

SEQ ID NO: 204607 - DNA, 25 bp, Homo sapien
aagctaatactgaagactcgactga

SEQ ID NO: 204608 - DNA, 25 bp, Homo sapien
gaagactcgactgaaatattatgta

SEQ ID NO: 204609 - DNA, 25 bp, Homo sapien
aaatattatgtatctagcccatagt

SEQ ID NO: 204610 - DNA, 25 bp, Homo sapien
gtatctagcccatagtattgtactt

SEQ ID NO: 204611 - DNA, 25 bp, Homo sapien
tagcccatagtattgtacttaactt

SEQ ID NO: 204612 - DNA, 25 bp, Homo sapien
gtacttaacttttacaggtgagaag

SEQ ID NO: 204613 - DNA, 25 bp, Homo sapien
tgagaagagagttctgtgtttgcat

SEQ ID NO: 204614 - DNA, 25 bp, Homo sapien
tggagcaggcaaaaccagacgtctg

SEQ ID NO: 204615 - DNA, 25 bp, Homo sapien
ccagacgtctgggaataccgtgaac

SEQ ID NO: 204616 - DNA, 25 bp, Homo sapien
gacgtctgggaataccgtgaactta

SEQ ID NO: 204617 - DNA, 25 bp, Homo sapien
taccgtgaacttaaggagtctgatt

SEQ ID NO: 204618 - DNA, 25 bp, Homo sapien
aggagtctgattctccgacacaggc

SEQ ID NO: 204619 - DNA, 25 bp, Homo sapien
tgattctccgacacaggctggtgga

SEQ ID NO: 204620 - DNA, 25 bp, Homo sapien
tggtggaccacctaccccactgaga

SEQ ID NO: 204621 - DNA, 25 bp, Homo sapien
agcctgagtcagctgtctggactgc

SEQ ID NO: 204622 - DNA, 25 bp, Homo sapien
gagtcagctgtctggactgcaagga

SEQ ID NO: 204623 - DNA, 25 bp, Homo sapien
tcagctgtctggactgcaaggaggc

SEQ ID NO: 204624 - DNA, 25 bp, Homo sapien
tctggactgcaaggaggctgggcac

SEQ ID NO: 204625 - DNA, 25 bp, Homo sapien
tcttccctgtattatagcaagttct

SEQ ID NO: 204626 - DNA, 25 bp, Homo sapien
cttccctgtattatagcaagttctt

SEQ ID NO: 204627 - DNA, 25 bp, Homo sapien
ttccctgtattatagcaagttcttt

SEQ ID NO: 204628 - DNA, 25 bp, Homo sapien
tccctgtattatagcaagttcttta

SEQ ID NO: 204629 - DNA, 25 bp, Homo sapien
ccctgtattatagcaagttctttat

SEQ ID NO: 204630 - DNA, 25 bp, Homo sapien
cctgtattatagcaagttctttatt

SEQ ID NO: 204631 - DNA, 25 bp, Homo sapien
ctgtattatagcaagttctttatta

SEQ ID NO: 204632 - DNA, 25 bp, Homo sapien
tgtattatagcaagttctttattaa

SEQ ID NO: 204633 - DNA, 25 bp, Homo sapien
ttaaagatttttgaggccgggcaca

SEQ ID NO: 204634 - DNA, 25 bp, Homo sapien
gaagaagtagaacatcagtgccaaa

SEQ ID NO: 204635 - DNA, 25 bp, Homo sapien
gtgccaaaagactattcagcaactg

SEQ ID NO: 204636 - DNA, 25 bp, Homo sapien
gagccactccagagctatttctaag

SEQ ID NO: 204637 - DNA, 25 bp, Homo sapien
ctaagactttctgtggtgtttcata

SEQ ID NO: 204638 - DNA, 25 bp, Homo sapien
tctgtggtgtttcatactctactca

SEQ ID NO: 204639 - DNA, 25 bp, Homo sapien
gagttcacactcatatttcatattt

SEQ ID NO: 204640 - DNA, 25 bp, Homo sapien
ttgggtgttgggtgccatgttactt

SEQ ID NO: 204641 - DNA, 25 bp, Homo sapien
gtgccatgttacttttggtgcctta

SEQ ID NO: 204642 - DNA, 25 bp, Homo sapien
gtgccttaatacacctacttggatt

SEQ ID NO: 204643 - DNA, 25 bp, Homo sapien
ttacaaaatccccacctggcttgtg

SEQ ID NO: 204644 - DNA, 25 bp, Homo sapien
tctcctgcctatcgtatagagctgc

SEQ ID NO: 204645 - DNA, 25 bp, Homo sapien
gaatgcattgctgtatatactgtaa

SEQ ID NO: 204646 - DNA, 25 bp, Homo sapien
actgtaagactgaaagctttgatga

SEQ ID NO: 204647 - DNA, 25 bp, Homo sapien
gaaaacctaaaacaagcctcttgct

SEQ ID NO: 204648 - DNA, 25 bp, Homo sapien
aaacaagcctcttgctcagtaaaga

SEQ ID NO: 204649 - DNA, 25 bp, Homo sapien
taaagagacaaaagccacacaggag

SEQ ID NO: 204650 - DNA, 25 bp, Homo sapien
aagccacacaggagtaggtgccact

SEQ ID NO: 204651 - DNA, 25 bp, Homo sapien
gagtaggtgccactgacctctattg

SEQ ID NO: 204652 - DNA, 25 bp, Homo sapien
gacctctattgttggagactttgtt

SEQ ID NO: 204653 - DNA, 25 bp, Homo sapien
ttgttccactttttgtttcagccag

SEQ ID NO: 204654 - DNA, 25 bp, Homo sapien
tccactttttgtttcagccagtaaa

SEQ ID NO: 204655 - DNA, 25 bp, Homo sapien
atattgttttgcttcatctgtacac

SEQ ID NO: 204656 - DNA, 25 bp, Homo sapien
tactcctgtggaatcttctgaccca

SEQ ID NO: 204657 - DNA, 25 bp, Homo sapien
tcctgtggaatcttctgacccaaag

SEQ ID NO: 204658 - DNA, 25 bp, Homo sapien
tggaatcttctgacccaaaggctgg

SEQ ID NO: 204659 - DNA, 25 bp, Homo sapien
cttctgacccaaaggctgggcacga

SEQ ID NO: 204660 - DNA, 25 bp, Homo sapien
tgggcacgacgctggtcctgacctt

SEQ ID NO: 204661 - DNA, 25 bp, Homo sapien
acgacgctggtcctgaccttgtgcc

SEQ ID NO: 204662 - DNA, 25 bp, Homo sapien
tgttctcccactcgtggcactgtca

SEQ ID NO: 204663 - DNA, 25 bp, Homo sapien
tccctaccggcgagagtccagagtg

SEQ ID NO: 204664 - DNA, 25 bp, Homo sapien
ccggcgagagtccagagtgggtaca

SEQ ID NO: 204665 - DNA, 25 bp, Homo sapien
atggctgaaggagacgccggcatcc

SEQ ID NO: 204666 - DNA, 25 bp, Homo sapien
tggctgaaggagacgccggcatcct

SEQ ID NO: 204667 - DNA, 25 bp, Homo sapien
caatctgtgaccaccacaagatgtg

SEQ ID NO: 204668 - DNA, 25 bp, Homo sapien
gtgaccaccacaagatgtgccctga

SEQ ID NO: 204669 - DNA, 25 bp, Homo sapien
accaccacaagatgtgccctgatgg

SEQ ID NO: 204670 - DNA, 25 bp, Homo sapien
tttgttccttgagtccacgcagaat

SEQ ID NO: 204671 - DNA, 25 bp, Homo sapien
tgttccttgagtccacgcagaattc

SEQ ID NO: 204672 - DNA, 25 bp, Homo sapien
ttgagtccacgcagaattccattct

SEQ ID NO: 204673 - DNA, 25 bp, Homo sapien
acgcagaattccattctctggtcag

SEQ ID NO: 204674 - DNA, 25 bp, Homo sapien
ctaaagtattgcctctattctgtaa

SEQ ID NO: 204675 - DNA, 25 bp, Homo sapien
gtattgcctctattctgtaaagttc

SEQ ID NO: 204676 - DNA, 25 bp, Homo sapien
gcctctattctgtaaagttctgtac

SEQ ID NO: 204677 - DNA, 25 bp, Homo sapien
ctgtaaagttctgtacatagttccc

SEQ ID NO: 204678 - DNA, 25 bp, Homo sapien
ctactcctgtggaatcttctgaccc

SEQ ID NO: 204679 - DNA, 25 bp, Homo sapien
tactcctgtggaatcttctgaccca

SEQ ID NO: 204680 - DNA, 25 bp, Homo sapien
actcctgtggaatcttctgacccaa

SEQ ID NO: 204681 - DNA, 25 bp, Homo sapien
ctcctgtggaatcttctgacccaaa

SEQ ID NO: 204682 - DNA, 25 bp, Homo sapien
tcctgtggaatcttctgacccaaag

SEQ ID NO: 204683 - DNA, 25 bp, Homo sapien
cctgtggaatcttctgacccaaagg

SEQ ID NO: 204684 - DNA, 25 bp, Homo sapien
ctgtggaatcttctgacccaaaggc

SEQ ID NO: 204685 - DNA, 25 bp, Homo sapien
tgtggaatcttctgacccaaaggct

SEQ ID NO: 204686 - DNA, 25 bp, Homo sapien
gtggaatcttctgacccaaaggctg

SEQ ID NO: 204687 - DNA, 25 bp, Homo sapien
gctgtcttcaggtaggcagaggcca

SEQ ID NO: 204688 - DNA, 25 bp, Homo sapien
ccctgagcatggctgggaccccaga

SEQ ID NO: 204689 - DNA, 25 bp, Homo sapien
agggcaagctgctccaaagctggct

SEQ ID NO: 204690 - DNA, 25 bp, Homo sapien
gcaagctgctccaaagctggctttg

SEQ ID NO: 204691 - DNA, 25 bp, Homo sapien
tggctttgctttccagaccaaggtt

SEQ ID NO: 204692 - DNA, 25 bp, Homo sapien
ttgctttccagaccaaggttgggat

SEQ ID NO: 204693 - DNA, 25 bp, Homo sapien
tccagaccaaggttgggatccaaat

SEQ ID NO: 204694 - DNA, 25 bp, Homo sapien
ttgggatccaaatgcgaatctgaga

SEQ ID NO: 204695 - DNA, 25 bp, Homo sapien
gaatctgagaaaactgctcccagga

SEQ ID NO: 204696 - DNA, 25 bp, Homo sapien
gagaaaactgctcccaggaatcaaa

SEQ ID NO: 204697 - DNA, 25 bp, Homo sapien
actgctcccaggaatcaaatagtgg

SEQ ID NO: 204698 - DNA, 25 bp, Homo sapien
gcctcatggagctgttgtatagatc

SEQ ID NO: 204699 - DNA, 25 bp, Homo sapien
tgtatagatcccagatccatcccat

SEQ ID NO: 204700 - DNA, 25 bp, Homo sapien
agatccatcccatgatttgttcctg

SEQ ID NO: 204701 - DNA, 25 bp, Homo sapien
tgttcctgtctgaggcatagaggca

SEQ ID NO: 204702 - DNA, 25 bp, Homo sapien
gcaggcaagccgtggattttgcaca

SEQ ID NO: 204703 - DNA, 25 bp, Homo sapien
ggattttgcacatggtgactttccc

SEQ ID NO: 204704 - DNA, 25 bp, Homo sapien
gtgactttcccactgtgccatgata

SEQ ID NO: 204705 - DNA, 25 bp, Homo sapien
gtgccatgatacagtctgcatctta

SEQ ID NO: 204706 - DNA, 25 bp, Homo sapien
tatagcagtgcctttgtctcagggc

SEQ ID NO: 204707 - DNA, 25 bp, Homo sapien
ggcagtctagaccttttgggcagaa

SEQ ID NO: 204708 - DNA, 25 bp, Homo sapien
attgtattggctgttcatgtatgta

SEQ ID NO: 204709 - DNA, 25 bp, Homo sapien
acgaccctggttgccaatgggcgcg

SEQ ID NO: 204710 - DNA, 25 bp, Homo sapien
atgggcgcgggagacattgtataca

SEQ ID NO: 204711 - DNA, 25 bp, Homo sapien
gacattgtatacacatcatgctatt

SEQ ID NO: 204712 - DNA, 25 bp, Homo sapien
aaccatattggtatataaccggaat

SEQ ID NO: 204713 - DNA, 25 bp, Homo sapien
gcctcctttttaaatatatgccgtg

SEQ ID NO: 204714 - DNA, 25 bp, Homo sapien
gtacttataggaacatctctttgaa

SEQ ID NO: 204715 - DNA, 25 bp, Homo sapien
ggaacatctctttgaattgtatttc

SEQ ID NO: 204716 - DNA, 25 bp, Homo sapien
gagagagactcttttagccaggcaa

SEQ ID NO: 204717 - DNA, 25 bp, Homo sapien
gactcttttagccaggcaaagtctt

SEQ ID NO: 204718 - DNA, 25 bp, Homo sapien
aaagtcttttttggctgtggctgga

SEQ ID NO: 204719 - DNA, 25 bp, Homo sapien
atcatttattacttgggagtcccat

SEQ ID NO: 204720 - DNA, 25 bp, Homo sapien
ggttagatacacagcatgttgattt

SEQ ID NO: 204721 - DNA, 25 bp, Homo sapien
cacagcatgttgatttggtcactaa

SEQ ID NO: 204722 - DNA, 25 bp, Homo sapien
ggactaacaagcttcacttttatga

SEQ ID NO: 204723 - DNA, 25 bp, Homo sapien
gaacaactattttgagaacatgcac

SEQ ID NO: 204724 - DNA, 25 bp, Homo sapien
gagtaatggtacttttattctttct

SEQ ID NO: 204725 - DNA, 25 bp, Homo sapien
tattctttcttgatagaaacctgct

SEQ ID NO: 204726 - DNA, 25 bp, Homo sapien
agaaacctgcttacatttaaccaag

SEQ ID NO: 204727 - DNA, 25 bp, Homo sapien
ttaaccaagcttctattatgccttt

SEQ ID NO: 204728 - DNA, 25 bp, Homo sapien
tttctaacacagactttcttcactg

SEQ ID NO: 204729 - DNA, 25 bp, Homo sapien
attttacgtagtgctgacaggaccc

SEQ ID NO: 204730 - DNA, 25 bp, Homo sapien
acaggacccactctttcattgaaag

SEQ ID NO: 204731 - DNA, 25 bp, Homo sapien
acattttgctaattatcctgtatat

SEQ ID NO: 204732 - DNA, 25 bp, Homo sapien
attcatgtttcaactcctacaacca

SEQ ID NO: 204733 - DNA, 25 bp, Homo sapien
tgtttcaactcctacaaccaaatga

SEQ ID NO: 204734 - DNA, 25 bp, Homo sapien
gatgagcagctttatcccatttggg

SEQ ID NO: 204735 - DNA, 25 bp, Homo sapien
gtaagtgatttacatgtgtcaattt

SEQ ID NO: 204736 - DNA, 25 bp, Homo sapien
tacatgtgtcaattttagtaatact

SEQ ID NO: 204737 - DNA, 25 bp, Homo sapien
tgtaacttcatccttcatatatgct

SEQ ID NO: 204738 - DNA, 25 bp, Homo sapien
atccttcatatatgcttgctataca

SEQ ID NO: 204739 - DNA, 25 bp, Homo sapien
tatgcttgctatacaggtatgttca

SEQ ID NO: 204740 - DNA, 25 bp, Homo sapien
acaggtatgttcatctttgtgtaca

SEQ ID NO: 204741 - DNA, 25 bp, Homo sapien
gtatgttcatctttgtgtacagagg

SEQ ID NO: 204742 - DNA, 25 bp, Homo sapien
taataactgtgctcacattgaaaaa

SEQ ID NO: 204743 - DNA, 25 bp, Homo sapien
aataactgtgctcacattgaaaaaa

SEQ ID NO: 204744 - DNA, 25 bp, Homo sapien
aactgtgctcacattgaaaaaaatg

SEQ ID NO: 204745 - DNA, 25 bp, Homo sapien
attgaaaaaaatggcccaggcgcgg

SEQ ID NO: 204746 - DNA, 25 bp, Homo sapien
aaaaaatggcccaggcgcggcggca

SEQ ID NO: 204747 - DNA, 25 bp, Homo sapien
aaaaatggcccaggcgcggcggcac

SEQ ID NO: 204748 - DNA, 25 bp, Homo sapien
aaaatggcccaggcgcggcggcaca

SEQ ID NO: 204749 - DNA, 25 bp, Homo sapien
cccaggcgcggcggcacatgcttgt

SEQ ID NO: 204750 - DNA, 25 bp, Homo sapien
cacatgcttgtaatatcagcacgtt

SEQ ID NO: 204751 - DNA, 25 bp, Homo sapien
acatgcttgtaatatcagcacgttg

SEQ ID NO: 204752 - DNA, 25 bp, Homo sapien
gcttgtaatatcagcacgttgggaa

SEQ ID NO: 204753 - DNA, 25 bp, Homo sapien
ggtccacatttgaagttcaaaacat

SEQ ID NO: 204754 - DNA, 25 bp, Homo sapien
gtccacatttgaagttcaaaacatg

SEQ ID NO: 204755 - DNA, 25 bp, Homo sapien
gttcaaaacatgcatcaagaagcag

SEQ ID NO: 204756 - DNA, 25 bp, Homo sapien
aaacatgcatcaagaagcagtgggc

SEQ ID NO: 204757 - DNA, 25 bp, Homo sapien
aacatgcatcaagaagcagtgggct

SEQ ID NO: 204758 - DNA, 25 bp, Homo sapien
acatgcatcaagaagcagtgggctc

SEQ ID NO: 204759 - DNA, 25 bp, Homo sapien
catgcatcaagaagcagtgggctct

SEQ ID NO: 204760 - DNA, 25 bp, Homo sapien
atgcatcaagaagcagtgggctctc

SEQ ID NO: 204761 - DNA, 25 bp, Homo sapien
tgcatcaagaagcagtgggctctcc

SEQ ID NO: 204762 - DNA, 25 bp, Homo sapien
gcatcaagaagcagtgggctctcca

SEQ ID NO: 204763 - DNA, 25 bp, Homo sapien
catcaagaagcagtgggctctccag

SEQ ID NO: 204764 - DNA, 25 bp, Homo sapien
ataaccaaattctgtcactcaagac

SEQ ID NO: 204765 - DNA, 25 bp, Homo sapien
gtcctttgcctctattaagcagagg

SEQ ID NO: 204766 - DNA, 25 bp, Homo sapien
agctttggagctgtgcttactggct

SEQ ID NO: 204767 - DNA, 25 bp, Homo sapien
tactggcttgtctttgtctggtaga

SEQ ID NO: 204768 - DNA, 25 bp, Homo sapien
gtagaacaaaccttgacctccagac

SEQ ID NO: 204769 - DNA, 25 bp, Homo sapien
aaaccttgacctccagacagagtcc

SEQ ID NO: 204770 - DNA, 25 bp, Homo sapien
acagagtcccttctcacttatagag

SEQ ID NO: 204771 - DNA, 25 bp, Homo sapien
acttatagagctctccaggactgga

SEQ ID NO: 204772 - DNA, 25 bp, Homo sapien
ctccaggactggaaaaagtgctgct

SEQ ID NO: 204773 - DNA, 25 bp, Homo sapien
tgctattttaacttgctcttgcttg

SEQ ID NO: 204774 - DNA, 25 bp, Homo sapien
gctcttgcttgtaaatcctaatctt

SEQ ID NO: 204775 - DNA, 25 bp, Homo sapien
aaacacctggcccatgcctgttcag

SEQ ID NO: 204776 - DNA, 25 bp, Homo sapien
atgcctgttcagtccgtcatggcgt

SEQ ID NO: 204777 - DNA, 25 bp, Homo sapien
tcagtccgtcatggcgtttggttta

SEQ ID NO: 204778 - DNA, 25 bp, Homo sapien
gcgtttggtttatggtggccgatac

SEQ ID NO: 204779 - DNA, 25 bp, Homo sapien
tttggtttatggtggccgatactaa

SEQ ID NO: 204780 - DNA, 25 bp, Homo sapien
gccgatactaagagccactgaggtc

SEQ ID NO: 204781 - DNA, 25 bp, Homo sapien
taagagccactgaggtctgggttgt

SEQ ID NO: 204782 - DNA, 25 bp, Homo sapien
ggttgtgtgagggttagctaccacc

SEQ ID NO: 204783 - DNA, 25 bp, Homo sapien
gtgagggttagctaccaccctataa

SEQ ID NO: 204784 - DNA, 25 bp, Homo sapien
tataacctccctaccaggtaataag

SEQ ID NO: 204785 - DNA, 25 bp, Homo sapien
aggtaataaggagaccaagtctttg

SEQ ID NO: 204786 - DNA, 25 bp, Homo sapien
gcttttgcacctttgactgatgcca

SEQ ID NO: 204787 - DNA, 25 bp, Homo sapien
tgcacctttgactgatgccaagact

SEQ ID NO: 204788 - DNA, 25 bp, Homo sapien
gactgatgccaagactaggagccat

SEQ ID NO: 204789 - DNA, 25 bp, Homo sapien
tgccaagactaggagccatgctgat

SEQ ID NO: 204790 - DNA, 25 bp, Homo sapien
agactaggagccatgctgatgatgt

SEQ ID NO: 204791 - DNA, 25 bp, Homo sapien
atgctgatgatgtgggtctcgttct

SEQ ID NO: 204792 - DNA, 25 bp, Homo sapien
atgatgtgggtctcgttctttcttc

SEQ ID NO: 204793 - DNA, 25 bp, Homo sapien
tgggtctcgttctttcttcattgca

SEQ ID NO: 204794 - DNA, 25 bp, Homo sapien
tcgttctttcttcattgcaggctag

SEQ ID NO: 204795 - DNA, 25 bp, Homo sapien
gttctttcttcattgcaggctagta

SEQ ID NO: 204796 - DNA, 25 bp, Homo sapien
cttcattgcaggctagtatataccg

SEQ ID NO: 204797 - DNA, 25 bp, Homo sapien
tcacctcatgatctgtgtcagttgg

SEQ ID NO: 204798 - DNA, 25 bp, Homo sapien
acctcatgatctgtgtcagttggga

SEQ ID NO: 204799 - DNA, 25 bp, Homo sapien
tcatgatctgtgtcagttgggaagt

SEQ ID NO: 204800 - DNA, 25 bp, Homo sapien
gatctgtgtcagttgggaagtacaa

SEQ ID NO: 204801 - DNA, 25 bp, Homo sapien
gtgtcagttgggaagtacaaatcat

SEQ ID NO: 204802 - DNA, 25 bp, Homo sapien
gggaagtacaaatcattattggaat

SEQ ID NO: 204803 - DNA, 25 bp, Homo sapien
tggagatactttttgttgagggatc

SEQ ID NO: 204804 - DNA, 25 bp, Homo sapien
atactttttgttgagggatcttcct

SEQ ID NO: 204805 - DNA, 25 bp, Homo sapien
tactttttgttgagggatcttcctt

SEQ ID NO: 204806 - DNA, 25 bp, Homo sapien
tggtgcattttttgactacatggca

SEQ ID NO: 204807 - DNA, 25 bp, Homo sapien
gtgcattttttgactacatggcagt

SEQ ID NO: 204808 - DNA, 25 bp, Homo sapien
gacttttgatattatttgatactgt

SEQ ID NO: 204809 - DNA, 25 bp, Homo sapien
atcaagatgaaagacctacaggaca

SEQ ID NO: 204810 - DNA, 25 bp, Homo sapien
ttcagtgttcacatcagtggctttg

SEQ ID NO: 204811 - DNA, 25 bp, Homo sapien
agtgttcacatcagtggctttgtat

SEQ ID NO: 204812 - DNA, 25 bp, Homo sapien
gtatgcaaatatgctgtgttggacc

SEQ ID NO: 204813 - DNA, 25 bp, Homo sapien
atatgctgtgttggacctggacgct

SEQ ID NO: 204814 - DNA, 25 bp, Homo sapien
gctgtgttggacctggacgctataa

SEQ ID NO: 204815 - DNA, 25 bp, Homo sapien
tggacctggacgctataacttattg

SEQ ID NO: 204816 - DNA, 25 bp, Homo sapien
ggacgctataacttattgtaaagac

SEQ ID NO: 204817 - DNA, 25 bp, Homo sapien
aagaccttggaaatgtggacataag

SEQ ID NO: 204818 - DNA, 25 bp, Homo sapien
atgtggacataagctctttctttcc

SEQ ID NO: 204819 - DNA, 25 bp, Homo sapien
ggcctgtgtggatatggcaccaatt

SEQ ID NO: 204820 - DNA, 25 bp, Homo sapien
gcctgtgtggatatggcaccaattc

SEQ ID NO: 204821 - DNA, 25 bp, Homo sapien
cctgtgtggatatggcaccaattct

SEQ ID NO: 204822 - DNA, 25 bp, Homo sapien
ctgtgtggatatggcaccaattcta

SEQ ID NO: 204823 - DNA, 25 bp, Homo sapien
gtgtggatatggcaccaattctacc

SEQ ID NO: 204824 - DNA, 25 bp, Homo sapien
tgtggatatggcaccaattctaccc

SEQ ID NO: 204825 - DNA, 25 bp, Homo sapien
gtggatatggcaccaattctaccct

SEQ ID NO: 204826 - DNA, 25 bp, Homo sapien
tggatatggcaccaattctaccctg

SEQ ID NO: 204827 - DNA, 25 bp, Homo sapien
ggatatggcaccaattctaccctgc

SEQ ID NO: 204828 - DNA, 25 bp, Homo sapien
gatatggcaccaattctaccctgct

SEQ ID NO: 204829 - DNA, 25 bp, Homo sapien
atatggcaccaattctaccctgctc

SEQ ID NO: 204830 - DNA, 25 bp, Homo sapien
tgaagatgaccatcagccagcaaga

SEQ ID NO: 204831 - DNA, 25 bp, Homo sapien
cagcaagagtttggccgcactgggc

SEQ ID NO: 204832 - DNA, 25 bp, Homo sapien
actgggcttcctgacctaagcagta

SEQ ID NO: 204833 - DNA, 25 bp, Homo sapien
tcctgacctaagcagtatgactgag

SEQ ID NO: 204834 - DNA, 25 bp, Homo sapien
gagcagattgcttatgccatgcaga

SEQ ID NO: 204835 - DNA, 25 bp, Homo sapien
atgccatgcagatgtccctgcaggg

SEQ ID NO: 204836 - DNA, 25 bp, Homo sapien
tggccaggcggaatcagcagacatt

SEQ ID NO: 204837 - DNA, 25 bp, Homo sapien
gcagacattgatgccagctcagcta

SEQ ID NO: 204838 - DNA, 25 bp, Homo sapien
gatgccagctcagctatggacacat

SEQ ID NO: 204839 - DNA, 25 bp, Homo sapien
agactcagacgatgccctgctgaag

SEQ ID NO: 204840 - DNA, 25 bp, Homo sapien
atgccctgctgaagatgaccatcag

SEQ ID NO: 204841 - DNA, 25 bp, Homo sapien
aaccaaaaccaaagtcagattcaca

SEQ ID NO: 204842 - DNA, 25 bp, Homo sapien
agtcagattcacacttgggaaatga

SEQ ID NO: 204843 - DNA, 25 bp, Homo sapien
acataagtcaagaccaaccacctgg

SEQ ID NO: 204844 - DNA, 25 bp, Homo sapien
caaccacctggtgagtcagagcatt

SEQ ID NO: 204845 - DNA, 25 bp, Homo sapien
cacctggtgagtcagagcattataa

SEQ ID NO: 204846 - DNA, 25 bp, Homo sapien
aacattaatcagtatgctggccaga

SEQ ID NO: 204847 - DNA, 25 bp, Homo sapien
attaatcagtatgctggccagaatg

SEQ ID NO: 204848 - DNA, 25 bp, Homo sapien
ggccagaatgcttaaaatcctaact

SEQ ID NO: 204849 - DNA, 25 bp, Homo sapien
aatcctaactttccttaatgcttca

SEQ ID NO: 204850 - DNA, 25 bp, Homo sapien
agccaaattaattgggtggattttg

SEQ ID NO: 204851 - DNA, 25 bp, Homo sapien
tttatgggtctttatgaggctttaa

SEQ ID NO: 204852 - DNA, 25 bp, Homo sapien
gaactaagagtgagttactcagcac

SEQ ID NO: 204853 - DNA, 25 bp, Homo sapien
gttactcagcactctcaagaattat

SEQ ID NO: 204854 - DNA, 25 bp, Homo sapien
agcactctcaagaattatgcagatt

SEQ ID NO: 204855 - DNA, 25 bp, Homo sapien
tctgcatttttcttatgccgtgtgc

SEQ ID NO: 204856 - DNA, 25 bp, Homo sapien
catttttcttatgccgtgtgcctaa

SEQ ID NO: 204857 - DNA, 25 bp, Homo sapien
tgccgtgtgcctaaaaacctacttg

SEQ ID NO: 204858 - DNA, 25 bp, Homo sapien
gtgtgcctaaaaacctacttgatat

SEQ ID NO: 204859 - DNA, 25 bp, Homo sapien
cctacttgatatttattgtggtttc

SEQ ID NO: 204860 - DNA, 25 bp, Homo sapien
gtggtttcaagattattcatagtat

SEQ ID NO: 204861 - DNA, 25 bp, Homo sapien
tatacaatatacttgcaatgcattt

SEQ ID NO: 204862 - DNA, 25 bp, Homo sapien
aacttgaagcaagatggcattttaa

SEQ ID NO: 204863 - DNA, 25 bp, Homo sapien
gcactctctcttcctatattgtgaa

SEQ ID NO: 204864 - DNA, 25 bp, Homo sapien
gctttggacaagaccgatgacagta

SEQ ID NO: 204865 - DNA, 25 bp, Homo sapien
atgacagtaatcctcgggaagccat

SEQ ID NO: 204866 - DNA, 25 bp, Homo sapien
gggaagccattttgcgtcatgccaa

SEQ ID NO: 204867 - DNA, 25 bp, Homo sapien
attttgcgtcatgccaaagcagcag

SEQ ID NO: 204868 - DNA, 25 bp, Homo sapien
cagcagaagacagcccatattgggt

SEQ ID NO: 204869 - DNA, 25 bp, Homo sapien
gcccatattgggtttctccagcata

SEQ ID NO: 204870 - DNA, 25 bp, Homo sapien
ggtttctccagcatattccaagact

SEQ ID NO: 204871 - DNA, 25 bp, Homo sapien
gcccaaaaccatgtttgcccaagtt

SEQ ID NO: 204872 - DNA, 25 bp, Homo sapien
catgtttgcccaagttgaatctgat

SEQ ID NO: 204873 - DNA, 25 bp, Homo sapien
gaatctcatttgagagctgtttgca

SEQ ID NO: 204874 - DNA, 25 bp, Homo sapien
cagtgaagtgcagacatttgatttc

SEQ ID NO: 204875 - DNA, 25 bp, Homo sapien
gtgaagtgcagacatttgatttctt

SEQ ID NO: 204876 - DNA, 25 bp, Homo sapien
tgaagtgcagacatttgatttcttt

SEQ ID NO: 204877 - DNA, 25 bp, Homo sapien
ccctgtgttagaaatggctatagaa

SEQ ID NO: 204878 - DNA, 25 bp, Homo sapien
aatggctatagaaaaatttgtcata

SEQ ID NO: 204879 - DNA, 25 bp, Homo sapien
ttgtcataataatttcatttgcatg

SEQ ID NO: 204880 - DNA, 25 bp, Homo sapien
tttcatttgcatgaaatcctgaggg

SEQ ID NO: 204881 - DNA, 25 bp, Homo sapien
gcattaaggaaactaaaagcaccac

SEQ ID NO: 204882 - DNA, 25 bp, Homo sapien
cattaaggaaactaaaagcaccact

SEQ ID NO: 204883 - DNA, 25 bp, Homo sapien
ttatgtcactgagttgtcagaaatt

SEQ ID NO: 204884 - DNA, 25 bp, Homo sapien
atgtcactgagttgtcagaaattat

SEQ ID NO: 204885 - DNA, 25 bp, Homo sapien
attcttggtgctgccacctagagga

SEQ ID NO: 204886 - DNA, 25 bp, Homo sapien
tcttggtgctgccacctagaggaag

SEQ ID NO: 204887 - DNA, 25 bp, Homo sapien
cttggtgctgccacctagaggaagt

SEQ ID NO: 204888 - DNA, 25 bp, Homo sapien
ttggtgctgccacctagaggaagta

SEQ ID NO: 204889 - DNA, 25 bp, Homo sapien
tacagcaatcatttgaaactccaag

SEQ ID NO: 204890 - DNA, 25 bp, Homo sapien
cagcaatcatttgaaactccaaggg

SEQ ID NO: 204891 - DNA, 25 bp, Homo sapien
gcaatcatttgaaactccaagggcc

SEQ ID NO: 204892 - DNA, 25 bp, Homo sapien
caatcatttgaaactccaagggcca

SEQ ID NO: 204893 - DNA, 25 bp, Homo sapien
aatcatttgaaactccaagggccaa

SEQ ID NO: 204894 - DNA, 25 bp, Homo sapien
ctggagagacagcacaatgggctct

SEQ ID NO: 204895 - DNA, 25 bp, Homo sapien
tggagagacagcacaatgggctcta

SEQ ID NO: 204896 - DNA, 25 bp, Homo sapien
aaccaaaaccaaagtcagattcaca

SEQ ID NO: 204897 - DNA, 25 bp, Homo sapien
aaaaccaaagtcagattcacacttg

SEQ ID NO: 204898 - DNA, 25 bp, Homo sapien
aagtcagattcacacttgggaaatg

SEQ ID NO: 204899 - DNA, 25 bp, Homo sapien
agtcagattcacacttgggaaatga

SEQ ID NO: 204900 - DNA, 25 bp, Homo sapien
gtcagattcacacttgggaaatgaa

SEQ ID NO: 204901 - DNA, 25 bp, Homo sapien
agattcacacttgggaaatgaactc

SEQ ID NO: 204902 - DNA, 25 bp, Homo sapien
attcacacttgggaaatgaactcaa

SEQ ID NO: 204903 - DNA, 25 bp, Homo sapien
cacacttgggaaatgaactcaagtt

SEQ ID NO: 204904 - DNA, 25 bp, Homo sapien
gggaaatgaactcaagttaaacata

SEQ ID NO: 204905 - DNA, 25 bp, Homo sapien
acataagtcaagaccaaccacctgg

SEQ ID NO: 204906 - DNA, 25 bp, Homo sapien
cataagtcaagaccaaccacctggt

SEQ ID NO: 204907 - DNA, 25 bp, Homo sapien
gagagtgaggtcacttccacttcaa

SEQ ID NO: 204908 - DNA, 25 bp, Homo sapien
gagtgaggtcacttccacttcaaac

SEQ ID NO: 204909 - DNA, 25 bp, Homo sapien
agtgaggtcacttccacttcaaacc

SEQ ID NO: 204910 - DNA, 25 bp, Homo sapien
ttccacttcaaaccttcagtgaggg

SEQ ID NO: 204911 - DNA, 25 bp, Homo sapien
gatggagagaatgctgaatcttttt

SEQ ID NO: 204912 - DNA, 25 bp, Homo sapien
ctgaatcttttttttgacgggatgg

SEQ ID NO: 204913 - DNA, 25 bp, Homo sapien
taaccttttggttgtttgtgcaata

SEQ ID NO: 204914 - DNA, 25 bp, Homo sapien
tgcatctccccagagtattttgtag

SEQ ID NO: 204915 - DNA, 25 bp, Homo sapien
cagagtattttgtagctgggaaaag

SEQ ID NO: 204916 - DNA, 25 bp, Homo sapien
gaactttgtcctgaaccttttacag

SEQ ID NO: 204917 - DNA, 25 bp, Homo sapien
ctgaaccttttacagacttgccgtt

SEQ ID NO: 204918 - DNA, 25 bp, Homo sapien
cttccacttcaaaccttcagtgagg

SEQ ID NO: 204919 - DNA, 25 bp, Homo sapien
ttccacttcaaaccttcagtgaggg

SEQ ID NO: 204920 - DNA, 25 bp, Homo sapien
ctgaatcttttttttgacgggatgg

SEQ ID NO: 204921 - DNA, 25 bp, Homo sapien
tgacgggatggggtttttctctttg

SEQ ID NO: 204922 - DNA, 25 bp, Homo sapien
taaccttttggttgtttgtgcaata

SEQ ID NO: 204923 - DNA, 25 bp, Homo sapien
aaccttttggttgtttgtgcaatat

SEQ ID NO: 204924 - DNA, 25 bp, Homo sapien
accttttggttgtttgtgcaatatt

SEQ ID NO: 204925 - DNA, 25 bp, Homo sapien
ccttttggttgtttgtgcaatatta

SEQ ID NO: 204926 - DNA, 25 bp, Homo sapien
cttttggttgtttgtgcaatattat

SEQ ID NO: 204927 - DNA, 25 bp, Homo sapien
ccagagtattttgtagctgggaaaa

SEQ ID NO: 204928 - DNA, 25 bp, Homo sapien
ctgaaccttttacagacttgccgtt

SEQ ID NO: 204929 - DNA, 25 bp, Homo sapien
tttttgtaatgttggcatacttggg

SEQ ID NO: 204930 - DNA, 25 bp, Homo sapien
cccagcaggccttttgttggttgca

SEQ ID NO: 204931 - DNA, 25 bp, Homo sapien
ccagcaggccttttgttggttgcac

SEQ ID NO: 204932 - DNA, 25 bp, Homo sapien
cagcaggccttttgttggttgcact

SEQ ID NO: 204933 - DNA, 25 bp, Homo sapien
agcaggccttttgttggttgcacta

SEQ ID NO: 204934 - DNA, 25 bp, Homo sapien
gcaggccttttgttggttgcactaa

SEQ ID NO: 204935 - DNA, 25 bp, Homo sapien
caggccttttgttggttgcactaac

SEQ ID NO: 204936 - DNA, 25 bp, Homo sapien
aggccttttgttggttgcactaact

SEQ ID NO: 204937 - DNA, 25 bp, Homo sapien
ttggttgcactaactgcaaggttgc

SEQ ID NO: 204938 - DNA, 25 bp, Homo sapien
ggttgcactaactgcaaggttgctg

SEQ ID NO: 204939 - DNA, 25 bp, Homo sapien
ttgcactaactgcaaggttgctggg

SEQ ID NO: 204940 - DNA, 25 bp, Homo sapien
catggcgaaacacctgtctctacta

SEQ ID NO: 204941 - DNA, 25 bp, Homo sapien
atggcgaaacacctgtctctactaa

SEQ ID NO: 204942 - DNA, 25 bp, Homo sapien
tgggaggccgacccagatgggtgga

SEQ ID NO: 204943 - DNA, 25 bp, Homo sapien
aggccgacccagatgggtggatcac

SEQ ID NO: 204944 - DNA, 25 bp, Homo sapien
accccatctctggtagaaatataaa

SEQ ID NO: 204945 - DNA, 25 bp, Homo sapien
ccccatctctggtagaaatataaaa

SEQ ID NO: 204946 - DNA, 25 bp, Homo sapien
cccatctctggtagaaatataaaaa

SEQ ID NO: 204947 - DNA, 25 bp, Homo sapien
ccatctctggtagaaatataaaaaa

SEQ ID NO: 204948 - DNA, 25 bp, Homo sapien
catctctggtagaaatataaaaaat

SEQ ID NO: 204949 - DNA, 25 bp, Homo sapien
gttctacgtttctaccatatgtgat

SEQ ID NO: 204950 - DNA, 25 bp, Homo sapien
gtttctaccatatgtgatcagttta

SEQ ID NO: 204951 - DNA, 25 bp, Homo sapien
ttacttttagaattggtcctatgaa

SEQ ID NO: 204952 - DNA, 25 bp, Homo sapien
gaaagtgagtcatgcactagacagt

SEQ ID NO: 204953 - DNA, 25 bp, Homo sapien
agtcatgcactagacagtgggccta

SEQ ID NO: 204954 - DNA, 25 bp, Homo sapien
tagacagtgggcctagctcatcagt

SEQ ID NO: 204955 - DNA, 25 bp, Homo sapien
tgggcctagctcatcagtggctaaa

SEQ ID NO: 204956 - DNA, 25 bp, Homo sapien
tagctcatcagtggctaaagttgaa

SEQ ID NO: 204957 - DNA, 25 bp, Homo sapien
ggttggtttcctgtatatatatgta

SEQ ID NO: 204958 - DNA, 25 bp, Homo sapien
tacacacgtacatacattcatatat

SEQ ID NO: 204959 - DNA, 25 bp, Homo sapien
tacataatgtgcttaaccactgcct

SEQ ID NO: 204960 - DNA, 25 bp, Homo sapien
ttccgattttgacatatgttcattt

SEQ ID NO: 204961 - DNA, 25 bp, Homo sapien
aaattatagctgcatatcccttctt

SEQ ID NO: 204962 - DNA, 25 bp, Homo sapien
atagctgcatatcccttctttcaaa

SEQ ID NO: 204963 - DNA, 25 bp, Homo sapien
gaatgtactgaacctactaaccctt

SEQ ID NO: 204964 - DNA, 25 bp, Homo sapien
acatacagtttagggtcctagcgca

SEQ ID NO: 204965 - DNA, 25 bp, Homo sapien
tttagggtcctagcgcagagtcctt

SEQ ID NO: 204966 - DNA, 25 bp, Homo sapien
tcctagcgcagagtccttgtttaaa

SEQ ID NO: 204967 - DNA, 25 bp, Homo sapien
gcagagtccttgtttaaaggtcatt

SEQ ID NO: 204968 - DNA, 25 bp, Homo sapien
aaaggtcattgactcatcatctgtc

SEQ ID NO: 204969 - DNA, 25 bp, Homo sapien
ggtcattgactcatcatctgtcagt

SEQ ID NO: 204970 - DNA, 25 bp, Homo sapien
ttgactcatcatctgtcagtaatga

SEQ ID NO: 204971 - DNA, 25 bp, Homo sapien
tgccctgtttttgggtcaacattgc

SEQ ID NO: 204972 - DNA, 25 bp, Homo sapien
aacattgctacggagccagcagtga

SEQ ID NO: 204973 - DNA, 25 bp, Homo sapien
agtgaggcctttcccttcaagggct

SEQ ID NO: 204974 - DNA, 25 bp, Homo sapien
tcaagggctctgtggtatctctggc

SEQ ID NO: 204975 - DNA, 25 bp, Homo sapien
ggccacatttgttctaatgtctgaa

SEQ ID NO: 204976 - DNA, 25 bp, Homo sapien
tgtctgaacctctaaatcttttctt

SEQ ID NO: 204977 - DNA, 25 bp, Homo sapien
agcactgctgtctcatagatgggat

SEQ ID NO: 204978 - DNA, 25 bp, Homo sapien
gcaacttaaagtgtctctctcgctg

SEQ ID NO: 204979 - DNA, 25 bp, Homo sapien
tctctcgctgctaacagacgattga

SEQ ID NO: 204980 - DNA, 25 bp, Homo sapien
attgatgtcttgtctctgtgaccca

SEQ ID NO: 204981 - DNA, 25 bp, Homo sapien
taacctcctatcttagcagacatcg

SEQ ID NO: 204982 - DNA, 25 bp, Homo sapien
gtttttgtgaccagtttctgtctgc

SEQ ID NO: 204983 - DNA, 25 bp, Homo sapien
gtgaccagtttctgtctgcatgtaa

SEQ ID NO: 204984 - DNA, 25 bp, Homo sapien
gtctgcatgtaatttggatttctca

SEQ ID NO: 204985 - DNA, 25 bp, Homo sapien
ggatttctcaaatacattcattagt

SEQ ID NO: 204986 - DNA, 25 bp, Homo sapien
atttttgttcatctccttatctata

SEQ ID NO: 204987 - DNA, 25 bp, Homo sapien
ttgtaatatttgtccactaagctgg

SEQ ID NO: 204988 - DNA, 25 bp, Homo sapien
tggagaagcagcctcatacagttga

SEQ ID NO: 204989 - DNA, 25 bp, Homo sapien
gcagcctcatacagttgattttgtg

SEQ ID NO: 204990 - DNA, 25 bp, Homo sapien
gattttgtgtatgtggctagtctta

SEQ ID NO: 204991 - DNA, 25 bp, Homo sapien
gtggctagtcttattgtcactatgt

SEQ ID NO: 204992 - DNA, 25 bp, Homo sapien
cactatgtaagtaatccaatggttt

SEQ ID NO: 204993 - DNA, 25 bp, Homo sapien
aattttctactcaacaattccgaga

SEQ ID NO: 204994 - DNA, 25 bp, Homo sapien
atgcctagtttgtcatatcacagaa

SEQ ID NO: 204995 - DNA, 25 bp, Homo sapien
catgttttggaagggcaggtcgttt

SEQ ID NO: 204996 - DNA, 25 bp, Homo sapien
attttcttaatcacctccacactgt

SEQ ID NO: 204997 - DNA, 25 bp, Homo sapien
ttaatcacctccacactgtacagag

SEQ ID NO: 204998 - DNA, 25 bp, Homo sapien
agaggaaactcaagccttaaatgtt

SEQ ID NO: 204999 - DNA, 25 bp, Homo sapien
atgtttaagtaaactctgtctcagt

SEQ ID NO: 205000 - DNA, 25 bp, Homo sapien
ctctgtctcagttttaggattaaaa

SEQ ID NO: 205001 - DNA, 25 bp, Homo sapien
cccaccggtggtgtgatgatgccat

SEQ ID NO: 205002 - DNA, 25 bp, Homo sapien
gatgatgccatataccgcagggctt

SEQ ID NO: 205003 - DNA, 25 bp, Homo sapien
ataccgcagggcttgcttctgtcaa

SEQ ID NO: 205004 - DNA, 25 bp, Homo sapien
taaatgcacccagcttaagtagaag

SEQ ID NO: 205005 - DNA, 25 bp, Homo sapien
gcacccagcttaagtagaagacatt

SEQ ID NO: 205006 - DNA, 25 bp, Homo sapien
gaagacattgaaggatgcattaatt

SEQ ID NO: 205007 - DNA, 25 bp, Homo sapien
ggatgcattaattttcaggaactat

SEQ ID NO: 205008 - DNA, 25 bp, Homo sapien
aattatgaaaagattcccaattgaa

SEQ ID NO: 205009 - DNA, 25 bp, Homo sapien
gaaatcataaggcagtttaagcata

SEQ ID NO: 205010 - DNA, 25 bp, Homo sapien
aaaatagctgtgtactactaattaa

SEQ ID NO: 205011 - DNA, 25 bp, Homo sapien
gaagagtcaagtgaatatcgtttgt

SEQ ID NO: 205012 - DNA, 25 bp, Homo sapien
agtgaatatcgtttgtttatttgct

SEQ ID NO: 205013 - DNA, 25 bp, Homo sapien
gtttatttgctagtgagtttctttg

SEQ ID NO: 205014 - DNA, 25 bp, Homo sapien
tgagtttctttgtaacgttgatttt

SEQ ID NO: 205015 - DNA, 25 bp, Homo sapien
catggcacacagagataccctatgc

SEQ ID NO: 205016 - DNA, 25 bp, Homo sapien
accctatgcctcaaaacctgatgtg

SEQ ID NO: 205017 - DNA, 25 bp, Homo sapien
gcagaaggaccgcatcagacagatg

SEQ ID NO: 205018 - DNA, 25 bp, Homo sapien
aagagatacatcgtcacgccctgaa

SEQ ID NO: 205019 - DNA, 25 bp, Homo sapien
gccctgaacatgaggcgagtgccaa

SEQ ID NO: 205020 - DNA, 25 bp, Homo sapien
gtgccaagctctcagattgaatgct

SEQ ID NO: 205021 - DNA, 25 bp, Homo sapien
gaatgctaggttctctcaagcgtgc

SEQ ID NO: 205022 - DNA, 25 bp, Homo sapien
aagcgtgccgattaaaactgttaca

SEQ ID NO: 205023 - DNA, 25 bp, Homo sapien
tgttacacccgtttcgtgaagctga

SEQ ID NO: 205024 - DNA, 25 bp, Homo sapien
gtgaagctgaagatacccaggctgt

SEQ ID NO: 205025 - DNA, 25 bp, Homo sapien
acatgaactgattattaccccatat

SEQ ID NO: 205026 - DNA, 25 bp, Homo sapien
tcaccagaatccgaggggccaattt

SEQ ID NO: 205027 - DNA, 25 bp, Homo sapien
ggaaatagctcaccatactcctttc

SEQ ID NO: 205028 - DNA, 25 bp, Homo sapien
ctttccatgtacatccagtgagggt

SEQ ID NO: 205029 - DNA, 25 bp, Homo sapien
ccatgtacatccagtgagggtttta

SEQ ID NO: 205030 - DNA, 25 bp, Homo sapien
tacatccagtgagggttttattacg

SEQ ID NO: 205031 - DNA, 25 bp, Homo sapien
taggtttcccttccatagattgtgc

SEQ ID NO: 205032 - DNA, 25 bp, Homo sapien
tttcccttccatagattgtgccttt

SEQ ID NO: 205033 - DNA, 25 bp, Homo sapien
ccttccatagattgtgcctttcaga

SEQ ID NO: 205034 - DNA, 25 bp, Homo sapien
atagattgtgcctttcagaaatgct

SEQ ID NO: 205035 - DNA, 25 bp, Homo sapien
attattcacttggtaagtgttcaag

SEQ ID NO: 205036 - DNA, 25 bp, Homo sapien
ttcaagtctttctgatcaccccaag

SEQ ID NO: 205037 - DNA, 25 bp, Homo sapien
tcccaacaagcatcagagtgctgtg

SEQ ID NO: 205038 - DNA, 25 bp, Homo sapien
gacctgtttacagttcaacaagaac

SEQ ID NO: 205039 - DNA, 25 bp, Homo sapien
agaactttgtaattaccagctcaga

SEQ ID NO: 205040 - DNA, 25 bp, Homo sapien
ttaccagctcagatgatggaactgt

SEQ ID NO: 205041 - DNA, 25 bp, Homo sapien
ggaactgtaaaactatgggacttga

SEQ ID NO: 205042 - DNA, 25 bp, Homo sapien
ctatgggacttgaaaacgggtgaat

SEQ ID NO: 205043 - DNA, 25 bp, Homo sapien
tcgaaacctagtcacattggagagt

SEQ ID NO: 205044 - DNA, 25 bp, Homo sapien
agttgtgtggcggatcagagcctca

SEQ ID NO: 205045 - DNA, 25 bp, Homo sapien
atcagagcctcaaacacaaagctgg

SEQ ID NO: 205046 - DNA, 25 bp, Homo sapien
gtcggaatgggactgaagaaaccaa

SEQ ID NO: 205047 - DNA, 25 bp, Homo sapien
ctggtgctggactttgatgtggaca

SEQ ID NO: 205048 - DNA, 25 bp, Homo sapien
cagagcatggcttaacttcagggac

SEQ ID NO: 205049 - DNA, 25 bp, Homo sapien
catggcttaacttcagggacaatca

SEQ ID NO: 205050 - DNA, 25 bp, Homo sapien
taactaaccagttgttcaacagcgg

SEQ ID NO: 205051 - DNA, 25 bp, Homo sapien
gttcaacagcgggttaagctcagca

SEQ ID NO: 205052 - DNA, 25 bp, Homo sapien
ggttaagctcagcagttttcacagt

SEQ ID NO: 205053 - DNA, 25 bp, Homo sapien
agcagaagtccccaggaaacaaagg

SEQ ID NO: 205054 - DNA, 25 bp, Homo sapien
aacaaagggttagtcattagctgag

SEQ ID NO: 205055 - DNA, 25 bp, Homo sapien
gggaggctggccaaaataagtctta

SEQ ID NO: 205056 - DNA, 25 bp, Homo sapien
aagtcttaaaactgcttatgtcata

SEQ ID NO: 205057 - DNA, 25 bp, Homo sapien
ggattttaagttcatgacattcgga

SEQ ID NO: 205058 - DNA, 25 bp, Homo sapien
tgacattcggaacagcaaagccata

SEQ ID NO: 205059 - DNA, 25 bp, Homo sapien
cgctattaccaacattttcctgtgc

SEQ ID NO: 205060 - DNA, 25 bp, Homo sapien
acattttcctgtgcattaacctctg

SEQ ID NO: 205061 - DNA, 25 bp, Homo sapien
ttaacctctgcatgtgaaaactttt

SEQ ID NO: 205062 - DNA, 25 bp, Homo sapien
aggtggatgcattttttgtctgttt

SEQ ID NO: 205063 - DNA, 25 bp, Homo sapien
tttgtctgtttactgctcttctcag

SEQ ID NO: 205064 - DNA, 25 bp, Homo sapien
gtttactgctcttctcagctttatt

SEQ ID NO: 205065 - DNA, 25 bp, Homo sapien
gcattttaagggttgtattggcaat

SEQ ID NO: 205066 - DNA, 25 bp, Homo sapien
catcatgatggaaggtgcagacttt

SEQ ID NO: 205067 - DNA, 25 bp, Homo sapien
tttccgagaggagggtctatagacc

SEQ ID NO: 205068 - DNA, 25 bp, Homo sapien
gggtctatagaccatttgtcagaaa

SEQ ID NO: 205069 - DNA, 25 bp, Homo sapien
tgtcagaaatcagatcagccctcaa

SEQ ID NO: 205070 - DNA, 25 bp, Homo sapien
ccctggttctgagtttacaaagtct

SEQ ID NO: 205071 - DNA, 25 bp, Homo sapien
gttctgagtttacaaagtctcttcc

SEQ ID NO: 205072 - DNA, 25 bp, Homo sapien
agtctcttcctcattcccgttgagt

SEQ ID NO: 205073 - DNA, 25 bp, Homo sapien
tcattcccgttgagttctttcccac

SEQ ID NO: 205074 - DNA, 25 bp, Homo sapien
tggtgatggctaagggcccctgaca

SEQ ID NO: 205075 - DNA, 25 bp, Homo sapien
taagggcccctgacagtgaccttcc

SEQ ID NO: 205076 - DNA, 25 bp, Homo sapien
gggacagggccaggtagcctcctgc

SEQ ID NO: 205077 - DNA, 25 bp, Homo sapien
tcctgccccttatgtttacgtttgc

SEQ ID NO: 205078 - DNA, 25 bp, Homo sapien
ttatgtttacgtttgcagcctgaag

SEQ ID NO: 205079 - DNA, 25 bp, Homo sapien
gtttgcagcctgaagcactttaatt

SEQ ID NO: 205080 - DNA, 25 bp, Homo sapien
attttccaactattgcttccaactg

SEQ ID NO: 205081 - DNA, 25 bp, Homo sapien
gtaatgtaattctctgcacatccag

SEQ ID NO: 205082 - DNA, 25 bp, Homo sapien
aactgcgtgctgtaagctgggacca

SEQ ID NO: 205083 - DNA, 25 bp, Homo sapien
gctttgtccataactgctgagagaa

SEQ ID NO: 205084 - DNA, 25 bp, Homo sapien
agaacttgctgaagctctaggaata

SEQ ID NO: 205085 - DNA, 25 bp, Homo sapien
aggaataattttgcctgcccggttg

SEQ ID NO: 205086 - DNA, 25 bp, Homo sapien
gttgctcaccagttgtagcttgcca

SEQ ID NO: 205087 - DNA, 25 bp, Homo sapien
ttcctggtgccaataaactttctca

SEQ ID NO: 205088 - DNA, 25 bp, Homo sapien
aaaacctccagccttctctgtgttg

SEQ ID NO: 205089 - DNA, 25 bp, Homo sapien
tctctgtgttgttccgacataccga

SEQ ID NO: 205090 - DNA, 25 bp, Homo sapien
cgacataccgaggaccaactggtct

SEQ ID NO: 205091 - DNA, 25 bp, Homo sapien
aactggtctacatggatgccctgaa

SEQ ID NO: 205092 - DNA, 25 bp, Homo sapien
accacttctcatattagattactaa

SEQ ID NO: 205093 - DNA, 25 bp, Homo sapien
tagattactaagtcatttgtatgaa

SEQ ID NO: 205094 - DNA, 25 bp, Homo sapien
ggcagtgaagagaacaggtctttca

SEQ ID NO: 205095 - DNA, 25 bp, Homo sapien
ttaaatacactctcttatttttcta

SEQ ID NO: 205096 - DNA, 25 bp, Homo sapien
tagcaggatatgacaactcttattt

SEQ ID NO: 205097 - DNA, 25 bp, Homo sapien
tcatatttcttaagatagccctaaa

SEQ ID NO: 205098 - DNA, 25 bp, Homo sapien
atagccctaaatgtactcttgaact

SEQ ID NO: 205099 - DNA, 25 bp, Homo sapien
gtactcttgaacttcttactggaac

SEQ ID NO: 205100 - DNA, 25 bp, Homo sapien
gaacttcttactggaacaatgtttg

SEQ ID NO: 205101 - DNA, 25 bp, Homo sapien
gaacaatgtttgatactctagtatg

SEQ ID NO: 205102 - DNA, 25 bp, Homo sapien
actctagtatgtaagctgtatttat

SEQ ID NO: 205103 - DNA, 25 bp, Homo sapien
ttctgaaaacttccatgcttgattt

SEQ ID NO: 205104 - DNA, 25 bp, Homo sapien
aacactatgaggcaactccttggta

SEQ ID NO: 205105 - DNA, 25 bp, Homo sapien
aaatttggaacacatactgactctt

SEQ ID NO: 205106 - DNA, 25 bp, Homo sapien
gactcttcccctgaatttttgagat

SEQ ID NO: 205107 - DNA, 25 bp, Homo sapien
ttttgagatcccctgagactggcat

SEQ ID NO: 205108 - DNA, 25 bp, Homo sapien
gactggcattttacttctgtgtttt

SEQ ID NO: 205109 - DNA, 25 bp, Homo sapien
tacttctgtgttttaccagttggaa

SEQ ID NO: 205110 - DNA, 25 bp, Homo sapien
ggaatggagcaaccttcactaaaat

SEQ ID NO: 205111 - DNA, 25 bp, Homo sapien
atctgtactgatggattttcgtaac

SEQ ID NO: 205112 - DNA, 25 bp, Homo sapien
gattttcgtaactttttaatgccat

SEQ ID NO: 205113 - DNA, 25 bp, Homo sapien
aaaaggctcgtcattctgttcaaga

SEQ ID NO: 205114 - DNA, 25 bp, Homo sapien
tagcacttcccctactgattgctgc

SEQ ID NO: 205115 - DNA, 25 bp, Homo sapien
tgccttctctgtggctacaagggac

SEQ ID NO: 205116 - DNA, 25 bp, Homo sapien
tacaagggacccacagaattacagg

SEQ ID NO: 205117 - DNA, 25 bp, Homo sapien
gttacagggaagcaggtttcatctc

SEQ ID NO: 205118 - DNA, 25 bp, Homo sapien
agcaggtttcatctcaatattggga

SEQ ID NO: 205119 - DNA, 25 bp, Homo sapien
gatttcaaacaatcacacctgcctg

SEQ ID NO: 205120 - DNA, 25 bp, Homo sapien
aacaatcacacctgcctgagaagga

SEQ ID NO: 205121 - DNA, 25 bp, Homo sapien
cctgagaaggagtgggctgtcacta

SEQ ID NO: 205122 - DNA, 25 bp, Homo sapien
tcccagtccgtcaggaattttgtag

SEQ ID NO: 205123 - DNA, 25 bp, Homo sapien
aagggcttcatgtgctggtaccaat

SEQ ID NO: 205124 - DNA, 25 bp, Homo sapien
ggtaccaataggacaggaagatttt

SEQ ID NO: 205125 - DNA, 25 bp, Homo sapien
gagtagagagtatcatttaagctta

SEQ ID NO: 205126 - DNA, 25 bp, Homo sapien
taagcttattttagtcacatgtagt

SEQ ID NO: 205127 - DNA, 25 bp, Homo sapien
gtagtatatatctccttaaagctgt

SEQ ID NO: 205128 - DNA, 25 bp, Homo sapien
ccattctcttgatttcttcagaaac

SEQ ID NO: 205129 - DNA, 25 bp, Homo sapien
gaaaccatctagtcatcatctttat

SEQ ID NO: 205130 - DNA, 25 bp, Homo sapien
atactctacctgcttctgcaattat

SEQ ID NO: 205131 - DNA, 25 bp, Homo sapien
gttttcagagcagttcattgtcaag

SEQ ID NO: 205132 - DNA, 25 bp, Homo sapien
gagcagttcattgtcaagttggact

SEQ ID NO: 205133 - DNA, 25 bp, Homo sapien
gttggactttaagtgaccattcaag

SEQ ID NO: 205134 - DNA, 25 bp, Homo sapien
aagatgaaatctcacgaacctcaaa

SEQ ID NO: 205135 - DNA, 25 bp, Homo sapien
gaacctcaaaacttcattcatgtct

SEQ ID NO: 205136 - DNA, 25 bp, Homo sapien
ctgtggactctcactgaacatcaga

SEQ ID NO: 205137 - DNA, 25 bp, Homo sapien
gtgagaaaacatttcgccacaaatc

SEQ ID NO: 205138 - DNA, 25 bp, Homo sapien
atttcgccacaaatcaaactttctt

SEQ ID NO: 205139 - DNA, 25 bp, Homo sapien
acaaatcaaactttcttttacatca

SEQ ID NO: 205140 - DNA, 25 bp, Homo sapien
ttttacatcagaaatcccacaagga

SEQ ID NO: 205141 - DNA, 25 bp, Homo sapien
atcccacaaggaataagttccaaca

SEQ ID NO: 205142 - DNA, 25 bp, Homo sapien
gtaataaattccaacaaagcaacaa

SEQ ID NO: 205143 - DNA, 25 bp, Homo sapien
aaataacttacacaatgctaaactg

SEQ ID NO: 205144 - DNA, 25 bp, Homo sapien
tgctaaactgtgagtatgtatagag

SEQ ID NO: 205145 - DNA, 25 bp, Homo sapien
atttttctgccataagtcaaccctc

SEQ ID NO: 205146 - DNA, 25 bp, Homo sapien
aagtcaaccctcaatgtaacatcag

SEQ ID NO: 205147 - DNA, 25 bp, Homo sapien
tgggtgactgggtctagcccctgat

SEQ ID NO: 205148 - DNA, 25 bp, Homo sapien
agcccctgatcccaaatctgtttac

SEQ ID NO: 205149 - DNA, 25 bp, Homo sapien
tctgtttacacatcaatctgcctca

SEQ ID NO: 205150 - DNA, 25 bp, Homo sapien
aatctgcctcactgctgttctgggc

SEQ ID NO: 205151 - DNA, 25 bp, Homo sapien
catccccatagccatgtttacatga

SEQ ID NO: 205152 - DNA, 25 bp, Homo sapien
gcaggctcgggagatagattgtctc

SEQ ID NO: 205153 - DNA, 25 bp, Homo sapien
agatagattgtctcccttgcctctg

SEQ ID NO: 205154 - DNA, 25 bp, Homo sapien
gcccagcagagcctaagcactgtgc

SEQ ID NO: 205155 - DNA, 25 bp, Homo sapien
ctaagcactgtgctatcctggaggg

SEQ ID NO: 205156 - DNA, 25 bp, Homo sapien
gggctttggaccacctgaaagacca

SEQ ID NO: 205157 - DNA, 25 bp, Homo sapien
gaggaggaggcttcagccatcagca

SEQ ID NO: 205158 - DNA, 25 bp, Homo sapien
atacatattcttctcgagtgcatat

SEQ ID NO: 205159 - DNA, 25 bp, Homo sapien
attcttctcgagtgcatatgaaaca

SEQ ID NO: 205160 - DNA, 25 bp, Homo sapien
gagtgcatatgaaacatctccaaaa

SEQ ID NO: 205161 - DNA, 25 bp, Homo sapien
catatgaaacatctccaaaataggt

SEQ ID NO: 205162 - DNA, 25 bp, Homo sapien
gaaatcatgcaaagcatgccctctg

SEQ ID NO: 205163 - DNA, 25 bp, Homo sapien
aagcatgccctctgaccacatggga

SEQ ID NO: 205164 - DNA, 25 bp, Homo sapien
cctctgaccacatgggatgaagtta

SEQ ID NO: 205165 - DNA, 25 bp, Homo sapien
agttgggaaactcacaaatatgtgg

SEQ ID NO: 205166 - DNA, 25 bp, Homo sapien
gtggaaatcagacacacttgtaagt

SEQ ID NO: 205167 - DNA, 25 bp, Homo sapien
cacttgtaagtgactggctgggtgc

SEQ ID NO: 205168 - DNA, 25 bp, Homo sapien
gaggattccttggatcccttgagac

SEQ ID NO: 205169 - DNA, 25 bp, Homo sapien
gctccgtggggttcttaaggcagta

SEQ ID NO: 205170 - DNA, 25 bp, Homo sapien
gggttcttaaggcagtaacacaata

SEQ ID NO: 205171 - DNA, 25 bp, Homo sapien
ggttcttaaggcagtaacacaataa

SEQ ID NO: 205172 - DNA, 25 bp, Homo sapien
cttaaggcagtaacacaataagtgt

SEQ ID NO: 205173 - DNA, 25 bp, Homo sapien
gtttttggtatgtgtttactgtgtt

SEQ ID NO: 205174 - DNA, 25 bp, Homo sapien
tactgtgttttcccaaatccaaaat

SEQ ID NO: 205175 - DNA, 25 bp, Homo sapien
aatgtgttttggttacaggagttca

SEQ ID NO: 205176 - DNA, 25 bp, Homo sapien
tgttttggttacaggagttcagtat

SEQ ID NO: 205177 - DNA, 25 bp, Homo sapien
ggagttcagtatttggaaactaatt

SEQ ID NO: 205178 - DNA, 25 bp, Homo sapien
tgatatttattgtaaacgtgactac

SEQ ID NO: 205179 - DNA, 25 bp, Homo sapien
ttgtaaacgtgactacaactttcta

SEQ ID NO: 205180 - DNA, 25 bp, Homo sapien
tcactgttaagtcatgtcccttgaa

SEQ ID NO: 205181 - DNA, 25 bp, Homo sapien
gtcccttgaaacatgatagttacat

SEQ ID NO: 205182 - DNA, 25 bp, Homo sapien
gttacatacacagttttctctccac

SEQ ID NO: 205183 - DNA, 25 bp, Homo sapien
cacagttttctctccacacataaat

SEQ ID NO: 205184 - DNA, 25 bp, Homo sapien
gtaaggttccaaactaatatggcat

SEQ ID NO: 205185 - DNA, 25 bp, Homo sapien
tatggcatatatcaactctacagtt

SEQ ID NO: 205186 - DNA, 25 bp, Homo sapien
atgtgaagatcacatgcttagtcat

SEQ ID NO: 205187 - DNA, 25 bp, Homo sapien
gttcattccactttgtatatctttt

SEQ ID NO: 205188 - DNA, 25 bp, Homo sapien
atttattgacttctcatgttctaga

SEQ ID NO: 205189 - DNA, 25 bp, Homo sapien
gacttctcatgttctagagagtagg

SEQ ID NO: 205190 - DNA, 25 bp, Homo sapien
gagagtaggacttttattccgtgta

SEQ ID NO: 205191 - DNA, 25 bp, Homo sapien
atgtgttgtaagacgtagagtttat

SEQ ID NO: 205192 - DNA, 25 bp, Homo sapien
gtagagtttatctcaagctgttaaa

SEQ ID NO: 205193 - DNA, 25 bp, Homo sapien
gacacttatctatataatatgggta

SEQ ID NO: 205194 - DNA, 25 bp, Homo sapien
tatgggtaagttttgtttcgcctat

SEQ ID NO: 205195 - DNA, 25 bp, Homo sapien
gtaagttttgtttcgcctataatag

SEQ ID NO: 205196 - DNA, 25 bp, Homo sapien
gttttgtttcgcctataatagatgt

SEQ ID NO: 205197 - DNA, 25 bp, Homo sapien
tttttgcttccacaggttgcactat

SEQ ID NO: 205198 - DNA, 25 bp, Homo sapien
gcttccacaggttgcactattgaaa

SEQ ID NO: 205199 - DNA, 25 bp, Homo sapien
ggttgcactattgaaaaatcgagat

SEQ ID NO: 205200 - DNA, 25 bp, Homo sapien
aaatcgagattgtataaacctggta

SEQ ID NO: 205201 - DNA, 25 bp, Homo sapien
aaacctggtaaaaagctgcaagatg

SEQ ID NO: 205202 - DNA, 25 bp, Homo sapien
gacatcaccaggtctaatgtttaca

SEQ ID NO: 205203 - DNA, 25 bp, Homo sapien
tcaccaggtctaatgtttacaaacg

SEQ ID NO: 205204 - DNA, 25 bp, Homo sapien
taatgtttacaaacggtgccagccc

SEQ ID NO: 205205 - DNA, 25 bp, Homo sapien
gtttacaaacggtgccagcccggct

SEQ ID NO: 205206 - DNA, 25 bp, Homo sapien
gtgccagcccggctctgaagccaag

SEQ ID NO: 205207 - DNA, 25 bp, Homo sapien
ggctctgaagccaagggccgtcccg

SEQ ID NO: 205208 - DNA, 25 bp, Homo sapien
acggtgctgtgagtattcctccgtt

SEQ ID NO: 205209 - DNA, 25 bp, Homo sapien
atctgcttttgtgtctgagatgggc

SEQ ID NO: 205210 - DNA, 25 bp, Homo sapien
gaaggctgagaacctttcagaccct

SEQ ID NO: 205211 - DNA, 25 bp, Homo sapien
agaacctttcagaccctctgtgtgg

SEQ ID NO: 205212 - DNA, 25 bp, Homo sapien
tttcagaccctctgtgtgggctggg

SEQ ID NO: 205213 - DNA, 25 bp, Homo sapien
ccttaattttagagtggtcttggat

SEQ ID NO: 205214 - DNA, 25 bp, Homo sapien
gagtggtcttggattactaaagata

SEQ ID NO: 205215 - DNA, 25 bp, Homo sapien
gaactcacagagatgtgctggctta

SEQ ID NO: 205216 - DNA, 25 bp, Homo sapien
ctggcttagactccaaaaggattat

SEQ ID NO: 205217 - DNA, 25 bp, Homo sapien
gattataaaactcccaaagtaccag

SEQ ID NO: 205218 - DNA, 25 bp, Homo sapien
tttccagaaaaccacattttacagt

SEQ ID NO: 205219 - DNA, 25 bp, Homo sapien
gatgattaatagcagcagcatgttc

SEQ ID NO: 205220 - DNA, 25 bp, Homo sapien
cagcagcatgttcagtttcgcttat

SEQ ID NO: 205221 - DNA, 25 bp, Homo sapien
gcatgttcagtttcgcttatatgag

SEQ ID NO: 205222 - DNA, 25 bp, Homo sapien
aacatgtttaggcaactagtcagaa

SEQ ID NO: 205223 - DNA, 25 bp, Homo sapien
aaaaccagctatggccttacagaaa

SEQ ID NO: 205224 - DNA, 25 bp, Homo sapien
ttttttatgtctcattctttaaaca

SEQ ID NO: 205225 - DNA, 25 bp, Homo sapien
tttcttgattagaggcacagtgaaa

SEQ ID NO: 205226 - DNA, 25 bp, Homo sapien
agttctacttttcatcagtgctatt

SEQ ID NO: 205227 - DNA, 25 bp, Homo sapien
tttcatcagtgctattaaaggtggc

SEQ ID NO: 205228 - DNA, 25 bp, Homo sapien
ggtggcagcaaatgtaaatcttggc

SEQ ID NO: 205229 - DNA, 25 bp, Homo sapien
gcaaatgtaaatcttggctgaatgg

SEQ ID NO: 205230 - DNA, 25 bp, Homo sapien
ttggctgaatggtcttaattactca

SEQ ID NO: 205231 - DNA, 25 bp, Homo sapien
taattactcattaaaccacagtcag

SEQ ID NO: 205232 - DNA, 25 bp, Homo sapien
gtcagaaagacatataggtgctatt

SEQ ID NO: 205233 - DNA, 25 bp, Homo sapien
atataggtgctatttgggaaaactt

SEQ ID NO: 205234 - DNA, 25 bp, Homo sapien
gggtttctctaattgctaatcacaa

SEQ ID NO: 205235 - DNA, 25 bp, Homo sapien
gattacatcagtcatgattcatgaa

SEQ ID NO: 205236 - DNA, 25 bp, Homo sapien
gaaccagtcatgaatcagttgacaa

SEQ ID NO: 205237 - DNA, 25 bp, Homo sapien
gttgacaacaaatttattgcacaga

SEQ ID NO: 205238 - DNA, 25 bp, Homo sapien
atatttctgtattttgtcaagctac

SEQ ID NO: 205239 - DNA, 25 bp, Homo sapien
tttctgtattttgtcaagctacttt

SEQ ID NO: 205240 - DNA, 25 bp, Homo sapien
aatgaatgtaatctatgaaccttta

SEQ ID NO: 205241 - DNA, 25 bp, Homo sapien
atgaacctttagagcttagactgta

SEQ ID NO: 205242 - DNA, 25 bp, Homo sapien
gagcttagactgtatttcacacaaa

SEQ ID NO: 205243 - DNA, 25 bp, Homo sapien
aataattgtcatgttttgttgctat

SEQ ID NO: 205244 - DNA, 25 bp, Homo sapien
attgtcatgttttgttgctattgtg

SEQ ID NO: 205245 - DNA, 25 bp, Homo sapien
atgttttgttgctattgtgaattat

SEQ ID NO: 205246 - DNA, 25 bp, Homo sapien
gacatcatgctttctggaaacttcc

SEQ ID NO: 205247 - DNA, 25 bp, Homo sapien
tggagcaccttccggcctctacatg

SEQ ID NO: 205248 - DNA, 25 bp, Homo sapien
ggagcaccttccggcctctacatgc

SEQ ID NO: 205249 - DNA, 25 bp, Homo sapien
gagcaccttccggcctctacatgct

SEQ ID NO: 205250 - DNA, 25 bp, Homo sapien
agcaccttccggcctctacatgctg

SEQ ID NO: 205251 - DNA, 25 bp, Homo sapien
gcaccttccggcctctacatgctgt

SEQ ID NO: 205252 - DNA, 25 bp, Homo sapien
caccttccggcctctacatgctgta

SEQ ID NO: 205253 - DNA, 25 bp, Homo sapien
accttccggcctctacatgctgtac

SEQ ID NO: 205254 - DNA, 25 bp, Homo sapien
cttccggcctctacatgctgtacgt

SEQ ID NO: 205255 - DNA, 25 bp, Homo sapien
ttccggcctctacatgctgtacgtt

SEQ ID NO: 205256 - DNA, 25 bp, Homo sapien
tccggcctctacatgctgtacgttc

SEQ ID NO: 205257 - DNA, 25 bp, Homo sapien
agctcagggcggtcgagtgcagtgg

SEQ ID NO: 205258 - DNA, 25 bp, Homo sapien
ctccagcccgggttacagtgtgagg

SEQ ID NO: 205259 - DNA, 25 bp, Homo sapien
tccagcccgggttacagtgtgaggc

SEQ ID NO: 205260 - DNA, 25 bp, Homo sapien
ccagcccgggttacagtgtgaggct

SEQ ID NO: 205261 - DNA, 25 bp, Homo sapien
agcccgggttacagtgtgaggcttt

SEQ ID NO: 205262 - DNA, 25 bp, Homo sapien
gcccgggttacagtgtgaggctttc

SEQ ID NO: 205263 - DNA, 25 bp, Homo sapien
cccgggttacagtgtgaggctttct

SEQ ID NO: 205264 - DNA, 25 bp, Homo sapien
ccgggttacagtgtgaggctttcta

SEQ ID NO: 205265 - DNA, 25 bp, Homo sapien
cgggttacagtgtgaggctttctaa

SEQ ID NO: 205266 - DNA, 25 bp, Homo sapien
gggttacagtgtgaggctttctaaa

SEQ ID NO: 205267 - DNA, 25 bp, Homo sapien
ggttacagtgtgaggctttctaaaa

SEQ ID NO: 205268 - DNA, 25 bp, Homo sapien
gttaatgtgatcatgatattgcaaa

SEQ ID NO: 205269 - DNA, 25 bp, Homo sapien
aactataaatggtctctaggcctta

SEQ ID NO: 205270 - DNA, 25 bp, Homo sapien
taaatggtctctaggccttactttg

SEQ ID NO: 205271 - DNA, 25 bp, Homo sapien
tggtctctaggccttactttgtgat

SEQ ID NO: 205272 - DNA, 25 bp, Homo sapien
ttactttgtgattatacgttatctc

SEQ ID NO: 205273 - DNA, 25 bp, Homo sapien
atgcctataataccataatgccagt

SEQ ID NO: 205274 - DNA, 25 bp, Homo sapien
taatgccagtttggtatagagtcca

SEQ ID NO: 205275 - DNA, 25 bp, Homo sapien
ggtatagagtccaactttaaaacat

SEQ ID NO: 205276 - DNA, 25 bp, Homo sapien
taaaacatgaattgctcgacagagt

SEQ ID NO: 205277 - DNA, 25 bp, Homo sapien
tgctcgacagagttctattcagtag

SEQ ID NO: 205278 - DNA, 25 bp, Homo sapien
gaaaatgctgcgttgtgttgaatga

SEQ ID NO: 205279 - DNA, 25 bp, Homo sapien
cacataagggctggttatttacctc

SEQ ID NO: 205280 - DNA, 25 bp, Homo sapien
aggacttttaacctttgctgacaag

SEQ ID NO: 205281 - DNA, 25 bp, Homo sapien
acctttgctgacaaggttttgtctg

SEQ ID NO: 205282 - DNA, 25 bp, Homo sapien
gctgacaaggttttgtctgtttcag

SEQ ID NO: 205283 - DNA, 25 bp, Homo sapien
tgtctgtttcagttatacttgtgaa

SEQ ID NO: 205284 - DNA, 25 bp, Homo sapien
cattattaaaatactttgccttgga

SEQ ID NO: 205285 - DNA, 25 bp, Homo sapien
aatactttgccttggaatagattat

SEQ ID NO: 205286 - DNA, 25 bp, Homo sapien
atcaaaagtatgttgtttcaggaga

SEQ ID NO: 205287 - DNA, 25 bp, Homo sapien
ttgtttcaggagactttgtatttag

SEQ ID NO: 205288 - DNA, 25 bp, Homo sapien
acttgtgaacaagctttcattttga

SEQ ID NO: 205289 - DNA, 25 bp, Homo sapien
ctttcattttgatcaaactgatctt

SEQ ID NO: 205290 - DNA, 25 bp, Homo sapien
aattcctctcctactttagagcatc

SEQ ID NO: 205291 - DNA, 25 bp, Homo sapien
agagcatccagcacgctcaaagttt

SEQ ID NO: 205292 - DNA, 25 bp, Homo sapien
aagtttaagagcatttagccatcgc

SEQ ID NO: 205293 - DNA, 25 bp, Homo sapien
ggaacctctcagatacctctaaaac

SEQ ID NO: 205294 - DNA, 25 bp, Homo sapien
cagcaaactgtgattctcaagatta

SEQ ID NO: 205295 - DNA, 25 bp, Homo sapien
gtaacaaggaatatgcccaaactgt

SEQ ID NO: 205296 - DNA, 25 bp, Homo sapien
tgcccaaactgtcaaatgtcacctg

SEQ ID NO: 205297 - DNA, 25 bp, Homo sapien
atgtcacctgttatgtattcgtccc

SEQ ID NO: 205298 - DNA, 25 bp, Homo sapien
ttatgtattcgtccctattccttaa

SEQ ID NO: 205299 - DNA, 25 bp, Homo sapien
tcgtccctattccttaactatgtat

SEQ ID NO: 205300 - DNA, 25 bp, Homo sapien
gtaaactagcccatagtcacctata

SEQ ID NO: 205301 - DNA, 25 bp, Homo sapien
tcaaacttccttcatttaacttgct

SEQ ID NO: 205302 - DNA, 25 bp, Homo sapien
ggtgaggtatatcccacttctgtga

SEQ ID NO: 205303 - DNA, 25 bp, Homo sapien
attacaaatcaaaccgcttctctca

SEQ ID NO: 205304 - DNA, 25 bp, Homo sapien
tcaaaccgcttctctcagtttattt

SEQ ID NO: 205305 - DNA, 25 bp, Homo sapien
gatgcttttgttgcgagcggagctc

SEQ ID NO: 205306 - DNA, 25 bp, Homo sapien
agctctagagtgaagcctcctgtgt

SEQ ID NO: 205307 - DNA, 25 bp, Homo sapien
tagagtgaagcctcctgtgtgtgtg

SEQ ID NO: 205308 - DNA, 25 bp, Homo sapien
gataataacaccttgtaactcatta

SEQ ID NO: 205309 - DNA, 25 bp, Homo sapien
gtaactcattacagctgggcactat

SEQ ID NO: 205310 - DNA, 25 bp, Homo sapien
acagctgggcactatttacataaac

SEQ ID NO: 205311 - DNA, 25 bp, Homo sapien
gagccaggcaggaatttgctgatta

SEQ ID NO: 205312 - DNA, 25 bp, Homo sapien
agaagcaagatgttcttctctcctg

SEQ ID NO: 205313 - DNA, 25 bp, Homo sapien
ccgttggttgttggtggtcagaatt

SEQ ID NO: 205314 - DNA, 25 bp, Homo sapien
cttatactatgtgtattgttccttt

SEQ ID NO: 205315 - DNA, 25 bp, Homo sapien
taaacttctcccctgctttatttgg

SEQ ID NO: 205316 - DNA, 25 bp, Homo sapien
acttctcccctgctttatttggatg

SEQ ID NO: 205317 - DNA, 25 bp, Homo sapien
ggatgggtcaagtttctgttctgtt

SEQ ID NO: 205318 - DNA, 25 bp, Homo sapien
atttggaaatgtccttggctttacg

SEQ ID NO: 205319 - DNA, 25 bp, Homo sapien
aatgtccttggctttacgattctgc

SEQ ID NO: 205320 - DNA, 25 bp, Homo sapien
cttggctttacgattctgcttgtag

SEQ ID NO: 205321 - DNA, 25 bp, Homo sapien
gattctgcttgtagatacttcccct

SEQ ID NO: 205322 - DNA, 25 bp, Homo sapien
cttgtagatacttcccctgtttcta

SEQ ID NO: 205323 - DNA, 25 bp, Homo sapien
atgtgtttgtttccaacttgatttt

SEQ ID NO: 205324 - DNA, 25 bp, Homo sapien
cttgattttccaactctaataaagg

SEQ ID NO: 205325 - DNA, 25 bp, Homo sapien
tttccaactctaataaaggtttctg

SEQ ID NO: 205326 - DNA, 25 bp, Homo sapien
gtagtaaatggtacttcccagcctc

SEQ ID NO: 205327 - DNA, 25 bp, Homo sapien
tctcttttgccccattctggaatac

SEQ ID NO: 205328 - DNA, 25 bp, Homo sapien
cattctggaatactccccagagttt

SEQ ID NO: 205329 - DNA, 25 bp, Homo sapien
taagtctgttggcatgaaggaccat

SEQ ID NO: 205330 - DNA, 25 bp, Homo sapien
ggcatgaaggaccattttctacata

SEQ ID NO: 205331 - DNA, 25 bp, Homo sapien
ataatatgacatggatacttgaccc

SEQ ID NO: 205332 - DNA, 25 bp, Homo sapien
tgacatggatacttgacccaaaaaa

SEQ ID NO: 205333 - DNA, 25 bp, Homo sapien
aaatgtttagtgctaatgagcagaa

SEQ ID NO: 205334 - DNA, 25 bp, Homo sapien
gactgagagaggaccttgtttcccc

SEQ ID NO: 205335 - DNA, 25 bp, Homo sapien
tttcccccctaaggaaaatgtgcag

SEQ ID NO: 205336 - DNA, 25 bp, Homo sapien
aaatgtgcagttaatgagctacaag

SEQ ID NO: 205337 - DNA, 25 bp, Homo sapien
ttaatgagctacaaggtgctccgtg

SEQ ID NO: 205338 - DNA, 25 bp, Homo sapien
taatgagctacaaggtgctccgtgg

SEQ ID NO: 205339 - DNA, 25 bp, Homo sapien
gggttcttaaggcagtaacacaata

SEQ ID NO: 205340 - DNA, 25 bp, Homo sapien
gttttccagccagttcaatcctata

SEQ ID NO: 205341 - DNA, 25 bp, Homo sapien
gttcaatcctatacttgagctggtt

SEQ ID NO: 205342 - DNA, 25 bp, Homo sapien
cctatacttgagctggtttttgttt

SEQ ID NO: 205343 - DNA, 25 bp, Homo sapien
tggtatgtgtttactgtgttttccc

SEQ ID NO: 205344 - DNA, 25 bp, Homo sapien
gtgttttcccaaatccaaaatgtgt

SEQ ID NO: 205345 - DNA, 25 bp, Homo sapien
ttctttattgagtgtactggctggc

SEQ ID NO: 205346 - DNA, 25 bp, Homo sapien
gtactggctggcaagagttctctct

SEQ ID NO: 205347 - DNA, 25 bp, Homo sapien
gcaagagttctctcttctgttggta

SEQ ID NO: 205348 - DNA, 25 bp, Homo sapien
attcaggacctgtagcttggttttc

SEQ ID NO: 205349 - DNA, 25 bp, Homo sapien
gcttggttttctaaagcacctcgta

SEQ ID NO: 205350 - DNA, 25 bp, Homo sapien
aagcacctcgtaaaatgatatgatt

SEQ ID NO: 205351 - DNA, 25 bp, Homo sapien
tgatatgattactccaagccctctg

SEQ ID NO: 205352 - DNA, 25 bp, Homo sapien
aagccctctgcatgttttcagacag

SEQ ID NO: 205353 - DNA, 25 bp, Homo sapien
gttttcagacagaacacattgacat

SEQ ID NO: 205354 - DNA, 25 bp, Homo sapien
ttaatcttgtatccagtatcctgag

SEQ ID NO: 205355 - DNA, 25 bp, Homo sapien
tgttctactgcctgatgtgaaagag

SEQ ID NO: 205356 - DNA, 25 bp, Homo sapien
tgagagtgatctgtcctgtgaggca

SEQ ID NO: 205357 - DNA, 25 bp, Homo sapien
gagtatgcctttccagtatcttcca

SEQ ID NO: 205358 - DNA, 25 bp, Homo sapien
catcttcctttgtatacttgtcctt

SEQ ID NO: 205359 - DNA, 25 bp, Homo sapien
tggagggaggctgctactctaccac

SEQ ID NO: 205360 - DNA, 25 bp, Homo sapien
tgctactctaccacttcctgtgtgc

SEQ ID NO: 205361 - DNA, 25 bp, Homo sapien
cctcaaccctggcaattatagctac

SEQ ID NO: 205362 - DNA, 25 bp, Homo sapien
caattatagctactcccatccctta

SEQ ID NO: 205363 - DNA, 25 bp, Homo sapien
ccatcccttacctgggcatgtgtga

SEQ ID NO: 205364 - DNA, 25 bp, Homo sapien
gggcatgtgtgagcccttctcactg

SEQ ID NO: 205365 - DNA, 25 bp, Homo sapien
actggattttatacccttgtgtctg

SEQ ID NO: 205366 - DNA, 25 bp, Homo sapien
ttttatacccttgtgtctgtgtaca

SEQ ID NO: 205367 - DNA, 25 bp, Homo sapien
taagtccgtttagagagcaaaccat

SEQ ID NO: 205368 - DNA, 25 bp, Homo sapien
accatattgtgcctcttcatcttga

SEQ ID NO: 205369 - DNA, 25 bp, Homo sapien
ttcatcttgacccaggctcttatag

SEQ ID NO: 205370 - DNA, 25 bp, Homo sapien
ggctcttatagataggtcctaaaca

SEQ ID NO: 205371 - DNA, 25 bp, Homo sapien
ttgctgttcactagattatcttaac

SEQ ID NO: 205372 - DNA, 25 bp, Homo sapien
tattgccaactagatacactgcctc

SEQ ID NO: 205373 - DNA, 25 bp, Homo sapien
gatacactgcctcaatcttgaccag

SEQ ID NO: 205374 - DNA, 25 bp, Homo sapien
tgagttctctcagttgggtagtaac

SEQ ID NO: 205375 - DNA, 25 bp, Homo sapien
gtagtaacttgaataccagtctatt

SEQ ID NO: 205376 - DNA, 25 bp, Homo sapien
cagtctatttatcagttggtttcaa

SEQ ID NO: 205377 - DNA, 25 bp, Homo sapien
gttggtttcaacacagaggtttcaa

SEQ ID NO: 205378 - DNA, 25 bp, Homo sapien
ggcagctgccttggaagggaagtca

SEQ ID NO: 205379 - DNA, 25 bp, Homo sapien
gggaagtcaggctcacttggacagc

SEQ ID NO: 205380 - DNA, 25 bp, Homo sapien
ggctcacttggacagcccaggccat

SEQ ID NO: 205381 - DNA, 25 bp, Homo sapien
ggcaggaagaatcccttcctcttgg

SEQ ID NO: 205382 - DNA, 25 bp, Homo sapien
caccagaggcctagcccttttgtca

SEQ ID NO: 205383 - DNA, 25 bp, Homo sapien
ggcctagcccttttgtcaccgaagg

SEQ ID NO: 205384 - DNA, 25 bp, Homo sapien
ccccagagtgtttctgtgtgaaacc

SEQ ID NO: 205385 - DNA, 25 bp, Homo sapien
gtgaaaccctctcatttacactgtg

SEQ ID NO: 205386 - DNA, 25 bp, Homo sapien
aaaccctctcatttacactgtggca

SEQ ID NO: 205387 - DNA, 25 bp, Homo sapien
tacactgtggcatcaaaatccacaa

SEQ ID NO: 205388 - DNA, 25 bp, Homo sapien
aaagatggattaattgcactctggt

SEQ ID NO: 205389 - DNA, 25 bp, Homo sapien
agtgggcaagtcctcagctgaacaa

SEQ ID NO: 205390 - DNA, 25 bp, Homo sapien
gtcctcagctgaacaatcttggatg

SEQ ID NO: 205391 - DNA, 25 bp, Homo sapien
ggatgtagtctagcagcaacccacc

SEQ ID NO: 205392 - DNA, 25 bp, Homo sapien
gcaacccacctacaatggcgttatg

SEQ ID NO: 205393 - DNA, 25 bp, Homo sapien
aatggcgttatgtttggagttatga

SEQ ID NO: 205394 - DNA, 25 bp, Homo sapien
ctacagctttgtactcagataattt

SEQ ID NO: 205395 - DNA, 25 bp, Homo sapien
tgtgttttaaatttcatactccaga

SEQ ID NO: 205396 - DNA, 25 bp, Homo sapien
atactccagaactttcatgtttatg

SEQ ID NO: 205397 - DNA, 25 bp, Homo sapien
gaggtgatatacttagtccattgat

SEQ ID NO: 205398 - DNA, 25 bp, Homo sapien
agtccattgatgttgtcacttgtca

SEQ ID NO: 205399 - DNA, 25 bp, Homo sapien
gttgtcacttgtcatctaaacttat

SEQ ID NO: 205400 - DNA, 25 bp, Homo sapien
aatttgacacccttcattcatttat

SEQ ID NO: 205401 - DNA, 25 bp, Homo sapien
gagctagttctttagtagttaaaca

SEQ ID NO: 205402 - DNA, 25 bp, Homo sapien
tttctccttctgtatttccatacca

SEQ ID NO: 205403 - DNA, 25 bp, Homo sapien
tgtatttccataccacttttcagcc

SEQ ID NO: 205404 - DNA, 25 bp, Homo sapien
ccacttttcagccaagaatcctatc

SEQ ID NO: 205405 - DNA, 25 bp, Homo sapien
gtaatctattatgcccgacatcttt

SEQ ID NO: 205406 - DNA, 25 bp, Homo sapien
gacatcttttaatcattcaccccat

SEQ ID NO: 205407 - DNA, 25 bp, Homo sapien
caccccattacttcttgtcaacaaa

SEQ ID NO: 205408 - DNA, 25 bp, Homo sapien
tttttagctcttgctttaagtgttt

SEQ ID NO: 205409 - DNA, 25 bp, Homo sapien
gtgtttgtttgttatctcagtccag

SEQ ID NO: 205410 - DNA, 25 bp, Homo sapien
ctcagtccagaaccaatattatcgt

SEQ ID NO: 205411 - DNA, 25 bp, Homo sapien
agagtctctgcttgtgggtgcttga

SEQ ID NO: 205412 - DNA, 25 bp, Homo sapien
ttgtgggtgcttgatccacctgctg

SEQ ID NO: 205413 - DNA, 25 bp, Homo sapien
tgatccacctgctgggaccctgcag

SEQ ID NO: 205414 - DNA, 25 bp, Homo sapien
tcagttggggattccacctttctgc

SEQ ID NO: 205415 - DNA, 25 bp, Homo sapien
acctttctgctgagcgccttctcgg

SEQ ID NO: 205416 - DNA, 25 bp, Homo sapien
tggaggcccatcttcagtgagagat

SEQ ID NO: 205417 - DNA, 25 bp, Homo sapien
ggcccatcttcagtgagagatcaca

SEQ ID NO: 205418 - DNA, 25 bp, Homo sapien
tgagagatcacaaagcggccaggca

SEQ ID NO: 205419 - DNA, 25 bp, Homo sapien
gggagactgaatttgccttgttcga

SEQ ID NO: 205420 - DNA, 25 bp, Homo sapien
gaatttgccttgttcgagagtaacg

SEQ ID NO: 205421 - DNA, 25 bp, Homo sapien
gccttgttcgagagtaacgtttgaa

SEQ ID NO: 205422 - DNA, 25 bp, Homo sapien
ctgcccacattgtcctgtggcacaa

SEQ ID NO: 205423 - DNA, 25 bp, Homo sapien
gtcctgtggcacaacccgagtggga

SEQ ID NO: 205424 - DNA, 25 bp, Homo sapien
gagtgggactctccaacgcccaaga

SEQ ID NO: 205425 - DNA, 25 bp, Homo sapien
gaatgagactgctgttacgacccac

SEQ ID NO: 205426 - DNA, 25 bp, Homo sapien
cacaccgcgaaaacaaggaccgctt

SEQ ID NO: 205427 - DNA, 25 bp, Homo sapien
atgaccttaaaggtgatcggcttta

SEQ ID NO: 205428 - DNA, 25 bp, Homo sapien
gatcggctttaacgaatatgtttac

SEQ ID NO: 205429 - DNA, 25 bp, Homo sapien
tatgtttacatatgcatagcgctgc

SEQ ID NO: 205430 - DNA, 25 bp, Homo sapien
atagcgctgcactcagtcggactga

SEQ ID NO: 205431 - DNA, 25 bp, Homo sapien
gtcggactgaacgtagccagaggaa

SEQ ID NO: 205432 - DNA, 25 bp, Homo sapien
gcctcgacctgttgcgctgggccgt

SEQ ID NO: 205433 - DNA, 25 bp, Homo sapien
tttattacagaattctaattccagt

SEQ ID NO: 205434 - DNA, 25 bp, Homo sapien
attccagtatgaatagtggaaaccc

SEQ ID NO: 205435 - DNA, 25 bp, Homo sapien
agtggaaacccatctgtaaattaga

SEQ ID NO: 205436 - DNA, 25 bp, Homo sapien
aaattagatggatgttggatggaaa

SEQ ID NO: 205437 - DNA, 25 bp, Homo sapien
aatgacattgctaaatttgagaatt

SEQ ID NO: 205438 - DNA, 25 bp, Homo sapien
cctactaatgtagattgctttgtat

SEQ ID NO: 205439 - DNA, 25 bp, Homo sapien
tggaaggttttgttacagggagcat

SEQ ID NO: 205440 - DNA, 25 bp, Homo sapien
aggttttgttacagggagcatggtc

SEQ ID NO: 205441 - DNA, 25 bp, Homo sapien
cagggagcatggtctgttgaagatt

SEQ ID NO: 205442 - DNA, 25 bp, Homo sapien
gcatggtctgttgaagatttttaaa

SEQ ID NO: 205443 - DNA, 25 bp, Homo sapien
gattaacttctgtacatgaaatgtc

SEQ ID NO: 205444 - DNA, 25 bp, Homo sapien
aaggcatttttcagtcatacctcga

SEQ ID NO: 205445 - DNA, 25 bp, Homo sapien
gtcatacctcgaaaaactgcctgtg

SEQ ID NO: 205446 - DNA, 25 bp, Homo sapien
gcctgtgtagggatatttcccctgc

SEQ ID NO: 205447 - DNA, 25 bp, Homo sapien
caggcagctgctgggaatgtattcc

SEQ ID NO: 205448 - DNA, 25 bp, Homo sapien
aatgtattccaccaaatgacgaagc

SEQ ID NO: 205449 - DNA, 25 bp, Homo sapien
gacgaagcaaaccaagaacagagaa

SEQ ID NO: 205450 - DNA, 25 bp, Homo sapien
tagaaaatgggctccaacacgggaa

SEQ ID NO: 205451 - DNA, 25 bp, Homo sapien
aagggagatcccacgcatcagccac

SEQ ID NO: 205452 - DNA, 25 bp, Homo sapien
gcatcagccacacagtaggtcttgt

SEQ ID NO: 205453 - DNA, 25 bp, Homo sapien
ggtcttgtgggcattcagtctagcc

SEQ ID NO: 205454 - DNA, 25 bp, Homo sapien
gaggtgtctcggaagaaatcaatta

SEQ ID NO: 205455 - DNA, 25 bp, Homo sapien
tctcactccccgaggatggccagtg

SEQ ID NO: 205456 - DNA, 25 bp, Homo sapien
aaatgaaggcagaggtcaccaaact

SEQ ID NO: 205457 - DNA, 25 bp, Homo sapien
gaaggcagaggtcaccaaactacat

SEQ ID NO: 205458 - DNA, 25 bp, Homo sapien
gcagaggtcaccaaactacataaaa

SEQ ID NO: 205459 - DNA, 25 bp, Homo sapien
gaggtcaccaaactacataaaaaat

SEQ ID NO: 205460 - DNA, 25 bp, Homo sapien
gcttttgcagctgagcaagcgccag

SEQ ID NO: 205461 - DNA, 25 bp, Homo sapien
tgcagctgagcaagcgccaggaaaa

SEQ ID NO: 205462 - DNA, 25 bp, Homo sapien
agcaagcgccaggaaaaagtcatct

SEQ ID NO: 205463 - DNA, 25 bp, Homo sapien
agaggaaacctggagcttaggcctg

SEQ ID NO: 205464 - DNA, 25 bp, Homo sapien
ggagcccatccaggaacatgcagtc

SEQ ID NO: 205465 - DNA, 25 bp, Homo sapien
tccaggaacatgcagtcccagcaga

SEQ ID NO: 205466 - DNA, 25 bp, Homo sapien
gtagaaaattaagagatggtggccc

SEQ ID NO: 205467 - DNA, 25 bp, Homo sapien
tgcagttgaaacttcagacagggtt

SEQ ID NO: 205468 - DNA, 25 bp, Homo sapien
acagggttgataaagtgaggacgat

SEQ ID NO: 205469 - DNA, 25 bp, Homo sapien
ggacgatcatagacatggagtactt

SEQ ID NO: 205470 - DNA, 25 bp, Homo sapien
gacatggagtacttagacatattaa

SEQ ID NO: 205471 - DNA, 25 bp, Homo sapien
tttacctgtctaatggaaaacctgg

SEQ ID NO: 205472 - DNA, 25 bp, Homo sapien
aacctggagaagtcgtcaggaacca

SEQ ID NO: 205473 - DNA, 25 bp, Homo sapien
gtcgtcaggaaccagactacagtgg

SEQ ID NO: 205474 - DNA, 25 bp, Homo sapien
gaaccagactacagtggaccctgga

SEQ ID NO: 205475 - DNA, 25 bp, Homo sapien
gagaaccttgaagaacatttttcct

SEQ ID NO: 205476 - DNA, 25 bp, Homo sapien
atgatgctacagtaatgtatttctg

SEQ ID NO: 205477 - DNA, 25 bp, Homo sapien
tggcagaacccatcttaatgacaag

SEQ ID NO: 205478 - DNA, 25 bp, Homo sapien
catcttaatgacaagtatggctatt

SEQ ID NO: 205479 - DNA, 25 bp, Homo sapien
atggctattgattgcttcagaatcc

SEQ ID NO: 205480 - DNA, 25 bp, Homo sapien
aagaaaaccttgtggaccatgtgac

SEQ ID NO: 205481 - DNA, 25 bp, Homo sapien
catgtgacatggaatatttgggata

SEQ ID NO: 205482 - DNA, 25 bp, Homo sapien
gtatcaaattgaatggccagagaag

SEQ ID NO: 205483 - DNA, 25 bp, Homo sapien
gaatggccagagaagtttagatgat

SEQ ID NO: 205484 - DNA, 25 bp, Homo sapien
tatttgtaagatctggtgactggct

SEQ ID NO: 205485 - DNA, 25 bp, Homo sapien
agatctggtgactggcttttcgttc

SEQ ID NO: 205486 - DNA, 25 bp, Homo sapien
actggcttttcgttctgtgttcttg

SEQ ID NO: 205487 - DNA, 25 bp, Homo sapien
ttggcttcctaaatttatctgccca

SEQ ID NO: 205488 - DNA, 25 bp, Homo sapien
tggccaggaccagcgcaaggaggaa

SEQ ID NO: 205489 - DNA, 25 bp, Homo sapien
aggaggaaggcatgcgggccgtcct

SEQ ID NO: 205490 - DNA, 25 bp, Homo sapien
tcctggacgcgctactggccagcaa

SEQ ID NO: 205491 - DNA, 25 bp, Homo sapien
tactggccagcaagcagcattggga

SEQ ID NO: 205492 - DNA, 25 bp, Homo sapien
gcaagcagcattgggaccgtgacct

SEQ ID NO: 205493 - DNA, 25 bp, Homo sapien
attgggaccgtgacctgcaggtgac

SEQ ID NO: 205494 - DNA, 25 bp, Homo sapien
accgtgacctgcaggtgaccctgat

SEQ ID NO: 205495 - DNA, 25 bp, Homo sapien
tgatccccactttcgactcggtggc

SEQ ID NO: 205496 - DNA, 25 bp, Homo sapien
actttcgactcggtggccatgcata

SEQ ID NO: 205497 - DNA, 25 bp, Homo sapien
atacgtggtacgcagagacgcacgc

SEQ ID NO: 205498 - DNA, 25 bp, Homo sapien
tggtacgcagagacgcacgcccggc

SEQ ID NO: 205499 - DNA, 25 bp, Homo sapien
ttatatccatggaaagactttctca

SEQ ID NO: 205500 - DNA, 25 bp, Homo sapien
aagactttctcattcacacatggag

SEQ ID NO: 205501 - DNA, 25 bp, Homo sapien
ataatgatgccttttgcattactgt

SEQ ID NO: 205502 - DNA, 25 bp, Homo sapien
tgcattactgtatgtcttctgcctc

SEQ ID NO: 205503 - DNA, 25 bp, Homo sapien
tccacacttgcttgcccagagatat

SEQ ID NO: 205504 - DNA, 25 bp, Homo sapien
acttgcttgcccagagatatggtgg

SEQ ID NO: 205505 - DNA, 25 bp, Homo sapien
atcctccctgcactgttcagtgtct

SEQ ID NO: 205506 - DNA, 25 bp, Homo sapien
agtgtctcctttgacagtccctgct

SEQ ID NO: 205507 - DNA, 25 bp, Homo sapien
tttgacagtccctgcttctagcgca

SEQ ID NO: 205508 - DNA, 25 bp, Homo sapien
ctagcgcacgcttgttcataaaatg

SEQ ID NO: 205509 - DNA, 25 bp, Homo sapien
atttgttctctctctcgtgttcttt

SEQ ID NO: 205510 - DNA, 25 bp, Homo sapien
tgtactctcacccagtttgtatctg

SEQ ID NO: 205511 - DNA, 25 bp, Homo sapien
ctactttgcagtacgagccaaggat

SEQ ID NO: 205512 - DNA, 25 bp, Homo sapien
gacgttttgggcctttctgtgatcc

SEQ ID NO: 205513 - DNA, 25 bp, Homo sapien
tgtgatcctcagtcaacagatgtga

SEQ ID NO: 205514 - DNA, 25 bp, Homo sapien
aacagatgtgatctcttctacccag

SEQ ID NO: 205515 - DNA, 25 bp, Homo sapien
tgatctcttctacccagagcagtta

SEQ ID NO: 205516 - DNA, 25 bp, Homo sapien
gagcagttaaaccttggagccttta

SEQ ID NO: 205517 - DNA, 25 bp, Homo sapien
tggagcctttatattttcctctttt

SEQ ID NO: 205518 - DNA, 25 bp, Homo sapien
tttaatcttgtgcatgataccccat

SEQ ID NO: 205519 - DNA, 25 bp, Homo sapien
taccccatgtaaaatccaccttgtg

SEQ ID NO: 205520 - DNA, 25 bp, Homo sapien
tccaccttgtgcaagatttcttgga

SEQ ID NO: 205521 - DNA, 25 bp, Homo sapien
gagctgcttctgcagggagttttct

SEQ ID NO: 205522 - DNA, 25 bp, Homo sapien
gagttttctggaatggcgtggcaca

SEQ ID NO: 205523 - DNA, 25 bp, Homo sapien
ggcgtggcacatattgaagcatttc

SEQ ID NO: 205524 - DNA, 25 bp, Homo sapien
gaagcatttctcagtgtcccgttca

SEQ ID NO: 205525 - DNA, 25 bp, Homo sapien
gtcccgttcacggaagcgcaggcag

SEQ ID NO: 205526 - DNA, 25 bp, Homo sapien
acgacacacggagagactgactgat

SEQ ID NO: 205527 - DNA, 25 bp, Homo sapien
gactgactgatacgagatttggaaa

SEQ ID NO: 205528 - DNA, 25 bp, Homo sapien
gtagacatctttggagctcttactg

SEQ ID NO: 205529 - DNA, 25 bp, Homo sapien
ggagctcttactgtcctaaactgta

SEQ ID NO: 205530 - DNA, 25 bp, Homo sapien
gtcctaaactgtacagctgtgctta

SEQ ID NO: 205531 - DNA, 25 bp, Homo sapien
catataaatggccttaagttttcta

SEQ ID NO: 205532 - DNA, 25 bp, Homo sapien
ttttgtgcttaataatagtacttct

SEQ ID NO: 205533 - DNA, 25 bp, Homo sapien
tagtacttctatgctttaaacaaac

SEQ ID NO: 205534 - DNA, 25 bp, Homo sapien
cttggttgcattcttggacagacag

SEQ ID NO: 205535 - DNA, 25 bp, Homo sapien
ttgcattcttggacagacagctctg

SEQ ID NO: 205536 - DNA, 25 bp, Homo sapien
tggacagacagctctggcatccgat

SEQ ID NO: 205537 - DNA, 25 bp, Homo sapien
ctggcatccgatgaagtgatcttag

SEQ ID NO: 205538 - DNA, 25 bp, Homo sapien
gaagtgatcttagttgtctgctcat

SEQ ID NO: 205539 - DNA, 25 bp, Homo sapien
gatcttagttgtctgctcatttatt

SEQ ID NO: 205540 - DNA, 25 bp, Homo sapien
agacagttgttaggcagttgttgca

SEQ ID NO: 205541 - DNA, 25 bp, Homo sapien
ttgcaaatagatgatgtagctgtac

SEQ ID NO: 205542 - DNA, 25 bp, Homo sapien
gtatgctctggaatgagtcactttt

SEQ ID NO: 205543 - DNA, 25 bp, Homo sapien
ttttgtaacaccagctgaggagaaa

SEQ ID NO: 205544 - DNA, 25 bp, Homo sapien
taacaccagctgaggagaaaccaat

SEQ ID NO: 205545 - DNA, 25 bp, Homo sapien
caccagctgaggagaaaccaataga

SEQ ID NO: 205546 - DNA, 25 bp, Homo sapien
gaaaccaatagaaatacagtgggta

SEQ ID NO: 205547 - DNA, 25 bp, Homo sapien
taaaaccagagccaaaagttgattt

SEQ ID NO: 205548 - DNA, 25 bp, Homo sapien
accagagccaaaagttgatttgaaa

SEQ ID NO: 205549 - DNA, 25 bp, Homo sapien
aacagaggatggacagtgggaaaac

SEQ ID NO: 205550 - DNA, 25 bp, Homo sapien
attatctaatactatcttacgtcta

SEQ ID NO: 205551 - DNA, 25 bp, Homo sapien
ctatcttacgtctaattagtgtagc

SEQ ID NO: 205552 - DNA, 25 bp, Homo sapien
tacgtctaattagtgtagcatttac

SEQ ID NO: 205553 - DNA, 25 bp, Homo sapien
gtctaattagtgtagcatttacaag

SEQ ID NO: 205554 - DNA, 25 bp, Homo sapien
gtacggacagacataatacttgctt

SEQ ID NO: 205555 - DNA, 25 bp, Homo sapien
ataatacttgcttctgagcctccca

SEQ ID NO: 205556 - DNA, 25 bp, Homo sapien
ttctgagcctcccagtctttcaaaa

SEQ ID NO: 205557 - DNA, 25 bp, Homo sapien
ctcccagtctttcaaaaccacatta

SEQ ID NO: 205558 - DNA, 25 bp, Homo sapien
cagtctttcaaaaccacattaggga

SEQ ID NO: 205559 - DNA, 25 bp, Homo sapien
accacattagggaataagcagtatt

SEQ ID NO: 205560 - DNA, 25 bp, Homo sapien
agcagtatttgcatggttccagtga

SEQ ID NO: 205561 - DNA, 25 bp, Homo sapien
catggttccagtgatatctgggagt

SEQ ID NO: 205562 - DNA, 25 bp, Homo sapien
gtaattatagttcacctttatacac

SEQ ID NO: 205563 - DNA, 25 bp, Homo sapien
tcacctttatacacacgttaacaga

SEQ ID NO: 205564 - DNA, 25 bp, Homo sapien
atacacacgttaacagaaatcatct

SEQ ID NO: 205565 - DNA, 25 bp, Homo sapien
cacagggagaggatggttgtccctg

SEQ ID NO: 205566 - DNA, 25 bp, Homo sapien
cagcctgtctcttgtagcttcctgg

SEQ ID NO: 205567 - DNA, 25 bp, Homo sapien
agcctgtctcttgtagcttcctggg

SEQ ID NO: 205568 - DNA, 25 bp, Homo sapien
ctgtctcttgtagcttcctggggtg

SEQ ID NO: 205569 - DNA, 25 bp, Homo sapien
tctcttgtagcttcctggggtggga

SEQ ID NO: 205570 - DNA, 25 bp, Homo sapien
gggcaaagcaataccccagggaaag

SEQ ID NO: 205571 - DNA, 25 bp, Homo sapien
ggcaaagcaataccccagggaaagt

SEQ ID NO: 205572 - DNA, 25 bp, Homo sapien
gcaaagcaataccccagggaaagtg

SEQ ID NO: 205573 - DNA, 25 bp, Homo sapien
caaagcaataccccagggaaagtgg

SEQ ID NO: 205574 - DNA, 25 bp, Homo sapien
caccatgctgggagaggcggccaga

SEQ ID NO: 205575 - DNA, 25 bp, Homo sapien
ctgggagaggcggccagagcctggg

SEQ ID NO: 205576 - DNA, 25 bp, Homo sapien
tctctccccgtggtgaatggatcta

SEQ ID NO: 205577 - DNA, 25 bp, Homo sapien
ccccgtggtgaatggatctactgtg

SEQ ID NO: 205578 - DNA, 25 bp, Homo sapien
gaggactttgtgctctactgtttca

SEQ ID NO: 205579 - DNA, 25 bp, Homo sapien
gactttgtgctctactgtttcagta

SEQ ID NO: 205580 - DNA, 25 bp, Homo sapien
gtgctctactgtttcagtacagtca

SEQ ID NO: 205581 - DNA, 25 bp, Homo sapien
gagagaactttgacagtgcacgaga

SEQ ID NO: 205582 - DNA, 25 bp, Homo sapien
ctttgacagtgcacgagaaggatgt

SEQ ID NO: 205583 - DNA, 25 bp, Homo sapien
gattggtattgcacatcaccctcat

SEQ ID NO: 205584 - DNA, 25 bp, Homo sapien
gtattgcacatcaccctcatcagaa

SEQ ID NO: 205585 - DNA, 25 bp, Homo sapien
gctctggaaaccataattcaacttt

SEQ ID NO: 205586 - DNA, 25 bp, Homo sapien
aaatcagctcgaaagcatgtactta

SEQ ID NO: 205587 - DNA, 25 bp, Homo sapien
tgttgaatttcatcccaagtgtaaa

SEQ ID NO: 205588 - DNA, 25 bp, Homo sapien
atttcatcccaagtgtaaatcattc

SEQ ID NO: 205589 - DNA, 25 bp, Homo sapien
tcattctataatggctgtgtctgtt

SEQ ID NO: 205590 - DNA, 25 bp, Homo sapien
ggctgtgtctgttatagtatattac

SEQ ID NO: 205591 - DNA, 25 bp, Homo sapien
gtaactgcatgtgtcaccaagtgtt

SEQ ID NO: 205592 - DNA, 25 bp, Homo sapien
gtcaccaagtgttctatatcaggct

SEQ ID NO: 205593 - DNA, 25 bp, Homo sapien
caagtgttctatatcaggctaggat

SEQ ID NO: 205594 - DNA, 25 bp, Homo sapien
caggctaggataacctagaggcagt

SEQ ID NO: 205595 - DNA, 25 bp, Homo sapien
taaactctcatgataaacctatttt

SEQ ID NO: 205596 - DNA, 25 bp, Homo sapien
acctattttttccatcatcagcctt

SEQ ID NO: 205597 - DNA, 25 bp, Homo sapien
tttttccatcatcagccttttcaag

SEQ ID NO: 205598 - DNA, 25 bp, Homo sapien
gaggtcatctttacagccttatgca

SEQ ID NO: 205599 - DNA, 25 bp, Homo sapien
gccttatgcaaaaagagctcgtcag

SEQ ID NO: 205600 - DNA, 25 bp, Homo sapien
aaaagagctcgtcaggagttcccct

SEQ ID NO: 205601 - DNA, 25 bp, Homo sapien
gaagagtacaggtcagcgctgcata

SEQ ID NO: 205602 - DNA, 25 bp, Homo sapien
caggtcagcgctgcatacaatagca

SEQ ID NO: 205603 - DNA, 25 bp, Homo sapien
gagtcactactccaaaagggtcctg

SEQ ID NO: 205604 - DNA, 25 bp, Homo sapien
gctccagcctggctttcaatggaaa

SEQ ID NO: 205605 - DNA, 25 bp, Homo sapien
ttcaatggaaatggaggcgctccaa

SEQ ID NO: 205606 - DNA, 25 bp, Homo sapien
aaaacgttacatacatactctaggg

SEQ ID NO: 205607 - DNA, 25 bp, Homo sapien
acatactctagggtgaaacttatca

SEQ ID NO: 205608 - DNA, 25 bp, Homo sapien
gggtgaaacttatcactaggcagaa

SEQ ID NO: 205609 - DNA, 25 bp, Homo sapien
ggctgagatggcagtgcacacaccc

SEQ ID NO: 205610 - DNA, 25 bp, Homo sapien
ggacctgagaatgcgtgtggcctgc

SEQ ID NO: 205611 - DNA, 25 bp, Homo sapien
gtgtggcctgctgtcctcgatagac

SEQ ID NO: 205612 - DNA, 25 bp, Homo sapien
tgctgtcctcgatagaccggaatgg

SEQ ID NO: 205613 - DNA, 25 bp, Homo sapien
caccccagagccagaaatcgaaggt

SEQ ID NO: 205614 - DNA, 25 bp, Homo sapien
atcgaaggtcacaggaagttgtcac

SEQ ID NO: 205615 - DNA, 25 bp, Homo sapien
gaagttgtcactgaacttggcccgt

SEQ ID NO: 205616 - DNA, 25 bp, Homo sapien
tgaacttggcccgtgtctgctactc

SEQ ID NO: 205617 - DNA, 25 bp, Homo sapien
tctgctactctgtaccttgctggta

SEQ ID NO: 205618 - DNA, 25 bp, Homo sapien
caggctctatgagtgggcccctagt

SEQ ID NO: 205619 - DNA, 25 bp, Homo sapien
gagtgggcccctagtgtcagctctg

SEQ ID NO: 205620 - DNA, 25 bp, Homo sapien
ggctgctacattgtgtaaagaactg

SEQ ID NO: 205621 - DNA, 25 bp, Homo sapien
gtgtaaagaactgggcttagcctat

SEQ ID NO: 205622 - DNA, 25 bp, Homo sapien
ctgggcttagcctatcaaatggtct

SEQ ID NO: 205623 - DNA, 25 bp, Homo sapien
tagcctatcaaatggtctgtggact

SEQ ID NO: 205624 - DNA, 25 bp, Homo sapien
tgaaactttcacagatctcagcttt

SEQ ID NO: 205625 - DNA, 25 bp, Homo sapien
gatctcagctttcatctgatgtcac

SEQ ID NO: 205626 - DNA, 25 bp, Homo sapien
ctgatgtcacttttcatgatcttct

SEQ ID NO: 205627 - DNA, 25 bp, Homo sapien
ccccttaacctggtctgaagttctg

SEQ ID NO: 205628 - DNA, 25 bp, Homo sapien
acctggtctgaagttctgggatgtt

SEQ ID NO: 205629 - DNA, 25 bp, Homo sapien
gatcagtctgatactcagtggcact

SEQ ID NO: 205630 - DNA, 25 bp, Homo sapien
gtggcactttattaaaacatcagct

SEQ ID NO: 205631 - DNA, 25 bp, Homo sapien
gcagagttagatatgcacatacatg

SEQ ID NO: 205632 - DNA, 25 bp, Homo sapien
gtggtataagcacatgtacagagga

SEQ ID NO: 205633 - DNA, 25 bp, Homo sapien
tacagaggagtacacatagcatata

SEQ ID NO: 205634 - DNA, 25 bp, Homo sapien
agcatataaacatgtctgtagcaca

SEQ ID NO: 205635 - DNA, 25 bp, Homo sapien
catgtctgtagcacatatatattct

SEQ ID NO: 205636 - DNA, 25 bp, Homo sapien
ggtagcaaaccaaccacacactgtt

SEQ ID NO: 205637 - DNA, 25 bp, Homo sapien
tgctctgtttgcttgatacatcttg

SEQ ID NO: 205638 - DNA, 25 bp, Homo sapien
gatacatcttgtaagtggctcctaa

SEQ ID NO: 205639 - DNA, 25 bp, Homo sapien
agtggctcctaattactatgtaaag

SEQ ID NO: 205640 - DNA, 25 bp, Homo sapien
gttgaaatcatcaatattcccatca

SEQ ID NO: 205641 - DNA, 25 bp, Homo sapien
attcccatcattatggtgtgttctt

SEQ ID NO: 205642 - DNA, 25 bp, Homo sapien
ggtggagtttgcaaccgtcaaggca

SEQ ID NO: 205643 - DNA, 25 bp, Homo sapien
ttgcaaccgtcaaggcagcggagct

SEQ ID NO: 205644 - DNA, 25 bp, Homo sapien
agcggagctggctgtccagaatgaa

SEQ ID NO: 205645 - DNA, 25 bp, Homo sapien
gcctggtggataaccctctgaagat

SEQ ID NO: 205646 - DNA, 25 bp, Homo sapien
gataaccctctgaagatttcctggt

SEQ ID NO: 205647 - DNA, 25 bp, Homo sapien
tttcctggttggagggacagcccca

SEQ ID NO: 205648 - DNA, 25 bp, Homo sapien
gccgcagccactcaggactgtcaaa

SEQ ID NO: 205649 - DNA, 25 bp, Homo sapien
tgtcaaagggctcagtgctgtcaga

SEQ ID NO: 205650 - DNA, 25 bp, Homo sapien
acgagagcctcgtcatgatgcgcat

SEQ ID NO: 205651 - DNA, 25 bp, Homo sapien
agcggcaacagctgatcgcacggat

SEQ ID NO: 205652 - DNA, 25 bp, Homo sapien
atcgcacggatgcagcaggaagacc

SEQ ID NO: 205653 - DNA, 25 bp, Homo sapien
accctgggccgcatgcactattact

SEQ ID NO: 205654 - DNA, 25 bp, Homo sapien
ccctgggccgcatgcactattactg

SEQ ID NO: 205655 - DNA, 25 bp, Homo sapien
acatgagctcagagctaccccacac

SEQ ID NO: 205656 - DNA, 25 bp, Homo sapien
tgagctcagagctaccccacacctt

SEQ ID NO: 205657 - DNA, 25 bp, Homo sapien
agagctaccccacaccttcggactg

SEQ ID NO: 205658 - DNA, 25 bp, Homo sapien
ctcccaggtgctactgggcgtggac

SEQ ID NO: 205659 - DNA, 25 bp, Homo sapien
ccaggtgctactgggcgtggaccgc

SEQ ID NO: 205660 - DNA, 25 bp, Homo sapien
gtgctactgggcgtggaccgccacc

SEQ ID NO: 205661 - DNA, 25 bp, Homo sapien
gcgtggaccgccaccccctgagagg

SEQ ID NO: 205662 - DNA, 25 bp, Homo sapien
cagtcctgccagaagaccccggggg

SEQ ID NO: 205663 - DNA, 25 bp, Homo sapien
gggggcagcatgcagggtccccact

SEQ ID NO: 205664 - DNA, 25 bp, Homo sapien
ctgtgtcagatgatatgtccttgaa

SEQ ID NO: 205665 - DNA, 25 bp, Homo sapien
gatgatatgtccttgaagctggcag

SEQ ID NO: 205666 - DNA, 25 bp, Homo sapien
gggattcccagtccagggaatatcc

SEQ ID NO: 205667 - DNA, 25 bp, Homo sapien
gggaatatccctacatgatttttgt

SEQ ID NO: 205668 - DNA, 25 bp, Homo sapien
ttttgtcattcatgggtcctccctg

SEQ ID NO: 205669 - DNA, 25 bp, Homo sapien
gccctagtcctaggcgacttgaata

SEQ ID NO: 205670 - DNA, 25 bp, Homo sapien
gaggtcaaacatgggccttcggcat

SEQ ID NO: 205671 - DNA, 25 bp, Homo sapien
ttcggcattgggtttctagggaata

SEQ ID NO: 205672 - DNA, 25 bp, Homo sapien
gaatatggctcagtagggcctgccc

SEQ ID NO: 205673 - DNA, 25 bp, Homo sapien
gggcctgccccttcaagggcagcaa

SEQ ID NO: 205674 - DNA, 25 bp, Homo sapien
gaagcaggatgttgtcactcccgtc

SEQ ID NO: 205675 - DNA, 25 bp, Homo sapien
gaagtctgtgactaccttgtcacta

SEQ ID NO: 205676 - DNA, 25 bp, Homo sapien
ttgtcactactttaggcccattcca

SEQ ID NO: 205677 - DNA, 25 bp, Homo sapien
acaaagcccatctctggtttgagaa

SEQ ID NO: 205678 - DNA, 25 bp, Homo sapien
tttgatctgtatctacaccacccaa

SEQ ID NO: 205679 - DNA, 25 bp, Homo sapien
gtatctacaccacccaaagttaggc

SEQ ID NO: 205680 - DNA, 25 bp, Homo sapien
gttaggcctcctataatgtccaaaa

SEQ ID NO: 205681 - DNA, 25 bp, Homo sapien
ctttcagcctttttatttcttactg

SEQ ID NO: 205682 - DNA, 25 bp, Homo sapien
tcttactgtactgtctatctgcagt

SEQ ID NO: 205683 - DNA, 25 bp, Homo sapien
tatctgcagtaattgaggacccata

SEQ ID NO: 205684 - DNA, 25 bp, Homo sapien
gataactacatgtctttgctcttag

SEQ ID NO: 205685 - DNA, 25 bp, Homo sapien
ctcttagaattgtcactcagcataa

SEQ ID NO: 205686 - DNA, 25 bp, Homo sapien
ctgaatcacattggcttatataata

SEQ ID NO: 205687 - DNA, 25 bp, Homo sapien
gaatcacattggcttatataataac

SEQ ID NO: 205688 - DNA, 25 bp, Homo sapien
aatcacattggcttatataataaca

SEQ ID NO: 205689 - DNA, 25 bp, Homo sapien
atcacattggcttatataataacaa

SEQ ID NO: 205690 - DNA, 25 bp, Homo sapien
ttccaaaccatcaatgtgggttgta

SEQ ID NO: 205691 - DNA, 25 bp, Homo sapien
tccaaaccatcaatgtgggttgtat

SEQ ID NO: 205692 - DNA, 25 bp, Homo sapien
ccaaaccatcaatgtgggttgtata

SEQ ID NO: 205693 - DNA, 25 bp, Homo sapien
caaaccatcaatgtgggttgtatat

SEQ ID NO: 205694 - DNA, 25 bp, Homo sapien
aaaccatcaatgtgggttgtatata

SEQ ID NO: 205695 - DNA, 25 bp, Homo sapien
agatttcaaggtgtgaaattctcag

SEQ ID NO: 205696 - DNA, 25 bp, Homo sapien
gtgaaattctcagtttttttatgtt

SEQ ID NO: 205697 - DNA, 25 bp, Homo sapien
agctcagggcggtcgagtgcagtgg

SEQ ID NO: 205698 - DNA, 25 bp, Homo sapien
gtggtggatggcacctgtagtctta

SEQ ID NO: 205699 - DNA, 25 bp, Homo sapien
ctccagcccgggttacagtgtgagg

SEQ ID NO: 205700 - DNA, 25 bp, Homo sapien
tccagcccgggttacagtgtgaggc

SEQ ID NO: 205701 - DNA, 25 bp, Homo sapien
ccagcccgggttacagtgtgaggct

SEQ ID NO: 205702 - DNA, 25 bp, Homo sapien
agcccgggttacagtgtgaggcttt

SEQ ID NO: 205703 - DNA, 25 bp, Homo sapien
cccgggttacagtgtgaggctttct

SEQ ID NO: 205704 - DNA, 25 bp, Homo sapien
ccgggttacagtgtgaggctttcta

SEQ ID NO: 205705 - DNA, 25 bp, Homo sapien
cgggttacagtgtgaggctttctaa

SEQ ID NO: 205706 - DNA, 25 bp, Homo sapien
gggttacagtgtgaggctttctaaa

SEQ ID NO: 205707 - DNA, 25 bp, Homo sapien
ggttacagtgtgaggctttctaaaa

SEQ ID NO: 205708 - DNA, 25 bp, Homo sapien
gaaattatatcccatttagttaaat

SEQ ID NO: 205709 - DNA, 25 bp, Homo sapien
tattcagaacaacctactatgtagc

SEQ ID NO: 205710 - DNA, 25 bp, Homo sapien
gaacaacctactatgtagcgtttat

SEQ ID NO: 205711 - DNA, 25 bp, Homo sapien
gtagcgtttattttactgaatgtgg

SEQ ID NO: 205712 - DNA, 25 bp, Homo sapien
ttaaacactgaggtttctgttcaaa

SEQ ID NO: 205713 - DNA, 25 bp, Homo sapien
ctgttcaaactgtgagttctgttct

SEQ ID NO: 205714 - DNA, 25 bp, Homo sapien
gttctgagtaaacaaatattgctat

SEQ ID NO: 205715 - DNA, 25 bp, Homo sapien
atattgctatgggagttatcttttt

SEQ ID NO: 205716 - DNA, 25 bp, Homo sapien
gatttagaataactgttccaatgat

SEQ ID NO: 205717 - DNA, 25 bp, Homo sapien
aagtacactaagatcgttgaagagc

SEQ ID NO: 205718 - DNA, 25 bp, Homo sapien
gatcgttgaagagcaatagaacctt

SEQ ID NO: 205719 - DNA, 25 bp, Homo sapien
taattttcattttaggagcttgact

SEQ ID NO: 205720 - DNA, 25 bp, Homo sapien
cattttaggagcttgacttattttt

SEQ ID NO: 205721 - DNA, 25 bp, Homo sapien
gtaggagaaattttctcagcatttt

SEQ ID NO: 205722 - DNA, 25 bp, Homo sapien
ttttgcatgttctttctaatctttg

SEQ ID NO: 205723 - DNA, 25 bp, Homo sapien
acaaaaagcatatccgttcaaaaat

SEQ ID NO: 205724 - DNA, 25 bp, Homo sapien
gtggctactgttttagttttctagt

SEQ ID NO: 205725 - DNA, 25 bp, Homo sapien
gttttctagttgaatatctctgaca

SEQ ID NO: 205726 - DNA, 25 bp, Homo sapien
gaatatctctgacaagctttcgtat

SEQ ID NO: 205727 - DNA, 25 bp, Homo sapien
tatctctgacaagctttcgtatggt

SEQ ID NO: 205728 - DNA, 25 bp, Homo sapien
ctctgacaagctttcgtatggtttt

SEQ ID NO: 205729 - DNA, 25 bp, Homo sapien
caagctttcgtatggttttgttata

SEQ ID NO: 205730 - DNA, 25 bp, Homo sapien
agtcaccttggctacccactgtgga

SEQ ID NO: 205731 - DNA, 25 bp, Homo sapien
actgtggacagctgtctgtcagcat

SEQ ID NO: 205732 - DNA, 25 bp, Homo sapien
tgtcagcatgcagagggatccagga

SEQ ID NO: 205733 - DNA, 25 bp, Homo sapien
ggccagccagataagtcagggtcct

SEQ ID NO: 205734 - DNA, 25 bp, Homo sapien
gaaaggctaggaccatgtcctcatt

SEQ ID NO: 205735 - DNA, 25 bp, Homo sapien
gaccatgtcctcattgacccagata

SEQ ID NO: 205736 - DNA, 25 bp, Homo sapien
ttgacccagatactgctgtgtgctg

SEQ ID NO: 205737 - DNA, 25 bp, Homo sapien
gctgcacagcagtgaaccaacacta

SEQ ID NO: 205738 - DNA, 25 bp, Homo sapien
aacactagagggagccacacaagcc

SEQ ID NO: 205739 - DNA, 25 bp, Homo sapien
ttcctggctttaactcttgagctgg

SEQ ID NO: 205740 - DNA, 25 bp, Homo sapien
gctttaactcttgagctggtttggg

SEQ ID NO: 205741 - DNA, 25 bp, Homo sapien
gggcaaaacacttgaggtcagacgt

SEQ ID NO: 205742 - DNA, 25 bp, Homo sapien
ggcaaaacacttgaggtcagacgtt

SEQ ID NO: 205743 - DNA, 25 bp, Homo sapien
gcaaaacacttgaggtcagacgttt

SEQ ID NO: 205744 - DNA, 25 bp, Homo sapien
caaaacacttgaggtcagacgtttg

SEQ ID NO: 205745 - DNA, 25 bp, Homo sapien
aaaacacttgaggtcagacgtttga

SEQ ID NO: 205746 - DNA, 25 bp, Homo sapien
ggaagctagagcacgagaattatgt

SEQ ID NO: 205747 - DNA, 25 bp, Homo sapien
gaagctagagcacgagaattatgtg

SEQ ID NO: 205748 - DNA, 25 bp, Homo sapien
aagctagagcacgagaattatgtgc

SEQ ID NO: 205749 - DNA, 25 bp, Homo sapien
gctagagcacgagaattatgtgcat

SEQ ID NO: 205750 - DNA, 25 bp, Homo sapien
tagagcacgagaattatgtgcatcc

SEQ ID NO: 205751 - DNA, 25 bp, Homo sapien
agagcacgagaattatgtgcatcct

SEQ ID NO: 205752 - DNA, 25 bp, Homo sapien
cagtggatttctttgagctaggaga

SEQ ID NO: 205753 - DNA, 25 bp, Homo sapien
tgagctaggagaataagagtctgga

SEQ ID NO: 205754 - DNA, 25 bp, Homo sapien
gagtctggagactgggagccttcac

SEQ ID NO: 205755 - DNA, 25 bp, Homo sapien
agtctggagactgggagccttcact

SEQ ID NO: 205756 - DNA, 25 bp, Homo sapien
gggagccttcacttcggcctccgat

SEQ ID NO: 205757 - DNA, 25 bp, Homo sapien
ttcacttcggcctccgattggtggc

SEQ ID NO: 205758 - DNA, 25 bp, Homo sapien
ttcggcctccgattggtggcgcata

SEQ ID NO: 205759 - DNA, 25 bp, Homo sapien
tcggcctccgattggtggcgcatag

SEQ ID NO: 205760 - DNA, 25 bp, Homo sapien
attggtggcgcatagggtgtaacca

SEQ ID NO: 205761 - DNA, 25 bp, Homo sapien
tacttaaaccccagattttgcaact

SEQ ID NO: 205762 - DNA, 25 bp, Homo sapien
ttaaaccccagattttgcaactggg

SEQ ID NO: 205763 - DNA, 25 bp, Homo sapien
tgaggtcagaagatctagaacagcc

SEQ ID NO: 205764 - DNA, 25 bp, Homo sapien
gaggtcagaagatctagaacagcct

SEQ ID NO: 205765 - DNA, 25 bp, Homo sapien
gtcagaagatctagaacagcctggt

SEQ ID NO: 205766 - DNA, 25 bp, Homo sapien
tcagaagatctagaacagcctggtc

SEQ ID NO: 205767 - DNA, 25 bp, Homo sapien
cagaagatctagaacagcctggtca

SEQ ID NO: 205768 - DNA, 25 bp, Homo sapien
agaagatctagaacagcctggtcaa

SEQ ID NO: 205769 - DNA, 25 bp, Homo sapien
gaagatctagaacagcctggtcaac

SEQ ID NO: 205770 - DNA, 25 bp, Homo sapien
aagatctagaacagcctggtcaaca

SEQ ID NO: 205771 - DNA, 25 bp, Homo sapien
agatctagaacagcctggtcaacat

SEQ ID NO: 205772 - DNA, 25 bp, Homo sapien
tagccaggcttagtggcgggcatct

SEQ ID NO: 205773 - DNA, 25 bp, Homo sapien
agccaggcttagtggcgggcatctg

SEQ ID NO: 205774 - DNA, 25 bp, Homo sapien
ctgaatcacattggcttatataata

SEQ ID NO: 205775 - DNA, 25 bp, Homo sapien
gaatcacattggcttatataataac

SEQ ID NO: 205776 - DNA, 25 bp, Homo sapien
atcacattggcttatataataacaa

SEQ ID NO: 205777 - DNA, 25 bp, Homo sapien
ttccaaaccatcaatgtgggttgta

SEQ ID NO: 205778 - DNA, 25 bp, Homo sapien
ccaaaccatcaatgtgggttgtata

SEQ ID NO: 205779 - DNA, 25 bp, Homo sapien
aaaccatcaatgtgggttgtatata

SEQ ID NO: 205780 - DNA, 25 bp, Homo sapien
agatttcaaggtgtgaaattctcag

SEQ ID NO: 205781 - DNA, 25 bp, Homo sapien
ttcaaggtgtgaaattctcagtttt

SEQ ID NO: 205782 - DNA, 25 bp, Homo sapien
caaggtgtgaaattctcagtttttt

SEQ ID NO: 205783 - DNA, 25 bp, Homo sapien
gtgaaattctcagtttttttatgtt

SEQ ID NO: 205784 - DNA, 25 bp, Homo sapien
caattaatttttggtgctgctattg

SEQ ID NO: 205785 - DNA, 25 bp, Homo sapien
gaggaaggtgtgatgccgtcataca

SEQ ID NO: 205786 - DNA, 25 bp, Homo sapien
gatgccgtcatacagttacaggaaa

SEQ ID NO: 205787 - DNA, 25 bp, Homo sapien
gaacaggtccgaattcttcctgtcg

SEQ ID NO: 205788 - DNA, 25 bp, Homo sapien
ttcctgtcgcgtcactgattttgag

SEQ ID NO: 205789 - DNA, 25 bp, Homo sapien
gcgtcactgattttgaggttctttt

SEQ ID NO: 205790 - DNA, 25 bp, Homo sapien
tgacaataggtgacccacgtggctc

SEQ ID NO: 205791 - DNA, 25 bp, Homo sapien
accaagaagcactttgtgcccagaa

SEQ ID NO: 205792 - DNA, 25 bp, Homo sapien
aaagttcctgaagcatcatcctggc

SEQ ID NO: 205793 - DNA, 25 bp, Homo sapien
gtttgtaatcgccaagcaccagcta

SEQ ID NO: 205794 - DNA, 25 bp, Homo sapien
aagcaccagctataggtcacagcca

SEQ ID NO: 205795 - DNA, 25 bp, Homo sapien
taggtcacagccacatcactcacag

SEQ ID NO: 205796 - DNA, 25 bp, Homo sapien
gtgcaggaacaacttcctagattgc

SEQ ID NO: 205797 - DNA, 25 bp, Homo sapien
acttcctagattgcaagtgctcacg

SEQ ID NO: 205798 - DNA, 25 bp, Homo sapien
gcaagtgctcacgtacaagttatta

SEQ ID NO: 205799 - DNA, 25 bp, Homo sapien
gcattttaggagtagatacatcttt

SEQ ID NO: 205800 - DNA, 25 bp, Homo sapien
agagaggatgcatagaaggctgata

SEQ ID NO: 205801 - DNA, 25 bp, Homo sapien
gaaggctgatagaagacataactga

SEQ ID NO: 205802 - DNA, 25 bp, Homo sapien
gtttgtagggttttaagtcattcat

SEQ ID NO: 205803 - DNA, 25 bp, Homo sapien
taatcactaatcttggttcttttta

SEQ ID NO: 205804 - DNA, 25 bp, Homo sapien
gtttgtaacttggatgctgccgcta

SEQ ID NO: 205805 - DNA, 25 bp, Homo sapien
gatgctgccgctactgaatgtttac

SEQ ID NO: 205806 - DNA, 25 bp, Homo sapien
gaatgtttacaaattgcttgcctgc

SEQ ID NO: 205807 - DNA, 25 bp, Homo sapien
acacttggcctgttagattgttcca

SEQ ID NO: 205808 - DNA, 25 bp, Homo sapien
ctgcatggcactcctgaagaaggga

SEQ ID NO: 205809 - DNA, 25 bp, Homo sapien
aagggagtgggacctgcagtcacca

SEQ ID NO: 205810 - DNA, 25 bp, Homo sapien
gatgagggttaggtgtgcccagccc

SEQ ID NO: 205811 - DNA, 25 bp, Homo sapien
ggcctttctggttaacccctgcatg

SEQ ID NO: 205812 - DNA, 25 bp, Homo sapien
tctggttaacccctgcatgccaagc

SEQ ID NO: 205813 - DNA, 25 bp, Homo sapien
aggtcctcacctcaggcctttgaag

SEQ ID NO: 205814 - DNA, 25 bp, Homo sapien
agcttctggaagttgttttctcctc

SEQ ID NO: 205815 - DNA, 25 bp, Homo sapien
gcttggagagtttgcccttgtctgt

SEQ ID NO: 205816 - DNA, 25 bp, Homo sapien
agtttgcccttgtctgtcttggaaa

SEQ ID NO: 205817 - DNA, 25 bp, Homo sapien
tgtcttggaaagtgtgggcagccac

SEQ ID NO: 205818 - DNA, 25 bp, Homo sapien
aatttcagctttgacccacctaact

SEQ ID NO: 205819 - DNA, 25 bp, Homo sapien
tgacccacctaactccagtgaatag

SEQ ID NO: 205820 - DNA, 25 bp, Homo sapien
taggtggcagctcagaaacaaggac

SEQ ID NO: 205821 - DNA, 25 bp, Homo sapien
cagagcaagctcacatccagctggc

SEQ ID NO: 205822 - DNA, 25 bp, Homo sapien
ttcctgccgggcacgtgtgagttca

SEQ ID NO: 205823 - DNA, 25 bp, Homo sapien
tgagttcagcgtgggcaagagactt

SEQ ID NO: 205824 - DNA, 25 bp, Homo sapien
ggcaagagacttttatgcacattct

SEQ ID NO: 205825 - DNA, 25 bp, Homo sapien
tgcacattctgtcattcaaaaggga

SEQ ID NO: 205826 - DNA, 25 bp, Homo sapien
aagggaaatgatgccaaccccagat

SEQ ID NO: 205827 - DNA, 25 bp, Homo sapien
aaccccagatgcagcatgtcctgaa

SEQ ID NO: 205828 - DNA, 25 bp, Homo sapien
gcatgtcctgaatgaatgatctgta

SEQ ID NO: 205829 - DNA, 25 bp, Homo sapien
ttctgtacaggaagcaatggcaaaa

SEQ ID NO: 205830 - DNA, 25 bp, Homo sapien
gaaagttgtgttcccgagactacag

SEQ ID NO: 205831 - DNA, 25 bp, Homo sapien
ttgtgttcccgagactacaggataa

SEQ ID NO: 205832 - DNA, 25 bp, Homo sapien
gtattcctgaagctggttgaacacc

SEQ ID NO: 205833 - DNA, 25 bp, Homo sapien
gaaggagtatttggcgatcatgaat

SEQ ID NO: 205834 - DNA, 25 bp, Homo sapien
gaatgatgactgaacagggcttgca

SEQ ID NO: 205835 - DNA, 25 bp, Homo sapien
acagggcttgcaggtgctgatgcca

SEQ ID NO: 205836 - DNA, 25 bp, Homo sapien
gctgatgccagaagcttctgtgcca

SEQ ID NO: 205837 - DNA, 25 bp, Homo sapien
gtgccattgcattaaagacttctgt

SEQ ID NO: 205838 - DNA, 25 bp, Homo sapien
atttgatccatgttcaagacccttg

SEQ ID NO: 205839 - DNA, 25 bp, Homo sapien
aagacccttgaggtattgtttcatc

SEQ ID NO: 205840 - DNA, 25 bp, Homo sapien
tgccctctgccgtgctaaaatatca

SEQ ID NO: 205841 - DNA, 25 bp, Homo sapien
gtgctaaaatatcactcatccttaa

SEQ ID NO: 205842 - DNA, 25 bp, Homo sapien
tcttccttgttaccttcaggcagaa

SEQ ID NO: 205843 - DNA, 25 bp, Homo sapien
ttcaggcagaattagttactctttc

SEQ ID NO: 205844 - DNA, 25 bp, Homo sapien
gcaattgttctatatcttcgctcta

SEQ ID NO: 205845 - DNA, 25 bp, Homo sapien
cttcgctctagctcttttcctgttg

SEQ ID NO: 205846 - DNA, 25 bp, Homo sapien
tgtttatgtttaccttccttactag

SEQ ID NO: 205847 - DNA, 25 bp, Homo sapien
tgagctcaagagcaggccgtcttaa

SEQ ID NO: 205848 - DNA, 25 bp, Homo sapien
gagcaggccgtcttaattattcctt

SEQ ID NO: 205849 - DNA, 25 bp, Homo sapien
ttattcctttctgtacccctagtgt

SEQ ID NO: 205850 - DNA, 25 bp, Homo sapien
tagtgtcttttatggttctcagccc

SEQ ID NO: 205851 - DNA, 25 bp, Homo sapien
aagggctgaccttctcccagggtct

SEQ ID NO: 205852 - DNA, 25 bp, Homo sapien
ccccgtggccatctgggtgtttcta

SEQ ID NO: 205853 - DNA, 25 bp, Homo sapien
gtgtttctaaagcaactccccacca

SEQ ID NO: 205854 - DNA, 25 bp, Homo sapien
ccaccaacctcttgggctgtggtga

SEQ ID NO: 205855 - DNA, 25 bp, Homo sapien
gctgtggtgaccaagggctaaaaat

SEQ ID NO: 205856 - DNA, 25 bp, Homo sapien
gggaccctggtatctgacttttgct

SEQ ID NO: 205857 - DNA, 25 bp, Homo sapien
tatctgacttttgctccacttctga

SEQ ID NO: 205858 - DNA, 25 bp, Homo sapien
tctcccgtttcactaggactggaaa

SEQ ID NO: 205859 - DNA, 25 bp, Homo sapien
tccttgtttctctcaaaccaagacc

SEQ ID NO: 205860 - DNA, 25 bp, Homo sapien
gacctcatctacataaaacatctag

SEQ ID NO: 205861 - DNA, 25 bp, Homo sapien
aacatctagggtcaggcccatccac

SEQ ID NO: 205862 - DNA, 25 bp, Homo sapien
ggaaccaaggtgctgatcctaccac

SEQ ID NO: 205863 - DNA, 25 bp, Homo sapien
ttccttagcttcaccctggctagaa

SEQ ID NO: 205864 - DNA, 25 bp, Homo sapien
caccctggctagaaataatcacgag

SEQ ID NO: 205865 - DNA, 25 bp, Homo sapien
taatcacgagggttgggtttgcttt

SEQ ID NO: 205866 - DNA, 25 bp, Homo sapien
agcggactcccaaatttgttggcaa

SEQ ID NO: 205867 - DNA, 25 bp, Homo sapien
cattttaaccttcagcatgggagat

SEQ ID NO: 205868 - DNA, 25 bp, Homo sapien
atgggagatgcatgccctgaagagc

SEQ ID NO: 205869 - DNA, 25 bp, Homo sapien
agatttgtggccagattgccttcat

SEQ ID NO: 205870 - DNA, 25 bp, Homo sapien
agattgccttcatcatttcacctct

SEQ ID NO: 205871 - DNA, 25 bp, Homo sapien
ccagacttccatttcttcacaagga

SEQ ID NO: 205872 - DNA, 25 bp, Homo sapien
atgactggcgtgatgcctggaacca

SEQ ID NO: 205873 - DNA, 25 bp, Homo sapien
aaatttttgcaccattctgttaaag

SEQ ID NO: 205874 - DNA, 25 bp, Homo sapien
cagatgaaataagcccttacctttc

SEQ ID NO: 205875 - DNA, 25 bp, Homo sapien
tcagctgatggttcttatttaaggt

SEQ ID NO: 205876 - DNA, 25 bp, Homo sapien
aaggttttgcattttgttcactatc

SEQ ID NO: 205877 - DNA, 25 bp, Homo sapien
tgcattttgttcactatccactact

SEQ ID NO: 205878 - DNA, 25 bp, Homo sapien
tatccactactgttcgttagccaga

SEQ ID NO: 205879 - DNA, 25 bp, Homo sapien
tgttcgttagccagaaattctctag

SEQ ID NO: 205880 - DNA, 25 bp, Homo sapien
gaaattctctagtgatctgaagcaa

SEQ ID NO: 205881 - DNA, 25 bp, Homo sapien
tctgaagcaatgtgactgaagacca

SEQ ID NO: 205882 - DNA, 25 bp, Homo sapien
ctgaagaccagttttaagttatgtg

SEQ ID NO: 205883 - DNA, 25 bp, Homo sapien
taagttatgtgttggcaagttgcct

SEQ ID NO: 205884 - DNA, 25 bp, Homo sapien
aaaagcacaattcatacttcgggaa

SEQ ID NO: 205885 - DNA, 25 bp, Homo sapien
gcacaattcatacttcgggaatatt

SEQ ID NO: 205886 - DNA, 25 bp, Homo sapien
taccctttgacttttataatcaaca

SEQ ID NO: 205887 - DNA, 25 bp, Homo sapien
tcaacataagttccaggcccagtat

SEQ ID NO: 205888 - DNA, 25 bp, Homo sapien
aagttccaggcccagtatggattta

SEQ ID NO: 205889 - DNA, 25 bp, Homo sapien
ggatttacaaaatctgtgtcagttg

SEQ ID NO: 205890 - DNA, 25 bp, Homo sapien
gtgtcagttgtacattcacaggatc

SEQ ID NO: 205891 - DNA, 25 bp, Homo sapien
gttgtacattcacaggatccacagc

SEQ ID NO: 205892 - DNA, 25 bp, Homo sapien
ggatccacagcttaagttactaatg

SEQ ID NO: 205893 - DNA, 25 bp, Homo sapien
gtttcttgtgtaaaatcctgttggt

SEQ ID NO: 205894 - DNA, 25 bp, Homo sapien
atcctgttggtagtaatagtaaagc

SEQ ID NO: 205895 - DNA, 25 bp, Homo sapien
gctgtttcaaagtgtgatatctttc

SEQ ID NO: 205896 - DNA, 25 bp, Homo sapien
gtgtgatatctttcacaatagcctt

SEQ ID NO: 205897 - DNA, 25 bp, Homo sapien
cacaatagcctttttatagtcagta

SEQ ID NO: 205898 - DNA, 25 bp, Homo sapien
gcctttttatagtcagtaattcaga

SEQ ID NO: 205899 - DNA, 25 bp, Homo sapien
ttcagaataatcaagttcatatgga

SEQ ID NO: 205900 - DNA, 25 bp, Homo sapien
gattgttttctatgccatgtatgtg

SEQ ID NO: 205901 - DNA, 25 bp, Homo sapien
tttctatgccatgtatgtgccactt

SEQ ID NO: 205902 - DNA, 25 bp, Homo sapien
tgtatgtgccacttctgagagtagt

SEQ ID NO: 205903 - DNA, 25 bp, Homo sapien
gtgccacttctgagagtagtaaatg

SEQ ID NO: 205904 - DNA, 25 bp, Homo sapien
gagtagtaaatgactctttgctaca

SEQ ID NO: 205905 - DNA, 25 bp, Homo sapien
aatgactctttgctacattttaaaa

SEQ ID NO: 205906 - DNA, 25 bp, Homo sapien
ttacttctttggttgtttagtgaat

SEQ ID NO: 205907 - DNA, 25 bp, Homo sapien
tattttctactgtcatcaaaacata

SEQ ID NO: 205908 - DNA, 25 bp, Homo sapien
gtcatcaaaacatattcccaaaaag

SEQ ID NO: 205909 - DNA, 25 bp, Homo sapien
taaaaaggaaccttagcacatttat

SEQ ID NO: 205910 - DNA, 25 bp, Homo sapien
gtgaataagttataacctagtgtat

SEQ ID NO: 205911 - DNA, 25 bp, Homo sapien
atttctaacaaactacagtatactg

SEQ ID NO: 205912 - DNA, 25 bp, Homo sapien
ctacagtatactgtcttgggttttt

SEQ ID NO: 205913 - DNA, 25 bp, Homo sapien
gaagtagttaagatatgcctgctat

SEQ ID NO: 205914 - DNA, 25 bp, Homo sapien
atgcctgctatctttaactttggag

SEQ ID NO: 205915 - DNA, 25 bp, Homo sapien
gctatctttaactttggaggtagta

SEQ ID NO: 205916 - DNA, 25 bp, Homo sapien
gaggtagtatcaaaattttacttct

SEQ ID NO: 205917 - DNA, 25 bp, Homo sapien
acaaagcacataacttgtcacttta

SEQ ID NO: 205918 - DNA, 25 bp, Homo sapien
ctttttcactgactaataggactca

SEQ ID NO: 205919 - DNA, 25 bp, Homo sapien
taagatcataccttacctaccaagg

SEQ ID NO: 205920 - DNA, 25 bp, Homo sapien
cagagtggcccacagacattgcttt

SEQ ID NO: 205921 - DNA, 25 bp, Homo sapien
tgctttcttatcacctatcatgtga

SEQ ID NO: 205922 - DNA, 25 bp, Homo sapien
gaattctacctgtattccagggctg

SEQ ID NO: 205923 - DNA, 25 bp, Homo sapien
ttccagggctggaccacttgataac

SEQ ID NO: 205924 - DNA, 25 bp, Homo sapien
ggaccacttgataacttccagtgtc

SEQ ID NO: 205925 - DNA, 25 bp, Homo sapien
cttccagtgtcctggcagcttttgg

SEQ ID NO: 205926 - DNA, 25 bp, Homo sapien
cagcttttggaatgacagcagtggt

SEQ ID NO: 205927 - DNA, 25 bp, Homo sapien
acaatgtctgaaaagttgcctagaa

SEQ ID NO: 205928 - DNA, 25 bp, Homo sapien
gctgaagtctcaaatcattgtctgg

SEQ ID NO: 205929 - DNA, 25 bp, Homo sapien
tggaattttcctcaccttggctagc

SEQ ID NO: 205930 - DNA, 25 bp, Homo sapien
acctgctctttgtctaaggcccttg

SEQ ID NO: 205931 - DNA, 25 bp, Homo sapien
aaggcccttgcctcatcagggatta

SEQ ID NO: 205932 - DNA, 25 bp, Homo sapien
agggattagaactggcccatatgcc

SEQ ID NO: 205933 - DNA, 25 bp, Homo sapien
ggcccatatgccagaacctgtacta

SEQ ID NO: 205934 - DNA, 25 bp, Homo sapien
aacctgtactaaatgcctaatttgt

SEQ ID NO: 205935 - DNA, 25 bp, Homo sapien
taatctcttttctatactgctcctt

SEQ ID NO: 205936 - DNA, 25 bp, Homo sapien
atactgctcctttctgatgcttatc

SEQ ID NO: 205937 - DNA, 25 bp, Homo sapien
atgcttatcctttcatctgtgtgat

SEQ ID NO: 205938 - DNA, 25 bp, Homo sapien
tctactaacaagatcctcccagctt

SEQ ID NO: 205939 - DNA, 25 bp, Homo sapien
aagagcacagggaccaggccttggt

SEQ ID NO: 205940 - DNA, 25 bp, Homo sapien
aggccttggttaggctgagctccca

SEQ ID NO: 205941 - DNA, 25 bp, Homo sapien
ggacaccgcctgcagaaaggacctg

SEQ ID NO: 205942 - DNA, 25 bp, Homo sapien
tgataatgtcccttccccagattct

SEQ ID NO: 205943 - DNA, 25 bp, Homo sapien
gattctcaagcagatgcccaaggga

SEQ ID NO: 205944 - DNA, 25 bp, Homo sapien
acagagccagagtgcctgaggcttc

SEQ ID NO: 205945 - DNA, 25 bp, Homo sapien
gaggcttcctgcttgagaacctgcc

SEQ ID NO: 205946 - DNA, 25 bp, Homo sapien
cccctggatcttggacacttacaga

SEQ ID NO: 205947 - DNA, 25 bp, Homo sapien
ggtctcactccagagggtcagaacg

SEQ ID NO: 205948 - DNA, 25 bp, Homo sapien
ctccagagggtcagaacgtttgctt

SEQ ID NO: 205949 - DNA, 25 bp, Homo sapien
ttgttccttgagtcagtgctgttga

SEQ ID NO: 205950 - DNA, 25 bp, Homo sapien
ttcagcttgcagtgtaattcagaag

SEQ ID NO: 205951 - DNA, 25 bp, Homo sapien
gaccagaagtactggaatcatactt

SEQ ID NO: 205952 - DNA, 25 bp, Homo sapien
gaatcatacttcctttcaggtcaaa

SEQ ID NO: 205953 - DNA, 25 bp, Homo sapien
cttcctttcaggtcaaaacattttg

SEQ ID NO: 205954 - DNA, 25 bp, Homo sapien
gtgggaaatatcctgttcgtgacct

SEQ ID NO: 205955 - DNA, 25 bp, Homo sapien
atcctgttcgtgacctaggagaaac

SEQ ID NO: 205956 - DNA, 25 bp, Homo sapien
gaatttcttactccatacaagcagt

SEQ ID NO: 205957 - DNA, 25 bp, Homo sapien
catagcacttgccatttaaaaacat

SEQ ID NO: 205958 - DNA, 25 bp, Homo sapien
ctgtggttaaaaatgatctccagaa

SEQ ID NO: 205959 - DNA, 25 bp, Homo sapien
actgcagttttcctttgcattgagg

SEQ ID NO: 205960 - DNA, 25 bp, Homo sapien
tttgcattgagggttttggcttttt

SEQ ID NO: 205961 - DNA, 25 bp, Homo sapien
aaataagttctggttgtcattgaat

SEQ ID NO: 205962 - DNA, 25 bp, Homo sapien
agagagcttgatgctttctgccttc

SEQ ID NO: 205963 - DNA, 25 bp, Homo sapien
gatgcattgcacatttgggatattt

SEQ ID NO: 205964 - DNA, 25 bp, Homo sapien
agaaattagggcctcctctgatctc

SEQ ID NO: 205965 - DNA, 25 bp, Homo sapien
tgatctctcgctatctgcgggtcct

SEQ ID NO: 205966 - DNA, 25 bp, Homo sapien
tgcgggtcctgtccttttctcaaga

SEQ ID NO: 205967 - DNA, 25 bp, Homo sapien
tttctcaagaccttcaccattactg

SEQ ID NO: 205968 - DNA, 25 bp, Homo sapien
accattactggtgttttcctgtctt

SEQ ID NO: 205969 - DNA, 25 bp, Homo sapien
gtcttctctttagtatgatccctca

SEQ ID NO: 205970 - DNA, 25 bp, Homo sapien
gtatgatccctcaaaacctcactaa

SEQ ID NO: 205971 - DNA, 25 bp, Homo sapien
ctaactggaaggatgattttgtctc

SEQ ID NO: 205972 - DNA, 25 bp, Homo sapien
aaactcatcagtgtggtaatcctat

SEQ ID NO: 205973 - DNA, 25 bp, Homo sapien
gttttagagacttgtgaggttccat

SEQ ID NO: 205974 - DNA, 25 bp, Homo sapien
gtgaggttccatatgataattcttt

SEQ ID NO: 205975 - DNA, 25 bp, Homo sapien
agtacacagggctattctgtaatat

SEQ ID NO: 205976 - DNA, 25 bp, Homo sapien
gcatgatagatgctgtgcctccaga

SEQ ID NO: 205977 - DNA, 25 bp, Homo sapien
tagatgctgtgcctccagagagttc

SEQ ID NO: 205978 - DNA, 25 bp, Homo sapien
gagttctctggagattactacccaa

SEQ ID NO: 205979 - DNA, 25 bp, Homo sapien
ggatgtaatatgttttcctccattt

SEQ ID NO: 205980 - DNA, 25 bp, Homo sapien
ttttcctccatttctgctaattttc

SEQ ID NO: 205981 - DNA, 25 bp, Homo sapien
tccatttctgctaattttctctctc

SEQ ID NO: 205982 - DNA, 25 bp, Homo sapien
ctctctctctcataacatactatac

SEQ ID NO: 205983 - DNA, 25 bp, Homo sapien
gatttggcacacagcatgttcaatg

SEQ ID NO: 205984 - DNA, 25 bp, Homo sapien
gttcaatgatggttactcgcctagt

SEQ ID NO: 205985 - DNA, 25 bp, Homo sapien
gttactcgcctagtacaagacatgg

SEQ ID NO: 205986 - DNA, 25 bp, Homo sapien
gagaagaaacctttggacacagagc

SEQ ID NO: 205987 - DNA, 25 bp, Homo sapien
gacacagagcagatgacacctcctt

SEQ ID NO: 205988 - DNA, 25 bp, Homo sapien
gatgacacctccttctgttttgtag

SEQ ID NO: 205989 - DNA, 25 bp, Homo sapien
gttttgtagtgtatcctggtgtcat

SEQ ID NO: 205990 - DNA, 25 bp, Homo sapien
gtatcctggtgtcattttctgtgaa

SEQ ID NO: 205991 - DNA, 25 bp, Homo sapien
gaatgtggtcaggtagagttgtttt

SEQ ID NO: 205992 - DNA, 25 bp, Homo sapien
gtgggctaaagccataggaagaaaa

SEQ ID NO: 205993 - DNA, 25 bp, Homo sapien
gtgatgtgtccagtatgtactattt

SEQ ID NO: 205994 - DNA, 25 bp, Homo sapien
agctcagcagccagcctttagtagc

SEQ ID NO: 205995 - DNA, 25 bp, Homo sapien
tttagtagctcctgggaatacccct

SEQ ID NO: 205996 - DNA, 25 bp, Homo sapien
tgggaatacccctattactccttga

SEQ ID NO: 205997 - DNA, 25 bp, Homo sapien
tattactccttgaccaggcccagtg

SEQ ID NO: 205998 - DNA, 25 bp, Homo sapien
agcagctcatctagacctctttact

SEQ ID NO: 205999 - DNA, 25 bp, Homo sapien
tatttgtctatatctgggagtggag

SEQ ID NO: 206000 - DNA, 25 bp, Homo sapien
gagggttcaggaacattatgcttcc

SEQ ID NO: 206001 - DNA, 25 bp, Homo sapien
ttatgcttccaactatgaagggatt

SEQ ID NO: 206002 - DNA, 25 bp, Homo sapien
gaaattctcatgaaagaatccccaa

SEQ ID NO: 206003 - DNA, 25 bp, Homo sapien
gaatccccaagcctagtagtcccat

SEQ ID NO: 206004 - DNA, 25 bp, Homo sapien
aagcctagtagtcccattatgtcaa

SEQ ID NO: 206005 - DNA, 25 bp, Homo sapien
gtggctacctgttgtttgtcctgta

SEQ ID NO: 206006 - DNA, 25 bp, Homo sapien
ttgtttgtcctgtatctggcggcca

SEQ ID NO: 206007 - DNA, 25 bp, Homo sapien
gccaccaaccagactactaacgagt

SEQ ID NO: 206008 - DNA, 25 bp, Homo sapien
accggaacattcactcccatgggct

SEQ ID NO: 206009 - DNA, 25 bp, Homo sapien
atgggcttcggagcaaccttcaaga

SEQ ID NO: 206010 - DNA, 25 bp, Homo sapien
tcaagagatctttctacctgccttt

SEQ ID NO: 206011 - DNA, 25 bp, Homo sapien
tacctgcctttccatgtcatgagag

SEQ ID NO: 206012 - DNA, 25 bp, Homo sapien
ggtctttcttattcagtacctgttc

SEQ ID NO: 206013 - DNA, 25 bp, Homo sapien
tgttcctgacttttccacggattgt

SEQ ID NO: 206014 - DNA, 25 bp, Homo sapien
ccacggattgtcttcatgctgggct

SEQ ID NO: 206015 - DNA, 25 bp, Homo sapien
atgctgggctttgtcgtggttctga

SEQ ID NO: 206016 - DNA, 25 bp, Homo sapien
tcatggaccaacagtgattgaggat

SEQ ID NO: 206017 - DNA, 25 bp, Homo sapien
gattgaggatttgtgggcagccaga

SEQ ID NO: 206018 - DNA, 25 bp, Homo sapien
ggagtctgactgaagtttacttgga

SEQ ID NO: 206019 - DNA, 25 bp, Homo sapien
cttggaaagaaagggcttgctaaga

SEQ ID NO: 206020 - DNA, 25 bp, Homo sapien
gggaagtgtctaatgtatgtgcaca

SEQ ID NO: 206021 - DNA, 25 bp, Homo sapien
tacaaaagttttgagctcttccaag

SEQ ID NO: 206022 - DNA, 25 bp, Homo sapien
gagctcttccaagtataccatttat

SEQ ID NO: 206023 - DNA, 25 bp, Homo sapien
attaaactactttggaagcgtcagt

SEQ ID NO: 206024 - DNA, 25 bp, Homo sapien
ctttggaagcgtcagtggatatatt

SEQ ID NO: 206025 - DNA, 25 bp, Homo sapien
aagtggtaatcctgaatctctttta

SEQ ID NO: 206026 - DNA, 25 bp, Homo sapien
aatcctgaatctcttttaaactatt

SEQ ID NO: 206027 - DNA, 25 bp, Homo sapien
tagggtgttctcttatactttcagt

SEQ ID NO: 206028 - DNA, 25 bp, Homo sapien
gcatctttccacagcaagggccaaa

SEQ ID NO: 206029 - DNA, 25 bp, Homo sapien
ctcctggttcccttcagagtctttt

SEQ ID NO: 206030 - DNA, 25 bp, Homo sapien
ctttttggcctgatgatgactcttg

SEQ ID NO: 206031 - DNA, 25 bp, Homo sapien
atgactcttgagtgataccctgtga

SEQ ID NO: 206032 - DNA, 25 bp, Homo sapien
tcttgagtgataccctgtgatgcag

SEQ ID NO: 206033 - DNA, 25 bp, Homo sapien
agacatgccccagatggattctact

SEQ ID NO: 206034 - DNA, 25 bp, Homo sapien
tgccccagatggattctactttctt

SEQ ID NO: 206035 - DNA, 25 bp, Homo sapien
gattgtcactactaatttgacgcct

SEQ ID NO: 206036 - DNA, 25 bp, Homo sapien
ctaatttgacgcctaacttcagaag

SEQ ID NO: 206037 - DNA, 25 bp, Homo sapien
aaactgtgccatggacatttttcct

SEQ ID NO: 206038 - DNA, 25 bp, Homo sapien
ttctggtgccactgaagttattttg

SEQ ID NO: 206039 - DNA, 25 bp, Homo sapien
gagatggtgatgtcgcttggcaaca

SEQ ID NO: 206040 - DNA, 25 bp, Homo sapien
gtgatgtcgcttggcaacacaccca

SEQ ID NO: 206041 - DNA, 25 bp, Homo sapien
gcaacacacccagctgtttagacaa

SEQ ID NO: 206042 - DNA, 25 bp, Homo sapien
ctggcaataatcaaggacttactga

SEQ ID NO: 206043 - DNA, 25 bp, Homo sapien
acttactgaagtagtctgttggttc

SEQ ID NO: 206044 - DNA, 25 bp, Homo sapien
ctgttggttcagtgcatgcttagtt

SEQ ID NO: 206045 - DNA, 25 bp, Homo sapien
atgcttagttggcagttaccaccct

SEQ ID NO: 206046 - DNA, 25 bp, Homo sapien
gttaccaccctgtgctagcatattt

SEQ ID NO: 206047 - DNA, 25 bp, Homo sapien
gcatatttcttttgctagctatcca

SEQ ID NO: 206048 - DNA, 25 bp, Homo sapien
tagctatccatcatgtaaccctcat

SEQ ID NO: 206049 - DNA, 25 bp, Homo sapien
catgtccttggtctatgccaatata

SEQ ID NO: 206050 - DNA, 25 bp, Homo sapien
gccaatataaaagccatctccctag

SEQ ID NO: 206051 - DNA, 25 bp, Homo sapien
catctccctagcttttgtttgtatt

SEQ ID NO: 206052 - DNA, 25 bp, Homo sapien
ctagcttttgtttgtattcaggtaa

SEQ ID NO: 206053 - DNA, 25 bp, Homo sapien
atgaagtttatcttggaaaaatcca

SEQ ID NO: 206054 - DNA, 25 bp, Homo sapien
ctgctgaacagaagtaggtgaatgg

SEQ ID NO: 206055 - DNA, 25 bp, Homo sapien
gttgtacgaagtagaaggctgtctt

SEQ ID NO: 206056 - DNA, 25 bp, Homo sapien
aaggctgtcttctaatgtgttttct

SEQ ID NO: 206057 - DNA, 25 bp, Homo sapien
cttctaatgtgttttcttatcctag

SEQ ID NO: 206058 - DNA, 25 bp, Homo sapien
tatcctagtttgctatccttattat

SEQ ID NO: 206059 - DNA, 25 bp, Homo sapien
atggatattggctactcccttttaa

SEQ ID NO: 206060 - DNA, 25 bp, Homo sapien
ctattcttgcccctgagttttttgc

SEQ ID NO: 206061 - DNA, 25 bp, Homo sapien
attcttgcccctgagttttttgctt

SEQ ID NO: 206062 - DNA, 25 bp, Homo sapien
ttcttgcccctgagttttttgcttc

SEQ ID NO: 206063 - DNA, 25 bp, Homo sapien
ccctgagttttttgcttcattaaga

SEQ ID NO: 206064 - DNA, 25 bp, Homo sapien
gagttttttgcttcattaagatata

SEQ ID NO: 206065 - DNA, 25 bp, Homo sapien
tttgcttcattaagatatatggtcg

SEQ ID NO: 206066 - DNA, 25 bp, Homo sapien
agatatatggtcgatgtctgggcac

SEQ ID NO: 206067 - DNA, 25 bp, Homo sapien
atatatggtcgatgtctgggcacgg

SEQ ID NO: 206068 - DNA, 25 bp, Homo sapien
tatatggtcgatgtctgggcacggt

SEQ ID NO: 206069 - DNA, 25 bp, Homo sapien
atggtcgatgtctgggcacggtggc

SEQ ID NO: 206070 - DNA, 25 bp, Homo sapien
aattatctggtgtagtggcgcctgc

SEQ ID NO: 206071 - DNA, 25 bp, Homo sapien
aaagggactttgtaggtgtgtgatt

SEQ ID NO: 206072 - DNA, 25 bp, Homo sapien
aagatctgcagtgagagggtagcct

SEQ ID NO: 206073 - DNA, 25 bp, Homo sapien
agggtagcctggattagccacgtgt

SEQ ID NO: 206074 - DNA, 25 bp, Homo sapien
ggattagccacgtgtgcccaaaagc

SEQ ID NO: 206075 - DNA, 25 bp, Homo sapien
ccacgtgtgcccaaaagcagagact

SEQ ID NO: 206076 - DNA, 25 bp, Homo sapien
agcagagactccttcccagccgtgg

SEQ ID NO: 206077 - DNA, 25 bp, Homo sapien
ccagccgtggtcagagacagaacaa

SEQ ID NO: 206078 - DNA, 25 bp, Homo sapien
gacgctgctggctttaaagacggaa

SEQ ID NO: 206079 - DNA, 25 bp, Homo sapien
gagccaaggagtgcaagtgccgcca

SEQ ID NO: 206080 - DNA, 25 bp, Homo sapien
tgcaagtgccgccagaggccagaaa

SEQ ID NO: 206081 - DNA, 25 bp, Homo sapien
tgccaacacctggattttagttctg

SEQ ID NO: 206082 - DNA, 25 bp, Homo sapien
gtagcaaactactaacccagcaaat

SEQ ID NO: 206083 - DNA, 25 bp, Homo sapien
cggaaccagaagtagggcctcgact

SEQ ID NO: 206084 - DNA, 25 bp, Homo sapien
tagggcctcgacttgcttcagacga

SEQ ID NO: 206085 - DNA, 25 bp, Homo sapien
gcttcagacgacacagagcaagagg

SEQ ID NO: 206086 - DNA, 25 bp, Homo sapien
aggaactgaccatctcatgacctgt

SEQ ID NO: 206087 - DNA, 25 bp, Homo sapien
atgacctgtggcattgcacggtgca

SEQ ID NO: 206088 - DNA, 25 bp, Homo sapien
cagaagggattatcctcagccagtc

SEQ ID NO: 206089 - DNA, 25 bp, Homo sapien
taagttagttagatcactcccagaa

SEQ ID NO: 206090 - DNA, 25 bp, Homo sapien
accagctgggaccttctttgcagta

SEQ ID NO: 206091 - DNA, 25 bp, Homo sapien
gggaccttctttgcagtacaatttg

SEQ ID NO: 206092 - DNA, 25 bp, Homo sapien
attcctgatgtattttgcttattat

SEQ ID NO: 206093 - DNA, 25 bp, Homo sapien
ataatcttaagtggccacacacaat

SEQ ID NO: 206094 - DNA, 25 bp, Homo sapien
gtggccacacacaatgttttctctt

SEQ ID NO: 206095 - DNA, 25 bp, Homo sapien
gttttctcttatgttatctggcagt

SEQ ID NO: 206096 - DNA, 25 bp, Homo sapien
tttctcttatgttatctggcagtaa

SEQ ID NO: 206097 - DNA, 25 bp, Homo sapien
ctggcagtaactgtaacttgaatta

SEQ ID NO: 206098 - DNA, 25 bp, Homo sapien
cttgaattacattagcacattctgc

SEQ ID NO: 206099 - DNA, 25 bp, Homo sapien
gcacattctgcttagctaaaattgt

SEQ ID NO: 206100 - DNA, 25 bp, Homo sapien
gccctctcatttgattgacagtatt

SEQ ID NO: 206101 - DNA, 25 bp, Homo sapien
agatctttgtttgtctgaacaggta

SEQ ID NO: 206102 - DNA, 25 bp, Homo sapien
gaacaggtatttttatacatgcttt

SEQ ID NO: 206103 - DNA, 25 bp, Homo sapien
aggttttctaacatgcttaccactg

SEQ ID NO: 206104 - DNA, 25 bp, Homo sapien
gtaggcggcgttgtcctcagttctg

SEQ ID NO: 206105 - DNA, 25 bp, Homo sapien
cgccctcggactagtctcttggaag

SEQ ID NO: 206106 - DNA, 25 bp, Homo sapien
tagtctcttggaagccggcctgtct

SEQ ID NO: 206107 - DNA, 25 bp, Homo sapien
gaggtcttaacctctgttctcagac

SEQ ID NO: 206108 - DNA, 25 bp, Homo sapien
aacctctgttctcagactctggaaa

SEQ ID NO: 206109 - DNA, 25 bp, Homo sapien
ggaaaaggcttctcaacggcttggc

SEQ ID NO: 206110 - DNA, 25 bp, Homo sapien
ttctcaacggcttggcctgacctca

SEQ ID NO: 206111 - DNA, 25 bp, Homo sapien
atctcaagacaccaacccagggatg

SEQ ID NO: 206112 - DNA, 25 bp, Homo sapien
aacccagggatgcaggacagacaca

SEQ ID NO: 206113 - DNA, 25 bp, Homo sapien
cagacacacagacactcagtgaggg

SEQ ID NO: 206114 - DNA, 25 bp, Homo sapien
cactcagtgagggtcaaatatcttt

SEQ ID NO: 206115 - DNA, 25 bp, Homo sapien
gcaccatggaaaggtccctgctcct

SEQ ID NO: 206116 - DNA, 25 bp, Homo sapien
caccatggaaaggtccctgctccta

SEQ ID NO: 206117 - DNA, 25 bp, Homo sapien
ggtccctgctcctagtgctcacact

SEQ ID NO: 206118 - DNA, 25 bp, Homo sapien
agtgctcacactccaataagaagaa

SEQ ID NO: 206119 - DNA, 25 bp, Homo sapien
gtgctcacactccaataagaagaag

SEQ ID NO: 206120 - DNA, 25 bp, Homo sapien
tgctcacactccaataagaagaagt

SEQ ID NO: 206121 - DNA, 25 bp, Homo sapien
gctcacactccaataagaagaagtg

SEQ ID NO: 206122 - DNA, 25 bp, Homo sapien
cacactccaataagaagaagtggct

SEQ ID NO: 206123 - DNA, 25 bp, Homo sapien
tccaataagaagaagtggctgggcc

SEQ ID NO: 206124 - DNA, 25 bp, Homo sapien
cacagcggctcacgctgtaacccca

SEQ ID NO: 206125 - DNA, 25 bp, Homo sapien
atttcgggaggcctgggcaggcaga

SEQ ID NO: 206126 - DNA, 25 bp, Homo sapien
gaactcaaatggataggcatcttgt

SEQ ID NO: 206127 - DNA, 25 bp, Homo sapien
ggcatcttgtgagggtgtgtttttc

SEQ ID NO: 206128 - DNA, 25 bp, Homo sapien
gtttttcccagtgtgaattggcttg

SEQ ID NO: 206129 - DNA, 25 bp, Homo sapien
tagaacaacaactgcccctcatgta

SEQ ID NO: 206130 - DNA, 25 bp, Homo sapien
tgtacgccaaggatgagctctagat

SEQ ID NO: 206131 - DNA, 25 bp, Homo sapien
agaggcacagtgtttccggagtcag

SEQ ID NO: 206132 - DNA, 25 bp, Homo sapien
tcagggactgcagctgagcgcaact

SEQ ID NO: 206133 - DNA, 25 bp, Homo sapien
ccactgactcaaatacgaactgctt

SEQ ID NO: 206134 - DNA, 25 bp, Homo sapien
gaactgcttgagacagacttctttt

SEQ ID NO: 206135 - DNA, 25 bp, Homo sapien
gtagttctttgcagtgtccattgag

SEQ ID NO: 206136 - DNA, 25 bp, Homo sapien
attgagacactataaccagccttgt

SEQ ID NO: 206137 - DNA, 25 bp, Homo sapien
agggaattctactctctcaaacggt

SEQ ID NO: 206138 - DNA, 25 bp, Homo sapien
aattctactctctcaaacggtgcag

SEQ ID NO: 206139 - DNA, 25 bp, Homo sapien
tactctctcaaacggtgcaggtcga

SEQ ID NO: 206140 - DNA, 25 bp, Homo sapien
tcaaacggtgcaggtcgaaatttca

SEQ ID NO: 206141 - DNA, 25 bp, Homo sapien
catgggaacctccagcaaggccagg

SEQ ID NO: 206142 - DNA, 25 bp, Homo sapien
agcaaggccaggaacactcttctca

SEQ ID NO: 206143 - DNA, 25 bp, Homo sapien
aggccaggaacactcttctcaccag

SEQ ID NO: 206144 - DNA, 25 bp, Homo sapien
ctgccaaacagaaggtcccacttct

SEQ ID NO: 206145 - DNA, 25 bp, Homo sapien
aacagaaggtcccacttctcagctg

SEQ ID NO: 206146 - DNA, 25 bp, Homo sapien
agcccttcacctccaagttggcatt

SEQ ID NO: 206147 - DNA, 25 bp, Homo sapien
cacctccaagttggcattactggga

SEQ ID NO: 206148 - DNA, 25 bp, Homo sapien
cgagacacggtctcaaaaaactaat

SEQ ID NO: 206149 - DNA, 25 bp, Homo sapien
gagacacggtctcaaaaaactaatg

SEQ ID NO: 206150 - DNA, 25 bp, Homo sapien
agacacggtctcaaaaaactaatgt

SEQ ID NO: 206151 - DNA, 25 bp, Homo sapien
gacacggtctcaaaaaactaatgtg

SEQ ID NO: 206152 - DNA, 25 bp, Homo sapien
cacggtctcaaaaaactaatgtgtg

SEQ ID NO: 206153 - DNA, 25 bp, Homo sapien
acggtctcaaaaaactaatgtgtgg

SEQ ID NO: 206154 - DNA, 25 bp, Homo sapien
cggtctcaaaaaactaatgtgtggc

SEQ ID NO: 206155 - DNA, 25 bp, Homo sapien
ggtctcaaaaaactaatgtgtggct

SEQ ID NO: 206156 - DNA, 25 bp, Homo sapien
actaatgtgtggctaaggagttacc

SEQ ID NO: 206157 - DNA, 25 bp, Homo sapien
ctaatgtgtggctaaggagttacct

SEQ ID NO: 206158 - DNA, 25 bp, Homo sapien
taatgtgtggctaaggagttacctg

SEQ ID NO: 206159 - DNA, 25 bp, Homo sapien
aaacgatagatgtgcaggttgtgcg

SEQ ID NO: 206160 - DNA, 25 bp, Homo sapien
gaaaatggtgtgagccccaccgctg

SEQ ID NO: 206161 - DNA, 25 bp, Homo sapien
ccaccgctgtgcatcgaatgaggga

SEQ ID NO: 206162 - DNA, 25 bp, Homo sapien
gtctcttcaatggacccttcacaag

SEQ ID NO: 206163 - DNA, 25 bp, Homo sapien
cttcaatggacccttcacaagtgtt

SEQ ID NO: 206164 - DNA, 25 bp, Homo sapien
tcttccttctcctgaaatccagaga

SEQ ID NO: 206165 - DNA, 25 bp, Homo sapien
aatccagagactttcttgctcatcc

SEQ ID NO: 206166 - DNA, 25 bp, Homo sapien
gaaagcagacttgcatatccctgat

SEQ ID NO: 206167 - DNA, 25 bp, Homo sapien
tgcatatccctgatgagcagctcgg

SEQ ID NO: 206168 - DNA, 25 bp, Homo sapien
tgatgagcagctcggctacttttgt

SEQ ID NO: 206169 - DNA, 25 bp, Homo sapien
gcagctcggctacttttgtaaactt

SEQ ID NO: 206170 - DNA, 25 bp, Homo sapien
aagccatccttaatgttcctgataa

SEQ ID NO: 206171 - DNA, 25 bp, Homo sapien
gccatccttaatgttcctgataagt

SEQ ID NO: 206172 - DNA, 25 bp, Homo sapien
ttaatgttcctgataagtctgactg

SEQ ID NO: 206173 - DNA, 25 bp, Homo sapien
ttcctgataagtctgactggaggca

SEQ ID NO: 206174 - DNA, 25 bp, Homo sapien
actggaggcagtgtcagatcagcaa

SEQ ID NO: 206175 - DNA, 25 bp, Homo sapien
gaaagactttgagccctatgacttt

SEQ ID NO: 206176 - DNA, 25 bp, Homo sapien
agactttgagccctatgactttact

SEQ ID NO: 206177 - DNA, 25 bp, Homo sapien
ttgagccctatgactttactctgga

SEQ ID NO: 206178 - DNA, 25 bp, Homo sapien
agccctatgactttactctggatga

SEQ ID NO: 206179 - DNA, 25 bp, Homo sapien
ctatgactttactctggatgactaa

SEQ ID NO: 206180 - DNA, 25 bp, Homo sapien
tgactttactctggatgactaaaac

SEQ ID NO: 206181 - DNA, 25 bp, Homo sapien
aagttttgtgattcctgtaatagat

SEQ ID NO: 206182 - DNA, 25 bp, Homo sapien
agttttgtgattcctgtaatagatg

SEQ ID NO: 206183 - DNA, 25 bp, Homo sapien
gttttgtgattcctgtaatagatgt

SEQ ID NO: 206184 - DNA, 25 bp, Homo sapien
ttttgtgattcctgtaatagatgtg

SEQ ID NO: 206185 - DNA, 25 bp, Homo sapien
tttgtgattcctgtaatagatgtgt

SEQ ID NO: 206186 - DNA, 25 bp, Homo sapien
ttgtgattcctgtaatagatgtgta

SEQ ID NO: 206187 - DNA, 25 bp, Homo sapien
tgtgattcctgtaatagatgtgtat

SEQ ID NO: 206188 - DNA, 25 bp, Homo sapien
gtgattcctgtaatagatgtgtatg

SEQ ID NO: 206189 - DNA, 25 bp, Homo sapien
gattcctgtaatagatgtgtatgtt

SEQ ID NO: 206190 - DNA, 25 bp, Homo sapien
tcctgtaatagatgtgtatgttttc

SEQ ID NO: 206191 - DNA, 25 bp, Homo sapien
cctgtaatagatgtgtatgttttct

SEQ ID NO: 206192 - DNA, 25 bp, Homo sapien
aaaccctacaagctaagacagaatt

SEQ ID NO: 206193 - DNA, 25 bp, Homo sapien
ctaagacagaattggggccctatct

SEQ ID NO: 206194 - DNA, 25 bp, Homo sapien
attttgtatacagcgaaactaagca

SEQ ID NO: 206195 - DNA, 25 bp, Homo sapien
gtatacagcgaaactaagcatcata

SEQ ID NO: 206196 - DNA, 25 bp, Homo sapien
gcgaaactaagcatcatatttgaag

SEQ ID NO: 206197 - DNA, 25 bp, Homo sapien
caagataattcacaccaagccacca

SEQ ID NO: 206198 - DNA, 25 bp, Homo sapien
gataattcacaccaagccaccacta

SEQ ID NO: 206199 - DNA, 25 bp, Homo sapien
atattgaaacaaatcctggaaaaca

SEQ ID NO: 206200 - DNA, 25 bp, Homo sapien
acaaatcctggaaaacagagcttct

SEQ ID NO: 206201 - DNA, 25 bp, Homo sapien
aaaacagagcttctttaaagcataa

SEQ ID NO: 206202 - DNA, 25 bp, Homo sapien
taaagcataaatcacgtgggaccta

SEQ ID NO: 206203 - DNA, 25 bp, Homo sapien
gcagcaggagccaggcaggtgatgt

SEQ ID NO: 206204 - DNA, 25 bp, Homo sapien
caggcaggtgatgtctttgttctcg

SEQ ID NO: 206205 - DNA, 25 bp, Homo sapien
aggcaggtgatgtctttgttctcgg

SEQ ID NO: 206206 - DNA, 25 bp, Homo sapien
ctgtggccggcatgccccgatcttt

SEQ ID NO: 206207 - DNA, 25 bp, Homo sapien
atgccccgatctttcacacactggt

SEQ ID NO: 206208 - DNA, 25 bp, Homo sapien
gccccgatctttcacacactggtga

SEQ ID NO: 206209 - DNA, 25 bp, Homo sapien
gatctttcacacactggtgaccctg

SEQ ID NO: 206210 - DNA, 25 bp, Homo sapien
tctttcacacactggtgaccctgag

SEQ ID NO: 206211 - DNA, 25 bp, Homo sapien
tttcacacactggtgaccctgagag

SEQ ID NO: 206212 - DNA, 25 bp, Homo sapien
tcacacactggtgaccctgagagag

SEQ ID NO: 206213 - DNA, 25 bp, Homo sapien
acacactggtgaccctgagagagga

SEQ ID NO: 206214 - DNA, 25 bp, Homo sapien
ctattcttgcccctgagttttttgc

SEQ ID NO: 206215 - DNA, 25 bp, Homo sapien
tattcttgcccctgagttttttgct

SEQ ID NO: 206216 - DNA, 25 bp, Homo sapien
attcttgcccctgagttttttgctt

SEQ ID NO: 206217 - DNA, 25 bp, Homo sapien
ttcttgcccctgagttttttgcttc

SEQ ID NO: 206218 - DNA, 25 bp, Homo sapien
ccctgagttttttgcttcattaaga

SEQ ID NO: 206219 - DNA, 25 bp, Homo sapien
gagttttttgcttcattaagatata

SEQ ID NO: 206220 - DNA, 25 bp, Homo sapien
tttgcttcattaagatatatggtcg

SEQ ID NO: 206221 - DNA, 25 bp, Homo sapien
agatatatggtcgatgtctgggcac

SEQ ID NO: 206222 - DNA, 25 bp, Homo sapien
atatatggtcgatgtctgggcacgg

SEQ ID NO: 206223 - DNA, 25 bp, Homo sapien
tatatggtcgatgtctgggcacggt

SEQ ID NO: 206224 - DNA, 25 bp, Homo sapien
atggtcgatgtctgggcacggtggc

SEQ ID NO: 206225 - DNA, 25 bp, Homo sapien
gttatctcctaaatggatctggctt

SEQ ID NO: 206226 - DNA, 25 bp, Homo sapien
gaagatggtatcagagggcctgcct

SEQ ID NO: 206227 - DNA, 25 bp, Homo sapien
gcctgggcagtctgtctccgggcca

SEQ ID NO: 206228 - DNA, 25 bp, Homo sapien
cagggtcagggaccctctgcctctg

SEQ ID NO: 206229 - DNA, 25 bp, Homo sapien
tctgcctctggcagccttaacctgt

SEQ ID NO: 206230 - DNA, 25 bp, Homo sapien
ttaacctgtcctctgctaggaccag

SEQ ID NO: 206231 - DNA, 25 bp, Homo sapien
taggaccagggtgatttcaagccag

SEQ ID NO: 206232 - DNA, 25 bp, Homo sapien
aagccagggaagcaactgggaccct

SEQ ID NO: 206233 - DNA, 25 bp, Homo sapien
gcaactgggaccctgaaaactgtcc

SEQ ID NO: 206234 - DNA, 25 bp, Homo sapien
tgccgccatgtggatgctgttgtga

SEQ ID NO: 206235 - DNA, 25 bp, Homo sapien
ctgttgtgattgctgtttgtatatt

SEQ ID NO: 206236 - DNA, 25 bp, Homo sapien
aagcctagatttacaatttgatgaa

SEQ ID NO: 206237 - DNA, 25 bp, Homo sapien
aatgagctttaagtgcctgtcgttc

SEQ ID NO: 206238 - DNA, 25 bp, Homo sapien
gctttaagtgcctgtcgttctgaaa

SEQ ID NO: 206239 - DNA, 25 bp, Homo sapien
gtgcctgtcgttctgaaaattgtgt

SEQ ID NO: 206240 - DNA, 25 bp, Homo sapien
tcagcttatctcataattggaccta

SEQ ID NO: 206241 - DNA, 25 bp, Homo sapien
ataattggacctaatagcatttctt

SEQ ID NO: 206242 - DNA, 25 bp, Homo sapien
agcatttctttgtgcagttaggtga

SEQ ID NO: 206243 - DNA, 25 bp, Homo sapien
agttaggtgatgagcactgctttga

SEQ ID NO: 206244 - DNA, 25 bp, Homo sapien
gatgagcactgctttgaggcccaag

SEQ ID NO: 206245 - DNA, 25 bp, Homo sapien
aggcccaagcactagtagagatgcg

SEQ ID NO: 206246 - DNA, 25 bp, Homo sapien
gcactagtagagatgcgcgatacag

SEQ ID NO: 206247 - DNA, 25 bp, Homo sapien
gctgcaagactgagcctaaatgtct

SEQ ID NO: 206248 - DNA, 25 bp, Homo sapien
tgagcctaaatgtctccccggcctt

SEQ ID NO: 206249 - DNA, 25 bp, Homo sapien
tgtctccccggccttgacttttctt

SEQ ID NO: 206250 - DNA, 25 bp, Homo sapien
agtcctggggcctagattctgcact

SEQ ID NO: 206251 - DNA, 25 bp, Homo sapien
gcacttggggtctctgacacaacac

SEQ ID NO: 206252 - DNA, 25 bp, Homo sapien
tgacacaacacaccatcccaaagta

SEQ ID NO: 206253 - DNA, 25 bp, Homo sapien
acaccatcccaaagtagccggaaga

SEQ ID NO: 206254 - DNA, 25 bp, Homo sapien
gtagccggaagagctaaacacaggg

SEQ ID NO: 206255 - DNA, 25 bp, Homo sapien
ggcaaaaggaattgtcagccctacc

SEQ ID NO: 206256 - DNA, 25 bp, Homo sapien
gggccaccccagcagtatttttatt

SEQ ID NO: 206257 - DNA, 25 bp, Homo sapien
gccaccccagcagtatttttattta

SEQ ID NO: 206258 - DNA, 25 bp, Homo sapien
gcggcagctcgagattgcccaagga

SEQ ID NO: 206259 - DNA, 25 bp, Homo sapien
gattgcccaaggacaaatccttcag

SEQ ID NO: 206260 - DNA, 25 bp, Homo sapien
gaaagatcaggaaatcaaggaccta

SEQ ID NO: 206261 - DNA, 25 bp, Homo sapien
ggacctaaaacagaagatagccgaa

SEQ ID NO: 206262 - DNA, 25 bp, Homo sapien
atagccgaagtcatggccgtcatgc

SEQ ID NO: 206263 - DNA, 25 bp, Homo sapien
tgaccccaatgcctctgtttaccag

SEQ ID NO: 206264 - DNA, 25 bp, Homo sapien
gcccctgaagaaatgaaggccagct

SEQ ID NO: 206265 - DNA, 25 bp, Homo sapien
aaggccagctgtgtgttgtgcccaa

SEQ ID NO: 206266 - DNA, 25 bp, Homo sapien
cagctgtgtgttgtgcccaaaaatt

SEQ ID NO: 206267 - DNA, 25 bp, Homo sapien
atttggttaccggaaggcattgcaa

SEQ ID NO: 206268 - DNA, 25 bp, Homo sapien
aggcattgcaaaggagcgtctctgg

SEQ ID NO: 206269 - DNA, 25 bp, Homo sapien
tgtgtccacaaaactacccatcata

SEQ ID NO: 206270 - DNA, 25 bp, Homo sapien
aaaactacccatcatatgaggaagg

SEQ ID NO: 206271 - DNA, 25 bp, Homo sapien
ggtatacgcagtgtgaccctcaaaa

SEQ ID NO: 206272 - DNA, 25 bp, Homo sapien
gaccctcaaaaagcttttagcctag

SEQ ID NO: 206273 - DNA, 25 bp, Homo sapien
aagcttttagcctagcctttgacag

SEQ ID NO: 206274 - DNA, 25 bp, Homo sapien
tagcctagcctttgacagaaatgag

SEQ ID NO: 206275 - DNA, 25 bp, Homo sapien
tatttatgtgcctgttgcttcaaag

SEQ ID NO: 206276 - DNA, 25 bp, Homo sapien
tgcctgttgcttcaaagaggacttg

SEQ ID NO: 206277 - DNA, 25 bp, Homo sapien
agaggacttggtagcatttcctaaa

SEQ ID NO: 206278 - DNA, 25 bp, Homo sapien
aaattttgtaatctggcttccgata

SEQ ID NO: 206279 - DNA, 25 bp, Homo sapien
atctggcttccgataatccaaaggg

SEQ ID NO: 206280 - DNA, 25 bp, Homo sapien
gtattcctccgttagctttccccat

SEQ ID NO: 206281 - DNA, 25 bp, Homo sapien
tccgttagctttccccataaggttg

SEQ ID NO: 206282 - DNA, 25 bp, Homo sapien
ttagctttccccataaggttgggag

SEQ ID NO: 206283 - DNA, 25 bp, Homo sapien
gctttccccataaggttgggagtat

SEQ ID NO: 206284 - DNA, 25 bp, Homo sapien
ccataaggttgggagtatctgcttt

SEQ ID NO: 206285 - DNA, 25 bp, Homo sapien
aaggttgggagtatctgcttttgtg

SEQ ID NO: 206286 - DNA, 25 bp, Homo sapien
gggctggtcagaatcagggtgtacc

SEQ ID NO: 206287 - DNA, 25 bp, Homo sapien
atcagggtgtacctccccgacacct

SEQ ID NO: 206288 - DNA, 25 bp, Homo sapien
cccgacaccttctttttcagtgatg

SEQ ID NO: 206289 - DNA, 25 bp, Homo sapien
ccgacaccttctttttcagtgatgt

SEQ ID NO: 206290 - DNA, 25 bp, Homo sapien
cgacaccttctttttcagtgatgtt

SEQ ID NO: 206291 - DNA, 25 bp, Homo sapien
aaacaaaactctgtcaactccaaat

SEQ ID NO: 206292 - DNA, 25 bp, Homo sapien
aacaaaactctgtcaactccaaatt

SEQ ID NO: 206293 - DNA, 25 bp, Homo sapien
acaaaactctgtcaactccaaattc

SEQ ID NO: 206294 - DNA, 25 bp, Homo sapien
caaaactctgtcaactccaaattcc

SEQ ID NO: 206295 - DNA, 25 bp, Homo sapien
aaaactctgtcaactccaaattcct

SEQ ID NO: 206296 - DNA, 25 bp, Homo sapien
aactctgtcaactccaaattcctat

SEQ ID NO: 206297 - DNA, 25 bp, Homo sapien
attcctatttggtgaaatgatcctt

SEQ ID NO: 206298 - DNA, 25 bp, Homo sapien
ttcctatttggtgaaatgatccttc

SEQ ID NO: 206299 - DNA, 25 bp, Homo sapien
tcctatttggtgaaatgatccttca

SEQ ID NO: 206300 - DNA, 25 bp, Homo sapien
ctatttggtgaaatgatccttcagg

SEQ ID NO: 206301 - DNA, 25 bp, Homo sapien
gaaatgatccttcaggattgatggg

SEQ ID NO: 206302 - DNA, 25 bp, Homo sapien
tgcagctgccggactcttctgcttg

SEQ ID NO: 206303 - DNA, 25 bp, Homo sapien
tcttctgcttgtcacttgtcaggaa

SEQ ID NO: 206304 - DNA, 25 bp, Homo sapien
gaatgtgtttttaccaccacaggga

SEQ ID NO: 206305 - DNA, 25 bp, Homo sapien
cacagggaaactgcgttcaaatcaa

SEQ ID NO: 206306 - DNA, 25 bp, Homo sapien
atttatatggtactgctgtgacgcg

SEQ ID NO: 206307 - DNA, 25 bp, Homo sapien
gtactgctgtgacgcggcacataca

SEQ ID NO: 206308 - DNA, 25 bp, Homo sapien
agccgcacagatgcgtgtgacccag

SEQ ID NO: 206309 - DNA, 25 bp, Homo sapien
tgacccagaggcgagacgcagcttt

SEQ ID NO: 206310 - DNA, 25 bp, Homo sapien
agacgcagctttgtcctgggagacg

SEQ ID NO: 206311 - DNA, 25 bp, Homo sapien
cctgggagacgttcatattggaatc

SEQ ID NO: 206312 - DNA, 25 bp, Homo sapien
caggtatgtctgacgggacgcagca

SEQ ID NO: 206313 - DNA, 25 bp, Homo sapien
aggaatgcttatacaaatcaatttg

SEQ ID NO: 206314 - DNA, 25 bp, Homo sapien
aatttgaaattctacccatcttgag

SEQ ID NO: 206315 - DNA, 25 bp, Homo sapien
ctacccatcttgagggaggaccgtt

SEQ ID NO: 206316 - DNA, 25 bp, Homo sapien
gagggaggaccgttcctcagttaag

SEQ ID NO: 206317 - DNA, 25 bp, Homo sapien
gaccgttcctcagttaaggacttgt

SEQ ID NO: 206318 - DNA, 25 bp, Homo sapien
ggacttgtttatttaaatgggactg

SEQ ID NO: 206319 - DNA, 25 bp, Homo sapien
aatatgttttggtttctaagctata

SEQ ID NO: 206320 - DNA, 25 bp, Homo sapien
ttatttttcaaaaacgcccactgtg

SEQ ID NO: 206321 - DNA, 25 bp, Homo sapien
caaaaacgcccactgtgatgtgaat

SEQ ID NO: 206322 - DNA, 25 bp, Homo sapien
gtcttattttatacttgtgaaactg

SEQ ID NO: 206323 - DNA, 25 bp, Homo sapien
tgaacacaattttgggacaacgttt

SEQ ID NO: 206324 - DNA, 25 bp, Homo sapien
gtgatgggcaagtgacagaccttcc

SEQ ID NO: 206325 - DNA, 25 bp, Homo sapien
aggctctgcttccagaactctaatg

SEQ ID NO: 206326 - DNA, 25 bp, Homo sapien
aactctaatgggaaactgggcctgt

SEQ ID NO: 206327 - DNA, 25 bp, Homo sapien
gaaactgggcctgtctacctttaga

SEQ ID NO: 206328 - DNA, 25 bp, Homo sapien
gcctgtctacctttagaagtcttcg

SEQ ID NO: 206329 - DNA, 25 bp, Homo sapien
gaagtcttcgattctcagagagcat

SEQ ID NO: 206330 - DNA, 25 bp, Homo sapien
aaacgtgagcgtatcttccaggctt

SEQ ID NO: 206331 - DNA, 25 bp, Homo sapien
ttccaggcttcatggattcttgaca

SEQ ID NO: 206332 - DNA, 25 bp, Homo sapien
gacatgtaattgttttgttcagaaa

SEQ ID NO: 206333 - DNA, 25 bp, Homo sapien
ttctgtataaactatggagatccac

SEQ ID NO: 206334 - DNA, 25 bp, Homo sapien
ggagatccacagtacttttttgttt

SEQ ID NO: 206335 - DNA, 25 bp, Homo sapien
ccagtcagaaaaggcaccacttggg

SEQ ID NO: 206336 - DNA, 25 bp, Homo sapien
aaggcaccacttgggtgggcacagc

SEQ ID NO: 206337 - DNA, 25 bp, Homo sapien
tgggcacagccccatgggtgtccaa

SEQ ID NO: 206338 - DNA, 25 bp, Homo sapien
gccccatgggtgtccaacttggtaa

SEQ ID NO: 206339 - DNA, 25 bp, Homo sapien
gtgtccaacttggtaagcagagcaa

SEQ ID NO: 206340 - DNA, 25 bp, Homo sapien
ttgtcccctgccatctaccgagtgg

SEQ ID NO: 206341 - DNA, 25 bp, Homo sapien
taccgagtggctcactctcaggtgg

SEQ ID NO: 206342 - DNA, 25 bp, Homo sapien
ctcactctcaggtgggagtgctggt

SEQ ID NO: 206343 - DNA, 25 bp, Homo sapien
gctggtgatggttaattaggactgc

SEQ ID NO: 206344 - DNA, 25 bp, Homo sapien
gactgcagaaacatgagcctcctta

SEQ ID NO: 206345 - DNA, 25 bp, Homo sapien
tgagcctccttaacaaagtattggg

SEQ ID NO: 206346 - DNA, 25 bp, Homo sapien
gtctggaaaatcgatctctacaaat

SEQ ID NO: 206347 - DNA, 25 bp, Homo sapien
aatgatccccaaatgctgaaaaagt

SEQ ID NO: 206348 - DNA, 25 bp, Homo sapien
gagcaatgtttagtatattcagctg

SEQ ID NO: 206349 - DNA, 25 bp, Homo sapien
tattcagctgtatctgtagaaactc

SEQ ID NO: 206350 - DNA, 25 bp, Homo sapien
tgtagaaactctttgacgaacctca

SEQ ID NO: 206351 - DNA, 25 bp, Homo sapien
tttgacgaacctcaatttaaccaat

SEQ ID NO: 206352 - DNA, 25 bp, Homo sapien
tgatgaatacccagttctcttcttt

SEQ ID NO: 206353 - DNA, 25 bp, Homo sapien
gaaagatagttgcaacctcacctcc

SEQ ID NO: 206354 - DNA, 25 bp, Homo sapien
tccctcactcaacactttgaatact

SEQ ID NO: 206355 - DNA, 25 bp, Homo sapien
gaatacttattgtttggcaggtcat

SEQ ID NO: 206356 - DNA, 25 bp, Homo sapien
tgtttggcaggtcatccacacactt

SEQ ID NO: 206357 - DNA, 25 bp, Homo sapien
gggcagttagttcacctacacacat

SEQ ID NO: 206358 - DNA, 25 bp, Homo sapien
acacacattgaaatatgatcctaat

SEQ ID NO: 206359 - DNA, 25 bp, Homo sapien
gatcctaattttgagtgctttctac

SEQ ID NO: 206360 - DNA, 25 bp, Homo sapien
taattttgagtgctttctacaattt

SEQ ID NO: 206361 - DNA, 25 bp, Homo sapien
acagtaagacattgttggtggagat

SEQ ID NO: 206362 - DNA, 25 bp, Homo sapien
agtcagggtgacaataagttatttt

SEQ ID NO: 206363 - DNA, 25 bp, Homo sapien
tttacctagtgtttcgagttagaat

SEQ ID NO: 206364 - DNA, 25 bp, Homo sapien
ttgaaataaggtccctaagaggtga

SEQ ID NO: 206365 - DNA, 25 bp, Homo sapien
ggtgaaataacaagtaatccctagt

SEQ ID NO: 206366 - DNA, 25 bp, Homo sapien
agtaatccctagtactaacaatggt

SEQ ID NO: 206367 - DNA, 25 bp, Homo sapien
acaagggcatgtagtttaattaagt

SEQ ID NO: 206368 - DNA, 25 bp, Homo sapien
atacctgtatctaaaattgattctg

SEQ ID NO: 206369 - DNA, 25 bp, Homo sapien
gattctgttaactgttgtcttaaaa

SEQ ID NO: 206370 - DNA, 25 bp, Homo sapien
tctgttaactgttgtcttaaaacta

SEQ ID NO: 206371 - DNA, 25 bp, Homo sapien
aaattgcaattttgattctcatggg

SEQ ID NO: 206372 - DNA, 25 bp, Homo sapien
aattgcaattttgattctcatgggg

SEQ ID NO: 206373 - DNA, 25 bp, Homo sapien
ttgcaattttgattctcatggggga

SEQ ID NO: 206374 - DNA, 25 bp, Homo sapien
ttgcctctggagtttaaagtttcct

SEQ ID NO: 206375 - DNA, 25 bp, Homo sapien
aagttttgtgattcctgtaatagat

SEQ ID NO: 206376 - DNA, 25 bp, Homo sapien
tcctgtaatagatgtgtatgttttc

SEQ ID NO: 206377 - DNA, 25 bp, Homo sapien
catttagttttaatacaacctatgt

SEQ ID NO: 206378 - DNA, 25 bp, Homo sapien
caacctatgtatatatacttctgtg

SEQ ID NO: 206379 - DNA, 25 bp, Homo sapien
gggcacacgccccaagggacatgat

SEQ ID NO: 206380 - DNA, 25 bp, Homo sapien
gacatgatcctctccttagtcttag

SEQ ID NO: 206381 - DNA, 25 bp, Homo sapien
atgatcctctccttagtcttagctc

SEQ ID NO: 206382 - DNA, 25 bp, Homo sapien
cctctccttagtcttagctcatggg

SEQ ID NO: 206383 - DNA, 25 bp, Homo sapien
gctcatggggctctttataaggagt

SEQ ID NO: 206384 - DNA, 25 bp, Homo sapien
ctagaggacagtgctcctggccacc

SEQ ID NO: 206385 - DNA, 25 bp, Homo sapien
tctgctgagaaccattcctgggatt

SEQ ID NO: 206386 - DNA, 25 bp, Homo sapien
gctgagaaccattcctgggattaga

SEQ ID NO: 206387 - DNA, 25 bp, Homo sapien
aaccattcctgggattagagctgcc

SEQ ID NO: 206388 - DNA, 25 bp, Homo sapien
attcctgggattagagctgcctttc

SEQ ID NO: 206389 - DNA, 25 bp, Homo sapien
tctatacaaaggtacttgtcctttc

SEQ ID NO: 206390 - DNA, 25 bp, Homo sapien
gcaaaatctgtttctactacaatgt

SEQ ID NO: 206391 - DNA, 25 bp, Homo sapien
tactaatgccttattgttgcactct

SEQ ID NO: 206392 - DNA, 25 bp, Homo sapien
gccttattgttgcactctttttgaa

SEQ ID NO: 206393 - DNA, 25 bp, Homo sapien
gttgcactctttttgaaatatcctg

SEQ ID NO: 206394 - DNA, 25 bp, Homo sapien
ctctttttgaaatatcctgcagtga

SEQ ID NO: 206395 - DNA, 25 bp, Homo sapien
atgaatcaatttgggcttaaaactg

SEQ ID NO: 206396 - DNA, 25 bp, Homo sapien
gccagttggctgaaaggtttgaaat

SEQ ID NO: 206397 - DNA, 25 bp, Homo sapien
gtaccccagtaaaaccattcaatca

SEQ ID NO: 206398 - DNA, 25 bp, Homo sapien
ctgtatagatgacattttgtagctt

SEQ ID NO: 206399 - DNA, 25 bp, Homo sapien
gtagctttgtacatgttgttaatta

SEQ ID NO: 206400 - DNA, 25 bp, Homo sapien
caaagtataattgctgaactcaggg

SEQ ID NO: 206401 - DNA, 25 bp, Homo sapien
catgcgtgaataccctgcttggatg

SEQ ID NO: 206402 - DNA, 25 bp, Homo sapien
aataccctgcttggatgctgtgctt

SEQ ID NO: 206403 - DNA, 25 bp, Homo sapien
tgtgcttttccggtttgtctctaag

SEQ ID NO: 206404 - DNA, 25 bp, Homo sapien
agggcatgttggtttccctggcctc

SEQ ID NO: 206405 - DNA, 25 bp, Homo sapien
tggcctctcagtgtcctaactggag

SEQ ID NO: 206406 - DNA, 25 bp, Homo sapien
ctaactggagcccagagtgccttgt

SEQ ID NO: 206407 - DNA, 25 bp, Homo sapien
agagtgccttgttctgagccaggag

SEQ ID NO: 206408 - DNA, 25 bp, Homo sapien
cacacctaagcgtcctttacattaa

SEQ ID NO: 206409 - DNA, 25 bp, Homo sapien
ggtcttgtataacacctggtgccat

SEQ ID NO: 206410 - DNA, 25 bp, Homo sapien
ggtgccattgccaagtggctgtgtc

SEQ ID NO: 206411 - DNA, 25 bp, Homo sapien
gtgtcctcagctacagagctggaat

SEQ ID NO: 206412 - DNA, 25 bp, Homo sapien
cacctttcctgtgccatatgatttg

SEQ ID NO: 206413 - DNA, 25 bp, Homo sapien
tgcctccagaactgtatggaagtaa

SEQ ID NO: 206414 - DNA, 25 bp, Homo sapien
gtaaagatcggccatggatatggaa

SEQ ID NO: 206415 - DNA, 25 bp, Homo sapien
attccttatgtcaaagcaccggata

SEQ ID NO: 206416 - DNA, 25 bp, Homo sapien
gcaccggatacgcatgggaacatgt

SEQ ID NO: 206417 - DNA, 25 bp, Homo sapien
ggaacatgtgggtgccctcctgaga

SEQ ID NO: 206418 - DNA, 25 bp, Homo sapien
gtgccctcctgagaatcttgaggca

SEQ ID NO: 206419 - DNA, 25 bp, Homo sapien
gagccacaaacatggaatctcttct

SEQ ID NO: 206420 - DNA, 25 bp, Homo sapien
ggatgtccacttcccttaaagtctt

SEQ ID NO: 206421 - DNA, 25 bp, Homo sapien
taaagtcttatttgcacccttacaa

SEQ ID NO: 206422 - DNA, 25 bp, Homo sapien
aatctttccaaaggtcactcttatg

SEQ ID NO: 206423 - DNA, 25 bp, Homo sapien
gggacttcagtctttccagggcctt

SEQ ID NO: 206424 - DNA, 25 bp, Homo sapien
tctttccagggccttggtggaattt

SEQ ID NO: 206425 - DNA, 25 bp, Homo sapien
gaatttttggctctggtgttttcgc

SEQ ID NO: 206426 - DNA, 25 bp, Homo sapien
actggaagctttgattcaccctcca

SEQ ID NO: 206427 - DNA, 25 bp, Homo sapien
accctccacagtactccagaaagga

SEQ ID NO: 206428 - DNA, 25 bp, Homo sapien
ggactgtcctataagttgtacactt

SEQ ID NO: 206429 - DNA, 25 bp, Homo sapien
tagtagaatggcttttcaccctggt

SEQ ID NO: 206430 - DNA, 25 bp, Homo sapien
cttttcaccctggtgactttggaag

SEQ ID NO: 206431 - DNA, 25 bp, Homo sapien
gaaactcttgaatactgcctgcatc

SEQ ID NO: 206432 - DNA, 25 bp, Homo sapien
ttgaatactgcctgcatccgggcac

SEQ ID NO: 206433 - DNA, 25 bp, Homo sapien
caccatggccaggttgcctaggagt

SEQ ID NO: 206434 - DNA, 25 bp, Homo sapien
tactggaagacttgccaaactggca

SEQ ID NO: 206435 - DNA, 25 bp, Homo sapien
tgccaaactggcaaagctttaagtt

SEQ ID NO: 206436 - DNA, 25 bp, Homo sapien
aagctttaagttcatcagcattcta

SEQ ID NO: 206437 - DNA, 25 bp, Homo sapien
gttcatcagcattctatgtggttca

SEQ ID NO: 206438 - DNA, 25 bp, Homo sapien
cattctatgtggttcagagctgtga

SEQ ID NO: 206439 - DNA, 25 bp, Homo sapien
gagctgtgatttttgcaaagtattt

SEQ ID NO: 206440 - DNA, 25 bp, Homo sapien
gtattttaccaacctcctcgatggc

SEQ ID NO: 206441 - DNA, 25 bp, Homo sapien
aacctcctcgatggctttgataaag

SEQ ID NO: 206442 - DNA, 25 bp, Homo sapien
tttcttactccactaaactataaag

SEQ ID NO: 206443 - DNA, 25 bp, Homo sapien
tttcatctgatttagttagcatcca

SEQ ID NO: 206444 - DNA, 25 bp, Homo sapien
atttagttagcatccacatatcatt

SEQ ID NO: 206445 - DNA, 25 bp, Homo sapien
cttacagattgagctgtatgaattc

SEQ ID NO: 206446 - DNA, 25 bp, Homo sapien
cagattgagctgtatgaattcagcg

SEQ ID NO: 206447 - DNA, 25 bp, Homo sapien
gattgagctgtatgaattcagcggg

SEQ ID NO: 206448 - DNA, 25 bp, Homo sapien
ttgagctgtatgaattcagcgggtc

SEQ ID NO: 206449 - DNA, 25 bp, Homo sapien
gagctgtatgaattcagcgggtctc

SEQ ID NO: 206450 - DNA, 25 bp, Homo sapien
agctgtatgaattcagcgggtctca

SEQ ID NO: 206451 - DNA, 25 bp, Homo sapien
gctgtatgaattcagcgggtctcac

SEQ ID NO: 206452 - DNA, 25 bp, Homo sapien
ctgtatgaattcagcgggtctcact

SEQ ID NO: 206453 - DNA, 25 bp, Homo sapien
tgtatgaattcagcgggtctcactc

SEQ ID NO: 206454 - DNA, 25 bp, Homo sapien
tgaattcagcgggtctcactccaga

SEQ ID NO: 206455 - DNA, 25 bp, Homo sapien
gaattcagcgggtctcactccagag

SEQ ID NO: 206456 - DNA, 25 bp, Homo sapien
gatgttctcagtgattcaactttaa

SEQ ID NO: 206457 - DNA, 25 bp, Homo sapien
aacaaatttctcgtgatgattcatt

SEQ ID NO: 206458 - DNA, 25 bp, Homo sapien
aaatcctgagtgagtctgactgaaa

SEQ ID NO: 206459 - DNA, 25 bp, Homo sapien
aaagagagtggtttccgtttgcagc

SEQ ID NO: 206460 - DNA, 25 bp, Homo sapien
ggtttccgtttgcagctacacagct

SEQ ID NO: 206461 - DNA, 25 bp, Homo sapien
cacagctgtgtgcatcgacgttctc

SEQ ID NO: 206462 - DNA, 25 bp, Homo sapien
gagaccaaagcctgtaactgtccag

SEQ ID NO: 206463 - DNA, 25 bp, Homo sapien
gcctgtaactgtccagcttctaatt

SEQ ID NO: 206464 - DNA, 25 bp, Homo sapien
tcaaaacgggtccattagggcttcg

SEQ ID NO: 206465 - DNA, 25 bp, Homo sapien
ccattagggcttcgttgtgttaaca

SEQ ID NO: 206466 - DNA, 25 bp, Homo sapien
gttaacaagttgacaccatgactag

SEQ ID NO: 206467 - DNA, 25 bp, Homo sapien
cccagagactgaacttcgtacattt

SEQ ID NO: 206468 - DNA, 25 bp, Homo sapien
tcagaatgcaaagatctacccaact

SEQ ID NO: 206469 - DNA, 25 bp, Homo sapien
gattagaagatgaccctccagtatc

SEQ ID NO: 206470 - DNA, 25 bp, Homo sapien
accctccagtatctttattctgctg

SEQ ID NO: 206471 - DNA, 25 bp, Homo sapien
aagtagctatcaggtttatctgtac

SEQ ID NO: 206472 - DNA, 25 bp, Homo sapien
caggtttatctgtactttagaggaa

SEQ ID NO: 206473 - DNA, 25 bp, Homo sapien
gtagctgagttggaacactgtggat

SEQ ID NO: 206474 - DNA, 25 bp, Homo sapien
gaacactgtggatattctgagatca

SEQ ID NO: 206475 - DNA, 25 bp, Homo sapien
gtttggagactgttattttgagcta

SEQ ID NO: 206476 - DNA, 25 bp, Homo sapien
ctaattgagacctataattcaccaa

SEQ ID NO: 206477 - DNA, 25 bp, Homo sapien
tttaatgtctttgcaactttatgct

SEQ ID NO: 206478 - DNA, 25 bp, Homo sapien
agagcctacaggatacacgtgagat

SEQ ID NO: 206479 - DNA, 25 bp, Homo sapien
aatgtcacgtgtagaagatcgttgt

SEQ ID NO: 206480 - DNA, 25 bp, Homo sapien
aagacttcttagattatgatgtaga

SEQ ID NO: 206481 - DNA, 25 bp, Homo sapien
tgatgtagattttagagctccttaa

SEQ ID NO: 206482 - DNA, 25 bp, Homo sapien
gagctccttaaaacataaagcgaat

SEQ ID NO: 206483 - DNA, 25 bp, Homo sapien
aagcgaatcttataaatgttcaatt

SEQ ID NO: 206484 - DNA, 25 bp, Homo sapien
ttccacttggaaaaattagcttttg

SEQ ID NO: 206485 - DNA, 25 bp, Homo sapien
taaatgcagctccatgtttagcata

SEQ ID NO: 206486 - DNA, 25 bp, Homo sapien
gcagctccatgtttagcataatcta

SEQ ID NO: 206487 - DNA, 25 bp, Homo sapien
atttcaagcaatccagaatcttcca

SEQ ID NO: 206488 - DNA, 25 bp, Homo sapien
agcaatccagaatcttccaagaatt

SEQ ID NO: 206489 - DNA, 25 bp, Homo sapien
agtaccgatcagttaactcagcgct

SEQ ID NO: 206490 - DNA, 25 bp, Homo sapien
gttaactcagcgctgaagggcttgt

SEQ ID NO: 206491 - DNA, 25 bp, Homo sapien
aaaggtactattccttctttcacat

SEQ ID NO: 206492 - DNA, 25 bp, Homo sapien
tgttgttcacaactagttttcttat

SEQ ID NO: 206493 - DNA, 25 bp, Homo sapien
gttttcttattgactgtattggact

SEQ ID NO: 206494 - DNA, 25 bp, Homo sapien
gtattggactgtctcttcttgtaga

SEQ ID NO: 206495 - DNA, 25 bp, Homo sapien
gtagagactgattttggccaacata

SEQ ID NO: 206496 - DNA, 25 bp, Homo sapien
gattttggccaacatattaatgcat

SEQ ID NO: 206497 - DNA, 25 bp, Homo sapien
tattagttgcttttaaggagttctg

SEQ ID NO: 206498 - DNA, 25 bp, Homo sapien
ggagttctggcattgtatgtgcatt

SEQ ID NO: 206499 - DNA, 25 bp, Homo sapien
attacatacttaactctgatcaggt

SEQ ID NO: 206500 - DNA, 25 bp, Homo sapien
gattaagacctacccatggcagtgt

SEQ ID NO: 206501 - DNA, 25 bp, Homo sapien
agacctacccatggcagtgtatgga

SEQ ID NO: 206502 - DNA, 25 bp, Homo sapien
catgcattatatgtggacaacccca

SEQ ID NO: 206503 - DNA, 25 bp, Homo sapien
atatgtggacaaccccaccatgaag

SEQ ID NO: 206504 - DNA, 25 bp, Homo sapien
aatgatgttctgtgatatgtgtgac

SEQ ID NO: 206505 - DNA, 25 bp, Homo sapien
gacagaggttatcatactttttgtg

SEQ ID NO: 206506 - DNA, 25 bp, Homo sapien
ttgtgtgggccttggtgctattcca

SEQ ID NO: 206507 - DNA, 25 bp, Homo sapien
ttggtgctattccatcaggtcgctg

SEQ ID NO: 206508 - DNA, 25 bp, Homo sapien
ccatcaggtcgctggatttgtgact

SEQ ID NO: 206509 - DNA, 25 bp, Homo sapien
atttgtgactgttgtcagcgggccc

SEQ ID NO: 206510 - DNA, 25 bp, Homo sapien
gtttttgactctaatactgtatatg

SEQ ID NO: 206511 - DNA, 25 bp, Homo sapien
gtgcccagccttctgttctatttaa

SEQ ID NO: 206512 - DNA, 25 bp, Homo sapien
cccagccttctgttctatttaagaa

SEQ ID NO: 206513 - DNA, 25 bp, Homo sapien
catttattactgtttaggccgaatt

SEQ ID NO: 206514 - DNA, 25 bp, Homo sapien
tattactgtttaggccgaattttcg

SEQ ID NO: 206515 - DNA, 25 bp, Homo sapien
gccgaattttcgctaaacttctgac

SEQ ID NO: 206516 - DNA, 25 bp, Homo sapien
ttttcgctaaacttctgactttcat

SEQ ID NO: 206517 - DNA, 25 bp, Homo sapien
aaacatattgcttatagaacatcag

SEQ ID NO: 206518 - DNA, 25 bp, Homo sapien
gaacatcagaagactcatctttgtg

SEQ ID NO: 206519 - DNA, 25 bp, Homo sapien
gaagactcatctttgtgatgcccaa

SEQ ID NO: 206520 - DNA, 25 bp, Homo sapien
tcatctttgtgatgcccaaatgaaa

SEQ ID NO: 206521 - DNA, 25 bp, Homo sapien
gaaggtagtaccattgtatgtatgt

SEQ ID NO: 206522 - DNA, 25 bp, Homo sapien
ggctctttgctgctggtttgaattg

SEQ ID NO: 206523 - DNA, 25 bp, Homo sapien
ggtttgaattggacacactgctgcg

SEQ ID NO: 206524 - DNA, 25 bp, Homo sapien
ccctctgcttgtggagtggttggca

SEQ ID NO: 206525 - DNA, 25 bp, Homo sapien
ttcccagcagtatcaaccctcagag

SEQ ID NO: 206526 - DNA, 25 bp, Homo sapien
caaccctcagaggagcgggaactgg

SEQ ID NO: 206527 - DNA, 25 bp, Homo sapien
ggaattctggccctacgtgcattca

SEQ ID NO: 206528 - DNA, 25 bp, Homo sapien
gccctacgtgcattcacaggcaatg

SEQ ID NO: 206529 - DNA, 25 bp, Homo sapien
gtgtatggtgtcatgagatcctcta

SEQ ID NO: 206530 - DNA, 25 bp, Homo sapien
agatcctctacctcataacaaaagg

SEQ ID NO: 206531 - DNA, 25 bp, Homo sapien
gtgggtagactaaggcagtagctca

SEQ ID NO: 206532 - DNA, 25 bp, Homo sapien
aaggcagtagctcaaagggctttgc

SEQ ID NO: 206533 - DNA, 25 bp, Homo sapien
aactaatgagtatctgctgcagcag

SEQ ID NO: 206534 - DNA, 25 bp, Homo sapien
aggttattccgggaaagcgctcctg

SEQ ID NO: 206535 - DNA, 25 bp, Homo sapien
gcctcctgagaagggtcatcatctg

SEQ ID NO: 206536 - DNA, 25 bp, Homo sapien
agatcatcgccctttgggaaaagca

SEQ ID NO: 206537 - DNA, 25 bp, Homo sapien
gggaaaagcacgttgtcttcctcct

SEQ ID NO: 206538 - DNA, 25 bp, Homo sapien
gtggcacatgagactggtcagtatc

SEQ ID NO: 206539 - DNA, 25 bp, Homo sapien
ggtcagtatctaatacagagcgtct

SEQ ID NO: 206540 - DNA, 25 bp, Homo sapien
atacagagcgtcttggatgctgccc

SEQ ID NO: 206541 - DNA, 25 bp, Homo sapien
agcctggcttatagagctagcatgg

SEQ ID NO: 206542 - DNA, 25 bp, Homo sapien
tatagagctagcatggaactcacac

SEQ ID NO: 206543 - DNA, 25 bp, Homo sapien
cgccattgccaccagtatggtggta

SEQ ID NO: 206544 - DNA, 25 bp, Homo sapien
attaggcaaactcccattgggttag

SEQ ID NO: 206545 - DNA, 25 bp, Homo sapien
tgggttagggcttctctcattccat

SEQ ID NO: 206546 - DNA, 25 bp, Homo sapien
tctctcattccattttgtggctaac

SEQ ID NO: 206547 - DNA, 25 bp, Homo sapien
ttgtggctaaccttactgtgtttca

SEQ ID NO: 206548 - DNA, 25 bp, Homo sapien
ttactgtgtttcagcccttgctgaa

SEQ ID NO: 206549 - DNA, 25 bp, Homo sapien
agcccttgctgaaaattcttctgat

SEQ ID NO: 206550 - DNA, 25 bp, Homo sapien
tggccattgggagtttggctgtccc

SEQ ID NO: 206551 - DNA, 25 bp, Homo sapien
tgggagtttggctgtccctcagagc

SEQ ID NO: 206552 - DNA, 25 bp, Homo sapien
cctcagagccatccggtcaagcaga

SEQ ID NO: 206553 - DNA, 25 bp, Homo sapien
agcagatggtctgttctatctcaca

SEQ ID NO: 206554 - DNA, 25 bp, Homo sapien
gagttctgtctgaactgaacatgta

SEQ ID NO: 206555 - DNA, 25 bp, Homo sapien
gggcatggagtcattagtctcacaa

SEQ ID NO: 206556 - DNA, 25 bp, Homo sapien
ggactgaagaggatcatttcttttt

SEQ ID NO: 206557 - DNA, 25 bp, Homo sapien
tttctttttgttcgtgaggtcactg

SEQ ID NO: 206558 - DNA, 25 bp, Homo sapien
aggtcactgtccaggcctctcatat

SEQ ID NO: 206559 - DNA, 25 bp, Homo sapien
tctcatatcatgaccagacggcggg

SEQ ID NO: 206560 - DNA, 25 bp, Homo sapien
agacggcgggtctccatcttctttc

SEQ ID NO: 206561 - DNA, 25 bp, Homo sapien
tgtggccctggctgctttacacaat

SEQ ID NO: 206562 - DNA, 25 bp, Homo sapien
ggctgctttacacaatctgttctat

SEQ ID NO: 206563 - DNA, 25 bp, Homo sapien
gttctataaggttcaggtgttttca

SEQ ID NO: 206564 - DNA, 25 bp, Homo sapien
ggtgttttcaagttggaacgatcat

SEQ ID NO: 206565 - DNA, 25 bp, Homo sapien
agttcttttaacagtcttttatgca

SEQ ID NO: 206566 - DNA, 25 bp, Homo sapien
gagttttccttcaggctttacttag

SEQ ID NO: 206567 - DNA, 25 bp, Homo sapien
ccttcaggctttacttaggagaatg

SEQ ID NO: 206568 - DNA, 25 bp, Homo sapien
atggactaagctgaaggtgtacttc

SEQ ID NO: 206569 - DNA, 25 bp, Homo sapien
ggtgtacttcaccagcaagagtcaa

SEQ ID NO: 206570 - DNA, 25 bp, Homo sapien
aagagtcaactctagaattcaggat

SEQ ID NO: 206571 - DNA, 25 bp, Homo sapien
ggatgttccttctattgttttctta

SEQ ID NO: 206572 - DNA, 25 bp, Homo sapien
tgttttcttagccatctgtcaggaa

SEQ ID NO: 206573 - DNA, 25 bp, Homo sapien
gccatctgtcaggaaatgtaacttt

SEQ ID NO: 206574 - DNA, 25 bp, Homo sapien
agcagaaactttttcaatctcaaat

SEQ ID NO: 206575 - DNA, 25 bp, Homo sapien
atatataaggtgtctgctcttttaa

SEQ ID NO: 206576 - DNA, 25 bp, Homo sapien
gctcttttaaaagctctaagctaag

SEQ ID NO: 206577 - DNA, 25 bp, Homo sapien
gggcaaaacacttgaggtcagacgt

SEQ ID NO: 206578 - DNA, 25 bp, Homo sapien
ggcaaaacacttgaggtcagacgtt

SEQ ID NO: 206579 - DNA, 25 bp, Homo sapien
gcaaaacacttgaggtcagacgttt

SEQ ID NO: 206580 - DNA, 25 bp, Homo sapien
caaaacacttgaggtcagacgtttg

SEQ ID NO: 206581 - DNA, 25 bp, Homo sapien
aaaacacttgaggtcagacgtttga

SEQ ID NO: 206582 - DNA, 25 bp, Homo sapien
ggaagctagagcacgagaattatgt

SEQ ID NO: 206583 - DNA, 25 bp, Homo sapien
gctagagcacgagaattatgtgcat

SEQ ID NO: 206584 - DNA, 25 bp, Homo sapien
agagcacgagaattatgtgcatcct

SEQ ID NO: 206585 - DNA, 25 bp, Homo sapien
acgagaattatgtgcatcctggagg

SEQ ID NO: 206586 - DNA, 25 bp, Homo sapien
agaattatgtgcatcctggaggtga

SEQ ID NO: 206587 - DNA, 25 bp, Homo sapien
ttatgtgcatcctggaggtgaaggt

SEQ ID NO: 206588 - DNA, 25 bp, Homo sapien
gcacaatacctaactcatgtttccc

SEQ ID NO: 206589 - DNA, 25 bp, Homo sapien
atacctaactcatgtttcccagtac

SEQ ID NO: 206590 - DNA, 25 bp, Homo sapien
atgtttcccagtacacctgtagata

SEQ ID NO: 206591 - DNA, 25 bp, Homo sapien
acacctgtagatattactgtacttt

SEQ ID NO: 206592 - DNA, 25 bp, Homo sapien
tactgtacttttatgttctcaagaa

SEQ ID NO: 206593 - DNA, 25 bp, Homo sapien
taagttgttgcctattcagtgttac

SEQ ID NO: 206594 - DNA, 25 bp, Homo sapien
gttgcctattcagtgttacagattt

SEQ ID NO: 206595 - DNA, 25 bp, Homo sapien
gacaaggtattttatttctgactga

SEQ ID NO: 206596 - DNA, 25 bp, Homo sapien
aacttgtgtacatgtgtttggaact

SEQ ID NO: 206597 - DNA, 25 bp, Homo sapien
atgtgtttggaactgttgaaatgcc

SEQ ID NO: 206598 - DNA, 25 bp, Homo sapien
ctgttgaaatgccaagttttctgta

SEQ ID NO: 206599 - DNA, 25 bp, Homo sapien
attatatcggttgatcttttttgaa

SEQ ID NO: 206600 - DNA, 25 bp, Homo sapien
gatgaaccaaaggatttgactgcta

SEQ ID NO: 206601 - DNA, 25 bp, Homo sapien
gtctctcataatgagtgcagtgtca

SEQ ID NO: 206602 - DNA, 25 bp, Homo sapien
agtgcagtgtcagactgtgcctact

SEQ ID NO: 206603 - DNA, 25 bp, Homo sapien
agactgtgcctactctgatggtatg

SEQ ID NO: 206604 - DNA, 25 bp, Homo sapien
gtgcctactctgatggtatgtgcca

SEQ ID NO: 206605 - DNA, 25 bp, Homo sapien
ctctgatggtatgtgccatttgtaa

SEQ ID NO: 206606 - DNA, 25 bp, Homo sapien
gagaacactggttcagacattcagt

SEQ ID NO: 206607 - DNA, 25 bp, Homo sapien
tggttcagacattcagtgggcaagt

SEQ ID NO: 206608 - DNA, 25 bp, Homo sapien
cagacattcagtgggcaagtaaatt

SEQ ID NO: 206609 - DNA, 25 bp, Homo sapien
tgggcaagtaaattatggactgcaa

SEQ ID NO: 206610 - DNA, 25 bp, Homo sapien
gttctagctgctcacatgtacaaat

SEQ ID NO: 206611 - DNA, 25 bp, Homo sapien
gtacaaatcacttctaggcctcagt

SEQ ID NO: 206612 - DNA, 25 bp, Homo sapien
agattgcactagcttgtctctaaaa

SEQ ID NO: 206613 - DNA, 25 bp, Homo sapien
ctctaaaattgctgtgactccagat

SEQ ID NO: 206614 - DNA, 25 bp, Homo sapien
gactccagatactttgcactgaaga

SEQ ID NO: 206615 - DNA, 25 bp, Homo sapien
gaatctagggtgtttgatatctgtt

SEQ ID NO: 206616 - DNA, 25 bp, Homo sapien
tatctgtttcagttagggctaatgg

SEQ ID NO: 206617 - DNA, 25 bp, Homo sapien
cttttgctgacttattatgagatga

SEQ ID NO: 206618 - DNA, 25 bp, Homo sapien
gagtgggcctaactcatgtgagctt

SEQ ID NO: 206619 - DNA, 25 bp, Homo sapien
gagcttgataactgatgaactcatt

SEQ ID NO: 206620 - DNA, 25 bp, Homo sapien
actcattgggagcattttaaacttt

SEQ ID NO: 206621 - DNA, 25 bp, Homo sapien
ggaagcattaatagacacaattcag

SEQ ID NO: 206622 - DNA, 25 bp, Homo sapien
aagatcactcatgcaaagacaacat

SEQ ID NO: 206623 - DNA, 25 bp, Homo sapien
aagacaacattcgtgaggcatttca

SEQ ID NO: 206624 - DNA, 25 bp, Homo sapien
ggaagcttcaggatatgtggacaga

SEQ ID NO: 206625 - DNA, 25 bp, Homo sapien
gtggacagagacatgttctttaaaa

SEQ ID NO: 206626 - DNA, 25 bp, Homo sapien
aaatctgtgaatcgcttaacgtccc

SEQ ID NO: 206627 - DNA, 25 bp, Homo sapien
atcgcttaacgtcccagtggatgac

SEQ ID NO: 206628 - DNA, 25 bp, Homo sapien
gttaatcaggatgtgctctcatgga

SEQ ID NO: 206629 - DNA, 25 bp, Homo sapien
tataactttgttcgtgctttctcaa

SEQ ID NO: 206630 - DNA, 25 bp, Homo sapien
gctttctcaaactgacctgctgatg

SEQ ID NO: 206631 - DNA, 25 bp, Homo sapien
caatttttgatactggaactatgct

SEQ ID NO: 206632 - DNA, 25 bp, Homo sapien
attcccagcactgtttcaggcaaga

SEQ ID NO: 206633 - DNA, 25 bp, Homo sapien
gaactttccctttcaacttcaggct

SEQ ID NO: 206634 - DNA, 25 bp, Homo sapien
aggctcattttcttctcaactctgg

SEQ ID NO: 206635 - DNA, 25 bp, Homo sapien
tcaactctggctctctcaaggagct

SEQ ID NO: 206636 - DNA, 25 bp, Homo sapien
gaagttttccaagaggttcatggga

SEQ ID NO: 206637 - DNA, 25 bp, Homo sapien
tggctgtcttgcatcagtcccaggc

SEQ ID NO: 206638 - DNA, 25 bp, Homo sapien
gagccagcctttggtttcgtttact

SEQ ID NO: 206639 - DNA, 25 bp, Homo sapien
tttggtttcgtttacttgcctacag

SEQ ID NO: 206640 - DNA, 25 bp, Homo sapien
acttgcctacagtgctgtacgcaat

SEQ ID NO: 206641 - DNA, 25 bp, Homo sapien
gtaaagtgaacccatctgtctgcat

SEQ ID NO: 206642 - DNA, 25 bp, Homo sapien
atctgtctgcattttctactctgag

SEQ ID NO: 206643 - DNA, 25 bp, Homo sapien
cacagggagaggatggttgtccctg

SEQ ID NO: 206644 - DNA, 25 bp, Homo sapien
aaccttagcccctcagaacagggag

SEQ ID NO: 206645 - DNA, 25 bp, Homo sapien
cagaacagggagtcccaggacccag

SEQ ID NO: 206646 - DNA, 25 bp, Homo sapien
cagcctgtctcttgtagcttcctgg

SEQ ID NO: 206647 - DNA, 25 bp, Homo sapien
agcctgtctcttgtagcttcctggg

SEQ ID NO: 206648 - DNA, 25 bp, Homo sapien
gggcaaagcaataccccagggaaag

SEQ ID NO: 206649 - DNA, 25 bp, Homo sapien
ggcaaagcaataccccagggaaagt

SEQ ID NO: 206650 - DNA, 25 bp, Homo sapien
agcaataccccagggaaagtgggag

SEQ ID NO: 206651 - DNA, 25 bp, Homo sapien
tctccaggcccaccatgctgggaga

SEQ ID NO: 206652 - DNA, 25 bp, Homo sapien
caccatgctgggagaggcggccaga

SEQ ID NO: 206653 - DNA, 25 bp, Homo sapien
ggcctccagcctgggactgctgtga

SEQ ID NO: 206654 - DNA, 25 bp, Homo sapien
tttatttcccttaaggtctggatga

SEQ ID NO: 206655 - DNA, 25 bp, Homo sapien
atttcccttaaggtctggatgagac

SEQ ID NO: 206656 - DNA, 25 bp, Homo sapien
aaggtctggatgagacttctttggg

SEQ ID NO: 206657 - DNA, 25 bp, Homo sapien
gggccacgtgggtcattagaagcca

SEQ ID NO: 206658 - DNA, 25 bp, Homo sapien
cattagaagccagagctctcctcca

SEQ ID NO: 206659 - DNA, 25 bp, Homo sapien
cttcccagtgcctagaggtgctata

SEQ ID NO: 206660 - DNA, 25 bp, Homo sapien
gtgcctagaggtgctataggaaaca

SEQ ID NO: 206661 - DNA, 25 bp, Homo sapien
ataggaaacatagatccagccaggg

SEQ ID NO: 206662 - DNA, 25 bp, Homo sapien
gggcttccctaaagcagtgcagcac

SEQ ID NO: 206663 - DNA, 25 bp, Homo sapien
taaagcagtgcagcaccggcccagg

SEQ ID NO: 206664 - DNA, 25 bp, Homo sapien
ggcatcactagacaggccctaatta

SEQ ID NO: 206665 - DNA, 25 bp, Homo sapien
ttcctggtacagctcagcatggatt

SEQ ID NO: 206666 - DNA, 25 bp, Homo sapien
atttcagctcctactacaaccgggt

SEQ ID NO: 206667 - DNA, 25 bp, Homo sapien
actacaaccgggtacacatcctggg

SEQ ID NO: 206668 - DNA, 25 bp, Homo sapien
ggagcctcgaccacacctctttggt

SEQ ID NO: 206669 - DNA, 25 bp, Homo sapien
tgcgtgaggtgctccatactggcct

SEQ ID NO: 206670 - DNA, 25 bp, Homo sapien
aggtgctccatactggcctggctat

SEQ ID NO: 206671 - DNA, 25 bp, Homo sapien
tactggcctggctatgctgggtctc

SEQ ID NO: 206672 - DNA, 25 bp, Homo sapien
taaggccacagaggctccaatacct

SEQ ID NO: 206673 - DNA, 25 bp, Homo sapien
gaggctccaatacctgggaatgttc

SEQ ID NO: 206674 - DNA, 25 bp, Homo sapien
aatacctgggaatgttcacaaagtc

SEQ ID NO: 206675 - DNA, 25 bp, Homo sapien
gttcacaaagtcatcaactggaaaa

SEQ ID NO: 206676 - DNA, 25 bp, Homo sapien
agaggagatctctccccagtagtgc

SEQ ID NO: 206677 - DNA, 25 bp, Homo sapien
gatctctccccagtagtgctggtca

SEQ ID NO: 206678 - DNA, 25 bp, Homo sapien
agtagtgctggtcaccctccggcat

SEQ ID NO: 206679 - DNA, 25 bp, Homo sapien
ggcatctgtgactctacctcaagga

SEQ ID NO: 206680 - DNA, 25 bp, Homo sapien
atctgtgactctacctcaaggacca

SEQ ID NO: 206681 - DNA, 25 bp, Homo sapien
tcctgctctgtttggggatcaagaa

SEQ ID NO: 206682 - DNA, 25 bp, Homo sapien
gaactgtaaatttatgtatcatagg

SEQ ID NO: 206683 - DNA, 25 bp, Homo sapien
atgtatcataggtgcacctgagccc

SEQ ID NO: 206684 - DNA, 25 bp, Homo sapien
ataggtgcacctgagccccacagaa

SEQ ID NO: 206685 - DNA, 25 bp, Homo sapien
gcacctgagccccacagaaagttgt

SEQ ID NO: 206686 - DNA, 25 bp, Homo sapien
gagccccacagaaagttgtgcataa

SEQ ID NO: 206687 - DNA, 25 bp, Homo sapien
agacggggttttgtctcattgccca

SEQ ID NO: 206688 - DNA, 25 bp, Homo sapien
aactcctgagcacaagcaatacgct

SEQ ID NO: 206689 - DNA, 25 bp, Homo sapien
actcctgagcacaagcaatacgctt

SEQ ID NO: 206690 - DNA, 25 bp, Homo sapien
gagcacaagcaatacgcttgcctta

SEQ ID NO: 206691 - DNA, 25 bp, Homo sapien
gcacaagcaatacgcttgccttagc

SEQ ID NO: 206692 - DNA, 25 bp, Homo sapien
aagcaatacgcttgccttagccacc

SEQ ID NO: 206693 - DNA, 25 bp, Homo sapien
atacgcttgccttagccacccaaag

SEQ ID NO: 206694 - DNA, 25 bp, Homo sapien
ttacatgggtgagctaccgtgtcca

SEQ ID NO: 206695 - DNA, 25 bp, Homo sapien
agctaccgtgtccagcctcaattta

SEQ ID NO: 206696 - DNA, 25 bp, Homo sapien
ctaccgtgtccagcctcaatttaaa

SEQ ID NO: 206697 - DNA, 25 bp, Homo sapien
gataccccctttaccctgtgattat

SEQ ID NO: 206698 - DNA, 25 bp, Homo sapien
aagtgaggaacggacccatcattcc

SEQ ID NO: 206699 - DNA, 25 bp, Homo sapien
gaggaacggacccatcattcccaag

SEQ ID NO: 206700 - DNA, 25 bp, Homo sapien
tgcccttgtgccctgttattagttt

SEQ ID NO: 206701 - DNA, 25 bp, Homo sapien
gccctgttattagtttgcatgtcct

SEQ ID NO: 206702 - DNA, 25 bp, Homo sapien
gtttgcatgtcctagaattctatgt

SEQ ID NO: 206703 - DNA, 25 bp, Homo sapien
tatcccttttttggtcaggcatatt

SEQ ID NO: 206704 - DNA, 25 bp, Homo sapien
ggtcaggcatattttactcagtata

SEQ ID NO: 206705 - DNA, 25 bp, Homo sapien
atgtggtagcatgtgtcacgagttt

SEQ ID NO: 206706 - DNA, 25 bp, Homo sapien
agcatgtgtcacgagtttttgtttt

SEQ ID NO: 206707 - DNA, 25 bp, Homo sapien
tttcattgctgagtactgcttcatt

SEQ ID NO: 206708 - DNA, 25 bp, Homo sapien
gctgagtactgcttcattgaataga

SEQ ID NO: 206709 - DNA, 25 bp, Homo sapien
aaggcttgactgcttcaaagcttcc

SEQ ID NO: 206710 - DNA, 25 bp, Homo sapien
aaagcttccctggacctgaagccag

SEQ ID NO: 206711 - DNA, 25 bp, Homo sapien
agggcagaggcgtccgctgacaaat

SEQ ID NO: 206712 - DNA, 25 bp, Homo sapien
cgctgacaaatcactcccatgatga

SEQ ID NO: 206713 - DNA, 25 bp, Homo sapien
atgatgagaccctggaggactccaa

SEQ ID NO: 206714 - DNA, 25 bp, Homo sapien
gactccaaatcctcgctgtgaacag

SEQ ID NO: 206715 - DNA, 25 bp, Homo sapien
gaacaggactggacggttgcgcaca

SEQ ID NO: 206716 - DNA, 25 bp, Homo sapien
ggttgcgcacaaacaaacgctgcca

SEQ ID NO: 206717 - DNA, 25 bp, Homo sapien
gacattagcacaacttacgcattgg

SEQ ID NO: 206718 - DNA, 25 bp, Homo sapien
attgtgtgtattttctagcacttgt

SEQ ID NO: 206719 - DNA, 25 bp, Homo sapien
agcacttgtgtattggaaaacctgt

SEQ ID NO: 206720 - DNA, 25 bp, Homo sapien
tttggtcctcctctgtttcatagaa

SEQ ID NO: 206721 - DNA, 25 bp, Homo sapien
ggtcctcctctgtttcatagaaaag

SEQ ID NO: 206722 - DNA, 25 bp, Homo sapien
actgcaatatttgagaactgttctt

SEQ ID NO: 206723 - DNA, 25 bp, Homo sapien
ttttcttgtgtgtgccatctttcca

SEQ ID NO: 206724 - DNA, 25 bp, Homo sapien
atctttccattgttggctacgtctt

SEQ ID NO: 206725 - DNA, 25 bp, Homo sapien
ttgttggctacgtcttttcttttgc

SEQ ID NO: 206726 - DNA, 25 bp, Homo sapien
tcttttgccttgatgaacgttctat

SEQ ID NO: 206727 - DNA, 25 bp, Homo sapien
gaacgttctatgtatttcatcggat

SEQ ID NO: 206728 - DNA, 25 bp, Homo sapien
tttcatcggatatacagcatattcc

SEQ ID NO: 206729 - DNA, 25 bp, Homo sapien
cggatatacagcatattccatttag

SEQ ID NO: 206730 - DNA, 25 bp, Homo sapien
gacgataaagtgtttttagtatgct

SEQ ID NO: 206731 - DNA, 25 bp, Homo sapien
aacatcaaagatgcagcaagcttat

SEQ ID NO: 206732 - DNA, 25 bp, Homo sapien
gtacttttggttatgcaaacacttt

SEQ ID NO: 206733 - DNA, 25 bp, Homo sapien
atataaacagttatgtcccctataa

SEQ ID NO: 206734 - DNA, 25 bp, Homo sapien
tatgtcccctataaatctggtcagc

SEQ ID NO: 206735 - DNA, 25 bp, Homo sapien
aaatctggtcagcaacctcttttga

SEQ ID NO: 206736 - DNA, 25 bp, Homo sapien
ggtcagcaacctcttttgattttgt

SEQ ID NO: 206737 - DNA, 25 bp, Homo sapien
aaatagtctgtagtaggtagagtac

SEQ ID NO: 206738 - DNA, 25 bp, Homo sapien
gtactgggtacaagtggtccaaact

SEQ ID NO: 206739 - DNA, 25 bp, Homo sapien
caagtggtccaaactaagataagag

SEQ ID NO: 206740 - DNA, 25 bp, Homo sapien
gaaactgggtttatgcactaaacgt

SEQ ID NO: 206741 - DNA, 25 bp, Homo sapien
cactaaacgttttgtgccttggtct

SEQ ID NO: 206742 - DNA, 25 bp, Homo sapien
gctcagagttcgtgccagtggtggt

SEQ ID NO: 206743 - DNA, 25 bp, Homo sapien
agttcgtgccagtggtggtgagccg

SEQ ID NO: 206744 - DNA, 25 bp, Homo sapien
tgagccggctggtgctgcgctccat

SEQ ID NO: 206745 - DNA, 25 bp, Homo sapien
tgcgctccatgagccgccgggatgt

SEQ ID NO: 206746 - DNA, 25 bp, Homo sapien
aggtggcaatacttccgctcactgc

SEQ ID NO: 206747 - DNA, 25 bp, Homo sapien
ccagatgttccattctgaggactat

SEQ ID NO: 206748 - DNA, 25 bp, Homo sapien
tgttccattctgaggactatgagtt

SEQ ID NO: 206749 - DNA, 25 bp, Homo sapien
atgagttgctggtgcttcagcatgg

SEQ ID NO: 206750 - DNA, 25 bp, Homo sapien
tgctggtgcttcagcatggctgctg

SEQ ID NO: 206751 - DNA, 25 bp, Homo sapien
cctactgccgcaggtgcaaggatga

SEQ ID NO: 206752 - DNA, 25 bp, Homo sapien
tgccgcaggtgcaaggatgaccctg

SEQ ID NO: 206753 - DNA, 25 bp, Homo sapien
aatgcagcagaggtactcttctgtc

SEQ ID NO: 206754 - DNA, 25 bp, Homo sapien
agcagaggtactcttctgtcccttc

SEQ ID NO: 206755 - DNA, 25 bp, Homo sapien
tcttctgtcccttccgtttatagtt

SEQ ID NO: 206756 - DNA, 25 bp, Homo sapien
cccttccgtttatagttctctgaga

SEQ ID NO: 206757 - DNA, 25 bp, Homo sapien
tccgtttatagttctctgagagagt

SEQ ID NO: 206758 - DNA, 25 bp, Homo sapien
gagagagttctattttttggttttg

SEQ ID NO: 206759 - DNA, 25 bp, Homo sapien
ttgtatcttgtatttatccctgaac

SEQ ID NO: 206760 - DNA, 25 bp, Homo sapien
tgtatttatccctgaacatgttttg

SEQ ID NO: 206761 - DNA, 25 bp, Homo sapien
tacttgcatgatatactgtagtcaa

SEQ ID NO: 206762 - DNA, 25 bp, Homo sapien
atgatatactgtagtcaatgttcgg

SEQ ID NO: 206763 - DNA, 25 bp, Homo sapien
tgcactccatccatcataactgtat

SEQ ID NO: 206764 - DNA, 25 bp, Homo sapien
ttaaaaattattgctagggtagtct

SEQ ID NO: 206765 - DNA, 25 bp, Homo sapien
acagaagcatgttatttcattccca

SEQ ID NO: 206766 - DNA, 25 bp, Homo sapien
agaagcatgttatttcattcccatt

SEQ ID NO: 206767 - DNA, 25 bp, Homo sapien
gaagcatgttatttcattcccattc

SEQ ID NO: 206768 - DNA, 25 bp, Homo sapien
gaaactttgttttctgatatgaact

SEQ ID NO: 206769 - DNA, 25 bp, Homo sapien
ctttgttttctgatatgaactattg

SEQ ID NO: 206770 - DNA, 25 bp, Homo sapien
atgaactattgcagatgtttttata

SEQ ID NO: 206771 - DNA, 25 bp, Homo sapien
aatgatgtaaacagtagtacccaac

SEQ ID NO: 206772 - DNA, 25 bp, Homo sapien
gatgtaaacagtagtacccaacact

SEQ ID NO: 206773 - DNA, 25 bp, Homo sapien
gtaaacagtagtacccaacactgta

SEQ ID NO: 206774 - DNA, 25 bp, Homo sapien
agtagtacccaacactgtaaactca

SEQ ID NO: 206775 - DNA, 25 bp, Homo sapien
cagagtcatctggtcaggttgcaat

SEQ ID NO: 206776 - DNA, 25 bp, Homo sapien
caggttgcaatatgaggacttctct

SEQ ID NO: 206777 - DNA, 25 bp, Homo sapien
ctgggacactgagcttacttaatac

SEQ ID NO: 206778 - DNA, 25 bp, Homo sapien
gacactgagcttacttaatacatta

SEQ ID NO: 206779 - DNA, 25 bp, Homo sapien
ttcaaaagaggagcgttgtttcatc

SEQ ID NO: 206780 - DNA, 25 bp, Homo sapien
aaaatgttaggccattactttgagt

SEQ ID NO: 206781 - DNA, 25 bp, Homo sapien
gaattttatgaccagaatccaacaa

SEQ ID NO: 206782 - DNA, 25 bp, Homo sapien
accagaatccaacaagagctctatt

SEQ ID NO: 206783 - DNA, 25 bp, Homo sapien
gagctctattttggaattgtgccca

SEQ ID NO: 206784 - DNA, 25 bp, Homo sapien
attttggaattgtgcccaagttggt

SEQ ID NO: 206785 - DNA, 25 bp, Homo sapien
gcccaagttggtgatgtttactcta

SEQ ID NO: 206786 - DNA, 25 bp, Homo sapien
tgttaggagatgtctgcttttccat

SEQ ID NO: 206787 - DNA, 25 bp, Homo sapien
gaaatgaaatagtggctaaagccct

SEQ ID NO: 206788 - DNA, 25 bp, Homo sapien
gtggctaaagccctgaaagaggcaa

SEQ ID NO: 206789 - DNA, 25 bp, Homo sapien
gaggcaagactacaatgggctgaaa

SEQ ID NO: 206790 - DNA, 25 bp, Homo sapien
acagttggtatagcaaccccagaga

SEQ ID NO: 206791 - DNA, 25 bp, Homo sapien
accccagagaagtgcttcattttct

SEQ ID NO: 206792 - DNA, 25 bp, Homo sapien
tttatagtagaagcaggtccatgtc

SEQ ID NO: 206793 - DNA, 25 bp, Homo sapien
gcaggtccatgtcttttgtggtttc

SEQ ID NO: 206794 - DNA, 25 bp, Homo sapien
atgtcttttgtggtttcctgcacat

SEQ ID NO: 206795 - DNA, 25 bp, Homo sapien
cctgcacatctttggagtagttatg

SEQ ID NO: 206796 - DNA, 25 bp, Homo sapien
ttggagtagttatgacttctcagtt

SEQ ID NO: 206797 - DNA, 25 bp, Homo sapien
tgaatacagcttcagtctggctctc

SEQ ID NO: 206798 - DNA, 25 bp, Homo sapien
gcttcagtctggctctctaatagga

SEQ ID NO: 206799 - DNA, 25 bp, Homo sapien
aaaagccagtccatgtgttgtctct

SEQ ID NO: 206800 - DNA, 25 bp, Homo sapien
gttgtctctcactgatttagctttt

SEQ ID NO: 206801 - DNA, 25 bp, Homo sapien
cttttctttgaacaattcggcatga

SEQ ID NO: 206802 - DNA, 25 bp, Homo sapien
tcggcatgaattgaaaccaggtttt

SEQ ID NO: 206803 - DNA, 25 bp, Homo sapien
tctttcttgcaactcttagtgttta

SEQ ID NO: 206804 - DNA, 25 bp, Homo sapien
agtaagacgaggataccttcagttt

SEQ ID NO: 206805 - DNA, 25 bp, Homo sapien
gaatctgcataatgttcactgccaa

SEQ ID NO: 206806 - DNA, 25 bp, Homo sapien
tgccaaactccttctcatttaatgc

SEQ ID NO: 206807 - DNA, 25 bp, Homo sapien
catttaatgcttatggccttcacat

SEQ ID NO: 206808 - DNA, 25 bp, Homo sapien
acttattgctgctaaaacttcttaa

SEQ ID NO: 206809 - DNA, 25 bp, Homo sapien
acttcttaaatggttgtttctgcta

SEQ ID NO: 206810 - DNA, 25 bp, Homo sapien
ggttgtttctgctatagttatttct

SEQ ID NO: 206811 - DNA, 25 bp, Homo sapien
agttatttctattgcagttccaaat

SEQ ID NO: 206812 - DNA, 25 bp, Homo sapien
gttccaaattgccatcttcccttgt

SEQ ID NO: 206813 - DNA, 25 bp, Homo sapien
catttgcaagttctcaattgtattt

SEQ ID NO: 206814 - DNA, 25 bp, Homo sapien
tttctctcaaatggacaggttcctt

SEQ ID NO: 206815 - DNA, 25 bp, Homo sapien
aatggacaggttccttctttactgg

SEQ ID NO: 206816 - DNA, 25 bp, Homo sapien
catattggtttttcattacttctga

SEQ ID NO: 206817 - DNA, 25 bp, Homo sapien
aaggatttctgtgctattataatta

SEQ ID NO: 206818 - DNA, 25 bp, Homo sapien
gaaatcaacgtctttggtcaggaac

SEQ ID NO: 206819 - DNA, 25 bp, Homo sapien
gaaatcccagagattgcaagttaat

SEQ ID NO: 206820 - DNA, 25 bp, Homo sapien
atcccagagattgcaagttaatgaa

SEQ ID NO: 206821 - DNA, 25 bp, Homo sapien
gatcaggactttttaattactgtgg

SEQ ID NO: 206822 - DNA, 25 bp, Homo sapien
gtggtaattaaatgtgttcagtatg

SEQ ID NO: 206823 - DNA, 25 bp, Homo sapien
gtgttcagtatgtacttatcagtac

SEQ ID NO: 206824 - DNA, 25 bp, Homo sapien
ttatcagtacatttagtctgcaatg

SEQ ID NO: 206825 - DNA, 25 bp, Homo sapien
atttagtctgcaatgttttaatttt

SEQ ID NO: 206826 - DNA, 25 bp, Homo sapien
gttacatgaaactaacattccaagg

SEQ ID NO: 206827 - DNA, 25 bp, Homo sapien
gaaactaacattccaagggtcagga

SEQ ID NO: 206828 - DNA, 25 bp, Homo sapien
ggcaaataagatatggaccaaagtc

SEQ ID NO: 206829 - DNA, 25 bp, Homo sapien
ggaccaaagtcactaatgttttaca

SEQ ID NO: 206830 - DNA, 25 bp, Homo sapien
agctgctcccatcttgctggaattt

SEQ ID NO: 206831 - DNA, 25 bp, Homo sapien
ctggaatttcttgggcggcttctcc

SEQ ID NO: 206832 - DNA, 25 bp, Homo sapien
ttctccacctgtatctcaagacaga

SEQ ID NO: 206833 - DNA, 25 bp, Homo sapien
caccctcgcttatctgtagattcaa

SEQ ID NO: 206834 - DNA, 25 bp, Homo sapien
agattcaaagcgatgttctcttctg

SEQ ID NO: 206835 - DNA, 25 bp, Homo sapien
gatgttctcttctgtgctcttagaa

SEQ ID NO: 206836 - DNA, 25 bp, Homo sapien
gggagttcagcagtaacagccaggt

SEQ ID NO: 206837 - DNA, 25 bp, Homo sapien
aacagccaggtgaagcgaacctgct

SEQ ID NO: 206838 - DNA, 25 bp, Homo sapien
gctgggtgatttgtttgcgctctgt

SEQ ID NO: 206839 - DNA, 25 bp, Homo sapien
gggcattcctgcgagatgtgtcagc

SEQ ID NO: 206840 - DNA, 25 bp, Homo sapien
ctgcgagatgtgtcagcttctgtat

SEQ ID NO: 206841 - DNA, 25 bp, Homo sapien
agcaccttgacttggcagcatggag

SEQ ID NO: 206842 - DNA, 25 bp, Homo sapien
agcatggagccaaggtctgtccccg

SEQ ID NO: 206843 - DNA, 25 bp, Homo sapien
tctgccccagggagtcccttttgat

SEQ ID NO: 206844 - DNA, 25 bp, Homo sapien
ccagggagtcccttttgatgggaag

SEQ ID NO: 206845 - DNA, 25 bp, Homo sapien
ccttttgatgggaagtgcagtcagc

SEQ ID NO: 206846 - DNA, 25 bp, Homo sapien
cgtggaggtgtctgggccaccttca

SEQ ID NO: 206847 - DNA, 25 bp, Homo sapien
ggtgtctgggccaccttcagaaggt

SEQ ID NO: 206848 - DNA, 25 bp, Homo sapien
gatgtggtggccgagaccccgtcca

SEQ ID NO: 206849 - DNA, 25 bp, Homo sapien
cccgtccacggagggtgatggcctt

SEQ ID NO: 206850 - DNA, 25 bp, Homo sapien
tggcctttcccttctgcaggtgcgg

SEQ ID NO: 206851 - DNA, 25 bp, Homo sapien
gcaggtgggcctgggaccggtgctg

SEQ ID NO: 206852 - DNA, 25 bp, Homo sapien
aaacaaaactctgtcaactccaaat

SEQ ID NO: 206853 - DNA, 25 bp, Homo sapien
aacaaaactctgtcaactccaaatt

SEQ ID NO: 206854 - DNA, 25 bp, Homo sapien
acaaaactctgtcaactccaaattc

SEQ ID NO: 206855 - DNA, 25 bp, Homo sapien
caaaactctgtcaactccaaattcc

SEQ ID NO: 206856 - DNA, 25 bp, Homo sapien
attcctatttggtgaaatgatcctt

SEQ ID NO: 206857 - DNA, 25 bp, Homo sapien
ttcctatttggtgaaatgatccttc

SEQ ID NO: 206858 - DNA, 25 bp, Homo sapien
tcctatttggtgaaatgatccttca

SEQ ID NO: 206859 - DNA, 25 bp, Homo sapien
cctatttggtgaaatgatccttcag

SEQ ID NO: 206860 - DNA, 25 bp, Homo sapien
ctatttggtgaaatgatccttcagg

SEQ ID NO: 206861 - DNA, 25 bp, Homo sapien
aatgatccttcaggattgatggggt

SEQ ID NO: 206862 - DNA, 25 bp, Homo sapien
gtaggtccaaagttgttgaccgtat

SEQ ID NO: 206863 - DNA, 25 bp, Homo sapien
ttgaccgtatttacagtctctacaa

SEQ ID NO: 206864 - DNA, 25 bp, Homo sapien
gtctctacaaacttacagctcataa

SEQ ID NO: 206865 - DNA, 25 bp, Homo sapien
gaagaattcttctataagcattcct

SEQ ID NO: 206866 - DNA, 25 bp, Homo sapien
agcattccttttatcccagaaacac

SEQ ID NO: 206867 - DNA, 25 bp, Homo sapien
cagaaacacctgtaaggaccagaat

SEQ ID NO: 206868 - DNA, 25 bp, Homo sapien
aagacttaagccagattgggttttg

SEQ ID NO: 206869 - DNA, 25 bp, Homo sapien
agccagattgggttttgagaagaga

SEQ ID NO: 206870 - DNA, 25 bp, Homo sapien
gaagaaatcacaaatcccctgcaag

SEQ ID NO: 206871 - DNA, 25 bp, Homo sapien
aatcccctgcaagctattcaaatgg

SEQ ID NO: 206872 - DNA, 25 bp, Homo sapien
gatggatacgcttggcattccttat

SEQ ID NO: 206873 - DNA, 25 bp, Homo sapien
gtctggagcataaggtttatctcaa

SEQ ID NO: 206874 - DNA, 25 bp, Homo sapien
ggagcataaggtttatctcaagtct

SEQ ID NO: 206875 - DNA, 25 bp, Homo sapien
gcataaggtttatctcaagtctcaa

SEQ ID NO: 206876 - DNA, 25 bp, Homo sapien
taaggtttatctcaagtctcaattg

SEQ ID NO: 206877 - DNA, 25 bp, Homo sapien
ggtttatctcaagtctcaattgaac

SEQ ID NO: 206878 - DNA, 25 bp, Homo sapien
ctcaagtctcaattgaactgcctcc

SEQ ID NO: 206879 - DNA, 25 bp, Homo sapien
aagtctcaattgaactgcctcctct

SEQ ID NO: 206880 - DNA, 25 bp, Homo sapien
actgcctcctcttgtcaggcaggga

SEQ ID NO: 206881 - DNA, 25 bp, Homo sapien
gcctcctcttgtcaggcagggacaa

SEQ ID NO: 206882 - DNA, 25 bp, Homo sapien
tcttgtcaggcagggacaactggga

SEQ ID NO: 206883 - DNA, 25 bp, Homo sapien
gggacaactgggaggatgagcccca

SEQ ID NO: 206884 - DNA, 25 bp, Homo sapien
gtgtccccagttgttacataatttg

SEQ ID NO: 206885 - DNA, 25 bp, Homo sapien
tgtgatatggtactgtggttatgtt

SEQ ID NO: 206886 - DNA, 25 bp, Homo sapien
atggtactgtggttatgttgtttta

SEQ ID NO: 206887 - DNA, 25 bp, Homo sapien
gatatgttactggtattcgcttcaa

SEQ ID NO: 206888 - DNA, 25 bp, Homo sapien
gttactggtattcgcttcaaaatca

SEQ ID NO: 206889 - DNA, 25 bp, Homo sapien
actggtattcgcttcaaaatcatct

SEQ ID NO: 206890 - DNA, 25 bp, Homo sapien
ggtattcgcttcaaaatcatctgag

SEQ ID NO: 206891 - DNA, 25 bp, Homo sapien
attcgcttcaaaatcatctgagtgt

SEQ ID NO: 206892 - DNA, 25 bp, Homo sapien
gattggccataaattggtaattgct

SEQ ID NO: 206893 - DNA, 25 bp, Homo sapien
ataaattggtaattgctgaagctgt

SEQ ID NO: 206894 - DNA, 25 bp, Homo sapien
ggatgtttgagagttcattatacta

SEQ ID NO: 206895 - DNA, 25 bp, Homo sapien
ttccaaatgggcctctctggtatgg

SEQ ID NO: 206896 - DNA, 25 bp, Homo sapien
tgggcctctctggtatgggcaatag

SEQ ID NO: 206897 - DNA, 25 bp, Homo sapien
tggtatgggcaataggcaagctcct

SEQ ID NO: 206898 - DNA, 25 bp, Homo sapien
gatgttccgcctggttagctggttc

SEQ ID NO: 206899 - DNA, 25 bp, Homo sapien
tggttagctggttctcttcagagaa

SEQ ID NO: 206900 - DNA, 25 bp, Homo sapien
ttcctagccatgaaagtagcacgat

SEQ ID NO: 206901 - DNA, 25 bp, Homo sapien
gtagcacgatcatattgtactgtat

SEQ ID NO: 206902 - DNA, 25 bp, Homo sapien
gcacgatcatattgtactgtattgt

SEQ ID NO: 206903 - DNA, 25 bp, Homo sapien
ttgtaaaatgactatttgccatgtc

SEQ ID NO: 206904 - DNA, 25 bp, Homo sapien
ttgccatgtcatgagtaggtagatg

SEQ ID NO: 206905 - DNA, 25 bp, Homo sapien
gttttgccacaaatatgaatgtgtt

SEQ ID NO: 206906 - DNA, 25 bp, Homo sapien
gctttcctgctgaaaacaggcccct

SEQ ID NO: 206907 - DNA, 25 bp, Homo sapien
aaaacaggcccctgctgtacagatt

SEQ ID NO: 206908 - DNA, 25 bp, Homo sapien
ttttgggtacataatttagctcttt

SEQ ID NO: 206909 - DNA, 25 bp, Homo sapien
taatttagctcttttagtcagtcca

SEQ ID NO: 206910 - DNA, 25 bp, Homo sapien
cttttagtcagtccaagagatttaa

SEQ ID NO: 206911 - DNA, 25 bp, Homo sapien
gaatgccatgtaaaggctttttggt

SEQ ID NO: 206912 - DNA, 25 bp, Homo sapien
taagacctcacttttaaaactgcct

SEQ ID NO: 206913 - DNA, 25 bp, Homo sapien
atttagttcatcatttgagctgcct

SEQ ID NO: 206914 - DNA, 25 bp, Homo sapien
atttgagctgccttcatactggttt

SEQ ID NO: 206915 - DNA, 25 bp, Homo sapien
gctgccttcatactggtttcctcag

SEQ ID NO: 206916 - DNA, 25 bp, Homo sapien
gcctgtaatattttcagcccactgt

SEQ ID NO: 206917 - DNA, 25 bp, Homo sapien
tagaaaaactcatacgtgattgcag

SEQ ID NO: 206918 - DNA, 25 bp, Homo sapien
agaaaaactcatacgtgattgcagc

SEQ ID NO: 206919 - DNA, 25 bp, Homo sapien
gaaaaactcatacgtgattgcagcc

SEQ ID NO: 206920 - DNA, 25 bp, Homo sapien
aaaaactcatacgtgattgcagccg

SEQ ID NO: 206921 - DNA, 25 bp, Homo sapien
aaaactcatacgtgattgcagccgg

SEQ ID NO: 206922 - DNA, 25 bp, Homo sapien
aaactcatacgtgattgcagccggg

SEQ ID NO: 206923 - DNA, 25 bp, Homo sapien
aactcatacgtgattgcagccgggc

SEQ ID NO: 206924 - DNA, 25 bp, Homo sapien
actcatacgtgattgcagccgggca

SEQ ID NO: 206925 - DNA, 25 bp, Homo sapien
ctcatacgtgattgcagccgggcat

SEQ ID NO: 206926 - DNA, 25 bp, Homo sapien
tcatacgtgattgcagccgggcatg

SEQ ID NO: 206927 - DNA, 25 bp, Homo sapien
atacgtgattgcagccgggcatggt

SEQ ID NO: 206928 - DNA, 25 bp, Homo sapien
ctgtgaacagttgccggaagcaccc

SEQ ID NO: 206929 - DNA, 25 bp, Homo sapien
cagcagtgtctgagctgtagtgaaa

SEQ ID NO: 206930 - DNA, 25 bp, Homo sapien
tagtgaaagtttcagggcctgcaaa

SEQ ID NO: 206931 - DNA, 25 bp, Homo sapien
ctgcaaaagaagaggcttgggcaca

SEQ ID NO: 206932 - DNA, 25 bp, Homo sapien
gcacaggactgaccatggctccagg

SEQ ID NO: 206933 - DNA, 25 bp, Homo sapien
acctgtgaaggtgggagcagctcac

SEQ ID NO: 206934 - DNA, 25 bp, Homo sapien
gtgaaggtgggagcagctcaccacc

SEQ ID NO: 206935 - DNA, 25 bp, Homo sapien
cttcacgcaggctttgtatgttctc

SEQ ID NO: 206936 - DNA, 25 bp, Homo sapien
cgcaggctttgtatgttctctgagc

SEQ ID NO: 206937 - DNA, 25 bp, Homo sapien
ctgagccttagttgattttggcccc

SEQ ID NO: 206938 - DNA, 25 bp, Homo sapien
tccaccctgctcacatgttgggaat

SEQ ID NO: 206939 - DNA, 25 bp, Homo sapien
gctgggtgctgagcattgagtcact

SEQ ID NO: 206940 - DNA, 25 bp, Homo sapien
tgagtcactgatctcttgtgatggg

SEQ ID NO: 206941 - DNA, 25 bp, Homo sapien
ggacaggagttttgcccaacgcagt

SEQ ID NO: 206942 - DNA, 25 bp, Homo sapien
gagttttgcccaacgcagtgtcata

SEQ ID NO: 206943 - DNA, 25 bp, Homo sapien
tttgcccaacgcagtgtcataaact

SEQ ID NO: 206944 - DNA, 25 bp, Homo sapien
gtcataaactgggttcatgggctta

SEQ ID NO: 206945 - DNA, 25 bp, Homo sapien
gttcatgggcttacccattgggtgt

SEQ ID NO: 206946 - DNA, 25 bp, Homo sapien
ttacccattgggtgtgcgctcactg

SEQ ID NO: 206947 - DNA, 25 bp, Homo sapien
tgtgcgctcactgcttgggaagtgc

SEQ ID NO: 206948 - DNA, 25 bp, Homo sapien
gtcctgggcacattgccagctgggt

SEQ ID NO: 206949 - DNA, 25 bp, Homo sapien
acattgccagctgggtgctgagcat

SEQ ID NO: 206950 - DNA, 25 bp, Homo sapien
caaattgtgaacttaatctctagaa

SEQ ID NO: 206951 - DNA, 25 bp, Homo sapien
aactcagccatttataggaatttag

SEQ ID NO: 206952 - DNA, 25 bp, Homo sapien
aggaatttaggttcaagtacaggat

SEQ ID NO: 206953 - DNA, 25 bp, Homo sapien
tacaggatatatgaaatcttttccc

SEQ ID NO: 206954 - DNA, 25 bp, Homo sapien
aatgtacttaattcacaggcaggat

SEQ ID NO: 206955 - DNA, 25 bp, Homo sapien
ttcacaggcaggatgcttcaatgca

SEQ ID NO: 206956 - DNA, 25 bp, Homo sapien
ggcaggatgcttcaatgcaaaatca

SEQ ID NO: 206957 - DNA, 25 bp, Homo sapien
ttattttctgaaatgcatctacttt

SEQ ID NO: 206958 - DNA, 25 bp, Homo sapien
atgcatctactttcatgggctttgt

SEQ ID NO: 206959 - DNA, 25 bp, Homo sapien
atctactttcatgggctttgtacgt

SEQ ID NO: 206960 - DNA, 25 bp, Homo sapien
tgggctttgtacgtttctgagattt

SEQ ID NO: 206961 - DNA, 25 bp, Homo sapien
cacctgctggacaatcacacgaaag

SEQ ID NO: 206962 - DNA, 25 bp, Homo sapien
aatcacacgaaaggcaggcgggctg

SEQ ID NO: 206963 - DNA, 25 bp, Homo sapien
tgtactgggccctgactgtgcgtcc

SEQ ID NO: 206964 - DNA, 25 bp, Homo sapien
tacctcaccaggctactggcagcag

SEQ ID NO: 206965 - DNA, 25 bp, Homo sapien
atctccacagcctggtaaattccat

SEQ ID NO: 206966 - DNA, 25 bp, Homo sapien
cctggtaaattccatgtgcctctgg

SEQ ID NO: 206967 - DNA, 25 bp, Homo sapien
gtgcctctgggtacaaaagtgcctc

SEQ ID NO: 206968 - DNA, 25 bp, Homo sapien
agtgcctcaacgacatgctctggaa

SEQ ID NO: 206969 - DNA, 25 bp, Homo sapien
caacgacatgctctggaaatcccaa

SEQ ID NO: 206970 - DNA, 25 bp, Homo sapien
tgccacagtctgaggttgatatcta

SEQ ID NO: 206971 - DNA, 25 bp, Homo sapien
tatgccttcaaaagagtctctgttt

SEQ ID NO: 206972 - DNA, 25 bp, Homo sapien
gttttccttttcttggtcatgtata

SEQ ID NO: 206973 - DNA, 25 bp, Homo sapien
tttcttctatgccttaggcttcgat

SEQ ID NO: 206974 - DNA, 25 bp, Homo sapien
tatgccttaggcttcgatggttctt

SEQ ID NO: 206975 - DNA, 25 bp, Homo sapien
ttaggcttcgatggttcttccaacc

SEQ ID NO: 206976 - DNA, 25 bp, Homo sapien
atttgcactactggccatggaacat

SEQ ID NO: 206977 - DNA, 25 bp, Homo sapien
catttatttctagtgttcctgccaa

SEQ ID NO: 206978 - DNA, 25 bp, Homo sapien
atttctagtgttcctgccaatcaga

SEQ ID NO: 206979 - DNA, 25 bp, Homo sapien
cctgccaatcagagatctctatatt

SEQ ID NO: 206980 - DNA, 25 bp, Homo sapien
ggagaattcacacttattgagtaac

SEQ ID NO: 206981 - DNA, 25 bp, Homo sapien
gtaactgatgtcatacaacctggaa

SEQ ID NO: 206982 - DNA, 25 bp, Homo sapien
tgatgtcatacaacctggaatttct

SEQ ID NO: 206983 - DNA, 25 bp, Homo sapien
tccaagaccctacagagcctgaggg

SEQ ID NO: 206984 - DNA, 25 bp, Homo sapien
ttccgcctgtgctagctttgccatg

SEQ ID NO: 206985 - DNA, 25 bp, Homo sapien
gctagctttgccatgtcatctggaa

SEQ ID NO: 206986 - DNA, 25 bp, Homo sapien
tgccatgtcatctggaataatactt

SEQ ID NO: 206987 - DNA, 25 bp, Homo sapien
tcttatcttttgttgaaatcacctg

SEQ ID NO: 206988 - DNA, 25 bp, Homo sapien
gaaatcacctgttatccttgtttgt

SEQ ID NO: 206989 - DNA, 25 bp, Homo sapien
atcacctgttatccttgtttgtaaa

SEQ ID NO: 206990 - DNA, 25 bp, Homo sapien
ataacttttttgcttcttctcagga

SEQ ID NO: 206991 - DNA, 25 bp, Homo sapien
gcttcttctcaggaatacagttttc

SEQ ID NO: 206992 - DNA, 25 bp, Homo sapien
caactgttgtcttgctcttgataga

SEQ ID NO: 206993 - DNA, 25 bp, Homo sapien
agcagcaatctgtatttgtggagga

SEQ ID NO: 206994 - DNA, 25 bp, Homo sapien
gagagtgaggcattttctgaagcac

SEQ ID NO: 206995 - DNA, 25 bp, Homo sapien
gaggcattttctgaagcacttaaag

SEQ ID NO: 206996 - DNA, 25 bp, Homo sapien
gtttcattctactttatatcacatg

SEQ ID NO: 206997 - DNA, 25 bp, Homo sapien
tatcacatggtgaaggattttgctt

SEQ ID NO: 206998 - DNA, 25 bp, Homo sapien
aagtcaggagttccaactgtcagtt

SEQ ID NO: 206999 - DNA, 25 bp, Homo sapien
caactgtcagtttgtcaactctgtg

SEQ ID NO: 207000 - DNA, 25 bp, Homo sapien
gtgtgccacatgctgctctctacca

SEQ ID NO: 207001 - DNA, 25 bp, Homo sapien
tgctctctaccagattgctcagcta

SEQ ID NO: 207002 - DNA, 25 bp, Homo sapien
agattgctcagctactcctaacctc

SEQ ID NO: 207003 - DNA, 25 bp, Homo sapien
ccaagcatggtgaaagacaggtatt

SEQ ID NO: 207004 - DNA, 25 bp, Homo sapien
acaggtatttctgcaacacaatgta

SEQ ID NO: 207005 - DNA, 25 bp, Homo sapien
gggtgctgattacctcagccatgtg

SEQ ID NO: 207006 - DNA, 25 bp, Homo sapien
ggtgctgattacctcagccatgtgg

SEQ ID NO: 207007 - DNA, 25 bp, Homo sapien
gccaggagggaaggccgcagcagga

SEQ ID NO: 207008 - DNA, 25 bp, Homo sapien
gaaggccgcagcaggactgccgtgg

SEQ ID NO: 207009 - DNA, 25 bp, Homo sapien
cctctcactgaccaggggtggacaa

SEQ ID NO: 207010 - DNA, 25 bp, Homo sapien
tggacaatgcccaagcagagggagc

SEQ ID NO: 207011 - DNA, 25 bp, Homo sapien
acaatgcccaagcagagggagcccc

SEQ ID NO: 207012 - DNA, 25 bp, Homo sapien
cttgccctgtttggccaccctctgg

SEQ ID NO: 207013 - DNA, 25 bp, Homo sapien
tggccagccaaaagcactctgaaac

SEQ ID NO: 207014 - DNA, 25 bp, Homo sapien
agccaaaagcactctgaaaccaaga

SEQ ID NO: 207015 - DNA, 25 bp, Homo sapien
aagcactctgaaaccaagaccttcc

SEQ ID NO: 207016 - DNA, 25 bp, Homo sapien
ggccgatagggcatgtttccgcaat

SEQ ID NO: 207017 - DNA, 25 bp, Homo sapien
gccgatagggcatgtttccgcaatt

SEQ ID NO: 207018 - DNA, 25 bp, Homo sapien
gatagggcatgtttccgcaattggc

SEQ ID NO: 207019 - DNA, 25 bp, Homo sapien
tagggcatgtttccgcaattggctt

SEQ ID NO: 207020 - DNA, 25 bp, Homo sapien
ggcatgtttccgcaattggcttgaa

SEQ ID NO: 207021 - DNA, 25 bp, Homo sapien
gcatgtttccgcaattggcttgaaa

SEQ ID NO: 207022 - DNA, 25 bp, Homo sapien
gtttccgcaattggcttgaaaagtt

SEQ ID NO: 207023 - DNA, 25 bp, Homo sapien
tggcttgaaaagttcaacccctgct

SEQ ID NO: 207024 - DNA, 25 bp, Homo sapien
ttgaaaagttcaacccctgctgggt

SEQ ID NO: 207025 - DNA, 25 bp, Homo sapien
aaagttcaacccctgctgggtgcag

SEQ ID NO: 207026 - DNA, 25 bp, Homo sapien
agttcaacccctgctgggtgcagtg

SEQ ID NO: 207027 - DNA, 25 bp, Homo sapien
agctgaagcagttcttgctgacctt

SEQ ID NO: 207028 - DNA, 25 bp, Homo sapien
gttcttgctgacctttctactttaa

SEQ ID NO: 207029 - DNA, 25 bp, Homo sapien
gttatgcctcttcttcagatttttc

SEQ ID NO: 207030 - DNA, 25 bp, Homo sapien
atttttctgtttgctactgtcacct

SEQ ID NO: 207031 - DNA, 25 bp, Homo sapien
tactgtcacctgatcttcttcacag

SEQ ID NO: 207032 - DNA, 25 bp, Homo sapien
gtcactggcaacacatctagttttt

SEQ ID NO: 207033 - DNA, 25 bp, Homo sapien
aaatcatgaactatgcaaactctgc

SEQ ID NO: 207034 - DNA, 25 bp, Homo sapien
aagccaataaagatcatgttccctc

SEQ ID NO: 207035 - DNA, 25 bp, Homo sapien
gatcatgttccctcttcagttaaac

SEQ ID NO: 207036 - DNA, 25 bp, Homo sapien
aactctgcaccaaatattgcatcgc

SEQ ID NO: 207037 - DNA, 25 bp, Homo sapien
attgcatcgcatgctgctgattttc

SEQ ID NO: 207038 - DNA, 25 bp, Homo sapien
tcaggccctccttccagggatgtct

SEQ ID NO: 207039 - DNA, 25 bp, Homo sapien
ttccagggatgtctctccagctcta

SEQ ID NO: 207040 - DNA, 25 bp, Homo sapien
ctccagctctactttatgtcctgaa

SEQ ID NO: 207041 - DNA, 25 bp, Homo sapien
agctctactttatgtcctgaagctg

SEQ ID NO: 207042 - DNA, 25 bp, Homo sapien
atgtcctgaagctgacccgaggtct

SEQ ID NO: 207043 - DNA, 25 bp, Homo sapien
tgaagctgacccgaggtcttcctat

SEQ ID NO: 207044 - DNA, 25 bp, Homo sapien
tgacccgaggtcttcctatctggaa

SEQ ID NO: 207045 - DNA, 25 bp, Homo sapien
cccgaggtcttcctatctggaatga

SEQ ID NO: 207046 - DNA, 25 bp, Homo sapien
ggtcttcctatctggaatgactaga

SEQ ID NO: 207047 - DNA, 25 bp, Homo sapien
ctatctggaatgactagagggagcc

SEQ ID NO: 207048 - DNA, 25 bp, Homo sapien
aatgactagagggagccaagaggat

SEQ ID NO: 207049 - DNA, 25 bp, Homo sapien
atctttttcactcattttttcatga

SEQ ID NO: 207050 - DNA, 25 bp, Homo sapien
gcagaggagttttcaagaggctatc

SEQ ID NO: 207051 - DNA, 25 bp, Homo sapien
ttttcaagaggctatctggtgtgat

SEQ ID NO: 207052 - DNA, 25 bp, Homo sapien
aggctatctggtgtgatattgtaat

SEQ ID NO: 207053 - DNA, 25 bp, Homo sapien
gatattgtaataggctgaatgcaaa

SEQ ID NO: 207054 - DNA, 25 bp, Homo sapien
agatacaagattccagctttcgtct

SEQ ID NO: 207055 - DNA, 25 bp, Homo sapien
acaagattccagctttcgtctgtca

SEQ ID NO: 207056 - DNA, 25 bp, Homo sapien
attccagctttcgtctgtcatcaga

SEQ ID NO: 207057 - DNA, 25 bp, Homo sapien
gctttcgtctgtcatcagacattga

SEQ ID NO: 207058 - DNA, 25 bp, Homo sapien
cagacattgaagagatttggagaaa

SEQ ID NO: 207059 - DNA, 25 bp, Homo sapien
taaagcagcagtactcttctcacta

SEQ ID NO: 207060 - DNA, 25 bp, Homo sapien
ataatttggttggtatttcactatt

SEQ ID NO: 207061 - DNA, 25 bp, Homo sapien
gaagcctattttactagtgttttat

SEQ ID NO: 207062 - DNA, 25 bp, Homo sapien
gtactgcagaagttaaacctgtgtt

SEQ ID NO: 207063 - DNA, 25 bp, Homo sapien
ctgagatgttttgctttaagagata

SEQ ID NO: 207064 - DNA, 25 bp, Homo sapien
gagatactttttgctcagtttttat

SEQ ID NO: 207065 - DNA, 25 bp, Homo sapien
gctcagtttttatatgccagataca

SEQ ID NO: 207066 - DNA, 25 bp, Homo sapien
tgtagcggttattttttgtatgatc

SEQ ID NO: 207067 - DNA, 25 bp, Homo sapien
gtatgatctagtaacttgcaaacag

SEQ ID NO: 207068 - DNA, 25 bp, Homo sapien
gtaacttgcaaacagaccaaatgga

SEQ ID NO: 207069 - DNA, 25 bp, Homo sapien
cggccgccccagtgctgatggagat

SEQ ID NO: 207070 - DNA, 25 bp, Homo sapien
gctgatggagatgccactttcgtgt

SEQ ID NO: 207071 - DNA, 25 bp, Homo sapien
tccttaaggtttttgaatgactgta

SEQ ID NO: 207072 - DNA, 25 bp, Homo sapien
atgactgtatatttggcagttaagc

SEQ ID NO: 207073 - DNA, 25 bp, Homo sapien
gcagttaagcagtgccacactacag

SEQ ID NO: 207074 - DNA, 25 bp, Homo sapien
tatttctgaccctgtgtgttagagc

SEQ ID NO: 207075 - DNA, 25 bp, Homo sapien
gaccctgtgtgttagagcagttgca

SEQ ID NO: 207076 - DNA, 25 bp, Homo sapien
tgttagagcagttgcatgctctcct

SEQ ID NO: 207077 - DNA, 25 bp, Homo sapien
gttaagctgtggatttgtactcaat

SEQ ID NO: 207078 - DNA, 25 bp, Homo sapien
gatttgtactcaataatgacttagg

SEQ ID NO: 207079 - DNA, 25 bp, Homo sapien
ttcattcattgctttacatactaga

SEQ ID NO: 207080 - DNA, 25 bp, Homo sapien
tacatactagacatttttcttctct

SEQ ID NO: 207081 - DNA, 25 bp, Homo sapien
tttcttctctttgtaagtagattca

SEQ ID NO: 207082 - DNA, 25 bp, Homo sapien
acatctagtgttgcctgtaatgctg

SEQ ID NO: 207083 - DNA, 25 bp, Homo sapien
gctggaaaccagtgtatctaccttg

SEQ ID NO: 207084 - DNA, 25 bp, Homo sapien
atctaccttgctgtgttaaatcatg

SEQ ID NO: 207085 - DNA, 25 bp, Homo sapien
gagatggattcgttttgcacacaac

SEQ ID NO: 207086 - DNA, 25 bp, Homo sapien
gacggatcgtttttgtcagatgaca

SEQ ID NO: 207087 - DNA, 25 bp, Homo sapien
ttgtcagatgacactggtggctccc

SEQ ID NO: 207088 - DNA, 25 bp, Homo sapien
gtttcttgtttcgagtgctgactga

SEQ ID NO: 207089 - DNA, 25 bp, Homo sapien
gctgactgacccgtttctgaaatgg

SEQ ID NO: 207090 - DNA, 25 bp, Homo sapien
aatgggcaccgagctaagtctgtgt

SEQ ID NO: 207091 - DNA, 25 bp, Homo sapien
gtctgtgtgcagcattagtacccgc

SEQ ID NO: 207092 - DNA, 25 bp, Homo sapien
tacccgctgccttaaaactcaagtt

SEQ ID NO: 207093 - DNA, 25 bp, Homo sapien
tgagtggaggagcagacaataaatt

SEQ ID NO: 207094 - DNA, 25 bp, Homo sapien
ttgtattcctacagatattcaccta

SEQ ID NO: 207095 - DNA, 25 bp, Homo sapien
tcctacagatattcacctaccactt

SEQ ID NO: 207096 - DNA, 25 bp, Homo sapien
gtgaacaataatttgactatagaga

SEQ ID NO: 207097 - DNA, 25 bp, Homo sapien
gatgcagatgcagaaagcagccttt

SEQ ID NO: 207098 - DNA, 25 bp, Homo sapien
gaaagcagccttttgaggtttatat

SEQ ID NO: 207099 - DNA, 25 bp, Homo sapien
aatgttttcacccttcataacagct

SEQ ID NO: 207100 - DNA, 25 bp, Homo sapien
ttttcacccttcataacagctaacg

SEQ ID NO: 207101 - DNA, 25 bp, Homo sapien
cacccttcataacagctaacgtatc

SEQ ID NO: 207102 - DNA, 25 bp, Homo sapien
aacagctaacgtatcactttttctt

SEQ ID NO: 207103 - DNA, 25 bp, Homo sapien
aactgtggcatacattctctataca

SEQ ID NO: 207104 - DNA, 25 bp, Homo sapien
aattcatgttttgtcagctttctca

SEQ ID NO: 207105 - DNA, 25 bp, Homo sapien
gttttgtcagctttctcatgttgag

SEQ ID NO: 207106 - DNA, 25 bp, Homo sapien
gtcagctttctcatgttgagatctg

SEQ ID NO: 207107 - DNA, 25 bp, Homo sapien
gttgagatctgttatgtcactgatg

SEQ ID NO: 207108 - DNA, 25 bp, Homo sapien
atgtcactgatgaatttaccctcaa

SEQ ID NO: 207109 - DNA, 25 bp, Homo sapien
gatgaatttaccctcaagtttcctt

SEQ ID NO: 207110 - DNA, 25 bp, Homo sapien
aagtttccttcctctgtaccactct

SEQ ID NO: 207111 - DNA, 25 bp, Homo sapien
ctgcttccttggacaatatcagtaa

SEQ ID NO: 207112 - DNA, 25 bp, Homo sapien
ggatatttagaccacccttgttcca

SEQ ID NO: 207113 - DNA, 25 bp, Homo sapien
ttagaccacccttgttccacgcaaa

SEQ ID NO: 207114 - DNA, 25 bp, Homo sapien
aaccagagtgtgtcagtgtttgtgt

SEQ ID NO: 207115 - DNA, 25 bp, Homo sapien
tgggctgggatcaagccccagtatg

SEQ ID NO: 207116 - DNA, 25 bp, Homo sapien
aagccccagtatgaactccaggaag

SEQ ID NO: 207117 - DNA, 25 bp, Homo sapien
tgagggatgcaggatatggttacct

SEQ ID NO: 207118 - DNA, 25 bp, Homo sapien
atggttacctggcaaccagtccgta

SEQ ID NO: 207119 - DNA, 25 bp, Homo sapien
gactgcagagcagccactcagatgc

SEQ ID NO: 207120 - DNA, 25 bp, Homo sapien
atcccctcagtgagcggtcctgatg

SEQ ID NO: 207121 - DNA, 25 bp, Homo sapien
aggtgccaaggctttggctctttgg

SEQ ID NO: 207122 - DNA, 25 bp, Homo sapien
gagagggacccaggcatgttaccca

SEQ ID NO: 207123 - DNA, 25 bp, Homo sapien
gcatgttacccaccttggttttcgt

SEQ ID NO: 207124 - DNA, 25 bp, Homo sapien
agatctctacaaggacattgcccct

SEQ ID NO: 207125 - DNA, 25 bp, Homo sapien
acattgcccctaagctggctcaggg

SEQ ID NO: 207126 - DNA, 25 bp, Homo sapien
gtgagaaaacatttcgccacaaatc

SEQ ID NO: 207127 - DNA, 25 bp, Homo sapien
atttcgccacaaatcaaactttctt

SEQ ID NO: 207128 - DNA, 25 bp, Homo sapien
acaaatcaaactttcttttacatca

SEQ ID NO: 207129 - DNA, 25 bp, Homo sapien
ttttacatcagaaatcccacaagga

SEQ ID NO: 207130 - DNA, 25 bp, Homo sapien
atcccacaaggaataagttccaaca

SEQ ID NO: 207131 - DNA, 25 bp, Homo sapien
gtaataaattccaacaaagcaacaa

SEQ ID NO: 207132 - DNA, 25 bp, Homo sapien
ttccaacaaagcaacaaatcaaata

SEQ ID NO: 207133 - DNA, 25 bp, Homo sapien
aaataacttacacaatgctaaactg

SEQ ID NO: 207134 - DNA, 25 bp, Homo sapien
tgctaaactgtgagtatgtatagag

SEQ ID NO: 207135 - DNA, 25 bp, Homo sapien
aagtcaaccctcaatgtaacatcag

SEQ ID NO: 207136 - DNA, 25 bp, Homo sapien
caaccctcaatgtaacatcagagaa

SEQ ID NO: 207137 - DNA, 25 bp, Homo sapien
attcgcctaactcatcatgatccag

SEQ ID NO: 207138 - DNA, 25 bp, Homo sapien
gtttcattcaacagagggatttttt

SEQ ID NO: 207139 - DNA, 25 bp, Homo sapien
gggattttttagtatcctcagcact

SEQ ID NO: 207140 - DNA, 25 bp, Homo sapien
tcagcactcattctattctcattcc

SEQ ID NO: 207141 - DNA, 25 bp, Homo sapien
cattcctttctctccaatgagttag

SEQ ID NO: 207142 - DNA, 25 bp, Homo sapien
gttaggccatgaacctgactcattt

SEQ ID NO: 207143 - DNA, 25 bp, Homo sapien
tcatttttggcacagaggactcttc

SEQ ID NO: 207144 - DNA, 25 bp, Homo sapien
atggactacctttttcagggatctt

SEQ ID NO: 207145 - DNA, 25 bp, Homo sapien
gatcttttggatctcacagagttct

SEQ ID NO: 207146 - DNA, 25 bp, Homo sapien
agcctgccagtcatgaatctcagac

SEQ ID NO: 207147 - DNA, 25 bp, Homo sapien
acctattgccctgatttgtgttata

SEQ ID NO: 207148 - DNA, 25 bp, Homo sapien
cctcccacagggtgcccgggcagtg

SEQ ID NO: 207149 - DNA, 25 bp, Homo sapien
gtgcccgggcagtgccatcctggtg

SEQ ID NO: 207150 - DNA, 25 bp, Homo sapien
ggagggcagccttcaaacgtgtggg

SEQ ID NO: 207151 - DNA, 25 bp, Homo sapien
cagccttcaaacgtgtggggtctac

SEQ ID NO: 207152 - DNA, 25 bp, Homo sapien
gggtctacagtcctcaggtctaggc

SEQ ID NO: 207153 - DNA, 25 bp, Homo sapien
ggtctacagtcctcaggtctaggca

SEQ ID NO: 207154 - DNA, 25 bp, Homo sapien
tctacagtcctcaggtctaggcagg

SEQ ID NO: 207155 - DNA, 25 bp, Homo sapien
tacagtcctcaggtctaggcagggc

SEQ ID NO: 207156 - DNA, 25 bp, Homo sapien
ctctgcttgggccacggtgtctctg

SEQ ID NO: 207157 - DNA, 25 bp, Homo sapien
gcttgggccacggtgtctctgcatt

SEQ ID NO: 207158 - DNA, 25 bp, Homo sapien
ttgggccacggtgtctctgcattgc

SEQ ID NO: 207159 - DNA, 25 bp, Homo sapien
gatgttattaagtgttctctgagag

SEQ ID NO: 207160 - DNA, 25 bp, Homo sapien
aggacattttgtcagctatatctta

SEQ ID NO: 207161 - DNA, 25 bp, Homo sapien
ttcagttttggcattgttgacttca

SEQ ID NO: 207162 - DNA, 25 bp, Homo sapien
ggcattgttgacttcataaagcagt

SEQ ID NO: 207163 - DNA, 25 bp, Homo sapien
tgagggctcaggattcaggaaatac

SEQ ID NO: 207164 - DNA, 25 bp, Homo sapien
atacaaacagacatggcagagcagt

SEQ ID NO: 207165 - DNA, 25 bp, Homo sapien
agcagtttgctttgggttggcagaa

SEQ ID NO: 207166 - DNA, 25 bp, Homo sapien
agcaggaaaataaccagccttcttg

SEQ ID NO: 207167 - DNA, 25 bp, Homo sapien
cagccttcttggattgcccacagtt

SEQ ID NO: 207168 - DNA, 25 bp, Homo sapien
ccacagtttttgtagactcctcagt

SEQ ID NO: 207169 - DNA, 25 bp, Homo sapien
agactcctcagttctgagtggagca

SEQ ID NO: 207170 - DNA, 25 bp, Homo sapien
acttacaaagaggagaagggcattt

SEQ ID NO: 207171 - DNA, 25 bp, Homo sapien
aagggcatttgcaaatcaacaagaa

SEQ ID NO: 207172 - DNA, 25 bp, Homo sapien
caagaagtgtgaggcccctctctct

SEQ ID NO: 207173 - DNA, 25 bp, Homo sapien
ggcccctctctctagcagaaaaata

SEQ ID NO: 207174 - DNA, 25 bp, Homo sapien
tatcttttaacatcctgtttaaggg

SEQ ID NO: 207175 - DNA, 25 bp, Homo sapien
acatcctgtttaagggaaatgccaa

SEQ ID NO: 207176 - DNA, 25 bp, Homo sapien
tgttttgcctcatgagtaatcaaaa

SEQ ID NO: 207177 - DNA, 25 bp, Homo sapien
tatatttaaaatcgtgttctgcctt

SEQ ID NO: 207178 - DNA, 25 bp, Homo sapien
aaaatcgtgttctgccttatgagta

SEQ ID NO: 207179 - DNA, 25 bp, Homo sapien
atcgtgttctgccttatgagtaaac

SEQ ID NO: 207180 - DNA, 25 bp, Homo sapien
gtgttctgccttatgagtaaacaaa

SEQ ID NO: 207181 - DNA, 25 bp, Homo sapien
gctttgcgtgaaggctgctcggctc

SEQ ID NO: 207182 - DNA, 25 bp, Homo sapien
tgctcggctcacttttcctaagtgt

SEQ ID NO: 207183 - DNA, 25 bp, Homo sapien
cttttcctaagtgtggttcctgaag

SEQ ID NO: 207184 - DNA, 25 bp, Homo sapien
ggttcctgaaggctgtctttgtaac

SEQ ID NO: 207185 - DNA, 25 bp, Homo sapien
ctgaaggctgtctttgtaacttttt

SEQ ID NO: 207186 - DNA, 25 bp, Homo sapien
tttgtgtaaaaagcgtattctgaat

SEQ ID NO: 207187 - DNA, 25 bp, Homo sapien
tcttcattatatcttccaggataca

SEQ ID NO: 207188 - DNA, 25 bp, Homo sapien
tatatcttccaggatacatctattt

SEQ ID NO: 207189 - DNA, 25 bp, Homo sapien
gaatgtgttatcaaaatgcttggtt

SEQ ID NO: 207190 - DNA, 25 bp, Homo sapien
taaggcacctttttaaaagcagaat

SEQ ID NO: 207191 - DNA, 25 bp, Homo sapien
aattttccagattttatagcttgcc

SEQ ID NO: 207192 - DNA, 25 bp, Homo sapien
tccacctcaagcctcaaagtgactg

SEQ ID NO: 207193 - DNA, 25 bp, Homo sapien
aagcctcaaagtgactgatgcattt

SEQ ID NO: 207194 - DNA, 25 bp, Homo sapien
tgatgcatttgcaagactcatgtct

SEQ ID NO: 207195 - DNA, 25 bp, Homo sapien
tagagaagacaagcacatctaccag

SEQ ID NO: 207196 - DNA, 25 bp, Homo sapien
gaagagcacctaagtgaagaagcta

SEQ ID NO: 207197 - DNA, 25 bp, Homo sapien
aagctatcaaggtgatcgctggcct

SEQ ID NO: 207198 - DNA, 25 bp, Homo sapien
tggccttcctgacttaacattcatg

SEQ ID NO: 207199 - DNA, 25 bp, Homo sapien
acattcatgcatgccaaggtgttga

SEQ ID NO: 207200 - DNA, 25 bp, Homo sapien
aaggtgttgatgttcccagccacgt

SEQ ID NO: 207201 - DNA, 25 bp, Homo sapien
ttaacaccttccacaagctctcaag

SEQ ID NO: 207202 - DNA, 25 bp, Homo sapien
atgtgaattggacagtttctattgc

SEQ ID NO: 207203 - DNA, 25 bp, Homo sapien
gaaaattgatgttccagttacagtg

SEQ ID NO: 207204 - DNA, 25 bp, Homo sapien
ccagttacagtgaggcaaggcaatc

SEQ ID NO: 207205 - DNA, 25 bp, Homo sapien
aaggcaatctggcagtaactccata

SEQ ID NO: 207206 - DNA, 25 bp, Homo sapien
tgcggctggtctgcgctcctgtgca

SEQ ID NO: 207207 - DNA, 25 bp, Homo sapien
gctcctgtgcattgccttggctaac

SEQ ID NO: 207208 - DNA, 25 bp, Homo sapien
gccttggctaacattttacttgtcc

SEQ ID NO: 207209 - DNA, 25 bp, Homo sapien
attttacttgtccttctgaatcacc

SEQ ID NO: 207210 - DNA, 25 bp, Homo sapien
gaatcaccctggcattgtcaacaaa

SEQ ID NO: 207211 - DNA, 25 bp, Homo sapien
gaataatgtatgatccttcttggag

SEQ ID NO: 207212 - DNA, 25 bp, Homo sapien
tgatccttcttggagtaaaaagcct

SEQ ID NO: 207213 - DNA, 25 bp, Homo sapien
aaaagccttcagcagtgcttcacaa

SEQ ID NO: 207214 - DNA, 25 bp, Homo sapien
gatatggttttaaagctggaatttt

SEQ ID NO: 207215 - DNA, 25 bp, Homo sapien
tttattttcaagattcaacacaggt

SEQ ID NO: 207216 - DNA, 25 bp, Homo sapien
tttcaagattcaacacaggttgcca

SEQ ID NO: 207217 - DNA, 25 bp, Homo sapien
gattcaacacaggttgccaaattgc

SEQ ID NO: 207218 - DNA, 25 bp, Homo sapien
actgtagaatttatgcctgtgggcc

SEQ ID NO: 207219 - DNA, 25 bp, Homo sapien
tgtagaatttatgcctgtgggccgg

SEQ ID NO: 207220 - DNA, 25 bp, Homo sapien
ccattgtactctggcctgagcaacg

SEQ ID NO: 207221 - DNA, 25 bp, Homo sapien
ttgtactctggcctgagcaacgaga

SEQ ID NO: 207222 - DNA, 25 bp, Homo sapien
gtactctggcctgagcaacgagagt

SEQ ID NO: 207223 - DNA, 25 bp, Homo sapien
tctggcctgagcaacgagagtaaaa

SEQ ID NO: 207224 - DNA, 25 bp, Homo sapien
tggcctgagcaacgagagtaaaact

SEQ ID NO: 207225 - DNA, 25 bp, Homo sapien
gaagaacttggtggcctgggtccct

SEQ ID NO: 207226 - DNA, 25 bp, Homo sapien
cattctgatgctggaggcaggtgac

SEQ ID NO: 207227 - DNA, 25 bp, Homo sapien
actttgtgtcctgcacactgagctc

SEQ ID NO: 207228 - DNA, 25 bp, Homo sapien
gagccttgtgacttgagcagatgtc

SEQ ID NO: 207229 - DNA, 25 bp, Homo sapien
gagcagatgtccgaagccgtttctt

SEQ ID NO: 207230 - DNA, 25 bp, Homo sapien
cgaagccgtttcttcatcccatgag

SEQ ID NO: 207231 - DNA, 25 bp, Homo sapien
ttcatcccatgagaccagtaatact

SEQ ID NO: 207232 - DNA, 25 bp, Homo sapien
gaccagtaatactgtctgcctcaga

SEQ ID NO: 207233 - DNA, 25 bp, Homo sapien
gtctgcctcagaacatagccgtgat

SEQ ID NO: 207234 - DNA, 25 bp, Homo sapien
aacatagccgtgatcaagatgagca

SEQ ID NO: 207235 - DNA, 25 bp, Homo sapien
gatgagcacggaggctcgtgtccca

SEQ ID NO: 207236 - DNA, 25 bp, Homo sapien
tcgagtttggtgaggtctctggcca

SEQ ID NO: 207237 - DNA, 25 bp, Homo sapien
gggacgaagaggaacacagtgcccc

SEQ ID NO: 207238 - DNA, 25 bp, Homo sapien
agtgccccaaacactgggatgctct

SEQ ID NO: 207239 - DNA, 25 bp, Homo sapien
gatgctctccactgctgtggaggga

SEQ ID NO: 207240 - DNA, 25 bp, Homo sapien
ggatgattattctgccctgggactc

SEQ ID NO: 207241 - DNA, 25 bp, Homo sapien
tgggactcgccaaactgataaggaa

SEQ ID NO: 207242 - DNA, 25 bp, Homo sapien
gtccaaccttagtagacttgattgt

SEQ ID NO: 207243 - DNA, 25 bp, Homo sapien
caaatttggtgtattgtccccttag

SEQ ID NO: 207244 - DNA, 25 bp, Homo sapien
gtattgtccccttagtacaccagta

SEQ ID NO: 207245 - DNA, 25 bp, Homo sapien
agtacaccagtactccagaggaaga

SEQ ID NO: 207246 - DNA, 25 bp, Homo sapien
tttcttgggagccatagggtgaata

SEQ ID NO: 207247 - DNA, 25 bp, Homo sapien
ctatatgccaggactcagcccatgg

SEQ ID NO: 207248 - DNA, 25 bp, Homo sapien
atgccaggactcagcccatggctca

SEQ ID NO: 207249 - DNA, 25 bp, Homo sapien
ccatggctcacgcagagctggagaa

SEQ ID NO: 207250 - DNA, 25 bp, Homo sapien
aaaacagcttgcttgctgggcggtc

SEQ ID NO: 207251 - DNA, 25 bp, Homo sapien
tgggcggtcccagactgcaaggtct

SEQ ID NO: 207252 - DNA, 25 bp, Homo sapien
gcggtcccagactgcaaggtctcca

SEQ ID NO: 207253 - DNA, 25 bp, Homo sapien
tcataactccttgaagtcaatccag

SEQ ID NO: 207254 - DNA, 25 bp, Homo sapien
ttgaagtcaatccagatgggctctg

SEQ ID NO: 207255 - DNA, 25 bp, Homo sapien
gggactgagcccattcccatcgaga

SEQ ID NO: 207256 - DNA, 25 bp, Homo sapien
ccattcccatcgagagctcattaaa

SEQ ID NO: 207257 - DNA, 25 bp, Homo sapien
agagctcattaaaattacccagaaa

SEQ ID NO: 207258 - DNA, 25 bp, Homo sapien
ttttgtaacatttaagcatatttca

SEQ ID NO: 207259 - DNA, 25 bp, Homo sapien
aagatcctttttagttaatactatg

SEQ ID NO: 207260 - DNA, 25 bp, Homo sapien
tagttaatactatgacagtactaaa

SEQ ID NO: 207261 - DNA, 25 bp, Homo sapien
aacatttcagataccattatattaa

SEQ ID NO: 207262 - DNA, 25 bp, Homo sapien
gtgtatgtgtacaaaagcgttgata

SEQ ID NO: 207263 - DNA, 25 bp, Homo sapien
caaaagcgttgataaatactaatct

SEQ ID NO: 207264 - DNA, 25 bp, Homo sapien
gtggagttcctttatttgtaatata

SEQ ID NO: 207265 - DNA, 25 bp, Homo sapien
ggagttcctttatttgtaatatatg

SEQ ID NO: 207266 - DNA, 25 bp, Homo sapien
tatatgtgctcttaaaagcaatggg

SEQ ID NO: 207267 - DNA, 25 bp, Homo sapien
gctcttaaaagcaatgggatgtgaa

SEQ ID NO: 207268 - DNA, 25 bp, Homo sapien
agcaatgggatgtgaaattatgaaa

SEQ ID NO: 207269 - DNA, 25 bp, Homo sapien
gaactatactaatcttctcacaaaa

SEQ ID NO: 207270 - DNA, 25 bp, Homo sapien
taatcttctcacaaaaggtctataa

SEQ ID NO: 207271 - DNA, 25 bp, Homo sapien
aggtctataaaatacagtcgttgaa

SEQ ID NO: 207272 - DNA, 25 bp, Homo sapien
agcttctccttaacctgtattgata

SEQ ID NO: 207273 - DNA, 25 bp, Homo sapien
cctgtattgatactgacttgagtta

SEQ ID NO: 207274 - DNA, 25 bp, Homo sapien
aattaagagccgtatacctacctgt

SEQ ID NO: 207275 - DNA, 25 bp, Homo sapien
gccgtatacctacctgtaagtcttt

SEQ ID NO: 207276 - DNA, 25 bp, Homo sapien
gtaagtcttttcacatatcatttaa

SEQ ID NO: 207277 - DNA, 25 bp, Homo sapien
actgatttacagcttagttattaat

SEQ ID NO: 207278 - DNA, 25 bp, Homo sapien
tctttataagaatgccgtcgatgtg

SEQ ID NO: 207279 - DNA, 25 bp, Homo sapien
aatgccgtcgatgtgcatgctttta

SEQ ID NO: 207280 - DNA, 25 bp, Homo sapien
gtttcactcagaccgacagtcactt

SEQ ID NO: 207281 - DNA, 25 bp, Homo sapien
ctcagaccgacagtcactttgctga

SEQ ID NO: 207282 - DNA, 25 bp, Homo sapien
actttgctgaattcaacacatgtat

SEQ ID NO: 207283 - DNA, 25 bp, Homo sapien
ggaaaaagcactagactcagggtca

SEQ ID NO: 207284 - DNA, 25 bp, Homo sapien
tagactcagggtcagccagccagaa

SEQ ID NO: 207285 - DNA, 25 bp, Homo sapien
agccagccagaagaactgagccgac

SEQ ID NO: 207286 - DNA, 25 bp, Homo sapien
agaactgagccgacctgggatccca

SEQ ID NO: 207287 - DNA, 25 bp, Homo sapien
atcccaccacttcctaactgttttg

SEQ ID NO: 207288 - DNA, 25 bp, Homo sapien
gttaggtagttcactttctctcttc

SEQ ID NO: 207289 - DNA, 25 bp, Homo sapien
ttctctcttcggataaatgtctcca

SEQ ID NO: 207290 - DNA, 25 bp, Homo sapien
tctccacatttcctacttcatagaa

SEQ ID NO: 207291 - DNA, 25 bp, Homo sapien
caacctccggaacaactgctggaag

SEQ ID NO: 207292 - DNA, 25 bp, Homo sapien
aaggcttgctgtaccgggcacgcta

SEQ ID NO: 207293 - DNA, 25 bp, Homo sapien
ggcacgctactttggcgacacagat

SEQ ID NO: 207294 - DNA, 25 bp, Homo sapien
gacacagatatgtaccacagagcac

SEQ ID NO: 207295 - DNA, 25 bp, Homo sapien
cagctgcagccgactgtcagaggtg

SEQ ID NO: 207296 - DNA, 25 bp, Homo sapien
gaggtgcaggcctccctgcatggat

SEQ ID NO: 207297 - DNA, 25 bp, Homo sapien
tgcatggatagtcctgggccagcca

SEQ ID NO: 207298 - DNA, 25 bp, Homo sapien
atttttggtgacatgcactgagcca

SEQ ID NO: 207299 - DNA, 25 bp, Homo sapien
gcactgagccaaggtgatggactgt

SEQ ID NO: 207300 - DNA, 25 bp, Homo sapien
gcctcaaaacagtcgagcggaatgt

SEQ ID NO: 207301 - DNA, 25 bp, Homo sapien
agatgattatatcgccaacctccgg

SEQ ID NO: 207302 - DNA, 25 bp, Homo sapien
gctgacgtgagcctgtggaacattc

SEQ ID NO: 207303 - DNA, 25 bp, Homo sapien
gtgagcctgtggaacattctgcgca

SEQ ID NO: 207304 - DNA, 25 bp, Homo sapien
gcctgtggaacattctgcgcaacaa

SEQ ID NO: 207305 - DNA, 25 bp, Homo sapien
gaacattctgcgcaacaacatcggc

SEQ ID NO: 207306 - DNA, 25 bp, Homo sapien
caacaacatcggcaaagacctgtcc

SEQ ID NO: 207307 - DNA, 25 bp, Homo sapien
agacctgtccaaggtgtcaatgcct

SEQ ID NO: 207308 - DNA, 25 bp, Homo sapien
gtccaaggtgtcaatgcctgtgcag

SEQ ID NO: 207309 - DNA, 25 bp, Homo sapien
aggtgtcaatgcctgtgcagctcaa

SEQ ID NO: 207310 - DNA, 25 bp, Homo sapien
gtcaatgcctgtgcagctcaacgag

SEQ ID NO: 207311 - DNA, 25 bp, Homo sapien
tcaacactctgcagcggctctgcga

SEQ ID NO: 207312 - DNA, 25 bp, Homo sapien
ccgacccctgcgagcgcatggtgta

SEQ ID NO: 207313 - DNA, 25 bp, Homo sapien
atcttttgcactaccttcaagaaaa

SEQ ID NO: 207314 - DNA, 25 bp, Homo sapien
aaaccttggatcacgtattgctgct

SEQ ID NO: 207315 - DNA, 25 bp, Homo sapien
acgtattgctgctctaaaagtgata

SEQ ID NO: 207316 - DNA, 25 bp, Homo sapien
ttgacctgtgtagaactctctggta

SEQ ID NO: 207317 - DNA, 25 bp, Homo sapien
gaactctctggtatacactggctat

SEQ ID NO: 207318 - DNA, 25 bp, Homo sapien
acactggctatttaaccaaatgagg

SEQ ID NO: 207319 - DNA, 25 bp, Homo sapien
gaaaacacagaattgatcatcacat

SEQ ID NO: 207320 - DNA, 25 bp, Homo sapien
atcacattttgatacctgccatgta

SEQ ID NO: 207321 - DNA, 25 bp, Homo sapien
ctgccatgtaacatctactcctgaa

SEQ ID NO: 207322 - DNA, 25 bp, Homo sapien
ggtctacggtttgtggtagtaatct

SEQ ID NO: 207323 - DNA, 25 bp, Homo sapien
gtaatctaataccttaaccccacat

SEQ ID NO: 207324 - DNA, 25 bp, Homo sapien
aagaaaaattagcagccaggtgcag

SEQ ID NO: 207325 - DNA, 25 bp, Homo sapien
atcacgccactacattccagctggg

SEQ ID NO: 207326 - DNA, 25 bp, Homo sapien
tcacgccactacattccagctgggc

SEQ ID NO: 207327 - DNA, 25 bp, Homo sapien
cacgccactacattccagctgggca

SEQ ID NO: 207328 - DNA, 25 bp, Homo sapien
acgccactacattccagctgggcaa

SEQ ID NO: 207329 - DNA, 25 bp, Homo sapien
cgccactacattccagctgggcaac

SEQ ID NO: 207330 - DNA, 25 bp, Homo sapien
ccactacattccagctgggcaacac

SEQ ID NO: 207331 - DNA, 25 bp, Homo sapien
cactacattccagctgggcaacaca

SEQ ID NO: 207332 - DNA, 25 bp, Homo sapien
actacattccagctgggcaacacag

SEQ ID NO: 207333 - DNA, 25 bp, Homo sapien
ctacattccagctgggcaacacagc

SEQ ID NO: 207334 - DNA, 25 bp, Homo sapien
ctggactctcagaacgccagggtcc

SEQ ID NO: 207335 - DNA, 25 bp, Homo sapien
tggactctcagaacgccagggtcca

SEQ ID NO: 207336 - DNA, 25 bp, Homo sapien
ggactctcagaacgccagggtccag

SEQ ID NO: 207337 - DNA, 25 bp, Homo sapien
gactctcagaacgccagggtccagg

SEQ ID NO: 207338 - DNA, 25 bp, Homo sapien
ctctcagaacgccagggtccaggca

SEQ ID NO: 207339 - DNA, 25 bp, Homo sapien
tctcagaacgccagggtccaggcag

SEQ ID NO: 207340 - DNA, 25 bp, Homo sapien
ctcagaacgccagggtccaggcagg

SEQ ID NO: 207341 - DNA, 25 bp, Homo sapien
acgccagggtccaggcagggtgcgg

SEQ ID NO: 207342 - DNA, 25 bp, Homo sapien
tgcgcctgtaaacctcagctaccca

SEQ ID NO: 207343 - DNA, 25 bp, Homo sapien
gcgcctgtaaacctcagctacccag

SEQ ID NO: 207344 - DNA, 25 bp, Homo sapien
ctgtaaacctcagctacccaggagg

SEQ ID NO: 207345 - DNA, 25 bp, Homo sapien
tttctgcatgtttgtgatcactgtg

SEQ ID NO: 207346 - DNA, 25 bp, Homo sapien
gtgagtctcagatgattattccagt

SEQ ID NO: 207347 - DNA, 25 bp, Homo sapien
gagtctcagatgattattccagttt

SEQ ID NO: 207348 - DNA, 25 bp, Homo sapien
taaggtattgaacactggattgcat

SEQ ID NO: 207349 - DNA, 25 bp, Homo sapien
ggtattgaacactggattgcatggt

SEQ ID NO: 207350 - DNA, 25 bp, Homo sapien
tgaacactggattgcatggttgaat

SEQ ID NO: 207351 - DNA, 25 bp, Homo sapien
gattgcatggttgaatgtgtcttta

SEQ ID NO: 207352 - DNA, 25 bp, Homo sapien
gaatgtgtctttaattcactacaaa

SEQ ID NO: 207353 - DNA, 25 bp, Homo sapien
gtgtctttaattcactacaaaatgt

SEQ ID NO: 207354 - DNA, 25 bp, Homo sapien
aaatgtgcttgttattgataggatc

SEQ ID NO: 207355 - DNA, 25 bp, Homo sapien
gtgcttgttattgataggatcatgt

SEQ ID NO: 207356 - DNA, 25 bp, Homo sapien
gaagcaggctgcagggcattccagc

SEQ ID NO: 207357 - DNA, 25 bp, Homo sapien
aggctgcagggcattccagccaagg

SEQ ID NO: 207358 - DNA, 25 bp, Homo sapien
gagggaagtcacatcagaaaaggga

SEQ ID NO: 207359 - DNA, 25 bp, Homo sapien
aagccacggaatgtgtgtgaagccc

SEQ ID NO: 207360 - DNA, 25 bp, Homo sapien
acggaatgtgtgtgaagcccagaaa

SEQ ID NO: 207361 - DNA, 25 bp, Homo sapien
ttttcagttatgtctttggtatcag

SEQ ID NO: 207362 - DNA, 25 bp, Homo sapien
gtctttggtatcagacatacgaaag

SEQ ID NO: 207363 - DNA, 25 bp, Homo sapien
gtatcagacatacgaaaggtctctt

SEQ ID NO: 207364 - DNA, 25 bp, Homo sapien
gtctctttgtagttcgtgttaatgt

SEQ ID NO: 207365 - DNA, 25 bp, Homo sapien
ctctttgtagttcgtgttaatgtaa

SEQ ID NO: 207366 - DNA, 25 bp, Homo sapien
gtagttcgtgttaatgtaacattaa

SEQ ID NO: 207367 - DNA, 25 bp, Homo sapien
actacattggattgcctgaaattcc

SEQ ID NO: 207368 - DNA, 25 bp, Homo sapien
gattgcctgaaattccgattggagc

SEQ ID NO: 207369 - DNA, 25 bp, Homo sapien
attccgattggagcatatcaagcaa

SEQ ID NO: 207370 - DNA, 25 bp, Homo sapien
tctggtggaagatgcaactattggt

SEQ ID NO: 207371 - DNA, 25 bp, Homo sapien
attactgacatcaagcaaggatcgt

SEQ ID NO: 207372 - DNA, 25 bp, Homo sapien
gcaaggatcgtgaactattagaata

SEQ ID NO: 207373 - DNA, 25 bp, Homo sapien
gaaaatctctccattgatagacgat

SEQ ID NO: 207374 - DNA, 25 bp, Homo sapien
tcatagttctcttgaaaagcagact

SEQ ID NO: 207375 - DNA, 25 bp, Homo sapien
gactttcagtctgttggactcttca

SEQ ID NO: 207376 - DNA, 25 bp, Homo sapien
gttggactcttcaaaccaggttctt

SEQ ID NO: 207377 - DNA, 25 bp, Homo sapien
caaaccaggttcttgaatacttaag

SEQ ID NO: 207378 - DNA, 25 bp, Homo sapien
gtgctgataatctcttctcttgtac

SEQ ID NO: 207379 - DNA, 25 bp, Homo sapien
aaatggtaaacatgagggtgctctt

SEQ ID NO: 207380 - DNA, 25 bp, Homo sapien
gagggtgctcttgtgacttaatttt

SEQ ID NO: 207381 - DNA, 25 bp, Homo sapien
gttcaagggactaaattgcttatgt

SEQ ID NO: 207382 - DNA, 25 bp, Homo sapien
tgcttatgtttattccctgtcagcg

SEQ ID NO: 207383 - DNA, 25 bp, Homo sapien
ttattccctgtcagcggagtggaga

SEQ ID NO: 207384 - DNA, 25 bp, Homo sapien
cagcggagtggagaatgtcattcat

SEQ ID NO: 207385 - DNA, 25 bp, Homo sapien
catcaataaaccaaagccaatagct

SEQ ID NO: 207386 - DNA, 25 bp, Homo sapien
atggtttacatgctgtactatcctg

SEQ ID NO: 207387 - DNA, 25 bp, Homo sapien
tacatgctgtactatcctgaggaat

SEQ ID NO: 207388 - DNA, 25 bp, Homo sapien
tcctgaggaattgcgagatattgct

SEQ ID NO: 207389 - DNA, 25 bp, Homo sapien
atgataatatcaaggtcaggcatgg

SEQ ID NO: 207390 - DNA, 25 bp, Homo sapien
tgataatatcaaggtcaggcatggt

SEQ ID NO: 207391 - DNA, 25 bp, Homo sapien
ttagccgggcgcagcagtgcacgcc

SEQ ID NO: 207392 - DNA, 25 bp, Homo sapien
tagccgggcgcagcagtgcacgcct

SEQ ID NO: 207393 - DNA, 25 bp, Homo sapien
cgggcgcagcagtgcacgcctgtaa

SEQ ID NO: 207394 - DNA, 25 bp, Homo sapien
taaaatgataatatcaaggtcaggc

SEQ ID NO: 207395 - DNA, 25 bp, Homo sapien
aaaatgataatatcaaggtcaggca

SEQ ID NO: 207396 - DNA, 25 bp, Homo sapien
aaatgataatatcaaggtcaggcat

SEQ ID NO: 207397 - DNA, 25 bp, Homo sapien
aatgataatatcaaggtcaggcatg

SEQ ID NO: 207398 - DNA, 25 bp, Homo sapien
ttcctctagggccaccaggctgagg

SEQ ID NO: 207399 - DNA, 25 bp, Homo sapien
ctagggccaccaggctgaggactcg

SEQ ID NO: 207400 - DNA, 25 bp, Homo sapien
caggacatggactggtctctcagac

SEQ ID NO: 207401 - DNA, 25 bp, Homo sapien
acatggactggtctctcagacccct

SEQ ID NO: 207402 - DNA, 25 bp, Homo sapien
agacccctgggccaccatgtaggcc

SEQ ID NO: 207403 - DNA, 25 bp, Homo sapien
ttcccaaatgtctctatccttttga

SEQ ID NO: 207404 - DNA, 25 bp, Homo sapien
aaatgtctctatccttttgactgga

SEQ ID NO: 207405 - DNA, 25 bp, Homo sapien
gtctctatccttttgactggagcat

SEQ ID NO: 207406 - DNA, 25 bp, Homo sapien
atccttttgactggagcatcttctg

SEQ ID NO: 207407 - DNA, 25 bp, Homo sapien
acaaccttgggagcccatccaaggg

SEQ ID NO: 207408 - DNA, 25 bp, Homo sapien
cagctctgactggaccccaagtggc

SEQ ID NO: 207409 - DNA, 25 bp, Homo sapien
ataagcctcgtatgcctttgtaaag

SEQ ID NO: 207410 - DNA, 25 bp, Homo sapien
atgcctttgtaaagtccacctacac

SEQ ID NO: 207411 - DNA, 25 bp, Homo sapien
aaagtccacctacacttttgaccag

SEQ ID NO: 207412 - DNA, 25 bp, Homo sapien
ccgcatgtgtttggcgctgtgctag

SEQ ID NO: 207413 - DNA, 25 bp, Homo sapien
gggcgggagttcttccagactcttg

SEQ ID NO: 207414 - DNA, 25 bp, Homo sapien
gagttcttccagactcttggaccag

SEQ ID NO: 207415 - DNA, 25 bp, Homo sapien
cactgcctgagaggtctctatcagt

SEQ ID NO: 207416 - DNA, 25 bp, Homo sapien
agaggtctctatcagtgtcctgcct

SEQ ID NO: 207417 - DNA, 25 bp, Homo sapien
gaattctttccttcaagtgaagatg

SEQ ID NO: 207418 - DNA, 25 bp, Homo sapien
tgtgactgactacctcctcgagttg

SEQ ID NO: 207419 - DNA, 25 bp, Homo sapien
gactacctcctcgagttgtcatgag

SEQ ID NO: 207420 - DNA, 25 bp, Homo sapien
gtcagaatagataacctcaagcttt

SEQ ID NO: 207421 - DNA, 25 bp, Homo sapien
aacctcaagctttgtctttctatgt

SEQ ID NO: 207422 - DNA, 25 bp, Homo sapien
tcaagctttgtctttctatgtgctt

SEQ ID NO: 207423 - DNA, 25 bp, Homo sapien
aatcacttattcctttggattctaa

SEQ ID NO: 207424 - DNA, 25 bp, Homo sapien
cagtaattatggactttctcttctg

SEQ ID NO: 207425 - DNA, 25 bp, Homo sapien
gtgtgaatttgtaaactgattgttt

SEQ ID NO: 207426 - DNA, 25 bp, Homo sapien
tgattgtttaattgtcagagggact

SEQ ID NO: 207427 - DNA, 25 bp, Homo sapien
tcagagggacttttggacatagaat

SEQ ID NO: 207428 - DNA, 25 bp, Homo sapien
gggacttttggacatagaatactca

SEQ ID NO: 207429 - DNA, 25 bp, Homo sapien
ttttcacttcattcaattcacgcat

SEQ ID NO: 207430 - DNA, 25 bp, Homo sapien
gcatttaaacgttctaaaattcact

SEQ ID NO: 207431 - DNA, 25 bp, Homo sapien
tggctttgtgcccacttaggcagta

SEQ ID NO: 207432 - DNA, 25 bp, Homo sapien
gcccacttaggcagtattatcaaca

SEQ ID NO: 207433 - DNA, 25 bp, Homo sapien
agtattatcaacaaggtcctgctca

SEQ ID NO: 207434 - DNA, 25 bp, Homo sapien
tcaacaaggtcctgctcagtgtcca

SEQ ID NO: 207435 - DNA, 25 bp, Homo sapien
aatgcatctgccaatcagcagcagg

SEQ ID NO: 207436 - DNA, 25 bp, Homo sapien
attctgcagctccttttgtgccaag

SEQ ID NO: 207437 - DNA, 25 bp, Homo sapien
ccaccaggcaggctcgagataaagt

SEQ ID NO: 207438 - DNA, 25 bp, Homo sapien
gagataaagtcatcacagccttccc

SEQ ID NO: 207439 - DNA, 25 bp, Homo sapien
agccttccctcatctgcagggagag

SEQ ID NO: 207440 - DNA, 25 bp, Homo sapien
gaatgtgagcagtctagcctggatg

SEQ ID NO: 207441 - DNA, 25 bp, Homo sapien
agcctggatgacatatttttcgttt

SEQ ID NO: 207442 - DNA, 25 bp, Homo sapien
ggcctggctcagaatctaacctatt

SEQ ID NO: 207443 - DNA, 25 bp, Homo sapien
gcctggctcagaatctaacctattt

SEQ ID NO: 207444 - DNA, 25 bp, Homo sapien
cctggctcagaatctaacctattta

SEQ ID NO: 207445 - DNA, 25 bp, Homo sapien
ggctggctcttactcaggaaactgc

SEQ ID NO: 207446 - DNA, 25 bp, Homo sapien
gctggctcttactcaggaaactgct

SEQ ID NO: 207447 - DNA, 25 bp, Homo sapien
ctggctcttactcaggaaactgctg

SEQ ID NO: 207448 - DNA, 25 bp, Homo sapien
caggaaactgctgtgcccaacccat

SEQ ID NO: 207449 - DNA, 25 bp, Homo sapien
tggaccaggcctcctctcagccttc

SEQ ID NO: 207450 - DNA, 25 bp, Homo sapien
ccaagctcatacggcagcagcacga

SEQ ID NO: 207451 - DNA, 25 bp, Homo sapien
agcagcacgagatgtgcctgaacca

SEQ ID NO: 207452 - DNA, 25 bp, Homo sapien
gcagcacgagatgtgcctgaaccac

SEQ ID NO: 207453 - DNA, 25 bp, Homo sapien
agatgtgcctgaaccactcaaacca

SEQ ID NO: 207454 - DNA, 25 bp, Homo sapien
gatgtgcctgaaccactcaaaccaa

SEQ ID NO: 207455 - DNA, 25 bp, Homo sapien
atgtgcctgaaccactcaaaccaat

SEQ ID NO: 207456 - DNA, 25 bp, Homo sapien
tgtgcctgaaccactcaaaccaatt

SEQ ID NO: 207457 - DNA, 25 bp, Homo sapien
gtgcctgaaccactcaaaccaattc

SEQ ID NO: 207458 - DNA, 25 bp, Homo sapien
tgcctgaaccactcaaaccaattca

SEQ ID NO: 207459 - DNA, 25 bp, Homo sapien
gcctgaaccactcaaaccaattcac

SEQ ID NO: 207460 - DNA, 25 bp, Homo sapien
cctgaaccactcaaaccaattcacc

SEQ ID NO: 207461 - DNA, 25 bp, Homo sapien
attacagtgtaccatattaagccat

SEQ ID NO: 207462 - DNA, 25 bp, Homo sapien
cagtgtaccatattaagccatgtga

SEQ ID NO: 207463 - DNA, 25 bp, Homo sapien
gtaccatattaagccatgtgaataa

SEQ ID NO: 207464 - DNA, 25 bp, Homo sapien
aagtagtagtcattatttgtgaaaa

SEQ ID NO: 207465 - DNA, 25 bp, Homo sapien
aatgtgtaacttttccagttacttg

SEQ ID NO: 207466 - DNA, 25 bp, Homo sapien
aacttttccagttacttgacacgat

SEQ ID NO: 207467 - DNA, 25 bp, Homo sapien
tttccagttacttgacacgattcag

SEQ ID NO: 207468 - DNA, 25 bp, Homo sapien
cagttacttgacacgattcagtggg

SEQ ID NO: 207469 - DNA, 25 bp, Homo sapien
accagcattttttattctattgata

SEQ ID NO: 207470 - DNA, 25 bp, Homo sapien
gcattttttattctattgataccaa

SEQ ID NO: 207471 - DNA, 25 bp, Homo sapien
agcatttctaataagagcttgttaa

SEQ ID NO: 207472 - DNA, 25 bp, Homo sapien
atctgcctagggtgtgctggtttgt

SEQ ID NO: 207473 - DNA, 25 bp, Homo sapien
gtgtgctggtttgtccttttcatac

SEQ ID NO: 207474 - DNA, 25 bp, Homo sapien
tcatacctttgtctcctaattgtgc

SEQ ID NO: 207475 - DNA, 25 bp, Homo sapien
tttgtctcctaattgtgctacaatt

SEQ ID NO: 207476 - DNA, 25 bp, Homo sapien
gctacaattggaagaccttctttct

SEQ ID NO: 207477 - DNA, 25 bp, Homo sapien
ttggaagaccttctttcttttgatt

SEQ ID NO: 207478 - DNA, 25 bp, Homo sapien
ttcttttgattgtctcaagctgcca

SEQ ID NO: 207479 - DNA, 25 bp, Homo sapien
ttgattgtctcaagctgccaccctt

SEQ ID NO: 207480 - DNA, 25 bp, Homo sapien
caagctgccacccttcaaggacagg

SEQ ID NO: 207481 - DNA, 25 bp, Homo sapien
agaccactgtgggatgacagccaga

SEQ ID NO: 207482 - DNA, 25 bp, Homo sapien
aaaggtttgcagagaccactgcact

SEQ ID NO: 207483 - DNA, 25 bp, Homo sapien
gggatcattatcagtaatttcatag

SEQ ID NO: 207484 - DNA, 25 bp, Homo sapien
tttcatatgaatcacagctgttgac

SEQ ID NO: 207485 - DNA, 25 bp, Homo sapien
agctgttgacaatgtcccatatatt

SEQ ID NO: 207486 - DNA, 25 bp, Homo sapien
gacaatgtcccatatatttaagaaa

SEQ ID NO: 207487 - DNA, 25 bp, Homo sapien
atcatactgatactatttgtaacat

SEQ ID NO: 207488 - DNA, 25 bp, Homo sapien
tgatttaatctccagggacagaaat

SEQ ID NO: 207489 - DNA, 25 bp, Homo sapien
gggacagaaataattcattggtaaa

SEQ ID NO: 207490 - DNA, 25 bp, Homo sapien
tggtaaagtgtaataatgcgttttt

SEQ ID NO: 207491 - DNA, 25 bp, Homo sapien
aatgctttgagaggtaattacttgc

SEQ ID NO: 207492 - DNA, 25 bp, Homo sapien
gaggtaattacttgcatatgagaga

SEQ ID NO: 207493 - DNA, 25 bp, Homo sapien
taaaacatttggcacattgtttaca

SEQ ID NO: 207494 - DNA, 25 bp, Homo sapien
gaatattttacagtttgcacagtat

SEQ ID NO: 207495 - DNA, 25 bp, Homo sapien
gagaatctacaacatagggccccag

SEQ ID NO: 207496 - DNA, 25 bp, Homo sapien
atagggccccagaacaacagtttca

SEQ ID NO: 207497 - DNA, 25 bp, Homo sapien
agaacaacagtttcactttgtggct

SEQ ID NO: 207498 - DNA, 25 bp, Homo sapien
tctagaattttaactgcatctcatt

SEQ ID NO: 207499 - DNA, 25 bp, Homo sapien
tgcatctcatttttctagcatggtg

SEQ ID NO: 207500 - DNA, 25 bp, Homo sapien
ttgaaggagctcttttgtccgtacc

SEQ ID NO: 207501 - DNA, 25 bp, Homo sapien
tgtccgtacctatcagaatgttttc

SEQ ID NO: 207502 - DNA, 25 bp, Homo sapien
gaatgttttcttgacacttccatgt

SEQ ID NO: 207503 - DNA, 25 bp, Homo sapien
ttgacacttccatgttggctcttct

SEQ ID NO: 207504 - DNA, 25 bp, Homo sapien
catgttggctcttctcagctttttt

SEQ ID NO: 207505 - DNA, 25 bp, Homo sapien
gctggagagagcttgggatcccttc

SEQ ID NO: 207506 - DNA, 25 bp, Homo sapien
gggccaatggtgttgattgcagact

SEQ ID NO: 207507 - DNA, 25 bp, Homo sapien
ctccgctgagggtcattatgtgcca

SEQ ID NO: 207508 - DNA, 25 bp, Homo sapien
gccaggcatggcattgggtactttc

SEQ ID NO: 207509 - DNA, 25 bp, Homo sapien
gtactttctgcattgggaccaggca

SEQ ID NO: 207510 - DNA, 25 bp, Homo sapien
gcagccgggcctgccatttgaggca

SEQ ID NO: 207511 - DNA, 25 bp, Homo sapien
tttgaggcagcgagcctccgtgacc

SEQ ID NO: 207512 - DNA, 25 bp, Homo sapien
acctgtcctccctcatttgtaaagt

SEQ ID NO: 207513 - DNA, 25 bp, Homo sapien
gtaacagctatgtcactggccagtt

SEQ ID NO: 207514 - DNA, 25 bp, Homo sapien
ttaaagtgctgagcttagtgcccag

SEQ ID NO: 207515 - DNA, 25 bp, Homo sapien
gcccagcccaaaatgctcaataaag

SEQ ID NO: 207516 - DNA, 25 bp, Homo sapien
aaggagttcggtaaagggcatagct

SEQ ID NO: 207517 - DNA, 25 bp, Homo sapien
aggagttcggtaaagggcatagcta

SEQ ID NO: 207518 - DNA, 25 bp, Homo sapien
gagttcggtaaagggcatagctaat

SEQ ID NO: 207519 - DNA, 25 bp, Homo sapien
ggcatagctaataacaaccacacat

SEQ ID NO: 207520 - DNA, 25 bp, Homo sapien
gcatagctaataacaaccacacatt

SEQ ID NO: 207521 - DNA, 25 bp, Homo sapien
tagctaataacaaccacacattggg

SEQ ID NO: 207522 - DNA, 25 bp, Homo sapien
gctaataacaaccacacattgggcc

SEQ ID NO: 207523 - DNA, 25 bp, Homo sapien
aataacaaccacacattgggccagg

SEQ ID NO: 207524 - DNA, 25 bp, Homo sapien
ataacaaccacacattgggccaggc

SEQ ID NO: 207525 - DNA, 25 bp, Homo sapien
taacaaccacacattgggccaggcg

SEQ ID NO: 207526 - DNA, 25 bp, Homo sapien
aacaaccacacattgggccaggcgc

SEQ ID NO: 207527 - DNA, 25 bp, Homo sapien
taggctttccttcaagaacagtcag

SEQ ID NO: 207528 - DNA, 25 bp, Homo sapien
gaacagtcagatcacaaagtgtctt

SEQ ID NO: 207529 - DNA, 25 bp, Homo sapien
ggttattgatatctttgtagtagct

SEQ ID NO: 207530 - DNA, 25 bp, Homo sapien
taccaaaatgtatggttgtcctttt

SEQ ID NO: 207531 - DNA, 25 bp, Homo sapien
attatttctcttagcagatcagcaa

SEQ ID NO: 207532 - DNA, 25 bp, Homo sapien
agcagatcagcaatccctctaggga

SEQ ID NO: 207533 - DNA, 25 bp, Homo sapien
tccctctagggacctaaatactagg

SEQ ID NO: 207534 - DNA, 25 bp, Homo sapien
aatactaggtcagctttggcgacac

SEQ ID NO: 207535 - DNA, 25 bp, Homo sapien
gctttggcgacactgtgtcttctca

SEQ ID NO: 207536 - DNA, 25 bp, Homo sapien
tgtcttctcacataaccacctgtag

SEQ ID NO: 207537 - DNA, 25 bp, Homo sapien
aaccacctgtagcaagatggatcat

SEQ ID NO: 207538 - DNA, 25 bp, Homo sapien
gtcaccgcagaagcgtgtgcgccgt

SEQ ID NO: 207539 - DNA, 25 bp, Homo sapien
agctgtgtcacagccagagggacaa

SEQ ID NO: 207540 - DNA, 25 bp, Homo sapien
gagacgccagtttccgagattgttc

SEQ ID NO: 207541 - DNA, 25 bp, Homo sapien
gccagtttccgagattgttctgcat

SEQ ID NO: 207542 - DNA, 25 bp, Homo sapien
attgttctgcatattcgtttgcaca

SEQ ID NO: 207543 - DNA, 25 bp, Homo sapien
attcgtttgcacattgttgtctggg

SEQ ID NO: 207544 - DNA, 25 bp, Homo sapien
attgttgtctgggttggacatgcgt

SEQ ID NO: 207545 - DNA, 25 bp, Homo sapien
attatccaagtggttgaatcctgtg

SEQ ID NO: 207546 - DNA, 25 bp, Homo sapien
ggttgaatcctgtgagacttggcaa

SEQ ID NO: 207547 - DNA, 25 bp, Homo sapien
gcaagtgtgtgcaaatcaagtatac

SEQ ID NO: 207548 - DNA, 25 bp, Homo sapien
gtatacttgacttttcaacctcttc

SEQ ID NO: 207549 - DNA, 25 bp, Homo sapien
gagggagcttgtgctcaggagtcca

SEQ ID NO: 207550 - DNA, 25 bp, Homo sapien
gtccagccgtccagcctcggggtgt

SEQ ID NO: 207551 - DNA, 25 bp, Homo sapien
gggtgtaggtttctgaggtgtgcca

SEQ ID NO: 207552 - DNA, 25 bp, Homo sapien
aggtgtgccattggggcctcagcct

SEQ ID NO: 207553 - DNA, 25 bp, Homo sapien
tcagctgtggccaccaacacacaac

SEQ ID NO: 207554 - DNA, 25 bp, Homo sapien
gtggccaccaacacacaaccacaca

SEQ ID NO: 207555 - DNA, 25 bp, Homo sapien
gggcaaccacatccagtacaagctt

SEQ ID NO: 207556 - DNA, 25 bp, Homo sapien
ggcaaccacatccagtacaagcttt

SEQ ID NO: 207557 - DNA, 25 bp, Homo sapien
attattatttgttcttgactgttaa

SEQ ID NO: 207558 - DNA, 25 bp, Homo sapien
atttgttcttgactgttaattgtga

SEQ ID NO: 207559 - DNA, 25 bp, Homo sapien
ctgttaattgtgaatggtaatgcaa

SEQ ID NO: 207560 - DNA, 25 bp, Homo sapien
gtgaaagatcaatccatctgccaga

SEQ ID NO: 207561 - DNA, 25 bp, Homo sapien
tccatctgccagaatctagtgggat

SEQ ID NO: 207562 - DNA, 25 bp, Homo sapien
ctagtgggatggaagtttttgctac

SEQ ID NO: 207563 - DNA, 25 bp, Homo sapien
gaagtttttgctacatgttatccac

SEQ ID NO: 207564 - DNA, 25 bp, Homo sapien
taagcagttctactcgatcaccaag

SEQ ID NO: 207565 - DNA, 25 bp, Homo sapien
gttctactcgatcaccaagatgctt

SEQ ID NO: 207566 - DNA, 25 bp, Homo sapien
actcgatcaccaagatgcttctgaa

SEQ ID NO: 207567 - DNA, 25 bp, Homo sapien
catagagtggtttcttcattcatgt

SEQ ID NO: 207568 - DNA, 25 bp, Homo sapien
aaattattagccagcaccagatgca

SEQ ID NO: 207569 - DNA, 25 bp, Homo sapien
gccagcaccagatgcatgagctaat

SEQ ID NO: 207570 - DNA, 25 bp, Homo sapien
tatctctttgagtccttgcttctgt

SEQ ID NO: 207571 - DNA, 25 bp, Homo sapien
aggtatttggttagatgactttgaa

SEQ ID NO: 207572 - DNA, 25 bp, Homo sapien
ctttgaatgaatagactgctgtgct

SEQ ID NO: 207573 - DNA, 25 bp, Homo sapien
tagactgctgtgctgaaagagcttt

SEQ ID NO: 207574 - DNA, 25 bp, Homo sapien
aagagctttatcacactgtctcaaa

SEQ ID NO: 207575 - DNA, 25 bp, Homo sapien
tatcacactgtctcaaagtatgtaa

SEQ ID NO: 207576 - DNA, 25 bp, Homo sapien
cataggtggatgctcttactgcagc

SEQ ID NO: 207577 - DNA, 25 bp, Homo sapien
tactgcagcagtcatgaatacattt

SEQ ID NO: 207578 - DNA, 25 bp, Homo sapien
aagacagtttttctaggtaccatga

SEQ ID NO: 207579 - DNA, 25 bp, Homo sapien
ggtaccatgaaggaagattgaccct

SEQ ID NO: 207580 - DNA, 25 bp, Homo sapien
agattgaccctgttggtatgcctgt

SEQ ID NO: 207581 - DNA, 25 bp, Homo sapien
atgtgagtgggactgataaactgat

SEQ ID NO: 207582 - DNA, 25 bp, Homo sapien
ggagcttgtgccgtccttggccaaa

SEQ ID NO: 207583 - DNA, 25 bp, Homo sapien
gcttgtgccgtccttggccaaacac

SEQ ID NO: 207584 - DNA, 25 bp, Homo sapien
caaacaccccgcaggcaaagatgca

SEQ ID NO: 207585 - DNA, 25 bp, Homo sapien
agatgcacccctgctgatggagagc

SEQ ID NO: 207586 - DNA, 25 bp, Homo sapien
tccccagccagaaccggcgtgcagc

SEQ ID NO: 207587 - DNA, 25 bp, Homo sapien
cggcgtgcagctaggaggaatgggt

SEQ ID NO: 207588 - DNA, 25 bp, Homo sapien
gaggaatgggttgcacggcggaggg

SEQ ID NO: 207589 - DNA, 25 bp, Homo sapien
aggtgggaggcgtctcactgctctc

SEQ ID NO: 207590 - DNA, 25 bp, Homo sapien
gtgggaggcgtctcactgctctcag

SEQ ID NO: 207591 - DNA, 25 bp, Homo sapien
gaggcgtctcactgctctcagggtt

SEQ ID NO: 207592 - DNA, 25 bp, Homo sapien
gtctcactgctctcagggttcaggt

SEQ ID NO: 207593 - DNA, 25 bp, Homo sapien
tgttggtggatccatgtatgtgtcc

SEQ ID NO: 207594 - DNA, 25 bp, Homo sapien
atgtatgtgtccagcacagcggcct

SEQ ID NO: 207595 - DNA, 25 bp, Homo sapien
cctgctggactctgagaactgggaa

SEQ ID NO: 207596 - DNA, 25 bp, Homo sapien
gaaagatcagagcaagccttgcctc

SEQ ID NO: 207597 - DNA, 25 bp, Homo sapien
aagccttgcctcttatcttcgggaa

SEQ ID NO: 207598 - DNA, 25 bp, Homo sapien
ttgcctcttatcttcgggaaaccag

SEQ ID NO: 207599 - DNA, 25 bp, Homo sapien
tcttatcttcgggaaaccagaatat

SEQ ID NO: 207600 - DNA, 25 bp, Homo sapien
ccctgtgcctttcctttgagagtga

SEQ ID NO: 207601 - DNA, 25 bp, Homo sapien
gagaattcgggaaagacccaaagtg

SEQ ID NO: 207602 - DNA, 25 bp, Homo sapien
ttacctacagaaatggtcacatggt

SEQ ID NO: 207603 - DNA, 25 bp, Homo sapien
agaaatggtcacatggttctattta

SEQ ID NO: 207604 - DNA, 25 bp, Homo sapien
gggagctggatggaaatgcctctca

SEQ ID NO: 207605 - DNA, 25 bp, Homo sapien
gctggatggaaatgcctctcacttc

SEQ ID NO: 207606 - DNA, 25 bp, Homo sapien
ctctcacttcaaaatgcccagcctg

SEQ ID NO: 207607 - DNA, 25 bp, Homo sapien
gggtcttggtcacaaggctcagctt

SEQ ID NO: 207608 - DNA, 25 bp, Homo sapien
ttggtcacaaggctcagcttctctc

SEQ ID NO: 207609 - DNA, 25 bp, Homo sapien
acaaggctcagcttctctccactgt

SEQ ID NO: 207610 - DNA, 25 bp, Homo sapien
tcctatcatctgtagagcagagcac

SEQ ID NO: 207611 - DNA, 25 bp, Homo sapien
cagggaaccctccatcaacctgaga

SEQ ID NO: 207612 - DNA, 25 bp, Homo sapien
gacaggactcagtatatggttcttg

SEQ ID NO: 207613 - DNA, 25 bp, Homo sapien
tatggttcttgggtatgccctacca

SEQ ID NO: 207614 - DNA, 25 bp, Homo sapien
ttgggtatgccctaccaggtggaat

SEQ ID NO: 207615 - DNA, 25 bp, Homo sapien
ccagcccagagtttactgacttgta

SEQ ID NO: 207616 - DNA, 25 bp, Homo sapien
tgacttgtaattctctatccaggac

SEQ ID NO: 207617 - DNA, 25 bp, Homo sapien
ttctctatccaggacatcaggagtg

SEQ ID NO: 207618 - DNA, 25 bp, Homo sapien
aggcctggagccacactctatatgg

SEQ ID NO: 207619 - DNA, 25 bp, Homo sapien
cacactctatatggctgaggaagga

SEQ ID NO: 207620 - DNA, 25 bp, Homo sapien
ggtgaagggtgtttgcttgaactca

SEQ ID NO: 207621 - DNA, 25 bp, Homo sapien
gggtgtttgcttgaactcatgagac

SEQ ID NO: 207622 - DNA, 25 bp, Homo sapien
gcttgaactcatgagacggtccaaa

SEQ ID NO: 207623 - DNA, 25 bp, Homo sapien
gacggtccaaatctcataaactagc

SEQ ID NO: 207624 - DNA, 25 bp, Homo sapien
ataaactagccttctcaaaatccca

SEQ ID NO: 207625 - DNA, 25 bp, Homo sapien
atcccagcaatataaagcactgttt

SEQ ID NO: 207626 - DNA, 25 bp, Homo sapien
ttctctgaccagcttactattttat

SEQ ID NO: 207627 - DNA, 25 bp, Homo sapien
ctgaccagcttactattttatttcc

SEQ ID NO: 207628 - DNA, 25 bp, Homo sapien
tattttatttcctcatagcacaaaa

SEQ ID NO: 207629 - DNA, 25 bp, Homo sapien
tatctatctgttcatgtatttgttt

SEQ ID NO: 207630 - DNA, 25 bp, Homo sapien
ttccctctttagtatgtaggtccca

SEQ ID NO: 207631 - DNA, 25 bp, Homo sapien
ctttagtatgtaggtcccatgagat

SEQ ID NO: 207632 - DNA, 25 bp, Homo sapien
gtaggtcccatgagattaaggcaag

SEQ ID NO: 207633 - DNA, 25 bp, Homo sapien
aaggcaagggttggcagattatagc

SEQ ID NO: 207634 - DNA, 25 bp, Homo sapien
cagattatagcctgcagggcgaatc

SEQ ID NO: 207635 - DNA, 25 bp, Homo sapien
ttatagcctgcagggcgaatctggc

SEQ ID NO: 207636 - DNA, 25 bp, Homo sapien
ctgcagggcgaatctggcctgccac

SEQ ID NO: 207637 - DNA, 25 bp, Homo sapien
aataggctgatggagctgttctgta

SEQ ID NO: 207638 - DNA, 25 bp, Homo sapien
atggagctgttctgtatggtactgt

SEQ ID NO: 207639 - DNA, 25 bp, Homo sapien
gctgttctgtatggtactgtgtggt

SEQ ID NO: 207640 - DNA, 25 bp, Homo sapien
tggtactgtgtggtggatacatgac

SEQ ID NO: 207641 - DNA, 25 bp, Homo sapien
gacaatatccatttgcaaacacaag

SEQ ID NO: 207642 - DNA, 25 bp, Homo sapien
gaactatacacatggccaggcgcgg

SEQ ID NO: 207643 - DNA, 25 bp, Homo sapien
ctgtctctactgtctctaacatttg

SEQ ID NO: 207644 - DNA, 25 bp, Homo sapien
gtctctactgtctctaacatttgta

SEQ ID NO: 207645 - DNA, 25 bp, Homo sapien
taacatttgtaaacctgtctctaat

SEQ ID NO: 207646 - DNA, 25 bp, Homo sapien
taaacctgtctctaatttgtaattt

SEQ ID NO: 207647 - DNA, 25 bp, Homo sapien
gtaaaccctgtctctcatattttgt

SEQ ID NO: 207648 - DNA, 25 bp, Homo sapien
accagagacttggactctgattata

SEQ ID NO: 207649 - DNA, 25 bp, Homo sapien
agagacttggactctgattatacaa

SEQ ID NO: 207650 - DNA, 25 bp, Homo sapien
gagacttggactctgattatacaat

SEQ ID NO: 207651 - DNA, 25 bp, Homo sapien
agacttggactctgattatacaatt

SEQ ID NO: 207652 - DNA, 25 bp, Homo sapien
gacttggactctgattatacaattt

SEQ ID NO: 207653 - DNA, 25 bp, Homo sapien
acttggactctgattatacaattta

SEQ ID NO: 207654 - DNA, 25 bp, Homo sapien
ttggactctgattatacaatttaaa

SEQ ID NO: 207655 - DNA, 25 bp, Homo sapien
aaaatcctgtgattggacaggcgct

SEQ ID NO: 207656 - DNA, 25 bp, Homo sapien
aaatcctgtgattggacaggcgctg

SEQ ID NO: 207657 - DNA, 25 bp, Homo sapien
aatcctgtgattggacaggcgctgt

SEQ ID NO: 207658 - DNA, 25 bp, Homo sapien
atcctgtgattggacaggcgctgtg

SEQ ID NO: 207659 - DNA, 25 bp, Homo sapien
gggagtgtatataaaacttgcttta

SEQ ID NO: 207660 - DNA, 25 bp, Homo sapien
tataaaacttgctttattgcatggg

SEQ ID NO: 207661 - DNA, 25 bp, Homo sapien
ggaagtccaggcctaatactcctaa

SEQ ID NO: 207662 - DNA, 25 bp, Homo sapien
agtccaggcctaatactcctaaagt

SEQ ID NO: 207663 - DNA, 25 bp, Homo sapien
caggcctaatactcctaaagtaaga

SEQ ID NO: 207664 - DNA, 25 bp, Homo sapien
ttttcttcaatacaactgtgctgta

SEQ ID NO: 207665 - DNA, 25 bp, Homo sapien
acaactgtgctgtaccttgtaaagt

SEQ ID NO: 207666 - DNA, 25 bp, Homo sapien
ctgtgctgtaccttgtaaagtattt

SEQ ID NO: 207667 - DNA, 25 bp, Homo sapien
tgtggaatgaaacctcaaacaaacc

SEQ ID NO: 207668 - DNA, 25 bp, Homo sapien
gattggaaatctgcctgcagattct

SEQ ID NO: 207669 - DNA, 25 bp, Homo sapien
ctgcagattctattaaatacaccct

SEQ ID NO: 207670 - DNA, 25 bp, Homo sapien
gtatctttacctaaattgctcaggc

SEQ ID NO: 207671 - DNA, 25 bp, Homo sapien
cctaaattgctcaggcattattcca

SEQ ID NO: 207672 - DNA, 25 bp, Homo sapien
ggcattattccagcagtagatagtg

SEQ ID NO: 207673 - DNA, 25 bp, Homo sapien
gatagtgactgtgtattactgaaat

SEQ ID NO: 207674 - DNA, 25 bp, Homo sapien
gctccaaacttagcttttccagtgg

SEQ ID NO: 207675 - DNA, 25 bp, Homo sapien
ttttccagtggatttgtatatgtac

SEQ ID NO: 207676 - DNA, 25 bp, Homo sapien
gtatatgtacttgctttatctcttt

SEQ ID NO: 207677 - DNA, 25 bp, Homo sapien
tacttgctttatctctttaccctta

SEQ ID NO: 207678 - DNA, 25 bp, Homo sapien
gctttatctctttacccttaaaatg

SEQ ID NO: 207679 - DNA, 25 bp, Homo sapien
tacccttaaaatgatgataccttgt

SEQ ID NO: 207680 - DNA, 25 bp, Homo sapien
gataccttgtattcaccattgtttt

SEQ ID NO: 207681 - DNA, 25 bp, Homo sapien
aggatagtttttgttgtatgttcac

SEQ ID NO: 207682 - DNA, 25 bp, Homo sapien
atctttcatcttagagaactataca

SEQ ID NO: 207683 - DNA, 25 bp, Homo sapien
gagaactatacaacttttattgttt

SEQ ID NO: 207684 - DNA, 25 bp, Homo sapien
gtttcttaatggaacattctggcta

SEQ ID NO: 207685 - DNA, 25 bp, Homo sapien
taatggaacattctggctaaccaga

SEQ ID NO: 207686 - DNA, 25 bp, Homo sapien
gtagtaccttgggatgtgtagtcaa

SEQ ID NO: 207687 - DNA, 25 bp, Homo sapien
aagatgacaaattttaagactggaa

SEQ ID NO: 207688 - DNA, 25 bp, Homo sapien
gactggaaaagctctaaacaggctt

SEQ ID NO: 207689 - DNA, 25 bp, Homo sapien
ggcttaatgattcttcaggtagaat

SEQ ID NO: 207690 - DNA, 25 bp, Homo sapien
tgattcttcaggtagaatgatcctg

SEQ ID NO: 207691 - DNA, 25 bp, Homo sapien
gtgcatgtgatgattaagtgaagac

SEQ ID NO: 207692 - DNA, 25 bp, Homo sapien
gaagtgagtaaaagtccgcagaggt

SEQ ID NO: 207693 - DNA, 25 bp, Homo sapien
gggatggaagatctctccttagata

SEQ ID NO: 207694 - DNA, 25 bp, Homo sapien
agatctctccttagatagaacctgt

SEQ ID NO: 207695 - DNA, 25 bp, Homo sapien
ttagatagaacctgtcttcctccct

SEQ ID NO: 207696 - DNA, 25 bp, Homo sapien
ctgtcttcctccctggcattgtggg

SEQ ID NO: 207697 - DNA, 25 bp, Homo sapien
gggcgtgacactgggactctcagca

SEQ ID NO: 207698 - DNA, 25 bp, Homo sapien
tttgtgctgccaacctgagattgaa

SEQ ID NO: 207699 - DNA, 25 bp, Homo sapien
gagattgaaggcagtgcctcagagc

SEQ ID NO: 207700 - DNA, 25 bp, Homo sapien
tgcctcagagcagcacagagagttg

SEQ ID NO: 207701 - DNA, 25 bp, Homo sapien
tatctccgcatttccagttgtatta

SEQ ID NO: 207702 - DNA, 25 bp, Homo sapien
gcatttccagttgtattagccaata

SEQ ID NO: 207703 - DNA, 25 bp, Homo sapien
atgaatccatacttctgcctcactt

SEQ ID NO: 207704 - DNA, 25 bp, Homo sapien
tgcctcacttcgagcagacttttgt

SEQ ID NO: 207705 - DNA, 25 bp, Homo sapien
gagcagacttttgttctcggcgctc

SEQ ID NO: 207706 - DNA, 25 bp, Homo sapien
ggcgctcctcacgatggagtttcat

SEQ ID NO: 207707 - DNA, 25 bp, Homo sapien
ggagtttcatgcttcattttcacat

SEQ ID NO: 207708 - DNA, 25 bp, Homo sapien
cacaattagattgggagctccttga

SEQ ID NO: 207709 - DNA, 25 bp, Homo sapien
gagtacgtgccttaatctttatctt

SEQ ID NO: 207710 - DNA, 25 bp, Homo sapien
taatctttatctttgtaatgccaca

SEQ ID NO: 207711 - DNA, 25 bp, Homo sapien
aatgaacagagtgcctcctggtaca

SEQ ID NO: 207712 - DNA, 25 bp, Homo sapien
ctggtacactgtaggagcttaagaa

SEQ ID NO: 207713 - DNA, 25 bp, Homo sapien
agaatgggatttactctgctttacc

SEQ ID NO: 207714 - DNA, 25 bp, Homo sapien
gttaggctatataacattgccactt

SEQ ID NO: 207715 - DNA, 25 bp, Homo sapien
attgccacttcaactctaaggaata

SEQ ID NO: 207716 - DNA, 25 bp, Homo sapien
tatttttgagatatccctttggaag

SEQ ID NO: 207717 - DNA, 25 bp, Homo sapien
gaccttgcttggaagagcctggaca

SEQ ID NO: 207718 - DNA, 25 bp, Homo sapien
gagcctggacactaacaattctaca

SEQ ID NO: 207719 - DNA, 25 bp, Homo sapien
aattctacaccaaattgtctcttca

SEQ ID NO: 207720 - DNA, 25 bp, Homo sapien
aattgtctcttcaaatacgtatgga

SEQ ID NO: 207721 - DNA, 25 bp, Homo sapien
atacgtatggactggataactctga

SEQ ID NO: 207722 - DNA, 25 bp, Homo sapien
gataactctgagaaacacatctagt

SEQ ID NO: 207723 - DNA, 25 bp, Homo sapien
gacagaaaccgaaagctctatataa

SEQ ID NO: 207724 - DNA, 25 bp, Homo sapien
atgtatttcttattggcattcaaca

SEQ ID NO: 207725 - DNA, 25 bp, Homo sapien
atcaatggcaactgataaattctgc

SEQ ID NO: 207726 - DNA, 25 bp, Homo sapien
gcaactgataaattctgcatcttta

SEQ ID NO: 207727 - DNA, 25 bp, Homo sapien
acaagcctgggcattataacgagat

SEQ ID NO: 207728 - DNA, 25 bp, Homo sapien
gcctgggcattataacgagatcctg

SEQ ID NO: 207729 - DNA, 25 bp, Homo sapien
gggcattataacgagatcctgtcct

SEQ ID NO: 207730 - DNA, 25 bp, Homo sapien
gcattataacgagatcctgtcctta

SEQ ID NO: 207731 - DNA, 25 bp, Homo sapien
tataacgagatcctgtccttacaaa

SEQ ID NO: 207732 - DNA, 25 bp, Homo sapien
taacgagatcctgtccttacaaaaa

SEQ ID NO: 207733 - DNA, 25 bp, Homo sapien
atattatctgggagtggtgttgcac

SEQ ID NO: 207734 - DNA, 25 bp, Homo sapien
atctgggagtggtgttgcactcctg

SEQ ID NO: 207735 - DNA, 25 bp, Homo sapien
aatgcaccattgcacactaacctgg

SEQ ID NO: 207736 - DNA, 25 bp, Homo sapien
gagctgctcagtcaactcaagaaac

SEQ ID NO: 207737 - DNA, 25 bp, Homo sapien
gactcagccggcctcagaaataagc

SEQ ID NO: 207738 - DNA, 25 bp, Homo sapien
ataagcctgagagaccatctttagc

SEQ ID NO: 207739 - DNA, 25 bp, Homo sapien
ctgaaactccagatcctggctaaga

SEQ ID NO: 207740 - DNA, 25 bp, Homo sapien
gagggaaatagctccttgggacaca

SEQ ID NO: 207741 - DNA, 25 bp, Homo sapien
agggacatttgcatactcctactgt

SEQ ID NO: 207742 - DNA, 25 bp, Homo sapien
tttgcatactcctactgtctgtgtg

SEQ ID NO: 207743 - DNA, 25 bp, Homo sapien
gtgtggtcacagctagtttctgtca

SEQ ID NO: 207744 - DNA, 25 bp, Homo sapien
agtttctgtcagctgggctctctgg

SEQ ID NO: 207745 - DNA, 25 bp, Homo sapien
aaagctggctgttgtccaatgcctt

SEQ ID NO: 207746 - DNA, 25 bp, Homo sapien
caatgccttccttggcagccaagtg

SEQ ID NO: 207747 - DNA, 25 bp, Homo sapien
gaggattgccctcatagtgagctcc

SEQ ID NO: 207748 - DNA, 25 bp, Homo sapien
agcctcagccgtaaggccctgggct

SEQ ID NO: 207749 - DNA, 25 bp, Homo sapien
gagcgggaaacctgagttctggccc

SEQ ID NO: 207750 - DNA, 25 bp, Homo sapien
ctggccctggtctgggaaaagtgct

SEQ ID NO: 207751 - DNA, 25 bp, Homo sapien
ggaaaagtgctaggcccatgttcca

SEQ ID NO: 207752 - DNA, 25 bp, Homo sapien
atgttccactcaggcttcagcctga

SEQ ID NO: 207753 - DNA, 25 bp, Homo sapien
ttcagcctgagagtccaggttgcta

SEQ ID NO: 207754 - DNA, 25 bp, Homo sapien
gctaacctgtaaaatggatctgtca

SEQ ID NO: 207755 - DNA, 25 bp, Homo sapien
ctgtcaaactaacacttatgccttt

SEQ ID NO: 207756 - DNA, 25 bp, Homo sapien
ttatgcctttagtctcattgtatga

SEQ ID NO: 207757 - DNA, 25 bp, Homo sapien
gaatcattatgcaaattttcctaaa

SEQ ID NO: 207758 - DNA, 25 bp, Homo sapien
gggactgtaaccaaaaataaacatg

SEQ ID NO: 207759 - DNA, 25 bp, Homo sapien
agaagtcttgaatagctctttactg

SEQ ID NO: 207760 - DNA, 25 bp, Homo sapien
atagctctttactgtcttacttggg

SEQ ID NO: 207761 - DNA, 25 bp, Homo sapien
gggttgataagatttgagtgtttgc

SEQ ID NO: 207762 - DNA, 25 bp, Homo sapien
ttactaaatgtagctccaagtctta

SEQ ID NO: 207763 - DNA, 25 bp, Homo sapien
tgtagctccaagtcttaaatggctt

SEQ ID NO: 207764 - DNA, 25 bp, Homo sapien
gctccaagtcttaaatggcttgttt

SEQ ID NO: 207765 - DNA, 25 bp, Homo sapien
aactgttaattgatgaaactgtgca

SEQ ID NO: 207766 - DNA, 25 bp, Homo sapien
aactgtgcataagtttacatgtact

SEQ ID NO: 207767 - DNA, 25 bp, Homo sapien
acatgtactaacttattttgcttat

SEQ ID NO: 207768 - DNA, 25 bp, Homo sapien
attggaaattgtaaccacacacttc

SEQ ID NO: 207769 - DNA, 25 bp, Homo sapien
attgttggtagagacggtgattcac

SEQ ID NO: 207770 - DNA, 25 bp, Homo sapien
tgttggtagagacggtgattcacta

SEQ ID NO: 207771 - DNA, 25 bp, Homo sapien
tatttattcctaaaatattaccttg

SEQ ID NO: 207772 - DNA, 25 bp, Homo sapien
ttaccttgaggccaaattctgcgct

SEQ ID NO: 207773 - DNA, 25 bp, Homo sapien
ttgaggccaaattctgcgcttaagg

SEQ ID NO: 207774 - DNA, 25 bp, Homo sapien
aggccaaattctgcgcttaaggaga

SEQ ID NO: 207775 - DNA, 25 bp, Homo sapien
tctgcgcttaaggagaatgtgcacc

SEQ ID NO: 207776 - DNA, 25 bp, Homo sapien
taaggagaatgtgcaccaagtgctg

SEQ ID NO: 207777 - DNA, 25 bp, Homo sapien
gggctggttataaacgaggccacaa

SEQ ID NO: 207778 - DNA, 25 bp, Homo sapien
taaacgaggccacaaatcatgcttg

SEQ ID NO: 207779 - DNA, 25 bp, Homo sapien
cgaggccacaaatcatgcttgttaa

SEQ ID NO: 207780 - DNA, 25 bp, Homo sapien
ctcagttcccagctgggattgctat

SEQ ID NO: 207781 - DNA, 25 bp, Homo sapien
ggattgctatgcactgggcagaccc

SEQ ID NO: 207782 - DNA, 25 bp, Homo sapien
atgcactgggcagacccgtcactgt

SEQ ID NO: 207783 - DNA, 25 bp, Homo sapien
acacagtggcttcccttagaaccag

SEQ ID NO: 207784 - DNA, 25 bp, Homo sapien
gcttcccttagaaccagtctttgta

SEQ ID NO: 207785 - DNA, 25 bp, Homo sapien
cagtctttgtactctccctaaacag

SEQ ID NO: 207786 - DNA, 25 bp, Homo sapien
tgtactctccctaaacagcagcagg

SEQ ID NO: 207787 - DNA, 25 bp, Homo sapien
cagcagcaggcttaggatttttgtc

SEQ ID NO: 207788 - DNA, 25 bp, Homo sapien
ggcttaggatttttgtcaggctggt

SEQ ID NO: 207789 - DNA, 25 bp, Homo sapien
aggctggttcttgcgtgctctgtgc

SEQ ID NO: 207790 - DNA, 25 bp, Homo sapien
gcattttgtaatgtgttttctctgt

SEQ ID NO: 207791 - DNA, 25 bp, Homo sapien
ttgtgaagtcctttaaaacataatt

SEQ ID NO: 207792 - DNA, 25 bp, Homo sapien
acataattttctcaagttctttctt

SEQ ID NO: 207793 - DNA, 25 bp, Homo sapien
ataattttctcaagttctttctttg

SEQ ID NO: 207794 - DNA, 25 bp, Homo sapien
ctcaatctgtcttagcattttgtaa

SEQ ID NO: 207795 - DNA, 25 bp, Homo sapien
caatctgtcttagcattttgtaact

SEQ ID NO: 207796 - DNA, 25 bp, Homo sapien
agcattttgtaactaataactgaaa

SEQ ID NO: 207797 - DNA, 25 bp, Homo sapien
taaaccaccaatttatttccatgtg

SEQ ID NO: 207798 - DNA, 25 bp, Homo sapien
tgtaattgcgttaaatcttttgaga

SEQ ID NO: 207799 - DNA, 25 bp, Homo sapien
aaatgccgggctaggcaattgcagt

SEQ ID NO: 207800 - DNA, 25 bp, Homo sapien
gccgggctaggcaattgcagttaat

SEQ ID NO: 207801 - DNA, 25 bp, Homo sapien
aggcaattgcagttaatacatacag

SEQ ID NO: 207802 - DNA, 25 bp, Homo sapien
gtaaactcttgcataatacattgat

SEQ ID NO: 207803 - DNA, 25 bp, Homo sapien
cattgataacatgttttgccaactt

SEQ ID NO: 207804 - DNA, 25 bp, Homo sapien
cataagcgaaaccagtagcaagtat

SEQ ID NO: 207805 - DNA, 25 bp, Homo sapien
gtagcaagtatgtgggtcagcttaa

SEQ ID NO: 207806 - DNA, 25 bp, Homo sapien
aaattttgattgttaatgccctatt

SEQ ID NO: 207807 - DNA, 25 bp, Homo sapien
gttaatgccctattttctaatttgg

SEQ ID NO: 207808 - DNA, 25 bp, Homo sapien
tttctaatttggcacctcttgatgc

SEQ ID NO: 207809 - DNA, 25 bp, Homo sapien
gcacctcttgatgcctaagcaggta

SEQ ID NO: 207810 - DNA, 25 bp, Homo sapien
gcctaagcaggtaagcagatgccta

SEQ ID NO: 207811 - DNA, 25 bp, Homo sapien
gatgcctaagctgtatttctccaaa

SEQ ID NO: 207812 - DNA, 25 bp, Homo sapien
gatagcctaaagacaagtttatgta

SEQ ID NO: 207813 - DNA, 25 bp, Homo sapien
ggattagagcacaagtctggcctca

SEQ ID NO: 207814 - DNA, 25 bp, Homo sapien
gagcacaagtctggcctcactgagt

SEQ ID NO: 207815 - DNA, 25 bp, Homo sapien
gtggacaagagctgatgggcctcat

SEQ ID NO: 207816 - DNA, 25 bp, Homo sapien
tgggcctcatcagggtgacattcac

SEQ ID NO: 207817 - DNA, 25 bp, Homo sapien
agggtgacattcaccccagggcagc

SEQ ID NO: 207818 - DNA, 25 bp, Homo sapien
gcaaagtgggcagaggaccccacct

SEQ ID NO: 207819 - DNA, 25 bp, Homo sapien
gagactagcacctaggtacccacat

SEQ ID NO: 207820 - DNA, 25 bp, Homo sapien
acccacatgggtatttatatctgaa

SEQ ID NO: 207821 - DNA, 25 bp, Homo sapien
atatctgaaccagacagacgcttga

SEQ ID NO: 207822 - DNA, 25 bp, Homo sapien
gacagacgcttgaatcaggcactat

SEQ ID NO: 207823 - DNA, 25 bp, Homo sapien
acgcttgaatcaggcactatgttaa

SEQ ID NO: 207824 - DNA, 25 bp, Homo sapien
gcagactgttacagtttgtcccata

SEQ ID NO: 207825 - DNA, 25 bp, Homo sapien
ttgtcccatatgtgaacctgtagct

SEQ ID NO: 207826 - DNA, 25 bp, Homo sapien
gaacctgtagcttgatcgtttttca

SEQ ID NO: 207827 - DNA, 25 bp, Homo sapien
ttgatcgtttttcagccccgtttct

SEQ ID NO: 207828 - DNA, 25 bp, Homo sapien
ctgcagttccagcttgattttaagt

SEQ ID NO: 207829 - DNA, 25 bp, Homo sapien
gttactgtcctagtgaatagcttcc

SEQ ID NO: 207830 - DNA, 25 bp, Homo sapien
tgaatagcttccacctcctttttgg

SEQ ID NO: 207831 - DNA, 25 bp, Homo sapien
atgtttttccatcaacgtgttccca

SEQ ID NO: 207832 - DNA, 25 bp, Homo sapien
gttcccatctactgtctgtcatcta

SEQ ID NO: 207833 - DNA, 25 bp, Homo sapien
tgtcatctacaacagacgttttgag

SEQ ID NO: 207834 - DNA, 25 bp, Homo sapien
atgtcaaatgttttgagctgctggc

SEQ ID NO: 207835 - DNA, 25 bp, Homo sapien
tgagagggtcttaaatccccagcct

SEQ ID NO: 207836 - DNA, 25 bp, Homo sapien
agggtcttaaatccccagcctgtga

SEQ ID NO: 207837 - DNA, 25 bp, Homo sapien
tcttaaatccccagcctgtgagtct

SEQ ID NO: 207838 - DNA, 25 bp, Homo sapien
tgagtctcagcctctttccagggaa

SEQ ID NO: 207839 - DNA, 25 bp, Homo sapien
ttccagggaagcctcattctactgc

SEQ ID NO: 207840 - DNA, 25 bp, Homo sapien
gggaagcctcattctactgcttggg

SEQ ID NO: 207841 - DNA, 25 bp, Homo sapien
atatgagttatttctgagtaagtga

SEQ ID NO: 207842 - DNA, 25 bp, Homo sapien
ctgaaggcagtgctgagtcctttct

SEQ ID NO: 207843 - DNA, 25 bp, Homo sapien
gaaggcagtgctgagtcctttctgc

SEQ ID NO: 207844 - DNA, 25 bp, Homo sapien
tctgctagctgggtggtatctttta

SEQ ID NO: 207845 - DNA, 25 bp, Homo sapien
ctgggtggtatcttttactgtgttt

SEQ ID NO: 207846 - DNA, 25 bp, Homo sapien
aagtagaaatactttggctgcccaa

SEQ ID NO: 207847 - DNA, 25 bp, Homo sapien
gctgcccaaatgtatcttttgttcc

SEQ ID NO: 207848 - DNA, 25 bp, Homo sapien
aaatgtatcttttgttcctcttaga

SEQ ID NO: 207849 - DNA, 25 bp, Homo sapien
accccagagtcctcatttgatagca

SEQ ID NO: 207850 - DNA, 25 bp, Homo sapien
tcctcatttgatagcatctgtctcc

SEQ ID NO: 207851 - DNA, 25 bp, Homo sapien
tgcagacctcatcattccacagtat

SEQ ID NO: 207852 - DNA, 25 bp, Homo sapien
tccacagtatttccctgccatgtaa

SEQ ID NO: 207853 - DNA, 25 bp, Homo sapien
tttccctgccatgtaaaaatcctga

SEQ ID NO: 207854 - DNA, 25 bp, Homo sapien
aaaatcctgactttgtgcgtatata

SEQ ID NO: 207855 - DNA, 25 bp, Homo sapien
aaagactgtattttgttgacacata

SEQ ID NO: 207856 - DNA, 25 bp, Homo sapien
gttgacacatactttgtgcagtttt

SEQ ID NO: 207857 - DNA, 25 bp, Homo sapien
ttttcataatcaatatgtgcctaaa

SEQ ID NO: 207858 - DNA, 25 bp, Homo sapien
tttaaatcatttcactctgtactat

SEQ ID NO: 207859 - DNA, 25 bp, Homo sapien
aatcatttcactctgtactatattt

SEQ ID NO: 207860 - DNA, 25 bp, Homo sapien
tactatattttcaggaattacagaa

SEQ ID NO: 207861 - DNA, 25 bp, Homo sapien
gtattcattcacttaaaggtacctc

SEQ ID NO: 207862 - DNA, 25 bp, Homo sapien
tcacttaaaggtacctctgtagaaa

SEQ ID NO: 207863 - DNA, 25 bp, Homo sapien
gtagaaataacctaaaactgcagaa

SEQ ID NO: 207864 - DNA, 25 bp, Homo sapien
ataacctaaaactgcagaaggatct

SEQ ID NO: 207865 - DNA, 25 bp, Homo sapien
aaagatctaaacatggtgtgcttag

SEQ ID NO: 207866 - DNA, 25 bp, Homo sapien
gcttagaaactgcagattttagatc

SEQ ID NO: 207867 - DNA, 25 bp, Homo sapien
attttagatctaatgtatactgcat

SEQ ID NO: 207868 - DNA, 25 bp, Homo sapien
tgatgatgagccctctgtctattct

SEQ ID NO: 207869 - DNA, 25 bp, Homo sapien
tctgtctattctgcttgacagcctt

SEQ ID NO: 207870 - DNA, 25 bp, Homo sapien
gcttgacagccttctgtcttaaagg

SEQ ID NO: 207871 - DNA, 25 bp, Homo sapien
aaggttttataatgctgactgaata

SEQ ID NO: 207872 - DNA, 25 bp, Homo sapien
gctgactgaatatctgttatgcatt

SEQ ID NO: 207873 - DNA, 25 bp, Homo sapien
taacattaggatttgctaactagct

SEQ ID NO: 207874 - DNA, 25 bp, Homo sapien
gctaactagctttcatcaaaaatgg

SEQ ID NO: 207875 - DNA, 25 bp, Homo sapien
ttcatcaaaaatgggagcatggcta

SEQ ID NO: 207876 - DNA, 25 bp, Homo sapien
gcatggctataagacaactatattt

SEQ ID NO: 207877 - DNA, 25 bp, Homo sapien
atataagactactggctttgtgagg

SEQ ID NO: 207878 - DNA, 25 bp, Homo sapien
gcaaaattttttcctctaatgtata

SEQ ID NO: 207879 - DNA, 25 bp, Homo sapien
actctgcaagaaagcactgtgacta

SEQ ID NO: 207880 - DNA, 25 bp, Homo sapien
gactaaaacatacataacgcctgca

SEQ ID NO: 207881 - DNA, 25 bp, Homo sapien
aacgcctgcataaatattccatggt

SEQ ID NO: 207882 - DNA, 25 bp, Homo sapien
attccatggtttcagttaaatttca

SEQ ID NO: 207883 - DNA, 25 bp, Homo sapien
tttcagtttttagcctttacacatg

SEQ ID NO: 207884 - DNA, 25 bp, Homo sapien
ttttagcctttacacatgaggtcaa

SEQ ID NO: 207885 - DNA, 25 bp, Homo sapien
aatatctggtttttgctgaatgctt

SEQ ID NO: 207886 - DNA, 25 bp, Homo sapien
tattttttactgtgccactccaata

SEQ ID NO: 207887 - DNA, 25 bp, Homo sapien
tactgtgccactccaatatttatca

SEQ ID NO: 207888 - DNA, 25 bp, Homo sapien
gctttcttaagaccagttgttcaca

SEQ ID NO: 207889 - DNA, 25 bp, Homo sapien
gaccagttgttcacactttgtagat

SEQ ID NO: 207890 - DNA, 25 bp, Homo sapien
aacccttcatcacaagttcaagcat

SEQ ID NO: 207891 - DNA, 25 bp, Homo sapien
aagcattcattgacatcagagtcca

SEQ ID NO: 207892 - DNA, 25 bp, Homo sapien
gacatcagagtccatgctaaagaga

SEQ ID NO: 207893 - DNA, 25 bp, Homo sapien
gagaaatcatatacacctaactgtg

SEQ ID NO: 207894 - DNA, 25 bp, Homo sapien
cacctaactgtgtggcagaggcttc

SEQ ID NO: 207895 - DNA, 25 bp, Homo sapien
aggcttcatttaggtctcacaactc

SEQ ID NO: 207896 - DNA, 25 bp, Homo sapien
aggtctcacaactcactagacatca

SEQ ID NO: 207897 - DNA, 25 bp, Homo sapien
gtgcatgttgaagctattaaccaag

SEQ ID NO: 207898 - DNA, 25 bp, Homo sapien
ggaataattcagtctagttgtgctg

SEQ ID NO: 207899 - DNA, 25 bp, Homo sapien
gttgtgctgataaacttttcatatt

SEQ ID NO: 207900 - DNA, 25 bp, Homo sapien
attgtagaacaaatgcaagcccaaa

SEQ ID NO: 207901 - DNA, 25 bp, Homo sapien
tcatgccagtgagggacgtcagact

SEQ ID NO: 207902 - DNA, 25 bp, Homo sapien
gagggacgtcagacttggctcagct

SEQ ID NO: 207903 - DNA, 25 bp, Homo sapien
gacgtcagacttggctcagctcggg

SEQ ID NO: 207904 - DNA, 25 bp, Homo sapien
gagccttagccgcccatgcactggg

SEQ ID NO: 207905 - DNA, 25 bp, Homo sapien
gggcatgaccagatgcgtcccaaga

SEQ ID NO: 207906 - DNA, 25 bp, Homo sapien
gaccagatgcgtcccaagatgttga

SEQ ID NO: 207907 - DNA, 25 bp, Homo sapien
gatgcgtcccaagatgttgattttt

SEQ ID NO: 207908 - DNA, 25 bp, Homo sapien
gtcccaagatgttgatttttgctgt

SEQ ID NO: 207909 - DNA, 25 bp, Homo sapien
aaaagtgatctacatgaggaactgt

SEQ ID NO: 207910 - DNA, 25 bp, Homo sapien
catgaggaactgtagatgatgtatt

SEQ ID NO: 207911 - DNA, 25 bp, Homo sapien
ttcatcttttttgttaactgatttg

SEQ ID NO: 207912 - DNA, 25 bp, Homo sapien
gaaagattccagcactgagccgtga

SEQ ID NO: 207913 - DNA, 25 bp, Homo sapien
agccgtgagccggtcatgagccacg

SEQ ID NO: 207914 - DNA, 25 bp, Homo sapien
gagccacgataaaaaatgccagttt

SEQ ID NO: 207915 - DNA, 25 bp, Homo sapien
agtttggcaaactcagcactcctgt

SEQ ID NO: 207916 - DNA, 25 bp, Homo sapien
actcctgttccctgctcaggtatat

SEQ ID NO: 207917 - DNA, 25 bp, Homo sapien
cctgctcaggtatatgcgatctcta

SEQ ID NO: 207918 - DNA, 25 bp, Homo sapien
gcgatctctactgagaagcaagcac

SEQ ID NO: 207919 - DNA, 25 bp, Homo sapien
ttaatgagtatttcctttctccata

SEQ ID NO: 207920 - DNA, 25 bp, Homo sapien
ctttctccataagtgcaggactgtt

SEQ ID NO: 207921 - DNA, 25 bp, Homo sapien
tgcaggactgttactcactactaaa

SEQ ID NO: 207922 - DNA, 25 bp, Homo sapien
ttactcactactaaactctaccaag

SEQ ID NO: 207923 - DNA, 25 bp, Homo sapien
agaagagagaatcaggtaccttttt

SEQ ID NO: 207924 - DNA, 25 bp, Homo sapien
ggactttgttactttagccacaaag

SEQ ID NO: 207925 - DNA, 25 bp, Homo sapien
agccacaaagctaaaacagcattac

SEQ ID NO: 207926 - DNA, 25 bp, Homo sapien
ttacctcagctctaaactagccttg

SEQ ID NO: 207927 - DNA, 25 bp, Homo sapien
tcagctctaaactagccttgaagtt

SEQ ID NO: 207928 - DNA, 25 bp, Homo sapien
tgaagtttacagacatgactttgta

SEQ ID NO: 207929 - DNA, 25 bp, Homo sapien
tttctttgttgtgatgtccttttat

SEQ ID NO: 207930 - DNA, 25 bp, Homo sapien
gaaaactgctatcatgtaagataaa

SEQ ID NO: 207931 - DNA, 25 bp, Homo sapien
aaatgtaaattgctgccaactgtag

SEQ ID NO: 207932 - DNA, 25 bp, Homo sapien
gctgccaactgtagtaatgatgctt

SEQ ID NO: 207933 - DNA, 25 bp, Homo sapien
taataaaagtgacccatgatatgca

SEQ ID NO: 207934 - DNA, 25 bp, Homo sapien
agctgcttcgactgctgcttcagca

SEQ ID NO: 207935 - DNA, 25 bp, Homo sapien
gcacccctcaggactcatatgttga

SEQ ID NO: 207936 - DNA, 25 bp, Homo sapien
ggactcatatgttgaccaatgcgat

SEQ ID NO: 207937 - DNA, 25 bp, Homo sapien
ccaatgcgatcttggtgcagcagat

SEQ ID NO: 207938 - DNA, 25 bp, Homo sapien
gaacagtggctcacagacttacatt

SEQ ID NO: 207939 - DNA, 25 bp, Homo sapien
agacttacattactgctttaacgtg

SEQ ID NO: 207940 - DNA, 25 bp, Homo sapien
aacgtgtatatcactgggcatcccc

SEQ ID NO: 207941 - DNA, 25 bp, Homo sapien
gcccagtgcactggctacagtgtat

SEQ ID NO: 207942 - DNA, 25 bp, Homo sapien
gctacagtgtattgaagaggccata

SEQ ID NO: 207943 - DNA, 25 bp, Homo sapien
gccatagtacctcctgtttgaagtt

SEQ ID NO: 207944 - DNA, 25 bp, Homo sapien
gaagttgtttattcacatctatctt

SEQ ID NO: 207945 - DNA, 25 bp, Homo sapien
tttggtgacatctctgcgttatcat

SEQ ID NO: 207946 - DNA, 25 bp, Homo sapien
gacatctctgcgttatcatttattt

SEQ ID NO: 207947 - DNA, 25 bp, Homo sapien
gagtgtattttctccaaaacttctc

SEQ ID NO: 207948 - DNA, 25 bp, Homo sapien
aaacttctctacgagggaatgcacc

SEQ ID NO: 207949 - DNA, 25 bp, Homo sapien
ggaatgcacctgctcattacagctg

SEQ ID NO: 207950 - DNA, 25 bp, Homo sapien
agctgctgtctgtgtattcttcacg

SEQ ID NO: 207951 - DNA, 25 bp, Homo sapien
aaccagactcacacagtcttagact

SEQ ID NO: 207952 - DNA, 25 bp, Homo sapien
gtcttagactaagctgaacactgga

SEQ ID NO: 207953 - DNA, 25 bp, Homo sapien
gcttaaagtctgctgttattctaaa

SEQ ID NO: 207954 - DNA, 25 bp, Homo sapien
agttgatggataactttctttgact

SEQ ID NO: 207955 - DNA, 25 bp, Homo sapien
ctttgactgctctacctgaatttag

SEQ ID NO: 207956 - DNA, 25 bp, Homo sapien
agcaccgcttttacaaggagaagag

SEQ ID NO: 207957 - DNA, 25 bp, Homo sapien
agagcgtcaagcagacctgtgacaa

SEQ ID NO: 207958 - DNA, 25 bp, Homo sapien
gacaagtgtaacaccatcatctggg

SEQ ID NO: 207959 - DNA, 25 bp, Homo sapien
ggctcattcagacctggtacacctg

SEQ ID NO: 207960 - DNA, 25 bp, Homo sapien
cacaggtgggccgagacccagacga

SEQ ID NO: 207961 - DNA, 25 bp, Homo sapien
tccgctgggctcacattcagatgtg

SEQ ID NO: 207962 - DNA, 25 bp, Homo sapien
gtgagctatccagtgtggtggccac

SEQ ID NO: 207963 - DNA, 25 bp, Homo sapien
gccaaacatggccagtcaaagttaa

SEQ ID NO: 207964 - DNA, 25 bp, Homo sapien
aaatatgcatttcctcgttgtactg

SEQ ID NO: 207965 - DNA, 25 bp, Homo sapien
atttcctcgttgtactgtctacatt

SEQ ID NO: 207966 - DNA, 25 bp, Homo sapien
tgtctacattggacagggctgttct

SEQ ID NO: 207967 - DNA, 25 bp, Homo sapien
ttttttaatgatcagaagcggctgg

SEQ ID NO: 207968 - DNA, 25 bp, Homo sapien
tttttaatgatcagaagcggctggg

SEQ ID NO: 207969 - DNA, 25 bp, Homo sapien
ttttaatgatcagaagcggctgggc

SEQ ID NO: 207970 - DNA, 25 bp, Homo sapien
tttaatgatcagaagcggctgggcg

SEQ ID NO: 207971 - DNA, 25 bp, Homo sapien
ttaatgatcagaagcggctgggcgc

SEQ ID NO: 207972 - DNA, 25 bp, Homo sapien
taatgatcagaagcggctgggcgcg

SEQ ID NO: 207973 - DNA, 25 bp, Homo sapien
atgatcagaagcggctgggcgcggt

SEQ ID NO: 207974 - DNA, 25 bp, Homo sapien
cctgaccaacatggccaaaaactgt

SEQ ID NO: 207975 - DNA, 25 bp, Homo sapien
gaccaacatggccaaaaactgtctc

SEQ ID NO: 207976 - DNA, 25 bp, Homo sapien
tgagatcgtggccactgcaatccag

SEQ ID NO: 207977 - DNA, 25 bp, Homo sapien
gagatcgtggccactgcaatccagc

SEQ ID NO: 207978 - DNA, 25 bp, Homo sapien
gtctcagagtagcttatgactgttt

SEQ ID NO: 207979 - DNA, 25 bp, Homo sapien
tgactgttttggttctagctttaga

SEQ ID NO: 207980 - DNA, 25 bp, Homo sapien
gattttggattttcaccagtcatgt

SEQ ID NO: 207981 - DNA, 25 bp, Homo sapien
ggattttcaccagtcatgtgttaat

SEQ ID NO: 207982 - DNA, 25 bp, Homo sapien
gaatggctacactaagactgaatta

SEQ ID NO: 207983 - DNA, 25 bp, Homo sapien
ctgaattatcttattagtctggcaa

SEQ ID NO: 207984 - DNA, 25 bp, Homo sapien
ttagtctggcaagcatataaagtat

SEQ ID NO: 207985 - DNA, 25 bp, Homo sapien
gtatgtaatgattgccaaggtaaca

SEQ ID NO: 207986 - DNA, 25 bp, Homo sapien
cagaattgctgacatctgtctaaaa

SEQ ID NO: 207987 - DNA, 25 bp, Homo sapien
atttctatatactttatgctgttta

SEQ ID NO: 207988 - DNA, 25 bp, Homo sapien
tgtttatatttcagtcattacacca

SEQ ID NO: 207989 - DNA, 25 bp, Homo sapien
ggtatatgatcaatgggttctccta

SEQ ID NO: 207990 - DNA, 25 bp, Homo sapien
tcaatgggttctcctagacactgac

SEQ ID NO: 207991 - DNA, 25 bp, Homo sapien
tgtccagggcactttgcagctccat

SEQ ID NO: 207992 - DNA, 25 bp, Homo sapien
tcctcaagttccacacgaagatgct

SEQ ID NO: 207993 - DNA, 25 bp, Homo sapien
acgaagatgcttggatgagtcagct

SEQ ID NO: 207994 - DNA, 25 bp, Homo sapien
gagtcagctgggaatattgttcttg

SEQ ID NO: 207995 - DNA, 25 bp, Homo sapien
attgttcttgtgtacctcattgctt

SEQ ID NO: 207996 - DNA, 25 bp, Homo sapien
attgctttagctggtcacttggaac

SEQ ID NO: 207997 - DNA, 25 bp, Homo sapien
tggaactttggagcagaatcctgca

SEQ ID NO: 207998 - DNA, 25 bp, Homo sapien
ctcactatgtatgcagactggaccc

SEQ ID NO: 207999 - DNA, 25 bp, Homo sapien
tcacctcacccacagattgtattta

SEQ ID NO: 208000 - DNA, 25 bp, Homo sapien
gaagccagagttcccacgaagcact

SEQ ID NO: 208001 - DNA, 25 bp, Homo sapien
ctggagcaggaaatgagcatctctc

SEQ ID NO: 208002 - DNA, 25 bp, Homo sapien
gagcatctctcatctccctgaattc

SEQ ID NO: 208003 - DNA, 25 bp, Homo sapien
ctgaattccacatccactggctgaa

SEQ ID NO: 208004 - DNA, 25 bp, Homo sapien
aatgatcagggaggcatagcagtga

SEQ ID NO: 208005 - DNA, 25 bp, Homo sapien
gcatagcagtgagagccataggtcg

SEQ ID NO: 208006 - DNA, 25 bp, Homo sapien
ccataggtcggcagagggaactcag

SEQ ID NO: 208007 - DNA, 25 bp, Homo sapien
gaactcaggccctcctttaggatgg

SEQ ID NO: 208008 - DNA, 25 bp, Homo sapien
ttaggatggccatcacctcatctca

SEQ ID NO: 208009 - DNA, 25 bp, Homo sapien
atccagccaaatcaaccatctagag

SEQ ID NO: 208010 - DNA, 25 bp, Homo sapien
accatctagagcacacaggccgaga

SEQ ID NO: 208011 - DNA, 25 bp, Homo sapien
cgtcttcaggaacaggacggatgaa

SEQ ID NO: 208012 - DNA, 25 bp, Homo sapien
agcccccttatgagtacccaagaag

SEQ ID NO: 208013 - DNA, 25 bp, Homo sapien
gactgtctatgcatgcacacccaca

SEQ ID NO: 208014 - DNA, 25 bp, Homo sapien
acccacaagcctatacaccatttat

SEQ ID NO: 208015 - DNA, 25 bp, Homo sapien
catttatatacctacacgcacgcaa

SEQ ID NO: 208016 - DNA, 25 bp, Homo sapien
tacacgcacgcaagagacgcggaga

SEQ ID NO: 208017 - DNA, 25 bp, Homo sapien
ataggcgatgcagactcgcgattca

SEQ ID NO: 208018 - DNA, 25 bp, Homo sapien
gcagactcgcgattcaatgatcgat

SEQ ID NO: 208019 - DNA, 25 bp, Homo sapien
gcgattcaatgatcgatatgctcat

SEQ ID NO: 208020 - DNA, 25 bp, Homo sapien
gatatgctcataaaagtgctcaatt

SEQ ID NO: 208021 - DNA, 25 bp, Homo sapien
gtatgctgtattttccaagacgtat

SEQ ID NO: 208022 - DNA, 25 bp, Homo sapien
tttactgataaaactcaatacctag

SEQ ID NO: 208023 - DNA, 25 bp, Homo sapien
aaactcaatacctagaactgcacct

SEQ ID NO: 208024 - DNA, 25 bp, Homo sapien
caatacctagaactgcacctagctc

SEQ ID NO: 208025 - DNA, 25 bp, Homo sapien
tacctagaactgcacctagctcatg

SEQ ID NO: 208026 - DNA, 25 bp, Homo sapien
tagaactgcacctagctcatgatgg

SEQ ID NO: 208027 - DNA, 25 bp, Homo sapien
gaactgcacctagctcatgatggta

SEQ ID NO: 208028 - DNA, 25 bp, Homo sapien
actgcacctagctcatgatggtacc

SEQ ID NO: 208029 - DNA, 25 bp, Homo sapien
tgcacctagctcatgatggtaccta

SEQ ID NO: 208030 - DNA, 25 bp, Homo sapien
gcacctagctcatgatggtacctaa

SEQ ID NO: 208031 - DNA, 25 bp, Homo sapien
acctagctcatgatggtacctaata

SEQ ID NO: 208032 - DNA, 25 bp, Homo sapien
aatgaaatgatgtggtgatgcatgc

SEQ ID NO: 208033 - DNA, 25 bp, Homo sapien
ctgagtggacagtcacagcctcagc

SEQ ID NO: 208034 - DNA, 25 bp, Homo sapien
gctcatgtctggctgtgacacacac

SEQ ID NO: 208035 - DNA, 25 bp, Homo sapien
atgtctggctgtgacacacactgcc

SEQ ID NO: 208036 - DNA, 25 bp, Homo sapien
aagggaggacatgcctcttcttcct

SEQ ID NO: 208037 - DNA, 25 bp, Homo sapien
tgtctttcttatctttaagcccctt

SEQ ID NO: 208038 - DNA, 25 bp, Homo sapien
tttaccctggtcctgtactgatcag

SEQ ID NO: 208039 - DNA, 25 bp, Homo sapien
tactgatcagtgaaggaaaccgtgg

SEQ ID NO: 208040 - DNA, 25 bp, Homo sapien
gaaaccgtggttactgaggccctgt

SEQ ID NO: 208041 - DNA, 25 bp, Homo sapien
gaggccctgttgaaaagtgcacgtc

SEQ ID NO: 208042 - DNA, 25 bp, Homo sapien
gaaaagtgcacgtcttgtccaataa

SEQ ID NO: 208043 - DNA, 25 bp, Homo sapien
gcacgtcttgtccaataaatcacgc

SEQ ID NO: 208044 - DNA, 25 bp, Homo sapien
aatgaagttgtccaggtctcagaga

SEQ ID NO: 208045 - DNA, 25 bp, Homo sapien
aggtctcagagactagccacaccct

SEQ ID NO: 208046 - DNA, 25 bp, Homo sapien
gccacaccctccagaggtcttaaga

SEQ ID NO: 208047 - DNA, 25 bp, Homo sapien
ggtcttaagaactagcccaccttat

SEQ ID NO: 208048 - DNA, 25 bp, Homo sapien
ttagctccagtgctacaaggtccac

SEQ ID NO: 208049 - DNA, 25 bp, Homo sapien
taaactgagctcacatagggccttg

SEQ ID NO: 208050 - DNA, 25 bp, Homo sapien
catagggccttgtggaagaagtact

SEQ ID NO: 208051 - DNA, 25 bp, Homo sapien
acacgggcaagcagcccactgatct

SEQ ID NO: 208052 - DNA, 25 bp, Homo sapien
ctgatctgttttgtagctgaggttt

SEQ ID NO: 208053 - DNA, 25 bp, Homo sapien
tagctgaggttttgcatacggtttt

SEQ ID NO: 208054 - DNA, 25 bp, Homo sapien
atacggttttgtttggaggatggct

SEQ ID NO: 208055 - DNA, 25 bp, Homo sapien
accagagacttggactctgattata

SEQ ID NO: 208056 - DNA, 25 bp, Homo sapien
gagacttggactctgattatacaat

SEQ ID NO: 208057 - DNA, 25 bp, Homo sapien
gacttggactctgattatacaattt

SEQ ID NO: 208058 - DNA, 25 bp, Homo sapien
acttggactctgattatacaattta

SEQ ID NO: 208059 - DNA, 25 bp, Homo sapien
ttggactctgattatacaatttaaa

SEQ ID NO: 208060 - DNA, 25 bp, Homo sapien
aaaatcctgtgattggacaggcgct

SEQ ID NO: 208061 - DNA, 25 bp, Homo sapien
aatcctgtgattggacaggcgctgt

SEQ ID NO: 208062 - DNA, 25 bp, Homo sapien
atcctgtgattggacaggcgctgtg

SEQ ID NO: 208063 - DNA, 25 bp, Homo sapien
ttagctgggcgcagtagcagttgcc

SEQ ID NO: 208064 - DNA, 25 bp, Homo sapien
tagctgggcgcagtagcagttgcct

SEQ ID NO: 208065 - DNA, 25 bp, Homo sapien
gcgcagtagcagttgcctgtaatct

SEQ ID NO: 208066 - DNA, 25 bp, Homo sapien
gatgcaatcctgagtaagatcctcg

SEQ ID NO: 208067 - DNA, 25 bp, Homo sapien
tgagtaagatcctcgtccgatccta

SEQ ID NO: 208068 - DNA, 25 bp, Homo sapien
tcgtccgatcctaacgtgtatgcac

SEQ ID NO: 208069 - DNA, 25 bp, Homo sapien
gatcctaacgtgtatgcaccctaca

SEQ ID NO: 208070 - DNA, 25 bp, Homo sapien
gtatgcaccctacagcagcagtatt

SEQ ID NO: 208071 - DNA, 25 bp, Homo sapien
cagcagtattactcactagccacag

SEQ ID NO: 208072 - DNA, 25 bp, Homo sapien
ttactcactagccacagaatacctg

SEQ ID NO: 208073 - DNA, 25 bp, Homo sapien
acctgttctgtactctaatgttgca

SEQ ID NO: 208074 - DNA, 25 bp, Homo sapien
atggctatatagtacatgtctattt

SEQ ID NO: 208075 - DNA, 25 bp, Homo sapien
gtctatttaacagcaccgattccaa

SEQ ID NO: 208076 - DNA, 25 bp, Homo sapien
taacagcaccgattccaaagggaag

SEQ ID NO: 208077 - DNA, 25 bp, Homo sapien
gaaattagttttcacgcatcaaacc

SEQ ID NO: 208078 - DNA, 25 bp, Homo sapien
aattagttttcacgcatcaaaccgg

SEQ ID NO: 208079 - DNA, 25 bp, Homo sapien
ttagttttcacgcatcaaaccggat

SEQ ID NO: 208080 - DNA, 25 bp, Homo sapien
agttttcacgcatcaaaccggattg

SEQ ID NO: 208081 - DNA, 25 bp, Homo sapien
ttttcacgcatcaaaccggattgtt

SEQ ID NO: 208082 - DNA, 25 bp, Homo sapien
tttcacgcatcaaaccggattgttt

SEQ ID NO: 208083 - DNA, 25 bp, Homo sapien
tcacgcatcaaaccggattgtttat

SEQ ID NO: 208084 - DNA, 25 bp, Homo sapien
gcatcaaaccggattgtttatatgt

SEQ ID NO: 208085 - DNA, 25 bp, Homo sapien
tcaaaccggattgtttatatgttta

SEQ ID NO: 208086 - DNA, 25 bp, Homo sapien
ttgcttggaaatgtacataaaacta

SEQ ID NO: 208087 - DNA, 25 bp, Homo sapien
ctaaaattttctgaatcgtgtgttt

SEQ ID NO: 208088 - DNA, 25 bp, Homo sapien
cagcgcctgtgggtgtcagtattac

SEQ ID NO: 208089 - DNA, 25 bp, Homo sapien
gggtgtcagtattacctgagcctag

SEQ ID NO: 208090 - DNA, 25 bp, Homo sapien
tgagcctaggccaaagctagcccaa

SEQ ID NO: 208091 - DNA, 25 bp, Homo sapien
taggccaaagctagcccaaggctgg

SEQ ID NO: 208092 - DNA, 25 bp, Homo sapien
caggtcagaatgtgaggtctcagtc

SEQ ID NO: 208093 - DNA, 25 bp, Homo sapien
ggtctcagtctgtgatttaaggtgt

SEQ ID NO: 208094 - DNA, 25 bp, Homo sapien
aaggtgttgcatgtggactcttaac

SEQ ID NO: 208095 - DNA, 25 bp, Homo sapien
atgtggactcttaactgtacgtgta

SEQ ID NO: 208096 - DNA, 25 bp, Homo sapien
ctgtacgtgtagtttctagtggaga

SEQ ID NO: 208097 - DNA, 25 bp, Homo sapien
tcaaggctctgatcattttgttttt

SEQ ID NO: 208098 - DNA, 25 bp, Homo sapien
gggatagtctacagctaatgaggga

SEQ ID NO: 208099 - DNA, 25 bp, Homo sapien
atttcccaatatttcatagtttatg

SEQ ID NO: 208100 - DNA, 25 bp, Homo sapien
gcttccttcacatcctctgtgatga

SEQ ID NO: 208101 - DNA, 25 bp, Homo sapien
tttactgataaaactcaatacctag

SEQ ID NO: 208102 - DNA, 25 bp, Homo sapien
aaactcaatacctagaactgcacct

SEQ ID NO: 208103 - DNA, 25 bp, Homo sapien
atacctagaactgcacctagctcat

SEQ ID NO: 208104 - DNA, 25 bp, Homo sapien
tagaactgcacctagctcatgatgg

SEQ ID NO: 208105 - DNA, 25 bp, Homo sapien
gaactgcacctagctcatgatggta

SEQ ID NO: 208106 - DNA, 25 bp, Homo sapien
actgcacctagctcatgatggtacc

SEQ ID NO: 208107 - DNA, 25 bp, Homo sapien
gcacctagctcatgatggtacctaa

SEQ ID NO: 208108 - DNA, 25 bp, Homo sapien
acctagctcatgatggtacctaata

SEQ ID NO: 208109 - DNA, 25 bp, Homo sapien
aatgaaatgatgtggtgatgcatgc

SEQ ID NO: 208110 - DNA, 25 bp, Homo sapien
acctgttagggatgtattctaggaa

SEQ ID NO: 208111 - DNA, 25 bp, Homo sapien
atcagaagtagttctcttttcttgc

SEQ ID NO: 208112 - DNA, 25 bp, Homo sapien
cttttcttgctggattattgcttag

SEQ ID NO: 208113 - DNA, 25 bp, Homo sapien
gcttagataactcttgttttctggt

SEQ ID NO: 208114 - DNA, 25 bp, Homo sapien
aaaactttagttgtattgccatcca

SEQ ID NO: 208115 - DNA, 25 bp, Homo sapien
attgccatccactcctttttcaaat

SEQ ID NO: 208116 - DNA, 25 bp, Homo sapien
aagctgatattctttgtccgattaa

SEQ ID NO: 208117 - DNA, 25 bp, Homo sapien
acagaagctgttttagtcattaatg

SEQ ID NO: 208118 - DNA, 25 bp, Homo sapien
gtagcttatagaatatggactgcct

SEQ ID NO: 208119 - DNA, 25 bp, Homo sapien
atatggactgccttattgctgttgc

SEQ ID NO: 208120 - DNA, 25 bp, Homo sapien
attgctgttgcttatcatttgaaaa

SEQ ID NO: 208121 - DNA, 25 bp, Homo sapien
ggagtccatgttgcaataggttctc

SEQ ID NO: 208122 - DNA, 25 bp, Homo sapien
agtccatgttgcaataggttctctt

SEQ ID NO: 208123 - DNA, 25 bp, Homo sapien
gactcattttccaaaaatccgcttc

SEQ ID NO: 208124 - DNA, 25 bp, Homo sapien
ctcattttccaaaaatccgcttcta

SEQ ID NO: 208125 - DNA, 25 bp, Homo sapien
gcatccagaaagacgcactcctgga

SEQ ID NO: 208126 - DNA, 25 bp, Homo sapien
agaaagacgcactcctggaccacaa

SEQ ID NO: 208127 - DNA, 25 bp, Homo sapien
actcctggaccacaaccggcggcta

SEQ ID NO: 208128 - DNA, 25 bp, Homo sapien
gcaggccccgcggagatgaagaatt

SEQ ID NO: 208129 - DNA, 25 bp, Homo sapien
aggccccgcggagatgaagaatttg

SEQ ID NO: 208130 - DNA, 25 bp, Homo sapien
tgaagaatttgcagggagcctccct

SEQ ID NO: 208131 - DNA, 25 bp, Homo sapien
gtcaggggcgtatccacaaaatcac

SEQ ID NO: 208132 - DNA, 25 bp, Homo sapien
actctgtcagcgtcaactccctgga

SEQ ID NO: 208133 - DNA, 25 bp, Homo sapien
aactccctggacgacaactctgtgg

SEQ ID NO: 208134 - DNA, 25 bp, Homo sapien
ctggacgacaactctgtggatgtgg

SEQ ID NO: 208135 - DNA, 25 bp, Homo sapien
gatgtggacaagaacagtcaggaaa

SEQ ID NO: 208136 - DNA, 25 bp, Homo sapien
gaacagtcaggaaatcaaggagcac

SEQ ID NO: 208137 - DNA, 25 bp, Homo sapien
aaatcaaggagcacaggccaccaca

SEQ ID NO: 208138 - DNA, 25 bp, Homo sapien
gcccctgagcgtggtcctgttagga

SEQ ID NO: 208139 - DNA, 25 bp, Homo sapien
gttaggacggcaggcaggcgcaagt

SEQ ID NO: 208140 - DNA, 25 bp, Homo sapien
tggacaccacggacctgtgacaggg

SEQ ID NO: 208141 - DNA, 25 bp, Homo sapien
cactcttctggaccccttgaagagg

SEQ ID NO: 208142 - DNA, 25 bp, Homo sapien
ttgaagaggccctaccacaccctaa

SEQ ID NO: 208143 - DNA, 25 bp, Homo sapien
gtaaccagataaaagtagcacatgt

SEQ ID NO: 208144 - DNA, 25 bp, Homo sapien
accagataaaagtagcacatgtgct

SEQ ID NO: 208145 - DNA, 25 bp, Homo sapien
gtagcacatgtgcttttgttaaaaa

SEQ ID NO: 208146 - DNA, 25 bp, Homo sapien
tgaagttaaaagtttcatcagaaac

SEQ ID NO: 208147 - DNA, 25 bp, Homo sapien
tgtgtatggcatataatggaaataa

SEQ ID NO: 208148 - DNA, 25 bp, Homo sapien
aattctttgagcaacagaagctatt

SEQ ID NO: 208149 - DNA, 25 bp, Homo sapien
gcaacagaagctattattaactact

SEQ ID NO: 208150 - DNA, 25 bp, Homo sapien
agaagctattattaactactgcaag

SEQ ID NO: 208151 - DNA, 25 bp, Homo sapien
tattattaactactgcaagctaagc

SEQ ID NO: 208152 - DNA, 25 bp, Homo sapien
gcaagctaagccgagcttaaaaatg

SEQ ID NO: 208153 - DNA, 25 bp, Homo sapien
ctaagccgagcttaaaaatgccttt

SEQ ID NO: 208154 - DNA, 25 bp, Homo sapien
gatgagaacctgctccgttctgcta

SEQ ID NO: 208155 - DNA, 25 bp, Homo sapien
tgctccgttctgctaccttgtcaaa

SEQ ID NO: 208156 - DNA, 25 bp, Homo sapien
tacacccctggcagggcagatccag

SEQ ID NO: 208157 - DNA, 25 bp, Homo sapien
agttctctgccccagccaacgttgg

SEQ ID NO: 208158 - DNA, 25 bp, Homo sapien
ttacttctgccactctgatcagcca

SEQ ID NO: 208159 - DNA, 25 bp, Homo sapien
tctgatcagccagagtgcacttggg

SEQ ID NO: 208160 - DNA, 25 bp, Homo sapien
ttcccaggacagtttcatggacttc

SEQ ID NO: 208161 - DNA, 25 bp, Homo sapien
atggacttcatgacggcagccatgc

SEQ ID NO: 208162 - DNA, 25 bp, Homo sapien
agcaaggcagatgacctaatcacct

SEQ ID NO: 208163 - DNA, 25 bp, Homo sapien
taatcacctcacgacagcaatacag

SEQ ID NO: 208164 - DNA, 25 bp, Homo sapien
tacagcagtgatcactcagccattt

SEQ ID NO: 208165 - DNA, 25 bp, Homo sapien
atcaacgagcacagctaagaacaga

SEQ ID NO: 208166 - DNA, 25 bp, Homo sapien
gagagaggcccatggctgattttac

SEQ ID NO: 208167 - DNA, 25 bp, Homo sapien
agaggcccatggctgattttaccat

SEQ ID NO: 208168 - DNA, 25 bp, Homo sapien
ggctgattttaccatgtgcccagat

SEQ ID NO: 208169 - DNA, 25 bp, Homo sapien
gattttaccatgtgcccagattaat

SEQ ID NO: 208170 - DNA, 25 bp, Homo sapien
atgtgcccagattaatgtatatagt

SEQ ID NO: 208171 - DNA, 25 bp, Homo sapien
aggcctttaatttctgtctgcatat

SEQ ID NO: 208172 - DNA, 25 bp, Homo sapien
ttctgtctgcatattagcttttaat

SEQ ID NO: 208173 - DNA, 25 bp, Homo sapien
gaatactttgacacctgtaaaaatc

SEQ ID NO: 208174 - DNA, 25 bp, Homo sapien
gacatttcacaaatattcacttaca

SEQ ID NO: 208175 - DNA, 25 bp, Homo sapien
tacaggctggaagtattttattcat

SEQ ID NO: 208176 - DNA, 25 bp, Homo sapien
agcatggccactattttgatgatgg

SEQ ID NO: 208177 - DNA, 25 bp, Homo sapien
ttctttggtatggaatttttctctc

SEQ ID NO: 208178 - DNA, 25 bp, Homo sapien
gaatttttcccttcagtgactgagc

SEQ ID NO: 208179 - DNA, 25 bp, Homo sapien
ttcagtgactgagctgtcctcgata

SEQ ID NO: 208180 - DNA, 25 bp, Homo sapien
gagctgtcctcgataggccatgcaa

SEQ ID NO: 208181 - DNA, 25 bp, Homo sapien
taggccatgcaagggcttcctgaga

SEQ ID NO: 208182 - DNA, 25 bp, Homo sapien
aggaaagttctcttgtgcaacagca

SEQ ID NO: 208183 - DNA, 25 bp, Homo sapien
tgcaacagcaagtagctaagcctat

SEQ ID NO: 208184 - DNA, 25 bp, Homo sapien
ctaagcctatagcatggtgtcttgt

SEQ ID NO: 208185 - DNA, 25 bp, Homo sapien
ggtgtcttgtaggaccaaatcgatg

SEQ ID NO: 208186 - DNA, 25 bp, Homo sapien
accaaatcgatgttacctgtcaagt

SEQ ID NO: 208187 - DNA, 25 bp, Homo sapien
aaagtgaagaacttgtcctaagtgt

SEQ ID NO: 208188 - DNA, 25 bp, Homo sapien
gtcctaagtgtggaaaagtgtcttc

SEQ ID NO: 208189 - DNA, 25 bp, Homo sapien
agatttagactcttctccatgtcag

SEQ ID NO: 208190 - DNA, 25 bp, Homo sapien
cgtctgtctcttggtattgggtaaa

SEQ ID NO: 208191 - DNA, 25 bp, Homo sapien
ctgcatgtctcctgcaatgagcaag

SEQ ID NO: 208192 - DNA, 25 bp, Homo sapien
tatgtctcatgttttgacttcagag

SEQ ID NO: 208193 - DNA, 25 bp, Homo sapien
gacttcagaggctttttgctttggt

SEQ ID NO: 208194 - DNA, 25 bp, Homo sapien
gaggctttttgctttggtgcatttc

SEQ ID NO: 208195 - DNA, 25 bp, Homo sapien
tatgtgtgaaagcatcctcttccgg

SEQ ID NO: 208196 - DNA, 25 bp, Homo sapien
tcctcttccggttttgctgttattc

SEQ ID NO: 208197 - DNA, 25 bp, Homo sapien
caaaagtgggaaatgtacctggcac

SEQ ID NO: 208198 - DNA, 25 bp, Homo sapien
tacgtagcactctgcgacatgctcc

SEQ ID NO: 208199 - DNA, 25 bp, Homo sapien
catgctcccggcgatgttgaaagta

SEQ ID NO: 208200 - DNA, 25 bp, Homo sapien
cgatgttgaaagtacgggacccgcg

SEQ ID NO: 208201 - DNA, 25 bp, Homo sapien
tgctgcacaacgtgggcctgctggg

SEQ ID NO: 208202 - DNA, 25 bp, Homo sapien
tgctgctgtccctgtacgaggatga

SEQ ID NO: 208203 - DNA, 25 bp, Homo sapien
gtccctgtacgaggatgacatcacc

SEQ ID NO: 208204 - DNA, 25 bp, Homo sapien
gaggatgacatcaccttctgatacc

SEQ ID NO: 208205 - DNA, 25 bp, Homo sapien
atgacatcaccttctgataccctgc

SEQ ID NO: 208206 - DNA, 25 bp, Homo sapien
acctttgacttaagatcccacacct

SEQ ID NO: 208207 - DNA, 25 bp, Homo sapien
agaagcccctatagaggccccagtc

SEQ ID NO: 208208 - DNA, 25 bp, Homo sapien
cagtcccaactccagtaaagacact

SEQ ID NO: 208209 - DNA, 25 bp, Homo sapien
gcggctctgcaggattgcttacgga

SEQ ID NO: 208210 - DNA, 25 bp, Homo sapien
tgcaggattgcttacggagaactct

SEQ ID NO: 208211 - DNA, 25 bp, Homo sapien
cttacggagaactctgtgtctggca

SEQ ID NO: 208212 - DNA, 25 bp, Homo sapien
cctgcccaggaatgcatcacattgt

SEQ ID NO: 208213 - DNA, 25 bp, Homo sapien
atcacattgttctctggtgctgtaa

SEQ ID NO: 208214 - DNA, 25 bp, Homo sapien
tctctggtgctgtaatttggctgca

SEQ ID NO: 208215 - DNA, 25 bp, Homo sapien
ggagctaggctgaatgcctcccagg

SEQ ID NO: 208216 - DNA, 25 bp, Homo sapien
gcctcccagggatgagaaacatact

SEQ ID NO: 208217 - DNA, 25 bp, Homo sapien
gctagcttgagcttctgccctatga

SEQ ID NO: 208218 - DNA, 25 bp, Homo sapien
tgccctatgaccactgagtgcattt

SEQ ID NO: 208219 - DNA, 25 bp, Homo sapien
gaccactgagtgcatttaaataaaa

SEQ ID NO: 208220 - DNA, 25 bp, Homo sapien
attatgtgagataacacgtggcccc

SEQ ID NO: 208221 - DNA, 25 bp, Homo sapien
gtgagataacacgtggccccatgac

SEQ ID NO: 208222 - DNA, 25 bp, Homo sapien
tggccccatgaccactggagcacat

SEQ ID NO: 208223 - DNA, 25 bp, Homo sapien
tgaccactggagcacatgggttaat

SEQ ID NO: 208224 - DNA, 25 bp, Homo sapien
gggaatggcctacaactctgcatgg

SEQ ID NO: 208225 - DNA, 25 bp, Homo sapien
acaactctgcatggccgtcttcttt

SEQ ID NO: 208226 - DNA, 25 bp, Homo sapien
gtgaagacaagtcaggccttgttaa

SEQ ID NO: 208227 - DNA, 25 bp, Homo sapien
caggccttgttaaagttagtttcag

SEQ ID NO: 208228 - DNA, 25 bp, Homo sapien
agtttcagaacaattactcatgcct

SEQ ID NO: 208229 - DNA, 25 bp, Homo sapien
ttctcatccctaaaacattggtggg

SEQ ID NO: 208230 - DNA, 25 bp, Homo sapien
gaggaagtatctattcactgtgaaa

SEQ ID NO: 208231 - DNA, 25 bp, Homo sapien
ttgatgtttacttaatggtcagaat

SEQ ID NO: 208232 - DNA, 25 bp, Homo sapien
gaattatttctgagacacactgaat

SEQ ID NO: 208233 - DNA, 25 bp, Homo sapien
ttctgagacacactgaattctaaag

SEQ ID NO: 208234 - DNA, 25 bp, Homo sapien
gtatactgtattaactattcgtgac

SEQ ID NO: 208235 - DNA, 25 bp, Homo sapien
actattcgtgacatagttcacactg

SEQ ID NO: 208236 - DNA, 25 bp, Homo sapien
gacatagttcacactgttttcttac

SEQ ID NO: 208237 - DNA, 25 bp, Homo sapien
acattgtaacaatcttactggtgga

SEQ ID NO: 208238 - DNA, 25 bp, Homo sapien
atcttactggtggaaagtctttgta

SEQ ID NO: 208239 - DNA, 25 bp, Homo sapien
agcaaggagcaaatttccacaaagt

SEQ ID NO: 208240 - DNA, 25 bp, Homo sapien
gtgcttggtttaggaattgtgatta

SEQ ID NO: 208241 - DNA, 25 bp, Homo sapien
aaaaaatgcatgtctttgaatcaat

SEQ ID NO: 208242 - DNA, 25 bp, Homo sapien
gggaatctatacattataagggact

SEQ ID NO: 208243 - DNA, 25 bp, Homo sapien
atctatacattataagggacttaac

SEQ ID NO: 208244 - DNA, 25 bp, Homo sapien
ggacttaacaactaaagggcaacat

SEQ ID NO: 208245 - DNA, 25 bp, Homo sapien
gacttaacaactaaagggcaacata

SEQ ID NO: 208246 - DNA, 25 bp, Homo sapien
gggcaacatatagactttagatcct

SEQ ID NO: 208247 - DNA, 25 bp, Homo sapien
gcaacatatagactttagatcctaa

SEQ ID NO: 208248 - DNA, 25 bp, Homo sapien
atagactttagatcctaatttgagc

SEQ ID NO: 208249 - DNA, 25 bp, Homo sapien
gactttagatcctaatttgagcaaa

SEQ ID NO: 208250 - DNA, 25 bp, Homo sapien
gatcctaatttgagcaaaatctaaa

SEQ ID NO: 208251 - DNA, 25 bp, Homo sapien
aaatcaattattaggcaatcagaaa

SEQ ID NO: 208252 - DNA, 25 bp, Homo sapien
ttaggcaatcagaaaaatttgaaca

SEQ ID NO: 208253 - DNA, 25 bp, Homo sapien
attaattgcctgtatgtgaggacca

SEQ ID NO: 208254 - DNA, 25 bp, Homo sapien
tgtgaggaccaaacaacctttggga

SEQ ID NO: 208255 - DNA, 25 bp, Homo sapien
acagttttcagagatggcgtggcac

SEQ ID NO: 208256 - DNA, 25 bp, Homo sapien
atggcgtggcactgcatccttggtt

SEQ ID NO: 208257 - DNA, 25 bp, Homo sapien
actgcatccttggttcttgctttga

SEQ ID NO: 208258 - DNA, 25 bp, Homo sapien
ttggttcttgctttgattggtgccc

SEQ ID NO: 208259 - DNA, 25 bp, Homo sapien
attggtgccctgctatagcccaaag

SEQ ID NO: 208260 - DNA, 25 bp, Homo sapien
gctatagcccaaagcacgtagtatt

SEQ ID NO: 208261 - DNA, 25 bp, Homo sapien
gctgatgattcagcatgagctgcat

SEQ ID NO: 208262 - DNA, 25 bp, Homo sapien
atgagctgcatctacctacttttag

SEQ ID NO: 208263 - DNA, 25 bp, Homo sapien
acctacttttagctgataattttca

SEQ ID NO: 208264 - DNA, 25 bp, Homo sapien
gaagtcttccaggactagcatcctc

SEQ ID NO: 208265 - DNA, 25 bp, Homo sapien
tagcatcctcggtgaaagagccttt

SEQ ID NO: 208266 - DNA, 25 bp, Homo sapien
tgccccaagcaacctgattttgaca

SEQ ID NO: 208267 - DNA, 25 bp, Homo sapien
tcttgagtgggtgaccacacttgtc

SEQ ID NO: 208268 - DNA, 25 bp, Homo sapien
cacacttgtcagtgggaggctctgg

SEQ ID NO: 208269 - DNA, 25 bp, Homo sapien
ccttgagggcgggatgaactgcttt

SEQ ID NO: 208270 - DNA, 25 bp, Homo sapien
gatgaactgctttgtgacttggaaa

SEQ ID NO: 208271 - DNA, 25 bp, Homo sapien
gacttggaaaggtacgctgctggcc

SEQ ID NO: 208272 - DNA, 25 bp, Homo sapien
tgctggccagcattggagaagaagc

SEQ ID NO: 208273 - DNA, 25 bp, Homo sapien
aagctgctgagcatggctttctgta

SEQ ID NO: 208274 - DNA, 25 bp, Homo sapien
atggctttctgtagtctttagcaag

SEQ ID NO: 208275 - DNA, 25 bp, Homo sapien
tgaagattagggaaccagtgatttt

SEQ ID NO: 208276 - DNA, 25 bp, Homo sapien
gtgattttaattatgctactttttc

SEQ ID NO: 208277 - DNA, 25 bp, Homo sapien
tatgctactttttcttctaagagat

SEQ ID NO: 208278 - DNA, 25 bp, Homo sapien
aattgatatatcattcagtgtcatg

SEQ ID NO: 208279 - DNA, 25 bp, Homo sapien
aacatgaatgttgtacaattttctt

SEQ ID NO: 208280 - DNA, 25 bp, Homo sapien
gagcacaatgtaggtgtatttgagt

SEQ ID NO: 208281 - DNA, 25 bp, Homo sapien
atgtaggtgtatttgagtattttca

SEQ ID NO: 208282 - DNA, 25 bp, Homo sapien
agtattaggttaactggatatcagc

SEQ ID NO: 208283 - DNA, 25 bp, Homo sapien
aactggatatcagctaagccttgtt

SEQ ID NO: 208284 - DNA, 25 bp, Homo sapien
tatcagctaagccttgttaacagtt

SEQ ID NO: 208285 - DNA, 25 bp, Homo sapien
cagctaagccttgttaacagttaaa

SEQ ID NO: 208286 - DNA, 25 bp, Homo sapien
gtacagactcattacaacaagtttc

SEQ ID NO: 208287 - DNA, 25 bp, Homo sapien
gactcattacaacaagtttctcata

SEQ ID NO: 208288 - DNA, 25 bp, Homo sapien
tacaacaagtttctcataaaaatac

SEQ ID NO: 208289 - DNA, 25 bp, Homo sapien
cccatagactgggaataggttccag

SEQ ID NO: 208290 - DNA, 25 bp, Homo sapien
gactgggaataggttccagttacag

SEQ ID NO: 208291 - DNA, 25 bp, Homo sapien
ggttccagttacagcttggatctgg

SEQ ID NO: 208292 - DNA, 25 bp, Homo sapien
cagttacagcttggatctggcataa

SEQ ID NO: 208293 - DNA, 25 bp, Homo sapien
gttacagcttggatctggcataaaa

SEQ ID NO: 208294 - DNA, 25 bp, Homo sapien
tacagcttggatctggcataaaata

SEQ ID NO: 208295 - DNA, 25 bp, Homo sapien
gaaattgttcaagaaatccttaatt

SEQ ID NO: 208296 - DNA, 25 bp, Homo sapien
agaaatccttaattgaatgtcatta

SEQ ID NO: 208297 - DNA, 25 bp, Homo sapien
atctctttccctattgacgatgcag

SEQ ID NO: 208298 - DNA, 25 bp, Homo sapien
tctttccctattgacgatgcagcct

SEQ ID NO: 208299 - DNA, 25 bp, Homo sapien
tgccttgtctccactgttgagagaa

SEQ ID NO: 208300 - DNA, 25 bp, Homo sapien
aggagaattattaggaacacacatc

SEQ ID NO: 208301 - DNA, 25 bp, Homo sapien
aacacacatcagtggtacatgccat

SEQ ID NO: 208302 - DNA, 25 bp, Homo sapien
ggtacatgccatgaacttaaagcag

SEQ ID NO: 208303 - DNA, 25 bp, Homo sapien
gaaaccactgggatgccaagtacct

SEQ ID NO: 208304 - DNA, 25 bp, Homo sapien
aagtacctgctcaccattggtcatg

SEQ ID NO: 208305 - DNA, 25 bp, Homo sapien
gctcaccattggtcatgaatgaatg

SEQ ID NO: 208306 - DNA, 25 bp, Homo sapien
aaatgttttcaagccggcaactcga

SEQ ID NO: 208307 - DNA, 25 bp, Homo sapien
ggcaactcgagattgggctcatttt

SEQ ID NO: 208308 - DNA, 25 bp, Homo sapien
tgaaaagtagcagcttctctatcca

SEQ ID NO: 208309 - DNA, 25 bp, Homo sapien
ggatgatgagtcaacaggtttcact

SEQ ID NO: 208310 - DNA, 25 bp, Homo sapien
caggtttcactaatatttgtcatgc

SEQ ID NO: 208311 - DNA, 25 bp, Homo sapien
aaactttttctattgctaggagcct

SEQ ID NO: 208312 - DNA, 25 bp, Homo sapien
tctattgctaggagcctgccagaac

SEQ ID NO: 208313 - DNA, 25 bp, Homo sapien
ggccaatatataatgttgtgacatc

SEQ ID NO: 208314 - DNA, 25 bp, Homo sapien
gttgtgacatcatatctgataacca

SEQ ID NO: 208315 - DNA, 25 bp, Homo sapien
accagaggtctggtatctacactcc

SEQ ID NO: 208316 - DNA, 25 bp, Homo sapien
ggtatctacactcctggtgccccat

SEQ ID NO: 208317 - DNA, 25 bp, Homo sapien
tggtgccccatcagtggttgtctcc

SEQ ID NO: 208318 - DNA, 25 bp, Homo sapien
cccatcagtggttgtctccataagt

SEQ ID NO: 208319 - DNA, 25 bp, Homo sapien
attgtggtgacccactgcttcagct

SEQ ID NO: 208320 - DNA, 25 bp, Homo sapien
gcttcagctggttgacctccctgtc

SEQ ID NO: 208321 - DNA, 25 bp, Homo sapien
gggaaaaccggcagggcatcagtca

SEQ ID NO: 208322 - DNA, 25 bp, Homo sapien
aaccggcagggcatcagtcactcag

SEQ ID NO: 208323 - DNA, 25 bp, Homo sapien
tgggcacatcgcttctctgagcctg

SEQ ID NO: 208324 - DNA, 25 bp, Homo sapien
tctgagcctgtctgtacagtgcttt

SEQ ID NO: 208325 - DNA, 25 bp, Homo sapien
ctaccagctgtcctgagggctgaag

SEQ ID NO: 208326 - DNA, 25 bp, Homo sapien
atcatgggtgccaagtctctgcatg

SEQ ID NO: 208327 - DNA, 25 bp, Homo sapien
gtgccaagtctctgcatgcccaggg

SEQ ID NO: 208328 - DNA, 25 bp, Homo sapien
aaaataaacagcttcattgaggcat

SEQ ID NO: 208329 - DNA, 25 bp, Homo sapien
gcttcattgaggcataattcacaga

SEQ ID NO: 208330 - DNA, 25 bp, Homo sapien
ccccaactttcttcagagtaatagc

SEQ ID NO: 208331 - DNA, 25 bp, Homo sapien
gagtaatagccttaattccttccct

SEQ ID NO: 208332 - DNA, 25 bp, Homo sapien
ttccctatctccttaccaaagtaca

SEQ ID NO: 208333 - DNA, 25 bp, Homo sapien
ccctatctccttaccaaagtacaag

SEQ ID NO: 208334 - DNA, 25 bp, Homo sapien
aaagtacaagtcacatctttcccac

SEQ ID NO: 208335 - DNA, 25 bp, Homo sapien
tacaagtcacatctttcccaccttt

SEQ ID NO: 208336 - DNA, 25 bp, Homo sapien
ttcccaccttttctgcaaactagga

SEQ ID NO: 208337 - DNA, 25 bp, Homo sapien
ttttctgcaaactaggagtctaccg

SEQ ID NO: 208338 - DNA, 25 bp, Homo sapien
ctgcaaactaggagtctaccgttca

SEQ ID NO: 208339 - DNA, 25 bp, Homo sapien
gaataagagtactagctctcaccct

SEQ ID NO: 208340 - DNA, 25 bp, Homo sapien
taagagtactagctctcaccctctg

SEQ ID NO: 208341 - DNA, 25 bp, Homo sapien
gattgcccaaggactttttttctct

SEQ ID NO: 208342 - DNA, 25 bp, Homo sapien
tttctctaaatgaagccccatctca

SEQ ID NO: 208343 - DNA, 25 bp, Homo sapien
gaagccccatctcaggtggatgttt

SEQ ID NO: 208344 - DNA, 25 bp, Homo sapien
agccccatctcaggtggatgtttaa

SEQ ID NO: 208345 - DNA, 25 bp, Homo sapien
gccccatctcaggtggatgtttaag

SEQ ID NO: 208346 - DNA, 25 bp, Homo sapien
atctcaggtggatgtttaagaactt

SEQ ID NO: 208347 - DNA, 25 bp, Homo sapien
ctcaggtggatgtttaagaacttag

SEQ ID NO: 208348 - DNA, 25 bp, Homo sapien
aagaacttaggtattcaaggccgag

SEQ ID NO: 208349 - DNA, 25 bp, Homo sapien
gaacttaggtattcaaggccgaggc

SEQ ID NO: 208350 - DNA, 25 bp, Homo sapien
acttaggtattcaaggccgaggcag

SEQ ID NO: 208351 - DNA, 25 bp, Homo sapien
ttaggtattcaaggccgaggcaggc

SEQ ID NO: 208352 - DNA, 25 bp, Homo sapien
ttgtcatccacacaacaccaggact

SEQ ID NO: 208353 - DNA, 25 bp, Homo sapien
tgtcatccacacaacaccaggactt

SEQ ID NO: 208354 - DNA, 25 bp, Homo sapien
gtcatccacacaacaccaggactta

SEQ ID NO: 208355 - DNA, 25 bp, Homo sapien
tcatccacacaacaccaggacttaa

SEQ ID NO: 208356 - DNA, 25 bp, Homo sapien
catccacacaacaccaggacttaag

SEQ ID NO: 208357 - DNA, 25 bp, Homo sapien
atccacacaacaccaggacttaaga

SEQ ID NO: 208358 - DNA, 25 bp, Homo sapien
tccacacaacaccaggacttaagac

SEQ ID NO: 208359 - DNA, 25 bp, Homo sapien
ccacacaacaccaggacttaagaca

SEQ ID NO: 208360 - DNA, 25 bp, Homo sapien
cacacaacaccaggacttaagacaa

SEQ ID NO: 208361 - DNA, 25 bp, Homo sapien
acacaacaccaggacttaagacaaa

SEQ ID NO: 208362 - DNA, 25 bp, Homo sapien
aattaattgttaagctgcagttgag

SEQ ID NO: 208363 - DNA, 25 bp, Homo sapien
gtgagagttttgataagccacttat

SEQ ID NO: 208364 - DNA, 25 bp, Homo sapien
gataagccacttatgggccgcgttg

SEQ ID NO: 208365 - DNA, 25 bp, Homo sapien
tatgggccgcgttgtgaatcacttg

SEQ ID NO: 208366 - DNA, 25 bp, Homo sapien
aatcacttgccagttgtactttatg

SEQ ID NO: 208367 - DNA, 25 bp, Homo sapien
tgtactttatggagcttattttatg

SEQ ID NO: 208368 - DNA, 25 bp, Homo sapien
tacataggaggtatgttaccttctc

SEQ ID NO: 208369 - DNA, 25 bp, Homo sapien
gttaccttctccttatttgtatgtt

SEQ ID NO: 208370 - DNA, 25 bp, Homo sapien
aaatgttatgtactggaaaggccac

SEQ ID NO: 208371 - DNA, 25 bp, Homo sapien
aggccacttatatttctagaacaga

SEQ ID NO: 208372 - DNA, 25 bp, Homo sapien
tatgcaaccttttttccttgaatta

SEQ ID NO: 208373 - DNA, 25 bp, Homo sapien
ggacatttcatagcagcatctcttg

SEQ ID NO: 208374 - DNA, 25 bp, Homo sapien
atctcttgagttgcctgcatcagtg

SEQ ID NO: 208375 - DNA, 25 bp, Homo sapien
tcacagtgaacaaatccagggagct

SEQ ID NO: 208376 - DNA, 25 bp, Homo sapien
aaagaccacttttaccactcaggct

SEQ ID NO: 208377 - DNA, 25 bp, Homo sapien
cttttaccactcaggctctatttgt

SEQ ID NO: 208378 - DNA, 25 bp, Homo sapien
ggctctatttgtgccttagcttggt

SEQ ID NO: 208379 - DNA, 25 bp, Homo sapien
gccttagcttggttatgagtaaaaa

SEQ ID NO: 208380 - DNA, 25 bp, Homo sapien
ttagaattatgctgcctacctcaca

SEQ ID NO: 208381 - DNA, 25 bp, Homo sapien
acctcacagaggtatcatgaagata

SEQ ID NO: 208382 - DNA, 25 bp, Homo sapien
ggtatcttcagttagtttttaaatg

SEQ ID NO: 208383 - DNA, 25 bp, Homo sapien
tgagggaatgctacacagcactcct

SEQ ID NO: 208384 - DNA, 25 bp, Homo sapien
gaagtttgaacagcaagcttttcct

SEQ ID NO: 208385 - DNA, 25 bp, Homo sapien
gaacagcaagcttttcctgatttta

SEQ ID NO: 208386 - DNA, 25 bp, Homo sapien
aaaacacaaagttgctttcaatgaa

SEQ ID NO: 208387 - DNA, 25 bp, Homo sapien
gtccccaaatgtgtacttagccttc

SEQ ID NO: 208388 - DNA, 25 bp, Homo sapien
aatgtgtacttagccttctgttatt

SEQ ID NO: 208389 - DNA, 25 bp, Homo sapien
cttctgttattccttattctttaag

SEQ ID NO: 208390 - DNA, 25 bp, Homo sapien
attctttaagcagtgttggcttcca

SEQ ID NO: 208391 - DNA, 25 bp, Homo sapien
gcagtgttggcttccattgaccata

SEQ ID NO: 208392 - DNA, 25 bp, Homo sapien
ggcttccattgaccatatgaaggcc

SEQ ID NO: 208393 - DNA, 25 bp, Homo sapien
gaaggccaccaattaaatggttgtg

SEQ ID NO: 208394 - DNA, 25 bp, Homo sapien
ggttgtgttaatccaacatgtaaaa

SEQ ID NO: 208395 - DNA, 25 bp, Homo sapien
ctactaaaaaattatggccaggcgt

SEQ ID NO: 208396 - DNA, 25 bp, Homo sapien
tactaaaaaattatggccaggcgtg

SEQ ID NO: 208397 - DNA, 25 bp, Homo sapien
actaaaaaattatggccaggcgtgg

SEQ ID NO: 208398 - DNA, 25 bp, Homo sapien
actccagcctggacagcaggagcga

SEQ ID NO: 208399 - DNA, 25 bp, Homo sapien
ctccagcctggacagcaggagcgaa

SEQ ID NO: 208400 - DNA, 25 bp, Homo sapien
tccagcctggacagcaggagcgaaa

SEQ ID NO: 208401 - DNA, 25 bp, Homo sapien
ccagcctggacagcaggagcgaaac

SEQ ID NO: 208402 - DNA, 25 bp, Homo sapien
cagcctggacagcaggagcgaaact

SEQ ID NO: 208403 - DNA, 25 bp, Homo sapien
agcctggacagcaggagcgaaactc

SEQ ID NO: 208404 - DNA, 25 bp, Homo sapien
gcctggacagcaggagcgaaactcc

SEQ ID NO: 208405 - DNA, 25 bp, Homo sapien
ctggacagcaggagcgaaactccgt

SEQ ID NO: 208406 - DNA, 25 bp, Homo sapien
aatgtatggatatactggcatttta

SEQ ID NO: 208407 - DNA, 25 bp, Homo sapien
ttatttggttttagcatatgattta

SEQ ID NO: 208408 - DNA, 25 bp, Homo sapien
gatttatagttggtgatttccgtat

SEQ ID NO: 208409 - DNA, 25 bp, Homo sapien
agttggtgatttccgtatatttgtt

SEQ ID NO: 208410 - DNA, 25 bp, Homo sapien
taaataagccttgttcttaggtttg

SEQ ID NO: 208411 - DNA, 25 bp, Homo sapien
agccttgttcttaggtttggaacag

SEQ ID NO: 208412 - DNA, 25 bp, Homo sapien
gttcttaggtttggaacagtctggt

SEQ ID NO: 208413 - DNA, 25 bp, Homo sapien
gtctcctgtgtttcatgtttcacct

SEQ ID NO: 208414 - DNA, 25 bp, Homo sapien
tcctgtgtttcatgtttcacctaag

SEQ ID NO: 208415 - DNA, 25 bp, Homo sapien
gtgtttcatgtttcacctaagtcat

SEQ ID NO: 208416 - DNA, 25 bp, Homo sapien
tcatgtttcacctaagtcataaata

SEQ ID NO: 208417 - DNA, 25 bp, Homo sapien
gaattatagctttgagttaccgtga

SEQ ID NO: 208418 - DNA, 25 bp, Homo sapien
tagctttgagttaccgtgactggga

SEQ ID NO: 208419 - DNA, 25 bp, Homo sapien
ctgtgattactccaagtcagaggca

SEQ ID NO: 208420 - DNA, 25 bp, Homo sapien
gattactccaagtcagaggcagcag

SEQ ID NO: 208421 - DNA, 25 bp, Homo sapien
gaggcagcagaagccaagtgcttga

SEQ ID NO: 208422 - DNA, 25 bp, Homo sapien
agccaagtgcttgatgctagctgaa

SEQ ID NO: 208423 - DNA, 25 bp, Homo sapien
tgcttgatgctagctgaaggactca

SEQ ID NO: 208424 - DNA, 25 bp, Homo sapien
atgctagctgaaggactcaaatgga

SEQ ID NO: 208425 - DNA, 25 bp, Homo sapien
tgaagtccaaaacggaaagcggcat

SEQ ID NO: 208426 - DNA, 25 bp, Homo sapien
acggaaagcggcatgtattgtacat

SEQ ID NO: 208427 - DNA, 25 bp, Homo sapien
tctttgattaaaggaaactcaccgc

SEQ ID NO: 208428 - DNA, 25 bp, Homo sapien
ctaaaagaatgtacttggtgtgcat

SEQ ID NO: 208429 - DNA, 25 bp, Homo sapien
tggtgtgcatttttaagtgtttcat

SEQ ID NO: 208430 - DNA, 25 bp, Homo sapien
aagtgtttcatgtagacagattaat

SEQ ID NO: 208431 - DNA, 25 bp, Homo sapien
gtatttctacatttatttcaagact

SEQ ID NO: 208432 - DNA, 25 bp, Homo sapien
cttttcagtgactttttcaagtgca

SEQ ID NO: 208433 - DNA, 25 bp, Homo sapien
gactttttcaagtgcatgtgttaac

SEQ ID NO: 208434 - DNA, 25 bp, Homo sapien
ggaacgagagtccagtggcttcttt

SEQ ID NO: 208435 - DNA, 25 bp, Homo sapien
gtccagtggcttctttactagcaaa

SEQ ID NO: 208436 - DNA, 25 bp, Homo sapien
ggtgagaatgtgtttatactgtata

SEQ ID NO: 208437 - DNA, 25 bp, Homo sapien
gtatatggaaacctaatgcctcttt

SEQ ID NO: 208438 - DNA, 25 bp, Homo sapien
aacctaatgcctcttttctaaagct

SEQ ID NO: 208439 - DNA, 25 bp, Homo sapien
ccacccagcccagattaaatgtttt

SEQ ID NO: 208440 - DNA, 25 bp, Homo sapien
gtttttatttctacctgccatcatt

SEQ ID NO: 208441 - DNA, 25 bp, Homo sapien
tttttatttctacctgccatcattg

SEQ ID NO: 208442 - DNA, 25 bp, Homo sapien
gccatcattggtctttactaagtga

SEQ ID NO: 208443 - DNA, 25 bp, Homo sapien
ccatcattggtctttactaagtgaa

SEQ ID NO: 208444 - DNA, 25 bp, Homo sapien
catcattggtctttactaagtgaag

SEQ ID NO: 208445 - DNA, 25 bp, Homo sapien
atcattggtctttactaagtgaagt

SEQ ID NO: 208446 - DNA, 25 bp, Homo sapien
tcattggtctttactaagtgaagtg

SEQ ID NO: 208447 - DNA, 25 bp, Homo sapien
cattggtctttactaagtgaagtga

SEQ ID NO: 208448 - DNA, 25 bp, Homo sapien
attggtctttactaagtgaagtgac

SEQ ID NO: 208449 - DNA, 25 bp, Homo sapien
gacttctttctttaacaataaatgg

SEQ ID NO: 208450 - DNA, 25 bp, Homo sapien
ttttgtaacatttaagcatatttca

SEQ ID NO: 208451 - DNA, 25 bp, Homo sapien
aagatcctttttagttaatactatg

SEQ ID NO: 208452 - DNA, 25 bp, Homo sapien
tagttaatactatgacagtactaaa

SEQ ID NO: 208453 - DNA, 25 bp, Homo sapien
aacatttcagataccattatattaa

SEQ ID NO: 208454 - DNA, 25 bp, Homo sapien
gtgtatgtgtacaaaagcgttgata

SEQ ID NO: 208455 - DNA, 25 bp, Homo sapien
gtgtacaaaagcgttgataaatact

SEQ ID NO: 208456 - DNA, 25 bp, Homo sapien
caaaagcgttgataaatactaatct

SEQ ID NO: 208457 - DNA, 25 bp, Homo sapien
ggagttcctttatttgtaatatatg

SEQ ID NO: 208458 - DNA, 25 bp, Homo sapien
tatatgtgctcttaaaagcaatggg

SEQ ID NO: 208459 - DNA, 25 bp, Homo sapien
gctcttaaaagcaatgggatgtgaa

SEQ ID NO: 208460 - DNA, 25 bp, Homo sapien
agcaatgggatgtgaaattatgaaa

SEQ ID NO: 208461 - DNA, 25 bp, Homo sapien
taactttatccccagtgtcagtatt

SEQ ID NO: 208462 - DNA, 25 bp, Homo sapien
aaaatgaatacaatatcctgaaggt

SEQ ID NO: 208463 - DNA, 25 bp, Homo sapien
gaaatatattctcttcaattagcat

SEQ ID NO: 208464 - DNA, 25 bp, Homo sapien
attctcttcaattagcataaatatg

SEQ ID NO: 208465 - DNA, 25 bp, Homo sapien
acataagttagctatacagctattg

SEQ ID NO: 208466 - DNA, 25 bp, Homo sapien
acagctattgagatagtactttcta

SEQ ID NO: 208467 - DNA, 25 bp, Homo sapien
gagatagtactttctagtaaactta

SEQ ID NO: 208468 - DNA, 25 bp, Homo sapien
tagagaatgatttgctttattgtaa

SEQ ID NO: 208469 - DNA, 25 bp, Homo sapien
gtaattgtatataagtgactggaaa

SEQ ID NO: 208470 - DNA, 25 bp, Homo sapien
ataagtgactggaaaagcacaaaga

SEQ ID NO: 208471 - DNA, 25 bp, Homo sapien
gaaataaagtgggttcgatctgttt

SEQ ID NO: 208472 - DNA, 25 bp, Homo sapien
ggatctggggacgggtatggtggct

SEQ ID NO: 208473 - DNA, 25 bp, Homo sapien
gatctggggacgggtatggtggctc

SEQ ID NO: 208474 - DNA, 25 bp, Homo sapien
aacacgctgagaccctatccctaaa

SEQ ID NO: 208475 - DNA, 25 bp, Homo sapien
acacgctgagaccctatccctaaaa

SEQ ID NO: 208476 - DNA, 25 bp, Homo sapien
cacgctgagaccctatccctaaaaa

SEQ ID NO: 208477 - DNA, 25 bp, Homo sapien
acgctgagaccctatccctaaaaat

SEQ ID NO: 208478 - DNA, 25 bp, Homo sapien
cgctgagaccctatccctaaaaata

SEQ ID NO: 208479 - DNA, 25 bp, Homo sapien
aaagaaggatctggggacgggtatg

SEQ ID NO: 208480 - DNA, 25 bp, Homo sapien
gaaggatctggggacgggtatggtg

SEQ ID NO: 208481 - DNA, 25 bp, Homo sapien
aaggatctggggacgggtatggtgg

SEQ ID NO: 208482 - DNA, 25 bp, Homo sapien
aggatctggggacgggtatggtggc

SEQ ID NO: 208483 - DNA, 25 bp, Homo sapien
atgataatatcaaggtcaggcatgg

SEQ ID NO: 208484 - DNA, 25 bp, Homo sapien
tgataatatcaaggtcaggcatggt

SEQ ID NO: 208485 - DNA, 25 bp, Homo sapien
gataatatcaaggtcaggcatggtg

SEQ ID NO: 208486 - DNA, 25 bp, Homo sapien
gcgggtggatctgctgaagtcagaa

SEQ ID NO: 208487 - DNA, 25 bp, Homo sapien
gtggatctgctgaagtcagaagttt

SEQ ID NO: 208488 - DNA, 25 bp, Homo sapien
tggatctgctgaagtcagaagtttg

SEQ ID NO: 208489 - DNA, 25 bp, Homo sapien
gatctgctgaagtcagaagtttgag

SEQ ID NO: 208490 - DNA, 25 bp, Homo sapien
ttagccgggcgcagcagtgcacgcc

SEQ ID NO: 208491 - DNA, 25 bp, Homo sapien
tagccgggcgcagcagtgcacgcct

SEQ ID NO: 208492 - DNA, 25 bp, Homo sapien
cgggcgcagcagtgcacgcctgtaa

SEQ ID NO: 208493 - DNA, 25 bp, Homo sapien
aatgataatatcaaggtcaggcatg

SEQ ID NO: 208494 - DNA, 25 bp, Homo sapien
ggagcccaagccaaatctgctggcc

SEQ ID NO: 208495 - DNA, 25 bp, Homo sapien
ccacccaaggagcagtgccggacaa

SEQ ID NO: 208496 - DNA, 25 bp, Homo sapien
gagcagtgccggacaactgtcggct

SEQ ID NO: 208497 - DNA, 25 bp, Homo sapien
gtgccggacaactgtcggctcagag

SEQ ID NO: 208498 - DNA, 25 bp, Homo sapien
ttggacaaggcttctggcctcggcg

SEQ ID NO: 208499 - DNA, 25 bp, Homo sapien
tggcctcggcgtctgtcaagcagaa

SEQ ID NO: 208500 - DNA, 25 bp, Homo sapien
tcggcgtctgtcaagcagaagggat

SEQ ID NO: 208501 - DNA, 25 bp, Homo sapien
agggatgtttgtcacttgttctgca

SEQ ID NO: 208502 - DNA, 25 bp, Homo sapien
gatgtttgtcacttgttctgcaact

SEQ ID NO: 208503 - DNA, 25 bp, Homo sapien
ttgtcacttgttctgcaacttgggc

SEQ ID NO: 208504 - DNA, 25 bp, Homo sapien
ttgttctgcaacttgggctgggagt

SEQ ID NO: 208505 - DNA, 25 bp, Homo sapien
tgatgctagaacagggatctttccc

SEQ ID NO: 208506 - DNA, 25 bp, Homo sapien
gatgctagaacagggatctttccca

SEQ ID NO: 208507 - DNA, 25 bp, Homo sapien
tgctagaacagggatctttcccagt

SEQ ID NO: 208508 - DNA, 25 bp, Homo sapien
gctagaacagggatctttcccagta

SEQ ID NO: 208509 - DNA, 25 bp, Homo sapien
tagaacagggatctttcccagtatc

SEQ ID NO: 208510 - DNA, 25 bp, Homo sapien
gaacagggatctttcccagtatctt

SEQ ID NO: 208511 - DNA, 25 bp, Homo sapien
aacagggatctttcccagtatcttg

SEQ ID NO: 208512 - DNA, 25 bp, Homo sapien
acagggatctttcccagtatcttga

SEQ ID NO: 208513 - DNA, 25 bp, Homo sapien
agggatctttcccagtatcttgagt

SEQ ID NO: 208514 - DNA, 25 bp, Homo sapien
gggatctttcccagtatcttgagtg

SEQ ID NO: 208515 - DNA, 25 bp, Homo sapien
ggatctttcccagtatcttgagtgg

SEQ ID NO: 208516 - DNA, 25 bp, Homo sapien
tctccattacttccagttaaagtgg

SEQ ID NO: 208517 - DNA, 25 bp, Homo sapien
acttccagttaaagtggcatcatag

SEQ ID NO: 208518 - DNA, 25 bp, Homo sapien
tggataaaaactccaccagtgtcta

SEQ ID NO: 208519 - DNA, 25 bp, Homo sapien
cagtgtctaccatctccaccatgaa

SEQ ID NO: 208520 - DNA, 25 bp, Homo sapien
atctccaccatgaactctgttaagg

SEQ ID NO: 208521 - DNA, 25 bp, Homo sapien
gaactctgttaaggaagcttcattt

SEQ ID NO: 208522 - DNA, 25 bp, Homo sapien
tatattcccgctcttttctcttcat

SEQ ID NO: 208523 - DNA, 25 bp, Homo sapien
ctgtcttctgcataatcatgccttc

SEQ ID NO: 208524 - DNA, 25 bp, Homo sapien
gcataatcatgccttcttgctaagt

SEQ ID NO: 208525 - DNA, 25 bp, Homo sapien
catgccttcttgctaagtaattcaa

SEQ ID NO: 208526 - DNA, 25 bp, Homo sapien
gccatgatgatatcttatgattaaa

SEQ ID NO: 208527 - DNA, 25 bp, Homo sapien
ggttggtcgctaatgatggctgtat

SEQ ID NO: 208528 - DNA, 25 bp, Homo sapien
taatgatggctgtatctcccttcac

SEQ ID NO: 208529 - DNA, 25 bp, Homo sapien
actgtctcttcctacattaccacta

SEQ ID NO: 208530 - DNA, 25 bp, Homo sapien
acattaccactactacatgctggca

SEQ ID NO: 208531 - DNA, 25 bp, Homo sapien
actactacatgctggcaaaggtgaa

SEQ ID NO: 208532 - DNA, 25 bp, Homo sapien
gaaaaatgattctgcaactctctta

SEQ ID NO: 208533 - DNA, 25 bp, Homo sapien
gattctgcaactctcttaaagttag

SEQ ID NO: 208534 - DNA, 25 bp, Homo sapien
atctcatggagaaaaactacttgca

SEQ ID NO: 208535 - DNA, 25 bp, Homo sapien
gaagatgtcttttattgtctacaat

SEQ ID NO: 208536 - DNA, 25 bp, Homo sapien
gtctacaatgatttctagtctttaa

SEQ ID NO: 208537 - DNA, 25 bp, Homo sapien
gagatttgtttttaggttggtcgct

SEQ ID NO: 208538 - DNA, 25 bp, Homo sapien
cttcttcaggcagtgctgtaagctg

SEQ ID NO: 208539 - DNA, 25 bp, Homo sapien
aagctgttcaacaattcctccagaa

SEQ ID NO: 208540 - DNA, 25 bp, Homo sapien
ttcctccagaactggtgaaacagaa

SEQ ID NO: 208541 - DNA, 25 bp, Homo sapien
gaaacgtcagttgacaaaacagcaa

SEQ ID NO: 208542 - DNA, 25 bp, Homo sapien
aaatcagctgtcagacgtcgattgc

SEQ ID NO: 208543 - DNA, 25 bp, Homo sapien
gtcagacgtcgattgcagaaaggag

SEQ ID NO: 208544 - DNA, 25 bp, Homo sapien
atatatttaccaagcaacgtaggga

SEQ ID NO: 208545 - DNA, 25 bp, Homo sapien
caacgtagggaaaacatgcaaaata

SEQ ID NO: 208546 - DNA, 25 bp, Homo sapien
tactgtaattcctttttgagccctc

SEQ ID NO: 208547 - DNA, 25 bp, Homo sapien
ttttgagccctcatttgtctttttt

SEQ ID NO: 208548 - DNA, 25 bp, Homo sapien
ttgtcttttttgagccaaggctatc

SEQ ID NO: 208549 - DNA, 25 bp, Homo sapien
ttctaccatatctgtattttcttag

SEQ ID NO: 208550 - DNA, 25 bp, Homo sapien
ttcttagaactactggacttatgtg

SEQ ID NO: 208551 - DNA, 25 bp, Homo sapien
gacttatgtggtacaggaggctgct

SEQ ID NO: 208552 - DNA, 25 bp, Homo sapien
gctgcttagcagttttgaatagttt

SEQ ID NO: 208553 - DNA, 25 bp, Homo sapien
aattttcctcagctgtgttgcacat

SEQ ID NO: 208554 - DNA, 25 bp, Homo sapien
tgtgttcactgccttgtcctttctc

SEQ ID NO: 208555 - DNA, 25 bp, Homo sapien
tgctccttgcacattatcatcctaa

SEQ ID NO: 208556 - DNA, 25 bp, Homo sapien
aaatttcactgacagggccgaccat

SEQ ID NO: 208557 - DNA, 25 bp, Homo sapien
ggccgaccattacaagggaactttg

SEQ ID NO: 208558 - DNA, 25 bp, Homo sapien
actttgttctgacgatggttccttg

SEQ ID NO: 208559 - DNA, 25 bp, Homo sapien
gacgatggttccttgatgtgaaaac

SEQ ID NO: 208560 - DNA, 25 bp, Homo sapien
atgctctgtggctacatatacacac

SEQ ID NO: 208561 - DNA, 25 bp, Homo sapien
gataaacactaggtgcttttgaatt

SEQ ID NO: 208562 - DNA, 25 bp, Homo sapien
gtgggatctttgatttcagggtgaa

SEQ ID NO: 208563 - DNA, 25 bp, Homo sapien
cagagtacccctttaaacacacaca

SEQ ID NO: 208564 - DNA, 25 bp, Homo sapien
acacacagtgtgcaactagccccag

SEQ ID NO: 208565 - DNA, 25 bp, Homo sapien
tgcaactagccccagttttgacaga

SEQ ID NO: 208566 - DNA, 25 bp, Homo sapien
gccccagttttgacagaataattct

SEQ ID NO: 208567 - DNA, 25 bp, Homo sapien
acagaataattcttggtcttcccca

SEQ ID NO: 208568 - DNA, 25 bp, Homo sapien
gagacaatttgttgtacccatgact

SEQ ID NO: 208569 - DNA, 25 bp, Homo sapien
atttgttgtacccatgactgttgcc

SEQ ID NO: 208570 - DNA, 25 bp, Homo sapien
tacccatgactgttgcctgcaaaaa

SEQ ID NO: 208571 - DNA, 25 bp, Homo sapien
cagtgcatcataagtgctaagacga

SEQ ID NO: 208572 - DNA, 25 bp, Homo sapien
aaatttgcggatggaaggcgtgaat

SEQ ID NO: 208573 - DNA, 25 bp, Homo sapien
gacagcaatcaggttcggtactatt

SEQ ID NO: 208574 - DNA, 25 bp, Homo sapien
cggtactattcacagtttcaggcat

SEQ ID NO: 208575 - DNA, 25 bp, Homo sapien
cagtttcaggcatccgctagggatc

SEQ ID NO: 208576 - DNA, 25 bp, Homo sapien
gcatccgctagggatcttggaacat

SEQ ID NO: 208577 - DNA, 25 bp, Homo sapien
gggtactgtaccttgtcatattgtg

SEQ ID NO: 208578 - DNA, 25 bp, Homo sapien
gtaccttgtcatattgtgcattaaa

SEQ ID NO: 208579 - DNA, 25 bp, Homo sapien
aaagctctcagatatcatttcgcct

SEQ ID NO: 208580 - DNA, 25 bp, Homo sapien
tcatttcgccttcggttgatgtaag

SEQ ID NO: 208581 - DNA, 25 bp, Homo sapien
tcaaagctactcaaatcattcaata

SEQ ID NO: 208582 - DNA, 25 bp, Homo sapien
aacatctctgcctaatttaccaaag

SEQ ID NO: 208583 - DNA, 25 bp, Homo sapien
catctctgcctaatttaccaaagcc

SEQ ID NO: 208584 - DNA, 25 bp, Homo sapien
atctctgcctaatttaccaaagcca

SEQ ID NO: 208585 - DNA, 25 bp, Homo sapien
tgcctaatttaccaaagccagacct

SEQ ID NO: 208586 - DNA, 25 bp, Homo sapien
gcctaatttaccaaagccagacctt

SEQ ID NO: 208587 - DNA, 25 bp, Homo sapien
taatttaccaaagccagaccttcag

SEQ ID NO: 208588 - DNA, 25 bp, Homo sapien
atttaccaaagccagaccttcagtt

SEQ ID NO: 208589 - DNA, 25 bp, Homo sapien
tttaccaaagccagaccttcagttc

SEQ ID NO: 208590 - DNA, 25 bp, Homo sapien
taccaaagccagaccttcagttcaa

SEQ ID NO: 208591 - DNA, 25 bp, Homo sapien
caaagccagaccttcagttcaacat

SEQ ID NO: 208592 - DNA, 25 bp, Homo sapien
aaagccagaccttcagttcaacatg

SEQ ID NO: 208593 - DNA, 25 bp, Homo sapien
aactagtaactaccatccatcctat

SEQ ID NO: 208594 - DNA, 25 bp, Homo sapien
gtaactaccatccatcctatttgaa

SEQ ID NO: 208595 - DNA, 25 bp, Homo sapien
aacttgttacattactctttgtgat

SEQ ID NO: 208596 - DNA, 25 bp, Homo sapien
attttctaataaccatgctaagtgt

SEQ ID NO: 208597 - DNA, 25 bp, Homo sapien
aagtgtatttccacagtgagctttt

SEQ ID NO: 208598 - DNA, 25 bp, Homo sapien
ccacagtgagcttttggcttactat

SEQ ID NO: 208599 - DNA, 25 bp, Homo sapien
ggcttactatatacattcttggtgg

SEQ ID NO: 208600 - DNA, 25 bp, Homo sapien
gtggataaattgttcatctgttttt

SEQ ID NO: 208601 - DNA, 25 bp, Homo sapien
catctgtttttgaagtgttacctta

SEQ ID NO: 208602 - DNA, 25 bp, Homo sapien
tgaagtgttaccttactattttgtt

SEQ ID NO: 208603 - DNA, 25 bp, Homo sapien
caagatagtctattgggttgattca

SEQ ID NO: 208604 - DNA, 25 bp, Homo sapien
agcgcctaagctcacagagtgtcgt

SEQ ID NO: 208605 - DNA, 25 bp, Homo sapien
ggtccttgctcttgttaacccaaga

SEQ ID NO: 208606 - DNA, 25 bp, Homo sapien
gttaacccaagatgctgctacacag

SEQ ID NO: 208607 - DNA, 25 bp, Homo sapien
gatgctgctacacagatgccaaatg

SEQ ID NO: 208608 - DNA, 25 bp, Homo sapien
aaatcttccacagggctttttcagt

SEQ ID NO: 208609 - DNA, 25 bp, Homo sapien
ctttttcagtaaacacgtgatgtgg

SEQ ID NO: 208610 - DNA, 25 bp, Homo sapien
ttcccactagaacatactttaacag

SEQ ID NO: 208611 - DNA, 25 bp, Homo sapien
gaaaacgagtcggaccttctagctg

SEQ ID NO: 208612 - DNA, 25 bp, Homo sapien
ggaccttctagctgcactctgtact

SEQ ID NO: 208613 - DNA, 25 bp, Homo sapien
gccgagaaggcatttctagacccgt

SEQ ID NO: 208614 - DNA, 25 bp, Homo sapien
gaaggcatttctagacccgtgtttt

SEQ ID NO: 208615 - DNA, 25 bp, Homo sapien
gtataatagtgatccctatggagaa

SEQ ID NO: 208616 - DNA, 25 bp, Homo sapien
gtgatccctatggagaattaaaggt

SEQ ID NO: 208617 - DNA, 25 bp, Homo sapien
gtgagaaagctactttgtggtgtct

SEQ ID NO: 208618 - DNA, 25 bp, Homo sapien
agctactttgtggtgtctaggtttc

SEQ ID NO: 208619 - DNA, 25 bp, Homo sapien
ggtgtctaggtttctgataaaaggg

SEQ ID NO: 208620 - DNA, 25 bp, Homo sapien
aaagggatgatcttaactgaagaat

SEQ ID NO: 208621 - DNA, 25 bp, Homo sapien
gtaggaacaagggagtgagccttat

SEQ ID NO: 208622 - DNA, 25 bp, Homo sapien
gagccttataagaggacgttcagtc

SEQ ID NO: 208623 - DNA, 25 bp, Homo sapien
ggacgttcagtctcatttattaaaa

SEQ ID NO: 208624 - DNA, 25 bp, Homo sapien
aataataactgagactgggagaggt

SEQ ID NO: 208625 - DNA, 25 bp, Homo sapien
ctttggtagcctgaagtgggagatt

SEQ ID NO: 208626 - DNA, 25 bp, Homo sapien
gccacattcagcacatatataacgt

SEQ ID NO: 208627 - DNA, 25 bp, Homo sapien
acatatataacgtctctctcctggg

SEQ ID NO: 208628 - DNA, 25 bp, Homo sapien
taggaactgattctctacctttctt

SEQ ID NO: 208629 - DNA, 25 bp, Homo sapien
aactgattctctacctttcttggag

SEQ ID NO: 208630 - DNA, 25 bp, Homo sapien
attctctacctttcttggagcctgc

SEQ ID NO: 208631 - DNA, 25 bp, Homo sapien
tcattttcaaggtttacgcactgcc

SEQ ID NO: 208632 - DNA, 25 bp, Homo sapien
aaggtttacgcactgcctctctaag

SEQ ID NO: 208633 - DNA, 25 bp, Homo sapien
tttacgcactgcctctctaagctgg

SEQ ID NO: 208634 - DNA, 25 bp, Homo sapien
ctctaagctggcctcaggtttattg

SEQ ID NO: 208635 - DNA, 25 bp, Homo sapien
tggcctcaggtttattggcgataat

SEQ ID NO: 208636 - DNA, 25 bp, Homo sapien
ggtttattggcgataatcacagaaa

SEQ ID NO: 208637 - DNA, 25 bp, Homo sapien
ggaatttttgttcccataattggat

SEQ ID NO: 208638 - DNA, 25 bp, Homo sapien
cataattggattctttgggaacatg

SEQ ID NO: 208639 - DNA, 25 bp, Homo sapien
gggaacatgaagcattcaggcttaa

SEQ ID NO: 208640 - DNA, 25 bp, Homo sapien
gaagcattcaggcttaaggcaagaa

SEQ ID NO: 208641 - DNA, 25 bp, Homo sapien
tcaaaaagcaacttctgccctgcaa

SEQ ID NO: 208642 - DNA, 25 bp, Homo sapien
cccactccatagtctggtattctga

SEQ ID NO: 208643 - DNA, 25 bp, Homo sapien
gtctggtattctgagcactagctta

SEQ ID NO: 208644 - DNA, 25 bp, Homo sapien
gagcactagcttaatatttcttcac

SEQ ID NO: 208645 - DNA, 25 bp, Homo sapien
ggcatattctataaatttaactgtg

SEQ ID NO: 208646 - DNA, 25 bp, Homo sapien
attctggtcattcttaattttactc

SEQ ID NO: 208647 - DNA, 25 bp, Homo sapien
aagtgatcatctttgtatataacag

SEQ ID NO: 208648 - DNA, 25 bp, Homo sapien
gatcttgatgagcttcttgctggaa

SEQ ID NO: 208649 - DNA, 25 bp, Homo sapien
gatgagcttcttgctggaagattag

SEQ ID NO: 208650 - DNA, 25 bp, Homo sapien
atcatcatcaggaaattcttcaagt

SEQ ID NO: 208651 - DNA, 25 bp, Homo sapien
gaaattcttcaagtaccctcttact

SEQ ID NO: 208652 - DNA, 25 bp, Homo sapien
ggacatattgaaaatcctggagatg

SEQ ID NO: 208653 - DNA, 25 bp, Homo sapien
aatcctggagatggactatttgctc

SEQ ID NO: 208654 - DNA, 25 bp, Homo sapien
gagatggactatttgctcctttgcc

SEQ ID NO: 208655 - DNA, 25 bp, Homo sapien
tactgtaagcagattagtgctcagg

SEQ ID NO: 208656 - DNA, 25 bp, Homo sapien
agtgctcaggagtttgatgagcaaa

SEQ ID NO: 208657 - DNA, 25 bp, Homo sapien
agtttctacctctcaagctgcaatt

SEQ ID NO: 208658 - DNA, 25 bp, Homo sapien
tttctacctctcaagctgcaattgc

SEQ ID NO: 208659 - DNA, 25 bp, Homo sapien
actgtggaaaagtagaatgtcatct

SEQ ID NO: 208660 - DNA, 25 bp, Homo sapien
gaatgtcatctgtattaattattgc

SEQ ID NO: 208661 - DNA, 25 bp, Homo sapien
tattgcttttacattcattgattat

SEQ ID NO: 208662 - DNA, 25 bp, Homo sapien
gattattagtcattctaacttggaa

SEQ ID NO: 208663 - DNA, 25 bp, Homo sapien
gaaaataatgcaattgggtcacagt

SEQ ID NO: 208664 - DNA, 25 bp, Homo sapien
aatgcaattgggtcacagtgttaaa

SEQ ID NO: 208665 - DNA, 25 bp, Homo sapien
tgttggtttatatgctgaaattgtt

SEQ ID NO: 208666 - DNA, 25 bp, Homo sapien
tttctccttagtttggatcactaac

SEQ ID NO: 208667 - DNA, 25 bp, Homo sapien
atcactaacagagatcttgggacat

SEQ ID NO: 208668 - DNA, 25 bp, Homo sapien
aacagagatcttgggacatttattt

SEQ ID NO: 208669 - DNA, 25 bp, Homo sapien
aatatttatggttatggaaacgctt

SEQ ID NO: 208670 - DNA, 25 bp, Homo sapien
gggaggagttttggcccacacaata

SEQ ID NO: 208671 - DNA, 25 bp, Homo sapien
tttggcccacacaatactaggagtt

SEQ ID NO: 208672 - DNA, 25 bp, Homo sapien
cacaatactaggagttgcatggaat

SEQ ID NO: 208673 - DNA, 25 bp, Homo sapien
catggaatgagattacagggcagat

SEQ ID NO: 208674 - DNA, 25 bp, Homo sapien
aaagtttctgattctagatccacat

SEQ ID NO: 208675 - DNA, 25 bp, Homo sapien
agatccacattataccggtgctgaa

SEQ ID NO: 208676 - DNA, 25 bp, Homo sapien
acattataccggtgctgaagacctg

SEQ ID NO: 208677 - DNA, 25 bp, Homo sapien
gctgaagacctgcaagttattttgg

SEQ ID NO: 208678 - DNA, 25 bp, Homo sapien
tggaacaaggatgcatactataact

SEQ ID NO: 208679 - DNA, 25 bp, Homo sapien
tcttcctcagcgaccaaatatgatt

SEQ ID NO: 208680 - DNA, 25 bp, Homo sapien
gtcaaagactgcagtagagtggtat

SEQ ID NO: 208681 - DNA, 25 bp, Homo sapien
aaagatttctctatgaatcatcatc

SEQ ID NO: 208682 - DNA, 25 bp, Homo sapien
tatgaatcatcatcaagaactctgg

SEQ ID NO: 208683 - DNA, 25 bp, Homo sapien
ctgggagaacttttgaattcataac

SEQ ID NO: 208684 - DNA, 25 bp, Homo sapien
aattcataaccaagccaacatctcc

SEQ ID NO: 208685 - DNA, 25 bp, Homo sapien
aagccaacatctccagacatgtaaa

SEQ ID NO: 208686 - DNA, 25 bp, Homo sapien
attcaaattgaaatgcctgtgtatt

SEQ ID NO: 208687 - DNA, 25 bp, Homo sapien
ggaggagataactcaaaacttcttc

SEQ ID NO: 208688 - DNA, 25 bp, Homo sapien
aaacttcttcaattttgcctagtgc

SEQ ID NO: 208689 - DNA, 25 bp, Homo sapien
tcaattttgcctagtgcctgcgtaa

SEQ ID NO: 208690 - DNA, 25 bp, Homo sapien
tttgcctagtgcctgcgtaaataat

SEQ ID NO: 208691 - DNA, 25 bp, Homo sapien
ctagtgcctgcgtaaataatatatt

SEQ ID NO: 208692 - DNA, 25 bp, Homo sapien
aagtcagtcagtgtgctaagtaccg

SEQ ID NO: 208693 - DNA, 25 bp, Homo sapien
gtgctaagtaccgtacacccattat

SEQ ID NO: 208694 - DNA, 25 bp, Homo sapien
cacccattatgttacttaattctca

SEQ ID NO: 208695 - DNA, 25 bp, Homo sapien
aaaaagctcagttggattcccttga

SEQ ID NO: 208696 - DNA, 25 bp, Homo sapien
ggattcccttgagcaaatcaatttc

SEQ ID NO: 208697 - DNA, 25 bp, Homo sapien
ctctaacagtttcctcatagcttga

SEQ ID NO: 208698 - DNA, 25 bp, Homo sapien
catagcttgagggtcctgtgcctat

SEQ ID NO: 208699 - DNA, 25 bp, Homo sapien
gtcctgtgcctattttgcggtgtgg

SEQ ID NO: 208700 - DNA, 25 bp, Homo sapien
ggtaatgctcgggaagtgtcacaaa

SEQ ID NO: 208701 - DNA, 25 bp, Homo sapien
agtgtcacaaatttaggtaagcggt

SEQ ID NO: 208702 - DNA, 25 bp, Homo sapien
ggtggtagcaccattggaagtttta

SEQ ID NO: 208703 - DNA, 25 bp, Homo sapien
ttctcagtcctatttctcagttcta

SEQ ID NO: 208704 - DNA, 25 bp, Homo sapien
gtcctatttctcagttctattattt

SEQ ID NO: 208705 - DNA, 25 bp, Homo sapien
ctattattttagaacctagtcagtt

SEQ ID NO: 208706 - DNA, 25 bp, Homo sapien
aacctagtcagttctttaagattat

SEQ ID NO: 208707 - DNA, 25 bp, Homo sapien
attataactggtcctacattaaaat

SEQ ID NO: 208708 - DNA, 25 bp, Homo sapien
agattttacctgtttgctgctgaga

SEQ ID NO: 208709 - DNA, 25 bp, Homo sapien
tacctgtttgctgctgagaacatct

SEQ ID NO: 208710 - DNA, 25 bp, Homo sapien
cttcagttcaacatgcttccttagc

SEQ ID NO: 208711 - DNA, 25 bp, Homo sapien
acatgcttccttagcttttcatagt

SEQ ID NO: 208712 - DNA, 25 bp, Homo sapien
tagcttttcatagttgtctgacatt

SEQ ID NO: 208713 - DNA, 25 bp, Homo sapien
agttgtctgacatttccatgaaaac

SEQ ID NO: 208714 - DNA, 25 bp, Homo sapien
gggaagaaactcagactttctattt

SEQ ID NO: 208715 - DNA, 25 bp, Homo sapien
gatattttgtgcattaatacattac

SEQ ID NO: 208716 - DNA, 25 bp, Homo sapien
tttctttgcagtcacatcattgtac

SEQ ID NO: 208717 - DNA, 25 bp, Homo sapien
tgcagtcacatcattgtaccacctt

SEQ ID NO: 208718 - DNA, 25 bp, Homo sapien
cacatcattgtaccaccttcattat

SEQ ID NO: 208719 - DNA, 25 bp, Homo sapien
atcattgtaccaccttcattattgt

SEQ ID NO: 208720 - DNA, 25 bp, Homo sapien
gtaccaccttcattattgtatagag

SEQ ID NO: 208721 - DNA, 25 bp, Homo sapien
attgtatagagctgcttcaattctg

SEQ ID NO: 208722 - DNA, 25 bp, Homo sapien
agagctgcttcaattctgagtcctc

SEQ ID NO: 208723 - DNA, 25 bp, Homo sapien
agctgcttcaattctgagtcctctg

SEQ ID NO: 208724 - DNA, 25 bp, Homo sapien
ttctgagtcctctggacttcccctg

SEQ ID NO: 208725 - DNA, 25 bp, Homo sapien
atgtatgttgtgagtttaaggagcc

SEQ ID NO: 208726 - DNA, 25 bp, Homo sapien
gtttaaggagcctgtaattgtcagt

SEQ ID NO: 208727 - DNA, 25 bp, Homo sapien
agttttacaaaaccatctgtgttca

SEQ ID NO: 208728 - DNA, 25 bp, Homo sapien
aaacatcatttcaaaggctgcctac

SEQ ID NO: 208729 - DNA, 25 bp, Homo sapien
ggctgcctacagaatattatcactt

SEQ ID NO: 208730 - DNA, 25 bp, Homo sapien
gttaataaattaccaatcaggcaca

SEQ ID NO: 208731 - DNA, 25 bp, Homo sapien
taccaatcaggcacattttataatg

SEQ ID NO: 208732 - DNA, 25 bp, Homo sapien
ataatgtttgtctctgtaaaggtaa

SEQ ID NO: 208733 - DNA, 25 bp, Homo sapien
ttagcagttaaagaacacggatgag

SEQ ID NO: 208734 - DNA, 25 bp, Homo sapien
gaatgtgttacataggttgcatcac

SEQ ID NO: 208735 - DNA, 25 bp, Homo sapien
ataggttgcatcacttgcagttaaa

SEQ ID NO: 208736 - DNA, 25 bp, Homo sapien
gcagtccctccggagaggatctgga

SEQ ID NO: 208737 - DNA, 25 bp, Homo sapien
cagtccctccggagaggatctggac

SEQ ID NO: 208738 - DNA, 25 bp, Homo sapien
agtccctccggagaggatctggact

SEQ ID NO: 208739 - DNA, 25 bp, Homo sapien
gtccctccggagaggatctggactg

SEQ ID NO: 208740 - DNA, 25 bp, Homo sapien
tccctccggagaggatctggactgg

SEQ ID NO: 208741 - DNA, 25 bp, Homo sapien
ccctccggagaggatctggactggc

SEQ ID NO: 208742 - DNA, 25 bp, Homo sapien
cctccggagaggatctggactggct

SEQ ID NO: 208743 - DNA, 25 bp, Homo sapien
ctccggagaggatctggactggctg

SEQ ID NO: 208744 - DNA, 25 bp, Homo sapien
tccggagaggatctggactggctgg

SEQ ID NO: 208745 - DNA, 25 bp, Homo sapien
cggagaggatctggactggctggga

SEQ ID NO: 208746 - DNA, 25 bp, Homo sapien
ggagaggatctggactggctgggag

SEQ ID NO: 208747 - DNA, 25 bp, Homo sapien
gcttttctaagcttaaatattgcat

SEQ ID NO: 208748 - DNA, 25 bp, Homo sapien
ttaaatattgcatagcttcgagctg

SEQ ID NO: 208749 - DNA, 25 bp, Homo sapien
ttgcatagcttcgagctgtatggac

SEQ ID NO: 208750 - DNA, 25 bp, Homo sapien
agcttcgagctgtatggactatatt

SEQ ID NO: 208751 - DNA, 25 bp, Homo sapien
cgagctgtatggactatattatgaa

SEQ ID NO: 208752 - DNA, 25 bp, Homo sapien
catacagtaatgcacagtccttaat

SEQ ID NO: 208753 - DNA, 25 bp, Homo sapien
gtaatgcacagtccttaatttgtgt

SEQ ID NO: 208754 - DNA, 25 bp, Homo sapien
cagtccttaatttgtgtataatgga

SEQ ID NO: 208755 - DNA, 25 bp, Homo sapien
aaagaagcgtattactgggtatagt

SEQ ID NO: 208756 - DNA, 25 bp, Homo sapien
tgggtatagtatgtgactcctcttc

SEQ ID NO: 208757 - DNA, 25 bp, Homo sapien
ctcctcttctcagactaataaatta

SEQ ID NO: 208758 - DNA, 25 bp, Homo sapien
gggaatctatacattataagggact

SEQ ID NO: 208759 - DNA, 25 bp, Homo sapien
atctatacattataagggacttaac

SEQ ID NO: 208760 - DNA, 25 bp, Homo sapien
ggacttaacaactaaagggcaacat

SEQ ID NO: 208761 - DNA, 25 bp, Homo sapien
gggcaacatatagactttagatcct

SEQ ID NO: 208762 - DNA, 25 bp, Homo sapien
gcaacatatagactttagatcctaa

SEQ ID NO: 208763 - DNA, 25 bp, Homo sapien
agactttagatcctaatttgagcaa

SEQ ID NO: 208764 - DNA, 25 bp, Homo sapien
gatcctaatttgagcaaaatctaaa

SEQ ID NO: 208765 - DNA, 25 bp, Homo sapien
aaatcaattattaggcaatcagaaa

SEQ ID NO: 208766 - DNA, 25 bp, Homo sapien
ggtactatattattgaagattccat

SEQ ID NO: 208767 - DNA, 25 bp, Homo sapien
gaagattccatggttatgtttttta

SEQ ID NO: 208768 - DNA, 25 bp, Homo sapien
agagttcatgccttttagagataca

SEQ ID NO: 208769 - DNA, 25 bp, Homo sapien
tgctcacatcacagctgtctgaaga

SEQ ID NO: 208770 - DNA, 25 bp, Homo sapien
aacagtgaggtggagtgcctagaac

SEQ ID NO: 208771 - DNA, 25 bp, Homo sapien
agtgcctagaactcccgtggtggtc

SEQ ID NO: 208772 - DNA, 25 bp, Homo sapien
tgcctgcctgaaggtctcccatgaa

SEQ ID NO: 208773 - DNA, 25 bp, Homo sapien
aggtctcccatgaaaacactgctga

SEQ ID NO: 208774 - DNA, 25 bp, Homo sapien
cactgctgaactgtgttgacactca

SEQ ID NO: 208775 - DNA, 25 bp, Homo sapien
gtgttgacactcatgaccctttttt

SEQ ID NO: 208776 - DNA, 25 bp, Homo sapien
aagttcggtgttggagcgatactca

SEQ ID NO: 208777 - DNA, 25 bp, Homo sapien
gagcgatactcaatgtagtcagtct

SEQ ID NO: 208778 - DNA, 25 bp, Homo sapien
tagtcagtctacacctggacgtgtg

SEQ ID NO: 208779 - DNA, 25 bp, Homo sapien
acacctggacgtgtgggccacttaa

SEQ ID NO: 208780 - DNA, 25 bp, Homo sapien
tatttgaggatattaaggtactata

SEQ ID NO: 208781 - DNA, 25 bp, Homo sapien
aaggtactatattattgaagattcc

SEQ ID NO: 208782 - DNA, 25 bp, Homo sapien
ggtactatattattgaagattccat

SEQ ID NO: 208783 - DNA, 25 bp, Homo sapien
gtactatattattgaagattccatg

SEQ ID NO: 208784 - DNA, 25 bp, Homo sapien
ctatattattgaagattccatggtt

SEQ ID NO: 208785 - DNA, 25 bp, Homo sapien
attattgaagattccatggttatgt

SEQ ID NO: 208786 - DNA, 25 bp, Homo sapien
ttattgaagattccatggttatgtt

SEQ ID NO: 208787 - DNA, 25 bp, Homo sapien
attgaagattccatggttatgtttt

SEQ ID NO: 208788 - DNA, 25 bp, Homo sapien
ttgaagattccatggttatgttttt

SEQ ID NO: 208789 - DNA, 25 bp, Homo sapien
tgaagattccatggttatgtttttt

SEQ ID NO: 208790 - DNA, 25 bp, Homo sapien
gaagattccatggttatgtttttta

SEQ ID NO: 208791 - DNA, 25 bp, Homo sapien
acacattaaaaggtatgcattagca

SEQ ID NO: 208792 - DNA, 25 bp, Homo sapien
atgcattagcagcatattagtatgc

SEQ ID NO: 208793 - DNA, 25 bp, Homo sapien
tacattaggtacgatgtgtagttcg

SEQ ID NO: 208794 - DNA, 25 bp, Homo sapien
gtgtagttcggtagagtcccaaaat

SEQ ID NO: 208795 - DNA, 25 bp, Homo sapien
ttttgtactactttcaatttggtga

SEQ ID NO: 208796 - DNA, 25 bp, Homo sapien
ttaagttgtctaccatgttttcttt

SEQ ID NO: 208797 - DNA, 25 bp, Homo sapien
tcttttctagctgaataaaccacat

SEQ ID NO: 208798 - DNA, 25 bp, Homo sapien
aggaaagggaccacagtatttgaat

SEQ ID NO: 208799 - DNA, 25 bp, Homo sapien
ggaccacagtatttgaatgtttgaa

SEQ ID NO: 208800 - DNA, 25 bp, Homo sapien
tgaaagtctgtaaagcttaaggttt

SEQ ID NO: 208801 - DNA, 25 bp, Homo sapien
tttaaaaatgttgcccgtaatgttg

SEQ ID NO: 208802 - DNA, 25 bp, Homo sapien
aaagccacggaatgtgtgtgaagcc

SEQ ID NO: 208803 - DNA, 25 bp, Homo sapien
agccacggaatgtgtgtgaagccca

SEQ ID NO: 208804 - DNA, 25 bp, Homo sapien
ccacggaatgtgtgtgaagcccaga

SEQ ID NO: 208805 - DNA, 25 bp, Homo sapien
acggaatgtgtgtgaagcccagaaa

SEQ ID NO: 208806 - DNA, 25 bp, Homo sapien
ttttcagttatgtctttggtatcag

SEQ ID NO: 208807 - DNA, 25 bp, Homo sapien
ttcagttatgtctttggtatcagac

SEQ ID NO: 208808 - DNA, 25 bp, Homo sapien
gtctttggtatcagacatacgaaag

SEQ ID NO: 208809 - DNA, 25 bp, Homo sapien
gtatcagacatacgaaaggtctctt

SEQ ID NO: 208810 - DNA, 25 bp, Homo sapien
gtctctttgtagttcgtgttaatgt

SEQ ID NO: 208811 - DNA, 25 bp, Homo sapien
ctctttgtagttcgtgttaatgtaa

SEQ ID NO: 208812 - DNA, 25 bp, Homo sapien
gtagttcgtgttaatgtaacattaa

SEQ ID NO: 208813 - DNA, 25 bp, Homo sapien
ggaacatggatagcattagcactaa

SEQ ID NO: 208814 - DNA, 25 bp, Homo sapien
acacacttgaagttctcagaatact

SEQ ID NO: 208815 - DNA, 25 bp, Homo sapien
ttgaaaactcaaacaactgctctgt

SEQ ID NO: 208816 - DNA, 25 bp, Homo sapien
actgctctgttgaagtcttcttttg

SEQ ID NO: 208817 - DNA, 25 bp, Homo sapien
gagatgcctatgttagctgacgaca

SEQ ID NO: 208818 - DNA, 25 bp, Homo sapien
gacgacattcactttaagggcttct

SEQ ID NO: 208819 - DNA, 25 bp, Homo sapien
agggcttcttcactggattcttccc

SEQ ID NO: 208820 - DNA, 25 bp, Homo sapien
ttccctctcctgtttataatgcagc

SEQ ID NO: 208821 - DNA, 25 bp, Homo sapien
gattatctgttaaatgctgacttct

SEQ ID NO: 208822 - DNA, 25 bp, Homo sapien
gctgacttctttcccctgctgtgtg

SEQ ID NO: 208823 - DNA, 25 bp, Homo sapien
gtgtgtcttcatgtaacagtttctc

SEQ ID NO: 208824 - DNA, 25 bp, Homo sapien
atgtcctgcctaggccctcagagga

SEQ ID NO: 208825 - DNA, 25 bp, Homo sapien
gggatcatgtctccaggtaacccga

SEQ ID NO: 208826 - DNA, 25 bp, Homo sapien
aggtaacccgactgtagcccctgct

SEQ ID NO: 208827 - DNA, 25 bp, Homo sapien
cagcctgtgcccactgataatagca

SEQ ID NO: 208828 - DNA, 25 bp, Homo sapien
actgataatagcagggacggccttt

SEQ ID NO: 208829 - DNA, 25 bp, Homo sapien
gagcagctgataagtttccctacct

SEQ ID NO: 208830 - DNA, 25 bp, Homo sapien
tgataagtttccctacctgatggcc

SEQ ID NO: 208831 - DNA, 25 bp, Homo sapien
ctctgacataaactgcacacctggg

SEQ ID NO: 208832 - DNA, 25 bp, Homo sapien
taagagggccaaccttagggcacgt

SEQ ID NO: 208833 - DNA, 25 bp, Homo sapien
caaccttagggcacgtgggcattat

SEQ ID NO: 208834 - DNA, 25 bp, Homo sapien
ggcacgtgggcattattaaaggtct

SEQ ID NO: 208835 - DNA, 25 bp, Homo sapien
tggcctgtcaaccactttcggagaa

SEQ ID NO: 208836 - DNA, 25 bp, Homo sapien
aaccactttcggagaatgagccagg

SEQ ID NO: 208837 - DNA, 25 bp, Homo sapien
cggagaatgagccaggtcagtcact

SEQ ID NO: 208838 - DNA, 25 bp, Homo sapien
ctgggaggacctgtgaaagaaagtt

SEQ ID NO: 208839 - DNA, 25 bp, Homo sapien
aaagttggtcactgagtgccttggg

SEQ ID NO: 208840 - DNA, 25 bp, Homo sapien
gggactggcaaaacattccagaatg

SEQ ID NO: 208841 - DNA, 25 bp, Homo sapien
ttcttcccttctccacctagtgaag

SEQ ID NO: 208842 - DNA, 25 bp, Homo sapien
acaagtccattctgccttcaaagtg

SEQ ID NO: 208843 - DNA, 25 bp, Homo sapien
gtccattctgccttcaaagtgtaag

SEQ ID NO: 208844 - DNA, 25 bp, Homo sapien
caaagtgtaagttctcatgtcatta

SEQ ID NO: 208845 - DNA, 25 bp, Homo sapien
agttctcatgtcattatggatttgg

SEQ ID NO: 208846 - DNA, 25 bp, Homo sapien
gttggagttttcttctaataccgag

SEQ ID NO: 208847 - DNA, 25 bp, Homo sapien
tttcttctaataccgagggttcctg

SEQ ID NO: 208848 - DNA, 25 bp, Homo sapien
gaggaaacagccacatgttcgtcat

SEQ ID NO: 208849 - DNA, 25 bp, Homo sapien
catgttcgtcatgattgagctgtga

SEQ ID NO: 208850 - DNA, 25 bp, Homo sapien
agctgtgaagtcttcttggacctgt

SEQ ID NO: 208851 - DNA, 25 bp, Homo sapien
gtcttcttggacctgttgtctgaaa

SEQ ID NO: 208852 - DNA, 25 bp, Homo sapien
agttaatttgtttgaggcatctctc

SEQ ID NO: 208853 - DNA, 25 bp, Homo sapien
gaggcatctctcttaagtaggtgga

SEQ ID NO: 208854 - DNA, 25 bp, Homo sapien
gttcagctaacaatcacagcatagg

SEQ ID NO: 208855 - DNA, 25 bp, Homo sapien
cagcataggttctgatgcatggaaa

SEQ ID NO: 208856 - DNA, 25 bp, Homo sapien
gttgcgtagagccactactttcttt

SEQ ID NO: 208857 - DNA, 25 bp, Homo sapien
atctgcctagggtgtgctggtttgt

SEQ ID NO: 208858 - DNA, 25 bp, Homo sapien
agggtgtgctggtttgtccttttca

SEQ ID NO: 208859 - DNA, 25 bp, Homo sapien
gtgtgctggtttgtccttttcatac

SEQ ID NO: 208860 - DNA, 25 bp, Homo sapien
tttgtctcctaattgtgctacaatt

SEQ ID NO: 208861 - DNA, 25 bp, Homo sapien
gctacaattggaagaccttctttct

SEQ ID NO: 208862 - DNA, 25 bp, Homo sapien
ttggaagaccttctttcttttgatt

SEQ ID NO: 208863 - DNA, 25 bp, Homo sapien
ttcttttgattgtctcaagctgcca

SEQ ID NO: 208864 - DNA, 25 bp, Homo sapien
ttttgattgtctcaagctgccaccc

SEQ ID NO: 208865 - DNA, 25 bp, Homo sapien
ttgattgtctcaagctgccaccctt

SEQ ID NO: 208866 - DNA, 25 bp, Homo sapien
caagctgccacccttcaaggacagg

SEQ ID NO: 208867 - DNA, 25 bp, Homo sapien
aaaggtttgcagagaccactgcact

SEQ ID NO: 208868 - DNA, 25 bp, Homo sapien
aatttatctataagatggctgctaa

SEQ ID NO: 208869 - DNA, 25 bp, Homo sapien
aagatggctgctaaattgatttttc

SEQ ID NO: 208870 - DNA, 25 bp, Homo sapien
gatggctgctaaattgatttttcag

SEQ ID NO: 208871 - DNA, 25 bp, Homo sapien
ggctgctaaattgatttttcagttc

SEQ ID NO: 208872 - DNA, 25 bp, Homo sapien
atatgaagaacagtagtttgctttg

SEQ ID NO: 208873 - DNA, 25 bp, Homo sapien
gaatgttcaatgttttaaatggcga

SEQ ID NO: 208874 - DNA, 25 bp, Homo sapien
tgttcaatgttttaaatggcgatta

SEQ ID NO: 208875 - DNA, 25 bp, Homo sapien
aaaatactctgctgtatatagtagt

SEQ ID NO: 208876 - DNA, 25 bp, Homo sapien
aatactctgctgtatatagtagttt

SEQ ID NO: 208877 - DNA, 25 bp, Homo sapien
ctctgctgtatatagtagtttttga

SEQ ID NO: 208878 - DNA, 25 bp, Homo sapien
gctgtatatagtagtttttgagtaa

SEQ ID NO: 208879 - DNA, 25 bp, Homo sapien
gaggctgctcttctgattctgagag

SEQ ID NO: 208880 - DNA, 25 bp, Homo sapien
ttctgattctgagagctggcctagt

SEQ ID NO: 208881 - DNA, 25 bp, Homo sapien
attctgagagctggcctagtggtgc

SEQ ID NO: 208882 - DNA, 25 bp, Homo sapien
acctgctgagttgccactcgcagtg

SEQ ID NO: 208883 - DNA, 25 bp, Homo sapien
agttgccactcgcagtgttgtcagt

SEQ ID NO: 208884 - DNA, 25 bp, Homo sapien
tcgcagtgttgtcagttcccgtgtt

SEQ ID NO: 208885 - DNA, 25 bp, Homo sapien
ttgtcagttcccgtgttctgagaag

SEQ ID NO: 208886 - DNA, 25 bp, Homo sapien
gttcccgtgttctgagaagaggtca

SEQ ID NO: 208887 - DNA, 25 bp, Homo sapien
cgtgttctgagaagaggtcatgcct

SEQ ID NO: 208888 - DNA, 25 bp, Homo sapien
ccctgcaggtgctgtgtggccgtga

SEQ ID NO: 208889 - DNA, 25 bp, Homo sapien
gtgtggccgtgatgtgcagagagca

SEQ ID NO: 208890 - DNA, 25 bp, Homo sapien
tgactgtctactagcaggccagatg

SEQ ID NO: 208891 - DNA, 25 bp, Homo sapien
gccagatgctgtgtttggctctgaa

SEQ ID NO: 208892 - DNA, 25 bp, Homo sapien
tggctctgaattcccaactagcaag

SEQ ID NO: 208893 - DNA, 25 bp, Homo sapien
gagaatctacattatggctgatcca

SEQ ID NO: 208894 - DNA, 25 bp, Homo sapien
gatccataagccaccaattcagcta

SEQ ID NO: 208895 - DNA, 25 bp, Homo sapien
gatgtttctaatctgggcttccact

SEQ ID NO: 208896 - DNA, 25 bp, Homo sapien
tgaaaagagcctacccttcttgatc

SEQ ID NO: 208897 - DNA, 25 bp, Homo sapien
tacccttcttgatcagagccatacc

SEQ ID NO: 208898 - DNA, 25 bp, Homo sapien
atacccctcttcaccaatgggaagt

SEQ ID NO: 208899 - DNA, 25 bp, Homo sapien
tgggaagtcaagacacctatgggta

SEQ ID NO: 208900 - DNA, 25 bp, Homo sapien
acctatgggtaaaagttctctctga

SEQ ID NO: 208901 - DNA, 25 bp, Homo sapien
gatctggggacgggtatggtggctc

SEQ ID NO: 208902 - DNA, 25 bp, Homo sapien
aacacgctgagaccctatccctaaa

SEQ ID NO: 208903 - DNA, 25 bp, Homo sapien
cacgctgagaccctatccctaaaaa

SEQ ID NO: 208904 - DNA, 25 bp, Homo sapien
acgctgagaccctatccctaaaaat

SEQ ID NO: 208905 - DNA, 25 bp, Homo sapien
cgctgagaccctatccctaaaaata

SEQ ID NO: 208906 - DNA, 25 bp, Homo sapien
gagaccctatccctaaaaataatat

SEQ ID NO: 208907 - DNA, 25 bp, Homo sapien
aaataggcatggtggcaagtacctg

SEQ ID NO: 208908 - DNA, 25 bp, Homo sapien
aggctgaggcaagaaaactgagtga

SEQ ID NO: 208909 - DNA, 25 bp, Homo sapien
gcaagaaaactgagtgagcctggga

SEQ ID NO: 208910 - DNA, 25 bp, Homo sapien
gaaaactgagtgagcctgggagttc

SEQ ID NO: 208911 - DNA, 25 bp, Homo sapien
ggaaagttacaaaagaaggatctgg

SEQ ID NO: 208912 - DNA, 25 bp, Homo sapien
tgccctgctgtctacatttttctat

SEQ ID NO: 208913 - DNA, 25 bp, Homo sapien
atttttctatggagcttgtcataat

SEQ ID NO: 208914 - DNA, 25 bp, Homo sapien
atagcagatattacctgatcaggaa

SEQ ID NO: 208915 - DNA, 25 bp, Homo sapien
tacctgatcaggaatccctgtggcg

SEQ ID NO: 208916 - DNA, 25 bp, Homo sapien
aggaatccctgtggcgcgtctgacg

SEQ ID NO: 208917 - DNA, 25 bp, Homo sapien
gcgtctgacgctcatgagtttttca

SEQ ID NO: 208918 - DNA, 25 bp, Homo sapien
tgatgagtagcactgcactgtcacc

SEQ ID NO: 208919 - DNA, 25 bp, Homo sapien
tctcctgggagatatgctgcttttc

SEQ ID NO: 208920 - DNA, 25 bp, Homo sapien
ctgggagatatgctgcttttccacc

SEQ ID NO: 208921 - DNA, 25 bp, Homo sapien
caccagacttgctccatactagaag

SEQ ID NO: 208922 - DNA, 25 bp, Homo sapien
ttgctccatactagaagcttctttt

SEQ ID NO: 208923 - DNA, 25 bp, Homo sapien
atttccagatgcttttgtagatgac

SEQ ID NO: 208924 - DNA, 25 bp, Homo sapien
ttgtgagccacatattgggagttct

SEQ ID NO: 208925 - DNA, 25 bp, Homo sapien
tctagatttgagtgaatggcaggaa

SEQ ID NO: 208926 - DNA, 25 bp, Homo sapien
aggaaagggccatctccattgagat

SEQ ID NO: 208927 - DNA, 25 bp, Homo sapien
gattaagtgaaccaaactagttctc

SEQ ID NO: 208928 - DNA, 25 bp, Homo sapien
aactagttctcagaattctacagag

SEQ ID NO: 208929 - DNA, 25 bp, Homo sapien
gaatcagactgaggaagctgtgaca

SEQ ID NO: 208930 - DNA, 25 bp, Homo sapien
gctgtgacataggacttgaagacca

SEQ ID NO: 208931 - DNA, 25 bp, Homo sapien
ctttgaaatttgcgagctgctcatg

SEQ ID NO: 208932 - DNA, 25 bp, Homo sapien
gagttattatcactgctgtctttct

SEQ ID NO: 208933 - DNA, 25 bp, Homo sapien
cactgctgtctttctattgagttac

SEQ ID NO: 208934 - DNA, 25 bp, Homo sapien
cctgggggactcagtccagttcaga

SEQ ID NO: 208935 - DNA, 25 bp, Homo sapien
agagagctggaggaagttgctatta

SEQ ID NO: 208936 - DNA, 25 bp, Homo sapien
gttgctattaaatttgctcgcctgg

SEQ ID NO: 208937 - DNA, 25 bp, Homo sapien
gctattaaatttgctcgcctggtca

SEQ ID NO: 208938 - DNA, 25 bp, Homo sapien
attaaatttgctcgcctggtcaact

SEQ ID NO: 208939 - DNA, 25 bp, Homo sapien
aatttgctcgcctggtcaactataa

SEQ ID NO: 208940 - DNA, 25 bp, Homo sapien
ttgctcgcctggtcaactataacaa

SEQ ID NO: 208941 - DNA, 25 bp, Homo sapien
gctcgcctggtcaactataacaaga

SEQ ID NO: 208942 - DNA, 25 bp, Homo sapien
gcctggtcaactataacaagatggt

SEQ ID NO: 208943 - DNA, 25 bp, Homo sapien
ttctgtccctactacgatgcaatcc

SEQ ID NO: 208944 - DNA, 25 bp, Homo sapien
gtccctactacgatgcaatcctgag

SEQ ID NO: 208945 - DNA, 25 bp, Homo sapien
aactggaagatctgtccgtgacata

SEQ ID NO: 208946 - DNA, 25 bp, Homo sapien
gatctgtccgtgacataaggaaatc

SEQ ID NO: 208947 - DNA, 25 bp, Homo sapien
aaatgatgcacgagaaaaccaaaca

SEQ ID NO: 208948 - DNA, 25 bp, Homo sapien
ccaccaccacttacgattttgattg

SEQ ID NO: 208949 - DNA, 25 bp, Homo sapien
ccacttacgattttgattgtgataa

SEQ ID NO: 208950 - DNA, 25 bp, Homo sapien
gtaataagcacagtgagtcaccagg

SEQ ID NO: 208951 - DNA, 25 bp, Homo sapien
gagtcaccaggagctacagaattaa

SEQ ID NO: 208952 - DNA, 25 bp, Homo sapien
aacatgtgccacagtaattgccaaa

SEQ ID NO: 208953 - DNA, 25 bp, Homo sapien
tgtgccacagtaattgccaaaataa

SEQ ID NO: 208954 - DNA, 25 bp, Homo sapien
accaacattaaggttcccagatgac

SEQ ID NO: 208955 - DNA, 25 bp, Homo sapien
tcccagatgaccaagtaaataatac

SEQ ID NO: 208956 - DNA, 25 bp, Homo sapien
agctgtacaaatgctttcttctgtt

SEQ ID NO: 208957 - DNA, 25 bp, Homo sapien
aatgctttcttctgttcgactcaat

SEQ ID NO: 208958 - DNA, 25 bp, Homo sapien
gggcttgttatctaaagcaaagcaa

SEQ ID NO: 208959 - DNA, 25 bp, Homo sapien
gcaactttttacagatgtggcaact

SEQ ID NO: 208960 - DNA, 25 bp, Homo sapien
aacagctatggacaccttagtgaca

SEQ ID NO: 208961 - DNA, 25 bp, Homo sapien
gacaccttagtgacagagctccaag

SEQ ID NO: 208962 - DNA, 25 bp, Homo sapien
gagctccaagacctaagcaaccagt

SEQ ID NO: 208963 - DNA, 25 bp, Homo sapien
ctaagcaaccagtttcgaaatcagt

SEQ ID NO: 208964 - DNA, 25 bp, Homo sapien
gcagattctggaaaaggtgctttca

SEQ ID NO: 208965 - DNA, 25 bp, Homo sapien
aggtgctttcacctgctggtaaaag

SEQ ID NO: 208966 - DNA, 25 bp, Homo sapien
cctgctggtaaaaggttacatctgt

SEQ ID NO: 208967 - DNA, 25 bp, Homo sapien
aatggaagtcccctggcatggtcag

SEQ ID NO: 208968 - DNA, 25 bp, Homo sapien
aggcccaaggctcaagtgtgcacag

SEQ ID NO: 208969 - DNA, 25 bp, Homo sapien
agacccctgtgttctgtgggtgaac

SEQ ID NO: 208970 - DNA, 25 bp, Homo sapien
aactgcccactaaccagactggaaa

SEQ ID NO: 208971 - DNA, 25 bp, Homo sapien
ttccatgaatgcttcatcccagagg

SEQ ID NO: 208972 - DNA, 25 bp, Homo sapien
agggcctccctgtgcaagggatcaa

SEQ ID NO: 208973 - DNA, 25 bp, Homo sapien
gatcaagcatgtctggcctgggttt

SEQ ID NO: 208974 - DNA, 25 bp, Homo sapien
aaagagggatcctcatgacctggtg

SEQ ID NO: 208975 - DNA, 25 bp, Homo sapien
cctggtggtctatggcctgggtcaa

SEQ ID NO: 208976 - DNA, 25 bp, Homo sapien
agatgagggtctttcagtgttcctg

SEQ ID NO: 208977 - DNA, 25 bp, Homo sapien
agtgttcctgtttacaacatgtcaa

SEQ ID NO: 208978 - DNA, 25 bp, Homo sapien
tttgtccaacagatcataatatatc

SEQ ID NO: 208979 - DNA, 25 bp, Homo sapien
aatatatctgctatccaactggttt

SEQ ID NO: 208980 - DNA, 25 bp, Homo sapien
atccaactggttttacctgcctaat

SEQ ID NO: 208981 - DNA, 25 bp, Homo sapien
ttacctgcctaatcctactgatttg

SEQ ID NO: 208982 - DNA, 25 bp, Homo sapien
aatcctactgatttgggcactgctt

SEQ ID NO: 208983 - DNA, 25 bp, Homo sapien
gggcactgcttgtatagtctctcaa

SEQ ID NO: 208984 - DNA, 25 bp, Homo sapien
gtatagtctctcaagttcacaggaa

SEQ ID NO: 208985 - DNA, 25 bp, Homo sapien
gtctctcaagttcacaggaaatgtt

SEQ ID NO: 208986 - DNA, 25 bp, Homo sapien
ttctaaggtcctcatttttacagag

SEQ ID NO: 208987 - DNA, 25 bp, Homo sapien
tacagagtatacaggcaaagtgaca

SEQ ID NO: 208988 - DNA, 25 bp, Homo sapien
atattgaggctaaaaccacaaagtg

SEQ ID NO: 208989 - DNA, 25 bp, Homo sapien
acttccttcttacctgtgccaacag

SEQ ID NO: 208990 - DNA, 25 bp, Homo sapien
tgtgccaacagacctatttcactgc

SEQ ID NO: 208991 - DNA, 25 bp, Homo sapien
agacctatttcactgcctcagcgta

SEQ ID NO: 208992 - DNA, 25 bp, Homo sapien
tcagcgtacaccagacccttcagaa

SEQ ID NO: 208993 - DNA, 25 bp, Homo sapien
gacccttcagaaacctctctggtgt

SEQ ID NO: 208994 - DNA, 25 bp, Homo sapien
ggtgtcacccagatagattgtgctt

SEQ ID NO: 208995 - DNA, 25 bp, Homo sapien
gtgcttactgagacaaatgaacgtt

SEQ ID NO: 208996 - DNA, 25 bp, Homo sapien
gagacaaatgaacgtttacttgatt

SEQ ID NO: 208997 - DNA, 25 bp, Homo sapien
atgatgtcaggttaggtcaaagcca

SEQ ID NO: 208998 - DNA, 25 bp, Homo sapien
aagccctaaatgaactgttaactat

SEQ ID NO: 208999 - DNA, 25 bp, Homo sapien
taactatttgatctttggatgtaaa

SEQ ID NO: 209000 - DNA, 25 bp, Homo sapien
atgaagaagactccggaggagccca

SEQ ID NO: 209001 - DNA, 25 bp, Homo sapien
gtgtgagcaccacaggcaccctgga

SEQ ID NO: 209002 - DNA, 25 bp, Homo sapien
cacagtagtgaaggcggtctcctgg

SEQ ID NO: 209003 - DNA, 25 bp, Homo sapien
gaaggcggtctcctggaccccagaa

SEQ ID NO: 209004 - DNA, 25 bp, Homo sapien
tcctggaccccagaagcgtgctgtg

SEQ ID NO: 209005 - DNA, 25 bp, Homo sapien
agaagcgtgctgtggtgtggactgg

SEQ ID NO: 209006 - DNA, 25 bp, Homo sapien
tgtggactgggtgctacttatagac

SEQ ID NO: 209007 - DNA, 25 bp, Homo sapien
ctgggtgctacttatagacccaatc

SEQ ID NO: 209008 - DNA, 25 bp, Homo sapien
agacccaatcagaatacggtggttg

SEQ ID NO: 209009 - DNA, 25 bp, Homo sapien
gttgagaaggaaccagtgtttacaa

SEQ ID NO: 209010 - DNA, 25 bp, Homo sapien
ggaaccagtgtttacaagtaatatc

SEQ ID NO: 209011 - DNA, 25 bp, Homo sapien
taataaaggctcatttaacccccag

SEQ ID NO: 209012 - DNA, 25 bp, Homo sapien
tgtgaatatcctcagtctgtaggaa

SEQ ID NO: 209013 - DNA, 25 bp, Homo sapien
aatatcctcagtctgtaggaaactt

SEQ ID NO: 209014 - DNA, 25 bp, Homo sapien
ttttttgacacagcatagaagacct

SEQ ID NO: 209015 - DNA, 25 bp, Homo sapien
gacacagcatagaagacctagtttt

SEQ ID NO: 209016 - DNA, 25 bp, Homo sapien
tagaagacctagttttggaaaacat

SEQ ID NO: 209017 - DNA, 25 bp, Homo sapien
tttttgtgcataacttggatgggct

SEQ ID NO: 209018 - DNA, 25 bp, Homo sapien
tgcataacttggatgggctgaagga

SEQ ID NO: 209019 - DNA, 25 bp, Homo sapien
gggaagggtggctttcattccaaga

SEQ ID NO: 209020 - DNA, 25 bp, Homo sapien
gaagggtggctttcattccaagatc

SEQ ID NO: 209021 - DNA, 25 bp, Homo sapien
gggtggctttcattccaagatccag

SEQ ID NO: 209022 - DNA, 25 bp, Homo sapien
agtgaacgtctgaccgggcgcggtg

SEQ ID NO: 209023 - DNA, 25 bp, Homo sapien
ccagcacttaaggagtacgagacgg

SEQ ID NO: 209024 - DNA, 25 bp, Homo sapien
cagcacttaaggagtacgagacggg

SEQ ID NO: 209025 - DNA, 25 bp, Homo sapien
agcacttaaggagtacgagacggga

SEQ ID NO: 209026 - DNA, 25 bp, Homo sapien
ttaaggagtacgagacgggaggatc

SEQ ID NO: 209027 - DNA, 25 bp, Homo sapien
tcaagagatcgacagcatgctggcc

SEQ ID NO: 209028 - DNA, 25 bp, Homo sapien
gagatcgacagcatgctggccaacg

SEQ ID NO: 209029 - DNA, 25 bp, Homo sapien
agatcgacagcatgctggccaacgt

SEQ ID NO: 209030 - DNA, 25 bp, Homo sapien
gatcgacagcatgctggccaacgtg

SEQ ID NO: 209031 - DNA, 25 bp, Homo sapien
atcgacagcatgctggccaacgtgg

SEQ ID NO: 209032 - DNA, 25 bp, Homo sapien
tcgacagcatgctggccaacgtggt

SEQ ID NO: 209033 - DNA, 25 bp, Homo sapien
aagccccggagccatccttagggct

SEQ ID NO: 209034 - DNA, 25 bp, Homo sapien
cggagccatccttagggctgcaggc

SEQ ID NO: 209035 - DNA, 25 bp, Homo sapien
tcaagcagggcccatgttttgtaag

SEQ ID NO: 209036 - DNA, 25 bp, Homo sapien
aagcagggcccatgttttgtaagaa

SEQ ID NO: 209037 - DNA, 25 bp, Homo sapien
gcagggcccatgttttgtaagaatt

SEQ ID NO: 209038 - DNA, 25 bp, Homo sapien
tctttcttgattccagttgtaagcc

SEQ ID NO: 209039 - DNA, 25 bp, Homo sapien
gattccagttgtaagccatttcagt

SEQ ID NO: 209040 - DNA, 25 bp, Homo sapien
ttccagttgtaagccatttcagtta

SEQ ID NO: 209041 - DNA, 25 bp, Homo sapien
agttgtaagccatttcagttactat

SEQ ID NO: 209042 - DNA, 25 bp, Homo sapien
gtaagccatttcagttactataact

SEQ ID NO: 209043 - DNA, 25 bp, Homo sapien
aaaataggcttttgactgggcatgg

SEQ ID NO: 209044 - DNA, 25 bp, Homo sapien
tttatttgctgtttactacttatac

SEQ ID NO: 209045 - DNA, 25 bp, Homo sapien
gtttactacttatacatactactac

SEQ ID NO: 209046 - DNA, 25 bp, Homo sapien
atcatttttcacttacggtatttgt

SEQ ID NO: 209047 - DNA, 25 bp, Homo sapien
ctactacaaaaatcagctttccgag

SEQ ID NO: 209048 - DNA, 25 bp, Homo sapien
tacaaaaatcagctttccgagaaag

SEQ ID NO: 209049 - DNA, 25 bp, Homo sapien
aaacatttgtaagatacacggtatc

SEQ ID NO: 209050 - DNA, 25 bp, Homo sapien
gatacacggtatctatttggagcaa

SEQ ID NO: 209051 - DNA, 25 bp, Homo sapien
acacggtatctatttggagcaacgg

SEQ ID NO: 209052 - DNA, 25 bp, Homo sapien
gtatctatttggagcaacggttttt

SEQ ID NO: 209053 - DNA, 25 bp, Homo sapien
tctatttggagcaacggtttttgta

SEQ ID NO: 209054 - DNA, 25 bp, Homo sapien
gtttttgtaactaatgtgtttcatt

SEQ ID NO: 209055 - DNA, 25 bp, Homo sapien
agtacaaaaccatgcttagaagaaa

SEQ ID NO: 209056 - DNA, 25 bp, Homo sapien
gtacaaaaccatgcttagaagaaag

SEQ ID NO: 209057 - DNA, 25 bp, Homo sapien
aaaccatgcttagaagaaagaacaa

SEQ ID NO: 209058 - DNA, 25 bp, Homo sapien
aagaacaaagggaccgggcacagtg

SEQ ID NO: 209059 - DNA, 25 bp, Homo sapien
aggcatggtgatgcgcacccataat

SEQ ID NO: 209060 - DNA, 25 bp, Homo sapien
ggcatggtgatgcgcacccataatc

SEQ ID NO: 209061 - DNA, 25 bp, Homo sapien
catggtgatgcgcacccataatcca

SEQ ID NO: 209062 - DNA, 25 bp, Homo sapien
atggtgatgcgcacccataatccag

SEQ ID NO: 209063 - DNA, 25 bp, Homo sapien
tggtgatgcgcacccataatccagc

SEQ ID NO: 209064 - DNA, 25 bp, Homo sapien
gtgatgcgcacccataatccagcta

SEQ ID NO: 209065 - DNA, 25 bp, Homo sapien
atgcgcacccataatccagctactt

SEQ ID NO: 209066 - DNA, 25 bp, Homo sapien
aggcatggtgatgcgcacccataat

SEQ ID NO: 209067 - DNA, 25 bp, Homo sapien
ggcatggtgatgcgcacccataatc

SEQ ID NO: 209068 - DNA, 25 bp, Homo sapien
gcatggtgatgcgcacccataatcc

SEQ ID NO: 209069 - DNA, 25 bp, Homo sapien
catggtgatgcgcacccataatcca

SEQ ID NO: 209070 - DNA, 25 bp, Homo sapien
atggtgatgcgcacccataatccag

SEQ ID NO: 209071 - DNA, 25 bp, Homo sapien
tggtgatgcgcacccataatccagc

SEQ ID NO: 209072 - DNA, 25 bp, Homo sapien
ggtgatgcgcacccataatccagct

SEQ ID NO: 209073 - DNA, 25 bp, Homo sapien
gtgatgcgcacccataatccagcta

SEQ ID NO: 209074 - DNA, 25 bp, Homo sapien
ggagcttgccgaagccccggagcca

SEQ ID NO: 209075 - DNA, 25 bp, Homo sapien
cggagccatccttagggctgcaggc

SEQ ID NO: 209076 - DNA, 25 bp, Homo sapien
tcgcttgctccactttcagattcaa

SEQ ID NO: 209077 - DNA, 25 bp, Homo sapien
tcaagcagggcccatgttttgtaag

SEQ ID NO: 209078 - DNA, 25 bp, Homo sapien
gcagggcccatgttttgtaagaatt

SEQ ID NO: 209079 - DNA, 25 bp, Homo sapien
gcccatgttttgtaagaattttgtc

SEQ ID NO: 209080 - DNA, 25 bp, Homo sapien
tctttcttgattccagttgtaagcc

SEQ ID NO: 209081 - DNA, 25 bp, Homo sapien
gattccagttgtaagccatttcagt

SEQ ID NO: 209082 - DNA, 25 bp, Homo sapien
ttccagttgtaagccatttcagtta

SEQ ID NO: 209083 - DNA, 25 bp, Homo sapien
gtaagccatttcagttactataact

SEQ ID NO: 209084 - DNA, 25 bp, Homo sapien
aaaataggcttttgactgggcatgg

SEQ ID NO: 209085 - DNA, 25 bp, Homo sapien
agattttttgtatgttaccactaga

SEQ ID NO: 209086 - DNA, 25 bp, Homo sapien
ttaccactagatgtcagcataactt

SEQ ID NO: 209087 - DNA, 25 bp, Homo sapien
gcataacttttgttttacagctcag

SEQ ID NO: 209088 - DNA, 25 bp, Homo sapien
gttttacagctcagtggcattaggt

SEQ ID NO: 209089 - DNA, 25 bp, Homo sapien
cagctcagtggcattaggtatccat

SEQ ID NO: 209090 - DNA, 25 bp, Homo sapien
ggcattaggtatccattgtctgttt

SEQ ID NO: 209091 - DNA, 25 bp, Homo sapien
ttaggtatccattgtctgtttggat

SEQ ID NO: 209092 - DNA, 25 bp, Homo sapien
gtaaatcatcactgaatttcataac

SEQ ID NO: 209093 - DNA, 25 bp, Homo sapien
caagctgttatttttgtactgataa

SEQ ID NO: 209094 - DNA, 25 bp, Homo sapien
aaatccgatttctacaacactacag

SEQ ID NO: 209095 - DNA, 25 bp, Homo sapien
tttctacaacactacagagcactgt

SEQ ID NO: 209096 - DNA, 25 bp, Homo sapien
atagtttctcctgaacacctgcttt

SEQ ID NO: 209097 - DNA, 25 bp, Homo sapien
tatgtgccaggcagagactaccttt

SEQ ID NO: 209098 - DNA, 25 bp, Homo sapien
tgtgccaggcagagactacctttgt

SEQ ID NO: 209099 - DNA, 25 bp, Homo sapien
tgccaggcagagactacctttgtga

SEQ ID NO: 209100 - DNA, 25 bp, Homo sapien
ggcagagactacctttgtgaccagc

SEQ ID NO: 209101 - DNA, 25 bp, Homo sapien
gcagagactacctttgtgaccagct

SEQ ID NO: 209102 - DNA, 25 bp, Homo sapien
agagactacctttgtgaccagctcc

SEQ ID NO: 209103 - DNA, 25 bp, Homo sapien
tacctttgtgaccagctcccagtaa

SEQ ID NO: 209104 - DNA, 25 bp, Homo sapien
ctttgtgaccagctcccagtaaaaa

SEQ ID NO: 209105 - DNA, 25 bp, Homo sapien
gaccagctcccagtaaaaaccccag

SEQ ID NO: 209106 - DNA, 25 bp, Homo sapien
aaaaccccaggcactcagtctctaa

SEQ ID NO: 209107 - DNA, 25 bp, Homo sapien
atttctgtcttggttggaaatacca

SEQ ID NO: 209108 - DNA, 25 bp, Homo sapien
tttctgtcttggttggaaataccat

SEQ ID NO: 209109 - DNA, 25 bp, Homo sapien
ttctgtcttggttggaaataccatc

SEQ ID NO: 209110 - DNA, 25 bp, Homo sapien
tctgtcttggttggaaataccatca

SEQ ID NO: 209111 - DNA, 25 bp, Homo sapien
ctgtcttggttggaaataccatcag

SEQ ID NO: 209112 - DNA, 25 bp, Homo sapien
cccaggtctgtttcaggcatctgag

SEQ ID NO: 209113 - DNA, 25 bp, Homo sapien
ccaggtctgtttcaggcatctgagt

SEQ ID NO: 209114 - DNA, 25 bp, Homo sapien
caggtctgtttcaggcatctgagtc

SEQ ID NO: 209115 - DNA, 25 bp, Homo sapien
cacgccgggccccaaagtgaccaga

SEQ ID NO: 209116 - DNA, 25 bp, Homo sapien
cgccgggccccaaagtgaccagact

SEQ ID NO: 209117 - DNA, 25 bp, Homo sapien
aaagtgaccagactccagcacacct

SEQ ID NO: 209118 - DNA, 25 bp, Homo sapien
gggccatgcgtatgactggtgcagg

SEQ ID NO: 209119 - DNA, 25 bp, Homo sapien
atgactggtgcagggaggcaaggcc

SEQ ID NO: 209120 - DNA, 25 bp, Homo sapien
ggaggcaaggcccacattctccttc

SEQ ID NO: 209121 - DNA, 25 bp, Homo sapien
aaggcccacattctccttcagagac

SEQ ID NO: 209122 - DNA, 25 bp, Homo sapien
attctccttcagagacaggcactgg

SEQ ID NO: 209123 - DNA, 25 bp, Homo sapien
ttcagagacaggcactggcgccaga

SEQ ID NO: 209124 - DNA, 25 bp, Homo sapien
aggcactggcgccagaggcttcctt

SEQ ID NO: 209125 - DNA, 25 bp, Homo sapien
cactggcgccagaggcttccttggg

SEQ ID NO: 209126 - DNA, 25 bp, Homo sapien
cagcccctgaagacaagcagcactg

SEQ ID NO: 209127 - DNA, 25 bp, Homo sapien
gcccctgaagacaagcagcactgca

SEQ ID NO: 209128 - DNA, 25 bp, Homo sapien
atggaaacactgacccggtgcggtg

SEQ ID NO: 209129 - DNA, 25 bp, Homo sapien
atgctatttgtacattaccatgatt

SEQ ID NO: 209130 - DNA, 25 bp, Homo sapien
gtgatagtatctgcttcaagaccta

SEQ ID NO: 209131 - DNA, 25 bp, Homo sapien
gtatctgcttcaagacctatagaaa

SEQ ID NO: 209132 - DNA, 25 bp, Homo sapien
aaagtacattccagtttgatcccac

SEQ ID NO: 209133 - DNA, 25 bp, Homo sapien
ttccagtttgatcccactcaactat

SEQ ID NO: 209134 - DNA, 25 bp, Homo sapien
gatcccactcaactatgaaaacagg

SEQ ID NO: 209135 - DNA, 25 bp, Homo sapien
gaaaacaggacttttcaactgtatt

SEQ ID NO: 209136 - DNA, 25 bp, Homo sapien
atatttaaagcatagttgacctgaa

SEQ ID NO: 209137 - DNA, 25 bp, Homo sapien
tgacctgaaatgagagtagttgtta

SEQ ID NO: 209138 - DNA, 25 bp, Homo sapien
gtagttgttaaatcttcatatgttg

SEQ ID NO: 209139 - DNA, 25 bp, Homo sapien
tcatatgttgactaattgctaaaat

SEQ ID NO: 209140 - DNA, 25 bp, Homo sapien
tactgattaagtgaccaatatgttc

SEQ ID NO: 209141 - DNA, 25 bp, Homo sapien
tagaaatgttgcctctcagctgaga

SEQ ID NO: 209142 - DNA, 25 bp, Homo sapien
gacacatattaagctggttctactg

SEQ ID NO: 209143 - DNA, 25 bp, Homo sapien
taagctggttctactgtctgttttc

SEQ ID NO: 209144 - DNA, 25 bp, Homo sapien
gttctactgtctgttttccttaatg

SEQ ID NO: 209145 - DNA, 25 bp, Homo sapien
tgttttccttaatgatcgacctgcc

SEQ ID NO: 209146 - DNA, 25 bp, Homo sapien
aatgatcgacctgccctattttcta

SEQ ID NO: 209147 - DNA, 25 bp, Homo sapien
ctattttctatcctcactgcagtaa

SEQ ID NO: 209148 - DNA, 25 bp, Homo sapien
tctatcctcactgcagtaatgtgaa

SEQ ID NO: 209149 - DNA, 25 bp, Homo sapien
ggtcaataatgacccttttgagggt

SEQ ID NO: 209150 - DNA, 25 bp, Homo sapien
gagagatggtatacagcaggtaact

SEQ ID NO: 209151 - DNA, 25 bp, Homo sapien
aaggaaacaaccactcttttgaatg

SEQ ID NO: 209152 - DNA, 25 bp, Homo sapien
acaaccactcttttgaatgtacaat

SEQ ID NO: 209153 - DNA, 25 bp, Homo sapien
tcttgttttaactggtggtttccag

SEQ ID NO: 209154 - DNA, 25 bp, Homo sapien
tggtggtttccagtaggcaaaataa

SEQ ID NO: 209155 - DNA, 25 bp, Homo sapien
taaaatgacaggcatgctagttttt

SEQ ID NO: 209156 - DNA, 25 bp, Homo sapien
ggcagggtggcgcactactataatc

SEQ ID NO: 209157 - DNA, 25 bp, Homo sapien
agggtggcgcactactataatccca

SEQ ID NO: 209158 - DNA, 25 bp, Homo sapien
gaagtaggagggtcacttagcccaa

SEQ ID NO: 209159 - DNA, 25 bp, Homo sapien
gagggtcacttagcccaagagtgca

SEQ ID NO: 209160 - DNA, 25 bp, Homo sapien
ttagcccaagagtgcaaatctgcca

SEQ ID NO: 209161 - DNA, 25 bp, Homo sapien
gtgcaaatctgccagcctaggcaac

SEQ ID NO: 209162 - DNA, 25 bp, Homo sapien
ataccactatgtatatccagttaac

SEQ ID NO: 209163 - DNA, 25 bp, Homo sapien
ccactatgtatatccagttaactga

SEQ ID NO: 209164 - DNA, 25 bp, Homo sapien
tccagttaactgagagaattttgac

SEQ ID NO: 209165 - DNA, 25 bp, Homo sapien
tttgactctcttaataaaactgcat

SEQ ID NO: 209166 - DNA, 25 bp, Homo sapien
ttgtctaggcaactagtggttatac

SEQ ID NO: 209167 - DNA, 25 bp, Homo sapien
aggcaactagtggttatactctgca

SEQ ID NO: 209168 - DNA, 25 bp, Homo sapien
caactagtggttatactctgcaaat

SEQ ID NO: 209169 - DNA, 25 bp, Homo sapien
actagtggttatactctgcaaatat

SEQ ID NO: 209170 - DNA, 25 bp, Homo sapien
agtggttatactctgcaaatattgt

SEQ ID NO: 209171 - DNA, 25 bp, Homo sapien
ggttatactctgcaaatattgtaat

SEQ ID NO: 209172 - DNA, 25 bp, Homo sapien
tactctgcaaatattgtaatgaatt

SEQ ID NO: 209173 - DNA, 25 bp, Homo sapien
cagaggtctggtggaaagcaacttc

SEQ ID NO: 209174 - DNA, 25 bp, Homo sapien
acttcaggtttcatcttgctctatt

SEQ ID NO: 209175 - DNA, 25 bp, Homo sapien
atcttgctctattcctcaaaggtct

SEQ ID NO: 209176 - DNA, 25 bp, Homo sapien
aaaggtctggtctgtgggcctctga

SEQ ID NO: 209177 - DNA, 25 bp, Homo sapien
aacaggtctagccaagacagggaca

SEQ ID NO: 209178 - DNA, 25 bp, Homo sapien
ggcctgaactgagctaagcacctgc

SEQ ID NO: 209179 - DNA, 25 bp, Homo sapien
tccacacttccatctttcttttgtc

SEQ ID NO: 209180 - DNA, 25 bp, Homo sapien
ttttgtcttcatttcacctctgtgt

SEQ ID NO: 209181 - DNA, 25 bp, Homo sapien
cacctctgtgtttaaagcactgtgt

SEQ ID NO: 209182 - DNA, 25 bp, Homo sapien
gcactgtgtgacatagctccttaga

SEQ ID NO: 209183 - DNA, 25 bp, Homo sapien
gagatataacctattgtctgctcat

SEQ ID NO: 209184 - DNA, 25 bp, Homo sapien
ggcagggtggcgcactactataatc

SEQ ID NO: 209185 - DNA, 25 bp, Homo sapien
gcagggtggcgcactactataatcc

SEQ ID NO: 209186 - DNA, 25 bp, Homo sapien
cagggtggcgcactactataatccc

SEQ ID NO: 209187 - DNA, 25 bp, Homo sapien
agggtggcgcactactataatccca

SEQ ID NO: 209188 - DNA, 25 bp, Homo sapien
gaagtaggagggtcacttagcccaa

SEQ ID NO: 209189 - DNA, 25 bp, Homo sapien
gagggtcacttagcccaagagtgca

SEQ ID NO: 209190 - DNA, 25 bp, Homo sapien
ggtcacttagcccaagagtgcaaat

SEQ ID NO: 209191 - DNA, 25 bp, Homo sapien
gtcacttagcccaagagtgcaaatc

SEQ ID NO: 209192 - DNA, 25 bp, Homo sapien
acttagcccaagagtgcaaatctgc

SEQ ID NO: 209193 - DNA, 25 bp, Homo sapien
ttagcccaagagtgcaaatctgcca

SEQ ID NO: 209194 - DNA, 25 bp, Homo sapien
tagcccaagagtgcaaatctgccag

SEQ ID NO: 209195 - DNA, 25 bp, Homo sapien
aatttacttgcaatcttggtaagac

SEQ ID NO: 209196 - DNA, 25 bp, Homo sapien
cttggtaagactaaacttgcagtgt

SEQ ID NO: 209197 - DNA, 25 bp, Homo sapien
gactaaacttgcagtgtttttctaa

SEQ ID NO: 209198 - DNA, 25 bp, Homo sapien
tgtttacaccaaaattatcagaagt

SEQ ID NO: 209199 - DNA, 25 bp, Homo sapien
tcagaagtaggttgattagtcatta

SEQ ID NO: 209200 - DNA, 25 bp, Homo sapien
gattagtcattataacacttaccat

SEQ ID NO: 209201 - DNA, 25 bp, Homo sapien
ttataacacttaccatatgattcta

SEQ ID NO: 209202 - DNA, 25 bp, Homo sapien
gtcaattcagtagcatgtatatcaa

SEQ ID NO: 209203 - DNA, 25 bp, Homo sapien
agatagcttttggatgattgaggca

SEQ ID NO: 209204 - DNA, 25 bp, Homo sapien
gattgaggcatgcttatattatgaa

SEQ ID NO: 209205 - DNA, 25 bp, Homo sapien
gataaatactacatgttcagaataa

SEQ ID NO: 209206 - DNA, 25 bp, Homo sapien
agtgaacgtctgaccgggcgcggtg

SEQ ID NO: 209207 - DNA, 25 bp, Homo sapien
ccagcacttaaggagtacgagacgg

SEQ ID NO: 209208 - DNA, 25 bp, Homo sapien
cagcacttaaggagtacgagacggg

SEQ ID NO: 209209 - DNA, 25 bp, Homo sapien
agcacttaaggagtacgagacggga

SEQ ID NO: 209210 - DNA, 25 bp, Homo sapien
gcacttaaggagtacgagacgggag

SEQ ID NO: 209211 - DNA, 25 bp, Homo sapien
cacttaaggagtacgagacgggagg

SEQ ID NO: 209212 - DNA, 25 bp, Homo sapien
cttaaggagtacgagacgggaggat

SEQ ID NO: 209213 - DNA, 25 bp, Homo sapien
ttaaggagtacgagacgggaggatc

SEQ ID NO: 209214 - DNA, 25 bp, Homo sapien
ggatgatgtggcaggacactcacct

SEQ ID NO: 209215 - DNA, 25 bp, Homo sapien
acactcacctgggtgtcctggagct

SEQ ID NO: 209216 - DNA, 25 bp, Homo sapien
tgggaactgagggacgccacgtcct

SEQ ID NO: 209217 - DNA, 25 bp, Homo sapien
gtccttggccagcttaatggccttc

SEQ ID NO: 209218 - DNA, 25 bp, Homo sapien
tcggcctcgttaagcatccctgtga

SEQ ID NO: 209219 - DNA, 25 bp, Homo sapien
ttaagcatccctgtgacgctctcaa

SEQ ID NO: 209220 - DNA, 25 bp, Homo sapien
tgacgctctcaacttcattctaagg

SEQ ID NO: 209221 - DNA, 25 bp, Homo sapien
ttcattctaagggtgccaagagact

SEQ ID NO: 209222 - DNA, 25 bp, Homo sapien
ggatcctcgttgaaaggagcccttt

SEQ ID NO: 209223 - DNA, 25 bp, Homo sapien
ggagccctttttactcaaaacacat

SEQ ID NO: 209224 - DNA, 25 bp, Homo sapien
atgggctagtacttgaggtgttcac

SEQ ID NO: 209225 - DNA, 25 bp, Homo sapien
gatagcaactttccacacaggacgt

SEQ ID NO: 209226 - DNA, 25 bp, Homo sapien
tgaaaacagtaatgtggctacacag

SEQ ID NO: 209227 - DNA, 25 bp, Homo sapien
gcagcatattaagggtttctagtat

SEQ ID NO: 209228 - DNA, 25 bp, Homo sapien
gtttctagtatgctaatatcaccag

SEQ ID NO: 209229 - DNA, 25 bp, Homo sapien
tatcaccagcaatgatctttggctt

SEQ ID NO: 209230 - DNA, 25 bp, Homo sapien
tgatttatttgctagatgtttcccc

SEQ ID NO: 209231 - DNA, 25 bp, Homo sapien
cttggagttttgtcagtttcacact

SEQ ID NO: 209232 - DNA, 25 bp, Homo sapien
tttgctggcccaggtgtactgtttg

SEQ ID NO: 209233 - DNA, 25 bp, Homo sapien
tgtactgtttgtggcctttgttaat

SEQ ID NO: 209234 - DNA, 25 bp, Homo sapien
gtggcctttgttaatatcgcaaacc

SEQ ID NO: 209235 - DNA, 25 bp, Homo sapien
atcgcaaaccattggttgggagtca

SEQ ID NO: 209236 - DNA, 25 bp, Homo sapien
gcgtggtggtcctcagaggacaact

SEQ ID NO: 209237 - DNA, 25 bp, Homo sapien
gaggacaactcccagcctgacaagg

SEQ ID NO: 209238 - DNA, 25 bp, Homo sapien
agcctgacaaggagggctgcgtctc

SEQ ID NO: 209239 - DNA, 25 bp, Homo sapien
gagcctccgtattggcctcctctgt

SEQ ID NO: 209240 - DNA, 25 bp, Homo sapien
gtggctcacacccatggctgaatct

SEQ ID NO: 209241 - DNA, 25 bp, Homo sapien
gctgaatctctgcagggcacgtgaa

SEQ ID NO: 209242 - DNA, 25 bp, Homo sapien
gccgtcactggcctgcacagtggtc

SEQ ID NO: 209243 - DNA, 25 bp, Homo sapien
aagggaccctcctcactggatggtg

SEQ ID NO: 209244 - DNA, 25 bp, Homo sapien
tccttgcagggagaacggtgacttt

SEQ ID NO: 209245 - DNA, 25 bp, Homo sapien
ttgtattgtcatgtgtgcggcttcc

SEQ ID NO: 209246 - DNA, 25 bp, Homo sapien
tgcggcttcctgttctcaataaaag

SEQ ID NO: 209247 - DNA, 25 bp, Homo sapien
gggtctgggtcttgtccctaggaat

SEQ ID NO: 209248 - DNA, 25 bp, Homo sapien
tctgggtcttgtccctaggaattct

SEQ ID NO: 209249 - DNA, 25 bp, Homo sapien
tgggtcttgtccctaggaattctcc

SEQ ID NO: 209250 - DNA, 25 bp, Homo sapien
ggtcttgtccctaggaattctcctc

SEQ ID NO: 209251 - DNA, 25 bp, Homo sapien
ggaggcagcgggtgatggctctgaa

SEQ ID NO: 209252 - DNA, 25 bp, Homo sapien
atggctctgaagctgaacccagggc

SEQ ID NO: 209253 - DNA, 25 bp, Homo sapien
gctctgaagctgaacccagggcctg

SEQ ID NO: 209254 - DNA, 25 bp, Homo sapien
cccctgtgacccaaaggcatgggat

SEQ ID NO: 209255 - DNA, 25 bp, Homo sapien
ccaaaggcatgggatggacagagat

SEQ ID NO: 209256 - DNA, 25 bp, Homo sapien
gggagggcagttcaccagcatccat

SEQ ID NO: 209257 - DNA, 25 bp, Homo sapien
agggcagttcaccagcatccataga

SEQ ID NO: 209258 - DNA, 25 bp, Homo sapien
aagccagtctacattgcccaaacag

SEQ ID NO: 209259 - DNA, 25 bp, Homo sapien
ttgcccaaacagcaagggttggaga

SEQ ID NO: 209260 - DNA, 25 bp, Homo sapien
caggaggttttgaaccatgagggcc

SEQ ID NO: 209261 - DNA, 25 bp, Homo sapien
ccatgagggccctctgcccgggtga

SEQ ID NO: 209262 - DNA, 25 bp, Homo sapien
tctgcccgggtgatgggcattccct

SEQ ID NO: 209263 - DNA, 25 bp, Homo sapien
tgggcattccctaagctgctatgga

SEQ ID NO: 209264 - DNA, 25 bp, Homo sapien
taagctgctatggaatctgctccct

SEQ ID NO: 209265 - DNA, 25 bp, Homo sapien
tgctatggaatctgctccctttggg

SEQ ID NO: 209266 - DNA, 25 bp, Homo sapien
ggttttgacctgagatgtttgggaa

SEQ ID NO: 209267 - DNA, 25 bp, Homo sapien
gagtaatgagaagtttctcctcaaa

SEQ ID NO: 209268 - DNA, 25 bp, Homo sapien
tctcctcaaatgaaactagaacaga

SEQ ID NO: 209269 - DNA, 25 bp, Homo sapien
tggacgtaagcgctctgagagggaa

SEQ ID NO: 209270 - DNA, 25 bp, Homo sapien
aggcgcgccccgagtgctagtgcct

SEQ ID NO: 209271 - DNA, 25 bp, Homo sapien
cccgagtgctagtgccttcttttgg

SEQ ID NO: 209272 - DNA, 25 bp, Homo sapien
gagtgctagtgccttcttttgggat

SEQ ID NO: 209273 - DNA, 25 bp, Homo sapien
ggtctttaccgagttgggaactgtg

SEQ ID NO: 209274 - DNA, 25 bp, Homo sapien
accgagttgggaactgtgatggcat

SEQ ID NO: 209275 - DNA, 25 bp, Homo sapien
aactgtgatggcatcgggaccagtc

SEQ ID NO: 209276 - DNA, 25 bp, Homo sapien
actgtgatggcatcgggaccagtcc

SEQ ID NO: 209277 - DNA, 25 bp, Homo sapien
atggcatcgggaccagtcctgggcg

SEQ ID NO: 209278 - DNA, 25 bp, Homo sapien
tgggcgccctgagaccactcgctgc

SEQ ID NO: 209279 - DNA, 25 bp, Homo sapien
gcggccccggcgcagggagagggag

SEQ ID NO: 209280 - DNA, 25 bp, Homo sapien
gtggccttgtccttgaggtgagccc

SEQ ID NO: 209281 - DNA, 25 bp, Homo sapien
ccttgtccttgaggtgagccccatg

SEQ ID NO: 209282 - DNA, 25 bp, Homo sapien
atctgggccactgtcaggaccacct

SEQ ID NO: 209283 - DNA, 25 bp, Homo sapien
gaccacctttgggagtgtcatcctt

SEQ ID NO: 209284 - DNA, 25 bp, Homo sapien
gggagtgtcatccttacaaaccaca

SEQ ID NO: 209285 - DNA, 25 bp, Homo sapien
tgtcatccttacaaaccacagcatg

SEQ ID NO: 209286 - DNA, 25 bp, Homo sapien
gtcccagcctgggaggatcaaggcc

SEQ ID NO: 209287 - DNA, 25 bp, Homo sapien
ctgggaggatcaaggcctggatccc

SEQ ID NO: 209288 - DNA, 25 bp, Homo sapien
gatcccgggccgttatccatctgga

SEQ ID NO: 209289 - DNA, 25 bp, Homo sapien
gccgttatccatctggaggctgcag

SEQ ID NO: 209290 - DNA, 25 bp, Homo sapien
ccactcacagattcctcacactggg

SEQ ID NO: 209291 - DNA, 25 bp, Homo sapien
gaagccccatctcaggtggatgttt

SEQ ID NO: 209292 - DNA, 25 bp, Homo sapien
agccccatctcaggtggatgtttaa

SEQ ID NO: 209293 - DNA, 25 bp, Homo sapien
gccccatctcaggtggatgtttaag

SEQ ID NO: 209294 - DNA, 25 bp, Homo sapien
ccccatctcaggtggatgtttaaga

SEQ ID NO: 209295 - DNA, 25 bp, Homo sapien
atctcaggtggatgtttaagaactt

SEQ ID NO: 209296 - DNA, 25 bp, Homo sapien
ctcaggtggatgtttaagaacttag

SEQ ID NO: 209297 - DNA, 25 bp, Homo sapien
aagaacttaggtattcaaggccgag

SEQ ID NO: 209298 - DNA, 25 bp, Homo sapien
gaacttaggtattcaaggccgaggc

SEQ ID NO: 209299 - DNA, 25 bp, Homo sapien
aacttaggtattcaaggccgaggca

SEQ ID NO: 209300 - DNA, 25 bp, Homo sapien
acttaggtattcaaggccgaggcag

SEQ ID NO: 209301 - DNA, 25 bp, Homo sapien
ttaggtattcaaggccgaggcaggc

SEQ ID NO: 209302 - DNA, 25 bp, Homo sapien
aaagcagtcaaacatgctgaccgct

SEQ ID NO: 209303 - DNA, 25 bp, Homo sapien
agcagtcaaacatgctgaccgctca

SEQ ID NO: 209304 - DNA, 25 bp, Homo sapien
gcagtcaaacatgctgaccgctcaa

SEQ ID NO: 209305 - DNA, 25 bp, Homo sapien
agtcaaacatgctgaccgctcaaga

SEQ ID NO: 209306 - DNA, 25 bp, Homo sapien
tcaaacatgctgaccgctcaagaga

SEQ ID NO: 209307 - DNA, 25 bp, Homo sapien
caaacatgctgaccgctcaagagat

SEQ ID NO: 209308 - DNA, 25 bp, Homo sapien
cgctcaagagattctacatcagttt

SEQ ID NO: 209309 - DNA, 25 bp, Homo sapien
gctcaagagattctacatcagtttg

SEQ ID NO: 209310 - DNA, 25 bp, Homo sapien
ctacatcagtttggtttcactcaga

SEQ ID NO: 209311 - DNA, 25 bp, Homo sapien
tacatcagtttggtttcactcagac

SEQ ID NO: 209312 - DNA, 25 bp, Homo sapien
catcagtttggtttcactcagaccg

SEQ ID NO: 209313 - DNA, 25 bp, Homo sapien
acagagaatgtaaacccagtgggct

SEQ ID NO: 209314 - DNA, 25 bp, Homo sapien
cagagaatgtaaacccagtgggctc

SEQ ID NO: 209315 - DNA, 25 bp, Homo sapien
agagaatgtaaacccagtgggctct

SEQ ID NO: 209316 - DNA, 25 bp, Homo sapien
gagaatgtaaacccagtgggctctg

SEQ ID NO: 209317 - DNA, 25 bp, Homo sapien
agaatgtaaacccagtgggctctgc

SEQ ID NO: 209318 - DNA, 25 bp, Homo sapien
gaatgtaaacccagtgggctctgcc

SEQ ID NO: 209319 - DNA, 25 bp, Homo sapien
aatgtaaacccagtgggctctgccc

SEQ ID NO: 209320 - DNA, 25 bp, Homo sapien
atgtaaacccagtgggctctgccca

SEQ ID NO: 209321 - DNA, 25 bp, Homo sapien
aataatctgagttattcagccagtc

SEQ ID NO: 209322 - DNA, 25 bp, Homo sapien
ctgagttattcagccagtcagctcc

SEQ ID NO: 209323 - DNA, 25 bp, Homo sapien
tcagccagtcagctcccctttaaaa

SEQ ID NO: 209324 - DNA, 25 bp, Homo sapien
aaaatctaaggtatctccaagcaac

SEQ ID NO: 209325 - DNA, 25 bp, Homo sapien
aaggtatctccaagcaacacatctc

SEQ ID NO: 209326 - DNA, 25 bp, Homo sapien
caagcaacacatctccattctagtt

SEQ ID NO: 209327 - DNA, 25 bp, Homo sapien
acacatctccattctagttgtcttg

SEQ ID NO: 209328 - DNA, 25 bp, Homo sapien
atctccattctagttgtcttgaacc

SEQ ID NO: 209329 - DNA, 25 bp, Homo sapien
agttgtcttgaaccacgtgggcaac

SEQ ID NO: 209330 - DNA, 25 bp, Homo sapien
gtcttgaaccacgtgggcaactgtt

SEQ ID NO: 209331 - DNA, 25 bp, Homo sapien
aaccacgtgggcaactgtttcaggg

SEQ ID NO: 209332 - DNA, 25 bp, Homo sapien
tgcccttggtgtggacacaccctct

SEQ ID NO: 209333 - DNA, 25 bp, Homo sapien
atgctaccagcaccataatccagtg

SEQ ID NO: 209334 - DNA, 25 bp, Homo sapien
gctaccagcaccataatccagtggg

SEQ ID NO: 209335 - DNA, 25 bp, Homo sapien
gggtgactgggtgcacacctgccca

SEQ ID NO: 209336 - DNA, 25 bp, Homo sapien
acctgcccaggtgaacacagcggct

SEQ ID NO: 209337 - DNA, 25 bp, Homo sapien
acaggtgctcctgcttcggctctgt

SEQ ID NO: 209338 - DNA, 25 bp, Homo sapien
ttcggctctgtttcggctcacaggt

SEQ ID NO: 209339 - DNA, 25 bp, Homo sapien
tgtttcggctcacaggtgtgcatca

SEQ ID NO: 209340 - DNA, 25 bp, Homo sapien
gtgtgcatcactgggcttggatttg

SEQ ID NO: 209341 - DNA, 25 bp, Homo sapien
cttggatttgcattacattgacccc

SEQ ID NO: 209342 - DNA, 25 bp, Homo sapien
tggatttgcattacattgaccccag

SEQ ID NO: 209343 - DNA, 25 bp, Homo sapien
gtcatgatgctatggactcctacta

SEQ ID NO: 209344 - DNA, 25 bp, Homo sapien
gactcctactacgactacatatggg

SEQ ID NO: 209345 - DNA, 25 bp, Homo sapien
gactacatatgggatgttaccattt

SEQ ID NO: 209346 - DNA, 25 bp, Homo sapien
gttaccattttggaatacttgactt

SEQ ID NO: 209347 - DNA, 25 bp, Homo sapien
aattgcaatcaaagccatcggccag

SEQ ID NO: 209348 - DNA, 25 bp, Homo sapien
aagccatcggccagacagagttgaa

SEQ ID NO: 209349 - DNA, 25 bp, Homo sapien
atcggccagacagagttgaatgcaa

SEQ ID NO: 209350 - DNA, 25 bp, Homo sapien
tgaatgcaagcaatccagaagaagt

SEQ ID NO: 209351 - DNA, 25 bp, Homo sapien
agaagaagtgttacagctggcagcg

SEQ ID NO: 209352 - DNA, 25 bp, Homo sapien
agctggcagcgcagagaaggaaaaa

SEQ ID NO: 209353 - DNA, 25 bp, Homo sapien
aaaagtttctccaagcaatggcaaa

SEQ ID NO: 209354 - DNA, 25 bp, Homo sapien
gccctctgggatgagtctgatgaca

SEQ ID NO: 209355 - DNA, 25 bp, Homo sapien
gtctgatgacagtaactcagaaatt

SEQ ID NO: 209356 - DNA, 25 bp, Homo sapien
aaattgaggctgctttacgccccag

SEQ ID NO: 209357 - DNA, 25 bp, Homo sapien
ttgaggctgctttacgccccagaaa

SEQ ID NO: 209358 - DNA, 25 bp, Homo sapien
tgctttacgccccagaaaccataac

SEQ ID NO: 209359 - DNA, 25 bp, Homo sapien
gccccagaaaccataacaccgatga

SEQ ID NO: 209360 - DNA, 25 bp, Homo sapien
ccataacaccgatgattctgatgat

SEQ ID NO: 209361 - DNA, 25 bp, Homo sapien
gatgatttttatgactaacgtgctg

SEQ ID NO: 209362 - DNA, 25 bp, Homo sapien
tttttatgactaacgtgctgtgaca

SEQ ID NO: 209363 - DNA, 25 bp, Homo sapien
aacgtgctgtgacattggtttcaaa

SEQ ID NO: 209364 - DNA, 25 bp, Homo sapien
gtgctgtgacattggtttcaaataa

SEQ ID NO: 209365 - DNA, 25 bp, Homo sapien
tgatgggttttattcgttgggcttt

SEQ ID NO: 209366 - DNA, 25 bp, Homo sapien
aaaactcacgtatcatctcaataga

SEQ ID NO: 209367 - DNA, 25 bp, Homo sapien
gataaaattcaacttgacttcatgt

SEQ ID NO: 209368 - DNA, 25 bp, Homo sapien
tgacttcatgttaaaaaccctcaac

SEQ ID NO: 209369 - DNA, 25 bp, Homo sapien
accctcaacaaaccaggcgtcgaag

SEQ ID NO: 209370 - DNA, 25 bp, Homo sapien
accaggcgtcgaaggaacatacctc

SEQ ID NO: 209371 - DNA, 25 bp, Homo sapien
ctgaatgagcaaaagctggagcatt

SEQ ID NO: 209372 - DNA, 25 bp, Homo sapien
aagctggagcattactcttgagaag

SEQ ID NO: 209373 - DNA, 25 bp, Homo sapien
agtagaacaaggcacttcagtccta

SEQ ID NO: 209374 - DNA, 25 bp, Homo sapien
atagtactggaagtctcgccacagc

SEQ ID NO: 209375 - DNA, 25 bp, Homo sapien
agtactggaagtctcgccacagcaa

SEQ ID NO: 209376 - DNA, 25 bp, Homo sapien
cagcttcctcagtacacttcatgaa

SEQ ID NO: 209377 - DNA, 25 bp, Homo sapien
aagtctacttgcaggtgctgaccaa

SEQ ID NO: 209378 - DNA, 25 bp, Homo sapien
aaccacaacctatgactggagcaga

SEQ ID NO: 209379 - DNA, 25 bp, Homo sapien
gaataagtctaaaggcagagcccca

SEQ ID NO: 209380 - DNA, 25 bp, Homo sapien
gagccccagcctcagagacaaatag

SEQ ID NO: 209381 - DNA, 25 bp, Homo sapien
ggcttcatcatggaaacttctgagc

SEQ ID NO: 209382 - DNA, 25 bp, Homo sapien
cagaacattgagtttgagaatcctg

SEQ ID NO: 209383 - DNA, 25 bp, Homo sapien
gagaatcctgaaattgagcctatga

SEQ ID NO: 209384 - DNA, 25 bp, Homo sapien
gttttccaagtgacattctcagtga

SEQ ID NO: 209385 - DNA, 25 bp, Homo sapien
ggtttcactgtgaagcatcaccagc

SEQ ID NO: 209386 - DNA, 25 bp, Homo sapien
aagcatcaccagcagatccttgttt

SEQ ID NO: 209387 - DNA, 25 bp, Homo sapien
tgtaaatatagctcaacacagttat

SEQ ID NO: 209388 - DNA, 25 bp, Homo sapien
gctcaacacagttatattctttttg

SEQ ID NO: 209389 - DNA, 25 bp, Homo sapien
gtattatatctacaatttacctttt

SEQ ID NO: 209390 - DNA, 25 bp, Homo sapien
ccttttttcttagattttacatgca

SEQ ID NO: 209391 - DNA, 25 bp, Homo sapien
ttgcctatctgtaaaggtaatacat

SEQ ID NO: 209392 - DNA, 25 bp, Homo sapien
acatagaaatgtaccgttatccatc

SEQ ID NO: 209393 - DNA, 25 bp, Homo sapien
aaatgtaccgttatccatctaccag

SEQ ID NO: 209394 - DNA, 25 bp, Homo sapien
tgtaccgttatccatctaccagata

SEQ ID NO: 209395 - DNA, 25 bp, Homo sapien
atccatctaccagataactattatt

SEQ ID NO: 209396 - DNA, 25 bp, Homo sapien
tccaggaattaaaaaacatctatca

SEQ ID NO: 209397 - DNA, 25 bp, Homo sapien
aacatctatcatataagtattgcaa

SEQ ID NO: 209398 - DNA, 25 bp, Homo sapien
tctgttagactggtgctgaaacaaa

SEQ ID NO: 209399 - DNA, 25 bp, Homo sapien
gttaaggctaggttgaagtctagaa

SEQ ID NO: 209400 - DNA, 25 bp, Homo sapien
gaaagaaatctgaatccatgtcatt

SEQ ID NO: 209401 - DNA, 25 bp, Homo sapien
gaatccatgtcattcataacccctt

SEQ ID NO: 209402 - DNA, 25 bp, Homo sapien
atgtcattcataaccccttgatctg

SEQ ID NO: 209403 - DNA, 25 bp, Homo sapien
taaccccttgatctgtagtgtcatg

SEQ ID NO: 209404 - DNA, 25 bp, Homo sapien
ctgtagtgtcatgggtgctgccgca

SEQ ID NO: 209405 - DNA, 25 bp, Homo sapien
gtttctcatgctttctctaacttcc

SEQ ID NO: 209406 - DNA, 25 bp, Homo sapien
ttcttttgtgcatatagccattctt

SEQ ID NO: 209407 - DNA, 25 bp, Homo sapien
atagccattcttaaatatcagtgat

SEQ ID NO: 209408 - DNA, 25 bp, Homo sapien
aatatcagtgatgtaaacctcactt

SEQ ID NO: 209409 - DNA, 25 bp, Homo sapien
ttactggaaagcactggaagatgta

SEQ ID NO: 209410 - DNA, 25 bp, Homo sapien
gcactggaagatgtagattatgtac

SEQ ID NO: 209411 - DNA, 25 bp, Homo sapien
aaggcaagataatcccaaacttgac

SEQ ID NO: 209412 - DNA, 25 bp, Homo sapien
caaacttgacagtatgcgttccatt

SEQ ID NO: 209413 - DNA, 25 bp, Homo sapien
gacagtatgcgttccattttgagga

SEQ ID NO: 209414 - DNA, 25 bp, Homo sapien
atcacagatatcgaagagatgccag

SEQ ID NO: 209415 - DNA, 25 bp, Homo sapien
gagatgccagaacactagaagatga

SEQ ID NO: 209416 - DNA, 25 bp, Homo sapien
gtggtttaacacagatgaagatgac

SEQ ID NO: 209417 - DNA, 25 bp, Homo sapien
agaagctgtagtgtctccatctgac

SEQ ID NO: 209418 - DNA, 25 bp, Homo sapien
agctgtagtgtctccatctgacaaa

SEQ ID NO: 209419 - DNA, 25 bp, Homo sapien
gtagtgtctccatctgacaaaacta

SEQ ID NO: 209420 - DNA, 25 bp, Homo sapien
agtttcagtatgttttggcctcggg

SEQ ID NO: 209421 - DNA, 25 bp, Homo sapien
tggcctcgggtttcgttatttgcaa

SEQ ID NO: 209422 - DNA, 25 bp, Homo sapien
gagtttctttgaactgtctcacgtg

SEQ ID NO: 209423 - DNA, 25 bp, Homo sapien
gtctcacgtgactattaagcaacta

SEQ ID NO: 209424 - DNA, 25 bp, Homo sapien
aagcaactatacacaggacatcggt

SEQ ID NO: 209425 - DNA, 25 bp, Homo sapien
gacacagtgctttttccaaattgct

SEQ ID NO: 209426 - DNA, 25 bp, Homo sapien
gtgctttttccaaattgctctggct

SEQ ID NO: 209427 - DNA, 25 bp, Homo sapien
aattgctctggctaccatatagaaa

SEQ ID NO: 209428 - DNA, 25 bp, Homo sapien
gcttctgtggttgtccaggtctgag

SEQ ID NO: 209429 - DNA, 25 bp, Homo sapien
tccaggtctgaggtgatggtaactt

SEQ ID NO: 209430 - DNA, 25 bp, Homo sapien
aacttggactcggatggtggtaatg

SEQ ID NO: 209431 - DNA, 25 bp, Homo sapien
cttcctccagagtgaggcccgtccc

SEQ ID NO: 209432 - DNA, 25 bp, Homo sapien
tcacagctgacagcgccagtcccag

SEQ ID NO: 209433 - DNA, 25 bp, Homo sapien
agctgacagcgccagtcccaggtcc

SEQ ID NO: 209434 - DNA, 25 bp, Homo sapien
cgtgaggtcctggccgctctgacag

SEQ ID NO: 209435 - DNA, 25 bp, Homo sapien
gagaaggcccgcgtctaaataaagc

SEQ ID NO: 209436 - DNA, 25 bp, Homo sapien
gaaggcccgcgtctaaataaagcgc

SEQ ID NO: 209437 - DNA, 25 bp, Homo sapien
aggcccgcgtctaaataaagcgcca

SEQ ID NO: 209438 - DNA, 25 bp, Homo sapien
gcccgcgtctaaataaagcgccagc

SEQ ID NO: 209439 - DNA, 25 bp, Homo sapien
ccgcgtctaaataaagcgccagcgc

SEQ ID NO: 209440 - DNA, 25 bp, Homo sapien
tgccctgaacactcaaggacctgtg

SEQ ID NO: 209441 - DNA, 25 bp, Homo sapien
gccctgaacactcaaggacctgtgc

SEQ ID NO: 209442 - DNA, 25 bp, Homo sapien
caggaatcagctaagtaattattac

SEQ ID NO: 209443 - DNA, 25 bp, Homo sapien
aattattacttgattcttttagcaa

SEQ ID NO: 209444 - DNA, 25 bp, Homo sapien
gcaaatcaatgcacgttatcctact

SEQ ID NO: 209445 - DNA, 25 bp, Homo sapien
atgcacgttatcctacttaatcctt

SEQ ID NO: 209446 - DNA, 25 bp, Homo sapien
gcacgttatcctacttaatccttaa

SEQ ID NO: 209447 - DNA, 25 bp, Homo sapien
taactaacccaaagtccaggaggat

SEQ ID NO: 209448 - DNA, 25 bp, Homo sapien
agtccaggaggatgttcttacaaaa

SEQ ID NO: 209449 - DNA, 25 bp, Homo sapien
gatgttcttacaaaaatagctatat

SEQ ID NO: 209450 - DNA, 25 bp, Homo sapien
tagctatatcaagggctggcaccta

SEQ ID NO: 209451 - DNA, 25 bp, Homo sapien
tcaagggctggcacctagacattaa

SEQ ID NO: 209452 - DNA, 25 bp, Homo sapien
ctagacattaaactgtactttgaaa

SEQ ID NO: 209453 - DNA, 25 bp, Homo sapien
tcagtggcctatgcatttccgcgag

SEQ ID NO: 209454 - DNA, 25 bp, Homo sapien
gcatttccgcgagtgagaatcatca

SEQ ID NO: 209455 - DNA, 25 bp, Homo sapien
gaatcatcaccacggcggtggacaa

SEQ ID NO: 209456 - DNA, 25 bp, Homo sapien
gtggacaagcgggtcaatgaccttt

SEQ ID NO: 209457 - DNA, 25 bp, Homo sapien
gggtcaatgaccttttccgcatcat

SEQ ID NO: 209458 - DNA, 25 bp, Homo sapien
tttccgcatcatcccaggcattggg

SEQ ID NO: 209459 - DNA, 25 bp, Homo sapien
gcattgggaactttggcgaccgcta

SEQ ID NO: 209460 - DNA, 25 bp, Homo sapien
tggcgaccgctactttgggacagac

SEQ ID NO: 209461 - DNA, 25 bp, Homo sapien
acgcggtccccgatggcagtgacga

SEQ ID NO: 209462 - DNA, 25 bp, Homo sapien
ggcctacacgggttagctgcccagt

SEQ ID NO: 209463 - DNA, 25 bp, Homo sapien
gggttagctgcccagtgagccatcc

SEQ ID NO: 209464 - DNA, 25 bp, Homo sapien
tcctaattcaaagatggctcatgtg

SEQ ID NO: 209465 - DNA, 25 bp, Homo sapien
gctcatgtgtgagggcattgagttt

SEQ ID NO: 209466 - DNA, 25 bp, Homo sapien
gagggcattgagtttgatttgtttt

SEQ ID NO: 209467 - DNA, 25 bp, Homo sapien
tttgatttgttttccctttggtctg

SEQ ID NO: 209468 - DNA, 25 bp, Homo sapien
atatattttggtgctgtgtggtaag

SEQ ID NO: 209469 - DNA, 25 bp, Homo sapien
gctgtgtggtaagagacttgttcct

SEQ ID NO: 209470 - DNA, 25 bp, Homo sapien
aagagacttgttcctagtggatcaa

SEQ ID NO: 209471 - DNA, 25 bp, Homo sapien
gtggatcaatgaaccatctcttctg

SEQ ID NO: 209472 - DNA, 25 bp, Homo sapien
aatgaaccatctcttctgggcagtt

SEQ ID NO: 209473 - DNA, 25 bp, Homo sapien
aaccatctcttctgggcagttttgt

SEQ ID NO: 209474 - DNA, 25 bp, Homo sapien
tctcttctgggcagttttgttgaaa

SEQ ID NO: 209475 - DNA, 25 bp, Homo sapien
acccacataacttgcggtgtttgtt

SEQ ID NO: 209476 - DNA, 25 bp, Homo sapien
ttttacttgttccttcttccccatg

SEQ ID NO: 209477 - DNA, 25 bp, Homo sapien
cttcttccccatgctaggatgtaaa

SEQ ID NO: 209478 - DNA, 25 bp, Homo sapien
aaactccacaatggcaggatgtctt

SEQ ID NO: 209479 - DNA, 25 bp, Homo sapien
taaagcatcaccaagcacttagaag

SEQ ID NO: 209480 - DNA, 25 bp, Homo sapien
cacttagaagagtgcctggcagact

SEQ ID NO: 209481 - DNA, 25 bp, Homo sapien
gtgcctggcagactcaatgagcaga

SEQ ID NO: 209482 - DNA, 25 bp, Homo sapien
gttcaatgactgaatgactgggcca

SEQ ID NO: 209483 - DNA, 25 bp, Homo sapien
gactgggccagcaatgatacttacc

SEQ ID NO: 209484 - DNA, 25 bp, Homo sapien
gatacttacctgtggttcattcatc

SEQ ID NO: 209485 - DNA, 25 bp, Homo sapien
gttcattcatcactggttccttagg

SEQ ID NO: 209486 - DNA, 25 bp, Homo sapien
taatcctttaaaacttggagaagct

SEQ ID NO: 209487 - DNA, 25 bp, Homo sapien
aatcctttaaaacttggagaagctg

SEQ ID NO: 209488 - DNA, 25 bp, Homo sapien
atcctttaaaacttggagaagctgg

SEQ ID NO: 209489 - DNA, 25 bp, Homo sapien
tcctttaaaacttggagaagctggc

SEQ ID NO: 209490 - DNA, 25 bp, Homo sapien
cctttaaaacttggagaagctggct

SEQ ID NO: 209491 - DNA, 25 bp, Homo sapien
ctttaaaacttggagaagctggctg

SEQ ID NO: 209492 - DNA, 25 bp, Homo sapien
tttaaaacttggagaagctggctgg

SEQ ID NO: 209493 - DNA, 25 bp, Homo sapien
ttaaaacttggagaagctggctggg

SEQ ID NO: 209494 - DNA, 25 bp, Homo sapien
taaaacttggagaagctggctgggc

SEQ ID NO: 209495 - DNA, 25 bp, Homo sapien
acttggagaagctggctgggcgcgg

SEQ ID NO: 209496 - DNA, 25 bp, Homo sapien
cttggagaagctggctgggcgcggt

SEQ ID NO: 209497 - DNA, 25 bp, Homo sapien
aggagacacagtaaccaccattcta

SEQ ID NO: 209498 - DNA, 25 bp, Homo sapien
gtaaccaccattctaatcgatttga

SEQ ID NO: 209499 - DNA, 25 bp, Homo sapien
aatcgatttgaatggcttctggact

SEQ ID NO: 209500 - DNA, 25 bp, Homo sapien
gaatggcttctggacttacgagaac

SEQ ID NO: 209501 - DNA, 25 bp, Homo sapien
agagaggctcttgttgcaaatgaca

SEQ ID NO: 209502 - DNA, 25 bp, Homo sapien
aatgacagtgaaaactctgcagacc

SEQ ID NO: 209503 - DNA, 25 bp, Homo sapien
gaccttgatgatacatgatctctga

SEQ ID NO: 209504 - DNA, 25 bp, Homo sapien
atgatctctgaaagactagactgtc

SEQ ID NO: 209505 - DNA, 25 bp, Homo sapien
gactagactgtcttatattatgaga

SEQ ID NO: 209506 - DNA, 25 bp, Homo sapien
gaatgctgcatgtaaagcctttaaa

SEQ ID NO: 209507 - DNA, 25 bp, Homo sapien
aagcctttaaagcaaaatcctcaga

SEQ ID NO: 209508 - DNA, 25 bp, Homo sapien
ggaacttggagttgcacttaacctt

SEQ ID NO: 209509 - DNA, 25 bp, Homo sapien
gttgcacttaaccttgtaactttgt

SEQ ID NO: 209510 - DNA, 25 bp, Homo sapien
gtaactttgtttggagctggcacct

SEQ ID NO: 209511 - DNA, 25 bp, Homo sapien
atgacgggagcagccatggccatgc

SEQ ID NO: 209512 - DNA, 25 bp, Homo sapien
tggccatgcccgcagacacaaacaa

SEQ ID NO: 209513 - DNA, 25 bp, Homo sapien
aagctttggagctgacggatcacca

SEQ ID NO: 209514 - DNA, 25 bp, Homo sapien
tgacggatcaccagtgggcactaga

SEQ ID NO: 209515 - DNA, 25 bp, Homo sapien
agagctcatggccaaagacctccac

SEQ ID NO: 209516 - DNA, 25 bp, Homo sapien
aagacctccacttcgaaggcatgtt

SEQ ID NO: 209517 - DNA, 25 bp, Homo sapien
agacctctattttttgaagaccgag

SEQ ID NO: 209518 - DNA, 25 bp, Homo sapien
cagggattagctgtgtcaggaactt

SEQ ID NO: 209519 - DNA, 25 bp, Homo sapien
agcatgaaccagatgccgttgaaca

SEQ ID NO: 209520 - DNA, 25 bp, Homo sapien
gaaccagatgccgttgaacagtttg

SEQ ID NO: 209521 - DNA, 25 bp, Homo sapien
agatgccgttgaacagtttgctggt

SEQ ID NO: 209522 - DNA, 25 bp, Homo sapien
tgccgttgaacagtttgctggtctt

SEQ ID NO: 209523 - DNA, 25 bp, Homo sapien
ttgaacagtttgctggtcttgcctg

SEQ ID NO: 209524 - DNA, 25 bp, Homo sapien
aacagtttgctggtcttgcctggca

SEQ ID NO: 209525 - DNA, 25 bp, Homo sapien
agtttgctggtcttgcctggcagaa

SEQ ID NO: 209526 - DNA, 25 bp, Homo sapien
tttgctggtcttgcctggcagaagt

SEQ ID NO: 209527 - DNA, 25 bp, Homo sapien
gctggtcttgcctggcagaagttag

SEQ ID NO: 209528 - DNA, 25 bp, Homo sapien
ttgcctggcagaagttagatgtcct

SEQ ID NO: 209529 - DNA, 25 bp, Homo sapien
tggcagaagttagatgtcctggcag

SEQ ID NO: 209530 - DNA, 25 bp, Homo sapien
actgttagttaatccagtgctcttt

SEQ ID NO: 209531 - DNA, 25 bp, Homo sapien
cagtgctctttccaaaccgtgaaga

SEQ ID NO: 209532 - DNA, 25 bp, Homo sapien
gctctttccaaaccgtgaagactat

SEQ ID NO: 209533 - DNA, 25 bp, Homo sapien
tgaagactatatccatctaatgggt

SEQ ID NO: 209534 - DNA, 25 bp, Homo sapien
atatccatctaatgggttatgacaa

SEQ ID NO: 209535 - DNA, 25 bp, Homo sapien
aaatgagcctatttgttagtgttcg

SEQ ID NO: 209536 - DNA, 25 bp, Homo sapien
gagcctatttgttagtgttcgtgct

SEQ ID NO: 209537 - DNA, 25 bp, Homo sapien
tgccttttgcattccgttagtgact

SEQ ID NO: 209538 - DNA, 25 bp, Homo sapien
ttttgcattccgttagtgactgatt

SEQ ID NO: 209539 - DNA, 25 bp, Homo sapien
gcattccgttagtgactgattgtta

SEQ ID NO: 209540 - DNA, 25 bp, Homo sapien
aattatcaaagcttttaatttccag

SEQ ID NO: 209541 - DNA, 25 bp, Homo sapien
agtcaagaaagtccatttaggccgg

SEQ ID NO: 209542 - DNA, 25 bp, Homo sapien
gaaagtccatttaggccggacgcgg

SEQ ID NO: 209543 - DNA, 25 bp, Homo sapien
ctggccaacactggtctctgtgaaa

SEQ ID NO: 209544 - DNA, 25 bp, Homo sapien
ggccaacactggtctctgtgaaact

SEQ ID NO: 209545 - DNA, 25 bp, Homo sapien
gccaacactggtctctgtgaaactc

SEQ ID NO: 209546 - DNA, 25 bp, Homo sapien
aacactggtctctgtgaaactccgt

SEQ ID NO: 209547 - DNA, 25 bp, Homo sapien
acactggtctctgtgaaactccgtc

SEQ ID NO: 209548 - DNA, 25 bp, Homo sapien
actggtctctgtgaaactccgtctc

SEQ ID NO: 209549 - DNA, 25 bp, Homo sapien
aaagattggctggacgtgttggcgg

SEQ ID NO: 209550 - DNA, 25 bp, Homo sapien
gtgttggcgggcatctgtgatacca

SEQ ID NO: 209551 - DNA, 25 bp, Homo sapien
ttggcgggcatctgtgataccagct

SEQ ID NO: 209552 - DNA, 25 bp, Homo sapien
cagagctcccctgccgcagaatggg

SEQ ID NO: 209553 - DNA, 25 bp, Homo sapien
gggtccaggagcactgctcgcctgt

SEQ ID NO: 209554 - DNA, 25 bp, Homo sapien
aggagcactgctcgcctgtacatac

SEQ ID NO: 209555 - DNA, 25 bp, Homo sapien
actgctcgcctgtacatactgttgc

SEQ ID NO: 209556 - DNA, 25 bp, Homo sapien
tcgcctgtacatactgttgccctag

SEQ ID NO: 209557 - DNA, 25 bp, Homo sapien
tgtacatactgttgccctagcccac

SEQ ID NO: 209558 - DNA, 25 bp, Homo sapien
atactgttgccctagcccacctggt

SEQ ID NO: 209559 - DNA, 25 bp, Homo sapien
tagcccacctggtgccgtgggagcc

SEQ ID NO: 209560 - DNA, 25 bp, Homo sapien
tgtttctgccctgtgactcctggaa

SEQ ID NO: 209561 - DNA, 25 bp, Homo sapien
ttctgccctgtgactcctggaacct

SEQ ID NO: 209562 - DNA, 25 bp, Homo sapien
agaccatgcccccagatgatttttt

SEQ ID NO: 209563 - DNA, 25 bp, Homo sapien
caaagcattgcttggatgttctttt

SEQ ID NO: 209564 - DNA, 25 bp, Homo sapien
gttgaaccttaaactgaaatatgaa

SEQ ID NO: 209565 - DNA, 25 bp, Homo sapien
gaagacaagctttataaactagttt

SEQ ID NO: 209566 - DNA, 25 bp, Homo sapien
tgaagtatatcaattatgtttgcct

SEQ ID NO: 209567 - DNA, 25 bp, Homo sapien
tgaatttgtatttcacttactagat

SEQ ID NO: 209568 - DNA, 25 bp, Homo sapien
cttactagattatactaatgagcta

SEQ ID NO: 209569 - DNA, 25 bp, Homo sapien
gctaatggggtcattgccatcctcc

SEQ ID NO: 209570 - DNA, 25 bp, Homo sapien
atcctccctactcatgactttgatg

SEQ ID NO: 209571 - DNA, 25 bp, Homo sapien
gactttgatgagttattgctgtaac

SEQ ID NO: 209572 - DNA, 25 bp, Homo sapien
gttattgctgtaacatcacttcttg

SEQ ID NO: 209573 - DNA, 25 bp, Homo sapien
gctgtaacatcacttcttgatttaa

SEQ ID NO: 209574 - DNA, 25 bp, Homo sapien
gcagaagtgatggttcggctgactt

SEQ ID NO: 209575 - DNA, 25 bp, Homo sapien
tgatggttcggctgacttggcacca

SEQ ID NO: 209576 - DNA, 25 bp, Homo sapien
ggttcggctgacttggcaccaggcc

SEQ ID NO: 209577 - DNA, 25 bp, Homo sapien
gcatcccctaccttacagggctggg

SEQ ID NO: 209578 - DNA, 25 bp, Homo sapien
ggttcaagctccgtgggccacactg

SEQ ID NO: 209579 - DNA, 25 bp, Homo sapien
gccacactgctgctgtgccaagaag

SEQ ID NO: 209580 - DNA, 25 bp, Homo sapien
aagaaggtgtacagcctccccagga

SEQ ID NO: 209581 - DNA, 25 bp, Homo sapien
cccttcatctgcactcaacatttaa

SEQ ID NO: 209582 - DNA, 25 bp, Homo sapien
aacatttaatcgtgtccttgctgtc

SEQ ID NO: 209583 - DNA, 25 bp, Homo sapien
aatcgtgtccttgctgtctttttat

SEQ ID NO: 209584 - DNA, 25 bp, Homo sapien
tttgttagcaaaaacctctatttag

SEQ ID NO: 209585 - DNA, 25 bp, Homo sapien
tcttgtctttaacctgtctgaacta

SEQ ID NO: 209586 - DNA, 25 bp, Homo sapien
acctgtctgaactacacaaatgcct

SEQ ID NO: 209587 - DNA, 25 bp, Homo sapien
aaaaccagatatcctctctgactct

SEQ ID NO: 209588 - DNA, 25 bp, Homo sapien
ccagatatcctctctgactctagct

SEQ ID NO: 209589 - DNA, 25 bp, Homo sapien
atgagccaagtgtgtagtgagacaa

SEQ ID NO: 209590 - DNA, 25 bp, Homo sapien
gtgagacaaataccactacctgtag

SEQ ID NO: 209591 - DNA, 25 bp, Homo sapien
ccagagagtgaatatctttggcact

SEQ ID NO: 209592 - DNA, 25 bp, Homo sapien
tatctttggcactgcaagccacacg

SEQ ID NO: 209593 - DNA, 25 bp, Homo sapien
actgcaagccacacggtcagtgttg

SEQ ID NO: 209594 - DNA, 25 bp, Homo sapien
gtcagtgttgtgactactcaaccct

SEQ ID NO: 209595 - DNA, 25 bp, Homo sapien
tcaaccctccctttgtagtgtgaaa

SEQ ID NO: 209596 - DNA, 25 bp, Homo sapien
acaatgccatgatctgctgctgcca

SEQ ID NO: 209597 - DNA, 25 bp, Homo sapien
cacctgtacacattggctcattcat

SEQ ID NO: 209598 - DNA, 25 bp, Homo sapien
ggctcattcattcgatggatatttc

SEQ ID NO: 209599 - DNA, 25 bp, Homo sapien
gatatttcgggtgcatctactttat

SEQ ID NO: 209600 - DNA, 25 bp, Homo sapien
gcatctactttatgccaggctctat

SEQ ID NO: 209601 - DNA, 25 bp, Homo sapien
tactttatgccaggctctatgctag

SEQ ID NO: 209602 - DNA, 25 bp, Homo sapien
aaagtcggatatggtctcgctctca

SEQ ID NO: 209603 - DNA, 25 bp, Homo sapien
gtctcgctctcatcaagatttcagt

SEQ ID NO: 209604 - DNA, 25 bp, Homo sapien
aagatttcagtctagctgggagtga

SEQ ID NO: 209605 - DNA, 25 bp, Homo sapien
gtgcacacacgtgatggcaagctgt

SEQ ID NO: 209606 - DNA, 25 bp, Homo sapien
gtgatggcaagctgtgatcatctat

SEQ ID NO: 209607 - DNA, 25 bp, Homo sapien
gatgctgctgtgtacagtcttcatt

SEQ ID NO: 209608 - DNA, 25 bp, Homo sapien
acagtcttcattatgcattgggcag

SEQ ID NO: 209609 - DNA, 25 bp, Homo sapien
gggcagtatttctggctagagtttt

SEQ ID NO: 209610 - DNA, 25 bp, Homo sapien
attttccttcttacggactcatctt

SEQ ID NO: 209611 - DNA, 25 bp, Homo sapien
ggactcatctttagcgtttatttca

SEQ ID NO: 209612 - DNA, 25 bp, Homo sapien
caaccttttgctaattctctgagaa

SEQ ID NO: 209613 - DNA, 25 bp, Homo sapien
gagaaatctgcagcactcagccata

SEQ ID NO: 209614 - DNA, 25 bp, Homo sapien
actcagccatacaccaacagtgttg

SEQ ID NO: 209615 - DNA, 25 bp, Homo sapien
gttaacaccctggttagggcagaat

SEQ ID NO: 209616 - DNA, 25 bp, Homo sapien
aaagaccatcttggcagagttccag

SEQ ID NO: 209617 - DNA, 25 bp, Homo sapien
ttccagccacgctctttattctgtt

SEQ ID NO: 209618 - DNA, 25 bp, Homo sapien
ggccaagaagggtggcttgagatga

SEQ ID NO: 209619 - DNA, 25 bp, Homo sapien
aagaagggtggcttgagatgagatc

SEQ ID NO: 209620 - DNA, 25 bp, Homo sapien
agaagggtggcttgagatgagatca

SEQ ID NO: 209621 - DNA, 25 bp, Homo sapien
gaagggtggcttgagatgagatcag

SEQ ID NO: 209622 - DNA, 25 bp, Homo sapien
aagggtggcttgagatgagatcagg

SEQ ID NO: 209623 - DNA, 25 bp, Homo sapien
agggtggcttgagatgagatcagga

SEQ ID NO: 209624 - DNA, 25 bp, Homo sapien
tggcttgagatgagatcaggagctc

SEQ ID NO: 209625 - DNA, 25 bp, Homo sapien
ggcttgagatgagatcaggagctca

SEQ ID NO: 209626 - DNA, 25 bp, Homo sapien
gcttgagatgagatcaggagctcaa

SEQ ID NO: 209627 - DNA, 25 bp, Homo sapien
cttgagatgagatcaggagctcaag

SEQ ID NO: 209628 - DNA, 25 bp, Homo sapien
gtgttggcacacgcccgtcatctca

SEQ ID NO: 209629 - DNA, 25 bp, Homo sapien
gtaacagttgctaggcttcaatgcc

SEQ ID NO: 209630 - DNA, 25 bp, Homo sapien
ggcttcaatgcctatcggtagcaag

SEQ ID NO: 209631 - DNA, 25 bp, Homo sapien
gcctatcggtagcaagccatggaaa

SEQ ID NO: 209632 - DNA, 25 bp, Homo sapien
aaactgccctgtctggcagtcagct

SEQ ID NO: 209633 - DNA, 25 bp, Homo sapien
gcttcccagacagactatagactat

SEQ ID NO: 209634 - DNA, 25 bp, Homo sapien
ataaatatgtctccatctgccttac

SEQ ID NO: 209635 - DNA, 25 bp, Homo sapien
tccatctgccttaccaagtgttttc

SEQ ID NO: 209636 - DNA, 25 bp, Homo sapien
aagtgttttcttactacaatgctga

SEQ ID NO: 209637 - DNA, 25 bp, Homo sapien
atggctagttcagctagctggtaca

SEQ ID NO: 209638 - DNA, 25 bp, Homo sapien
tttaattttgtaacctgtggcctga

SEQ ID NO: 209639 - DNA, 25 bp, Homo sapien
gtaacctgtggcctgatctgtaaat

SEQ ID NO: 209640 - DNA, 25 bp, Homo sapien
gaaactgagggaagcctccaaccaa

SEQ ID NO: 209641 - DNA, 25 bp, Homo sapien
tgagggaagcctccaaccaacactc

SEQ ID NO: 209642 - DNA, 25 bp, Homo sapien
aagcctccaaccaacactcagtgag

SEQ ID NO: 209643 - DNA, 25 bp, Homo sapien
tccaaccaacactcagtgaggaact

SEQ ID NO: 209644 - DNA, 25 bp, Homo sapien
aacagccacgtacgtgagtgagctt

SEQ ID NO: 209645 - DNA, 25 bp, Homo sapien
gccacgtacgtgagtgagcttggaa

SEQ ID NO: 209646 - DNA, 25 bp, Homo sapien
cttgattgaagcctgtaggagacct

SEQ ID NO: 209647 - DNA, 25 bp, Homo sapien
aagcctgtaggagaccttgagccag

SEQ ID NO: 209648 - DNA, 25 bp, Homo sapien
cagctaagccatgcctacagatact

SEQ ID NO: 209649 - DNA, 25 bp, Homo sapien
taagccatgcctacagatactatga

SEQ ID NO: 209650 - DNA, 25 bp, Homo sapien
gccatgcctacagatactatgagat

SEQ ID NO: 209651 - DNA, 25 bp, Homo sapien
agttgcatttccctctcgcacattc

SEQ ID NO: 209652 - DNA, 25 bp, Homo sapien
ttgcatttccctctcgcacattcta

SEQ ID NO: 209653 - DNA, 25 bp, Homo sapien
gcacattctacacccaagtgcctaa

SEQ ID NO: 209654 - DNA, 25 bp, Homo sapien
acattctacacccaagtgcctaaaa

SEQ ID NO: 209655 - DNA, 25 bp, Homo sapien
ttctacacccaagtgcctaaaagat

SEQ ID NO: 209656 - DNA, 25 bp, Homo sapien
gtgggtagtgttaccggaagccatt

SEQ ID NO: 209657 - DNA, 25 bp, Homo sapien
gtagtgttaccggaagccattgtgt

SEQ ID NO: 209658 - DNA, 25 bp, Homo sapien
gtgttaccggaagccattgtgttca

SEQ ID NO: 209659 - DNA, 25 bp, Homo sapien
gttaccggaagccattgtgttcaca

SEQ ID NO: 209660 - DNA, 25 bp, Homo sapien
taccggaagccattgtgttcacacg

SEQ ID NO: 209661 - DNA, 25 bp, Homo sapien
ccggaagccattgtgttcacacggg

SEQ ID NO: 209662 - DNA, 25 bp, Homo sapien
tggccctgctgcagttgatggagac

SEQ ID NO: 209663 - DNA, 25 bp, Homo sapien
gacgctgtacggatgcagcagctga

SEQ ID NO: 209664 - DNA, 25 bp, Homo sapien
aattaaaaccatggaggcgatcagc

SEQ ID NO: 209665 - DNA, 25 bp, Homo sapien
ccatggaggcgatcagcgaggttct

SEQ ID NO: 209666 - DNA, 25 bp, Homo sapien
aggcgatcagcgaggttctccagga

SEQ ID NO: 209667 - DNA, 25 bp, Homo sapien
tcagcgaggttctccaggaccttag

SEQ ID NO: 209668 - DNA, 25 bp, Homo sapien
aggaccttaggtttgatgcggaatc

SEQ ID NO: 209669 - DNA, 25 bp, Homo sapien
cttaggtttgatgcggaatctgccg

SEQ ID NO: 209670 - DNA, 25 bp, Homo sapien
tttgatgcggaatctgccgagtgat

SEQ ID NO: 209671 - DNA, 25 bp, Homo sapien
gaatctgccgagtgatggcggctcc

SEQ ID NO: 209672 - DNA, 25 bp, Homo sapien
ggctccccagggatgcgccgaggga

SEQ ID NO: 209673 - DNA, 25 bp, Homo sapien
gctgatgctgtactatcacagaaga

SEQ ID NO: 209674 - DNA, 25 bp, Homo sapien
cacagaagacaagaggagctcaaga

SEQ ID NO: 209675 - DNA, 25 bp, Homo sapien
ttaaactcaccatgggcggataaca

SEQ ID NO: 209676 - DNA, 25 bp, Homo sapien
tcaccatgggcggataacactgctt

SEQ ID NO: 209677 - DNA, 25 bp, Homo sapien
catgggcggataacactgctttgaa

SEQ ID NO: 209678 - DNA, 25 bp, Homo sapien
gcggataacactgctttgaaaagac

SEQ ID NO: 209679 - DNA, 25 bp, Homo sapien
gacattttcatggagtgaaagacat

SEQ ID NO: 209680 - DNA, 25 bp, Homo sapien
gagctccagcccgagagcctattat

SEQ ID NO: 209681 - DNA, 25 bp, Homo sapien
tccagcccgagagcctattattagc

SEQ ID NO: 209682 - DNA, 25 bp, Homo sapien
gcccgagagcctattattagcagtg

SEQ ID NO: 209683 - DNA, 25 bp, Homo sapien
gcctattattagcagtgaggagcag

SEQ ID NO: 209684 - DNA, 25 bp, Homo sapien
cgtatggagtcacgccctctgaact

SEQ ID NO: 209685 - DNA, 25 bp, Homo sapien
tggagtcacgccctctgaactgctc

SEQ ID NO: 209686 - DNA, 25 bp, Homo sapien
tctgaactgctcttcgggaggcagc

SEQ ID NO: 209687 - DNA, 25 bp, Homo sapien
gccctggttctaggatgctgaggcc

SEQ ID NO: 209688 - DNA, 25 bp, Homo sapien
ctggttctaggatgctgaggccctg

SEQ ID NO: 209689 - DNA, 25 bp, Homo sapien
tgcctcacttctctcttgagaactt

SEQ ID NO: 209690 - DNA, 25 bp, Homo sapien
tcacttctctcttgagaacttggct

SEQ ID NO: 209691 - DNA, 25 bp, Homo sapien
ttctctcttgagaacttggctcagg

SEQ ID NO: 209692 - DNA, 25 bp, Homo sapien
tctcttgagaacttggctcagggct

SEQ ID NO: 209693 - DNA, 25 bp, Homo sapien
ctcctgaggacctttcccagcatta

SEQ ID NO: 209694 - DNA, 25 bp, Homo sapien
gaggacctttcccagcattaccttc

SEQ ID NO: 209695 - DNA, 25 bp, Homo sapien
caaccaccaattcttacggaggaat

SEQ ID NO: 209696 - DNA, 25 bp, Homo sapien
atattatttagccagcaggagtgga

SEQ ID NO: 209697 - DNA, 25 bp, Homo sapien
caggagtggagtttggtttactgat

SEQ ID NO: 209698 - DNA, 25 bp, Homo sapien
gagtttggtttactgattttactgt

SEQ ID NO: 209699 - DNA, 25 bp, Homo sapien
ttactgttttgtgttcatgaatctt

SEQ ID NO: 209700 - DNA, 25 bp, Homo sapien
aaagcacaggaaaatgtatttggaa

SEQ ID NO: 209701 - DNA, 25 bp, Homo sapien
atgtatttggaaatgcagcttagta

SEQ ID NO: 209702 - DNA, 25 bp, Homo sapien
atgcagcttagtatgaattctatta

SEQ ID NO: 209703 - DNA, 25 bp, Homo sapien
ttctattaaagacacaattgggctc

SEQ ID NO: 209704 - DNA, 25 bp, Homo sapien
ttaaagacacaattgggctctgcaa

SEQ ID NO: 209705 - DNA, 25 bp, Homo sapien
aaagacacaattgggctctgcaaaa

SEQ ID NO: 209706 - DNA, 25 bp, Homo sapien
ttataatttatgtgccaggttcgtt

SEQ ID NO: 209707 - DNA, 25 bp, Homo sapien
gtgccaggttcgttttgtacttaat

SEQ ID NO: 209708 - DNA, 25 bp, Homo sapien
ttaatcttggttcttagtactttga

SEQ ID NO: 209709 - DNA, 25 bp, Homo sapien
tagtactttgaattggtctacaggt

SEQ ID NO: 209710 - DNA, 25 bp, Homo sapien
tggtctacaggtatattcctgggat

SEQ ID NO: 209711 - DNA, 25 bp, Homo sapien
gatgaaaggattgccaaacccaaat

SEQ ID NO: 209712 - DNA, 25 bp, Homo sapien
ttatccaatgggtttgtgtctttgt

SEQ ID NO: 209713 - DNA, 25 bp, Homo sapien
gtgtctttgttccattctcaacatt

SEQ ID NO: 209714 - DNA, 25 bp, Homo sapien
gcaagtgtgcttccgtcaagatacc

SEQ ID NO: 209715 - DNA, 25 bp, Homo sapien
ccgtcaagataccatattctcctgc

SEQ ID NO: 209716 - DNA, 25 bp, Homo sapien
catattctcctgctccagtataaca

SEQ ID NO: 209717 - DNA, 25 bp, Homo sapien
tccccatggactatagcgccaatgc

SEQ ID NO: 209718 - DNA, 25 bp, Homo sapien
ccatggactatagcgccaatgccat

SEQ ID NO: 209719 - DNA, 25 bp, Homo sapien
ggactatagcgccaatgccattgcc

SEQ ID NO: 209720 - DNA, 25 bp, Homo sapien
ccctccaagctcagtggacactggg

SEQ ID NO: 209721 - DNA, 25 bp, Homo sapien
tccaagctcagtggacactgggtct

SEQ ID NO: 209722 - DNA, 25 bp, Homo sapien
caagctcagtggacactgggtctga

SEQ ID NO: 209723 - DNA, 25 bp, Homo sapien
agctcagtggacactgggtctgaaa

SEQ ID NO: 209724 - DNA, 25 bp, Homo sapien
tcagtggacactgggtctgaaagga

SEQ ID NO: 209725 - DNA, 25 bp, Homo sapien
atccaggctcagaacttcttctcca

SEQ ID NO: 209726 - DNA, 25 bp, Homo sapien
tccaggctcagaacttcttctccag

SEQ ID NO: 209727 - DNA, 25 bp, Homo sapien
ttcttctccagcttcaccctgatga

SEQ ID NO: 209728 - DNA, 25 bp, Homo sapien
tggtattttatacttgccttcttcc

SEQ ID NO: 209729 - DNA, 25 bp, Homo sapien
gtattttatacttgccttcttcctg

SEQ ID NO: 209730 - DNA, 25 bp, Homo sapien
tattttatacttgccttcttcctgt

SEQ ID NO: 209731 - DNA, 25 bp, Homo sapien
ttttatacttgccttcttcctgtac

SEQ ID NO: 209732 - DNA, 25 bp, Homo sapien
ttatacttgccttcttcctgtacag

SEQ ID NO: 209733 - DNA, 25 bp, Homo sapien
atacttgccttcttcctgtacaggg

SEQ ID NO: 209734 - DNA, 25 bp, Homo sapien
acttgccttcttcctgtacagggct

SEQ ID NO: 209735 - DNA, 25 bp, Homo sapien
ttgccttcttcctgtacagggctgg

SEQ ID NO: 209736 - DNA, 25 bp, Homo sapien
ccttcttcctgtacagggctgggaa

SEQ ID NO: 209737 - DNA, 25 bp, Homo sapien
ttcttcctgtacagggctgggaaag

SEQ ID NO: 209738 - DNA, 25 bp, Homo sapien
ttgtgtccccgcgtatttatttgtt

SEQ ID NO: 209739 - DNA, 25 bp, Homo sapien
gggacataatggagctctgagtgct

SEQ ID NO: 209740 - DNA, 25 bp, Homo sapien
ggacataatggagctctgagtgctg

SEQ ID NO: 209741 - DNA, 25 bp, Homo sapien
agctctgagtgctggtggacagtgc

SEQ ID NO: 209742 - DNA, 25 bp, Homo sapien
tccccacaacagaagagaccagcga

SEQ ID NO: 209743 - DNA, 25 bp, Homo sapien
gagaccagcgactcccgcaaaggga

SEQ ID NO: 209744 - DNA, 25 bp, Homo sapien
ctgcagagtaggcatctgggcacca

SEQ ID NO: 209745 - DNA, 25 bp, Homo sapien
tgcagagtaggcatctgggcaccaa

SEQ ID NO: 209746 - DNA, 25 bp, Homo sapien
gcagagtaggcatctgggcaccaag

SEQ ID NO: 209747 - DNA, 25 bp, Homo sapien
agagtaggcatctgggcaccaagac

SEQ ID NO: 209748 - DNA, 25 bp, Homo sapien
gagtaggcatctgggcaccaagacc

SEQ ID NO: 209749 - DNA, 25 bp, Homo sapien
aggcatctgggcaccaagaccttcc

SEQ ID NO: 209750 - DNA, 25 bp, Homo sapien
caaagcattgcttggatgttctttt

SEQ ID NO: 209751 - DNA, 25 bp, Homo sapien
gttgaaccttaaactgaaatatgaa

SEQ ID NO: 209752 - DNA, 25 bp, Homo sapien
gaagacaagctttataaactagttt

SEQ ID NO: 209753 - DNA, 25 bp, Homo sapien
tgaagtatatcaattatgtttgcct

SEQ ID NO: 209754 - DNA, 25 bp, Homo sapien
tgaatttgtatttcacttactagat

SEQ ID NO: 209755 - DNA, 25 bp, Homo sapien
cttactagattatactaatgagcta

SEQ ID NO: 209756 - DNA, 25 bp, Homo sapien
agctaatggggtcattgccatcctc

SEQ ID NO: 209757 - DNA, 25 bp, Homo sapien
tgccatcctccctactcatgacttt

SEQ ID NO: 209758 - DNA, 25 bp, Homo sapien
gactttgatgagttattgctgtaac

SEQ ID NO: 209759 - DNA, 25 bp, Homo sapien
gagttattgctgtaacatcacttct

SEQ ID NO: 209760 - DNA, 25 bp, Homo sapien
gttattgctgtaacatcacttcttg

SEQ ID NO: 209761 - DNA, 25 bp, Homo sapien
acataggtgtgattgcagcatttac

SEQ ID NO: 209762 - DNA, 25 bp, Homo sapien
gcatttacagttgcagtccttgctg

SEQ ID NO: 209763 - DNA, 25 bp, Homo sapien
ttgctgcgggtatctcctttcatta

SEQ ID NO: 209764 - DNA, 25 bp, Homo sapien
ggtatctcctttcattacttcagtg

SEQ ID NO: 209765 - DNA, 25 bp, Homo sapien
acttcagtgattagggtgaggcaca

SEQ ID NO: 209766 - DNA, 25 bp, Homo sapien
gaggcacaaagagtttcttgatcat

SEQ ID NO: 209767 - DNA, 25 bp, Homo sapien
gatcatccagagaacattgacagac

SEQ ID NO: 209768 - DNA, 25 bp, Homo sapien
gatgttaacaatccatctgtattta

SEQ ID NO: 209769 - DNA, 25 bp, Homo sapien
tttaaaacactagcagccagatctg

SEQ ID NO: 209770 - DNA, 25 bp, Homo sapien
agatctgctgccatgatgcctattt

SEQ ID NO: 209771 - DNA, 25 bp, Homo sapien
catgatgcctatttggtgtgtttct

SEQ ID NO: 209772 - DNA, 25 bp, Homo sapien
gatctccagtcagatactatggagg

SEQ ID NO: 209773 - DNA, 25 bp, Homo sapien
gaggcctcaggttgttatttggttg

SEQ ID NO: 209774 - DNA, 25 bp, Homo sapien
aggcacagagcagaggttcaggtct

SEQ ID NO: 209775 - DNA, 25 bp, Homo sapien
cagaggttcaggtctcagcaggtgt

SEQ ID NO: 209776 - DNA, 25 bp, Homo sapien
agaggtgattacagcccttcccatc

SEQ ID NO: 209777 - DNA, 25 bp, Homo sapien
cctttcatctttaactgggcacctg

SEQ ID NO: 209778 - DNA, 25 bp, Homo sapien
ctgggcacctgagatgggaaccaat

SEQ ID NO: 209779 - DNA, 25 bp, Homo sapien
ggaccatcccagacacatgggtttg

SEQ ID NO: 209780 - DNA, 25 bp, Homo sapien
atgggtttgtctgtccctgacttct

SEQ ID NO: 209781 - DNA, 25 bp, Homo sapien
cctctgagattgtctttgttggtct

SEQ ID NO: 209782 - DNA, 25 bp, Homo sapien
gagattgtctttgttggtctttgtt

SEQ ID NO: 209783 - DNA, 25 bp, Homo sapien
ttcttaaaacatttccctgagccag

SEQ ID NO: 209784 - DNA, 25 bp, Homo sapien
ccctgagccagtaaacagtagttta

SEQ ID NO: 209785 - DNA, 25 bp, Homo sapien
aatcattggtcttttcaaaactagg

SEQ ID NO: 209786 - DNA, 25 bp, Homo sapien
gagacatatatgatattgctgttat

SEQ ID NO: 209787 - DNA, 25 bp, Homo sapien
aacatggcacaacaagaactgtctg

SEQ ID NO: 209788 - DNA, 25 bp, Homo sapien
agaactgtctgccaggtcattcttc

SEQ ID NO: 209789 - DNA, 25 bp, Homo sapien
tttaattgggtaggacaccccatat

SEQ ID NO: 209790 - DNA, 25 bp, Homo sapien
acaccccatataaaaaccatccata

SEQ ID NO: 209791 - DNA, 25 bp, Homo sapien
accatccatatttggccatgtggga

SEQ ID NO: 209792 - DNA, 25 bp, Homo sapien
ggccatgtgggattacccaaataaa

SEQ ID NO: 209793 - DNA, 25 bp, Homo sapien
tccatggatggattcagaatttttt

SEQ ID NO: 209794 - DNA, 25 bp, Homo sapien
aatattatttagccagcaggagtgg

SEQ ID NO: 209795 - DNA, 25 bp, Homo sapien
caggagtggagtttggtttactgat

SEQ ID NO: 209796 - DNA, 25 bp, Homo sapien
gagtttggtttactgattttactgt

SEQ ID NO: 209797 - DNA, 25 bp, Homo sapien
aaagcacaggaaaatgtatttggaa

SEQ ID NO: 209798 - DNA, 25 bp, Homo sapien
atgtatttggaaatgcagcttagta

SEQ ID NO: 209799 - DNA, 25 bp, Homo sapien
aatgcagcttagtatgaattctatt

SEQ ID NO: 209800 - DNA, 25 bp, Homo sapien
gcagcttagtatgaattctattaaa

SEQ ID NO: 209801 - DNA, 25 bp, Homo sapien
ttctattaaagacacaattgggctc

SEQ ID NO: 209802 - DNA, 25 bp, Homo sapien
ttaaagacacaattgggctctgcaa

SEQ ID NO: 209803 - DNA, 25 bp, Homo sapien
aaagacacaattgggctctgcaaaa

SEQ ID NO: 209804 - DNA, 25 bp, Homo sapien
acacaattgggctctgcaaaaaaaa

SEQ ID NO: 209805 - DNA, 25 bp, Homo sapien
tgtgctccttcctccagagtgaggc

SEQ ID NO: 209806 - DNA, 25 bp, Homo sapien
agctgacagcgccagtcccaggtcc

SEQ ID NO: 209807 - DNA, 25 bp, Homo sapien
cagcccgtgaggtccgtgaggtcct

SEQ ID NO: 209808 - DNA, 25 bp, Homo sapien
cgtgaggtcctggccgctctgacag

SEQ ID NO: 209809 - DNA, 25 bp, Homo sapien
ggctccagagaaggcccgcgtctaa

SEQ ID NO: 209810 - DNA, 25 bp, Homo sapien
gagaaggcccgcgtctaaataaagc

SEQ ID NO: 209811 - DNA, 25 bp, Homo sapien
gaaggcccgcgtctaaataaagcgc

SEQ ID NO: 209812 - DNA, 25 bp, Homo sapien
ggcccgcgtctaaataaagcgccag

SEQ ID NO: 209813 - DNA, 25 bp, Homo sapien
ccgcgtctaaataaagcgccagcgc

SEQ ID NO: 209814 - DNA, 25 bp, Homo sapien
tgccctgaacactcaaggacctgtg

SEQ ID NO: 209815 - DNA, 25 bp, Homo sapien
aaggacctgtgctccttcctccaga

SEQ ID NO: 209816 - DNA, 25 bp, Homo sapien
ttcttaaaacatttccctgagccag

SEQ ID NO: 209817 - DNA, 25 bp, Homo sapien
tttccctgagccagtaaacagtagt

SEQ ID NO: 209818 - DNA, 25 bp, Homo sapien
ttccctgagccagtaaacagtagtt

SEQ ID NO: 209819 - DNA, 25 bp, Homo sapien
ccctgagccagtaaacagtagttta

SEQ ID NO: 209820 - DNA, 25 bp, Homo sapien
tgagccagtaaacagtagtttaatc

SEQ ID NO: 209821 - DNA, 25 bp, Homo sapien
taatcattggtcttttcaaaactag

SEQ ID NO: 209822 - DNA, 25 bp, Homo sapien
atcattggtcttttcaaaactaggt

SEQ ID NO: 209823 - DNA, 25 bp, Homo sapien
cattggtcttttcaaaactaggtgt

SEQ ID NO: 209824 - DNA, 25 bp, Homo sapien
gagacatatatgatattgctgttat

SEQ ID NO: 209825 - DNA, 25 bp, Homo sapien
gatattgctgttatatcaataacat

SEQ ID NO: 209826 - DNA, 25 bp, Homo sapien
atatcaataacatggcacaacaaga

SEQ ID NO: 209827 - DNA, 25 bp, Homo sapien
aattttgtattcctctgcagtttta

SEQ ID NO: 209828 - DNA, 25 bp, Homo sapien
gtttttcttcggtttgctggaacat

SEQ ID NO: 209829 - DNA, 25 bp, Homo sapien
ataaaccgtggtcctttttgcgatg

SEQ ID NO: 209830 - DNA, 25 bp, Homo sapien
ctttttgcgatgtcacgactcttca

SEQ ID NO: 209831 - DNA, 25 bp, Homo sapien
acctgcctgggctgttgtgcacaca

SEQ ID NO: 209832 - DNA, 25 bp, Homo sapien
tgcacacagtgcagcctggatcctg

SEQ ID NO: 209833 - DNA, 25 bp, Homo sapien
ctggatcctgtcgatctttacttgt

SEQ ID NO: 209834 - DNA, 25 bp, Homo sapien
atctttacttgtggcggagctaatg

SEQ ID NO: 209835 - DNA, 25 bp, Homo sapien
ggcggagctaatggtcacattgata

SEQ ID NO: 209836 - DNA, 25 bp, Homo sapien
atagttgattacactgtggcacgaa

SEQ ID NO: 209837 - DNA, 25 bp, Homo sapien
gtggcacgaattaatgcagaacact

SEQ ID NO: 209838 - DNA, 25 bp, Homo sapien
ttctctggagttgctacctgtcttc

SEQ ID NO: 209839 - DNA, 25 bp, Homo sapien
aactggaagattctagggtcctcaa

SEQ ID NO: 209840 - DNA, 25 bp, Homo sapien
gaaaggtgacatgataccctggaaa

SEQ ID NO: 209841 - DNA, 25 bp, Homo sapien
aacttagttgtcagttcgtccttgc

SEQ ID NO: 209842 - DNA, 25 bp, Homo sapien
tcaatgctgtgtggccacggcaaat

SEQ ID NO: 209843 - DNA, 25 bp, Homo sapien
ggccacggcaaattaatgaacatct

SEQ ID NO: 209844 - DNA, 25 bp, Homo sapien
atgaacatctctgagtttcggtctc

SEQ ID NO: 209845 - DNA, 25 bp, Homo sapien
ttcggtctcctgtctaaaatgaggt

SEQ ID NO: 209846 - DNA, 25 bp, Homo sapien
gcttcttgaaggttgtaaggcccca

SEQ ID NO: 209847 - DNA, 25 bp, Homo sapien
gtaaggccccaaacatgctgcctgg

SEQ ID NO: 209848 - DNA, 25 bp, Homo sapien
gctgcctggcacatagatggctaat

SEQ ID NO: 209849 - DNA, 25 bp, Homo sapien
gtatatgatcgcacatcaatgtatg

SEQ ID NO: 209850 - DNA, 25 bp, Homo sapien
gtatgtaggaatcatgctggttctc

SEQ ID NO: 209851 - DNA, 25 bp, Homo sapien
atgctggttctcagggcattgcctg

SEQ ID NO: 209852 - DNA, 25 bp, Homo sapien
ctgtcagctccagattcatcaggac

SEQ ID NO: 209853 - DNA, 25 bp, Homo sapien
agattcatcaggacctgctcagcag

SEQ ID NO: 209854 - DNA, 25 bp, Homo sapien
ctggcttggttcaggccgctccagg

SEQ ID NO: 209855 - DNA, 25 bp, Homo sapien
gaagagcagctttcttcaagtcgct

SEQ ID NO: 209856 - DNA, 25 bp, Homo sapien
agctttcttcaagtcgctctttagc

SEQ ID NO: 209857 - DNA, 25 bp, Homo sapien
cgctctttagccctttgtggttaat

SEQ ID NO: 209858 - DNA, 25 bp, Homo sapien
tagccctttgtggttaatctctcag

SEQ ID NO: 209859 - DNA, 25 bp, Homo sapien
gtggttaatctctcagtactagtta

SEQ ID NO: 209860 - DNA, 25 bp, Homo sapien
gctcacggccaggattatggtggct

SEQ ID NO: 209861 - DNA, 25 bp, Homo sapien
tggcttggaggcagtagaactgctt

SEQ ID NO: 209862 - DNA, 25 bp, Homo sapien
gcttggaggcagtagaactgcttga

SEQ ID NO: 209863 - DNA, 25 bp, Homo sapien
gcggaggttacagttatccgaggtt

SEQ ID NO: 209864 - DNA, 25 bp, Homo sapien
gaggttacagttatccgaggttgtg

SEQ ID NO: 209865 - DNA, 25 bp, Homo sapien
ggttacagttatccgaggttgtgtc

SEQ ID NO: 209866 - DNA, 25 bp, Homo sapien
ttacagttatccgaggttgtgtcat

SEQ ID NO: 209867 - DNA, 25 bp, Homo sapien
tacagttatccgaggttgtgtcatt

SEQ ID NO: 209868 - DNA, 25 bp, Homo sapien
cagttatccgaggttgtgtcattgc

SEQ ID NO: 209869 - DNA, 25 bp, Homo sapien
gttatccgaggttgtgtcattgcac

SEQ ID NO: 209870 - DNA, 25 bp, Homo sapien
ttatccgaggttgtgtcattgcact

SEQ ID NO: 209871 - DNA, 25 bp, Homo sapien
gagcagcttttttattacattgaat

SEQ ID NO: 209872 - DNA, 25 bp, Homo sapien
ataaagtgcatgttaccttagaaaa

SEQ ID NO: 209873 - DNA, 25 bp, Homo sapien
aaaattagtatttgctgctttactc

SEQ ID NO: 209874 - DNA, 25 bp, Homo sapien
atttccaatatgtatcttgactgca

SEQ ID NO: 209875 - DNA, 25 bp, Homo sapien
cttgactgcattttgtaatatttac

SEQ ID NO: 209876 - DNA, 25 bp, Homo sapien
tctgctttaaagtactgaactgggc

SEQ ID NO: 209877 - DNA, 25 bp, Homo sapien
tttaaagtactgaactgggcatgaa

SEQ ID NO: 209878 - DNA, 25 bp, Homo sapien
taaactggatgttgcttaaaatctg

SEQ ID NO: 209879 - DNA, 25 bp, Homo sapien
gcttaaaatctgtatcactgccatg

SEQ ID NO: 209880 - DNA, 25 bp, Homo sapien
aaatctgtatcactgccatgttgaa

SEQ ID NO: 209881 - DNA, 25 bp, Homo sapien
gtatcactgccatgttgaaaattca

SEQ ID NO: 209882 - DNA, 25 bp, Homo sapien
ccaacatatagtgaaacccagtctc

SEQ ID NO: 209883 - DNA, 25 bp, Homo sapien
caacatatagtgaaacccagtctct

SEQ ID NO: 209884 - DNA, 25 bp, Homo sapien
aacatatagtgaaacccagtctcta

SEQ ID NO: 209885 - DNA, 25 bp, Homo sapien
attagctaggtgtggtggcgcacac

SEQ ID NO: 209886 - DNA, 25 bp, Homo sapien
ttagctaggtgtggtggcgcacacc

SEQ ID NO: 209887 - DNA, 25 bp, Homo sapien
tagctaggtgtggtggcgcacacct

SEQ ID NO: 209888 - DNA, 25 bp, Homo sapien
acctgtagtagtcccagctacatgg

SEQ ID NO: 209889 - DNA, 25 bp, Homo sapien
cctgtagtagtcccagctacatggg

SEQ ID NO: 209890 - DNA, 25 bp, Homo sapien
ctgtagtagtcccagctacatggga

SEQ ID NO: 209891 - DNA, 25 bp, Homo sapien
tgtagtagtcccagctacatgggaa

SEQ ID NO: 209892 - DNA, 25 bp, Homo sapien
gtagtagtcccagctacatgggaag

SEQ ID NO: 209893 - DNA, 25 bp, Homo sapien
atgtatttattgtgagaatggctac

SEQ ID NO: 209894 - DNA, 25 bp, Homo sapien
gagaatggctacacttctttaggaa

SEQ ID NO: 209895 - DNA, 25 bp, Homo sapien
ggctacacttctttaggaatgcccc

SEQ ID NO: 209896 - DNA, 25 bp, Homo sapien
aatgcccccacttacaaccaggtgg

SEQ ID NO: 209897 - DNA, 25 bp, Homo sapien
ccaggtgggtggaacaggcatgtga

SEQ ID NO: 209898 - DNA, 25 bp, Homo sapien
tctaggcctatatgggacaatcaat

SEQ ID NO: 209899 - DNA, 25 bp, Homo sapien
gacaatcaattctgactgagctccc

SEQ ID NO: 209900 - DNA, 25 bp, Homo sapien
ttcccctcgggtgaggatgactgtt

SEQ ID NO: 209901 - DNA, 25 bp, Homo sapien
cctcgggtgaggatgactgttattt

SEQ ID NO: 209902 - DNA, 25 bp, Homo sapien
ggtgaggatgactgttatttttgta

SEQ ID NO: 209903 - DNA, 25 bp, Homo sapien
tgagaacgtggaatcccacgggttt

SEQ ID NO: 209904 - DNA, 25 bp, Homo sapien
aatgcagcgggaagctaattcttga

SEQ ID NO: 209905 - DNA, 25 bp, Homo sapien
agctaattcttgaaatatgcacatt

SEQ ID NO: 209906 - DNA, 25 bp, Homo sapien
tgcacattatagttactcagtctca

SEQ ID NO: 209907 - DNA, 25 bp, Homo sapien
gtctcacatactctagttactggca

SEQ ID NO: 209908 - DNA, 25 bp, Homo sapien
tctagttactggcaaagaagttact

SEQ ID NO: 209909 - DNA, 25 bp, Homo sapien
gaatatgtcattcaaaggcataggg

SEQ ID NO: 209910 - DNA, 25 bp, Homo sapien
gggcctttgaatggaacaaatgctt

SEQ ID NO: 209911 - DNA, 25 bp, Homo sapien
aaacctccaacaactgtgaatttat

SEQ ID NO: 209912 - DNA, 25 bp, Homo sapien
aagagtgatttacactgaatttcaa

SEQ ID NO: 209913 - DNA, 25 bp, Homo sapien
gtaagggctataacatacatgtcaa

SEQ ID NO: 209914 - DNA, 25 bp, Homo sapien
acatacatgtcaatatcactgtttt

SEQ ID NO: 209915 - DNA, 25 bp, Homo sapien
tggtattttatacttgccttcttcc

SEQ ID NO: 209916 - DNA, 25 bp, Homo sapien
gtattttatacttgccttcttcctg

SEQ ID NO: 209917 - DNA, 25 bp, Homo sapien
tattttatacttgccttcttcctgt

SEQ ID NO: 209918 - DNA, 25 bp, Homo sapien
ttttatacttgccttcttcctgtac

SEQ ID NO: 209919 - DNA, 25 bp, Homo sapien
ttatacttgccttcttcctgtacag

SEQ ID NO: 209920 - DNA, 25 bp, Homo sapien
atacttgccttcttcctgtacaggg

SEQ ID NO: 209921 - DNA, 25 bp, Homo sapien
acttgccttcttcctgtacagggct

SEQ ID NO: 209922 - DNA, 25 bp, Homo sapien
gccttcttcctgtacagggctggga

SEQ ID NO: 209923 - DNA, 25 bp, Homo sapien
ttcttcctgtacagggctgggaaag

SEQ ID NO: 209924 - DNA, 25 bp, Homo sapien
aggagggctcctaacagtgtaactt

SEQ ID NO: 209925 - DNA, 25 bp, Homo sapien
ttgtgtccccgcgtatttatttgtt

SEQ ID NO: 209926 - DNA, 25 bp, Homo sapien
aaggttatatgtccggtcaccgtat

SEQ ID NO: 209927 - DNA, 25 bp, Homo sapien
tgagatctaattgtggttgccccta

SEQ ID NO: 209928 - DNA, 25 bp, Homo sapien
ttgcatttccctctcgcacattcta

SEQ ID NO: 209929 - DNA, 25 bp, Homo sapien
gcacattctacacccaagtgcctaa

SEQ ID NO: 209930 - DNA, 25 bp, Homo sapien
ttctacacccaagtgcctaaaagat

SEQ ID NO: 209931 - DNA, 25 bp, Homo sapien
gtgggtagtgttaccggaagccatt

SEQ ID NO: 209932 - DNA, 25 bp, Homo sapien
gtagtgttaccggaagccattgtgt

SEQ ID NO: 209933 - DNA, 25 bp, Homo sapien
gtgttaccggaagccattgtgttca

SEQ ID NO: 209934 - DNA, 25 bp, Homo sapien
gttaccggaagccattgtgttcaca

SEQ ID NO: 209935 - DNA, 25 bp, Homo sapien
accggaagccattgtgttcacacgg

SEQ ID NO: 209936 - DNA, 25 bp, Homo sapien
gggaaatgccgtatatatttttcaa

SEQ ID NO: 209937 - DNA, 25 bp, Homo sapien
gcagtggcagacctcagctctctgg

SEQ ID NO: 209938 - DNA, 25 bp, Homo sapien
agtggcagacctcagctctctggac

SEQ ID NO: 209939 - DNA, 25 bp, Homo sapien
ccctcctacagcactagagctaaat

SEQ ID NO: 209940 - DNA, 25 bp, Homo sapien
cagcactagagctaaatcatgaagt

SEQ ID NO: 209941 - DNA, 25 bp, Homo sapien
gagctaaatcatgaagttgaattgt

SEQ ID NO: 209942 - DNA, 25 bp, Homo sapien
attgtaggaatttaccaccgtagtg

SEQ ID NO: 209943 - DNA, 25 bp, Homo sapien
gtaggaatttaccaccgtagtgtat

SEQ ID NO: 209944 - DNA, 25 bp, Homo sapien
gaatttaccaccgtagtgtatctga

SEQ ID NO: 209945 - DNA, 25 bp, Homo sapien
tttaccaccgtagtgtatctgaatc

SEQ ID NO: 209946 - DNA, 25 bp, Homo sapien
accaccgtagtgtatctgaatcata

SEQ ID NO: 209947 - DNA, 25 bp, Homo sapien
accgtagtgtatctgaatcataaac

SEQ ID NO: 209948 - DNA, 25 bp, Homo sapien
tttagcttgttttacctacatctag

SEQ ID NO: 209949 - DNA, 25 bp, Homo sapien
cctacatctagtttcatttcatctt

SEQ ID NO: 209950 - DNA, 25 bp, Homo sapien
tttgctttgttgactctgctaccgc

SEQ ID NO: 209951 - DNA, 25 bp, Homo sapien
taccgctgatgtttgccttgtcaat

SEQ ID NO: 209952 - DNA, 25 bp, Homo sapien
gatgtttgccttgtcaatatcagaa

SEQ ID NO: 209953 - DNA, 25 bp, Homo sapien
gggcatcagtgtcccgtgaaataca

SEQ ID NO: 209954 - DNA, 25 bp, Homo sapien
gtgtcccgtgaaatacattttgttg

SEQ ID NO: 209955 - DNA, 25 bp, Homo sapien
attttgttgtgctatgagcctctgt

SEQ ID NO: 209956 - DNA, 25 bp, Homo sapien
gagcctctgtaatcaaatgcttgta

SEQ ID NO: 209957 - DNA, 25 bp, Homo sapien
acatactttgacaaccccagtgagt

SEQ ID NO: 209958 - DNA, 25 bp, Homo sapien
gacaaccccagtgagttacttaata

SEQ ID NO: 209959 - DNA, 25 bp, Homo sapien
tgaaggaccctgaggagcttcgcaa

SEQ ID NO: 209960 - DNA, 25 bp, Homo sapien
aggaccctgaggagcttcgcaacta

SEQ ID NO: 209961 - DNA, 25 bp, Homo sapien
gaggagcttcgcaactacatggaga

SEQ ID NO: 209962 - DNA, 25 bp, Homo sapien
gagcttcgcaactacatggagagga

SEQ ID NO: 209963 - DNA, 25 bp, Homo sapien
acgagggtggaggtcccactgagcc

SEQ ID NO: 209964 - DNA, 25 bp, Homo sapien
actcgtctggtgcttgttgatccaa

SEQ ID NO: 209965 - DNA, 25 bp, Homo sapien
gtctggtgcttgttgatccaagtcc

SEQ ID NO: 209966 - DNA, 25 bp, Homo sapien
gtgcttgttgatccaagtcccctgc

SEQ ID NO: 209967 - DNA, 25 bp, Homo sapien
cctgccccttgtcatggaccatggt

SEQ ID NO: 209968 - DNA, 25 bp, Homo sapien
cccttgtcatggaccatggtcgtga

SEQ ID NO: 209969 - DNA, 25 bp, Homo sapien
accatggtcgtgaggaagggctcat

SEQ ID NO: 209970 - DNA, 25 bp, Homo sapien
acagtggaaccatgtttgtgagcag

SEQ ID NO: 209971 - DNA, 25 bp, Homo sapien
aaccatgtttgtgagcagtttcaag

SEQ ID NO: 209972 - DNA, 25 bp, Homo sapien
gattttaattgttcccatcctgacc

SEQ ID NO: 209973 - DNA, 25 bp, Homo sapien
aattgttcccatcctgaccaggcaa

SEQ ID NO: 209974 - DNA, 25 bp, Homo sapien
cctgaccaggcaaaaagtccatttt

SEQ ID NO: 209975 - DNA, 25 bp, Homo sapien
aaaagtccattttgatgctcagaaa

SEQ ID NO: 209976 - DNA, 25 bp, Homo sapien
ttgtcagagcccagaaaatatacga

SEQ ID NO: 209977 - DNA, 25 bp, Homo sapien
gcccagaaaatatacgagaccctta

SEQ ID NO: 209978 - DNA, 25 bp, Homo sapien
gaagtcacagatagaaacccaaata

SEQ ID NO: 209979 - DNA, 25 bp, Homo sapien
gaaacccaaataaccttgatcaagg

SEQ ID NO: 209980 - DNA, 25 bp, Homo sapien
aaactggatgaatctgtggaaattt

SEQ ID NO: 209981 - DNA, 25 bp, Homo sapien
gcagcagtgctggatggaattgtct

SEQ ID NO: 209982 - DNA, 25 bp, Homo sapien
gatggaattgtctaggctgtggcat

SEQ ID NO: 209983 - DNA, 25 bp, Homo sapien
ttgtctaggctgtggcatgttggtt

SEQ ID NO: 209984 - DNA, 25 bp, Homo sapien
tttctcctttgattatgtaagagct

SEQ ID NO: 209985 - DNA, 25 bp, Homo sapien
atggtgattatacaggcaagaagac

SEQ ID NO: 209986 - DNA, 25 bp, Homo sapien
gagaaaatgtacctcttctactgga

SEQ ID NO: 209987 - DNA, 25 bp, Homo sapien
tttatcaatatgaaggcaaccttgg

SEQ ID NO: 209988 - DNA, 25 bp, Homo sapien
ggcaaccttggctgataaaacctct

SEQ ID NO: 209989 - DNA, 25 bp, Homo sapien
ggctgataaaacctctatagtgaat

SEQ ID NO: 209990 - DNA, 25 bp, Homo sapien
agtgaatactcacatctttacttca

SEQ ID NO: 209991 - DNA, 25 bp, Homo sapien
catctttacttcactcactatcaat

SEQ ID NO: 209992 - DNA, 25 bp, Homo sapien
cagtggcgtgaacacagctcaccac

SEQ ID NO: 209993 - DNA, 25 bp, Homo sapien
caggctcaagtgatcgttccagttc

SEQ ID NO: 209994 - DNA, 25 bp, Homo sapien
aggctcaagtgatcgttccagttca

SEQ ID NO: 209995 - DNA, 25 bp, Homo sapien
ggctcaagtgatcgttccagttcag

SEQ ID NO: 209996 - DNA, 25 bp, Homo sapien
gctcaagtgatcgttccagttcagc

SEQ ID NO: 209997 - DNA, 25 bp, Homo sapien
tcaagtgatcgttccagttcagcct

SEQ ID NO: 209998 - DNA, 25 bp, Homo sapien
gtgatcgttccagttcagcctcctt

SEQ ID NO: 209999 - DNA, 25 bp, Homo sapien
tgatcgttccagttcagcctcctta

SEQ ID NO: 210000 - DNA, 25 bp, Homo sapien
gatcgttccagttcagcctccttag

SEQ ID NO: 210001 - DNA, 25 bp, Homo sapien
atcgttccagttcagcctccttagt

SEQ ID NO: 210002 - DNA, 25 bp, Homo sapien
tcgttccagttcagcctccttagta

SEQ ID NO: 210003 - DNA, 25 bp, Homo sapien
gtcaccaacgcatgggttttcctgc

SEQ ID NO: 210004 - DNA, 25 bp, Homo sapien
atgggttttcctgctgctgtacatc

SEQ ID NO: 210005 - DNA, 25 bp, Homo sapien
tgtacatcgtccctgagctctgcat

SEQ ID NO: 210006 - DNA, 25 bp, Homo sapien
gatcgtgtagacaggagtgcccttt

SEQ ID NO: 210007 - DNA, 25 bp, Homo sapien
gtgccctttacaaggcaatgcctgc

SEQ ID NO: 210008 - DNA, 25 bp, Homo sapien
taccaacacagcttccaagtggaga

SEQ ID NO: 210009 - DNA, 25 bp, Homo sapien
ctccagagcccgagacagtgatgga

SEQ ID NO: 210010 - DNA, 25 bp, Homo sapien
acttcatatggtactcccattcagc

SEQ ID NO: 210011 - DNA, 25 bp, Homo sapien
attcagccgcagactgttgatccca

SEQ ID NO: 210012 - DNA, 25 bp, Homo sapien
tgttgatcccacacaagagtgtttc

SEQ ID NO: 210013 - DNA, 25 bp, Homo sapien
agagtgtttcatcccacaggctaaa

SEQ ID NO: 210014 - DNA, 25 bp, Homo sapien
aggcactgcttgtatccctgctgat

SEQ ID NO: 210015 - DNA, 25 bp, Homo sapien
gcttgtatccctgctgataagagga

SEQ ID NO: 210016 - DNA, 25 bp, Homo sapien
gggagtcactccaggaataagacaa

SEQ ID NO: 210017 - DNA, 25 bp, Homo sapien
cttcctgtctctggtttaatcatga

SEQ ID NO: 210018 - DNA, 25 bp, Homo sapien
atcatgatgcatggagctacaacag

SEQ ID NO: 210019 - DNA, 25 bp, Homo sapien
ggagctacaacagccatcttaggtc

SEQ ID NO: 210020 - DNA, 25 bp, Homo sapien
acagccatcttaggtccccgaggtg

SEQ ID NO: 210021 - DNA, 25 bp, Homo sapien
gaggtgcccagcatcacgtaaaaca

SEQ ID NO: 210022 - DNA, 25 bp, Homo sapien
gcccagcatcacgtaaaacatcgat

SEQ ID NO: 210023 - DNA, 25 bp, Homo sapien
aaaagagcccaatctctgatgttat

SEQ ID NO: 210024 - DNA, 25 bp, Homo sapien
tctgatgttattgagctcctgcatg

SEQ ID NO: 210025 - DNA, 25 bp, Homo sapien
aggcttatttcatccatatgaggtg

SEQ ID NO: 210026 - DNA, 25 bp, Homo sapien
catccatatgaggtgtcaacttgac

SEQ ID NO: 210027 - DNA, 25 bp, Homo sapien
gactaagaatctagcccttactttt

SEQ ID NO: 210028 - DNA, 25 bp, Homo sapien
atctagcccttacttttaaaagctg

SEQ ID NO: 210029 - DNA, 25 bp, Homo sapien
aaagctgacaggatttcccttgctc

SEQ ID NO: 210030 - DNA, 25 bp, Homo sapien
caggatttcccttgctcagttagaa

SEQ ID NO: 210031 - DNA, 25 bp, Homo sapien
ttaatcgtttaggtttgacagttga

SEQ ID NO: 210032 - DNA, 25 bp, Homo sapien
attgtgttctttgcatattcatgta

SEQ ID NO: 210033 - DNA, 25 bp, Homo sapien
atgtgtgaatgacattgcagtgagc

SEQ ID NO: 210034 - DNA, 25 bp, Homo sapien
gcagtgagctagattaacggtgatt

SEQ ID NO: 210035 - DNA, 25 bp, Homo sapien
atagatacagtagcctgtcaaagaa

SEQ ID NO: 210036 - DNA, 25 bp, Homo sapien
gccagagatgatctgacccggtggg

SEQ ID NO: 210037 - DNA, 25 bp, Homo sapien
agctggaaagcaacactggccccca

SEQ ID NO: 210038 - DNA, 25 bp, Homo sapien
agctgcagccagacagatggtgctt

SEQ ID NO: 210039 - DNA, 25 bp, Homo sapien
tgcttgagaaccgaggcccggtgat

SEQ ID NO: 210040 - DNA, 25 bp, Homo sapien
cactttccatgggacttagaacttc

SEQ ID NO: 210041 - DNA, 25 bp, Homo sapien
ccatgggacttagaacttcggagtt

SEQ ID NO: 210042 - DNA, 25 bp, Homo sapien
agaacttcggagttgctgccttgca

SEQ ID NO: 210043 - DNA, 25 bp, Homo sapien
ctgccttgcaattggaggaaggacc

SEQ ID NO: 210044 - DNA, 25 bp, Homo sapien
ggcccctataggcagcagccaatta

SEQ ID NO: 210045 - DNA, 25 bp, Homo sapien
ataggcagcagccaattacagcccc

SEQ ID NO: 210046 - DNA, 25 bp, Homo sapien
gcagccaattacagccccttttgta

SEQ ID NO: 210047 - DNA, 25 bp, Homo sapien
tagacgcttatatcccgctgcagat

SEQ ID NO: 210048 - DNA, 25 bp, Homo sapien
ccgctgcagatcaactctcatgaga

SEQ ID NO: 210049 - DNA, 25 bp, Homo sapien
actctcatgagagcaaggcagcctt

SEQ ID NO: 210050 - DNA, 25 bp, Homo sapien
aaggcagccttccaccggaagagaa

SEQ ID NO: 210051 - DNA, 25 bp, Homo sapien
gcaattaatggtggccatgccgctt

SEQ ID NO: 210052 - DNA, 25 bp, Homo sapien
tgatcagggtgtctccttgtgcttc

SEQ ID NO: 210053 - DNA, 25 bp, Homo sapien
gtctccttgtgcttctgagatgtgg

SEQ ID NO: 210054 - DNA, 25 bp, Homo sapien
gagaagaggctgctggcttccctaa

SEQ ID NO: 210055 - DNA, 25 bp, Homo sapien
ctgctggcttccctaaaagttgaaa

SEQ ID NO: 210056 - DNA, 25 bp, Homo sapien
agttgacctccccaaactggatgga

SEQ ID NO: 210057 - DNA, 25 bp, Homo sapien
agcagctgtatcatctagacgctta

SEQ ID NO: 210058 - DNA, 25 bp, Homo sapien
gagtggctcattgcttgtacgacat

SEQ ID NO: 210059 - DNA, 25 bp, Homo sapien
ggctcattgcttgtacgacatgaaa

SEQ ID NO: 210060 - DNA, 25 bp, Homo sapien
agtttgttctgccatcctggaaggt

SEQ ID NO: 210061 - DNA, 25 bp, Homo sapien
gttctgccatcctggaaggttgaga

SEQ ID NO: 210062 - DNA, 25 bp, Homo sapien
gggaaatacgtggagacactacgga

SEQ ID NO: 210063 - DNA, 25 bp, Homo sapien
tgctgaagcaagtccccagacctga

SEQ ID NO: 210064 - DNA, 25 bp, Homo sapien
ggatgcggtctagttggctcttagc

SEQ ID NO: 210065 - DNA, 25 bp, Homo sapien
gttggctcttagcagcatcaagctg

SEQ ID NO: 210066 - DNA, 25 bp, Homo sapien
gcatcaagctgtacatgagctagtt

SEQ ID NO: 210067 - DNA, 25 bp, Homo sapien
tacatgagctagtttgtagtgactc

SEQ ID NO: 210068 - DNA, 25 bp, Homo sapien
actggcttgtggttctgtttctaaa

SEQ ID NO: 210069 - DNA, 25 bp, Homo sapien
ggaaccataagaagttgccctgatc

SEQ ID NO: 210070 - DNA, 25 bp, Homo sapien
gaagttgccctgatcattcagacat

SEQ ID NO: 210071 - DNA, 25 bp, Homo sapien
ctgatcattcagacattttgggaaa

SEQ ID NO: 210072 - DNA, 25 bp, Homo sapien
gggaaaaagatgtggccatgccttg

SEQ ID NO: 210073 - DNA, 25 bp, Homo sapien
tgtggccatgccttggatataattt

SEQ ID NO: 210074 - DNA, 25 bp, Homo sapien
taattttaggctattagcttcctca

SEQ ID NO: 210075 - DNA, 25 bp, Homo sapien
gcttcctcaatgctagtatcagttc

SEQ ID NO: 210076 - DNA, 25 bp, Homo sapien
atgctagtatcagttctttggaata

SEQ ID NO: 210077 - DNA, 25 bp, Homo sapien
aatcatgtaatgagtcttgtcttac

SEQ ID NO: 210078 - DNA, 25 bp, Homo sapien
gagtcttgtcttacaaaattatatg

SEQ ID NO: 210079 - DNA, 25 bp, Homo sapien
gtctcttcaaatatcctatcattgt

SEQ ID NO: 210080 - DNA, 25 bp, Homo sapien
atgttcacacaaaacctttgtaatc

SEQ ID NO: 210081 - DNA, 25 bp, Homo sapien
gttcacacaaaacctttgtaatcag

SEQ ID NO: 210082 - DNA, 25 bp, Homo sapien
ttcacacaaaacctttgtaatcagg

SEQ ID NO: 210083 - DNA, 25 bp, Homo sapien
tcacacaaaacctttgtaatcaggg

SEQ ID NO: 210084 - DNA, 25 bp, Homo sapien
tacagtttatataagcaagagtttc

SEQ ID NO: 210085 - DNA, 25 bp, Homo sapien
cagtttatataagcaagagtttcag

SEQ ID NO: 210086 - DNA, 25 bp, Homo sapien
gtttatataagcaagagtttcagta

SEQ ID NO: 210087 - DNA, 25 bp, Homo sapien
ttatataagcaagagtttcagtact

SEQ ID NO: 210088 - DNA, 25 bp, Homo sapien
atataagcaagagtttcagtactaa

SEQ ID NO: 210089 - DNA, 25 bp, Homo sapien
ataagcaagagtttcagtactaagc

SEQ ID NO: 210090 - DNA, 25 bp, Homo sapien
taagcaagagtttcagtactaagca

SEQ ID NO: 210091 - DNA, 25 bp, Homo sapien
gcaaatgcttggtggttcgacttct

SEQ ID NO: 210092 - DNA, 25 bp, Homo sapien
ttggtggttcgacttctccctctgt

SEQ ID NO: 210093 - DNA, 25 bp, Homo sapien
atctgcccactggtctcactaagag

SEQ ID NO: 210094 - DNA, 25 bp, Homo sapien
taagagctttcagatttccctccat

SEQ ID NO: 210095 - DNA, 25 bp, Homo sapien
gatttccctccataggacaggttac

SEQ ID NO: 210096 - DNA, 25 bp, Homo sapien
taggacaggttaccatagacttggg

SEQ ID NO: 210097 - DNA, 25 bp, Homo sapien
gtgggtactcattttctgccagtgg

SEQ ID NO: 210098 - DNA, 25 bp, Homo sapien
gtactcattttctgccagtgggaat

SEQ ID NO: 210099 - DNA, 25 bp, Homo sapien
cagtgggaatgtaaaggcttcatcc

SEQ ID NO: 210100 - DNA, 25 bp, Homo sapien
gaatgtaaaggcttcatcctttgta

SEQ ID NO: 210101 - DNA, 25 bp, Homo sapien
atcctttgtatgtaaccatttggca

SEQ ID NO: 210102 - DNA, 25 bp, Homo sapien
tgtgagccgctgctcctcagagtag

SEQ ID NO: 210103 - DNA, 25 bp, Homo sapien
tcagagtagtcctggcttccttgtt

SEQ ID NO: 210104 - DNA, 25 bp, Homo sapien
ctggcttccttgttgtgtagcagta

SEQ ID NO: 210105 - DNA, 25 bp, Homo sapien
gtagcagtaggaacacctttgcatt

SEQ ID NO: 210106 - DNA, 25 bp, Homo sapien
aacacctttgcattgtcccaaacgg

SEQ ID NO: 210107 - DNA, 25 bp, Homo sapien
tgtcccaaacggaagtagcccaatt

SEQ ID NO: 210108 - DNA, 25 bp, Homo sapien
tagcccaatttgcacactcaatcat

SEQ ID NO: 210109 - DNA, 25 bp, Homo sapien
actcaatcatatcgtgccctaggac

SEQ ID NO: 210110 - DNA, 25 bp, Homo sapien
gtgccctaggacatctcggagagct

SEQ ID NO: 210111 - DNA, 25 bp, Homo sapien
ggctgagttacaaatgggctgagaa

SEQ ID NO: 210112 - DNA, 25 bp, Homo sapien
gggctgagaaaaggaccctcatata

SEQ ID NO: 210113 - DNA, 25 bp, Homo sapien
gtaaaccagtctacattttcccatt

SEQ ID NO: 210114 - DNA, 25 bp, Homo sapien
taaaccagtctacattttcccattt

SEQ ID NO: 210115 - DNA, 25 bp, Homo sapien
aaccagtctacattttcccatttct

SEQ ID NO: 210116 - DNA, 25 bp, Homo sapien
accagtctacattttcccatttctg

SEQ ID NO: 210117 - DNA, 25 bp, Homo sapien
ccagtctacattttcccatttctgt

SEQ ID NO: 210118 - DNA, 25 bp, Homo sapien
cagtctacattttcccatttctgtc

SEQ ID NO: 210119 - DNA, 25 bp, Homo sapien
agtctacattttcccatttctgtct

SEQ ID NO: 210120 - DNA, 25 bp, Homo sapien
gtctacattttcccatttctgtctc

SEQ ID NO: 210121 - DNA, 25 bp, Homo sapien
ctgtctcatcaaaaactgaagttag

SEQ ID NO: 210122 - DNA, 25 bp, Homo sapien
catcaaaaactgaagttagctgggt

SEQ ID NO: 210123 - DNA, 25 bp, Homo sapien
atcaaaaactgaagttagctgggtg

SEQ ID NO: 210124 - DNA, 25 bp, Homo sapien
ggccctgggatgtgatctagctcag

SEQ ID NO: 210125 - DNA, 25 bp, Homo sapien
atgtgatctagctcagatgccctct

SEQ ID NO: 210126 - DNA, 25 bp, Homo sapien
agatgccctctcatccttgatgtca

SEQ ID NO: 210127 - DNA, 25 bp, Homo sapien
gatgtcatagttgagtgcacccaag

SEQ ID NO: 210128 - DNA, 25 bp, Homo sapien
gtggcaatagaactgtgcccctcct

SEQ ID NO: 210129 - DNA, 25 bp, Homo sapien
ttactccaccatgcggacaatcatt

SEQ ID NO: 210130 - DNA, 25 bp, Homo sapien
cattttgtacggatcacgggagcaa

SEQ ID NO: 210131 - DNA, 25 bp, Homo sapien
cgggagcaatgctgtacggttttgt

SEQ ID NO: 210132 - DNA, 25 bp, Homo sapien
gtacactggtggtttgtttcctaga

SEQ ID NO: 210133 - DNA, 25 bp, Homo sapien
aaacccattgtgtctctggatctct

SEQ ID NO: 210134 - DNA, 25 bp, Homo sapien
gtctctggatctctagcacattact

SEQ ID NO: 210135 - DNA, 25 bp, Homo sapien
ttgcccctgcctcctagagggaggt

SEQ ID NO: 210136 - DNA, 25 bp, Homo sapien
tcctagagggaggtctgggttccct

SEQ ID NO: 210137 - DNA, 25 bp, Homo sapien
tgggttcccttctatggctgaccag

SEQ ID NO: 210138 - DNA, 25 bp, Homo sapien
ttctatggctgaccagtgcctgtgg

SEQ ID NO: 210139 - DNA, 25 bp, Homo sapien
gggtgactgccaagcaccaggctcc

SEQ ID NO: 210140 - DNA, 25 bp, Homo sapien
ctgtgacatggcctgggctgacaac

SEQ ID NO: 210141 - DNA, 25 bp, Homo sapien
tccttgcctcaggtgggtgttcaaa

SEQ ID NO: 210142 - DNA, 25 bp, Homo sapien
tgcctcaggtgggtgttcaaaaact

SEQ ID NO: 210143 - DNA, 25 bp, Homo sapien
agtgtggagagcagcagaagaccca

SEQ ID NO: 210144 - DNA, 25 bp, Homo sapien
gaagacccaggaaagcacagttggc

SEQ ID NO: 210145 - DNA, 25 bp, Homo sapien
aagcacagttggcttccgtttctcc

SEQ ID NO: 210146 - DNA, 25 bp, Homo sapien
ttatgttgcggaaaggtaaccacaa

SEQ ID NO: 210147 - DNA, 25 bp, Homo sapien
aaccacaaagttatgatgaactgca

SEQ ID NO: 210148 - DNA, 25 bp, Homo sapien
atgaactgcaaacatccaaaggatg

SEQ ID NO: 210149 - DNA, 25 bp, Homo sapien
atccaaaggatgtgagagtttttct

SEQ ID NO: 210150 - DNA, 25 bp, Homo sapien
taactggttgcactacccatgagga

SEQ ID NO: 210151 - DNA, 25 bp, Homo sapien
gttgcactacccatgaggaattcgt

SEQ ID NO: 210152 - DNA, 25 bp, Homo sapien
ggaattcgtggaatggctactgctg

SEQ ID NO: 210153 - DNA, 25 bp, Homo sapien
ctgctgactaacatgatgcacataa

SEQ ID NO: 210154 - DNA, 25 bp, Homo sapien
aacatgatgcacataaccaaatggg

SEQ ID NO: 210155 - DNA, 25 bp, Homo sapien
gggccaatggcacagtaccttactc

SEQ ID NO: 210156 - DNA, 25 bp, Homo sapien
ggcacagtaccttactcatcattta

SEQ ID NO: 210157 - DNA, 25 bp, Homo sapien
gaatttctcacattcagagttccag

SEQ ID NO: 210158 - DNA, 25 bp, Homo sapien
tcacattcagagttccagtcattat

SEQ ID NO: 210159 - DNA, 25 bp, Homo sapien
gagttccagtcattattgttacatc

SEQ ID NO: 210160 - DNA, 25 bp, Homo sapien
gttacatcatgtttgcagaaacctt

SEQ ID NO: 210161 - DNA, 25 bp, Homo sapien
gaaaccttgtcttatttagtgtcta

SEQ ID NO: 210162 - DNA, 25 bp, Homo sapien
gtcttatttagtgtctatttgcata

SEQ ID NO: 210163 - DNA, 25 bp, Homo sapien
tatttgcatataaccctgaaaacat

SEQ ID NO: 210164 - DNA, 25 bp, Homo sapien
tatacattttcataacctacctttg

SEQ ID NO: 210165 - DNA, 25 bp, Homo sapien
acctacctttgtattaagacttgca

SEQ ID NO: 210166 - DNA, 25 bp, Homo sapien
aagacttgcaattttatcaatctat

SEQ ID NO: 210167 - DNA, 25 bp, Homo sapien
gaaagcaatgttatcgtcatataat

SEQ ID NO: 210168 - DNA, 25 bp, Homo sapien
ccagtgccttcacatcttgaggata

SEQ ID NO: 210169 - DNA, 25 bp, Homo sapien
gtgccttcacatcttgaggatatgc

SEQ ID NO: 210170 - DNA, 25 bp, Homo sapien
gaggatatgcttctgtactttttaa

SEQ ID NO: 210171 - DNA, 25 bp, Homo sapien
gggccggagtctctatactcactcg

SEQ ID NO: 210172 - DNA, 25 bp, Homo sapien
ggagtctctatactcactcgtatga

SEQ ID NO: 210173 - DNA, 25 bp, Homo sapien
tcactcgtatgaggtaccagatcat

SEQ ID NO: 210174 - DNA, 25 bp, Homo sapien
ggtaccagatcatgacaactggccc

SEQ ID NO: 210175 - DNA, 25 bp, Homo sapien
gggacctttctgttgtcaaaaagat

SEQ ID NO: 210176 - DNA, 25 bp, Homo sapien
gacctttaaggagaaagctaagctc

SEQ ID NO: 210177 - DNA, 25 bp, Homo sapien
aaagctaagctctgagctgaggaaa

SEQ ID NO: 210178 - DNA, 25 bp, Homo sapien
gctgaggaaacaaggtgtcctccat

SEQ ID NO: 210179 - DNA, 25 bp, Homo sapien
agattcttttttcactagcggcggt

SEQ ID NO: 210180 - DNA, 25 bp, Homo sapien
gcggcggtttttcttttatgtcttg

SEQ ID NO: 210181 - DNA, 25 bp, Homo sapien
aagaagtatctcattggaccctatt

SEQ ID NO: 210182 - DNA, 25 bp, Homo sapien
ggaccctattatcggaagctgcaca

SEQ ID NO: 210183 - DNA, 25 bp, Homo sapien
aatcctgatcttgggaatatctgcc

SEQ ID NO: 210184 - DNA, 25 bp, Homo sapien
gggaatatctgcctttatcttctta

SEQ ID NO: 210185 - DNA, 25 bp, Homo sapien
gcctttatcttcttaatgttaacgg

SEQ ID NO: 210186 - DNA, 25 bp, Homo sapien
ttaacggtaattctcaaactatgtg

SEQ ID NO: 210187 - DNA, 25 bp, Homo sapien
aatctctttcactgaaatcttgtga

SEQ ID NO: 210188 - DNA, 25 bp, Homo sapien
aatcttgtgatccattctttacctt

SEQ ID NO: 210189 - DNA, 25 bp, Homo sapien
gatccattctttacctttccatttt

SEQ ID NO: 210190 - DNA, 25 bp, Homo sapien
ctgcgaggacccatgcagctgacgc

SEQ ID NO: 210191 - DNA, 25 bp, Homo sapien
tgcgaggacccatgcagctgacgct

SEQ ID NO: 210192 - DNA, 25 bp, Homo sapien
gcgaggacccatgcagctgacgctg

SEQ ID NO: 210193 - DNA, 25 bp, Homo sapien
cgaggacccatgcagctgacgctgg

SEQ ID NO: 210194 - DNA, 25 bp, Homo sapien
gaggacccatgcagctgacgctggg

SEQ ID NO: 210195 - DNA, 25 bp, Homo sapien
aggacccatgcagctgacgctgggg

SEQ ID NO: 210196 - DNA, 25 bp, Homo sapien
gacccatgcagctgacgctgggggg

SEQ ID NO: 210197 - DNA, 25 bp, Homo sapien
tggccgccagcctgctctgggcgtg

SEQ ID NO: 210198 - DNA, 25 bp, Homo sapien
ccgccagcctgctctgggcgtgcgc

SEQ ID NO: 210199 - DNA, 25 bp, Homo sapien
ccagcctgctctgggcgtgcgccgt

SEQ ID NO: 210200 - DNA, 25 bp, Homo sapien
cagcctgctctgggcgtgcgccgtg

SEQ ID NO: 210201 - DNA, 25 bp, Homo sapien
aaagaagtatctcattggaccctat

SEQ ID NO: 210202 - DNA, 25 bp, Homo sapien
gtatctcattggaccctattatcgg

SEQ ID NO: 210203 - DNA, 25 bp, Homo sapien
ttggaccctattatcggaagctgca

SEQ ID NO: 210204 - DNA, 25 bp, Homo sapien
accctattatcggaagctgcacatg

SEQ ID NO: 210205 - DNA, 25 bp, Homo sapien
atcggaagctgcacatggaaagcaa

SEQ ID NO: 210206 - DNA, 25 bp, Homo sapien
aatcctgatcttgggaatatctgcc

SEQ ID NO: 210207 - DNA, 25 bp, Homo sapien
atcttgggaatatctgcctttatct

SEQ ID NO: 210208 - DNA, 25 bp, Homo sapien
gggaatatctgcctttatcttctta

SEQ ID NO: 210209 - DNA, 25 bp, Homo sapien
aatatctgcctttatcttcttaatg

SEQ ID NO: 210210 - DNA, 25 bp, Homo sapien
atctgcctttatcttcttaatgtta

SEQ ID NO: 210211 - DNA, 25 bp, Homo sapien
gcctttatcttcttaatgttaacgg

SEQ ID NO: 210212 - DNA, 25 bp, Homo sapien
gagatgttctcttggcatgctaaat

SEQ ID NO: 210213 - DNA, 25 bp, Homo sapien
atggtgcaacatacgagacatgaat

SEQ ID NO: 210214 - DNA, 25 bp, Homo sapien
aatatagtccaaccatcagcatctc

SEQ ID NO: 210215 - DNA, 25 bp, Homo sapien
ctcatcatgattttaaactgtgcgt

SEQ ID NO: 210216 - DNA, 25 bp, Homo sapien
aactgtgcgtgatataaactcttaa

SEQ ID NO: 210217 - DNA, 25 bp, Homo sapien
tatctttttactttgccagtcatgc

SEQ ID NO: 210218 - DNA, 25 bp, Homo sapien
gtcatgcaaatgtgagtttgccaca

SEQ ID NO: 210219 - DNA, 25 bp, Homo sapien
gtttgccacatgataatcacccttc

SEQ ID NO: 210220 - DNA, 25 bp, Homo sapien
tcacccttcatcagaaatgggaccg

SEQ ID NO: 210221 - DNA, 25 bp, Homo sapien
gcaagtggtaggcagtgtcccttct

SEQ ID NO: 210222 - DNA, 25 bp, Homo sapien
ttctgcttgaaacctattgaaacca

SEQ ID NO: 210223 - DNA, 25 bp, Homo sapien
cagagtgggagaaaagcaagcaatg

SEQ ID NO: 210224 - DNA, 25 bp, Homo sapien
caagcaatggatttgagggcaagca

SEQ ID NO: 210225 - DNA, 25 bp, Homo sapien
tttgagggcaagcagtcccccagga

SEQ ID NO: 210226 - DNA, 25 bp, Homo sapien
ccccaggactggtgtatattaatat

SEQ ID NO: 210227 - DNA, 25 bp, Homo sapien
gtattgcataagatctgcagcgagg

SEQ ID NO: 210228 - DNA, 25 bp, Homo sapien
tcacagagatgccacaggagatttt

SEQ ID NO: 210229 - DNA, 25 bp, Homo sapien
gatgccacaggagattttccatttt

SEQ ID NO: 210230 - DNA, 25 bp, Homo sapien
tttccattttttgaggttaatgcag

SEQ ID NO: 210231 - DNA, 25 bp, Homo sapien
gaggttaatgcagtgatacttaata

SEQ ID NO: 210232 - DNA, 25 bp, Homo sapien
atatgagttggatacagccgggcac

SEQ ID NO: 210233 - DNA, 25 bp, Homo sapien
tgagttggatacagccgggcacagt

SEQ ID NO: 210234 - DNA, 25 bp, Homo sapien
ttaaaaaatcctaccgatcaagatg

SEQ ID NO: 210235 - DNA, 25 bp, Homo sapien
aaatcctaccgatcaagatgagttc

SEQ ID NO: 210236 - DNA, 25 bp, Homo sapien
atcctaccgatcaagatgagttcag

SEQ ID NO: 210237 - DNA, 25 bp, Homo sapien
taccgatcaagatgagttcagctag

SEQ ID NO: 210238 - DNA, 25 bp, Homo sapien
gttcagctagaagtcataccaccct

SEQ ID NO: 210239 - DNA, 25 bp, Homo sapien
tcagctagaagtcataccaccctca

SEQ ID NO: 210240 - DNA, 25 bp, Homo sapien
agctagaagtcataccaccctcagg

SEQ ID NO: 210241 - DNA, 25 bp, Homo sapien
tagaagtcataccaccctcaggaat

SEQ ID NO: 210242 - DNA, 25 bp, Homo sapien
gaagtcataccaccctcaggaatca

SEQ ID NO: 210243 - DNA, 25 bp, Homo sapien
agtcataccaccctcaggaatcagc

SEQ ID NO: 210244 - DNA, 25 bp, Homo sapien
cataccaccctcaggaatcagctaa

SEQ ID NO: 210245 - DNA, 25 bp, Homo sapien
taatgtgctgctaggttttttgttt

SEQ ID NO: 210246 - DNA, 25 bp, Homo sapien
gtggtaccatatgttgcaggaagtc

SEQ ID NO: 210247 - DNA, 25 bp, Homo sapien
gtcaaactggactttttgtggctac

SEQ ID NO: 210248 - DNA, 25 bp, Homo sapien
gtggctactaaatttgcctttaatc

SEQ ID NO: 210249 - DNA, 25 bp, Homo sapien
gcctttaatcttattgttctcaatt

SEQ ID NO: 210250 - DNA, 25 bp, Homo sapien
aagtatgaaaatctgcacaaatgca

SEQ ID NO: 210251 - DNA, 25 bp, Homo sapien
atgcaatgtttacaagaactggttg

SEQ ID NO: 210252 - DNA, 25 bp, Homo sapien
aactggttgattctgggaggcatct

SEQ ID NO: 210253 - DNA, 25 bp, Homo sapien
ggaggcatctgctacagtctctttt

SEQ ID NO: 210254 - DNA, 25 bp, Homo sapien
gctacagtctctttttatatggata

SEQ ID NO: 210255 - DNA, 25 bp, Homo sapien
ggatatgtacatgtcctattctaca

SEQ ID NO: 210256 - DNA, 25 bp, Homo sapien
gaccgtttcagcaccctgggttgtt

SEQ ID NO: 210257 - DNA, 25 bp, Homo sapien
tgggttgttaccacgtcctacaact

SEQ ID NO: 210258 - DNA, 25 bp, Homo sapien
acgtcctacaactctgacatttctt

SEQ ID NO: 210259 - DNA, 25 bp, Homo sapien
gacatttcttgttctcaagcgtttc

SEQ ID NO: 210260 - DNA, 25 bp, Homo sapien
ttcactgtgagttgtctttggtcct

SEQ ID NO: 210261 - DNA, 25 bp, Homo sapien
ctcccacttggtacttgtatcttga

SEQ ID NO: 210262 - DNA, 25 bp, Homo sapien
ggtacttgtatcttgatgctttata

SEQ ID NO: 210263 - DNA, 25 bp, Homo sapien
tgctttataatcctgactctcgacg

SEQ ID NO: 210264 - DNA, 25 bp, Homo sapien
gactctcgacgtgttcatttataca

SEQ ID NO: 210265 - DNA, 25 bp, Homo sapien
ctttgtttttatactgattgcagca

SEQ ID NO: 210266 - DNA, 25 bp, Homo sapien
gattgcagcaatgttggctacatgt

SEQ ID NO: 210267 - DNA, 25 bp, Homo sapien
gaagacactgctctttgtaacccag

SEQ ID NO: 210268 - DNA, 25 bp, Homo sapien
atggttaagccattggataatactg

SEQ ID NO: 210269 - DNA, 25 bp, Homo sapien
gataatactgaatctgtttccctaa

SEQ ID NO: 210270 - DNA, 25 bp, Homo sapien
gaatctgtttccctaagtgacttaa

SEQ ID NO: 210271 - DNA, 25 bp, Homo sapien
agtgacttaaccttagagcaagcac

SEQ ID NO: 210272 - DNA, 25 bp, Homo sapien
aaccttagagcaagcacaacatcca

SEQ ID NO: 210273 - DNA, 25 bp, Homo sapien
cacaacatccaggttaattttttgt

SEQ ID NO: 210274 - DNA, 25 bp, Homo sapien
tctccttttattattgccctcatca

SEQ ID NO: 210275 - DNA, 25 bp, Homo sapien
attgccctcatcatagttcctgatt

SEQ ID NO: 210276 - DNA, 25 bp, Homo sapien
agttcctgattgtctcttaaagtaa

SEQ ID NO: 210277 - DNA, 25 bp, Homo sapien
ggtttatagacattactatttctga

SEQ ID NO: 210278 - DNA, 25 bp, Homo sapien
ttgcagtaaccagcagcattctcag

SEQ ID NO: 210279 - DNA, 25 bp, Homo sapien
tttcagaattcatgcctggtattgc

SEQ ID NO: 210280 - DNA, 25 bp, Homo sapien
tgcctggtattgctgagacatgatg

SEQ ID NO: 210281 - DNA, 25 bp, Homo sapien
agggtcatgaaaagatggccacatc

SEQ ID NO: 210282 - DNA, 25 bp, Homo sapien
gccacatcactgacagcttgacaca

SEQ ID NO: 210283 - DNA, 25 bp, Homo sapien
agcttgacacatgcctcctaagaga

SEQ ID NO: 210284 - DNA, 25 bp, Homo sapien
gagtgcattgctttagtacccgggc

SEQ ID NO: 210285 - DNA, 25 bp, Homo sapien
gtacccgggccagttgagactgaaa

SEQ ID NO: 210286 - DNA, 25 bp, Homo sapien
gattttctttatttggcttgagttc

SEQ ID NO: 210287 - DNA, 25 bp, Homo sapien
ggcttgagttcaatgtggagatttt

SEQ ID NO: 210288 - DNA, 25 bp, Homo sapien
gcttgaagatattatcttctccctg

SEQ ID NO: 210289 - DNA, 25 bp, Homo sapien
gccagttaactctcgtagatagaga

SEQ ID NO: 210290 - DNA, 25 bp, Homo sapien
catgcagctgggtgatgatagaaga

SEQ ID NO: 210291 - DNA, 25 bp, Homo sapien
gtgggctttaactggcaggcctgta

SEQ ID NO: 210292 - DNA, 25 bp, Homo sapien
ggcaggcctgtatgtttacagacta

SEQ ID NO: 210293 - DNA, 25 bp, Homo sapien
gactaccatactgtaaatatgagct

SEQ ID NO: 210294 - DNA, 25 bp, Homo sapien
atatgagctttatggtgtcattctc

SEQ ID NO: 210295 - DNA, 25 bp, Homo sapien
atggtgtcattctcagaaacttata

SEQ ID NO: 210296 - DNA, 25 bp, Homo sapien
agaaacttatacatttccgctctcc

SEQ ID NO: 210297 - DNA, 25 bp, Homo sapien
tctcctttctcctaagtttcatgca

SEQ ID NO: 210298 - DNA, 25 bp, Homo sapien
ttctcctaagtttcatgcagatgaa

SEQ ID NO: 210299 - DNA, 25 bp, Homo sapien
gatatccacaataatatgactggca

SEQ ID NO: 210300 - DNA, 25 bp, Homo sapien
ttaggtggctgtagcatccctacca

SEQ ID NO: 210301 - DNA, 25 bp, Homo sapien
cccaggacactggtgcgaatgacac

SEQ ID NO: 210302 - DNA, 25 bp, Homo sapien
ggtgcgaatgacacaactcaagttg

SEQ ID NO: 210303 - DNA, 25 bp, Homo sapien
tactctgtttaagcagaacaccttg

SEQ ID NO: 210304 - DNA, 25 bp, Homo sapien
ttaagcagaacaccttgtttgcggt

SEQ ID NO: 210305 - DNA, 25 bp, Homo sapien
gtttgcggtgttggaacatggttcc

SEQ ID NO: 210306 - DNA, 25 bp, Homo sapien
acatggttcctttggcagaagtgct

SEQ ID NO: 210307 - DNA, 25 bp, Homo sapien
gatgaagacagctgacccttttgcg

SEQ ID NO: 210308 - DNA, 25 bp, Homo sapien
acccttttgcgcttcagttctggtg

SEQ ID NO: 210309 - DNA, 25 bp, Homo sapien
agttctggtgtgcttaaccatgcaa

SEQ ID NO: 210310 - DNA, 25 bp, Homo sapien
gggctccttgccttaggtggctgta

SEQ ID NO: 210311 - DNA, 25 bp, Homo sapien
tctgtaccccaactcatttaaaata

SEQ ID NO: 210312 - DNA, 25 bp, Homo sapien
tcactttttgccttacttaacgctt

SEQ ID NO: 210313 - DNA, 25 bp, Homo sapien
aacgcttttttctgagcacagggat

SEQ ID NO: 210314 - DNA, 25 bp, Homo sapien
gcacctgcaccccagaaggtgtgag

SEQ ID NO: 210315 - DNA, 25 bp, Homo sapien
gaaggtgtgagctgtctctctgcca

SEQ ID NO: 210316 - DNA, 25 bp, Homo sapien
ctgccaggagctaaggttcattagg

SEQ ID NO: 210317 - DNA, 25 bp, Homo sapien
ggatggtttatcacttctttctttc

SEQ ID NO: 210318 - DNA, 25 bp, Homo sapien
tttcatgtccctgtctaaagagact

SEQ ID NO: 210319 - DNA, 25 bp, Homo sapien
gactttctctttcatacgtcttaaa

SEQ ID NO: 210320 - DNA, 25 bp, Homo sapien
atacgtcttaaatctcatcaatgaa

SEQ ID NO: 210321 - DNA, 25 bp, Homo sapien
gtgaaacagcaccatttcttagtat

SEQ ID NO: 210322 - DNA, 25 bp, Homo sapien
attcactgccatgttgtcctgtggg

SEQ ID NO: 210323 - DNA, 25 bp, Homo sapien
tgtcctgtgggattcatcttcaaag

SEQ ID NO: 210324 - DNA, 25 bp, Homo sapien
ttgacttagattttacctgttactc

SEQ ID NO: 210325 - DNA, 25 bp, Homo sapien
cttctgcattttagtggttccacaa

SEQ ID NO: 210326 - DNA, 25 bp, Homo sapien
gtggttccacaagtaatgtcatgtt

SEQ ID NO: 210327 - DNA, 25 bp, Homo sapien
attcattttttatcccaagaggcct

SEQ ID NO: 210328 - DNA, 25 bp, Homo sapien
caagaggcctttttgaactttgcca

SEQ ID NO: 210329 - DNA, 25 bp, Homo sapien
actttgccaaacctttgtaccacag

SEQ ID NO: 210330 - DNA, 25 bp, Homo sapien
gtaccacagaatgttcatctgaaca

SEQ ID NO: 210331 - DNA, 25 bp, Homo sapien
gaacatgttccaagagccttttagt

SEQ ID NO: 210332 - DNA, 25 bp, Homo sapien
aaaaaaggagatgcgcgcaaccgcg

SEQ ID NO: 210333 - DNA, 25 bp, Homo sapien
agaacgcttagaagttagctaccag

SEQ ID NO: 210334 - DNA, 25 bp, Homo sapien
gcttagaagttagctaccagggttt

SEQ ID NO: 210335 - DNA, 25 bp, Homo sapien
agctaccagggtttagatatagaaa

SEQ ID NO: 210336 - DNA, 25 bp, Homo sapien
aaatccagcaattagagagtgaact

SEQ ID NO: 210337 - DNA, 25 bp, Homo sapien
gagagtgaactacaagacttagaga

SEQ ID NO: 210338 - DNA, 25 bp, Homo sapien
agatggaaaatcaaacattgcagaa

SEQ ID NO: 210339 - DNA, 25 bp, Homo sapien
cattgcagaaaaacctagaagaact

SEQ ID NO: 210340 - DNA, 25 bp, Homo sapien
gcaaaagactagaacagctgggaaa

SEQ ID NO: 210341 - DNA, 25 bp, Homo sapien
aaatccatttagagccagagacttc

SEQ ID NO: 210342 - DNA, 25 bp, Homo sapien
tttagagccagagacttcctccaac

SEQ ID NO: 210343 - DNA, 25 bp, Homo sapien
gagacttcctccaactgggaaaagg

SEQ ID NO: 210344 - DNA, 25 bp, Homo sapien
tgtaccttagcaagttgctccctct

SEQ ID NO: 210345 - DNA, 25 bp, Homo sapien
cctctccagggagcgcatagataca

SEQ ID NO: 210346 - DNA, 25 bp, Homo sapien
gcgcatagatacagcagagctcaca

SEQ ID NO: 210347 - DNA, 25 bp, Homo sapien
agtctccactttctgaacatagctc

SEQ ID NO: 210348 - DNA, 25 bp, Homo sapien
gtcaaacttttctaactggagctca

SEQ ID NO: 210349 - DNA, 25 bp, Homo sapien
gagtaatttaagaaccttcaccaag

SEQ ID NO: 210350 - DNA, 25 bp, Homo sapien
gaaccttcaccaagatacaatgtat

SEQ ID NO: 210351 - DNA, 25 bp, Homo sapien
gacagccattgtttcatatgtttga

SEQ ID NO: 210352 - DNA, 25 bp, Homo sapien
ttattgcacatggttttcccaacat

SEQ ID NO: 210353 - DNA, 25 bp, Homo sapien
gaacaataaatatccatgccaatgg

SEQ ID NO: 210354 - DNA, 25 bp, Homo sapien
ggacaggactgtaccttagcaagtt

SEQ ID NO: 210355 - DNA, 25 bp, Homo sapien
ataagtatcatggtccagcagtact

SEQ ID NO: 210356 - DNA, 25 bp, Homo sapien
atcatggtccagcagtactgtttaa

SEQ ID NO: 210357 - DNA, 25 bp, Homo sapien
tggtccagcagtactgtttaatggg

SEQ ID NO: 210358 - DNA, 25 bp, Homo sapien
gcaaaattctgtttatcccgtgtta

SEQ ID NO: 210359 - DNA, 25 bp, Homo sapien
ttatcccgtgttaccaaattaccat

SEQ ID NO: 210360 - DNA, 25 bp, Homo sapien
gtgttaccaaattaccatttcagtg

SEQ ID NO: 210361 - DNA, 25 bp, Homo sapien
aagtcttctgacttccagtctttca

SEQ ID NO: 210362 - DNA, 25 bp, Homo sapien
caccagatgactgcactggattaga

SEQ ID NO: 210363 - DNA, 25 bp, Homo sapien
aatattggtcatgaactgtgtaagg

SEQ ID NO: 210364 - DNA, 25 bp, Homo sapien
catgcttattgggatcagttttaaa

SEQ ID NO: 210365 - DNA, 25 bp, Homo sapien
gatattaataccagaccaaagacat

SEQ ID NO: 210366 - DNA, 25 bp, Homo sapien
ttacagggtacagttcttcacagct

SEQ ID NO: 210367 - DNA, 25 bp, Homo sapien
cttcacagctgaaatggttagcctg

SEQ ID NO: 210368 - DNA, 25 bp, Homo sapien
aaatggttagcctgagatgctggaa

SEQ ID NO: 210369 - DNA, 25 bp, Homo sapien
atgctggaagcttcaaaggattggt

SEQ ID NO: 210370 - DNA, 25 bp, Homo sapien
gactatgcatggttaaggccatccc

SEQ ID NO: 210371 - DNA, 25 bp, Homo sapien
catggttaaggccatcccgaacttt

SEQ ID NO: 210372 - DNA, 25 bp, Homo sapien
tgaagcatcagagacttattttccc

SEQ ID NO: 210373 - DNA, 25 bp, Homo sapien
gacttattttccctgtaatagaatg

SEQ ID NO: 210374 - DNA, 25 bp, Homo sapien
aatcagggaaaatgggttgctttgt

SEQ ID NO: 210375 - DNA, 25 bp, Homo sapien
gagactattttcatacagttgtcat

SEQ ID NO: 210376 - DNA, 25 bp, Homo sapien
cagttgtcatacacaaggcgcatat

SEQ ID NO: 210377 - DNA, 25 bp, Homo sapien
agtcttatgaattctgtgcctttca

SEQ ID NO: 210378 - DNA, 25 bp, Homo sapien
tctgtgcctttcatcacattcctag

SEQ ID NO: 210379 - DNA, 25 bp, Homo sapien
tagcccactctcatcattactgcag

SEQ ID NO: 210380 - DNA, 25 bp, Homo sapien
cattactgcagaagggtgttgtgat

SEQ ID NO: 210381 - DNA, 25 bp, Homo sapien
gtgttgtgatgaccagttttatact

SEQ ID NO: 210382 - DNA, 25 bp, Homo sapien
ttatactgtgttttgatatgtctag

SEQ ID NO: 210383 - DNA, 25 bp, Homo sapien
aaacctgggaaatcttcaacatgtt

SEQ ID NO: 210384 - DNA, 25 bp, Homo sapien
atatacatggcttaacttatacgtt

SEQ ID NO: 210385 - DNA, 25 bp, Homo sapien
aacttatacgttatggcagctctgt

SEQ ID NO: 210386 - DNA, 25 bp, Homo sapien
ggcagctctgtatacagtttgatct

SEQ ID NO: 210387 - DNA, 25 bp, Homo sapien
tataccactgtgaaactgcaatatg

SEQ ID NO: 210388 - DNA, 25 bp, Homo sapien
ccctgaagctcagttatagtgcact

SEQ ID NO: 210389 - DNA, 25 bp, Homo sapien
gttatagtgcactgatgaactgaga

SEQ ID NO: 210390 - DNA, 25 bp, Homo sapien
actgatgaactgagaggatgcgtgt

SEQ ID NO: 210391 - DNA, 25 bp, Homo sapien
cattctggggttctctgatgcagtg

SEQ ID NO: 210392 - DNA, 25 bp, Homo sapien
gatgtgaagatatggtaccttctca

SEQ ID NO: 210393 - DNA, 25 bp, Homo sapien
gatatggtaccttctcaagtgtagc

SEQ ID NO: 210394 - DNA, 25 bp, Homo sapien
tggtaccttctcaagtgtagctctt

SEQ ID NO: 210395 - DNA, 25 bp, Homo sapien
gtaccttctcaagtgtagctctttc

SEQ ID NO: 210396 - DNA, 25 bp, Homo sapien
accttctcaagtgtagctctttcaa

SEQ ID NO: 210397 - DNA, 25 bp, Homo sapien
tctcaagtgtagctctttcaaatat

SEQ ID NO: 210398 - DNA, 25 bp, Homo sapien
tctttcaaatatagtcaatgctggg

SEQ ID NO: 210399 - DNA, 25 bp, Homo sapien
agggtatggtatgtgggacttcgct

SEQ ID NO: 210400 - DNA, 25 bp, Homo sapien
acctccgcggagagactgcactttg

SEQ ID NO: 210401 - DNA, 25 bp, Homo sapien
tccgcggagagactgcactttgcaa

SEQ ID NO: 210402 - DNA, 25 bp, Homo sapien
ccgcggagagactgcactttgcaat

SEQ ID NO: 210403 - DNA, 25 bp, Homo sapien
ctgcagcgccggtacatagccaagg

SEQ ID NO: 210404 - DNA, 25 bp, Homo sapien
gcgccggtacatagccaaggctcgt

SEQ ID NO: 210405 - DNA, 25 bp, Homo sapien
ggtacatagccaaggctcgtctgcg

SEQ ID NO: 210406 - DNA, 25 bp, Homo sapien
atagccaaggctcgtctgcgcacct

SEQ ID NO: 210407 - DNA, 25 bp, Homo sapien
gtctgcgcaccttgtgtcttgtagg

SEQ ID NO: 210408 - DNA, 25 bp, Homo sapien
gcgcaccttgtgtcttgtagggtat

SEQ ID NO: 210409 - DNA, 25 bp, Homo sapien
caccttgtgtcttgtagggtatggt

SEQ ID NO: 210410 - DNA, 25 bp, Homo sapien
agatccatgtggatggagcctcctt

SEQ ID NO: 210411 - DNA, 25 bp, Homo sapien
gggtcacaggtctttgagactcagc

SEQ ID NO: 210412 - DNA, 25 bp, Homo sapien
gagactcagcctgggctttaatgtg

SEQ ID NO: 210413 - DNA, 25 bp, Homo sapien
taggaaaagccttctggccacccag

SEQ ID NO: 210414 - DNA, 25 bp, Homo sapien
agagccggagccctgcttgctgtat

SEQ ID NO: 210415 - DNA, 25 bp, Homo sapien
tgcttgctgtattctctgctccctt

SEQ ID NO: 210416 - DNA, 25 bp, Homo sapien
tcttcctgctgggttttagccataa

SEQ ID NO: 210417 - DNA, 25 bp, Homo sapien
ttagccataatagggcccggtacga

SEQ ID NO: 210418 - DNA, 25 bp, Homo sapien
ccggtacgatttgggagtgacattt

SEQ ID NO: 210419 - DNA, 25 bp, Homo sapien
gtgaaagagccactaccacagtttt

SEQ ID NO: 210420 - DNA, 25 bp, Homo sapien
accacagtttttacattgattattg

SEQ ID NO: 210421 - DNA, 25 bp, Homo sapien
gaacgcctgctgaatgtgccgctga

SEQ ID NO: 210422 - DNA, 25 bp, Homo sapien
aatgtgccgctgactcagctgtgct

SEQ ID NO: 210423 - DNA, 25 bp, Homo sapien
tgtgctgctttcagccctcctgtga

SEQ ID NO: 210424 - DNA, 25 bp, Homo sapien
acagatgtttttcaagttcctcagt

SEQ ID NO: 210425 - DNA, 25 bp, Homo sapien
ttttcaagttcctcagtttgtactg

SEQ ID NO: 210426 - DNA, 25 bp, Homo sapien
gtactgaaattagggattcatcagg

SEQ ID NO: 210427 - DNA, 25 bp, Homo sapien
attcatcagggcaggaagcaggcag

SEQ ID NO: 210428 - DNA, 25 bp, Homo sapien
agcaggcaggcctctcagaagggag

SEQ ID NO: 210429 - DNA, 25 bp, Homo sapien
agaggaggcctccaaatctattgag

SEQ ID NO: 210430 - DNA, 25 bp, Homo sapien
aaatctattgagtccccacagtttg

SEQ ID NO: 210431 - DNA, 25 bp, Homo sapien
attgagtccccacagtttgctcaag

SEQ ID NO: 210432 - DNA, 25 bp, Homo sapien
ttttgtaaggccaactatttacaag

SEQ ID NO: 210433 - DNA, 25 bp, Homo sapien
tttgtaaggccaactatttacaagt

SEQ ID NO: 210434 - DNA, 25 bp, Homo sapien
atcatgtatatttacacatctgata

SEQ ID NO: 210435 - DNA, 25 bp, Homo sapien
catgtatatttacacatctgataaa

SEQ ID NO: 210436 - DNA, 25 bp, Homo sapien
gtgttaatctttgtgctatatggta

SEQ ID NO: 210437 - DNA, 25 bp, Homo sapien
tgttaatctttgtgctatatggtat

SEQ ID NO: 210438 - DNA, 25 bp, Homo sapien
gttaatctttgtgctatatggtatg

SEQ ID NO: 210439 - DNA, 25 bp, Homo sapien
taatctttgtgctatatggtatgaa

SEQ ID NO: 210440 - DNA, 25 bp, Homo sapien
aatctttgtgctatatggtatgaaa

SEQ ID NO: 210441 - DNA, 25 bp, Homo sapien
ctttgtgctatatggtatgaaatac

SEQ ID NO: 210442 - DNA, 25 bp, Homo sapien
atacaatattgtactcagtgttttg

SEQ ID NO: 210443 - DNA, 25 bp, Homo sapien
aaccctgcttcctcagcaatgagct

SEQ ID NO: 210444 - DNA, 25 bp, Homo sapien
agcaatgagctctcctccagctttg

SEQ ID NO: 210445 - DNA, 25 bp, Homo sapien
gaagccagactccagggactgaaaa

SEQ ID NO: 210446 - DNA, 25 bp, Homo sapien
gactccagggactgaaaaggagcaa

SEQ ID NO: 210447 - DNA, 25 bp, Homo sapien
aaaaggagcaacaaggagagggtct

SEQ ID NO: 210448 - DNA, 25 bp, Homo sapien
gagagggtctgcttgagaaatgcca

SEQ ID NO: 210449 - DNA, 25 bp, Homo sapien
gtctgcttgagaaatgccagatgct

SEQ ID NO: 210450 - DNA, 25 bp, Homo sapien
gcttggtccccaggaactaaggcga

SEQ ID NO: 210451 - DNA, 25 bp, Homo sapien
tccccaggaactaaggcgacagagt

SEQ ID NO: 210452 - DNA, 25 bp, Homo sapien
gggagctggactactttagtcttcc

SEQ ID NO: 210453 - DNA, 25 bp, Homo sapien
agctggactactttagtcttcctaa

SEQ ID NO: 210454 - DNA, 25 bp, Homo sapien
gctgatgctgtactatcacagaaga

SEQ ID NO: 210455 - DNA, 25 bp, Homo sapien
atcacagaagacaagaggagctcaa

SEQ ID NO: 210456 - DNA, 25 bp, Homo sapien
ttaaactcaccatgggcggataaca

SEQ ID NO: 210457 - DNA, 25 bp, Homo sapien
caccatgggcggataacactgcttt

SEQ ID NO: 210458 - DNA, 25 bp, Homo sapien
ggcggataacactgctttgaaaaga

SEQ ID NO: 210459 - DNA, 25 bp, Homo sapien
gacattttcatggagtgaaagacat

SEQ ID NO: 210460 - DNA, 25 bp, Homo sapien
gttcaccagctgatgacacttccaa

SEQ ID NO: 210461 - DNA, 25 bp, Homo sapien
ccagctgatgacacttccaaagaga

SEQ ID NO: 210462 - DNA, 25 bp, Homo sapien
gagctccagcccgagagcctattat

SEQ ID NO: 210463 - DNA, 25 bp, Homo sapien
agcccgagagcctattattagcagt

SEQ ID NO: 210464 - DNA, 25 bp, Homo sapien
gagcctattattagcagtgaggagc

SEQ ID NO: 210465 - DNA, 25 bp, Homo sapien
aatgaaatatctcaattataaaagc

SEQ ID NO: 210466 - DNA, 25 bp, Homo sapien
atgaaatatctcaattataaaagca

SEQ ID NO: 210467 - DNA, 25 bp, Homo sapien
caattataaaagcaacatggccggg

SEQ ID NO: 210468 - DNA, 25 bp, Homo sapien
aattataaaagcaacatggccgggc

SEQ ID NO: 210469 - DNA, 25 bp, Homo sapien
attataaaagcaacatggccgggca

SEQ ID NO: 210470 - DNA, 25 bp, Homo sapien
ttataaaagcaacatggccgggcac

SEQ ID NO: 210471 - DNA, 25 bp, Homo sapien
tataaaagcaacatggccgggcacg

SEQ ID NO: 210472 - DNA, 25 bp, Homo sapien
aattagccaggcgcaccactgtagt

SEQ ID NO: 210473 - DNA, 25 bp, Homo sapien
cctcctcacttgacaactaatgaat

SEQ ID NO: 210474 - DNA, 25 bp, Homo sapien
aaattgatgtgtgcttttgcatttc

SEQ ID NO: 210475 - DNA, 25 bp, Homo sapien
gcttttgcatttcacaatcccttga

SEQ ID NO: 210476 - DNA, 25 bp, Homo sapien
tttgcatttcacaatcccttgagtg

SEQ ID NO: 210477 - DNA, 25 bp, Homo sapien
tcccttgagtgaaacgatggctaat

SEQ ID NO: 210478 - DNA, 25 bp, Homo sapien
ctttctggaccttaagttacagact

SEQ ID NO: 210479 - DNA, 25 bp, Homo sapien
agttacagactagcaggttttttgt

SEQ ID NO: 210480 - DNA, 25 bp, Homo sapien
atctcttcctccctatgggtattag

SEQ ID NO: 210481 - DNA, 25 bp, Homo sapien
cttcctccctatgggtattagaaag

SEQ ID NO: 210482 - DNA, 25 bp, Homo sapien
atatttcactgaattgttcttatat

SEQ ID NO: 210483 - DNA, 25 bp, Homo sapien
taaaatactcagttttcaccctgaa

SEQ ID NO: 210484 - DNA, 25 bp, Homo sapien
aattaggccgggtgccgtggctcat

SEQ ID NO: 210485 - DNA, 25 bp, Homo sapien
attaggccgggtgccgtggctcatg

SEQ ID NO: 210486 - DNA, 25 bp, Homo sapien
ttaggccgggtgccgtggctcatgc

SEQ ID NO: 210487 - DNA, 25 bp, Homo sapien
tagccgggcgtggcacctgtagtcc

SEQ ID NO: 210488 - DNA, 25 bp, Homo sapien
agccgggcgtggcacctgtagtccc

SEQ ID NO: 210489 - DNA, 25 bp, Homo sapien
atgaacccgggtggcggcgcttgca

SEQ ID NO: 210490 - DNA, 25 bp, Homo sapien
cgggtggcggcgcttgcagtgagct

SEQ ID NO: 210491 - DNA, 25 bp, Homo sapien
gggtggcggcgcttgcagtgagctg

SEQ ID NO: 210492 - DNA, 25 bp, Homo sapien
ttgcagtgagctgagctcccaccac

SEQ ID NO: 210493 - DNA, 25 bp, Homo sapien
taaactctcatgttattgttcccag

SEQ ID NO: 210494 - DNA, 25 bp, Homo sapien
gtgagtggaatctagccatgcctct

SEQ ID NO: 210495 - DNA, 25 bp, Homo sapien
tagccatgcctctcctgattattag

SEQ ID NO: 210496 - DNA, 25 bp, Homo sapien
atgcctctcctgattattagtgcct

SEQ ID NO: 210497 - DNA, 25 bp, Homo sapien
attattagtgcctggtgcttctgca

SEQ ID NO: 210498 - DNA, 25 bp, Homo sapien
tggtgcttctgcaccgggcgtccct

SEQ ID NO: 210499 - DNA, 25 bp, Homo sapien
gtccctgcatctgactgctggaaga

SEQ ID NO: 210500 - DNA, 25 bp, Homo sapien
aaagaggcttttcaacagccccagt

SEQ ID NO: 210501 - DNA, 25 bp, Homo sapien
tttcaacagccccagttatcctggc

SEQ ID NO: 210502 - DNA, 25 bp, Homo sapien
tcccctcctgagtagtcatgtgata

SEQ ID NO: 210503 - DNA, 25 bp, Homo sapien
gtagtcatgtgataataaactctca

SEQ ID NO: 210504 - DNA, 25 bp, Homo sapien
agtccattatattattcttcttcac

SEQ ID NO: 210505 - DNA, 25 bp, Homo sapien
ttatattattcttcttcacctttgc

SEQ ID NO: 210506 - DNA, 25 bp, Homo sapien
atattattcttcttcacctttgcat

SEQ ID NO: 210507 - DNA, 25 bp, Homo sapien
tattattcttcttcacctttgcatc

SEQ ID NO: 210508 - DNA, 25 bp, Homo sapien
attattcttcttcacctttgcatcc

SEQ ID NO: 210509 - DNA, 25 bp, Homo sapien
tattcttcttcacctttgcatcctc

SEQ ID NO: 210510 - DNA, 25 bp, Homo sapien
attcttcttcacctttgcatcctca

SEQ ID NO: 210511 - DNA, 25 bp, Homo sapien
aaaagagagaacatcacaaagtcag

SEQ ID NO: 210512 - DNA, 25 bp, Homo sapien
aaagagagaacatcacaaagtcagg

SEQ ID NO: 210513 - DNA, 25 bp, Homo sapien
aagagagaacatcacaaagtcagga

SEQ ID NO: 210514 - DNA, 25 bp, Homo sapien
agtgagccgagttcgcatgccactg

SEQ ID NO: 210515 - DNA, 25 bp, Homo sapien
tgtacagattcaagcaatggatgca

SEQ ID NO: 210516 - DNA, 25 bp, Homo sapien
gatgcaaggaacatgctgtatgtaa

SEQ ID NO: 210517 - DNA, 25 bp, Homo sapien
gaaagaagtccacgttttcggcaga

SEQ ID NO: 210518 - DNA, 25 bp, Homo sapien
agaagtccacgttttcggcagaagt

SEQ ID NO: 210519 - DNA, 25 bp, Homo sapien
agtccacgttttcggcagaagtagt

SEQ ID NO: 210520 - DNA, 25 bp, Homo sapien
ttttcggcagaagtagtgagtcagt

SEQ ID NO: 210521 - DNA, 25 bp, Homo sapien
agaggtgagggtgtgctttactttt

SEQ ID NO: 210522 - DNA, 25 bp, Homo sapien
gagggtgtgctttactttttgataa

SEQ ID NO: 210523 - DNA, 25 bp, Homo sapien
tgtttactcataaacccttcaaaag

SEQ ID NO: 210524 - DNA, 25 bp, Homo sapien
atgtttaccaaacctattgctttat

SEQ ID NO: 210525 - DNA, 25 bp, Homo sapien
tttgtaagatctgacatttcgaggc

SEQ ID NO: 210526 - DNA, 25 bp, Homo sapien
tttctgtatttcacgtgttccttca

SEQ ID NO: 210527 - DNA, 25 bp, Homo sapien
tgaatcttactaggagaggcatggg

SEQ ID NO: 210528 - DNA, 25 bp, Homo sapien
agagacagttctgggagtgtgacct

SEQ ID NO: 210529 - DNA, 25 bp, Homo sapien
agtgtgacctgtaagcctcctgtag

SEQ ID NO: 210530 - DNA, 25 bp, Homo sapien
taagcctcctgtagggcagtgccag

SEQ ID NO: 210531 - DNA, 25 bp, Homo sapien
gtgccaggccttgattgcccacgtt

SEQ ID NO: 210532 - DNA, 25 bp, Homo sapien
agccccgagtgtgcatcacggtaaa

SEQ ID NO: 210533 - DNA, 25 bp, Homo sapien
gtgtgcatcacggtaaaagagctga

SEQ ID NO: 210534 - DNA, 25 bp, Homo sapien
taaaagagctgagggctctcttcag

SEQ ID NO: 210535 - DNA, 25 bp, Homo sapien
agggagcagcccatttaggtctctt

SEQ ID NO: 210536 - DNA, 25 bp, Homo sapien
gcccatttaggtctcttttgttgtt

SEQ ID NO: 210537 - DNA, 25 bp, Homo sapien
ctcctctgggatcttgagcagcagg

SEQ ID NO: 210538 - DNA, 25 bp, Homo sapien
ggagctgccagccaattatcgccat

SEQ ID NO: 210539 - DNA, 25 bp, Homo sapien
aattatcgccatgggcctcccgtgg

SEQ ID NO: 210540 - DNA, 25 bp, Homo sapien
ggccacgtctccttgagaaccaata

SEQ ID NO: 210541 - DNA, 25 bp, Homo sapien
gaaccaataccaaacgagcgcgcga

SEQ ID NO: 210542 - DNA, 25 bp, Homo sapien
acgagcgcgcgaaccttgaaatgtc

SEQ ID NO: 210543 - DNA, 25 bp, Homo sapien
atgtcacgggcttctacggacagga

SEQ ID NO: 210544 - DNA, 25 bp, Homo sapien
aggagcccgcctgagcgcaaagctt

SEQ ID NO: 210545 - DNA, 25 bp, Homo sapien
agcgcaaagctttctgggagttgta

SEQ ID NO: 210546 - DNA, 25 bp, Homo sapien
agttgtagttcttatcccgcgtgga

SEQ ID NO: 210547 - DNA, 25 bp, Homo sapien
taaaggtatccgtggtatcggcaaa

SEQ ID NO: 210548 - DNA, 25 bp, Homo sapien
atatttgaattgttgccccatttgc

SEQ ID NO: 210549 - DNA, 25 bp, Homo sapien
ccccatttgcttttacctgtactgt

SEQ ID NO: 210550 - DNA, 25 bp, Homo sapien
cctgtactgtattcttggtcatctc

SEQ ID NO: 210551 - DNA, 25 bp, Homo sapien
ttcttggtcatctcaaatggcgtct

SEQ ID NO: 210552 - DNA, 25 bp, Homo sapien
aatggcgtctaaacccagctacttt

SEQ ID NO: 210553 - DNA, 25 bp, Homo sapien
tccacctaatttttcatctgtccta

SEQ ID NO: 210554 - DNA, 25 bp, Homo sapien
tttttcatctgtcctagttactggc

SEQ ID NO: 210555 - DNA, 25 bp, Homo sapien
tggctctttcttcatgtcttatttc

SEQ ID NO: 210556 - DNA, 25 bp, Homo sapien
gtcttatttctcttgctttgggagc

SEQ ID NO: 210557 - DNA, 25 bp, Homo sapien
gttccttccttggagccatagttac

SEQ ID NO: 210558 - DNA, 25 bp, Homo sapien
gagccatagttaccctgccaagaag

SEQ ID NO: 210559 - DNA, 25 bp, Homo sapien
aatttcatcaaaggcattagctgac

SEQ ID NO: 210560 - DNA, 25 bp, Homo sapien
catcaaaggcattagctgacaggct

SEQ ID NO: 210561 - DNA, 25 bp, Homo sapien
aaaggcattagctgacaggctggta

SEQ ID NO: 210562 - DNA, 25 bp, Homo sapien
aggcattagctgacaggctggtaac

SEQ ID NO: 210563 - DNA, 25 bp, Homo sapien
gcattagctgacaggctggtaacag

SEQ ID NO: 210564 - DNA, 25 bp, Homo sapien
ttagctgacaggctggtaacagtcc

SEQ ID NO: 210565 - DNA, 25 bp, Homo sapien
agctgacaggctggtaacagtccac

SEQ ID NO: 210566 - DNA, 25 bp, Homo sapien
gctgacaggctggtaacagtccaca

SEQ ID NO: 210567 - DNA, 25 bp, Homo sapien
tgacaggctggtaacagtccacaca

SEQ ID NO: 210568 - DNA, 25 bp, Homo sapien
gacaggctggtaacagtccacacaa

SEQ ID NO: 210569 - DNA, 25 bp, Homo sapien
aacagtccacacaagatggtatagg

SEQ ID NO: 210570 - DNA, 25 bp, Homo sapien
attactgaagactgcacttccttga

SEQ ID NO: 210571 - DNA, 25 bp, Homo sapien
acttccttgaacagagtgctcttct

SEQ ID NO: 210572 - DNA, 25 bp, Homo sapien
gtgctcttctcagcaaatcggaaat

SEQ ID NO: 210573 - DNA, 25 bp, Homo sapien
ggaaatgcctacacaaatcgcttta

SEQ ID NO: 210574 - DNA, 25 bp, Homo sapien
aaagcagcacctttctcaatgttct

SEQ ID NO: 210575 - DNA, 25 bp, Homo sapien
ctcaatgttctcgttcaggtgacaa

SEQ ID NO: 210576 - DNA, 25 bp, Homo sapien
caggtgacaattcttcttggtctca

SEQ ID NO: 210577 - DNA, 25 bp, Homo sapien
ggtctcagctccaattttattgtca

SEQ ID NO: 210578 - DNA, 25 bp, Homo sapien
taaggatacacatctctgccaggag

SEQ ID NO: 210579 - DNA, 25 bp, Homo sapien
gaacctgttgcttgtcgaggtggtt

SEQ ID NO: 210580 - DNA, 25 bp, Homo sapien
aatgtctgatctgttctagaaccct

SEQ ID NO: 210581 - DNA, 25 bp, Homo sapien
agttctctcatccttatgaatctgt

SEQ ID NO: 210582 - DNA, 25 bp, Homo sapien
ctgttgtgttgttttgattccatca

SEQ ID NO: 210583 - DNA, 25 bp, Homo sapien
tttgattccatcattaatgcacttg

SEQ ID NO: 210584 - DNA, 25 bp, Homo sapien
ggagacttgtgataagctgctgctc

SEQ ID NO: 210585 - DNA, 25 bp, Homo sapien
gataagctgctgctcctatattttt

SEQ ID NO: 210586 - DNA, 25 bp, Homo sapien
gggaaatcatctcggtaatcatgga

SEQ ID NO: 210587 - DNA, 25 bp, Homo sapien
atctcggtaatcatggaacctaagg

SEQ ID NO: 210588 - DNA, 25 bp, Homo sapien
ggaacctaaggatgtgatttgtttt

SEQ ID NO: 210589 - DNA, 25 bp, Homo sapien
gtatgtactacttttatggcagtca

SEQ ID NO: 210590 - DNA, 25 bp, Homo sapien
ggcagtcatatgaaccattatctta

SEQ ID NO: 210591 - DNA, 25 bp, Homo sapien
attatcttagcatggtaaacctggg

SEQ ID NO: 210592 - DNA, 25 bp, Homo sapien
aaatgaatgtcgaagctatctgctc

SEQ ID NO: 210593 - DNA, 25 bp, Homo sapien
aagctatctgctctgttaaattaag

SEQ ID NO: 210594 - DNA, 25 bp, Homo sapien
gaagatccaaaatttcaagggtagg

SEQ ID NO: 210595 - DNA, 25 bp, Homo sapien
gaaagagcccttttatagcccaccg

SEQ ID NO: 210596 - DNA, 25 bp, Homo sapien
ccttttatagcccaccgtagtggtg

SEQ ID NO: 210597 - DNA, 25 bp, Homo sapien
tgggtgactggcctctagtttatat

SEQ ID NO: 210598 - DNA, 25 bp, Homo sapien
gactggcctctagtttatataatta

SEQ ID NO: 210599 - DNA, 25 bp, Homo sapien
taattatttacctctttggcagtac

SEQ ID NO: 210600 - DNA, 25 bp, Homo sapien
ttacctctttggcagtacagataac

SEQ ID NO: 210601 - DNA, 25 bp, Homo sapien
agataacaaaatacactttactggt

SEQ ID NO: 210602 - DNA, 25 bp, Homo sapien
cccttagttcccattaaaatatgca

SEQ ID NO: 210603 - DNA, 25 bp, Homo sapien
aaaggtttacttccagcatctgagc

SEQ ID NO: 210604 - DNA, 25 bp, Homo sapien
aaggtttacttccagcatctgagct

SEQ ID NO: 210605 - DNA, 25 bp, Homo sapien
aggtttacttccagcatctgagctc

SEQ ID NO: 210606 - DNA, 25 bp, Homo sapien
tacttccagcatctgagctctggct

SEQ ID NO: 210607 - DNA, 25 bp, Homo sapien
acttccagcatctgagctctggctc

SEQ ID NO: 210608 - DNA, 25 bp, Homo sapien
ttccagcatctgagctctggctctc

SEQ ID NO: 210609 - DNA, 25 bp, Homo sapien
tccagcatctgagctctggctctca

SEQ ID NO: 210610 - DNA, 25 bp, Homo sapien
ccagcatctgagctctggctctcac

SEQ ID NO: 210611 - DNA, 25 bp, Homo sapien
tgagctctggctctcacccctgaag

SEQ ID NO: 210612 - DNA, 25 bp, Homo sapien
agctctggctctcacccctgaagct

SEQ ID NO: 210613 - DNA, 25 bp, Homo sapien
ctggctctcacccctgaagctcagt

SEQ ID NO: 210614 - DNA, 25 bp, Homo sapien
atgagcgctgtactatggtagttcc

SEQ ID NO: 210615 - DNA, 25 bp, Homo sapien
tgagcgctgtactatggtagttccc

SEQ ID NO: 210616 - DNA, 25 bp, Homo sapien
gagcgctgtactatggtagttccct

SEQ ID NO: 210617 - DNA, 25 bp, Homo sapien
agcgctgtactatggtagttccctt

SEQ ID NO: 210618 - DNA, 25 bp, Homo sapien
gcgctgtactatggtagttccctta

SEQ ID NO: 210619 - DNA, 25 bp, Homo sapien
cgctgtactatggtagttcccttag

SEQ ID NO: 210620 - DNA, 25 bp, Homo sapien
gagctgcagcagttgtaccctttct

SEQ ID NO: 210621 - DNA, 25 bp, Homo sapien
agctgcagcagttgtaccctttctt

SEQ ID NO: 210622 - DNA, 25 bp, Homo sapien
ctgcagcagttgtaccctttcttga

SEQ ID NO: 210623 - DNA, 25 bp, Homo sapien
tgcagcagttgtaccctttcttgat

SEQ ID NO: 210624 - DNA, 25 bp, Homo sapien
gcagcagttgtaccctttcttgatg

SEQ ID NO: 210625 - DNA, 25 bp, Homo sapien
gtctagtcttaaatttgtacatctt

SEQ ID NO: 210626 - DNA, 25 bp, Homo sapien
ataaactatgaatgtttcctgtata

SEQ ID NO: 210627 - DNA, 25 bp, Homo sapien
atagttgaaaggctaacctgctcaa

SEQ ID NO: 210628 - DNA, 25 bp, Homo sapien
ggctaacctgctcaaaggataccaa

SEQ ID NO: 210629 - DNA, 25 bp, Homo sapien
taatggtttaactggacaacctgaa

SEQ ID NO: 210630 - DNA, 25 bp, Homo sapien
aactggacaacctgaaaattagcat

SEQ ID NO: 210631 - DNA, 25 bp, Homo sapien
acaatcctttgttatattttagtga

SEQ ID NO: 210632 - DNA, 25 bp, Homo sapien
ttagtgatccacaagattgagaaaa

SEQ ID NO: 210633 - DNA, 25 bp, Homo sapien
attcttgtctactttatcctgtctg

SEQ ID NO: 210634 - DNA, 25 bp, Homo sapien
gtctactttatcctgtctggttaca

SEQ ID NO: 210635 - DNA, 25 bp, Homo sapien
tactttatcctgtctggttacaaaa

SEQ ID NO: 210636 - DNA, 25 bp, Homo sapien
tgatggtttccctaaagttattacg

SEQ ID NO: 210637 - DNA, 25 bp, Homo sapien
gttattacggaaacagacccctgct

SEQ ID NO: 210638 - DNA, 25 bp, Homo sapien
gacccctgctttcgaatttacatgt

SEQ ID NO: 210639 - DNA, 25 bp, Homo sapien
gctttcgaatttacatgttcatgat

SEQ ID NO: 210640 - DNA, 25 bp, Homo sapien
atgttcatgatgtgcccttgttgta

SEQ ID NO: 210641 - DNA, 25 bp, Homo sapien
gatgtgcccttgttgtaaaccttta

SEQ ID NO: 210642 - DNA, 25 bp, Homo sapien
tgtaaacctttacctgtcacttgtt

SEQ ID NO: 210643 - DNA, 25 bp, Homo sapien
acctgtcacttgtttacgtgggtct

SEQ ID NO: 210644 - DNA, 25 bp, Homo sapien
cacttgtttacgtgggtctcctatt

SEQ ID NO: 210645 - DNA, 25 bp, Homo sapien
attgtgtttttgaaccagtctgtaa

SEQ ID NO: 210646 - DNA, 25 bp, Homo sapien
catggaaagatgctcattatagtga

SEQ ID NO: 210647 - DNA, 25 bp, Homo sapien
ggcagggaagtcagacctgacaccc

SEQ ID NO: 210648 - DNA, 25 bp, Homo sapien
tgacacccagtacaccggccgcaag

SEQ ID NO: 210649 - DNA, 25 bp, Homo sapien
aagcgcaagccccgcttctaagtca

SEQ ID NO: 210650 - DNA, 25 bp, Homo sapien
ttctaagtcaccacgcggttctgga

SEQ ID NO: 210651 - DNA, 25 bp, Homo sapien
agtcaccacgcggttctggaaaggc

SEQ ID NO: 210652 - DNA, 25 bp, Homo sapien
accacgcggttctggaaaggcactt

SEQ ID NO: 210653 - DNA, 25 bp, Homo sapien
gcggttctggaaaggcacttgcctc

SEQ ID NO: 210654 - DNA, 25 bp, Homo sapien
ggaaaggcacttgcctctgcacttt

SEQ ID NO: 210655 - DNA, 25 bp, Homo sapien
cttgcctctgcacttttctatattg

SEQ ID NO: 210656 - DNA, 25 bp, Homo sapien
ttttctatattgttcagctgacaaa

SEQ ID NO: 210657 - DNA, 25 bp, Homo sapien
tgttcagctgacaaagtagtatttt

SEQ ID NO: 210658 - DNA, 25 bp, Homo sapien
ttgcttctgctcagaatctgctcat

SEQ ID NO: 210659 - DNA, 25 bp, Homo sapien
gaatctgctcattcttagaaggcct

SEQ ID NO: 210660 - DNA, 25 bp, Homo sapien
gctcattcttagaaggcctacatta

SEQ ID NO: 210661 - DNA, 25 bp, Homo sapien
gaaggcctacattaacatggatgca

SEQ ID NO: 210662 - DNA, 25 bp, Homo sapien
tgcagaataatttcagaaacccctt

SEQ ID NO: 210663 - DNA, 25 bp, Homo sapien
aattccttaacatctctataaacgc

SEQ ID NO: 210664 - DNA, 25 bp, Homo sapien
tatatcctttattaagcatcatctc

SEQ ID NO: 210665 - DNA, 25 bp, Homo sapien
tcatctccatttcaccatatcctaa

SEQ ID NO: 210666 - DNA, 25 bp, Homo sapien
accatatcctaactgaaatcctata

SEQ ID NO: 210667 - DNA, 25 bp, Homo sapien
atcctatatatttcttgtgtgttct

SEQ ID NO: 210668 - DNA, 25 bp, Homo sapien
tatatttcttgtgtgttcttttcta

SEQ ID NO: 210669 - DNA, 25 bp, Homo sapien
agggtatggtatgtgggacttcgct

SEQ ID NO: 210670 - DNA, 25 bp, Homo sapien
gacttcgctgtttttatctccaata

SEQ ID NO: 210671 - DNA, 25 bp, Homo sapien
acctccgcggagagactgcactttg

SEQ ID NO: 210672 - DNA, 25 bp, Homo sapien
ccgcggagagactgcactttgcaat

SEQ ID NO: 210673 - DNA, 25 bp, Homo sapien
ctgcagcgccggtacatagccaagg

SEQ ID NO: 210674 - DNA, 25 bp, Homo sapien
gcgccggtacatagccaaggctcgt

SEQ ID NO: 210675 - DNA, 25 bp, Homo sapien
ggtacatagccaaggctcgtctgcg

SEQ ID NO: 210676 - DNA, 25 bp, Homo sapien
atagccaaggctcgtctgcgcacct

SEQ ID NO: 210677 - DNA, 25 bp, Homo sapien
gtctgcgcaccttgtgtcttgtagg

SEQ ID NO: 210678 - DNA, 25 bp, Homo sapien
gcgcaccttgtgtcttgtagggtat

SEQ ID NO: 210679 - DNA, 25 bp, Homo sapien
caccttgtgtcttgtagggtatggt

SEQ ID NO: 210680 - DNA, 25 bp, Homo sapien
gtgccaaaggccctgagcaaaagcc

SEQ ID NO: 210681 - DNA, 25 bp, Homo sapien
aaggccctgagcaaaagccagagct

SEQ ID NO: 210682 - DNA, 25 bp, Homo sapien
agagctcctctcatcaaagccttta

SEQ ID NO: 210683 - DNA, 25 bp, Homo sapien
agcctttacaaggtactgggcccag

SEQ ID NO: 210684 - DNA, 25 bp, Homo sapien
tgggcccagaggctttgccttgaca

SEQ ID NO: 210685 - DNA, 25 bp, Homo sapien
ctttgccttgacagagtggcccagg

SEQ ID NO: 210686 - DNA, 25 bp, Homo sapien
gaagggacccacaggaagtcacagt

SEQ ID NO: 210687 - DNA, 25 bp, Homo sapien
aagtcacagtggtgcccagggatgt

SEQ ID NO: 210688 - DNA, 25 bp, Homo sapien
tggtgcccagggatgtgtcagcccc

SEQ ID NO: 210689 - DNA, 25 bp, Homo sapien
gacgcgggattcaagaatgaagtaa

SEQ ID NO: 210690 - DNA, 25 bp, Homo sapien
gaagtaaatacagtcacagccccaa

SEQ ID NO: 210691 - DNA, 25 bp, Homo sapien
aaccagccaggccaggcaaccagtg

SEQ ID NO: 210692 - DNA, 25 bp, Homo sapien
aaaggcaggcaggatcctcaggccc

SEQ ID NO: 210693 - DNA, 25 bp, Homo sapien
gtgacaccacgccagatcacagggc

SEQ ID NO: 210694 - DNA, 25 bp, Homo sapien
cacagggcaccaggccagagatagt

SEQ ID NO: 210695 - DNA, 25 bp, Homo sapien
gcaccaggccagagatagtcttctt

SEQ ID NO: 210696 - DNA, 25 bp, Homo sapien
agagatagtcttctttttgtccttt

SEQ ID NO: 210697 - DNA, 25 bp, Homo sapien
ttttgtcctttctggcctctggcta

SEQ ID NO: 210698 - DNA, 25 bp, Homo sapien
gcctctggctagtcagtttttcata

SEQ ID NO: 210699 - DNA, 25 bp, Homo sapien
gtttttcatagccttacagtatctg

SEQ ID NO: 210700 - DNA, 25 bp, Homo sapien
agccttacagtatctggctttgtac

SEQ ID NO: 210701 - DNA, 25 bp, Homo sapien
gtatctggctttgtactgagaaata

SEQ ID NO: 210702 - DNA, 25 bp, Homo sapien
gacggccgtgcaggtgaacgcaggc

SEQ ID NO: 210703 - DNA, 25 bp, Homo sapien
agctgagcccagatttgctgctcaa

SEQ ID NO: 210704 - DNA, 25 bp, Homo sapien
gcccagatttgctgctcaactgaga

SEQ ID NO: 210705 - DNA, 25 bp, Homo sapien
tcaactgagaaagcttcatggccta

SEQ ID NO: 210706 - DNA, 25 bp, Homo sapien
agcttcatggcctagaaattctcaa

SEQ ID NO: 210707 - DNA, 25 bp, Homo sapien
gaaattctcaactctacgatgaaat

SEQ ID NO: 210708 - DNA, 25 bp, Homo sapien
aatacatcagtgattcttgagagag

SEQ ID NO: 210709 - DNA, 25 bp, Homo sapien
agagagacagggtttgtgtgcattt

SEQ ID NO: 210710 - DNA, 25 bp, Homo sapien
agatgcacaccgtgtgttgttccta

SEQ ID NO: 210711 - DNA, 25 bp, Homo sapien
ccgtgtgttgttcctatgctaataa

SEQ ID NO: 210712 - DNA, 25 bp, Homo sapien
tgttcctatgctaataaagaccttt

SEQ ID NO: 210713 - DNA, 25 bp, Homo sapien
gagaccttaaaggcttcctatccca

SEQ ID NO: 210714 - DNA, 25 bp, Homo sapien
ttcctatcccaccaattacagggaa

SEQ ID NO: 210715 - DNA, 25 bp, Homo sapien
gatcctgaagcttactatgcagcct

SEQ ID NO: 210716 - DNA, 25 bp, Homo sapien
gaagcttactatgcagcctacaaac

SEQ ID NO: 210717 - DNA, 25 bp, Homo sapien
tatgcagcctacaaacagccttagt

SEQ ID NO: 210718 - DNA, 25 bp, Homo sapien
gcagcctacaaacagccttagtaat

SEQ ID NO: 210719 - DNA, 25 bp, Homo sapien
agcctacaaacagccttagtaatta

SEQ ID NO: 210720 - DNA, 25 bp, Homo sapien
aatgtagcattaactaacgattgga

SEQ ID NO: 210721 - DNA, 25 bp, Homo sapien
gcattaactaacgattggaaactac

SEQ ID NO: 210722 - DNA, 25 bp, Homo sapien
ggaaactacatttacaacttcaaag

SEQ ID NO: 210723 - DNA, 25 bp, Homo sapien
acaacttcaaagctgttttatacat

SEQ ID NO: 210724 - DNA, 25 bp, Homo sapien
tcagcatcacactacatctcaaaat

SEQ ID NO: 210725 - DNA, 25 bp, Homo sapien
taattttgtgcatttgtgtcagaat

SEQ ID NO: 210726 - DNA, 25 bp, Homo sapien
gggctctctttgcttcgagaagtaa

SEQ ID NO: 210727 - DNA, 25 bp, Homo sapien
tcgagaagtaaacctaataccattt

SEQ ID NO: 210728 - DNA, 25 bp, Homo sapien
gctgcattcaacgtcaaaattacct

SEQ ID NO: 210729 - DNA, 25 bp, Homo sapien
cttttgataacttacatgtgtggac

SEQ ID NO: 210730 - DNA, 25 bp, Homo sapien
tgtgtggacaaagctaatagtggtt

SEQ ID NO: 210731 - DNA, 25 bp, Homo sapien
tttttaaacagcaccttgcctgaac

SEQ ID NO: 210732 - DNA, 25 bp, Homo sapien
gcaccttgcctgaacatgactttaa

SEQ ID NO: 210733 - DNA, 25 bp, Homo sapien
tgaaaacatgtttgaacccttattt

SEQ ID NO: 210734 - DNA, 25 bp, Homo sapien
gaacccttattttaattgcaccatt

SEQ ID NO: 210735 - DNA, 25 bp, Homo sapien
tgcatttccgcctggctcctagaag

SEQ ID NO: 210736 - DNA, 25 bp, Homo sapien
agaagccccattcaatatcactact

SEQ ID NO: 210737 - DNA, 25 bp, Homo sapien
atatcactactctttaacgagtgcc

SEQ ID NO: 210738 - DNA, 25 bp, Homo sapien
ttaacgagtgccaaatcttttccca

SEQ ID NO: 210739 - DNA, 25 bp, Homo sapien
agtgccaaatcttttcccacttttg

SEQ ID NO: 210740 - DNA, 25 bp, Homo sapien
cacttttgctcttccccaaggaact

SEQ ID NO: 210741 - DNA, 25 bp, Homo sapien
tcagcacgtggaggcctctcacggt

SEQ ID NO: 210742 - DNA, 25 bp, Homo sapien
ttcctgggacctgagcaggtttggt

SEQ ID NO: 210743 - DNA, 25 bp, Homo sapien
caggtttggtgaaagccaccgtcct

SEQ ID NO: 210744 - DNA, 25 bp, Homo sapien
tcccaggagaaactcccggtgtgtt

SEQ ID NO: 210745 - DNA, 25 bp, Homo sapien
gagaaactcccggtgtgtttctgac

SEQ ID NO: 210746 - DNA, 25 bp, Homo sapien
ggtgagctgacctcacgatgctgtc

SEQ ID NO: 210747 - DNA, 25 bp, Homo sapien
acgatgctgtcctcgtgcgattgcc

SEQ ID NO: 210748 - DNA, 25 bp, Homo sapien
tggacttctgcctttgttggcctga

SEQ ID NO: 210749 - DNA, 25 bp, Homo sapien
ttgttggcctgatgtgctgctgtga

SEQ ID NO: 210750 - DNA, 25 bp, Homo sapien
tgctgctgtgatgctggtccttcat

SEQ ID NO: 210751 - DNA, 25 bp, Homo sapien
ggtccttcatcttaggtgttcatgc

SEQ ID NO: 210752 - DNA, 25 bp, Homo sapien
gttcatgcagttctaacacagttgg

SEQ ID NO: 210753 - DNA, 25 bp, Homo sapien
gggtcaatagtttcccaatttcagg

SEQ ID NO: 210754 - DNA, 25 bp, Homo sapien
aatttcaggatatttcgatgtcaga

SEQ ID NO: 210755 - DNA, 25 bp, Homo sapien
gaaataacgcatcttaggaatgact

SEQ ID NO: 210756 - DNA, 25 bp, Homo sapien
agtttaggctgcacaactggtaaaa

SEQ ID NO: 210757 - DNA, 25 bp, Homo sapien
gtagctaaaggcaagagagcaccaa

SEQ ID NO: 210758 - DNA, 25 bp, Homo sapien
gaacaggtattagaatgaggccgaa

SEQ ID NO: 210759 - DNA, 25 bp, Homo sapien
atgaggccgaagatcacggtgacca

SEQ ID NO: 210760 - DNA, 25 bp, Homo sapien
atcacggtgaccagagatttctagg

SEQ ID NO: 210761 - DNA, 25 bp, Homo sapien
gagatttctaggagtctctaacctt

SEQ ID NO: 210762 - DNA, 25 bp, Homo sapien
ctatcctgttaaccctttagatctc

SEQ ID NO: 210763 - DNA, 25 bp, Homo sapien
gatctctagtataacactcaggcta

SEQ ID NO: 210764 - DNA, 25 bp, Homo sapien
ttttagagcaacaagctgggttact

SEQ ID NO: 210765 - DNA, 25 bp, Homo sapien
gctgggttactttcagagcaaccag

SEQ ID NO: 210766 - DNA, 25 bp, Homo sapien
gagcaaccagcttgactggaactga

SEQ ID NO: 210767 - DNA, 25 bp, Homo sapien
atgtatgaccaatcttagaccctga

SEQ ID NO: 210768 - DNA, 25 bp, Homo sapien
agagaagtaaacatcacacccaact

SEQ ID NO: 210769 - DNA, 25 bp, Homo sapien
ttccttatctttccagtggctaaac

SEQ ID NO: 210770 - DNA, 25 bp, Homo sapien
tgtgcttggagaggcagataacgct

SEQ ID NO: 210771 - DNA, 25 bp, Homo sapien
taacgctgaagcaggcctctcatga

SEQ ID NO: 210772 - DNA, 25 bp, Homo sapien
gatccctctttgtgttgtagtccat

SEQ ID NO: 210773 - DNA, 25 bp, Homo sapien
gttgtagtccatgctattaaaagtg

SEQ ID NO: 210774 - DNA, 25 bp, Homo sapien
aaaagtgtggcccacagaccaagag

SEQ ID NO: 210775 - DNA, 25 bp, Homo sapien
agagcctcaacatttcctagagcct

SEQ ID NO: 210776 - DNA, 25 bp, Homo sapien
tcctagagccttattagaaatgcag

SEQ ID NO: 210777 - DNA, 25 bp, Homo sapien
ctggacccaggacattttgatgaga

SEQ ID NO: 210778 - DNA, 25 bp, Homo sapien
gatccaaaggagttgtatgcacatg

SEQ ID NO: 210779 - DNA, 25 bp, Homo sapien
agctttgctcccattatgattccaa

SEQ ID NO: 210780 - DNA, 25 bp, Homo sapien
gattccaataaggaacgctttccta

SEQ ID NO: 210781 - DNA, 25 bp, Homo sapien
ggaacgctttcctagtgcaatttta

SEQ ID NO: 210782 - DNA, 25 bp, Homo sapien
aatagccaaagataggagacgtctg

SEQ ID NO: 210783 - DNA, 25 bp, Homo sapien
ggagacgtctgaattttgaatgata

SEQ ID NO: 210784 - DNA, 25 bp, Homo sapien
aaaagctgttgttcttcaggaggca

SEQ ID NO: 210785 - DNA, 25 bp, Homo sapien
gttgttcttcaggaggcatttgcct

SEQ ID NO: 210786 - DNA, 25 bp, Homo sapien
gaggcatttgcctaggatattgctg

SEQ ID NO: 210787 - DNA, 25 bp, Homo sapien
ggatattgctggattataccccatt

SEQ ID NO: 210788 - DNA, 25 bp, Homo sapien
gattataccccattggaggctttta

SEQ ID NO: 210789 - DNA, 25 bp, Homo sapien
atttgtatgaattttccaggatttc

SEQ ID NO: 210790 - DNA, 25 bp, Homo sapien
cacagggactcccaccagggtctgg

SEQ ID NO: 210791 - DNA, 25 bp, Homo sapien
acagggactcccaccagggtctggg

SEQ ID NO: 210792 - DNA, 25 bp, Homo sapien
cagggactcccaccagggtctggga

SEQ ID NO: 210793 - DNA, 25 bp, Homo sapien
agggactcccaccagggtctgggag

SEQ ID NO: 210794 - DNA, 25 bp, Homo sapien
ggactcccaccagggtctgggagag

SEQ ID NO: 210795 - DNA, 25 bp, Homo sapien
gtggccccattactgctgccttgct

SEQ ID NO: 210796 - DNA, 25 bp, Homo sapien
tggccccattactgctgccttgctt

SEQ ID NO: 210797 - DNA, 25 bp, Homo sapien
cattactgctgccttgcttcagcca

SEQ ID NO: 210798 - DNA, 25 bp, Homo sapien
attactgctgccttgcttcagccac

SEQ ID NO: 210799 - DNA, 25 bp, Homo sapien
tactgctgccttgcttcagccacct

SEQ ID NO: 210800 - DNA, 25 bp, Homo sapien
tgctgccttgcttcagccacctctc

SEQ ID NO: 210801 - DNA, 25 bp, Homo sapien
aggtctaccgttgagctctggcagg

SEQ ID NO: 210802 - DNA, 25 bp, Homo sapien
gacatggcttctgcatagctgctgc

SEQ ID NO: 210803 - DNA, 25 bp, Homo sapien
tgcatagctgctgcctcctaatctt

SEQ ID NO: 210804 - DNA, 25 bp, Homo sapien
taatcttcctgctagtgggaccacc

SEQ ID NO: 210805 - DNA, 25 bp, Homo sapien
ggagtgtggaaatgcttacgcttga

SEQ ID NO: 210806 - DNA, 25 bp, Homo sapien
ttacgcttgaaacactgcagtcatt

SEQ ID NO: 210807 - DNA, 25 bp, Homo sapien
gtcatttaggcactctcctggtttc

SEQ ID NO: 210808 - DNA, 25 bp, Homo sapien
tattttttatgactgggcctcttct

SEQ ID NO: 210809 - DNA, 25 bp, Homo sapien
cctcttctggaaaatctagcaagga

SEQ ID NO: 210810 - DNA, 25 bp, Homo sapien
gtgtcagccctgtattgtatttgat

SEQ ID NO: 210811 - DNA, 25 bp, Homo sapien
attgtatttgattatctcctgaata

SEQ ID NO: 210812 - DNA, 25 bp, Homo sapien
tcccggagttcctgggagaaaggcg

SEQ ID NO: 210813 - DNA, 25 bp, Homo sapien
agaaaggcgccgtcgtggccgcctc

SEQ ID NO: 210814 - DNA, 25 bp, Homo sapien
cgggctccaccgtgggtctcagacg

SEQ ID NO: 210815 - DNA, 25 bp, Homo sapien
tgcggcaccggcaccgtctgcttta

SEQ ID NO: 210816 - DNA, 25 bp, Homo sapien
accggcaccgtctgctttagcatgg

SEQ ID NO: 210817 - DNA, 25 bp, Homo sapien
ggcaccgtctgctttagcatgggac

SEQ ID NO: 210818 - DNA, 25 bp, Homo sapien
accgtctgctttagcatgggacccc

SEQ ID NO: 210819 - DNA, 25 bp, Homo sapien
gtctgctttagcatgggacccccat

SEQ ID NO: 210820 - DNA, 25 bp, Homo sapien
tcctttgcgaagtccactgtgggtg

SEQ ID NO: 210821 - DNA, 25 bp, Homo sapien
tgggtgccatcatggtctccgggac

SEQ ID NO: 210822 - DNA, 25 bp, Homo sapien
gcactgggtgtgctgatataaagtc

SEQ ID NO: 210823 - DNA, 25 bp, Homo sapien
cattccgctgggatacttctacggg

SEQ ID NO: 210824 - DNA, 25 bp, Homo sapien
agggcgttcgcgtccgtctgttatg

SEQ ID NO: 210825 - DNA, 25 bp, Homo sapien
tctgttatggcggtactgctgtaga

SEQ ID NO: 210826 - DNA, 25 bp, Homo sapien
tgctgtagataaccggatccgcgaa

SEQ ID NO: 210827 - DNA, 25 bp, Homo sapien
gaatgctaacgctcaccaggatgct

SEQ ID NO: 210828 - DNA, 25 bp, Homo sapien
tattgcctatcaagcccggaatgtc

SEQ ID NO: 210829 - DNA, 25 bp, Homo sapien
aatgtctgggtctagcgggtattgc

SEQ ID NO: 210830 - DNA, 25 bp, Homo sapien
agtaggattgtgacagtcacgcccc

SEQ ID NO: 210831 - DNA, 25 bp, Homo sapien
agcggtgtttcaaagtcccctgaca

SEQ ID NO: 210832 - DNA, 25 bp, Homo sapien
atgttgtcacacttcaggactgtgc

SEQ ID NO: 210833 - DNA, 25 bp, Homo sapien
caggactgtgccaatccgattgatg

SEQ ID NO: 210834 - DNA, 25 bp, Homo sapien
ctgtgggtcttccttagtgttttct

SEQ ID NO: 210835 - DNA, 25 bp, Homo sapien
gtgttttctttgaagccaatctgtt

SEQ ID NO: 210836 - DNA, 25 bp, Homo sapien
atctgttcgagatgcctcttctctg

SEQ ID NO: 210837 - DNA, 25 bp, Homo sapien
cttctctgtctccttatcagataga

SEQ ID NO: 210838 - DNA, 25 bp, Homo sapien
gctgctgcttcatctagcagaggtt

SEQ ID NO: 210839 - DNA, 25 bp, Homo sapien
agaggttggcctctggctctgacac

SEQ ID NO: 210840 - DNA, 25 bp, Homo sapien
ttgtcagttgtctttaggtggtcct

SEQ ID NO: 210841 - DNA, 25 bp, Homo sapien
ttaggtggtcctgaatcttgggccc

SEQ ID NO: 210842 - DNA, 25 bp, Homo sapien
cttgggcccttttgattgtgaatac

SEQ ID NO: 210843 - DNA, 25 bp, Homo sapien
atcttgagagtccttgttcttacat

SEQ ID NO: 210844 - DNA, 25 bp, Homo sapien
tgttcttacataggcattgctctag

SEQ ID NO: 210845 - DNA, 25 bp, Homo sapien
ggacctactaaagaatgtgccacca

SEQ ID NO: 210846 - DNA, 25 bp, Homo sapien
gaatgtgccaccagactttaagtga

SEQ ID NO: 210847 - DNA, 25 bp, Homo sapien
gtgccaccagactttaagtgatagt

SEQ ID NO: 210848 - DNA, 25 bp, Homo sapien
gatagttgcaatatccttgtctaaa

SEQ ID NO: 210849 - DNA, 25 bp, Homo sapien
ttttttccctgctattgaggaagta

SEQ ID NO: 210850 - DNA, 25 bp, Homo sapien
tgctattgaggaagtattttgcctt

SEQ ID NO: 210851 - DNA, 25 bp, Homo sapien
aagtattgacttcgtggtacacatt

SEQ ID NO: 210852 - DNA, 25 bp, Homo sapien
attgacttcgtggtacacattctaa

SEQ ID NO: 210853 - DNA, 25 bp, Homo sapien
gacttcgtggtacacattctaaagc

SEQ ID NO: 210854 - DNA, 25 bp, Homo sapien
cgtggtacacattctaaagcatttc

SEQ ID NO: 210855 - DNA, 25 bp, Homo sapien
ggtacacattctaaagcatttctga

SEQ ID NO: 210856 - DNA, 25 bp, Homo sapien
atgcagtgaatcacagatgtctcct

SEQ ID NO: 210857 - DNA, 25 bp, Homo sapien
gcagtgaatcacagatgtctcctga

SEQ ID NO: 210858 - DNA, 25 bp, Homo sapien
gtgaatcacagatgtctcctgaaag

SEQ ID NO: 210859 - DNA, 25 bp, Homo sapien
gaatcacagatgtctcctgaaagaa

SEQ ID NO: 210860 - DNA, 25 bp, Homo sapien
cacagatgtctcctgaaagaactct

SEQ ID NO: 210861 - DNA, 25 bp, Homo sapien
agatgtctcctgaaagaactctttt

SEQ ID NO: 210862 - DNA, 25 bp, Homo sapien
taaaagcaagaaatttcttcctttg

SEQ ID NO: 210863 - DNA, 25 bp, Homo sapien
ggtaaaattacttttggcagacagt

SEQ ID NO: 210864 - DNA, 25 bp, Homo sapien
aattacttttggcagacagtgtttt

SEQ ID NO: 210865 - DNA, 25 bp, Homo sapien
tacttttggcagacagtgttttatg

SEQ ID NO: 210866 - DNA, 25 bp, Homo sapien
tgtaatttttactttgtacaaagca

SEQ ID NO: 210867 - DNA, 25 bp, Homo sapien
cccagagcaccatgcagacatatga

SEQ ID NO: 210868 - DNA, 25 bp, Homo sapien
gagcaccatgcagacatatgaagaa

SEQ ID NO: 210869 - DNA, 25 bp, Homo sapien
attggaagaccccatgccacagctg

SEQ ID NO: 210870 - DNA, 25 bp, Homo sapien
aagaccccatgccacagctggatgt

SEQ ID NO: 210871 - DNA, 25 bp, Homo sapien
accccatgccacagctggatgtgac

SEQ ID NO: 210872 - DNA, 25 bp, Homo sapien
atgtgactgaggccaacaaggagtt

SEQ ID NO: 210873 - DNA, 25 bp, Homo sapien
atgacgctctgatggactgtcactg

SEQ ID NO: 210874 - DNA, 25 bp, Homo sapien
acgctctgatggactgtcactggca

SEQ ID NO: 210875 - DNA, 25 bp, Homo sapien
gctctgatggactgtcactggcagc

SEQ ID NO: 210876 - DNA, 25 bp, Homo sapien
tgatggactgtcactggcagcccct

SEQ ID NO: 210877 - DNA, 25 bp, Homo sapien
tggactgtcactggcagcccctgga

SEQ ID NO: 210878 - DNA, 25 bp, Homo sapien
aacgaagacattctggacaatccat

SEQ ID NO: 210879 - DNA, 25 bp, Homo sapien
atccatgtaatgatgctattgccaa

SEQ ID NO: 210880 - DNA, 25 bp, Homo sapien
gctattgccaatactttaaatgaag

SEQ ID NO: 210881 - DNA, 25 bp, Homo sapien
gaggaaacactgctggaccagtctt

SEQ ID NO: 210882 - DNA, 25 bp, Homo sapien
ctgctggaccagtcttttaaaaatg

SEQ ID NO: 210883 - DNA, 25 bp, Homo sapien
aatgtgcaacagcaacttgatgcta

SEQ ID NO: 210884 - DNA, 25 bp, Homo sapien
gcaacttgatgctacatccagaaat

SEQ ID NO: 210885 - DNA, 25 bp, Homo sapien
actgaagctagataagtttccatta

SEQ ID NO: 210886 - DNA, 25 bp, Homo sapien
gtatctgttaagtcatcgtcctgca

SEQ ID NO: 210887 - DNA, 25 bp, Homo sapien
taagtcatcgtcctgcaagcttggc

SEQ ID NO: 210888 - DNA, 25 bp, Homo sapien
gcaagcttggcgttactatgtattt

SEQ ID NO: 210889 - DNA, 25 bp, Homo sapien
gtgcttgaccaaggatgggccataa

SEQ ID NO: 210890 - DNA, 25 bp, Homo sapien
aaagtgtggatcctgctttgagctg

SEQ ID NO: 210891 - DNA, 25 bp, Homo sapien
gagctgtgtcatctagcagacctgc

SEQ ID NO: 210892 - DNA, 25 bp, Homo sapien
gactgctctggctaggaccccagta

SEQ ID NO: 210893 - DNA, 25 bp, Homo sapien
taggaccccagtaagattgtggcaa

SEQ ID NO: 210894 - DNA, 25 bp, Homo sapien
gattgtggcaagacctggcactcct

SEQ ID NO: 210895 - DNA, 25 bp, Homo sapien
actcctccaagcttggcacagtgag

SEQ ID NO: 210896 - DNA, 25 bp, Homo sapien
aagcttggcacagtgagcccaccag

SEQ ID NO: 210897 - DNA, 25 bp, Homo sapien
gagcccaccagctcagatggttgat

SEQ ID NO: 210898 - DNA, 25 bp, Homo sapien
tggttgatcttaccataccctcata

SEQ ID NO: 210899 - DNA, 25 bp, Homo sapien
tcttaccataccctcatagtaccaa

SEQ ID NO: 210900 - DNA, 25 bp, Homo sapien
gaacttagtacttaacacattttga

SEQ ID NO: 210901 - DNA, 25 bp, Homo sapien
agttgtcactaatttgcacattttc

SEQ ID NO: 210902 - DNA, 25 bp, Homo sapien
gtttccattctgaacatgttttgtc

SEQ ID NO: 210903 - DNA, 25 bp, Homo sapien
gttttgtcattcacaagtacattgt

SEQ ID NO: 210904 - DNA, 25 bp, Homo sapien
agtacattgtgtcaacttaatttaa

SEQ ID NO: 210905 - DNA, 25 bp, Homo sapien
gtatgtaacctgaattaactcgtgt

SEQ ID NO: 210906 - DNA, 25 bp, Homo sapien
aactcgtgtaatatttgtgtgtgga

SEQ ID NO: 210907 - DNA, 25 bp, Homo sapien
tgcaatgtaatgttactgagactta

SEQ ID NO: 210908 - DNA, 25 bp, Homo sapien
atgattgtctgtttaagtgtttgaa

SEQ ID NO: 210909 - DNA, 25 bp, Homo sapien
aaattgttaattatgcccagtgtga

SEQ ID NO: 210910 - DNA, 25 bp, Homo sapien
atgcccagtgtgaacttagtactta

SEQ ID NO: 210911 - DNA, 25 bp, Homo sapien
caggagattccatgtctttctcata

SEQ ID NO: 210912 - DNA, 25 bp, Homo sapien
attccatgtctttctcatatttcag

SEQ ID NO: 210913 - DNA, 25 bp, Homo sapien
atttcttagagaacacctctttgtc

SEQ ID NO: 210914 - DNA, 25 bp, Homo sapien
gagaacacctctttgtcagagataa

SEQ ID NO: 210915 - DNA, 25 bp, Homo sapien
gaacaaatactctaaacttatgtga

SEQ ID NO: 210916 - DNA, 25 bp, Homo sapien
acattttacttctgcgcttctatgt

SEQ ID NO: 210917 - DNA, 25 bp, Homo sapien
tctgcgcttctatgtttgggaaaca

SEQ ID NO: 210918 - DNA, 25 bp, Homo sapien
tgggaaacattgctctgataaaaaa

SEQ ID NO: 210919 - DNA, 25 bp, Homo sapien
atagctgtcattatgcagtgtgtat

SEQ ID NO: 210920 - DNA, 25 bp, Homo sapien
gataagactatgtacacatccactt

SEQ ID NO: 210921 - DNA, 25 bp, Homo sapien
tgtacacatccacttttgttaataa

SEQ ID NO: 210922 - DNA, 25 bp, Homo sapien
ttttctgggcccagttcccacgtgc

SEQ ID NO: 210923 - DNA, 25 bp, Homo sapien
cacgtgcctttcgtggcagtctaac

SEQ ID NO: 210924 - DNA, 25 bp, Homo sapien
tggcagtctaacctcaggccattct

SEQ ID NO: 210925 - DNA, 25 bp, Homo sapien
ctcagtgtccttctcatttcagtag

SEQ ID NO: 210926 - DNA, 25 bp, Homo sapien
cttctcatttcagtagggacttctg

SEQ ID NO: 210927 - DNA, 25 bp, Homo sapien
ctgtggatgtctgtgcagagccttt

SEQ ID NO: 210928 - DNA, 25 bp, Homo sapien
actgaaggcatgcagcctgtcggca

SEQ ID NO: 210929 - DNA, 25 bp, Homo sapien
gcctgtcggcagagtgtcttaacac

SEQ ID NO: 210930 - DNA, 25 bp, Homo sapien
gtgtcttaacaccagatgctacttt

SEQ ID NO: 210931 - DNA, 25 bp, Homo sapien
caccagatgctactttttactgtat

SEQ ID NO: 210932 - DNA, 25 bp, Homo sapien
gtattgtagtttattgcccggagat

SEQ ID NO: 210933 - DNA, 25 bp, Homo sapien
ccacacagagcccatgtgcttgagg

SEQ ID NO: 210934 - DNA, 25 bp, Homo sapien
atgtgcttgaggaagccgactcgga

SEQ ID NO: 210935 - DNA, 25 bp, Homo sapien
gctcccagtttacttcactgcaagc

SEQ ID NO: 210936 - DNA, 25 bp, Homo sapien
actgcaagccgaagagtcctcccat

SEQ ID NO: 210937 - DNA, 25 bp, Homo sapien
tactatccacatgacctagtggcaa

SEQ ID NO: 210938 - DNA, 25 bp, Homo sapien
tagtggcaaatctactcccagtctt

SEQ ID NO: 210939 - DNA, 25 bp, Homo sapien
cagtcttggtctcagtggcttaatt

SEQ ID NO: 210940 - DNA, 25 bp, Homo sapien
ggcttaattactttgccagcaggta

SEQ ID NO: 210941 - DNA, 25 bp, Homo sapien
acgaggcaggagtgaaattccttca

SEQ ID NO: 210942 - DNA, 25 bp, Homo sapien
aattccttcactgtcgtggatgtgg

SEQ ID NO: 210943 - DNA, 25 bp, Homo sapien
gtcgtggatgtggttattattctag

SEQ ID NO: 210944 - DNA, 25 bp, Homo sapien
gattctaattacgtcctgcagctgg

SEQ ID NO: 210945 - DNA, 25 bp, Homo sapien
gagtgggcagctacctgaagttccc

SEQ ID NO: 210946 - DNA, 25 bp, Homo sapien
tgaagttccccacctatgcaaagtc

SEQ ID NO: 210947 - DNA, 25 bp, Homo sapien
tgcaaagtctacgagaactactgat

SEQ ID NO: 210948 - DNA, 25 bp, Homo sapien
gatgaaatgaccacagaattcttcc

SEQ ID NO: 210949 - DNA, 25 bp, Homo sapien
cttccagaacatcagctcagagcac

SEQ ID NO: 210950 - DNA, 25 bp, Homo sapien
gctcagagcaccaaacgcagctgta

SEQ ID NO: 210951 - DNA, 25 bp, Homo sapien
aaacgcagctgtacgaagtctacaa

SEQ ID NO: 210952 - DNA, 25 bp, Homo sapien
gtacgaagtctacaaactcgatttt

SEQ ID NO: 210953 - DNA, 25 bp, Homo sapien
taatgttcaattactcagtgccaag

SEQ ID NO: 210954 - DNA, 25 bp, Homo sapien
tactcagtgccaagctacctgaaat

SEQ ID NO: 210955 - DNA, 25 bp, Homo sapien
gattacagaagtcacctgcaccggt

SEQ ID NO: 210956 - DNA, 25 bp, Homo sapien
tgccctcggcctttgtgagctttgt

SEQ ID NO: 210957 - DNA, 25 bp, Homo sapien
tcggcctttgtgagctttgtggtct

SEQ ID NO: 210958 - DNA, 25 bp, Homo sapien
ctttgtgagctttgtggtcttccca

SEQ ID NO: 210959 - DNA, 25 bp, Homo sapien
tgtgagctttgtggtcttcccatca

SEQ ID NO: 210960 - DNA, 25 bp, Homo sapien
agctttgtggtcttcccatcaggaa

SEQ ID NO: 210961 - DNA, 25 bp, Homo sapien
ttgtggtcttcccatcaggaacgct

SEQ ID NO: 210962 - DNA, 25 bp, Homo sapien
ggtcttcccatcaggaacgctggaa

SEQ ID NO: 210963 - DNA, 25 bp, Homo sapien
caggaacgctggaaagtgacattgt

SEQ ID NO: 210964 - DNA, 25 bp, Homo sapien
acgctggaaagtgacattgtgtaca

SEQ ID NO: 210965 - DNA, 25 bp, Homo sapien
gacattgtgtacacactgcagcttg

SEQ ID NO: 210966 - DNA, 25 bp, Homo sapien
ctggtgctaaggtggctgtggatgc

SEQ ID NO: 210967 - DNA, 25 bp, Homo sapien
ctgtggatgccacagcatgaaccag

SEQ ID NO: 210968 - DNA, 25 bp, Homo sapien
gggccatcagcctagagcatggacc

SEQ ID NO: 210969 - DNA, 25 bp, Homo sapien
catcagcctagagcatggaccaggg

SEQ ID NO: 210970 - DNA, 25 bp, Homo sapien
atcctggcccctttggtggatctga

SEQ ID NO: 210971 - DNA, 25 bp, Homo sapien
tgagtgacagggtcaagttctcttt

SEQ ID NO: 210972 - DNA, 25 bp, Homo sapien
aacaggagcttttcaggtggtaact

SEQ ID NO: 210973 - DNA, 25 bp, Homo sapien
gagcttttcaggtggtaactcccca

SEQ ID NO: 210974 - DNA, 25 bp, Homo sapien
gtaactccccaacctgacattggta

SEQ ID NO: 210975 - DNA, 25 bp, Homo sapien
tccccaacctgacattggtactgtg

SEQ ID NO: 210976 - DNA, 25 bp, Homo sapien
tggtactgtgcaataaagacacccc

SEQ ID NO: 210977 - DNA, 25 bp, Homo sapien
attgcaggacaatgatggctattct

SEQ ID NO: 210978 - DNA, 25 bp, Homo sapien
tgatggctattctaaacgctaagga

SEQ ID NO: 210979 - DNA, 25 bp, Homo sapien
acacagaactgtttcaagtactcaa

SEQ ID NO: 210980 - DNA, 25 bp, Homo sapien
accttgctggaacccttgctagcag

SEQ ID NO: 210981 - DNA, 25 bp, Homo sapien
acccttgctagcaggcattcttata

SEQ ID NO: 210982 - DNA, 25 bp, Homo sapien
aagaaactttcgagcctccttatat

SEQ ID NO: 210983 - DNA, 25 bp, Homo sapien
tcgagcctccttatattgctggaaa

SEQ ID NO: 210984 - DNA, 25 bp, Homo sapien
ttgctggaaactcagctgtgctcca

SEQ ID NO: 210985 - DNA, 25 bp, Homo sapien
aactcagctgtgctccagactagag

SEQ ID NO: 210986 - DNA, 25 bp, Homo sapien
ccttacctatgctatggatttttaa

SEQ ID NO: 210987 - DNA, 25 bp, Homo sapien
ttctcttatttcatgtacactgctt

SEQ ID NO: 210988 - DNA, 25 bp, Homo sapien
gaaatagcgattgtcctttttataa

SEQ ID NO: 210989 - DNA, 25 bp, Homo sapien
tatgacgaatcgtaccaggtaaaat

SEQ ID NO: 210990 - DNA, 25 bp, Homo sapien
aaatttccccatgttgattctgata

SEQ ID NO: 210991 - DNA, 25 bp, Homo sapien
gataaacatagccagtaaaattcgt

SEQ ID NO: 210992 - DNA, 25 bp, Homo sapien
agtgaatttgtgacagggactgctg

SEQ ID NO: 210993 - DNA, 25 bp, Homo sapien
gggactgctggtattgatcgctaca

SEQ ID NO: 210994 - DNA, 25 bp, Homo sapien
gatcgctacattgatgtggcagcct

SEQ ID NO: 210995 - DNA, 25 bp, Homo sapien
atgtggcagccttgaatcatcttct

SEQ ID NO: 210996 - DNA, 25 bp, Homo sapien
gcagccttgaatcatcttcttgagc

SEQ ID NO: 210997 - DNA, 25 bp, Homo sapien
atcatcttcttgagcaaatgccaga

SEQ ID NO: 210998 - DNA, 25 bp, Homo sapien
gatgttttggcagaacgtgccttat

SEQ ID NO: 210999 - DNA, 25 bp, Homo sapien
tccccatggactatagcgccaatgc

SEQ ID NO: 211000 - DNA, 25 bp, Homo sapien
ccatggactatagcgccaatgccat

SEQ ID NO: 211001 - DNA, 25 bp, Homo sapien
ggactatagcgccaatgccattgcc

SEQ ID NO: 211002 - DNA, 25 bp, Homo sapien
ccctccaagctcagtggacactggg

SEQ ID NO: 211003 - DNA, 25 bp, Homo sapien
tccaagctcagtggacactgggtct

SEQ ID NO: 211004 - DNA, 25 bp, Homo sapien
aagctcagtggacactgggtctgaa

SEQ ID NO: 211005 - DNA, 25 bp, Homo sapien
tcagtggacactgggtctgaaagga

SEQ ID NO: 211006 - DNA, 25 bp, Homo sapien
aggttttcttttggcgctgacccag

SEQ ID NO: 211007 - DNA, 25 bp, Homo sapien
atccaggctcagaacttcttctcca

SEQ ID NO: 211008 - DNA, 25 bp, Homo sapien
ttcttctccagcttcaccctgatga

SEQ ID NO: 211009 - DNA, 25 bp, Homo sapien
accctgatgaagctgaggcactcct

SEQ ID NO: 211010 - DNA, 25 bp, Homo sapien
caacttctctctaatgaggctcttg

SEQ ID NO: 211011 - DNA, 25 bp, Homo sapien
gagctgtacaaaaaggctggatcag

SEQ ID NO: 211012 - DNA, 25 bp, Homo sapien
aaggctggatcaggtgcaacaccac

SEQ ID NO: 211013 - DNA, 25 bp, Homo sapien
gtgcaacaccaccataaggaagagt

SEQ ID NO: 211014 - DNA, 25 bp, Homo sapien
tggattcggtggcatcactatgctc

SEQ ID NO: 211015 - DNA, 25 bp, Homo sapien
atcactatgctcttcacaggatact

SEQ ID NO: 211016 - DNA, 25 bp, Homo sapien
atgctcttcacaggatacttcgtcc

SEQ ID NO: 211017 - DNA, 25 bp, Homo sapien
gatacttcgtcctgtgttgtagctg

SEQ ID NO: 211018 - DNA, 25 bp, Homo sapien
gttgtagctggagtttcagacgtct

SEQ ID NO: 211019 - DNA, 25 bp, Homo sapien
ttcagacgtctgaagctgcagcggt

SEQ ID NO: 211020 - DNA, 25 bp, Homo sapien
gtaagtagtgttgacctggacatca

SEQ ID NO: 211021 - DNA, 25 bp, Homo sapien
tcccggagttcctgggagaaaggcg

SEQ ID NO: 211022 - DNA, 25 bp, Homo sapien
tgggagaaaggcgccgtcgtggccg

SEQ ID NO: 211023 - DNA, 25 bp, Homo sapien
cgggctccaccgtgggtctcagacg

SEQ ID NO: 211024 - DNA, 25 bp, Homo sapien
gtctcagacgccctgcggcaccggc

SEQ ID NO: 211025 - DNA, 25 bp, Homo sapien
tgcggcaccggcaccgtctgcttta

SEQ ID NO: 211026 - DNA, 25 bp, Homo sapien
accggcaccgtctgctttagcatgg

SEQ ID NO: 211027 - DNA, 25 bp, Homo sapien
cggcaccgtctgctttagcatggga

SEQ ID NO: 211028 - DNA, 25 bp, Homo sapien
ggcaccgtctgctttagcatgggac

SEQ ID NO: 211029 - DNA, 25 bp, Homo sapien
gcaccgtctgctttagcatgggacc

SEQ ID NO: 211030 - DNA, 25 bp, Homo sapien
accgtctgctttagcatgggacccc

SEQ ID NO: 211031 - DNA, 25 bp, Homo sapien
gtctgctttagcatgggacccccat

SEQ ID NO: 211032 - DNA, 25 bp, Homo sapien
tttcctcctttcaaccgagactatt

SEQ ID NO: 211033 - DNA, 25 bp, Homo sapien
gactatttctggattgtgtgctcct

SEQ ID NO: 211034 - DNA, 25 bp, Homo sapien
gattgtgtgctcctcgtcagttgac

SEQ ID NO: 211035 - DNA, 25 bp, Homo sapien
gtcagttgacttgttttgcacactt

SEQ ID NO: 211036 - DNA, 25 bp, Homo sapien
acttttctttacttcatgtccccat

SEQ ID NO: 211037 - DNA, 25 bp, Homo sapien
ctttacttcatgtccccatcaacaa

SEQ ID NO: 211038 - DNA, 25 bp, Homo sapien
tgtgaccctggaggctcttaagatg

SEQ ID NO: 211039 - DNA, 25 bp, Homo sapien
tttttattgggctgagttcacgaat

SEQ ID NO: 211040 - DNA, 25 bp, Homo sapien
aggagctggaagtcgccctaggaac

SEQ ID NO: 211041 - DNA, 25 bp, Homo sapien
aagtcgccctaggaacaccagattt

SEQ ID NO: 211042 - DNA, 25 bp, Homo sapien
aggaacaccagatttcctggttctg

SEQ ID NO: 211043 - DNA, 25 bp, Homo sapien
tgaggagctccaaccagggaagact

SEQ ID NO: 211044 - DNA, 25 bp, Homo sapien
tgtgaggagaggagtcactgtcacc

SEQ ID NO: 211045 - DNA, 25 bp, Homo sapien
caggtcacagactgactgaggtgat

SEQ ID NO: 211046 - DNA, 25 bp, Homo sapien
cagatgcccttctttaattggttct

SEQ ID NO: 211047 - DNA, 25 bp, Homo sapien
gcccttctttaattggttctcagtt

SEQ ID NO: 211048 - DNA, 25 bp, Homo sapien
attggttctcagttaacttctcaga

SEQ ID NO: 211049 - DNA, 25 bp, Homo sapien
ctctggagaacgggacagtggcttt

SEQ ID NO: 211050 - DNA, 25 bp, Homo sapien
ctagcctctgaatgttccaaataaa

SEQ ID NO: 211051 - DNA, 25 bp, Homo sapien
ttttttggtcttggcccctgtactg

SEQ ID NO: 211052 - DNA, 25 bp, Homo sapien
gttttacctctaaattctggcattt

SEQ ID NO: 211053 - DNA, 25 bp, Homo sapien
tttttccctgcaattaaagtgctgt

SEQ ID NO: 211054 - DNA, 25 bp, Homo sapien
ctggatcaggtgcaacaccaccata

SEQ ID NO: 211055 - DNA, 25 bp, Homo sapien
gatcaggtgcaacaccaccataagg

SEQ ID NO: 211056 - DNA, 25 bp, Homo sapien
gtgcaacaccaccataaggaagagt

SEQ ID NO: 211057 - DNA, 25 bp, Homo sapien
acaccaccataaggaagagtggatt

SEQ ID NO: 211058 - DNA, 25 bp, Homo sapien
atgctcttcacaggatacttcgtcc

SEQ ID NO: 211059 - DNA, 25 bp, Homo sapien
gctcttcacaggatacttcgtcctg

SEQ ID NO: 211060 - DNA, 25 bp, Homo sapien
aggatacttcgtcctgtgttgtagc

SEQ ID NO: 211061 - DNA, 25 bp, Homo sapien
gatacttcgtcctgtgttgtagctg

SEQ ID NO: 211062 - DNA, 25 bp, Homo sapien
ctgtgttgtagctggagtttcagac

SEQ ID NO: 211063 - DNA, 25 bp, Homo sapien
gttgtagctggagtttcagacgtct

SEQ ID NO: 211064 - DNA, 25 bp, Homo sapien
gtagctggagtttcagacgtctgaa

SEQ ID NO: 211065 - DNA, 25 bp, Homo sapien
gagcctttctgaagagaattatatc

SEQ ID NO: 211066 - DNA, 25 bp, Homo sapien
tatatcaaactaattacaaccaaga

SEQ ID NO: 211067 - DNA, 25 bp, Homo sapien
tagtatgaagcggatgctgtttgga

SEQ ID NO: 211068 - DNA, 25 bp, Homo sapien
tggaggacaggaaaatttatcggga

SEQ ID NO: 211069 - DNA, 25 bp, Homo sapien
attacataatccctctgattccact

SEQ ID NO: 211070 - DNA, 25 bp, Homo sapien
aatccctctgattccactatccaga

SEQ ID NO: 211071 - DNA, 25 bp, Homo sapien
gattccactatccagagatagccat

SEQ ID NO: 211072 - DNA, 25 bp, Homo sapien
atttggtatgtacatccttatatta

SEQ ID NO: 211073 - DNA, 25 bp, Homo sapien
aactgtatatactgttttgtagcct

SEQ ID NO: 211074 - DNA, 25 bp, Homo sapien
gtatatactgttttgtagcctacat

SEQ ID NO: 211075 - DNA, 25 bp, Homo sapien
gtagcctacatatttcatatagaag

SEQ ID NO: 211076 - DNA, 25 bp, Homo sapien
ctatgcattgtatgggactttcctt

SEQ ID NO: 211077 - DNA, 25 bp, Homo sapien
aagcaatgcgtaagcctgtgtcctt

SEQ ID NO: 211078 - DNA, 25 bp, Homo sapien
taagcctgtgtccttcctgaagctt

SEQ ID NO: 211079 - DNA, 25 bp, Homo sapien
tgaagcttctcgactgcccagatag

SEQ ID NO: 211080 - DNA, 25 bp, Homo sapien
tagggaggtgagtcctctctatctc

SEQ ID NO: 211081 - DNA, 25 bp, Homo sapien
gtgcattttcaaggacacttgctgg

SEQ ID NO: 211082 - DNA, 25 bp, Homo sapien
aggacacttgctgggttgtgcatta

SEQ ID NO: 211083 - DNA, 25 bp, Homo sapien
gttgtgcattaagggccagtttact

SEQ ID NO: 211084 - DNA, 25 bp, Homo sapien
ttacttgtctgcctctttgaccacc

SEQ ID NO: 211085 - DNA, 25 bp, Homo sapien
tgaccacctgtgaactctgttgggt

SEQ ID NO: 211086 - DNA, 25 bp, Homo sapien
tgggtgtactctgctaagttctggg

SEQ ID NO: 211087 - DNA, 25 bp, Homo sapien
agaccctgggcctgcacttcaggac

SEQ ID NO: 211088 - DNA, 25 bp, Homo sapien
gcacttcaggactgtgggtgccctg

SEQ ID NO: 211089 - DNA, 25 bp, Homo sapien
gtgccctgggtgaacagaccctgca

SEQ ID NO: 211090 - DNA, 25 bp, Homo sapien
ggtgaacagaccctgcaggtcccat

SEQ ID NO: 211091 - DNA, 25 bp, Homo sapien
ggacggaggccttgtgtcacctgcc

SEQ ID NO: 211092 - DNA, 25 bp, Homo sapien
tgcccaggcagctgtttgcagctga

SEQ ID NO: 211093 - DNA, 25 bp, Homo sapien
aacaaactggtctccaggctgtctt

SEQ ID NO: 211094 - DNA, 25 bp, Homo sapien
aggctgtcttgcctttattcctggt

SEQ ID NO: 211095 - DNA, 25 bp, Homo sapien
ggcaggtggtcctagacagcagttt

SEQ ID NO: 211096 - DNA, 25 bp, Homo sapien
aggtggtcctagacagcagtttcca

SEQ ID NO: 211097 - DNA, 25 bp, Homo sapien
gcagtttccagtaaaagctgaacaa

SEQ ID NO: 211098 - DNA, 25 bp, Homo sapien
tttcagtactaagcaattttagtct

SEQ ID NO: 211099 - DNA, 25 bp, Homo sapien
ttcagtactaagcaattttagtctc

SEQ ID NO: 211100 - DNA, 25 bp, Homo sapien
tcagtactaagcaattttagtctct

SEQ ID NO: 211101 - DNA, 25 bp, Homo sapien
cagtactaagcaattttagtctctg

SEQ ID NO: 211102 - DNA, 25 bp, Homo sapien
agtactaagcaattttagtctctgc

SEQ ID NO: 211103 - DNA, 25 bp, Homo sapien
gtactaagcaattttagtctctgca

SEQ ID NO: 211104 - DNA, 25 bp, Homo sapien
tactaagcaattttagtctctgcag

SEQ ID NO: 211105 - DNA, 25 bp, Homo sapien
gtcttgaattaatacaacttttgtt

SEQ ID NO: 211106 - DNA, 25 bp, Homo sapien
cttttgttaattctcttatgaagtt

SEQ ID NO: 211107 - DNA, 25 bp, Homo sapien
ttttgttaattctcttatgaagtta

SEQ ID NO: 211108 - DNA, 25 bp, Homo sapien
tttgttaattctcttatgaagttaa

SEQ ID NO: 211109 - DNA, 25 bp, Homo sapien
gaatgtgaacaaggctcacctaagg

SEQ ID NO: 211110 - DNA, 25 bp, Homo sapien
aggctcacctaaggaaactgaccca

SEQ ID NO: 211111 - DNA, 25 bp, Homo sapien
cagaaaacagttttagctgacaaag

SEQ ID NO: 211112 - DNA, 25 bp, Homo sapien
atctggctgacggaatatcattctg

SEQ ID NO: 211113 - DNA, 25 bp, Homo sapien
aatatcattctggttgccatctttt

SEQ ID NO: 211114 - DNA, 25 bp, Homo sapien
gttgccatctttttctgtggaactc

SEQ ID NO: 211115 - DNA, 25 bp, Homo sapien
ttttctgtggaactcctctgcattt

SEQ ID NO: 211116 - DNA, 25 bp, Homo sapien
tcctctgcatttcttcctaagtaat

SEQ ID NO: 211117 - DNA, 25 bp, Homo sapien
tttgccctctatcctgagtaactaa

SEQ ID NO: 211118 - DNA, 25 bp, Homo sapien
gtaactaatggacatcttctcatgc

SEQ ID NO: 211119 - DNA, 25 bp, Homo sapien
ggacatcttctcatgcaaggtttat

SEQ ID NO: 211120 - DNA, 25 bp, Homo sapien
tattattttggtctacagtgtatgt

SEQ ID NO: 211121 - DNA, 25 bp, Homo sapien
tttggtctacagtgtatgtaaggtt

SEQ ID NO: 211122 - DNA, 25 bp, Homo sapien
gtatgtaaggttagtatgttaagca

SEQ ID NO: 211123 - DNA, 25 bp, Homo sapien
aataccttagatgcaaatttatagg

SEQ ID NO: 211124 - DNA, 25 bp, Homo sapien
ataagaggtgtttgctgggatggaa

SEQ ID NO: 211125 - DNA, 25 bp, Homo sapien
ctgggatggaagaactacctggcat

SEQ ID NO: 211126 - DNA, 25 bp, Homo sapien
gatggaagaactacctggcatgtaa

SEQ ID NO: 211127 - DNA, 25 bp, Homo sapien
gtaagaaatatcgtcagtcgtccta

SEQ ID NO: 211128 - DNA, 25 bp, Homo sapien
gaaatatcgtcagtcgtcctaatgc

SEQ ID NO: 211129 - DNA, 25 bp, Homo sapien
atatcgtcagtcgtcctaatgcata

SEQ ID NO: 211130 - DNA, 25 bp, Homo sapien
atcgtcagtcgtcctaatgcatatt

SEQ ID NO: 211131 - DNA, 25 bp, Homo sapien
ctggccaacactggtctctgtgaaa

SEQ ID NO: 211132 - DNA, 25 bp, Homo sapien
tggccaacactggtctctgtgaaac

SEQ ID NO: 211133 - DNA, 25 bp, Homo sapien
ggccaacactggtctctgtgaaact

SEQ ID NO: 211134 - DNA, 25 bp, Homo sapien
gccaacactggtctctgtgaaactc

SEQ ID NO: 211135 - DNA, 25 bp, Homo sapien
aacactggtctctgtgaaactccgt

SEQ ID NO: 211136 - DNA, 25 bp, Homo sapien
acactggtctctgtgaaactccgtc

SEQ ID NO: 211137 - DNA, 25 bp, Homo sapien
actggtctctgtgaaactccgtctc

SEQ ID NO: 211138 - DNA, 25 bp, Homo sapien
aaagattggctggacgtgttggcgg

SEQ ID NO: 211139 - DNA, 25 bp, Homo sapien
gtgttggcgggcatctgtgatacca

SEQ ID NO: 211140 - DNA, 25 bp, Homo sapien
tgttggcgggcatctgtgataccag

SEQ ID NO: 211141 - DNA, 25 bp, Homo sapien
ttggcgggcatctgtgataccagct

SEQ ID NO: 211142 - DNA, 25 bp, Homo sapien
tgtctaacctcaccctctaaacgtt

SEQ ID NO: 211143 - DNA, 25 bp, Homo sapien
tctaacctcaccctctaaacgttca

SEQ ID NO: 211144 - DNA, 25 bp, Homo sapien
ctaacctcaccctctaaacgttcag

SEQ ID NO: 211145 - DNA, 25 bp, Homo sapien
ctcaccctctaaacgttcagcggtg

SEQ ID NO: 211146 - DNA, 25 bp, Homo sapien
tcaccctctaaacgttcagcggtgg

SEQ ID NO: 211147 - DNA, 25 bp, Homo sapien
caccctctaaacgttcagcggtgga

SEQ ID NO: 211148 - DNA, 25 bp, Homo sapien
cctctaaacgttcagcggtggaaag

SEQ ID NO: 211149 - DNA, 25 bp, Homo sapien
ctctaaacgttcagcggtggaaaga

SEQ ID NO: 211150 - DNA, 25 bp, Homo sapien
tctaaacgttcagcggtggaaagat

SEQ ID NO: 211151 - DNA, 25 bp, Homo sapien
taaacgttcagcggtggaaagattt

SEQ ID NO: 211152 - DNA, 25 bp, Homo sapien
ttttaaattattactgctttgaaat

SEQ ID NO: 211153 - DNA, 25 bp, Homo sapien
agacaactctgttctcaggattggg

SEQ ID NO: 211154 - DNA, 25 bp, Homo sapien
gacggcttcggccaagcgttttagc

SEQ ID NO: 211155 - DNA, 25 bp, Homo sapien
gccaagcgttttagcctcattcact

SEQ ID NO: 211156 - DNA, 25 bp, Homo sapien
tgccagccaagaccattgatttgga

SEQ ID NO: 211157 - DNA, 25 bp, Homo sapien
tgagctgttgacactgttgttcctt

SEQ ID NO: 211158 - DNA, 25 bp, Homo sapien
ccttgctgaattggattgttgactt

SEQ ID NO: 211159 - DNA, 25 bp, Homo sapien
gttgacttgtagttcagaggcgtac

SEQ ID NO: 211160 - DNA, 25 bp, Homo sapien
gaggcgtacaactagttggcgatta

SEQ ID NO: 211161 - DNA, 25 bp, Homo sapien
gacttgttatgtgatgttaccagcc

SEQ ID NO: 211162 - DNA, 25 bp, Homo sapien
gttaccagcctgaaatgcgatcacc

SEQ ID NO: 211163 - DNA, 25 bp, Homo sapien
gaaatgcgatcaccccgtaggaaat

SEQ ID NO: 211164 - DNA, 25 bp, Homo sapien
ttctcttgctgtttatatctctagc

SEQ ID NO: 211165 - DNA, 25 bp, Homo sapien
gctttgcattcagtagatgtgagat

SEQ ID NO: 211166 - DNA, 25 bp, Homo sapien
tgagatagagtctaacagttcttac

SEQ ID NO: 211167 - DNA, 25 bp, Homo sapien
aaaattacatggctcctccacttga

SEQ ID NO: 211168 - DNA, 25 bp, Homo sapien
ctcctccacttgaaatctttgaatt

SEQ ID NO: 211169 - DNA, 25 bp, Homo sapien
atctttgaattctgatcccttcctg

SEQ ID NO: 211170 - DNA, 25 bp, Homo sapien
ttagggcattctccacatttctttt

SEQ ID NO: 211171 - DNA, 25 bp, Homo sapien
atttcttttttattagcttcatgga

SEQ ID NO: 211172 - DNA, 25 bp, Homo sapien
gcttcatggatagttttttgcccta

SEQ ID NO: 211173 - DNA, 25 bp, Homo sapien
ttttgccctattgaatcattcagtt

SEQ ID NO: 211174 - DNA, 25 bp, Homo sapien
cagttggtgtacaaacatgccttaa

SEQ ID NO: 211175 - DNA, 25 bp, Homo sapien
taaaatttaaacatcacttcaggaa

SEQ ID NO: 211176 - DNA, 25 bp, Homo sapien
gcatacggaaagtactgagcccata

SEQ ID NO: 211177 - DNA, 25 bp, Homo sapien
tgagcccatatgacttgacccacaa

SEQ ID NO: 211178 - DNA, 25 bp, Homo sapien
gagataactgtatataggctactga

SEQ ID NO: 211179 - DNA, 25 bp, Homo sapien
ggctactgaaagaaggattctgcat

SEQ ID NO: 211180 - DNA, 25 bp, Homo sapien
gattctgcatttctattcccctcag

SEQ ID NO: 211181 - DNA, 25 bp, Homo sapien
tcagcctacccactgaagtctttgg

SEQ ID NO: 211182 - DNA, 25 bp, Homo sapien
aagtctttgggtagctcttaagcca

SEQ ID NO: 211183 - DNA, 25 bp, Homo sapien
gggtagctcttaagccataactaag

SEQ ID NO: 211184 - DNA, 25 bp, Homo sapien
agccataactaaggagcagcatttg

SEQ ID NO: 211185 - DNA, 25 bp, Homo sapien
gcagcatttgagtagatttctgaaa

SEQ ID NO: 211186 - DNA, 25 bp, Homo sapien
tgccctcggcctttgtgagctttgt

SEQ ID NO: 211187 - DNA, 25 bp, Homo sapien
tcggcctttgtgagctttgtggtct

SEQ ID NO: 211188 - DNA, 25 bp, Homo sapien
ctttgtgagctttgtggtcttccca

SEQ ID NO: 211189 - DNA, 25 bp, Homo sapien
tgtgagctttgtggtcttcccatca

SEQ ID NO: 211190 - DNA, 25 bp, Homo sapien
agctttgtggtcttcccatcaggaa

SEQ ID NO: 211191 - DNA, 25 bp, Homo sapien
ttgtggtcttcccatcaggaacgct

SEQ ID NO: 211192 - DNA, 25 bp, Homo sapien
ggtcttcccatcaggaacgctggaa

SEQ ID NO: 211193 - DNA, 25 bp, Homo sapien
cttcccatcaggaacgctggaaagt

SEQ ID NO: 211194 - DNA, 25 bp, Homo sapien
caggaacgctggaaagtgacattgt

SEQ ID NO: 211195 - DNA, 25 bp, Homo sapien
aacgctggaaagtgacattgtgtac

SEQ ID NO: 211196 - DNA, 25 bp, Homo sapien
gctggaaagtgacattgtgtacaca

SEQ ID NO: 211197 - DNA, 25 bp, Homo sapien
ggcatgtgctattaccagaaacaac

SEQ ID NO: 211198 - DNA, 25 bp, Homo sapien
aaatacccttcatttgacacagttt

SEQ ID NO: 211199 - DNA, 25 bp, Homo sapien
taatgagtgatttaatttcctctgt

SEQ ID NO: 211200 - DNA, 25 bp, Homo sapien
gactgcctaaaacatgagcactgta

SEQ ID NO: 211201 - DNA, 25 bp, Homo sapien
gagcactgtacttcataaaggaaac

SEQ ID NO: 211202 - DNA, 25 bp, Homo sapien
gaaactgcgtatgcagattcagtat

SEQ ID NO: 211203 - DNA, 25 bp, Homo sapien
gattcagtattgtgtatctttggac

SEQ ID NO: 211204 - DNA, 25 bp, Homo sapien
ctttggacaattagatggacattta

SEQ ID NO: 211205 - DNA, 25 bp, Homo sapien
aacttcttttatctgacaggatcag

SEQ ID NO: 211206 - DNA, 25 bp, Homo sapien
tctgacaggatcagctacaatgccc

SEQ ID NO: 211207 - DNA, 25 bp, Homo sapien
agctacaatgccctgtgttaaattg

SEQ ID NO: 211208 - DNA, 25 bp, Homo sapien
atttcaattggctctttgcgtttcc

SEQ ID NO: 211209 - DNA, 25 bp, Homo sapien
cttgtcacagatgccagatgatttg

SEQ ID NO: 211210 - DNA, 25 bp, Homo sapien
tttgcatcgaccagcaaactgggca

SEQ ID NO: 211211 - DNA, 25 bp, Homo sapien
gggcaacgaaaccagcatgttttcc

SEQ ID NO: 211212 - DNA, 25 bp, Homo sapien
gaactttggcatgtacctgatgcat

SEQ ID NO: 211213 - DNA, 25 bp, Homo sapien
atcattggatttatcctccccatgt

SEQ ID NO: 211214 - DNA, 25 bp, Homo sapien
tccccatgtttcctgtctgtaggat

SEQ ID NO: 211215 - DNA, 25 bp, Homo sapien
gtctgtaggatctcaggtgctccct

SEQ ID NO: 211216 - DNA, 25 bp, Homo sapien
ggtgctccctgtgttgaaagagaat

SEQ ID NO: 211217 - DNA, 25 bp, Homo sapien
ggtcatgatttacctgcatctgaga

SEQ ID NO: 211218 - DNA, 25 bp, Homo sapien
gaaacaccaggatgttacctcctaa

SEQ ID NO: 211219 - DNA, 25 bp, Homo sapien
tgggcgtgcgccgtgggcctctaca

SEQ ID NO: 211220 - DNA, 25 bp, Homo sapien
ggcgtgcgccgtgggcctctacatg

SEQ ID NO: 211221 - DNA, 25 bp, Homo sapien
gcgccgtgggcctctacatggggca

SEQ ID NO: 211222 - DNA, 25 bp, Homo sapien
gaggacgacgggacggcctccgcgg

SEQ ID NO: 211223 - DNA, 25 bp, Homo sapien
gacgacgggacggcctccgcggaag

SEQ ID NO: 211224 - DNA, 25 bp, Homo sapien
ggtcggccgccacccgagtgagcga

SEQ ID NO: 211225 - DNA, 25 bp, Homo sapien
ggccgccacccgagtgagcgacacg

SEQ ID NO: 211226 - DNA, 25 bp, Homo sapien
gccgccacccgagtgagcgacacgg

SEQ ID NO: 211227 - DNA, 25 bp, Homo sapien
gccacccgagtgagcgacacggccg

SEQ ID NO: 211228 - DNA, 25 bp, Homo sapien
acccgagtgagcgacacggccgtgg

SEQ ID NO: 211229 - DNA, 25 bp, Homo sapien
cccgagtgagcgacacggccgtggg

SEQ ID NO: 211230 - DNA, 25 bp, Homo sapien
gtgcccattttctttctgggagtgt

SEQ ID NO: 211231 - DNA, 25 bp, Homo sapien
cccattttctttctgggagtgttct

SEQ ID NO: 211232 - DNA, 25 bp, Homo sapien
caaagtgtgtgcacagactcacaga

SEQ ID NO: 211233 - DNA, 25 bp, Homo sapien
gtgtgtgcacagactcacagagtcc

SEQ ID NO: 211234 - DNA, 25 bp, Homo sapien
gactcacagagtccatgacacactg

SEQ ID NO: 211235 - DNA, 25 bp, Homo sapien
caggagctgtgtttcgtggtctacc

SEQ ID NO: 211236 - DNA, 25 bp, Homo sapien
ggagctgtgtttcgtggtctacccc

SEQ ID NO: 211237 - DNA, 25 bp, Homo sapien
gccctcgaagccacaatgagatttt

SEQ ID NO: 211238 - DNA, 25 bp, Homo sapien
gccacaatgagatttttgtagagac

SEQ ID NO: 211239 - DNA, 25 bp, Homo sapien
ttacatgttgtttattgaggaggtg

SEQ ID NO: 211240 - DNA, 25 bp, Homo sapien
tattgaggaggtgttttggcaaaaa

SEQ ID NO: 211241 - DNA, 25 bp, Homo sapien
catgagtaaggtggctttgattggt

SEQ ID NO: 211242 - DNA, 25 bp, Homo sapien
gtaaggtggctttgattggtgtaca

SEQ ID NO: 211243 - DNA, 25 bp, Homo sapien
aaggtggctttgattggtgtacagt

SEQ ID NO: 211244 - DNA, 25 bp, Homo sapien
aggtggctttgattggtgtacagta

SEQ ID NO: 211245 - DNA, 25 bp, Homo sapien
gtggctttgattggtgtacagtatt

SEQ ID NO: 211246 - DNA, 25 bp, Homo sapien
ggctttgattggtgtacagtatttc

SEQ ID NO: 211247 - DNA, 25 bp, Homo sapien
tgattggtgtacagtatttcaaagg

SEQ ID NO: 211248 - DNA, 25 bp, Homo sapien
gcttgaattgggaatggatctcttt

SEQ ID NO: 211249 - DNA, 25 bp, Homo sapien
gaattgggaatggatctcttttgct

SEQ ID NO: 211250 - DNA, 25 bp, Homo sapien
aattgggaatggatctcttttgcta

SEQ ID NO: 211251 - DNA, 25 bp, Homo sapien
attgggaatggatctcttttgctat

SEQ ID NO: 211252 - DNA, 25 bp, Homo sapien
tattacaccaaattatgttcacaca

SEQ ID NO: 211253 - DNA, 25 bp, Homo sapien
atgttcacacaaaacctttgtaatc

SEQ ID NO: 211254 - DNA, 25 bp, Homo sapien
gttcacacaaaacctttgtaatcag

SEQ ID NO: 211255 - DNA, 25 bp, Homo sapien
tcacacaaaacctttgtaatcaggg

SEQ ID NO: 211256 - DNA, 25 bp, Homo sapien
gaattaaagagccttcctggaaaat

SEQ ID NO: 211257 - DNA, 25 bp, Homo sapien
agagccttcctggaaaatggaggtt

SEQ ID NO: 211258 - DNA, 25 bp, Homo sapien
ttattttctccataaactacagttt

SEQ ID NO: 211259 - DNA, 25 bp, Homo sapien
cagtttatataagcaagagtttcag

SEQ ID NO: 211260 - DNA, 25 bp, Homo sapien
gtttatataagcaagagtttcagta

SEQ ID NO: 211261 - DNA, 25 bp, Homo sapien
ataagcaagagtttcagtactaagc

SEQ ID NO: 211262 - DNA, 25 bp, Homo sapien
taagcaagagtttcagtactaagca

SEQ ID NO: 211263 - DNA, 25 bp, Homo sapien
cccacagactgggtgccccggcggc

SEQ ID NO: 211264 - DNA, 25 bp, Homo sapien
ggcggcgccacgcttggctggtcag

SEQ ID NO: 211265 - DNA, 25 bp, Homo sapien
gccacgcttggctggtcagcgctgc

SEQ ID NO: 211266 - DNA, 25 bp, Homo sapien
ggtcagcgctgcaggtcccgcctgt

SEQ ID NO: 211267 - DNA, 25 bp, Homo sapien
aggtcccgcctgttccagggcagga

SEQ ID NO: 211268 - DNA, 25 bp, Homo sapien
aaggcgtgggccacatggtcccctc

SEQ ID NO: 211269 - DNA, 25 bp, Homo sapien
tgtctaacctcaccctctaaacgtt

SEQ ID NO: 211270 - DNA, 25 bp, Homo sapien
caccctctaaacgttcagcggtgga

SEQ ID NO: 211271 - DNA, 25 bp, Homo sapien
cgttcagcggtggaaagatttttat

SEQ ID NO: 211272 - DNA, 25 bp, Homo sapien
ctgctttgaaataaacggacgtttg

SEQ ID NO: 211273 - DNA, 25 bp, Homo sapien
tgaaataaacggacgtttgagctca

SEQ ID NO: 211274 - DNA, 25 bp, Homo sapien
tttagctcagaaattctatcttcgg

SEQ ID NO: 211275 - DNA, 25 bp, Homo sapien
tagctcagaaattctatcttcggga

SEQ ID NO: 211276 - DNA, 25 bp, Homo sapien
gctcagaaattctatcttcgggagt

SEQ ID NO: 211277 - DNA, 25 bp, Homo sapien
tcagaaattctatcttcgggagtca

SEQ ID NO: 211278 - DNA, 25 bp, Homo sapien
cagaaattctatcttcgggagtcac

SEQ ID NO: 211279 - DNA, 25 bp, Homo sapien
agaaattctatcttcgggagtcacc

SEQ ID NO: 211280 - DNA, 25 bp, Homo sapien
gaaattctatcttcgggagtcacca

SEQ ID NO: 211281 - DNA, 25 bp, Homo sapien
ttctatcttcgggagtcaccacaaa

SEQ ID NO: 211282 - DNA, 25 bp, Homo sapien
tctatcttcgggagtcaccacaaaa

SEQ ID NO: 211283 - DNA, 25 bp, Homo sapien
ctatcttcgggagtcaccacaaaag

SEQ ID NO: 211284 - DNA, 25 bp, Homo sapien
tatcttcgggagtcaccacaaaaga

SEQ ID NO: 211285 - DNA, 25 bp, Homo sapien
ccttctggtcctggctagggcaaat

SEQ ID NO: 211286 - DNA, 25 bp, Homo sapien
tggtcctggctagggcaaattttag

SEQ ID NO: 211287 - DNA, 25 bp, Homo sapien
ttttctctgtaagtgaagattgtcg

SEQ ID NO: 211288 - DNA, 25 bp, Homo sapien
gaagattgtcgtattccaagtctaa

SEQ ID NO: 211289 - DNA, 25 bp, Homo sapien
gtctaaaatacacctggatctgtct

SEQ ID NO: 211290 - DNA, 25 bp, Homo sapien
ggatctgtctagtcaatcaacatag

SEQ ID NO: 211291 - DNA, 25 bp, Homo sapien
tcaatcaacatagcagagacagtct

SEQ ID NO: 211292 - DNA, 25 bp, Homo sapien
gagacagtcttaaacctaccattga

SEQ ID NO: 211293 - DNA, 25 bp, Homo sapien
taaacctaccattgacctgtgtgta

SEQ ID NO: 211294 - DNA, 25 bp, Homo sapien
caagatggtataggcctgaacagtg

SEQ ID NO: 211295 - DNA, 25 bp, Homo sapien
ggcagtaataaagtgggaccatttt

SEQ ID NO: 211296 - DNA, 25 bp, Homo sapien
gttggtctagcattgctggacacaa

SEQ ID NO: 211297 - DNA, 25 bp, Homo sapien
tattgttgtattgggtgatgtgtgc

SEQ ID NO: 211298 - DNA, 25 bp, Homo sapien
gtgtgcaaaactgcagaagctcact

SEQ ID NO: 211299 - DNA, 25 bp, Homo sapien
gaagctcactgcctataagaggaaa

SEQ ID NO: 211300 - DNA, 25 bp, Homo sapien
atttggtatagatccacccatccca

SEQ ID NO: 211301 - DNA, 25 bp, Homo sapien
gctcctcatgtttctggtttggtga

SEQ ID NO: 211302 - DNA, 25 bp, Homo sapien
gtttggtgagtcctttgtgccacca

SEQ ID NO: 211303 - DNA, 25 bp, Homo sapien
gccaccacccataatgctttgcatt

SEQ ID NO: 211304 - DNA, 25 bp, Homo sapien
gctttgcattgctgcatcctgggaa

SEQ ID NO: 211305 - DNA, 25 bp, Homo sapien
gggtatatggtctcacaagttgttg

SEQ ID NO: 211306 - DNA, 25 bp, Homo sapien
ggtctcacaagttgttgtcattgtt

SEQ ID NO: 211307 - DNA, 25 bp, Homo sapien
cttggtagacctgagaactgtggac

SEQ ID NO: 211308 - DNA, 25 bp, Homo sapien
gacagatctactggcgagcgatgaa

SEQ ID NO: 211309 - DNA, 25 bp, Homo sapien
gagagtcagcagaggcatttgtagc

SEQ ID NO: 211310 - DNA, 25 bp, Homo sapien
acatgctatgcatcagactggccat

SEQ ID NO: 211311 - DNA, 25 bp, Homo sapien
agatgaagaataccgtccgctttgt

SEQ ID NO: 211312 - DNA, 25 bp, Homo sapien
aataccgtccgctttgtgaaatagt

SEQ ID NO: 211313 - DNA, 25 bp, Homo sapien
aaatagtattgcaagccagccccgt

SEQ ID NO: 211314 - DNA, 25 bp, Homo sapien
agccccgtgggcaaatttgtattga

SEQ ID NO: 211315 - DNA, 25 bp, Homo sapien
tgtattgagtccatctgtaatttgc

SEQ ID NO: 211316 - DNA, 25 bp, Homo sapien
gtaatttgctcagtgatggcagaca

SEQ ID NO: 211317 - DNA, 25 bp, Homo sapien
acaagatggctgtctggttttgaga

SEQ ID NO: 211318 - DNA, 25 bp, Homo sapien
gagtgtgtttcatttgttctggtgc

SEQ ID NO: 211319 - DNA, 25 bp, Homo sapien
atgagcgctgtactatggtagttcc

SEQ ID NO: 211320 - DNA, 25 bp, Homo sapien
gagcgctgtactatggtagttccct

SEQ ID NO: 211321 - DNA, 25 bp, Homo sapien
gcgctgtactatggtagttccctta

SEQ ID NO: 211322 - DNA, 25 bp, Homo sapien
cgctgtactatggtagttcccttag

SEQ ID NO: 211323 - DNA, 25 bp, Homo sapien
atggtagttcccttaggatttgtat

SEQ ID NO: 211324 - DNA, 25 bp, Homo sapien
gagctgcagcagttgtaccctttct

SEQ ID NO: 211325 - DNA, 25 bp, Homo sapien
ctgcagcagttgtaccctttcttga

SEQ ID NO: 211326 - DNA, 25 bp, Homo sapien
gcagcagttgtaccctttcttgatg

SEQ ID NO: 211327 - DNA, 25 bp, Homo sapien
gttgtaccctttcttgatgacctaa

SEQ ID NO: 211328 - DNA, 25 bp, Homo sapien
aaggctcccatcattgactgtggat

SEQ ID NO: 211329 - DNA, 25 bp, Homo sapien
accacagtgcccaaacgaagaggaa

SEQ ID NO: 211330 - DNA, 25 bp, Homo sapien
ggagaactccacgtggatctctgat

SEQ ID NO: 211331 - DNA, 25 bp, Homo sapien
ggatctctgattgcgaaaccgtcac

SEQ ID NO: 211332 - DNA, 25 bp, Homo sapien
gtcacatacaccaagagagccacat

SEQ ID NO: 211333 - DNA, 25 bp, Homo sapien
acatgggcatgtggccctgaaggct

SEQ ID NO: 211334 - DNA, 25 bp, Homo sapien
agggtgacgcggacacatttcaggt

SEQ ID NO: 211335 - DNA, 25 bp, Homo sapien
catttcaggtggactttgcaaggac

SEQ ID NO: 211336 - DNA, 25 bp, Homo sapien
tgatggatagctacctcagggacca

SEQ ID NO: 211337 - DNA, 25 bp, Homo sapien
acctcagggaccagaatccgtggga

SEQ ID NO: 211338 - DNA, 25 bp, Homo sapien
gatggacctggtgttcccgttccca

SEQ ID NO: 211339 - DNA, 25 bp, Homo sapien
acaggctctcttttgtcaaggtggt

SEQ ID NO: 211340 - DNA, 25 bp, Homo sapien
aagtctgttttcaatcctggtaata

SEQ ID NO: 211341 - DNA, 25 bp, Homo sapien
actgcggcacctaagaagccttaaa

SEQ ID NO: 211342 - DNA, 25 bp, Homo sapien
gaagccttaaatgagagctaatcca

SEQ ID NO: 211343 - DNA, 25 bp, Homo sapien
tagagagcgatggtgtcagcatttc

SEQ ID NO: 211344 - DNA, 25 bp, Homo sapien
gtgtcagcatttcggtctgcatatc

SEQ ID NO: 211345 - DNA, 25 bp, Homo sapien
gtctgcatatctgtgtgtccgtatc

SEQ ID NO: 211346 - DNA, 25 bp, Homo sapien
atatctgtgtgtccgtatctgcgtt

SEQ ID NO: 211347 - DNA, 25 bp, Homo sapien
tatctgcgtttgtgtgcgtgtacgt

SEQ ID NO: 211348 - DNA, 25 bp, Homo sapien
ggcccagttttcaggcatgtagaat

SEQ ID NO: 211349 - DNA, 25 bp, Homo sapien
gaggaggactcacttcttgaagata

SEQ ID NO: 211350 - DNA, 25 bp, Homo sapien
agatatgcttgttgctttacaacat

SEQ ID NO: 211351 - DNA, 25 bp, Homo sapien
tttgcgcccccgtgtccccagctgc

SEQ ID NO: 211352 - DNA, 25 bp, Homo sapien
gggtcccgaggccattgtctccgaa

SEQ ID NO: 211353 - DNA, 25 bp, Homo sapien
ggtcccgaggccattgtctccgaag

SEQ ID NO: 211354 - DNA, 25 bp, Homo sapien
gtcccgaggccattgtctccgaagc

SEQ ID NO: 211355 - DNA, 25 bp, Homo sapien
tcccgaggccattgtctccgaagcg

SEQ ID NO: 211356 - DNA, 25 bp, Homo sapien
ccgaggccattgtctccgaagcgta

SEQ ID NO: 211357 - DNA, 25 bp, Homo sapien
cgaggccattgtctccgaagcgtat

SEQ ID NO: 211358 - DNA, 25 bp, Homo sapien
gaggccattgtctccgaagcgtatg

SEQ ID NO: 211359 - DNA, 25 bp, Homo sapien
aggccattgtctccgaagcgtatgt

SEQ ID NO: 211360 - DNA, 25 bp, Homo sapien
tgtgccaggtttgagtggcgagggt

SEQ ID NO: 211361 - DNA, 25 bp, Homo sapien
gtgccaggtttgagtggcgagggtg

SEQ ID NO: 211362 - DNA, 25 bp, Homo sapien
tgcgaggacccatgcagctgacgct

SEQ ID NO: 211363 - DNA, 25 bp, Homo sapien
gcgaggacccatgcagctgacgctg

SEQ ID NO: 211364 - DNA, 25 bp, Homo sapien
cgaggacccatgcagctgacgctgg

SEQ ID NO: 211365 - DNA, 25 bp, Homo sapien
gaggacccatgcagctgacgctggg

SEQ ID NO: 211366 - DNA, 25 bp, Homo sapien
tggccgccagcctgctctgggcgtg

SEQ ID NO: 211367 - DNA, 25 bp, Homo sapien
ccagcctgctctgggcgtgcgccgt

SEQ ID NO: 211368 - DNA, 25 bp, Homo sapien
acgtggagctggtgcccgaggacga

SEQ ID NO: 211369 - DNA, 25 bp, Homo sapien
cggcctccgcggaaggccctgatga

SEQ ID NO: 211370 - DNA, 25 bp, Homo sapien
gaaggccctgatgaggcgggtcggc

SEQ ID NO: 211371 - DNA, 25 bp, Homo sapien
ggactgggacattaaacctgacctc

SEQ ID NO: 211372 - DNA, 25 bp, Homo sapien
tgggacattaaacctgacctcccct

SEQ ID NO: 211373 - DNA, 25 bp, Homo sapien
ggccaatgattggttcattccagga

SEQ ID NO: 211374 - DNA, 25 bp, Homo sapien
aaggagtcaaaccacaccagtcttg

SEQ ID NO: 211375 - DNA, 25 bp, Homo sapien
accagtcttggattggctgtgagcc

SEQ ID NO: 211376 - DNA, 25 bp, Homo sapien
ggctgtgagccaattcacctcagtc

SEQ ID NO: 211377 - DNA, 25 bp, Homo sapien
cacctcagtctctaattggctgtga

SEQ ID NO: 211378 - DNA, 25 bp, Homo sapien
tggctgtgagtcagtctttcattta

SEQ ID NO: 211379 - DNA, 25 bp, Homo sapien
gtaaccatcaagaaacctctacagg

SEQ ID NO: 211380 - DNA, 25 bp, Homo sapien
tctacagggtacttaagccccagaa

SEQ ID NO: 211381 - DNA, 25 bp, Homo sapien
agattttgctaccagggctcttgag

SEQ ID NO: 211382 - DNA, 25 bp, Homo sapien
tgtactttcacttttgctgcttcac

SEQ ID NO: 211383 - DNA, 25 bp, Homo sapien
ttcactgccttgtgctccaataaat

SEQ ID NO: 211384 - DNA, 25 bp, Homo sapien
ggagcacccggagtcagtgtcgata

SEQ ID NO: 211385 - DNA, 25 bp, Homo sapien
ccggagtcagtgtcgatatgaacat

SEQ ID NO: 211386 - DNA, 25 bp, Homo sapien
gaacataacgtacatgtcacctgca

SEQ ID NO: 211387 - DNA, 25 bp, Homo sapien
acgtacatgtcacctgcaaaattag

SEQ ID NO: 211388 - DNA, 25 bp, Homo sapien
gattacagcacatgttctgaagcaa

SEQ ID NO: 211389 - DNA, 25 bp, Homo sapien
ggaaaaacacttgcatttacctctg

SEQ ID NO: 211390 - DNA, 25 bp, Homo sapien
tgcatttacctctgtggatctgacc

SEQ ID NO: 211391 - DNA, 25 bp, Homo sapien
tctgtggatctgaccaacaaggcca

SEQ ID NO: 211392 - DNA, 25 bp, Homo sapien
ggaagacacacaaaacacctgggaa

SEQ ID NO: 211393 - DNA, 25 bp, Homo sapien
aactgagagaacagcagaatgacct

SEQ ID NO: 211394 - DNA, 25 bp, Homo sapien
gaatgacctaaagaaacccaacaat

SEQ ID NO: 211395 - DNA, 25 bp, Homo sapien
tggagttcaggagaccccggacacc

SEQ ID NO: 211396 - DNA, 25 bp, Homo sapien
gaccccggacacctgggacctgtgt

SEQ ID NO: 211397 - DNA, 25 bp, Homo sapien
tgagcccgtcctgacatctgtgttc

SEQ ID NO: 211398 - DNA, 25 bp, Homo sapien
gacatctgtgttcttcctgtcagct

SEQ ID NO: 211399 - DNA, 25 bp, Homo sapien
gtccttgctgcctcagagtcagtca

SEQ ID NO: 211400 - DNA, 25 bp, Homo sapien
agtcactgaccctgttatcattgag

SEQ ID NO: 211401 - DNA, 25 bp, Homo sapien
ttatcattgagggtcccagtgggaa

SEQ ID NO: 211402 - DNA, 25 bp, Homo sapien
aagcaggacgtctgggctttacggt

SEQ ID NO: 211403 - DNA, 25 bp, Homo sapien
ctgggctttacggttctagggacag

SEQ ID NO: 211404 - DNA, 25 bp, Homo sapien
tttcctcctacagtgctgagcaaaa

SEQ ID NO: 211405 - DNA, 25 bp, Homo sapien
tacagtgctgagcaaaaagtcccca

SEQ ID NO: 211406 - DNA, 25 bp, Homo sapien
agcattcaagatgtgagtgcccgtg

SEQ ID NO: 211407 - DNA, 25 bp, Homo sapien
actcccatggcaccgtatttattga

SEQ ID NO: 211408 - DNA, 25 bp, Homo sapien
ggcaccgtatttattgactgatctg

SEQ ID NO: 211409 - DNA, 25 bp, Homo sapien
ttgactgatctgtgaaggcttccct

SEQ ID NO: 211410 - DNA, 25 bp, Homo sapien
aggaagagttcactggtcgctctgt

SEQ ID NO: 211411 - DNA, 25 bp, Homo sapien
acagcactttgttatacctctgcca

SEQ ID NO: 211412 - DNA, 25 bp, Homo sapien
tttgttatacctctgccacacactt

SEQ ID NO: 211413 - DNA, 25 bp, Homo sapien
acacacttcacgcagcgcgttgtaa

SEQ ID NO: 211414 - DNA, 25 bp, Homo sapien
gcagcgcgttgtaactcatgtgttt

SEQ ID NO: 211415 - DNA, 25 bp, Homo sapien
gagggcagggactgtacattctcca

SEQ ID NO: 211416 - DNA, 25 bp, Homo sapien
ggcctggcacattgtagacgcttaa

SEQ ID NO: 211417 - DNA, 25 bp, Homo sapien
tttaagcggagactcgatggccctc

SEQ ID NO: 211418 - DNA, 25 bp, Homo sapien
tcgatggccctcctcagcaaggatc

SEQ ID NO: 211419 - DNA, 25 bp, Homo sapien
tcagcaaggatcacttctgcctctg

SEQ ID NO: 211420 - DNA, 25 bp, Homo sapien
acagaggcagtggtcggcacagcct

SEQ ID NO: 211421 - DNA, 25 bp, Homo sapien
agtggtcggcacagcctgcagacag

SEQ ID NO: 211422 - DNA, 25 bp, Homo sapien
ggccacacgtagcagcggtgcacta

SEQ ID NO: 211423 - DNA, 25 bp, Homo sapien
gcagcggtgcactaacgtgtgcaga

SEQ ID NO: 211424 - DNA, 25 bp, Homo sapien
acgtgtgcagaaacagggctactct

SEQ ID NO: 211425 - DNA, 25 bp, Homo sapien
agcttcaccaggaggttctccactg

SEQ ID NO: 211426 - DNA, 25 bp, Homo sapien
accaggaggttctccactgtggtgg

SEQ ID NO: 211427 - DNA, 25 bp, Homo sapien
cagtgattgattctatttttctata

SEQ ID NO: 211428 - DNA, 25 bp, Homo sapien
accagtttttggcttactcctgaga

SEQ ID NO: 211429 - DNA, 25 bp, Homo sapien
cttactcctgagatatgatttgcaa

SEQ ID NO: 211430 - DNA, 25 bp, Homo sapien
ggttggacaagatgccactgctttt

SEQ ID NO: 211431 - DNA, 25 bp, Homo sapien
actgcttttcttagcactcttccct

SEQ ID NO: 211432 - DNA, 25 bp, Homo sapien
taaaccatcccgtagtcttctaata

SEQ ID NO: 211433 - DNA, 25 bp, Homo sapien
gtagtcttctaatacagtctctcag

SEQ ID NO: 211434 - DNA, 25 bp, Homo sapien
tacagtctctcagacaagtgtctct

SEQ ID NO: 211435 - DNA, 25 bp, Homo sapien
caagtgtctctagatggatgtgaac

SEQ ID NO: 211436 - DNA, 25 bp, Homo sapien
ggatgtgaactccttaactcatcaa

SEQ ID NO: 211437 - DNA, 25 bp, Homo sapien
gtgaactccttaactcatcaagtaa

SEQ ID NO: 211438 - DNA, 25 bp, Homo sapien
ctttttggaacagagcacggtataa

SEQ ID NO: 211439 - DNA, 25 bp, Homo sapien
aggcaccttcgcttccagatgctgc

SEQ ID NO: 211440 - DNA, 25 bp, Homo sapien
gatgctgccaggctgtcactcaatt

SEQ ID NO: 211441 - DNA, 25 bp, Homo sapien
ctgtcactcaattcggtcatttcat

SEQ ID NO: 211442 - DNA, 25 bp, Homo sapien
ggttgggctaacagcaagagacaat

SEQ ID NO: 211443 - DNA, 25 bp, Homo sapien
caagagacaataggcctttgttcct

SEQ ID NO: 211444 - DNA, 25 bp, Homo sapien
ttgttcctatttattgggtactgct

SEQ ID NO: 211445 - DNA, 25 bp, Homo sapien
tattgggtactgcttacgtgctaag

SEQ ID NO: 211446 - DNA, 25 bp, Homo sapien
ttaatgcttgcaacgactctctgag

SEQ ID NO: 211447 - DNA, 25 bp, Homo sapien
ttgcaacgactctctgaggtagaaa

SEQ ID NO: 211448 - DNA, 25 bp, Homo sapien
attgttaattccgttcaggatcccg

SEQ ID NO: 211449 - DNA, 25 bp, Homo sapien
tcaggatcccggctacataatctgt

SEQ ID NO: 211450 - DNA, 25 bp, Homo sapien
tctcactgcccttcaactagagctt

SEQ ID NO: 211451 - DNA, 25 bp, Homo sapien
ccttcaactagagctttcacctttt

SEQ ID NO: 211452 - DNA, 25 bp, Homo sapien
tagagctttcacctttttacatttc

SEQ ID NO: 211453 - DNA, 25 bp, Homo sapien
cccttctgaaggacacaaatctgct

SEQ ID NO: 211454 - DNA, 25 bp, Homo sapien
aatctgcttttctgcccatacactg

SEQ ID NO: 211455 - DNA, 25 bp, Homo sapien
ttctgcccatacactggcccaaggg

SEQ ID NO: 211456 - DNA, 25 bp, Homo sapien
atacactggcccaagggctcaccta

SEQ ID NO: 211457 - DNA, 25 bp, Homo sapien
caagggctcacctaacttgggaggg

SEQ ID NO: 211458 - DNA, 25 bp, Homo sapien
ggctgttggtacaaggatgattttc

SEQ ID NO: 211459 - DNA, 25 bp, Homo sapien
tcagctctttgccttatctgtgtca

SEQ ID NO: 211460 - DNA, 25 bp, Homo sapien
ctctttgccttatctgtgtcactgt

SEQ ID NO: 211461 - DNA, 25 bp, Homo sapien
tcagctgttaagagtaggcaatttc

SEQ ID NO: 211462 - DNA, 25 bp, Homo sapien
atttcttcagttcttccacaagaaa

SEQ ID NO: 211463 - DNA, 25 bp, Homo sapien
gcaacagcactttgatgtgcagcaa

SEQ ID NO: 211464 - DNA, 25 bp, Homo sapien
cttgctaaggctaaagaatccctga

SEQ ID NO: 211465 - DNA, 25 bp, Homo sapien
gaatccctgaaacaggcgcgtcatt

SEQ ID NO: 211466 - DNA, 25 bp, Homo sapien
gaaacaggcgcgtcattctctctgt

SEQ ID NO: 211467 - DNA, 25 bp, Homo sapien
cattctctctgtttgcaaatgcaag

SEQ ID NO: 211468 - DNA, 25 bp, Homo sapien
atcttacagttttaaatgtcgtcag

SEQ ID NO: 211469 - DNA, 25 bp, Homo sapien
tgtcgtcagattttccattatgtat

SEQ ID NO: 211470 - DNA, 25 bp, Homo sapien
aggatgtttttgagtcccatggttc

SEQ ID NO: 211471 - DNA, 25 bp, Homo sapien
gagtcccatggttcattttgattgt

SEQ ID NO: 211472 - DNA, 25 bp, Homo sapien
gttttgttacactaatgcgcaccac

SEQ ID NO: 211473 - DNA, 25 bp, Homo sapien
tgttacactaatgcgcaccacatat

SEQ ID NO: 211474 - DNA, 25 bp, Homo sapien
actaatgcgcaccacatatttatgg

SEQ ID NO: 211475 - DNA, 25 bp, Homo sapien
taggttttcgtcttagttgtagcac

SEQ ID NO: 211476 - DNA, 25 bp, Homo sapien
gtcttagttgtagcacacttaccct

SEQ ID NO: 211477 - DNA, 25 bp, Homo sapien
gttgtagcacacttaccctaatttt

SEQ ID NO: 211478 - DNA, 25 bp, Homo sapien
cacacttaccctaattttgccaatt

SEQ ID NO: 211479 - DNA, 25 bp, Homo sapien
aagcagactggtggcaagtacacag

SEQ ID NO: 211480 - DNA, 25 bp, Homo sapien
gactggtggcaagtacacagccctt

SEQ ID NO: 211481 - DNA, 25 bp, Homo sapien
ggtggcaagtacacagccctttttt

SEQ ID NO: 211482 - DNA, 25 bp, Homo sapien
cagcccttttttttgcagtgctaac

SEQ ID NO: 211483 - DNA, 25 bp, Homo sapien
agtttcctcaactaagggagcaaca

SEQ ID NO: 211484 - DNA, 25 bp, Homo sapien
aagggagcaacaggacatctgctgg

SEQ ID NO: 211485 - DNA, 25 bp, Homo sapien
ggcagcttttaccacattagcttgt

SEQ ID NO: 211486 - DNA, 25 bp, Homo sapien
taccacctactttaaacctggattg

SEQ ID NO: 211487 - DNA, 25 bp, Homo sapien
ttgttcggaaccagaatttgatctc

SEQ ID NO: 211488 - DNA, 25 bp, Homo sapien
atttgatctcaactatgttccacta

SEQ ID NO: 211489 - DNA, 25 bp, Homo sapien
aactatgttccactaaaggcacagg

SEQ ID NO: 211490 - DNA, 25 bp, Homo sapien
agaaaagatttattggcctcaccaa

SEQ ID NO: 211491 - DNA, 25 bp, Homo sapien
ggcctcaccaattcctttggttttg

SEQ ID NO: 211492 - DNA, 25 bp, Homo sapien
ggtggtactaatgcaacactttgta

SEQ ID NO: 211493 - DNA, 25 bp, Homo sapien
tgtattgctggactgtagaacatat

SEQ ID NO: 211494 - DNA, 25 bp, Homo sapien
gaaattacatataaatctttgcagt

SEQ ID NO: 211495 - DNA, 25 bp, Homo sapien
aaatctttgcagttatgctatttgt

SEQ ID NO: 211496 - DNA, 25 bp, Homo sapien
tgcagttatgctatttgtaaacagg

SEQ ID NO: 211497 - DNA, 25 bp, Homo sapien
aaacaggattatataggagagcaaa

SEQ ID NO: 211498 - DNA, 25 bp, Homo sapien
cttagagcagtagcttgcagtttca

SEQ ID NO: 211499 - DNA, 25 bp, Homo sapien
gtagcttgcagtttcagttgagttc

SEQ ID NO: 211500 - DNA, 25 bp, Homo sapien
gcagtttcagttgagttctacttag

SEQ ID NO: 211501 - DNA, 25 bp, Homo sapien
agaaattctttttagctagtgggca

SEQ ID NO: 211502 - DNA, 25 bp, Homo sapien
tagctagtgggcatgtgaagatatt

SEQ ID NO: 211503 - DNA, 25 bp, Homo sapien
tgtgaagatatttagtcacccagag

SEQ ID NO: 211504 - DNA, 25 bp, Homo sapien
acccagaggagccagtaaatgttat

SEQ ID NO: 211505 - DNA, 25 bp, Homo sapien
aagacacggaacttcaccttttctg

SEQ ID NO: 211506 - DNA, 25 bp, Homo sapien
gacacggaacttcaccttttctggg

SEQ ID NO: 211507 - DNA, 25 bp, Homo sapien
gttaaagccacccagcattcacgaa

SEQ ID NO: 211508 - DNA, 25 bp, Homo sapien
aaagccacccagcattcacgaagag

SEQ ID NO: 211509 - DNA, 25 bp, Homo sapien
agcattcacgaagagcacctgaagt

SEQ ID NO: 211510 - DNA, 25 bp, Homo sapien
cacgaagagcacctgaagtatggaa

SEQ ID NO: 211511 - DNA, 25 bp, Homo sapien
cctgcttcagaggagcatctctgag

SEQ ID NO: 211512 - DNA, 25 bp, Homo sapien
aggagcatctctgagggttctagct

SEQ ID NO: 211513 - DNA, 25 bp, Homo sapien
atctctgagggttctagctctttta

SEQ ID NO: 211514 - DNA, 25 bp, Homo sapien
tgagggttctagctcttttaacacc

SEQ ID NO: 211515 - DNA, 25 bp, Homo sapien
ggagacccaggactgaactctccag

SEQ ID NO: 211516 - DNA, 25 bp, Homo sapien
tcagttatttgatgaagtctactag

SEQ ID NO: 211517 - DNA, 25 bp, Homo sapien
gaagtctactagagtgagaaatcac

SEQ ID NO: 211518 - DNA, 25 bp, Homo sapien
ttgacataaccttaagcacttgatt

SEQ ID NO: 211519 - DNA, 25 bp, Homo sapien
ccccattttaggatgtaggactaag

SEQ ID NO: 211520 - DNA, 25 bp, Homo sapien
gactaaggtctttgaggactggtct

SEQ ID NO: 211521 - DNA, 25 bp, Homo sapien
aggactggtctgctcctaggagttc

SEQ ID NO: 211522 - DNA, 25 bp, Homo sapien
ctgctcctaggagttccatgtatat

SEQ ID NO: 211523 - DNA, 25 bp, Homo sapien
gtagtgacataattcaacattccca

SEQ ID NO: 211524 - DNA, 25 bp, Homo sapien
tcaacattcccaatttacacttttg

SEQ ID NO: 211525 - DNA, 25 bp, Homo sapien
aatacagttggtaagcacttccatt

SEQ ID NO: 211526 - DNA, 25 bp, Homo sapien
gcacttccattatagagtccttatg

SEQ ID NO: 211527 - DNA, 25 bp, Homo sapien
aatagtgaccacatgggcctgtttt

SEQ ID NO: 211528 - DNA, 25 bp, Homo sapien
ggcctgttttcagggtcccagctta

SEQ ID NO: 211529 - DNA, 25 bp, Homo sapien
ttcagggtcccagcttagttaagtc

SEQ ID NO: 211530 - DNA, 25 bp, Homo sapien
agcttagttaagtcacccatgcacc

SEQ ID NO: 211531 - DNA, 25 bp, Homo sapien
gtcacccatgcacctggtcattgtg

SEQ ID NO: 211532 - DNA, 25 bp, Homo sapien
tgcacatccagcgtttctcagaagc

SEQ ID NO: 211533 - DNA, 25 bp, Homo sapien
agcgtttctcagaagcagacccacc

SEQ ID NO: 211534 - DNA, 25 bp, Homo sapien
agacccacccttaagttgacaggat

SEQ ID NO: 211535 - DNA, 25 bp, Homo sapien
gattgatggaacatgctctcctgct

SEQ ID NO: 211536 - DNA, 25 bp, Homo sapien
aaggcacaacctctgggctggagta

SEQ ID NO: 211537 - DNA, 25 bp, Homo sapien
ctctggtgggaaggttttgctgcta

SEQ ID NO: 211538 - DNA, 25 bp, Homo sapien
tggccagatttgctttcacagtgtg

SEQ ID NO: 211539 - DNA, 25 bp, Homo sapien
cagtgtggctgtggattatacaata

SEQ ID NO: 211540 - DNA, 25 bp, Homo sapien
gaactcaactggtctttcttaagaa

SEQ ID NO: 211541 - DNA, 25 bp, Homo sapien
aagcacacgtcgtccatttgtgcca

SEQ ID NO: 211542 - DNA, 25 bp, Homo sapien
atttgtgccacaaagctgccttcca

SEQ ID NO: 211543 - DNA, 25 bp, Homo sapien
gccttccacatgaagctgtgggctc

SEQ ID NO: 211544 - DNA, 25 bp, Homo sapien
tgtgggctcagccagcaacctgacc

SEQ ID NO: 211545 - DNA, 25 bp, Homo sapien
aacctgaccttggactgtttgactg

SEQ ID NO: 211546 - DNA, 25 bp, Homo sapien
gtttgactgcaaagcttagtggcct

SEQ ID NO: 211547 - DNA, 25 bp, Homo sapien
gcttagtggcctacaggtggctgta

SEQ ID NO: 211548 - DNA, 25 bp, Homo sapien
gagaatagcatgttcgtattacaag

SEQ ID NO: 211549 - DNA, 25 bp, Homo sapien
tactacgccaagtaagggggccgca

SEQ ID NO: 211550 - DNA, 25 bp, Homo sapien
gggaggacgcgcactccagcgcagc

SEQ ID NO: 211551 - DNA, 25 bp, Homo sapien
gcgtgcggtgcaaagtgaaagtaac

SEQ ID NO: 211552 - DNA, 25 bp, Homo sapien
gaaagtaactgttaaggagcttcag

SEQ ID NO: 211553 - DNA, 25 bp, Homo sapien
gtaactgttaaggagcttcagggaa

SEQ ID NO: 211554 - DNA, 25 bp, Homo sapien
aggagcttcagggaaaagggtccag

SEQ ID NO: 211555 - DNA, 25 bp, Homo sapien
ccttggtgggcctcgggtccagcgg

SEQ ID NO: 211556 - DNA, 25 bp, Homo sapien
tctgctgttcaggatgcagcactgc

SEQ ID NO: 211557 - DNA, 25 bp, Homo sapien
tgttcaggatgcagcactgcgcggc

SEQ ID NO: 211558 - DNA, 25 bp, Homo sapien
aggatgcagcactgcgcggcgcggc

SEQ ID NO: 211559 - DNA, 25 bp, Homo sapien
cggcgagggcaaagcggcctcatcc

SEQ ID NO: 211560 - DNA, 25 bp, Homo sapien
cattaaaaatgtggccgagcgcggt

SEQ ID NO: 211561 - DNA, 25 bp, Homo sapien
attaaaaatgtggccgagcgcggtg

SEQ ID NO: 211562 - DNA, 25 bp, Homo sapien
ttaaaaatgtggccgagcgcggtgg

SEQ ID NO: 211563 - DNA, 25 bp, Homo sapien
taaaaatgtggccgagcgcggtggc

SEQ ID NO: 211564 - DNA, 25 bp, Homo sapien
aaaaatgtggccgagcgcggtggct

SEQ ID NO: 211565 - DNA, 25 bp, Homo sapien
aaaatgtggccgagcgcggtggctc

SEQ ID NO: 211566 - DNA, 25 bp, Homo sapien
aaatgtggccgagcgcggtggctca

SEQ ID NO: 211567 - DNA, 25 bp, Homo sapien
aatgtggccgagcgcggtggctcac

SEQ ID NO: 211568 - DNA, 25 bp, Homo sapien
ctccagcctgggcaaaaagagccag

SEQ ID NO: 211569 - DNA, 25 bp, Homo sapien
tccagcctgggcaaaaagagccaga

SEQ ID NO: 211570 - DNA, 25 bp, Homo sapien
ctgggcaaaaagagccagactccgt

SEQ ID NO: 211571 - DNA, 25 bp, Homo sapien
gttgtcttaattcagcaactcgaga

SEQ ID NO: 211572 - DNA, 25 bp, Homo sapien
gcaactcgagaaggcgcttaaagaa

SEQ ID NO: 211573 - DNA, 25 bp, Homo sapien
aaagaaatagattcccactgccatc

SEQ ID NO: 211574 - DNA, 25 bp, Homo sapien
ttcccactgccatctcagaaaagtt

SEQ ID NO: 211575 - DNA, 25 bp, Homo sapien
gccatctcagaaaagttaagcacat

SEQ ID NO: 211576 - DNA, 25 bp, Homo sapien
caaggacatatgctgtaggatggaa

SEQ ID NO: 211577 - DNA, 25 bp, Homo sapien
gaacaggttattgctgaagctccct

SEQ ID NO: 211578 - DNA, 25 bp, Homo sapien
tattgctgaagctccctataatcct

SEQ ID NO: 211579 - DNA, 25 bp, Homo sapien
gaagctccctataatcctgaaatga

SEQ ID NO: 211580 - DNA, 25 bp, Homo sapien
atgaagagaattcccttccagaagc

SEQ ID NO: 211581 - DNA, 25 bp, Homo sapien
tcccttccagaagctacgaaaaagg

SEQ ID NO: 211582 - DNA, 25 bp, Homo sapien
gagccttgaacttcagcaggccaag

SEQ ID NO: 211583 - DNA, 25 bp, Homo sapien
ttgaacttcagcaggccaagagcaa

SEQ ID NO: 211584 - DNA, 25 bp, Homo sapien
ttcagcaggccaagagcaactcatt

SEQ ID NO: 211585 - DNA, 25 bp, Homo sapien
ggccaagagcaactcattacttctt

SEQ ID NO: 211586 - DNA, 25 bp, Homo sapien
gagcaactcattacttcttcagaga

SEQ ID NO: 211587 - DNA, 25 bp, Homo sapien
ttcttcagagagaggccaatgcttt

SEQ ID NO: 211588 - DNA, 25 bp, Homo sapien
gagaggccaatgctttggccatgca

SEQ ID NO: 211589 - DNA, 25 bp, Homo sapien
aatgctttggccatgcaacagaagt

SEQ ID NO: 211590 - DNA, 25 bp, Homo sapien
ggccatgcaacagaagtggaattcc

SEQ ID NO: 211591 - DNA, 25 bp, Homo sapien
gaattccctggatgaaggccgtcac

SEQ ID NO: 211592 - DNA, 25 bp, Homo sapien
gatgaaggccgtcaccttaccttaa

SEQ ID NO: 211593 - DNA, 25 bp, Homo sapien
gatgataaagcgaaacttctgtgga

SEQ ID NO: 211594 - DNA, 25 bp, Homo sapien
aagcgaaacttctgtggaagttcca

SEQ ID NO: 211595 - DNA, 25 bp, Homo sapien
agtgttctctcttattccacttcgg

SEQ ID NO: 211596 - DNA, 25 bp, Homo sapien
ttctctcttattccacttcggtaga

SEQ ID NO: 211597 - DNA, 25 bp, Homo sapien
attccacttcggtagaggatttcta

SEQ ID NO: 211598 - DNA, 25 bp, Homo sapien
gaggatttctagtttcttgtgggct

SEQ ID NO: 211599 - DNA, 25 bp, Homo sapien
atttctagtttcttgtgggctaatt

SEQ ID NO: 211600 - DNA, 25 bp, Homo sapien
acaaatgcacagatcaagggtagtt

SEQ ID NO: 211601 - DNA, 25 bp, Homo sapien
aatccttccaagttagttcaaaatg

SEQ ID NO: 211602 - DNA, 25 bp, Homo sapien
tataaaagctgtacacggctgaaaa

SEQ ID NO: 211603 - DNA, 25 bp, Homo sapien
gctgtacacggctgaaaaatatata

SEQ ID NO: 211604 - DNA, 25 bp, Homo sapien
gaagctgctcggtgcctaagggccc

SEQ ID NO: 211605 - DNA, 25 bp, Homo sapien
cgggaggttccgagacaaatgaatt

SEQ ID NO: 211606 - DNA, 25 bp, Homo sapien
gggaggttccgagacaaatgaattc

SEQ ID NO: 211607 - DNA, 25 bp, Homo sapien
gttccgagacaaatgaattcaagtt

SEQ ID NO: 211608 - DNA, 25 bp, Homo sapien
accggttatccctaatatccaggca

SEQ ID NO: 211609 - DNA, 25 bp, Homo sapien
ccggttatccctaatatccaggcaa

SEQ ID NO: 211610 - DNA, 25 bp, Homo sapien
ggttatccctaatatccaggcaaaa

SEQ ID NO: 211611 - DNA, 25 bp, Homo sapien
ttatccctaatatccaggcaaaagg

SEQ ID NO: 211612 - DNA, 25 bp, Homo sapien
atccaggcaaaaggtcttgggaaga

SEQ ID NO: 211613 - DNA, 25 bp, Homo sapien
ccaggcaaaaggtcttgggaagaat

SEQ ID NO: 211614 - DNA, 25 bp, Homo sapien
aagaatagtgaagaaaactccacct

SEQ ID NO: 211615 - DNA, 25 bp, Homo sapien
tggtgctgctgtttgaaaccgccct

SEQ ID NO: 211616 - DNA, 25 bp, Homo sapien
tgctgtttgaaaccgccctgctatc

SEQ ID NO: 211617 - DNA, 25 bp, Homo sapien
ttgaaaccgccctgctatcttctgg

SEQ ID NO: 211618 - DNA, 25 bp, Homo sapien
tcttctggcttttcccttgaggatc

SEQ ID NO: 211619 - DNA, 25 bp, Homo sapien
ggcttttcccttgaggatccccaga

SEQ ID NO: 211620 - DNA, 25 bp, Homo sapien
actccaaccgcatctatcgcatgat

SEQ ID NO: 211621 - DNA, 25 bp, Homo sapien
aaccgcatctatcgcatgatcaagc

SEQ ID NO: 211622 - DNA, 25 bp, Homo sapien
tcgcatgatcaagctaggtctaggt

SEQ ID NO: 211623 - DNA, 25 bp, Homo sapien
agctaggtctaggtattgatgaaga

SEQ ID NO: 211624 - DNA, 25 bp, Homo sapien
gcagaggaacccaatgctgcagttc

SEQ ID NO: 211625 - DNA, 25 bp, Homo sapien
tgctgcagttcctgatgagatcccc

SEQ ID NO: 211626 - DNA, 25 bp, Homo sapien
gtaaatatacatgcgccgggagctt

SEQ ID NO: 211627 - DNA, 25 bp, Homo sapien
tacatgcgccgggagcttcttgcag

SEQ ID NO: 211628 - DNA, 25 bp, Homo sapien
gccgggagcttcttgcaggaatact

SEQ ID NO: 211629 - DNA, 25 bp, Homo sapien
gcttcttgcaggaatactgctccga

SEQ ID NO: 211630 - DNA, 25 bp, Homo sapien
gcaggaatactgctccgaatcactt

SEQ ID NO: 211631 - DNA, 25 bp, Homo sapien
gaatactgctccgaatcacttttaa

SEQ ID NO: 211632 - DNA, 25 bp, Homo sapien
ctgctccgaatcacttttaattttt

SEQ ID NO: 211633 - DNA, 25 bp, Homo sapien
tttcttgccctttccattagttgta

SEQ ID NO: 211634 - DNA, 25 bp, Homo sapien
tgccctttccattagttgtattttt

SEQ ID NO: 211635 - DNA, 25 bp, Homo sapien
tgggactttaagtgtacaccactgt

SEQ ID NO: 211636 - DNA, 25 bp, Homo sapien
ttaagtgtacaccactgtgcctgct

SEQ ID NO: 211637 - DNA, 25 bp, Homo sapien
gagaccatatgactaataataaata

SEQ ID NO: 211638 - DNA, 25 bp, Homo sapien
agaccatatgactaataataaataa

SEQ ID NO: 211639 - DNA, 25 bp, Homo sapien
aaatatatgaaataccctgtttggc

SEQ ID NO: 211640 - DNA, 25 bp, Homo sapien
aatatatgaaataccctgtttggcc

SEQ ID NO: 211641 - DNA, 25 bp, Homo sapien
atatatgaaataccctgtttggccg

SEQ ID NO: 211642 - DNA, 25 bp, Homo sapien
tatatgaaataccctgtttggccgg

SEQ ID NO: 211643 - DNA, 25 bp, Homo sapien
atatgaaataccctgtttggccggg

SEQ ID NO: 211644 - DNA, 25 bp, Homo sapien
tatgaaataccctgtttggccgggc

SEQ ID NO: 211645 - DNA, 25 bp, Homo sapien
atgaaataccctgtttggccgggcg

SEQ ID NO: 211646 - DNA, 25 bp, Homo sapien
tgaaataccctgtttggccgggcgc

SEQ ID NO: 211647 - DNA, 25 bp, Homo sapien
aacagtcttcagatgggttaagatt

SEQ ID NO: 211648 - DNA, 25 bp, Homo sapien
aagggtggactggactctactgagc

SEQ ID NO: 211649 - DNA, 25 bp, Homo sapien
tggactggactctactgagcaccgt

SEQ ID NO: 211650 - DNA, 25 bp, Homo sapien
tgagcaccgtccttcaacaaggaaa

SEQ ID NO: 211651 - DNA, 25 bp, Homo sapien
aaaattgtctgctccaatccagggt

SEQ ID NO: 211652 - DNA, 25 bp, Homo sapien
caatccagggttattaggccaaagt

SEQ ID NO: 211653 - DNA, 25 bp, Homo sapien
ggccaaagttacataattcagatct

SEQ ID NO: 211654 - DNA, 25 bp, Homo sapien
gatctcactgcaaccatccaaaagt

SEQ ID NO: 211655 - DNA, 25 bp, Homo sapien
aaaagtggattctcgagcccttgct

SEQ ID NO: 211656 - DNA, 25 bp, Homo sapien
attctcgagcccttgctccaatggg

SEQ ID NO: 211657 - DNA, 25 bp, Homo sapien
aatacaattccccaatttccatgga

SEQ ID NO: 211658 - DNA, 25 bp, Homo sapien
aaagcagcgatacgctgacccgaca

SEQ ID NO: 211659 - DNA, 25 bp, Homo sapien
gaaacggacttagatctgaccgtcc

SEQ ID NO: 211660 - DNA, 25 bp, Homo sapien
gacttagatctgaccgtccaggaaa

SEQ ID NO: 211661 - DNA, 25 bp, Homo sapien
accgtccaggaaacaggtctgcaag

SEQ ID NO: 211662 - DNA, 25 bp, Homo sapien
aacaggtctgcaaggacctgtgggt

SEQ ID NO: 211663 - DNA, 25 bp, Homo sapien
aggaccctgaagagttgtccccagc

SEQ ID NO: 211664 - DNA, 25 bp, Homo sapien
aagagttgtccccagcacttgtagt

SEQ ID NO: 211665 - DNA, 25 bp, Homo sapien
gcacttgtagtgtccagttcacaga

SEQ ID NO: 211666 - DNA, 25 bp, Homo sapien
cagttcacagagctttgtcatcagt

SEQ ID NO: 211667 - DNA, 25 bp, Homo sapien
ggtggaggcagcactgttacagaaa

SEQ ID NO: 211668 - DNA, 25 bp, Homo sapien
gttacagaaaacgtagtgaattcat

SEQ ID NO: 211669 - DNA, 25 bp, Homo sapien
acacagtagggccagaacaccatcc

SEQ ID NO: 211670 - DNA, 25 bp, Homo sapien
gctggcatcgggttcctggcacagc

SEQ ID NO: 211671 - DNA, 25 bp, Homo sapien
tgtccaggactttatcatcggcaga

SEQ ID NO: 211672 - DNA, 25 bp, Homo sapien
ggactttatcatcggcagacctcag

SEQ ID NO: 211673 - DNA, 25 bp, Homo sapien
agacctcagaagacaacacacaaag

SEQ ID NO: 211674 - DNA, 25 bp, Homo sapien
gaagacaacacacaaaggtttcttt

SEQ ID NO: 211675 - DNA, 25 bp, Homo sapien
gaaaacattgcaccagcgttctaag

SEQ ID NO: 211676 - DNA, 25 bp, Homo sapien
ttgcaccagcgttctaagcctcaaa

SEQ ID NO: 211677 - DNA, 25 bp, Homo sapien
accagcgttctaagcctcaaacaaa

SEQ ID NO: 211678 - DNA, 25 bp, Homo sapien
ttctaagcctcaaacaaaacacaaa

SEQ ID NO: 211679 - DNA, 25 bp, Homo sapien
acacaaaacaaatccccctgcgaag

SEQ ID NO: 211680 - DNA, 25 bp, Homo sapien
gagtttgagatttcttttccttgtt

SEQ ID NO: 211681 - DNA, 25 bp, Homo sapien
aaagagcgaatgactgaacagccat

SEQ ID NO: 211682 - DNA, 25 bp, Homo sapien
gactgaacagccatggcaaggcaga

SEQ ID NO: 211683 - DNA, 25 bp, Homo sapien
atggcaaggcagacctacaggcgag

SEQ ID NO: 211684 - DNA, 25 bp, Homo sapien
aggcagacctacaggcgaggccgca

SEQ ID NO: 211685 - DNA, 25 bp, Homo sapien
gtttccctggcgcagcgaaagtctc

SEQ ID NO: 211686 - DNA, 25 bp, Homo sapien
ggcgcagcgaaagtctctgagcact

SEQ ID NO: 211687 - DNA, 25 bp, Homo sapien
gtctctgagcacttaccgggcgtga

SEQ ID NO: 211688 - DNA, 25 bp, Homo sapien
cgtgaccgtttcttaggtgtgagag

SEQ ID NO: 211689 - DNA, 25 bp, Homo sapien
tgtggcttttgtgcagcgactatgt

SEQ ID NO: 211690 - DNA, 25 bp, Homo sapien
ttgtgcagcgactatgttggtgtta

SEQ ID NO: 211691 - DNA, 25 bp, Homo sapien
gttgggctcttccattctattcatc

SEQ ID NO: 211692 - DNA, 25 bp, Homo sapien
ggctcttccattctattcatcaagt

SEQ ID NO: 211693 - DNA, 25 bp, Homo sapien
ttcatcaagttgtctatctctgcac

SEQ ID NO: 211694 - DNA, 25 bp, Homo sapien
aagttgtctatctctgcacaaatag

SEQ ID NO: 211695 - DNA, 25 bp, Homo sapien
tctctgcacaaatagtacatgatat

SEQ ID NO: 211696 - DNA, 25 bp, Homo sapien
tgagtcttgatatctagtaggacaa

SEQ ID NO: 211697 - DNA, 25 bp, Homo sapien
gtaggacaagtatctgtattttcat

SEQ ID NO: 211698 - DNA, 25 bp, Homo sapien
ttttcattaggagctgcctgacgca

SEQ ID NO: 211699 - DNA, 25 bp, Homo sapien
aggagctgcctgacgcattcatata

SEQ ID NO: 211700 - DNA, 25 bp, Homo sapien
gaatcagcttatcaaattccttgga

SEQ ID NO: 211701 - DNA, 25 bp, Homo sapien
attccttggaaaagtattcttgtgg

SEQ ID NO: 211702 - DNA, 25 bp, Homo sapien
tacacagtctatgcattattcatat

SEQ ID NO: 211703 - DNA, 25 bp, Homo sapien
tatacatttattttagcctaaagtg

SEQ ID NO: 211704 - DNA, 25 bp, Homo sapien
tccagttcttcaagccataaatgac

SEQ ID NO: 211705 - DNA, 25 bp, Homo sapien
aagccataaatgaccaagatccaag

SEQ ID NO: 211706 - DNA, 25 bp, Homo sapien
gaccaagatccaagcaatctgaatt

SEQ ID NO: 211707 - DNA, 25 bp, Homo sapien
gtgattatttgactggaatgcttct

SEQ ID NO: 211708 - DNA, 25 bp, Homo sapien
tatttgactggaatgcttcttaagt

SEQ ID NO: 211709 - DNA, 25 bp, Homo sapien
gtggaataactatactccgttatcc

SEQ ID NO: 211710 - DNA, 25 bp, Homo sapien
aactatactccgttatccacccgat

SEQ ID NO: 211711 - DNA, 25 bp, Homo sapien
gttatccacccgatttcctaatgta

SEQ ID NO: 211712 - DNA, 25 bp, Homo sapien
ccacccgatttcctaatgtaattga

SEQ ID NO: 211713 - DNA, 25 bp, Homo sapien
ttttaacaagcaccctaagtgattt

SEQ ID NO: 211714 - DNA, 25 bp, Homo sapien
gtgatttttatgtagccagcccaga

SEQ ID NO: 211715 - DNA, 25 bp, Homo sapien
gatcaactgggaaccactgatggtc

SEQ ID NO: 211716 - DNA, 25 bp, Homo sapien
gatggtccaaactcttcatttaaga

SEQ ID NO: 211717 - DNA, 25 bp, Homo sapien
gaaaaccaagtctccaaggccctag

SEQ ID NO: 211718 - DNA, 25 bp, Homo sapien
caaggccctagtctgggcaaggcca

SEQ ID NO: 211719 - DNA, 25 bp, Homo sapien
aaggccacaggtgctcttgcaaaac

SEQ ID NO: 211720 - DNA, 25 bp, Homo sapien
gtgctcttgcaaaactaactaggct

SEQ ID NO: 211721 - DNA, 25 bp, Homo sapien
taggcttcttaattgttttctcatc

SEQ ID NO: 211722 - DNA, 25 bp, Homo sapien
gggtatatgccacatggttctatag

SEQ ID NO: 211723 - DNA, 25 bp, Homo sapien
ttgcagctgggcaaaatcttcagca

SEQ ID NO: 211724 - DNA, 25 bp, Homo sapien
ttttaaagacttccggccaggcacg

SEQ ID NO: 211725 - DNA, 25 bp, Homo sapien
tttaaagacttccggccaggcacgg

SEQ ID NO: 211726 - DNA, 25 bp, Homo sapien
ttaaagacttccggccaggcacggt

SEQ ID NO: 211727 - DNA, 25 bp, Homo sapien
taaagacttccggccaggcacggtg

SEQ ID NO: 211728 - DNA, 25 bp, Homo sapien
aaagacttccggccaggcacggtgg

SEQ ID NO: 211729 - DNA, 25 bp, Homo sapien
aagacttccggccaggcacggtggt

SEQ ID NO: 211730 - DNA, 25 bp, Homo sapien
agacttccggccaggcacggtggtt

SEQ ID NO: 211731 - DNA, 25 bp, Homo sapien
gacttccggccaggcacggtggttc

SEQ ID NO: 211732 - DNA, 25 bp, Homo sapien
acttccggccaggcacggtggttca

SEQ ID NO: 211733 - DNA, 25 bp, Homo sapien
cttccggccaggcacggtggttcac

SEQ ID NO: 211734 - DNA, 25 bp, Homo sapien
gaggcaggagaattcttttaaccca

SEQ ID NO: 211735 - DNA, 25 bp, Homo sapien
agtgtaaattaagaatttgttggca

SEQ ID NO: 211736 - DNA, 25 bp, Homo sapien
gtgtaaattaagaatttgttggcag

SEQ ID NO: 211737 - DNA, 25 bp, Homo sapien
tgtaaattaagaatttgttggcagg

SEQ ID NO: 211738 - DNA, 25 bp, Homo sapien
gtaaattaagaatttgttggcaggg

SEQ ID NO: 211739 - DNA, 25 bp, Homo sapien
taaattaagaatttgttggcagggc

SEQ ID NO: 211740 - DNA, 25 bp, Homo sapien
aaattaagaatttgttggcagggcg

SEQ ID NO: 211741 - DNA, 25 bp, Homo sapien
aattaagaatttgttggcagggcgt

SEQ ID NO: 211742 - DNA, 25 bp, Homo sapien
attaagaatttgttggcagggcgtg

SEQ ID NO: 211743 - DNA, 25 bp, Homo sapien
ttaagaatttgttggcagggcgtgg

SEQ ID NO: 211744 - DNA, 25 bp, Homo sapien
taagaatttgttggcagggcgtggt

SEQ ID NO: 211745 - DNA, 25 bp, Homo sapien
aagaatttgttggcagggcgtggtg

SEQ ID NO: 211746 - DNA, 25 bp, Homo sapien
gagcatgtgctaccttgagatttca

SEQ ID NO: 211747 - DNA, 25 bp, Homo sapien
gatttcaagaagtgtcctacctcag

SEQ ID NO: 211748 - DNA, 25 bp, Homo sapien
agtgtcctacctcagctgaagatgg

SEQ ID NO: 211749 - DNA, 25 bp, Homo sapien
gatcagcccagggtaccatgtgatg

SEQ ID NO: 211750 - DNA, 25 bp, Homo sapien
gtaccatgtgatgactaatatgcca

SEQ ID NO: 211751 - DNA, 25 bp, Homo sapien
taatatgccactcattaagggcttt

SEQ ID NO: 211752 - DNA, 25 bp, Homo sapien
taagggcttttacctcggctgtcca

SEQ ID NO: 211753 - DNA, 25 bp, Homo sapien
gtccacatccagtcatgcatttggg

SEQ ID NO: 211754 - DNA, 25 bp, Homo sapien
aggcatgcctgcgaaatgattgaca

SEQ ID NO: 211755 - DNA, 25 bp, Homo sapien
gattgacattcctgtaggtgcccca

SEQ ID NO: 211756 - DNA, 25 bp, Homo sapien
aggtgccccatagaggtgtggcatt

SEQ ID NO: 211757 - DNA, 25 bp, Homo sapien
gacctcgggctagttaaggtgtgca

SEQ ID NO: 211758 - DNA, 25 bp, Homo sapien
agagtttagtccttactgtctcact

SEQ ID NO: 211759 - DNA, 25 bp, Homo sapien
ttactgtctcactcgttctgttacc

SEQ ID NO: 211760 - DNA, 25 bp, Homo sapien
ttctgttacccagggctctgcagca

SEQ ID NO: 211761 - DNA, 25 bp, Homo sapien
tccacatctgcatcactcatggaac

SEQ ID NO: 211762 - DNA, 25 bp, Homo sapien
ggaacactcatgtctggagtcccct

SEQ ID NO: 211763 - DNA, 25 bp, Homo sapien
gcaacaacagcttcagtccatgggt

SEQ ID NO: 211764 - DNA, 25 bp, Homo sapien
gtccatgggtaatccgttcatagaa

SEQ ID NO: 211765 - DNA, 25 bp, Homo sapien
gtgtttgctaacaaggtgcccttta

SEQ ID NO: 211766 - DNA, 25 bp, Homo sapien
caaggtgccctttagccagatgcta

SEQ ID NO: 211767 - DNA, 25 bp, Homo sapien
agccagatgctaggctgtctgcgaa

SEQ ID NO: 211768 - DNA, 25 bp, Homo sapien
gtacaattgttacaaataacgcaga

SEQ ID NO: 211769 - DNA, 25 bp, Homo sapien
attgttacaaataacgcagacttca

SEQ ID NO: 211770 - DNA, 25 bp, Homo sapien
tgttacaaataacgcagacttcaaa

SEQ ID NO: 211771 - DNA, 25 bp, Homo sapien
acaaataacgcagacttcaaaaaca

SEQ ID NO: 211772 - DNA, 25 bp, Homo sapien
tttaaatgatcagaattggcagcac

SEQ ID NO: 211773 - DNA, 25 bp, Homo sapien
ttaaatgatcagaattggcagcaca

SEQ ID NO: 211774 - DNA, 25 bp, Homo sapien
taaatgatcagaattggcagcacaa

SEQ ID NO: 211775 - DNA, 25 bp, Homo sapien
aaatgatcagaattggcagcacaaa

SEQ ID NO: 211776 - DNA, 25 bp, Homo sapien
gcaaacttcaggtaactattttgga

SEQ ID NO: 211777 - DNA, 25 bp, Homo sapien
cttcaggtaactattttggattgca

SEQ ID NO: 211778 - DNA, 25 bp, Homo sapien
ttcaggtaactattttggattgcaa

SEQ ID NO: 211779 - DNA, 25 bp, Homo sapien
aagaattggtgtagtcatgacttta

SEQ ID NO: 211780 - DNA, 25 bp, Homo sapien
gtcatgactttagctgatactctta

SEQ ID NO: 211781 - DNA, 25 bp, Homo sapien
gatactcttatgtacgagatctgtc

SEQ ID NO: 211782 - DNA, 25 bp, Homo sapien
agatctgtctctgctgtttaacttc

SEQ ID NO: 211783 - DNA, 25 bp, Homo sapien
ggattaatcagctggtttcaactct

SEQ ID NO: 211784 - DNA, 25 bp, Homo sapien
agctggtttcaactctactgcgaaa

SEQ ID NO: 211785 - DNA, 25 bp, Homo sapien
atagctccttaaaagtactgttctc

SEQ ID NO: 211786 - DNA, 25 bp, Homo sapien
aagtactgttctccttcagtggcat

SEQ ID NO: 211787 - DNA, 25 bp, Homo sapien
gttctccttcagtggcatgtagtta

SEQ ID NO: 211788 - DNA, 25 bp, Homo sapien
gtagttatctaatcaagacacctca

SEQ ID NO: 211789 - DNA, 25 bp, Homo sapien
agacacctcattcaaacaaaacctg

SEQ ID NO: 211790 - DNA, 25 bp, Homo sapien
gaaagcagagctggctaatcccaag

SEQ ID NO: 211791 - DNA, 25 bp, Homo sapien
ctaatcccaaggcagtgtgactcag

SEQ ID NO: 211792 - DNA, 25 bp, Homo sapien
gtgactcagctaaccacaaatgtct

SEQ ID NO: 211793 - DNA, 25 bp, Homo sapien
caaatgtctcctccaggctatgaaa

SEQ ID NO: 211794 - DNA, 25 bp, Homo sapien
ggccgatttcaagaacacatctcct

SEQ ID NO: 211795 - DNA, 25 bp, Homo sapien
tatctgctccaacctggactcattt

SEQ ID NO: 211796 - DNA, 25 bp, Homo sapien
ggactcatttagatcgtgcttattt

SEQ ID NO: 211797 - DNA, 25 bp, Homo sapien
gagtgcatggaccacgctctaacaa

SEQ ID NO: 211798 - DNA, 25 bp, Homo sapien
ctaagactcattatgccgctggaaa

SEQ ID NO: 211799 - DNA, 25 bp, Homo sapien
caaaattttctggatacctctgtct

SEQ ID NO: 211800 - DNA, 25 bp, Homo sapien
atgccagcagctttgcaagactttt

SEQ ID NO: 211801 - DNA, 25 bp, Homo sapien
agtgctggctcacagtacagcatgt

SEQ ID NO: 211802 - DNA, 25 bp, Homo sapien
ggctcacagtacagcatgtgcctta

SEQ ID NO: 211803 - DNA, 25 bp, Homo sapien
catgtgccttaatgcttcatatgag

SEQ ID NO: 211804 - DNA, 25 bp, Homo sapien
gcttcatatgaggaggatgtccctg

SEQ ID NO: 211805 - DNA, 25 bp, Homo sapien
tctgtgtgaatgtgggcactggccc

SEQ ID NO: 211806 - DNA, 25 bp, Homo sapien
aatgtgggcactggcccaggttcat

SEQ ID NO: 211807 - DNA, 25 bp, Homo sapien
tttgctaatcaaagccagggtctct

SEQ ID NO: 211808 - DNA, 25 bp, Homo sapien
cagggtctctccctcaggtgttttt

SEQ ID NO: 211809 - DNA, 25 bp, Homo sapien
tatgaagtgcgtgaatgtatgtaat

SEQ ID NO: 211810 - DNA, 25 bp, Homo sapien
atgtatgtaatgtgtggtggcctca

SEQ ID NO: 211811 - DNA, 25 bp, Homo sapien
gcctcagctgaatgcctcctgtggg

SEQ ID NO: 211812 - DNA, 25 bp, Homo sapien
ttggtttttcgtgtggatgtactcc

SEQ ID NO: 211813 - DNA, 25 bp, Homo sapien
gatgtactccaagtaaagctccagt

SEQ ID NO: 211814 - DNA, 25 bp, Homo sapien
tccaagtaaagctccagtgactaat

SEQ ID NO: 211815 - DNA, 25 bp, Homo sapien
aaagctccagtgactaatatgtata

SEQ ID NO: 211816 - DNA, 25 bp, Homo sapien
ggctactattaatatgcagacttac

SEQ ID NO: 211817 - DNA, 25 bp, Homo sapien
gcagacttacttttaatcatttgaa

SEQ ID NO: 211818 - DNA, 25 bp, Homo sapien
gaaatctgaactcatttacctcatt

SEQ ID NO: 211819 - DNA, 25 bp, Homo sapien
aactcatttacctcatttcttgcca

SEQ ID NO: 211820 - DNA, 25 bp, Homo sapien
atttcttgccaattactcccttggg

SEQ ID NO: 211821 - DNA, 25 bp, Homo sapien
tactcccttgggtatttactgcgta

SEQ ID NO: 211822 - DNA, 25 bp, Homo sapien
actgcgtaattggaacatttactaa

SEQ ID NO: 211823 - DNA, 25 bp, Homo sapien
cctgggacgtggctggtagtgtttg

SEQ ID NO: 211824 - DNA, 25 bp, Homo sapien
tagtgtttgtgtgggaagcagctca

SEQ ID NO: 211825 - DNA, 25 bp, Homo sapien
gaagcagctcaagacgcggaccgcg

SEQ ID NO: 211826 - DNA, 25 bp, Homo sapien
gacgcggaccgcgtgacattaagga

SEQ ID NO: 211827 - DNA, 25 bp, Homo sapien
ggaccgggccctgtgtagagaccct

SEQ ID NO: 211828 - DNA, 25 bp, Homo sapien
gtagagacccttccgcgccggcgtt

SEQ ID NO: 211829 - DNA, 25 bp, Homo sapien
ttcccgctccgctaaagatttcaaa

SEQ ID NO: 211830 - DNA, 25 bp, Homo sapien
ccgctccgctaaagatttcaaatcc

SEQ ID NO: 211831 - DNA, 25 bp, Homo sapien
aatccaggggattccatgctcaatg

SEQ ID NO: 211832 - DNA, 25 bp, Homo sapien
gaatgtagacacaaaacagcaacac

SEQ ID NO: 211833 - DNA, 25 bp, Homo sapien
aacagcaacacttgtatgaagatgt

SEQ ID NO: 211834 - DNA, 25 bp, Homo sapien
caacccaaacacatcagctttcaaa

SEQ ID NO: 211835 - DNA, 25 bp, Homo sapien
ccaaacacatcagctttcaaatgag

SEQ ID NO: 211836 - DNA, 25 bp, Homo sapien
gagatgatagtaaatgcggcaatgt

SEQ ID NO: 211837 - DNA, 25 bp, Homo sapien
gtaaatgcggcaatgttaagacaag

SEQ ID NO: 211838 - DNA, 25 bp, Homo sapien
atgcggcaatgttaagacaagaaat

SEQ ID NO: 211839 - DNA, 25 bp, Homo sapien
gacaagaaatttatgatttgccaga

SEQ ID NO: 211840 - DNA, 25 bp, Homo sapien
gatttgccagattcaacatttatga

SEQ ID NO: 211841 - DNA, 25 bp, Homo sapien
tttgccagattcaacatttatgacc

SEQ ID NO: 211842 - DNA, 25 bp, Homo sapien
caacatttatgacctccccttccaa

SEQ ID NO: 211843 - DNA, 25 bp, Homo sapien
aaaagcggccgcgactctagaacta

SEQ ID NO: 211844 - DNA, 25 bp, Homo sapien
aaagcggccgcgactctagaactag

SEQ ID NO: 211845 - DNA, 25 bp, Homo sapien
aggttgacaattggtctgtttgctt

SEQ ID NO: 211846 - DNA, 25 bp, Homo sapien
attggtctgtttgcttttgtcatac

SEQ ID NO: 211847 - DNA, 25 bp, Homo sapien
gtttgcttttgtcatacatgtattt

SEQ ID NO: 211848 - DNA, 25 bp, Homo sapien
caaggaccttcacaagacagtggat

SEQ ID NO: 211849 - DNA, 25 bp, Homo sapien
gacagtggatatgacttcatacttc

SEQ ID NO: 211850 - DNA, 25 bp, Homo sapien
gacttcatacttcaagaggtcccaa

SEQ ID NO: 211851 - DNA, 25 bp, Homo sapien
catacttcaagaggtcccaaaattt

SEQ ID NO: 211852 - DNA, 25 bp, Homo sapien
gtgcgtattttacaaccttctctct

SEQ ID NO: 211853 - DNA, 25 bp, Homo sapien
gtattttacaaccttctctcttcac

SEQ ID NO: 211854 - DNA, 25 bp, Homo sapien
tctcttcacccttagttactagtca

SEQ ID NO: 211855 - DNA, 25 bp, Homo sapien
aaaagattataatttggccagggtg

SEQ ID NO: 211856 - DNA, 25 bp, Homo sapien
agctaggtgagggtcctgaacatct

SEQ ID NO: 211857 - DNA, 25 bp, Homo sapien
gctaggtgagggtcctgaacatctg

SEQ ID NO: 211858 - DNA, 25 bp, Homo sapien
ctaggtgagggtcctgaacatctga

SEQ ID NO: 211859 - DNA, 25 bp, Homo sapien
taggtgagggtcctgaacatctgac

SEQ ID NO: 211860 - DNA, 25 bp, Homo sapien
aggtgagggtcctgaacatctgaca

SEQ ID NO: 211861 - DNA, 25 bp, Homo sapien
ggtgagggtcctgaacatctgacag

SEQ ID NO: 211862 - DNA, 25 bp, Homo sapien
gtgagggtcctgaacatctgacagg

SEQ ID NO: 211863 - DNA, 25 bp, Homo sapien
agggtcctgaacatctgacagggca

SEQ ID NO: 211864 - DNA, 25 bp, Homo sapien
gggtcctgaacatctgacagggcag

SEQ ID NO: 211865 - DNA, 25 bp, Homo sapien
gtcctgaacatctgacagggcagct

SEQ ID NO: 211866 - DNA, 25 bp, Homo sapien
ctgaacatctgacagggcagctggt

SEQ ID NO: 211867 - DNA, 25 bp, Homo sapien
aaagtatttgcctctggaaagaaca

SEQ ID NO: 211868 - DNA, 25 bp, Homo sapien
gaaagaacaactggcaggactgttg

SEQ ID NO: 211869 - DNA, 25 bp, Homo sapien
aaagaacaactggcaggactgttgt

SEQ ID NO: 211870 - DNA, 25 bp, Homo sapien
aagaacaactggcaggactgttgtt

SEQ ID NO: 211871 - DNA, 25 bp, Homo sapien
agaacaactggcaggactgttgttt

SEQ ID NO: 211872 - DNA, 25 bp, Homo sapien
gaacaactggcaggactgttgtttt

SEQ ID NO: 211873 - DNA, 25 bp, Homo sapien
aacaactggcaggactgttgttttc

SEQ ID NO: 211874 - DNA, 25 bp, Homo sapien
acaactggcaggactgttgttttca

SEQ ID NO: 211875 - DNA, 25 bp, Homo sapien
caactggcaggactgttgttttcat

SEQ ID NO: 211876 - DNA, 25 bp, Homo sapien
aactggcaggactgttgttttcatt

SEQ ID NO: 211877 - DNA, 25 bp, Homo sapien
atagcattgacttttacacacattc

SEQ ID NO: 211878 - DNA, 25 bp, Homo sapien
attgacttttacacacattcacaca

SEQ ID NO: 211879 - DNA, 25 bp, Homo sapien
aaaaagtggcctgggctctgttggt

SEQ ID NO: 211880 - DNA, 25 bp, Homo sapien
tgggctctgttggtgtgcgtgttcc

SEQ ID NO: 211881 - DNA, 25 bp, Homo sapien
tggtgtgcgtgttccgtggcggaga

SEQ ID NO: 211882 - DNA, 25 bp, Homo sapien
aaaatgggaaagacatctcactggt

SEQ ID NO: 211883 - DNA, 25 bp, Homo sapien
aagacatctcactggtgcttttctc

SEQ ID NO: 211884 - DNA, 25 bp, Homo sapien
atctcactggtgcttttctcttttg

SEQ ID NO: 211885 - DNA, 25 bp, Homo sapien
gcccccatccctataatatctgtaa

SEQ ID NO: 211886 - DNA, 25 bp, Homo sapien
atatctgtaactactcctaaaaagg

SEQ ID NO: 211887 - DNA, 25 bp, Homo sapien
tcctaaaaaggttttgattcaggct

SEQ ID NO: 211888 - DNA, 25 bp, Homo sapien
aagtgtgatactaacagtacctggg

SEQ ID NO: 211889 - DNA, 25 bp, Homo sapien
gtgatactaacagtacctggggcct

SEQ ID NO: 211890 - DNA, 25 bp, Homo sapien
gttgttcaacattgtttactgggta

SEQ ID NO: 211891 - DNA, 25 bp, Homo sapien
ttgttcaacattgtttactgggtat

SEQ ID NO: 211892 - DNA, 25 bp, Homo sapien
gtttactgggtataccatatgtatt

SEQ ID NO: 211893 - DNA, 25 bp, Homo sapien
gggtataccatatgtattagtcccc

SEQ ID NO: 211894 - DNA, 25 bp, Homo sapien
ataccatatgtattagtcccccagt

SEQ ID NO: 211895 - DNA, 25 bp, Homo sapien
catatgtattagtcccccagtgctc

SEQ ID NO: 211896 - DNA, 25 bp, Homo sapien
ccccagtgctccagaacagcgggag

SEQ ID NO: 211897 - DNA, 25 bp, Homo sapien
tgctccagaacagcgggagcactgt

SEQ ID NO: 211898 - DNA, 25 bp, Homo sapien
tccagaacagcgggagcactgtgct

SEQ ID NO: 211899 - DNA, 25 bp, Homo sapien
cccaaacacatcagctttcaaatga

SEQ ID NO: 211900 - DNA, 25 bp, Homo sapien
ccaaacacatcagctttcaaatgag

SEQ ID NO: 211901 - DNA, 25 bp, Homo sapien
gagatgatagtaaatgcggcaatgt

SEQ ID NO: 211902 - DNA, 25 bp, Homo sapien
gtaaatgcggcaatgttaagacaag

SEQ ID NO: 211903 - DNA, 25 bp, Homo sapien
aatgcggcaatgttaagacaagaaa

SEQ ID NO: 211904 - DNA, 25 bp, Homo sapien
aagacaagaaatttatgatttgcca

SEQ ID NO: 211905 - DNA, 25 bp, Homo sapien
tttatgatttgccagattcaacatt

SEQ ID NO: 211906 - DNA, 25 bp, Homo sapien
tatgatttgccagattcaacattta

SEQ ID NO: 211907 - DNA, 25 bp, Homo sapien
gatttgccagattcaacatttatga

SEQ ID NO: 211908 - DNA, 25 bp, Homo sapien
tttgccagattcaacatttatgacc

SEQ ID NO: 211909 - DNA, 25 bp, Homo sapien
caacatttatgacctccccttccaa

SEQ ID NO: 211910 - DNA, 25 bp, Homo sapien
gaaaactcacgtaactacagaggtt

SEQ ID NO: 211911 - DNA, 25 bp, Homo sapien
atattactaaagactctactgacct

SEQ ID NO: 211912 - DNA, 25 bp, Homo sapien
agactctactgacctatcttcaaag

SEQ ID NO: 211913 - DNA, 25 bp, Homo sapien
actgacctatcttcaaagctcataa

SEQ ID NO: 211914 - DNA, 25 bp, Homo sapien
ggcttaacaataacttgtctactta

SEQ ID NO: 211915 - DNA, 25 bp, Homo sapien
aaaattacctgtagtagccctccat

SEQ ID NO: 211916 - DNA, 25 bp, Homo sapien
tgtagtagccctccatcatcaaaac

SEQ ID NO: 211917 - DNA, 25 bp, Homo sapien
cctccatcatcaaaacgcagtactt

SEQ ID NO: 211918 - DNA, 25 bp, Homo sapien
gtacttctattatgctctctgactg

SEQ ID NO: 211919 - DNA, 25 bp, Homo sapien
atgctctctgactgaacgaatgctt

SEQ ID NO: 211920 - DNA, 25 bp, Homo sapien
gactgaacgaatgcttccttctcgg

SEQ ID NO: 211921 - DNA, 25 bp, Homo sapien
attttcaatggccacgcgactatca

SEQ ID NO: 211922 - DNA, 25 bp, Homo sapien
cgactatcatcacccaaaacagctt

SEQ ID NO: 211923 - DNA, 25 bp, Homo sapien
gaacccataccaaagactggaccga

SEQ ID NO: 211924 - DNA, 25 bp, Homo sapien
gacattctcggtactaagactacag

SEQ ID NO: 211925 - DNA, 25 bp, Homo sapien
ttgctagagagcttaccggacgtta

SEQ ID NO: 211926 - DNA, 25 bp, Homo sapien
ttaccggacgttagaaatcaagcag

SEQ ID NO: 211927 - DNA, 25 bp, Homo sapien
gttaacactcaattgctagagagcg

SEQ ID NO: 211928 - DNA, 25 bp, Homo sapien
ttgccagggttcatccctgtagtac

SEQ ID NO: 211929 - DNA, 25 bp, Homo sapien
atccctgtagtaccgggctcgaaca

SEQ ID NO: 211930 - DNA, 25 bp, Homo sapien
atccatgcagcgaacatcgaccgcg

SEQ ID NO: 211931 - DNA, 25 bp, Homo sapien
gcgtccgcacctctataattgctaa

SEQ ID NO: 211932 - DNA, 25 bp, Homo sapien
accgaatcaccatcaagaaacgctt

SEQ ID NO: 211933 - DNA, 25 bp, Homo sapien
aaacgcttcaaggtgctcatgaccc

SEQ ID NO: 211934 - DNA, 25 bp, Homo sapien
gagggtcccttaaactgatgtcttt

SEQ ID NO: 211935 - DNA, 25 bp, Homo sapien
tgatgtcttttctgccacctgttac

SEQ ID NO: 211936 - DNA, 25 bp, Homo sapien
ggagactccgtaaccaaactcttcg

SEQ ID NO: 211937 - DNA, 25 bp, Homo sapien
aaactcttcggactgtgagccctga

SEQ ID NO: 211938 - DNA, 25 bp, Homo sapien
tgatgcctttttgccagccatactc

SEQ ID NO: 211939 - DNA, 25 bp, Homo sapien
agccatactctttggcatccagtct

SEQ ID NO: 211940 - DNA, 25 bp, Homo sapien
gtctctcgtggcgattgattatgct

SEQ ID NO: 211941 - DNA, 25 bp, Homo sapien
tatgcttgtgtgaggcaatcatggt

SEQ ID NO: 211942 - DNA, 25 bp, Homo sapien
aatcatggtggcatcacccataaag

SEQ ID NO: 211943 - DNA, 25 bp, Homo sapien
agagcatccagggaggtttctcgcc

SEQ ID NO: 211944 - DNA, 25 bp, Homo sapien
cagggaggtttctcgccccaatagc

SEQ ID NO: 211945 - DNA, 25 bp, Homo sapien
atagcctcacggcacagtactcttg

SEQ ID NO: 211946 - DNA, 25 bp, Homo sapien
cacggcacagtactcttgggcagta

SEQ ID NO: 211947 - DNA, 25 bp, Homo sapien
gggcagtaactggacaccttttatt

SEQ ID NO: 211948 - DNA, 25 bp, Homo sapien
gtaactggacaccttttatttgaag

SEQ ID NO: 211949 - DNA, 25 bp, Homo sapien
aaatgcttccttaagtgctgacagc

SEQ ID NO: 211950 - DNA, 25 bp, Homo sapien
gtgctgacagcctttttaaccaata

SEQ ID NO: 211951 - DNA, 25 bp, Homo sapien
caaagactgatcttgtacagatatt

SEQ ID NO: 211952 - DNA, 25 bp, Homo sapien
gatattagtgttaccagcattcatg

SEQ ID NO: 211953 - DNA, 25 bp, Homo sapien
taccagcattcatgtggaaatcaag

SEQ ID NO: 211954 - DNA, 25 bp, Homo sapien
atcttgtttctcaatgtcactcatt

SEQ ID NO: 211955 - DNA, 25 bp, Homo sapien
gtttctcaatgtcactcattcccct

SEQ ID NO: 211956 - DNA, 25 bp, Homo sapien
caagcttgtttgtccagtagagcct

SEQ ID NO: 211957 - DNA, 25 bp, Homo sapien
gtccagtagagcctttggagattta

SEQ ID NO: 211958 - DNA, 25 bp, Homo sapien
ttggagatttaggaccataatgagg

SEQ ID NO: 211959 - DNA, 25 bp, Homo sapien
taatgaggtctcatgttctctgctc

SEQ ID NO: 211960 - DNA, 25 bp, Homo sapien
taagccaagacctttgggtcccagc

SEQ ID NO: 211961 - DNA, 25 bp, Homo sapien
gcaggaggaccaaaagggactcagt

SEQ ID NO: 211962 - DNA, 25 bp, Homo sapien
gggactcagtgtggtctacttactc

SEQ ID NO: 211963 - DNA, 25 bp, Homo sapien
ctcagtgtggtctacttactctggg

SEQ ID NO: 211964 - DNA, 25 bp, Homo sapien
gtttgcttcagcagctggtagcttt

SEQ ID NO: 211965 - DNA, 25 bp, Homo sapien
tggccgtggtgccatccgagaattt

SEQ ID NO: 211966 - DNA, 25 bp, Homo sapien
gccgtggtgccatccgagaatttgc

SEQ ID NO: 211967 - DNA, 25 bp, Homo sapien
ccgtggtgccatccgagaatttgca

SEQ ID NO: 211968 - DNA, 25 bp, Homo sapien
gtggtgccatccgagaatttgcaga

SEQ ID NO: 211969 - DNA, 25 bp, Homo sapien
ttgcagagcacatttgcctactaat

SEQ ID NO: 211970 - DNA, 25 bp, Homo sapien
gcagagcacatttgcctactaatgg

SEQ ID NO: 211971 - DNA, 25 bp, Homo sapien
cagagcacatttgcctactaatgga

SEQ ID NO: 211972 - DNA, 25 bp, Homo sapien
gagcacatttgcctactaatggaaa

SEQ ID NO: 211973 - DNA, 25 bp, Homo sapien
gcacatttgcctactaatggaaaag

SEQ ID NO: 211974 - DNA, 25 bp, Homo sapien
catttgcctactaatggaaaaggtt

SEQ ID NO: 211975 - DNA, 25 bp, Homo sapien
tggaaaaggttaataattcatgcca

SEQ ID NO: 211976 - DNA, 25 bp, Homo sapien
accggaatttgggtcaatacatcct

SEQ ID NO: 211977 - DNA, 25 bp, Homo sapien
gaatttgggtcaatacatccttttg

SEQ ID NO: 211978 - DNA, 25 bp, Homo sapien
tgggtcaatacatccttttgtctcc

SEQ ID NO: 211979 - DNA, 25 bp, Homo sapien
cttttgtctcccaagggaagagaat

SEQ ID NO: 211980 - DNA, 25 bp, Homo sapien
gggggttcccagatattcagggcaa

SEQ ID NO: 211981 - DNA, 25 bp, Homo sapien
gatattcagggcaagaccagtcgga

SEQ ID NO: 211982 - DNA, 25 bp, Homo sapien
agaccagtcggaaggatctgctatt

SEQ ID NO: 211983 - DNA, 25 bp, Homo sapien
ccagtcggaaggatctgctattggg

SEQ ID NO: 211984 - DNA, 25 bp, Homo sapien
ggaaggatctgctattggggaccca

SEQ ID NO: 211985 - DNA, 25 bp, Homo sapien
gaaagttccagggtgtgtatgtttt

SEQ ID NO: 211986 - DNA, 25 bp, Homo sapien
gttccagggtgtgtatgttttcagg

SEQ ID NO: 211987 - DNA, 25 bp, Homo sapien
tataacatgaaactacacaggatta

SEQ ID NO: 211988 - DNA, 25 bp, Homo sapien
atcagggtgccctagaacttgtttc

SEQ ID NO: 211989 - DNA, 25 bp, Homo sapien
ggtgccctagaacttgtttccacaa

SEQ ID NO: 211990 - DNA, 25 bp, Homo sapien
aactccaaggattcttaaagtagct

SEQ ID NO: 211991 - DNA, 25 bp, Homo sapien
gtagctgaattcttcaactactcaa

SEQ ID NO: 211992 - DNA, 25 bp, Homo sapien
actactcaaaaaacaggattcagat

SEQ ID NO: 211993 - DNA, 25 bp, Homo sapien
attctattagagttggagtactagc

SEQ ID NO: 211994 - DNA, 25 bp, Homo sapien
ggagtactagcaattgcagcattaa

SEQ ID NO: 211995 - DNA, 25 bp, Homo sapien
gcagcattaatataatccaaagcca

SEQ ID NO: 211996 - DNA, 25 bp, Homo sapien
aaagccaaagaatactgtccaagtt

SEQ ID NO: 211997 - DNA, 25 bp, Homo sapien
gtccaagtttatcaaagtgctgtgc

SEQ ID NO: 211998 - DNA, 25 bp, Homo sapien
gtttgttcttggtgccttgcagaga

SEQ ID NO: 211999 - DNA, 25 bp, Homo sapien
ttgcagagagactcacagcaactct

SEQ ID NO: 212000 - DNA, 25 bp, Homo sapien
gcaactctccattatagctttcaca

SEQ ID NO: 212001 - DNA, 25 bp, Homo sapien
attatagctttcacacggtttggat

SEQ ID NO: 212002 - DNA, 25 bp, Homo sapien
cacacggtttggatgtgcagcacat

SEQ ID NO: 212003 - DNA, 25 bp, Homo sapien
atccaaggcacaccacagctgtggt

SEQ ID NO: 212004 - DNA, 25 bp, Homo sapien
agactgaatacattggtgctttgat

SEQ ID NO: 212005 - DNA, 25 bp, Homo sapien
gaaaaggtcagttggctggtccctc

SEQ ID NO: 212006 - DNA, 25 bp, Homo sapien
ggtccctctctcaaaaagcttatta

SEQ ID NO: 212007 - DNA, 25 bp, Homo sapien
aactgctattttcgcttatttctgg

SEQ ID NO: 212008 - DNA, 25 bp, Homo sapien
gaattagtgtatgcttcctgaataa

SEQ ID NO: 212009 - DNA, 25 bp, Homo sapien
gagcttaagctgtaaagaagtccaa

SEQ ID NO: 212010 - DNA, 25 bp, Homo sapien
gaagtccaaatttacaggttcaggg

SEQ ID NO: 212011 - DNA, 25 bp, Homo sapien
gtttttgaatgtactggtaatgcct

SEQ ID NO: 212012 - DNA, 25 bp, Homo sapien
gtaatgcctaatgtggtctgcctgt

SEQ ID NO: 212013 - DNA, 25 bp, Homo sapien
aatgtggtctgcctgtgaatctccc

SEQ ID NO: 212014 - DNA, 25 bp, Homo sapien
gaatctccccatgtagaatttgccc

SEQ ID NO: 212015 - DNA, 25 bp, Homo sapien
ctccccatgtagaatttgcccttaa

SEQ ID NO: 212016 - DNA, 25 bp, Homo sapien
gaatttgcccttaatgcaataaggt

SEQ ID NO: 212017 - DNA, 25 bp, Homo sapien
aagtaggttcacatgtacaggtaag

SEQ ID NO: 212018 - DNA, 25 bp, Homo sapien
tattgtgtatttctgttcattttct

SEQ ID NO: 212019 - DNA, 25 bp, Homo sapien
cattttctgttcatagagttgtata

SEQ ID NO: 212020 - DNA, 25 bp, Homo sapien
cttaccccaaatcagaccatctgag

SEQ ID NO: 212021 - DNA, 25 bp, Homo sapien
atctgagcccactactatcaaacaa

SEQ ID NO: 212022 - DNA, 25 bp, Homo sapien
ataaattcccagtgctcatcatgag

SEQ ID NO: 212023 - DNA, 25 bp, Homo sapien
tgagggaaacatgtgactatacctt

SEQ ID NO: 212024 - DNA, 25 bp, Homo sapien
tgtgactatacctttcctatgagga

SEQ ID NO: 212025 - DNA, 25 bp, Homo sapien
tcctatgaggaaagccaggttatac

SEQ ID NO: 212026 - DNA, 25 bp, Homo sapien
agagttcctttgtcatatctttaga

SEQ ID NO: 212027 - DNA, 25 bp, Homo sapien
gtcatatctttagacttgatttgag

SEQ ID NO: 212028 - DNA, 25 bp, Homo sapien
atttgagtagacagcaatgatcttt

SEQ ID NO: 212029 - DNA, 25 bp, Homo sapien
gatctttacatagcttagtgttctg

SEQ ID NO: 212030 - DNA, 25 bp, Homo sapien
tagtgttctgatggcaaaatattgt

SEQ ID NO: 212031 - DNA, 25 bp, Homo sapien
tgacgggaggctcagaaacaaatga

SEQ ID NO: 212032 - DNA, 25 bp, Homo sapien
gaggctcagaaacaaatgagttcaa

SEQ ID NO: 212033 - DNA, 25 bp, Homo sapien
ctgaagccgattatgcccaacttcc

SEQ ID NO: 212034 - DNA, 25 bp, Homo sapien
tgaagccgattatgcccaacttccc

SEQ ID NO: 212035 - DNA, 25 bp, Homo sapien
aacttccctcctcagggcactgaga

SEQ ID NO: 212036 - DNA, 25 bp, Homo sapien
gagagagaaatggaagaaaccccca

SEQ ID NO: 212037 - DNA, 25 bp, Homo sapien
acctctcggaatagcttcccgttca

SEQ ID NO: 212038 - DNA, 25 bp, Homo sapien
ctctcggaatagcttcccgttcagt

SEQ ID NO: 212039 - DNA, 25 bp, Homo sapien
tctcggaatagcttcccgttcagtt

SEQ ID NO: 212040 - DNA, 25 bp, Homo sapien
ctcggaatagcttcccgttcagtta

SEQ ID NO: 212041 - DNA, 25 bp, Homo sapien
tcggaatagcttcccgttcagttaa

SEQ ID NO: 212042 - DNA, 25 bp, Homo sapien
gtatatttcagtgaggtatatttta

SEQ ID NO: 212043 - DNA, 25 bp, Homo sapien
aatactgatcaatgtgaacttttct

SEQ ID NO: 212044 - DNA, 25 bp, Homo sapien
gtgaacttttctaaatactctattg

SEQ ID NO: 212045 - DNA, 25 bp, Homo sapien
ttctaaatactctattgtctttaat

SEQ ID NO: 212046 - DNA, 25 bp, Homo sapien
tgtctttaataattgtgctgaaatc

SEQ ID NO: 212047 - DNA, 25 bp, Homo sapien
ataattgtgctgaaatctatttcct

SEQ ID NO: 212048 - DNA, 25 bp, Homo sapien
gatttttgaaaagtcagccttgtgg

SEQ ID NO: 212049 - DNA, 25 bp, Homo sapien
ccttgtgggatgaaaaatatgtctt

SEQ ID NO: 212050 - DNA, 25 bp, Homo sapien
atatgtcttactggaaaaatccctc

SEQ ID NO: 212051 - DNA, 25 bp, Homo sapien
gaaaaatccctcataataacctaat

SEQ ID NO: 212052 - DNA, 25 bp, Homo sapien
aataacctaatagggcattgctatt

SEQ ID NO: 212053 - DNA, 25 bp, Homo sapien
acttgacacatcacaatcagcaggt

SEQ ID NO: 212054 - DNA, 25 bp, Homo sapien
atcagcaggtgtttggtccctacta

SEQ ID NO: 212055 - DNA, 25 bp, Homo sapien
gtccctactacactgagatcctaaa

SEQ ID NO: 212056 - DNA, 25 bp, Homo sapien
gagtctgtttgatagcgtcggctca

SEQ ID NO: 212057 - DNA, 25 bp, Homo sapien
gtttgatagcgtcggctcagagccc

SEQ ID NO: 212058 - DNA, 25 bp, Homo sapien
agagccctggtaccttggacccaag

SEQ ID NO: 212059 - DNA, 25 bp, Homo sapien
atcttcctggagtaacatcaccagt

SEQ ID NO: 212060 - DNA, 25 bp, Homo sapien
agcagacagtgagcttctatcccag

SEQ ID NO: 212061 - DNA, 25 bp, Homo sapien
gccagtacaccaaggctgtagggat

SEQ ID NO: 212062 - DNA, 25 bp, Homo sapien
gtagggatcaagcatgtaaacacca

SEQ ID NO: 212063 - DNA, 25 bp, Homo sapien
gtaaacaccaactggtccataccca

SEQ ID NO: 212064 - DNA, 25 bp, Homo sapien
aaatcaaaggctatgtctggcgctc

SEQ ID NO: 212065 - DNA, 25 bp, Homo sapien
tcaaaggctatgtctggcgctcagc

SEQ ID NO: 212066 - DNA, 25 bp, Homo sapien
gtctggcgctcagctgtgggcttcc

SEQ ID NO: 212067 - DNA, 25 bp, Homo sapien
tgtgggcttcctcttctgggtgata

SEQ ID NO: 212068 - DNA, 25 bp, Homo sapien
tgggcttcctcttctgggtgatagt

SEQ ID NO: 212069 - DNA, 25 bp, Homo sapien
tgggtgatagtgctcacctcctgga

SEQ ID NO: 212070 - DNA, 25 bp, Homo sapien
gtgatagtgctcacctcctggatca

SEQ ID NO: 212071 - DNA, 25 bp, Homo sapien
cctgacaacttctgcacatactggg

SEQ ID NO: 212072 - DNA, 25 bp, Homo sapien
cccttctcaaactcctaagacttgt

SEQ ID NO: 212073 - DNA, 25 bp, Homo sapien
taagacttgttttcatgtcccacgt

SEQ ID NO: 212074 - DNA, 25 bp, Homo sapien
atgtcccacgttctctgctgacatc

SEQ ID NO: 212075 - DNA, 25 bp, Homo sapien
ggatgataatccgaccaagccaacc

SEQ ID NO: 212076 - DNA, 25 bp, Homo sapien
atgataatccgaccaagccaaccac

SEQ ID NO: 212077 - DNA, 25 bp, Homo sapien
caaccacccggcaaagatacgacgg

SEQ ID NO: 212078 - DNA, 25 bp, Homo sapien
gcaaagatacgacggcagcaccact

SEQ ID NO: 212079 - DNA, 25 bp, Homo sapien
acggcagcaccactgccatggaaat

SEQ ID NO: 212080 - DNA, 25 bp, Homo sapien
ggcagcaccactgccatggaaattc

SEQ ID NO: 212081 - DNA, 25 bp, Homo sapien
tgccatggaaattctccagggccgg

SEQ ID NO: 212082 - DNA, 25 bp, Homo sapien
catggaaattctccagggccgggat

SEQ ID NO: 212083 - DNA, 25 bp, Homo sapien
tggaaattctccagggccgggattt

SEQ ID NO: 212084 - DNA, 25 bp, Homo sapien
tccagggccgggatttcactggcaa

SEQ ID NO: 212085 - DNA, 25 bp, Homo sapien
agggccgggatttcactggcaaagt

SEQ ID NO: 212086 - DNA, 25 bp, Homo sapien
gagagacaactcaggaacagacggg

SEQ ID NO: 212087 - DNA, 25 bp, Homo sapien
catctcatgggaggactgagtctca

SEQ ID NO: 212088 - DNA, 25 bp, Homo sapien
agggatgtccctgtcacctgtgagg

SEQ ID NO: 212089 - DNA, 25 bp, Homo sapien
cagccccacagtagactgatactga

SEQ ID NO: 212090 - DNA, 25 bp, Homo sapien
gactgatactgacccaggaacgagg

SEQ ID NO: 212091 - DNA, 25 bp, Homo sapien
tgggcccatacttaccagggatact

SEQ ID NO: 212092 - DNA, 25 bp, Homo sapien
cagggatactggatagggctgacca

SEQ ID NO: 212093 - DNA, 25 bp, Homo sapien
tagggctgaccaggtgacaaacatg

SEQ ID NO: 212094 - DNA, 25 bp, Homo sapien
aaacatggtgtagagggtgatgacc

SEQ ID NO: 212095 - DNA, 25 bp, Homo sapien
accgaggcctgcagcagacccgagt

SEQ ID NO: 212096 - DNA, 25 bp, Homo sapien
gttgggctgggcgtcctggcaagag

SEQ ID NO: 212097 - DNA, 25 bp, Homo sapien
gaaacccccacctctcggaatagct

SEQ ID NO: 212098 - DNA, 25 bp, Homo sapien
ccccacctctcggaatagcttcccg

SEQ ID NO: 212099 - DNA, 25 bp, Homo sapien
cccacctctcggaatagcttcccgt

SEQ ID NO: 212100 - DNA, 25 bp, Homo sapien
ccacctctcggaatagcttcccgtt

SEQ ID NO: 212101 - DNA, 25 bp, Homo sapien
cacctctcggaatagcttcccgttc

SEQ ID NO: 212102 - DNA, 25 bp, Homo sapien
acctctcggaatagcttcccgttca

SEQ ID NO: 212103 - DNA, 25 bp, Homo sapien
cctctcggaatagcttcccgttcag

SEQ ID NO: 212104 - DNA, 25 bp, Homo sapien
ctctcggaatagcttcccgttcagt

SEQ ID NO: 212105 - DNA, 25 bp, Homo sapien
tctcggaatagcttcccgttcagtt

SEQ ID NO: 212106 - DNA, 25 bp, Homo sapien
ctcggaatagcttcccgttcagtta

SEQ ID NO: 212107 - DNA, 25 bp, Homo sapien
tcggaatagcttcccgttcagttaa

SEQ ID NO: 212108 - DNA, 25 bp, Homo sapien
gagacaaaaaagtcgcaaccaattg

SEQ ID NO: 212109 - DNA, 25 bp, Homo sapien
aaaagtcgcaaccaattgaagattg

SEQ ID NO: 212110 - DNA, 25 bp, Homo sapien
gtcgcaaccaattgaagattgggca

SEQ ID NO: 212111 - DNA, 25 bp, Homo sapien
tgaagattgggcaatagatttggcc

SEQ ID NO: 212112 - DNA, 25 bp, Homo sapien
ggcaatagatttggcccagactgag

SEQ ID NO: 212113 - DNA, 25 bp, Homo sapien
aatagatttggcccagactgaggca

SEQ ID NO: 212114 - DNA, 25 bp, Homo sapien
gatttggcccagactgaggcagatg

SEQ ID NO: 212115 - DNA, 25 bp, Homo sapien
actgaggcagatgggtgaatagtaa

SEQ ID NO: 212116 - DNA, 25 bp, Homo sapien
ggcagatgggtgaatagtaaaaaca

SEQ ID NO: 212117 - DNA, 25 bp, Homo sapien
aaagtatttgcctctggaaagaaca

SEQ ID NO: 212118 - DNA, 25 bp, Homo sapien
ctggcaggactgttgttttcattgt

SEQ ID NO: 212119 - DNA, 25 bp, Homo sapien
ctgaagagtcttagcgtttgtgtcg

SEQ ID NO: 212120 - DNA, 25 bp, Homo sapien
tagcgtttgtgtcgtgtttcctaaa

SEQ ID NO: 212121 - DNA, 25 bp, Homo sapien
aagactccatcataagccatgtgaa

SEQ ID NO: 212122 - DNA, 25 bp, Homo sapien
gccatgtgaattcctacttcaggac

SEQ ID NO: 212123 - DNA, 25 bp, Homo sapien
tttcccttgacactacagatgcgtt

SEQ ID NO: 212124 - DNA, 25 bp, Homo sapien
atgcgttctgaaccatattttatga

SEQ ID NO: 212125 - DNA, 25 bp, Homo sapien
gtcaagccttgtttaagagtcccag

SEQ ID NO: 212126 - DNA, 25 bp, Homo sapien
taagagtcccagttggagcacccag

SEQ ID NO: 212127 - DNA, 25 bp, Homo sapien
tggagcacccagttggaaaccccat

SEQ ID NO: 212128 - DNA, 25 bp, Homo sapien
ggaaaccccatttgccattcaatta

SEQ ID NO: 212129 - DNA, 25 bp, Homo sapien
gccattcaattacccataactgtca

SEQ ID NO: 212130 - DNA, 25 bp, Homo sapien
tggcttcggcggtggaccaaacact

SEQ ID NO: 212131 - DNA, 25 bp, Homo sapien
cttcggcggtggaccaaacactggt

SEQ ID NO: 212132 - DNA, 25 bp, Homo sapien
gtggaccaaacactggtgctggctt

SEQ ID NO: 212133 - DNA, 25 bp, Homo sapien
ggaccaaacactggtgctggctttg

SEQ ID NO: 212134 - DNA, 25 bp, Homo sapien
gagcaccagtgctggctttggcagt

SEQ ID NO: 212135 - DNA, 25 bp, Homo sapien
gctttggcagtggagccgccagtct

SEQ ID NO: 212136 - DNA, 25 bp, Homo sapien
agtggagccgccagtcttggtgcct

SEQ ID NO: 212137 - DNA, 25 bp, Homo sapien
agccgccagtcttggtgcctgtggc

SEQ ID NO: 212138 - DNA, 25 bp, Homo sapien
tgcctgtggcttctcgtatggctag

SEQ ID NO: 212139 - DNA, 25 bp, Homo sapien
ctgtggcttctcgtatggctagtga

SEQ ID NO: 212140 - DNA, 25 bp, Homo sapien
cttctcgtatggctagtgaggtttc

SEQ ID NO: 212141 - DNA, 25 bp, Homo sapien
agacgcgaaaacagtgttacaccag

SEQ ID NO: 212142 - DNA, 25 bp, Homo sapien
gttacaccagaagagcagccggcct

SEQ ID NO: 212143 - DNA, 25 bp, Homo sapien
agagcagccggcctcctgtaccgat

SEQ ID NO: 212144 - DNA, 25 bp, Homo sapien
tgtaccgatctccaacgcgaccaaa

SEQ ID NO: 212145 - DNA, 25 bp, Homo sapien
gcgaccaaacgcagtttcctaggca

SEQ ID NO: 212146 - DNA, 25 bp, Homo sapien
cggcggaaggctgtcacaggcacta

SEQ ID NO: 212147 - DNA, 25 bp, Homo sapien
aggcactacctgcacccggaagaac

SEQ ID NO: 212148 - DNA, 25 bp, Homo sapien
acctgcacccggaagaacctgaata

SEQ ID NO: 212149 - DNA, 25 bp, Homo sapien
tatgcgccattagtgttgaagccga

SEQ ID NO: 212150 - DNA, 25 bp, Homo sapien
gaagccgaatgttatggtttttatt

SEQ ID NO: 212151 - DNA, 25 bp, Homo sapien
ttatggtttttattgcggagctttt

SEQ ID NO: 212152 - DNA, 25 bp, Homo sapien
aacctcatttgataagcactcctag

SEQ ID NO: 212153 - DNA, 25 bp, Homo sapien
ttgataagcactcctagtctctggc

SEQ ID NO: 212154 - DNA, 25 bp, Homo sapien
tagtctctggcctgtggatccagtg

SEQ ID NO: 212155 - DNA, 25 bp, Homo sapien
tggatccagtgctattctgtcacca

SEQ ID NO: 212156 - DNA, 25 bp, Homo sapien
agtgctattctgtcaccaacctaag

SEQ ID NO: 212157 - DNA, 25 bp, Homo sapien
aagaatcccaattgcaccttctgtt

SEQ ID NO: 212158 - DNA, 25 bp, Homo sapien
gcaccttctgtttctgacagtcaca

SEQ ID NO: 212159 - DNA, 25 bp, Homo sapien
ggtgacagctgtgattctataatac

SEQ ID NO: 212160 - DNA, 25 bp, Homo sapien
gactggtgtcttagaggtaggaata

SEQ ID NO: 212161 - DNA, 25 bp, Homo sapien
gaagcatcaccctgctaatacataa

SEQ ID NO: 212162 - DNA, 25 bp, Homo sapien
gagtttagttcatttcaatacattg

SEQ ID NO: 212163 - DNA, 25 bp, Homo sapien
gagctcatggcccatggccaagaga

SEQ ID NO: 212164 - DNA, 25 bp, Homo sapien
agaaggacagtagctcagagtctga

SEQ ID NO: 212165 - DNA, 25 bp, Homo sapien
tctgaggatagttgccccccaagcc

SEQ ID NO: 212166 - DNA, 25 bp, Homo sapien
aagccctgggtgctccttcactgaa

SEQ ID NO: 212167 - DNA, 25 bp, Homo sapien
cttcactgaagggttctccttcgat

SEQ ID NO: 212168 - DNA, 25 bp, Homo sapien
cactgaagggttctccttcgatctc

SEQ ID NO: 212169 - DNA, 25 bp, Homo sapien
ttaatcctgactacgtcccaaaggt

SEQ ID NO: 212170 - DNA, 25 bp, Homo sapien
gactacgtcccaaaggtcgacaagt

SEQ ID NO: 212171 - DNA, 25 bp, Homo sapien
tcccaaaggtcgacaagtggtcccg

SEQ ID NO: 212172 - DNA, 25 bp, Homo sapien
tccctctggcctttgggttgttcaa

SEQ ID NO: 212173 - DNA, 25 bp, Homo sapien
tctggcctttgggttgttcaacatt

SEQ ID NO: 212174 - DNA, 25 bp, Homo sapien
aagcatgtagtatttgggtttgtta

SEQ ID NO: 212175 - DNA, 25 bp, Homo sapien
aaggatggcatggatactgtgaaaa

SEQ ID NO: 212176 - DNA, 25 bp, Homo sapien
agattgaatcatttggttctcccaa

SEQ ID NO: 212177 - DNA, 25 bp, Homo sapien
agggtctgtttgtcgaagaataact

SEQ ID NO: 212178 - DNA, 25 bp, Homo sapien
atttcatctgtataagcagttggat

SEQ ID NO: 212179 - DNA, 25 bp, Homo sapien
gcagttggattgaagcttagctatt

SEQ ID NO: 212180 - DNA, 25 bp, Homo sapien
gaagcttagctattacaatttgata

SEQ ID NO: 212181 - DNA, 25 bp, Homo sapien
ttgatagttatgttcagcttttgaa

SEQ ID NO: 212182 - DNA, 25 bp, Homo sapien
gcttttgaaaatggacgtttccgat

SEQ ID NO: 212183 - DNA, 25 bp, Homo sapien
atggacgtttccgatttacaaatgt

SEQ ID NO: 212184 - DNA, 25 bp, Homo sapien
gcagcttatagctgttgtcactttt

SEQ ID NO: 212185 - DNA, 25 bp, Homo sapien
atctggttttggtagcaggaggccc

SEQ ID NO: 212186 - DNA, 25 bp, Homo sapien
cactcctttgacttctggagagtct

SEQ ID NO: 212187 - DNA, 25 bp, Homo sapien
actgcctgagaggtgggctcagcta

SEQ ID NO: 212188 - DNA, 25 bp, Homo sapien
ggtgggctcagctaagccacaatgt

SEQ ID NO: 212189 - DNA, 25 bp, Homo sapien
agccacaatgtgtactttgatagta

SEQ ID NO: 212190 - DNA, 25 bp, Homo sapien
tactttgatagtacagctggctgct

SEQ ID NO: 212191 - DNA, 25 bp, Homo sapien
tgatagtacagctggctgctcagtg

SEQ ID NO: 212192 - DNA, 25 bp, Homo sapien
ctgctcagtgagtggcctagacatt

SEQ ID NO: 212193 - DNA, 25 bp, Homo sapien
tggcctagacattgatgactggagc

SEQ ID NO: 212194 - DNA, 25 bp, Homo sapien
gttcggaaagggtcatgggctaaat

SEQ ID NO: 212195 - DNA, 25 bp, Homo sapien
gtcatgggctaaatgtcacctgagg

SEQ ID NO: 212196 - DNA, 25 bp, Homo sapien
tctagggcttctgtcaacagggtca

SEQ ID NO: 212197 - DNA, 25 bp, Homo sapien
agggcttctgtcaacagggtcagaa

SEQ ID NO: 212198 - DNA, 25 bp, Homo sapien
agggtcagaactgcctcagtgactc

SEQ ID NO: 212199 - DNA, 25 bp, Homo sapien
agaactgcctcagtgactctgagca

SEQ ID NO: 212200 - DNA, 25 bp, Homo sapien
agtgactctgagcagcccctttcaa

SEQ ID NO: 212201 - DNA, 25 bp, Homo sapien
tctgagcagcccctttcaagagact

SEQ ID NO: 212202 - DNA, 25 bp, Homo sapien
agcccctttcaagagactgcagaag

SEQ ID NO: 212203 - DNA, 25 bp, Homo sapien
gaaaagatccactcaaatctggagt

SEQ ID NO: 212204 - DNA, 25 bp, Homo sapien
tcaaatctggagtaggagcaaggag

SEQ ID NO: 212205 - DNA, 25 bp, Homo sapien
gtggcgcaccatgaacaggaggata

SEQ ID NO: 212206 - DNA, 25 bp, Homo sapien
gcgcaccatgaacaggaggatagct

SEQ ID NO: 212207 - DNA, 25 bp, Homo sapien
gatacaataaggtcatgattgcttt

SEQ ID NO: 212208 - DNA, 25 bp, Homo sapien
gagcaatttaattgcccgttgaata

SEQ ID NO: 212209 - DNA, 25 bp, Homo sapien
tgaataggaatgaaatcccaccggt

SEQ ID NO: 212210 - DNA, 25 bp, Homo sapien
atcccaccggtaggcagttatttct

SEQ ID NO: 212211 - DNA, 25 bp, Homo sapien
gttatttcttacaaccactgtgtgt

SEQ ID NO: 212212 - DNA, 25 bp, Homo sapien
ccactgtgtgtgaaattgaaatctt

SEQ ID NO: 212213 - DNA, 25 bp, Homo sapien
tcaccttctctaaggaagttctccc

SEQ ID NO: 212214 - DNA, 25 bp, Homo sapien
gaagttctccccaaagagttgtgaa

SEQ ID NO: 212215 - DNA, 25 bp, Homo sapien
gaaactgacccaaagtcatatgcag

SEQ ID NO: 212216 - DNA, 25 bp, Homo sapien
gtcatatgcagtaatctctttttct

SEQ ID NO: 212217 - DNA, 25 bp, Homo sapien
ctttttctttacacactcaggtcaa

SEQ ID NO: 212218 - DNA, 25 bp, Homo sapien
cagggacacctggacaatatttatt

SEQ ID NO: 212219 - DNA, 25 bp, Homo sapien
atttttgctgaaacccaatgacggc

SEQ ID NO: 212220 - DNA, 25 bp, Homo sapien
aatgacggcaacctctgagccatcc

SEQ ID NO: 212221 - DNA, 25 bp, Homo sapien
ggctgacggcgcaagaccagcttta

SEQ ID NO: 212222 - DNA, 25 bp, Homo sapien
ccagctttagccgacaacagagact

SEQ ID NO: 212223 - DNA, 25 bp, Homo sapien
ctccaggccagtttgaagactacat

SEQ ID NO: 212224 - DNA, 25 bp, Homo sapien
gactacatgaacacgtcttgtttgg

SEQ ID NO: 212225 - DNA, 25 bp, Homo sapien
tcttgtttggaggtaccggacctca

SEQ ID NO: 212226 - DNA, 25 bp, Homo sapien
gtaccggacctcataaaaggactct

SEQ ID NO: 212227 - DNA, 25 bp, Homo sapien
ataaaaggactctcagcctcttggc

SEQ ID NO: 212228 - DNA, 25 bp, Homo sapien
actctcagcctcttggcaatcataa

SEQ ID NO: 212229 - DNA, 25 bp, Homo sapien
tttccattcttgctagtcagagtaa

SEQ ID NO: 212230 - DNA, 25 bp, Homo sapien
tccattcttgctagtcagagtaagt

SEQ ID NO: 212231 - DNA, 25 bp, Homo sapien
ttcttgctagtcagagtaagtaggc

SEQ ID NO: 212232 - DNA, 25 bp, Homo sapien
gtcagagtaagtaggcagcactttt

SEQ ID NO: 212233 - DNA, 25 bp, Homo sapien
agagtaagtaggcagcacttttaaa

SEQ ID NO: 212234 - DNA, 25 bp, Homo sapien
aatatgtgaactcaaatattgcact

SEQ ID NO: 212235 - DNA, 25 bp, Homo sapien
ttctttcaagatgttatcaattggt

SEQ ID NO: 212236 - DNA, 25 bp, Homo sapien
caattggttattgtactgtatagtt

SEQ ID NO: 212237 - DNA, 25 bp, Homo sapien
tgattgaaaccctttaacaactctt

SEQ ID NO: 212238 - DNA, 25 bp, Homo sapien
ttcagtactatttacataggaattg

SEQ ID NO: 212239 - DNA, 25 bp, Homo sapien
gatatagtagaagaaatgtgctgta

SEQ ID NO: 212240 - DNA, 25 bp, Homo sapien
tgatgtctgggagaatgcccctcaa

SEQ ID NO: 212241 - DNA, 25 bp, Homo sapien
agaatgcccctcaagctttcccttt

SEQ ID NO: 212242 - DNA, 25 bp, Homo sapien
aagaagcttgtttgcttcctctcac

SEQ ID NO: 212243 - DNA, 25 bp, Homo sapien
ctctcacttccataacgtctatatt

SEQ ID NO: 212244 - DNA, 25 bp, Homo sapien
cagttggaggaacactaatatctga

SEQ ID NO: 212245 - DNA, 25 bp, Homo sapien
taaagaagggctgcttcagaccatt

SEQ ID NO: 212246 - DNA, 25 bp, Homo sapien
gggctgcttcagaccattattaact

SEQ ID NO: 212247 - DNA, 25 bp, Homo sapien
ttaactggtgacttgatgtttttct

SEQ ID NO: 212248 - DNA, 25 bp, Homo sapien
tggcttgctgatggcgatccatgtc

SEQ ID NO: 212249 - DNA, 25 bp, Homo sapien
tggcgatccatgtccctatttcaga

SEQ ID NO: 212250 - DNA, 25 bp, Homo sapien
atgtccctatttcagaccacacttt

SEQ ID NO: 212251 - DNA, 25 bp, Homo sapien
agggctggctgacctgtccctatca

SEQ ID NO: 212252 - DNA, 25 bp, Homo sapien
gtccctatcagtcccaagtcatgca

SEQ ID NO: 212253 - DNA, 25 bp, Homo sapien
agtcatgcaccctgtgccccgggaa

SEQ ID NO: 212254 - DNA, 25 bp, Homo sapien
accctatgctggtggtgtggcatca

SEQ ID NO: 212255 - DNA, 25 bp, Homo sapien
aaacctgggatgtagagccgcattc

SEQ ID NO: 212256 - DNA, 25 bp, Homo sapien
actccctgtgcatgctgggcttggc

SEQ ID NO: 212257 - DNA, 25 bp, Homo sapien
ttggccccacattatgccaagggaa

SEQ ID NO: 212258 - DNA, 25 bp, Homo sapien
agggaagcgggacctcttttgtcat

SEQ ID NO: 212259 - DNA, 25 bp, Homo sapien
tttgtcattggccatcctagccacc

SEQ ID NO: 212260 - DNA, 25 bp, Homo sapien
cctgccttgtgcctgcatgaggttg

SEQ ID NO: 212261 - DNA, 25 bp, Homo sapien
cctgcatgaggttgggagacttgat

SEQ ID NO: 212262 - DNA, 25 bp, Homo sapien
gcacctccaacatctgcttcagcgg

SEQ ID NO: 212263 - DNA, 25 bp, Homo sapien
tgtttctcctgttccacagtcgcca

SEQ ID NO: 212264 - DNA, 25 bp, Homo sapien
ttctcctgttccacagtcgccaata

SEQ ID NO: 212265 - DNA, 25 bp, Homo sapien
gtcgccaatacctcccttacttcag

SEQ ID NO: 212266 - DNA, 25 bp, Homo sapien
cttacttcaggacccaaatcttctt

SEQ ID NO: 212267 - DNA, 25 bp, Homo sapien
cttcaggacccaaatcttcttagac

SEQ ID NO: 212268 - DNA, 25 bp, Homo sapien
aatcttcttagacaattgcttcctg

SEQ ID NO: 212269 - DNA, 25 bp, Homo sapien
cttcttagacaattgcttcctgctt

SEQ ID NO: 212270 - DNA, 25 bp, Homo sapien
ttcctgctttgcaagccacgctgca

SEQ ID NO: 212271 - DNA, 25 bp, Homo sapien
gccacgctgcagcttaataattcta

SEQ ID NO: 212272 - DNA, 25 bp, Homo sapien
gctgcagcttaataattctaatgtg

SEQ ID NO: 212273 - DNA, 25 bp, Homo sapien
ttacccgggccctacaggagcctgt

SEQ ID NO: 212274 - DNA, 25 bp, Homo sapien
cgggccctacaggagcctgtgcaga

SEQ ID NO: 212275 - DNA, 25 bp, Homo sapien
tgtgcagatggccatgcccaaccaa

SEQ ID NO: 212276 - DNA, 25 bp, Homo sapien
ccagagactgggttccaatctcacc

SEQ ID NO: 212277 - DNA, 25 bp, Homo sapien
gagactgggttccaatctcacccca

SEQ ID NO: 212278 - DNA, 25 bp, Homo sapien
accacatacagagccctcatctgtg

SEQ ID NO: 212279 - DNA, 25 bp, Homo sapien
atgagaatgatcacgtgacccaccc

SEQ ID NO: 212280 - DNA, 25 bp, Homo sapien
cccagggcaggtatcagggtgaact

SEQ ID NO: 212281 - DNA, 25 bp, Homo sapien
gtgaactgatcttagcaccggccaa

SEQ ID NO: 212282 - DNA, 25 bp, Homo sapien
ctgatcttagcaccggccaaataaa

SEQ ID NO: 212283 - DNA, 25 bp, Homo sapien
gccaaataaatggaacctgctgaga

SEQ ID NO: 212284 - DNA, 25 bp, Homo sapien
ttcagctttgaggacagatgctatc

SEQ ID NO: 212285 - DNA, 25 bp, Homo sapien
aggacagatgctatcctaagggcat

SEQ ID NO: 212286 - DNA, 25 bp, Homo sapien
atcctaagggcatggcagtacccat

SEQ ID NO: 212287 - DNA, 25 bp, Homo sapien
tggcagtacccatgttgatttgaca

SEQ ID NO: 212288 - DNA, 25 bp, Homo sapien
tgatttgacatctctctagcccatc

SEQ ID NO: 212289 - DNA, 25 bp, Homo sapien
tagcccatccattgcttacagtaga

SEQ ID NO: 212290 - DNA, 25 bp, Homo sapien
gctgtatgcttgataatcttgaaca

SEQ ID NO: 212291 - DNA, 25 bp, Homo sapien
gacttgacaaggtagagatctgata

SEQ ID NO: 212292 - DNA, 25 bp, Homo sapien
agattttggagaccatttcctgtgc

SEQ ID NO: 212293 - DNA, 25 bp, Homo sapien
ctctattccataccgtgccatggag

SEQ ID NO: 212294 - DNA, 25 bp, Homo sapien
ataccgtgccatggaggctgtttta

SEQ ID NO: 212295 - DNA, 25 bp, Homo sapien
gagagaatgtagaacatccattgtt

SEQ ID NO: 212296 - DNA, 25 bp, Homo sapien
gtagaacatccattgttatacaaga

SEQ ID NO: 212297 - DNA, 25 bp, Homo sapien
gagatggcctatttaacttacttca

SEQ ID NO: 212298 - DNA, 25 bp, Homo sapien
aattctcaagcaccaggaaaacaat

SEQ ID NO: 212299 - DNA, 25 bp, Homo sapien
ggaaaacaattttagagctgactac

SEQ ID NO: 212300 - DNA, 25 bp, Homo sapien
tttagagctgactacaatagatctt

SEQ ID NO: 212301 - DNA, 25 bp, Homo sapien
caatagatcttttgctagactgttc

SEQ ID NO: 212302 - DNA, 25 bp, Homo sapien
gctagactgttctgaagactagttt

SEQ ID NO: 212303 - DNA, 25 bp, Homo sapien
gaatattaatccacaataaggttga

SEQ ID NO: 212304 - DNA, 25 bp, Homo sapien
gaacagactccatgtactattacaa

SEQ ID NO: 212305 - DNA, 25 bp, Homo sapien
tattacaaaaatgaggtctgacctg

SEQ ID NO: 212306 - DNA, 25 bp, Homo sapien
tgtcgctgtttacaaagtcttttca

SEQ ID NO: 212307 - DNA, 25 bp, Homo sapien
acaaagtcttttcagtgggcagagc

SEQ ID NO: 212308 - DNA, 25 bp, Homo sapien
gtgggcagagctagaacgttcgtaa

SEQ ID NO: 212309 - DNA, 25 bp, Homo sapien
gaacgttcgtaatgagtaaatactg

SEQ ID NO: 212310 - DNA, 25 bp, Homo sapien
tctgattttcaggtttaggcttata

SEQ ID NO: 212311 - DNA, 25 bp, Homo sapien
gtatcttattaggattttggtttct

SEQ ID NO: 212312 - DNA, 25 bp, Homo sapien
attttggtttctaatgatccattac

SEQ ID NO: 212313 - DNA, 25 bp, Homo sapien
gatccattacgtgctttatcctata

SEQ ID NO: 212314 - DNA, 25 bp, Homo sapien
cgtgctttatcctatatatgctata

SEQ ID NO: 212315 - DNA, 25 bp, Homo sapien
gtatggcatagtttcagaataccaa

SEQ ID NO: 212316 - DNA, 25 bp, Homo sapien
cagaataccaattccaatattgtta

SEQ ID NO: 212317 - DNA, 25 bp, Homo sapien
ggaagcagctactcctatggcagtg

SEQ ID NO: 212318 - DNA, 25 bp, Homo sapien
gaagcagctactcctatggcagtgg

SEQ ID NO: 212319 - DNA, 25 bp, Homo sapien
aagcagctactcctatggcagtggt

SEQ ID NO: 212320 - DNA, 25 bp, Homo sapien
gcagctactcctatggcagtggtct

SEQ ID NO: 212321 - DNA, 25 bp, Homo sapien
agctactcctatggcagtggtcttg

SEQ ID NO: 212322 - DNA, 25 bp, Homo sapien
ctcagctctgttggaggcggcagtt

SEQ ID NO: 212323 - DNA, 25 bp, Homo sapien
agctctgttggaggcggcagttcca

SEQ ID NO: 212324 - DNA, 25 bp, Homo sapien
tgttggaggcggcagttccaccatc

SEQ ID NO: 212325 - DNA, 25 bp, Homo sapien
ttggaggcggcagttccaccatcaa

SEQ ID NO: 212326 - DNA, 25 bp, Homo sapien
gaggcggcagttccaccatcaagta

SEQ ID NO: 212327 - DNA, 25 bp, Homo sapien
aggcggcagttccaccatcaagtac

SEQ ID NO: 212328 - DNA, 25 bp, Homo sapien
aacagccctttcaatcttggttaca

SEQ ID NO: 212329 - DNA, 25 bp, Homo sapien
gggaaacacttaccatggctcgcag

SEQ ID NO: 212330 - DNA, 25 bp, Homo sapien
catggctcgcagaagcatcctaagt

SEQ ID NO: 212331 - DNA, 25 bp, Homo sapien
gcatcctaagtgttacaggcctgct

SEQ ID NO: 212332 - DNA, 25 bp, Homo sapien
agtgttacaggcctgctatgcaccg

SEQ ID NO: 212333 - DNA, 25 bp, Homo sapien
gctatgcaccggctggacagaattt

SEQ ID NO: 212334 - DNA, 25 bp, Homo sapien
ggacagaattttataacccacatct

SEQ ID NO: 212335 - DNA, 25 bp, Homo sapien
acccacatctgggaatgaatttgca

SEQ ID NO: 212336 - DNA, 25 bp, Homo sapien
atgaatttgcagcacctggtagaag

SEQ ID NO: 212337 - DNA, 25 bp, Homo sapien
acctggtagaagaaggcaccttgga

SEQ ID NO: 212338 - DNA, 25 bp, Homo sapien
actgccttgggcttccatggcagga

SEQ ID NO: 212339 - DNA, 25 bp, Homo sapien
gtcagtgtatcagacaagctagcag

SEQ ID NO: 212340 - DNA, 25 bp, Homo sapien
gacaagctagcagttgtagatgaat

SEQ ID NO: 212341 - DNA, 25 bp, Homo sapien
agaagtggcatatcttggaaatgaa

SEQ ID NO: 212342 - DNA, 25 bp, Homo sapien
atcttggaaatgaagtgtctgatga

SEQ ID NO: 212343 - DNA, 25 bp, Homo sapien
gagtgcttgaagagagtgggcctaa

SEQ ID NO: 212344 - DNA, 25 bp, Homo sapien
agtgggcctaagtggcgctcctgct

SEQ ID NO: 212345 - DNA, 25 bp, Homo sapien
aagtggcgctcctgctgatgcctgt

SEQ ID NO: 212346 - DNA, 25 bp, Homo sapien
tgatgcctgttctactgcccagaag

SEQ ID NO: 212347 - DNA, 25 bp, Homo sapien
tgcctgttctactgcccagaaggct

SEQ ID NO: 212348 - DNA, 25 bp, Homo sapien
atttgcaaatgtaatggtggccgtg

SEQ ID NO: 212349 - DNA, 25 bp, Homo sapien
caaatgtaatggtggccgtggtgcc

SEQ ID NO: 212350 - DNA, 25 bp, Homo sapien
aatgacagcgtggactacttagtat

SEQ ID NO: 212351 - DNA, 25 bp, Homo sapien
ttttaactgtatttgagaccacaag

SEQ ID NO: 212352 - DNA, 25 bp, Homo sapien
gagaccacaagtagtttcttcaata

SEQ ID NO: 212353 - DNA, 25 bp, Homo sapien
tcttcaatattttctcaagcccttg

SEQ ID NO: 212354 - DNA, 25 bp, Homo sapien
tgagacacttaattctccctcttga

SEQ ID NO: 212355 - DNA, 25 bp, Homo sapien
cttcctcttcatcttagaaactgca

SEQ ID NO: 212356 - DNA, 25 bp, Homo sapien
ctgcaatttcctttgtaggaacaac

SEQ ID NO: 212357 - DNA, 25 bp, Homo sapien
ggaacaacttcctgctgggtactgc

SEQ ID NO: 212358 - DNA, 25 bp, Homo sapien
tgggtactgccctctttggccactt

SEQ ID NO: 212359 - DNA, 25 bp, Homo sapien
ctaaagccataagtgcattgcaaca

SEQ ID NO: 212360 - DNA, 25 bp, Homo sapien
cattgcaacactagccatttcatca

SEQ ID NO: 212361 - DNA, 25 bp, Homo sapien
ttccccgagctttattacttacctg

SEQ ID NO: 212362 - DNA, 25 bp, Homo sapien
attacttacctgacaaatccttttg

SEQ ID NO: 212363 - DNA, 25 bp, Homo sapien
ccttttgcaagtcagaaagcttcag

SEQ ID NO: 212364 - DNA, 25 bp, Homo sapien
ttcagattcttcacttttatcaaaa

SEQ ID NO: 212365 - DNA, 25 bp, Homo sapien
agtgagttgttttgccagttatcca

SEQ ID NO: 212366 - DNA, 25 bp, Homo sapien
ttgccagttatccactgctgcaaaa

SEQ ID NO: 212367 - DNA, 25 bp, Homo sapien
aaaaacggtgccttgcaaagaagca

SEQ ID NO: 212368 - DNA, 25 bp, Homo sapien
acttgtatttttgcttctgagtctg

SEQ ID NO: 212369 - DNA, 25 bp, Homo sapien
gagtctgtatcttgtgcggctcagc

SEQ ID NO: 212370 - DNA, 25 bp, Homo sapien
gtccaggccggacttgctcttgtac

SEQ ID NO: 212371 - DNA, 25 bp, Homo sapien
gctcttgtacctttggtcagttgtg

SEQ ID NO: 212372 - DNA, 25 bp, Homo sapien
gggtaaaaatttaagagcaggccag

SEQ ID NO: 212373 - DNA, 25 bp, Homo sapien
ggtaaaaatttaagagcaggccagg

SEQ ID NO: 212374 - DNA, 25 bp, Homo sapien
gtaaaaatttaagagcaggccaggc

SEQ ID NO: 212375 - DNA, 25 bp, Homo sapien
taaaaatttaagagcaggccaggcg

SEQ ID NO: 212376 - DNA, 25 bp, Homo sapien
aaaaatttaagagcaggccaggcgt

SEQ ID NO: 212377 - DNA, 25 bp, Homo sapien
aaaatttaagagcaggccaggcgtg

SEQ ID NO: 212378 - DNA, 25 bp, Homo sapien
aaatttaagagcaggccaggcgtgg

SEQ ID NO: 212379 - DNA, 25 bp, Homo sapien
aatttaagagcaggccaggcgtggt

SEQ ID NO: 212380 - DNA, 25 bp, Homo sapien
gcagagcacttgaggccagtagttg

SEQ ID NO: 212381 - DNA, 25 bp, Homo sapien
cagagcacttgaggccagtagttgg

SEQ ID NO: 212382 - DNA, 25 bp, Homo sapien
agagcacttgaggccagtagttgga

SEQ ID NO: 212383 - DNA, 25 bp, Homo sapien
gtttaggaccttaatcaaactgata

SEQ ID NO: 212384 - DNA, 25 bp, Homo sapien
gggaaatgggcttctaatgtctttt

SEQ ID NO: 212385 - DNA, 25 bp, Homo sapien
ggcttctaatgtctttttcccatgt

SEQ ID NO: 212386 - DNA, 25 bp, Homo sapien
atgtctttttcccatgtgaacaagt

SEQ ID NO: 212387 - DNA, 25 bp, Homo sapien
tgtgaacaagtgaccctgctatatt

SEQ ID NO: 212388 - DNA, 25 bp, Homo sapien
tatatttccccccatcgatttgtaa

SEQ ID NO: 212389 - DNA, 25 bp, Homo sapien
gatttgtaatggctatttctgcttt

SEQ ID NO: 212390 - DNA, 25 bp, Homo sapien
ttctgctttatatgcatggatctgt

SEQ ID NO: 212391 - DNA, 25 bp, Homo sapien
gcatggatctgtttggatactctca

SEQ ID NO: 212392 - DNA, 25 bp, Homo sapien
ctgtttggatactctcaattctttt

SEQ ID NO: 212393 - DNA, 25 bp, Homo sapien
cttttggtttttcctgcattggcag

SEQ ID NO: 212394 - DNA, 25 bp, Homo sapien
aggatgctggacctcccaggatatt

SEQ ID NO: 212395 - DNA, 25 bp, Homo sapien
ctcccaggatattttgggtcaaatg

SEQ ID NO: 212396 - DNA, 25 bp, Homo sapien
gaggatgaaaccacaagtacactta

SEQ ID NO: 212397 - DNA, 25 bp, Homo sapien
caagtacacttagcgtggagaagct

SEQ ID NO: 212398 - DNA, 25 bp, Homo sapien
gagaagctggtgatctagactgaga

SEQ ID NO: 212399 - DNA, 25 bp, Homo sapien
ctagactgagaatcagcctgagctt

SEQ ID NO: 212400 - DNA, 25 bp, Homo sapien
gggtctgctactcgcgttttgtaga

SEQ ID NO: 212401 - DNA, 25 bp, Homo sapien
ctgctactcgcgttttgtagacttt

SEQ ID NO: 212402 - DNA, 25 bp, Homo sapien
ctcgcgttttgtagacttttgtgta

SEQ ID NO: 212403 - DNA, 25 bp, Homo sapien
gtgtaactatttgtaccgtaggaca

SEQ ID NO: 212404 - DNA, 25 bp, Homo sapien
ctatttgtaccgtaggacagaatgt

SEQ ID NO: 212405 - DNA, 25 bp, Homo sapien
cagttcctattgttattctctctta

SEQ ID NO: 212406 - DNA, 25 bp, Homo sapien
gttattctctcttagagcactctgt

SEQ ID NO: 212407 - DNA, 25 bp, Homo sapien
tcttagagcactctgtatttttctt

SEQ ID NO: 212408 - DNA, 25 bp, Homo sapien
atttttcttccatagcagtaatcaa

SEQ ID NO: 212409 - DNA, 25 bp, Homo sapien
agtttatttgtatacctaatctgta

SEQ ID NO: 212410 - DNA, 25 bp, Homo sapien
taatctgtattttcatggctccatg

SEQ ID NO: 212411 - DNA, 25 bp, Homo sapien
tggctccatgaagctagattcacat

SEQ ID NO: 212412 - DNA, 25 bp, Homo sapien
agattcacatctgttttacctagaa

SEQ ID NO: 212413 - DNA, 25 bp, Homo sapien
agatgataacctcctttgcagcaag

SEQ ID NO: 212414 - DNA, 25 bp, Homo sapien
aaatcagattcctgctagcttcttt

SEQ ID NO: 212415 - DNA, 25 bp, Homo sapien
ctgctagcttctttttgcaccttct

SEQ ID NO: 212416 - DNA, 25 bp, Homo sapien
tgtaatcgaaaaggcccgcaacttc

SEQ ID NO: 212417 - DNA, 25 bp, Homo sapien
aaaaggcccgcaacttcaagatcgt

SEQ ID NO: 212418 - DNA, 25 bp, Homo sapien
ttcaagatcgtcacggaggtgcagc

SEQ ID NO: 212419 - DNA, 25 bp, Homo sapien
agcaggatgggcaggacttcacttg

SEQ ID NO: 212420 - DNA, 25 bp, Homo sapien
ggcaggacttcacttggtcccagca

SEQ ID NO: 212421 - DNA, 25 bp, Homo sapien
aacaagttcactgttggcaaggaaa

SEQ ID NO: 212422 - DNA, 25 bp, Homo sapien
caagacgttcaaggccactgtgcag

SEQ ID NO: 212423 - DNA, 25 bp, Homo sapien
ccaactatcaccagacctcagagat

SEQ ID NO: 212424 - DNA, 25 bp, Homo sapien
agacctcagagatcgtgggtgacaa

SEQ ID NO: 212425 - DNA, 25 bp, Homo sapien
gaggtctccaccatcggaggcgtga

SEQ ID NO: 212426 - DNA, 25 bp, Homo sapien
cgtgacctatgagcgcgtgagcaag

SEQ ID NO: 212427 - DNA, 25 bp, Homo sapien
ctctttaacagattcagggcctcat

SEQ ID NO: 212428 - DNA, 25 bp, Homo sapien
agggcctcatcctttgactcggaac

SEQ ID NO: 212429 - DNA, 25 bp, Homo sapien
ggaattaggagcgagtcctcctgcc

SEQ ID NO: 212430 - DNA, 25 bp, Homo sapien
tcctgcccagagagctaattactga

SEQ ID NO: 212431 - DNA, 25 bp, Homo sapien
actgaaattcagtggcctcaccagg

SEQ ID NO: 212432 - DNA, 25 bp, Homo sapien
ctcaccagggcgagtggcgtcaccg

SEQ ID NO: 212433 - DNA, 25 bp, Homo sapien
agctcctaatttctaactggtcaaa

SEQ ID NO: 212434 - DNA, 25 bp, Homo sapien
ggtcaaagttagacatttcagtaca

SEQ ID NO: 212435 - DNA, 25 bp, Homo sapien
tgggctgcccaaagccagctggaag

SEQ ID NO: 212436 - DNA, 25 bp, Homo sapien
aactctccctgagacaagtagccag

SEQ ID NO: 212437 - DNA, 25 bp, Homo sapien
aagtagccaggtttcacatattaaa

SEQ ID NO: 212438 - DNA, 25 bp, Homo sapien
tggctgaagaggtgcgcgcagtctt

SEQ ID NO: 212439 - DNA, 25 bp, Homo sapien
cagtcttggagctcggccgccgcaa

SEQ ID NO: 212440 - DNA, 25 bp, Homo sapien
gccgccgcaagtaccaggacagcat

SEQ ID NO: 212441 - DNA, 25 bp, Homo sapien
aggacagcatccgacgcatgggctt

SEQ ID NO: 212442 - DNA, 25 bp, Homo sapien
aggcataggccccacagaattttag

SEQ ID NO: 212443 - DNA, 25 bp, Homo sapien
ccacagaattttaggctggcccaga

SEQ ID NO: 212444 - DNA, 25 bp, Homo sapien
aggctggcccagatattccccagtg

SEQ ID NO: 212445 - DNA, 25 bp, Homo sapien
accttcaagtctctccagtgtgtgg

SEQ ID NO: 212446 - DNA, 25 bp, Homo sapien
gggacgggtccctgtgagcaacaaa

SEQ ID NO: 212447 - DNA, 25 bp, Homo sapien
acgggtccctgtgagcaacaaaact

SEQ ID NO: 212448 - DNA, 25 bp, Homo sapien
gtgagcaacaaaactgcactgtttc

SEQ ID NO: 212449 - DNA, 25 bp, Homo sapien
atcttcatgcatcaaccaaatgggc

SEQ ID NO: 212450 - DNA, 25 bp, Homo sapien
ccaaatgggccatcaggtacttcat

SEQ ID NO: 212451 - DNA, 25 bp, Homo sapien
tgggccatcaggtacttcattagtc

SEQ ID NO: 212452 - DNA, 25 bp, Homo sapien
aggtacttcattagtcatggcagaa

SEQ ID NO: 212453 - DNA, 25 bp, Homo sapien
gaaaagacttgttttccagacagaa

SEQ ID NO: 212454 - DNA, 25 bp, Homo sapien
agacagaaaatctactcccctgtcc

SEQ ID NO: 212455 - DNA, 25 bp, Homo sapien
tccccagccatatccctggatagga

SEQ ID NO: 212456 - DNA, 25 bp, Homo sapien
ataggaagagactacttggtgccat

SEQ ID NO: 212457 - DNA, 25 bp, Homo sapien
atcagagtgggaagacctcagcctt

SEQ ID NO: 212458 - DNA, 25 bp, Homo sapien
aagacctcagccttgggtggcttgt

SEQ ID NO: 212459 - DNA, 25 bp, Homo sapien
tgtctctgcttcttgccaggtggga

SEQ ID NO: 212460 - DNA, 25 bp, Homo sapien
aaataagagcaacaggttttccaga

SEQ ID NO: 212461 - DNA, 25 bp, Homo sapien
gaatgttgcgcatgttctactggaa

SEQ ID NO: 212462 - DNA, 25 bp, Homo sapien
gttctactggaaggactacatcatc

SEQ ID NO: 212463 - DNA, 25 bp, Homo sapien
gactacatcatcaaagacccaaacg

SEQ ID NO: 212464 - DNA, 25 bp, Homo sapien
gacccaaacgttatttcaccatagt

SEQ ID NO: 212465 - DNA, 25 bp, Homo sapien
tagtgattatttcaagtagcttgct

SEQ ID NO: 212466 - DNA, 25 bp, Homo sapien
gtagcttgctacttggacttattgt

SEQ ID NO: 212467 - DNA, 25 bp, Homo sapien
ggacttattgtacttctgttgatct

SEQ ID NO: 212468 - DNA, 25 bp, Homo sapien
gtacttctgttgatctcatatgtta

SEQ ID NO: 212469 - DNA, 25 bp, Homo sapien
agacaatacaaatctatcctacaag

SEQ ID NO: 212470 - DNA, 25 bp, Homo sapien
agcaatgatgattaaggacttcttt

SEQ ID NO: 212471 - DNA, 25 bp, Homo sapien
ggttacattacatccttattttgtt

SEQ ID NO: 212472 - DNA, 25 bp, Homo sapien
tttgttatccaatattgactagagg

SEQ ID NO: 212473 - DNA, 25 bp, Homo sapien
gactagaggatcatccattatatct

SEQ ID NO: 212474 - DNA, 25 bp, Homo sapien
ttgagtcaaccaaatttcagtgaag

SEQ ID NO: 212475 - DNA, 25 bp, Homo sapien
ttcagtgaagatagactagcatgct

SEQ ID NO: 212476 - DNA, 25 bp, Homo sapien
ctagcatgctaaactcatcgtctct

SEQ ID NO: 212477 - DNA, 25 bp, Homo sapien
gctaaactcatcgtctcttgaatta

SEQ ID NO: 212478 - DNA, 25 bp, Homo sapien
aaacaaacattaccaccacttcaat

SEQ ID NO: 212479 - DNA, 25 bp, Homo sapien
caccacttcaataatatctgtcagg

SEQ ID NO: 212480 - DNA, 25 bp, Homo sapien
atctgtcaggaatgaaaccactttt

SEQ ID NO: 212481 - DNA, 25 bp, Homo sapien
ttccaaatgaatgtttcctgatcta

SEQ ID NO: 212482 - DNA, 25 bp, Homo sapien
atgattactacctcaggaccaacct

SEQ ID NO: 212483 - DNA, 25 bp, Homo sapien
gaccaacctcagaaaagccaactcg

SEQ ID NO: 212484 - DNA, 25 bp, Homo sapien
aagccaactcgaagtcatccatgga

SEQ ID NO: 212485 - DNA, 25 bp, Homo sapien
tccatggacccctgatgattccaca

SEQ ID NO: 212486 - DNA, 25 bp, Homo sapien
gatcagataactccatcccaatggc

SEQ ID NO: 212487 - DNA, 25 bp, Homo sapien
catcccaatggcttatcttacactg

SEQ ID NO: 212488 - DNA, 25 bp, Homo sapien
ggcttatcttacactggatcaccaa

SEQ ID NO: 212489 - DNA, 25 bp, Homo sapien
aactagttgcagaactggaccagga

SEQ ID NO: 212490 - DNA, 25 bp, Homo sapien
gcaaaatacatctcgcctggtacag

SEQ ID NO: 212491 - DNA, 25 bp, Homo sapien
acatctcgcctggtacaggaacata

SEQ ID NO: 212492 - DNA, 25 bp, Homo sapien
gcctttctacttactaccagcaatg

SEQ ID NO: 212493 - DNA, 25 bp, Homo sapien
cttttggttatagagtgttcacttc

SEQ ID NO: 212494 - DNA, 25 bp, Homo sapien
agagtgttcacttctttatcataac

SEQ ID NO: 212495 - DNA, 25 bp, Homo sapien
gtttatacgaacacccagaggcaaa

SEQ ID NO: 212496 - DNA, 25 bp, Homo sapien
cgaacacccagaggcaaaagaattt

SEQ ID NO: 212497 - DNA, 25 bp, Homo sapien
aatttggcttaattctcactccagg

SEQ ID NO: 212498 - DNA, 25 bp, Homo sapien
ttggcttaattctcactccaggtaa

SEQ ID NO: 212499 - DNA, 25 bp, Homo sapien
attctcactccaggtaagtagctta

SEQ ID NO: 212500 - DNA, 25 bp, Homo sapien
aagtagcttaacttctgggcttcag

SEQ ID NO: 212501 - DNA, 25 bp, Homo sapien
tagcttaacttctgggcttcagttt

SEQ ID NO: 212502 - DNA, 25 bp, Homo sapien
tcaggaagattggactaagtgatcc

SEQ ID NO: 212503 - DNA, 25 bp, Homo sapien
gtattttttagcactggatttctac

SEQ ID NO: 212504 - DNA, 25 bp, Homo sapien
ttgccaaggttttaggtatgatgat

SEQ ID NO: 212505 - DNA, 25 bp, Homo sapien
aaggtacaagatatatgcttaagtg

SEQ ID NO: 212506 - DNA, 25 bp, Homo sapien
aagcatttacactaggttttagtgt

SEQ ID NO: 212507 - DNA, 25 bp, Homo sapien
ctaggttttagtgttgatgcaatgt

SEQ ID NO: 212508 - DNA, 25 bp, Homo sapien
ttagtgttgatgcaatgtatctttt

SEQ ID NO: 212509 - DNA, 25 bp, Homo sapien
aatgaattataccttcactgctaat

SEQ ID NO: 212510 - DNA, 25 bp, Homo sapien
ttataccttcactgctaattttgta

SEQ ID NO: 212511 - DNA, 25 bp, Homo sapien
tttcttactcttcttaaccattatc

SEQ ID NO: 212512 - DNA, 25 bp, Homo sapien
ttactcttcttaaccattatcacat

SEQ ID NO: 212513 - DNA, 25 bp, Homo sapien
aaccattatcacatgaactcattgc

SEQ ID NO: 212514 - DNA, 25 bp, Homo sapien
atcacatgaactcattgccaaggtt

SEQ ID NO: 212515 - DNA, 25 bp, Homo sapien
tctacattttgaccatactaccctt

SEQ ID NO: 212516 - DNA, 25 bp, Homo sapien
attttgaccatactaccctttcatg

SEQ ID NO: 212517 - DNA, 25 bp, Homo sapien
ttgaccatactaccctttcatgttc

SEQ ID NO: 212518 - DNA, 25 bp, Homo sapien
catactaccctttcatgttcttatt

SEQ ID NO: 212519 - DNA, 25 bp, Homo sapien
gatttcattcagtcatgtccagtta

SEQ ID NO: 212520 - DNA, 25 bp, Homo sapien
cattcagtcatgtccagttatataa

SEQ ID NO: 212521 - DNA, 25 bp, Homo sapien
tcagtcatgtccagttatataaaac

SEQ ID NO: 212522 - DNA, 25 bp, Homo sapien
tatataaaacgttactttctcattt

SEQ ID NO: 212523 - DNA, 25 bp, Homo sapien
aaaacatactactaagaccaatcat

SEQ ID NO: 212524 - DNA, 25 bp, Homo sapien
gaccaatcatcaaacccactattat

SEQ ID NO: 212525 - DNA, 25 bp, Homo sapien
ttaattttggctgggtaaggtggct

SEQ ID NO: 212526 - DNA, 25 bp, Homo sapien
gtgttcagatggactgttttaataa

SEQ ID NO: 212527 - DNA, 25 bp, Homo sapien
atctttgagcaagtgagttatggca

SEQ ID NO: 212528 - DNA, 25 bp, Homo sapien
agttatggcaagagaaactcagcct

SEQ ID NO: 212529 - DNA, 25 bp, Homo sapien
gaaactcagcctctttctgtataaa

SEQ ID NO: 212530 - DNA, 25 bp, Homo sapien
tgtataaacttaacagggaagggct

SEQ ID NO: 212531 - DNA, 25 bp, Homo sapien
atttttgggactgcactatcctgtt

SEQ ID NO: 212532 - DNA, 25 bp, Homo sapien
gactgcactatcctgttcacgaaga

SEQ ID NO: 212533 - DNA, 25 bp, Homo sapien
actatcctgttcacgaagacatgtg

SEQ ID NO: 212534 - DNA, 25 bp, Homo sapien
gacatgtgaacttggttcagtccaa

SEQ ID NO: 212535 - DNA, 25 bp, Homo sapien
aaaccagtgctctccattagaaata

SEQ ID NO: 212536 - DNA, 25 bp, Homo sapien
ttagaaatatggtgcaagccacata

SEQ ID NO: 212537 - DNA, 25 bp, Homo sapien
tagacaaaaattgctgccctcctgg

SEQ ID NO: 212538 - DNA, 25 bp, Homo sapien
gccctcctgggccttattatgaaga

SEQ ID NO: 212539 - DNA, 25 bp, Homo sapien
atataggctaggtgtgctgcctctc

SEQ ID NO: 212540 - DNA, 25 bp, Homo sapien
ataggctaggtgtgctgcctctcgc

SEQ ID NO: 212541 - DNA, 25 bp, Homo sapien
gtgtgctgcctctcgcctgtgatac

SEQ ID NO: 212542 - DNA, 25 bp, Homo sapien
atgctggagggtcaccatgataagc

SEQ ID NO: 212543 - DNA, 25 bp, Homo sapien
ggtcaccatgataagccaggcatca

SEQ ID NO: 212544 - DNA, 25 bp, Homo sapien
tgataagccaggcatcactcaaggc

SEQ ID NO: 212545 - DNA, 25 bp, Homo sapien
aagccaggcatcactcaaggcactg

SEQ ID NO: 212546 - DNA, 25 bp, Homo sapien
aggcatcactcaaggcactggaatt

SEQ ID NO: 212547 - DNA, 25 bp, Homo sapien
cactggaattgccatagtgaataaa

SEQ ID NO: 212548 - DNA, 25 bp, Homo sapien
aaactgctgttttataagaagactt

SEQ ID NO: 212549 - DNA, 25 bp, Homo sapien
gaagactttttgttgtactatgtgc

SEQ ID NO: 212550 - DNA, 25 bp, Homo sapien
tttttgttgtactatgtgcatgcat

SEQ ID NO: 212551 - DNA, 25 bp, Homo sapien
gtgcatgcatactacctatttctaa

SEQ ID NO: 212552 - DNA, 25 bp, Homo sapien
tacctatttctaaactttgccatat

SEQ ID NO: 212553 - DNA, 25 bp, Homo sapien
ttgccatattgaggcctttataaac

SEQ ID NO: 212554 - DNA, 25 bp, Homo sapien
atgtaatactagtgcaattttgctt

SEQ ID NO: 212555 - DNA, 25 bp, Homo sapien
gtgcaattttgcttgaacaatgtta

SEQ ID NO: 212556 - DNA, 25 bp, Homo sapien
ttcaggttcttgtttaagtacattt

SEQ ID NO: 212557 - DNA, 25 bp, Homo sapien
agtcattttgcctatgtttctacaa

SEQ ID NO: 212558 - DNA, 25 bp, Homo sapien
ttgcctatgtttctacaatgaagtg

SEQ ID NO: 212559 - DNA, 25 bp, Homo sapien
cttcacacagtttccctactgtatg

SEQ ID NO: 212560 - DNA, 25 bp, Homo sapien
gtttccctactgtatgtagaatcca

SEQ ID NO: 212561 - DNA, 25 bp, Homo sapien
ggtgctgaaaccaagtgtttctttt

SEQ ID NO: 212562 - DNA, 25 bp, Homo sapien
aaccaagtgtttcttttcccatgct

SEQ ID NO: 212563 - DNA, 25 bp, Homo sapien
tttttccagtcttaagctctgtcca

SEQ ID NO: 212564 - DNA, 25 bp, Homo sapien
ttaagctctgtccaccttcaagtca

SEQ ID NO: 212565 - DNA, 25 bp, Homo sapien
ctgtccaccttcaagtcaattcata

SEQ ID NO: 212566 - DNA, 25 bp, Homo sapien
tcaagtcaattcataaccaagtttt

SEQ ID NO: 212567 - DNA, 25 bp, Homo sapien
gaacgctgctatgaattgcactgtg

SEQ ID NO: 212568 - DNA, 25 bp, Homo sapien
tgcactgtgaaaagcactcttccct

SEQ ID NO: 212569 - DNA, 25 bp, Homo sapien
aaaagcactcttccctctcagtttt

SEQ ID NO: 212570 - DNA, 25 bp, Homo sapien
ctggccaaggcctgtggacgacgct

SEQ ID NO: 212571 - DNA, 25 bp, Homo sapien
ggtgccagtgggaagcctgatgggt

SEQ ID NO: 212572 - DNA, 25 bp, Homo sapien
ccagtgggaagcctgatgggtgctg

SEQ ID NO: 212573 - DNA, 25 bp, Homo sapien
gggaagcctgatgggtgctggtggc

SEQ ID NO: 212574 - DNA, 25 bp, Homo sapien
tctgaaagagcagcacttctcagct

SEQ ID NO: 212575 - DNA, 25 bp, Homo sapien
ctgaaagagcagcacttctcagcta

SEQ ID NO: 212576 - DNA, 25 bp, Homo sapien
tgaaagagcagcacttctcagctat

SEQ ID NO: 212577 - DNA, 25 bp, Homo sapien
gaaagagcagcacttctcagctatt

SEQ ID NO: 212578 - DNA, 25 bp, Homo sapien
aaagagcagcacttctcagctatta

SEQ ID NO: 212579 - DNA, 25 bp, Homo sapien
aagagcagcacttctcagctattaa

SEQ ID NO: 212580 - DNA, 25 bp, Homo sapien
agagcagcacttctcagctattaaa

SEQ ID NO: 212581 - DNA, 25 bp, Homo sapien
aagtgcttccggctccaggaaataa

SEQ ID NO: 212582 - DNA, 25 bp, Homo sapien
ggaaataaccattcatgtgtttgct

SEQ ID NO: 212583 - DNA, 25 bp, Homo sapien
tgtttgctggaggtcacacaatttt

SEQ ID NO: 212584 - DNA, 25 bp, Homo sapien
gaggtcacacaattttcccctatta

SEQ ID NO: 212585 - DNA, 25 bp, Homo sapien
tttcccctattacctggtgcaaaat

SEQ ID NO: 212586 - DNA, 25 bp, Homo sapien
aaatgactcatcacttcccaaaagc

SEQ ID NO: 212587 - DNA, 25 bp, Homo sapien
caaaagcttcttttcaaaccacgat

SEQ ID NO: 212588 - DNA, 25 bp, Homo sapien
tcaaaccacgattttcccatttatt

SEQ ID NO: 212589 - DNA, 25 bp, Homo sapien
tattttggtccaatgcagtcccatt

SEQ ID NO: 212590 - DNA, 25 bp, Homo sapien
gcagtcccattctttatggcctata

SEQ ID NO: 212591 - DNA, 25 bp, Homo sapien
ttatggcctatagtctcactcccaa

SEQ ID NO: 212592 - DNA, 25 bp, Homo sapien
tgtccaggaacttacccatttcttc

SEQ ID NO: 212593 - DNA, 25 bp, Homo sapien
gaggtgtttgtagtatcccctgaag

SEQ ID NO: 212594 - DNA, 25 bp, Homo sapien
ggtgtttgtagtatcccctgaaggt

SEQ ID NO: 212595 - DNA, 25 bp, Homo sapien
gtgtttgtagtatcccctgaaggta

SEQ ID NO: 212596 - DNA, 25 bp, Homo sapien
tgtttgtagtatcccctgaaggtaa

SEQ ID NO: 212597 - DNA, 25 bp, Homo sapien
ttgtagtatcccctgaaggtaattt

SEQ ID NO: 212598 - DNA, 25 bp, Homo sapien
gtagtatcccctgaaggtaatttgt

SEQ ID NO: 212599 - DNA, 25 bp, Homo sapien
agtatcccctgaaggtaatttgtat

SEQ ID NO: 212600 - DNA, 25 bp, Homo sapien
tatcccctgaaggtaatttgtattt

SEQ ID NO: 212601 - DNA, 25 bp, Homo sapien
tattagtctagctagtggtctatct

SEQ ID NO: 212602 - DNA, 25 bp, Homo sapien
agctagtggtctatctattttgttg

SEQ ID NO: 212603 - DNA, 25 bp, Homo sapien
aaaagacactagaatgctgttctta

SEQ ID NO: 212604 - DNA, 25 bp, Homo sapien
agacactagaatgctgttcttaatt

SEQ ID NO: 212605 - DNA, 25 bp, Homo sapien
agataggtgttagtgtggtctgttc

SEQ ID NO: 212606 - DNA, 25 bp, Homo sapien
tctttacctccctttatttggtgca

SEQ ID NO: 212607 - DNA, 25 bp, Homo sapien
tttacctccctttatttggtgcaga

SEQ ID NO: 212608 - DNA, 25 bp, Homo sapien
tacctccctttatttggtgcagaga

SEQ ID NO: 212609 - DNA, 25 bp, Homo sapien
acctccctttatttggtgcagagaa

SEQ ID NO: 212610 - DNA, 25 bp, Homo sapien
ctccctttatttggtgcagagaagt

SEQ ID NO: 212611 - DNA, 25 bp, Homo sapien
ccctttatttggtgcagagaagtta

SEQ ID NO: 212612 - DNA, 25 bp, Homo sapien
tcctgctaaatttcaattaagaggg

SEQ ID NO: 212613 - DNA, 25 bp, Homo sapien
aggatcaatctcttatttaaccctg

SEQ ID NO: 212614 - DNA, 25 bp, Homo sapien
agactgagtagtattcttggataca

SEQ ID NO: 212615 - DNA, 25 bp, Homo sapien
cttggatacaggctgatgtgtactt

SEQ ID NO: 212616 - DNA, 25 bp, Homo sapien
atgtgtacttaaccacttccagatt

SEQ ID NO: 212617 - DNA, 25 bp, Homo sapien
aaccacttccagatttatacagtct

SEQ ID NO: 212618 - DNA, 25 bp, Homo sapien
gatttatacagtcttcctgtggaag

SEQ ID NO: 212619 - DNA, 25 bp, Homo sapien
tccctcctttcttctagtaatgcag

SEQ ID NO: 212620 - DNA, 25 bp, Homo sapien
aatgcagttcatgggctttaggtac

SEQ ID NO: 212621 - DNA, 25 bp, Homo sapien
catgggctttaggtacttcagttat

SEQ ID NO: 212622 - DNA, 25 bp, Homo sapien
cttcagttatgaagtaggcttttca

SEQ ID NO: 212623 - DNA, 25 bp, Homo sapien
ttgggattatgctttctgttgttta

SEQ ID NO: 212624 - DNA, 25 bp, Homo sapien
aaactgtttgattttagagtctatt

SEQ ID NO: 212625 - DNA, 25 bp, Homo sapien
tcttctgtttgctaatctttgtccc

SEQ ID NO: 212626 - DNA, 25 bp, Homo sapien
gctaatctttgtccctcacaatttt

SEQ ID NO: 212627 - DNA, 25 bp, Homo sapien
ttatttttcttcaacttctcttgat

SEQ ID NO: 212628 - DNA, 25 bp, Homo sapien
acttctcttgatttgacctcagtgc

SEQ ID NO: 212629 - DNA, 25 bp, Homo sapien
atttgacctcagtgctttgaattca

SEQ ID NO: 212630 - DNA, 25 bp, Homo sapien
aattcactggtgctacaatatgtaa

SEQ ID NO: 212631 - DNA, 25 bp, Homo sapien
gtaactgtggttaattgccttgtaa

SEQ ID NO: 212632 - DNA, 25 bp, Homo sapien
aattttgcgtgtctgtatactttta

SEQ ID NO: 212633 - DNA, 25 bp, Homo sapien
taccaacttattgtaggctctttga

SEQ ID NO: 212634 - DNA, 25 bp, Homo sapien
ggtcaggtatgtatttctttcccat

SEQ ID NO: 212635 - DNA, 25 bp, Homo sapien
gatagtattttgtacataccagttg

SEQ ID NO: 212636 - DNA, 25 bp, Homo sapien
gtagtacaaggtgctttaatgggat

SEQ ID NO: 212637 - DNA, 25 bp, Homo sapien
gcatatcaatatctataactgcatt

SEQ ID NO: 212638 - DNA, 25 bp, Homo sapien
ataactgcattttgtgctagacaat

SEQ ID NO: 212639 - DNA, 25 bp, Homo sapien
gctagacaattactgttcttttctc

SEQ ID NO: 212640 - DNA, 25 bp, Homo sapien
gtatatgtcaatttacaaggccagg

SEQ ID NO: 212641 - DNA, 25 bp, Homo sapien
gtcaatttacaaggccagggataga

SEQ ID NO: 212642 - DNA, 25 bp, Homo sapien
gatagaaaacactccataattgctt

SEQ ID NO: 212643 - DNA, 25 bp, Homo sapien
ttgctttccttgattttgctgagga

SEQ ID NO: 212644 - DNA, 25 bp, Homo sapien
tttgctgaggatttggtatgatttt

SEQ ID NO: 212645 - DNA, 25 bp, Homo sapien
ttttcctcttgcaacaatgacggtg

SEQ ID NO: 212646 - DNA, 25 bp, Homo sapien
atgacggtgcatgttcttataaata

SEQ ID NO: 212647 - DNA, 25 bp, Homo sapien
gatcacaatttacaattccgcattt

SEQ ID NO: 212648 - DNA, 25 bp, Homo sapien
ttaagtgcagtctggcttccccaaa

SEQ ID NO: 212649 - DNA, 25 bp, Homo sapien
aaatccaagagccttcttagcccag

SEQ ID NO: 212650 - DNA, 25 bp, Homo sapien
gtttctggcatgcaggaagcataca

SEQ ID NO: 212651 - DNA, 25 bp, Homo sapien
ggcacggaatggtagcaagtcatct

SEQ ID NO: 212652 - DNA, 25 bp, Homo sapien
gcaagtcatctaggctctgaggcat

SEQ ID NO: 212653 - DNA, 25 bp, Homo sapien
taaccctgaaaacgtccacttggag

SEQ ID NO: 212654 - DNA, 25 bp, Homo sapien
cgtccacttggagggcaagagccaa

SEQ ID NO: 212655 - DNA, 25 bp, Homo sapien
tattatacacactgtctctcagctc

SEQ ID NO: 212656 - DNA, 25 bp, Homo sapien
gctcaaatatgtatgctctcactcc

SEQ ID NO: 212657 - DNA, 25 bp, Homo sapien
atgctctcactccaagttcagatca

SEQ ID NO: 212658 - DNA, 25 bp, Homo sapien
tttagcaggctgttaatttcccatc

SEQ ID NO: 212659 - DNA, 25 bp, Homo sapien
agcaggctgttaatttcccatctat

SEQ ID NO: 212660 - DNA, 25 bp, Homo sapien
caggctgttaatttcccatctatga

SEQ ID NO: 212661 - DNA, 25 bp, Homo sapien
ggctgttaatttcccatctatgaat

SEQ ID NO: 212662 - DNA, 25 bp, Homo sapien
atttcccatctatgaatagcacttt

SEQ ID NO: 212663 - DNA, 25 bp, Homo sapien
gaatagcactttatgatgtaggcta

SEQ ID NO: 212664 - DNA, 25 bp, Homo sapien
aataatgcagcgttatgtggatcat

SEQ ID NO: 212665 - DNA, 25 bp, Homo sapien
atgcagcgttatgtggatcattatg

SEQ ID NO: 212666 - DNA, 25 bp, Homo sapien
gcgttatgtggatcattatgcaata

SEQ ID NO: 212667 - DNA, 25 bp, Homo sapien
tgcaataaagctgctaaagtcacat

SEQ ID NO: 212668 - DNA, 25 bp, Homo sapien
gtgaagctttaacaggaataggata

SEQ ID NO: 212669 - DNA, 25 bp, Homo sapien
tttttgaaggccatggcttttcaca

SEQ ID NO: 212670 - DNA, 25 bp, Homo sapien
ggcttttcacacagttattttattt

SEQ ID NO: 212671 - DNA, 25 bp, Homo sapien
ttttatgacgttatctgaaagcaga

SEQ ID NO: 212672 - DNA, 25 bp, Homo sapien
gaaagcagactgttaggagcagtat

SEQ ID NO: 212673 - DNA, 25 bp, Homo sapien
gagcagtattgagtggctgtcacac

SEQ ID NO: 212674 - DNA, 25 bp, Homo sapien
ggctgtcacactttgaggcaactaa

SEQ ID NO: 212675 - DNA, 25 bp, Homo sapien
gaggcaactaaaaaggcttcaaacg

SEQ ID NO: 212676 - DNA, 25 bp, Homo sapien
ggcttcaaacgttttgatcagtttc

SEQ ID NO: 212677 - DNA, 25 bp, Homo sapien
gatcagtttcttttcaggaaacatt

SEQ ID NO: 212678 - DNA, 25 bp, Homo sapien
tcaggaaacattgtgctctaacagt

SEQ ID NO: 212679 - DNA, 25 bp, Homo sapien
gtgctctaacagtatgactattctt

SEQ ID NO: 212680 - DNA, 25 bp, Homo sapien
ggatgaccacactagcacagaagag

SEQ ID NO: 212681 - DNA, 25 bp, Homo sapien
ttaaagcaggtgattcctcccttgg

SEQ ID NO: 212682 - DNA, 25 bp, Homo sapien
gagctctctcagtgtgaacatgcct

SEQ ID NO: 212683 - DNA, 25 bp, Homo sapien
catgccttctgtgggcggaaatcag

SEQ ID NO: 212684 - DNA, 25 bp, Homo sapien
ggaaatcaggaagccaccagctgtt

SEQ ID NO: 212685 - DNA, 25 bp, Homo sapien
ggaagccaccagctgttaatggaga

SEQ ID NO: 212686 - DNA, 25 bp, Homo sapien
ggagagtgccttgcttttatttcag

SEQ ID NO: 212687 - DNA, 25 bp, Homo sapien
tatttcagacagcagagttttccaa

SEQ ID NO: 212688 - DNA, 25 bp, Homo sapien
agttttccaaagtttctctgctcct

SEQ ID NO: 212689 - DNA, 25 bp, Homo sapien
gctcctctaacagcattgctcttta

SEQ ID NO: 212690 - DNA, 25 bp, Homo sapien
tgctctttagtgtgtgttaacctgt

SEQ ID NO: 212691 - DNA, 25 bp, Homo sapien
attcatcctttcatgactgtggcct

SEQ ID NO: 212692 - DNA, 25 bp, Homo sapien
gatttagcacactctcagttattta

SEQ ID NO: 212693 - DNA, 25 bp, Homo sapien
cttgagtatgtatgttgaggccatc

SEQ ID NO: 212694 - DNA, 25 bp, Homo sapien
gaggccatctgagctcatagctgat

SEQ ID NO: 212695 - DNA, 25 bp, Homo sapien
atagctgattcagtaaccagtttca

SEQ ID NO: 212696 - DNA, 25 bp, Homo sapien
aaccagtttcatgctgtgtcattca

SEQ ID NO: 212697 - DNA, 25 bp, Homo sapien
catgctgtgtcattcacactcacta

SEQ ID NO: 212698 - DNA, 25 bp, Homo sapien
ttcacactcactacttaatactgcc

SEQ ID NO: 212699 - DNA, 25 bp, Homo sapien
actacttaatactgccatggtgaaa

SEQ ID NO: 212700 - DNA, 25 bp, Homo sapien
tgggaagcatatacacttgtacatt

SEQ ID NO: 212701 - DNA, 25 bp, Homo sapien
aaacctagaaattgtattcatcctt

SEQ ID NO: 212702 - DNA, 25 bp, Homo sapien
aaagactgctcgacaggcctgcaag

SEQ ID NO: 212703 - DNA, 25 bp, Homo sapien
ctgcaaggcaggactacttttgtga

SEQ ID NO: 212704 - DNA, 25 bp, Homo sapien
gaatttgaagaccatgccgacctgt

SEQ ID NO: 212705 - DNA, 25 bp, Homo sapien
gaccatgccgacctgtcatttaaag

SEQ ID NO: 212706 - DNA, 25 bp, Homo sapien
tcatttaaagacacccatctctgcc

SEQ ID NO: 212707 - DNA, 25 bp, Homo sapien
atttgccaagttctgggttgtctca

SEQ ID NO: 212708 - DNA, 25 bp, Homo sapien
gccaagttctgggttgtctcataat

SEQ ID NO: 212709 - DNA, 25 bp, Homo sapien
ggttgtctcataattatttactcag

SEQ ID NO: 212710 - DNA, 25 bp, Homo sapien
acaaaataataccagccatgatcct

SEQ ID NO: 212711 - DNA, 25 bp, Homo sapien
catgatcctcagtggtaagtagcag

SEQ ID NO: 212712 - DNA, 25 bp, Homo sapien
ggctgtgctaataaagtgctgtaaa

SEQ ID NO: 212713 - DNA, 25 bp, Homo sapien
agagcccagtatctccactaggtgg

SEQ ID NO: 212714 - DNA, 25 bp, Homo sapien
gtatctccactaggtggctagactg

SEQ ID NO: 212715 - DNA, 25 bp, Homo sapien
ctaggtggctagactgagaagagca

SEQ ID NO: 212716 - DNA, 25 bp, Homo sapien
tgcagtccagctctcaggaagccct

SEQ ID NO: 212717 - DNA, 25 bp, Homo sapien
agtccagctctcaggaagccctatc

SEQ ID NO: 212718 - DNA, 25 bp, Homo sapien
aaaggagcaccctatgggacacaag

SEQ ID NO: 212719 - DNA, 25 bp, Homo sapien
gcaccctatgggacacaagaatgtg

SEQ ID NO: 212720 - DNA, 25 bp, Homo sapien
acaagaatgtgaacagcagccctta

SEQ ID NO: 212721 - DNA, 25 bp, Homo sapien
atgtgaacagcagcccttaagtcaa

SEQ ID NO: 212722 - DNA, 25 bp, Homo sapien
acagcagcccttaagtcaaatatct

SEQ ID NO: 212723 - DNA, 25 bp, Homo sapien
aatatcttccccctgacataatcta

SEQ ID NO: 212724 - DNA, 25 bp, Homo sapien
gactctgaaatcaaccttacaaatg

SEQ ID NO: 212725 - DNA, 25 bp, Homo sapien
gatatcatcagggttccggtgttca

SEQ ID NO: 212726 - DNA, 25 bp, Homo sapien
ggttccggtgttcaacattgtcatt

SEQ ID NO: 212727 - DNA, 25 bp, Homo sapien
attctcctggctggtggattcctga

SEQ ID NO: 212728 - DNA, 25 bp, Homo sapien
tggattcctgagtaagagcctggtc

SEQ ID NO: 212729 - DNA, 25 bp, Homo sapien
ctggtcttctctgtcctgtttgctg

SEQ ID NO: 212730 - DNA, 25 bp, Homo sapien
ctgtttgctgtcacgctgaggtcat

SEQ ID NO: 212731 - DNA, 25 bp, Homo sapien
tgaggtcatttgtaccctaggccca

SEQ ID NO: 212732 - DNA, 25 bp, Homo sapien
taggcccacgaacccacgagaatgt

SEQ ID NO: 212733 - DNA, 25 bp, Homo sapien
acgagaatgtcctctgacttccagc

SEQ ID NO: 212734 - DNA, 25 bp, Homo sapien
agccacatccatctggcagttgtgc

SEQ ID NO: 212735 - DNA, 25 bp, Homo sapien
ggagccgctagtgaaaatctggcat

SEQ ID NO: 212736 - DNA, 25 bp, Homo sapien
ggtggctctaagtaaaactgggatt

SEQ ID NO: 212737 - DNA, 25 bp, Homo sapien
gacagtagtggtgcatctggtcctt

SEQ ID NO: 212738 - DNA, 25 bp, Homo sapien
tgagagccccaggagacatcggcta

SEQ ID NO: 212739 - DNA, 25 bp, Homo sapien
gacatcggctagagtgaccatggct

SEQ ID NO: 212740 - DNA, 25 bp, Homo sapien
tagagtgaccatggctatgctcccg

SEQ ID NO: 212741 - DNA, 25 bp, Homo sapien
tatgctcccgtctggaagatgccag

SEQ ID NO: 212742 - DNA, 25 bp, Homo sapien
gcctcccactgttttcagctgtgtc

SEQ ID NO: 212743 - DNA, 25 bp, Homo sapien
ccccagtccgtgtctttttagaatg

SEQ ID NO: 212744 - DNA, 25 bp, Homo sapien
ggagctctttttggaatatggtatg

SEQ ID NO: 212745 - DNA, 25 bp, Homo sapien
ggtatgttacttacggtcatgaact

SEQ ID NO: 212746 - DNA, 25 bp, Homo sapien
tggccacctgtctgcaagagaggcg

SEQ ID NO: 212747 - DNA, 25 bp, Homo sapien
tgtctgcaagagaggcggcccctgt

SEQ ID NO: 212748 - DNA, 25 bp, Homo sapien
agaggcggcccctgtgcttgcaacg

SEQ ID NO: 212749 - DNA, 25 bp, Homo sapien
cctgtgcttgcaacgcttacgtgtt

SEQ ID NO: 212750 - DNA, 25 bp, Homo sapien
ccttttccaaatgagtgctgtagct

SEQ ID NO: 212751 - DNA, 25 bp, Homo sapien
gctgtagctttagaagtggccctct

SEQ ID NO: 212752 - DNA, 25 bp, Homo sapien
tagaagtggccctctatagaaagaa

SEQ ID NO: 212753 - DNA, 25 bp, Homo sapien
aagtcaaaagatgaggccccttcta

SEQ ID NO: 212754 - DNA, 25 bp, Homo sapien
gtgttgacagtttgaggagtcgaat

SEQ ID NO: 212755 - DNA, 25 bp, Homo sapien
ggagtcgaattgagattcatcatca

SEQ ID NO: 212756 - DNA, 25 bp, Homo sapien
aagagcaatgcagcgtcgttaaaat

SEQ ID NO: 212757 - DNA, 25 bp, Homo sapien
ggatgcgaaccaaagcacagacgaa

SEQ ID NO: 212758 - DNA, 25 bp, Homo sapien
cacagacgaatgtgccccgacgatt

SEQ ID NO: 212759 - DNA, 25 bp, Homo sapien
ccgacgattcctccgagaacataat

SEQ ID NO: 212760 - DNA, 25 bp, Homo sapien
aatgaaatggcggaccttcctgcca

SEQ ID NO: 212761 - DNA, 25 bp, Homo sapien
gccagaggagcgcacagtcacccag

SEQ ID NO: 212762 - DNA, 25 bp, Homo sapien
gatgtgacacacacgttagggtcta

SEQ ID NO: 212763 - DNA, 25 bp, Homo sapien
caaggctggagtcccctttactgga

SEQ ID NO: 212764 - DNA, 25 bp, Homo sapien
tactggaccctaaacatgtctgcct

SEQ ID NO: 212765 - DNA, 25 bp, Homo sapien
tgccccgcaatcagacttagagaac

SEQ ID NO: 212766 - DNA, 25 bp, Homo sapien
actgtggacggtggaaagtcttatc

SEQ ID NO: 212767 - DNA, 25 bp, Homo sapien
aagtcttatcatgaccaggccatcc

SEQ ID NO: 212768 - DNA, 25 bp, Homo sapien
tgggcacagcgcagagcgcacagca

SEQ ID NO: 212769 - DNA, 25 bp, Homo sapien
ggcacagcgcagagcgcacagcaag

SEQ ID NO: 212770 - DNA, 25 bp, Homo sapien
cagcgcagagcgcacagcaagactc

SEQ ID NO: 212771 - DNA, 25 bp, Homo sapien
gcgcagagcgcacagcaagactccg

SEQ ID NO: 212772 - DNA, 25 bp, Homo sapien
gagctttaaaccttggtctttcttg

SEQ ID NO: 212773 - DNA, 25 bp, Homo sapien
taaaccttggtctttcttgaatcca

SEQ ID NO: 212774 - DNA, 25 bp, Homo sapien
tttcttgaatccaaaattccatctt

SEQ ID NO: 212775 - DNA, 25 bp, Homo sapien
aaattccatcttcttttcattatac

SEQ ID NO: 212776 - DNA, 25 bp, Homo sapien
ttccatcttcttttcattataccat

SEQ ID NO: 212777 - DNA, 25 bp, Homo sapien
cattataccatgctgattgaaaata

SEQ ID NO: 212778 - DNA, 25 bp, Homo sapien
atgctgattgaaaataactatgctt

SEQ ID NO: 212779 - DNA, 25 bp, Homo sapien
agaaacacttgcttacagaccgaaa

SEQ ID NO: 212780 - DNA, 25 bp, Homo sapien
gcttacagaccgaaactggcatctt

SEQ ID NO: 212781 - DNA, 25 bp, Homo sapien
gaaactggcatcttactcttggcac

SEQ ID NO: 212782 - DNA, 25 bp, Homo sapien
ttactcttggcaccttgacttgcac

SEQ ID NO: 212783 - DNA, 25 bp, Homo sapien
ttgcaccctctgaggttccaactca

SEQ ID NO: 212784 - DNA, 25 bp, Homo sapien
aactcagtcattctttgtccagcag

SEQ ID NO: 212785 - DNA, 25 bp, Homo sapien
agaatcagaaatgagcccttcagga

SEQ ID NO: 212786 - DNA, 25 bp, Homo sapien
tcaggattaatcctcttgcaccagc

SEQ ID NO: 212787 - DNA, 25 bp, Homo sapien
tctcagagaaatgctgggtatccct

SEQ ID NO: 212788 - DNA, 25 bp, Homo sapien
cctggtaatggccacagttattgtt

SEQ ID NO: 212789 - DNA, 25 bp, Homo sapien
ttaaatgccaacactgtcttctcat

SEQ ID NO: 212790 - DNA, 25 bp, Homo sapien
tgtatagaaaacatattttgggccg

SEQ ID NO: 212791 - DNA, 25 bp, Homo sapien
gtatagaaaacatattttgggccgg

SEQ ID NO: 212792 - DNA, 25 bp, Homo sapien
tatagaaaacatattttgggccggg

SEQ ID NO: 212793 - DNA, 25 bp, Homo sapien
tagaaaacatattttgggccgggca

SEQ ID NO: 212794 - DNA, 25 bp, Homo sapien
agaaaacatattttgggccgggcat

SEQ ID NO: 212795 - DNA, 25 bp, Homo sapien
gaaaacatattttgggccgggcatg

SEQ ID NO: 212796 - DNA, 25 bp, Homo sapien
aaaacatattttgggccgggcatgg

SEQ ID NO: 212797 - DNA, 25 bp, Homo sapien
aaacatattttgggccgggcatggt

SEQ ID NO: 212798 - DNA, 25 bp, Homo sapien
aacatattttgggccgggcatggtg

SEQ ID NO: 212799 - DNA, 25 bp, Homo sapien
acatattttgggccgggcatggtgg

SEQ ID NO: 212800 - DNA, 25 bp, Homo sapien
atatttgaggaccatagtttcttgt

SEQ ID NO: 212801 - DNA, 25 bp, Homo sapien
gaggaccatagtttcttgttaacat

SEQ ID NO: 212802 - DNA, 25 bp, Homo sapien
ggctataagcacttggaattgtact

SEQ ID NO: 212803 - DNA, 25 bp, Homo sapien
gaattgtactgggttttctgtaaag

SEQ ID NO: 212804 - DNA, 25 bp, Homo sapien
gaaactagctacataagtactttga

SEQ ID NO: 212805 - DNA, 25 bp, Homo sapien
gtactttgatactgctcatgctgac

SEQ ID NO: 212806 - DNA, 25 bp, Homo sapien
gatactgctcatgctgacttaaaac

SEQ ID NO: 212807 - DNA, 25 bp, Homo sapien
gctgacttaaaacactagcagtaaa

SEQ ID NO: 212808 - DNA, 25 bp, Homo sapien
cactagcagtaaaacgctgtaaact

SEQ ID NO: 212809 - DNA, 25 bp, Homo sapien
atggatctactgacattagcacttt

SEQ ID NO: 212810 - DNA, 25 bp, Homo sapien
ctactgacattagcactttgtacag

SEQ ID NO: 212811 - DNA, 25 bp, Homo sapien
gtttattctctttaatggactgtaa

SEQ ID NO: 212812 - DNA, 25 bp, Homo sapien
taatcacaagagtgccaaatatctt

SEQ ID NO: 212813 - DNA, 25 bp, Homo sapien
ttctctgtgctctgagtccacgtac

SEQ ID NO: 212814 - DNA, 25 bp, Homo sapien
gtgctctgagtccacgtacaggaat

SEQ ID NO: 212815 - DNA, 25 bp, Homo sapien
tgagtccacgtacaggaatgcttgg

SEQ ID NO: 212816 - DNA, 25 bp, Homo sapien
gaatgcttggagtgtcttttctgtt

SEQ ID NO: 212817 - DNA, 25 bp, Homo sapien
ttctgttatttatagggattctctt

SEQ ID NO: 212818 - DNA, 25 bp, Homo sapien
agggattctcttaaggcacaccagc

SEQ ID NO: 212819 - DNA, 25 bp, Homo sapien
agctgcctgttttgcatggtatttg

SEQ ID NO: 212820 - DNA, 25 bp, Homo sapien
gcaaaaatgcctcttgcgtgaggaa

SEQ ID NO: 212821 - DNA, 25 bp, Homo sapien
gcgtgaggaaatcttttaccatttt

SEQ ID NO: 212822 - DNA, 25 bp, Homo sapien
ctagtttagcagaattcgttgtcct

SEQ ID NO: 212823 - DNA, 25 bp, Homo sapien
ttagcagaattcgttgtccttaggg

SEQ ID NO: 212824 - DNA, 25 bp, Homo sapien
gcagaattcgttgtccttagggagt

SEQ ID NO: 212825 - DNA, 25 bp, Homo sapien
gtccttagggagttggtaatatcac

SEQ ID NO: 212826 - DNA, 25 bp, Homo sapien
ggagttggtaatatcacctttggta

SEQ ID NO: 212827 - DNA, 25 bp, Homo sapien
ggtaatatcacctttggtatgactt

SEQ ID NO: 212828 - DNA, 25 bp, Homo sapien
aagcccattaacgatatattttaag

SEQ ID NO: 212829 - DNA, 25 bp, Homo sapien
agaatgcaggttattcatatattta

SEQ ID NO: 212830 - DNA, 25 bp, Homo sapien
cagcttgacagttgaaattacatgc

SEQ ID NO: 212831 - DNA, 25 bp, Homo sapien
gacagttgaaattacatgctaacat

SEQ ID NO: 212832 - DNA, 25 bp, Homo sapien
ataatatgtataggcttgtttaaag

SEQ ID NO: 212833 - DNA, 25 bp, Homo sapien
tggaagctagtgattctgaatgata

SEQ ID NO: 212834 - DNA, 25 bp, Homo sapien
atatccattgcatgttgaactcctt

SEQ ID NO: 212835 - DNA, 25 bp, Homo sapien
gcatgttgaactcctttagaatttt

SEQ ID NO: 212836 - DNA, 25 bp, Homo sapien
aagttggagtgtttatgattattgc

SEQ ID NO: 212837 - DNA, 25 bp, Homo sapien
aagaaggcagacttcatattctcat

SEQ ID NO: 212838 - DNA, 25 bp, Homo sapien
acttcatattctcatcgcccatttt

SEQ ID NO: 212839 - DNA, 25 bp, Homo sapien
tctcatcgcccatttttcaaacttg

SEQ ID NO: 212840 - DNA, 25 bp, Homo sapien
caaacttgttacattgatctgtaca

SEQ ID NO: 212841 - DNA, 25 bp, Homo sapien
ttttaagccacatgtttgtaattgt

SEQ ID NO: 212842 - DNA, 25 bp, Homo sapien
gtggaaacattacacaatgtcctta

SEQ ID NO: 212843 - DNA, 25 bp, Homo sapien
gtccttaataaataggcccatgtaa

SEQ ID NO: 212844 - DNA, 25 bp, Homo sapien
gaatgggatgagcactcctacaaaa

SEQ ID NO: 212845 - DNA, 25 bp, Homo sapien
aaggattccagagagctcgcttgct

SEQ ID NO: 212846 - DNA, 25 bp, Homo sapien
cgcttgctccttccacagtgtgagg

SEQ ID NO: 212847 - DNA, 25 bp, Homo sapien
gggaaggctctgtctatgaatgaga

SEQ ID NO: 212848 - DNA, 25 bp, Homo sapien
tatgaatgagaaagtgggtccccac

SEQ ID NO: 212849 - DNA, 25 bp, Homo sapien
agtgggtccccaccagacattgaat

SEQ ID NO: 212850 - DNA, 25 bp, Homo sapien
gacattgaatctgccgcatcttgat

SEQ ID NO: 212851 - DNA, 25 bp, Homo sapien
ccgcatcttgatactggacttccag

SEQ ID NO: 212852 - DNA, 25 bp, Homo sapien
acctgtccagtatctttggtatttt

SEQ ID NO: 212853 - DNA, 25 bp, Homo sapien
ttgctatagcaacccaaatggacta

SEQ ID NO: 212854 - DNA, 25 bp, Homo sapien
gaaaacaccagaggccatacctaat

SEQ ID NO: 212855 - DNA, 25 bp, Homo sapien
aagcatgcttctattagtcacctaa

SEQ ID NO: 212856 - DNA, 25 bp, Homo sapien
ttctattagtcacctaaccctctgt

SEQ ID NO: 212857 - DNA, 25 bp, Homo sapien
gggccaagagtcacttctaataaac

SEQ ID NO: 212858 - DNA, 25 bp, Homo sapien
tatgctgcagccatgcatgtgaatg

SEQ ID NO: 212859 - DNA, 25 bp, Homo sapien
tgctggtgagatgcttcatgggact

SEQ ID NO: 212860 - DNA, 25 bp, Homo sapien
tctcctgctcagtctggccctgatg

SEQ ID NO: 212861 - DNA, 25 bp, Homo sapien
gatgctgcaactctggctccttggc

SEQ ID NO: 212862 - DNA, 25 bp, Homo sapien
tggctccttggctgagttcagtcct

SEQ ID NO: 212863 - DNA, 25 bp, Homo sapien
tgccctcagcttggataaccaggct

SEQ ID NO: 212864 - DNA, 25 bp, Homo sapien
ggctcagctcagctcccacaaatga

SEQ ID NO: 212865 - DNA, 25 bp, Homo sapien
aaatgacagccccttaagcatgctt

SEQ ID NO: 212866 - DNA, 25 bp, Homo sapien
gaactggctacggataaaagactga

SEQ ID NO: 212867 - DNA, 25 bp, Homo sapien
gtagcactatcagcttcattttgga

SEQ ID NO: 212868 - DNA, 25 bp, Homo sapien
atcagcttcattttggatagcagtt

SEQ ID NO: 212869 - DNA, 25 bp, Homo sapien
atacactgaacttgctgagactggt

SEQ ID NO: 212870 - DNA, 25 bp, Homo sapien
atctcttcctcatttcaatcaacat

SEQ ID NO: 212871 - DNA, 25 bp, Homo sapien
tcctttctctactttgactgctgtt

SEQ ID NO: 212872 - DNA, 25 bp, Homo sapien
gatacacattatcccctgcaaagag

SEQ ID NO: 212873 - DNA, 25 bp, Homo sapien
tatcccctgcaaagagcattgccat

SEQ ID NO: 212874 - DNA, 25 bp, Homo sapien
aagagcattgccatccattcaaacc

SEQ ID NO: 212875 - DNA, 25 bp, Homo sapien
gccatccattcaaaccagattaggt

SEQ ID NO: 212876 - DNA, 25 bp, Homo sapien
tgacaaccaggaagcaagattaatt

SEQ ID NO: 212877 - DNA, 25 bp, Homo sapien
ttctaagtgggagtcagcttgcccc

SEQ ID NO: 212878 - DNA, 25 bp, Homo sapien
ttgaggagccgaagtggagcccctt

SEQ ID NO: 212879 - DNA, 25 bp, Homo sapien
tgcctgtcttagttatggccctgta

SEQ ID NO: 212880 - DNA, 25 bp, Homo sapien
tatggccctgtatggaagagtgttt

SEQ ID NO: 212881 - DNA, 25 bp, Homo sapien
agagtgtttgagaaggaccctccac

SEQ ID NO: 212882 - DNA, 25 bp, Homo sapien
ttgagaaggaccctccacgcttagg

SEQ ID NO: 212883 - DNA, 25 bp, Homo sapien
cctccacgcttagggcagggatctg

SEQ ID NO: 212884 - DNA, 25 bp, Homo sapien
ggaaattccagtgatctcctttagc

SEQ ID NO: 212885 - DNA, 25 bp, Homo sapien
atctcctttagcagagcccttttag

SEQ ID NO: 212886 - DNA, 25 bp, Homo sapien
gcccttttaggattagcctggctaa

SEQ ID NO: 212887 - DNA, 25 bp, Homo sapien
aaagagatccgttagtgtctgttta

SEQ ID NO: 212888 - DNA, 25 bp, Homo sapien
gggtcatggtctgtgagaggtggca

SEQ ID NO: 212889 - DNA, 25 bp, Homo sapien
tgtgccctctggccgcactgtgagc

SEQ ID NO: 212890 - DNA, 25 bp, Homo sapien
tctggccgcactgtgagctggctgt

SEQ ID NO: 212891 - DNA, 25 bp, Homo sapien
cagccacagccaagggtggaggctt

SEQ ID NO: 212892 - DNA, 25 bp, Homo sapien
ccacagccaagggtggaggcttcag

SEQ ID NO: 212893 - DNA, 25 bp, Homo sapien
ggtggaggcttcaggtctccagctt

SEQ ID NO: 212894 - DNA, 25 bp, Homo sapien
tggaggcttcaggtctccagcttct

SEQ ID NO: 212895 - DNA, 25 bp, Homo sapien
cttcaggtctccagcttctctgctt

SEQ ID NO: 212896 - DNA, 25 bp, Homo sapien
tgcttctcagctgccatctccagtg

SEQ ID NO: 212897 - DNA, 25 bp, Homo sapien
tctccagtgccccagaatggtacag

SEQ ID NO: 212898 - DNA, 25 bp, Homo sapien
ccagaatggtacagcgataataaaa

SEQ ID NO: 212899 - DNA, 25 bp, Homo sapien
gacagcacgctaataatgcaattac

SEQ ID NO: 212900 - DNA, 25 bp, Homo sapien
aattactgagagacaacttgacatt

SEQ ID NO: 212901 - DNA, 25 bp, Homo sapien
gacattgtggacatcggatacccaa

SEQ ID NO: 212902 - DNA, 25 bp, Homo sapien
ggatacccaaggagacgaagctgaa

SEQ ID NO: 212903 - DNA, 25 bp, Homo sapien
taaccggccttccaacttttgtctg

SEQ ID NO: 212904 - DNA, 25 bp, Homo sapien
acttttgtctgcctcattctaaaat

SEQ ID NO: 212905 - DNA, 25 bp, Homo sapien
gtctgcctcattctaaaatttacac

SEQ ID NO: 212906 - DNA, 25 bp, Homo sapien
gtagaccatttgtcatccatgctgt

SEQ ID NO: 212907 - DNA, 25 bp, Homo sapien
tccatgctgtcccacaaatagtttt

SEQ ID NO: 212908 - DNA, 25 bp, Homo sapien
gtttacgatttatgacaggtttatg

SEQ ID NO: 212909 - DNA, 25 bp, Homo sapien
acaggtttatgttacttctatttga

SEQ ID NO: 212910 - DNA, 25 bp, Homo sapien
gttatatgaacccaaatatgagcat

SEQ ID NO: 212911 - DNA, 25 bp, Homo sapien
tgagcatcatttatctctggtgaga

SEQ ID NO: 212912 - DNA, 25 bp, Homo sapien
gtctttttgtttatccttatcttct

SEQ ID NO: 212913 - DNA, 25 bp, Homo sapien
tatccttatcttctaatctgcctac

SEQ ID NO: 212914 - DNA, 25 bp, Homo sapien
atctgcctacaagtcaaattgctgg

SEQ ID NO: 212915 - DNA, 25 bp, Homo sapien
tttccctataattcctatggctcag

SEQ ID NO: 212916 - DNA, 25 bp, Homo sapien
ggtcatgagacctaaaattgtaaat

SEQ ID NO: 212917 - DNA, 25 bp, Homo sapien
gtagaagcaaagaagaccaccagtt

SEQ ID NO: 212918 - DNA, 25 bp, Homo sapien
caaagaagaccaccagttcaccaac

SEQ ID NO: 212919 - DNA, 25 bp, Homo sapien
ggtgaggcacaatctgggactgaat

SEQ ID NO: 212920 - DNA, 25 bp, Homo sapien
ctgaatccatcatctagcctttaga

SEQ ID NO: 212921 - DNA, 25 bp, Homo sapien
aacaccagattttcacacggcaaag

SEQ ID NO: 212922 - DNA, 25 bp, Homo sapien
cagattttcacacggcaaaggcaat

SEQ ID NO: 212923 - DNA, 25 bp, Homo sapien
acggcaaaggcaatatgtttttata

SEQ ID NO: 212924 - DNA, 25 bp, Homo sapien
aatactgatcaatgtgaacttttct

SEQ ID NO: 212925 - DNA, 25 bp, Homo sapien
gtgaacttttctaaatactctattg

SEQ ID NO: 212926 - DNA, 25 bp, Homo sapien
ataattgtgctgaaatctatttcct

SEQ ID NO: 212927 - DNA, 25 bp, Homo sapien
gatttttgaaaagtcagccttgtgg

SEQ ID NO: 212928 - DNA, 25 bp, Homo sapien
ccttgtgggatgaaaaatatgtctt

SEQ ID NO: 212929 - DNA, 25 bp, Homo sapien
atatgtcttactggaaaaatccctc

SEQ ID NO: 212930 - DNA, 25 bp, Homo sapien
gaaaaatccctcataataacctaat

SEQ ID NO: 212931 - DNA, 25 bp, Homo sapien
aataacctaatagggcattgctatt

SEQ ID NO: 212932 - DNA, 25 bp, Homo sapien
gggtcatggtctgtgagaggtggca

SEQ ID NO: 212933 - DNA, 25 bp, Homo sapien
catggtctgtgagaggtggcaggaa

SEQ ID NO: 212934 - DNA, 25 bp, Homo sapien
aggtggcaggaatggggaccctcac

SEQ ID NO: 212935 - DNA, 25 bp, Homo sapien
tgtgccctctggccgcactgtgagc

SEQ ID NO: 212936 - DNA, 25 bp, Homo sapien
gtgccctctggccgcactgtgagct

SEQ ID NO: 212937 - DNA, 25 bp, Homo sapien
ggtggaggcttcaggtctccagctt

SEQ ID NO: 212938 - DNA, 25 bp, Homo sapien
gtggaggcttcaggtctccagcttc

SEQ ID NO: 212939 - DNA, 25 bp, Homo sapien
tggaggcttcaggtctccagcttct

SEQ ID NO: 212940 - DNA, 25 bp, Homo sapien
ccagaatggtacagcgataataaaa

SEQ ID NO: 212941 - DNA, 25 bp, Homo sapien
cagaatggtacagcgataataaaat

SEQ ID NO: 212942 - DNA, 25 bp, Homo sapien
gaatggtacagcgataataaaatgt

SEQ ID NO: 212943 - DNA, 25 bp, Homo sapien
gggacctaaagaccagcaaccatac

SEQ ID NO: 212944 - DNA, 25 bp, Homo sapien
gcaaccatactgaaacaagtctagg

SEQ ID NO: 212945 - DNA, 25 bp, Homo sapien
agtctagggtaggtcttgaaacttg

SEQ ID NO: 212946 - DNA, 25 bp, Homo sapien
agagatcgtatctgtcatgacctgt

SEQ ID NO: 212947 - DNA, 25 bp, Homo sapien
gtatctgtcatgacctgtcaagagt

SEQ ID NO: 212948 - DNA, 25 bp, Homo sapien
ctgtcaagagtaattatctacccct

SEQ ID NO: 212949 - DNA, 25 bp, Homo sapien
ttttctccaaatatgtcagttgcta

SEQ ID NO: 212950 - DNA, 25 bp, Homo sapien
agttgctatgatgtttgtcccacca

SEQ ID NO: 212951 - DNA, 25 bp, Homo sapien
tgatgtttgtcccaccacgaggatc

SEQ ID NO: 212952 - DNA, 25 bp, Homo sapien
tttgagcaagtgcagatgtgtgtct

SEQ ID NO: 212953 - DNA, 25 bp, Homo sapien
gtgtgtctggtggtaatcaaataga

SEQ ID NO: 212954 - DNA, 25 bp, Homo sapien
tttccattatactttacagcctctt

SEQ ID NO: 212955 - DNA, 25 bp, Homo sapien
tactttacagcctcttttcatctgt

SEQ ID NO: 212956 - DNA, 25 bp, Homo sapien
gagcattggattagaggctctcaaa

SEQ ID NO: 212957 - DNA, 25 bp, Homo sapien
ggtctcttccagctcaaaaatattg

SEQ ID NO: 212958 - DNA, 25 bp, Homo sapien
gtcattcctgtgacattagtcgtaa

SEQ ID NO: 212959 - DNA, 25 bp, Homo sapien
ttcttgaagaggcagtataaccttt

SEQ ID NO: 212960 - DNA, 25 bp, Homo sapien
agaggcagtataacctttgcaaggt

SEQ ID NO: 212961 - DNA, 25 bp, Homo sapien
gagaatatcatcaggcgaggtgcta

SEQ ID NO: 212962 - DNA, 25 bp, Homo sapien
tatcatcaggcgaggtgctatgtct

SEQ ID NO: 212963 - DNA, 25 bp, Homo sapien
atcaggcgaggtgctatgtctcagg

SEQ ID NO: 212964 - DNA, 25 bp, Homo sapien
cgaggtgctatgtctcaggcctgta

SEQ ID NO: 212965 - DNA, 25 bp, Homo sapien
ggaacaatccaacaccaatctagct

SEQ ID NO: 212966 - DNA, 25 bp, Homo sapien
caccaatctagctaaattccgcaag

SEQ ID NO: 212967 - DNA, 25 bp, Homo sapien
agtcccaggtgaacaaactgcgggt

SEQ ID NO: 212968 - DNA, 25 bp, Homo sapien
gaagagtgatcatgtcctgatgcca

SEQ ID NO: 212969 - DNA, 25 bp, Homo sapien
gtgatcatgtcctgatgccatggaa

SEQ ID NO: 212970 - DNA, 25 bp, Homo sapien
gtcctgatgccatggaatgactgaa

SEQ ID NO: 212971 - DNA, 25 bp, Homo sapien
gatgccatggaatgactgaagacag

SEQ ID NO: 212972 - DNA, 25 bp, Homo sapien
ttggtcatttccctctgtaattatt

SEQ ID NO: 212973 - DNA, 25 bp, Homo sapien
catttccctctgtaattattgtgta

SEQ ID NO: 212974 - DNA, 25 bp, Homo sapien
attattgtgtattctaccctgttgc

SEQ ID NO: 212975 - DNA, 25 bp, Homo sapien
ttgtgtattctaccctgttgcaaag

SEQ ID NO: 212976 - DNA, 25 bp, Homo sapien
gataaagctgtgtactgccgttgtt

SEQ ID NO: 212977 - DNA, 25 bp, Homo sapien
gtactgccgttgttggaggtccaaa

SEQ ID NO: 212978 - DNA, 25 bp, Homo sapien
gaggtccaaaaagttcccattctgt

SEQ ID NO: 212979 - DNA, 25 bp, Homo sapien
actggagacaatgtgggccctctga

SEQ ID NO: 212980 - DNA, 25 bp, Homo sapien
taaatggacacttttgatgctgcaa

SEQ ID NO: 212981 - DNA, 25 bp, Homo sapien
gctgcaaatcagcttgtcgtgaagt

SEQ ID NO: 212982 - DNA, 25 bp, Homo sapien
gtcgtgaagttacctgattgtttaa

SEQ ID NO: 212983 - DNA, 25 bp, Homo sapien
tagaatgactaccacctctgtctga

SEQ ID NO: 212984 - DNA, 25 bp, Homo sapien
attcaccttcgctggattctaaatg

SEQ ID NO: 212985 - DNA, 25 bp, Homo sapien
ttgcaaactgcagctttcacattta

SEQ ID NO: 212986 - DNA, 25 bp, Homo sapien
atggcatttgtcttgttgaaacatc

SEQ ID NO: 212987 - DNA, 25 bp, Homo sapien
cagcttctgatcttgactaagttca

SEQ ID NO: 212988 - DNA, 25 bp, Homo sapien
cttgactaagttcataattactcag

SEQ ID NO: 212989 - DNA, 25 bp, Homo sapien
tactcagggaaaaacactgctggtt

SEQ ID NO: 212990 - DNA, 25 bp, Homo sapien
aacactgctggttccttataagcca

SEQ ID NO: 212991 - DNA, 25 bp, Homo sapien
gctggttccttataagccactgtgc

SEQ ID NO: 212992 - DNA, 25 bp, Homo sapien
gccactgtgctgtacgaaatcaatt

SEQ ID NO: 212993 - DNA, 25 bp, Homo sapien
gtgctgtacgaaatcaattcatgaa

SEQ ID NO: 212994 - DNA, 25 bp, Homo sapien
tcaattcatgaaaaggaaacgccct

SEQ ID NO: 212995 - DNA, 25 bp, Homo sapien
ggaaacgccctatttccaagcatac

SEQ ID NO: 212996 - DNA, 25 bp, Homo sapien
tttccaagcatacctgtactagaat

SEQ ID NO: 212997 - DNA, 25 bp, Homo sapien
ttacttaatacccttactggaacat

SEQ ID NO: 212998 - DNA, 25 bp, Homo sapien
agtgacgaccgctgggagaacatca

SEQ ID NO: 212999 - DNA, 25 bp, Homo sapien
agaacatcaggtgcactgtggacgt

SEQ ID NO: 213000 - DNA, 25 bp, Homo sapien
gcccagcgagagcagaaccaatcca

SEQ ID NO: 213001 - DNA, 25 bp, Homo sapien
gaaccaatccagtcaggatgtcact

SEQ ID NO: 213002 - DNA, 25 bp, Homo sapien
ggatgtcactgactctaaatcaggt

SEQ ID NO: 213003 - DNA, 25 bp, Homo sapien
aatcaggtgattcaagatgcccaaa

SEQ ID NO: 213004 - DNA, 25 bp, Homo sapien
ctgaatgtcagaaccctgtctttta

SEQ ID NO: 213005 - DNA, 25 bp, Homo sapien
gtggtgctgccccagaaacttaaaa

SEQ ID NO: 213006 - DNA, 25 bp, Homo sapien
atttagtcgaggcagtttcaattgt

SEQ ID NO: 213007 - DNA, 25 bp, Homo sapien
tttcaattgttactgtggaccgaat

SEQ ID NO: 213008 - DNA, 25 bp, Homo sapien
tgttactgtggaccgaattaggatc

SEQ ID NO: 213009 - DNA, 25 bp, Homo sapien
aaagttgatcagagccttccagagt

SEQ ID NO: 213010 - DNA, 25 bp, Homo sapien
cttccagagtgtggtatgcttttca

SEQ ID NO: 213011 - DNA, 25 bp, Homo sapien
gtgtggtatgcttttcactgtgtga

SEQ ID NO: 213012 - DNA, 25 bp, Homo sapien
atgcttttcactgtgtgatgatcct

SEQ ID NO: 213013 - DNA, 25 bp, Homo sapien
gtgatgatccttagtggcacatgaa

SEQ ID NO: 213014 - DNA, 25 bp, Homo sapien
tggcacatgaatgaacgtccagatg

SEQ ID NO: 213015 - DNA, 25 bp, Homo sapien
gtccagatgtttgtgcagtagccca

SEQ ID NO: 213016 - DNA, 25 bp, Homo sapien
tgtttgtgcagtagcccacccttat

SEQ ID NO: 213017 - DNA, 25 bp, Homo sapien
ccttatctgcaggatacgttccaag

SEQ ID NO: 213018 - DNA, 25 bp, Homo sapien
ttttatgatacatacatgcctatga

SEQ ID NO: 213019 - DNA, 25 bp, Homo sapien
catgcctatgatgaagtttaatttc

SEQ ID NO: 213020 - DNA, 25 bp, Homo sapien
cgacataaactatgggtggacccaa

SEQ ID NO: 213021 - DNA, 25 bp, Homo sapien
cagttcttttggaggacccagttct

SEQ ID NO: 213022 - DNA, 25 bp, Homo sapien
tcttttggaggacccagttctttgt

SEQ ID NO: 213023 - DNA, 25 bp, Homo sapien
gcaaagaaacacaaacgaaccccag

SEQ ID NO: 213024 - DNA, 25 bp, Homo sapien
tgagcagcggatcagagagaacatc

SEQ ID NO: 213025 - DNA, 25 bp, Homo sapien
acatccaggtttttgaattccagtt

SEQ ID NO: 213026 - DNA, 25 bp, Homo sapien
ggatatgaaagttctagatggtcta

SEQ ID NO: 213027 - DNA, 25 bp, Homo sapien
gaaattatcgatatgttgtcatgga

SEQ ID NO: 213028 - DNA, 25 bp, Homo sapien
tgttgtcatggattttgttatggac

SEQ ID NO: 213029 - DNA, 25 bp, Homo sapien
tgttatggaccatcctgattatcca

SEQ ID NO: 213030 - DNA, 25 bp, Homo sapien
ggaccatcctgattatccattttca

SEQ ID NO: 213031 - DNA, 25 bp, Homo sapien
gctctaccctcagcggatgataatc

SEQ ID NO: 213032 - DNA, 25 bp, Homo sapien
gataatctcaagacacctgccgagt

SEQ ID NO: 213033 - DNA, 25 bp, Homo sapien
ctgccgagtgcctgctctatcccct

SEQ ID NO: 213034 - DNA, 25 bp, Homo sapien
tgataatctcaagacacctcccgag

SEQ ID NO: 213035 - DNA, 25 bp, Homo sapien
agctccaccctcagcggatgataat

SEQ ID NO: 213036 - DNA, 25 bp, Homo sapien
tctcaagacacctcctgagtgtgtc

SEQ ID NO: 213037 - DNA, 25 bp, Homo sapien
tcaagacacctcctgagtgtgtctg

SEQ ID NO: 213038 - DNA, 25 bp, Homo sapien
gacacctcctgagtgtgtctgctca

SEQ ID NO: 213039 - DNA, 25 bp, Homo sapien
acctcctgagtgtgtctgctcactc

SEQ ID NO: 213040 - DNA, 25 bp, Homo sapien
tgagtgtgtctgctcactccccttc

SEQ ID NO: 213041 - DNA, 25 bp, Homo sapien
ccttccaccctcagcggatgataat

SEQ ID NO: 213042 - DNA, 25 bp, Homo sapien
aaactattcagaagggctcctaata

SEQ ID NO: 213043 - DNA, 25 bp, Homo sapien
cagatttttatcacctgatcagcat

SEQ ID NO: 213044 - DNA, 25 bp, Homo sapien
gatcagcataacagaagtagccaaa

SEQ ID NO: 213045 - DNA, 25 bp, Homo sapien
gccaaaagtgacttactggtctcat

SEQ ID NO: 213046 - DNA, 25 bp, Homo sapien
tactggtctcatagttcttatttgc

SEQ ID NO: 213047 - DNA, 25 bp, Homo sapien
ttatttgcctacatttagagtctgt

SEQ ID NO: 213048 - DNA, 25 bp, Homo sapien
tagagtctgtagatgcatatgcaac

SEQ ID NO: 213049 - DNA, 25 bp, Homo sapien
aatacaactccatagccttgcaaaa

SEQ ID NO: 213050 - DNA, 25 bp, Homo sapien
tgcaacttgtgctctgtcttataaa

SEQ ID NO: 213051 - DNA, 25 bp, Homo sapien
aaggagtcatggctctctttcttgg

SEQ ID NO: 213052 - DNA, 25 bp, Homo sapien
tggccatccctctgtaatgaagttt

SEQ ID NO: 213053 - DNA, 25 bp, Homo sapien
gttacgccgtctcaagggcaaacat

SEQ ID NO: 213054 - DNA, 25 bp, Homo sapien
agggcaaacattccaccctaactcg

SEQ ID NO: 213055 - DNA, 25 bp, Homo sapien
taactcgccagagggtgaactgccc

SEQ ID NO: 213056 - DNA, 25 bp, Homo sapien
aatctaactgaaaacacttgccctt

SEQ ID NO: 213057 - DNA, 25 bp, Homo sapien
ttctcaagcctaacgagctgggcct

SEQ ID NO: 213058 - DNA, 25 bp, Homo sapien
tgccaccactgactacgatgacata

SEQ ID NO: 213059 - DNA, 25 bp, Homo sapien
aatatacctatgaaatccttcgaga

SEQ ID NO: 213060 - DNA, 25 bp, Homo sapien
aaatccttcgagatcttcactctca

SEQ ID NO: 213061 - DNA, 25 bp, Homo sapien
ttcactctcaagatccctgggaagc

SEQ ID NO: 213062 - DNA, 25 bp, Homo sapien
agatccctgggaagcgcacatacac

SEQ ID NO: 213063 - DNA, 25 bp, Homo sapien
ggaagagtcggtgttttagcaagaa

SEQ ID NO: 213064 - DNA, 25 bp, Homo sapien
ctctttgaaggcatggctggcgcta

SEQ ID NO: 213065 - DNA, 25 bp, Homo sapien
atggctggcgctattcactttctct

SEQ ID NO: 213066 - DNA, 25 bp, Homo sapien
gtcctgggaccagagacatcacggt

SEQ ID NO: 213067 - DNA, 25 bp, Homo sapien
gacatcacggtttccagcatttgaa

SEQ ID NO: 213068 - DNA, 25 bp, Homo sapien
gcatttgaacttgactcttcgaaga

SEQ ID NO: 213069 - DNA, 25 bp, Homo sapien
tttggaccaaaagccgccagattgc

SEQ ID NO: 213070 - DNA, 25 bp, Homo sapien
gccagattgcttagtgcctgacaca

SEQ ID NO: 213071 - DNA, 25 bp, Homo sapien
aggcccctctggttagactagcatg

SEQ ID NO: 213072 - DNA, 25 bp, Homo sapien
tagactagcatgagtgaccgaagcc

SEQ ID NO: 213073 - DNA, 25 bp, Homo sapien
gaccgaagccatccatcaacatttt

SEQ ID NO: 213074 - DNA, 25 bp, Homo sapien
tttctaacagcaccctcatcaatat

SEQ ID NO: 213075 - DNA, 25 bp, Homo sapien
atgaggtacactaattatgcagagt

SEQ ID NO: 213076 - DNA, 25 bp, Homo sapien
gggaggtgtttctagcccaacagat

SEQ ID NO: 213077 - DNA, 25 bp, Homo sapien
gcccaacagataggcatggaagctc

SEQ ID NO: 213078 - DNA, 25 bp, Homo sapien
tccactccattttcttacacaaggg

SEQ ID NO: 213079 - DNA, 25 bp, Homo sapien
gggaagccactatggtatagcatct

SEQ ID NO: 213080 - DNA, 25 bp, Homo sapien
gtatagcatctaacttaaggcatat

SEQ ID NO: 213081 - DNA, 25 bp, Homo sapien
gagtctaactttctgtggcaaggac

SEQ ID NO: 213082 - DNA, 25 bp, Homo sapien
aactttctgtggcaaggaccttctt

SEQ ID NO: 213083 - DNA, 25 bp, Homo sapien
aaggaccttcttgcagtagtaacat

SEQ ID NO: 213084 - DNA, 25 bp, Homo sapien
gtagtaacatagtctggaacacctc

SEQ ID NO: 213085 - DNA, 25 bp, Homo sapien
ggaacacctccaacataaattatga

SEQ ID NO: 213086 - DNA, 25 bp, Homo sapien
atgaccctgaggcacgaattctctg

SEQ ID NO: 213087 - DNA, 25 bp, Homo sapien
acgaattctctgtgcgctgtatgtt

SEQ ID NO: 213088 - DNA, 25 bp, Homo sapien
gctgtatgttgttgtctctatcctg

SEQ ID NO: 213089 - DNA, 25 bp, Homo sapien
acctctgtctcttcctaactacaaa

SEQ ID NO: 213090 - DNA, 25 bp, Homo sapien
tctgggttttccctttaccagtctg

SEQ ID NO: 213091 - DNA, 25 bp, Homo sapien
tgtcaccagtgggacctctttaaaa

SEQ ID NO: 213092 - DNA, 25 bp, Homo sapien
aaacaagcagccaaccattctttga

SEQ ID NO: 213093 - DNA, 25 bp, Homo sapien
gccaaccattctttgatgtatccca

SEQ ID NO: 213094 - DNA, 25 bp, Homo sapien
atgtatcccattcgctccatgttaa

SEQ ID NO: 213095 - DNA, 25 bp, Homo sapien
ctggatttcatacatggacttctga

SEQ ID NO: 213096 - DNA, 25 bp, Homo sapien
ggacttctgattaaaagtggcaggt

SEQ ID NO: 213097 - DNA, 25 bp, Homo sapien
gccaggacgaaagtgtggacagcaa

SEQ ID NO: 213098 - DNA, 25 bp, Homo sapien
gacagcaagaaatccaccagccatg

SEQ ID NO: 213099 - DNA, 25 bp, Homo sapien
caccagccatgacctggtctcggag

SEQ ID NO: 213100 - DNA, 25 bp, Homo sapien
cattgtgggtgtgtatcttcttatc

SEQ ID NO: 213101 - DNA, 25 bp, Homo sapien
ggtgtgtatcttcttatctcatttc

SEQ ID NO: 213102 - DNA, 25 bp, Homo sapien
atctcatttcacaagactggcttca

SEQ ID NO: 213103 - DNA, 25 bp, Homo sapien
aagactggcttcaggcatagctgga

SEQ ID NO: 213104 - DNA, 25 bp, Homo sapien
tccaggagctcaatgatgtcttcat

SEQ ID NO: 213105 - DNA, 25 bp, Homo sapien
agatatccatcatgcacttgctatg

SEQ ID NO: 213106 - DNA, 25 bp, Homo sapien
catgcacttgctatgtgcaaggcct

SEQ ID NO: 213107 - DNA, 25 bp, Homo sapien
gtgcaaggcctttttaggcactaga

SEQ ID NO: 213108 - DNA, 25 bp, Homo sapien
ttgtccttactgtcctgagaagaac

SEQ ID NO: 213109 - DNA, 25 bp, Homo sapien
gaaggacttgtggaacactgcaaat

SEQ ID NO: 213110 - DNA, 25 bp, Homo sapien
aattattccatagcacggataccaa

SEQ ID NO: 213111 - DNA, 25 bp, Homo sapien
ataccaaatctgtggtttgtccgat

SEQ ID NO: 213112 - DNA, 25 bp, Homo sapien
gtttgtccgatatgtgcctcgatgc

SEQ ID NO: 213113 - DNA, 25 bp, Homo sapien
gcagcgccaacttcagagagcacat

SEQ ID NO: 213114 - DNA, 25 bp, Homo sapien
tcagagagcacatccagcgccggca

SEQ ID NO: 213115 - DNA, 25 bp, Homo sapien
ccggcaccggttttcttatgacact

SEQ ID NO: 213116 - DNA, 25 bp, Homo sapien
ggtgttgcagcgctccatcatcgac

SEQ ID NO: 213117 - DNA, 25 bp, Homo sapien
atcgaccagtgagcagagtccgtgc

SEQ ID NO: 213118 - DNA, 25 bp, Homo sapien
agtccgtgcttgctatctgtctcat

SEQ ID NO: 213119 - DNA, 25 bp, Homo sapien
tcagcctgcctttagctaagataat

SEQ ID NO: 213120 - DNA, 25 bp, Homo sapien
ggacagatccattcagtttgcagtg

SEQ ID NO: 213121 - DNA, 25 bp, Homo sapien
gtttgcagtgaaacacctagtcatt

SEQ ID NO: 213122 - DNA, 25 bp, Homo sapien
gaaacacctagtcattttgttcagg

SEQ ID NO: 213123 - DNA, 25 bp, Homo sapien
cattttgttcaggatctgttgacaa

SEQ ID NO: 213124 - DNA, 25 bp, Homo sapien
aagactttgctgctaatgtgtatga

SEQ ID NO: 213125 - DNA, 25 bp, Homo sapien
gtatgaagcttttagtacccctcag

SEQ ID NO: 213126 - DNA, 25 bp, Homo sapien
cttttagtacccctcagcaactgga

SEQ ID NO: 213127 - DNA, 25 bp, Homo sapien
ggagaaatgatttttccttcaagaa

SEQ ID NO: 213128 - DNA, 25 bp, Homo sapien
actgggtaaatcacctatacttaga

SEQ ID NO: 213129 - DNA, 25 bp, Homo sapien
aacagtttgttatcaaaatgcctga

SEQ ID NO: 213130 - DNA, 25 bp, Homo sapien
aaatcaaaggctatgtctggcgctc

SEQ ID NO: 213131 - DNA, 25 bp, Homo sapien
atcaaaggctatgtctggcgctcag

SEQ ID NO: 213132 - DNA, 25 bp, Homo sapien
tcaaaggctatgtctggcgctcagc

SEQ ID NO: 213133 - DNA, 25 bp, Homo sapien
gtctggcgctcagctgtgggcttcc

SEQ ID NO: 213134 - DNA, 25 bp, Homo sapien
tgtgggcttcctcttctgggtgata

SEQ ID NO: 213135 - DNA, 25 bp, Homo sapien
tgggcttcctcttctgggtgatagt

SEQ ID NO: 213136 - DNA, 25 bp, Homo sapien
tgggtgatagtgctcacctcctgga

SEQ ID NO: 213137 - DNA, 25 bp, Homo sapien
gtgatagtgctcacctcctggatca

SEQ ID NO: 213138 - DNA, 25 bp, Homo sapien
tggggactacctctccttcaccata

SEQ ID NO: 213139 - DNA, 25 bp, Homo sapien
taagacttgttttcatgtcccacgt

SEQ ID NO: 213140 - DNA, 25 bp, Homo sapien
atgtcccacgttctctgctgacatc

SEQ ID NO: 213141 - DNA, 25 bp, Homo sapien
ccaacagatatcatcgtgtacacgg

SEQ ID NO: 213142 - DNA, 25 bp, Homo sapien
aacagatatcatcgtgtacacggaa

SEQ ID NO: 213143 - DNA, 25 bp, Homo sapien
acaaatctgaatgtgcctctcactt

SEQ ID NO: 213144 - DNA, 25 bp, Homo sapien
caaatctgaatgtgcctctcacttg

SEQ ID NO: 213145 - DNA, 25 bp, Homo sapien
aaatctgaatgtgcctctcacttgc

SEQ ID NO: 213146 - DNA, 25 bp, Homo sapien
aatctgaatgtgcctctcacttgct

SEQ ID NO: 213147 - DNA, 25 bp, Homo sapien
atctgaatgtgcctctcacttgctt

SEQ ID NO: 213148 - DNA, 25 bp, Homo sapien
tctgaatgtgcctctcacttgctta

SEQ ID NO: 213149 - DNA, 25 bp, Homo sapien
ctgaatgtgcctctcacttgcttac

SEQ ID NO: 213150 - DNA, 25 bp, Homo sapien
tgaatgtgcctctcacttgcttaca

SEQ ID NO: 213151 - DNA, 25 bp, Homo sapien
gaatgtgcctctcacttgcttacaa

SEQ ID NO: 213152 - DNA, 25 bp, Homo sapien
gctgtgttcggagtctgcgtcgttt

SEQ ID NO: 213153 - DNA, 25 bp, Homo sapien
gtgttcggagtctgcgtcgtttcgt

SEQ ID NO: 213154 - DNA, 25 bp, Homo sapien
tgttcggagtctgcgtcgtttcgta

SEQ ID NO: 213155 - DNA, 25 bp, Homo sapien
ttcggagtctgcgtcgtttcgtata

SEQ ID NO: 213156 - DNA, 25 bp, Homo sapien
cggagtctgcgtcgtttcgtataca

SEQ ID NO: 213157 - DNA, 25 bp, Homo sapien
ggagtctgcgtcgtttcgtatacac

SEQ ID NO: 213158 - DNA, 25 bp, Homo sapien
gagtctgcgtcgtttcgtatacaca

SEQ ID NO: 213159 - DNA, 25 bp, Homo sapien
agtctgcgtcgtttcgtatacacac

SEQ ID NO: 213160 - DNA, 25 bp, Homo sapien
gtctgcgtcgtttcgtatacacacc

SEQ ID NO: 213161 - DNA, 25 bp, Homo sapien
tctgcgtcgtttcgtatacacaccc

SEQ ID NO: 213162 - DNA, 25 bp, Homo sapien
cgtcgtttcgtatacacaccctctg

SEQ ID NO: 213163 - DNA, 25 bp, Homo sapien
tgggcacagcgcagagcgcacagca

SEQ ID NO: 213164 - DNA, 25 bp, Homo sapien
agcgcagagcgcacagcaagactcc

SEQ ID NO: 213165 - DNA, 25 bp, Homo sapien
gagctttaaaccttggtctttcttg

SEQ ID NO: 213166 - DNA, 25 bp, Homo sapien
taaaccttggtctttcttgaatcca

SEQ ID NO: 213167 - DNA, 25 bp, Homo sapien
tttcttgaatccaaaattccatctt

SEQ ID NO: 213168 - DNA, 25 bp, Homo sapien
aaattccatcttcttttcattatac

SEQ ID NO: 213169 - DNA, 25 bp, Homo sapien
ttccatcttcttttcattataccat

SEQ ID NO: 213170 - DNA, 25 bp, Homo sapien
cattataccatgctgattgaaaata

SEQ ID NO: 213171 - DNA, 25 bp, Homo sapien
taccatgctgattgaaaataactat

SEQ ID NO: 213172 - DNA, 25 bp, Homo sapien
aaataactatgcttttaggccaggc

SEQ ID NO: 213173 - DNA, 25 bp, Homo sapien
tcagcaccctggaaggccacggagg

SEQ ID NO: 213174 - DNA, 25 bp, Homo sapien
gtgaagcagcgcttgcagatgtaca

SEQ ID NO: 213175 - DNA, 25 bp, Homo sapien
aagcagcgcttgcagatgtacaact

SEQ ID NO: 213176 - DNA, 25 bp, Homo sapien
gcagatgtacaactcgcagcaccgg

SEQ ID NO: 213177 - DNA, 25 bp, Homo sapien
atgtacaactcgcagcaccggtcag

SEQ ID NO: 213178 - DNA, 25 bp, Homo sapien
acaactcgcagcaccggtcagcaat

SEQ ID NO: 213179 - DNA, 25 bp, Homo sapien
agcaccggtcagcaatcagctgcat

SEQ ID NO: 213180 - DNA, 25 bp, Homo sapien
agcaatcagctgcatccggacggtg

SEQ ID NO: 213181 - DNA, 25 bp, Homo sapien
caatcagctgcatccggacggtgtg

SEQ ID NO: 213182 - DNA, 25 bp, Homo sapien
gcatccggacggtgtggaggaccga

SEQ ID NO: 213183 - DNA, 25 bp, Homo sapien
ttgggggccttctaccggagctaca

SEQ ID NO: 213184 - DNA, 25 bp, Homo sapien
accacgcagctgaccatgaacatcc

SEQ ID NO: 213185 - DNA, 25 bp, Homo sapien
gggcaacaaattgaggcccccatct

SEQ ID NO: 213186 - DNA, 25 bp, Homo sapien
ggcaacaaattgaggcccccatctc

SEQ ID NO: 213187 - DNA, 25 bp, Homo sapien
caaattgaggcccccatctctacaa

SEQ ID NO: 213188 - DNA, 25 bp, Homo sapien
atcactcaagccctgggaggtcaag

SEQ ID NO: 213189 - DNA, 25 bp, Homo sapien
tcactcaagccctgggaggtcaagg

SEQ ID NO: 213190 - DNA, 25 bp, Homo sapien
tgagctgcaatcacaccactactct

SEQ ID NO: 213191 - DNA, 25 bp, Homo sapien
gagctgcaatcacaccactactctc

SEQ ID NO: 213192 - DNA, 25 bp, Homo sapien
agctgcaatcacaccactactctcc

SEQ ID NO: 213193 - DNA, 25 bp, Homo sapien
ctgcaatcacaccactactctccaa

SEQ ID NO: 213194 - DNA, 25 bp, Homo sapien
tgcaatcacaccactactctccaac

SEQ ID NO: 213195 - DNA, 25 bp, Homo sapien
caatcacaccactactctccaacct

SEQ ID NO: 213196 - DNA, 25 bp, Homo sapien
gtgatgacagcatgacagacctgta

SEQ ID NO: 213197 - DNA, 25 bp, Homo sapien
atgacagacctgtacccacctgagc

SEQ ID NO: 213198 - DNA, 25 bp, Homo sapien
tacccacctgagctattcaccagaa

SEQ ID NO: 213199 - DNA, 25 bp, Homo sapien
acctgagctattcaccagaaaggac

SEQ ID NO: 213200 - DNA, 25 bp, Homo sapien
gatgactttttgacagacaaagagg

SEQ ID NO: 213201 - DNA, 25 bp, Homo sapien
cccccaagagagaaggccactgatg

SEQ ID NO: 213202 - DNA, 25 bp, Homo sapien
agacgaccgtgtaccaagggctggt

SEQ ID NO: 213203 - DNA, 25 bp, Homo sapien
agggctggtccagaagcgcgggaag

SEQ ID NO: 213204 - DNA, 25 bp, Homo sapien
aagaagttcaagagtcatcaccgca

SEQ ID NO: 213205 - DNA, 25 bp, Homo sapien
gaagttcaagagtcatcaccgcaaa

SEQ ID NO: 213206 - DNA, 25 bp, Homo sapien
caagagtcatcaccgcaaacccaag

SEQ ID NO: 213207 - DNA, 25 bp, Homo sapien
gagtgaacaagatggacaaagcccc

SEQ ID NO: 213208 - DNA, 25 bp, Homo sapien
tcccaccccactaggtctagaagag

SEQ ID NO: 213209 - DNA, 25 bp, Homo sapien
aaatatataatggtgagtgcttcta

SEQ ID NO: 213210 - DNA, 25 bp, Homo sapien
gagtgcttctaaagatgctacagga

SEQ ID NO: 213211 - DNA, 25 bp, Homo sapien
ccgatttacactgggttatggtcaa

SEQ ID NO: 213212 - DNA, 25 bp, Homo sapien
aggtatctctaaggaaatgacattt

SEQ ID NO: 213213 - DNA, 25 bp, Homo sapien
agctgaatcctcaacgactaacggg

SEQ ID NO: 213214 - DNA, 25 bp, Homo sapien
tttctagatactgagtacctatcat

SEQ ID NO: 213215 - DNA, 25 bp, Homo sapien
gtacctatcatatgcttggttctag

SEQ ID NO: 213216 - DNA, 25 bp, Homo sapien
tcatatgcttggttctaggctagat

SEQ ID NO: 213217 - DNA, 25 bp, Homo sapien
ggttctaggctagatgccattagag

SEQ ID NO: 213218 - DNA, 25 bp, Homo sapien
gaggtgtttgtagtatcccctgaag

SEQ ID NO: 213219 - DNA, 25 bp, Homo sapien
aggtgtttgtagtatcccctgaagg

SEQ ID NO: 213220 - DNA, 25 bp, Homo sapien
ggtgtttgtagtatcccctgaaggt

SEQ ID NO: 213221 - DNA, 25 bp, Homo sapien
gtgtttgtagtatcccctgaaggta

SEQ ID NO: 213222 - DNA, 25 bp, Homo sapien
tgtttgtagtatcccctgaaggtaa

SEQ ID NO: 213223 - DNA, 25 bp, Homo sapien
ttgtagtatcccctgaaggtaattt

SEQ ID NO: 213224 - DNA, 25 bp, Homo sapien
tgtagtatcccctgaaggtaatttg

SEQ ID NO: 213225 - DNA, 25 bp, Homo sapien
gtagtatcccctgaaggtaatttgt

SEQ ID NO: 213226 - DNA, 25 bp, Homo sapien
tagtatcccctgaaggtaatttgta

SEQ ID NO: 213227 - DNA, 25 bp, Homo sapien
gtatcccctgaaggtaatttgtatt

SEQ ID NO: 213228 - DNA, 25 bp, Homo sapien
tatcccctgaaggtaatttgtattt

SEQ ID NO: 213229 - DNA, 25 bp, Homo sapien
cccacatttgggaggacagtctgca

SEQ ID NO: 213230 - DNA, 25 bp, Homo sapien
taatgtcattgcgaaacaccctcac

SEQ ID NO: 213231 - DNA, 25 bp, Homo sapien
tcattgcgaaacaccctcacaggaa

SEQ ID NO: 213232 - DNA, 25 bp, Homo sapien
tgcgaaacaccctcacaggaacact

SEQ ID NO: 213233 - DNA, 25 bp, Homo sapien
aaatagctgggcatcttgtgaccca

SEQ ID NO: 213234 - DNA, 25 bp, Homo sapien
gggcatcttgtgacccagttaagtg

SEQ ID NO: 213235 - DNA, 25 bp, Homo sapien
tcttgtgacccagttaagtggatac

SEQ ID NO: 213236 - DNA, 25 bp, Homo sapien
acccagttaagtggatacataagat

SEQ ID NO: 213237 - DNA, 25 bp, Homo sapien
taagattaactatcacagtgactca

SEQ ID NO: 213238 - DNA, 25 bp, Homo sapien
actatcacagtgactcagtggaatt

SEQ ID NO: 213239 - DNA, 25 bp, Homo sapien
acagtgactcagtggaattttttgt

SEQ ID NO: 213240 - DNA, 25 bp, Homo sapien
tttgggataacctaacattggtttg

SEQ ID NO: 213241 - DNA, 25 bp, Homo sapien
tgggataacctaacattggtttgga

SEQ ID NO: 213242 - DNA, 25 bp, Homo sapien
ggataacctaacattggtttggaat

SEQ ID NO: 213243 - DNA, 25 bp, Homo sapien
gataacctaacattggtttggaatg

SEQ ID NO: 213244 - DNA, 25 bp, Homo sapien
tgtataaaacaaaactagcagaatg

SEQ ID NO: 213245 - DNA, 25 bp, Homo sapien
tgccgtgtatgaggagtgctagaaa

SEQ ID NO: 213246 - DNA, 25 bp, Homo sapien
gccgtgtatgaggagtgctagaaaa

SEQ ID NO: 213247 - DNA, 25 bp, Homo sapien
gaggagtgctagaaaatgcaaagtg

SEQ ID NO: 213248 - DNA, 25 bp, Homo sapien
agtgcaatattttccctaaccttca

SEQ ID NO: 213249 - DNA, 25 bp, Homo sapien
gtgcaatattttccctaaccttcaa

SEQ ID NO: 213250 - DNA, 25 bp, Homo sapien
gcaatattttccctaaccttcaaat

SEQ ID NO: 213251 - DNA, 25 bp, Homo sapien
atatgctttccctttacaccctgta

SEQ ID NO: 213252 - DNA, 25 bp, Homo sapien
atacaagaccattgcaatttatgct

SEQ ID NO: 213253 - DNA, 25 bp, Homo sapien
aatttatgcttttcgcctggcagtt

SEQ ID NO: 213254 - DNA, 25 bp, Homo sapien
tgcttttcgcctggcagttattttc

SEQ ID NO: 213255 - DNA, 25 bp, Homo sapien
ccccaagctatcctgtttcagataa

SEQ ID NO: 213256 - DNA, 25 bp, Homo sapien
tatcaatttatttccaatccatcag

SEQ ID NO: 213257 - DNA, 25 bp, Homo sapien
tttccaatccatcagactaaaatct

SEQ ID NO: 213258 - DNA, 25 bp, Homo sapien
tttattgttgatttggtgccaccaa

SEQ ID NO: 213259 - DNA, 25 bp, Homo sapien
taaatctttctaattatcctttctt

SEQ ID NO: 213260 - DNA, 25 bp, Homo sapien
ttttcaatcccattgctaacaccca

SEQ ID NO: 213261 - DNA, 25 bp, Homo sapien
attgctaacacccagaacatatttt

SEQ ID NO: 213262 - DNA, 25 bp, Homo sapien
tgcagcgacatcagaacctccagga

SEQ ID NO: 213263 - DNA, 25 bp, Homo sapien
cagcgacatcagaacctccaggaaa

SEQ ID NO: 213264 - DNA, 25 bp, Homo sapien
gaaaagctggcggaagagatgctag

SEQ ID NO: 213265 - DNA, 25 bp, Homo sapien
agatgctaggactggcccggagcct

SEQ ID NO: 213266 - DNA, 25 bp, Homo sapien
ggagcctcaagaccaataccctggc

SEQ ID NO: 213267 - DNA, 25 bp, Homo sapien
tggccgcccagagtgtcatcaagaa

SEQ ID NO: 213268 - DNA, 25 bp, Homo sapien
ggccgcccagagtgtcatcaagaag

SEQ ID NO: 213269 - DNA, 25 bp, Homo sapien
ccgcccagagtgtcatcaagaagga

SEQ ID NO: 213270 - DNA, 25 bp, Homo sapien
atcaagaaggacaaccagaccctgt

SEQ ID NO: 213271 - DNA, 25 bp, Homo sapien
aagaaggacaaccagaccctgtcac

SEQ ID NO: 213272 - DNA, 25 bp, Homo sapien
aaggacaaccagaccctgtcacact

SEQ ID NO: 213273 - DNA, 25 bp, Homo sapien
attatccccaacttcgttgctcagg

SEQ ID NO: 213274 - DNA, 25 bp, Homo sapien
atccccaacttcgttgctcagggtg

SEQ ID NO: 213275 - DNA, 25 bp, Homo sapien
ccaacttcgttgctcagggtgcaga

SEQ ID NO: 213276 - DNA, 25 bp, Homo sapien
acttcgttgctcagggtgcagagag

SEQ ID NO: 213277 - DNA, 25 bp, Homo sapien
cagagagggttagcgaggcaaatcc

SEQ ID NO: 213278 - DNA, 25 bp, Homo sapien
ggttagcgaggcaaatcccagtttc

SEQ ID NO: 213279 - DNA, 25 bp, Homo sapien
tagcgaggcaaatcccagtttcagg

SEQ ID NO: 213280 - DNA, 25 bp, Homo sapien
gaggcaaatcccagtttcaggaaga

SEQ ID NO: 213281 - DNA, 25 bp, Homo sapien
gcaaatcccagtttcaggaagagct

SEQ ID NO: 213282 - DNA, 25 bp, Homo sapien
atcccagtttcaggaagagctttga

SEQ ID NO: 213283 - DNA, 25 bp, Homo sapien
agtttcaggaagagctttgaattca

SEQ ID NO: 213284 - DNA, 25 bp, Homo sapien
gagacattttattattttgccttac

SEQ ID NO: 213285 - DNA, 25 bp, Homo sapien
gccttactaatgattttgcagctct

SEQ ID NO: 213286 - DNA, 25 bp, Homo sapien
tactaatgattttgcagctctgttt

SEQ ID NO: 213287 - DNA, 25 bp, Homo sapien
attgtgggtctgagatgccctttga

SEQ ID NO: 213288 - DNA, 25 bp, Homo sapien
gatgccctttgaaaatgcctgaaag

SEQ ID NO: 213289 - DNA, 25 bp, Homo sapien
gaaaacatgggctactacattatgt

SEQ ID NO: 213290 - DNA, 25 bp, Homo sapien
taatgttttgtaatgtccttttaat

SEQ ID NO: 213291 - DNA, 25 bp, Homo sapien
gtccttttaatgagtggtgacataa

SEQ ID NO: 213292 - DNA, 25 bp, Homo sapien
agtggtgacataaaagggctgcttt

SEQ ID NO: 213293 - DNA, 25 bp, Homo sapien
aaagggctgctttgttgtcctgata

SEQ ID NO: 213294 - DNA, 25 bp, Homo sapien
ctgctttgttgtcctgatatggcaa

SEQ ID NO: 213295 - DNA, 25 bp, Homo sapien
tgtgtatttccataatccagaggtt

SEQ ID NO: 213296 - DNA, 25 bp, Homo sapien
gtatttccataatccagaggttgta

SEQ ID NO: 213297 - DNA, 25 bp, Homo sapien
ccagaggttgtaaaaccactagtgt

SEQ ID NO: 213298 - DNA, 25 bp, Homo sapien
ctagtgttttagtggttacagcaac

SEQ ID NO: 213299 - DNA, 25 bp, Homo sapien
gttttagtggttacagcaacatttg

SEQ ID NO: 213300 - DNA, 25 bp, Homo sapien
gtggttacagcaacatttgaaatgg

SEQ ID NO: 213301 - DNA, 25 bp, Homo sapien
aagttaggattttatggagtatgga

SEQ ID NO: 213302 - DNA, 25 bp, Homo sapien
agtatggagatagggtccagtatct

SEQ ID NO: 213303 - DNA, 25 bp, Homo sapien
ggtccagtatctatttaccctgtaa

SEQ ID NO: 213304 - DNA, 25 bp, Homo sapien
tccagtatctatttaccctgtaatg

SEQ ID NO: 213305 - DNA, 25 bp, Homo sapien
ctatttaccctgtaatgtttaggat

SEQ ID NO: 213306 - DNA, 25 bp, Homo sapien
gattctgaacctgtgccaataatac

SEQ ID NO: 213307 - DNA, 25 bp, Homo sapien
gaacctgtgccaataataccattat

SEQ ID NO: 213308 - DNA, 25 bp, Homo sapien
accattatgtgccatgtactgaccc

SEQ ID NO: 213309 - DNA, 25 bp, Homo sapien
atgtgccatgtactgacccgaaagg

SEQ ID NO: 213310 - DNA, 25 bp, Homo sapien
gacccgaaaggctcggccgcagagc

SEQ ID NO: 213311 - DNA, 25 bp, Homo sapien
gggcccagcgaatcacgcagagaaa

SEQ ID NO: 213312 - DNA, 25 bp, Homo sapien
gcgaatcacgcagagaaatcttaca

SEQ ID NO: 213313 - DNA, 25 bp, Homo sapien
ggtgggaatctcttccgatagagtc

SEQ ID NO: 213314 - DNA, 25 bp, Homo sapien
gaatctcttccgatagagtcgctat

SEQ ID NO: 213315 - DNA, 25 bp, Homo sapien
gagtcgctatttctggttaatatac

SEQ ID NO: 213316 - DNA, 25 bp, Homo sapien
ttttgtactgtagcaatttttgaag

SEQ ID NO: 213317 - DNA, 25 bp, Homo sapien
ttccgacctggggtggggccacatc

SEQ ID NO: 213318 - DNA, 25 bp, Homo sapien
ggtggggccacatccaacccactgc

SEQ ID NO: 213319 - DNA, 25 bp, Homo sapien
ggccacatccaacccactgcccact

SEQ ID NO: 213320 - DNA, 25 bp, Homo sapien
ggctgtccgtctggcctgccccgcg

SEQ ID NO: 213321 - DNA, 25 bp, Homo sapien
tgtccgtctggcctgccccgcggtt

SEQ ID NO: 213322 - DNA, 25 bp, Homo sapien
gtccgtctggcctgccccgcggttc

SEQ ID NO: 213323 - DNA, 25 bp, Homo sapien
cccgcggttccaaccacagtggtga

SEQ ID NO: 213324 - DNA, 25 bp, Homo sapien
ccgcggttccaaccacagtggtgaa

SEQ ID NO: 213325 - DNA, 25 bp, Homo sapien
cgcggttccaaccacagtggtgaag

SEQ ID NO: 213326 - DNA, 25 bp, Homo sapien
gcggttccaaccacagtggtgaagc

SEQ ID NO: 213327 - DNA, 25 bp, Homo sapien
cggttccaaccacagtggtgaagca

SEQ ID NO: 213328 - DNA, 25 bp, Homo sapien
gatctgtgggccgacgtggacctca

SEQ ID NO: 213329 - DNA, 25 bp, Homo sapien
tggacctcaccgagttcgaccagta

SEQ ID NO: 213330 - DNA, 25 bp, Homo sapien
gttcgaccagtacctcaactgcagc

SEQ ID NO: 213331 - DNA, 25 bp, Homo sapien
gtacctcaactgcagccggactcgg

SEQ ID NO: 213332 - DNA, 25 bp, Homo sapien
gtaccacgtggcactggccaaactg

SEQ ID NO: 213333 - DNA, 25 bp, Homo sapien
tgcccagaggagagcagcctgatct

SEQ ID NO: 213334 - DNA, 25 bp, Homo sapien
aggagagcagcctgatctccgcgct

SEQ ID NO: 213335 - DNA, 25 bp, Homo sapien
tgatctccgcgctgtcggacgccag

SEQ ID NO: 213336 - DNA, 25 bp, Homo sapien
cggacgccagcagcgcggtctatta

SEQ ID NO: 213337 - DNA, 25 bp, Homo sapien
agcgcggtctattacagcgcgtgca

SEQ ID NO: 213338 - DNA, 25 bp, Homo sapien
tacagcgcgtgcatctccggctagg

SEQ ID NO: 213339 - DNA, 25 bp, Homo sapien
cctgcttcgagaatgtataacgtgg

SEQ ID NO: 213340 - DNA, 25 bp, Homo sapien
gagaatgtataacgtggaaatccac

SEQ ID NO: 213341 - DNA, 25 bp, Homo sapien
ggaaatccacgggaccaaatttctg

SEQ ID NO: 213342 - DNA, 25 bp, Homo sapien
aatccacgggaccaaatttctgcag

SEQ ID NO: 213343 - DNA, 25 bp, Homo sapien
tccacgggaccaaatttctgcagag

SEQ ID NO: 213344 - DNA, 25 bp, Homo sapien
acgggaccaaatttctgcagaggcc

SEQ ID NO: 213345 - DNA, 25 bp, Homo sapien
gggaccaaatttctgcagaggcctt

SEQ ID NO: 213346 - DNA, 25 bp, Homo sapien
gaccaaatttctgcagaggccttgc

SEQ ID NO: 213347 - DNA, 25 bp, Homo sapien
ccaaatttctgcagaggccttgccg

SEQ ID NO: 213348 - DNA, 25 bp, Homo sapien
gctatccattacagaaattaatcgt

SEQ ID NO: 213349 - DNA, 25 bp, Homo sapien
cagaaattaatcgttcagttgaaag

SEQ ID NO: 213350 - DNA, 25 bp, Homo sapien
ggaacagagtagattcttcatagac

SEQ ID NO: 213351 - DNA, 25 bp, Homo sapien
gacaaatgaaatcatgcttaccaat

SEQ ID NO: 213352 - DNA, 25 bp, Homo sapien
atcatgcttaccaatcaaatctcaa

SEQ ID NO: 213353 - DNA, 25 bp, Homo sapien
ttaccaatcaaatctcaaagcacag

SEQ ID NO: 213354 - DNA, 25 bp, Homo sapien
agcacagaattattgacttgaatca

SEQ ID NO: 213355 - DNA, 25 bp, Homo sapien
gcaagatagttttgagctattttaa

SEQ ID NO: 213356 - DNA, 25 bp, Homo sapien
aacacaaaatcatggaggtgctcta

SEQ ID NO: 213357 - DNA, 25 bp, Homo sapien
atggaggtgctctaaataactttta

SEQ ID NO: 213358 - DNA, 25 bp, Homo sapien
aacttttagatttcctctctctgtg

SEQ ID NO: 213359 - DNA, 25 bp, Homo sapien
ctctctctgtgtgcattaccaatat

SEQ ID NO: 213360 - DNA, 25 bp, Homo sapien
gtgtgcattaccaatatctaagtgt

SEQ ID NO: 213361 - DNA, 25 bp, Homo sapien
tgcgccaggccctctatctttttga

SEQ ID NO: 213362 - DNA, 25 bp, Homo sapien
aggccctctatctttttgatcctca

SEQ ID NO: 213363 - DNA, 25 bp, Homo sapien
gccctctatctttttgatcctcaaa

SEQ ID NO: 213364 - DNA, 25 bp, Homo sapien
tttgatcctcaaatatctctaacaa

SEQ ID NO: 213365 - DNA, 25 bp, Homo sapien
ataatgacactgtttatacaagaat

SEQ ID NO: 213366 - DNA, 25 bp, Homo sapien
agtgttcctcaaattccattattta

SEQ ID NO: 213367 - DNA, 25 bp, Homo sapien
tatatctcatcttcaccattttgcc

SEQ ID NO: 213368 - DNA, 25 bp, Homo sapien
tctcatcttcaccattttgccatat

SEQ ID NO: 213369 - DNA, 25 bp, Homo sapien
ttttgccatatcaatgatccaccta

SEQ ID NO: 213370 - DNA, 25 bp, Homo sapien
gccatatcaatgatccacctatact

SEQ ID NO: 213371 - DNA, 25 bp, Homo sapien
aatgatccacctatactcatattta

SEQ ID NO: 213372 - DNA, 25 bp, Homo sapien
gaagagacctgacagattatctata

SEQ ID NO: 213373 - DNA, 25 bp, Homo sapien
gagacctgacagattatctatactc

SEQ ID NO: 213374 - DNA, 25 bp, Homo sapien
gacctgacagattatctatactctt

SEQ ID NO: 213375 - DNA, 25 bp, Homo sapien
gacagattatctatactcttcatat

SEQ ID NO: 213376 - DNA, 25 bp, Homo sapien
cagattatctatactcttcatatgt

SEQ ID NO: 213377 - DNA, 25 bp, Homo sapien
gattatctatactcttcatatgtta

SEQ ID NO: 213378 - DNA, 25 bp, Homo sapien
ttatctatactcttcatatgttaaa

SEQ ID NO: 213379 - DNA, 25 bp, Homo sapien
atctatactcttcatatgttaaaag

SEQ ID NO: 213380 - DNA, 25 bp, Homo sapien
atatgttaaaagaccatttcctgta

SEQ ID NO: 213381 - DNA, 25 bp, Homo sapien
gtgaagtaaactataacttgtcctt

SEQ ID NO: 213382 - DNA, 25 bp, Homo sapien
tgaagtaaactataacttgtccttt

SEQ ID NO: 213383 - DNA, 25 bp, Homo sapien
gctctggaaagatgatcatgtaccc

SEQ ID NO: 213384 - DNA, 25 bp, Homo sapien
gtatatagacaggacccatgctcct

SEQ ID NO: 213385 - DNA, 25 bp, Homo sapien
ggacccatgctcctacaggatggga

SEQ ID NO: 213386 - DNA, 25 bp, Homo sapien
gggaagggacaatattacccacaca

SEQ ID NO: 213387 - DNA, 25 bp, Homo sapien
tacccacacaaacccacattgagtt

SEQ ID NO: 213388 - DNA, 25 bp, Homo sapien
gtaattgtttttgtgcttgagatag

SEQ ID NO: 213389 - DNA, 25 bp, Homo sapien
gatagaacagtgttttgtctagtgc

SEQ ID NO: 213390 - DNA, 25 bp, Homo sapien
tcagaattctggcatgtgtttgaaa

SEQ ID NO: 213391 - DNA, 25 bp, Homo sapien
tgtgtttgaaatcactgctgctcct

SEQ ID NO: 213392 - DNA, 25 bp, Homo sapien
ctccttgcaaggtagcaatgggcat

SEQ ID NO: 213393 - DNA, 25 bp, Homo sapien
gggcatgcattttccttagcagtaa

SEQ ID NO: 213394 - DNA, 25 bp, Homo sapien
agtgaggtttcagataccgctaata

SEQ ID NO: 213395 - DNA, 25 bp, Homo sapien
atggagccaaagtaccttggatctt

SEQ ID NO: 213396 - DNA, 25 bp, Homo sapien
tggagccaaagtaccttggatcttt

SEQ ID NO: 213397 - DNA, 25 bp, Homo sapien
ggagccaaagtaccttggatctttg

SEQ ID NO: 213398 - DNA, 25 bp, Homo sapien
agccaaagtaccttggatctttgtc

SEQ ID NO: 213399 - DNA, 25 bp, Homo sapien
gccaaagtaccttggatctttgtcc

SEQ ID NO: 213400 - DNA, 25 bp, Homo sapien
ccaaagtaccttggatctttgtcca

SEQ ID NO: 213401 - DNA, 25 bp, Homo sapien
aaagtaccttggatctttgtccaca

SEQ ID NO: 213402 - DNA, 25 bp, Homo sapien
aagtaccttggatctttgtccacac

SEQ ID NO: 213403 - DNA, 25 bp, Homo sapien
agtaccttggatctttgtccacaca

SEQ ID NO: 213404 - DNA, 25 bp, Homo sapien
ttttgtttatgacatgcctttctgt

SEQ ID NO: 213405 - DNA, 25 bp, Homo sapien
atgtgcagcaagttaccactataat

SEQ ID NO: 213406 - DNA, 25 bp, Homo sapien
aaaacaattccttgctcacctattc

SEQ ID NO: 213407 - DNA, 25 bp, Homo sapien
agttcctactctagtttcatctcat

SEQ ID NO: 213408 - DNA, 25 bp, Homo sapien
gtttcatctcatgctgataccactt

SEQ ID NO: 213409 - DNA, 25 bp, Homo sapien
atctcatgctgataccacttcaaca

SEQ ID NO: 213410 - DNA, 25 bp, Homo sapien
acttcaacagtatcttgtctcccta

SEQ ID NO: 213411 - DNA, 25 bp, Homo sapien
tccctacttccaattcctgtgtcat

SEQ ID NO: 213412 - DNA, 25 bp, Homo sapien
tgtcatttcttcagttacaatgggc

SEQ ID NO: 213413 - DNA, 25 bp, Homo sapien
caatgggcattgtttctaaataatt

SEQ ID NO: 213414 - DNA, 25 bp, Homo sapien
ataattttccaacactgtattttgt

SEQ ID NO: 213415 - DNA, 25 bp, Homo sapien
ggatagctgggagtatggccaccct

SEQ ID NO: 213416 - DNA, 25 bp, Homo sapien
gatagctgggagtatggccaccctg

SEQ ID NO: 213417 - DNA, 25 bp, Homo sapien
atagctgggagtatggccaccctgc

SEQ ID NO: 213418 - DNA, 25 bp, Homo sapien
tagctgggagtatggccaccctgct

SEQ ID NO: 213419 - DNA, 25 bp, Homo sapien
accctgctccacgatgcggtaatga

SEQ ID NO: 213420 - DNA, 25 bp, Homo sapien
cctgctccacgatgcggtaatgaat

SEQ ID NO: 213421 - DNA, 25 bp, Homo sapien
ctgctccacgatgcggtaatgaatc

SEQ ID NO: 213422 - DNA, 25 bp, Homo sapien
ctccacgatgcggtaatgaatccag

SEQ ID NO: 213423 - DNA, 25 bp, Homo sapien
tccacgatgcggtaatgaatccagc

SEQ ID NO: 213424 - DNA, 25 bp, Homo sapien
cacgatgcggtaatgaatccagcag

SEQ ID NO: 213425 - DNA, 25 bp, Homo sapien
aatccagcagaagtggtgaagcagc

SEQ ID NO: 213426 - DNA, 25 bp, Homo sapien
agcatggtgcctggtatatacgaga

SEQ ID NO: 213427 - DNA, 25 bp, Homo sapien
gtgcctggtatatacgagagctcca

SEQ ID NO: 213428 - DNA, 25 bp, Homo sapien
tatacgagagctccacaaatgtgag

SEQ ID NO: 213429 - DNA, 25 bp, Homo sapien
aatgtgagctataatcctactagta

SEQ ID NO: 213430 - DNA, 25 bp, Homo sapien
cctactagtaaaggatgctaagcag

SEQ ID NO: 213431 - DNA, 25 bp, Homo sapien
gatgctaagcagttccactgtggca

SEQ ID NO: 213432 - DNA, 25 bp, Homo sapien
agcagttccactgtggcaggtgtca

SEQ ID NO: 213433 - DNA, 25 bp, Homo sapien
gtggcaggtgtcatttgctagtaga

SEQ ID NO: 213434 - DNA, 25 bp, Homo sapien
caggtgtcatttgctagtagaattt

SEQ ID NO: 213435 - DNA, 25 bp, Homo sapien
gggaatctgtgaacgcctagaaaat

SEQ ID NO: 213436 - DNA, 25 bp, Homo sapien
tgtgaacgcctagaaaatgagcaga

SEQ ID NO: 213437 - DNA, 25 bp, Homo sapien
attatttgcaaaggtaagttacagc

SEQ ID NO: 213438 - DNA, 25 bp, Homo sapien
gtaagttacagcttgttttttgaga

SEQ ID NO: 213439 - DNA, 25 bp, Homo sapien
tacagcttgttttttgagagaatca

SEQ ID NO: 213440 - DNA, 25 bp, Homo sapien
aatgagtttacttttgttcctgttg

SEQ ID NO: 213441 - DNA, 25 bp, Homo sapien
ttgttcctgttgtttttaactagct

SEQ ID NO: 213442 - DNA, 25 bp, Homo sapien
tgttcctgttgtttttaactagctt

SEQ ID NO: 213443 - DNA, 25 bp, Homo sapien
ggaagctaagcaatggaaatgctat

SEQ ID NO: 213444 - DNA, 25 bp, Homo sapien
atggaaatgctatacgtttttgaca

SEQ ID NO: 213445 - DNA, 25 bp, Homo sapien
ggaaatgctatacgtttttgacatt

SEQ ID NO: 213446 - DNA, 25 bp, Homo sapien
atgctatacgtttttgacatttatt

SEQ ID NO: 213447 - DNA, 25 bp, Homo sapien
gctatacgtttttgacatttattaa

SEQ ID NO: 213448 - DNA, 25 bp, Homo sapien
taccttctgatacctggaaatccct

SEQ ID NO: 213449 - DNA, 25 bp, Homo sapien
tgatacctggaaatccctgccctgt

SEQ ID NO: 213450 - DNA, 25 bp, Homo sapien
acctggaaatccctgccctgttcag

SEQ ID NO: 213451 - DNA, 25 bp, Homo sapien
gctcccaactatttggttcctgctc

SEQ ID NO: 213452 - DNA, 25 bp, Homo sapien
ccaactatttggttcctgctccatg

SEQ ID NO: 213453 - DNA, 25 bp, Homo sapien
tgcaatgaaatctggactcactcct

SEQ ID NO: 213454 - DNA, 25 bp, Homo sapien
tgaaatctggactcactcctacaag

SEQ ID NO: 213455 - DNA, 25 bp, Homo sapien
atctggactcactcctacaaggtca

SEQ ID NO: 213456 - DNA, 25 bp, Homo sapien
tttcctgcttagcctggccctaatg

SEQ ID NO: 213457 - DNA, 25 bp, Homo sapien
tgtggctgctcagctgacctccttt

SEQ ID NO: 213458 - DNA, 25 bp, Homo sapien
tgctcagctgacctccttttacctt

SEQ ID NO: 213459 - DNA, 25 bp, Homo sapien
acggctaccgcgcagccaaggagga

SEQ ID NO: 213460 - DNA, 25 bp, Homo sapien
ggctaccgcgcagccaaggaggagc

SEQ ID NO: 213461 - DNA, 25 bp, Homo sapien
ggaggagcgcaaggggcccacccag

SEQ ID NO: 213462 - DNA, 25 bp, Homo sapien
gaagccgtcggccaaggcggagaag

SEQ ID NO: 213463 - DNA, 25 bp, Homo sapien
agccgtcggccaaggcggagaagga

SEQ ID NO: 213464 - DNA, 25 bp, Homo sapien
aggcggcgcggaaggcggccgggag

SEQ ID NO: 213465 - DNA, 25 bp, Homo sapien
cgcagtgacgtctccagccccgcag

SEQ ID NO: 213466 - DNA, 25 bp, Homo sapien
ccagctcctgtgaccagcgcgtctc

SEQ ID NO: 213467 - DNA, 25 bp, Homo sapien
tgtgaccagcgcgtctcccgatgct

SEQ ID NO: 213468 - DNA, 25 bp, Homo sapien
gatgctctccgccgtgttcgtgtcc

SEQ ID NO: 213469 - DNA, 25 bp, Homo sapien
tccgccgtgttcgtgtccccaggcg

SEQ ID NO: 213470 - DNA, 25 bp, Homo sapien
tgcagactgggctcagcccgacatc

SEQ ID NO: 213471 - DNA, 25 bp, Homo sapien
tccaacaggcgccaaactcacagag

SEQ ID NO: 213472 - DNA, 25 bp, Homo sapien
tcacagagcccttgtgcagatccag

SEQ ID NO: 213473 - DNA, 25 bp, Homo sapien
agcccttgtgcagatccagcatgga

SEQ ID NO: 213474 - DNA, 25 bp, Homo sapien
cttgtgcagatccagcatggaggcc

SEQ ID NO: 213475 - DNA, 25 bp, Homo sapien
ggaggccaccctcaggagtgacttc

SEQ ID NO: 213476 - DNA, 25 bp, Homo sapien
aggagtgacttctcatccaccctgg

SEQ ID NO: 213477 - DNA, 25 bp, Homo sapien
atccaccctggcagctagtaggttc

SEQ ID NO: 213478 - DNA, 25 bp, Homo sapien
gtaggttctgctgttatgcagagcc

SEQ ID NO: 213479 - DNA, 25 bp, Homo sapien
ctgctgttatgcagagccatttcct

SEQ ID NO: 213480 - DNA, 25 bp, Homo sapien
aaagatgcttattgtctctcccttc

SEQ ID NO: 213481 - DNA, 25 bp, Homo sapien
tatgccccgcctgagggtggacaaa

SEQ ID NO: 213482 - DNA, 25 bp, Homo sapien
gaatatttgctactcactcttcagt

SEQ ID NO: 213483 - DNA, 25 bp, Homo sapien
tcagtttccttgtcttctgctgaag

SEQ ID NO: 213484 - DNA, 25 bp, Homo sapien
gtcttctgctgaagtgcctggcaag

SEQ ID NO: 213485 - DNA, 25 bp, Homo sapien
gtgcctggcaagtgttcgataattc

SEQ ID NO: 213486 - DNA, 25 bp, Homo sapien
tgaaggttccgttgttccgaaattg

SEQ ID NO: 213487 - DNA, 25 bp, Homo sapien
gttgttccgaaattgcttcctctaa

SEQ ID NO: 213488 - DNA, 25 bp, Homo sapien
aattgcttcctctaatttatgcagt

SEQ ID NO: 213489 - DNA, 25 bp, Homo sapien
gacgtagctttttcactggcagtgt

SEQ ID NO: 213490 - DNA, 25 bp, Homo sapien
gcagtgtgggcttctcgatctcgat

SEQ ID NO: 213491 - DNA, 25 bp, Homo sapien
tcgatccttaccctggacatggata

SEQ ID NO: 213492 - DNA, 25 bp, Homo sapien
ggatagttggttgtcttttctcttc

SEQ ID NO: 213493 - DNA, 25 bp, Homo sapien
tggttgtcttttctcttcatgcttc

SEQ ID NO: 213494 - DNA, 25 bp, Homo sapien
ttcatgcttccttatctcctttatt

SEQ ID NO: 213495 - DNA, 25 bp, Homo sapien
gacaggaattacctatatttcattg

SEQ ID NO: 213496 - DNA, 25 bp, Homo sapien
gtatttgtaccttagttccacactt

SEQ ID NO: 213497 - DNA, 25 bp, Homo sapien
ttctttctggaaacgtatatgataa

SEQ ID NO: 213498 - DNA, 25 bp, Homo sapien
tacatggatattctgaactcccaaa

SEQ ID NO: 213499 - DNA, 25 bp, Homo sapien
agagaatctcatgactaagccaatt

SEQ ID NO: 213500 - DNA, 25 bp, Homo sapien
gactaagccaatttcacatttctaa

SEQ ID NO: 213501 - DNA, 25 bp, Homo sapien
cacatttctaattagcatacttgct

SEQ ID NO: 213502 - DNA, 25 bp, Homo sapien
acttgctttcattgagtgttttgaa

SEQ ID NO: 213503 - DNA, 25 bp, Homo sapien
taaattaagaatttgttggcagggc

SEQ ID NO: 213504 - DNA, 25 bp, Homo sapien
aaattaagaatttgttggcagggcg

SEQ ID NO: 213505 - DNA, 25 bp, Homo sapien
aattaagaatttgttggcagggcgt

SEQ ID NO: 213506 - DNA, 25 bp, Homo sapien
attaagaatttgttggcagggcgtg

SEQ ID NO: 213507 - DNA, 25 bp, Homo sapien
ttaagaatttgttggcagggcgtgg

SEQ ID NO: 213508 - DNA, 25 bp, Homo sapien
taagaatttgttggcagggcgtggt

SEQ ID NO: 213509 - DNA, 25 bp, Homo sapien
aagaatttgttggcagggcgtggtg

SEQ ID NO: 213510 - DNA, 25 bp, Homo sapien
agaatttgttggcagggcgtggtgg

SEQ ID NO: 213511 - DNA, 25 bp, Homo sapien
gaatttgttggcagggcgtggtggc

SEQ ID NO: 213512 - DNA, 25 bp, Homo sapien
aatttgttggcagggcgtggtggct

SEQ ID NO: 213513 - DNA, 25 bp, Homo sapien
atttgttggcagggcgtggtggctc

SEQ ID NO: 213514 - DNA, 25 bp, Homo sapien
acggctaccgcgcagccaaggagga

SEQ ID NO: 213515 - DNA, 25 bp, Homo sapien
taccgcgcagccaaggaggagcgca

SEQ ID NO: 213516 - DNA, 25 bp, Homo sapien
accgcgcagccaaggaggagcgcaa

SEQ ID NO: 213517 - DNA, 25 bp, Homo sapien
gaagccgtcggccaaggcggagaag

SEQ ID NO: 213518 - DNA, 25 bp, Homo sapien
agccgtcggccaaggcggagaagga

SEQ ID NO: 213519 - DNA, 25 bp, Homo sapien
aggcggcgcggaaggcggccgggag

SEQ ID NO: 213520 - DNA, 25 bp, Homo sapien
cgcagtgacgtctccagccccgcag

SEQ ID NO: 213521 - DNA, 25 bp, Homo sapien
ccagctcctgtgaccagcgcgtctc

SEQ ID NO: 213522 - DNA, 25 bp, Homo sapien
tgtgaccagcgcgtctcccgatgct

SEQ ID NO: 213523 - DNA, 25 bp, Homo sapien
gatgctctccgccgtgttcgtgtcc

SEQ ID NO: 213524 - DNA, 25 bp, Homo sapien
tccgccgtgttcgtgtccccaggcg

SEQ ID NO: 213525 - DNA, 25 bp, Homo sapien
agtggtcatgtgtccttaggctccc

SEQ ID NO: 213526 - DNA, 25 bp, Homo sapien
cttaggctcccctgacttgtgacaa

SEQ ID NO: 213527 - DNA, 25 bp, Homo sapien
gacttgtgacaatttctctgactct

SEQ ID NO: 213528 - DNA, 25 bp, Homo sapien
gacaatttctctgactctgtttttg

SEQ ID NO: 213529 - DNA, 25 bp, Homo sapien
gactctgtttttgatgaccatgaca

SEQ ID NO: 213530 - DNA, 25 bp, Homo sapien
gtattttgtagaatggcctctgttg

SEQ ID NO: 213531 - DNA, 25 bp, Homo sapien
atggcctctgttgtgattttcctga

SEQ ID NO: 213532 - DNA, 25 bp, Homo sapien
tataagcttcgggttgtgggtttgc

SEQ ID NO: 213533 - DNA, 25 bp, Homo sapien
atacggtgagcacgacttaccacta

SEQ ID NO: 213534 - DNA, 25 bp, Homo sapien
taccactactggtgttgacctggat

SEQ ID NO: 213535 - DNA, 25 bp, Homo sapien
tgttgacctggatgaactggctgag

SEQ ID NO: 213536 - DNA, 25 bp, Homo sapien
taaagaacagacattcaggccaggc

SEQ ID NO: 213537 - DNA, 25 bp, Homo sapien
aaagaacagacattcaggccaggca

SEQ ID NO: 213538 - DNA, 25 bp, Homo sapien
aagaacagacattcaggccaggcac

SEQ ID NO: 213539 - DNA, 25 bp, Homo sapien
agaacagacattcaggccaggcacg

SEQ ID NO: 213540 - DNA, 25 bp, Homo sapien
gaacagacattcaggccaggcacgg

SEQ ID NO: 213541 - DNA, 25 bp, Homo sapien
aacagacattcaggccaggcacggt

SEQ ID NO: 213542 - DNA, 25 bp, Homo sapien
acagacattcaggccaggcacggtg

SEQ ID NO: 213543 - DNA, 25 bp, Homo sapien
cagacattcaggccaggcacggtga

SEQ ID NO: 213544 - DNA, 25 bp, Homo sapien
agacattcaggccaggcacggtgac

SEQ ID NO: 213545 - DNA, 25 bp, Homo sapien
aactagctgggggtggtggtgtatg

SEQ ID NO: 213546 - DNA, 25 bp, Homo sapien
actagctgggggtggtggtgtatgc

SEQ ID NO: 213547 - DNA, 25 bp, Homo sapien
gagacaaaaaagtcgcaaccaattg

SEQ ID NO: 213548 - DNA, 25 bp, Homo sapien
aaaaaagtcgcaaccaattgaagat

SEQ ID NO: 213549 - DNA, 25 bp, Homo sapien
aaaagtcgcaaccaattgaagattg

SEQ ID NO: 213550 - DNA, 25 bp, Homo sapien
agtcgcaaccaattgaagattgggc

SEQ ID NO: 213551 - DNA, 25 bp, Homo sapien
cgcaaccaattgaagattgggcaat

SEQ ID NO: 213552 - DNA, 25 bp, Homo sapien
tgaagattgggcaatagatttggcc

SEQ ID NO: 213553 - DNA, 25 bp, Homo sapien
attgggcaatagatttggcccagac

SEQ ID NO: 213554 - DNA, 25 bp, Homo sapien
ggcaatagatttggcccagactgag

SEQ ID NO: 213555 - DNA, 25 bp, Homo sapien
aatagatttggcccagactgaggca

SEQ ID NO: 213556 - DNA, 25 bp, Homo sapien
actgaggcagatgggtgaatagtaa

SEQ ID NO: 213557 - DNA, 25 bp, Homo sapien
ggcagatgggtgaatagtaaaaaca

SEQ ID NO: 213558 - DNA, 25 bp, Homo sapien
gagaccatatgactaataataaata

SEQ ID NO: 213559 - DNA, 25 bp, Homo sapien
agaccatatgactaataataaataa

SEQ ID NO: 213560 - DNA, 25 bp, Homo sapien
aaatatatgaaataccctgtttggc

SEQ ID NO: 213561 - DNA, 25 bp, Homo sapien
aatatatgaaataccctgtttggcc

SEQ ID NO: 213562 - DNA, 25 bp, Homo sapien
atatatgaaataccctgtttggccg

SEQ ID NO: 213563 - DNA, 25 bp, Homo sapien
tatatgaaataccctgtttggccgg

SEQ ID NO: 213564 - DNA, 25 bp, Homo sapien
atatgaaataccctgtttggccggg

SEQ ID NO: 213565 - DNA, 25 bp, Homo sapien
tatgaaataccctgtttggccgggc

SEQ ID NO: 213566 - DNA, 25 bp, Homo sapien
atgaaataccctgtttggccgggcg

SEQ ID NO: 213567 - DNA, 25 bp, Homo sapien
tgaaataccctgtttggccgggcgc

SEQ ID NO: 213568 - DNA, 25 bp, Homo sapien
gaaataccctgtttggccgggcgcg

SEQ ID NO: 213569 - DNA, 25 bp, Homo sapien
agtactctgtctcctagatcttatt

SEQ ID NO: 213570 - DNA, 25 bp, Homo sapien
gtcatgcaacatggtcactttgtgg

SEQ ID NO: 213571 - DNA, 25 bp, Homo sapien
tgtggtcaccaactgtcctaaaaag

SEQ ID NO: 213572 - DNA, 25 bp, Homo sapien
ttgggacaaattccacagtgtcatg

SEQ ID NO: 213573 - DNA, 25 bp, Homo sapien
ccacagtgtcatggtatggatgaaa

SEQ ID NO: 213574 - DNA, 25 bp, Homo sapien
aataggcactattgagaacacttaa

SEQ ID NO: 213575 - DNA, 25 bp, Homo sapien
atcatctcatggaaaggtgggcagg

SEQ ID NO: 213576 - DNA, 25 bp, Homo sapien
ggtgccacagaacccttcgtgtgta

SEQ ID NO: 213577 - DNA, 25 bp, Homo sapien
acccttcgtgtgtatctgtgtttta

SEQ ID NO: 213578 - DNA, 25 bp, Homo sapien
gttttagcgaaggaaccctctgctc

SEQ ID NO: 213579 - DNA, 25 bp, Homo sapien
cctgtggctctctctatttattgag

SEQ ID NO: 213580 - DNA, 25 bp, Homo sapien
agccgccctggtaagcagaaactca

SEQ ID NO: 213581 - DNA, 25 bp, Homo sapien
aactcaagaaacttctagggtcctg

SEQ ID NO: 213582 - DNA, 25 bp, Homo sapien
gaaacttctagggtcctgttttctg

SEQ ID NO: 213583 - DNA, 25 bp, Homo sapien
tggtcgtatgatcccaggagtgcac

SEQ ID NO: 213584 - DNA, 25 bp, Homo sapien
ccaggagtgcacatgggcccctcgg

SEQ ID NO: 213585 - DNA, 25 bp, Homo sapien
ggcccctcgggtgtctgaacagaag

SEQ ID NO: 213586 - DNA, 25 bp, Homo sapien
aagggcataggagggagggccgcag

SEQ ID NO: 213587 - DNA, 25 bp, Homo sapien
agccctgcagtcttactctgctggt

SEQ ID NO: 213588 - DNA, 25 bp, Homo sapien
gctggtgtagcggtcacctgccaac

SEQ ID NO: 213589 - DNA, 25 bp, Homo sapien
tggtgtagcggtcacctgccaactc

SEQ ID NO: 213590 - DNA, 25 bp, Homo sapien
ggtgtagcggtcacctgccaactcc

SEQ ID NO: 213591 - DNA, 25 bp, Homo sapien
gaacaatcatcagctggaactggca

SEQ ID NO: 213592 - DNA, 25 bp, Homo sapien
ggaactggcaaagcagctacacaaa

SEQ ID NO: 213593 - DNA, 25 bp, Homo sapien
cagctacacaaagagggtcatctct

SEQ ID NO: 213594 - DNA, 25 bp, Homo sapien
gagggtcatctcttctattgtacct

SEQ ID NO: 213595 - DNA, 25 bp, Homo sapien
gtcatctcttctattgtacctgcag

SEQ ID NO: 213596 - DNA, 25 bp, Homo sapien
tcttctattgtacctgcagcacgct

SEQ ID NO: 213597 - DNA, 25 bp, Homo sapien
tgcagcacgcttcctgggctgttac

SEQ ID NO: 213598 - DNA, 25 bp, Homo sapien
gggctgttacagtcaatggacttat

SEQ ID NO: 213599 - DNA, 25 bp, Homo sapien
tcctggccagccagaaaaattttct

SEQ ID NO: 213600 - DNA, 25 bp, Homo sapien
gcatttttggataaagttgttggat

SEQ ID NO: 213601 - DNA, 25 bp, Homo sapien
aataaacactaaactctcaacactt

SEQ ID NO: 213602 - DNA, 25 bp, Homo sapien
gaaacctggcagacatcaactcacc

SEQ ID NO: 213603 - DNA, 25 bp, Homo sapien
ggcagacatcaactcaccaagtgat

SEQ ID NO: 213604 - DNA, 25 bp, Homo sapien
gttaacatcacctgattaaactggc

SEQ ID NO: 213605 - DNA, 25 bp, Homo sapien
catcacctgattaaactggcattgt

SEQ ID NO: 213606 - DNA, 25 bp, Homo sapien
acctgattaaactggcattgtatgc

SEQ ID NO: 213607 - DNA, 25 bp, Homo sapien
aaactggcattgtatgcttcatgat

SEQ ID NO: 213608 - DNA, 25 bp, Homo sapien
ggcattgtatgcttcatgatatgat

SEQ ID NO: 213609 - DNA, 25 bp, Homo sapien
gtatgcttcatgatatgatgcataa

SEQ ID NO: 213610 - DNA, 25 bp, Homo sapien
gatgcataaaggaggatatatcact

SEQ ID NO: 213611 - DNA, 25 bp, Homo sapien
caaaataaatgttccatcctattaa

SEQ ID NO: 213612 - DNA, 25 bp, Homo sapien
agtaatatttcagtggagaaacctg

SEQ ID NO: 213613 - DNA, 25 bp, Homo sapien
gtggccaagttctatgctgcggcca

SEQ ID NO: 213614 - DNA, 25 bp, Homo sapien
ccaagttctatgctgcggccatgaa

SEQ ID NO: 213615 - DNA, 25 bp, Homo sapien
aagttctatgctgcggccatgaatg

SEQ ID NO: 213616 - DNA, 25 bp, Homo sapien
ctatgctgcggccatgaatgctggg

SEQ ID NO: 213617 - DNA, 25 bp, Homo sapien
gggccccgtctcgtgggattattga

SEQ ID NO: 213618 - DNA, 25 bp, Homo sapien
ccgtctcgtgggattattgattcct

SEQ ID NO: 213619 - DNA, 25 bp, Homo sapien
tctcgtgggattattgattcctgat

SEQ ID NO: 213620 - DNA, 25 bp, Homo sapien
gattcctgatccaagaagggtcctc

SEQ ID NO: 213621 - DNA, 25 bp, Homo sapien
ttcctgatccaagaagggtcctctg

SEQ ID NO: 213622 - DNA, 25 bp, Homo sapien
cctgatccaagaagggtcctctggg

SEQ ID NO: 213623 - DNA, 25 bp, Homo sapien
tctggggttcttccaacaacctatt

SEQ ID NO: 213624 - DNA, 25 bp, Homo sapien
aagggcataggagggagggccgcag

SEQ ID NO: 213625 - DNA, 25 bp, Homo sapien
ctgctggtgtagcggtcacctgcca

SEQ ID NO: 213626 - DNA, 25 bp, Homo sapien
tgctggtgtagcggtcacctgccaa

SEQ ID NO: 213627 - DNA, 25 bp, Homo sapien
gctggtgtagcggtcacctgccaac

SEQ ID NO: 213628 - DNA, 25 bp, Homo sapien
ctggtgtagcggtcacctgccaact

SEQ ID NO: 213629 - DNA, 25 bp, Homo sapien
tggtgtagcggtcacctgccaactc

SEQ ID NO: 213630 - DNA, 25 bp, Homo sapien
ggtgtagcggtcacctgccaactcc

SEQ ID NO: 213631 - DNA, 25 bp, Homo sapien
gtgtagcggtcacctgccaactccc

SEQ ID NO: 213632 - DNA, 25 bp, Homo sapien
tgtagcggtcacctgccaactccca

SEQ ID NO: 213633 - DNA, 25 bp, Homo sapien
gtagcggtcacctgccaactcccac

SEQ ID NO: 213634 - DNA, 25 bp, Homo sapien
ctaccactatgaggtgtgtgtgact

SEQ ID NO: 213635 - DNA, 25 bp, Homo sapien
ccactatgaggtgtgtgtgactgga

SEQ ID NO: 213636 - DNA, 25 bp, Homo sapien
ctatgaggtgtgtgtgactggaggc

SEQ ID NO: 213637 - DNA, 25 bp, Homo sapien
gactggaggctccaggtcaaataag

SEQ ID NO: 213638 - DNA, 25 bp, Homo sapien
tggaggctccaggtcaaataagttc

SEQ ID NO: 213639 - DNA, 25 bp, Homo sapien
gaggctccaggtcaaataagttcaa

SEQ ID NO: 213640 - DNA, 25 bp, Homo sapien
aggctccaggtcaaataagttcaaa

SEQ ID NO: 213641 - DNA, 25 bp, Homo sapien
ggctccaggtcaaataagttcaaat

SEQ ID NO: 213642 - DNA, 25 bp, Homo sapien
gctccaggtcaaataagttcaaatt

SEQ ID NO: 213643 - DNA, 25 bp, Homo sapien
aggtcaaataagttcaaatttctga

SEQ ID NO: 213644 - DNA, 25 bp, Homo sapien
gtgaagtcgaagaaaatcccccatt

SEQ ID NO: 213645 - DNA, 25 bp, Homo sapien
ggaggaggctgattgcactccacaa

SEQ ID NO: 213646 - DNA, 25 bp, Homo sapien
gattgcactccacaaacaggactgt

SEQ ID NO: 213647 - DNA, 25 bp, Homo sapien
aacaggactgtctggaccaagggaa

SEQ ID NO: 213648 - DNA, 25 bp, Homo sapien
ctgtctggaccaagggaaactggca

SEQ ID NO: 213649 - DNA, 25 bp, Homo sapien
gaagtggaatcctagccacggctgc

SEQ ID NO: 213650 - DNA, 25 bp, Homo sapien
gaatcctagccacggctgcggagct

SEQ ID NO: 213651 - DNA, 25 bp, Homo sapien
tgcggagctctcgtgatgaaggcca

SEQ ID NO: 213652 - DNA, 25 bp, Homo sapien
tgaaggccagagtgctgactgacat

SEQ ID NO: 213653 - DNA, 25 bp, Homo sapien
gctgactgacatgccgggtggacca

SEQ ID NO: 213654 - DNA, 25 bp, Homo sapien
agcacgaatgctcatgaccttggtt

SEQ ID NO: 213655 - DNA, 25 bp, Homo sapien
acgaatgctcatgaccttggtttag

SEQ ID NO: 213656 - DNA, 25 bp, Homo sapien
ctattcttaagaggccttcatctgc

SEQ ID NO: 213657 - DNA, 25 bp, Homo sapien
taagaggccttcatctgccatcact

SEQ ID NO: 213658 - DNA, 25 bp, Homo sapien
ccatcactcgtgtctctcagtgaaa

SEQ ID NO: 213659 - DNA, 25 bp, Homo sapien
actcgtgtctctcagtgaaaggctg

SEQ ID NO: 213660 - DNA, 25 bp, Homo sapien
ggctgcttaaacagaaagctggatt

SEQ ID NO: 213661 - DNA, 25 bp, Homo sapien
gctggattttctgcagtcttagagc

SEQ ID NO: 213662 - DNA, 25 bp, Homo sapien
gcagtcttagagcattatagccatt

SEQ ID NO: 213663 - DNA, 25 bp, Homo sapien
gagcattatagccatttgctacttt

SEQ ID NO: 213664 - DNA, 25 bp, Homo sapien
atatattcctaatatgcatgtactt

SEQ ID NO: 213665 - DNA, 25 bp, Homo sapien
gtgcaaattgttaagtaccacactt

SEQ ID NO: 213666 - DNA, 25 bp, Homo sapien
gtaccacactttacacagcatttca

SEQ ID NO: 213667 - DNA, 25 bp, Homo sapien
aaagaaaacgccctctcctgacttg

SEQ ID NO: 213668 - DNA, 25 bp, Homo sapien
aagaaaacgccctctcctgacttgt

SEQ ID NO: 213669 - DNA, 25 bp, Homo sapien
gaaaacgccctctcctgacttgtat

SEQ ID NO: 213670 - DNA, 25 bp, Homo sapien
aaaacgccctctcctgacttgtatt

SEQ ID NO: 213671 - DNA, 25 bp, Homo sapien
aaacgccctctcctgacttgtattg

SEQ ID NO: 213672 - DNA, 25 bp, Homo sapien
aacgccctctcctgacttgtattgt

SEQ ID NO: 213673 - DNA, 25 bp, Homo sapien
acgccctctcctgacttgtattgtg

SEQ ID NO: 213674 - DNA, 25 bp, Homo sapien
cgccctctcctgacttgtattgtgg

SEQ ID NO: 213675 - DNA, 25 bp, Homo sapien
ccctctcctgacttgtattgtggca

SEQ ID NO: 213676 - DNA, 25 bp, Homo sapien
cctctcctgacttgtattgtggcag

SEQ ID NO: 213677 - DNA, 25 bp, Homo sapien
ctctcctgacttgtattgtggcagt

SEQ ID NO: 213678 - DNA, 25 bp, Homo sapien
aatgcttgtggaaaattaacctagg

SEQ ID NO: 213679 - DNA, 25 bp, Homo sapien
ataacccttataacaatttcaaatg

SEQ ID NO: 213680 - DNA, 25 bp, Homo sapien
aatactatctggatttgaacttcaa

SEQ ID NO: 213681 - DNA, 25 bp, Homo sapien
ttgaacttcaatacttttcctaagt

SEQ ID NO: 213682 - DNA, 25 bp, Homo sapien
agaagttatgtttgttgatgttcac

SEQ ID NO: 213683 - DNA, 25 bp, Homo sapien
gttgatgttcactcatctataccct

SEQ ID NO: 213684 - DNA, 25 bp, Homo sapien
tataccctccatattctcagcaaag

SEQ ID NO: 213685 - DNA, 25 bp, Homo sapien
catattctcagcaaagttggcataa

SEQ ID NO: 213686 - DNA, 25 bp, Homo sapien
gttggcataaatctgacctgaataa

SEQ ID NO: 213687 - DNA, 25 bp, Homo sapien
cagggttataacattatcaggcttg

SEQ ID NO: 213688 - DNA, 25 bp, Homo sapien
cattatcaggcttgtaaaatacttt

SEQ ID NO: 213689 - DNA, 25 bp, Homo sapien
gctccagattgtgaaatcatacagg

SEQ ID NO: 213690 - DNA, 25 bp, Homo sapien
aagtgggaaaactctatccactgga

SEQ ID NO: 213691 - DNA, 25 bp, Homo sapien
aggcaaaaaccatccagcagacttt

SEQ ID NO: 213692 - DNA, 25 bp, Homo sapien
cagcagactttaattttggcaaaca

SEQ ID NO: 213693 - DNA, 25 bp, Homo sapien
tttggcaaacattttagaagcttgt

SEQ ID NO: 213694 - DNA, 25 bp, Homo sapien
gcttgtgaacacatgacgtcagatc

SEQ ID NO: 213695 - DNA, 25 bp, Homo sapien
aaacagatcttctccagattggcag

SEQ ID NO: 213696 - DNA, 25 bp, Homo sapien
gatcttctccagattggcagaaagt

SEQ ID NO: 213697 - DNA, 25 bp, Homo sapien
ataggtggacttttttacaggtcag

SEQ ID NO: 213698 - DNA, 25 bp, Homo sapien
cttttttacaggtcagttgaggcaa

SEQ ID NO: 213699 - DNA, 25 bp, Homo sapien
cctcccccatttaaatactcagaag

SEQ ID NO: 213700 - DNA, 25 bp, Homo sapien
gaggagctgcctgttcactgggatc

SEQ ID NO: 213701 - DNA, 25 bp, Homo sapien
ggagctgcctgttcactgggatcag

SEQ ID NO: 213702 - DNA, 25 bp, Homo sapien
tgcctgttcactgggatcagccagg

SEQ ID NO: 213703 - DNA, 25 bp, Homo sapien
ttcactgggatcagccagggcgccg

SEQ ID NO: 213704 - DNA, 25 bp, Homo sapien
aaggcagaggatgtagccccattgg

SEQ ID NO: 213705 - DNA, 25 bp, Homo sapien
gtggaggaaggacatgtaccctttc

SEQ ID NO: 213706 - DNA, 25 bp, Homo sapien
gaaggacatgtaccctttcatgcct

SEQ ID NO: 213707 - DNA, 25 bp, Homo sapien
acatgtaccctttcatgcctacaca

SEQ ID NO: 213708 - DNA, 25 bp, Homo sapien
ctacacacccctcattaaagcagag

SEQ ID NO: 213709 - DNA, 25 bp, Homo sapien
acacccctcattaaagcagagtcgt

SEQ ID NO: 213710 - DNA, 25 bp, Homo sapien
taaagcagagtcgtggcatctcaaa

SEQ ID NO: 213711 - DNA, 25 bp, Homo sapien
ggctgcgatattagatttccttgta

SEQ ID NO: 213712 - DNA, 25 bp, Homo sapien
ggagaaaactgcatcataactttac

SEQ ID NO: 213713 - DNA, 25 bp, Homo sapien
gaattgaatctagagtcttccccga

SEQ ID NO: 213714 - DNA, 25 bp, Homo sapien
gaatctagagtcttccccgaaaagc

SEQ ID NO: 213715 - DNA, 25 bp, Homo sapien
gaaacttctctgcagtatctggctt

SEQ ID NO: 213716 - DNA, 25 bp, Homo sapien
tatctggcttgtccatctggtctaa

SEQ ID NO: 213717 - DNA, 25 bp, Homo sapien
atctggtctaaggtggctgcttctt

SEQ ID NO: 213718 - DNA, 25 bp, Homo sapien
cagccatgagtcagtttgtgcccat

SEQ ID NO: 213719 - DNA, 25 bp, Homo sapien
tgcccatgaataatacacgacctgt

SEQ ID NO: 213720 - DNA, 25 bp, Homo sapien
acacgacctgttatttccatgactg

SEQ ID NO: 213721 - DNA, 25 bp, Homo sapien
tccatgactgctttactgtattttt

SEQ ID NO: 213722 - DNA, 25 bp, Homo sapien
gggagttaatgacacacttgtccag

SEQ ID NO: 213723 - DNA, 25 bp, Homo sapien
caatgctcagcctaaacacgctaac

SEQ ID NO: 213724 - DNA, 25 bp, Homo sapien
taaacacgctaacatggtgccccac

SEQ ID NO: 213725 - DNA, 25 bp, Homo sapien
ctgtgggctgcctcctcacatttgt

SEQ ID NO: 213726 - DNA, 25 bp, Homo sapien
ctcacatttgtcctgcgctagataa

SEQ ID NO: 213727 - DNA, 25 bp, Homo sapien
gtcctgcgctagataagcaatcttg

SEQ ID NO: 213728 - DNA, 25 bp, Homo sapien
tcagaacttaagagatgtgccatct

SEQ ID NO: 213729 - DNA, 25 bp, Homo sapien
agatgtgccatcttgcatttggaaa

SEQ ID NO: 213730 - DNA, 25 bp, Homo sapien
ttactgaactcaggtacagcagtct

SEQ ID NO: 213731 - DNA, 25 bp, Homo sapien
gtacagcagtctcatcactcctatt

SEQ ID NO: 213732 - DNA, 25 bp, Homo sapien
tccttctgctggaatgtttgttttc

SEQ ID NO: 213733 - DNA, 25 bp, Homo sapien
tgactaccaatcttttttgagcaac

SEQ ID NO: 213734 - DNA, 25 bp, Homo sapien
gatttatgtcacttttattacaggg

SEQ ID NO: 213735 - DNA, 25 bp, Homo sapien
tgcatagtggtgaaatctgggctta

SEQ ID NO: 213736 - DNA, 25 bp, Homo sapien
aatctgggcttagtataccctcacc

SEQ ID NO: 213737 - DNA, 25 bp, Homo sapien
tagtataccctcacccaaatagtat

SEQ ID NO: 213738 - DNA, 25 bp, Homo sapien
gtacctagtaaatactttcccatct

SEQ ID NO: 213739 - DNA, 25 bp, Homo sapien
actcccacctttgaaggctctagtg

SEQ ID NO: 213740 - DNA, 25 bp, Homo sapien
agtgtctatgactctgctctccacg

SEQ ID NO: 213741 - DNA, 25 bp, Homo sapien
tccacgtccaggtgtacacattgtt

SEQ ID NO: 213742 - DNA, 25 bp, Homo sapien
tatctcccacttacgagaacatgtg

SEQ ID NO: 213743 - DNA, 25 bp, Homo sapien
gactttctgtatcattacttcactt

SEQ ID NO: 213744 - DNA, 25 bp, Homo sapien
tgtcctgccaggaagtcctgtggcc

SEQ ID NO: 213745 - DNA, 25 bp, Homo sapien
tacttgctggtgtccgccggctgct

SEQ ID NO: 213746 - DNA, 25 bp, Homo sapien
gcactgtgggctatcgtgtggccac

SEQ ID NO: 213747 - DNA, 25 bp, Homo sapien
tatcgtgtggccacttttcatgact

SEQ ID NO: 213748 - DNA, 25 bp, Homo sapien
tgtggccacttttcatgactgcgag

SEQ ID NO: 213749 - DNA, 25 bp, Homo sapien
acttttcatgactgcgaggacgccg

SEQ ID NO: 213750 - DNA, 25 bp, Homo sapien
atgactgcgaggacgccgcacgcga

SEQ ID NO: 213751 - DNA, 25 bp, Homo sapien
ctgcagagccagatacaggaggccc

SEQ ID NO: 213752 - DNA, 25 bp, Homo sapien
gccagatacaggaggcccgagccga

SEQ ID NO: 213753 - DNA, 25 bp, Homo sapien
gggcgtgcgcttctgacagcctaac

SEQ ID NO: 213754 - DNA, 25 bp, Homo sapien
cctgaccacgggagccttgggcctg

SEQ ID NO: 213755 - DNA, 25 bp, Homo sapien
gaacatctgatgttaacttgacagt

SEQ ID NO: 213756 - DNA, 25 bp, Homo sapien
gttaacttgacagtcttgtctcgtg

SEQ ID NO: 213757 - DNA, 25 bp, Homo sapien
gacagtcttgtctcgtgtattgaat

SEQ ID NO: 213758 - DNA, 25 bp, Homo sapien
gtctcgtgtattgaattcgtgccaa

SEQ ID NO: 213759 - DNA, 25 bp, Homo sapien
gaattcgtgccaaaggtgagggtaa

SEQ ID NO: 213760 - DNA, 25 bp, Homo sapien
gagttgtgtcctgtatgtttaggat

SEQ ID NO: 213761 - DNA, 25 bp, Homo sapien
cattaagtaattttggtttgttcag

SEQ ID NO: 213762 - DNA, 25 bp, Homo sapien
ggtctgatgtagttccatgtaccaa

SEQ ID NO: 213763 - DNA, 25 bp, Homo sapien
gtagttccatgtaccaatgatagtt

SEQ ID NO: 213764 - DNA, 25 bp, Homo sapien
gtaacatatacttgtacttctagct

SEQ ID NO: 213765 - DNA, 25 bp, Homo sapien
atacttgtacttctagctagataca

SEQ ID NO: 213766 - DNA, 25 bp, Homo sapien
caggatctcctgcaatcatctccat

SEQ ID NO: 213767 - DNA, 25 bp, Homo sapien
tgcaatcatctccatccggcaggag

SEQ ID NO: 213768 - DNA, 25 bp, Homo sapien
gcaggagcctactaacagccaaatt

SEQ ID NO: 213769 - DNA, 25 bp, Homo sapien
aaagtgacttcataaccttcggcaa

SEQ ID NO: 213770 - DNA, 25 bp, Homo sapien
gggaacagcacgactgacaacagtg

SEQ ID NO: 213771 - DNA, 25 bp, Homo sapien
aacagtgaccagtgaggtcctcaaa

SEQ ID NO: 213772 - DNA, 25 bp, Homo sapien
atggaaacaagccacttagccagtt

SEQ ID NO: 213773 - DNA, 25 bp, Homo sapien
gtaataatggcaaatctctcccatg

SEQ ID NO: 213774 - DNA, 25 bp, Homo sapien
gcaaatctctcccatgtagcaattc

SEQ ID NO: 213775 - DNA, 25 bp, Homo sapien
ttttcctatctacatgagccctctt

SEQ ID NO: 213776 - DNA, 25 bp, Homo sapien
tctacatgagccctcttagagacct

SEQ ID NO: 213777 - DNA, 25 bp, Homo sapien
cttcccaggaatctttgttgtatat

SEQ ID NO: 213778 - DNA, 25 bp, Homo sapien
tttgataaccatttgattaacttta

SEQ ID NO: 213779 - DNA, 25 bp, Homo sapien
acacacatgtatctgtatagtttta

SEQ ID NO: 213780 - DNA, 25 bp, Homo sapien
atacacatagacatacagagaacca

SEQ ID NO: 213781 - DNA, 25 bp, Homo sapien
agacatacagagaaccactactttg

SEQ ID NO: 213782 - DNA, 25 bp, Homo sapien
acagagaaccactactttgtaatag

SEQ ID NO: 213783 - DNA, 25 bp, Homo sapien
tgttactattttatctggccagcgt

SEQ ID NO: 213784 - DNA, 25 bp, Homo sapien
tatctggccagcgtaatagttttat

SEQ ID NO: 213785 - DNA, 25 bp, Homo sapien
ggccagcgtaatagttttatttaga

SEQ ID NO: 213786 - DNA, 25 bp, Homo sapien
aattctgtagattaaagcaaatgac

SEQ ID NO: 213787 - DNA, 25 bp, Homo sapien
aatgacagttattgaactatcacaa

SEQ ID NO: 213788 - DNA, 25 bp, Homo sapien
cctcgagtgggggactgtacagacc

SEQ ID NO: 213789 - DNA, 25 bp, Homo sapien
gtgggggactgtacagaccccgtct

SEQ ID NO: 213790 - DNA, 25 bp, Homo sapien
gggactgtacagaccccgtctccgc

SEQ ID NO: 213791 - DNA, 25 bp, Homo sapien
ggaggagctgcccacctgattcccg

SEQ ID NO: 213792 - DNA, 25 bp, Homo sapien
aggagctgcccacctgattcccgga

SEQ ID NO: 213793 - DNA, 25 bp, Homo sapien
cccaactccgcgtgagacagagaat

SEQ ID NO: 213794 - DNA, 25 bp, Homo sapien
ccaactccgcgtgagacagagaatt

SEQ ID NO: 213795 - DNA, 25 bp, Homo sapien
caactccgcgtgagacagagaatta

SEQ ID NO: 213796 - DNA, 25 bp, Homo sapien
aactccgcgtgagacagagaattat

SEQ ID NO: 213797 - DNA, 25 bp, Homo sapien
actccgcgtgagacagagaattatt

SEQ ID NO: 213798 - DNA, 25 bp, Homo sapien
tccgcgtgagacagagaattattca

SEQ ID NO: 213799 - DNA, 25 bp, Homo sapien
tctggacaccaaacagattgagatg

SEQ ID NO: 213800 - DNA, 25 bp, Homo sapien
aaggaactcgagttccaggacctga

SEQ ID NO: 213801 - DNA, 25 bp, Homo sapien
tcgagttccaggacctgagggctgt

SEQ ID NO: 213802 - DNA, 25 bp, Homo sapien
tcatagcagccaaggtggcctccgt

SEQ ID NO: 213803 - DNA, 25 bp, Homo sapien
accccggcttcatggacagtcagag

SEQ ID NO: 213804 - DNA, 25 bp, Homo sapien
ggacagtcagagtcttgccagaaaa

SEQ ID NO: 213805 - DNA, 25 bp, Homo sapien
gccagaaaatacatgtacagcagct

SEQ ID NO: 213806 - DNA, 25 bp, Homo sapien
acagcagctaaaggttgtttctgtt

SEQ ID NO: 213807 - DNA, 25 bp, Homo sapien
gattctttcctgcagaatattgcaa

SEQ ID NO: 213808 - DNA, 25 bp, Homo sapien
gtgttgttttatgatgagcctatag

SEQ ID NO: 213809 - DNA, 25 bp, Homo sapien
gatgagcctatagttgtgataccaa

SEQ ID NO: 213810 - DNA, 25 bp, Homo sapien
gacatggttgggaagacgtcaccaa

SEQ ID NO: 213811 - DNA, 25 bp, Homo sapien
gtagaattactgtttacacacattt

SEQ ID NO: 213812 - DNA, 25 bp, Homo sapien
tatattttatcaccaacatttcaag

SEQ ID NO: 213813 - DNA, 25 bp, Homo sapien
acacgcattgatttttgcctggaat

SEQ ID NO: 213814 - DNA, 25 bp, Homo sapien
atggtatacacctccaacttttatg

SEQ ID NO: 213815 - DNA, 25 bp, Homo sapien
acacctccaacttttatgatagctg

SEQ ID NO: 213816 - DNA, 25 bp, Homo sapien
atgatagctgttttccttccaattg

SEQ ID NO: 213817 - DNA, 25 bp, Homo sapien
agctgttttccttccaattgttgtc

SEQ ID NO: 213818 - DNA, 25 bp, Homo sapien
tccaattgttgtcctgatatttaaa

SEQ ID NO: 213819 - DNA, 25 bp, Homo sapien
ttaaaagcatactattcctgccatg

SEQ ID NO: 213820 - DNA, 25 bp, Homo sapien
actattcctgccatgcttgaggaag

SEQ ID NO: 213821 - DNA, 25 bp, Homo sapien
cagagccacgcagcggtgctatgga

SEQ ID NO: 213822 - DNA, 25 bp, Homo sapien
gtgctatggatggagtaccacctga

SEQ ID NO: 213823 - DNA, 25 bp, Homo sapien
atggagtaccacctgaccccggagt

SEQ ID NO: 213824 - DNA, 25 bp, Homo sapien
ggagtgcacgctcagcactggcctc

SEQ ID NO: 213825 - DNA, 25 bp, Homo sapien
tgcaagcaggccgtctacttcttca

SEQ ID NO: 213826 - DNA, 25 bp, Homo sapien
ccagatcccagagcactgctgggtg

SEQ ID NO: 213827 - DNA, 25 bp, Homo sapien
agcactgctgggtggcccacggact

SEQ ID NO: 213828 - DNA, 25 bp, Homo sapien
tatgcagtggagtttcaccccgaca

SEQ ID NO: 213829 - DNA, 25 bp, Homo sapien
agtttcaccccgacacaggcgacat

SEQ ID NO: 213830 - DNA, 25 bp, Homo sapien
gagttcaggcatgcagataccccag

SEQ ID NO: 213831 - DNA, 25 bp, Homo sapien
atgcagataccccagactgaccact

SEQ ID NO: 213832 - DNA, 25 bp, Homo sapien
gagctttggcatcagacgtagtttt

SEQ ID NO: 213833 - DNA, 25 bp, Homo sapien
gagttgactattctactgcttgtta

SEQ ID NO: 213834 - DNA, 25 bp, Homo sapien
tactgcttgttagctgggtagccaa

SEQ ID NO: 213835 - DNA, 25 bp, Homo sapien
gttagctgggtagccaaagctcaaa

SEQ ID NO: 213836 - DNA, 25 bp, Homo sapien
aaaaccaggcttccgtagcacagta

SEQ ID NO: 213837 - DNA, 25 bp, Homo sapien
caggcttccgtagcacagtagaaat

SEQ ID NO: 213838 - DNA, 25 bp, Homo sapien
ggcgacttttgatggagtttcctct

SEQ ID NO: 213839 - DNA, 25 bp, Homo sapien
gagtttcctctcatagtgatttgcc

SEQ ID NO: 213840 - DNA, 25 bp, Homo sapien
gtgatttgccacaaaggaccttctg

SEQ ID NO: 213841 - DNA, 25 bp, Homo sapien
aacacaggatcagcataaccgccaa

SEQ ID NO: 213842 - DNA, 25 bp, Homo sapien
agcataaccgccaaagtgcaatata

SEQ ID NO: 213843 - DNA, 25 bp, Homo sapien
accatggttaagggattatatggaa

SEQ ID NO: 213844 - DNA, 25 bp, Homo sapien
ccatggttaagggattatatggaat

SEQ ID NO: 213845 - DNA, 25 bp, Homo sapien
gaaaaatcttaggagagtgcaccca

SEQ ID NO: 213846 - DNA, 25 bp, Homo sapien
aaaaatcttaggagagtgcacccag

SEQ ID NO: 213847 - DNA, 25 bp, Homo sapien
aaaatcttaggagagtgcacccagt

SEQ ID NO: 213848 - DNA, 25 bp, Homo sapien
tccaccatggttaagggattatatg

SEQ ID NO: 213849 - DNA, 25 bp, Homo sapien
ccaccatggttaagggattatatgg

SEQ ID NO: 213850 - DNA, 25 bp, Homo sapien
caccatggttaagggattatatgga

SEQ ID NO: 213851 - DNA, 25 bp, Homo sapien
tgcgagaattttgttttccaccctt

SEQ ID NO: 213852 - DNA, 25 bp, Homo sapien
cacccttatttgctgctctttcact

SEQ ID NO: 213853 - DNA, 25 bp, Homo sapien
tttcacttgggcactgactgtagga

SEQ ID NO: 213854 - DNA, 25 bp, Homo sapien
gactgtaggatatgttcccttgcat

SEQ ID NO: 213855 - DNA, 25 bp, Homo sapien
atgttcccttgcatggatgttttta

SEQ ID NO: 213856 - DNA, 25 bp, Homo sapien
aaagttattattttagccctgagca

SEQ ID NO: 213857 - DNA, 25 bp, Homo sapien
attttagccctgagcaaattgcatt

SEQ ID NO: 213858 - DNA, 25 bp, Homo sapien
gggcagttagaatgttgatttccta

SEQ ID NO: 213859 - DNA, 25 bp, Homo sapien
gaatgttgatttcctaacagcattg

SEQ ID NO: 213860 - DNA, 25 bp, Homo sapien
tcctaacagcattgtgaagttgacc

SEQ ID NO: 213861 - DNA, 25 bp, Homo sapien
accattgtgaagtttctgtccttta

SEQ ID NO: 213862 - DNA, 25 bp, Homo sapien
tgggacccaactggccacagcatgg

SEQ ID NO: 213863 - DNA, 25 bp, Homo sapien
gggctagcaacattcctgtatttgg

SEQ ID NO: 213864 - DNA, 25 bp, Homo sapien
atttggatatacttctgctgccgcc

SEQ ID NO: 213865 - DNA, 25 bp, Homo sapien
tgccgcctacattcctggtttagac

SEQ ID NO: 213866 - DNA, 25 bp, Homo sapien
tggtttagacccacctacccagaat

SEQ ID NO: 213867 - DNA, 25 bp, Homo sapien
tccatagttggaggcccttgtgttc

SEQ ID NO: 213868 - DNA, 25 bp, Homo sapien
tgcttttcaacagtgcatcctgcag

SEQ ID NO: 213869 - DNA, 25 bp, Homo sapien
catcctgcagcacacatggacagag

SEQ ID NO: 213870 - DNA, 25 bp, Homo sapien
aaattctacacttcaagcacccact

SEQ ID NO: 213871 - DNA, 25 bp, Homo sapien
agcacccactactatggacaagaaa

SEQ ID NO: 213872 - DNA, 25 bp, Homo sapien
tatgttaggagacatgtctgtttcc

SEQ ID NO: 213873 - DNA, 25 bp, Homo sapien
acgacgacgacgacagcgagaggtt

SEQ ID NO: 213874 - DNA, 25 bp, Homo sapien
acgacgacgacagcgagaggtttaa

SEQ ID NO: 213875 - DNA, 25 bp, Homo sapien
acgacagcgagaggtttaagctcct

SEQ ID NO: 213876 - DNA, 25 bp, Homo sapien
gtacgtgtatgagcacgagcgggaa

SEQ ID NO: 213877 - DNA, 25 bp, Homo sapien
aggcggccagcaaactgaccccgga

SEQ ID NO: 213878 - DNA, 25 bp, Homo sapien
gccagcaaactgaccccggatgatt

SEQ ID NO: 213879 - DNA, 25 bp, Homo sapien
ggatgattcgcctgcgctgacgcct

SEQ ID NO: 213880 - DNA, 25 bp, Homo sapien
gactcggtggcctcgggcagctcgg

SEQ ID NO: 213881 - DNA, 25 bp, Homo sapien
gtgtccgagtcggtgctctgcaccc

SEQ ID NO: 213882 - DNA, 25 bp, Homo sapien
caacgtatcctacgcctctgtcatt

SEQ ID NO: 213883 - DNA, 25 bp, Homo sapien
atcctacgcctctgtcattctgcgg

SEQ ID NO: 213884 - DNA, 25 bp, Homo sapien
agcgagggctccttagccaatggtt

SEQ ID NO: 213885 - DNA, 25 bp, Homo sapien
agcctctgaggacaatgccgccagc

SEQ ID NO: 213886 - DNA, 25 bp, Homo sapien
agccttgtcagctcctccgatggct

SEQ ID NO: 213887 - DNA, 25 bp, Homo sapien
tcgctgatgctcactttgcccgggc

SEQ ID NO: 213888 - DNA, 25 bp, Homo sapien
ctgtggatagctttggtttcggtct

SEQ ID NO: 213889 - DNA, 25 bp, Homo sapien
ttggtttcggtctagagcccaggga

SEQ ID NO: 213890 - DNA, 25 bp, Homo sapien
cagggaggcagactgcgtcttcata

SEQ ID NO: 213891 - DNA, 25 bp, Homo sapien
ttcataggtatgtgaggtctcccca

SEQ ID NO: 213892 - DNA, 25 bp, Homo sapien
gtatgtgaggtctccccatcttact

SEQ ID NO: 213893 - DNA, 25 bp, Homo sapien
cccttgcctttctaacaactgttat

SEQ ID NO: 213894 - DNA, 25 bp, Homo sapien
ttctaacaactgttatcatgtcatc

SEQ ID NO: 213895 - DNA, 25 bp, Homo sapien
cagcgagggctccttagccaatggt

SEQ ID NO: 213896 - DNA, 25 bp, Homo sapien
cgagggctccttagccaatggttgg

SEQ ID NO: 213897 - DNA, 25 bp, Homo sapien
ttgtcagctcctccgatggctcctt

SEQ ID NO: 213898 - DNA, 25 bp, Homo sapien
atggctccttcctcgctgatgctca

SEQ ID NO: 213899 - DNA, 25 bp, Homo sapien
tcgctgatgctcactttgcccgggc

SEQ ID NO: 213900 - DNA, 25 bp, Homo sapien
tgatgctcactttgcccgggccctg

SEQ ID NO: 213901 - DNA, 25 bp, Homo sapien
ctgtggatagctttggtttcggtct

SEQ ID NO: 213902 - DNA, 25 bp, Homo sapien
tagctttggtttcggtctagagccc

SEQ ID NO: 213903 - DNA, 25 bp, Homo sapien
ttggtttcggtctagagcccaggga

SEQ ID NO: 213904 - DNA, 25 bp, Homo sapien
ccagggaggcagactgcgtcttcat

SEQ ID NO: 213905 - DNA, 25 bp, Homo sapien
agggaggcagactgcgtcttcatag

SEQ ID NO: 213906 - DNA, 25 bp, Homo sapien
taaaagcctttctagaaggcagact

SEQ ID NO: 213907 - DNA, 25 bp, Homo sapien
agaaggcagacttagccccagcaga

SEQ ID NO: 213908 - DNA, 25 bp, Homo sapien
agctgctggccgcttagcgttgttt

SEQ ID NO: 213909 - DNA, 25 bp, Homo sapien
gccgcttagcgttgtttgatttttg

SEQ ID NO: 213910 - DNA, 25 bp, Homo sapien
gtttgatttttgaccttgacatagt

SEQ ID NO: 213911 - DNA, 25 bp, Homo sapien
gatttttgaccttgacatagtagat

SEQ ID NO: 213912 - DNA, 25 bp, Homo sapien
atagtagataggcttgtggtttttt

SEQ ID NO: 213913 - DNA, 25 bp, Homo sapien
ttaggtatcgtattttatcagctta

SEQ ID NO: 213914 - DNA, 25 bp, Homo sapien
ttttatcagcttacagtttaatgcc

SEQ ID NO: 213915 - DNA, 25 bp, Homo sapien
taatgcctaagtttcccctggaaat

SEQ ID NO: 213916 - DNA, 25 bp, Homo sapien
taagtttcccctggaaatagcaaat

SEQ ID NO: 213917 - DNA, 25 bp, Homo sapien
agcctcaggacagattgcgctgctt

SEQ ID NO: 213918 - DNA, 25 bp, Homo sapien
cctcaggacagattgcgctgcttga

SEQ ID NO: 213919 - DNA, 25 bp, Homo sapien
tcaggacagattgcgctgcttgaga

SEQ ID NO: 213920 - DNA, 25 bp, Homo sapien
gacagattgcgctgcttgagatgga

SEQ ID NO: 213921 - DNA, 25 bp, Homo sapien
agattgcgctgcttgagatggatgc

SEQ ID NO: 213922 - DNA, 25 bp, Homo sapien
attgcgctgcttgagatggatgccc

SEQ ID NO: 213923 - DNA, 25 bp, Homo sapien
ttgcgctgcttgagatggatgcccg

SEQ ID NO: 213924 - DNA, 25 bp, Homo sapien
cgctgcttgagatggatgcccggct

SEQ ID NO: 213925 - DNA, 25 bp, Homo sapien
ctgcttgagatggatgcccggctgc

SEQ ID NO: 213926 - DNA, 25 bp, Homo sapien
gcttgagatggatgcccggctgcac

SEQ ID NO: 213927 - DNA, 25 bp, Homo sapien
cttgagatggatgcccggctgcacg

SEQ ID NO: 213928 - DNA, 25 bp, Homo sapien
cctattgctataccaatgatgttga

SEQ ID NO: 213929 - DNA, 25 bp, Homo sapien
ctattgctataccaatgatgttgag

SEQ ID NO: 213930 - DNA, 25 bp, Homo sapien
tattgctataccaatgatgttgagt

SEQ ID NO: 213931 - DNA, 25 bp, Homo sapien
atatattccatatctacaactataa

SEQ ID NO: 213932 - DNA, 25 bp, Homo sapien
tatattccatatctacaactataat

SEQ ID NO: 213933 - DNA, 25 bp, Homo sapien
atattccatatctacaactataata

SEQ ID NO: 213934 - DNA, 25 bp, Homo sapien
tattccatatctacaactataatat

SEQ ID NO: 213935 - DNA, 25 bp, Homo sapien
attccatatctacaactataatatc

SEQ ID NO: 213936 - DNA, 25 bp, Homo sapien
ttccatatctacaactataatatca

SEQ ID NO: 213937 - DNA, 25 bp, Homo sapien
aaattctttaacctcccttgtcatg

SEQ ID NO: 213938 - DNA, 25 bp, Homo sapien
taacctcccttgtcatggaaagtga

SEQ ID NO: 213939 - DNA, 25 bp, Homo sapien
gtaatgccaactatgcaggttgttt

SEQ ID NO: 213940 - DNA, 25 bp, Homo sapien
ggtattttgtcctaagaatgtaaat

SEQ ID NO: 213941 - DNA, 25 bp, Homo sapien
ctgggaaatttgaaagccttagagg

SEQ ID NO: 213942 - DNA, 25 bp, Homo sapien
aagccttagaggtgtgcaatttact

SEQ ID NO: 213943 - DNA, 25 bp, Homo sapien
tgtgcaatttactcagattccaggt

SEQ ID NO: 213944 - DNA, 25 bp, Homo sapien
gattccaggtattattcaactagtt

SEQ ID NO: 213945 - DNA, 25 bp, Homo sapien
caactagttgtataacatggaacac

SEQ ID NO: 213946 - DNA, 25 bp, Homo sapien
aacatggaacacagtctctgtcctt

SEQ ID NO: 213947 - DNA, 25 bp, Homo sapien
tgtccttcagtacagcttttttgag

SEQ ID NO: 213948 - DNA, 25 bp, Homo sapien
atggatcgctccactttgaccctga

SEQ ID NO: 213949 - DNA, 25 bp, Homo sapien
ctgaggcctgcagcttccgggagct

SEQ ID NO: 213950 - DNA, 25 bp, Homo sapien
ggagctgcttcttgaggacggatac

SEQ ID NO: 213951 - DNA, 25 bp, Homo sapien
gctgcttcttgaggacggatacaat

SEQ ID NO: 213952 - DNA, 25 bp, Homo sapien
gaggacggatacaatgtttaccagt

SEQ ID NO: 213953 - DNA, 25 bp, Homo sapien
gatacaatgtttaccagtccgaagc

SEQ ID NO: 213954 - DNA, 25 bp, Homo sapien
tacaatgtttaccagtccgaagccc

SEQ ID NO: 213955 - DNA, 25 bp, Homo sapien
atgtttaccagtccgaagcccacgg

SEQ ID NO: 213956 - DNA, 25 bp, Homo sapien
tgccagggaacaagtccccacaccg

SEQ ID NO: 213957 - DNA, 25 bp, Homo sapien
tcctcggaccctctgagcatggtgg

SEQ ID NO: 213958 - DNA, 25 bp, Homo sapien
gaccctctgagcatggtgggacctt

SEQ ID NO: 213959 - DNA, 25 bp, Homo sapien
gccttctacttgctgacgactgcct

SEQ ID NO: 213960 - DNA, 25 bp, Homo sapien
tacttgctgacgactgcctcatctc

SEQ ID NO: 213961 - DNA, 25 bp, Homo sapien
gactgcctcatctcttctgaggttt

SEQ ID NO: 213962 - DNA, 25 bp, Homo sapien
ctgaggtttcctctgataaacaatt

SEQ ID NO: 213963 - DNA, 25 bp, Homo sapien
gtaaaggagataatgtgacacacat

SEQ ID NO: 213964 - DNA, 25 bp, Homo sapien
tgtgacacacatttacccataattg

SEQ ID NO: 213965 - DNA, 25 bp, Homo sapien
tacccataattgagattgccataat

SEQ ID NO: 213966 - DNA, 25 bp, Homo sapien
ttgagattgccataattgctataac

SEQ ID NO: 213967 - DNA, 25 bp, Homo sapien
gagattgccataattgctataactt

SEQ ID NO: 213968 - DNA, 25 bp, Homo sapien
gattgccataattgctataactttt

SEQ ID NO: 213969 - DNA, 25 bp, Homo sapien
gccataattgctataactttttcaa

SEQ ID NO: 213970 - DNA, 25 bp, Homo sapien
taaatcacatgagcggaccttgtct

SEQ ID NO: 213971 - DNA, 25 bp, Homo sapien
gagcggaccttgtctgtcagataag

SEQ ID NO: 213972 - DNA, 25 bp, Homo sapien
ggaaattccatgaccaatacatgtg

SEQ ID NO: 213973 - DNA, 25 bp, Homo sapien
attgacctaatggatggctttttaa

SEQ ID NO: 213974 - DNA, 25 bp, Homo sapien
gatgtttgtttttctagtggttata

SEQ ID NO: 213975 - DNA, 25 bp, Homo sapien
gtggttataccaagctatacttcct

SEQ ID NO: 213976 - DNA, 25 bp, Homo sapien
aagctatacttcctgttttcacgtg

SEQ ID NO: 213977 - DNA, 25 bp, Homo sapien
aacatgggacatgcctttcttttcc

SEQ ID NO: 213978 - DNA, 25 bp, Homo sapien
tgcctttcttttccgatcagtttat

SEQ ID NO: 213979 - DNA, 25 bp, Homo sapien
agctatacagcaaactttggcattt

SEQ ID NO: 213980 - DNA, 25 bp, Homo sapien
ggcatttatgtggagcatttctcat

SEQ ID NO: 213981 - DNA, 25 bp, Homo sapien
atgatggccggaggcaagaagcacc

SEQ ID NO: 213982 - DNA, 25 bp, Homo sapien
tggacttctagggattcctccttag

SEQ ID NO: 213983 - DNA, 25 bp, Homo sapien
ttcctccttagtcgctgcatgcaga

SEQ ID NO: 213984 - DNA, 25 bp, Homo sapien
gctgcatgcagaattctatgacact

SEQ ID NO: 213985 - DNA, 25 bp, Homo sapien
ctatgacactctaattatgattgct

SEQ ID NO: 213986 - DNA, 25 bp, Homo sapien
ttaacaatttgaccctccactcctt

SEQ ID NO: 213987 - DNA, 25 bp, Homo sapien
ttgaccctccactccttgaaaaaca

SEQ ID NO: 213988 - DNA, 25 bp, Homo sapien
acaggattataaaatggtgccgcca

SEQ ID NO: 213989 - DNA, 25 bp, Homo sapien
taactttttacagaactagcacagc

SEQ ID NO: 213990 - DNA, 25 bp, Homo sapien
gaactagcacagcagaaatactttt

SEQ ID NO: 213991 - DNA, 25 bp, Homo sapien
aaatttttccttcatgctctagaga

SEQ ID NO: 213992 - DNA, 25 bp, Homo sapien
atccttttgcactgatgtgttgaac

SEQ ID NO: 213993 - DNA, 25 bp, Homo sapien
actgatgtgttgaaccttattcttg

SEQ ID NO: 213994 - DNA, 25 bp, Homo sapien
gtacattcattcaatcaaggcaaac

SEQ ID NO: 213995 - DNA, 25 bp, Homo sapien
catggtaatattctatgcaactata

SEQ ID NO: 213996 - DNA, 25 bp, Homo sapien
tgcaactatagttatactttttggt

SEQ ID NO: 213997 - DNA, 25 bp, Homo sapien
tactttttggtttgacactgtattt

SEQ ID NO: 213998 - DNA, 25 bp, Homo sapien
gatgatagattttataacctaacgg

SEQ ID NO: 213999 - DNA, 25 bp, Homo sapien
taacctaacggttctcatgcggtgc

SEQ ID NO: 214000 - DNA, 25 bp, Homo sapien
aacggttctcatgcggtgcgtaatt

SEQ ID NO: 214001 - DNA, 25 bp, Homo sapien
tcatgcggtgcgtaattgtagatgc

SEQ ID NO: 214002 - DNA, 25 bp, Homo sapien
gtagatgcatgtacttgtgtgtttt

SEQ ID NO: 214003 - DNA, 25 bp, Homo sapien
gtaaattatttatgcactcctggtg

SEQ ID NO: 214004 - DNA, 25 bp, Homo sapien
gcactcctggtgtgctatgaatatt

SEQ ID NO: 214005 - DNA, 25 bp, Homo sapien
atgaatattattccagttagccttg

SEQ ID NO: 214006 - DNA, 25 bp, Homo sapien
cagttagccttggattatttcagtg

SEQ ID NO: 214007 - DNA, 25 bp, Homo sapien
tatttcagtggccaacatatgcaga

SEQ ID NO: 214008 - DNA, 25 bp, Homo sapien
atgcagacatttgtactcctcaacc

SEQ ID NO: 214009 - DNA, 25 bp, Homo sapien
tactcctcaaccattttctcaaagt

SEQ ID NO: 214010 - DNA, 25 bp, Homo sapien
ttttctcaaagtaatgggcattcta

SEQ ID NO: 214011 - DNA, 25 bp, Homo sapien
atattcaacaggtatattctgctgc

SEQ ID NO: 214012 - DNA, 25 bp, Homo sapien
tattctgctgcatgtactgtactcc

SEQ ID NO: 214013 - DNA, 25 bp, Homo sapien
gtactccagagctgttatgtaacac

SEQ ID NO: 214014 - DNA, 25 bp, Homo sapien
ggagcatgcacattcagaaaaccca

SEQ ID NO: 214015 - DNA, 25 bp, Homo sapien
aaacccaagccccacatggattttg

SEQ ID NO: 214016 - DNA, 25 bp, Homo sapien
ttttggaacagacagccagtttagt

SEQ ID NO: 214017 - DNA, 25 bp, Homo sapien
gtttagttaaacagctgggcctatc

SEQ ID NO: 214018 - DNA, 25 bp, Homo sapien
cagctgggcctatcagtagatgtat

SEQ ID NO: 214019 - DNA, 25 bp, Homo sapien
gtattacaacacctcaaacaactat

SEQ ID NO: 214020 - DNA, 25 bp, Homo sapien
atgttcagaacatttggtttcctaa

SEQ ID NO: 214021 - DNA, 25 bp, Homo sapien
tggtttcctaacaatcgaaatttgt

SEQ ID NO: 214022 - DNA, 25 bp, Homo sapien
aaatttgtactggtttctgcatcaa

SEQ ID NO: 214023 - DNA, 25 bp, Homo sapien
tctgcatcaaacacctcaactgtag

SEQ ID NO: 214024 - DNA, 25 bp, Homo sapien
tcaactgtagggttaccctttatgg

SEQ ID NO: 214025 - DNA, 25 bp, Homo sapien
aaactgataggattttgtttgtcat

SEQ ID NO: 214026 - DNA, 25 bp, Homo sapien
tttggtaatttctactgcattctta

SEQ ID NO: 214027 - DNA, 25 bp, Homo sapien
tttctactgcattcttaccatcctt

SEQ ID NO: 214028 - DNA, 25 bp, Homo sapien
taccatccttctctcacaaattttg

SEQ ID NO: 214029 - DNA, 25 bp, Homo sapien
gatagcttgaagatctttttaatta

SEQ ID NO: 214030 - DNA, 25 bp, Homo sapien
gtatttgtttcctaggagcaagtgt

SEQ ID NO: 214031 - DNA, 25 bp, Homo sapien
taggagcaagtgttcctgctgccag

SEQ ID NO: 214032 - DNA, 25 bp, Homo sapien
gagcaagtgttcctgctgccagttc

SEQ ID NO: 214033 - DNA, 25 bp, Homo sapien
ttctttcctctttaggcgtggttga

SEQ ID NO: 214034 - DNA, 25 bp, Homo sapien
tcctctttaggcgtggttgagaaaa

SEQ ID NO: 214035 - DNA, 25 bp, Homo sapien
atttcctggaagttatatctactag

SEQ ID NO: 214036 - DNA, 25 bp, Homo sapien
accacgcaggccaagggactgagag

SEQ ID NO: 214037 - DNA, 25 bp, Homo sapien
gagcaggaaggcgacagcccctagg

SEQ ID NO: 214038 - DNA, 25 bp, Homo sapien
gggccggcccaacttagacgcggct

SEQ ID NO: 214039 - DNA, 25 bp, Homo sapien
cagccactttctgagtgttgtcctg

SEQ ID NO: 214040 - DNA, 25 bp, Homo sapien
gggctctttggaacgccatcttcct

SEQ ID NO: 214041 - DNA, 25 bp, Homo sapien
tcccctccttttcgcaaatgtacag

SEQ ID NO: 214042 - DNA, 25 bp, Homo sapien
cttttcgcaaatgtacagaagccat

SEQ ID NO: 214043 - DNA, 25 bp, Homo sapien
gtcacctcagcattcgctgccgaaa

SEQ ID NO: 214044 - DNA, 25 bp, Homo sapien
tcagcattcgctgccgaaatgagca

SEQ ID NO: 214045 - DNA, 25 bp, Homo sapien
cgctgccgaaatgagcaactccatt

SEQ ID NO: 214046 - DNA, 25 bp, Homo sapien
tgagcaactccattcagtaacgtgg

SEQ ID NO: 214047 - DNA, 25 bp, Homo sapien
atacctggatttgctcctgtcaatg

SEQ ID NO: 214048 - DNA, 25 bp, Homo sapien
tacctggatttgctcctgtcaatga

SEQ ID NO: 214049 - DNA, 25 bp, Homo sapien
tgaagttttaaaggctgtaccaatc

SEQ ID NO: 214050 - DNA, 25 bp, Homo sapien
aaagaatgaatgaagcagcagcagt

SEQ ID NO: 214051 - DNA, 25 bp, Homo sapien
aagaatgaatgaagcagcagcagta

SEQ ID NO: 214052 - DNA, 25 bp, Homo sapien
ggactagaatttcttcttgggtatt

SEQ ID NO: 214053 - DNA, 25 bp, Homo sapien
gaatttcttcttgggtattaaagag

SEQ ID NO: 214054 - DNA, 25 bp, Homo sapien
ttcctgctggccctattgctatacc

SEQ ID NO: 214055 - DNA, 25 bp, Homo sapien
gctggccctattgctataccaatga

SEQ ID NO: 214056 - DNA, 25 bp, Homo sapien
ggccctattgctataccaatgatgt

SEQ ID NO: 214057 - DNA, 25 bp, Homo sapien
atatattccatatctacaactataa

SEQ ID NO: 214058 - DNA, 25 bp, Homo sapien
ctggactgagttttgccaaatgtta

SEQ ID NO: 214059 - DNA, 25 bp, Homo sapien
gactttgaacacttgctttttgtga

SEQ ID NO: 214060 - DNA, 25 bp, Homo sapien
tgaacacttgctttttgtgattgct

SEQ ID NO: 214061 - DNA, 25 bp, Homo sapien
gattgcttatgtcattagtgcctca

SEQ ID NO: 214062 - DNA, 25 bp, Homo sapien
attagtgcctcatgactgtgtttga

SEQ ID NO: 214063 - DNA, 25 bp, Homo sapien
ctgtgtttgatgtcctttattgata

SEQ ID NO: 214064 - DNA, 25 bp, Homo sapien
attgatacaaagtgagcctgtgcct

SEQ ID NO: 214065 - DNA, 25 bp, Homo sapien
taatacaaatggaaacctggtgttt

SEQ ID NO: 214066 - DNA, 25 bp, Homo sapien
ttgaaaatctctgaactgtgtgggt

SEQ ID NO: 214067 - DNA, 25 bp, Homo sapien
atctctgaactgtgtgggttttgga

SEQ ID NO: 214068 - DNA, 25 bp, Homo sapien
attcaataacagtttctggacagga

SEQ ID NO: 214069 - DNA, 25 bp, Homo sapien
attggccctgtggtcacagcctcag

SEQ ID NO: 214070 - DNA, 25 bp, Homo sapien
ttggccctgtggtcacagcctcagg

SEQ ID NO: 214071 - DNA, 25 bp, Homo sapien
tggccctgtggtcacagcctcaggg

SEQ ID NO: 214072 - DNA, 25 bp, Homo sapien
caggctggggaaacctcacctggcc

SEQ ID NO: 214073 - DNA, 25 bp, Homo sapien
gaaacctcacctggcccgtactctt

SEQ ID NO: 214074 - DNA, 25 bp, Homo sapien
tcacctggcccgtactcttgggggt

SEQ ID NO: 214075 - DNA, 25 bp, Homo sapien
cccctgagggactgtgggggctcaa

SEQ ID NO: 214076 - DNA, 25 bp, Homo sapien
ggctcaagggtaatgccagaggccc

SEQ ID NO: 214077 - DNA, 25 bp, Homo sapien
gctcaagggtaatgccagaggccca

SEQ ID NO: 214078 - DNA, 25 bp, Homo sapien
ctcaagggtaatgccagaggcccat

SEQ ID NO: 214079 - DNA, 25 bp, Homo sapien
tcaagggtaatgccagaggcccatg

SEQ ID NO: 214080 - DNA, 25 bp, Homo sapien
gagggaagtcagctataaaacattt

SEQ ID NO: 214081 - DNA, 25 bp, Homo sapien
tgtgtttgtaaatgacatgtcagcc

SEQ ID NO: 214082 - DNA, 25 bp, Homo sapien
ttgcaacatttgttttgtataggaa

SEQ ID NO: 214083 - DNA, 25 bp, Homo sapien
aggaattatttgtgccacctgctgt

SEQ ID NO: 214084 - DNA, 25 bp, Homo sapien
ttttctttgcctagtgactagtgac

SEQ ID NO: 214085 - DNA, 25 bp, Homo sapien
cctagtgactagtgacctgtgttgt

SEQ ID NO: 214086 - DNA, 25 bp, Homo sapien
gactagtgacctgtgttgtctaaac

SEQ ID NO: 214087 - DNA, 25 bp, Homo sapien
gtgacctgtgttgtctaaacatgag

SEQ ID NO: 214088 - DNA, 25 bp, Homo sapien
taaacatgagtttcagccctttggt

SEQ ID NO: 214089 - DNA, 25 bp, Homo sapien
acatgagtttcagccctttggtttt

SEQ ID NO: 214090 - DNA, 25 bp, Homo sapien
atgtcaaatgcaaacttcaattctc

SEQ ID NO: 214091 - DNA, 25 bp, Homo sapien
agtctgtgtaccgagccctgaagga

SEQ ID NO: 214092 - DNA, 25 bp, Homo sapien
gggacgtcaccatggctgctgatgt

SEQ ID NO: 214093 - DNA, 25 bp, Homo sapien
tcaaagccatccagcgcatcatgac

SEQ ID NO: 214094 - DNA, 25 bp, Homo sapien
gaggacgccggcgtattcatcagcc

SEQ ID NO: 214095 - DNA, 25 bp, Homo sapien
atcagccggatgagggatgacaacc

SEQ ID NO: 214096 - DNA, 25 bp, Homo sapien
tgagggatgacaaccgataccatga

SEQ ID NO: 214097 - DNA, 25 bp, Homo sapien
gatatttttggagtcaccctgcgaa

SEQ ID NO: 214098 - DNA, 25 bp, Homo sapien
gagtcaccctgcgaacgtacgaagt

SEQ ID NO: 214099 - DNA, 25 bp, Homo sapien
gtacgaagtgaccaaccgccttaga

SEQ ID NO: 214100 - DNA, 25 bp, Homo sapien
aaccgccttagatctgagtccattg

SEQ ID NO: 214101 - DNA, 25 bp, Homo sapien
tgagtccattgccttcattgaagag

SEQ ID NO: 214102 - DNA, 25 bp, Homo sapien
aaactgctttctcaagtcgttattg

SEQ ID NO: 214103 - DNA, 25 bp, Homo sapien
aagtcgttattgatacagcaagtga

SEQ ID NO: 214104 - DNA, 25 bp, Homo sapien
cagcaagtgaacctgctgcagacag

SEQ ID NO: 214105 - DNA, 25 bp, Homo sapien
caagaacagcctttattggtgaaga

SEQ ID NO: 214106 - DNA, 25 bp, Homo sapien
aatgaatgattctttgtaggcgcca

SEQ ID NO: 214107 - DNA, 25 bp, Homo sapien
atgattctttgtaggcgccatcagc

SEQ ID NO: 214108 - DNA, 25 bp, Homo sapien
taggcgccatcagccacttttagaa

SEQ ID NO: 214109 - DNA, 25 bp, Homo sapien
acttttagaagccatcagccagtgt

SEQ ID NO: 214110 - DNA, 25 bp, Homo sapien
gtttgtcaagtgttggcctatggga

SEQ ID NO: 214111 - DNA, 25 bp, Homo sapien
cctatgggaaggtggtcaatgaatg

SEQ ID NO: 214112 - DNA, 25 bp, Homo sapien
taatggccttaaacttttctggaag

SEQ ID NO: 214113 - DNA, 25 bp, Homo sapien
agcatccctggatttcagagttctg

SEQ ID NO: 214114 - DNA, 25 bp, Homo sapien
cagagttctggaactttgttcataa

SEQ ID NO: 214115 - DNA, 25 bp, Homo sapien
caatctgaggtgatgtggtgactga

SEQ ID NO: 214116 - DNA, 25 bp, Homo sapien
tgatgtactttcaccattagcttaa

SEQ ID NO: 214117 - DNA, 25 bp, Homo sapien
aaattaccagttccctttcttgcag

SEQ ID NO: 214118 - DNA, 25 bp, Homo sapien
tttcttgcagtcagcttcataccat

SEQ ID NO: 214119 - DNA, 25 bp, Homo sapien
gcagtcagcttcataccatttttaa

SEQ ID NO: 214120 - DNA, 25 bp, Homo sapien
atctgaattccgaacatgttgtgtg

SEQ ID NO: 214121 - DNA, 25 bp, Homo sapien
tgttgtgtggaatactcttaagtgt

SEQ ID NO: 214122 - DNA, 25 bp, Homo sapien
gtgtgtttgagagtagatctgccaa

SEQ ID NO: 214123 - DNA, 25 bp, Homo sapien
gagtagatctgccaattatgttgac

SEQ ID NO: 214124 - DNA, 25 bp, Homo sapien
ggtgtttacctttacatttggatca

SEQ ID NO: 214125 - DNA, 25 bp, Homo sapien
atttggatcaccttgtagtctttaa

SEQ ID NO: 214126 - DNA, 25 bp, Homo sapien
tttaaattcttggtccctgaggcca

SEQ ID NO: 214127 - DNA, 25 bp, Homo sapien
aagtccacaacttgccttctagtca

SEQ ID NO: 214128 - DNA, 25 bp, Homo sapien
tagtcacttgcctgcccgcagtggt

SEQ ID NO: 214129 - DNA, 25 bp, Homo sapien
tggaatcagtcaccagtctttctgt

SEQ ID NO: 214130 - DNA, 25 bp, Homo sapien
gtctttctgtactgtcttggttagc

SEQ ID NO: 214131 - DNA, 25 bp, Homo sapien
gtactgtcttggttagctctatata

SEQ ID NO: 214132 - DNA, 25 bp, Homo sapien
aggcccagagacctgctgtcctttt

SEQ ID NO: 214133 - DNA, 25 bp, Homo sapien
tgtcctttttctccttgagggagga

SEQ ID NO: 214134 - DNA, 25 bp, Homo sapien
atacaatgtccttccatagcatggg

SEQ ID NO: 214135 - DNA, 25 bp, Homo sapien
acagacgcatgaatgtaagagtagg

SEQ ID NO: 214136 - DNA, 25 bp, Homo sapien
ggatcacttgggatctttgacactt

SEQ ID NO: 214137 - DNA, 25 bp, Homo sapien
tcacttgggatctttgacacttgaa

SEQ ID NO: 214138 - DNA, 25 bp, Homo sapien
acacttgaaaaattacacctggcag

SEQ ID NO: 214139 - DNA, 25 bp, Homo sapien
gaaaaattacacctggcagctgcgt

SEQ ID NO: 214140 - DNA, 25 bp, Homo sapien
aaaattacacctggcagctgcgttt

SEQ ID NO: 214141 - DNA, 25 bp, Homo sapien
attacacctggcagctgcgtttaag

SEQ ID NO: 214142 - DNA, 25 bp, Homo sapien
acacctggcagctgcgtttaagcct

SEQ ID NO: 214143 - DNA, 25 bp, Homo sapien
tggcagctgcgtttaagccttcccc

SEQ ID NO: 214144 - DNA, 25 bp, Homo sapien
ccccatcgtgtactgcagagttgag

SEQ ID NO: 214145 - DNA, 25 bp, Homo sapien
catcgtgtactgcagagttgagctg

SEQ ID NO: 214146 - DNA, 25 bp, Homo sapien
atctgggaacgctgtggaggcatcc

SEQ ID NO: 214147 - DNA, 25 bp, Homo sapien
ggaggcatccagtaccttcagaatg

SEQ ID NO: 214148 - DNA, 25 bp, Homo sapien
gtaccttcagaatgcgattgagagc

SEQ ID NO: 214149 - DNA, 25 bp, Homo sapien
attgagagcagacaggctcggccca

SEQ ID NO: 214150 - DNA, 25 bp, Homo sapien
acagccatgctgcagagtctgttaa

SEQ ID NO: 214151 - DNA, 25 bp, Homo sapien
agccttacagctgggagcctttgcc

SEQ ID NO: 214152 - DNA, 25 bp, Homo sapien
gagcctttgccatggtacttaggta

SEQ ID NO: 214153 - DNA, 25 bp, Homo sapien
gtgtgtgcccccagatttaaccatt

SEQ ID NO: 214154 - DNA, 25 bp, Homo sapien
aaccattccataatcatgttagagt

SEQ ID NO: 214155 - DNA, 25 bp, Homo sapien
gattttattaatcacggcttttggt

SEQ ID NO: 214156 - DNA, 25 bp, Homo sapien
aatcacggcttttggtgaatttgtt

SEQ ID NO: 214157 - DNA, 25 bp, Homo sapien
tgtcgcgtctcattttgtccatgtc

SEQ ID NO: 214158 - DNA, 25 bp, Homo sapien
ccccgtgcacggttcaatggtagat

SEQ ID NO: 214159 - DNA, 25 bp, Homo sapien
cggttcaatggtagattcgctgtcc

SEQ ID NO: 214160 - DNA, 25 bp, Homo sapien
gggccttgaagactccctgatccca

SEQ ID NO: 214161 - DNA, 25 bp, Homo sapien
aagactccctgatcccagacctggt

SEQ ID NO: 214162 - DNA, 25 bp, Homo sapien
aaagccactggaaggagcacatact

SEQ ID NO: 214163 - DNA, 25 bp, Homo sapien
aggagcacatactacctagaagtaa

SEQ ID NO: 214164 - DNA, 25 bp, Homo sapien
attaattttctatgtgttgtgtttg

SEQ ID NO: 214165 - DNA, 25 bp, Homo sapien
tgtgttgtgtttgtagtcttgtctt

SEQ ID NO: 214166 - DNA, 25 bp, Homo sapien
gtgtttgtagtcttgtcttagctct

SEQ ID NO: 214167 - DNA, 25 bp, Homo sapien
tgtagtcttgtcttagctctggacg

SEQ ID NO: 214168 - DNA, 25 bp, Homo sapien
tcaaaactctgcctaaggtgatttt

SEQ ID NO: 214169 - DNA, 25 bp, Homo sapien
ctgcctaaggtgattttgtagttct

SEQ ID NO: 214170 - DNA, 25 bp, Homo sapien
gtagttcttaacagttctccagagc

SEQ ID NO: 214171 - DNA, 25 bp, Homo sapien
agttctccagagcatcttgaacagg

SEQ ID NO: 214172 - DNA, 25 bp, Homo sapien
tgtgaatctgcaatggctgaaaaga

SEQ ID NO: 214173 - DNA, 25 bp, Homo sapien
gagttgtgagcttttttattcatga

SEQ ID NO: 214174 - DNA, 25 bp, Homo sapien
tccctgtggaaagctactagtacat

SEQ ID NO: 214175 - DNA, 25 bp, Homo sapien
tactagtacattgaccagcgctggg

SEQ ID NO: 214176 - DNA, 25 bp, Homo sapien
accagcgctgggtgatacagattct

SEQ ID NO: 214177 - DNA, 25 bp, Homo sapien
gtattagttcatctccatgtagtaa

SEQ ID NO: 214178 - DNA, 25 bp, Homo sapien
acaatgttttgtacttgtatttcat

SEQ ID NO: 214179 - DNA, 25 bp, Homo sapien
aatatgttgttctatggatggcaat

SEQ ID NO: 214180 - DNA, 25 bp, Homo sapien
gatggcaatggtgatttcttcattt

SEQ ID NO: 214181 - DNA, 25 bp, Homo sapien
atatactttagtgctttgtgcctgc

SEQ ID NO: 214182 - DNA, 25 bp, Homo sapien
agtgctttgtgcctgcaaatttcaa

SEQ ID NO: 214183 - DNA, 25 bp, Homo sapien
gcaaatttcaagacaccttcatcta

SEQ ID NO: 214184 - DNA, 25 bp, Homo sapien
tcaagacaccttcatctaaatatat

SEQ ID NO: 214185 - DNA, 25 bp, Homo sapien
aaatatattcaagactgcatgtcat

SEQ ID NO: 214186 - DNA, 25 bp, Homo sapien
ctgcatgtcatcaagcacctgaaca

SEQ ID NO: 214187 - DNA, 25 bp, Homo sapien
ttgaagagacttccgaacacttgct

SEQ ID NO: 214188 - DNA, 25 bp, Homo sapien
agagacttccgaacacttgctatct

SEQ ID NO: 214189 - DNA, 25 bp, Homo sapien
gaacacttgctatctcttgctgctg

SEQ ID NO: 214190 - DNA, 25 bp, Homo sapien
atgttcagaactctttccactggac

SEQ ID NO: 214191 - DNA, 25 bp, Homo sapien
ccactggactggtatttgctcaaaa

SEQ ID NO: 214192 - DNA, 25 bp, Homo sapien
aaggctttcttctatcagtagcgtt

SEQ ID NO: 214193 - DNA, 25 bp, Homo sapien
atcagtagcgtttaccctttgtcac

SEQ ID NO: 214194 - DNA, 25 bp, Homo sapien
agcgtttaccctttgtcaccagtgg

SEQ ID NO: 214195 - DNA, 25 bp, Homo sapien
gtcaccagtggctttggtatttcca

SEQ ID NO: 214196 - DNA, 25 bp, Homo sapien
ggtatttccatgtctggcattgcat

SEQ ID NO: 214197 - DNA, 25 bp, Homo sapien
ggcattgcataaacttctctggtgt

SEQ ID NO: 214198 - DNA, 25 bp, Homo sapien
aaacttctctggtgtgaaaggataa

SEQ ID NO: 214199 - DNA, 25 bp, Homo sapien
gataaatatgcctttctaaagttgt

SEQ ID NO: 214200 - DNA, 25 bp, Homo sapien
taaaatctcctttctactggttatg

SEQ ID NO: 214201 - DNA, 25 bp, Homo sapien
ttaaggtacatgatcagctctttct

SEQ ID NO: 214202 - DNA, 25 bp, Homo sapien
ggtacatgatcagctctttctattt

SEQ ID NO: 214203 - DNA, 25 bp, Homo sapien
gatcagctctttctatttttactcg

SEQ ID NO: 214204 - DNA, 25 bp, Homo sapien
cagctctttctatttttactcgtaa

SEQ ID NO: 214205 - DNA, 25 bp, Homo sapien
atgaataattttgctaacaactttg

SEQ ID NO: 214206 - DNA, 25 bp, Homo sapien
ggtatgaatgtgatttgtctgtaca

SEQ ID NO: 214207 - DNA, 25 bp, Homo sapien
tgtctgtacatcttgtatcttttcc

SEQ ID NO: 214208 - DNA, 25 bp, Homo sapien
aagccgagagttgaagatagtatat

SEQ ID NO: 214209 - DNA, 25 bp, Homo sapien
atttctggtagtactgaatatttac

SEQ ID NO: 214210 - DNA, 25 bp, Homo sapien
gaatatttacttacagtttctatca

SEQ ID NO: 214211 - DNA, 25 bp, Homo sapien
tttacttacagtttctatcaaaaat

SEQ ID NO: 214212 - DNA, 25 bp, Homo sapien
aatttatttgattctgatctgaaac

SEQ ID NO: 214213 - DNA, 25 bp, Homo sapien
gatctgaaactattgtcttcgtaaa

SEQ ID NO: 214214 - DNA, 25 bp, Homo sapien
gtcttcgtaaaagttagatctgact

SEQ ID NO: 214215 - DNA, 25 bp, Homo sapien
gtaaaagttagatctgacttcagac

SEQ ID NO: 214216 - DNA, 25 bp, Homo sapien
gacttcagacagaaaccaataccag

SEQ ID NO: 214217 - DNA, 25 bp, Homo sapien
cagaaaccaataccagcttcctttt

SEQ ID NO: 214218 - DNA, 25 bp, Homo sapien
ttcctttaaactttgaagagtgttg

SEQ ID NO: 214219 - DNA, 25 bp, Homo sapien
gagtgttgatttgttactatattac

SEQ ID NO: 214220 - DNA, 25 bp, Homo sapien
ttactatgcaaaactggcagttatt

SEQ ID NO: 214221 - DNA, 25 bp, Homo sapien
actgggttaatcaagtctcggtaag

SEQ ID NO: 214222 - DNA, 25 bp, Homo sapien
ttaatcaagtctcggtaagtccttt

SEQ ID NO: 214223 - DNA, 25 bp, Homo sapien
cagacgatgctggaggaggtattct

SEQ ID NO: 214224 - DNA, 25 bp, Homo sapien
gctggaggaggtattcttgtacttc

SEQ ID NO: 214225 - DNA, 25 bp, Homo sapien
gaggtattcttgtacttctccaagg

SEQ ID NO: 214226 - DNA, 25 bp, Homo sapien
ggtattcttgtacttctccaaggac

SEQ ID NO: 214227 - DNA, 25 bp, Homo sapien
aggagtgggagtggaccccgcgcca

SEQ ID NO: 214228 - DNA, 25 bp, Homo sapien
aaacgcgtcagccagttcctcgatg

SEQ ID NO: 214229 - DNA, 25 bp, Homo sapien
tcagccagttcctcgatgaccctag

SEQ ID NO: 214230 - DNA, 25 bp, Homo sapien
gatgaccctagcactgccgagactg

SEQ ID NO: 214231 - DNA, 25 bp, Homo sapien
actgccgagactgtgctctgagcct

SEQ ID NO: 214232 - DNA, 25 bp, Homo sapien
gcaaggtagagtgcctaggagccct

SEQ ID NO: 214233 - DNA, 25 bp, Homo sapien
gtagagtgcctaggagccctggact

SEQ ID NO: 214234 - DNA, 25 bp, Homo sapien
tcgtgtgcttcctcttcaacaggga

SEQ ID NO: 214235 - DNA, 25 bp, Homo sapien
ctcttcaacagggagctgagggact

SEQ ID NO: 214236 - DNA, 25 bp, Homo sapien
agctgagggactgcttcagggccca

SEQ ID NO: 214237 - DNA, 25 bp, Homo sapien
agggactgcttcagggcccagttcc

SEQ ID NO: 214238 - DNA, 25 bp, Homo sapien
atccctgcgacctgaaaggcattgg

SEQ ID NO: 214239 - DNA, 25 bp, Homo sapien
agaggctgtgcaagatgttctacgc

SEQ ID NO: 214240 - DNA, 25 bp, Homo sapien
tgttctacgccgtcacgctgctctt

SEQ ID NO: 214241 - DNA, 25 bp, Homo sapien
tggccagctacctgcgggtcctggt

SEQ ID NO: 214242 - DNA, 25 bp, Homo sapien
tacctgacggcctccgtgtggctga

SEQ ID NO: 214243 - DNA, 25 bp, Homo sapien
tccgtgtggctgaccttcgcgcagg

SEQ ID NO: 214244 - DNA, 25 bp, Homo sapien
tgaccttcgcgcaggccggcatcaa

SEQ ID NO: 214245 - DNA, 25 bp, Homo sapien
aacgatgtgcaggaccagtgctcct

SEQ ID NO: 214246 - DNA, 25 bp, Homo sapien
cgacacggacggagcccatgcaggt

SEQ ID NO: 214247 - DNA, 25 bp, Homo sapien
tgcactgcaccaatggctctgttgt

SEQ ID NO: 214248 - DNA, 25 bp, Homo sapien
ggctctgttgtgtaccatgaggttc

SEQ ID NO: 214249 - DNA, 25 bp, Homo sapien
gaggttctcaatgccatggagtgca

SEQ ID NO: 214250 - DNA, 25 bp, Homo sapien
atgccatggagtgcaaatgctcccc

SEQ ID NO: 214251 - DNA, 25 bp, Homo sapien
cccaggaagtgcagcaagtgaggct

SEQ ID NO: 214252 - DNA, 25 bp, Homo sapien
agagtgctgccagtcctctgcatgt

SEQ ID NO: 214253 - DNA, 25 bp, Homo sapien
agtcctctgcatgttctgctcttgt

SEQ ID NO: 214254 - DNA, 25 bp, Homo sapien
ttctgagcccacaataaaggctgag

SEQ ID NO: 214255 - DNA, 25 bp, Homo sapien
aaggctgagctcttatcttgctgca

SEQ ID NO: 214256 - DNA, 25 bp, Homo sapien
tttcgcctttgtaactcccatctgt

SEQ ID NO: 214257 - DNA, 25 bp, Homo sapien
ttgtaactcccatctgtggacccat

SEQ ID NO: 214258 - DNA, 25 bp, Homo sapien
gaggatgccgccctgcagcatgtac

SEQ ID NO: 214259 - DNA, 25 bp, Homo sapien
atgtacaccgagtgtctgcagctgg

SEQ ID NO: 214260 - DNA, 25 bp, Homo sapien
tgcccgggactctaacttccaggaa

SEQ ID NO: 214261 - DNA, 25 bp, Homo sapien
ttccaggaattaaagactcaccaca

SEQ ID NO: 214262 - DNA, 25 bp, Homo sapien
gactcaccacacacgaaggatctaa

SEQ ID NO: 214263 - DNA, 25 bp, Homo sapien
ggatctaaccacttcattttccatg

SEQ ID NO: 214264 - DNA, 25 bp, Homo sapien
ggtctaatcattaaattcccaatcg

SEQ ID NO: 214265 - DNA, 25 bp, Homo sapien
tgggtccatcactctttagccatat

SEQ ID NO: 214266 - DNA, 25 bp, Homo sapien
cactctttagccatatccacatggg

SEQ ID NO: 214267 - DNA, 25 bp, Homo sapien
tttaagcaccgctaacattcctttc

SEQ ID NO: 214268 - DNA, 25 bp, Homo sapien
gcaatgttcctgatgatgtacccca

SEQ ID NO: 214269 - DNA, 25 bp, Homo sapien
aatgttcctgatgatgtaccccaca

SEQ ID NO: 214270 - DNA, 25 bp, Homo sapien
gtaattcggatcagatcctcatccc

SEQ ID NO: 214271 - DNA, 25 bp, Homo sapien
tcctcatcccctgactgtgtgaaaa

SEQ ID NO: 214272 - DNA, 25 bp, Homo sapien
catcccctgactgtgtgaaaaaagt

SEQ ID NO: 214273 - DNA, 25 bp, Homo sapien
gaaaaaagtactctccttctagtga

SEQ ID NO: 214274 - DNA, 25 bp, Homo sapien
ccttctagtgaaggattgtcacaga

SEQ ID NO: 214275 - DNA, 25 bp, Homo sapien
tgtcacagagtttcactggatgaaa

SEQ ID NO: 214276 - DNA, 25 bp, Homo sapien
ggatgaaactatgacccagtattct

SEQ ID NO: 214277 - DNA, 25 bp, Homo sapien
tatgacccagtattcttactgtatt

SEQ ID NO: 214278 - DNA, 25 bp, Homo sapien
agcagggtcccaaaggtagctggat

SEQ ID NO: 214279 - DNA, 25 bp, Homo sapien
gctggatggctgaactgctggatat

SEQ ID NO: 214280 - DNA, 25 bp, Homo sapien
ctgaactgctggatatgggagatac

SEQ ID NO: 214281 - DNA, 25 bp, Homo sapien
tatgggagatacatgacgcgaagac

SEQ ID NO: 214282 - DNA, 25 bp, Homo sapien
atgacgcgaagacggatttcacatc

SEQ ID NO: 214283 - DNA, 25 bp, Homo sapien
atttcacatccacaggacggtcttg

SEQ ID NO: 214284 - DNA, 25 bp, Homo sapien
gttctttaaattacgactccatgct

SEQ ID NO: 214285 - DNA, 25 bp, Homo sapien
attacgactccatgcttttcttctt

SEQ ID NO: 214286 - DNA, 25 bp, Homo sapien
aatcaaccactcataatttgaccaa

SEQ ID NO: 214287 - DNA, 25 bp, Homo sapien
gtcagagacacatgggacagaaccc

SEQ ID NO: 214288 - DNA, 25 bp, Homo sapien
tgggacagaaccctactttttgtag

SEQ ID NO: 214289 - DNA, 25 bp, Homo sapien
gttctgcagagcaataatgcctttt

SEQ ID NO: 214290 - DNA, 25 bp, Homo sapien
aatcaaggtcaaaattcatcttttc

SEQ ID NO: 214291 - DNA, 25 bp, Homo sapien
taaaaagctctcttaatggaaatat

SEQ ID NO: 214292 - DNA, 25 bp, Homo sapien
ataaagcactatagccatgttttcc

SEQ ID NO: 214293 - DNA, 25 bp, Homo sapien
aaatatacacttacctttcattcag

SEQ ID NO: 214294 - DNA, 25 bp, Homo sapien
tacacttacctttcattcagtgaaa

SEQ ID NO: 214295 - DNA, 25 bp, Homo sapien
aagtgctgaattacaatgtgaagtt

SEQ ID NO: 214296 - DNA, 25 bp, Homo sapien
gacttctgtttacaaatgagacact

SEQ ID NO: 214297 - DNA, 25 bp, Homo sapien
gagacactctaacgagttttcagtc

SEQ ID NO: 214298 - DNA, 25 bp, Homo sapien
aacgagttttcagtctctctgtatg

SEQ ID NO: 214299 - DNA, 25 bp, Homo sapien
atgcctttgctatttaggggtccac

SEQ ID NO: 214300 - DNA, 25 bp, Homo sapien
ttcttccccactgatcactgtggag

SEQ ID NO: 214301 - DNA, 25 bp, Homo sapien
aaatgcagccgatgtgctcttcaga

SEQ ID NO: 214302 - DNA, 25 bp, Homo sapien
gtgctcttcagatgggtggttccca

SEQ ID NO: 214303 - DNA, 25 bp, Homo sapien
agccccacgtgccatggagggacat

SEQ ID NO: 214304 - DNA, 25 bp, Homo sapien
gaaagacgataccatcatcttccca

SEQ ID NO: 214305 - DNA, 25 bp, Homo sapien
aggccctgactcaaggcagccacgg

SEQ ID NO: 214306 - DNA, 25 bp, Homo sapien
gctgttccacgtgcagacattgcta

SEQ ID NO: 214307 - DNA, 25 bp, Homo sapien
taagggtcacaaacatctccgctgt

SEQ ID NO: 214308 - DNA, 25 bp, Homo sapien
atctccgctgtggacgtcacttgtt

SEQ ID NO: 214309 - DNA, 25 bp, Homo sapien
ttgttccatcagcatcccctttttg

SEQ ID NO: 214310 - DNA, 25 bp, Homo sapien
aaaatcgcaactttttctctctcag

SEQ ID NO: 214311 - DNA, 25 bp, Homo sapien
ttaacagtgcaatcctttctgtgga

SEQ ID NO: 214312 - DNA, 25 bp, Homo sapien
gtgcaatcctttctgtggatgaaat

SEQ ID NO: 214313 - DNA, 25 bp, Homo sapien
tggatgaaatcttgctcagaagctc

SEQ ID NO: 214314 - DNA, 25 bp, Homo sapien
agaaaaacagcagggctggacggat

SEQ ID NO: 214315 - DNA, 25 bp, Homo sapien
gggtaagaccccaaccactcagagc

SEQ ID NO: 214316 - DNA, 25 bp, Homo sapien
ggcctctagagggtacatagtacac

SEQ ID NO: 214317 - DNA, 25 bp, Homo sapien
catagtacaccatggagcacggttt

SEQ ID NO: 214318 - DNA, 25 bp, Homo sapien
gagcacggtttaagcaccactggac

SEQ ID NO: 214319 - DNA, 25 bp, Homo sapien
accactggactacacattcttctgt

SEQ ID NO: 214320 - DNA, 25 bp, Homo sapien
ggactacacattcttctgtggcagt

SEQ ID NO: 214321 - DNA, 25 bp, Homo sapien
cttctgtggcagttatcttaccttc

SEQ ID NO: 214322 - DNA, 25 bp, Homo sapien
gcaacacagccacacataccaataa

SEQ ID NO: 214323 - DNA, 25 bp, Homo sapien
gggactcagccttaaatcatatagt

SEQ ID NO: 214324 - DNA, 25 bp, Homo sapien
gaaaacgttaccagcattgccaaca

SEQ ID NO: 214325 - DNA, 25 bp, Homo sapien
tcttactttagaaccttcccaatgc

SEQ ID NO: 214326 - DNA, 25 bp, Homo sapien
ttcccaatgccaagcaacaaaagct

SEQ ID NO: 214327 - DNA, 25 bp, Homo sapien
gcataataactgtgtccagctgcct

SEQ ID NO: 214328 - DNA, 25 bp, Homo sapien
gtccagctgcctggaactttggcaa

SEQ ID NO: 214329 - DNA, 25 bp, Homo sapien
aaggaatctggaaataaggccgtga

SEQ ID NO: 214330 - DNA, 25 bp, Homo sapien
aaggccgtgagataggtatccctac

SEQ ID NO: 214331 - DNA, 25 bp, Homo sapien
gtgagataggtatccctacccacaa

SEQ ID NO: 214332 - DNA, 25 bp, Homo sapien
tccgcaggctccatttgcaacacag

SEQ ID NO: 214333 - DNA, 25 bp, Homo sapien
atccctgcgggcacccccacctggg

SEQ ID NO: 214334 - DNA, 25 bp, Homo sapien
acttttctcatcagtcacaatagga

SEQ ID NO: 214335 - DNA, 25 bp, Homo sapien
aggacacggccacaccaagtgcagc

SEQ ID NO: 214336 - DNA, 25 bp, Homo sapien
ggacacggccacaccaagtgcagcc

SEQ ID NO: 214337 - DNA, 25 bp, Homo sapien
acacggccacaccaagtgcagccct

SEQ ID NO: 214338 - DNA, 25 bp, Homo sapien
tgggtctgcaccgggcagctctccc

SEQ ID NO: 214339 - DNA, 25 bp, Homo sapien
tgcaccgggcagctctcccctcact

SEQ ID NO: 214340 - DNA, 25 bp, Homo sapien
ctgcccccctgcttcttaagaagat

SEQ ID NO: 214341 - DNA, 25 bp, Homo sapien
tgcccccctgcttcttaagaagatg

SEQ ID NO: 214342 - DNA, 25 bp, Homo sapien
gcccccctgcttcttaagaagatgg

SEQ ID NO: 214343 - DNA, 25 bp, Homo sapien
cccccctgcttcttaagaagatggg

SEQ ID NO: 214344 - DNA, 25 bp, Homo sapien
tcactaaatgtgaacagctttgctt

SEQ ID NO: 214345 - DNA, 25 bp, Homo sapien
agctttgcttttcacgtgattaaga

SEQ ID NO: 214346 - DNA, 25 bp, Homo sapien
gtgattaagaccctactccaaattg

SEQ ID NO: 214347 - DNA, 25 bp, Homo sapien
gtagaagcttttcaggaaccatatt

SEQ ID NO: 214348 - DNA, 25 bp, Homo sapien
gaaccatattactctcatgatactt

SEQ ID NO: 214349 - DNA, 25 bp, Homo sapien
gatacttcattaatctccatcatgt

SEQ ID NO: 214350 - DNA, 25 bp, Homo sapien
gccaagcctgacacatttgacagtg

SEQ ID NO: 214351 - DNA, 25 bp, Homo sapien
gtgaggacaatgtggcttgctcctt

SEQ ID NO: 214352 - DNA, 25 bp, Homo sapien
ggcttgctcctttttgaatctacag

SEQ ID NO: 214353 - DNA, 25 bp, Homo sapien
aatgcatgttttacagtactccaga

SEQ ID NO: 214354 - DNA, 25 bp, Homo sapien
gtactccagatgtctacactcaata

SEQ ID NO: 214355 - DNA, 25 bp, Homo sapien
tccaggacatctcctaatacaaggt

SEQ ID NO: 214356 - DNA, 25 bp, Homo sapien
tcctaatacaaggtagccactgtgt

SEQ ID NO: 214357 - DNA, 25 bp, Homo sapien
caaggtagccactgtgttactatat

SEQ ID NO: 214358 - DNA, 25 bp, Homo sapien
agccactgtgttactatatgttgta

SEQ ID NO: 214359 - DNA, 25 bp, Homo sapien
atgttgtaaccaggagccagtacgg

SEQ ID NO: 214360 - DNA, 25 bp, Homo sapien
gtaaccaggagccagtacggacttt

SEQ ID NO: 214361 - DNA, 25 bp, Homo sapien
aggagccagtacggactttattcat

SEQ ID NO: 214362 - DNA, 25 bp, Homo sapien
atctcacagtggcaagcactcaatg

SEQ ID NO: 214363 - DNA, 25 bp, Homo sapien
gtggcaagcactcaatgcagtcaca

SEQ ID NO: 214364 - DNA, 25 bp, Homo sapien
ccaactgcaaagatcaccctgcaag

SEQ ID NO: 214365 - DNA, 25 bp, Homo sapien
gcaaagatcaccctgcaaggctctg

SEQ ID NO: 214366 - DNA, 25 bp, Homo sapien
aaaatgggtgttgactgaggaatcc

SEQ ID NO: 214367 - DNA, 25 bp, Homo sapien
gtcttcttttgaaaccgggcatctc

SEQ ID NO: 214368 - DNA, 25 bp, Homo sapien
gaaaccgggcatctctgaagtcctg

SEQ ID NO: 214369 - DNA, 25 bp, Homo sapien
gacttctcagaggttctaggtgatg

SEQ ID NO: 214370 - DNA, 25 bp, Homo sapien
gatgctgagaccttggtgtctctaa

SEQ ID NO: 214371 - DNA, 25 bp, Homo sapien
gtgtctctaaactctgggcatgtgg

SEQ ID NO: 214372 - DNA, 25 bp, Homo sapien
gtgtctctgacctgtgtgatgtgca

SEQ ID NO: 214373 - DNA, 25 bp, Homo sapien
tgtgcaggagggtctcattgactca

SEQ ID NO: 214374 - DNA, 25 bp, Homo sapien
ttgactcagcgcctgcgcgttagtg

SEQ ID NO: 214375 - DNA, 25 bp, Homo sapien
ctgcgcgttagtgcctggctgtgct

SEQ ID NO: 214376 - DNA, 25 bp, Homo sapien
gcctggctgtgctctcttttatgcc

SEQ ID NO: 214377 - DNA, 25 bp, Homo sapien
agtgctgaaaaaccccaacaggaat

SEQ ID NO: 214378 - DNA, 25 bp, Homo sapien
gaaactactaacagcagtgagattt

SEQ ID NO: 214379 - DNA, 25 bp, Homo sapien
aaagagctagtgtgataatcctaac

SEQ ID NO: 214380 - DNA, 25 bp, Homo sapien
gataatcctaactctactacgcatt

SEQ ID NO: 214381 - DNA, 25 bp, Homo sapien
aactctactacgcattatatattta

SEQ ID NO: 214382 - DNA, 25 bp, Homo sapien
aatccattgctttttgtggctttgc

SEQ ID NO: 214383 - DNA, 25 bp, Homo sapien
gctttttgtggctttgcacttcaaa

SEQ ID NO: 214384 - DNA, 25 bp, Homo sapien
gtggctttgcacttcaaatttttca

SEQ ID NO: 214385 - DNA, 25 bp, Homo sapien
aacatttactgaaagccctctctgg

SEQ ID NO: 214386 - DNA, 25 bp, Homo sapien
tactgaaagccctctctggcaaaaa

SEQ ID NO: 214387 - DNA, 25 bp, Homo sapien
cgtagagtgacttagacatgtttgc

SEQ ID NO: 214388 - DNA, 25 bp, Homo sapien
taattgattaaagtgctgcattttg

SEQ ID NO: 214389 - DNA, 25 bp, Homo sapien
ggaattgagtattttgtgtacggta

SEQ ID NO: 214390 - DNA, 25 bp, Homo sapien
ttgtgtacggtatgtttccatcctc

SEQ ID NO: 214391 - DNA, 25 bp, Homo sapien
tgtacggtatgtttccatcctccct

SEQ ID NO: 214392 - DNA, 25 bp, Homo sapien
tctctcttcctacctatttaatttt

SEQ ID NO: 214393 - DNA, 25 bp, Homo sapien
ttcctacctatttaattttcatttg

SEQ ID NO: 214394 - DNA, 25 bp, Homo sapien
gtcatgaggtttttggatttgccaa

SEQ ID NO: 214395 - DNA, 25 bp, Homo sapien
gacatcatgccccatgtcatagaga

SEQ ID NO: 214396 - DNA, 25 bp, Homo sapien
tcatgccccatgtcatagagaataa

SEQ ID NO: 214397 - DNA, 25 bp, Homo sapien
aaagctgatgattgtaccagtctta

SEQ ID NO: 214398 - DNA, 25 bp, Homo sapien
gattgtaccagtcttaaattattca

SEQ ID NO: 214399 - DNA, 25 bp, Homo sapien
agacctgcctgaacgcacatgacat

SEQ ID NO: 214400 - DNA, 25 bp, Homo sapien
atgacatagcacttgccgatctgcg

SEQ ID NO: 214401 - DNA, 25 bp, Homo sapien
ttgccgatctgcgtgtgcccagaag

SEQ ID NO: 214402 - DNA, 25 bp, Homo sapien
gtgcccagaagtggcccttggccga

SEQ ID NO: 214403 - DNA, 25 bp, Homo sapien
cctctagatgtccaagtgccacgtg

SEQ ID NO: 214404 - DNA, 25 bp, Homo sapien
aagtgccacgtgaactatgcaattt

SEQ ID NO: 214405 - DNA, 25 bp, Homo sapien
tatgcaatttaaagggttgacccac

SEQ ID NO: 214406 - DNA, 25 bp, Homo sapien
gggttgacccacactagacgaaact

SEQ ID NO: 214407 - DNA, 25 bp, Homo sapien
acgaaactggactcgtacgactctt

SEQ ID NO: 214408 - DNA, 25 bp, Homo sapien
ggactcgtacgactctttttatatt

SEQ ID NO: 214409 - DNA, 25 bp, Homo sapien
gtttgcactgatttagttgcatgat

SEQ ID NO: 214410 - DNA, 25 bp, Homo sapien
ttttcagaaagagacttggcagcat

SEQ ID NO: 214411 - DNA, 25 bp, Homo sapien
cttggcagcatgatattagcactta

SEQ ID NO: 214412 - DNA, 25 bp, Homo sapien
ttagcacttagacccagaccaaatt

SEQ ID NO: 214413 - DNA, 25 bp, Homo sapien
gaaacctattacgagcgtgtcttga

SEQ ID NO: 214414 - DNA, 25 bp, Homo sapien
aacaaggttttaggacatgtcaaca

SEQ ID NO: 214415 - DNA, 25 bp, Homo sapien
atatattaatctctgcagtgctgcc

SEQ ID NO: 214416 - DNA, 25 bp, Homo sapien
tgcagtgctgccaacagcattccgg

SEQ ID NO: 214417 - DNA, 25 bp, Homo sapien
acagcattccgggtggccaagaaaa

SEQ ID NO: 214418 - DNA, 25 bp, Homo sapien
aaaagttcttggcacgacccttgtg

SEQ ID NO: 214419 - DNA, 25 bp, Homo sapien
gacccttgtggttggtttgcttgca

SEQ ID NO: 214420 - DNA, 25 bp, Homo sapien
gtttgcttgcaggagtgggatattt

SEQ ID NO: 214421 - DNA, 25 bp, Homo sapien
gagaagagaaattacctaccaagga

SEQ ID NO: 214422 - DNA, 25 bp, Homo sapien
atcaggttgacagcagacttatcac

SEQ ID NO: 214423 - DNA, 25 bp, Homo sapien
gcagacttatcactggacacactgg

SEQ ID NO: 214424 - DNA, 25 bp, Homo sapien
tggacacactggatgctagaagtaa

SEQ ID NO: 214425 - DNA, 25 bp, Homo sapien
gtaaatggagcaatgtcttcaaagt

SEQ ID NO: 214426 - DNA, 25 bp, Homo sapien
atgtcttcaaagttctgctggaaaa

SEQ ID NO: 214427 - DNA, 25 bp, Homo sapien
gattatgttttgcatatgcccacct

SEQ ID NO: 214428 - DNA, 25 bp, Homo sapien
ttgcatatgcccaccttgagagaat

SEQ ID NO: 214429 - DNA, 25 bp, Homo sapien
tatgcccaccttgagagaattactg

SEQ ID NO: 214430 - DNA, 25 bp, Homo sapien
ggaataatataccttagcacgccag

SEQ ID NO: 214431 - DNA, 25 bp, Homo sapien
cttagcacgccagggtgactacaaa

SEQ ID NO: 214432 - DNA, 25 bp, Homo sapien
gatagacttcagacccttaatgcca

SEQ ID NO: 214433 - DNA, 25 bp, Homo sapien
gacttcagacccttaatgccattta

SEQ ID NO: 214434 - DNA, 25 bp, Homo sapien
tagtgattcgtatacaattttgtct

SEQ ID NO: 214435 - DNA, 25 bp, Homo sapien
aattttgtctgcagcattcttgaat

SEQ ID NO: 214436 - DNA, 25 bp, Homo sapien
tttaacactgtgtaatccctgagca

SEQ ID NO: 214437 - DNA, 25 bp, Homo sapien
gtaatccctgagcagcacaaaactt

SEQ ID NO: 214438 - DNA, 25 bp, Homo sapien
caaaacttttattccgatgaccagt

SEQ ID NO: 214439 - DNA, 25 bp, Homo sapien
ttattccgatgaccagttacacaat

SEQ ID NO: 214440 - DNA, 25 bp, Homo sapien
ccagttacacaattcctgtttttat

SEQ ID NO: 214441 - DNA, 25 bp, Homo sapien
ctgtttttattttgtcctgttgtgc

SEQ ID NO: 214442 - DNA, 25 bp, Homo sapien
tgtcctgttgtgctcatcttctatg

SEQ ID NO: 214443 - DNA, 25 bp, Homo sapien
gtgagctctgatttctagactgctt

SEQ ID NO: 214444 - DNA, 25 bp, Homo sapien
gctctgatttctagactgctttgaa

SEQ ID NO: 214445 - DNA, 25 bp, Homo sapien
taacttagtatttgggtaccctgct

SEQ ID NO: 214446 - DNA, 25 bp, Homo sapien
gtaccctgctctttggctgttcttt

SEQ ID NO: 214447 - DNA, 25 bp, Homo sapien
tgttctttttttggagcccttctca

SEQ ID NO: 214448 - DNA, 25 bp, Homo sapien
ttctcagtcaagtctgccggatgtc

SEQ ID NO: 214449 - DNA, 25 bp, Homo sapien
tctgccggatgtctttctttaccta

SEQ ID NO: 214450 - DNA, 25 bp, Homo sapien
ttttccttaaaacgcgcacacaact

SEQ ID NO: 214451 - DNA, 25 bp, Homo sapien
aaacgcgcacacaactctagagagt

SEQ ID NO: 214452 - DNA, 25 bp, Homo sapien
attgagtattgtttgtgctaagcat

SEQ ID NO: 214453 - DNA, 25 bp, Homo sapien
gattgactccactttgttgtgttgt

SEQ ID NO: 214454 - DNA, 25 bp, Homo sapien
agctcagatgcagtcaccagcatga

SEQ ID NO: 214455 - DNA, 25 bp, Homo sapien
gtcaccagcatgagaagcagtccag

SEQ ID NO: 214456 - DNA, 25 bp, Homo sapien
gaagcagtccagagtctaggcaatt

SEQ ID NO: 214457 - DNA, 25 bp, Homo sapien
taggcaatttttacaacctgagttc

SEQ ID NO: 214458 - DNA, 25 bp, Homo sapien
gagttcaagtcaaattctgagcctg

SEQ ID NO: 214459 - DNA, 25 bp, Homo sapien
aaagcatggagagtggcatcttctt

SEQ ID NO: 214460 - DNA, 25 bp, Homo sapien
gcatcttctttgcatcctaaggacg

SEQ ID NO: 214461 - DNA, 25 bp, Homo sapien
taaggacgaaagacacagtgcactc

SEQ ID NO: 214462 - DNA, 25 bp, Homo sapien
agagctgctgaggacaatgtctgct

SEQ ID NO: 214463 - DNA, 25 bp, Homo sapien
gacaatgtctgctgaagcccgcttt

SEQ ID NO: 214464 - DNA, 25 bp, Homo sapien
ggctgacaatgcgaggtcgcaactg

SEQ ID NO: 214465 - DNA, 25 bp, Homo sapien
gcgccttccggatgctgcacgtgga

SEQ ID NO: 214466 - DNA, 25 bp, Homo sapien
ggatgctgcacgtggaccgccgcac

SEQ ID NO: 214467 - DNA, 25 bp, Homo sapien
cctccagaatgccgtgcgcaacgtg

SEQ ID NO: 214468 - DNA, 25 bp, Homo sapien
aaccgctacctgtacctgagcacca

SEQ ID NO: 214469 - DNA, 25 bp, Homo sapien
accatggagcgcagcgagctagcca

SEQ ID NO: 214470 - DNA, 25 bp, Homo sapien
tggagcgcagcgagctagccaagaa

SEQ ID NO: 214471 - DNA, 25 bp, Homo sapien
gcgcagcgagctagccaagaagatc

SEQ ID NO: 214472 - DNA, 25 bp, Homo sapien
aagaagatcggcaccacaccagaca

SEQ ID NO: 214473 - DNA, 25 bp, Homo sapien
agatcggcaccacaccagacataat

SEQ ID NO: 214474 - DNA, 25 bp, Homo sapien
cagacataatcctggacgacttgct

SEQ ID NO: 214475 - DNA, 25 bp, Homo sapien
ctggacgacttgctggagacggacc

SEQ ID NO: 214476 - DNA, 25 bp, Homo sapien
tttcaacttggtttcgtatctgcca

SEQ ID NO: 214477 - DNA, 25 bp, Homo sapien
gtggtgttgatttcaatcggctact

SEQ ID NO: 214478 - DNA, 25 bp, Homo sapien
aatcggctactgttctgttctgtat

SEQ ID NO: 214479 - DNA, 25 bp, Homo sapien
gttctgttctgtattttggcatctg

SEQ ID NO: 214480 - DNA, 25 bp, Homo sapien
agatctgtggttctctgttttgtgt

SEQ ID NO: 214481 - DNA, 25 bp, Homo sapien
tatgttttggtatcagctttgtgct

SEQ ID NO: 214482 - DNA, 25 bp, Homo sapien
ctttgtgctggctttgtgaaatgaa

SEQ ID NO: 214483 - DNA, 25 bp, Homo sapien
gaagctatccatctcatttctggta

SEQ ID NO: 214484 - DNA, 25 bp, Homo sapien
atctcatttctggtatagttcatgt

SEQ ID NO: 214485 - DNA, 25 bp, Homo sapien
gtagcattgtaatcggttgttcttt

SEQ ID NO: 214486 - DNA, 25 bp, Homo sapien
ttgaacgttcaaatgactcatcagt

SEQ ID NO: 214487 - DNA, 25 bp, Homo sapien
gagctggagcaagaataccaagaca

SEQ ID NO: 214488 - DNA, 25 bp, Homo sapien
acaaattcaaaagactgcccctcga

SEQ ID NO: 214489 - DNA, 25 bp, Homo sapien
aattcaaaagactgcccctcgagat

SEQ ID NO: 214490 - DNA, 25 bp, Homo sapien
aaagactgcccctcgagattttgga

SEQ ID NO: 214491 - DNA, 25 bp, Homo sapien
actgcccctcgagattttggaattc

SEQ ID NO: 214492 - DNA, 25 bp, Homo sapien
gcccctcgagattttggaattcgtg

SEQ ID NO: 214493 - DNA, 25 bp, Homo sapien
tggaattcgtgcaggaagccatgaa

SEQ ID NO: 214494 - DNA, 25 bp, Homo sapien
aattcgtgcaggaagccatgaaagg

SEQ ID NO: 214495 - DNA, 25 bp, Homo sapien
gaagacagcaatcacggttctgccc

SEQ ID NO: 214496 - DNA, 25 bp, Homo sapien
agacagcaatcacggttctgcccct

SEQ ID NO: 214497 - DNA, 25 bp, Homo sapien
aaaagaatttgatactcctctgtga

SEQ ID NO: 214498 - DNA, 25 bp, Homo sapien
acaactcacaactgctagctttggg

SEQ ID NO: 214499 - DNA, 25 bp, Homo sapien
aatactggaccatcattaaatgtgt

SEQ ID NO: 214500 - DNA, 25 bp, Homo sapien
gaccatcattaaatgtgtactgtga

SEQ ID NO: 214501 - DNA, 25 bp, Homo sapien
tatgaagggctttaccaaagtccac

SEQ ID NO: 214502 - DNA, 25 bp, Homo sapien
gtccactaaataaacactactcaag

SEQ ID NO: 214503 - DNA, 25 bp, Homo sapien
aacactactcaagtacagactgcaa

SEQ ID NO: 214504 - DNA, 25 bp, Homo sapien
gactgcaaaccaaaatgtatctgtg

SEQ ID NO: 214505 - DNA, 25 bp, Homo sapien
accaaaatgtatctgtgttacgaca

SEQ ID NO: 214506 - DNA, 25 bp, Homo sapien
ctgtgttacgacattaattgcaaat

SEQ ID NO: 214507 - DNA, 25 bp, Homo sapien
gcaagtatggtgctaaagtctacac

SEQ ID NO: 214508 - DNA, 25 bp, Homo sapien
gctaaagtctacaccaatggaatta

SEQ ID NO: 214509 - DNA, 25 bp, Homo sapien
atggacggtatgtgatgggtcacac

SEQ ID NO: 214510 - DNA, 25 bp, Homo sapien
tgatgggtcacactaacctgtcact

SEQ ID NO: 214511 - DNA, 25 bp, Homo sapien
gtcacactaacctgtcacttgttgg

SEQ ID NO: 214512 - DNA, 25 bp, Homo sapien
ctaacctgtcacttgttgggagcat

SEQ ID NO: 214513 - DNA, 25 bp, Homo sapien
gtcacttgttgggagcatgagcagc

SEQ ID NO: 214514 - DNA, 25 bp, Homo sapien
ttgggagcatgagcagctttctgtc

SEQ ID NO: 214515 - DNA, 25 bp, Homo sapien
gcagctttctgtctggaacattaat

SEQ ID NO: 214516 - DNA, 25 bp, Homo sapien
ataatgatctaaaacggcctattta

SEQ ID NO: 214517 - DNA, 25 bp, Homo sapien
aacggcctatttaatatgttacaag

SEQ ID NO: 214518 - DNA, 25 bp, Homo sapien
acaaggcacttgagtatggttgcat

SEQ ID NO: 214519 - DNA, 25 bp, Homo sapien
cttgagtatggttgcatgtccaaat

SEQ ID NO: 214520 - DNA, 25 bp, Homo sapien
gaagccagagttcttggctcaggac

SEQ ID NO: 214521 - DNA, 25 bp, Homo sapien
gccagagttcttggctcaggactga

SEQ ID NO: 214522 - DNA, 25 bp, Homo sapien
tgtgtgtctgtctggcatgcatgca

SEQ ID NO: 214523 - DNA, 25 bp, Homo sapien
tgtctgtctggcatgcatgcactca

SEQ ID NO: 214524 - DNA, 25 bp, Homo sapien
ggaggagatcagaaaatccctctga

SEQ ID NO: 214525 - DNA, 25 bp, Homo sapien
tcagaaaatccctctgacatctcca

SEQ ID NO: 214526 - DNA, 25 bp, Homo sapien
ccaaagacctccgttgaacattctg

SEQ ID NO: 214527 - DNA, 25 bp, Homo sapien
gacctccgttgaacattctgtatgg

SEQ ID NO: 214528 - DNA, 25 bp, Homo sapien
aacattctgtatggaaaagagccct

SEQ ID NO: 214529 - DNA, 25 bp, Homo sapien
gagccctggagcatcaggttcccca

SEQ ID NO: 214530 - DNA, 25 bp, Homo sapien
ccctggagcatcaggttccccagat

SEQ ID NO: 214531 - DNA, 25 bp, Homo sapien
atgtatctgttagcacaatcacttc

SEQ ID NO: 214532 - DNA, 25 bp, Homo sapien
gttagcacaatcacttcagttactg

SEQ ID NO: 214533 - DNA, 25 bp, Homo sapien
gaattttgttgggatctgacttggg

SEQ ID NO: 214534 - DNA, 25 bp, Homo sapien
tttgatgtacataccacactccttg

SEQ ID NO: 214535 - DNA, 25 bp, Homo sapien
tctgcttttcattaaccacattcct

SEQ ID NO: 214536 - DNA, 25 bp, Homo sapien
acattcctgcacaactcatttctga

SEQ ID NO: 214537 - DNA, 25 bp, Homo sapien
gaaaacctaccatgtttctttacag

SEQ ID NO: 214538 - DNA, 25 bp, Homo sapien
tgtttctttacagagccatccaaaa

SEQ ID NO: 214539 - DNA, 25 bp, Homo sapien
tttgtccctacatagcaattttctg

SEQ ID NO: 214540 - DNA, 25 bp, Homo sapien
catagcaattttctgtggcactgag

SEQ ID NO: 214541 - DNA, 25 bp, Homo sapien
tggcactgagaaaccatgtatgacc

SEQ ID NO: 214542 - DNA, 25 bp, Homo sapien
gggcaaaagtccattctcatttggt

SEQ ID NO: 214543 - DNA, 25 bp, Homo sapien
agtccattctcatttggtccattag

SEQ ID NO: 214544 - DNA, 25 bp, Homo sapien
tcatttggtccattagttccagcaa

SEQ ID NO: 214545 - DNA, 25 bp, Homo sapien
attttctattcctgtcagcaccttt

SEQ ID NO: 214546 - DNA, 25 bp, Homo sapien
tagcagctgccagtttggagcattg

SEQ ID NO: 214547 - DNA, 25 bp, Homo sapien
ccagtttggagcattgccctctaag

SEQ ID NO: 214548 - DNA, 25 bp, Homo sapien
gccctctaagagctttaaaactatt

SEQ ID NO: 214549 - DNA, 25 bp, Homo sapien
catgccttatatacattccactaat

SEQ ID NO: 214550 - DNA, 25 bp, Homo sapien
ttaaacacatgatcttggtactaac

SEQ ID NO: 214551 - DNA, 25 bp, Homo sapien
gatcttggtactaacatactcactg

SEQ ID NO: 214552 - DNA, 25 bp, Homo sapien
taacatactcactgtgaacccagcc

SEQ ID NO: 214553 - DNA, 25 bp, Homo sapien
aagttctcaataaaggcattacaat

SEQ ID NO: 214554 - DNA, 25 bp, Homo sapien
gaaagatggacttttctgataaatc

SEQ ID NO: 214555 - DNA, 25 bp, Homo sapien
ggacttttctgataaatcttggcag

SEQ ID NO: 214556 - DNA, 25 bp, Homo sapien
gataaatcttggcagacatctaaaa

SEQ ID NO: 214557 - DNA, 25 bp, Homo sapien
ttttggaaataatactcactgatta

SEQ ID NO: 214558 - DNA, 25 bp, Homo sapien
aatactcactgattatggataaaat

SEQ ID NO: 214559 - DNA, 25 bp, Homo sapien
aatggaatattttcagatactatat

SEQ ID NO: 214560 - DNA, 25 bp, Homo sapien
cagatactatattggctgtttcaaa

SEQ ID NO: 214561 - DNA, 25 bp, Homo sapien
tactatattggctgtttcaaaatag

SEQ ID NO: 214562 - DNA, 25 bp, Homo sapien
atttttgctaagttatttgtctttg

SEQ ID NO: 214563 - DNA, 25 bp, Homo sapien
aaatagatgtacctgttttgctttc

SEQ ID NO: 214564 - DNA, 25 bp, Homo sapien
tggaattgtgggtatctttcctttt

SEQ ID NO: 214565 - DNA, 25 bp, Homo sapien
atcttaactgttgcctgtcagtgtt

SEQ ID NO: 214566 - DNA, 25 bp, Homo sapien
gttgcctgtcagtgtttacaaacta

SEQ ID NO: 214567 - DNA, 25 bp, Homo sapien
gtttacaaactagtgcgttgacggc

SEQ ID NO: 214568 - DNA, 25 bp, Homo sapien
aactagtgcgttgacggcaccgtgt

SEQ ID NO: 214569 - DNA, 25 bp, Homo sapien
gacggcaccgtgtccaagtttttag

SEQ ID NO: 214570 - DNA, 25 bp, Homo sapien
tttagaacccttgttagccagaccg

SEQ ID NO: 214571 - DNA, 25 bp, Homo sapien
ttgttagccagaccgaggtgtcctg

SEQ ID NO: 214572 - DNA, 25 bp, Homo sapien
agaccgaggtgtcctggtcaccgtt

SEQ ID NO: 214573 - DNA, 25 bp, Homo sapien
tcaccgtttcaccatcatgctttga

SEQ ID NO: 214574 - DNA, 25 bp, Homo sapien
atcatgctttgatgttcccctgtct

SEQ ID NO: 214575 - DNA, 25 bp, Homo sapien
ggatttacagtgcattctgaaagag

SEQ ID NO: 214576 - DNA, 25 bp, Homo sapien
ggagttgtgcaacagctcttttgag

SEQ ID NO: 214577 - DNA, 25 bp, Homo sapien
acagctcttttgagaggaggcctaa

SEQ ID NO: 214578 - DNA, 25 bp, Homo sapien
gagaaaaggtcttcaatcgtggaaa

SEQ ID NO: 214579 - DNA, 25 bp, Homo sapien
aatagatcaccagctagtttcagag

SEQ ID NO: 214580 - DNA, 25 bp, Homo sapien
accagctagtttcagagttaccatg

SEQ ID NO: 214581 - DNA, 25 bp, Homo sapien
tacgtattccactagctgggttctg

SEQ ID NO: 214582 - DNA, 25 bp, Homo sapien
tccactagctgggttctgtatttca

SEQ ID NO: 214583 - DNA, 25 bp, Homo sapien
agctgggttctgtatttcagttctt

SEQ ID NO: 214584 - DNA, 25 bp, Homo sapien
cacctgattccgttgccttgcttaa

SEQ ID NO: 214585 - DNA, 25 bp, Homo sapien
tccgttgccttgcttaactctaaag

SEQ ID NO: 214586 - DNA, 25 bp, Homo sapien
gcaggtcctggacttggcagtttct

SEQ ID NO: 214587 - DNA, 25 bp, Homo sapien
tggacttggcagtttcttgctccca

SEQ ID NO: 214588 - DNA, 25 bp, Homo sapien
acttggcagtttcttgctcccagca

SEQ ID NO: 214589 - DNA, 25 bp, Homo sapien
ttccttattccataggctgggagag

SEQ ID NO: 214590 - DNA, 25 bp, Homo sapien
attccataggctgggagagaaactc

SEQ ID NO: 214591 - DNA, 25 bp, Homo sapien
cccatccccctgattttatatgaag

SEQ ID NO: 214592 - DNA, 25 bp, Homo sapien
ctcgcgagtgccttcttgcaattac

SEQ ID NO: 214593 - DNA, 25 bp, Homo sapien
agtgccttcttgcaattacctgcct

SEQ ID NO: 214594 - DNA, 25 bp, Homo sapien
aattacctgccttagcgggtgttgc

SEQ ID NO: 214595 - DNA, 25 bp, Homo sapien
ttagcgggtgttgcgggtccctcct

SEQ ID NO: 214596 - DNA, 25 bp, Homo sapien
ggtgttgcgggtccctccttcacag

SEQ ID NO: 214597 - DNA, 25 bp, Homo sapien
catgacatcggtgtgtacagcgtct

SEQ ID NO: 214598 - DNA, 25 bp, Homo sapien
acatcggtgtgtacagcgtctactg

SEQ ID NO: 214599 - DNA, 25 bp, Homo sapien
tcggtgtgtacagcgtctactggta

SEQ ID NO: 214600 - DNA, 25 bp, Homo sapien
tgtgtacagcgtctactggtaccag

SEQ ID NO: 214601 - DNA, 25 bp, Homo sapien
gagatatttctcacaatcagacaag

SEQ ID NO: 214602 - DNA, 25 bp, Homo sapien
tttctcacaatcagacaagagccag

SEQ ID NO: 214603 - DNA, 25 bp, Homo sapien
atccaaagatgtggccaggaacagg

SEQ ID NO: 214604 - DNA, 25 bp, Homo sapien
gaacagggggtatttgagcatctct

SEQ ID NO: 214605 - DNA, 25 bp, Homo sapien
ggacgaggctatgtattactgtgct

SEQ ID NO: 214606 - DNA, 25 bp, Homo sapien
gaggctatgtattactgtgctatgg

SEQ ID NO: 214607 - DNA, 25 bp, Homo sapien
attactgtgctatgggggcccgcag

SEQ ID NO: 214608 - DNA, 25 bp, Homo sapien
ccaactctctctgtgtccgtgtgga

SEQ ID NO: 214609 - DNA, 25 bp, Homo sapien
agagcctgcagggtgacctgcttcc

SEQ ID NO: 214610 - DNA, 25 bp, Homo sapien
ggtgacctgcttccccaaaggccaa

SEQ ID NO: 214611 - DNA, 25 bp, Homo sapien
aaggccaacagcattggcctggcca

SEQ ID NO: 214612 - DNA, 25 bp, Homo sapien
tgaccttagatttggtgaacaacgt

SEQ ID NO: 214613 - DNA, 25 bp, Homo sapien
tgaacaacgtactatggaagccaca

SEQ ID NO: 214614 - DNA, 25 bp, Homo sapien
acgtactatggaagccacatcacta

SEQ ID NO: 214615 - DNA, 25 bp, Homo sapien
tattgggcccccaggtctgatctgg

SEQ ID NO: 214616 - DNA, 25 bp, Homo sapien
atgctatcagaaattcgccccattt

SEQ ID NO: 214617 - DNA, 25 bp, Homo sapien
ctatcagaaattcgccccattttct

SEQ ID NO: 214618 - DNA, 25 bp, Homo sapien
ttctttacagtcttttgtgtctgtc

SEQ ID NO: 214619 - DNA, 25 bp, Homo sapien
gctgggcctcggagtttgccccgta

SEQ ID NO: 214620 - DNA, 25 bp, Homo sapien
ttgccccgtaaagcgaattgcactt

SEQ ID NO: 214621 - DNA, 25 bp, Homo sapien
ttgcactttgatgttcagaaaccca

SEQ ID NO: 214622 - DNA, 25 bp, Homo sapien
gttcagaaacccactttgttctcag

SEQ ID NO: 214623 - DNA, 25 bp, Homo sapien
tttgttctcagccacgcaaaactcc

SEQ ID NO: 214624 - DNA, 25 bp, Homo sapien
aaaactccctgaccccgatgtgatt

SEQ ID NO: 214625 - DNA, 25 bp, Homo sapien
tccctgaccccgatgtgatttttct

SEQ ID NO: 214626 - DNA, 25 bp, Homo sapien
atgcgtgggacactggaccctactg

SEQ ID NO: 214627 - DNA, 25 bp, Homo sapien
ggaccctactgtctacacgggcttg

SEQ ID NO: 214628 - DNA, 25 bp, Homo sapien
gcaggtgctcagcaaatgcctattg

SEQ ID NO: 214629 - DNA, 25 bp, Homo sapien
atgcctattgatttgattgtctttt

SEQ ID NO: 214630 - DNA, 25 bp, Homo sapien
taatgattgccctgacggtggtagg

SEQ ID NO: 214631 - DNA, 25 bp, Homo sapien
atgattgccctgacggtggtaggat

SEQ ID NO: 214632 - DNA, 25 bp, Homo sapien
ccctgacggtggtaggatgcatctt

SEQ ID NO: 214633 - DNA, 25 bp, Homo sapien
taacgtgcctgtattaaaaaggatg

SEQ ID NO: 214634 - DNA, 25 bp, Homo sapien
tgaggatccatttcataaagtatga

SEQ ID NO: 214635 - DNA, 25 bp, Homo sapien
cataaagtatgatttgcccaaacct

SEQ ID NO: 214636 - DNA, 25 bp, Homo sapien
gtatgatttgcccaaacctgtacca

SEQ ID NO: 214637 - DNA, 25 bp, Homo sapien
tgatttgcccaaacctgtaccattt

SEQ ID NO: 214638 - DNA, 25 bp, Homo sapien
aacctgtaccatttccgtatttctg

SEQ ID NO: 214639 - DNA, 25 bp, Homo sapien
gtaccatttccgtatttctgctgta

SEQ ID NO: 214640 - DNA, 25 bp, Homo sapien
accatttccgtatttctgctgtaga

SEQ ID NO: 214641 - DNA, 25 bp, Homo sapien
tacttgctgacgactgcctcatctc

SEQ ID NO: 214642 - DNA, 25 bp, Homo sapien
gtaaaggagataatgtgacacacat

SEQ ID NO: 214643 - DNA, 25 bp, Homo sapien
tgtgacacacatttacccataattg

SEQ ID NO: 214644 - DNA, 25 bp, Homo sapien
tacccataattgagattgccataat

SEQ ID NO: 214645 - DNA, 25 bp, Homo sapien
cataattgagattgccataattgct

SEQ ID NO: 214646 - DNA, 25 bp, Homo sapien
attgagattgccataattgctataa

SEQ ID NO: 214647 - DNA, 25 bp, Homo sapien
ttgagattgccataattgctataac

SEQ ID NO: 214648 - DNA, 25 bp, Homo sapien
gagattgccataattgctataactt

SEQ ID NO: 214649 - DNA, 25 bp, Homo sapien
gattgccataattgctataactttt

SEQ ID NO: 214650 - DNA, 25 bp, Homo sapien
ttgccataattgctataactttttc

SEQ ID NO: 214651 - DNA, 25 bp, Homo sapien
gccataattgctataactttttcaa

SEQ ID NO: 214652 - DNA, 25 bp, Homo sapien
tctatgctgacaagccagagacgac

SEQ ID NO: 214653 - DNA, 25 bp, Homo sapien
atgctgacaagccagagacgaccaa

SEQ ID NO: 214654 - DNA, 25 bp, Homo sapien
gacaagccagagacgaccaaggagc

SEQ ID NO: 214655 - DNA, 25 bp, Homo sapien
agccagagacgaccaaggagcaact

SEQ ID NO: 214656 - DNA, 25 bp, Homo sapien
agacgaccaaggagcaactgggaga

SEQ ID NO: 214657 - DNA, 25 bp, Homo sapien
caaggagcaactgggagagttctac

SEQ ID NO: 214658 - DNA, 25 bp, Homo sapien
agagttctacgaagctctcgactgc

SEQ ID NO: 214659 - DNA, 25 bp, Homo sapien
gttctacgaagctctcgactgcttg

SEQ ID NO: 214660 - DNA, 25 bp, Homo sapien
gtgtgagccactggagaagcagcac

SEQ ID NO: 214661 - DNA, 25 bp, Homo sapien
gagccactggagaagcagcacgaga

SEQ ID NO: 214662 - DNA, 25 bp, Homo sapien
cactggagaagcagcacgagaagga

SEQ ID NO: 214663 - DNA, 25 bp, Homo sapien
ggcctctccttgaggtgggcacagc

SEQ ID NO: 214664 - DNA, 25 bp, Homo sapien
tcctgcatttcgctacccgagttta

SEQ ID NO: 214665 - DNA, 25 bp, Homo sapien
gctacccgagtttagtaacagtgca

SEQ ID NO: 214666 - DNA, 25 bp, Homo sapien
gtaacagtgcagattccacgttctt

SEQ ID NO: 214667 - DNA, 25 bp, Homo sapien
cagtgcagattccacgttcttgttc

SEQ ID NO: 214668 - DNA, 25 bp, Homo sapien
agattccacgttcttgttccgatac

SEQ ID NO: 214669 - DNA, 25 bp, Homo sapien
cacgttcttgttccgatactctgag

SEQ ID NO: 214670 - DNA, 25 bp, Homo sapien
ttcttgttccgatactctgagaagt

SEQ ID NO: 214671 - DNA, 25 bp, Homo sapien
gatgttgatgtacttacagacacaa

SEQ ID NO: 214672 - DNA, 25 bp, Homo sapien
acacaagaacaatctttgctataat

SEQ ID NO: 214673 - DNA, 25 bp, Homo sapien
tatgcagaataagctctttattagg

SEQ ID NO: 214674 - DNA, 25 bp, Homo sapien
gtcaccaacaacctcctggagaaat

SEQ ID NO: 214675 - DNA, 25 bp, Homo sapien
aatgcaaaaccctcgttagccaaag

SEQ ID NO: 214676 - DNA, 25 bp, Homo sapien
aagcaacgacttaagcagcctcaga

SEQ ID NO: 214677 - DNA, 25 bp, Homo sapien
ataccctcatgatgtggtgaaccac

SEQ ID NO: 214678 - DNA, 25 bp, Homo sapien
tggtgaaccacctcagctgtgacga

SEQ ID NO: 214679 - DNA, 25 bp, Homo sapien
tcagctgtgacgaggcccggaacca

SEQ ID NO: 214680 - DNA, 25 bp, Homo sapien
actacggcggcgtggtcagcctcat

SEQ ID NO: 214681 - DNA, 25 bp, Homo sapien
cccctcatcctagacttaatgaaag

SEQ ID NO: 214682 - DNA, 25 bp, Homo sapien
gaaagaatggatcgcccactccgag

SEQ ID NO: 214683 - DNA, 25 bp, Homo sapien
agttgccgcgcaaggtgctgcagca

SEQ ID NO: 214684 - DNA, 25 bp, Homo sapien
gctgcagcacgggacgacttagctt

SEQ ID NO: 214685 - DNA, 25 bp, Homo sapien
ggatggcaaggttgtctcgtctcaa

SEQ ID NO: 214686 - DNA, 25 bp, Homo sapien
gtctcgtctcaagtcagcagtattt

SEQ ID NO: 214687 - DNA, 25 bp, Homo sapien
ggaacttccagatcaacaaaagtgt

SEQ ID NO: 214688 - DNA, 25 bp, Homo sapien
cacaagcgaagaaatggcatcaatc

SEQ ID NO: 214689 - DNA, 25 bp, Homo sapien
ggcatcaatctaggcatctttctgg

SEQ ID NO: 214690 - DNA, 25 bp, Homo sapien
ggcatctttctggataatttcagga

SEQ ID NO: 214691 - DNA, 25 bp, Homo sapien
atttcaggaaaagcttcagtccaga

SEQ ID NO: 214692 - DNA, 25 bp, Homo sapien
ggatgactagccaacttttctgcat

SEQ ID NO: 214693 - DNA, 25 bp, Homo sapien
ctgcatcttcttatttcctcattag

SEQ ID NO: 214694 - DNA, 25 bp, Homo sapien
atttcctcattagaatgctcttgaa

SEQ ID NO: 214695 - DNA, 25 bp, Homo sapien
ttgctttaattgtttctatgcttca

SEQ ID NO: 214696 - DNA, 25 bp, Homo sapien
aaaattacttttacgccttgcagct

SEQ ID NO: 214697 - DNA, 25 bp, Homo sapien
acttttacgccttgcagctgtggaa

SEQ ID NO: 214698 - DNA, 25 bp, Homo sapien
cttgcagctgtggaacttggtctta

SEQ ID NO: 214699 - DNA, 25 bp, Homo sapien
gtggaacttggtcttacagcctctg

SEQ ID NO: 214700 - DNA, 25 bp, Homo sapien
tggtcttacagcctctgctcttctg

SEQ ID NO: 214701 - DNA, 25 bp, Homo sapien
tcttctgcccaaacgggccatgcag

SEQ ID NO: 214702 - DNA, 25 bp, Homo sapien
catctgataaatgtggacggctcca

SEQ ID NO: 214703 - DNA, 25 bp, Homo sapien
acggctccaaatcatgtccttagaa

SEQ ID NO: 214704 - DNA, 25 bp, Homo sapien
aatcatgtccttagaaaatctttct

SEQ ID NO: 214705 - DNA, 25 bp, Homo sapien
gagactaaattgtaatgtgattcac

SEQ ID NO: 214706 - DNA, 25 bp, Homo sapien
taaaagtaaggtactctgctgcttt

SEQ ID NO: 214707 - DNA, 25 bp, Homo sapien
aggctgccgtcaacccaattgtctg

SEQ ID NO: 214708 - DNA, 25 bp, Homo sapien
cgtcaacccaattgtctgcttcctg

SEQ ID NO: 214709 - DNA, 25 bp, Homo sapien
aagaagtgcctgaggactcacgccc

SEQ ID NO: 214710 - DNA, 25 bp, Homo sapien
cagagaaccctactgtgtcatgtga

SEQ ID NO: 214711 - DNA, 25 bp, Homo sapien
agctgggccgcatgttctacgcgat

SEQ ID NO: 214712 - DNA, 25 bp, Homo sapien
gttctacgcgatcacactgctcttt

SEQ ID NO: 214713 - DNA, 25 bp, Homo sapien
tctggtcaccctacatcgtggcctg

SEQ ID NO: 214714 - DNA, 25 bp, Homo sapien
tacatcgtggcctgctactggcgag

SEQ ID NO: 214715 - DNA, 25 bp, Homo sapien
cctgctactggcgagtgtttgtgaa

SEQ ID NO: 214716 - DNA, 25 bp, Homo sapien
tggccactgctgtttggatgagctt

SEQ ID NO: 214717 - DNA, 25 bp, Homo sapien
gtttggatgagcttcgcccaggctg

SEQ ID NO: 214718 - DNA, 25 bp, Homo sapien
tggagaagaaccaccactgtcctcg

SEQ ID NO: 214719 - DNA, 25 bp, Homo sapien
tgtcctcgatgtgtcccaagcctgg

SEQ ID NO: 214720 - DNA, 25 bp, Homo sapien
gatgtgtcccaagcctggagcgaat

SEQ ID NO: 214721 - DNA, 25 bp, Homo sapien
aagcctggagcgaatccgtcctctt

SEQ ID NO: 214722 - DNA, 25 bp, Homo sapien
ggagcgaatccgtcctcttggctct

SEQ ID NO: 214723 - DNA, 25 bp, Homo sapien
tcccagccctatcacaggaatcatt

SEQ ID NO: 214724 - DNA, 25 bp, Homo sapien
caggaatcattcctgggtttctgtc

SEQ ID NO: 214725 - DNA, 25 bp, Homo sapien
ctgggtttctgtccctctgaggctc

SEQ ID NO: 214726 - DNA, 25 bp, Homo sapien
cctctgaggctcaccaggtgtagtt

SEQ ID NO: 214727 - DNA, 25 bp, Homo sapien
accaggtgtagttggccttgttctt

SEQ ID NO: 214728 - DNA, 25 bp, Homo sapien
gtattagcccttctactttctttct

SEQ ID NO: 214729 - DNA, 25 bp, Homo sapien
gaacaagtcttgaagatcttggtca

SEQ ID NO: 214730 - DNA, 25 bp, Homo sapien
gtcagcatcatgcaaagtgcaacgg

SEQ ID NO: 214731 - DNA, 25 bp, Homo sapien
aacggaatagtgaattttgctctaa

SEQ ID NO: 214732 - DNA, 25 bp, Homo sapien
gagcatgaacaagtctttctaatgt

SEQ ID NO: 214733 - DNA, 25 bp, Homo sapien
tctaatgttttgtacagtgcctggc

SEQ ID NO: 214734 - DNA, 25 bp, Homo sapien
tgcctggcactctgggtgctcaata

SEQ ID NO: 214735 - DNA, 25 bp, Homo sapien
gaaacagttgacagacatcaccagt

SEQ ID NO: 214736 - DNA, 25 bp, Homo sapien
gacatcaccagttgacttctgcatt

SEQ ID NO: 214737 - DNA, 25 bp, Homo sapien
gttgacttctgcattaacctgcatg

SEQ ID NO: 214738 - DNA, 25 bp, Homo sapien
ctgcattaacctgcatgatctgttt

SEQ ID NO: 214739 - DNA, 25 bp, Homo sapien
ctactatggattggaaacttgtttc

SEQ ID NO: 214740 - DNA, 25 bp, Homo sapien
atctctctcccaggtgttttagttg

SEQ ID NO: 214741 - DNA, 25 bp, Homo sapien
ttttagttgggaacaagacagacct

SEQ ID NO: 214742 - DNA, 25 bp, Homo sapien
caagacagacctggccggcagacga

SEQ ID NO: 214743 - DNA, 25 bp, Homo sapien
gcagacgagcagtggactcagctga

SEQ ID NO: 214744 - DNA, 25 bp, Homo sapien
tgttttgaaacatccgtgaaagaga

SEQ ID NO: 214745 - DNA, 25 bp, Homo sapien
gagatggaaaacttcgaagcccctt

SEQ ID NO: 214746 - DNA, 25 bp, Homo sapien
tttccactgccttgccaagcagttc

SEQ ID NO: 214747 - DNA, 25 bp, Homo sapien
agttccaccagctgtaccgggagaa

SEQ ID NO: 214748 - DNA, 25 bp, Homo sapien
ttttccgggccctggcatgacgagc

SEQ ID NO: 214749 - DNA, 25 bp, Homo sapien
gagctggagcagatcgtgctgcaca

SEQ ID NO: 214750 - DNA, 25 bp, Homo sapien
atcgtgctgcacaaccggagaagac

SEQ ID NO: 214751 - DNA, 25 bp, Homo sapien
acagtggtgtggaccctgcaagatc

SEQ ID NO: 214752 - DNA, 25 bp, Homo sapien
tggtgtggaccctgcaagatcctgg

SEQ ID NO: 214753 - DNA, 25 bp, Homo sapien
atggccaaggtggatattgatgacc

SEQ ID NO: 214754 - DNA, 25 bp, Homo sapien
cacagacctcgccattgagtatgag

SEQ ID NO: 214755 - DNA, 25 bp, Homo sapien
gtatgaggtgtcagcggtgcccact

SEQ ID NO: 214756 - DNA, 25 bp, Homo sapien
gtgcccactgtgctggccatgaaga

SEQ ID NO: 214757 - DNA, 25 bp, Homo sapien
gcatcaaggatgaggatcagttgga

SEQ ID NO: 214758 - DNA, 25 bp, Homo sapien
aagctgattggctgacaagcaggga

SEQ ID NO: 214759 - DNA, 25 bp, Homo sapien
caagcagggatgagtcctggttccc

SEQ ID NO: 214760 - DNA, 25 bp, Homo sapien
ttgcccgcgtgggaccccaatagaa

SEQ ID NO: 214761 - DNA, 25 bp, Homo sapien
cgcgtgggaccccaatagaactcag

SEQ ID NO: 214762 - DNA, 25 bp, Homo sapien
tttccactgccttgccaagcagttc

SEQ ID NO: 214763 - DNA, 25 bp, Homo sapien
ttttccgggccctggcatgacgagc

SEQ ID NO: 214764 - DNA, 25 bp, Homo sapien
ccctggcatgacgagctggagcaga

SEQ ID NO: 214765 - DNA, 25 bp, Homo sapien
atgacgagctggagcagatcgtgct

SEQ ID NO: 214766 - DNA, 25 bp, Homo sapien
gagctggagcagatcgtgctgcaca

SEQ ID NO: 214767 - DNA, 25 bp, Homo sapien
gagcagatcgtgctgcacaaccgga

SEQ ID NO: 214768 - DNA, 25 bp, Homo sapien
gcagatcgtgctgcacaaccggaga

SEQ ID NO: 214769 - DNA, 25 bp, Homo sapien
atcgtgctgcacaaccggagaagac

SEQ ID NO: 214770 - DNA, 25 bp, Homo sapien
tcgtgctgcacaaccggagaagaca

SEQ ID NO: 214771 - DNA, 25 bp, Homo sapien
tgcacaaccggagaagacagaatta

SEQ ID NO: 214772 - DNA, 25 bp, Homo sapien
aaccggagaagacagaattacctct

SEQ ID NO: 214773 - DNA, 25 bp, Homo sapien
aagcccagcgcaacaaaggaaaact

SEQ ID NO: 214774 - DNA, 25 bp, Homo sapien
gaaaactacgaaccggctgtccaag

SEQ ID NO: 214775 - DNA, 25 bp, Homo sapien
tacgaaccggctgtccaaggctgag

SEQ ID NO: 214776 - DNA, 25 bp, Homo sapien
caaggctgagcggtgactgtcccca

SEQ ID NO: 214777 - DNA, 25 bp, Homo sapien
ttcctgggacccagacagcaggccg

SEQ ID NO: 214778 - DNA, 25 bp, Homo sapien
ggacggtgtgctacccctctcgcgg

SEQ ID NO: 214779 - DNA, 25 bp, Homo sapien
aaggaccctggacctgtgggtccat

SEQ ID NO: 214780 - DNA, 25 bp, Homo sapien
gtgggtccatcgtccgttccaggag

SEQ ID NO: 214781 - DNA, 25 bp, Homo sapien
tgcagacgttgcagcctccgggttg

SEQ ID NO: 214782 - DNA, 25 bp, Homo sapien
acgttgcagcctccgggttgttgtt

SEQ ID NO: 214783 - DNA, 25 bp, Homo sapien
gaatctacttatttgcgtatggaat

SEQ ID NO: 214784 - DNA, 25 bp, Homo sapien
tgtttgacctggtttaacccttctg

SEQ ID NO: 214785 - DNA, 25 bp, Homo sapien
gacctggtttaacccttctgatagg

SEQ ID NO: 214786 - DNA, 25 bp, Homo sapien
ccttctgataggtagttgtggatgc

SEQ ID NO: 214787 - DNA, 25 bp, Homo sapien
ggatgagagctgaataatctttgcc

SEQ ID NO: 214788 - DNA, 25 bp, Homo sapien
aatctttgcctggagtggcactaca

SEQ ID NO: 214789 - DNA, 25 bp, Homo sapien
ggcactacactctagaatttccact

SEQ ID NO: 214790 - DNA, 25 bp, Homo sapien
gtgattcctgatagaacagacttta

SEQ ID NO: 214791 - DNA, 25 bp, Homo sapien
agactttacttttctagcccagcat

SEQ ID NO: 214792 - DNA, 25 bp, Homo sapien
tagcccagcattgatctagaagcag

SEQ ID NO: 214793 - DNA, 25 bp, Homo sapien
tgatctagaagcagaggaatcccag

SEQ ID NO: 214794 - DNA, 25 bp, Homo sapien
caacgtatgttcattatttgtacat

SEQ ID NO: 214795 - DNA, 25 bp, Homo sapien
ggagatttctcagcattctcaagag

SEQ ID NO: 214796 - DNA, 25 bp, Homo sapien
gaaggcaaagacttaattcattttc

SEQ ID NO: 214797 - DNA, 25 bp, Homo sapien
caaaaggttctctgaatgtgcacag

SEQ ID NO: 214798 - DNA, 25 bp, Homo sapien
gaacacgtggctcaaatgagaacat

SEQ ID NO: 214799 - DNA, 25 bp, Homo sapien
gttaatgtatttcttcccaaacaat

SEQ ID NO: 214800 - DNA, 25 bp, Homo sapien
catttttctcttctaaaggtagtct

SEQ ID NO: 214801 - DNA, 25 bp, Homo sapien
gtctttcccaactgactgtagggtt

SEQ ID NO: 214802 - DNA, 25 bp, Homo sapien
gactgtagggttgtgtcttttccca

SEQ ID NO: 214803 - DNA, 25 bp, Homo sapien
gtcttttcccaattaaatatctgca

SEQ ID NO: 214804 - DNA, 25 bp, Homo sapien
tctgcagaactttgggattatactt

SEQ ID NO: 214805 - DNA, 25 bp, Homo sapien
gggattatactttgtttactgtaga

SEQ ID NO: 214806 - DNA, 25 bp, Homo sapien
taccgcctgccagtacgtgcaaggt

SEQ ID NO: 214807 - DNA, 25 bp, Homo sapien
accgcctgccagtacgtgcaaggtg

SEQ ID NO: 214808 - DNA, 25 bp, Homo sapien
ccgcctgccagtacgtgcaaggtgt

SEQ ID NO: 214809 - DNA, 25 bp, Homo sapien
cgcctgccagtacgtgcaaggtgtt

SEQ ID NO: 214810 - DNA, 25 bp, Homo sapien
gcctgccagtacgtgcaaggtgtta

SEQ ID NO: 214811 - DNA, 25 bp, Homo sapien
cctgccagtacgtgcaaggtgttag

SEQ ID NO: 214812 - DNA, 25 bp, Homo sapien
ctgccagtacgtgcaaggtgttagt

SEQ ID NO: 214813 - DNA, 25 bp, Homo sapien
gtggagagcaaacttcgaggacgta

SEQ ID NO: 214814 - DNA, 25 bp, Homo sapien
gaggagggagcgtgagcctcccaga

SEQ ID NO: 214815 - DNA, 25 bp, Homo sapien
tctttttccatggtttccaggtaat

SEQ ID NO: 214816 - DNA, 25 bp, Homo sapien
ttccatggtttccaggtaataaaag

SEQ ID NO: 214817 - DNA, 25 bp, Homo sapien
caaatgtatgcctgaggttggtttt

SEQ ID NO: 214818 - DNA, 25 bp, Homo sapien
cagaaaacagtctctgcttctaaaa

SEQ ID NO: 214819 - DNA, 25 bp, Homo sapien
gtctctgcttctaaaaacttctatg

SEQ ID NO: 214820 - DNA, 25 bp, Homo sapien
aaaacttctatgtctagtcttccat

SEQ ID NO: 214821 - DNA, 25 bp, Homo sapien
agtcttccataggaaatcctcactg

SEQ ID NO: 214822 - DNA, 25 bp, Homo sapien
taggaaatcctcactgtttaaccat

SEQ ID NO: 214823 - DNA, 25 bp, Homo sapien
ttaaccatgtgaggagcctaagtca

SEQ ID NO: 214824 - DNA, 25 bp, Homo sapien
gagcctaagtcattaaacggatcat

SEQ ID NO: 214825 - DNA, 25 bp, Homo sapien
aacggatcatgtctgtacattgtgt

SEQ ID NO: 214826 - DNA, 25 bp, Homo sapien
gatgtgtggaggctattcttgtttc

SEQ ID NO: 214827 - DNA, 25 bp, Homo sapien
gctattcttgtttctccatctcaag

SEQ ID NO: 214828 - DNA, 25 bp, Homo sapien
caggttacgtcgctggatttgtaga

SEQ ID NO: 214829 - DNA, 25 bp, Homo sapien
gttacgtcgctggatttgtagactt

SEQ ID NO: 214830 - DNA, 25 bp, Homo sapien
acgtcgctggatttgtagacttgga

SEQ ID NO: 214831 - DNA, 25 bp, Homo sapien
tcgctggatttgtagacttggaggt

SEQ ID NO: 214832 - DNA, 25 bp, Homo sapien
gacttggaggtgagcaacagaccag

SEQ ID NO: 214833 - DNA, 25 bp, Homo sapien
acctctatgatgtgtttgtgaatct

SEQ ID NO: 214834 - DNA, 25 bp, Homo sapien
gagagtgagattaccattgctcccc

SEQ ID NO: 214835 - DNA, 25 bp, Homo sapien
gagtgagattaccattgctcccctt

SEQ ID NO: 214836 - DNA, 25 bp, Homo sapien
attgctccccttgcaaaagaggcca

SEQ ID NO: 214837 - DNA, 25 bp, Homo sapien
tgctccccttgcaaaagaggccatg

SEQ ID NO: 214838 - DNA, 25 bp, Homo sapien
tccccttgcaaaagaggccatggca

SEQ ID NO: 214839 - DNA, 25 bp, Homo sapien
tccaaacacctgtcacagcatatga

SEQ ID NO: 214840 - DNA, 25 bp, Homo sapien
cacctgtcacagcatatgatctcta

SEQ ID NO: 214841 - DNA, 25 bp, Homo sapien
tgtcacagcatatgatctctacagc

SEQ ID NO: 214842 - DNA, 25 bp, Homo sapien
cagggaaagccattgcctatggtaa

SEQ ID NO: 214843 - DNA, 25 bp, Homo sapien
agccattgcctatggtaagtcacct

SEQ ID NO: 214844 - DNA, 25 bp, Homo sapien
attgcctatggtaagtcacctctcc

SEQ ID NO: 214845 - DNA, 25 bp, Homo sapien
ctatggtaagtcacctctcctttag

SEQ ID NO: 214846 - DNA, 25 bp, Homo sapien
tggtaagtcacctctcctttagcac

SEQ ID NO: 214847 - DNA, 25 bp, Homo sapien
ctctcctttagcacattaggaataa

SEQ ID NO: 214848 - DNA, 25 bp, Homo sapien
aggaataatcttggctttggaaatt

SEQ ID NO: 214849 - DNA, 25 bp, Homo sapien
aaaaagattccttactgaattgtga

SEQ ID NO: 214850 - DNA, 25 bp, Homo sapien
aatggcttcaggcaactcccagcct

SEQ ID NO: 214851 - DNA, 25 bp, Homo sapien
gggcgtcagctaaacctgagcttcc

SEQ ID NO: 214852 - DNA, 25 bp, Homo sapien
gtcagctaaacctgagcttccaaga

SEQ ID NO: 214853 - DNA, 25 bp, Homo sapien
ttccaagaagtcaggttgccaaagg

SEQ ID NO: 214854 - DNA, 25 bp, Homo sapien
gagttcttgttctcgaagaacccca

SEQ ID NO: 214855 - DNA, 25 bp, Homo sapien
agaaccccaggcctcatgatggtct

SEQ ID NO: 214856 - DNA, 25 bp, Homo sapien
aggcctcatgatggtctacggtaga

SEQ ID NO: 214857 - DNA, 25 bp, Homo sapien
ggtctacggtagaggtccaacaact

SEQ ID NO: 214858 - DNA, 25 bp, Homo sapien
tagaggtccaacaactacagcctgt

SEQ ID NO: 214859 - DNA, 25 bp, Homo sapien
ggtccaacaactacagcctgtgggc

SEQ ID NO: 214860 - DNA, 25 bp, Homo sapien
agcctgtgggccacatctggccaca

SEQ ID NO: 214861 - DNA, 25 bp, Homo sapien
gggccctcttttagtgatactggat

SEQ ID NO: 214862 - DNA, 25 bp, Homo sapien
tactggattggcgttgtttgtggct

SEQ ID NO: 214863 - DNA, 25 bp, Homo sapien
gtttgtggctgttgcgcacatccct

SEQ ID NO: 214864 - DNA, 25 bp, Homo sapien
tccaccttgggacctgtttagagaa

SEQ ID NO: 214865 - DNA, 25 bp, Homo sapien
gagaagccggctcttcaaagacaat

SEQ ID NO: 214866 - DNA, 25 bp, Homo sapien
ggaaactgtaccatacacattggaa

SEQ ID NO: 214867 - DNA, 25 bp, Homo sapien
tacacattggaaggctccctaacac

SEQ ID NO: 214868 - DNA, 25 bp, Homo sapien
gaagctgggccgagtaccttaatct

SEQ ID NO: 214869 - DNA, 25 bp, Homo sapien
gtaccttaatctgccataaagccat

SEQ ID NO: 214870 - DNA, 25 bp, Homo sapien
ataaagccattcttactcgggcgac

SEQ ID NO: 214871 - DNA, 25 bp, Homo sapien
gagttttcaaagatcccgtgaaatt

SEQ ID NO: 214872 - DNA, 25 bp, Homo sapien
gggctgtctgtctatgctgacaagc

SEQ ID NO: 214873 - DNA, 25 bp, Homo sapien
tacgaagctctcgactgcttgcgca

SEQ ID NO: 214874 - DNA, 25 bp, Homo sapien
ttgcgcattcccaagtcagatgtcg

SEQ ID NO: 214875 - DNA, 25 bp, Homo sapien
aagtcagatgtcgtgtacaccgatt

SEQ ID NO: 214876 - DNA, 25 bp, Homo sapien
agtcagatgtcgtgtacaccgattg

SEQ ID NO: 214877 - DNA, 25 bp, Homo sapien
gggaatcctagcaggacacagcctt

SEQ ID NO: 214878 - DNA, 25 bp, Homo sapien
aatcctagcaggacacagccttgga

SEQ ID NO: 214879 - DNA, 25 bp, Homo sapien
tagcaggacacagccttggatcagg

SEQ ID NO: 214880 - DNA, 25 bp, Homo sapien
agccttggatcaggacagagacttg

SEQ ID NO: 214881 - DNA, 25 bp, Homo sapien
ggacagagacttggggccatcctgc

SEQ ID NO: 214882 - DNA, 25 bp, Homo sapien
cgacatgtgtacctcagctttttcc

SEQ ID NO: 214883 - DNA, 25 bp, Homo sapien
tataaccagctcagagctgaacata

SEQ ID NO: 214884 - DNA, 25 bp, Homo sapien
ataaccagctcagagctgaacataa

SEQ ID NO: 214885 - DNA, 25 bp, Homo sapien
taaccagctcagagctgaacataat

SEQ ID NO: 214886 - DNA, 25 bp, Homo sapien
aaccagctcagagctgaacataatt

SEQ ID NO: 214887 - DNA, 25 bp, Homo sapien
tgaatccagggaaagctattgcaga

SEQ ID NO: 214888 - DNA, 25 bp, Homo sapien
gaatccagggaaagctattgcagag

SEQ ID NO: 214889 - DNA, 25 bp, Homo sapien
aatccagggaaagctattgcagaga

SEQ ID NO: 214890 - DNA, 25 bp, Homo sapien
atccagggaaagctattgcagagat

SEQ ID NO: 214891 - DNA, 25 bp, Homo sapien
gagatcaagaaaatgatggcaacct

SEQ ID NO: 214892 - DNA, 25 bp, Homo sapien
agatcaagaaaatgatggcaaccta

SEQ ID NO: 214893 - DNA, 25 bp, Homo sapien
tcagtttaactgtttccatgctaaa

SEQ ID NO: 214894 - DNA, 25 bp, Homo sapien
ttcagccttattttacggtcccagg

SEQ ID NO: 214895 - DNA, 25 bp, Homo sapien
tcagccttattttacggtcccaggg

SEQ ID NO: 214896 - DNA, 25 bp, Homo sapien
gatcaaaacagagacactgactttg

SEQ ID NO: 214897 - DNA, 25 bp, Homo sapien
caaaacagagacactgactttgggc

SEQ ID NO: 214898 - DNA, 25 bp, Homo sapien
tgactttgggctaaaggactttttg

SEQ ID NO: 214899 - DNA, 25 bp, Homo sapien
tgggctaaaggactttttgcaaaat

SEQ ID NO: 214900 - DNA, 25 bp, Homo sapien
gcaaaataatgctttgttggagttt

SEQ ID NO: 214901 - DNA, 25 bp, Homo sapien
attcagggaaaaaatcggcagacca

SEQ ID NO: 214902 - DNA, 25 bp, Homo sapien
aaatcggcagaccattagttactat

SEQ ID NO: 214903 - DNA, 25 bp, Homo sapien
ggcagaccattagttactatggatt

SEQ ID NO: 214904 - DNA, 25 bp, Homo sapien
caaacacggtaaggaaacaatctat

SEQ ID NO: 214905 - DNA, 25 bp, Homo sapien
aatgccctagaaatagcctctgaaa

SEQ ID NO: 214906 - DNA, 25 bp, Homo sapien
gaaatagcctctgaaattctccaaa

SEQ ID NO: 214907 - DNA, 25 bp, Homo sapien
cctctgaaattctccaaacacctgt

SEQ ID NO: 214908 - DNA, 25 bp, Homo sapien
tatgatctctacagccacacatcaa

SEQ ID NO: 214909 - DNA, 25 bp, Homo sapien
atctctacagccacacatcaatttg

SEQ ID NO: 214910 - DNA, 25 bp, Homo sapien
acagccacacatcaatttggttgtt

SEQ ID NO: 214911 - DNA, 25 bp, Homo sapien
acacatcaatttggttgttgcgaac

SEQ ID NO: 214912 - DNA, 25 bp, Homo sapien
tgttttggactatcccaaacccgtg

SEQ ID NO: 214913 - DNA, 25 bp, Homo sapien
tggactatcccaaacccgtgatgcc

SEQ ID NO: 214914 - DNA, 25 bp, Homo sapien
cttcattggtggtatcaactgccat

SEQ ID NO: 214915 - DNA, 25 bp, Homo sapien
attggtggtatcaactgccatcagg

SEQ ID NO: 214916 - DNA, 25 bp, Homo sapien
accgcttcctcctcgctcttccaga

SEQ ID NO: 214917 - DNA, 25 bp, Homo sapien
gcttcctcctcgctcttccagactc

SEQ ID NO: 214918 - DNA, 25 bp, Homo sapien
ttcctcctcgctcttccagactctt

SEQ ID NO: 214919 - DNA, 25 bp, Homo sapien
tcctcctcgctcttccagactcttc

SEQ ID NO: 214920 - DNA, 25 bp, Homo sapien
tcctcgctcttccagactcttcctg

SEQ ID NO: 214921 - DNA, 25 bp, Homo sapien
cctcgctcttccagactcttcctgc

SEQ ID NO: 214922 - DNA, 25 bp, Homo sapien
ctcgctcttccagactcttcctgca

SEQ ID NO: 214923 - DNA, 25 bp, Homo sapien
tcgctcttccagactcttcctgcag

SEQ ID NO: 214924 - DNA, 25 bp, Homo sapien
gtgcccctaacctggcttttcccat

SEQ ID NO: 214925 - DNA, 25 bp, Homo sapien
tgcccctaacctggcttttcccatc

SEQ ID NO: 214926 - DNA, 25 bp, Homo sapien
gcccctaacctggcttttcccatct

SEQ ID NO: 214927 - DNA, 25 bp, Homo sapien
cagaggtcaggaaaacacaagatgg

SEQ ID NO: 214928 - DNA, 25 bp, Homo sapien
ggaaaattgcaataacccatgcact

SEQ ID NO: 214929 - DNA, 25 bp, Homo sapien
attgcaataacccatgcactgagac

SEQ ID NO: 214930 - DNA, 25 bp, Homo sapien
gaaaatcatccttactaggtaaaat

SEQ ID NO: 214931 - DNA, 25 bp, Homo sapien
tatgatgcaataagtgccaactgat

SEQ ID NO: 214932 - DNA, 25 bp, Homo sapien
actgatatttctcacgttgggactg

SEQ ID NO: 214933 - DNA, 25 bp, Homo sapien
atatttctcacgttgggactggcca

SEQ ID NO: 214934 - DNA, 25 bp, Homo sapien
ttctcacgttgggactggccaggaa

SEQ ID NO: 214935 - DNA, 25 bp, Homo sapien
cacgttgggactggccaggaactgc

SEQ ID NO: 214936 - DNA, 25 bp, Homo sapien
tagttctgaggttatcatatgcctt

SEQ ID NO: 214937 - DNA, 25 bp, Homo sapien
ttctgaggttatcatatgccttttt

SEQ ID NO: 214938 - DNA, 25 bp, Homo sapien
acagaccccgttcctccagcctgcg

SEQ ID NO: 214939 - DNA, 25 bp, Homo sapien
cagaccccgttcctccagcctgcgt

SEQ ID NO: 214940 - DNA, 25 bp, Homo sapien
agaccccgttcctccagcctgcgtg

SEQ ID NO: 214941 - DNA, 25 bp, Homo sapien
gaccccgttcctccagcctgcgtgc

SEQ ID NO: 214942 - DNA, 25 bp, Homo sapien
accccgttcctccagcctgcgtgcc

SEQ ID NO: 214943 - DNA, 25 bp, Homo sapien
gttcctccagcctgcgtgcccctaa

SEQ ID NO: 214944 - DNA, 25 bp, Homo sapien
ttcctccagcctgcgtgcccctaac

SEQ ID NO: 214945 - DNA, 25 bp, Homo sapien
ctccagcctgcgtgcccctaacctg

SEQ ID NO: 214946 - DNA, 25 bp, Homo sapien
agcataaccaaatcttactaaactc

SEQ ID NO: 214947 - DNA, 25 bp, Homo sapien
gcataaccaaatcttactaaactca

SEQ ID NO: 214948 - DNA, 25 bp, Homo sapien
cataaccaaatcttactaaactcat

SEQ ID NO: 214949 - DNA, 25 bp, Homo sapien
ggtgttaaggtagccctgccacgtg

SEQ ID NO: 214950 - DNA, 25 bp, Homo sapien
acgtggctctccaggcagggccaag

SEQ ID NO: 214951 - DNA, 25 bp, Homo sapien
ttggccataagctcatatgctgccc

SEQ ID NO: 214952 - DNA, 25 bp, Homo sapien
tgtgtgcctcagtgttgcagtgtga

SEQ ID NO: 214953 - DNA, 25 bp, Homo sapien
cagtgttgcagtgtgaattcctaaa

SEQ ID NO: 214954 - DNA, 25 bp, Homo sapien
aaagtgagcctagccaggaggtgtt

SEQ ID NO: 214955 - DNA, 25 bp, Homo sapien
atctctcctaccaagctgggcaaga

SEQ ID NO: 214956 - DNA, 25 bp, Homo sapien
gggcaagagcttttaggagattcat

SEQ ID NO: 214957 - DNA, 25 bp, Homo sapien
ggagattcatccagctttgtggatt

SEQ ID NO: 214958 - DNA, 25 bp, Homo sapien
gaaaggaagccttcagttccaatca

SEQ ID NO: 214959 - DNA, 25 bp, Homo sapien
tcagttccaatcagaatcctctttc

SEQ ID NO: 214960 - DNA, 25 bp, Homo sapien
ccccaaggaatgctgtcccaacaag

SEQ ID NO: 214961 - DNA, 25 bp, Homo sapien
ccaaggaatgctgtcccaacaagat

SEQ ID NO: 214962 - DNA, 25 bp, Homo sapien
tgtcccaacaagattcccgtgaaag

SEQ ID NO: 214963 - DNA, 25 bp, Homo sapien
caagattcccgtgaaagagcacccg

SEQ ID NO: 214964 - DNA, 25 bp, Homo sapien
ccgtccacacctgttcttgggtgca

SEQ ID NO: 214965 - DNA, 25 bp, Homo sapien
tttcggttcctggcggtccaggacg

SEQ ID NO: 214966 - DNA, 25 bp, Homo sapien
tgatccgctccgtgctggaagccca

SEQ ID NO: 214967 - DNA, 25 bp, Homo sapien
cgagggaacaaggatgccgccatca

SEQ ID NO: 214968 - DNA, 25 bp, Homo sapien
gggaacaaggatgccgccatcaact

SEQ ID NO: 214969 - DNA, 25 bp, Homo sapien
aggagccatagagcctctgcctcga

SEQ ID NO: 214970 - DNA, 25 bp, Homo sapien
agccatagagcctctgcctcgatgc

SEQ ID NO: 214971 - DNA, 25 bp, Homo sapien
catgacatcggtgtgtacagcgtct

SEQ ID NO: 214972 - DNA, 25 bp, Homo sapien
acatcggtgtgtacagcgtctactg

SEQ ID NO: 214973 - DNA, 25 bp, Homo sapien
tgtgtacagcgtctactggtaccag

SEQ ID NO: 214974 - DNA, 25 bp, Homo sapien
cctcccaggttcctgctgagatatt

SEQ ID NO: 214975 - DNA, 25 bp, Homo sapien
gagatatttctcacaatcagacaag

SEQ ID NO: 214976 - DNA, 25 bp, Homo sapien
cacaatcagacaagagccagggccc

SEQ ID NO: 214977 - DNA, 25 bp, Homo sapien
atccaaagatgtggccaggaacagg

SEQ ID NO: 214978 - DNA, 25 bp, Homo sapien
gaacagggggtatttgagcatctct

SEQ ID NO: 214979 - DNA, 25 bp, Homo sapien
gacgaggctatgtattactgtgcta

SEQ ID NO: 214980 - DNA, 25 bp, Homo sapien
gaaatggaacccactgcagccagga

SEQ ID NO: 214981 - DNA, 25 bp, Homo sapien
tgcagccaggacacgtgtcccttga

SEQ ID NO: 214982 - DNA, 25 bp, Homo sapien
tccacccagtgaactggactgtggc

SEQ ID NO: 214983 - DNA, 25 bp, Homo sapien
tgacccagggtatcagctccaaact

SEQ ID NO: 214984 - DNA, 25 bp, Homo sapien
gaaaagcccaggagaagtcccacca

SEQ ID NO: 214985 - DNA, 25 bp, Homo sapien
agcctgcatacttgccacttggcca

SEQ ID NO: 214986 - DNA, 25 bp, Homo sapien
cacttggccaccaggactccttgtt

SEQ ID NO: 214987 - DNA, 25 bp, Homo sapien
gactccttgttctgctctggcaaga

SEQ ID NO: 214988 - DNA, 25 bp, Homo sapien
gttctgctctggcaagagactactc

SEQ ID NO: 214989 - DNA, 25 bp, Homo sapien
aagagactactctgcctgaacactg

SEQ ID NO: 214990 - DNA, 25 bp, Homo sapien
ctgcctgaacactgcttctcctgga

SEQ ID NO: 214991 - DNA, 25 bp, Homo sapien
tgcttctcctggaccctggaagcag

SEQ ID NO: 214992 - DNA, 25 bp, Homo sapien
ggtaagaacacctgacaacttctga

SEQ ID NO: 214993 - DNA, 25 bp, Homo sapien
gagatggtcctgataccaagagggt

SEQ ID NO: 214994 - DNA, 25 bp, Homo sapien
taccaagagggtgtgcctgcgaaat

SEQ ID NO: 214995 - DNA, 25 bp, Homo sapien
gagcagatgaaactgcccgcagaag

SEQ ID NO: 214996 - DNA, 25 bp, Homo sapien
gaaactgcccgcagaagggccagag

SEQ ID NO: 214997 - DNA, 25 bp, Homo sapien
gccagagcctgaagcggatagccag

SEQ ID NO: 214998 - DNA, 25 bp, Homo sapien
aggaacaggttcacccgaagactgg

SEQ ID NO: 214999 - DNA, 25 bp, Homo sapien
tgatgtccaggagttgggcctgcca

SEQ ID NO: 215000 - DNA, 25 bp, Homo sapien
agttgggcctgccaaatccagagga

SEQ ID NO: 215001 - DNA, 25 bp, Homo sapien
aaagaagacacgctgaaatggttca

SEQ ID NO: 215002 - DNA, 25 bp, Homo sapien
aaatggttcaggctgctcctgtgtt

SEQ ID NO: 215003 - DNA, 25 bp, Homo sapien
gctcctgtgttggaaatttgaccat

SEQ ID NO: 215004 - DNA, 25 bp, Homo sapien
gctcatgcccaggtggaatcatgct

SEQ ID NO: 215005 - DNA, 25 bp, Homo sapien
tgagacaggccagggttaccagcgc

SEQ ID NO: 215006 - DNA, 25 bp, Homo sapien
ttaccagcgctttctcctctacaat

SEQ ID NO: 215007 - DNA, 25 bp, Homo sapien
aggaattcaagtccctgacttcctg

SEQ ID NO: 215008 - DNA, 25 bp, Homo sapien
tgacttcctgcctggactccaaagc

SEQ ID NO: 215009 - DNA, 25 bp, Homo sapien
gccttcttagttgactcctaggaat

SEQ ID NO: 215010 - DNA, 25 bp, Homo sapien
gactcctaggaatcaagaggcctgt

SEQ ID NO: 215011 - DNA, 25 bp, Homo sapien
gaggcctgtgagctgtccaataact

SEQ ID NO: 215012 - DNA, 25 bp, Homo sapien
gtgagctgtccaataactgacctgt

SEQ ID NO: 215013 - DNA, 25 bp, Homo sapien
aactgacctgtaacttcatctaagt

SEQ ID NO: 215014 - DNA, 25 bp, Homo sapien
atctaagtccccagatgggtacaat

SEQ ID NO: 215015 - DNA, 25 bp, Homo sapien
agctcatgcccaggtggaatcatgc

SEQ ID NO: 215016 - DNA, 25 bp, Homo sapien
tcatgcccaggtggaatcatgctga

SEQ ID NO: 215017 - DNA, 25 bp, Homo sapien
tgcccaggtggaatcatgctgaatg

SEQ ID NO: 215018 - DNA, 25 bp, Homo sapien
ttaccagcgctttctcctctacaat

SEQ ID NO: 215019 - DNA, 25 bp, Homo sapien
ctcaccacatcctcccgaaaagtgt

SEQ ID NO: 215020 - DNA, 25 bp, Homo sapien
gtgtggaggaattcaagtccctgac

SEQ ID NO: 215021 - DNA, 25 bp, Homo sapien
tggaggaattcaagtccctgacttc

SEQ ID NO: 215022 - DNA, 25 bp, Homo sapien
aggaattcaagtccctgacttcctg

SEQ ID NO: 215023 - DNA, 25 bp, Homo sapien
tgacttcctgcctggactccaaagc

SEQ ID NO: 215024 - DNA, 25 bp, Homo sapien
ttgactcctaggaatcaagaggcct

SEQ ID NO: 215025 - DNA, 25 bp, Homo sapien
ctcctaggaatcaagaggcctgtga

SEQ ID NO: 215026 - DNA, 25 bp, Homo sapien
caacaagtgaaggtttattactgaa

SEQ ID NO: 215027 - DNA, 25 bp, Homo sapien
gaagattgatccattgttgcctaaa

SEQ ID NO: 215028 - DNA, 25 bp, Homo sapien
tgatccattgttgcctaaagaagta

SEQ ID NO: 215029 - DNA, 25 bp, Homo sapien
gcctaaatgtggtgaattgtgaaat

SEQ ID NO: 215030 - DNA, 25 bp, Homo sapien
acagcataatttttacatttgatgt

SEQ ID NO: 215031 - DNA, 25 bp, Homo sapien
gatgtcttgttattgatcatacttg

SEQ ID NO: 215032 - DNA, 25 bp, Homo sapien
aatcgtacagtcatttcaagaataa

SEQ ID NO: 215033 - DNA, 25 bp, Homo sapien
tttgggtccctttgtggtacgtgct

SEQ ID NO: 215034 - DNA, 25 bp, Homo sapien
ttgtggtacgtgctttccttcgtag

SEQ ID NO: 215035 - DNA, 25 bp, Homo sapien
gtgctttccttcgtagttcaacaag

SEQ ID NO: 215036 - DNA, 25 bp, Homo sapien
tttccttcgtagttcaacaagtgaa

SEQ ID NO: 215037 - DNA, 25 bp, Homo sapien
ccagcctgggtcaagaattacacgc

SEQ ID NO: 215038 - DNA, 25 bp, Homo sapien
ttacacgcttggatgacaggcttgc

SEQ ID NO: 215039 - DNA, 25 bp, Homo sapien
gcttggatgacaggcttgcacttgc

SEQ ID NO: 215040 - DNA, 25 bp, Homo sapien
ttgcacttgcccttgggatagcata

SEQ ID NO: 215041 - DNA, 25 bp, Homo sapien
atagcatagctaaaactgttggtgg

SEQ ID NO: 215042 - DNA, 25 bp, Homo sapien
gggagcagacacaaactacttgaac

SEQ ID NO: 215043 - DNA, 25 bp, Homo sapien
tgttcctcttattccaatgttcttg

SEQ ID NO: 215044 - DNA, 25 bp, Homo sapien
tgcagtattgatgccattgtagaat

SEQ ID NO: 215045 - DNA, 25 bp, Homo sapien
gttacggactaagactggctccttt

SEQ ID NO: 215046 - DNA, 25 bp, Homo sapien
gggaaatcacatgccagcgggactt

SEQ ID NO: 215047 - DNA, 25 bp, Homo sapien
ggacttgcaagccacaaccgagatg

SEQ ID NO: 215048 - DNA, 25 bp, Homo sapien
actgcacccggccacggagactggg

SEQ ID NO: 215049 - DNA, 25 bp, Homo sapien
tcggaagcccgggagcccagtatgg

SEQ ID NO: 215050 - DNA, 25 bp, Homo sapien
ggaagggtcttacctcagcagttac

SEQ ID NO: 215051 - DNA, 25 bp, Homo sapien
gggtcttacctcagcagttacccca

SEQ ID NO: 215052 - DNA, 25 bp, Homo sapien
acttgcccagcacaggcctggtgct

SEQ ID NO: 215053 - DNA, 25 bp, Homo sapien
ccagcacaggcctggtgctcaagat

SEQ ID NO: 215054 - DNA, 25 bp, Homo sapien
tggtgctcaagatctcgcctcaggg

SEQ ID NO: 215055 - DNA, 25 bp, Homo sapien
tcaagatctcgcctcagggctcctt

SEQ ID NO: 215056 - DNA, 25 bp, Homo sapien
tccttcctccagtcttggagcattt

SEQ ID NO: 215057 - DNA, 25 bp, Homo sapien
cttcctccagtcttggagcattttt

SEQ ID NO: 215058 - DNA, 25 bp, Homo sapien
ccagtcttggagcattttttgcagg

SEQ ID NO: 215059 - DNA, 25 bp, Homo sapien
agggccattccacagtgctcccctg

SEQ ID NO: 215060 - DNA, 25 bp, Homo sapien
tcgctcttccagactcttcctgcag

SEQ ID NO: 215061 - DNA, 25 bp, Homo sapien
tcttccagactcttcctgcagaggc

SEQ ID NO: 215062 - DNA, 25 bp, Homo sapien
agactcttcctgcagaggctccttt

SEQ ID NO: 215063 - DNA, 25 bp, Homo sapien
ttcctgcagaggctcctttctgcct

SEQ ID NO: 215064 - DNA, 25 bp, Homo sapien
cagaggctcctttctgcctccatgg

SEQ ID NO: 215065 - DNA, 25 bp, Homo sapien
gtgcccctaacctggcttttcccat

SEQ ID NO: 215066 - DNA, 25 bp, Homo sapien
atctccccagcataaccaaatctta

SEQ ID NO: 215067 - DNA, 25 bp, Homo sapien
aaatcttactaaactcatgctaggc

SEQ ID NO: 215068 - DNA, 25 bp, Homo sapien
ttactaaactcatgctaggctgggc

SEQ ID NO: 215069 - DNA, 25 bp, Homo sapien
actaaactcatgctaggctgggcat

SEQ ID NO: 215070 - DNA, 25 bp, Homo sapien
ctctgggtcacacatctttagggtc

SEQ ID NO: 215071 - DNA, 25 bp, Homo sapien
gggcacatttggcactagcttgagc

SEQ ID NO: 215072 - DNA, 25 bp, Homo sapien
tagcttgagcccaactctggctctg

SEQ ID NO: 215073 - DNA, 25 bp, Homo sapien
tgtcagggctgacttcacctctgct

SEQ ID NO: 215074 - DNA, 25 bp, Homo sapien
ctctgctcatctcagtttcctaatc

SEQ ID NO: 215075 - DNA, 25 bp, Homo sapien
agcccttgatttctccctcaagctg

SEQ ID NO: 215076 - DNA, 25 bp, Homo sapien
aaagaggtggctccagtgcccaaaa

SEQ ID NO: 215077 - DNA, 25 bp, Homo sapien
gtgcccaaaatccactagtcctaaa

SEQ ID NO: 215078 - DNA, 25 bp, Homo sapien
atccactagtcctaaaccggaagag

SEQ ID NO: 215079 - DNA, 25 bp, Homo sapien
gatgacaccggccatgggttaacgt

SEQ ID NO: 215080 - DNA, 25 bp, Homo sapien
atgggttaacgtggctcctcaggac

SEQ ID NO: 215081 - DNA, 25 bp, Homo sapien
tccagctgtgagtaattttgacctg

SEQ ID NO: 215082 - DNA, 25 bp, Homo sapien
gagtaattttgacctgttgactttt

SEQ ID NO: 215083 - DNA, 25 bp, Homo sapien
aaaatctcaagtggcattctttgtc

SEQ ID NO: 215084 - DNA, 25 bp, Homo sapien
caagtggcattctttgtcaactcgc

SEQ ID NO: 215085 - DNA, 25 bp, Homo sapien
tttgtcaactcgctgcttttctaac

SEQ ID NO: 215086 - DNA, 25 bp, Homo sapien
caactcgctgcttttctaactgctt

SEQ ID NO: 215087 - DNA, 25 bp, Homo sapien
gctttgaacttttcggattttctgt

SEQ ID NO: 215088 - DNA, 25 bp, Homo sapien
cggtgatggataaattgacaactct

SEQ ID NO: 215089 - DNA, 25 bp, Homo sapien
gacaactctgtaggatttactagca

SEQ ID NO: 215090 - DNA, 25 bp, Homo sapien
taattgtgttggagcttctttttcc

SEQ ID NO: 215091 - DNA, 25 bp, Homo sapien
gaaaaactagttgcagtcagggagc

SEQ ID NO: 215092 - DNA, 25 bp, Homo sapien
gagccctcggctcccatcgactgca

SEQ ID NO: 215093 - DNA, 25 bp, Homo sapien
actgcacccggccacggagactggg

SEQ ID NO: 215094 - DNA, 25 bp, Homo sapien
ctgggggacgagaggccaccagctc

SEQ ID NO: 215095 - DNA, 25 bp, Homo sapien
cagaccccagcctcgggaccgccgc

SEQ ID NO: 215096 - DNA, 25 bp, Homo sapien
tcggaagcccgggagcccagtatgg

SEQ ID NO: 215097 - DNA, 25 bp, Homo sapien
cggaagcccgggagcccagtatggg

SEQ ID NO: 215098 - DNA, 25 bp, Homo sapien
ggtcttacctcagcagttaccccac

SEQ ID NO: 215099 - DNA, 25 bp, Homo sapien
tccttcctccagtcttggagcattt

SEQ ID NO: 215100 - DNA, 25 bp, Homo sapien
ccttcctccagtcttggagcatttt

SEQ ID NO: 215101 - DNA, 25 bp, Homo sapien
cttcctccagtcttggagcattttt

SEQ ID NO: 215102 - DNA, 25 bp, Homo sapien
ttcctccagtcttggagcatttttt

SEQ ID NO: 215103 - DNA, 25 bp, Homo sapien
ttctttatccatgagcaccaggctt

SEQ ID NO: 215104 - DNA, 25 bp, Homo sapien
agcaccaggctttgctcacttaaaa

SEQ ID NO: 215105 - DNA, 25 bp, Homo sapien
caccaggctttgctcacttaaaaaa

SEQ ID NO: 215106 - DNA, 25 bp, Homo sapien
ttaagccacattaaggagtgagtct

SEQ ID NO: 215107 - DNA, 25 bp, Homo sapien
gagtgagtcttcttttttacaataa

SEQ ID NO: 215108 - DNA, 25 bp, Homo sapien
gagtcttcttttttacaataatgta

SEQ ID NO: 215109 - DNA, 25 bp, Homo sapien
tttgtgttgttgaatttgaaagcct

SEQ ID NO: 215110 - DNA, 25 bp, Homo sapien
ggcaatgaaaccctgatcatgttgt

SEQ ID NO: 215111 - DNA, 25 bp, Homo sapien
gaaaccctgatcatgttgttgatgg

SEQ ID NO: 215112 - DNA, 25 bp, Homo sapien
cctgatcatgttgttgatggttagc

SEQ ID NO: 215113 - DNA, 25 bp, Homo sapien
gatggttagcatatgtttctgaaaa

SEQ ID NO: 215114 - DNA, 25 bp, Homo sapien
tgatgggcaagtacacgtaccctgc

SEQ ID NO: 215115 - DNA, 25 bp, Homo sapien
gatgggcaagtacacgtaccctgca

SEQ ID NO: 215116 - DNA, 25 bp, Homo sapien
atgggcaagtacacgtaccctgcac

SEQ ID NO: 215117 - DNA, 25 bp, Homo sapien
tgggcaagtacacgtaccctgcact

SEQ ID NO: 215118 - DNA, 25 bp, Homo sapien
gggcaagtacacgtaccctgcactc

SEQ ID NO: 215119 - DNA, 25 bp, Homo sapien
ggcaagtacacgtaccctgcactcc

SEQ ID NO: 215120 - DNA, 25 bp, Homo sapien
gcaagtacacgtaccctgcactccg

SEQ ID NO: 215121 - DNA, 25 bp, Homo sapien
caagtacacgtaccctgcactccgg

SEQ ID NO: 215122 - DNA, 25 bp, Homo sapien
agtacacgtaccctgcactccggga

SEQ ID NO: 215123 - DNA, 25 bp, Homo sapien
gtacacgtaccctgcactccgggag

SEQ ID NO: 215124 - DNA, 25 bp, Homo sapien
cttccagaagatggacagaaacaag

SEQ ID NO: 215125 - DNA, 25 bp, Homo sapien
ccaatgttatgttatgctttgtaaa

SEQ ID NO: 215126 - DNA, 25 bp, Homo sapien
tttgcttttacctagataaacttct

SEQ ID NO: 215127 - DNA, 25 bp, Homo sapien
gataaacttctagctaatcaaataa

SEQ ID NO: 215128 - DNA, 25 bp, Homo sapien
cttcttttgtgttagatactgtatt

SEQ ID NO: 215129 - DNA, 25 bp, Homo sapien
gatactgtattagagatctgcattt

SEQ ID NO: 215130 - DNA, 25 bp, Homo sapien
tttatttttgggaaagtaacacatg

SEQ ID NO: 215131 - DNA, 25 bp, Homo sapien
gtaacacatgaagtagttcagtcat

SEQ ID NO: 215132 - DNA, 25 bp, Homo sapien
gaagtagttcagtcatgtcaggttt

SEQ ID NO: 215133 - DNA, 25 bp, Homo sapien
tagttcagtcatgtcaggtttgtct

SEQ ID NO: 215134 - DNA, 25 bp, Homo sapien
ttcagtcatgtcaggtttgtctggg

SEQ ID NO: 215135 - DNA, 25 bp, Homo sapien
gaatggaacagtcaggtagttgaaa

SEQ ID NO: 215136 - DNA, 25 bp, Homo sapien
gcgtactggtcgttgtgggaatact

SEQ ID NO: 215137 - DNA, 25 bp, Homo sapien
tttccttttttgatcttgaatcgga

SEQ ID NO: 215138 - DNA, 25 bp, Homo sapien
tcggataaccatttagcacagcctc

SEQ ID NO: 215139 - DNA, 25 bp, Homo sapien
gcacagcctctagtaaaagtattga

SEQ ID NO: 215140 - DNA, 25 bp, Homo sapien
gacagatgctcaacaggatgttcct

SEQ ID NO: 215141 - DNA, 25 bp, Homo sapien
ttagtacatacattcctggcttcag

SEQ ID NO: 215142 - DNA, 25 bp, Homo sapien
attcctggcttcagtggtagtacaa

SEQ ID NO: 215143 - DNA, 25 bp, Homo sapien
aaacgtgtttgcatcagttgatacc

SEQ ID NO: 215144 - DNA, 25 bp, Homo sapien
gggcaagagcactttgaacacagct

SEQ ID NO: 215145 - DNA, 25 bp, Homo sapien
gaacacagctgggttttcttcttca

SEQ ID NO: 215146 - DNA, 25 bp, Homo sapien
agctcccaatccagtagatgatgag

SEQ ID NO: 215147 - DNA, 25 bp, Homo sapien
ttctcggtcagattgcaatgtcagc

SEQ ID NO: 215148 - DNA, 25 bp, Homo sapien
attgcaatgtcagcagttactgcca

SEQ ID NO: 215149 - DNA, 25 bp, Homo sapien
agcagttactgccacactcctgtca

SEQ ID NO: 215150 - DNA, 25 bp, Homo sapien
cacactcctgtcagcttaaacacaa

SEQ ID NO: 215151 - DNA, 25 bp, Homo sapien
aatgttactgcttatcttttcttaa

SEQ ID NO: 215152 - DNA, 25 bp, Homo sapien
gtaggtattttgaagtactgggctt

SEQ ID NO: 215153 - DNA, 25 bp, Homo sapien
gtactgggcttatatttcattggaa

SEQ ID NO: 215154 - DNA, 25 bp, Homo sapien
atttcattggaatacatgtgtacag

SEQ ID NO: 215155 - DNA, 25 bp, Homo sapien
atacatgtgtacagcaataagcagg

SEQ ID NO: 215156 - DNA, 25 bp, Homo sapien
gcacatgtaatgtattaaaggctac

SEQ ID NO: 215157 - DNA, 25 bp, Homo sapien
caaatgttcatatctcatttctttt

SEQ ID NO: 215158 - DNA, 25 bp, Homo sapien
agagattacttaagactgtgtcagt

SEQ ID NO: 215159 - DNA, 25 bp, Homo sapien
gactgtgtcagtcaactaaacattc

SEQ ID NO: 215160 - DNA, 25 bp, Homo sapien
gtcagtcaactaaacattctaatat

SEQ ID NO: 215161 - DNA, 25 bp, Homo sapien
gtatgttttgtatcaatagcataat

SEQ ID NO: 215162 - DNA, 25 bp, Homo sapien
aagtatggtcttgataatgcattag

SEQ ID NO: 215163 - DNA, 25 bp, Homo sapien
acctttgaaatatcctttgtgtcca

SEQ ID NO: 215164 - DNA, 25 bp, Homo sapien
ttgaaatatcctttgtgtccagtga

SEQ ID NO: 215165 - DNA, 25 bp, Homo sapien
ttgtgtccagtgataaatgtgattg

SEQ ID NO: 215166 - DNA, 25 bp, Homo sapien
atgtgattgatcttgccttttgtac

SEQ ID NO: 215167 - DNA, 25 bp, Homo sapien
gccttttgtacatggaggtcacctc

SEQ ID NO: 215168 - DNA, 25 bp, Homo sapien
ggaggtcacctctgaagtgattttt

SEQ ID NO: 215169 - DNA, 25 bp, Homo sapien
tgacagattactcacctcagctcca

SEQ ID NO: 215170 - DNA, 25 bp, Homo sapien
agctccagaagcctaaattttgatg

SEQ ID NO: 215171 - DNA, 25 bp, Homo sapien
taaaccaatccctaacacgtggtat

SEQ ID NO: 215172 - DNA, 25 bp, Homo sapien
aacacgtggtatgggcgaatcgtac

SEQ ID NO: 215173 - DNA, 25 bp, Homo sapien
gaatcgtacgatatgctttgccatt

SEQ ID NO: 215174 - DNA, 25 bp, Homo sapien
ctttgccattgtgaaactttcctta

SEQ ID NO: 215175 - DNA, 25 bp, Homo sapien
tgtgaaactttccttaagccttcaa

SEQ ID NO: 215176 - DNA, 25 bp, Homo sapien
ttaagccttcaatttaagtgctgat

SEQ ID NO: 215177 - DNA, 25 bp, Homo sapien
gtgctgatgcactgtaatacgtgct

SEQ ID NO: 215178 - DNA, 25 bp, Homo sapien
gtaatacgtgcttaactttgcttaa

SEQ ID NO: 215179 - DNA, 25 bp, Homo sapien
gcttaaactctctaattcccaattt

SEQ ID NO: 215180 - DNA, 25 bp, Homo sapien
gggaggcagatacagcacacttgac

SEQ ID NO: 215181 - DNA, 25 bp, Homo sapien
gatacagcacacttgaccgcagaac

SEQ ID NO: 215182 - DNA, 25 bp, Homo sapien
tgaccgcagaactgggctatccaag

SEQ ID NO: 215183 - DNA, 25 bp, Homo sapien
gtaaacagaaggcatttagctgaaa

SEQ ID NO: 215184 - DNA, 25 bp, Homo sapien
gatcagcccatgtagtgttggtcac

SEQ ID NO: 215185 - DNA, 25 bp, Homo sapien
gtgttggtcacttgggcctttcacc

SEQ ID NO: 215186 - DNA, 25 bp, Homo sapien
tttcacctgccatggtaccttttgt

SEQ ID NO: 215187 - DNA, 25 bp, Homo sapien
tggtaccttttgttcccagctcctc

SEQ ID NO: 215188 - DNA, 25 bp, Homo sapien
ttggtggtgacagcaactggaacga

SEQ ID NO: 215189 - DNA, 25 bp, Homo sapien
acgttactcaagttgatttctcaga

SEQ ID NO: 215190 - DNA, 25 bp, Homo sapien
attgaaaacagaccttgtgctgagg

SEQ ID NO: 215191 - DNA, 25 bp, Homo sapien
aacttcggatgcatgttgagaaaca

SEQ ID NO: 215192 - DNA, 25 bp, Homo sapien
gtaaaactcaaatataggagctgtg

SEQ ID NO: 215193 - DNA, 25 bp, Homo sapien
ctgtgtctacgattcaaagtgaaaa

SEQ ID NO: 215194 - DNA, 25 bp, Homo sapien
tttggtttaatatcctgtaaggcac

SEQ ID NO: 215195 - DNA, 25 bp, Homo sapien
gtttaatatcctgtaaggcacgtga

SEQ ID NO: 215196 - DNA, 25 bp, Homo sapien
tatcctgtaaggcacgtgagtgtac

SEQ ID NO: 215197 - DNA, 25 bp, Homo sapien
gtaaggcacgtgagtgtacactttt

SEQ ID NO: 215198 - DNA, 25 bp, Homo sapien
aaggcacgtgagtgtacactttttt

SEQ ID NO: 215199 - DNA, 25 bp, Homo sapien
ggatacgggacaattttaagatgta

SEQ ID NO: 215200 - DNA, 25 bp, Homo sapien
gatgtaataccaatactttagaagt

SEQ ID NO: 215201 - DNA, 25 bp, Homo sapien
caatactttagaagtttggtcgtgt

SEQ ID NO: 215202 - DNA, 25 bp, Homo sapien
ggcacctagagttctcggtgtgtct

SEQ ID NO: 215203 - DNA, 25 bp, Homo sapien
acctagagttctcggtgtgtctcct

SEQ ID NO: 215204 - DNA, 25 bp, Homo sapien
tagagttctcggtgtgtctccttca

SEQ ID NO: 215205 - DNA, 25 bp, Homo sapien
gagttctcggtgtgtctccttcatt

SEQ ID NO: 215206 - DNA, 25 bp, Homo sapien
ccttcattcattggcctctgctggg

SEQ ID NO: 215207 - DNA, 25 bp, Homo sapien
ggcctcctatgggtgtcttacgtct

SEQ ID NO: 215208 - DNA, 25 bp, Homo sapien
ctcctatgggtgtcttacgtctgtc

SEQ ID NO: 215209 - DNA, 25 bp, Homo sapien
cctatgggtgtcttacgtctgtcca

SEQ ID NO: 215210 - DNA, 25 bp, Homo sapien
tatgggtgtcttacgtctgtccatc

SEQ ID NO: 215211 - DNA, 25 bp, Homo sapien
gggtgtcttacgtctgtccatccat

SEQ ID NO: 215212 - DNA, 25 bp, Homo sapien
gtgtcttacgtctgtccatccatct

SEQ ID NO: 215213 - DNA, 25 bp, Homo sapien
accatcctggtccaaccaaaagctg

SEQ ID NO: 215214 - DNA, 25 bp, Homo sapien
tggtccaaccaaaagctgaacggat

SEQ ID NO: 215215 - DNA, 25 bp, Homo sapien
aaagctgaacggatgccacactgtg

SEQ ID NO: 215216 - DNA, 25 bp, Homo sapien
tgaacggatgccacactgtgctggg

SEQ ID NO: 215217 - DNA, 25 bp, Homo sapien
gggccccttgacctcagcagagccg

SEQ ID NO: 215218 - DNA, 25 bp, Homo sapien
tccacactcagagcccgtggactgg

SEQ ID NO: 215219 - DNA, 25 bp, Homo sapien
agggctgatggtactgctggcccaa

SEQ ID NO: 215220 - DNA, 25 bp, Homo sapien
tgatggtactgctggcccaacactg

SEQ ID NO: 215221 - DNA, 25 bp, Homo sapien
tggcccaacactgctctctttgtgt

SEQ ID NO: 215222 - DNA, 25 bp, Homo sapien
cactgctctctttgtgtttggtttt

SEQ ID NO: 215223 - DNA, 25 bp, Homo sapien
acttttgatactgtgaagatctttc

SEQ ID NO: 215224 - DNA, 25 bp, Homo sapien
aacaactctatgctgtgtccatggc

SEQ ID NO: 215225 - DNA, 25 bp, Homo sapien
tatgacgatgaacagcatccagttc

SEQ ID NO: 215226 - DNA, 25 bp, Homo sapien
tccagttcatatgccgttggtagaa

SEQ ID NO: 215227 - DNA, 25 bp, Homo sapien
ataagtgcctaagtgtatacagtga

SEQ ID NO: 215228 - DNA, 25 bp, Homo sapien
cagtgagagcatctatagaagccta

SEQ ID NO: 215229 - DNA, 25 bp, Homo sapien
ttctgttatgtttagactatgtctt

SEQ ID NO: 215230 - DNA, 25 bp, Homo sapien
cttatctttagactatttcaggctt

SEQ ID NO: 215231 - DNA, 25 bp, Homo sapien
tttcaggcttaattttcctaacttg

SEQ ID NO: 215232 - DNA, 25 bp, Homo sapien
tttcctaacttgttcagccctagtg

SEQ ID NO: 215233 - DNA, 25 bp, Homo sapien
agccctagtgctttacctctcattt

SEQ ID NO: 215234 - DNA, 25 bp, Homo sapien
ttacctctcatttttaattgaactg

SEQ ID NO: 215235 - DNA, 25 bp, Homo sapien
cagtaaaaacagtcccggctgggtg

SEQ ID NO: 215236 - DNA, 25 bp, Homo sapien
gtaaaaacagtcccggctgggtgct

SEQ ID NO: 215237 - DNA, 25 bp, Homo sapien
taaaaacagtcccggctgggtgctg

SEQ ID NO: 215238 - DNA, 25 bp, Homo sapien
aaaaacagtcccggctgggtgctgt

SEQ ID NO: 215239 - DNA, 25 bp, Homo sapien
aaaacagtcccggctgggtgctgtg

SEQ ID NO: 215240 - DNA, 25 bp, Homo sapien
aaacagtcccggctgggtgctgtgg

SEQ ID NO: 215241 - DNA, 25 bp, Homo sapien
atttagccgtgcttggtggcacctg

SEQ ID NO: 215242 - DNA, 25 bp, Homo sapien
tttagccgtgcttggtggcacctgt

SEQ ID NO: 215243 - DNA, 25 bp, Homo sapien
ttagccgtgcttggtggcacctgta

SEQ ID NO: 215244 - DNA, 25 bp, Homo sapien
tagccgtgcttggtggcacctgtaa

SEQ ID NO: 215245 - DNA, 25 bp, Homo sapien
agcccagacggcaccattgcactct

SEQ ID NO: 215246 - DNA, 25 bp, Homo sapien
ggacttacagtcagagatgacctta

SEQ ID NO: 215247 - DNA, 25 bp, Homo sapien
gatgtgcatggactcattgaagtat

SEQ ID NO: 215248 - DNA, 25 bp, Homo sapien
tggaagcttagtgcccatatataag

SEQ ID NO: 215249 - DNA, 25 bp, Homo sapien
gatggatttggtgccatggtctata

SEQ ID NO: 215250 - DNA, 25 bp, Homo sapien
ggtgccatggtctataatgtttcat

SEQ ID NO: 215251 - DNA, 25 bp, Homo sapien
atgtttcatgcatccatacttctgt

SEQ ID NO: 215252 - DNA, 25 bp, Homo sapien
gcatccatacttctgtttttgcttc

SEQ ID NO: 215253 - DNA, 25 bp, Homo sapien
tcaaaatttttagtgctccctacaa

SEQ ID NO: 215254 - DNA, 25 bp, Homo sapien
agtgctccctacaaatacgaatcct

SEQ ID NO: 215255 - DNA, 25 bp, Homo sapien
aatacgaatccttctatcccactaa

SEQ ID NO: 215256 - DNA, 25 bp, Homo sapien
cactaaccaaaatacctccttcatt

SEQ ID NO: 215257 - DNA, 25 bp, Homo sapien
aaatctgatcttttttggctactgc

SEQ ID NO: 215258 - DNA, 25 bp, Homo sapien
ttggctactgcaaaaatctattcag

SEQ ID NO: 215259 - DNA, 25 bp, Homo sapien
atctattcagcaagaaggtatcagc

SEQ ID NO: 215260 - DNA, 25 bp, Homo sapien
gtatcagctgcataccttgcacagt

SEQ ID NO: 215261 - DNA, 25 bp, Homo sapien
ttgcacagtggagctgactacctat

SEQ ID NO: 215262 - DNA, 25 bp, Homo sapien
tgactacctataaactctccctaag

SEQ ID NO: 215263 - DNA, 25 bp, Homo sapien
tctccctaaggcatttgtttacagg

SEQ ID NO: 215264 - DNA, 25 bp, Homo sapien
acaggtgtattccattttagcagac

SEQ ID NO: 215265 - DNA, 25 bp, Homo sapien
tattccattttagcagacgttctga

SEQ ID NO: 215266 - DNA, 25 bp, Homo sapien
acgttctgatgctcagtgtatgtgc

SEQ ID NO: 215267 - DNA, 25 bp, Homo sapien
aaatgtgttctgaatcttttcatct

SEQ ID NO: 215268 - DNA, 25 bp, Homo sapien
agtgtctggcccagccatggctgga

SEQ ID NO: 215269 - DNA, 25 bp, Homo sapien
cagccatggctggatgtgcatctgg

SEQ ID NO: 215270 - DNA, 25 bp, Homo sapien
atggctggatgtgcatctggcctat

SEQ ID NO: 215271 - DNA, 25 bp, Homo sapien
tggatgtgcatctggcctatgaccc

SEQ ID NO: 215272 - DNA, 25 bp, Homo sapien
gtgcatctggcctatgaccctgtgc

SEQ ID NO: 215273 - DNA, 25 bp, Homo sapien
gcctgtgtttcatgttctgtgtcac

SEQ ID NO: 215274 - DNA, 25 bp, Homo sapien
gtgtttcatgttctgtgtcacgtga

SEQ ID NO: 215275 - DNA, 25 bp, Homo sapien
ttcatgttctgtgtcacgtgaccct

SEQ ID NO: 215276 - DNA, 25 bp, Homo sapien
tgttctgtgtcacgtgaccctgtgc

SEQ ID NO: 215277 - DNA, 25 bp, Homo sapien
ttctcccgccattggccttaactgg

SEQ ID NO: 215278 - DNA, 25 bp, Homo sapien
cattggccttaactggccctcgggc

SEQ ID NO: 215279 - DNA, 25 bp, Homo sapien
gggaacggtagatgacagactgaat

SEQ ID NO: 215280 - DNA, 25 bp, Homo sapien
gacagactgaattgggccttcaact

SEQ ID NO: 215281 - DNA, 25 bp, Homo sapien
actgaattgggccttcaacttgtat

SEQ ID NO: 215282 - DNA, 25 bp, Homo sapien
gggccttcaacttgtatgacctcaa

SEQ ID NO: 215283 - DNA, 25 bp, Homo sapien
tgacctcaacaaggacggctgcatc

SEQ ID NO: 215284 - DNA, 25 bp, Homo sapien
gacggctgcatcactaaggaggaaa

SEQ ID NO: 215285 - DNA, 25 bp, Homo sapien
aggaggaaatgctcgacatcatgaa

SEQ ID NO: 215286 - DNA, 25 bp, Homo sapien
gatgggcaagtacacgtaccctgca

SEQ ID NO: 215287 - DNA, 25 bp, Homo sapien
tgaggaattcattgagtcttgtcaa

SEQ ID NO: 215288 - DNA, 25 bp, Homo sapien
caaaaggacgagaacatcatgaggt

SEQ ID NO: 215289 - DNA, 25 bp, Homo sapien
catcatgaggtccatgcagctcttt

SEQ ID NO: 215290 - DNA, 25 bp, Homo sapien
aagtcagatgtcgtgtacaccgatt

SEQ ID NO: 215291 - DNA, 25 bp, Homo sapien
agtcagatgtcgtgtacaccgattg

SEQ ID NO: 215292 - DNA, 25 bp, Homo sapien
gggaatcctagcaggacacagcctt

SEQ ID NO: 215293 - DNA, 25 bp, Homo sapien
ggaatcctagcaggacacagccttg

SEQ ID NO: 215294 - DNA, 25 bp, Homo sapien
gaatcctagcaggacacagccttgg

SEQ ID NO: 215295 - DNA, 25 bp, Homo sapien
aatcctagcaggacacagccttgga

SEQ ID NO: 215296 - DNA, 25 bp, Homo sapien
atcctagcaggacacagccttggat

SEQ ID NO: 215297 - DNA, 25 bp, Homo sapien
tcctagcaggacacagccttggatc

SEQ ID NO: 215298 - DNA, 25 bp, Homo sapien
ctagcaggacacagccttggatcag

SEQ ID NO: 215299 - DNA, 25 bp, Homo sapien
tagcaggacacagccttggatcagg

SEQ ID NO: 215300 - DNA, 25 bp, Homo sapien
ggacagagacttggggccatcctgc

SEQ ID NO: 215301 - DNA, 25 bp, Homo sapien
caatcacaaacttggcggcaaagtg

SEQ ID NO: 215302 - DNA, 25 bp, Homo sapien
ggcaaagtggcgactcaaccttggg

SEQ ID NO: 215303 - DNA, 25 bp, Homo sapien
cggctgtgggtgtcgtctggactga

SEQ ID NO: 215304 - DNA, 25 bp, Homo sapien
tgtcgtctggactgaggtttttaaa

SEQ ID NO: 215305 - DNA, 25 bp, Homo sapien
taaatatttctttctctaacccatc

SEQ ID NO: 215306 - DNA, 25 bp, Homo sapien
ttctttctctaacccatcagcacaa

SEQ ID NO: 215307 - DNA, 25 bp, Homo sapien
ttctctaacccatcagcacaataaa

SEQ ID NO: 215308 - DNA, 25 bp, Homo sapien
aaaaaagtcactggttcaacaacag

SEQ ID NO: 215309 - DNA, 25 bp, Homo sapien
tcactggttcaacaacagggtttaa

SEQ ID NO: 215310 - DNA, 25 bp, Homo sapien
gtcttcagctttaattcaaaacttc

SEQ ID NO: 215311 - DNA, 25 bp, Homo sapien
gagccttttgttttacggtatattg

SEQ ID NO: 215312 - DNA, 25 bp, Homo sapien
aagaagctgtcttcctcttgtagga

SEQ ID NO: 215313 - DNA, 25 bp, Homo sapien
cactgcgcagcttcaagcacaaagg

SEQ ID NO: 215314 - DNA, 25 bp, Homo sapien
aaagaaattcagacccacagccaag

SEQ ID NO: 215315 - DNA, 25 bp, Homo sapien
agccaagccctcctgaggttgttgg

SEQ ID NO: 215316 - DNA, 25 bp, Homo sapien
ttgggcctctctggagctgagcaca

SEQ ID NO: 215317 - DNA, 25 bp, Homo sapien
attgtggagcacaggcttacaccct

SEQ ID NO: 215318 - DNA, 25 bp, Homo sapien
ttacacccttcgtggacaggcgagg

SEQ ID NO: 215319 - DNA, 25 bp, Homo sapien
aggcgaggctctggtgcttactgca

SEQ ID NO: 215320 - DNA, 25 bp, Homo sapien
gtgcttactgcacagcctgaacaga

SEQ ID NO: 215321 - DNA, 25 bp, Homo sapien
ttggcacttccaagctggcatcttg

SEQ ID NO: 215322 - DNA, 25 bp, Homo sapien
catcttgccccttgacaacagaata

SEQ ID NO: 215323 - DNA, 25 bp, Homo sapien
ttgggaagcggtctccccaccggca

SEQ ID NO: 215324 - DNA, 25 bp, Homo sapien
gattggcgggtccaagcccagcaac

SEQ ID NO: 215325 - DNA, 25 bp, Homo sapien
aacacacaccacacctgggactgtt

SEQ ID NO: 215326 - DNA, 25 bp, Homo sapien
cacaccacacctgggactgttttta

SEQ ID NO: 215327 - DNA, 25 bp, Homo sapien
cacacctgggactgtttttaataca

SEQ ID NO: 215328 - DNA, 25 bp, Homo sapien
gggactgtttttaatacatagcaac

SEQ ID NO: 215329 - DNA, 25 bp, Homo sapien
acatagcaacagactgggttattta

SEQ ID NO: 215330 - DNA, 25 bp, Homo sapien
gatgtgtattgtgtcatatgaagtt

SEQ ID NO: 215331 - DNA, 25 bp, Homo sapien
aaactccaattgttctctggctgtt

SEQ ID NO: 215332 - DNA, 25 bp, Homo sapien
tccaattgttctctggctgtttttt

SEQ ID NO: 215333 - DNA, 25 bp, Homo sapien
gtttttttcagttgtgtctagcaaa

SEQ ID NO: 215334 - DNA, 25 bp, Homo sapien
caatcacaaacttggcggcaaagtg

SEQ ID NO: 215335 - DNA, 25 bp, Homo sapien
aatcacaaacttggcggcaaagtgg

SEQ ID NO: 215336 - DNA, 25 bp, Homo sapien
cggctgtgggtgtcgtctggactga

SEQ ID NO: 215337 - DNA, 25 bp, Homo sapien
tgtgggtgtcgtctggactgaggtt

SEQ ID NO: 215338 - DNA, 25 bp, Homo sapien
taaatatttctttctctaacccatc

SEQ ID NO: 215339 - DNA, 25 bp, Homo sapien
atttctttctctaacccatcagcac

SEQ ID NO: 215340 - DNA, 25 bp, Homo sapien
tttctttctctaacccatcagcaca

SEQ ID NO: 215341 - DNA, 25 bp, Homo sapien
ttctttctctaacccatcagcacaa

SEQ ID NO: 215342 - DNA, 25 bp, Homo sapien
aaaaaagtcactggttcaacaacag

SEQ ID NO: 215343 - DNA, 25 bp, Homo sapien
tgagccttttgttttacggtatatt

SEQ ID NO: 215344 - DNA, 25 bp, Homo sapien
gagccttttgttttacggtatattg

SEQ ID NO: 215345 - DNA, 25 bp, Homo sapien
cctcccctctccacccaccccacag

SEQ ID NO: 215346 - DNA, 25 bp, Homo sapien
ctcccctctccacccaccccacagc

SEQ ID NO: 215347 - DNA, 25 bp, Homo sapien
tcccctctccacccaccccacagca

SEQ ID NO: 215348 - DNA, 25 bp, Homo sapien
cccctctccacccaccccacagcag

SEQ ID NO: 215349 - DNA, 25 bp, Homo sapien
ccctctccacccaccccacagcagg

SEQ ID NO: 215350 - DNA, 25 bp, Homo sapien
cctctccacccaccccacagcaggc

SEQ ID NO: 215351 - DNA, 25 bp, Homo sapien
ctctccacccaccccacagcaggcc

SEQ ID NO: 215352 - DNA, 25 bp, Homo sapien
tctccacccaccccacagcaggccc

SEQ ID NO: 215353 - DNA, 25 bp, Homo sapien
tatgtggtgtttggtttttggtcct

SEQ ID NO: 215354 - DNA, 25 bp, Homo sapien
atgtacttctggcaattctatctgt

SEQ ID NO: 215355 - DNA, 25 bp, Homo sapien
ctggcaattctatctgtatttaaag

SEQ ID NO: 215356 - DNA, 25 bp, Homo sapien
gatgtgacaatcttgacaccaattt

SEQ ID NO: 215357 - DNA, 25 bp, Homo sapien
aagaatagctgtgagaccgaattaa

SEQ ID NO: 215358 - DNA, 25 bp, Homo sapien
taaagataatccctaccaagtgaaa

SEQ ID NO: 215359 - DNA, 25 bp, Homo sapien
aatccctaccaagtgaaaattgatg

SEQ ID NO: 215360 - DNA, 25 bp, Homo sapien
ttaagagggtacagaattatcaact

SEQ ID NO: 215361 - DNA, 25 bp, Homo sapien
cagaattatcaactgatttggtcag

SEQ ID NO: 215362 - DNA, 25 bp, Homo sapien
ttggtcagttgcttccaatgctggt

SEQ ID NO: 215363 - DNA, 25 bp, Homo sapien
ttccaatgctggttgatttccctca

SEQ ID NO: 215364 - DNA, 25 bp, Homo sapien
cattgtgtaaacattgacaggtatg

SEQ ID NO: 215365 - DNA, 25 bp, Homo sapien
tcctggaccgtgagaagtcgctctt

SEQ ID NO: 215366 - DNA, 25 bp, Homo sapien
aagtcgctcttcttctaccagaagg

SEQ ID NO: 215367 - DNA, 25 bp, Homo sapien
agaaggccaggaccttcgccacaga

SEQ ID NO: 215368 - DNA, 25 bp, Homo sapien
aggaccttcgccacagagctcaacg

SEQ ID NO: 215369 - DNA, 25 bp, Homo sapien
agagctcaacgtccgcagggtcaac

SEQ ID NO: 215370 - DNA, 25 bp, Homo sapien
cctcgctgaggacagcatccaaggg

SEQ ID NO: 215371 - DNA, 25 bp, Homo sapien
catccaagggagtgggttttgtgca

SEQ ID NO: 215372 - DNA, 25 bp, Homo sapien
tcgtgtcgccggtggctcattttct

SEQ ID NO: 215373 - DNA, 25 bp, Homo sapien
gccggtggctcattttctggcaaat

SEQ ID NO: 215374 - DNA, 25 bp, Homo sapien
tctggcaaatggaggcacgaacgca

SEQ ID NO: 215375 - DNA, 25 bp, Homo sapien
gggccaaatagcaataaatgggttt

SEQ ID NO: 215376 - DNA, 25 bp, Homo sapien
gacactgaagaaaaccttcgtcctt

SEQ ID NO: 215377 - DNA, 25 bp, Homo sapien
cagctctgtgctgcggatcatcgtc

SEQ ID NO: 215378 - DNA, 25 bp, Homo sapien
gtgctgcggatcatcgtcctcatcg

SEQ ID NO: 215379 - DNA, 25 bp, Homo sapien
agatggagaatgagtcggccacgga

SEQ ID NO: 215380 - DNA, 25 bp, Homo sapien
ggaagactctgccatgacagacatg

SEQ ID NO: 215381 - DNA, 25 bp, Homo sapien
agactctgccatgacagacatgcct

SEQ ID NO: 215382 - DNA, 25 bp, Homo sapien
catgacagacatgcctccgacagag

SEQ ID NO: 215383 - DNA, 25 bp, Homo sapien
gacagacatgcctccgacagaggag

SEQ ID NO: 215384 - DNA, 25 bp, Homo sapien
tccgacagaggaggtgacagacatc

SEQ ID NO: 215385 - DNA, 25 bp, Homo sapien
aggaggtgacagacatcgtggaaat

SEQ ID NO: 215386 - DNA, 25 bp, Homo sapien
tgacagacatcgtggaaatgagaga

SEQ ID NO: 215387 - DNA, 25 bp, Homo sapien
tgctgacctctgttctcttagggca

SEQ ID NO: 215388 - DNA, 25 bp, Homo sapien
acctctgttctcttagggcatggga

SEQ ID NO: 215389 - DNA, 25 bp, Homo sapien
ggatatcaaattctctagccctttc

SEQ ID NO: 215390 - DNA, 25 bp, Homo sapien
ttcccatttctcctcggccattgta

SEQ ID NO: 215391 - DNA, 25 bp, Homo sapien
tcggccattgtacctagctcttgtc

SEQ ID NO: 215392 - DNA, 25 bp, Homo sapien
attgtacctagctcttgtccctagc

SEQ ID NO: 215393 - DNA, 25 bp, Homo sapien
ttgtccctagctgcatttcagtgga

SEQ ID NO: 215394 - DNA, 25 bp, Homo sapien
ctagctgcatttcagtggaccatgg

SEQ ID NO: 215395 - DNA, 25 bp, Homo sapien
tcagtggaccatggatagagggact

SEQ ID NO: 215396 - DNA, 25 bp, Homo sapien
ggaggcacgcaggtactgtgaaaat

SEQ ID NO: 215397 - DNA, 25 bp, Homo sapien
gtactgtgaaaatccttccctttgc

SEQ ID NO: 215398 - DNA, 25 bp, Homo sapien
attcattctctcaatccagaacttg

SEQ ID NO: 215399 - DNA, 25 bp, Homo sapien
gaacttgaaagctcaacgtctttgg

SEQ ID NO: 215400 - DNA, 25 bp, Homo sapien
cgtctttggattcaaatagcagtca

SEQ ID NO: 215401 - DNA, 25 bp, Homo sapien
atagcagtcaagatttggttggtgg

SEQ ID NO: 215402 - DNA, 25 bp, Homo sapien
ctgttccagtccagtctcattctga

SEQ ID NO: 215403 - DNA, 25 bp, Homo sapien
gaaaactttacagcagctactgatt

SEQ ID NO: 215404 - DNA, 25 bp, Homo sapien
cagcagctactgatttatctagata

SEQ ID NO: 215405 - DNA, 25 bp, Homo sapien
atctagatataacaacacactggta

SEQ ID NO: 215406 - DNA, 25 bp, Homo sapien
ggtagaatcagcatcaactcaggat

SEQ ID NO: 215407 - DNA, 25 bp, Homo sapien
atcaactcaggatgcactaactatg

SEQ ID NO: 215408 - DNA, 25 bp, Homo sapien
agaagccagctagatcaggagagtg

SEQ ID NO: 215409 - DNA, 25 bp, Homo sapien
gggagcatgaaacccaccactggtc

SEQ ID NO: 215410 - DNA, 25 bp, Homo sapien
actggtcctgcgacccactgtcttt

SEQ ID NO: 215411 - DNA, 25 bp, Homo sapien
ctgtctttggaatccaccccaggag

SEQ ID NO: 215412 - DNA, 25 bp, Homo sapien
tggaatccaccccaggagcccagga

SEQ ID NO: 215413 - DNA, 25 bp, Homo sapien
gacacttggatttacttctttatca

SEQ ID NO: 215414 - DNA, 25 bp, Homo sapien
tacttctttatcaagcatccatctg

SEQ ID NO: 215415 - DNA, 25 bp, Homo sapien
caagcatccatctgactaaggcaca

SEQ ID NO: 215416 - DNA, 25 bp, Homo sapien
gactaaggcacaaatccaacatgtt

SEQ ID NO: 215417 - DNA, 25 bp, Homo sapien
ccaacatgttactgttactgataca

SEQ ID NO: 215418 - DNA, 25 bp, Homo sapien
gccttcagggacaaatagctcgatt

SEQ ID NO: 215419 - DNA, 25 bp, Homo sapien
aaatcagtttcatacaacctccctc

SEQ ID NO: 215420 - DNA, 25 bp, Homo sapien
ttataactggatatttcttcaaaca

SEQ ID NO: 215421 - DNA, 25 bp, Homo sapien
ttcttcaaacagatgtcctggatga

SEQ ID NO: 215422 - DNA, 25 bp, Homo sapien
gtcctggatgatggtccataagaat

SEQ ID NO: 215423 - DNA, 25 bp, Homo sapien
aaatgtatggacagtttttccggca

SEQ ID NO: 215424 - DNA, 25 bp, Homo sapien
tgtatggacagtttttccggcaaaa

SEQ ID NO: 215425 - DNA, 25 bp, Homo sapien
aaaatttgtagcttatgtcttggct

SEQ ID NO: 215426 - DNA, 25 bp, Homo sapien
gtagcttatgtcttggctaaatagt

SEQ ID NO: 215427 - DNA, 25 bp, Homo sapien
tttagtgtctccttcctaaagagca

SEQ ID NO: 215428 - DNA, 25 bp, Homo sapien
gtgtctccttcctaaagagcacttt

SEQ ID NO: 215429 - DNA, 25 bp, Homo sapien
gtctccttcctaaagagcacttttg

SEQ ID NO: 215430 - DNA, 25 bp, Homo sapien
agagcacttttgtattgtaatttat

SEQ ID NO: 215431 - DNA, 25 bp, Homo sapien
gggctttatccctcttgtgatttac

SEQ ID NO: 215432 - DNA, 25 bp, Homo sapien
cctcttgtgatttacctgggattta

SEQ ID NO: 215433 - DNA, 25 bp, Homo sapien
gtgcagatcccggaatgcctgaacc

SEQ ID NO: 215434 - DNA, 25 bp, Homo sapien
ggaatgcctgaaccaactgttttga

SEQ ID NO: 215435 - DNA, 25 bp, Homo sapien
ccaactgttttgagcctactttggg

SEQ ID NO: 215436 - DNA, 25 bp, Homo sapien
aggattatttggtcttctggatttg

SEQ ID NO: 215437 - DNA, 25 bp, Homo sapien
atttggaggcaatcagcggacagca

SEQ ID NO: 215438 - DNA, 25 bp, Homo sapien
agcatggaagatgtgtgctctggct

SEQ ID NO: 215439 - DNA, 25 bp, Homo sapien
gacatcattcagtcactagttggat

SEQ ID NO: 215440 - DNA, 25 bp, Homo sapien
tggatggcacaaggctcttcacaga

SEQ ID NO: 215441 - DNA, 25 bp, Homo sapien
acaaggctcttcacagacgcatctg

SEQ ID NO: 215442 - DNA, 25 bp, Homo sapien
ggaggctaaggactggaggccgcca

SEQ ID NO: 215443 - DNA, 25 bp, Homo sapien
aggccgccaggcaggcgtggccgag

SEQ ID NO: 215444 - DNA, 25 bp, Homo sapien
gcaggcgtggccgagggaagaaaaa

SEQ ID NO: 215445 - DNA, 25 bp, Homo sapien
aaagcttctggatgtccagccagct

SEQ ID NO: 215446 - DNA, 25 bp, Homo sapien
actgccgctgctctctgcaaaaaga

SEQ ID NO: 215447 - DNA, 25 bp, Homo sapien
tgccgctgctctctgcaaaaagaat

SEQ ID NO: 215448 - DNA, 25 bp, Homo sapien
ctgcaaaaagaatgggcatcccgga

SEQ ID NO: 215449 - DNA, 25 bp, Homo sapien
ctccatgcaccatcactgtggctgg

SEQ ID NO: 215450 - DNA, 25 bp, Homo sapien
gctggcaggcatcggacagcctcat

SEQ ID NO: 215451 - DNA, 25 bp, Homo sapien
caggcatcggacagcctcatccaga

SEQ ID NO: 215452 - DNA, 25 bp, Homo sapien
tgtcttggcaacctctactgcccat

SEQ ID NO: 215453 - DNA, 25 bp, Homo sapien
tggagacattacacttcacaggaca

SEQ ID NO: 215454 - DNA, 25 bp, Homo sapien
ttcacaggacacttgagcacagtca

SEQ ID NO: 215455 - DNA, 25 bp, Homo sapien
gattttattcacacttttggttcct

SEQ ID NO: 215456 - DNA, 25 bp, Homo sapien
ggttcctgtgttttatatcgaagac

SEQ ID NO: 215457 - DNA, 25 bp, Homo sapien
agaagccaacccagtgactagacct

SEQ ID NO: 215458 - DNA, 25 bp, Homo sapien
cagtgactagaccttccagtgaaga

SEQ ID NO: 215459 - DNA, 25 bp, Homo sapien
gtgatctcaagaggtccagggactt

SEQ ID NO: 215460 - DNA, 25 bp, Homo sapien
gtccagggacttaacagccaagcca

SEQ ID NO: 215461 - DNA, 25 bp, Homo sapien
ggttcttctgtgacaccgagagatc

SEQ ID NO: 215462 - DNA, 25 bp, Homo sapien
caccgagagatctaacccaaggcct

SEQ ID NO: 215463 - DNA, 25 bp, Homo sapien
aaggcctgggttatgtcttagtcga

SEQ ID NO: 215464 - DNA, 25 bp, Homo sapien
tgcctatgacagtgaccccgagtat

SEQ ID NO: 215465 - DNA, 25 bp, Homo sapien
agtgaccccgagtatagctcatgtc

SEQ ID NO: 215466 - DNA, 25 bp, Homo sapien
atagctcatgtcagcagccacgtgg

SEQ ID NO: 215467 - DNA, 25 bp, Homo sapien
gcactttccatttggatgacggtga

SEQ ID NO: 215468 - DNA, 25 bp, Homo sapien
atgacggtgaatactggtccaacag

SEQ ID NO: 215469 - DNA, 25 bp, Homo sapien
aacagggcagcctcttataagggaa

SEQ ID NO: 215470 - DNA, 25 bp, Homo sapien
accgacccatctttgagaacagcat

SEQ ID NO: 215471 - DNA, 25 bp, Homo sapien
aaaaggcctgtagttctgcttcaca

SEQ ID NO: 215472 - DNA, 25 bp, Homo sapien
gaaagcttctgagaccatccatgat

SEQ ID NO: 215473 - DNA, 25 bp, Homo sapien
gataaacctcattagtgtccgtgtc

SEQ ID NO: 215474 - DNA, 25 bp, Homo sapien
tagtgtccgtgtcaatttctcaatg

SEQ ID NO: 215475 - DNA, 25 bp, Homo sapien
gaggtggtgatgacaaaaagtccaa

SEQ ID NO: 215476 - DNA, 25 bp, Homo sapien
atgacaaaaagtccaaaacatgttt

SEQ ID NO: 215477 - DNA, 25 bp, Homo sapien
gtaatattatctaactggtctaaac

SEQ ID NO: 215478 - DNA, 25 bp, Homo sapien
aacttcaaatatcattttacctttg

SEQ ID NO: 215479 - DNA, 25 bp, Homo sapien
ttcaacaaatcatcacgtaacagga

SEQ ID NO: 215480 - DNA, 25 bp, Homo sapien
aatcatcacgtaacaggatcttcag

SEQ ID NO: 215481 - DNA, 25 bp, Homo sapien
tcacgtaacaggatcttcagaaaaa

SEQ ID NO: 215482 - DNA, 25 bp, Homo sapien
acaggatcttcagaaaaactaccct

SEQ ID NO: 215483 - DNA, 25 bp, Homo sapien
aaaactaccctgtgactatgaagaa

SEQ ID NO: 215484 - DNA, 25 bp, Homo sapien
actaccctgtgactatgaagaaaat

SEQ ID NO: 215485 - DNA, 25 bp, Homo sapien
atatatattgctagcccaaaaatcc

SEQ ID NO: 215486 - DNA, 25 bp, Homo sapien
agaagattgccttacgctcgtgagc

SEQ ID NO: 215487 - DNA, 25 bp, Homo sapien
cgctcgtgagcgtgagaagccataa

SEQ ID NO: 215488 - DNA, 25 bp, Homo sapien
gaagccataagagagagaccgaatt

SEQ ID NO: 215489 - DNA, 25 bp, Homo sapien
gagaccgaattctgtggctcagcac

SEQ ID NO: 215490 - DNA, 25 bp, Homo sapien
tgtggctcagcacacaggactgacc

SEQ ID NO: 215491 - DNA, 25 bp, Homo sapien
gagatggcgccctgtcctgccaagg

SEQ ID NO: 215492 - DNA, 25 bp, Homo sapien
gtggagcccacaggattcagcagca

SEQ ID NO: 215493 - DNA, 25 bp, Homo sapien
attcagcagcatggacagtcactct

SEQ ID NO: 215494 - DNA, 25 bp, Homo sapien
atggacagtcactcttgcactattc

SEQ ID NO: 215495 - DNA, 25 bp, Homo sapien
cactattccttctccaagccagaaa

SEQ ID NO: 215496 - DNA, 25 bp, Homo sapien
tccaagccagaaaccacatttaatt

SEQ ID NO: 215497 - DNA, 25 bp, Homo sapien
taacaactggtttacatggtgtcat

SEQ ID NO: 215498 - DNA, 25 bp, Homo sapien
acatggtgtcataattgcaggcacg

SEQ ID NO: 215499 - DNA, 25 bp, Homo sapien
cggtggacatgctggacatatgctt

SEQ ID NO: 215500 - DNA, 25 bp, Homo sapien
acatatgcttagttggttcagggac

SEQ ID NO: 215501 - DNA, 25 bp, Homo sapien
ccctgtgtctgcatgcacgtgtaaa

SEQ ID NO: 215502 - DNA, 25 bp, Homo sapien
tacctgcagagactgtccagccata

SEQ ID NO: 215503 - DNA, 25 bp, Homo sapien
agccataaaatgttaccaccttaag

SEQ ID NO: 215504 - DNA, 25 bp, Homo sapien
gaacccttcaagtgtggagctttct

SEQ ID NO: 215505 - DNA, 25 bp, Homo sapien
ggagctttctagtaggtgtccttca

SEQ ID NO: 215506 - DNA, 25 bp, Homo sapien
tagtaggtgtccttcatagctcaga

SEQ ID NO: 215507 - DNA, 25 bp, Homo sapien
aagccattcatgacttacctgtaat

SEQ ID NO: 215508 - DNA, 25 bp, Homo sapien
attaatccattaaagctaacctatt

SEQ ID NO: 215509 - DNA, 25 bp, Homo sapien
ttaaagctaacctatttttcaatat

SEQ ID NO: 215510 - DNA, 25 bp, Homo sapien
ctatgtacatatattgtctgtccat

SEQ ID NO: 215511 - DNA, 25 bp, Homo sapien
attgtctgtccatatgtatttgtaa

SEQ ID NO: 215512 - DNA, 25 bp, Homo sapien
taatgtcaggtttgggtcttgggtt

SEQ ID NO: 215513 - DNA, 25 bp, Homo sapien
tgtcaggtttgggtcttgggttcaa

SEQ ID NO: 215514 - DNA, 25 bp, Homo sapien
gggttcaagtgtatatattcctgta

SEQ ID NO: 215515 - DNA, 25 bp, Homo sapien
tattcctgtaagtttcttaactgca

SEQ ID NO: 215516 - DNA, 25 bp, Homo sapien
aagtttcttaactgcattttgatga

SEQ ID NO: 215517 - DNA, 25 bp, Homo sapien
atgtaactataagaattgtcccaaa

SEQ ID NO: 215518 - DNA, 25 bp, Homo sapien
gaattgtcccaaaagtacctgtaca

SEQ ID NO: 215519 - DNA, 25 bp, Homo sapien
aattgtgttgtgatattgtgtccta

SEQ ID NO: 215520 - DNA, 25 bp, Homo sapien
gatattgtgtcctaaattgctcatt

SEQ ID NO: 215521 - DNA, 25 bp, Homo sapien
cagattgaaaaagaggcaccgtgta

SEQ ID NO: 215522 - DNA, 25 bp, Homo sapien
aggatcatcatcacgatagctaaac

SEQ ID NO: 215523 - DNA, 25 bp, Homo sapien
atcacgatagctaaacagtacttaa

SEQ ID NO: 215524 - DNA, 25 bp, Homo sapien
aatagcggttggaactaggtagcct

SEQ ID NO: 215525 - DNA, 25 bp, Homo sapien
gttggaactaggtagcctttcgaat

SEQ ID NO: 215526 - DNA, 25 bp, Homo sapien
ctaggtagcctttcgaattttatga

SEQ ID NO: 215527 - DNA, 25 bp, Homo sapien
tagcctttcgaattttatgattttt

SEQ ID NO: 215528 - DNA, 25 bp, Homo sapien
aaacatgtagtttgaaggcggtcag

SEQ ID NO: 215529 - DNA, 25 bp, Homo sapien
aaggcggtcagatttctttgagaaa

SEQ ID NO: 215530 - DNA, 25 bp, Homo sapien
aagtttagaccaaaggacattcgtg

SEQ ID NO: 215531 - DNA, 25 bp, Homo sapien
gaccaaaggacattcgtggcttagc

SEQ ID NO: 215532 - DNA, 25 bp, Homo sapien
aaaggacattcgtggcttagctgct

SEQ ID NO: 215533 - DNA, 25 bp, Homo sapien
aaggacattcgtggcttagctgctg

SEQ ID NO: 215534 - DNA, 25 bp, Homo sapien
gacattcgtggcttagctgctgggt

SEQ ID NO: 215535 - DNA, 25 bp, Homo sapien
cttagctgctgggtcagcagagact

SEQ ID NO: 215536 - DNA, 25 bp, Homo sapien
agactctccctgcaaacttccgggt

SEQ ID NO: 215537 - DNA, 25 bp, Homo sapien
gcaaacttccgggtgacttcttcta

SEQ ID NO: 215538 - DNA, 25 bp, Homo sapien
aacttccgggtgacttcttctatgt

SEQ ID NO: 215539 - DNA, 25 bp, Homo sapien
ttccgggtgacttcttctatgtctt

SEQ ID NO: 215540 - DNA, 25 bp, Homo sapien
gggtgacttcttctatgtcttcccc

SEQ ID NO: 215541 - DNA, 25 bp, Homo sapien
agggcattacttaactgtgaaagat

SEQ ID NO: 215542 - DNA, 25 bp, Homo sapien
taaccaggtggttcagttgcatccc

SEQ ID NO: 215543 - DNA, 25 bp, Homo sapien
agttgcatccctctactgttcttga

SEQ ID NO: 215544 - DNA, 25 bp, Homo sapien
actgttcttgaccacaaacctgaat

SEQ ID NO: 215545 - DNA, 25 bp, Homo sapien
acctgaatgggtgctttataatgag

SEQ ID NO: 215546 - DNA, 25 bp, Homo sapien
caacaaagaattacatccggacatg

SEQ ID NO: 215547 - DNA, 25 bp, Homo sapien
gaatggttggtgaaaattgcccctc

SEQ ID NO: 215548 - DNA, 25 bp, Homo sapien
attgcccctcaatattatgacatga

SEQ ID NO: 215549 - DNA, 25 bp, Homo sapien
tatgacatgagcaatttcccacagt

SEQ ID NO: 215550 - DNA, 25 bp, Homo sapien
gagcaatttcccacagtgtgaagca

SEQ ID NO: 215551 - DNA, 25 bp, Homo sapien
gagacagttggaccgcatcattgcc

SEQ ID NO: 215552 - DNA, 25 bp, Homo sapien
cgaggaggcctaatcaggagtttca

SEQ ID NO: 215553 - DNA, 25 bp, Homo sapien
aggagtttcaattccagatcgggct

SEQ ID NO: 215554 - DNA, 25 bp, Homo sapien
ttcaattccagatcgggctgggtcc

SEQ ID NO: 215555 - DNA, 25 bp, Homo sapien
gggtccagccccaaaacatggcctg

SEQ ID NO: 215556 - DNA, 25 bp, Homo sapien
gcggacgttcacatgagtgggtcta

SEQ ID NO: 215557 - DNA, 25 bp, Homo sapien
atgagtgggtctatagcccgctccg

SEQ ID NO: 215558 - DNA, 25 bp, Homo sapien
ctccgggcatcatctagacttagca

SEQ ID NO: 215559 - DNA, 25 bp, Homo sapien
catcatctagacttagcatgcattc

SEQ ID NO: 215560 - DNA, 25 bp, Homo sapien
atcacatattccaatacacaccctg

SEQ ID NO: 215561 - DNA, 25 bp, Homo sapien
cctaggcactgagagctggagagtt

SEQ ID NO: 215562 - DNA, 25 bp, Homo sapien
aagcgagacgaacacatttcctgcc

SEQ ID NO: 215563 - DNA, 25 bp, Homo sapien
tttggaaatggcaagaacagcagta

SEQ ID NO: 215564 - DNA, 25 bp, Homo sapien
agaacagcagtatattccttacaca

SEQ ID NO: 215565 - DNA, 25 bp, Homo sapien
attccttacacaaatcctcaactag

SEQ ID NO: 215566 - DNA, 25 bp, Homo sapien
ccttacacaaatcctcaactagaga

SEQ ID NO: 215567 - DNA, 25 bp, Homo sapien
gatagatattatagcagaacttcga

SEQ ID NO: 215568 - DNA, 25 bp, Homo sapien
gaacttcgatatgacctgccagcat

SEQ ID NO: 215569 - DNA, 25 bp, Homo sapien
acttcgatatgacctgccagcatca

SEQ ID NO: 215570 - DNA, 25 bp, Homo sapien
gatatgacctgccagcatcatacaa

SEQ ID NO: 215571 - DNA, 25 bp, Homo sapien
gacctgccagcatcatacaagtttc

SEQ ID NO: 215572 - DNA, 25 bp, Homo sapien
gccagcatcatacaagtttcacaaa

SEQ ID NO: 215573 - DNA, 25 bp, Homo sapien
gcatcatacaagtttcacaaaaaga

SEQ ID NO: 215574 - DNA, 25 bp, Homo sapien
aattgtgttgtgatattgtgtccta

SEQ ID NO: 215575 - DNA, 25 bp, Homo sapien
tgtgttgtgatattgtgtcctaaat

SEQ ID NO: 215576 - DNA, 25 bp, Homo sapien
gtgatattgtgtcctaaattgctca

SEQ ID NO: 215577 - DNA, 25 bp, Homo sapien
gatattgtgtcctaaattgctcatt

SEQ ID NO: 215578 - DNA, 25 bp, Homo sapien
tattgtgtcctaaattgctcattaa

SEQ ID NO: 215579 - DNA, 25 bp, Homo sapien
taaacagtacttaaatagcggttgg

SEQ ID NO: 215580 - DNA, 25 bp, Homo sapien
tcatatgtggaaatctattacatgt

SEQ ID NO: 215581 - DNA, 25 bp, Homo sapien
aaacatgtagtttgaaggcggtcag

SEQ ID NO: 215582 - DNA, 25 bp, Homo sapien
acatgtagtttgaaggcggtcagat

SEQ ID NO: 215583 - DNA, 25 bp, Homo sapien
agtttgaaggcggtcagatttcttt

SEQ ID NO: 215584 - DNA, 25 bp, Homo sapien
ttgaaggcggtcagatttctttgag

SEQ ID NO: 215585 - DNA, 25 bp, Homo sapien
ctacgtggaggaagggctaccgcct

SEQ ID NO: 215586 - DNA, 25 bp, Homo sapien
taccgcctgccagtacgtgcaaggt

SEQ ID NO: 215587 - DNA, 25 bp, Homo sapien
accgcctgccagtacgtgcaaggtg

SEQ ID NO: 215588 - DNA, 25 bp, Homo sapien
gcctgccagtacgtgcaaggtgtta

SEQ ID NO: 215589 - DNA, 25 bp, Homo sapien
ctgccagtacgtgcaaggtgttagt

SEQ ID NO: 215590 - DNA, 25 bp, Homo sapien
gtggagagcaaacttcgaggacgta

SEQ ID NO: 215591 - DNA, 25 bp, Homo sapien
caaacttcgaggacgtaccctggag

SEQ ID NO: 215592 - DNA, 25 bp, Homo sapien
gaggagggagcgtgagcctcccaga

SEQ ID NO: 215593 - DNA, 25 bp, Homo sapien
cagagcacttaggtttctttttcca

SEQ ID NO: 215594 - DNA, 25 bp, Homo sapien
tctttttccatggtttccaggtaat

SEQ ID NO: 215595 - DNA, 25 bp, Homo sapien
ttccatggtttccaggtaataaaag

SEQ ID NO: 215596 - DNA, 25 bp, Homo sapien
tcttcatatatgtagtggttttcct

SEQ ID NO: 215597 - DNA, 25 bp, Homo sapien
tttcctactacattgtgttccaaaa

SEQ ID NO: 215598 - DNA, 25 bp, Homo sapien
gtgttccaaaattttgtgatctaca

SEQ ID NO: 215599 - DNA, 25 bp, Homo sapien
aaatttgtccagatattttgactga

SEQ ID NO: 215600 - DNA, 25 bp, Homo sapien
tgaaactgttgatgcccaagaacct

SEQ ID NO: 215601 - DNA, 25 bp, Homo sapien
agaacctgtccttctttgttgttat

SEQ ID NO: 215602 - DNA, 25 bp, Homo sapien
tgtccttctttgttgttattatgtg

SEQ ID NO: 215603 - DNA, 25 bp, Homo sapien
aagatagacttctttggtccgtcac

SEQ ID NO: 215604 - DNA, 25 bp, Homo sapien
ttctttggtccgtcacagcatatat

SEQ ID NO: 215605 - DNA, 25 bp, Homo sapien
gtccgtcacagcatatataagggtt

SEQ ID NO: 215606 - DNA, 25 bp, Homo sapien
gcaaagaatgttgtagtttttccaa

SEQ ID NO: 215607 - DNA, 25 bp, Homo sapien
tttccctggtatacatctttctagg

SEQ ID NO: 215608 - DNA, 25 bp, Homo sapien
ctggtatacatctttctaggaaaaa

SEQ ID NO: 215609 - DNA, 25 bp, Homo sapien
aatgatttttcgtttacatgctgaa

SEQ ID NO: 215610 - DNA, 25 bp, Homo sapien
attatcagttctgcacagcagcaga

SEQ ID NO: 215611 - DNA, 25 bp, Homo sapien
gcacagcagcagatgcagggttttt

SEQ ID NO: 215612 - DNA, 25 bp, Homo sapien
gtgctgatgataatactggctttga

SEQ ID NO: 215613 - DNA, 25 bp, Homo sapien
gatgataatactggctttgactttg

SEQ ID NO: 215614 - DNA, 25 bp, Homo sapien
atgttcagctaatttaggtttgtga

SEQ ID NO: 215615 - DNA, 25 bp, Homo sapien
aggtttgtgagattaactttaggat

SEQ ID NO: 215616 - DNA, 25 bp, Homo sapien
tgataactattatttgtgcaacatt

SEQ ID NO: 215617 - DNA, 25 bp, Homo sapien
atttgtgcaacattactctttgaaa

SEQ ID NO: 215618 - DNA, 25 bp, Homo sapien
tacaggacctaaaacaggcaccacc

SEQ ID NO: 215619 - DNA, 25 bp, Homo sapien
ggacagattccccaggctacacatt

SEQ ID NO: 215620 - DNA, 25 bp, Homo sapien
tccccaggctacacattctgtcagt

SEQ ID NO: 215621 - DNA, 25 bp, Homo sapien
gtgctgttctccaagaggcccagag

SEQ ID NO: 215622 - DNA, 25 bp, Homo sapien
ggcccagagacatgctgaaacatcg

SEQ ID NO: 215623 - DNA, 25 bp, Homo sapien
gagacatgctgaaacatcgaaggta

SEQ ID NO: 215624 - DNA, 25 bp, Homo sapien
gcaagcagctgacccctataagcca

SEQ ID NO: 215625 - DNA, 25 bp, Homo sapien
tgacccctataagccatgttctaaa

SEQ ID NO: 215626 - DNA, 25 bp, Homo sapien
gccatgttctaaaccattcacatta

SEQ ID NO: 215627 - DNA, 25 bp, Homo sapien
attcacattattccagtaactgctc

SEQ ID NO: 215628 - DNA, 25 bp, Homo sapien
ttattccagtaactgctcttttaaa

SEQ ID NO: 215629 - DNA, 25 bp, Homo sapien
ggctgcacgaggaccacctggagcg

SEQ ID NO: 215630 - DNA, 25 bp, Homo sapien
aggctgcccgagatgtgcacaccct

SEQ ID NO: 215631 - DNA, 25 bp, Homo sapien
gagatgtgcacaccctcttagatcg

SEQ ID NO: 215632 - DNA, 25 bp, Homo sapien
atgtgcacaccctcttagatcgagt

SEQ ID NO: 215633 - DNA, 25 bp, Homo sapien
tgcacaccctcttagatcgagtggt

SEQ ID NO: 215634 - DNA, 25 bp, Homo sapien
acaccctcttagatcgagtggtccg

SEQ ID NO: 215635 - DNA, 25 bp, Homo sapien
tcttagatcgagtggtccggcagca

SEQ ID NO: 215636 - DNA, 25 bp, Homo sapien
tagatcgagtggtccggcagcatgt

SEQ ID NO: 215637 - DNA, 25 bp, Homo sapien
ggcagcatgtgcgtgaggcctctat

SEQ ID NO: 215638 - DNA, 25 bp, Homo sapien
agcatgtgcgtgaggcctctatctt

SEQ ID NO: 215639 - DNA, 25 bp, Homo sapien
gtgcgtgaggcctctatcttgctgg

SEQ ID NO: 215640 - DNA, 25 bp, Homo sapien
gtagaggcttcttagattctcccag

SEQ ID NO: 215641 - DNA, 25 bp, Homo sapien
ttagattctcccagcatccgccttt

SEQ ID NO: 215642 - DNA, 25 bp, Homo sapien
ccctttagccagtctgctgtcctga

SEQ ID NO: 215643 - DNA, 25 bp, Homo sapien
tgtcctgaaacccagaagtgatgga

SEQ ID NO: 215644 - DNA, 25 bp, Homo sapien
acaagagatctcgaaccctgtctag

SEQ ID NO: 215645 - DNA, 25 bp, Homo sapien
gatctcgaaccctgtctagaaggaa

SEQ ID NO: 215646 - DNA, 25 bp, Homo sapien
gctaaatttcgtagcactgtttaca

SEQ ID NO: 215647 - DNA, 25 bp, Homo sapien
acagttttcctccatgttatttatg

SEQ ID NO: 215648 - DNA, 25 bp, Homo sapien
attccgtgaatgtatattgtcttgt

SEQ ID NO: 215649 - DNA, 25 bp, Homo sapien
gtaatgttgcataatgttcactttt

SEQ ID NO: 215650 - DNA, 25 bp, Homo sapien
gttcactttttatagtgtgtccttt

SEQ ID NO: 215651 - DNA, 25 bp, Homo sapien
agccactggacagacctgaatgtac

SEQ ID NO: 215652 - DNA, 25 bp, Homo sapien
acctgaatgtacagcaagtcctatt

SEQ ID NO: 215653 - DNA, 25 bp, Homo sapien
agcaagtcctattgcagtggaggaa

SEQ ID NO: 215654 - DNA, 25 bp, Homo sapien
gaggaagaaccccactcagttagaa

SEQ ID NO: 215655 - DNA, 25 bp, Homo sapien
accccactcagttagaaggacagtt

SEQ ID NO: 215656 - DNA, 25 bp, Homo sapien
gacagttttacccagagggacttct

SEQ ID NO: 215657 - DNA, 25 bp, Homo sapien
agagggacttctcgtcaatcactca

SEQ ID NO: 215658 - DNA, 25 bp, Homo sapien
cttctcgtcaatcactcattatcag

SEQ ID NO: 215659 - DNA, 25 bp, Homo sapien
actcattatcagcatggctccttct

SEQ ID NO: 215660 - DNA, 25 bp, Homo sapien
atcagcatggctccttctgctgagg

SEQ ID NO: 215661 - DNA, 25 bp, Homo sapien
gcggagaagaggttcttactattga

SEQ ID NO: 215662 - DNA, 25 bp, Homo sapien
tcgtctttgtttcctttcgctctgc

SEQ ID NO: 215663 - DNA, 25 bp, Homo sapien
tctgctccagcgacattcctctaag

SEQ ID NO: 215664 - DNA, 25 bp, Homo sapien
gtcttacccaccagtggctggaaag

SEQ ID NO: 215665 - DNA, 25 bp, Homo sapien
agatgaagacgatttggccaaacga

SEQ ID NO: 215666 - DNA, 25 bp, Homo sapien
cgagaagatgagttcgtggacctag

SEQ ID NO: 215667 - DNA, 25 bp, Homo sapien
gacctgtttgttgagtgattgtgaa

SEQ ID NO: 215668 - DNA, 25 bp, Homo sapien
acagctgatccctggatttgtgtca

SEQ ID NO: 215669 - DNA, 25 bp, Homo sapien
atttgtgtcacgctacagctcatgc

SEQ ID NO: 215670 - DNA, 25 bp, Homo sapien
agctcatgctggctgggtccttagc

SEQ ID NO: 215671 - DNA, 25 bp, Homo sapien
ttagcccggcactccgttagaataa

SEQ ID NO: 215672 - DNA, 25 bp, Homo sapien
ggcactccgttagaataaacctggg

SEQ ID NO: 215673 - DNA, 25 bp, Homo sapien
ttgcccctaacgtgctgcccaggat

SEQ ID NO: 215674 - DNA, 25 bp, Homo sapien
aggatggcctcctcttgacaggcgg

SEQ ID NO: 215675 - DNA, 25 bp, Homo sapien
aaaggaagcttttaaactcagcagc

SEQ ID NO: 215676 - DNA, 25 bp, Homo sapien
gcagctgcaccccagaatctgtatg

SEQ ID NO: 215677 - DNA, 25 bp, Homo sapien
ccagaatctgtatgcctgcacctgc

SEQ ID NO: 215678 - DNA, 25 bp, Homo sapien
ctgcacctgcccaaggatttattca

SEQ ID NO: 215679 - DNA, 25 bp, Homo sapien
ggatttattcatagcttacctaaga

SEQ ID NO: 215680 - DNA, 25 bp, Homo sapien
atttcaaatttctaccataacactg

SEQ ID NO: 215681 - DNA, 25 bp, Homo sapien
gcgacctcctcctctaggcatggag

SEQ ID NO: 215682 - DNA, 25 bp, Homo sapien
ctaggcatggaggtttgccctcagc

SEQ ID NO: 215683 - DNA, 25 bp, Homo sapien
ctcagctgggcatctgggccatttg

SEQ ID NO: 215684 - DNA, 25 bp, Homo sapien
gtctcgatgatagtatttctgctgc

SEQ ID NO: 215685 - DNA, 25 bp, Homo sapien
ttctgctgcaagtacttctgatgtt

SEQ ID NO: 215686 - DNA, 25 bp, Homo sapien
tgatgttcaagatcgcctgtcagct

SEQ ID NO: 215687 - DNA, 25 bp, Homo sapien
agctcttgagtcacgagttcagcaa

SEQ ID NO: 215688 - DNA, 25 bp, Homo sapien
aaatcactgtgctaaaggcggcttt

SEQ ID NO: 215689 - DNA, 25 bp, Homo sapien
taaaggcggctttggctgatgtttt

SEQ ID NO: 215690 - DNA, 25 bp, Homo sapien
ttgaggcgtcttgcaatctctgaag

SEQ ID NO: 215691 - DNA, 25 bp, Homo sapien
aagccctcgagcagttattcccatg

SEQ ID NO: 215692 - DNA, 25 bp, Homo sapien
tattcccatgtcctgtataaccaat

SEQ ID NO: 215693 - DNA, 25 bp, Homo sapien
gaaaaccaagtcataccagtgctgt

SEQ ID NO: 215694 - DNA, 25 bp, Homo sapien
accagtgctgtctcaattgcaggaa

SEQ ID NO: 215695 - DNA, 25 bp, Homo sapien
aagttagcaattatgtacggatatt

SEQ ID NO: 215696 - DNA, 25 bp, Homo sapien
aatgctattattgcagaggatcatc

SEQ ID NO: 215697 - DNA, 25 bp, Homo sapien
gaggtaatctacgttatttcctatt

SEQ ID NO: 215698 - DNA, 25 bp, Homo sapien
atctacgttatttcctattctaatg

SEQ ID NO: 215699 - DNA, 25 bp, Homo sapien
ttcctattctaatgtcttttcctaa

SEQ ID NO: 215700 - DNA, 25 bp, Homo sapien
caactttctaagttagtagagactg

SEQ ID NO: 215701 - DNA, 25 bp, Homo sapien
tagagactgtttttgtagttttact

SEQ ID NO: 215702 - DNA, 25 bp, Homo sapien
gttttactttcattaactgttgctt

SEQ ID NO: 215703 - DNA, 25 bp, Homo sapien
tcattaactgttgcttaagggtttt

SEQ ID NO: 215704 - DNA, 25 bp, Homo sapien
taagggtttttatacacttccagat

SEQ ID NO: 215705 - DNA, 25 bp, Homo sapien
aatactttcatatttctaggaacat

SEQ ID NO: 215706 - DNA, 25 bp, Homo sapien
gcctccaagggtttcgactggtcca

SEQ ID NO: 215707 - DNA, 25 bp, Homo sapien
gtttcgactggtccagctctgacat

SEQ ID NO: 215708 - DNA, 25 bp, Homo sapien
ggctgcgagtgcaagatcacgcgct

SEQ ID NO: 215709 - DNA, 25 bp, Homo sapien
ccccggacgagtgcctctggatgga

SEQ ID NO: 215710 - DNA, 25 bp, Homo sapien
agaagaacatcaacgggcaccaggc

SEQ ID NO: 215711 - DNA, 25 bp, Homo sapien
tcaacgggcaccaggccaagttctt

SEQ ID NO: 215712 - DNA, 25 bp, Homo sapien
aagttcttcgcctgcatcaagagaa

SEQ ID NO: 215713 - DNA, 25 bp, Homo sapien
agtgacggctcctgtgcgtggtacc

SEQ ID NO: 215714 - DNA, 25 bp, Homo sapien
aagcaggagtttctcgacatcgagg

SEQ ID NO: 215715 - DNA, 25 bp, Homo sapien
acatcgaggacccataagcaggcct

SEQ ID NO: 215716 - DNA, 25 bp, Homo sapien
cgcccctgtggccaactgcaaaaaa

SEQ ID NO: 215717 - DNA, 25 bp, Homo sapien
gatttcctggaatgacaattatatt

SEQ ID NO: 215718 - DNA, 25 bp, Homo sapien
gggaaagagttataggaccacagtc

SEQ ID NO: 215719 - DNA, 25 bp, Homo sapien
gagttataggaccacagtcttcact

SEQ ID NO: 215720 - DNA, 25 bp, Homo sapien
ataggaccacagtcttcacttctga

SEQ ID NO: 215721 - DNA, 25 bp, Homo sapien
accacagtcttcacttctgatactt

SEQ ID NO: 215722 - DNA, 25 bp, Homo sapien
acagtcttcacttctgatacttgta

SEQ ID NO: 215723 - DNA, 25 bp, Homo sapien
gtcttcacttctgatacttgtaaat

SEQ ID NO: 215724 - DNA, 25 bp, Homo sapien
aatcttttattgcacttgttttgac

SEQ ID NO: 215725 - DNA, 25 bp, Homo sapien
attgcacttgttttgaccattaagc

SEQ ID NO: 215726 - DNA, 25 bp, Homo sapien
gcacttgttttgaccattaagctat

SEQ ID NO: 215727 - DNA, 25 bp, Homo sapien
gaccattaagctatatgtttagaaa

SEQ ID NO: 215728 - DNA, 25 bp, Homo sapien
agaaccagcggaactcaaaactgct

SEQ ID NO: 215729 - DNA, 25 bp, Homo sapien
aaactgctgttcaagaaacctcttc

SEQ ID NO: 215730 - DNA, 25 bp, Homo sapien
gaaacctcttcaagacttttgactt

SEQ ID NO: 215731 - DNA, 25 bp, Homo sapien
gacttttgacttagaacctgctata

SEQ ID NO: 215732 - DNA, 25 bp, Homo sapien
caagcttacctactgttatctctaa

SEQ ID NO: 215733 - DNA, 25 bp, Homo sapien
gaatttctaggaaacgtgcctttgt

SEQ ID NO: 215734 - DNA, 25 bp, Homo sapien
tgcactccaaattagaaggccggcc

SEQ ID NO: 215735 - DNA, 25 bp, Homo sapien
ggccccgtccacattttgcacagtg

SEQ ID NO: 215736 - DNA, 25 bp, Homo sapien
gcacagtgcctttacagatttacgt

SEQ ID NO: 215737 - DNA, 25 bp, Homo sapien
atgggctgatgaagaggccttctta

SEQ ID NO: 215738 - DNA, 25 bp, Homo sapien
ggccttcttaagttccagagtgcta

SEQ ID NO: 215739 - DNA, 25 bp, Homo sapien
attatgacccagaagatggacctag

SEQ ID NO: 215740 - DNA, 25 bp, Homo sapien
gatggacctagatgaagacactgct

SEQ ID NO: 215741 - DNA, 25 bp, Homo sapien
gacactgctgaaaaattttatcaaa

SEQ ID NO: 215742 - DNA, 25 bp, Homo sapien
aactggaaaagcacattagggtcac

SEQ ID NO: 215743 - DNA, 25 bp, Homo sapien
aagcacattagggtcactattcaaa

SEQ ID NO: 215744 - DNA, 25 bp, Homo sapien
tagggtcactattcaaaaaacagat

SEQ ID NO: 215745 - DNA, 25 bp, Homo sapien
aaaaacagatgatcaggccaggctc

SEQ ID NO: 215746 - DNA, 25 bp, Homo sapien
aaagcctgaatctgtcaatcctctg

SEQ ID NO: 215747 - DNA, 25 bp, Homo sapien
gtcaatcctctgaccaaatatctga

SEQ ID NO: 215748 - DNA, 25 bp, Homo sapien
aaatatctgagtgccaccactgact

SEQ ID NO: 215749 - DNA, 25 bp, Homo sapien
agtgccaccactgactttggaagaa

SEQ ID NO: 215750 - DNA, 25 bp, Homo sapien
ggcccctgactgaaccttgggcaga

SEQ ID NO: 215751 - DNA, 25 bp, Homo sapien
tgactgaaccttgggcagaagacag

SEQ ID NO: 215752 - DNA, 25 bp, Homo sapien
ttccagatggtgaagccttgggact

SEQ ID NO: 215753 - DNA, 25 bp, Homo sapien
atggtgaagccttgggactcgcggg

SEQ ID NO: 215754 - DNA, 25 bp, Homo sapien
gccactgacaccgagtactcggaga

SEQ ID NO: 215755 - DNA, 25 bp, Homo sapien
agatcaagatccacagatgagaaac

SEQ ID NO: 215756 - DNA, 25 bp, Homo sapien
aactgcagagactcaccctgattga

SEQ ID NO: 215757 - DNA, 25 bp, Homo sapien
gagactcaccctgattgagggatca

SEQ ID NO: 215758 - DNA, 25 bp, Homo sapien
tcaccctgattgagggatcacagcc

SEQ ID NO: 215759 - DNA, 25 bp, Homo sapien
atcacagcccctccaggcaagggag

SEQ ID NO: 215760 - DNA, 25 bp, Homo sapien
tcagaggctgattcttgtagaatta

SEQ ID NO: 215761 - DNA, 25 bp, Homo sapien
tctgcccaacgtgcgggtcaactat

SEQ ID NO: 215762 - DNA, 25 bp, Homo sapien
gggtcaactatgacttcggtcccat

SEQ ID NO: 215763 - DNA, 25 bp, Homo sapien
tatgacttcggtcccatccacatgc

SEQ ID NO: 215764 - DNA, 25 bp, Homo sapien
ccagccgcggcatcgcttctgatgg

SEQ ID NO: 215765 - DNA, 25 bp, Homo sapien
ggcatcgcttctgatggccccgaat

SEQ ID NO: 215766 - DNA, 25 bp, Homo sapien
atggccccgaatccccattgagcag

SEQ ID NO: 215767 - DNA, 25 bp, Homo sapien
aaggctggtgtctgtaccattgcat

SEQ ID NO: 215768 - DNA, 25 bp, Homo sapien
gtaccattgcatcctaagtcagctt

SEQ ID NO: 215769 - DNA, 25 bp, Homo sapien
gcatcctaagtcagcttgaagggta

SEQ ID NO: 215770 - DNA, 25 bp, Homo sapien
gcttgaagggtaggctggttttctt

SEQ ID NO: 215771 - DNA, 25 bp, Homo sapien
tcctagaagggctactgctcctgga

SEQ ID NO: 215772 - DNA, 25 bp, Homo sapien
acgtggtcacttttctcatcagtca

SEQ ID NO: 215773 - DNA, 25 bp, Homo sapien
acttttctcatcagtcacaatagga

SEQ ID NO: 215774 - DNA, 25 bp, Homo sapien
tcacaataggaagccaagcccggtt

SEQ ID NO: 215775 - DNA, 25 bp, Homo sapien
tgctacgccccatggaggctccgag

SEQ ID NO: 215776 - DNA, 25 bp, Homo sapien
ggaggctccgagaccatctgcccag

SEQ ID NO: 215777 - DNA, 25 bp, Homo sapien
tcactgaggctcaggacacggccac

SEQ ID NO: 215778 - DNA, 25 bp, Homo sapien
tgaggctcaggacacggccacacca

SEQ ID NO: 215779 - DNA, 25 bp, Homo sapien
aggacacggccacaccaagtgcagc

SEQ ID NO: 215780 - DNA, 25 bp, Homo sapien
aagtgcagccctcgtcctgggtctg

SEQ ID NO: 215781 - DNA, 25 bp, Homo sapien
tcctgggtctgcaccgggcagctct

SEQ ID NO: 215782 - DNA, 25 bp, Homo sapien
tgcccccctgcttcttaagaagatg

SEQ ID NO: 215783 - DNA, 25 bp, Homo sapien
cgtctccatcatcctggtccttggc

SEQ ID NO: 215784 - DNA, 25 bp, Homo sapien
ccgcgaagctgagaggcttgtgaaa

SEQ ID NO: 215785 - DNA, 25 bp, Homo sapien
agctgagaggcttgtgaaataccga

SEQ ID NO: 215786 - DNA, 25 bp, Homo sapien
tgaaataccgagaggccaatggcct

SEQ ID NO: 215787 - DNA, 25 bp, Homo sapien
gaggccaatggccttcccatcatgg

SEQ ID NO: 215788 - DNA, 25 bp, Homo sapien
gccaatggccttcccatcatggaat

SEQ ID NO: 215789 - DNA, 25 bp, Homo sapien
atcatggaatccaactgcttcgacc

SEQ ID NO: 215790 - DNA, 25 bp, Homo sapien
atggaatccaactgcttcgacccca

SEQ ID NO: 215791 - DNA, 25 bp, Homo sapien
cagaggatgagtgaccagttgctaa

SEQ ID NO: 215792 - DNA, 25 bp, Homo sapien
gaccagttgctaagtggggctcaag

SEQ ID NO: 215793 - DNA, 25 bp, Homo sapien
tggggctcaagaagcaccgccttcc

SEQ ID NO: 215794 - DNA, 25 bp, Homo sapien
tagggagtagaaccgtctctcttct

SEQ ID NO: 215795 - DNA, 25 bp, Homo sapien
aaccgtctctcttcttagttggtga

SEQ ID NO: 215796 - DNA, 25 bp, Homo sapien
ctctcttcttagttggtgactgttt

SEQ ID NO: 215797 - DNA, 25 bp, Homo sapien
atagatgaacactacttttttaatt

SEQ ID NO: 215798 - DNA, 25 bp, Homo sapien
ctacccttaacccatgaacactatt

SEQ ID NO: 215799 - DNA, 25 bp, Homo sapien
tgataaacgtgtattcctgaaactt

SEQ ID NO: 215800 - DNA, 25 bp, Homo sapien
cgtgtattcctgaaactttttgact

SEQ ID NO: 215801 - DNA, 25 bp, Homo sapien
tttgacttacttatcttacatgtgg

SEQ ID NO: 215802 - DNA, 25 bp, Homo sapien
tatcttacatgtggtgtcttcctgt

SEQ ID NO: 215803 - DNA, 25 bp, Homo sapien
tgtggtgtcttcctgtatatagtac

SEQ ID NO: 215804 - DNA, 25 bp, Homo sapien
gtgtcttcctgtatatagtacatta

SEQ ID NO: 215805 - DNA, 25 bp, Homo sapien
gtcccagcgcattaatctgaatctg

SEQ ID NO: 215806 - DNA, 25 bp, Homo sapien
attaatctgaatctgctgtcctaaa

SEQ ID NO: 215807 - DNA, 25 bp, Homo sapien
tctgctgtcctaaaatacactggtg

SEQ ID NO: 215808 - DNA, 25 bp, Homo sapien
acattacttgtacaatctcctatca

SEQ ID NO: 215809 - DNA, 25 bp, Homo sapien
gaaaactgttcatctactcactgta

SEQ ID NO: 215810 - DNA, 25 bp, Homo sapien
actgtagtgccctccttgaaatgtg

SEQ ID NO: 215811 - DNA, 25 bp, Homo sapien
gggatccctgtagtaaacactgtat

SEQ ID NO: 215812 - DNA, 25 bp, Homo sapien
gaattttacacagtctggccatcaa

SEQ ID NO: 215813 - DNA, 25 bp, Homo sapien
gtctggccatcaagaaagatcacgg

SEQ ID NO: 215814 - DNA, 25 bp, Homo sapien
tgaataggaatcaccacgctgggct

SEQ ID NO: 215815 - DNA, 25 bp, Homo sapien
ccacgctgggctgtttattaggtac

SEQ ID NO: 215816 - DNA, 25 bp, Homo sapien
ttagtaatttgtagtgactgttccc

SEQ ID NO: 215817 - DNA, 25 bp, Homo sapien
agatgttgccatatttcctactctt

SEQ ID NO: 215818 - DNA, 25 bp, Homo sapien
tactctttaggcatggactctcctt

SEQ ID NO: 215819 - DNA, 25 bp, Homo sapien
ttaggcatggactctcctttccctt

SEQ ID NO: 215820 - DNA, 25 bp, Homo sapien
tcctttccctttgttagtgtcctgg

SEQ ID NO: 215821 - DNA, 25 bp, Homo sapien
tttgttagtgtcctgggttcccatg

SEQ ID NO: 215822 - DNA, 25 bp, Homo sapien
ctgggttcccatggactcagggatt

SEQ ID NO: 215823 - DNA, 25 bp, Homo sapien
catggactcagggatttgttggcta

SEQ ID NO: 215824 - DNA, 25 bp, Homo sapien
cagggatttgttggctaaggtttct

SEQ ID NO: 215825 - DNA, 25 bp, Homo sapien
gttggctaaggtttctctgtgcata

SEQ ID NO: 215826 - DNA, 25 bp, Homo sapien
tggctaaggtttctctgtgcatata

SEQ ID NO: 215827 - DNA, 25 bp, Homo sapien
gacaggcccaaggtggcagtgacaa

SEQ ID NO: 215828 - DNA, 25 bp, Homo sapien
caatgattcagacagcggcagcaat

SEQ ID NO: 215829 - DNA, 25 bp, Homo sapien
aagctgcagcttctgattccagtga

SEQ ID NO: 215830 - DNA, 25 bp, Homo sapien
gattccagtgaagctgatagtgaca

SEQ ID NO: 215831 - DNA, 25 bp, Homo sapien
gactgagtcccagggcattcagggc

SEQ ID NO: 215832 - DNA, 25 bp, Homo sapien
ttcagggctggttcagacaccatta

SEQ ID NO: 215833 - DNA, 25 bp, Homo sapien
agacaccattattgtgagcagcaaa

SEQ ID NO: 215834 - DNA, 25 bp, Homo sapien
agcaaagcacttttctagtggtctg

SEQ ID NO: 215835 - DNA, 25 bp, Homo sapien
acttttctagtggtctgtttgtgag

SEQ ID NO: 215836 - DNA, 25 bp, Homo sapien
gtttgtgagcctttcacttgtttgt

SEQ ID NO: 215837 - DNA, 25 bp, Homo sapien
gagcctttcacttgtttgttcccca

SEQ ID NO: 215838 - DNA, 25 bp, Homo sapien
attatgacccagaagatggacctag

SEQ ID NO: 215839 - DNA, 25 bp, Homo sapien
tatgacccagaagatggacctagat

SEQ ID NO: 215840 - DNA, 25 bp, Homo sapien
atgacccagaagatggacctagatg

SEQ ID NO: 215841 - DNA, 25 bp, Homo sapien
gacccagaagatggacctagatgaa

SEQ ID NO: 215842 - DNA, 25 bp, Homo sapien
gaagatggacctagatgaagacact

SEQ ID NO: 215843 - DNA, 25 bp, Homo sapien
gatggacctagatgaagacactgct

SEQ ID NO: 215844 - DNA, 25 bp, Homo sapien
tatcaaaagttactggaactggaaa

SEQ ID NO: 215845 - DNA, 25 bp, Homo sapien
ggaactggaaaagcacattagggtc

SEQ ID NO: 215846 - DNA, 25 bp, Homo sapien
aactggaaaagcacattagggtcac

SEQ ID NO: 215847 - DNA, 25 bp, Homo sapien
actggaaaagcacattagggtcact

SEQ ID NO: 215848 - DNA, 25 bp, Homo sapien
attagggtcactattcaaaaaacag

SEQ ID NO: 215849 - DNA, 25 bp, Homo sapien
gaagaactctttctcagtatccctt

SEQ ID NO: 215850 - DNA, 25 bp, Homo sapien
agaactctttctcagtatcccttgt

SEQ ID NO: 215851 - DNA, 25 bp, Homo sapien
cggaatggtgtctcagatgttgtga

SEQ ID NO: 215852 - DNA, 25 bp, Homo sapien
ggtgtctcagatgttgtgaaaatta

SEQ ID NO: 215853 - DNA, 25 bp, Homo sapien
aacttgaattctgaggaggaggccc

SEQ ID NO: 215854 - DNA, 25 bp, Homo sapien
ggaggaggcccttttcaagaagagt

SEQ ID NO: 215855 - DNA, 25 bp, Homo sapien
ggcccttttcaagaagagtgcagaa

SEQ ID NO: 215856 - DNA, 25 bp, Homo sapien
gcagaaacactttggaatattcaaa

SEQ ID NO: 215857 - DNA, 25 bp, Homo sapien
ttaaagccttctaatgttccactgt

SEQ ID NO: 215858 - DNA, 25 bp, Homo sapien
gccttctaatgttccactgtttgga

SEQ ID NO: 215859 - DNA, 25 bp, Homo sapien
cagaagatagcaggctgtgtatttt

SEQ ID NO: 215860 - DNA, 25 bp, Homo sapien
tgaccttatcgggtgcaatactagc

SEQ ID NO: 215861 - DNA, 25 bp, Homo sapien
accttatcgggtgcaatactagcta

SEQ ID NO: 215862 - DNA, 25 bp, Homo sapien
aaagctagaaacctacactgtcact

SEQ ID NO: 215863 - DNA, 25 bp, Homo sapien
aaacctacactgtcactttactgag

SEQ ID NO: 215864 - DNA, 25 bp, Homo sapien
tacactgtcactttactgagatttc

SEQ ID NO: 215865 - DNA, 25 bp, Homo sapien
tgtcactttactgagatttctgagt

SEQ ID NO: 215866 - DNA, 25 bp, Homo sapien
gagatttctgagtatacttttcata

SEQ ID NO: 215867 - DNA, 25 bp, Homo sapien
tctgagtatacttttcatattgcct

SEQ ID NO: 215868 - DNA, 25 bp, Homo sapien
gtttctttgcacagacattttgtca

SEQ ID NO: 215869 - DNA, 25 bp, Homo sapien
ataagcctttattccaagaggtatt

SEQ ID NO: 215870 - DNA, 25 bp, Homo sapien
gttatatcctagaggactctgtctt

SEQ ID NO: 215871 - DNA, 25 bp, Homo sapien
gatgcacgcccaagaatcttgatta

SEQ ID NO: 215872 - DNA, 25 bp, Homo sapien
gagagacttgttttgcctcagtgtt

SEQ ID NO: 215873 - DNA, 25 bp, Homo sapien
gttttgcctcagtgttgaagccatt

SEQ ID NO: 215874 - DNA, 25 bp, Homo sapien
gaaagttatgttttagggtcctctg

SEQ ID NO: 215875 - DNA, 25 bp, Homo sapien
gaaaagtctctaacacagatggaag

SEQ ID NO: 215876 - DNA, 25 bp, Homo sapien
atggaagatgtcttgaaagcattac

SEQ ID NO: 215877 - DNA, 25 bp, Homo sapien
gggaggccgaatccaaattgtcctt

SEQ ID NO: 215878 - DNA, 25 bp, Homo sapien
cgaatccaaattgtcctttgccact

SEQ ID NO: 215879 - DNA, 25 bp, Homo sapien
tcctttgccacttgtaaaagctgaa

SEQ ID NO: 215880 - DNA, 25 bp, Homo sapien
aaagctgaactctagtctgtgtcct

SEQ ID NO: 215881 - DNA, 25 bp, Homo sapien
tgaactctagtctgtgtcctccatt

SEQ ID NO: 215882 - DNA, 25 bp, Homo sapien
aagacaatagtattacccatgggac

SEQ ID NO: 215883 - DNA, 25 bp, Homo sapien
gacaatagtattacccatgggacaa

SEQ ID NO: 215884 - DNA, 25 bp, Homo sapien
ttacccatgggacaaaatttgtact

SEQ ID NO: 215885 - DNA, 25 bp, Homo sapien
ggacaaaatttgtactattagcaag

SEQ ID NO: 215886 - DNA, 25 bp, Homo sapien
agcaagaatcattttgtgtctcatt

SEQ ID NO: 215887 - DNA, 25 bp, Homo sapien
tctcatttagaaacaatttgacttt

SEQ ID NO: 215888 - DNA, 25 bp, Homo sapien
caatttgacttttgttccagtgttt

SEQ ID NO: 215889 - DNA, 25 bp, Homo sapien
tgttccagtgtttaaactttgacaa

SEQ ID NO: 215890 - DNA, 25 bp, Homo sapien
gaatagatctttataacctgatgcc

SEQ ID NO: 215891 - DNA, 25 bp, Homo sapien
attggtattaactatgatcatcttg

SEQ ID NO: 215892 - DNA, 25 bp, Homo sapien
actatgatcatcttgatgtctatga

SEQ ID NO: 215893 - DNA, 25 bp, Homo sapien
tggcaaatgggcaaacctgcacaaa

SEQ ID NO: 215894 - DNA, 25 bp, Homo sapien
caaatgggcaaacctgcacaaaaga

SEQ ID NO: 215895 - DNA, 25 bp, Homo sapien
gggtcagctaattggttcaagtcct

SEQ ID NO: 215896 - DNA, 25 bp, Homo sapien
gtcagctaattggttcaagtcctgc

SEQ ID NO: 215897 - DNA, 25 bp, Homo sapien
agctaattggttcaagtcctgcaga

SEQ ID NO: 215898 - DNA, 25 bp, Homo sapien
gctaattggttcaagtcctgcagaa

SEQ ID NO: 215899 - DNA, 25 bp, Homo sapien
taattggttcaagtcctgcagaaga

SEQ ID NO: 215900 - DNA, 25 bp, Homo sapien
attggttcaagtcctgcagaagatc

SEQ ID NO: 215901 - DNA, 25 bp, Homo sapien
aaattcagaggagccacgttatacc

SEQ ID NO: 215902 - DNA, 25 bp, Homo sapien
ttcagaggagccacgttataccagg

SEQ ID NO: 215903 - DNA, 25 bp, Homo sapien
aatcttttaccaacctaggcaccat

SEQ ID NO: 215904 - DNA, 25 bp, Homo sapien
acagacggttgtgaaatcatgtgct

SEQ ID NO: 215905 - DNA, 25 bp, Homo sapien
aatcatgtgctgtggccgagggtac

SEQ ID NO: 215906 - DNA, 25 bp, Homo sapien
gagggtacgacacaactcgagtcac

SEQ ID NO: 215907 - DNA, 25 bp, Homo sapien
gagtcacccgtgttacccagtgtga

SEQ ID NO: 215908 - DNA, 25 bp, Homo sapien
ttacccagtgtgagtgcaaattcca

SEQ ID NO: 215909 - DNA, 25 bp, Homo sapien
tgtggacgtccatacttgcaaagcc

SEQ ID NO: 215910 - DNA, 25 bp, Homo sapien
agagtggctggaccagacctgaaca

SEQ ID NO: 215911 - DNA, 25 bp, Homo sapien
agacctgaacacacagatacctcac

SEQ ID NO: 215912 - DNA, 25 bp, Homo sapien
ttgacaactctccagattactgtgt

SEQ ID NO: 215913 - DNA, 25 bp, Homo sapien
ttactgtgtcttggacaaggctgca

SEQ ID NO: 215914 - DNA, 25 bp, Homo sapien
aggttccctaggcactgcaggccgt

SEQ ID NO: 215915 - DNA, 25 bp, Homo sapien
ggagaaatgctactatttacccttt

SEQ ID NO: 215916 - DNA, 25 bp, Homo sapien
tgctactatttaccctttgaagatg

SEQ ID NO: 215917 - DNA, 25 bp, Homo sapien
gagctgtgcatctatgtgcgtcaca

SEQ ID NO: 215918 - DNA, 25 bp, Homo sapien
gtgcgtcacaaggaatacaaggtaa

SEQ ID NO: 215919 - DNA, 25 bp, Homo sapien
aatggccaacgcatttacaactttg

SEQ ID NO: 215920 - DNA, 25 bp, Homo sapien
atttacaactttgcccatcgattcc

SEQ ID NO: 215921 - DNA, 25 bp, Homo sapien
tcgattcccgccagcatctgtgaag

SEQ ID NO: 215922 - DNA, 25 bp, Homo sapien
aagatgctgcaagtcttcagagata

SEQ ID NO: 215923 - DNA, 25 bp, Homo sapien
gcaagtcttcagagatatctccctg

SEQ ID NO: 215924 - DNA, 25 bp, Homo sapien
atatctccctgaccagagtgcttat

SEQ ID NO: 215925 - DNA, 25 bp, Homo sapien
gaccagagtgcttatcagcgattga

SEQ ID NO: 215926 - DNA, 25 bp, Homo sapien
tgttgcccagttcaagctctattgg

SEQ ID NO: 215927 - DNA, 25 bp, Homo sapien
gttcaagctctattgggtcctgagg

SEQ ID NO: 215928 - DNA, 25 bp, Homo sapien
gggtcctgaggaagattactatttt

SEQ ID NO: 215929 - DNA, 25 bp, Homo sapien
ttatcattaaaaccagcccagggat

SEQ ID NO: 215930 - DNA, 25 bp, Homo sapien
agggatgtgtaaacctgcatctgga

SEQ ID NO: 215931 - DNA, 25 bp, Homo sapien
cttcactttcaattatatccagcaa

SEQ ID NO: 215932 - DNA, 25 bp, Homo sapien
tatccagcaataagttgttctccag

SEQ ID NO: 215933 - DNA, 25 bp, Homo sapien
gcttggaaacttacccagtttgcct

SEQ ID NO: 215934 - DNA, 25 bp, Homo sapien
tacccagtttgccttccatttggga

SEQ ID NO: 215935 - DNA, 25 bp, Homo sapien
atttgggacatgactgatgtgcttc

SEQ ID NO: 215936 - DNA, 25 bp, Homo sapien
gatgtgcttcagtctttgtataata

SEQ ID NO: 215937 - DNA, 25 bp, Homo sapien
gaagctgctttccagaagctgatga

SEQ ID NO: 215938 - DNA, 25 bp, Homo sapien
gagcaacttggacagcaacagggac

SEQ ID NO: 215939 - DNA, 25 bp, Homo sapien
caacagggacaacgaggtggacttc

SEQ ID NO: 215940 - DNA, 25 bp, Homo sapien
aggtggacttccaagagtactgtgt

SEQ ID NO: 215941 - DNA, 25 bp, Homo sapien
aagagtactgtgtcttcctgtcctg

SEQ ID NO: 215942 - DNA, 25 bp, Homo sapien
gtcctgcatcgccatgatgtgtaac

SEQ ID NO: 215943 - DNA, 25 bp, Homo sapien
aacgaattctttgaaggcttcccag

SEQ ID NO: 215944 - DNA, 25 bp, Homo sapien
gcttcccagataagcagcccaggaa

SEQ ID NO: 215945 - DNA, 25 bp, Homo sapien
tgaaaactcctctgatgtggttggg

SEQ ID NO: 215946 - DNA, 25 bp, Homo sapien
tccctgtcgccagtgggcacttttt

SEQ ID NO: 215947 - DNA, 25 bp, Homo sapien
ggctccttcagacacgtgcttgatg

SEQ ID NO: 215948 - DNA, 25 bp, Homo sapien
actcacccgacaggaaatagttgct

SEQ ID NO: 215949 - DNA, 25 bp, Homo sapien
tcacccgacaggaaatagttgctct

SEQ ID NO: 215950 - DNA, 25 bp, Homo sapien
acccgacaggaaatagttgctcttt

SEQ ID NO: 215951 - DNA, 25 bp, Homo sapien
aatagttgctcttttaaatgctttt

SEQ ID NO: 215952 - DNA, 25 bp, Homo sapien
aaatgcttttggaaggctttctaca

SEQ ID NO: 215953 - DNA, 25 bp, Homo sapien
atgcttttggaaggctttctacaag

SEQ ID NO: 215954 - DNA, 25 bp, Homo sapien
gcttttggaaggctttctacaagta

SEQ ID NO: 215955 - DNA, 25 bp, Homo sapien
tttggaaggctttctacaagtataa

SEQ ID NO: 215956 - DNA, 25 bp, Homo sapien
ggaaggctttctacaagtataagag

SEQ ID NO: 215957 - DNA, 25 bp, Homo sapien
ggctttctacaagtataagagactt

SEQ ID NO: 215958 - DNA, 25 bp, Homo sapien
aagtcttattacaacagagtaggta

SEQ ID NO: 215959 - DNA, 25 bp, Homo sapien
ttccacaagtactccggcagggagg

SEQ ID NO: 215960 - DNA, 25 bp, Homo sapien
gcagggagggtgacaagcacaccct

SEQ ID NO: 215961 - DNA, 25 bp, Homo sapien
gacaagcacaccctgagcaagaagg

SEQ ID NO: 215962 - DNA, 25 bp, Homo sapien
gctgatccagaaggagctcaccatt

SEQ ID NO: 215963 - DNA, 25 bp, Homo sapien
atccagaaggagctcaccattggct

SEQ ID NO: 215964 - DNA, 25 bp, Homo sapien
agaaggagctcaccattggctcgaa

SEQ ID NO: 215965 - DNA, 25 bp, Homo sapien
aggagctcaccattggctcgaagct

SEQ ID NO: 215966 - DNA, 25 bp, Homo sapien
gagctcaccattggctcgaagctgc

SEQ ID NO: 215967 - DNA, 25 bp, Homo sapien
ctcaccattggctcgaagctgcagg

SEQ ID NO: 215968 - DNA, 25 bp, Homo sapien
ccattggctcgaagctgcaggatgc

SEQ ID NO: 215969 - DNA, 25 bp, Homo sapien
gggccttggctttgatctacaatga

SEQ ID NO: 215970 - DNA, 25 bp, Homo sapien
gatgacctgagcaagttcggaaaaa

SEQ ID NO: 215971 - DNA, 25 bp, Homo sapien
gcaaacatgtgtcgtgggattccaa

SEQ ID NO: 215972 - DNA, 25 bp, Homo sapien
gtgggattccaacatacatggctga

SEQ ID NO: 215973 - DNA, 25 bp, Homo sapien
gatgcaagaggcaagcctgtttttt

SEQ ID NO: 215974 - DNA, 25 bp, Homo sapien
tttttactcaggaacgtgctacacg

SEQ ID NO: 215975 - DNA, 25 bp, Homo sapien
gaacgtgctacacgaccagtgtact

SEQ ID NO: 215976 - DNA, 25 bp, Homo sapien
atttccttctgtggagacacggtgg

SEQ ID NO: 215977 - DNA, 25 bp, Homo sapien
aagccactatggatttagtcgtctg

SEQ ID NO: 215978 - DNA, 25 bp, Homo sapien
tttagtcgtctgaatatgctgtgca

SEQ ID NO: 215979 - DNA, 25 bp, Homo sapien
tgggctccagtggtttttaccatgt

SEQ ID NO: 215980 - DNA, 25 bp, Homo sapien
ggtttttaccatgtcattctgaaat

SEQ ID NO: 215981 - DNA, 25 bp, Homo sapien
ggtcattgaaccataactaggactt

SEQ ID NO: 215982 - DNA, 25 bp, Homo sapien
aactaggactttatcagaaactcaa

SEQ ID NO: 215983 - DNA, 25 bp, Homo sapien
caaacttcgtacagagttcggtcta

SEQ ID NO: 215984 - DNA, 25 bp, Homo sapien
gagttcggtctattaattgtttcat

SEQ ID NO: 215985 - DNA, 25 bp, Homo sapien
agatattctatgtgtttacctcaat

SEQ ID NO: 215986 - DNA, 25 bp, Homo sapien
gtttttgctagtatcagatctgctg

SEQ ID NO: 215987 - DNA, 25 bp, Homo sapien
tcagatctgctgtggaattggtatt

SEQ ID NO: 215988 - DNA, 25 bp, Homo sapien
tggtattgtatgtccatgaattctt

SEQ ID NO: 215989 - DNA, 25 bp, Homo sapien
gaattcttcttttctcagcacgtgt

SEQ ID NO: 215990 - DNA, 25 bp, Homo sapien
tcagcacgtgttcctcactagaaga

SEQ ID NO: 215991 - DNA, 25 bp, Homo sapien
aatgctgttacctttaagctttgtc

SEQ ID NO: 215992 - DNA, 25 bp, Homo sapien
gaacccggcgactgaggtgcttcca

SEQ ID NO: 215993 - DNA, 25 bp, Homo sapien
tcaccccacatgaccttctgtgtat

SEQ ID NO: 215994 - DNA, 25 bp, Homo sapien
acatgaccttctgtgtattcagcaa

SEQ ID NO: 215995 - DNA, 25 bp, Homo sapien
ttctgtgtattcagcaaacactcac

SEQ ID NO: 215996 - DNA, 25 bp, Homo sapien
aacactcactaggtgacagcggcca

SEQ ID NO: 215997 - DNA, 25 bp, Homo sapien
tcactaggtgacagcggccaccagg

SEQ ID NO: 215998 - DNA, 25 bp, Homo sapien
tggccctggcctcgaccagcttaga

SEQ ID NO: 215999 - DNA, 25 bp, Homo sapien
gaggtttctcacacctctgttccca

SEQ ID NO: 216000 - DNA, 25 bp, Homo sapien
gcccagcagagagtccgtaggcttg

SEQ ID NO: 216001 - DNA, 25 bp, Homo sapien
gagtccgtaggcttgaacatgtgtt

SEQ ID NO: 216002 - DNA, 25 bp, Homo sapien
aggcttgaacatgtgttgagtgcat

SEQ ID NO: 216003 - DNA, 25 bp, Homo sapien
agcttctgcccaacgtcacgacagt

SEQ ID NO: 216004 - DNA, 25 bp, Homo sapien
gcttctgcccaacgtcacgacagtg

SEQ ID NO: 216005 - DNA, 25 bp, Homo sapien
ttctgcccaacgtcacgacagtgga

SEQ ID NO: 216006 - DNA, 25 bp, Homo sapien
tctgcccaacgtcacgacagtggag

SEQ ID NO: 216007 - DNA, 25 bp, Homo sapien
ctgcccaacgtcacgacagtggaga

SEQ ID NO: 216008 - DNA, 25 bp, Homo sapien
tgcccaacgtcacgacagtggagag

SEQ ID NO: 216009 - DNA, 25 bp, Homo sapien
gcccaacgtcacgacagtggagaga

SEQ ID NO: 216010 - DNA, 25 bp, Homo sapien
cccaacgtcacgacagtggagagaa

SEQ ID NO: 216011 - DNA, 25 bp, Homo sapien
ccaacgtcacgacagtggagagaaa

SEQ ID NO: 216012 - DNA, 25 bp, Homo sapien
gatgcattagcacaacaggcctttg

SEQ ID NO: 216013 - DNA, 25 bp, Homo sapien
ggctcggagaaggacacgcgaattt

SEQ ID NO: 216014 - DNA, 25 bp, Homo sapien
gagacaggtctcatcgggaggaaat

SEQ ID NO: 216015 - DNA, 25 bp, Homo sapien
aagacaacaagaccctagtcctggt

SEQ ID NO: 216016 - DNA, 25 bp, Homo sapien
tagtcctggttccaatttaggtggt

SEQ ID NO: 216017 - DNA, 25 bp, Homo sapien
ggtggtgatgacctcaaacttcgtt

SEQ ID NO: 216018 - DNA, 25 bp, Homo sapien
agcacagcagatgtgtgctgcccat

SEQ ID NO: 216019 - DNA, 25 bp, Homo sapien
tgctgcccatctttacatacacatt

SEQ ID NO: 216020 - DNA, 25 bp, Homo sapien
atacacattgcttctagttggcaga

SEQ ID NO: 216021 - DNA, 25 bp, Homo sapien
gataactggaggtactacggtctat

SEQ ID NO: 216022 - DNA, 25 bp, Homo sapien
tacggtctatttctcaaccttaggc

SEQ ID NO: 216023 - DNA, 25 bp, Homo sapien
gaagattcacgtgtacggctattcc

SEQ ID NO: 216024 - DNA, 25 bp, Homo sapien
gattcacgtgtacggctattccatg

SEQ ID NO: 216025 - DNA, 25 bp, Homo sapien
ccagcacgccatttcaactgagaaa

SEQ ID NO: 216026 - DNA, 25 bp, Homo sapien
atcaaagccaagtaccccgactacg

SEQ ID NO: 216027 - DNA, 25 bp, Homo sapien
caaagccaagtaccccgactacgag

SEQ ID NO: 216028 - DNA, 25 bp, Homo sapien
tacgaggtcacctgggctaacgacg

SEQ ID NO: 216029 - DNA, 25 bp, Homo sapien
acctgggctaacgacggctactgag

SEQ ID NO: 216030 - DNA, 25 bp, Homo sapien
ggctaacgacggctactgagcactc

SEQ ID NO: 216031 - DNA, 25 bp, Homo sapien
aacgacggctactgagcactcccag

SEQ ID NO: 216032 - DNA, 25 bp, Homo sapien
agcctctggtgacgtgctgtccacc

SEQ ID NO: 216033 - DNA, 25 bp, Homo sapien
tggtgacgtgctgtccaccaggcct

SEQ ID NO: 216034 - DNA, 25 bp, Homo sapien
cctctcggccagatgtgatgttcat

SEQ ID NO: 216035 - DNA, 25 bp, Homo sapien
tgatgttcatggtttatcccctgga

SEQ ID NO: 216036 - DNA, 25 bp, Homo sapien
atggtttatcccctggaccagaact

SEQ ID NO: 216037 - DNA, 25 bp, Homo sapien
gaccagaacttgtccgatgaggact

SEQ ID NO: 216038 - DNA, 25 bp, Homo sapien
atagtcatagaggatgctttaccca

SEQ ID NO: 216039 - DNA, 25 bp, Homo sapien
gatgctttacccaagagccacagtg

SEQ ID NO: 216040 - DNA, 25 bp, Homo sapien
ggctcctcgctgtctagggaaggac

SEQ ID NO: 216041 - DNA, 25 bp, Homo sapien
agggttgcctattgtgttctcggag

SEQ ID NO: 216042 - DNA, 25 bp, Homo sapien
attgtgttctcggagttgactcgtt

SEQ ID NO: 216043 - DNA, 25 bp, Homo sapien
gttgactcgttgaaattgttttcca

SEQ ID NO: 216044 - DNA, 25 bp, Homo sapien
ttattcacatgtaatcaccaatagt

SEQ ID NO: 216045 - DNA, 25 bp, Homo sapien
tttctccgctccaaagataccacag

SEQ ID NO: 216046 - DNA, 25 bp, Homo sapien
gataccacagagaacgtgtcattcc

SEQ ID NO: 216047 - DNA, 25 bp, Homo sapien
acgtgtcattcccacattcagtgag

SEQ ID NO: 216048 - DNA, 25 bp, Homo sapien
attcagtgagccaatcagcagtccc

SEQ ID NO: 216049 - DNA, 25 bp, Homo sapien
agcagtcccttctctatagccaaca

SEQ ID NO: 216050 - DNA, 25 bp, Homo sapien
acacgctccctttgcatagaaactg

SEQ ID NO: 216051 - DNA, 25 bp, Homo sapien
ctgagggtcccttagctgaaggcac

SEQ ID NO: 216052 - DNA, 25 bp, Homo sapien
gtcccttagctgaaggcaccacaag

SEQ ID NO: 216053 - DNA, 25 bp, Homo sapien
agagcttgcccctatgaccctcatg

SEQ ID NO: 216054 - DNA, 25 bp, Homo sapien
ctatgaccctcatgccttttttcat

SEQ ID NO: 216055 - DNA, 25 bp, Homo sapien
atgtgtgcagcaactagaaactata

SEQ ID NO: 216056 - DNA, 25 bp, Homo sapien
ccgtccagagctggcatttgcacaa

SEQ ID NO: 216057 - DNA, 25 bp, Homo sapien
aaacacggcaacactgggtggcatc

SEQ ID NO: 216058 - DNA, 25 bp, Homo sapien
cactgggtggcatccaagtcttgga

SEQ ID NO: 216059 - DNA, 25 bp, Homo sapien
gaaaaccgtgtgaagcaactactat

SEQ ID NO: 216060 - DNA, 25 bp, Homo sapien
aaacttgagtcatcccgacgttgat

SEQ ID NO: 216061 - DNA, 25 bp, Homo sapien
gacgttgatctcttacaactgtgta

SEQ ID NO: 216062 - DNA, 25 bp, Homo sapien
agcacatgttttgtacttggtacac

SEQ ID NO: 216063 - DNA, 25 bp, Homo sapien
ttggtacacgagaaaacccagcttt

SEQ ID NO: 216064 - DNA, 25 bp, Homo sapien
aaaacccagctttcatcttttgtct

SEQ ID NO: 216065 - DNA, 25 bp, Homo sapien
catcttttgtctgtatgaggtcaat

SEQ ID NO: 216066 - DNA, 25 bp, Homo sapien
agtgtcctatagaaaatgccattaa

SEQ ID NO: 216067 - DNA, 25 bp, Homo sapien
ttccacaagtactccggcagggagg

SEQ ID NO: 216068 - DNA, 25 bp, Homo sapien
gcagggagggtgacaagcacaccct

SEQ ID NO: 216069 - DNA, 25 bp, Homo sapien
gacaagcacaccctgagcaagaagg

SEQ ID NO: 216070 - DNA, 25 bp, Homo sapien
acaagcacaccctgagcaagaagga

SEQ ID NO: 216071 - DNA, 25 bp, Homo sapien
gctgatccagaaggagctcaccatt

SEQ ID NO: 216072 - DNA, 25 bp, Homo sapien
tgatccagaaggagctcaccattgg

SEQ ID NO: 216073 - DNA, 25 bp, Homo sapien
atccagaaggagctcaccattggct

SEQ ID NO: 216074 - DNA, 25 bp, Homo sapien
agaaggagctcaccattggctcgaa

SEQ ID NO: 216075 - DNA, 25 bp, Homo sapien
aggagctcaccattggctcgaagct

SEQ ID NO: 216076 - DNA, 25 bp, Homo sapien
gagctcaccattggctcgaagctgc

SEQ ID NO: 216077 - DNA, 25 bp, Homo sapien
ctcaccattggctcgaagctgcagg

SEQ ID NO: 216078 - DNA, 25 bp, Homo sapien
ccccttccccattaatgtgagtaat

SEQ ID NO: 216079 - DNA, 25 bp, Homo sapien
gagtaatgaattagcctgaccacag

SEQ ID NO: 216080 - DNA, 25 bp, Homo sapien
gaccacaggtggtcactgtaggcta

SEQ ID NO: 216081 - DNA, 25 bp, Homo sapien
aatgtttgcgaatgttgactgccac

SEQ ID NO: 216082 - DNA, 25 bp, Homo sapien
gccccacacactgtgtctttataga

SEQ ID NO: 216083 - DNA, 25 bp, Homo sapien
tctttatagaattcccctttgccca

SEQ ID NO: 216084 - DNA, 25 bp, Homo sapien
tccacctggacacaacttgctcaaa

SEQ ID NO: 216085 - DNA, 25 bp, Homo sapien
caacttgctcaaaggctggtgactt

SEQ ID NO: 216086 - DNA, 25 bp, Homo sapien
gctggtgacttgtgggccattcatc

SEQ ID NO: 216087 - DNA, 25 bp, Homo sapien
gtgggccattcatctacaaccaagt

SEQ ID NO: 216088 - DNA, 25 bp, Homo sapien
tacaaccaagtcctgatggagcaag

SEQ ID NO: 216089 - DNA, 25 bp, Homo sapien
gacatgtttcacaaatacaccagac

SEQ ID NO: 216090 - DNA, 25 bp, Homo sapien
acaccagacgtgatgacaagattga

SEQ ID NO: 216091 - DNA, 25 bp, Homo sapien
gattgacaagccaagcctgctgacg

SEQ ID NO: 216092 - DNA, 25 bp, Homo sapien
gccaagcctgctgacgatgatgaag

SEQ ID NO: 216093 - DNA, 25 bp, Homo sapien
caacttccttagtgcctgtgacaaa

SEQ ID NO: 216094 - DNA, 25 bp, Homo sapien
aagggcacaaattacctcgccgacg

SEQ ID NO: 216095 - DNA, 25 bp, Homo sapien
tacctcgccgacgtctttgagaaaa

SEQ ID NO: 216096 - DNA, 25 bp, Homo sapien
gattgatttttctgagtttctgtcc

SEQ ID NO: 216097 - DNA, 25 bp, Homo sapien
gtttctgtccttgctgggagacata

SEQ ID NO: 216098 - DNA, 25 bp, Homo sapien
gctgggagacatagccacagactac

SEQ ID NO: 216099 - DNA, 25 bp, Homo sapien
acagactaccacaagcagagccatg

SEQ ID NO: 216100 - DNA, 25 bp, Homo sapien
tgtattttgtgctgcctgagaccaa

SEQ ID NO: 216101 - DNA, 25 bp, Homo sapien
gagaccaaaaacagaacctatgcag

SEQ ID NO: 216102 - DNA, 25 bp, Homo sapien
agaacctatgcagaaatcagccagg

SEQ ID NO: 216103 - DNA, 25 bp, Homo sapien
gaacaaagcatacccaccagaagag

SEQ ID NO: 216104 - DNA, 25 bp, Homo sapien
gagaaaatcgactcagctgtcactg

SEQ ID NO: 216105 - DNA, 25 bp, Homo sapien
gctgtcactgatggtaagataaatg

SEQ ID NO: 216106 - DNA, 25 bp, Homo sapien
ttaacaagtttcctcctccacgttg

SEQ ID NO: 216107 - DNA, 25 bp, Homo sapien
tcctcctccacgttggacaattatg

SEQ ID NO: 216108 - DNA, 25 bp, Homo sapien
aacaggattgtctacatggatgatc

SEQ ID NO: 216109 - DNA, 25 bp, Homo sapien
acatggatgatctcacttttcagga

SEQ ID NO: 216110 - DNA, 25 bp, Homo sapien
gaattgaagctatgcaagtctttta

SEQ ID NO: 216111 - DNA, 25 bp, Homo sapien
gaggtgctgagctaacagtgccaac

SEQ ID NO: 216112 - DNA, 25 bp, Homo sapien
aacaagtgctccttaagcctgcgag

SEQ ID NO: 216113 - DNA, 25 bp, Homo sapien
gggctggttctcacctttgacagct

SEQ ID NO: 216114 - DNA, 25 bp, Homo sapien
tgacagctgaatgttcctaaagaac

SEQ ID NO: 216115 - DNA, 25 bp, Homo sapien
ctaaagaactgctgccccacagtga

SEQ ID NO: 216116 - DNA, 25 bp, Homo sapien
agggaatgccagacacaggctcgct

SEQ ID NO: 216117 - DNA, 25 bp, Homo sapien
acacaggctcgctgctgctggaagg

SEQ ID NO: 216118 - DNA, 25 bp, Homo sapien
agaggcacaggtgtcaccagttcca

SEQ ID NO: 216119 - DNA, 25 bp, Homo sapien
gtgtcaccagttccagccaaaggct

SEQ ID NO: 216120 - DNA, 25 bp, Homo sapien
aaaggctcctcacaggcgctgtgaa

SEQ ID NO: 216121 - DNA, 25 bp, Homo sapien
acaggcgctgtgaatttttgtacaa

SEQ ID NO: 216122 - DNA, 25 bp, Homo sapien
ctactggggaccttgctttctggag

SEQ ID NO: 216123 - DNA, 25 bp, Homo sapien
gcacctactgaggatctcggctgtt

SEQ ID NO: 216124 - DNA, 25 bp, Homo sapien
acctactgaggatctcggctgttgg

SEQ ID NO: 216125 - DNA, 25 bp, Homo sapien
agcctcacccgctgggaggcacagg

SEQ ID NO: 216126 - DNA, 25 bp, Homo sapien
ggcacagggcccaagggagctggat

SEQ ID NO: 216127 - DNA, 25 bp, Homo sapien
gctggatgtgttgcccaaggtgtgc

SEQ ID NO: 216128 - DNA, 25 bp, Homo sapien
gcgaagggtatgtgtgtgaccatca

SEQ ID NO: 216129 - DNA, 25 bp, Homo sapien
gggtatgtgtgtgaccatcagcagt

SEQ ID NO: 216130 - DNA, 25 bp, Homo sapien
tgaccatcagcagtggtgtgcacat

SEQ ID NO: 216131 - DNA, 25 bp, Homo sapien
catcagcagtggtgtgcacatggct

SEQ ID NO: 216132 - DNA, 25 bp, Homo sapien
acactcggtgtgagcgccagcggat

SEQ ID NO: 216133 - DNA, 25 bp, Homo sapien
agcccttctaagacccacgagcggg

SEQ ID NO: 216134 - DNA, 25 bp, Homo sapien
ccctgtggacaagatggcatccctg

SEQ ID NO: 216135 - DNA, 25 bp, Homo sapien
atccctggagtctacacctatattt

SEQ ID NO: 216136 - DNA, 25 bp, Homo sapien
acctatatttgcaagtatgtggact

SEQ ID NO: 216137 - DNA, 25 bp, Homo sapien
atgtggactggatccggatgatcat

SEQ ID NO: 216138 - DNA, 25 bp, Homo sapien
gatccggatgatcatgaggaacaac

SEQ ID NO: 216139 - DNA, 25 bp, Homo sapien
aggaacaactgacctgtttcctcca

SEQ ID NO: 216140 - DNA, 25 bp, Homo sapien
tctggccctcagagcaccaatatct

SEQ ID NO: 216141 - DNA, 25 bp, Homo sapien
actcttgttggcctgggaacttctt

SEQ ID NO: 216142 - DNA, 25 bp, Homo sapien
gaacttcttggaactttaactcctg

SEQ ID NO: 216143 - DNA, 25 bp, Homo sapien
tcttggaactttaactcctgccagc

SEQ ID NO: 216144 - DNA, 25 bp, Homo sapien
tcccatccttaatgactcacttgtc

SEQ ID NO: 216145 - DNA, 25 bp, Homo sapien
gactcacttgtcaactagtggacta

SEQ ID NO: 216146 - DNA, 25 bp, Homo sapien
tagtggactaattaaccctccacca

SEQ ID NO: 216147 - DNA, 25 bp, Homo sapien
gcttctgtgagaccaattttgtgct

SEQ ID NO: 216148 - DNA, 25 bp, Homo sapien
gagaccaattttgtgctaatgagca

SEQ ID NO: 216149 - DNA, 25 bp, Homo sapien
gagcattgagactgatgctttgtaa

SEQ ID NO: 216150 - DNA, 25 bp, Homo sapien
aatattgattgagggcgctgcatgt

SEQ ID NO: 216151 - DNA, 25 bp, Homo sapien
gctgcatgtgctgggtacatttctt

SEQ ID NO: 216152 - DNA, 25 bp, Homo sapien
catttcttggcacttgggaatcagt

SEQ ID NO: 216153 - DNA, 25 bp, Homo sapien
ggaatcagtagtcaagcgaaaccct

SEQ ID NO: 216154 - DNA, 25 bp, Homo sapien
agcgaaacccttgcctttgagagtt

SEQ ID NO: 216155 - DNA, 25 bp, Homo sapien
actcatctacgctttccggagcctg

SEQ ID NO: 216156 - DNA, 25 bp, Homo sapien
ttccggagcctggaattgcgcaaca

SEQ ID NO: 216157 - DNA, 25 bp, Homo sapien
ggaattgcgcaacacctttagggag

SEQ ID NO: 216158 - DNA, 25 bp, Homo sapien
aacacctttagggagattctctgtg

SEQ ID NO: 216159 - DNA, 25 bp, Homo sapien
gattctctgtggctgcaacggcatg

SEQ ID NO: 216160 - DNA, 25 bp, Homo sapien
tctgtggctgcaacggcatgaactt

SEQ ID NO: 216161 - DNA, 25 bp, Homo sapien
gctgcaacggcatgaacttgggata

SEQ ID NO: 216162 - DNA, 25 bp, Homo sapien
cacagcaacactcatgcatgaaggg

SEQ ID NO: 216163 - DNA, 25 bp, Homo sapien
attctcctgggcgtgttcatcttct

SEQ ID NO: 216164 - DNA, 25 bp, Homo sapien
tcctgggcgtgttcatcttctgctg

SEQ ID NO: 216165 - DNA, 25 bp, Homo sapien
tacctggtcctcatcatgtgcaact

SEQ ID NO: 216166 - DNA, 25 bp, Homo sapien
ggataaaaggtatttcactggagaa

SEQ ID NO: 216167 - DNA, 25 bp, Homo sapien
tttaaatcctaacacttcactaatt

SEQ ID NO: 216168 - DNA, 25 bp, Homo sapien
aactaaaatttctcatcttcgtact

SEQ ID NO: 216169 - DNA, 25 bp, Homo sapien
atcttcgtacttgatgctcacagag

SEQ ID NO: 216170 - DNA, 25 bp, Homo sapien
gtacttgatgctcacagaggaagaa

SEQ ID NO: 216171 - DNA, 25 bp, Homo sapien
atggtttttattcctggcatccaga

SEQ ID NO: 216172 - DNA, 25 bp, Homo sapien
catccagagtgacagtgaacttaag

SEQ ID NO: 216173 - DNA, 25 bp, Homo sapien
cagtgaacttaagcaaattaccctc

SEQ ID NO: 216174 - DNA, 25 bp, Homo sapien
taccctcctacccaattctatggaa

SEQ ID NO: 216175 - DNA, 25 bp, Homo sapien
gaatattttatacgtctccttgttt

SEQ ID NO: 216176 - DNA, 25 bp, Homo sapien
actgctttactttgatgtatcatat

SEQ ID NO: 216177 - DNA, 25 bp, Homo sapien
tttgctctgtcctccaagaataaat

SEQ ID NO: 216178 - DNA, 25 bp, Homo sapien
ctgtcctccaagaataaatctcaag

SEQ ID NO: 216179 - DNA, 25 bp, Homo sapien
gcaagtgaatttctactaccctctc

SEQ ID NO: 216180 - DNA, 25 bp, Homo sapien
gtgaatttctactaccctctcagtc

SEQ ID NO: 216181 - DNA, 25 bp, Homo sapien
ctctcagtcaccatgttgcagactt

SEQ ID NO: 216182 - DNA, 25 bp, Homo sapien
agtcaccatgttgcagactttccct

SEQ ID NO: 216183 - DNA, 25 bp, Homo sapien
atgttgcagactttccctgtctgga

SEQ ID NO: 216184 - DNA, 25 bp, Homo sapien
tgcagactttccctgtctggaggct

SEQ ID NO: 216185 - DNA, 25 bp, Homo sapien
tgtctggaggctcaccttagagctt

SEQ ID NO: 216186 - DNA, 25 bp, Homo sapien
gaggctcaccttagagcttctgagt

SEQ ID NO: 216187 - DNA, 25 bp, Homo sapien
caccttagagcttctgagtttccaa

SEQ ID NO: 216188 - DNA, 25 bp, Homo sapien
tttgtgttttcttgagtgtcacttg

SEQ ID NO: 216189 - DNA, 25 bp, Homo sapien
gagtgtcacttgataggctatgcat

SEQ ID NO: 216190 - DNA, 25 bp, Homo sapien
gataggctatgcatattggaattca

SEQ ID NO: 216191 - DNA, 25 bp, Homo sapien
gaattcaaagaaacccatactctag

SEQ ID NO: 216192 - DNA, 25 bp, Homo sapien
atactctagtcgtttctgcatttcc

SEQ ID NO: 216193 - DNA, 25 bp, Homo sapien
gcatgggatcatatttaaacaattg

SEQ ID NO: 216194 - DNA, 25 bp, Homo sapien
gaaacagtgtttttaggtcagacca

SEQ ID NO: 216195 - DNA, 25 bp, Homo sapien
ttaggtcagaccaggcttttggcct

SEQ ID NO: 216196 - DNA, 25 bp, Homo sapien
gaccaggcttttggcctttcaaaat

SEQ ID NO: 216197 - DNA, 25 bp, Homo sapien
gaaagcactttagtgacttggattt

SEQ ID NO: 216198 - DNA, 25 bp, Homo sapien
ctgcgtttcctttgccatttattta

SEQ ID NO: 216199 - DNA, 25 bp, Homo sapien
caaacgtatggaatgcttcttaaag

SEQ ID NO: 216200 - DNA, 25 bp, Homo sapien
gggaactgtcaagctggtgtcttca

SEQ ID NO: 216201 - DNA, 25 bp, Homo sapien
gctggtgtcttcagccagatgacat

SEQ ID NO: 216202 - DNA, 25 bp, Homo sapien
gaaccctctctccaaggtgtttcta

SEQ ID NO: 216203 - DNA, 25 bp, Homo sapien
aggtgtttctagatagcacaggaga

SEQ ID NO: 216204 - DNA, 25 bp, Homo sapien
aggagagcaggcactgcactgtcca

SEQ ID NO: 216205 - DNA, 25 bp, Homo sapien
acagtccacggtacacagtcgggtg

SEQ ID NO: 216206 - DNA, 25 bp, Homo sapien
ggagcattcgtcgtgcccagcctga

SEQ ID NO: 216207 - DNA, 25 bp, Homo sapien
agagccttcctctctttgtaccaca

SEQ ID NO: 216208 - DNA, 25 bp, Homo sapien
ctttgtaccacagtttcttctgtaa

SEQ ID NO: 216209 - DNA, 25 bp, Homo sapien
gtaaatccagtgttacaatcagtgt

SEQ ID NO: 216210 - DNA, 25 bp, Homo sapien
ggatgatatcatccagtctttatat

SEQ ID NO: 216211 - DNA, 25 bp, Homo sapien
atccagtctttatatgttgccaata

SEQ ID NO: 216212 - DNA, 25 bp, Homo sapien
gttgccaatatacctcattgtgtgt

SEQ ID NO: 216213 - DNA, 25 bp, Homo sapien
cattgtgtgtaatagaaccttctta

SEQ ID NO: 216214 - DNA, 25 bp, Homo sapien
gaaccttcttagcattaagaccttg

SEQ ID NO: 216215 - DNA, 25 bp, Homo sapien
atttttgtcctaattgtaatgtgta

SEQ ID NO: 216216 - DNA, 25 bp, Homo sapien
gatgcttcagagctcatgcgcgtta

SEQ ID NO: 216217 - DNA, 25 bp, Homo sapien
atgcgcgttacccacgatggcatga

SEQ ID NO: 216218 - DNA, 25 bp, Homo sapien
cgatggcatgactagcacagagctg

SEQ ID NO: 216219 - DNA, 25 bp, Homo sapien
tagcacagagctgatctctgtttct

SEQ ID NO: 216220 - DNA, 25 bp, Homo sapien
ttgctttattccctcttgggatgat

SEQ ID NO: 216221 - DNA, 25 bp, Homo sapien
ctgtgaagtcaagaatcacttgccg

SEQ ID NO: 216222 - DNA, 25 bp, Homo sapien
tgtgaagtcaagaatcacttgccgg

SEQ ID NO: 216223 - DNA, 25 bp, Homo sapien
gtgaagtcaagaatcacttgccggc

SEQ ID NO: 216224 - DNA, 25 bp, Homo sapien
tgaagtcaagaatcacttgccggcc

SEQ ID NO: 216225 - DNA, 25 bp, Homo sapien
gaagtcaagaatcacttgccggccg

SEQ ID NO: 216226 - DNA, 25 bp, Homo sapien
aagtcaagaatcacttgccggccgg

SEQ ID NO: 216227 - DNA, 25 bp, Homo sapien
agtcaagaatcacttgccggccggg

SEQ ID NO: 216228 - DNA, 25 bp, Homo sapien
gtcaagaatcacttgccggccgggt

SEQ ID NO: 216229 - DNA, 25 bp, Homo sapien
tcaagaatcacttgccggccgggtg

SEQ ID NO: 216230 - DNA, 25 bp, Homo sapien
caagaatcacttgccggccgggtgt

SEQ ID NO: 216231 - DNA, 25 bp, Homo sapien
agaatcacttgccggccgggtgtgg

SEQ ID NO: 216232 - DNA, 25 bp, Homo sapien
caaggtagggctgcagcactgatgc

SEQ ID NO: 216233 - DNA, 25 bp, Homo sapien
ggtagggctgcagcactgatgccca

SEQ ID NO: 216234 - DNA, 25 bp, Homo sapien
tagggctgcagcactgatgcccagg

SEQ ID NO: 216235 - DNA, 25 bp, Homo sapien
cctcgctgctctttctgctggtgaa

SEQ ID NO: 216236 - DNA, 25 bp, Homo sapien
tcgctgctctttctgctggtgaacg

SEQ ID NO: 216237 - DNA, 25 bp, Homo sapien
gctgctctttctgctggtgaacgtg

SEQ ID NO: 216238 - DNA, 25 bp, Homo sapien
tgctctttctgctggtgaacgtgct

SEQ ID NO: 216239 - DNA, 25 bp, Homo sapien
ctctttctgctggtgaacgtgctgt

SEQ ID NO: 216240 - DNA, 25 bp, Homo sapien
ctttctgctggtgaacgtgctgtgt

SEQ ID NO: 216241 - DNA, 25 bp, Homo sapien
ttctgctggtgaacgtgctgtgtgc

SEQ ID NO: 216242 - DNA, 25 bp, Homo sapien
tgctggtgaacgtgctgtgtgctgt

SEQ ID NO: 216243 - DNA, 25 bp, Homo sapien
tagctgggcacggtgttgtacctct

SEQ ID NO: 216244 - DNA, 25 bp, Homo sapien
agctgggcacggtgttgtacctcta

SEQ ID NO: 216245 - DNA, 25 bp, Homo sapien
gctgggcacggtgttgtacctctag

SEQ ID NO: 216246 - DNA, 25 bp, Homo sapien
ctgggcacggtgttgtacctctagt

SEQ ID NO: 216247 - DNA, 25 bp, Homo sapien
tgggcacggtgttgtacctctagtc

SEQ ID NO: 216248 - DNA, 25 bp, Homo sapien
gggcacggtgttgtacctctagtcc

SEQ ID NO: 216249 - DNA, 25 bp, Homo sapien
ggcacggtgttgtacctctagtccc

SEQ ID NO: 216250 - DNA, 25 bp, Homo sapien
gcacggtgttgtacctctagtccca

SEQ ID NO: 216251 - DNA, 25 bp, Homo sapien
gatcctttgagggtgctggtagcag

SEQ ID NO: 216252 - DNA, 25 bp, Homo sapien
ggacaaagttgaccaaggacactta

SEQ ID NO: 216253 - DNA, 25 bp, Homo sapien
ggacacttatttctagattatgatt

SEQ ID NO: 216254 - DNA, 25 bp, Homo sapien
gacattgaagagctacacattgtat

SEQ ID NO: 216255 - DNA, 25 bp, Homo sapien
ttgtatatatatcaccacagactat

SEQ ID NO: 216256 - DNA, 25 bp, Homo sapien
ggaattatttccctctttgtcacat

SEQ ID NO: 216257 - DNA, 25 bp, Homo sapien
ttatttccctctttgtcacatatct

SEQ ID NO: 216258 - DNA, 25 bp, Homo sapien
atgatccatttgctgtttcttgttt

SEQ ID NO: 216259 - DNA, 25 bp, Homo sapien
ttgctgtttcttgttttccaaaggt

SEQ ID NO: 216260 - DNA, 25 bp, Homo sapien
ggtcatacattgtgtttggttattg

SEQ ID NO: 216261 - DNA, 25 bp, Homo sapien
gtttggttattgttaccagctcaat

SEQ ID NO: 216262 - DNA, 25 bp, Homo sapien
aggagctagatgagaccctgtcgga

SEQ ID NO: 216263 - DNA, 25 bp, Homo sapien
gatgagaccctgtcggagagactat

SEQ ID NO: 216264 - DNA, 25 bp, Homo sapien
gcggccggagccacttttgatcttt

SEQ ID NO: 216265 - DNA, 25 bp, Homo sapien
ctttccctctttgtggctcagaaaa

SEQ ID NO: 216266 - DNA, 25 bp, Homo sapien
ggcagccttgtggattgggaccact

SEQ ID NO: 216267 - DNA, 25 bp, Homo sapien
attgggaccacttcctttatgatcc

SEQ ID NO: 216268 - DNA, 25 bp, Homo sapien
tttatgatcctggttcttcccgttg

SEQ ID NO: 216269 - DNA, 25 bp, Homo sapien
ttcttcccgttgtctttgagacgga

SEQ ID NO: 216270 - DNA, 25 bp, Homo sapien
gcagcagcggcagatacttctagga

SEQ ID NO: 216271 - DNA, 25 bp, Homo sapien
gatacttctaggacctaacacaggg

SEQ ID NO: 216272 - DNA, 25 bp, Homo sapien
aacacagggctctcaggaggaatgc

SEQ ID NO: 216273 - DNA, 25 bp, Homo sapien
tgttctccgtggtggaattgaccga

SEQ ID NO: 216274 - DNA, 25 bp, Homo sapien
ggaattgaccgaaagctctatgttt

SEQ ID NO: 216275 - DNA, 25 bp, Homo sapien
tgccgcactgccttgtgggtggctt

SEQ ID NO: 216276 - DNA, 25 bp, Homo sapien
gcgctcgtgattgcttcctgtgaac

SEQ ID NO: 216277 - DNA, 25 bp, Homo sapien
ctgtgaacgcctcccaaggacgagc

SEQ ID NO: 216278 - DNA, 25 bp, Homo sapien
aaggacgagcccagtgtagttgtgt

SEQ ID NO: 216279 - DNA, 25 bp, Homo sapien
agttgtgtgggcgtgaactctgccc

SEQ ID NO: 216280 - DNA, 25 bp, Homo sapien
aactctgcccgtgtgttctcaaatt

SEQ ID NO: 216281 - DNA, 25 bp, Homo sapien
tgttctcaaattccccagcttggga

SEQ ID NO: 216282 - DNA, 25 bp, Homo sapien
tagcccttggtgtgggttttatctc

SEQ ID NO: 216283 - DNA, 25 bp, Homo sapien
tttatctctggtttgtgttctccgt

SEQ ID NO: 216284 - DNA, 25 bp, Homo sapien
tggagtcaggtgtcgaggccacatt

SEQ ID NO: 216285 - DNA, 25 bp, Homo sapien
tgtcgaggccacattgctggctgcc

SEQ ID NO: 216286 - DNA, 25 bp, Homo sapien
cccctctttgtagctcctataaagg

SEQ ID NO: 216287 - DNA, 25 bp, Homo sapien
ctataaagggcccacacctggtgga

SEQ ID NO: 216288 - DNA, 25 bp, Homo sapien
acacctggtggatacctggttgagc

SEQ ID NO: 216289 - DNA, 25 bp, Homo sapien
gatacctggttgagcgtgtggtctc

SEQ ID NO: 216290 - DNA, 25 bp, Homo sapien
gttgagcgtgtggtctctgccccag

SEQ ID NO: 216291 - DNA, 25 bp, Homo sapien
tgtccttgtcacgatcacaggcctt

SEQ ID NO: 216292 - DNA, 25 bp, Homo sapien
cggcctgtctcatcttctgaagagg

SEQ ID NO: 216293 - DNA, 25 bp, Homo sapien
agtcaaagtgttgctgtggctccat

SEQ ID NO: 216294 - DNA, 25 bp, Homo sapien
gctgtggctccatatttcaactaaa

SEQ ID NO: 216295 - DNA, 25 bp, Homo sapien
taatgtatctatttgctgcattgta

SEQ ID NO: 216296 - DNA, 25 bp, Homo sapien
gtatctatttgctgcattgtatatg

SEQ ID NO: 216297 - DNA, 25 bp, Homo sapien
ctatttgctgcattgtatatggatt

SEQ ID NO: 216298 - DNA, 25 bp, Homo sapien
tttgctgcattgtatatggattaaa

SEQ ID NO: 216299 - DNA, 25 bp, Homo sapien
aaaacaagtaatctaccctcagagc

SEQ ID NO: 216300 - DNA, 25 bp, Homo sapien
aacaagtaatctaccctcagagcca

SEQ ID NO: 216301 - DNA, 25 bp, Homo sapien
aagtaatctaccctcagagccatgt

SEQ ID NO: 216302 - DNA, 25 bp, Homo sapien
gagccatgtatttgagaatgcttca

SEQ ID NO: 216303 - DNA, 25 bp, Homo sapien
gagaatgcttcaatcatattttcct

SEQ ID NO: 216304 - DNA, 25 bp, Homo sapien
agaatgcttcaatcatattttccta

SEQ ID NO: 216305 - DNA, 25 bp, Homo sapien
cattatattgtttcaggattttgtc

SEQ ID NO: 216306 - DNA, 25 bp, Homo sapien
agatgggtctgatccgccgccgccc

SEQ ID NO: 216307 - DNA, 25 bp, Homo sapien
gatgggtctgatccgccgccgcccc

SEQ ID NO: 216308 - DNA, 25 bp, Homo sapien
acggagcccttcacgggacgctaca

SEQ ID NO: 216309 - DNA, 25 bp, Homo sapien
cggagcccttcacgggacgctacag

SEQ ID NO: 216310 - DNA, 25 bp, Homo sapien
cttcacgggacgctacagcctgtgc

SEQ ID NO: 216311 - DNA, 25 bp, Homo sapien
ttcacgggacgctacagcctgtgcc

SEQ ID NO: 216312 - DNA, 25 bp, Homo sapien
tcacgggacgctacagcctgtgccg

SEQ ID NO: 216313 - DNA, 25 bp, Homo sapien
cacgggacgctacagcctgtgccgg

SEQ ID NO: 216314 - DNA, 25 bp, Homo sapien
acgggacgctacagcctgtgccggg

SEQ ID NO: 216315 - DNA, 25 bp, Homo sapien
cgggacgctacagcctgtgccgggc

SEQ ID NO: 216316 - DNA, 25 bp, Homo sapien
gggacgctacagcctgtgccgggcc

SEQ ID NO: 216317 - DNA, 25 bp, Homo sapien
gatgataccttaattacactcccgc

SEQ ID NO: 216318 - DNA, 25 bp, Homo sapien
tattgtctagctccagttatctgta

SEQ ID NO: 216319 - DNA, 25 bp, Homo sapien
gtaattgacaggatggctgctgcag

SEQ ID NO: 216320 - DNA, 25 bp, Homo sapien
gctgctgcagaatgctggttgacac

SEQ ID NO: 216321 - DNA, 25 bp, Homo sapien
gacacagggattattatactgctat

SEQ ID NO: 216322 - DNA, 25 bp, Homo sapien
actgctatttttccctgaattcttt

SEQ ID NO: 216323 - DNA, 25 bp, Homo sapien
ttggaattccaactgtggacctttt

SEQ ID NO: 216324 - DNA, 25 bp, Homo sapien
caactgtggaccttttatatgtgcc

SEQ ID NO: 216325 - DNA, 25 bp, Homo sapien
gccttcactttagctgtttgcctta

SEQ ID NO: 216326 - DNA, 25 bp, Homo sapien
ctttagctgtttgccttactctaca

SEQ ID NO: 216327 - DNA, 25 bp, Homo sapien
ttactctacagccttgctctccggg

SEQ ID NO: 216328 - DNA, 25 bp, Homo sapien
tcttttgttttcctacacgatttat

SEQ ID NO: 216329 - DNA, 25 bp, Homo sapien
ttgttttcctacacgatttatagag

SEQ ID NO: 216330 - DNA, 25 bp, Homo sapien
gaaaaaagggatgagctagctgtta

SEQ ID NO: 216331 - DNA, 25 bp, Homo sapien
gagctagctgttagagcaagggttt

SEQ ID NO: 216332 - DNA, 25 bp, Homo sapien
gcaagggttttggtgagagataata

SEQ ID NO: 216333 - DNA, 25 bp, Homo sapien
ggattcattgtaactctccttgtga

SEQ ID NO: 216334 - DNA, 25 bp, Homo sapien
attgtaactctccttgtgaactgct

SEQ ID NO: 216335 - DNA, 25 bp, Homo sapien
gtaactctccttgtgaactgctcag

SEQ ID NO: 216336 - DNA, 25 bp, Homo sapien
actctccttgtgaactgctcagtaa

SEQ ID NO: 216337 - DNA, 25 bp, Homo sapien
gaactgctcagtaaactctacattg

SEQ ID NO: 216338 - DNA, 25 bp, Homo sapien
gtaaactctacattgttcatgaaca

SEQ ID NO: 216339 - DNA, 25 bp, Homo sapien
aaagccagggcaaaggacctggcgt

SEQ ID NO: 216340 - DNA, 25 bp, Homo sapien
ggcaaaggacctggcgtggccactt

SEQ ID NO: 216341 - DNA, 25 bp, Homo sapien
aaaggacctggcgtggccacttcct

SEQ ID NO: 216342 - DNA, 25 bp, Homo sapien
aaggacctggcgtggccacttcctc

SEQ ID NO: 216343 - DNA, 25 bp, Homo sapien
cagcccaacctctgggaacaggcag

SEQ ID NO: 216344 - DNA, 25 bp, Homo sapien
tctgggaacaggcagctcctatctg

SEQ ID NO: 216345 - DNA, 25 bp, Homo sapien
ctgggaacaggcagctcctatctgc

SEQ ID NO: 216346 - DNA, 25 bp, Homo sapien
tgggaacaggcagctcctatctgca

SEQ ID NO: 216347 - DNA, 25 bp, Homo sapien
agctcctatctgcaaactgtgttca

SEQ ID NO: 216348 - DNA, 25 bp, Homo sapien
gctcctatctgcaaactgtgttcac

SEQ ID NO: 216349 - DNA, 25 bp, Homo sapien
ctcctatctgcaaactgtgttcacc

SEQ ID NO: 216350 - DNA, 25 bp, Homo sapien
gagggcgacaagttcaagctgagta

SEQ ID NO: 216351 - DNA, 25 bp, Homo sapien
ggaacttctgcacaaggagctgccc

SEQ ID NO: 216352 - DNA, 25 bp, Homo sapien
aggagtatgctgttttcctggcact

SEQ ID NO: 216353 - DNA, 25 bp, Homo sapien
tatgctgttttcctggcactcatca

SEQ ID NO: 216354 - DNA, 25 bp, Homo sapien
ggcactcatcactgtcatgtgcaat

SEQ ID NO: 216355 - DNA, 25 bp, Homo sapien
gtgcaatgacttcttccagggctgc

SEQ ID NO: 216356 - DNA, 25 bp, Homo sapien
agggctgcccagaccgaccctgaag

SEQ ID NO: 216357 - DNA, 25 bp, Homo sapien
gaccctgaagcagaactcttgactt

SEQ ID NO: 216358 - DNA, 25 bp, Homo sapien
ttgacttcctgccatggatctcttg

SEQ ID NO: 216359 - DNA, 25 bp, Homo sapien
ctcttgggcccaggactgttgatgc

SEQ ID NO: 216360 - DNA, 25 bp, Homo sapien
ccaggactgttgatgcctttgagtt

SEQ ID NO: 216361 - DNA, 25 bp, Homo sapien
tgtgccttcatctactagcactatg

SEQ ID NO: 216362 - DNA, 25 bp, Homo sapien
acaggcccattgattagcagttctc

SEQ ID NO: 216363 - DNA, 25 bp, Homo sapien
ctcagggtagaaacagtcctgcctt

SEQ ID NO: 216364 - DNA, 25 bp, Homo sapien
tgccttggctgtaatgacagcatct

SEQ ID NO: 216365 - DNA, 25 bp, Homo sapien
tgtggctaacatacaggctactgaa

SEQ ID NO: 216366 - DNA, 25 bp, Homo sapien
ggctactgaattttccttgcaacag

SEQ ID NO: 216367 - DNA, 25 bp, Homo sapien
tttccttgcaacaggtgaataccaa

SEQ ID NO: 216368 - DNA, 25 bp, Homo sapien
aacgaaagtattcctcacgctgtct

SEQ ID NO: 216369 - DNA, 25 bp, Homo sapien
atttctccatcaccaaaggccatgg

SEQ ID NO: 216370 - DNA, 25 bp, Homo sapien
aaaggccatggtcgccagagttgtt

SEQ ID NO: 216371 - DNA, 25 bp, Homo sapien
agagttgtttcttcaacatgtctca

SEQ ID NO: 216372 - DNA, 25 bp, Homo sapien
caccccagctggtctgcttggattt

SEQ ID NO: 216373 - DNA, 25 bp, Homo sapien
ccagctggtctgcttggatttccta

SEQ ID NO: 216374 - DNA, 25 bp, Homo sapien
agctggtctgcttggatttcctaca

SEQ ID NO: 216375 - DNA, 25 bp, Homo sapien
gctggtctgcttggatttcctacag

SEQ ID NO: 216376 - DNA, 25 bp, Homo sapien
ctggtctgcttggatttcctacagc

SEQ ID NO: 216377 - DNA, 25 bp, Homo sapien
gtgggcatggaccacctttatttta

SEQ ID NO: 216378 - DNA, 25 bp, Homo sapien
aaaagttagtggactgcagccctgg

SEQ ID NO: 216379 - DNA, 25 bp, Homo sapien
gacctgggcctgacgggcccttctc

SEQ ID NO: 216380 - DNA, 25 bp, Homo sapien
cgggcccttctcagcccgttttgag

SEQ ID NO: 216381 - DNA, 25 bp, Homo sapien
tctcagcccgttttgaggacagaca

SEQ ID NO: 216382 - DNA, 25 bp, Homo sapien
agacagtcccccgaggtaggctaca

SEQ ID NO: 216383 - DNA, 25 bp, Homo sapien
gctattctcatccagccatattagt

SEQ ID NO: 216384 - DNA, 25 bp, Homo sapien
tctcatccagccatattagtcttct

SEQ ID NO: 216385 - DNA, 25 bp, Homo sapien
agccatattagtcttctggcttttc

SEQ ID NO: 216386 - DNA, 25 bp, Homo sapien
agcttcatcaaataagcatgttgtg

SEQ ID NO: 216387 - DNA, 25 bp, Homo sapien
gatagatgtacaattccaacaaggt

SEQ ID NO: 216388 - DNA, 25 bp, Homo sapien
atcacttctagtttaataatacata

SEQ ID NO: 216389 - DNA, 25 bp, Homo sapien
atacatacatgatttttcttctgaa

SEQ ID NO: 216390 - DNA, 25 bp, Homo sapien
tcttctccctgcatcactgttcatt

SEQ ID NO: 216391 - DNA, 25 bp, Homo sapien
atcactgttcattcacaatgaaagg

SEQ ID NO: 216392 - DNA, 25 bp, Homo sapien
aaattcactattttactatcaatca

SEQ ID NO: 216393 - DNA, 25 bp, Homo sapien
cactattttactatcaatcatttgt

SEQ ID NO: 216394 - DNA, 25 bp, Homo sapien
tctgagtttccaagctctgagtcac

SEQ ID NO: 216395 - DNA, 25 bp, Homo sapien
ctgagtttccaagctctgagtcacc

SEQ ID NO: 216396 - DNA, 25 bp, Homo sapien
agctctgagtcacctccacatttgg

SEQ ID NO: 216397 - DNA, 25 bp, Homo sapien
tgagtcacctccacatttgggcatg

SEQ ID NO: 216398 - DNA, 25 bp, Homo sapien
agtcacctccacatttgggcatggc

SEQ ID NO: 216399 - DNA, 25 bp, Homo sapien
tcacctccacatttgggcatggcat

SEQ ID NO: 216400 - DNA, 25 bp, Homo sapien
acctccacatttgggcatggcatct

SEQ ID NO: 216401 - DNA, 25 bp, Homo sapien
ccacatttgggcatggcatcttcaa

SEQ ID NO: 216402 - DNA, 25 bp, Homo sapien
acatttgggcatggcatcttcaaaa

SEQ ID NO: 216403 - DNA, 25 bp, Homo sapien
tgggcatggcatcttcaaaacaatt

SEQ ID NO: 216404 - DNA, 25 bp, Homo sapien
gcatggcatcttcaaaacaattaat

SEQ ID NO: 216405 - DNA, 25 bp, Homo sapien
gaaggccctgaaagtaagtggttct

SEQ ID NO: 216406 - DNA, 25 bp, Homo sapien
ggccctgaaagtaagtggttcttct

SEQ ID NO: 216407 - DNA, 25 bp, Homo sapien
gccctgaaagtaagtggttcttctg

SEQ ID NO: 216408 - DNA, 25 bp, Homo sapien
cctgaaagtaagtggttcttctgac

SEQ ID NO: 216409 - DNA, 25 bp, Homo sapien
gaaagtaagtggttcttctgactgc

SEQ ID NO: 216410 - DNA, 25 bp, Homo sapien
aaagtaagtggttcttctgactgcc

SEQ ID NO: 216411 - DNA, 25 bp, Homo sapien
taggaaccaattcccagtaaaactg

SEQ ID NO: 216412 - DNA, 25 bp, Homo sapien
ggaaagaatctttccagaatcatcc

SEQ ID NO: 216413 - DNA, 25 bp, Homo sapien
gaatcatcccatggataatgatgac

SEQ ID NO: 216414 - DNA, 25 bp, Homo sapien
aatcatcccatggataatgatgacg

SEQ ID NO: 216415 - DNA, 25 bp, Homo sapien
tatgtaaaaaagtgcacctttagtt

SEQ ID NO: 216416 - DNA, 25 bp, Homo sapien
ctttgggcttcagttcactcaggaa

SEQ ID NO: 216417 - DNA, 25 bp, Homo sapien
tgtcgccatctttatgtgcttccag

SEQ ID NO: 216418 - DNA, 25 bp, Homo sapien
gccatctttatgtgcttccagtgga

SEQ ID NO: 216419 - DNA, 25 bp, Homo sapien
gcttccagtggaaatgtcacttgct

SEQ ID NO: 216420 - DNA, 25 bp, Homo sapien
gtcacttgctacagacaatagtgca

SEQ ID NO: 216421 - DNA, 25 bp, Homo sapien
gaagtagtgaccagaacagggcaga

SEQ ID NO: 216422 - DNA, 25 bp, Homo sapien
aacagggcagagtaggtcccctcca

SEQ ID NO: 216423 - DNA, 25 bp, Homo sapien
gtaggtcccctccatggccctgaat

SEQ ID NO: 216424 - DNA, 25 bp, Homo sapien
tgaatcctcctctgctccagggctg

SEQ ID NO: 216425 - DNA, 25 bp, Homo sapien
gctggcctctgcagagctgattaaa

SEQ ID NO: 216426 - DNA, 25 bp, Homo sapien
cagtgttgtgactgtctcatgggaa

SEQ ID NO: 216427 - DNA, 25 bp, Homo sapien
ctgggtcagagagaggagtcctttt

SEQ ID NO: 216428 - DNA, 25 bp, Homo sapien
gagtcctttttgtcatgcccttaag

SEQ ID NO: 216429 - DNA, 25 bp, Homo sapien
ttgtcatgcccttaagttcagcaac

SEQ ID NO: 216430 - DNA, 25 bp, Homo sapien
tcagcaactgtttaacctgttttca

SEQ ID NO: 216431 - DNA, 25 bp, Homo sapien
gttttcagtcttatttacgtcgtca

SEQ ID NO: 216432 - DNA, 25 bp, Homo sapien
atgatttagtacttgttccctctgt

SEQ ID NO: 216433 - DNA, 25 bp, Homo sapien
gttccctctgttgggatgccagttg

SEQ ID NO: 216434 - DNA, 25 bp, Homo sapien
cagtttgtacgatttctttgtatgt

SEQ ID NO: 216435 - DNA, 25 bp, Homo sapien
gtatgtatttctgatgtgttctctg

SEQ ID NO: 216436 - DNA, 25 bp, Homo sapien
ttctgatgtgttctctgatctgccc

SEQ ID NO: 216437 - DNA, 25 bp, Homo sapien
ttacctggtgctctcaacaggactt

SEQ ID NO: 216438 - DNA, 25 bp, Homo sapien
tcttccgtttctaccgggaatcgct

SEQ ID NO: 216439 - DNA, 25 bp, Homo sapien
gtttctaccgggaatcgctgcagag

SEQ ID NO: 216440 - DNA, 25 bp, Homo sapien
gaatcgctgcagaggcgttactcca

SEQ ID NO: 216441 - DNA, 25 bp, Homo sapien
gctgcagaggcgttactccaagagc

SEQ ID NO: 216442 - DNA, 25 bp, Homo sapien
cagaggcgttactccaagagctgag

SEQ ID NO: 216443 - DNA, 25 bp, Homo sapien
ctctctgacccatgggctccttgag

SEQ ID NO: 216444 - DNA, 25 bp, Homo sapien
tctgtaaccacagggctcctgtggg

SEQ ID NO: 216445 - DNA, 25 bp, Homo sapien
agatccccccagcaaggataacatt

SEQ ID NO: 216446 - DNA, 25 bp, Homo sapien
aaggataacattcaaaggagctcac

SEQ ID NO: 216447 - DNA, 25 bp, Homo sapien
tcaaaggagctcacatttatggaat

SEQ ID NO: 216448 - DNA, 25 bp, Homo sapien
gagctcacatttatggaatggatga

SEQ ID NO: 216449 - DNA, 25 bp, Homo sapien
aaacctccccgggtgatgtctgcaa

SEQ ID NO: 216450 - DNA, 25 bp, Homo sapien
cccgggtgatgtctgcaaagtctgt

SEQ ID NO: 216451 - DNA, 25 bp, Homo sapien
gtctgcaaagtctgtgctgtccgtg

SEQ ID NO: 216452 - DNA, 25 bp, Homo sapien
gccccaggctgggagagctatctgg

SEQ ID NO: 216453 - DNA, 25 bp, Homo sapien
aggaggccgagcagaatacacccca

SEQ ID NO: 216454 - DNA, 25 bp, Homo sapien
cgagcagaatacaccccagagttag

SEQ ID NO: 216455 - DNA, 25 bp, Homo sapien
tacaccccagagttagggtttgcga

SEQ ID NO: 216456 - DNA, 25 bp, Homo sapien
agagttagggtttgcgactccgcct

SEQ ID NO: 216457 - DNA, 25 bp, Homo sapien
ttgactgcttaggaggcgcgacgca

SEQ ID NO: 216458 - DNA, 25 bp, Homo sapien
gactgcttaggaggcgcgacgcaca

SEQ ID NO: 216459 - DNA, 25 bp, Homo sapien
aggcctggcccctctctgggaaggt

SEQ ID NO: 216460 - DNA, 25 bp, Homo sapien
gatgaaggcttgatctaaaatagta

SEQ ID NO: 216461 - DNA, 25 bp, Homo sapien
aatagtataaggtctccagcttcag

SEQ ID NO: 216462 - DNA, 25 bp, Homo sapien
tagtataaggtctccagcttcagta

SEQ ID NO: 216463 - DNA, 25 bp, Homo sapien
gtataaggtctccagcttcagtaaa

SEQ ID NO: 216464 - DNA, 25 bp, Homo sapien
ataaggtctccagcttcagtaaaag

SEQ ID NO: 216465 - DNA, 25 bp, Homo sapien
aaggtctccagcttcagtaaaagtt

SEQ ID NO: 216466 - DNA, 25 bp, Homo sapien
ggtctccagcttcagtaaaagtttt

SEQ ID NO: 216467 - DNA, 25 bp, Homo sapien
ctccagcttcagtaaaagtttttag

SEQ ID NO: 216468 - DNA, 25 bp, Homo sapien
actttctgtctggttaaaatgtctt

SEQ ID NO: 216469 - DNA, 25 bp, Homo sapien
ttctgtctggttaaaatgtcttaaa

SEQ ID NO: 216470 - DNA, 25 bp, Homo sapien
caaaattacatttctcataaattgt

SEQ ID NO: 216471 - DNA, 25 bp, Homo sapien
gtaatccttttagagcccgaagagt

SEQ ID NO: 216472 - DNA, 25 bp, Homo sapien
ttagagcccgaagagtcaaaaccct

SEQ ID NO: 216473 - DNA, 25 bp, Homo sapien
gagtcaaaaccctcaatgttccctc

SEQ ID NO: 216474 - DNA, 25 bp, Homo sapien
tcctgccccatgtcaacaaatttca

SEQ ID NO: 216475 - DNA, 25 bp, Homo sapien
atttcaggctaaggatgccccagac

SEQ ID NO: 216476 - DNA, 25 bp, Homo sapien
agacccagggctctaaccttgtatg

SEQ ID NO: 216477 - DNA, 25 bp, Homo sapien
ctaaccttgtatgcgggcaggccca

SEQ ID NO: 216478 - DNA, 25 bp, Homo sapien
agtgttcttcccctcagagtgactt

SEQ ID NO: 216479 - DNA, 25 bp, Homo sapien
ataggaggagacgtccagctctgtc

SEQ ID NO: 216480 - DNA, 25 bp, Homo sapien
gaggaacaggactttctccacattg

SEQ ID NO: 216481 - DNA, 25 bp, Homo sapien
ggactttctccacattgttttgtat

SEQ ID NO: 216482 - DNA, 25 bp, Homo sapien
tccactagcatctacctggaggcca

SEQ ID NO: 216483 - DNA, 25 bp, Homo sapien
actagcatctacctggaggccaagg

SEQ ID NO: 216484 - DNA, 25 bp, Homo sapien
caaggtgaagcgtcggccggagatg

SEQ ID NO: 216485 - DNA, 25 bp, Homo sapien
atgagccgaggcttgctcgctgtcc

SEQ ID NO: 216486 - DNA, 25 bp, Homo sapien
gagccgaggcttgctcgctgtccga

SEQ ID NO: 216487 - DNA, 25 bp, Homo sapien
tgcttgtccgcgtcctggtgagcga

SEQ ID NO: 216488 - DNA, 25 bp, Homo sapien
ttgtccgcgtcctggtgagcgactc

SEQ ID NO: 216489 - DNA, 25 bp, Homo sapien
tggtgagcgactccctgttcgtcat

SEQ ID NO: 216490 - DNA, 25 bp, Homo sapien
tgagcgactccctgttcgtcatctg

SEQ ID NO: 216491 - DNA, 25 bp, Homo sapien
tgttcgtcatctgcgcgctgtctct

SEQ ID NO: 216492 - DNA, 25 bp, Homo sapien
atctgcgcgctgtctcttgctgcct

SEQ ID NO: 216493 - DNA, 25 bp, Homo sapien
aatgttataattttgtgtctgtctt

SEQ ID NO: 216494 - DNA, 25 bp, Homo sapien
attttgtgtctgtctttataaacta

SEQ ID NO: 216495 - DNA, 25 bp, Homo sapien
taagtactatttttgttataattca

SEQ ID NO: 216496 - DNA, 25 bp, Homo sapien
gaattttgctctattgtaaacatgg

SEQ ID NO: 216497 - DNA, 25 bp, Homo sapien
tgctctattgtaaacatggttcaaa

SEQ ID NO: 216498 - DNA, 25 bp, Homo sapien
aatatgtttttatcacagtcgtttt

SEQ ID NO: 216499 - DNA, 25 bp, Homo sapien
gtttttatcacagtcgttttaatat

SEQ ID NO: 216500 - DNA, 25 bp, Homo sapien
atcacagtcgttttaatattgaaaa

SEQ ID NO: 216501 - DNA, 25 bp, Homo sapien
gatatgaaactggtaccgtgtgagt

SEQ ID NO: 216502 - DNA, 25 bp, Homo sapien
accgtgtgagtgtttttgctgtcgt

SEQ ID NO: 216503 - DNA, 25 bp, Homo sapien
gagtgtttttgctgtcgtggtttta

SEQ ID NO: 216504 - DNA, 25 bp, Homo sapien
atttacatgtgatgtctggtctgaa

SEQ ID NO: 216505 - DNA, 25 bp, Homo sapien
ctggtctgaatgcacaagctaagag

SEQ ID NO: 216506 - DNA, 25 bp, Homo sapien
gtctgaatgcacaagctaagagagc

SEQ ID NO: 216507 - DNA, 25 bp, Homo sapien
aaaaccacgtttctttgttgagctg

SEQ ID NO: 216508 - DNA, 25 bp, Homo sapien
acgtttctttgttgagctgtgtctt

SEQ ID NO: 216509 - DNA, 25 bp, Homo sapien
gttgagctgtgtcttgaaggcaaaa

SEQ ID NO: 216510 - DNA, 25 bp, Homo sapien
aacagaaaggacaccctctctaggg

SEQ ID NO: 216511 - DNA, 25 bp, Homo sapien
tgaaaaggcagaacactccgcgctt

SEQ ID NO: 216512 - DNA, 25 bp, Homo sapien
aaggcagaacactccgcgcttctta

SEQ ID NO: 216513 - DNA, 25 bp, Homo sapien
tccgcgcttcttagaagaggagtga

SEQ ID NO: 216514 - DNA, 25 bp, Homo sapien
gcgcagcaacgcatcgtgtggccct

SEQ ID NO: 216515 - DNA, 25 bp, Homo sapien
cttcagtagagagtatttaacacac

SEQ ID NO: 216516 - DNA, 25 bp, Homo sapien
aacacactctaaacttaacactaag

SEQ ID NO: 216517 - DNA, 25 bp, Homo sapien
gaagatcagattgtacatcatcctg

SEQ ID NO: 216518 - DNA, 25 bp, Homo sapien
ttgtacatcatcctgagaccatgcc

SEQ ID NO: 216519 - DNA, 25 bp, Homo sapien
gagaccatgccttcagaagattatt

SEQ ID NO: 216520 - DNA, 25 bp, Homo sapien
tgcttatcattttgtaccattccct

SEQ ID NO: 216521 - DNA, 25 bp, Homo sapien
taccattccctaaattccggttcat

SEQ ID NO: 216522 - DNA, 25 bp, Homo sapien
ttccggttcattttacttgatgcat

SEQ ID NO: 216523 - DNA, 25 bp, Homo sapien
acttgagtgtcttgggcgtggatca

SEQ ID NO: 216524 - DNA, 25 bp, Homo sapien
tgggcgtggatcagtcttctccaaa

SEQ ID NO: 216525 - DNA, 25 bp, Homo sapien
gtcttctccaaaatacgagcagtgt

SEQ ID NO: 216526 - DNA, 25 bp, Homo sapien
aacagaagcacagaagggagcctat

SEQ ID NO: 216527 - DNA, 25 bp, Homo sapien
gggagcctatatagaactaacactg

SEQ ID NO: 216528 - DNA, 25 bp, Homo sapien
gaactaacactgcagacttatcaag

SEQ ID NO: 216529 - DNA, 25 bp, Homo sapien
tatcaagaagcactcagtcgccatt

SEQ ID NO: 216530 - DNA, 25 bp, Homo sapien
tcagtcgccattctgcagcttccta

SEQ ID NO: 216531 - DNA, 25 bp, Homo sapien
aaagattgatggtttgctgattgac

SEQ ID NO: 216532 - DNA, 25 bp, Homo sapien
ggtttgctgattgaccagattcaga

SEQ ID NO: 216533 - DNA, 25 bp, Homo sapien
atcgatgatgcaaccaacttggtcc

SEQ ID NO: 216534 - DNA, 25 bp, Homo sapien
acttggtccagctgtatcacgtgct

SEQ ID NO: 216535 - DNA, 25 bp, Homo sapien
tgtatcacgtgctccatccagatgg

SEQ ID NO: 216536 - DNA, 25 bp, Homo sapien
tcaggctgctgagggaataaattta

SEQ ID NO: 216537 - DNA, 25 bp, Homo sapien
gagaccagggtttccggttcgctca

SEQ ID NO: 216538 - DNA, 25 bp, Homo sapien
tgttccctgatctgctccagatgaa

SEQ ID NO: 216539 - DNA, 25 bp, Homo sapien
tccagatgaaacctgtccctactga

SEQ ID NO: 216540 - DNA, 25 bp, Homo sapien
gacagcacaagacccagaattagac

SEQ ID NO: 216541 - DNA, 25 bp, Homo sapien
gacaatcagtcaagctctatccagg

SEQ ID NO: 216542 - DNA, 25 bp, Homo sapien
ggacagggcaagcaggactctcacc

SEQ ID NO: 216543 - DNA, 25 bp, Homo sapien
actctcacctccttcattagagata

SEQ ID NO: 216544 - DNA, 25 bp, Homo sapien
ttgagcctaaaatcccatttgcatt

SEQ ID NO: 216545 - DNA, 25 bp, Homo sapien
gccctattgcatggctgaattcagt

SEQ ID NO: 216546 - DNA, 25 bp, Homo sapien
gtcaacttcagagctgtacgttagt

SEQ ID NO: 216547 - DNA, 25 bp, Homo sapien
gaagttatataaactgggccctcac

SEQ ID NO: 216548 - DNA, 25 bp, Homo sapien
gtggcctacttcaaggctttgaatc

SEQ ID NO: 216549 - DNA, 25 bp, Homo sapien
tagctaaggtttacagtggacatta

SEQ ID NO: 216550 - DNA, 25 bp, Homo sapien
ggacattagccagatcattttcttc

SEQ ID NO: 216551 - DNA, 25 bp, Homo sapien
gattatgccataatctcctttgatt

SEQ ID NO: 216552 - DNA, 25 bp, Homo sapien
atctcctttgattcttatggaagtt

SEQ ID NO: 216553 - DNA, 25 bp, Homo sapien
gttctaacaatatatggtggttcca

SEQ ID NO: 216554 - DNA, 25 bp, Homo sapien
gtggttccaacacctgcagtgagtt

SEQ ID NO: 216555 - DNA, 25 bp, Homo sapien
aacacctgcagtgagtttaatgact

SEQ ID NO: 216556 - DNA, 25 bp, Homo sapien
gactgacttagtagcaggtacaaga

SEQ ID NO: 216557 - DNA, 25 bp, Homo sapien
ggtattttacttgagcattttccat

SEQ ID NO: 216558 - DNA, 25 bp, Homo sapien
acttgagcattttccatgactgtaa

SEQ ID NO: 216559 - DNA, 25 bp, Homo sapien
ttccttttattctgtaccttgcagc

SEQ ID NO: 216560 - DNA, 25 bp, Homo sapien
taccttgcagccatgaccagttctg

SEQ ID NO: 216561 - DNA, 25 bp, Homo sapien
ggtgggagctccttttaggtagaat

SEQ ID NO: 216562 - DNA, 25 bp, Homo sapien
gaatttaacatgacttctgccccag

SEQ ID NO: 216563 - DNA, 25 bp, Homo sapien
ccagctttatctgtcacacaaggct

SEQ ID NO: 216564 - DNA, 25 bp, Homo sapien
aggctgggcacctctagtgctactg

SEQ ID NO: 216565 - DNA, 25 bp, Homo sapien
ggcacctctagtgctactgctagat

SEQ ID NO: 216566 - DNA, 25 bp, Homo sapien
gctactgctagatatcacttactca

SEQ ID NO: 216567 - DNA, 25 bp, Homo sapien
gctagatatcacttactcagttaga

SEQ ID NO: 216568 - DNA, 25 bp, Homo sapien
aaagagtcttggttcctctactact

SEQ ID NO: 216569 - DNA, 25 bp, Homo sapien
ggttcctctactacttttactacag

SEQ ID NO: 216570 - DNA, 25 bp, Homo sapien
agaacttccaccaacgcatcctatt

SEQ ID NO: 216571 - DNA, 25 bp, Homo sapien
aacgcatcctattcgcttaggtctt

SEQ ID NO: 216572 - DNA, 25 bp, Homo sapien
atcctattcgcttaggtcttgctct

SEQ ID NO: 216573 - DNA, 25 bp, Homo sapien
tccgtattctactacgaaattctta

SEQ ID NO: 216574 - DNA, 25 bp, Homo sapien
gaaattcttaattcccctgaccgtg

SEQ ID NO: 216575 - DNA, 25 bp, Homo sapien
tgcagaactggatacgctgagtgaa

SEQ ID NO: 216576 - DNA, 25 bp, Homo sapien
agaaagctataaggactctacactt

SEQ ID NO: 216577 - DNA, 25 bp, Homo sapien
actctacacttatcatgcagttgtt

SEQ ID NO: 216578 - DNA, 25 bp, Homo sapien
tcatgcagttgttacgtgataatct

SEQ ID NO: 216579 - DNA, 25 bp, Homo sapien
gtgataatctgacactatggacttc

SEQ ID NO: 216580 - DNA, 25 bp, Homo sapien
gacttcagacatgcagggtgacggt

SEQ ID NO: 216581 - DNA, 25 bp, Homo sapien
agggtaccccagactccagtttcat

SEQ ID NO: 216582 - DNA, 25 bp, Homo sapien
tgggattgacgcctgccattggtca

SEQ ID NO: 216583 - DNA, 25 bp, Homo sapien
ttgacgcctgccattggtcaggctg

SEQ ID NO: 216584 - DNA, 25 bp, Homo sapien
gtggaccactcgctgccttaggtgc

SEQ ID NO: 216585 - DNA, 25 bp, Homo sapien
cgctgccttaggtgccttctgctct

SEQ ID NO: 216586 - DNA, 25 bp, Homo sapien
tctggaaccagaggactagctgact

SEQ ID NO: 216587 - DNA, 25 bp, Homo sapien
gaggactagctgacttttgccaagg

SEQ ID NO: 216588 - DNA, 25 bp, Homo sapien
gacttttgccaaggagcagtgccaa

SEQ ID NO: 216589 - DNA, 25 bp, Homo sapien
gccaaggagcagtgccaacgggcat

SEQ ID NO: 216590 - DNA, 25 bp, Homo sapien
aacgggcatggcatggtgccctgcc

SEQ ID NO: 216591 - DNA, 25 bp, Homo sapien
gacaccttcccaggtgtgggtcact

SEQ ID NO: 216592 - DNA, 25 bp, Homo sapien
cccgcgggctgctgacagagatacg

SEQ ID NO: 216593 - DNA, 25 bp, Homo sapien
ccgcgggctgctgacagagatacgc

SEQ ID NO: 216594 - DNA, 25 bp, Homo sapien
cgggctgctgacagagatacgcgcc

SEQ ID NO: 216595 - DNA, 25 bp, Homo sapien
ggctgctgacagagatacgcgccgt

SEQ ID NO: 216596 - DNA, 25 bp, Homo sapien
gctgctgacagagatacgcgccgtg

SEQ ID NO: 216597 - DNA, 25 bp, Homo sapien
ctgctgacagagatacgcgccgtgg

SEQ ID NO: 216598 - DNA, 25 bp, Homo sapien
tgctgacagagatacgcgccgtggt

SEQ ID NO: 216599 - DNA, 25 bp, Homo sapien
gctgacagagatacgcgccgtggtg

SEQ ID NO: 216600 - DNA, 25 bp, Homo sapien
ctgacagagatacgcgccgtggtgc

SEQ ID NO: 216601 - DNA, 25 bp, Homo sapien
acagagatacgcgccgtggtgcgca

SEQ ID NO: 216602 - DNA, 25 bp, Homo sapien
gcagtggtgagaaaatgtataaaga

SEQ ID NO: 216603 - DNA, 25 bp, Homo sapien
gtgctgtatcagtgattactttcaa

SEQ ID NO: 216604 - DNA, 25 bp, Homo sapien
ttcagtatgcagtgaaattgccttt

SEQ ID NO: 216605 - DNA, 25 bp, Homo sapien
aattgcctttcaagggcagcgtgca

SEQ ID NO: 216606 - DNA, 25 bp, Homo sapien
gcagcgtgcagcagaatttgcattt

SEQ ID NO: 216607 - DNA, 25 bp, Homo sapien
ttaagacaacaccacaggccgcatg

SEQ ID NO: 216608 - DNA, 25 bp, Homo sapien
gcatgctctaatcggtctctttata

SEQ ID NO: 216609 - DNA, 25 bp, Homo sapien
ggtctctttatatactcaggcagca

SEQ ID NO: 216610 - DNA, 25 bp, Homo sapien
gcatctttttatcttctggtttcta

SEQ ID NO: 216611 - DNA, 25 bp, Homo sapien
gatggccacccaaagcagagaattt

SEQ ID NO: 216612 - DNA, 25 bp, Homo sapien
gagaatttatcctttggttagcatt

SEQ ID NO: 216613 - DNA, 25 bp, Homo sapien
gaaggccccttgatattccttttgt

SEQ ID NO: 216614 - DNA, 25 bp, Homo sapien
tttattgtaccttcagacgtgtctg

SEQ ID NO: 216615 - DNA, 25 bp, Homo sapien
acgtgtctgagggtttggctagtaa

SEQ ID NO: 216616 - DNA, 25 bp, Homo sapien
tgttttacactttcccacattgttg

SEQ ID NO: 216617 - DNA, 25 bp, Homo sapien
gaaggcatcctgatgtgtgtggtct

SEQ ID NO: 216618 - DNA, 25 bp, Homo sapien
gtggtcttttgtttgtaacctctat

SEQ ID NO: 216619 - DNA, 25 bp, Homo sapien
gtttgtaacctctatcaacttgtag

SEQ ID NO: 216620 - DNA, 25 bp, Homo sapien
caacttgtagactcttctgtctttg

SEQ ID NO: 216621 - DNA, 25 bp, Homo sapien
ttgctccccgtgttttaaaagtctg

SEQ ID NO: 216622 - DNA, 25 bp, Homo sapien
agtctgcactgggtacttgttgggc

SEQ ID NO: 216623 - DNA, 25 bp, Homo sapien
tacttgttgggcctttcaatctgga

SEQ ID NO: 216624 - DNA, 25 bp, Homo sapien
tcctttcagttctagggaagtttct

SEQ ID NO: 216625 - DNA, 25 bp, Homo sapien
aaaatagccaacgagctgaagcttt

SEQ ID NO: 216626 - DNA, 25 bp, Homo sapien
gccaacgagctgaagctttaacagg

SEQ ID NO: 216627 - DNA, 25 bp, Homo sapien
gctttaacaggctgccaggagcggg

SEQ ID NO: 216628 - DNA, 25 bp, Homo sapien
ccacctgggcgagactgcagcgatg

SEQ ID NO: 216629 - DNA, 25 bp, Homo sapien
ctgcagcgatggattggtgtgtctc

SEQ ID NO: 216630 - DNA, 25 bp, Homo sapien
agcgatggattggtgtgtctccctg

SEQ ID NO: 216631 - DNA, 25 bp, Homo sapien
gatggattggtgtgtctccctgctg

SEQ ID NO: 216632 - DNA, 25 bp, Homo sapien
attggtgtgtctccctgctggcact

SEQ ID NO: 216633 - DNA, 25 bp, Homo sapien
ctctcccctactggaggcaaaggaa

SEQ ID NO: 216634 - DNA, 25 bp, Homo sapien
ctcggtactgcggttgcacagagta

SEQ ID NO: 216635 - DNA, 25 bp, Homo sapien
tgcggttgcacagagtatttcgcct

SEQ ID NO: 216636 - DNA, 25 bp, Homo sapien
gaggcatggttagtgtgtgatacaa

SEQ ID NO: 216637 - DNA, 25 bp, Homo sapien
gtaattgtttggtagttgtaactgc

SEQ ID NO: 216638 - DNA, 25 bp, Homo sapien
gtttggtagttgtaactgctaataa

SEQ ID NO: 216639 - DNA, 25 bp, Homo sapien
cagtgactagaatataagggaggta

SEQ ID NO: 216640 - DNA, 25 bp, Homo sapien
ggacaagatagattaatagcctaaa

SEQ ID NO: 216641 - DNA, 25 bp, Homo sapien
aataaagagaaaagcctgatgcctt

SEQ ID NO: 216642 - DNA, 25 bp, Homo sapien
actttggatgtattacttaggccaa

SEQ ID NO: 216643 - DNA, 25 bp, Homo sapien
atgtattacttaggccaaaatctgg

SEQ ID NO: 216644 - DNA, 25 bp, Homo sapien
caaaatctggcctggatttatgcta

SEQ ID NO: 216645 - DNA, 25 bp, Homo sapien
tctggcctggatttatgctataata

SEQ ID NO: 216646 - DNA, 25 bp, Homo sapien
ggcctggatttatgctataatatat

SEQ ID NO: 216647 - DNA, 25 bp, Homo sapien
ttatttcttccctgtgcgtaaacat

SEQ ID NO: 216648 - DNA, 25 bp, Homo sapien
aacataagacaatccctcttcagaa

SEQ ID NO: 216649 - DNA, 25 bp, Homo sapien
tgacaacaggtcatctcttggcccc

SEQ ID NO: 216650 - DNA, 25 bp, Homo sapien
tggccccgaaaatctgtcacctgca

SEQ ID NO: 216651 - DNA, 25 bp, Homo sapien
ctggagcctgggtgactttgaacag

SEQ ID NO: 216652 - DNA, 25 bp, Homo sapien
tgactttgaacagctggtgaccagt

SEQ ID NO: 216653 - DNA, 25 bp, Homo sapien
agtctgacccttcacgatcctaaca

SEQ ID NO: 216654 - DNA, 25 bp, Homo sapien
ttcacgatcctaacatctttggtcc

SEQ ID NO: 216655 - DNA, 25 bp, Homo sapien
ctttggtccccagtaaaggcgctga

SEQ ID NO: 216656 - DNA, 25 bp, Homo sapien
aaggcgctgaagcactgcatgatgt

SEQ ID NO: 216657 - DNA, 25 bp, Homo sapien
gcactgcatgatgttgctgagaact

SEQ ID NO: 216658 - DNA, 25 bp, Homo sapien
tttgccatcaaagatgccatccgtg

SEQ ID NO: 216659 - DNA, 25 bp, Homo sapien
aagatgccatccgtgcagctcgagc

SEQ ID NO: 216660 - DNA, 25 bp, Homo sapien
gagctcagcacacaggtaataacgt

SEQ ID NO: 216661 - DNA, 25 bp, Homo sapien
aacgtgaaggaactcttccgcctag

SEQ ID NO: 216662 - DNA, 25 bp, Homo sapien
agaagatccgcaatgcctgcgtgga

SEQ ID NO: 216663 - DNA, 25 bp, Homo sapien
tgcgtggacaagttcaccaccctgt

SEQ ID NO: 216664 - DNA, 25 bp, Homo sapien
cctgtgtgtcactggtgtcccagaa

SEQ ID NO: 216665 - DNA, 25 bp, Homo sapien
gaaaactgcaaaccctggtctgtga

SEQ ID NO: 216666 - DNA, 25 bp, Homo sapien
caaaccctggtctgtgagggtctaa

SEQ ID NO: 216667 - DNA, 25 bp, Homo sapien
ctaaagagagagtcctcagcagagt

SEQ ID NO: 216668 - DNA, 25 bp, Homo sapien
agagtcttcttgtgctgcctttggg

SEQ ID NO: 216669 - DNA, 25 bp, Homo sapien
ttcctcgtcctcgtgagaacctgtg

SEQ ID NO: 216670 - DNA, 25 bp, Homo sapien
tcctcgtgagaacctgtgggcagta

SEQ ID NO: 216671 - DNA, 25 bp, Homo sapien
gtgagaacctgtgggcagtattcaa

SEQ ID NO: 216672 - DNA, 25 bp, Homo sapien
ggcagtattcaagccctgatgacaa

SEQ ID NO: 216673 - DNA, 25 bp, Homo sapien
tcaagccctgatgacaaaacccagt

SEQ ID NO: 216674 - DNA, 25 bp, Homo sapien
gatgttgtttaggatcaggcccctc

SEQ ID NO: 216675 - DNA, 25 bp, Homo sapien
tgtttaggatcaggcccctctcctg

SEQ ID NO: 216676 - DNA, 25 bp, Homo sapien
tgtgcaggagcacaggaactatctg

SEQ ID NO: 216677 - DNA, 25 bp, Homo sapien
cacaggaactatctgctggcgttgg

SEQ ID NO: 216678 - DNA, 25 bp, Homo sapien
ctatctgctggcgttgggttccaaa

SEQ ID NO: 216679 - DNA, 25 bp, Homo sapien
tggcgttgggttccaaatttgcatt

SEQ ID NO: 216680 - DNA, 25 bp, Homo sapien
tggctgcaacccaaactcgactctt

SEQ ID NO: 216681 - DNA, 25 bp, Homo sapien
aaactcgactcttctacttacactt

SEQ ID NO: 216682 - DNA, 25 bp, Homo sapien
ttctacttacacttgctcagcattt

SEQ ID NO: 216683 - DNA, 25 bp, Homo sapien
ctgctcttcccacacaaagttttgg

SEQ ID NO: 216684 - DNA, 25 bp, Homo sapien
taaccaaagtccatgatcagttctg

SEQ ID NO: 216685 - DNA, 25 bp, Homo sapien
gatcagttctggaccgctatggatt

SEQ ID NO: 216686 - DNA, 25 bp, Homo sapien
ggaccgctatggattccagatccac

SEQ ID NO: 216687 - DNA, 25 bp, Homo sapien
agatccaccttacgtagccgtgtga

SEQ ID NO: 216688 - DNA, 25 bp, Homo sapien
gccgtgtgagctccggtaaattaca

SEQ ID NO: 216689 - DNA, 25 bp, Homo sapien
taacccatcaaatttctttatctat

SEQ ID NO: 216690 - DNA, 25 bp, Homo sapien
aagcagcaacaataatgtcacgaag

SEQ ID NO: 216691 - DNA, 25 bp, Homo sapien
ccctcctagtgggatgatctattca

SEQ ID NO: 216692 - DNA, 25 bp, Homo sapien
attcacatatctcccagctttttta

SEQ ID NO: 216693 - DNA, 25 bp, Homo sapien
tcacagtgagtggatggcccttcag

SEQ ID NO: 216694 - DNA, 25 bp, Homo sapien
agctttttctctcctggccagacat

SEQ ID NO: 216695 - DNA, 25 bp, Homo sapien
ggccagacatgcagtcttgccttta

SEQ ID NO: 216696 - DNA, 25 bp, Homo sapien
gcagtcttgcctttagatatcgcag

SEQ ID NO: 216697 - DNA, 25 bp, Homo sapien
gatatcgcagagacaaaattcacag

SEQ ID NO: 216698 - DNA, 25 bp, Homo sapien
gcatgtcttaaatcttccaggattt

SEQ ID NO: 216699 - DNA, 25 bp, Homo sapien
gaaccaaattgctcaacagtatgta

SEQ ID NO: 216700 - DNA, 25 bp, Homo sapien
aaatctggatatctaaccacctact

SEQ ID NO: 216701 - DNA, 25 bp, Homo sapien
taaccacctacttaaatctgtttga

SEQ ID NO: 216702 - DNA, 25 bp, Homo sapien
tggagcctgcatcttcctaagcttt

SEQ ID NO: 216703 - DNA, 25 bp, Homo sapien
gcatcttcctaagctttttagcagg

SEQ ID NO: 216704 - DNA, 25 bp, Homo sapien
ttttagcaggtatatgttgaacact

SEQ ID NO: 216705 - DNA, 25 bp, Homo sapien
gaacacttctgtttcatggttgaga

SEQ ID NO: 216706 - DNA, 25 bp, Homo sapien
gtttcatggttgagacagaatcaga

SEQ ID NO: 216707 - DNA, 25 bp, Homo sapien
tcagaggccatggatactgacaact

SEQ ID NO: 216708 - DNA, 25 bp, Homo sapien
tggatactgacaactgatttgtctg

SEQ ID NO: 216709 - DNA, 25 bp, Homo sapien
ctctgtctttttccatgactcttat

SEQ ID NO: 216710 - DNA, 25 bp, Homo sapien
gactcttatatactgcctcatcttg

SEQ ID NO: 216711 - DNA, 25 bp, Homo sapien
tactgcctcatcttgatttataagc

SEQ ID NO: 216712 - DNA, 25 bp, Homo sapien
cttgatttataagcaaaacctggaa

SEQ ID NO: 216713 - DNA, 25 bp, Homo sapien
tgcagccctggagacccggcaccat

SEQ ID NO: 216714 - DNA, 25 bp, Homo sapien
gcagccctggagacccggcaccatc

SEQ ID NO: 216715 - DNA, 25 bp, Homo sapien
cagccctggagacccggcaccatca

SEQ ID NO: 216716 - DNA, 25 bp, Homo sapien
agccctggagacccggcaccatcac

SEQ ID NO: 216717 - DNA, 25 bp, Homo sapien
gccctggagacccggcaccatcaca

SEQ ID NO: 216718 - DNA, 25 bp, Homo sapien
ccctggagacccggcaccatcacac

SEQ ID NO: 216719 - DNA, 25 bp, Homo sapien
cctggagacccggcaccatcacacc

SEQ ID NO: 216720 - DNA, 25 bp, Homo sapien
ctggagacccggcaccatcacaccc

SEQ ID NO: 216721 - DNA, 25 bp, Homo sapien
tggagacccggcaccatcacaccca

SEQ ID NO: 216722 - DNA, 25 bp, Homo sapien
tttcaacaggcccttcctgatgatc

SEQ ID NO: 216723 - DNA, 25 bp, Homo sapien
gatgatcattgtccctacagacacc

SEQ ID NO: 216724 - DNA, 25 bp, Homo sapien
ctacagacacccagaacatcttctt

SEQ ID NO: 216725 - DNA, 25 bp, Homo sapien
tgagcaaagtcaccaatcccagcaa

SEQ ID NO: 216726 - DNA, 25 bp, Homo sapien
aagcctagagcttgcatcaagcagt

SEQ ID NO: 216727 - DNA, 25 bp, Homo sapien
aacttggaatgcaagctggatgcct

SEQ ID NO: 216728 - DNA, 25 bp, Homo sapien
tgtgcaccgtagtggccatggcatg

SEQ ID NO: 216729 - DNA, 25 bp, Homo sapien
catggcatgtgtggccctgtctgct

SEQ ID NO: 216730 - DNA, 25 bp, Homo sapien
cctgtctgcttatccttggaaggtg

SEQ ID NO: 216731 - DNA, 25 bp, Homo sapien
gaaggtgacagcgattccctgtgaa

SEQ ID NO: 216732 - DNA, 25 bp, Homo sapien
gggcccatggactcttcagtctgga

SEQ ID NO: 216733 - DNA, 25 bp, Homo sapien
agtgctcagccctcacccagagagg

SEQ ID NO: 216734 - DNA, 25 bp, Homo sapien
gagaggcctgaaaaccgtgttcgac

SEQ ID NO: 216735 - DNA, 25 bp, Homo sapien
gaaaaccgtgttcgacgaggccatc

SEQ ID NO: 216736 - DNA, 25 bp, Homo sapien
agcgctcccacctagatgggtctga

SEQ ID NO: 216737 - DNA, 25 bp, Homo sapien
agatgggtctgatccgccgccgccc

SEQ ID NO: 216738 - DNA, 25 bp, Homo sapien
cccgcgggctgctgacagagatacg

SEQ ID NO: 216739 - DNA, 25 bp, Homo sapien
tgctgacagagatacgcgccgtggt

SEQ ID NO: 216740 - DNA, 25 bp, Homo sapien
gccgtggtgcgcacggagcccttca

SEQ ID NO: 216741 - DNA, 25 bp, Homo sapien
acggagcccttcacgggacgctaca

SEQ ID NO: 216742 - DNA, 25 bp, Homo sapien
cttcacgggacgctacagcctgtgc

SEQ ID NO: 216743 - DNA, 25 bp, Homo sapien
tcacgggacgctacagcctgtgccg

SEQ ID NO: 216744 - DNA, 25 bp, Homo sapien
ttcaggccttccttccctagctgtg

SEQ ID NO: 216745 - DNA, 25 bp, Homo sapien
tccctagctgtgtcttggtcttcaa

SEQ ID NO: 216746 - DNA, 25 bp, Homo sapien
tgtgtcttggtcttcaatcccagaa

SEQ ID NO: 216747 - DNA, 25 bp, Homo sapien
gagtaaggctgtaggatctttggaa

SEQ ID NO: 216748 - DNA, 25 bp, Homo sapien
taggatctttggaatctcttggttc

SEQ ID NO: 216749 - DNA, 25 bp, Homo sapien
tctttggaatctcttggttcctaag

SEQ ID NO: 216750 - DNA, 25 bp, Homo sapien
tcctaagagtttcctcagagatcat

SEQ ID NO: 216751 - DNA, 25 bp, Homo sapien
gagtttcctcagagatcatacctcc

SEQ ID NO: 216752 - DNA, 25 bp, Homo sapien
agagatcatacctccccagagggaa

SEQ ID NO: 216753 - DNA, 25 bp, Homo sapien
agggaagcaggaatgaggccaaaaa

SEQ ID NO: 216754 - DNA, 25 bp, Homo sapien
gaggccaaaaagtgtgcattggata

SEQ ID NO: 216755 - DNA, 25 bp, Homo sapien
aagattctagaaagtcgcagcagga

SEQ ID NO: 216756 - DNA, 25 bp, Homo sapien
aagtgtggcttcttctcctaatgga

SEQ ID NO: 216757 - DNA, 25 bp, Homo sapien
tggcttcttctcctaatggacacct

SEQ ID NO: 216758 - DNA, 25 bp, Homo sapien
atctctgtagcccaagatgtgaaag

SEQ ID NO: 216759 - DNA, 25 bp, Homo sapien
tctgtagcccaagatgtgaaagcca

SEQ ID NO: 216760 - DNA, 25 bp, Homo sapien
gaaagccagacaagaacacgcgtgt

SEQ ID NO: 216761 - DNA, 25 bp, Homo sapien
agccagacaagaacacgcgtgtgtg

SEQ ID NO: 216762 - DNA, 25 bp, Homo sapien
gggtatgtgccctccgtgtaggtaa

SEQ ID NO: 216763 - DNA, 25 bp, Homo sapien
atgtgccctccgtgtaggtaactgt

SEQ ID NO: 216764 - DNA, 25 bp, Homo sapien
gccctccgtgtaggtaactgtgtga

SEQ ID NO: 216765 - DNA, 25 bp, Homo sapien
tccgtgtaggtaactgtgtgagtgt

SEQ ID NO: 216766 - DNA, 25 bp, Homo sapien
gccaatcaggtagcttaatggatgt

SEQ ID NO: 216767 - DNA, 25 bp, Homo sapien
ggatgtaatacatttctgagtacca

SEQ ID NO: 216768 - DNA, 25 bp, Homo sapien
ttctgagtaccattatcttatctag

SEQ ID NO: 216769 - DNA, 25 bp, Homo sapien
aagtacttaagtagcctggaggtag

SEQ ID NO: 216770 - DNA, 25 bp, Homo sapien
gtagcctggaggtaggttctagaaa

SEQ ID NO: 216771 - DNA, 25 bp, Homo sapien
gagagttttgctaaaatcatcctat

SEQ ID NO: 216772 - DNA, 25 bp, Homo sapien
attatactgtcctaggcttctgatg

SEQ ID NO: 216773 - DNA, 25 bp, Homo sapien
aggcttctgatgatcattgttgcca

SEQ ID NO: 216774 - DNA, 25 bp, Homo sapien
gatcattgttgccagatgcagcaca

SEQ ID NO: 216775 - DNA, 25 bp, Homo sapien
gttgccagatgcagcacatatacta

SEQ ID NO: 216776 - DNA, 25 bp, Homo sapien
gaactggtaagtttttgcatgctac

SEQ ID NO: 216777 - DNA, 25 bp, Homo sapien
aatcttcttatcctctttgatattt

SEQ ID NO: 216778 - DNA, 25 bp, Homo sapien
attttattgcaaacactcagtcttt

SEQ ID NO: 216779 - DNA, 25 bp, Homo sapien
aataaaattgctgcaccagaaggag

SEQ ID NO: 216780 - DNA, 25 bp, Homo sapien
gagggtccctccaaagttgaacact

SEQ ID NO: 216781 - DNA, 25 bp, Homo sapien
gaagatgccccgacttctttggcca

SEQ ID NO: 216782 - DNA, 25 bp, Homo sapien
cccgacttctttggccagtgatggg

SEQ ID NO: 216783 - DNA, 25 bp, Homo sapien
atcagtgagtgctccatgatggtca

SEQ ID NO: 216784 - DNA, 25 bp, Homo sapien
catgatggtcatgttccaggtgcta

SEQ ID NO: 216785 - DNA, 25 bp, Homo sapien
gttccaggtgctagtacatcattca

SEQ ID NO: 216786 - DNA, 25 bp, Homo sapien
gtacatcattcatgatcaccttaat

SEQ ID NO: 216787 - DNA, 25 bp, Homo sapien
gatcaccttaatgctcatgagacta

SEQ ID NO: 216788 - DNA, 25 bp, Homo sapien
tgcccttgggacgtggagcccaggg

SEQ ID NO: 216789 - DNA, 25 bp, Homo sapien
ctgggcttgggcatcacgcccacct

SEQ ID NO: 216790 - DNA, 25 bp, Homo sapien
acgcccacctcctttggcagaggga

SEQ ID NO: 216791 - DNA, 25 bp, Homo sapien
ggaccccagcacactaactctgggt

SEQ ID NO: 216792 - DNA, 25 bp, Homo sapien
agcacactaactctgggtggctgtc

SEQ ID NO: 216793 - DNA, 25 bp, Homo sapien
gcacactaactctgggtggctgtcc

SEQ ID NO: 216794 - DNA, 25 bp, Homo sapien
tcccttcactggtgccttgatgcta

SEQ ID NO: 216795 - DNA, 25 bp, Homo sapien
cttcactggtgccttgatgctaggg

SEQ ID NO: 216796 - DNA, 25 bp, Homo sapien
ctctgtgactctgggctacctcagt

SEQ ID NO: 216797 - DNA, 25 bp, Homo sapien
attttggccagactcaccggcccac

SEQ ID NO: 216798 - DNA, 25 bp, Homo sapien
gtgatgttttcgttctgttttattt

SEQ ID NO: 216799 - DNA, 25 bp, Homo sapien
ccgtctgccattcaccaggaaaaat

SEQ ID NO: 216800 - DNA, 25 bp, Homo sapien
aaatttctatggcaattttgtacca

SEQ ID NO: 216801 - DNA, 25 bp, Homo sapien
ggcaattttgtaccatgaagtaaac

SEQ ID NO: 216802 - DNA, 25 bp, Homo sapien
ctgttacaatagtttctgagaagca

SEQ ID NO: 216803 - DNA, 25 bp, Homo sapien
gagaagcatactataactctgatct

SEQ ID NO: 216804 - DNA, 25 bp, Homo sapien
ataactctgatcttccattgagaat

SEQ ID NO: 216805 - DNA, 25 bp, Homo sapien
atcaattttacacctcatatgtctt

SEQ ID NO: 216806 - DNA, 25 bp, Homo sapien
cacctcatatgtcttcttagttctg

SEQ ID NO: 216807 - DNA, 25 bp, Homo sapien
atgtcttcttagttctgaatgatta

SEQ ID NO: 216808 - DNA, 25 bp, Homo sapien
agaacttgcatgtatttttatccta

SEQ ID NO: 216809 - DNA, 25 bp, Homo sapien
catcaaagttattttcttccaaatg

SEQ ID NO: 216810 - DNA, 25 bp, Homo sapien
cacggaactggcaaagctggttaac

SEQ ID NO: 216811 - DNA, 25 bp, Homo sapien
gttaacaagcgctcagactttgcct

SEQ ID NO: 216812 - DNA, 25 bp, Homo sapien
tcagactttgcctccaactgctgtt

SEQ ID NO: 216813 - DNA, 25 bp, Homo sapien
aactgctgttccataaactcacctc

SEQ ID NO: 216814 - DNA, 25 bp, Homo sapien
gaagaatatcctgtagtcctgaagc

SEQ ID NO: 216815 - DNA, 25 bp, Homo sapien
gtagtcctgaagcatgtttattaac

SEQ ID NO: 216816 - DNA, 25 bp, Homo sapien
taactttgaccagagttggagccac

SEQ ID NO: 216817 - DNA, 25 bp, Homo sapien
ggagccacccaagggaatgatctct

SEQ ID NO: 216818 - DNA, 25 bp, Homo sapien
atgatctctgatgacctaacctaag

SEQ ID NO: 216819 - DNA, 25 bp, Homo sapien
gacctaacctaagcaaaaccactga

SEQ ID NO: 216820 - DNA, 25 bp, Homo sapien
cttctgggaagacaactaggatact

SEQ ID NO: 216821 - DNA, 25 bp, Homo sapien
tgactggcatccttctgagaaggca

SEQ ID NO: 216822 - DNA, 25 bp, Homo sapien
aaagctgggaacgagaggttaagca

SEQ ID NO: 216823 - DNA, 25 bp, Homo sapien
gctgcaggaggaaacgccacctggt

SEQ ID NO: 216824 - DNA, 25 bp, Homo sapien
cacctggtggtcctttaactgaagc

SEQ ID NO: 216825 - DNA, 25 bp, Homo sapien
ctggtggtcctttaactgaagcttt

SEQ ID NO: 216826 - DNA, 25 bp, Homo sapien
tggtcctttaactgaagctttgccc

SEQ ID NO: 216827 - DNA, 25 bp, Homo sapien
tttaactgaagctttgccccctgcc

SEQ ID NO: 216828 - DNA, 25 bp, Homo sapien
agagagagacctcatctttcatgct

SEQ ID NO: 216829 - DNA, 25 bp, Homo sapien
agagagacctcatctttcatgcttg

SEQ ID NO: 216830 - DNA, 25 bp, Homo sapien
gcttgcaagtgaaatatgttacaga

SEQ ID NO: 216831 - DNA, 25 bp, Homo sapien
acagaacatgcacttgccctaataa

SEQ ID NO: 216832 - DNA, 25 bp, Homo sapien
taaatatgtcaattcggtcctgaaa

SEQ ID NO: 216833 - DNA, 25 bp, Homo sapien
gaggaatatttgtcattccccaaat

SEQ ID NO: 216834 - DNA, 25 bp, Homo sapien
aattaaaacatgaaccgtggtgtag

SEQ ID NO: 216835 - DNA, 25 bp, Homo sapien
cgtggtgtagtataattctggttaa

SEQ ID NO: 216836 - DNA, 25 bp, Homo sapien
tttcatacaagcaccactgatgctg

SEQ ID NO: 216837 - DNA, 25 bp, Homo sapien
actgatgctgcattcggctgtctgt

SEQ ID NO: 216838 - DNA, 25 bp, Homo sapien
gcattcggctgtctgtccgtggtca

SEQ ID NO: 216839 - DNA, 25 bp, Homo sapien
ctgtccgtggtcagagctgtcatga

SEQ ID NO: 216840 - DNA, 25 bp, Homo sapien
agagctgtcatgaccttgtctatat

SEQ ID NO: 216841 - DNA, 25 bp, Homo sapien
ttgtctatattctaccactctgctg

SEQ ID NO: 216842 - DNA, 25 bp, Homo sapien
actctgctggtcatacgtggattga

SEQ ID NO: 216843 - DNA, 25 bp, Homo sapien
tgccagaaaatcgtgccccatgcaa

SEQ ID NO: 216844 - DNA, 25 bp, Homo sapien
tggtcctaaccagctttttgtgccc

SEQ ID NO: 216845 - DNA, 25 bp, Homo sapien
ttttgtgccctacgtagatcagaca

SEQ ID NO: 216846 - DNA, 25 bp, Homo sapien
acaactttccaaccagctcatctat

SEQ ID NO: 216847 - DNA, 25 bp, Homo sapien
aaaaccttctgcatttcaccgtggg

SEQ ID NO: 216848 - DNA, 25 bp, Homo sapien
gtgggtcgacaacccatttttctgg

SEQ ID NO: 216849 - DNA, 25 bp, Homo sapien
tctgggacccctctctgtagcagag

SEQ ID NO: 216850 - DNA, 25 bp, Homo sapien
ttaaacttcctgctgttaacctcac

SEQ ID NO: 216851 - DNA, 25 bp, Homo sapien
ttaacctcactcttgtggtgtccat

SEQ ID NO: 216852 - DNA, 25 bp, Homo sapien
ttgtggtgtccatgtccttgatctc

SEQ ID NO: 216853 - DNA, 25 bp, Homo sapien
ccttgatctctgtggctgtgagaca

SEQ ID NO: 216854 - DNA, 25 bp, Homo sapien
ctcacccgacaggaaatagttgctc

SEQ ID NO: 216855 - DNA, 25 bp, Homo sapien
acccgacaggaaatagttgctcttt

SEQ ID NO: 216856 - DNA, 25 bp, Homo sapien
aatagttgctcttttaaatgctttt

SEQ ID NO: 216857 - DNA, 25 bp, Homo sapien
aaatgcttttggaaggctttctaca

SEQ ID NO: 216858 - DNA, 25 bp, Homo sapien
gcttttggaaggctttctacaagta

SEQ ID NO: 216859 - DNA, 25 bp, Homo sapien
tggaaggctttctacaagtataaga

SEQ ID NO: 216860 - DNA, 25 bp, Homo sapien
ggctttctacaagtataagagactt

SEQ ID NO: 216861 - DNA, 25 bp, Homo sapien
aagtcttattacaacagagtaggta

SEQ ID NO: 216862 - DNA, 25 bp, Homo sapien
aaaggcttttatgtgtctaactaga

SEQ ID NO: 216863 - DNA, 25 bp, Homo sapien
aaagccttttaattatggacattca

SEQ ID NO: 216864 - DNA, 25 bp, Homo sapien
gaaagacactaatctgacttcaaga

SEQ ID NO: 216865 - DNA, 25 bp, Homo sapien
caaagtactgtgaaaacattttaca

SEQ ID NO: 216866 - DNA, 25 bp, Homo sapien
ttttttaaatcttctgactaatgct

SEQ ID NO: 216867 - DNA, 25 bp, Homo sapien
aaatcttctgactaatgctaaaacg

SEQ ID NO: 216868 - DNA, 25 bp, Homo sapien
ttctgactaatgctaaaacgtaatc

SEQ ID NO: 216869 - DNA, 25 bp, Homo sapien
gactaatgctaaaacgtaatctaat

SEQ ID NO: 216870 - DNA, 25 bp, Homo sapien
tcatacagttactgcagtaagcatt

SEQ ID NO: 216871 - DNA, 25 bp, Homo sapien
ctgcagtaagcattaggaagtgaat

SEQ ID NO: 216872 - DNA, 25 bp, Homo sapien
ttattttactggcaaatgtcatgca

SEQ ID NO: 216873 - DNA, 25 bp, Homo sapien
attttactggcaaatgtcatgcaac

SEQ ID NO: 216874 - DNA, 25 bp, Homo sapien
ttactggcaaatgtcatgcaacaat

SEQ ID NO: 216875 - DNA, 25 bp, Homo sapien
ctggcaaatgtcatgcaacaataat

SEQ ID NO: 216876 - DNA, 25 bp, Homo sapien
tttactaaaactacactgcaccatg

SEQ ID NO: 216877 - DNA, 25 bp, Homo sapien
ctacactgcaccatgttagtaataa

SEQ ID NO: 216878 - DNA, 25 bp, Homo sapien
gttagtaataaacagatctgcctta

SEQ ID NO: 216879 - DNA, 25 bp, Homo sapien
aacagatctgccttaaagaaaagaa

SEQ ID NO: 216880 - DNA, 25 bp, Homo sapien
gaaatattgttgctcagtgttgtta

SEQ ID NO: 216881 - DNA, 25 bp, Homo sapien
gctcagtgttgttaatatagctcaa

SEQ ID NO: 216882 - DNA, 25 bp, Homo sapien
tgcagtatgctataaatgatacccc

SEQ ID NO: 216883 - DNA, 25 bp, Homo sapien
cacacagtttttgtctaatgaaaat

SEQ ID NO: 216884 - DNA, 25 bp, Homo sapien
ataattggtagtatttcttccagaa

SEQ ID NO: 216885 - DNA, 25 bp, Homo sapien
agactggcacttaccctgaagtgca

SEQ ID NO: 216886 - DNA, 25 bp, Homo sapien
cttaccctgaagtgcattaataaaa

SEQ ID NO: 216887 - DNA, 25 bp, Homo sapien
gaggccggcggtggcgctggtttgg

SEQ ID NO: 216888 - DNA, 25 bp, Homo sapien
aggaggatctggtgtgcacaccgca

SEQ ID NO: 216889 - DNA, 25 bp, Homo sapien
aggatctggtgtgcacaccgcagca

SEQ ID NO: 216890 - DNA, 25 bp, Homo sapien
gtgtgcacaccgcagcagtaccgag

SEQ ID NO: 216891 - DNA, 25 bp, Homo sapien
gcagtaccgagcctcgggcagctac

SEQ ID NO: 216892 - DNA, 25 bp, Homo sapien
agctacttcggcctggaagagaacg

SEQ ID NO: 216893 - DNA, 25 bp, Homo sapien
gcctggaagagaacggccgcctctt

SEQ ID NO: 216894 - DNA, 25 bp, Homo sapien
ccaagtcccgagacgggcgaggcga

SEQ ID NO: 216895 - DNA, 25 bp, Homo sapien
agcgcagcgccttcgtggaggtgaa

SEQ ID NO: 216896 - DNA, 25 bp, Homo sapien
tggaggtgaagaaggctgcccgcgc

SEQ ID NO: 216897 - DNA, 25 bp, Homo sapien
acggcgcgggagtcgcctccgagga

SEQ ID NO: 216898 - DNA, 25 bp, Homo sapien
tccaagcggccgcagtctttaccta

SEQ ID NO: 216899 - DNA, 25 bp, Homo sapien
caagcggccgcagtctttacctatt

SEQ ID NO: 216900 - DNA, 25 bp, Homo sapien
agcggccgcagtctttacctattca

SEQ ID NO: 216901 - DNA, 25 bp, Homo sapien
cggccgcagtctttacctattcaca

SEQ ID NO: 216902 - DNA, 25 bp, Homo sapien
gccgcagtctttacctattcacact

SEQ ID NO: 216903 - DNA, 25 bp, Homo sapien
cgcagtctttacctattcacactca

SEQ ID NO: 216904 - DNA, 25 bp, Homo sapien
agtctttacctattcacactcactt

SEQ ID NO: 216905 - DNA, 25 bp, Homo sapien
tctttacctattcacactcactttt

SEQ ID NO: 216906 - DNA, 25 bp, Homo sapien
ctttacctattcacactcacttttt

SEQ ID NO: 216907 - DNA, 25 bp, Homo sapien
tttacctattcacactcacttttta

SEQ ID NO: 216908 - DNA, 25 bp, Homo sapien
cctttgtgtggcgaagtcacctggg

SEQ ID NO: 216909 - DNA, 25 bp, Homo sapien
ggctgcatgtaaatgggttgcctta

SEQ ID NO: 216910 - DNA, 25 bp, Homo sapien
aatgggttgccttattatggagaaa

SEQ ID NO: 216911 - DNA, 25 bp, Homo sapien
tcactccctgagtttagtatggctg

SEQ ID NO: 216912 - DNA, 25 bp, Homo sapien
ggctgtatatttatgcctattaata

SEQ ID NO: 216913 - DNA, 25 bp, Homo sapien
gtgttacctttgtagtcaaatttca

SEQ ID NO: 216914 - DNA, 25 bp, Homo sapien
gtacataatgttaccggagctgatt

SEQ ID NO: 216915 - DNA, 25 bp, Homo sapien
ccggagctgatttgtttggtcatta

SEQ ID NO: 216916 - DNA, 25 bp, Homo sapien
gatttgtttggtcattagctcttaa

SEQ ID NO: 216917 - DNA, 25 bp, Homo sapien
ggtcattagctcttaatagttgtga

SEQ ID NO: 216918 - DNA, 25 bp, Homo sapien
aaatctattctaacgcaaaaccact

SEQ ID NO: 216919 - DNA, 25 bp, Homo sapien
gcaaaaccactaactgaagttcaga

SEQ ID NO: 216920 - DNA, 25 bp, Homo sapien
gctattctcatccagccatattagt

SEQ ID NO: 216921 - DNA, 25 bp, Homo sapien
tctcatccagccatattagtcttct

SEQ ID NO: 216922 - DNA, 25 bp, Homo sapien
agccatattagtcttctggcttttc

SEQ ID NO: 216923 - DNA, 25 bp, Homo sapien
ctggcttttctttagcttcatcaaa

SEQ ID NO: 216924 - DNA, 25 bp, Homo sapien
agcttcatcaaataagcatgttgtg

SEQ ID NO: 216925 - DNA, 25 bp, Homo sapien
gatagatgtacaattccaacaaggt

SEQ ID NO: 216926 - DNA, 25 bp, Homo sapien
atacatacatgatttttcttctgaa

SEQ ID NO: 216927 - DNA, 25 bp, Homo sapien
ttctgaatgtctcttctccctgcat

SEQ ID NO: 216928 - DNA, 25 bp, Homo sapien
tcttctccctgcatcactgttcatt

SEQ ID NO: 216929 - DNA, 25 bp, Homo sapien
atcactgttcattcacaatgaaagg

SEQ ID NO: 216930 - DNA, 25 bp, Homo sapien
aaattcactattttactatcaatca

SEQ ID NO: 216931 - DNA, 25 bp, Homo sapien
ttcagatactcaaaccacttagcga

SEQ ID NO: 216932 - DNA, 25 bp, Homo sapien
tactcaaaccacttagcgatgaccc

SEQ ID NO: 216933 - DNA, 25 bp, Homo sapien
cacttagcgatgaccccacagtatc

SEQ ID NO: 216934 - DNA, 25 bp, Homo sapien
tgcctcacggtggaaaataccaagt

SEQ ID NO: 216935 - DNA, 25 bp, Homo sapien
agttcttggagattactctttggca

SEQ ID NO: 216936 - DNA, 25 bp, Homo sapien
attactctttggcagtggtcttccc

SEQ ID NO: 216937 - DNA, 25 bp, Homo sapien
cccctgcacttttctgatctaattt

SEQ ID NO: 216938 - DNA, 25 bp, Homo sapien
gcacttttctgatctaatttctgtt

SEQ ID NO: 216939 - DNA, 25 bp, Homo sapien
caaaacacttactaccaacacagct

SEQ ID NO: 216940 - DNA, 25 bp, Homo sapien
actaccaacacagctgttaaacatt

SEQ ID NO: 216941 - DNA, 25 bp, Homo sapien
gatctggtattaggaaattactttc

SEQ ID NO: 216942 - DNA, 25 bp, Homo sapien
gtgtcttactgatgttttcatgatc

SEQ ID NO: 216943 - DNA, 25 bp, Homo sapien
gatgttttcatgatcaacttgtaaa

SEQ ID NO: 216944 - DNA, 25 bp, Homo sapien
tattcttggagtcctttgctaccca

SEQ ID NO: 216945 - DNA, 25 bp, Homo sapien
tttgctacccaagcacctggtttca

SEQ ID NO: 216946 - DNA, 25 bp, Homo sapien
tggtttcaccatgcgatcactgact

SEQ ID NO: 216947 - DNA, 25 bp, Homo sapien
atgcgatcactgacttctctacagt

SEQ ID NO: 216948 - DNA, 25 bp, Homo sapien
ttctctacagtgaagactctttctt

SEQ ID NO: 216949 - DNA, 25 bp, Homo sapien
taatataggatttcgctgtgctctt

SEQ ID NO: 216950 - DNA, 25 bp, Homo sapien
gatttcgctgtgctcttttgattaa

SEQ ID NO: 216951 - DNA, 25 bp, Homo sapien
gaaatctcactttgttagcgttgct

SEQ ID NO: 216952 - DNA, 25 bp, Homo sapien
actttgttagcgttgctgctgttgt

SEQ ID NO: 216953 - DNA, 25 bp, Homo sapien
aggtgctccatgtgttgcccttgta

SEQ ID NO: 216954 - DNA, 25 bp, Homo sapien
ataaaggaagttccgctgcagaagg

SEQ ID NO: 216955 - DNA, 25 bp, Homo sapien
gtgtgtgctgtgttcttgacccgtt

SEQ ID NO: 216956 - DNA, 25 bp, Homo sapien
gcctttctctggtactggtgtctta

SEQ ID NO: 216957 - DNA, 25 bp, Homo sapien
tgtcttaccccaaagcccaatttct

SEQ ID NO: 216958 - DNA, 25 bp, Homo sapien
ctgtccccagtctcaagcagggtgt

SEQ ID NO: 216959 - DNA, 25 bp, Homo sapien
gcagggtgtcccactggagagatct

SEQ ID NO: 216960 - DNA, 25 bp, Homo sapien
cactggagagatctcttggcttccc

SEQ ID NO: 216961 - DNA, 25 bp, Homo sapien
gttcttctcttcctgaatctctgtc

SEQ ID NO: 216962 - DNA, 25 bp, Homo sapien
gaatctctgtcctgccacacatggt

SEQ ID NO: 216963 - DNA, 25 bp, Homo sapien
agttccctagcctggagttctagaa

SEQ ID NO: 216964 - DNA, 25 bp, Homo sapien
ggcacacccggcaaatgagaaacac

SEQ ID NO: 216965 - DNA, 25 bp, Homo sapien
ggtgcacccatcagcgcgttgctgt

SEQ ID NO: 216966 - DNA, 25 bp, Homo sapien
agcgcgttgctgtctatcctgtcct

SEQ ID NO: 216967 - DNA, 25 bp, Homo sapien
acttctcccactgcatgataaaagt

SEQ ID NO: 216968 - DNA, 25 bp, Homo sapien
aagtttcacatcagaaggttcatct

SEQ ID NO: 216969 - DNA, 25 bp, Homo sapien
aaggttcatctttctgttcttcatc

SEQ ID NO: 216970 - DNA, 25 bp, Homo sapien
ctgttcttcatccttgtgattggta

SEQ ID NO: 216971 - DNA, 25 bp, Homo sapien
gattggtatatacccttctggacac

SEQ ID NO: 216972 - DNA, 25 bp, Homo sapien
ttctggacactctctcatcttaatt

SEQ ID NO: 216973 - DNA, 25 bp, Homo sapien
gacactctctcatcttaattttagg

SEQ ID NO: 216974 - DNA, 25 bp, Homo sapien
cctccacagtaagtgctgtcagtga

SEQ ID NO: 216975 - DNA, 25 bp, Homo sapien
gcagctgagcttcgaggagttcatc

SEQ ID NO: 216976 - DNA, 25 bp, Homo sapien
gaggagttcatcatgctgatggcga

SEQ ID NO: 216977 - DNA, 25 bp, Homo sapien
catgctgatggcgaggctaacctgg

SEQ ID NO: 216978 - DNA, 25 bp, Homo sapien
taacctgggcctcccacgagaagat

SEQ ID NO: 216979 - DNA, 25 bp, Homo sapien
ggcctcccacgagaagatgcacgag

SEQ ID NO: 216980 - DNA, 25 bp, Homo sapien
gaccacagtggccaagatcacagtg

SEQ ID NO: 216981 - DNA, 25 bp, Homo sapien
caagatcacagtggccacggccatg

SEQ ID NO: 216982 - DNA, 25 bp, Homo sapien
cggccacaggccactaatcaggagg

SEQ ID NO: 216983 - DNA, 25 bp, Homo sapien
ggccactaatcaggaggccaggcca

SEQ ID NO: 216984 - DNA, 25 bp, Homo sapien
gggcctgttatgtcaaactgtcttg

SEQ ID NO: 216985 - DNA, 25 bp, Homo sapien
tgttatgtcaaactgtcttggctgt

SEQ ID NO: 216986 - DNA, 25 bp, Homo sapien
gacctgcctcaagagagaggaccca

SEQ ID NO: 216987 - DNA, 25 bp, Homo sapien
gacccacatgggacaagaacctcag

SEQ ID NO: 216988 - DNA, 25 bp, Homo sapien
ccaaccatggttgtgaagatgctag

SEQ ID NO: 216989 - DNA, 25 bp, Homo sapien
aagatgctagcgacacatcgctgtt

SEQ ID NO: 216990 - DNA, 25 bp, Homo sapien
cgacacatcgctgttgggagttctt

SEQ ID NO: 216991 - DNA, 25 bp, Homo sapien
tgcctctgaagccacaaaatgactt

SEQ ID NO: 216992 - DNA, 25 bp, Homo sapien
atgactttagacttccagggctcac

SEQ ID NO: 216993 - DNA, 25 bp, Homo sapien
ggctcaccagatcaacctctaaata

SEQ ID NO: 216994 - DNA, 25 bp, Homo sapien
agaggaagtcaagttgccctatgga

SEQ ID NO: 216995 - DNA, 25 bp, Homo sapien
gttgccctatggaaaacttgtccaa

SEQ ID NO: 216996 - DNA, 25 bp, Homo sapien
aacttgtccaaataacatttcttga

SEQ ID NO: 216997 - DNA, 25 bp, Homo sapien
accccaccccgtggacgagaggctg

SEQ ID NO: 216998 - DNA, 25 bp, Homo sapien
acgctgggcactctggacttctaca

SEQ ID NO: 216999 - DNA, 25 bp, Homo sapien
ctgggcactctggacttctacatgg

SEQ ID NO: 217000 - DNA, 25 bp, Homo sapien
tacatggcccggcttcacggagcca

SEQ ID NO: 217001 - DNA, 25 bp, Homo sapien
gcttcacggagccatcgagcgcgac

SEQ ID NO: 217002 - DNA, 25 bp, Homo sapien
agcacgagaagctcatcgtccgcat

SEQ ID NO: 217003 - DNA, 25 bp, Homo sapien
gagaagctcatcgtccgcatcaagg

SEQ ID NO: 217004 - DNA, 25 bp, Homo sapien
gaagctcatcgtccgcatcaaggaa

SEQ ID NO: 217005 - DNA, 25 bp, Homo sapien
ctcatcgtccgcatcaaggaaatcc

SEQ ID NO: 217006 - DNA, 25 bp, Homo sapien
caggtcgccagcgagcacctgtgag

SEQ ID NO: 217007 - DNA, 25 bp, Homo sapien
tcgccagcgagcacctgtgaggagt

SEQ ID NO: 217008 - DNA, 25 bp, Homo sapien
ggaagtagtacaactcattgctgga

SEQ ID NO: 217009 - DNA, 25 bp, Homo sapien
caactcattgctggaattgtgaaat

SEQ ID NO: 217010 - DNA, 25 bp, Homo sapien
attattcaaggcgtgatctctgtca

SEQ ID NO: 217011 - DNA, 25 bp, Homo sapien
aggcgtgatctctgtcactttattt

SEQ ID NO: 217012 - DNA, 25 bp, Homo sapien
gggatcattctctgaatggtctaag

SEQ ID NO: 217013 - DNA, 25 bp, Homo sapien
ggaagcggtagccatgccatgcaat

SEQ ID NO: 217014 - DNA, 25 bp, Homo sapien
catgcaatgatgtaggagttctctt

SEQ ID NO: 217015 - DNA, 25 bp, Homo sapien
taggagttctcttttgtaaaaccat

SEQ ID NO: 217016 - DNA, 25 bp, Homo sapien
caggaggtttctataatgccacata

SEQ ID NO: 217017 - DNA, 25 bp, Homo sapien
ttgcaattggatttcaggttccctt

SEQ ID NO: 217018 - DNA, 25 bp, Homo sapien
tggatttcaggttccctttttgtgc

SEQ ID NO: 217019 - DNA, 25 bp, Homo sapien
gtgcgagacctcgatttcacagtag

SEQ ID NO: 217020 - DNA, 25 bp, Homo sapien
gacctcgatttcacagtagacttgg

SEQ ID NO: 217021 - DNA, 25 bp, Homo sapien
cttggattttaagggacagctgtgt

SEQ ID NO: 217022 - DNA, 25 bp, Homo sapien
agctgtgtgaaacatctgtatctaa

SEQ ID NO: 217023 - DNA, 25 bp, Homo sapien
tacaaaatgcgttagcacacgtggg

SEQ ID NO: 217024 - DNA, 25 bp, Homo sapien
tagcacacgtgggaagctgcagaga

SEQ ID NO: 217025 - DNA, 25 bp, Homo sapien
aggaactctcacctcgatctgccgt

SEQ ID NO: 217026 - DNA, 25 bp, Homo sapien
gaagcagaccgtcttctacttggaa

SEQ ID NO: 217027 - DNA, 25 bp, Homo sapien
tggaagattacctcactgtccggag

SEQ ID NO: 217028 - DNA, 25 bp, Homo sapien
gggaggaaatctacgggaccatatc

SEQ ID NO: 217029 - DNA, 25 bp, Homo sapien
gggaccatatccatgaagccaaatg

SEQ ID NO: 217030 - DNA, 25 bp, Homo sapien
gtttctagtaaaatggcatcccgag

SEQ ID NO: 217031 - DNA, 25 bp, Homo sapien
atggcatcccgagacaaagatgaca

SEQ ID NO: 217032 - DNA, 25 bp, Homo sapien
agaagttctaccagatatgcacact

SEQ ID NO: 217033 - DNA, 25 bp, Homo sapien
ccagatatgcacacttaacaaaggg

SEQ ID NO: 217034 - DNA, 25 bp, Homo sapien
aacggctaaagctctggcatcatca

SEQ ID NO: 217035 - DNA, 25 bp, Homo sapien
tggcatcatcatcccagaacatggt

SEQ ID NO: 217036 - DNA, 25 bp, Homo sapien
catcatcccagaacatggtcatgtt

SEQ ID NO: 217037 - DNA, 25 bp, Homo sapien
ggtcatgttccagattgcagtttgt

SEQ ID NO: 217038 - DNA, 25 bp, Homo sapien
gttccagattgcagtttgttacaaa

SEQ ID NO: 217039 - DNA, 25 bp, Homo sapien
taatattgctctgattggtgagggt

SEQ ID NO: 217040 - DNA, 25 bp, Homo sapien
attggtgagggtgtgtaaattagcc

SEQ ID NO: 217041 - DNA, 25 bp, Homo sapien
gggcctcatctacctaaggactcgt

SEQ ID NO: 217042 - DNA, 25 bp, Homo sapien
gcctcatctacctaaggactcgttt

SEQ ID NO: 217043 - DNA, 25 bp, Homo sapien
tcatctacctaaggactcgtttgcc

SEQ ID NO: 217044 - DNA, 25 bp, Homo sapien
atctacctaaggactcgtttgcctg

SEQ ID NO: 217045 - DNA, 25 bp, Homo sapien
ctacctaaggactcgtttgcctgaa

SEQ ID NO: 217046 - DNA, 25 bp, Homo sapien
acctaaggactcgtttgcctgaagc

SEQ ID NO: 217047 - DNA, 25 bp, Homo sapien
ctaaggactcgtttgcctgaagctt

SEQ ID NO: 217048 - DNA, 25 bp, Homo sapien
aaggactcgtttgcctgaagcttca

SEQ ID NO: 217049 - DNA, 25 bp, Homo sapien
ggactcgtttgcctgaagcttcacc

SEQ ID NO: 217050 - DNA, 25 bp, Homo sapien
actcgtttgcctgaagcttcacctg

SEQ ID NO: 217051 - DNA, 25 bp, Homo sapien
tttgcctgaagcttcacctgcctga

SEQ ID NO: 217052 - DNA, 25 bp, Homo sapien
agactccgcgcaatcacatactgta

SEQ ID NO: 217053 - DNA, 25 bp, Homo sapien
ctccgcgcaatcacatactgtatat

SEQ ID NO: 217054 - DNA, 25 bp, Homo sapien
catactgtatatagacgtgaatcga

SEQ ID NO: 217055 - DNA, 25 bp, Homo sapien
agacgtgaatcgattttatttttat

SEQ ID NO: 217056 - DNA, 25 bp, Homo sapien
aaggtcgtgataaagtgttgccaaa

SEQ ID NO: 217057 - DNA, 25 bp, Homo sapien
gccaaagatacctgctgaattctcg

SEQ ID NO: 217058 - DNA, 25 bp, Homo sapien
tgaattctcgcgtttcaggaaacaa

SEQ ID NO: 217059 - DNA, 25 bp, Homo sapien
tatttgaggagggtcgtgttgactc

SEQ ID NO: 217060 - DNA, 25 bp, Homo sapien
gagggtcgtgttgactccatatgaa

SEQ ID NO: 217061 - DNA, 25 bp, Homo sapien
gactccatatgaaaggacacagctc

SEQ ID NO: 217062 - DNA, 25 bp, Homo sapien
ggacacagctcaaagcttttttgtt

SEQ ID NO: 217063 - DNA, 25 bp, Homo sapien
tgcccgggatgacaaagcctcctat

SEQ ID NO: 217064 - DNA, 25 bp, Homo sapien
gacaaagcctcctatgttgcctggg

SEQ ID NO: 217065 - DNA, 25 bp, Homo sapien
gacacagcaccgtggtgaacccttg

SEQ ID NO: 217066 - DNA, 25 bp, Homo sapien
gaggttctagccaaagctggcacag

SEQ ID NO: 217067 - DNA, 25 bp, Homo sapien
gaagcaatcgtgtattcagacatag

SEQ ID NO: 217068 - DNA, 25 bp, Homo sapien
tgaaatacgccagcaaatccccgtt

SEQ ID NO: 217069 - DNA, 25 bp, Homo sapien
gcaaatccccgtttttagacagaag

SEQ ID NO: 217070 - DNA, 25 bp, Homo sapien
agacagaagcgatcagacctctatg

SEQ ID NO: 217071 - DNA, 25 bp, Homo sapien
gacctctatgctgtggagatgaaaa

SEQ ID NO: 217072 - DNA, 25 bp, Homo sapien
ataggacgatatgattctacaacat

SEQ ID NO: 217073 - DNA, 25 bp, Homo sapien
ttctacaacataatcaactccctat

SEQ ID NO: 217074 - DNA, 25 bp, Homo sapien
ggagattattccctggcaaatgcaa

SEQ ID NO: 217075 - DNA, 25 bp, Homo sapien
aatgcaagttctctggcatccacaa

SEQ ID NO: 217076 - DNA, 25 bp, Homo sapien
ggcatccacaatacggcactaaagt

SEQ ID NO: 217077 - DNA, 25 bp, Homo sapien
agtaaaacataatagccgtctgcca

SEQ ID NO: 217078 - DNA, 25 bp, Homo sapien
atagccgtctgccaaaggaagtaca

SEQ ID NO: 217079 - DNA, 25 bp, Homo sapien
caaaaaccctaacactggaagtgca

SEQ ID NO: 217080 - DNA, 25 bp, Homo sapien
ggaagtgcaaacatgtctattgatg

SEQ ID NO: 217081 - DNA, 25 bp, Homo sapien
attgatgtgtatgccaatttcactg

SEQ ID NO: 217082 - DNA, 25 bp, Homo sapien
atttcactggcatctagcttatgag

SEQ ID NO: 217083 - DNA, 25 bp, Homo sapien
agcttatgaggccaaataatcccaa

SEQ ID NO: 217084 - DNA, 25 bp, Homo sapien
aaataatcccaaagtgtcactttat

SEQ ID NO: 217085 - DNA, 25 bp, Homo sapien
aaatgaattaggttgtttgcagtct

SEQ ID NO: 217086 - DNA, 25 bp, Homo sapien
cagtcttcagttgtgttcttatgct

SEQ ID NO: 217087 - DNA, 25 bp, Homo sapien
gttgtgttcttatgcttcagtgtca

SEQ ID NO: 217088 - DNA, 25 bp, Homo sapien
tgtacatagcacagttctttaaaat

SEQ ID NO: 217089 - DNA, 25 bp, Homo sapien
agcagaaattgctgtcaactggaca

SEQ ID NO: 217090 - DNA, 25 bp, Homo sapien
gttctaaattagttccattctggag

SEQ ID NO: 217091 - DNA, 25 bp, Homo sapien
ctggagctggctacaaatgggtaaa

SEQ ID NO: 217092 - DNA, 25 bp, Homo sapien
cctactttttatacgacttcgatat

SEQ ID NO: 217093 - DNA, 25 bp, Homo sapien
gacttcgatatttgactggtgcctg

SEQ ID NO: 217094 - DNA, 25 bp, Homo sapien
atatttgactggtgcctggaggctt

SEQ ID NO: 217095 - DNA, 25 bp, Homo sapien
ctggaggcttgagcaaactcggaaa

SEQ ID NO: 217096 - DNA, 25 bp, Homo sapien
atcattgatttgtaccgacagaaat

SEQ ID NO: 217097 - DNA, 25 bp, Homo sapien
tcatgtaaaattcctgttattctgg

SEQ ID NO: 217098 - DNA, 25 bp, Homo sapien
tgatcttcttgttttctgacttgga

SEQ ID NO: 217099 - DNA, 25 bp, Homo sapien
aaaactcttaagatatctaggtcta

SEQ ID NO: 217100 - DNA, 25 bp, Homo sapien
atctaggtctaaaaagcacttcatg

SEQ ID NO: 217101 - DNA, 25 bp, Homo sapien
atgctaaagctgacccactggttga

SEQ ID NO: 217102 - DNA, 25 bp, Homo sapien
tgacccactggttgaaaatgttgac

SEQ ID NO: 217103 - DNA, 25 bp, Homo sapien
aatgttgaccctatcctgttattta

SEQ ID NO: 217104 - DNA, 25 bp, Homo sapien
gaccctatcctgttatttaaatgtg

SEQ ID NO: 217105 - DNA, 25 bp, Homo sapien
aacatttattgtacattcagtgagt

SEQ ID NO: 217106 - DNA, 25 bp, Homo sapien
gttaatagtcttgtgctatgcagca

SEQ ID NO: 217107 - DNA, 25 bp, Homo sapien
agttctacagggtttctcagtcagc

SEQ ID NO: 217108 - DNA, 25 bp, Homo sapien
agggtttctcagtcagcactcaatc

SEQ ID NO: 217109 - DNA, 25 bp, Homo sapien
accagtcgcctgacttcaagagaag

SEQ ID NO: 217110 - DNA, 25 bp, Homo sapien
gacttcaagagaagccccagggacc

SEQ ID NO: 217111 - DNA, 25 bp, Homo sapien
ccaacaccataccagggatgccttt

SEQ ID NO: 217112 - DNA, 25 bp, Homo sapien
ggatgcctttgcaccctgagactga

SEQ ID NO: 217113 - DNA, 25 bp, Homo sapien
ttgcaccctgagactgactcaagag

SEQ ID NO: 217114 - DNA, 25 bp, Homo sapien
gagactgactcaagagccagtgaag

SEQ ID NO: 217115 - DNA, 25 bp, Homo sapien
tggaataccggaaaaagccccacag

SEQ ID NO: 217116 - DNA, 25 bp, Homo sapien
catctcccgccaaaaccaataaaga

SEQ ID NO: 217117 - DNA, 25 bp, Homo sapien
caccgtggatggagaaacttttgat

SEQ ID NO: 217118 - DNA, 25 bp, Homo sapien
aacagctacagatccgctttcagaa

SEQ ID NO: 217119 - DNA, 25 bp, Homo sapien
gaaacgggagcactgtacaaagaga

SEQ ID NO: 217120 - DNA, 25 bp, Homo sapien
gaaccaagccgagaaggtcctcaga

SEQ ID NO: 217121 - DNA, 25 bp, Homo sapien
gaaggtcctcagaaacgtgaagaat

SEQ ID NO: 217122 - DNA, 25 bp, Homo sapien
ggacaggaaatcaccccatttgaaa

SEQ ID NO: 217123 - DNA, 25 bp, Homo sapien
aatgctagttttttctgatctgtct

SEQ ID NO: 217124 - DNA, 25 bp, Homo sapien
gggcaggagtgccacaccttttgat

SEQ ID NO: 217125 - DNA, 25 bp, Homo sapien
gccacaccttttgattctgagcatt

SEQ ID NO: 217126 - DNA, 25 bp, Homo sapien
gagcatttgattctgacttctgtac

SEQ ID NO: 217127 - DNA, 25 bp, Homo sapien
gattctgacttctgtactctggtgg

SEQ ID NO: 217128 - DNA, 25 bp, Homo sapien
gccactggatctttgggattaaagc

SEQ ID NO: 217129 - DNA, 25 bp, Homo sapien
aactcaaatcttgtttcctgctggc

SEQ ID NO: 217130 - DNA, 25 bp, Homo sapien
gcctggtctgcccacgagctagagc

SEQ ID NO: 217131 - DNA, 25 bp, Homo sapien
acctagagaatctcctcttacaggg

SEQ ID NO: 217132 - DNA, 25 bp, Homo sapien
gggatgcatataacagatcatgtat

SEQ ID NO: 217133 - DNA, 25 bp, Homo sapien
aagtagtaattcttcccagctcttt

SEQ ID NO: 217134 - DNA, 25 bp, Homo sapien
gtaattcttcccagctctttgattt

SEQ ID NO: 217135 - DNA, 25 bp, Homo sapien
gctctttgatttgccatatataaaa

SEQ ID NO: 217136 - DNA, 25 bp, Homo sapien
aataggtgggtcgtatgtcttccct

SEQ ID NO: 217137 - DNA, 25 bp, Homo sapien
gggtcgtatgtcttccctttagaca

SEQ ID NO: 217138 - DNA, 25 bp, Homo sapien
tcttccctttagacatgatgttttc

SEQ ID NO: 217139 - DNA, 25 bp, Homo sapien
ttttctactcatttgtctctctggc

SEQ ID NO: 217140 - DNA, 25 bp, Homo sapien
ttcctatttcaacctctggttcctg

SEQ ID NO: 217141 - DNA, 25 bp, Homo sapien
tctggttcctgggatgagccatacc

SEQ ID NO: 217142 - DNA, 25 bp, Homo sapien
gggatgagccataccctggaactgg

SEQ ID NO: 217143 - DNA, 25 bp, Homo sapien
actgtgtcttccacgtaagggagac

SEQ ID NO: 217144 - DNA, 25 bp, Homo sapien
ttccacgtaagggagacctttgcaa

SEQ ID NO: 217145 - DNA, 25 bp, Homo sapien
gacctttgcaaagggcatccaaatg

SEQ ID NO: 217146 - DNA, 25 bp, Homo sapien
catccaaatgggtaggcaggtgaca

SEQ ID NO: 217147 - DNA, 25 bp, Homo sapien
gacagccgccgtatttattttgcat

SEQ ID NO: 217148 - DNA, 25 bp, Homo sapien
attttggcgttatgagtttgactct

SEQ ID NO: 217149 - DNA, 25 bp, Homo sapien
gttttgttgttatgactcttgtgtc

SEQ ID NO: 217150 - DNA, 25 bp, Homo sapien
tgttatgactcttgtgtcttttgtc

SEQ ID NO: 217151 - DNA, 25 bp, Homo sapien
gtggatccagaaagagttccagaat

SEQ ID NO: 217152 - DNA, 25 bp, Homo sapien
gttccagaattgtacaaggacctac

SEQ ID NO: 217153 - DNA, 25 bp, Homo sapien
aaggacctactgatgtacacttgaa

SEQ ID NO: 217154 - DNA, 25 bp, Homo sapien
gaagtgcgatagtgacattatggaa

SEQ ID NO: 217155 - DNA, 25 bp, Homo sapien
ggaagagtcaaaccacaaccattct

SEQ ID NO: 217156 - DNA, 25 bp, Homo sapien
ccacaaccattctttcttgtcatag

SEQ ID NO: 217157 - DNA, 25 bp, Homo sapien
ctttcttgtcatagttcccatcata

SEQ ID NO: 217158 - DNA, 25 bp, Homo sapien
gtcatagttcccatcataaaataat

SEQ ID NO: 217159 - DNA, 25 bp, Homo sapien
ataatgacccaagcagacgttcaaa

SEQ ID NO: 217160 - DNA, 25 bp, Homo sapien
tattttctactgagagactggattt

SEQ ID NO: 217161 - DNA, 25 bp, Homo sapien
gatcatgatcactctttatatgtgg

SEQ ID NO: 217162 - DNA, 25 bp, Homo sapien
gggaatttccatgccgtctacaggg

SEQ ID NO: 217163 - DNA, 25 bp, Homo sapien
ggaatttccatgccgtctacaggga

SEQ ID NO: 217164 - DNA, 25 bp, Homo sapien
gaatttccatgccgtctacagggat

SEQ ID NO: 217165 - DNA, 25 bp, Homo sapien
aatttccatgccgtctacagggatg

SEQ ID NO: 217166 - DNA, 25 bp, Homo sapien
atttccatgccgtctacagggatga

SEQ ID NO: 217167 - DNA, 25 bp, Homo sapien
tttccatgccgtctacagggatgac

SEQ ID NO: 217168 - DNA, 25 bp, Homo sapien
tcaggaaaaagggtgcagacgtctg

SEQ ID NO: 217169 - DNA, 25 bp, Homo sapien
caggaaaaagggtgcagacgtctgg

SEQ ID NO: 217170 - DNA, 25 bp, Homo sapien
acgtctggttcaaagagttggatat

SEQ ID NO: 217171 - DNA, 25 bp, Homo sapien
tttttccccatgtgctttagtgggc

SEQ ID NO: 217172 - DNA, 25 bp, Homo sapien
catgtgctttagtgggctttggttt

SEQ ID NO: 217173 - DNA, 25 bp, Homo sapien
gttttctttttgtgcgagtgtgtgt

SEQ ID NO: 217174 - DNA, 25 bp, Homo sapien
gtgaactttgttctgtgatcataga

SEQ ID NO: 217175 - DNA, 25 bp, Homo sapien
tagaaagggtattttaggctgcagg

SEQ ID NO: 217176 - DNA, 25 bp, Homo sapien
agttcccctttcatcctttggtgct

SEQ ID NO: 217177 - DNA, 25 bp, Homo sapien
catcctttggtgctgagttttctgt

SEQ ID NO: 217178 - DNA, 25 bp, Homo sapien
ggtgctgagttttctgtaacccttg

SEQ ID NO: 217179 - DNA, 25 bp, Homo sapien
tgagttttctgtaacccttggttgc

SEQ ID NO: 217180 - DNA, 25 bp, Homo sapien
tttctgtaacccttggttgccagag

SEQ ID NO: 217181 - DNA, 25 bp, Homo sapien
gtaacccttggttgccagagataaa

SEQ ID NO: 217182 - DNA, 25 bp, Homo sapien
cgttcagcagactggtttgcagtga

SEQ ID NO: 217183 - DNA, 25 bp, Homo sapien
gactggtttgcagtgaattttcatt

SEQ ID NO: 217184 - DNA, 25 bp, Homo sapien
ccttgttgtaaaaagcccagcactt

SEQ ID NO: 217185 - DNA, 25 bp, Homo sapien
agcccagcacttgaattgttattac

SEQ ID NO: 217186 - DNA, 25 bp, Homo sapien
tagccaattagtgggattttatgcc

SEQ ID NO: 217187 - DNA, 25 bp, Homo sapien
tttatgccagttgttaaaatgagca

SEQ ID NO: 217188 - DNA, 25 bp, Homo sapien
gagcattgatgtacccattttttaa

SEQ ID NO: 217189 - DNA, 25 bp, Homo sapien
tttgcccaaaactgtcatcctaacg

SEQ ID NO: 217190 - DNA, 25 bp, Homo sapien
gtcatcctaacgtttgtcattccag

SEQ ID NO: 217191 - DNA, 25 bp, Homo sapien
acgtttgtcattccagtttgagtta

SEQ ID NO: 217192 - DNA, 25 bp, Homo sapien
gtttgagttaatgtgctgagcattt

SEQ ID NO: 217193 - DNA, 25 bp, Homo sapien
attgtaagttcaataaacctctttg

SEQ ID NO: 217194 - DNA, 25 bp, Homo sapien
ggactaatacaacaagtaaatcact

SEQ ID NO: 217195 - DNA, 25 bp, Homo sapien
gactaatacaacaagtaaatcactg

SEQ ID NO: 217196 - DNA, 25 bp, Homo sapien
taatacaacaagtaaatcactgaac

SEQ ID NO: 217197 - DNA, 25 bp, Homo sapien
aatacaacaagtaaatcactgaaca

SEQ ID NO: 217198 - DNA, 25 bp, Homo sapien
atacaacaagtaaatcactgaacat

SEQ ID NO: 217199 - DNA, 25 bp, Homo sapien
tacaacaagtaaatcactgaacatt

SEQ ID NO: 217200 - DNA, 25 bp, Homo sapien
acaacaagtaaatcactgaacattt

SEQ ID NO: 217201 - DNA, 25 bp, Homo sapien
gtaaatcactgaacatttaatccca

SEQ ID NO: 217202 - DNA, 25 bp, Homo sapien
taaatcactgaacatttaatcccag

SEQ ID NO: 217203 - DNA, 25 bp, Homo sapien
aaatcactgaacatttaatcccagc

SEQ ID NO: 217204 - DNA, 25 bp, Homo sapien
agggagcccgacttcagcagcctgg

SEQ ID NO: 217205 - DNA, 25 bp, Homo sapien
tcctggtgctctcagcgcaacagat

SEQ ID NO: 217206 - DNA, 25 bp, Homo sapien
agcgcaacagattcttcacgtgaaa

SEQ ID NO: 217207 - DNA, 25 bp, Homo sapien
agaaaagccatatggtcgcctcctg

SEQ ID NO: 217208 - DNA, 25 bp, Homo sapien
gggcccagattccactgaggttaga

SEQ ID NO: 217209 - DNA, 25 bp, Homo sapien
gaggttagagtccatttacaaagct

SEQ ID NO: 217210 - DNA, 25 bp, Homo sapien
gctgccaggaaaccggccacttcta

SEQ ID NO: 217211 - DNA, 25 bp, Homo sapien
ggccacttctagtaaaccacgtcgt

SEQ ID NO: 217212 - DNA, 25 bp, Homo sapien
taaaccacgtcgtgcctcactgggt

SEQ ID NO: 217213 - DNA, 25 bp, Homo sapien
actgggtcctgcttacctcatttct

SEQ ID NO: 217214 - DNA, 25 bp, Homo sapien
ttctgaatgtgcatttccagccttc

SEQ ID NO: 217215 - DNA, 25 bp, Homo sapien
tactgttgatgacttggtggctgaa

SEQ ID NO: 217216 - DNA, 25 bp, Homo sapien
ggtggctgaaatcactccaaaaggc

SEQ ID NO: 217217 - DNA, 25 bp, Homo sapien
aatcactccaaaaggcagagccctg

SEQ ID NO: 217218 - DNA, 25 bp, Homo sapien
agagccctggtacctgacagtgtaa

SEQ ID NO: 217219 - DNA, 25 bp, Homo sapien
gacagtgtaaagaaggagctcctac

SEQ ID NO: 217220 - DNA, 25 bp, Homo sapien
gaaggagctcctacaaagaataaga

SEQ ID NO: 217221 - DNA, 25 bp, Homo sapien
taagaacattccttgctcagcatgc

SEQ ID NO: 217222 - DNA, 25 bp, Homo sapien
gaacattccttgctcagcatgccag

SEQ ID NO: 217223 - DNA, 25 bp, Homo sapien
tgctcagcatgccagcctttaagat

SEQ ID NO: 217224 - DNA, 25 bp, Homo sapien
agcatgccagcctttaagattgaat

SEQ ID NO: 217225 - DNA, 25 bp, Homo sapien
acagttttcagtaatgatgtataca

SEQ ID NO: 217226 - DNA, 25 bp, Homo sapien
aactgttttggtaaatctcttaatg

SEQ ID NO: 217227 - DNA, 25 bp, Homo sapien
gtaagtagctatttgactttggaat

SEQ ID NO: 217228 - DNA, 25 bp, Homo sapien
aattttgcattcgaggtatactgtc

SEQ ID NO: 217229 - DNA, 25 bp, Homo sapien
cgaggtatactgtcatttcttgaaa

SEQ ID NO: 217230 - DNA, 25 bp, Homo sapien
ttcttgaaatctttttctcgtttag

SEQ ID NO: 217231 - DNA, 25 bp, Homo sapien
tctcgtttagttgctctgtgggaaa

SEQ ID NO: 217232 - DNA, 25 bp, Homo sapien
gaggaagcctaagtttgtatttgta

SEQ ID NO: 217233 - DNA, 25 bp, Homo sapien
gtaaatttcttatgccatcctctag

SEQ ID NO: 217234 - DNA, 25 bp, Homo sapien
ttcttatgccatcctctagtcaaat

SEQ ID NO: 217235 - DNA, 25 bp, Homo sapien
atgccatcctctagtcaaatttttt

SEQ ID NO: 217236 - DNA, 25 bp, Homo sapien
tgtactggatggctaggattctaga

SEQ ID NO: 217237 - DNA, 25 bp, Homo sapien
aaaattacaaagaaccatgcaggaa

SEQ ID NO: 217238 - DNA, 25 bp, Homo sapien
agaaccatgcaggaaggaaaactat

SEQ ID NO: 217239 - DNA, 25 bp, Homo sapien
gttaaagtttaagtgtgcagccata

SEQ ID NO: 217240 - DNA, 25 bp, Homo sapien
aagtgtgcagccatagtttgggtat

SEQ ID NO: 217241 - DNA, 25 bp, Homo sapien
gcagccatagtttgggtatttttgg

SEQ ID NO: 217242 - DNA, 25 bp, Homo sapien
atttttggtttatatgccctcaagt

SEQ ID NO: 217243 - DNA, 25 bp, Homo sapien
tttggtttatatgccctcaagtaaa

SEQ ID NO: 217244 - DNA, 25 bp, Homo sapien
gtttatatgccctcaagtaaaagaa

SEQ ID NO: 217245 - DNA, 25 bp, Homo sapien
gaaaagccgaaagggttaatcatat

SEQ ID NO: 217246 - DNA, 25 bp, Homo sapien
gccgaaagggttaatcatatttgaa

SEQ ID NO: 217247 - DNA, 25 bp, Homo sapien
tctactaagttattttatgacatga

SEQ ID NO: 217248 - DNA, 25 bp, Homo sapien
ctcatcctcagaagagactcagaag

SEQ ID NO: 217249 - DNA, 25 bp, Homo sapien
gacagccctcagaatgcacgttatg

SEQ ID NO: 217250 - DNA, 25 bp, Homo sapien
aatgtgggtctgtaattcctccgtg

SEQ ID NO: 217251 - DNA, 25 bp, Homo sapien
cctctgcaaaccgtcgtaacaataa

SEQ ID NO: 217252 - DNA, 25 bp, Homo sapien
aatagttcctaacacatgggacaat

SEQ ID NO: 217253 - DNA, 25 bp, Homo sapien
aaatgagttagcctgcagaaatcac

SEQ ID NO: 217254 - DNA, 25 bp, Homo sapien
gaaatcacttgatgcacagcacatg

SEQ ID NO: 217255 - DNA, 25 bp, Homo sapien
gatgcacagcacatgggaagcattg

SEQ ID NO: 217256 - DNA, 25 bp, Homo sapien
attaatccttcacaaagtctttgag

SEQ ID NO: 217257 - DNA, 25 bp, Homo sapien
caaatatttagcatggatcccggta

SEQ ID NO: 217258 - DNA, 25 bp, Homo sapien
gatcccggtacactttcaatactta

SEQ ID NO: 217259 - DNA, 25 bp, Homo sapien
tccgggcaatgcttcgttttctaaa

SEQ ID NO: 217260 - DNA, 25 bp, Homo sapien
tcgttttctaaaggatgctgctgtt

SEQ ID NO: 217261 - DNA, 25 bp, Homo sapien
gctggtccgagctgaggactctgca

SEQ ID NO: 217262 - DNA, 25 bp, Homo sapien
tgaggactctgcaagtgtctggagc

SEQ ID NO: 217263 - DNA, 25 bp, Homo sapien
tgctcgcccaggaaggcctaggcta

SEQ ID NO: 217264 - DNA, 25 bp, Homo sapien
ggcctaggctaggacgttggcctca

SEQ ID NO: 217265 - DNA, 25 bp, Homo sapien
agcggcgccctggacttggtacagt

SEQ ID NO: 217266 - DNA, 25 bp, Homo sapien
acttggtacagtttcaggagcgtga

SEQ ID NO: 217267 - DNA, 25 bp, Homo sapien
gtgaaggacttaaccgactgccgct

SEQ ID NO: 217268 - DNA, 25 bp, Homo sapien
actgccgctgctttttcaaaacgga

SEQ ID NO: 217269 - DNA, 25 bp, Homo sapien
tgctttttcaaaacggatccgggca

SEQ ID NO: 217270 - DNA, 25 bp, Homo sapien
atagacatttttgcatcgacacttc

SEQ ID NO: 217271 - DNA, 25 bp, Homo sapien
gcatcgacacttcaacattaacact

SEQ ID NO: 217272 - DNA, 25 bp, Homo sapien
agtcatggtctggtgccagatttaa

SEQ ID NO: 217273 - DNA, 25 bp, Homo sapien
taagaaactcgaaccacctaatatt

SEQ ID NO: 217274 - DNA, 25 bp, Homo sapien
gaaccacctaatatttcataacctt

SEQ ID NO: 217275 - DNA, 25 bp, Homo sapien
ataaccttcttcattaggtacttgt

SEQ ID NO: 217276 - DNA, 25 bp, Homo sapien
gattaatttctaacattgcagcagt

SEQ ID NO: 217277 - DNA, 25 bp, Homo sapien
gcagcagtttcatatgtgtgcaata

SEQ ID NO: 217278 - DNA, 25 bp, Homo sapien
tctttcattttagttttgcacttgg

SEQ ID NO: 217279 - DNA, 25 bp, Homo sapien
gttttgcacttggttttctataaag

SEQ ID NO: 217280 - DNA, 25 bp, Homo sapien
gtacgtttttactcagttcatgcgt

SEQ ID NO: 217281 - DNA, 25 bp, Homo sapien
ttgtgatgttgttagccgcctgtga

SEQ ID NO: 217282 - DNA, 25 bp, Homo sapien
tgtgatgttgttagccgcctgtgag

SEQ ID NO: 217283 - DNA, 25 bp, Homo sapien
gtgatgttgttagccgcctgtgagg

SEQ ID NO: 217284 - DNA, 25 bp, Homo sapien
tgatgttgttagccgcctgtgaggg

SEQ ID NO: 217285 - DNA, 25 bp, Homo sapien
gttgttagccgcctgtgaggggtgc

SEQ ID NO: 217286 - DNA, 25 bp, Homo sapien
ttgttagccgcctgtgaggggtgca

SEQ ID NO: 217287 - DNA, 25 bp, Homo sapien
tgttagccgcctgtgaggggtgcag

SEQ ID NO: 217288 - DNA, 25 bp, Homo sapien
gttagccgcctgtgaggggtgcaga

SEQ ID NO: 217289 - DNA, 25 bp, Homo sapien
ttagccgcctgtgaggggtgcagag

SEQ ID NO: 217290 - DNA, 25 bp, Homo sapien
tagccgcctgtgaggggtgcagaga

SEQ ID NO: 217291 - DNA, 25 bp, Homo sapien
agccgcctgtgaggggtgcagagag

SEQ ID NO: 217292 - DNA, 25 bp, Homo sapien
cgccagcttcgcctcactgccggtg

SEQ ID NO: 217293 - DNA, 25 bp, Homo sapien
agcttcgcctcactgccggtgccgg

SEQ ID NO: 217294 - DNA, 25 bp, Homo sapien
gcttcgcctcactgccggtgccggg

SEQ ID NO: 217295 - DNA, 25 bp, Homo sapien
cttcgcctcactgccggtgccgggc

SEQ ID NO: 217296 - DNA, 25 bp, Homo sapien
gcctcactgccggtgccgggcacgg

SEQ ID NO: 217297 - DNA, 25 bp, Homo sapien
tcactgccggtgccgggcacgggcg

SEQ ID NO: 217298 - DNA, 25 bp, Homo sapien
gggcacgggcgaaacgcccacgctg

SEQ ID NO: 217299 - DNA, 25 bp, Homo sapien
ggcacgggcgaaacgcccacgctgg

SEQ ID NO: 217300 - DNA, 25 bp, Homo sapien
gcacgggcgaaacgcccacgctggg

SEQ ID NO: 217301 - DNA, 25 bp, Homo sapien
gggcgaaacgcccacgctgggcact

SEQ ID NO: 217302 - DNA, 25 bp, Homo sapien
ggcgaaacgcccacgctgggcactc

SEQ ID NO: 217303 - DNA, 25 bp, Homo sapien
tttgttcatcattggccctcattcc

SEQ ID NO: 217304 - DNA, 25 bp, Homo sapien
tcatcattggccctcattccaagca

SEQ ID NO: 217305 - DNA, 25 bp, Homo sapien
attccaagcactttacgctgtctgt

SEQ ID NO: 217306 - DNA, 25 bp, Homo sapien
ccaagcactttacgctgtctgtaat

SEQ ID NO: 217307 - DNA, 25 bp, Homo sapien
gcactttacgctgtctgtaatggga

SEQ ID NO: 217308 - DNA, 25 bp, Homo sapien
gggatctatttttgcactggaatat

SEQ ID NO: 217309 - DNA, 25 bp, Homo sapien
atttttgcactggaatatctgagaa

SEQ ID NO: 217310 - DNA, 25 bp, Homo sapien
cactggaatatctgagaattgcaaa

SEQ ID NO: 217311 - DNA, 25 bp, Homo sapien
actagacaaaagtttcacaacagat

SEQ ID NO: 217312 - DNA, 25 bp, Homo sapien
tctatgttgtaatataatgagtcac

SEQ ID NO: 217313 - DNA, 25 bp, Homo sapien
aataaagctgtgacagttctgttaa

SEQ ID NO: 217314 - DNA, 25 bp, Homo sapien
ggtgtctggacgaaaacatcaatgt

SEQ ID NO: 217315 - DNA, 25 bp, Homo sapien
acatcaatgtgaataagggccaagt

SEQ ID NO: 217316 - DNA, 25 bp, Homo sapien
ataagggccaagtgcagtcctgtct

SEQ ID NO: 217317 - DNA, 25 bp, Homo sapien
agtgcagtcctgtcttgattaaatt

SEQ ID NO: 217318 - DNA, 25 bp, Homo sapien
gtctgggcagtattgtttttaacct

SEQ ID NO: 217319 - DNA, 25 bp, Homo sapien
ttaacctgactcatccagctgtcct

SEQ ID NO: 217320 - DNA, 25 bp, Homo sapien
agctgtccttcaaatagctccgtct

SEQ ID NO: 217321 - DNA, 25 bp, Homo sapien
tccctgggctgggaaaaccctaatg

SEQ ID NO: 217322 - DNA, 25 bp, Homo sapien
tgaactgaaacacacttttacttta

SEQ ID NO: 217323 - DNA, 25 bp, Homo sapien
tttctgtctggcgtttttgtaatca

SEQ ID NO: 217324 - DNA, 25 bp, Homo sapien
gtctggcgtttttgtaatcatacta

SEQ ID NO: 217325 - DNA, 25 bp, Homo sapien
ggcctgggcgttggctgagccgacg

SEQ ID NO: 217326 - DNA, 25 bp, Homo sapien
tccgaggtgccggttaggagtttga

SEQ ID NO: 217327 - DNA, 25 bp, Homo sapien
gggtttcaggcaggagacacgagga

SEQ ID NO: 217328 - DNA, 25 bp, Homo sapien
aggagacacgaggagggcctgcccg

SEQ ID NO: 217329 - DNA, 25 bp, Homo sapien
agggcctgcccggaagtcacatcgg

SEQ ID NO: 217330 - DNA, 25 bp, Homo sapien
cggaagtcacatcggcagcagctgt

SEQ ID NO: 217331 - DNA, 25 bp, Homo sapien
aagtcacatcggcagcagctgtcta

SEQ ID NO: 217332 - DNA, 25 bp, Homo sapien
gtcacatcggcagcagctgtctaaa

SEQ ID NO: 217333 - DNA, 25 bp, Homo sapien
cctctgtaaatacggccccagggtg

SEQ ID NO: 217334 - DNA, 25 bp, Homo sapien
ccccagggtggtgagagagtcccat

SEQ ID NO: 217335 - DNA, 25 bp, Homo sapien
tggtgagagagtcccatgccacccg

SEQ ID NO: 217336 - DNA, 25 bp, Homo sapien
gtttcctctgaccactgagtttgct

SEQ ID NO: 217337 - DNA, 25 bp, Homo sapien
actgagtttgctatgaagaagataa

SEQ ID NO: 217338 - DNA, 25 bp, Homo sapien
gaagaagctctgtgacattgatggg

SEQ ID NO: 217339 - DNA, 25 bp, Homo sapien
gctctgtgacattgatggggccaag

SEQ ID NO: 217340 - DNA, 25 bp, Homo sapien
gtcaacaccctgatggagagatgaa

SEQ ID NO: 217341 - DNA, 25 bp, Homo sapien
gatcatccaaactgagtccatctgg

SEQ ID NO: 217342 - DNA, 25 bp, Homo sapien
tcatccaaactgagtccatctggct

SEQ ID NO: 217343 - DNA, 25 bp, Homo sapien
catccaaactgagtccatctggcta

SEQ ID NO: 217344 - DNA, 25 bp, Homo sapien
tccatctggctaattctaaatatac

SEQ ID NO: 217345 - DNA, 25 bp, Homo sapien
catctggctaattctaaatatacat

SEQ ID NO: 217346 - DNA, 25 bp, Homo sapien
tggctaattctaaatatacatatct

SEQ ID NO: 217347 - DNA, 25 bp, Homo sapien
gggagcctggctggaaacttttaag

SEQ ID NO: 217348 - DNA, 25 bp, Homo sapien
gctggaaacttttaagtgtgtgcac

SEQ ID NO: 217349 - DNA, 25 bp, Homo sapien
gtgtgtgcacacaggagtgctgcca

SEQ ID NO: 217350 - DNA, 25 bp, Homo sapien
gggctgtactattcctctgcagagc

SEQ ID NO: 217351 - DNA, 25 bp, Homo sapien
tcctctgcagagcttgacttgatga

SEQ ID NO: 217352 - DNA, 25 bp, Homo sapien
cagagcttgacttgatgaggtttga

SEQ ID NO: 217353 - DNA, 25 bp, Homo sapien
atggcgattctgtcttataacctcc

SEQ ID NO: 217354 - DNA, 25 bp, Homo sapien
gattctgtcttataacctcctgggt

SEQ ID NO: 217355 - DNA, 25 bp, Homo sapien
tgtcttataacctcctgggtcccat

SEQ ID NO: 217356 - DNA, 25 bp, Homo sapien
tcccatccagggacctaagagaaag

SEQ ID NO: 217357 - DNA, 25 bp, Homo sapien
gggcaaaggaggttctcagtcaata

SEQ ID NO: 217358 - DNA, 25 bp, Homo sapien
tatggtccacttcatgtgcctttca

SEQ ID NO: 217359 - DNA, 25 bp, Homo sapien
cttcatgtgcctttcagacttcaaa

SEQ ID NO: 217360 - DNA, 25 bp, Homo sapien
aaaatcgataagtagctccacctga

SEQ ID NO: 217361 - DNA, 25 bp, Homo sapien
aagtagctccacctgaagagggatg

SEQ ID NO: 217362 - DNA, 25 bp, Homo sapien
ctctgggtcaggaaacagctggaat

SEQ ID NO: 217363 - DNA, 25 bp, Homo sapien
aaacagctggaatccacactcacct

SEQ ID NO: 217364 - DNA, 25 bp, Homo sapien
ctcattcccattgtttggatcatgc

SEQ ID NO: 217365 - DNA, 25 bp, Homo sapien
ctttccaacacgtgttcacaatctc

SEQ ID NO: 217366 - DNA, 25 bp, Homo sapien
acgtgttcacaatctccaaagggac

SEQ ID NO: 217367 - DNA, 25 bp, Homo sapien
acaatctccaaagggactgtatttc

SEQ ID NO: 217368 - DNA, 25 bp, Homo sapien
tcttctctgtgcttaatgtgatttg

SEQ ID NO: 217369 - DNA, 25 bp, Homo sapien
caccccagctggtctgcttggattt

SEQ ID NO: 217370 - DNA, 25 bp, Homo sapien
accccagctggtctgcttggatttc

SEQ ID NO: 217371 - DNA, 25 bp, Homo sapien
ccagctggtctgcttggatttccta

SEQ ID NO: 217372 - DNA, 25 bp, Homo sapien
cagctggtctgcttggatttcctac

SEQ ID NO: 217373 - DNA, 25 bp, Homo sapien
agctggtctgcttggatttcctaca

SEQ ID NO: 217374 - DNA, 25 bp, Homo sapien
gctggtctgcttggatttcctacag

SEQ ID NO: 217375 - DNA, 25 bp, Homo sapien
ctggtctgcttggatttcctacagc

SEQ ID NO: 217376 - DNA, 25 bp, Homo sapien
ttcctacagcccccgtgggcatgga

SEQ ID NO: 217377 - DNA, 25 bp, Homo sapien
gacctgggcctgacgggcccttctc

SEQ ID NO: 217378 - DNA, 25 bp, Homo sapien
cgggcccttctcagcccgttttgag

SEQ ID NO: 217379 - DNA, 25 bp, Homo sapien
agacagtcccccgaggtaggctaca

SEQ ID NO: 217380 - DNA, 25 bp, Homo sapien
cactggagagcgacggctgccccaa

SEQ ID NO: 217381 - DNA, 25 bp, Homo sapien
aaggagccagctaagactcagcccg

SEQ ID NO: 217382 - DNA, 25 bp, Homo sapien
gccacggccgcagaaaagtacaaac

SEQ ID NO: 217383 - DNA, 25 bp, Homo sapien
gagggagagcgcaaagacattgttt

SEQ ID NO: 217384 - DNA, 25 bp, Homo sapien
acattgtttcatcctccatgccaag

SEQ ID NO: 217385 - DNA, 25 bp, Homo sapien
ccatgccaaggccaaacagagagga

SEQ ID NO: 217386 - DNA, 25 bp, Homo sapien
cggacgcccgtgaccgagagagtta

SEQ ID NO: 217387 - DNA, 25 bp, Homo sapien
gaccgagagagttagctgactttac

SEQ ID NO: 217388 - DNA, 25 bp, Homo sapien
gactttacacggagcggattgcaaa

SEQ ID NO: 217389 - DNA, 25 bp, Homo sapien
aataaaggcagctgttgtctcttct

SEQ ID NO: 217390 - DNA, 25 bp, Homo sapien
tgtctcttctccttatgggtagggc

SEQ ID NO: 217391 - DNA, 25 bp, Homo sapien
tgacgtagaccgtttgcttctttaa

SEQ ID NO: 217392 - DNA, 25 bp, Homo sapien
ttctttaactccagccgcggaatga

SEQ ID NO: 217393 - DNA, 25 bp, Homo sapien
actccagccgcggaatgacattagt

SEQ ID NO: 217394 - DNA, 25 bp, Homo sapien
atgacattagtggaaccgggctagg

SEQ ID NO: 217395 - DNA, 25 bp, Homo sapien
tggaagttcaggatgccaccacctt

SEQ ID NO: 217396 - DNA, 25 bp, Homo sapien
gatgccaccaccttgaacacctagg

SEQ ID NO: 217397 - DNA, 25 bp, Homo sapien
tgtcccgggtttctttcttcgagag

SEQ ID NO: 217398 - DNA, 25 bp, Homo sapien
tcttcgagagtatagaaccgttcat

SEQ ID NO: 217399 - DNA, 25 bp, Homo sapien
aaccgttcattcttgctttgtgtcc

SEQ ID NO: 217400 - DNA, 25 bp, Homo sapien
gtgtcccattccatctcttgaaaaa

SEQ ID NO: 217401 - DNA, 25 bp, Homo sapien
gggacattcaatctagtcttttaaa

SEQ ID NO: 217402 - DNA, 25 bp, Homo sapien
attgtattttcactcgatgccttgg

SEQ ID NO: 217403 - DNA, 25 bp, Homo sapien
tcactcgatgccttggctgagagaa

SEQ ID NO: 217404 - DNA, 25 bp, Homo sapien
gaagacctaaagactctgggttgat

SEQ ID NO: 217405 - DNA, 25 bp, Homo sapien
ggttgatacctgaaagaatcctgtc

SEQ ID NO: 217406 - DNA, 25 bp, Homo sapien
ttggtctccataatcctttgaatgg

SEQ ID NO: 217407 - DNA, 25 bp, Homo sapien
gtgacctgtgagagattgaaccatg

SEQ ID NO: 217408 - DNA, 25 bp, Homo sapien
aatatgaaaaccctggattctgagt

SEQ ID NO: 217409 - DNA, 25 bp, Homo sapien
gggcagggcgtttagtactgtctcc

SEQ ID NO: 217410 - DNA, 25 bp, Homo sapien
tttagtactgtctcccctttaccag

SEQ ID NO: 217411 - DNA, 25 bp, Homo sapien
agcaaacctgacttcaccatgttta

SEQ ID NO: 217412 - DNA, 25 bp, Homo sapien
accatgtttattccctttgcctaca

SEQ ID NO: 217413 - DNA, 25 bp, Homo sapien
gagaaactgtgttaggcatgtatta

SEQ ID NO: 217414 - DNA, 25 bp, Homo sapien
tttctacaatttctttgccgcttcc

SEQ ID NO: 217415 - DNA, 25 bp, Homo sapien
tacaatttctttgccgcttccttga

SEQ ID NO: 217416 - DNA, 25 bp, Homo sapien
tctttgccgcttccttgaattggaa

SEQ ID NO: 217417 - DNA, 25 bp, Homo sapien
tgccgcttccttgaattggaaaaat

SEQ ID NO: 217418 - DNA, 25 bp, Homo sapien
gaaccggttaagtgaactatgataa

SEQ ID NO: 217419 - DNA, 25 bp, Homo sapien
gataatatttttgctgactacccag

SEQ ID NO: 217420 - DNA, 25 bp, Homo sapien
atatttttgctgactacccagttga

SEQ ID NO: 217421 - DNA, 25 bp, Homo sapien
ttttgctgactacccagttgaagaa

SEQ ID NO: 217422 - DNA, 25 bp, Homo sapien
cattatattgtgaaccatcagctga

SEQ ID NO: 217423 - DNA, 25 bp, Homo sapien
ttgtgaaccatcagctgaaaagata

SEQ ID NO: 217424 - DNA, 25 bp, Homo sapien
taagtgtttaggctctatgtggctc

SEQ ID NO: 217425 - DNA, 25 bp, Homo sapien
tctatgtggctcacgcagccagaat

SEQ ID NO: 217426 - DNA, 25 bp, Homo sapien
gcagccagaatccttaagtctgtgt

SEQ ID NO: 217427 - DNA, 25 bp, Homo sapien
aagactgggctcacattctggcttt

SEQ ID NO: 217428 - DNA, 25 bp, Homo sapien
ggctttgtccataacaatgctctgg

SEQ ID NO: 217429 - DNA, 25 bp, Homo sapien
tgggatttcagggagttccctcatt

SEQ ID NO: 217430 - DNA, 25 bp, Homo sapien
cagggagttccctcatttgtaaaat

SEQ ID NO: 217431 - DNA, 25 bp, Homo sapien
gcaggtgatatccatgtttcttccc

SEQ ID NO: 217432 - DNA, 25 bp, Homo sapien
cttccctttctgatattgttgtctg

SEQ ID NO: 217433 - DNA, 25 bp, Homo sapien
attgttgtctgtggcatattctttg

SEQ ID NO: 217434 - DNA, 25 bp, Homo sapien
ggcatattctttgtatggcgaattt

SEQ ID NO: 217435 - DNA, 25 bp, Homo sapien
cctttatcgccatctatttccatta

SEQ ID NO: 217436 - DNA, 25 bp, Homo sapien
tttccattaatgtgcttccgtcatc

SEQ ID NO: 217437 - DNA, 25 bp, Homo sapien
attaatgtgcttccgtcatctcttt

SEQ ID NO: 217438 - DNA, 25 bp, Homo sapien
tttctaccaccataccaatagctgt

SEQ ID NO: 217439 - DNA, 25 bp, Homo sapien
accagctctcacagtataggatcca

SEQ ID NO: 217440 - DNA, 25 bp, Homo sapien
aaacaagggctccaacttcatctcc

SEQ ID NO: 217441 - DNA, 25 bp, Homo sapien
gcgcgactcctaccctaagggctaa

SEQ ID NO: 217442 - DNA, 25 bp, Homo sapien
taccctaagggctaactggcgaagt

SEQ ID NO: 217443 - DNA, 25 bp, Homo sapien
taactggcgaagtgactgcagtggc

SEQ ID NO: 217444 - DNA, 25 bp, Homo sapien
tgcagtggccgcgactgcgagtctc

SEQ ID NO: 217445 - DNA, 25 bp, Homo sapien
gagtctcgaggagcgatagcccctg

SEQ ID NO: 217446 - DNA, 25 bp, Homo sapien
gaagacctcgtcacctgtgagttga

SEQ ID NO: 217447 - DNA, 25 bp, Homo sapien
gacctcgtcacctgtgagttgatgt

SEQ ID NO: 217448 - DNA, 25 bp, Homo sapien
tgagttgatgtagaggagagccacc

SEQ ID NO: 217449 - DNA, 25 bp, Homo sapien
ggagagccacctgacagctgaccag

SEQ ID NO: 217450 - DNA, 25 bp, Homo sapien
acagctgaccaggtgaagagaggat

SEQ ID NO: 217451 - DNA, 25 bp, Homo sapien
agaactgagtgagccaagaatcctg

SEQ ID NO: 217452 - DNA, 25 bp, Homo sapien
tgagccaagaatcctggtctccttg

SEQ ID NO: 217453 - DNA, 25 bp, Homo sapien
ggtaacatttgagtaggtgtcattt

SEQ ID NO: 217454 - DNA, 25 bp, Homo sapien
atagttggtgaatgtcacaaatgcc

SEQ ID NO: 217455 - DNA, 25 bp, Homo sapien
aaatgccttctatgttgtttgctct

SEQ ID NO: 217456 - DNA, 25 bp, Homo sapien
tgttgtttgctctgtagacatgaaa

SEQ ID NO: 217457 - DNA, 25 bp, Homo sapien
acaagcaattttttggccgtcaccg

SEQ ID NO: 217458 - DNA, 25 bp, Homo sapien
ggccgtcaccgatgggttgtatata

SEQ ID NO: 217459 - DNA, 25 bp, Homo sapien
tggaagcatggtgcctcctgaatgg

SEQ ID NO: 217460 - DNA, 25 bp, Homo sapien
tcctgaatggcatcgttggcttcac

SEQ ID NO: 217461 - DNA, 25 bp, Homo sapien
atcgttggcttcacagtatgactga

SEQ ID NO: 217462 - DNA, 25 bp, Homo sapien
gtatgactgatgatcctccaacaac

SEQ ID NO: 217463 - DNA, 25 bp, Homo sapien
cgtaaattcatttggacgaaccata

SEQ ID NO: 217464 - DNA, 25 bp, Homo sapien
taaattcaacgtgactggcacccca

SEQ ID NO: 217465 - DNA, 25 bp, Homo sapien
tgactggcaccccagaacaatatgt

SEQ ID NO: 217466 - DNA, 25 bp, Homo sapien
atatgtaccttattctaccactaga

SEQ ID NO: 217467 - DNA, 25 bp, Homo sapien
gaagattcaggagtggatcccacct

SEQ ID NO: 217468 - DNA, 25 bp, Homo sapien
tgggaactggcacccatgggcccac

SEQ ID NO: 217469 - DNA, 25 bp, Homo sapien
atgggcccacccatgagtgatggtt

SEQ ID NO: 217470 - DNA, 25 bp, Homo sapien
gcccacccatgagtgatggttctgg

SEQ ID NO: 217471 - DNA, 25 bp, Homo sapien
gcagagagataatcaccgcaccgtt

SEQ ID NO: 217472 - DNA, 25 bp, Homo sapien
agagagataatcaccgcaccgtttc

SEQ ID NO: 217473 - DNA, 25 bp, Homo sapien
gagagataatcaccgcaccgtttcc

SEQ ID NO: 217474 - DNA, 25 bp, Homo sapien
agataatcaccgcaccgtttccaga

SEQ ID NO: 217475 - DNA, 25 bp, Homo sapien
ataatcaccgcaccgtttccagatg

SEQ ID NO: 217476 - DNA, 25 bp, Homo sapien
aatcaccgcaccgtttccagatgta

SEQ ID NO: 217477 - DNA, 25 bp, Homo sapien
gtaatactgcaaagaaaaccaatga

SEQ ID NO: 217478 - DNA, 25 bp, Homo sapien
aaaaccaatgatgaggccgggtgcg

SEQ ID NO: 217479 - DNA, 25 bp, Homo sapien
tgagagcacacgcaattcctactgg

SEQ ID NO: 217480 - DNA, 25 bp, Homo sapien
acacgcaattcctactggtgaaatt

SEQ ID NO: 217481 - DNA, 25 bp, Homo sapien
gggattccaaataaacacttgcaca

SEQ ID NO: 217482 - DNA, 25 bp, Homo sapien
ataaacacttgcacacatttttgaa

SEQ ID NO: 217483 - DNA, 25 bp, Homo sapien
cacacatttttgaagtgcggctaga

SEQ ID NO: 217484 - DNA, 25 bp, Homo sapien
gcggctagattctcagattcacctt

SEQ ID NO: 217485 - DNA, 25 bp, Homo sapien
attcacctttcttccagggaagata

SEQ ID NO: 217486 - DNA, 25 bp, Homo sapien
cttccagggaagataactttcaatc

SEQ ID NO: 217487 - DNA, 25 bp, Homo sapien
tataaaaatctctgtcctaaaacta

SEQ ID NO: 217488 - DNA, 25 bp, Homo sapien
gaagagacttactaacttacatata

SEQ ID NO: 217489 - DNA, 25 bp, Homo sapien
agcccttttgtttggtctatcagta

SEQ ID NO: 217490 - DNA, 25 bp, Homo sapien
ctctcaggctgcagtcactgacagt

SEQ ID NO: 217491 - DNA, 25 bp, Homo sapien
tcaggctgcagtcactgacagtgcc

SEQ ID NO: 217492 - DNA, 25 bp, Homo sapien
caggctgcagtcactgacagtgccc

SEQ ID NO: 217493 - DNA, 25 bp, Homo sapien
ctgcagtcactgacagtgcccaggg

SEQ ID NO: 217494 - DNA, 25 bp, Homo sapien
gggtgtctctcacagctaataaagt

SEQ ID NO: 217495 - DNA, 25 bp, Homo sapien
gtgtgggactgagaagcaagatatc

SEQ ID NO: 217496 - DNA, 25 bp, Homo sapien
gaagcaagatatcaatgtagcagaa

SEQ ID NO: 217497 - DNA, 25 bp, Homo sapien
tgtagcagaattgcacttgtgcctc

SEQ ID NO: 217498 - DNA, 25 bp, Homo sapien
gcagaattgcacttgtgcctcacga

SEQ ID NO: 217499 - DNA, 25 bp, Homo sapien
cagaattgcacttgtgcctcacgaa

SEQ ID NO: 217500 - DNA, 25 bp, Homo sapien
tcatcctgagatgggagcagtctcc

SEQ ID NO: 217501 - DNA, 25 bp, Homo sapien
ttggaaatcttcctttccaggggat

SEQ ID NO: 217502 - DNA, 25 bp, Homo sapien
tggaaatcttcctttccaggggatg

SEQ ID NO: 217503 - DNA, 25 bp, Homo sapien
ggaaatcttcctttccaggggatgt

SEQ ID NO: 217504 - DNA, 25 bp, Homo sapien
gaaatcttcctttccaggggatgtg

SEQ ID NO: 217505 - DNA, 25 bp, Homo sapien
aaatcttcctttccaggggatgtgg

SEQ ID NO: 217506 - DNA, 25 bp, Homo sapien
aatcttcctttccaggggatgtggc

SEQ ID NO: 217507 - DNA, 25 bp, Homo sapien
atcttcctttccaggggatgtggct

SEQ ID NO: 217508 - DNA, 25 bp, Homo sapien
tcttcctttccaggggatgtggctc

SEQ ID NO: 217509 - DNA, 25 bp, Homo sapien
tgcagagagataatcaccgcaccgt

SEQ ID NO: 217510 - DNA, 25 bp, Homo sapien
gcagagagataatcaccgcaccgtt

SEQ ID NO: 217511 - DNA, 25 bp, Homo sapien
cagagagataatcaccgcaccgttt

SEQ ID NO: 217512 - DNA, 25 bp, Homo sapien
agagagataatcaccgcaccgtttc

SEQ ID NO: 217513 - DNA, 25 bp, Homo sapien
gagagataatcaccgcaccgtttcc

SEQ ID NO: 217514 - DNA, 25 bp, Homo sapien
agagataatcaccgcaccgtttcca

SEQ ID NO: 217515 - DNA, 25 bp, Homo sapien
agataatcaccgcaccgtttccaga

SEQ ID NO: 217516 - DNA, 25 bp, Homo sapien
gataatcaccgcaccgtttccagat

SEQ ID NO: 217517 - DNA, 25 bp, Homo sapien
ataatcaccgcaccgtttccagatg

SEQ ID NO: 217518 - DNA, 25 bp, Homo sapien
taatcaccgcaccgtttccagatgt

SEQ ID NO: 217519 - DNA, 25 bp, Homo sapien
aatcaccgcaccgtttccagatgta

SEQ ID NO: 217520 - DNA, 25 bp, Homo sapien
gggtttctctgcagaagctctcttt

SEQ ID NO: 217521 - DNA, 25 bp, Homo sapien
gcagaagctctctttttgcctcctg

SEQ ID NO: 217522 - DNA, 25 bp, Homo sapien
ctcctgccatccacatacgatgtga

SEQ ID NO: 217523 - DNA, 25 bp, Homo sapien
ctttgtcttccgctatgattgtgag

SEQ ID NO: 217524 - DNA, 25 bp, Homo sapien
ctcagccatgtggaattgtaagttc

SEQ ID NO: 217525 - DNA, 25 bp, Homo sapien
attgtaagttcaataaacctctttg

SEQ ID NO: 217526 - DNA, 25 bp, Homo sapien
gactaatacaacaagtaaatcactg

SEQ ID NO: 217527 - DNA, 25 bp, Homo sapien
aaatcactgaacatttaatcccagc

SEQ ID NO: 217528 - DNA, 25 bp, Homo sapien
catttaatcccagcagttctctttt

SEQ ID NO: 217529 - DNA, 25 bp, Homo sapien
ttaatcccagcagttctcttttttc

SEQ ID NO: 217530 - DNA, 25 bp, Homo sapien
aatcccagcagttctcttttttcaa

SEQ ID NO: 217531 - DNA, 25 bp, Homo sapien
gcagttttgctcttttgtacatttt

SEQ ID NO: 217532 - DNA, 25 bp, Homo sapien
tgtacattttccgaaactacagtta

SEQ ID NO: 217533 - DNA, 25 bp, Homo sapien
gggagcataagtttacagcctacag

SEQ ID NO: 217534 - DNA, 25 bp, Homo sapien
gcataagtttacagcctacaggacg

SEQ ID NO: 217535 - DNA, 25 bp, Homo sapien
gtttacagcctacaggacgtacaca

SEQ ID NO: 217536 - DNA, 25 bp, Homo sapien
gacgtacacaatatcctgctgctgg

SEQ ID NO: 217537 - DNA, 25 bp, Homo sapien
gtacacaatatcctgctgctgggaa

SEQ ID NO: 217538 - DNA, 25 bp, Homo sapien
tatcctgctgctgggaaaaccacag

SEQ ID NO: 217539 - DNA, 25 bp, Homo sapien
ttaataggtttggtgcttatcttct

SEQ ID NO: 217540 - DNA, 25 bp, Homo sapien
aggtttggtgcttatcttctaataa

SEQ ID NO: 217541 - DNA, 25 bp, Homo sapien
tgtcacaaactgtagcacaaataat

SEQ ID NO: 217542 - DNA, 25 bp, Homo sapien
gagaagcaagatatcaatgtagcag

SEQ ID NO: 217543 - DNA, 25 bp, Homo sapien
gaagcaagatatcaatgtagcagaa

SEQ ID NO: 217544 - DNA, 25 bp, Homo sapien
agcaagatatcaatgtagcagaatt

SEQ ID NO: 217545 - DNA, 25 bp, Homo sapien
aatgtagcagaattgcacttgtgcc

SEQ ID NO: 217546 - DNA, 25 bp, Homo sapien
atgtagcagaattgcacttgtgcct

SEQ ID NO: 217547 - DNA, 25 bp, Homo sapien
tgtagcagaattgcacttgtgcctc

SEQ ID NO: 217548 - DNA, 25 bp, Homo sapien
gtagcagaattgcacttgtgcctca

SEQ ID NO: 217549 - DNA, 25 bp, Homo sapien
tagcagaattgcacttgtgcctcac

SEQ ID NO: 217550 - DNA, 25 bp, Homo sapien
agcagaattgcacttgtgcctcacg

SEQ ID NO: 217551 - DNA, 25 bp, Homo sapien
gcagaattgcacttgtgcctcacga

SEQ ID NO: 217552 - DNA, 25 bp, Homo sapien
cagaattgcacttgtgcctcacgaa

SEQ ID NO: 217553 - DNA, 25 bp, Homo sapien
ataaagaatgccaaatgctctggag

SEQ ID NO: 217554 - DNA, 25 bp, Homo sapien
aacaagccacttatgtctttttatt

SEQ ID NO: 217555 - DNA, 25 bp, Homo sapien
gaaaaacttgcttttggcgccatca

SEQ ID NO: 217556 - DNA, 25 bp, Homo sapien
gcttttggcgccatcaaaaaggaaa

SEQ ID NO: 217557 - DNA, 25 bp, Homo sapien
ttcctttctacaattgaagccattt

SEQ ID NO: 217558 - DNA, 25 bp, Homo sapien
gaagccatttactactttctggtag

SEQ ID NO: 217559 - DNA, 25 bp, Homo sapien
ttactactttctggtagactaccat

SEQ ID NO: 217560 - DNA, 25 bp, Homo sapien
ggtagactaccatactgatatatta

SEQ ID NO: 217561 - DNA, 25 bp, Homo sapien
gagggcaatatgacaatcttttatt

SEQ ID NO: 217562 - DNA, 25 bp, Homo sapien
ctattcttttatgtaccagttgata

SEQ ID NO: 217563 - DNA, 25 bp, Homo sapien
atgtaccagttgataaagaatgcca

SEQ ID NO: 217564 - DNA, 25 bp, Homo sapien
ttccagagggtttatgtacaaggcg

SEQ ID NO: 217565 - DNA, 25 bp, Homo sapien
caaggcgaaggataggtatacatga

SEQ ID NO: 217566 - DNA, 25 bp, Homo sapien
gcaaaaggatatccaatttctcaag

SEQ ID NO: 217567 - DNA, 25 bp, Homo sapien
agaattttctactgagccaacctat

SEQ ID NO: 217568 - DNA, 25 bp, Homo sapien
attttctactgagccaacctatcta

SEQ ID NO: 217569 - DNA, 25 bp, Homo sapien
gagccaacctatctatcaagtatga

SEQ ID NO: 217570 - DNA, 25 bp, Homo sapien
agcaccctttctaaggacaccatag

SEQ ID NO: 217571 - DNA, 25 bp, Homo sapien
ccctttctaaggacaccataggaga

SEQ ID NO: 217572 - DNA, 25 bp, Homo sapien
aggagaatgtactctgcactctgca

SEQ ID NO: 217573 - DNA, 25 bp, Homo sapien
gaatgtactctgcactctgcaaaaa

SEQ ID NO: 217574 - DNA, 25 bp, Homo sapien
gtactctgcactctgcaaaaaagaa

SEQ ID NO: 217575 - DNA, 25 bp, Homo sapien
acaccctacccatggtactgtatgc

SEQ ID NO: 217576 - DNA, 25 bp, Homo sapien
ggtactgtatgctattaactcctgg

SEQ ID NO: 217577 - DNA, 25 bp, Homo sapien
tgctattaactcctggaaacgcccc

SEQ ID NO: 217578 - DNA, 25 bp, Homo sapien
gaaacgccccgtaaatgcgagttgt

SEQ ID NO: 217579 - DNA, 25 bp, Homo sapien
gtatttgtgtgttgagatgggcctt

SEQ ID NO: 217580 - DNA, 25 bp, Homo sapien
tggtttctctgtactcagagcacat

SEQ ID NO: 217581 - DNA, 25 bp, Homo sapien
gtactcagagcacatttcttgtaat

SEQ ID NO: 217582 - DNA, 25 bp, Homo sapien
atttttattgtcatgactgcccctg

SEQ ID NO: 217583 - DNA, 25 bp, Homo sapien
actgcccctgagctctggtgagaaa

SEQ ID NO: 217584 - DNA, 25 bp, Homo sapien
tatatcattactgtgtatctgtgta

SEQ ID NO: 217585 - DNA, 25 bp, Homo sapien
ctgtgtattgtactaaatggactga

SEQ ID NO: 217586 - DNA, 25 bp, Homo sapien
agggaagctgcctttgcatcagact

SEQ ID NO: 217587 - DNA, 25 bp, Homo sapien
gcatcagactctctaaggactggaa

SEQ ID NO: 217588 - DNA, 25 bp, Homo sapien
gaaggtcacgatcatctcagagcat

SEQ ID NO: 217589 - DNA, 25 bp, Homo sapien
atctcagagcatttgtaaggcagga

SEQ ID NO: 217590 - DNA, 25 bp, Homo sapien
ggagaaagtacagatgccctcagct

SEQ ID NO: 217591 - DNA, 25 bp, Homo sapien
cagcttgcctcatgtcaaactgaaa

SEQ ID NO: 217592 - DNA, 25 bp, Homo sapien
tttctttccaggcatagcagttctt

SEQ ID NO: 217593 - DNA, 25 bp, Homo sapien
agcagttctttagccatacatatca

SEQ ID NO: 217594 - DNA, 25 bp, Homo sapien
tagccatacatatcattgcatgaac

SEQ ID NO: 217595 - DNA, 25 bp, Homo sapien
tgaactatttcgaaagcccttctaa

SEQ ID NO: 217596 - DNA, 25 bp, Homo sapien
tgaaaggcagtttataagcccgtta

SEQ ID NO: 217597 - DNA, 25 bp, Homo sapien
ctatgactacgaggcagccgacagc

SEQ ID NO: 217598 - DNA, 25 bp, Homo sapien
tacgaggcagccgacagcagtgagc

SEQ ID NO: 217599 - DNA, 25 bp, Homo sapien
gcagccgacagcagtgagctggccc

SEQ ID NO: 217600 - DNA, 25 bp, Homo sapien
tggctgatgagctcatcactgtcta

SEQ ID NO: 217601 - DNA, 25 bp, Homo sapien
tgatgagctcatcactgtctacagc

SEQ ID NO: 217602 - DNA, 25 bp, Homo sapien
tgagctcatcactgtctacagcctg

SEQ ID NO: 217603 - DNA, 25 bp, Homo sapien
actgtctacagcctgcctggcatgg

SEQ ID NO: 217604 - DNA, 25 bp, Homo sapien
tggcatggaccctgactggctcatt

SEQ ID NO: 217605 - DNA, 25 bp, Homo sapien
gaccctgactggctcattggcgaga

SEQ ID NO: 217606 - DNA, 25 bp, Homo sapien
ggctcattggcgagagaggcaacaa

SEQ ID NO: 217607 - DNA, 25 bp, Homo sapien
agaggcaacaagaagggcaaggtcc

SEQ ID NO: 217608 - DNA, 25 bp, Homo sapien
tacttcttctttccaggacctgaca

SEQ ID NO: 217609 - DNA, 25 bp, Homo sapien
gttatgtccaaacttagcacctgca

SEQ ID NO: 217610 - DNA, 25 bp, Homo sapien
ttagcacctgcaattgttgggatgt

SEQ ID NO: 217611 - DNA, 25 bp, Homo sapien
tgtgtgtgcgtctgcgagcgcacac

SEQ ID NO: 217612 - DNA, 25 bp, Homo sapien
gcacacacatgcacaagtgcgaagg

SEQ ID NO: 217613 - DNA, 25 bp, Homo sapien
aaggagttgcggttgctccatgttc

SEQ ID NO: 217614 - DNA, 25 bp, Homo sapien
gctccatgttctgacttagggcaat

SEQ ID NO: 217615 - DNA, 25 bp, Homo sapien
gggtctgtctgtacagttactcatg

SEQ ID NO: 217616 - DNA, 25 bp, Homo sapien
gtctgtacagttactcatgtcattg

SEQ ID NO: 217617 - DNA, 25 bp, Homo sapien
gtcattgtaatgatttcactcctaa

SEQ ID NO: 217618 - DNA, 25 bp, Homo sapien
gatttcactcctaactgtgacattt

SEQ ID NO: 217619 - DNA, 25 bp, Homo sapien
actgagtttgctatgaagaagataa

SEQ ID NO: 217620 - DNA, 25 bp, Homo sapien
gctctgtgacattgatggggccaag

SEQ ID NO: 217621 - DNA, 25 bp, Homo sapien
gatcatccaaactgagtccatctgg

SEQ ID NO: 217622 - DNA, 25 bp, Homo sapien
atcatccaaactgagtccatctggc

SEQ ID NO: 217623 - DNA, 25 bp, Homo sapien
tcatccaaactgagtccatctggct

SEQ ID NO: 217624 - DNA, 25 bp, Homo sapien
catccaaactgagtccatctggcta

SEQ ID NO: 217625 - DNA, 25 bp, Homo sapien
tccatctggctaattctaaatatac

SEQ ID NO: 217626 - DNA, 25 bp, Homo sapien
ccatctggctaattctaaatataca

SEQ ID NO: 217627 - DNA, 25 bp, Homo sapien
catctggctaattctaaatatacat

SEQ ID NO: 217628 - DNA, 25 bp, Homo sapien
atctggctaattctaaatatacata

SEQ ID NO: 217629 - DNA, 25 bp, Homo sapien
tggctaattctaaatatacatatct

SEQ ID NO: 217630 - DNA, 25 bp, Homo sapien
atatatagcaactcagggcctggga

SEQ ID NO: 217631 - DNA, 25 bp, Homo sapien
ggcaatccgttcttagggactggat

SEQ ID NO: 217632 - DNA, 25 bp, Homo sapien
tagggactggatacttctggctggc

SEQ ID NO: 217633 - DNA, 25 bp, Homo sapien
cttctggctggctgagtatagtact

SEQ ID NO: 217634 - DNA, 25 bp, Homo sapien
tggctgagtatagtactagctgcct

SEQ ID NO: 217635 - DNA, 25 bp, Homo sapien
ccaccaggttccgagtagtgtctga

SEQ ID NO: 217636 - DNA, 25 bp, Homo sapien
tagtgtctgagactctgctctgcag

SEQ ID NO: 217637 - DNA, 25 bp, Homo sapien
ctctgctctgcagggcctagggtag

SEQ ID NO: 217638 - DNA, 25 bp, Homo sapien
ggagtgtagaagtggcctgccctta

SEQ ID NO: 217639 - DNA, 25 bp, Homo sapien
gcctgcccttaactgttttcactaa

SEQ ID NO: 217640 - DNA, 25 bp, Homo sapien
tgttttcactaaacagctttttcta

SEQ ID NO: 217641 - DNA, 25 bp, Homo sapien
tcaagaatttctggcaatgggcaat

SEQ ID NO: 217642 - DNA, 25 bp, Homo sapien
aatggtcatcgattgtctcacgtat

SEQ ID NO: 217643 - DNA, 25 bp, Homo sapien
gattgtctcacgtattttctgggct

SEQ ID NO: 217644 - DNA, 25 bp, Homo sapien
tattttctgggctcttgcaagtcac

SEQ ID NO: 217645 - DNA, 25 bp, Homo sapien
ttgcaagtcacccatctcaggaaaa

SEQ ID NO: 217646 - DNA, 25 bp, Homo sapien
gattaatgtcaggaccatttctctt

SEQ ID NO: 217647 - DNA, 25 bp, Homo sapien
ccacgcagcccctagaaagtagtaa

SEQ ID NO: 217648 - DNA, 25 bp, Homo sapien
tgtgaggctattctggctccccagg

SEQ ID NO: 217649 - DNA, 25 bp, Homo sapien
gctccccagggcttacgtgggaaga

SEQ ID NO: 217650 - DNA, 25 bp, Homo sapien
ttttttcccagcctcctgtaggtct

SEQ ID NO: 217651 - DNA, 25 bp, Homo sapien
gtctctctctccacttagcaagcaa

SEQ ID NO: 217652 - DNA, 25 bp, Homo sapien
gtttgcctgcctgaggagttacagt

SEQ ID NO: 217653 - DNA, 25 bp, Homo sapien
gagttacagttttgtcattgtggga

SEQ ID NO: 217654 - DNA, 25 bp, Homo sapien
cactgggtcttttgggaggcgtcta

SEQ ID NO: 217655 - DNA, 25 bp, Homo sapien
ttgggaggcgtctagcgttcctgct

SEQ ID NO: 217656 - DNA, 25 bp, Homo sapien
gacaaagacccagaatagaactcgt

SEQ ID NO: 217657 - DNA, 25 bp, Homo sapien
tagaactcgtagctcgtgactgcac

SEQ ID NO: 217658 - DNA, 25 bp, Homo sapien
tgactgcacggtttacgccacaaaa

SEQ ID NO: 217659 - DNA, 25 bp, Homo sapien
ggtttacgccacaaaagtgctcttg

SEQ ID NO: 217660 - DNA, 25 bp, Homo sapien
aaaagtgctcttgacatccgtgaca

SEQ ID NO: 217661 - DNA, 25 bp, Homo sapien
ttgacatccgtgacaccgttttgac

SEQ ID NO: 217662 - DNA, 25 bp, Homo sapien
tccgtgacaccgttttgactttttg

SEQ ID NO: 217663 - DNA, 25 bp, Homo sapien
gaaggccctgaaagtaagtggttct

SEQ ID NO: 217664 - DNA, 25 bp, Homo sapien
aaagtaagtggttcttctgactgcc

SEQ ID NO: 217665 - DNA, 25 bp, Homo sapien
ggttcttctgactgccgtgaaacag

SEQ ID NO: 217666 - DNA, 25 bp, Homo sapien
taggaaccaattcccagtaaaactg

SEQ ID NO: 217667 - DNA, 25 bp, Homo sapien
ggaaagaatctttccagaatcatcc

SEQ ID NO: 217668 - DNA, 25 bp, Homo sapien
gaatcatcccatggataatgatgac

SEQ ID NO: 217669 - DNA, 25 bp, Homo sapien
agaagtcaccgatgaaccactggaa

SEQ ID NO: 217670 - DNA, 25 bp, Homo sapien
gaaccactggaacaagactatttag

SEQ ID NO: 217671 - DNA, 25 bp, Homo sapien
ttacatgcagtattttacacacagt

SEQ ID NO: 217672 - DNA, 25 bp, Homo sapien
tacacacagttctggttttaacact

SEQ ID NO: 217673 - DNA, 25 bp, Homo sapien
tatgtaaaaaagtgcacctttagtt

SEQ ID NO: 217674 - DNA, 25 bp, Homo sapien
aaagccagggcaaaggacctggcgt

SEQ ID NO: 217675 - DNA, 25 bp, Homo sapien
aagccagggcaaaggacctggcgtg

SEQ ID NO: 217676 - DNA, 25 bp, Homo sapien
agccagggcaaaggacctggcgtgg

SEQ ID NO: 217677 - DNA, 25 bp, Homo sapien
aggacctggcgtggccacttcctcc

SEQ ID NO: 217678 - DNA, 25 bp, Homo sapien
acctggcgtggccacttcctcctgc

SEQ ID NO: 217679 - DNA, 25 bp, Homo sapien
tctgggaacaggcagctcctatctg

SEQ ID NO: 217680 - DNA, 25 bp, Homo sapien
ctgggaacaggcagctcctatctgc

SEQ ID NO: 217681 - DNA, 25 bp, Homo sapien
tgggaacaggcagctcctatctgca

SEQ ID NO: 217682 - DNA, 25 bp, Homo sapien
agctcctatctgcaaactgtgttca

SEQ ID NO: 217683 - DNA, 25 bp, Homo sapien
gctcctatctgcaaactgtgttcac

SEQ ID NO: 217684 - DNA, 25 bp, Homo sapien
ctcctatctgcaaactgtgttcacc

SEQ ID NO: 217685 - DNA, 25 bp, Homo sapien
atatgtgatttgaaccatggttgac

SEQ ID NO: 217686 - DNA, 25 bp, Homo sapien
tgaaccatggttgacttacaagtgt

SEQ ID NO: 217687 - DNA, 25 bp, Homo sapien
gacttacaagtgtcactacagcttt

SEQ ID NO: 217688 - DNA, 25 bp, Homo sapien
tacagctttttagaaaacatagccc

SEQ ID NO: 217689 - DNA, 25 bp, Homo sapien
atatatgttaagcaggacccgggtg

SEQ ID NO: 217690 - DNA, 25 bp, Homo sapien
ttgcgctttatgtagagctggaaga

SEQ ID NO: 217691 - DNA, 25 bp, Homo sapien
gagctggaagaaggccgtccatcct

SEQ ID NO: 217692 - DNA, 25 bp, Homo sapien
gtccatcctgtctcttgggcggaca

SEQ ID NO: 217693 - DNA, 25 bp, Homo sapien
gggcggacagtgtactttcctaata

SEQ ID NO: 217694 - DNA, 25 bp, Homo sapien
gaagcacaatggaaatacccctgaa

SEQ ID NO: 217695 - DNA, 25 bp, Homo sapien
tacccctgaaccgttttattgcagt

SEQ ID NO: 217696 - DNA, 25 bp, Homo sapien
aagcggcggcgtatctcggctgcta

SEQ ID NO: 217697 - DNA, 25 bp, Homo sapien
cggctgctacgaacctatctgagag

SEQ ID NO: 217698 - DNA, 25 bp, Homo sapien
ctatctgagagacaagtgaccattt

SEQ ID NO: 217699 - DNA, 25 bp, Homo sapien
aagaaaattgtctccaagctcaaag

SEQ ID NO: 217700 - DNA, 25 bp, Homo sapien
gtctccaagctcaaagatactgtct

SEQ ID NO: 217701 - DNA, 25 bp, Homo sapien
ggatgtggctctaaatcagccggac

SEQ ID NO: 217702 - DNA, 25 bp, Homo sapien
aatcagccggacatgtgcgtctacc

SEQ ID NO: 217703 - DNA, 25 bp, Homo sapien
gacatgtgcgtctaccgaagaggga

SEQ ID NO: 217704 - DNA, 25 bp, Homo sapien
gagagtgccttacaccaaactgcag

SEQ ID NO: 217705 - DNA, 25 bp, Homo sapien
caaactgcagcttaaagaactggag

SEQ ID NO: 217706 - DNA, 25 bp, Homo sapien
gaactggagaacgagtatgccatta

SEQ ID NO: 217707 - DNA, 25 bp, Homo sapien
tcatgctctgagtactgttcctgta

SEQ ID NO: 217708 - DNA, 25 bp, Homo sapien
gtacctgacggatgctccagactgg

SEQ ID NO: 217709 - DNA, 25 bp, Homo sapien
tggcttccagtttcactctcagcat

SEQ ID NO: 217710 - DNA, 25 bp, Homo sapien
tcagcattccaagatcttagccctt

SEQ ID NO: 217711 - DNA, 25 bp, Homo sapien
agaacagaacgcttgcatctacctc

SEQ ID NO: 217712 - DNA, 25 bp, Homo sapien
ggctcttttgatgcacaatatccat

SEQ ID NO: 217713 - DNA, 25 bp, Homo sapien
tatccatccgttttgatttcatctt

SEQ ID NO: 217714 - DNA, 25 bp, Homo sapien
gatttcatctttatgtcccctttat

SEQ ID NO: 217715 - DNA, 25 bp, Homo sapien
tttatctccaacttctagaactccc

SEQ ID NO: 217716 - DNA, 25 bp, Homo sapien
ctagaactcccagtttatacctgtg

SEQ ID NO: 217717 - DNA, 25 bp, Homo sapien
tgtgtcactctcaattttttccagt

SEQ ID NO: 217718 - DNA, 25 bp, Homo sapien
acagcttggctcaggggcagtgcat

SEQ ID NO: 217719 - DNA, 25 bp, Homo sapien
ctctctgccagagggcacagaacat

SEQ ID NO: 217720 - DNA, 25 bp, Homo sapien
gccagagggcacagaacatgtttgt

SEQ ID NO: 217721 - DNA, 25 bp, Homo sapien
agggcacagaacatgtttgtttaat

SEQ ID NO: 217722 - DNA, 25 bp, Homo sapien
tttgtttaatgaacctgcctgcctc

SEQ ID NO: 217723 - DNA, 25 bp, Homo sapien
ttgtttaatgaacctgcctgcctca

SEQ ID NO: 217724 - DNA, 25 bp, Homo sapien
ggggagttaatgcatctacaccact

SEQ ID NO: 217725 - DNA, 25 bp, Homo sapien
ggaatttctgagatcccatggaggt

SEQ ID NO: 217726 - DNA, 25 bp, Homo sapien
tctgagatcccatggaggttagatt

SEQ ID NO: 217727 - DNA, 25 bp, Homo sapien
aaagatgtcctttttgtgagaggga

SEQ ID NO: 217728 - DNA, 25 bp, Homo sapien
tgtgagagggatggaattgttttct

SEQ ID NO: 217729 - DNA, 25 bp, Homo sapien
tcttttgatttatcacttacccaaa

SEQ ID NO: 217730 - DNA, 25 bp, Homo sapien
gatttatcacttacccaaaattatt

SEQ ID NO: 217731 - DNA, 25 bp, Homo sapien
aaaatataccgtgttggtggtgaat

SEQ ID NO: 217732 - DNA, 25 bp, Homo sapien
taccgtgttggtggtgaatgactat

SEQ ID NO: 217733 - DNA, 25 bp, Homo sapien
gaatgactattgatgactgtgttaa

SEQ ID NO: 217734 - DNA, 25 bp, Homo sapien
actgtgttaagtgcatctgtattgt

SEQ ID NO: 217735 - DNA, 25 bp, Homo sapien
gtgcatctgtattgtaagtgaaatg

SEQ ID NO: 217736 - DNA, 25 bp, Homo sapien
gtaattatttctgtgtaccatatgg

SEQ ID NO: 217737 - DNA, 25 bp, Homo sapien
ttctgtgtaccatatggagtaacta

SEQ ID NO: 217738 - DNA, 25 bp, Homo sapien
gagtaactaaggtcattgtttttga

SEQ ID NO: 217739 - DNA, 25 bp, Homo sapien
aaggatagcataatatctgcattat

SEQ ID NO: 217740 - DNA, 25 bp, Homo sapien
gatggccccaaactctctgcaaaca

SEQ ID NO: 217741 - DNA, 25 bp, Homo sapien
ctctgcaaacatccatgccaggaaa

SEQ ID NO: 217742 - DNA, 25 bp, Homo sapien
gagcccgagatgatgcatgacgcat

SEQ ID NO: 217743 - DNA, 25 bp, Homo sapien
tgcatgacgcatggcatttccaaga

SEQ ID NO: 217744 - DNA, 25 bp, Homo sapien
ggcatttccaagagccctgacagct

SEQ ID NO: 217745 - DNA, 25 bp, Homo sapien
tttctgtatgcacaagcttcccagc

SEQ ID NO: 217746 - DNA, 25 bp, Homo sapien
tccccacagtgtacctttttgctaa

SEQ ID NO: 217747 - DNA, 25 bp, Homo sapien
aaaacacttattacccttctgcagc

SEQ ID NO: 217748 - DNA, 25 bp, Homo sapien
aaggcattaaaagcgctaagcatat

SEQ ID NO: 217749 - DNA, 25 bp, Homo sapien
gctagaaatagtgtaggtccccttc

SEQ ID NO: 217750 - DNA, 25 bp, Homo sapien
taggtccccttcttgctttcaatat

SEQ ID NO: 217751 - DNA, 25 bp, Homo sapien
aggtactccagctaccaaggctcca

SEQ ID NO: 217752 - DNA, 25 bp, Homo sapien
aaggctccaggaacggctacctggg

SEQ ID NO: 217753 - DNA, 25 bp, Homo sapien
ctacctgggaggacatggcttcaac

SEQ ID NO: 217754 - DNA, 25 bp, Homo sapien
ttcaacgccagggtcatgctggaaa

SEQ ID NO: 217755 - DNA, 25 bp, Homo sapien
atgctggaaactcaggagctccttc

SEQ ID NO: 217756 - DNA, 25 bp, Homo sapien
gagctccttcgccaggaacagaggc

SEQ ID NO: 217757 - DNA, 25 bp, Homo sapien
cagcaactatgactcgtataagaaa

SEQ ID NO: 217758 - DNA, 25 bp, Homo sapien
tcgtataagaaagtccaggacccca

SEQ ID NO: 217759 - DNA, 25 bp, Homo sapien
tccccttctcaggttgcgaggctga

SEQ ID NO: 217760 - DNA, 25 bp, Homo sapien
aggttgcgaggctgaacagacttca

SEQ ID NO: 217761 - DNA, 25 bp, Homo sapien
gaacagacttcagactcctgagaaa

SEQ ID NO: 217762 - DNA, 25 bp, Homo sapien
gtaaactgagagatgcaaatgtaat

SEQ ID NO: 217763 - DNA, 25 bp, Homo sapien
atataattatagtagtggccttgtt

SEQ ID NO: 217764 - DNA, 25 bp, Homo sapien
tatagtagtggccttgttttacaaa

SEQ ID NO: 217765 - DNA, 25 bp, Homo sapien
taaagtcccatacatttggaccatg

SEQ ID NO: 217766 - DNA, 25 bp, Homo sapien
agtcccatacatttggaccatggca

SEQ ID NO: 217767 - DNA, 25 bp, Homo sapien
tcccatacatttggaccatggcagc

SEQ ID NO: 217768 - DNA, 25 bp, Homo sapien
catggcagctaattttgtaacttaa

SEQ ID NO: 217769 - DNA, 25 bp, Homo sapien
gcagctaattttgtaacttaagcat

SEQ ID NO: 217770 - DNA, 25 bp, Homo sapien
atgaactacctatggacatctatta

SEQ ID NO: 217771 - DNA, 25 bp, Homo sapien
gaactacctatggacatctattaaa

SEQ ID NO: 217772 - DNA, 25 bp, Homo sapien
ggacatctattaaagtgattgacaa

SEQ ID NO: 217773 - DNA, 25 bp, Homo sapien
gagatgcaggtaaaactgctccagt

SEQ ID NO: 217774 - DNA, 25 bp, Homo sapien
gcaggtaaaactgctccagtccctg

SEQ ID NO: 217775 - DNA, 25 bp, Homo sapien
atcaacctcttcaacacagcctttg

SEQ ID NO: 217776 - DNA, 25 bp, Homo sapien
acctcttcaacacagcctttgggct

SEQ ID NO: 217777 - DNA, 25 bp, Homo sapien
gggatatccccccagtctgctcagg

SEQ ID NO: 217778 - DNA, 25 bp, Homo sapien
tggagacaaccacgtggtgcctgta

SEQ ID NO: 217779 - DNA, 25 bp, Homo sapien
agacaaccacgtggtgcctgtactg

SEQ ID NO: 217780 - DNA, 25 bp, Homo sapien
acgtggtgcctgtactgcgctaact

SEQ ID NO: 217781 - DNA, 25 bp, Homo sapien
tgtactgcgctaactcctgattaat

SEQ ID NO: 217782 - DNA, 25 bp, Homo sapien
actgcgctaactcctgattaataca

SEQ ID NO: 217783 - DNA, 25 bp, Homo sapien
gcgctaactcctgattaatacaatg

SEQ ID NO: 217784 - DNA, 25 bp, Homo sapien
ctgcaccatgactgtcgtactggat

SEQ ID NO: 217785 - DNA, 25 bp, Homo sapien
gtaactagtctaccagtgacctcag

SEQ ID NO: 217786 - DNA, 25 bp, Homo sapien
tcagggcactttgggcttggctaga

SEQ ID NO: 217787 - DNA, 25 bp, Homo sapien
gcttggctagatcactcactgttgt

SEQ ID NO: 217788 - DNA, 25 bp, Homo sapien
cactcactgttgtagcttctgttgt

SEQ ID NO: 217789 - DNA, 25 bp, Homo sapien
ttttgaagttgcagtccatcacctt

SEQ ID NO: 217790 - DNA, 25 bp, Homo sapien
ctttgagccctagctaagtcactga

SEQ ID NO: 217791 - DNA, 25 bp, Homo sapien
aagctatactagctcacatctgaag

SEQ ID NO: 217792 - DNA, 25 bp, Homo sapien
tgaagtcaacatgaagtttcctact

SEQ ID NO: 217793 - DNA, 25 bp, Homo sapien
ttcctacttccttgtctttgaaata

SEQ ID NO: 217794 - DNA, 25 bp, Homo sapien
aattagaccccagggagtgacctct

SEQ ID NO: 217795 - DNA, 25 bp, Homo sapien
tgccacacgttatcttagtcctgaa

SEQ ID NO: 217796 - DNA, 25 bp, Homo sapien
tagtcctgaaaaggctcctgccaag

SEQ ID NO: 217797 - DNA, 25 bp, Homo sapien
atttgaccttatagaaccatgccag

SEQ ID NO: 217798 - DNA, 25 bp, Homo sapien
accatgccaggtttgggtagagtgt

SEQ ID NO: 217799 - DNA, 25 bp, Homo sapien
tttaagggcccttattttgagatgg

SEQ ID NO: 217800 - DNA, 25 bp, Homo sapien
gagatggtatgcctgagacctgctt

SEQ ID NO: 217801 - DNA, 25 bp, Homo sapien
gtatgcctgagacctgctttccatt

SEQ ID NO: 217802 - DNA, 25 bp, Homo sapien
gctttccattccctcagggaagttt

SEQ ID NO: 217803 - DNA, 25 bp, Homo sapien
ttttttgacgctaagtgtgccctac

SEQ ID NO: 217804 - DNA, 25 bp, Homo sapien
tgacgctaagtgtgccctactgtct

SEQ ID NO: 217805 - DNA, 25 bp, Homo sapien
tccctttgtgtatccggcaccaggc

SEQ ID NO: 217806 - DNA, 25 bp, Homo sapien
tttgcttcatgccatgtgacctcac

SEQ ID NO: 217807 - DNA, 25 bp, Homo sapien
gcttcatgccatgtgacctcacagt

SEQ ID NO: 217808 - DNA, 25 bp, Homo sapien
tcacagtaaacatctctgcctttgc

SEQ ID NO: 217809 - DNA, 25 bp, Homo sapien
cagtaaacatctctgcctttgcctg

SEQ ID NO: 217810 - DNA, 25 bp, Homo sapien
ggagatgttttagatcagtaacagc

SEQ ID NO: 217811 - DNA, 25 bp, Homo sapien
agatcagtaacagctaataggaata

SEQ ID NO: 217812 - DNA, 25 bp, Homo sapien
aatttctccttgttctacctatcac

SEQ ID NO: 217813 - DNA, 25 bp, Homo sapien
ttgttctacctatcaccacattttc

SEQ ID NO: 217814 - DNA, 25 bp, Homo sapien
tacctatcaccacattttctcaaat

SEQ ID NO: 217815 - DNA, 25 bp, Homo sapien
atcaccacattttctcaaattgaac

SEQ ID NO: 217816 - DNA, 25 bp, Homo sapien
cacattttctcaaattgaactcttt

SEQ ID NO: 217817 - DNA, 25 bp, Homo sapien
atttgtatacagtgttgttgatgaa

SEQ ID NO: 217818 - DNA, 25 bp, Homo sapien
tatttaactagagcatgatatttta

SEQ ID NO: 217819 - DNA, 25 bp, Homo sapien
aaaattctgccaaactattacttat

SEQ ID NO: 217820 - DNA, 25 bp, Homo sapien
attctgccaaactattacttatatg

SEQ ID NO: 217821 - DNA, 25 bp, Homo sapien
tctgccaaactattacttatatgta

SEQ ID NO: 217822 - DNA, 25 bp, Homo sapien
actattacttatatgtactattgtg

SEQ ID NO: 217823 - DNA, 25 bp, Homo sapien
ctattgtgtaacatactttcttgaa

SEQ ID NO: 217824 - DNA, 25 bp, Homo sapien
attgtgtaacatactttcttgaaat

SEQ ID NO: 217825 - DNA, 25 bp, Homo sapien
gaattgaaggttcttatcagatggg

SEQ ID NO: 217826 - DNA, 25 bp, Homo sapien
tgaaggttcttatcagatgggatac

SEQ ID NO: 217827 - DNA, 25 bp, Homo sapien
gggatactggggactataaacaatg

SEQ ID NO: 217828 - DNA, 25 bp, Homo sapien
cagtttactcatttcgattcagaat

SEQ ID NO: 217829 - DNA, 25 bp, Homo sapien
aaacatattccaagggcaggttcga

SEQ ID NO: 217830 - DNA, 25 bp, Homo sapien
aagggcaggttcgattctagctcta

SEQ ID NO: 217831 - DNA, 25 bp, Homo sapien
gcaggttcgattctagctctaatta

SEQ ID NO: 217832 - DNA, 25 bp, Homo sapien
ttctagctctaattactgtcatgtc

SEQ ID NO: 217833 - DNA, 25 bp, Homo sapien
actgtcatgtcatttacccactgga

SEQ ID NO: 217834 - DNA, 25 bp, Homo sapien
ggtatgtttcacttcttgacaatat

SEQ ID NO: 217835 - DNA, 25 bp, Homo sapien
ttgacaatataaatgctgcagcaaa

SEQ ID NO: 217836 - DNA, 25 bp, Homo sapien
aaccgatacctgtcctgcaggtcta

SEQ ID NO: 217837 - DNA, 25 bp, Homo sapien
tgtcctgcaggtctaaaatttgaat

SEQ ID NO: 217838 - DNA, 25 bp, Homo sapien
tggaaattcaagcacaagtactggg

SEQ ID NO: 217839 - DNA, 25 bp, Homo sapien
atccaatgtgccaatccttatcttg

SEQ ID NO: 217840 - DNA, 25 bp, Homo sapien
gtgccaatccttatcttgggtaaca

SEQ ID NO: 217841 - DNA, 25 bp, Homo sapien
aaactccgtgagatatttgggcttt

SEQ ID NO: 217842 - DNA, 25 bp, Homo sapien
gggctttatggacagaccacaggaa

SEQ ID NO: 217843 - DNA, 25 bp, Homo sapien
tgaaggagctgaatgctcgccccat

SEQ ID NO: 217844 - DNA, 25 bp, Homo sapien
aatgctcgccccatggaagtgttca

SEQ ID NO: 217845 - DNA, 25 bp, Homo sapien
ggaagtgttcatgtgcagtgtgctc

SEQ ID NO: 217846 - DNA, 25 bp, Homo sapien
cagtgtgctcaagaggcaaggttac

SEQ ID NO: 217847 - DNA, 25 bp, Homo sapien
ttacggcgagggtttccgctggctc

SEQ ID NO: 217848 - DNA, 25 bp, Homo sapien
ctggctctcccagtatattgactga

SEQ ID NO: 217849 - DNA, 25 bp, Homo sapien
attgactgatgtttggacggtgaaa

SEQ ID NO: 217850 - DNA, 25 bp, Homo sapien
ttgccatgcttttcatcatatgcac

SEQ ID NO: 217851 - DNA, 25 bp, Homo sapien
gccatgcttttcatcatatgcacca

SEQ ID NO: 217852 - DNA, 25 bp, Homo sapien
catgcttttcatcatatgcaccaaa

SEQ ID NO: 217853 - DNA, 25 bp, Homo sapien
tgcttttcatcatatgcaccaaatg

SEQ ID NO: 217854 - DNA, 25 bp, Homo sapien
agattaagggtctctttgccatgct

SEQ ID NO: 217855 - DNA, 25 bp, Homo sapien
attaagggtctctttgccatgcttt

SEQ ID NO: 217856 - DNA, 25 bp, Homo sapien
taagggtctctttgccatgcttttc

SEQ ID NO: 217857 - DNA, 25 bp, Homo sapien
aagggtctctttgccatgcttttca

SEQ ID NO: 217858 - DNA, 25 bp, Homo sapien
gggtctctttgccatgcttttcatc

SEQ ID NO: 217859 - DNA, 25 bp, Homo sapien
tctctttgccatgcttttcatcata

SEQ ID NO: 217860 - DNA, 25 bp, Homo sapien
tctttgccatgcttttcatcatatg

SEQ ID NO: 217861 - DNA, 25 bp, Homo sapien
ttgagtgtgttacctcctttccaag

SEQ ID NO: 217862 - DNA, 25 bp, Homo sapien
ttccaagctcctcgtgataatgcag

SEQ ID NO: 217863 - DNA, 25 bp, Homo sapien
gctcctcgtgataatgcagacttcc

SEQ ID NO: 217864 - DNA, 25 bp, Homo sapien
taacggagtttagagccagggctga

SEQ ID NO: 217865 - DNA, 25 bp, Homo sapien
gctgatgctttggtgtggccagcac

SEQ ID NO: 217866 - DNA, 25 bp, Homo sapien
tttggtgtggccagcactctgaaac

SEQ ID NO: 217867 - DNA, 25 bp, Homo sapien
gtggccagcactctgaaactgagaa

SEQ ID NO: 217868 - DNA, 25 bp, Homo sapien
gaatgtacggaaagatgatcagcta

SEQ ID NO: 217869 - DNA, 25 bp, Homo sapien
gatcagctattttcaacataactga

SEQ ID NO: 217870 - DNA, 25 bp, Homo sapien
actgaaggcatatgctggcccataa

SEQ ID NO: 217871 - DNA, 25 bp, Homo sapien
atgctggcccataaacaccctgtag

SEQ ID NO: 217872 - DNA, 25 bp, Homo sapien
agctggcggctgaggcggagcgtga

SEQ ID NO: 217873 - DNA, 25 bp, Homo sapien
aggcggagcgtgaccagcccttgcg

SEQ ID NO: 217874 - DNA, 25 bp, Homo sapien
gaggagtgacgcctcccgggaggag

SEQ ID NO: 217875 - DNA, 25 bp, Homo sapien
agctggcacagcaggtcaaccccga

SEQ ID NO: 217876 - DNA, 25 bp, Homo sapien
cgaggagatccagctgggcgaggac

SEQ ID NO: 217877 - DNA, 25 bp, Homo sapien
aggacgagatggacctggagcccaa

SEQ ID NO: 217878 - DNA, 25 bp, Homo sapien
gatggacctggagcccaacgaggtt

SEQ ID NO: 217879 - DNA, 25 bp, Homo sapien
gacctggagcccaacgaggttcggc

SEQ ID NO: 217880 - DNA, 25 bp, Homo sapien
ccaacgaggttcggctggagcagca

SEQ ID NO: 217881 - DNA, 25 bp, Homo sapien
gcagagcgtgccagccgcagtgttt

SEQ ID NO: 217882 - DNA, 25 bp, Homo sapien
catccccaatacagctacgtttgta

SEQ ID NO: 217883 - DNA, 25 bp, Homo sapien
atgcctacacattcagtacaacctg

SEQ ID NO: 217884 - DNA, 25 bp, Homo sapien
gtacaacctgatggcattaattctg

SEQ ID NO: 217885 - DNA, 25 bp, Homo sapien
cctgatggcattaattctgtggttg

SEQ ID NO: 217886 - DNA, 25 bp, Homo sapien
gtgaaatcgataataccacagttct

SEQ ID NO: 217887 - DNA, 25 bp, Homo sapien
ataccacagttctaaatgtgcactg

SEQ ID NO: 217888 - DNA, 25 bp, Homo sapien
aaatgtgcactgttggctgaactta

SEQ ID NO: 217889 - DNA, 25 bp, Homo sapien
actgttggctgaacttatggtgtgg

SEQ ID NO: 217890 - DNA, 25 bp, Homo sapien
ggcttctaagaaaggatgggactct

SEQ ID NO: 217891 - DNA, 25 bp, Homo sapien
caaggagtaaatggccccagcagat

SEQ ID NO: 217892 - DNA, 25 bp, Homo sapien
gcaaatgtaatcacctgcattttga

SEQ ID NO: 217893 - DNA, 25 bp, Homo sapien
ggtgtgtttctgagaatttgtttga

SEQ ID NO: 217894 - DNA, 25 bp, Homo sapien
tgctggctgtgaaaactgagctccc

SEQ ID NO: 217895 - DNA, 25 bp, Homo sapien
gctggctgtgaaaactgagctcccc

SEQ ID NO: 217896 - DNA, 25 bp, Homo sapien
ctggctgtgaaaactgagctccccg

SEQ ID NO: 217897 - DNA, 25 bp, Homo sapien
tggctgtgaaaactgagctccccga

SEQ ID NO: 217898 - DNA, 25 bp, Homo sapien
ggctgtgaaaactgagctccccgaa

SEQ ID NO: 217899 - DNA, 25 bp, Homo sapien
gctgtgaaaactgagctccccgaag

SEQ ID NO: 217900 - DNA, 25 bp, Homo sapien
ctgtgaaaactgagctccccgaaga

SEQ ID NO: 217901 - DNA, 25 bp, Homo sapien
gagctccccgaagaccggatacagg

SEQ ID NO: 217902 - DNA, 25 bp, Homo sapien
agctccccgaagaccggatacaggt

SEQ ID NO: 217903 - DNA, 25 bp, Homo sapien
gatattgtgtacaccatgcccatgt

SEQ ID NO: 217904 - DNA, 25 bp, Homo sapien
caccatgcccatgtatatacaagta

SEQ ID NO: 217905 - DNA, 25 bp, Homo sapien
acacagatgtacacatgctccagcc

SEQ ID NO: 217906 - DNA, 25 bp, Homo sapien
ctgcctgcgtctgtgctcaaagcag

SEQ ID NO: 217907 - DNA, 25 bp, Homo sapien
tctgtgctcaaagcagcagctccaa

SEQ ID NO: 217908 - DNA, 25 bp, Homo sapien
agccttctgagcagaccaggtacct

SEQ ID NO: 217909 - DNA, 25 bp, Homo sapien
gagcagaccaggtaccttggctgca

SEQ ID NO: 217910 - DNA, 25 bp, Homo sapien
aggtaccttggctgcaccggtgtgt

SEQ ID NO: 217911 - DNA, 25 bp, Homo sapien
tgcaccggtgtgtggcccgctctca

SEQ ID NO: 217912 - DNA, 25 bp, Homo sapien
caccatggatctccgtgtacactat

SEQ ID NO: 217913 - DNA, 25 bp, Homo sapien
ggatctccgtgtacactatcaataa

SEQ ID NO: 217914 - DNA, 25 bp, Homo sapien
atactcatactgtaaactgcaggag

SEQ ID NO: 217915 - DNA, 25 bp, Homo sapien
taaggagttgtttccaccaagtcct

SEQ ID NO: 217916 - DNA, 25 bp, Homo sapien
ggagctagaggctaccaggcaaaac

SEQ ID NO: 217917 - DNA, 25 bp, Homo sapien
aaccagagtactgttgctgtccaca

SEQ ID NO: 217918 - DNA, 25 bp, Homo sapien
tgttgctgtccacagccatgagcca

SEQ ID NO: 217919 - DNA, 25 bp, Homo sapien
atgagccactcctcagtgatggtgc

SEQ ID NO: 217920 - DNA, 25 bp, Homo sapien
gtgcacagttggatttcgatgccct

SEQ ID NO: 217921 - DNA, 25 bp, Homo sapien
tttcgatgccctatgtgacaatgat

SEQ ID NO: 217922 - DNA, 25 bp, Homo sapien
acagccatggctgcatttatgaatt

SEQ ID NO: 217923 - DNA, 25 bp, Homo sapien
acttcagtgacatccagtggaccct

SEQ ID NO: 217924 - DNA, 25 bp, Homo sapien
agtggaccctctagcctttgatttt

SEQ ID NO: 217925 - DNA, 25 bp, Homo sapien
aaacttcagcaaccctacagtatat

SEQ ID NO: 217926 - DNA, 25 bp, Homo sapien
gatgataaacactggaactctcagt

SEQ ID NO: 217927 - DNA, 25 bp, Homo sapien
gaactctcagtgcaaaacatcccaa

SEQ ID NO: 217928 - DNA, 25 bp, Homo sapien
tacgtccgagcactgacttcagaga

SEQ ID NO: 217929 - DNA, 25 bp, Homo sapien
aacaataaactcgtgggctggcggt

SEQ ID NO: 217930 - DNA, 25 bp, Homo sapien
gtggatacggatagacacgtcctgt

SEQ ID NO: 217931 - DNA, 25 bp, Homo sapien
acggatagacacgtcctgtgtgtgt

SEQ ID NO: 217932 - DNA, 25 bp, Homo sapien
ctgtgtgtgtgccttgtcgagaaaa

SEQ ID NO: 217933 - DNA, 25 bp, Homo sapien
gtgtgccttgtcgagaaaaatcgga

SEQ ID NO: 217934 - DNA, 25 bp, Homo sapien
agaacatgaattggcatctctcccc

SEQ ID NO: 217935 - DNA, 25 bp, Homo sapien
attggcatctctccccatatataaa

SEQ ID NO: 217936 - DNA, 25 bp, Homo sapien
gggactgcctgtgaggcctctgaaa

SEQ ID NO: 217937 - DNA, 25 bp, Homo sapien
ctgtgaggcctctgaaataattgaa

SEQ ID NO: 217938 - DNA, 25 bp, Homo sapien
gaaggaactatctgaagaaatcact

SEQ ID NO: 217939 - DNA, 25 bp, Homo sapien
agaaatcactacactcttagagaat

SEQ ID NO: 217940 - DNA, 25 bp, Homo sapien
ttagagaatccctctgttctccagc

SEQ ID NO: 217941 - DNA, 25 bp, Homo sapien
tgttctccagcaaacatgggatgta

SEQ ID NO: 217942 - DNA, 25 bp, Homo sapien
atgggatgtaaagcctcacagggaa

SEQ ID NO: 217943 - DNA, 25 bp, Homo sapien
gataatacatacttctgtcaaccag

SEQ ID NO: 217944 - DNA, 25 bp, Homo sapien
catacttctgtcaaccagaaccaga

SEQ ID NO: 217945 - DNA, 25 bp, Homo sapien
cagaggcagcctttggtacttaaaa

SEQ ID NO: 217946 - DNA, 25 bp, Homo sapien
gtagctgattaaatttttcccaaca

SEQ ID NO: 217947 - DNA, 25 bp, Homo sapien
caggaggattgctgtcagcctagtt

SEQ ID NO: 217948 - DNA, 25 bp, Homo sapien
gtcagcctagtttctttctgggaat

SEQ ID NO: 217949 - DNA, 25 bp, Homo sapien
gaatatggctccctagtgttggaaa

SEQ ID NO: 217950 - DNA, 25 bp, Homo sapien
gcagtgcctcgtggacagatggtca

SEQ ID NO: 217951 - DNA, 25 bp, Homo sapien
gacagatggtcatttagcctctggg

SEQ ID NO: 217952 - DNA, 25 bp, Homo sapien
gaaatacttgcaataccaggtcact

SEQ ID NO: 217953 - DNA, 25 bp, Homo sapien
accaggtcactctgtggtccaaaag

SEQ ID NO: 217954 - DNA, 25 bp, Homo sapien
ggtcacattcagttgtcatcaggca

SEQ ID NO: 217955 - DNA, 25 bp, Homo sapien
aggcaactttaacccttagagtgct

SEQ ID NO: 217956 - DNA, 25 bp, Homo sapien
cattaagctgaaattgccccacggc

SEQ ID NO: 217957 - DNA, 25 bp, Homo sapien
acccattgactctgccttcatcaag

SEQ ID NO: 217958 - DNA, 25 bp, Homo sapien
aaatgtccccaagtgagtgggctcc

SEQ ID NO: 217959 - DNA, 25 bp, Homo sapien
tgtcactgccagtcacccacaggaa

SEQ ID NO: 217960 - DNA, 25 bp, Homo sapien
agtcacccacaggaagggactggtg

SEQ ID NO: 217961 - DNA, 25 bp, Homo sapien
tggtgatgggctgtctctacccgga

SEQ ID NO: 217962 - DNA, 25 bp, Homo sapien
gtctctacccggagcgtgcgggatt

SEQ ID NO: 217963 - DNA, 25 bp, Homo sapien
gtgcgggattcagcaccaggctctt

SEQ ID NO: 217964 - DNA, 25 bp, Homo sapien
cactgtgggtcttcccgtgggatgc

SEQ ID NO: 217965 - DNA, 25 bp, Homo sapien
tcctgagaccgaagggtgtttggtt

SEQ ID NO: 217966 - DNA, 25 bp, Homo sapien
aaaaagaagactgggcgtccgctct

SEQ ID NO: 217967 - DNA, 25 bp, Homo sapien
aagactgggcgtccgctcttccagg

SEQ ID NO: 217968 - DNA, 25 bp, Homo sapien
caggagctcttctgccctgaacgct

SEQ ID NO: 217969 - DNA, 25 bp, Homo sapien
gtgtgcctcaggatcaccaggtgca

SEQ ID NO: 217970 - DNA, 25 bp, Homo sapien
atgctgctgcagtgagtggttccac

SEQ ID NO: 217971 - DNA, 25 bp, Homo sapien
tgagtggttccactgcctggataac

SEQ ID NO: 217972 - DNA, 25 bp, Homo sapien
cactgcctggataacccttgaggaa

SEQ ID NO: 217973 - DNA, 25 bp, Homo sapien
gataacccttgaggaacacgtcagt

SEQ ID NO: 217974 - DNA, 25 bp, Homo sapien
ggaacacgtcagttactgtcacgat

SEQ ID NO: 217975 - DNA, 25 bp, Homo sapien
gggcaggtggagctccttcctattt

SEQ ID NO: 217976 - DNA, 25 bp, Homo sapien
gtggagctccttcctattttttggg

SEQ ID NO: 217977 - DNA, 25 bp, Homo sapien
aagacctgggtcttgacacggccct

SEQ ID NO: 217978 - DNA, 25 bp, Homo sapien
cacccgtgctgctcaagtgcaaatg

SEQ ID NO: 217979 - DNA, 25 bp, Homo sapien
gtgctgctcaagtgcaaatggactt

SEQ ID NO: 217980 - DNA, 25 bp, Homo sapien
aaattgcctttatgagtgataccca

SEQ ID NO: 217981 - DNA, 25 bp, Homo sapien
gtgatacccatttgagggcctctaa

SEQ ID NO: 217982 - DNA, 25 bp, Homo sapien
ttgagggcctctaaacccttcaatt

SEQ ID NO: 217983 - DNA, 25 bp, Homo sapien
ggttctgatcttaccggctagtggt

SEQ ID NO: 217984 - DNA, 25 bp, Homo sapien
gatcttaccggctagtggtcatttt

SEQ ID NO: 217985 - DNA, 25 bp, Homo sapien
taaaaaacttgtaccctcttatctg

SEQ ID NO: 217986 - DNA, 25 bp, Homo sapien
gtaccctcttatctgaaatcctgtt

SEQ ID NO: 217987 - DNA, 25 bp, Homo sapien
ttatctgaaatcctgtttctggaat

SEQ ID NO: 217988 - DNA, 25 bp, Homo sapien
ggaatttggccattttaagtgattt

SEQ ID NO: 217989 - DNA, 25 bp, Homo sapien
ctcttctataatattcctacttccc

SEQ ID NO: 217990 - DNA, 25 bp, Homo sapien
tacttcccataataatgactgattt

SEQ ID NO: 217991 - DNA, 25 bp, Homo sapien
aagcagcgctggctcaaggcctttg

SEQ ID NO: 217992 - DNA, 25 bp, Homo sapien
tggctcaaggcctttgccagggaga

SEQ ID NO: 217993 - DNA, 25 bp, Homo sapien
cagctggaccaggagacaggcttct

SEQ ID NO: 217994 - DNA, 25 bp, Homo sapien
aggcttctccatcactgaactgcag

SEQ ID NO: 217995 - DNA, 25 bp, Homo sapien
tctccatcactgaactgcagaggaa

SEQ ID NO: 217996 - DNA, 25 bp, Homo sapien
gaagcaggccatgctgaatgccagc

SEQ ID NO: 217997 - DNA, 25 bp, Homo sapien
ggccatgctgaatgccagcaagcag

SEQ ID NO: 217998 - DNA, 25 bp, Homo sapien
cagcaagcagcaggtcacagggaag

SEQ ID NO: 217999 - DNA, 25 bp, Homo sapien
gaagcccaaagctgttggccggccc

SEQ ID NO: 218000 - DNA, 25 bp, Homo sapien
ctggcggagcccaggcgcaagccat

SEQ ID NO: 218001 - DNA, 25 bp, Homo sapien
aagccatctaccttctggcacagca

SEQ ID NO: 218002 - DNA, 25 bp, Homo sapien
aagcagcgctggctcaaggcctttg

SEQ ID NO: 218003 - DNA, 25 bp, Homo sapien
agcagcgctggctcaaggcctttgc

SEQ ID NO: 218004 - DNA, 25 bp, Homo sapien
gcttctccatcactgaactgcagag

SEQ ID NO: 218005 - DNA, 25 bp, Homo sapien
ttctccatcactgaactgcagagga

SEQ ID NO: 218006 - DNA, 25 bp, Homo sapien
ctccatcactgaactgcagaggaag

SEQ ID NO: 218007 - DNA, 25 bp, Homo sapien
aagcaggccatgctgaatgccagca

SEQ ID NO: 218008 - DNA, 25 bp, Homo sapien
caggccatgctgaatgccagcaagc

SEQ ID NO: 218009 - DNA, 25 bp, Homo sapien
gccctgctacctgacgcgccagaag

SEQ ID NO: 218010 - DNA, 25 bp, Homo sapien
tacctgacgcgccagaagcacccag

SEQ ID NO: 218011 - DNA, 25 bp, Homo sapien
ggcacagcatcagccggctggcacc

SEQ ID NO: 218012 - DNA, 25 bp, Homo sapien
ccggctggcacccttccgcaagtga

SEQ ID NO: 218013 - DNA, 25 bp, Homo sapien
tgtgatgacatcagccgacgcctgg

SEQ ID NO: 218014 - DNA, 25 bp, Homo sapien
ggaaagttgtcaatacctgtaaaga

SEQ ID NO: 218015 - DNA, 25 bp, Homo sapien
agagaatggctctactggtgcaaga

SEQ ID NO: 218016 - DNA, 25 bp, Homo sapien
aagagctttcaagccaccggtggga

SEQ ID NO: 218017 - DNA, 25 bp, Homo sapien
tgggacgcagcagatgacatccacc

SEQ ID NO: 218018 - DNA, 25 bp, Homo sapien
accgctccctcatggttgaccatgt

SEQ ID NO: 218019 - DNA, 25 bp, Homo sapien
gttgaccatgtgactgaggtcagtc

SEQ ID NO: 218020 - DNA, 25 bp, Homo sapien
agtctgttttcagaggaggcagcca

SEQ ID NO: 218021 - DNA, 25 bp, Homo sapien
gccaatgaagagaaatctgcagcca

SEQ ID NO: 218022 - DNA, 25 bp, Homo sapien
agccacagctgagaagaaccatacc

SEQ ID NO: 218023 - DNA, 25 bp, Homo sapien
gaaccataccataccaggcttccag

SEQ ID NO: 218024 - DNA, 25 bp, Homo sapien
ctgtctgtcacaagtagagtgaaag

SEQ ID NO: 218025 - DNA, 25 bp, Homo sapien
gtaagagttttgacaagttgtggca

SEQ ID NO: 218026 - DNA, 25 bp, Homo sapien
ggcaaaggaaactatacttttcatt

SEQ ID NO: 218027 - DNA, 25 bp, Homo sapien
gactgacaaatgttgaactgtacat

SEQ ID NO: 218028 - DNA, 25 bp, Homo sapien
gaactgtacatacatttatcagcat

SEQ ID NO: 218029 - DNA, 25 bp, Homo sapien
gtacatacatttatcagcataactg

SEQ ID NO: 218030 - DNA, 25 bp, Homo sapien
gtagaattcatcaacggtctcctaa

SEQ ID NO: 218031 - DNA, 25 bp, Homo sapien
aacggtctcctaatttttgcatcta

SEQ ID NO: 218032 - DNA, 25 bp, Homo sapien
ggtctcctaatttttgcatctacat

SEQ ID NO: 218033 - DNA, 25 bp, Homo sapien
cctaatttttgcatctacatctggg

SEQ ID NO: 218034 - DNA, 25 bp, Homo sapien
gggaaaaagctgtgatactatagtt

SEQ ID NO: 218035 - DNA, 25 bp, Homo sapien
gacagctttggaagaggtgtcctgc

SEQ ID NO: 218036 - DNA, 25 bp, Homo sapien
tgctgctgttaccagccatgtgggc

SEQ ID NO: 218037 - DNA, 25 bp, Homo sapien
ttaccagccatgtgggccccatagg

SEQ ID NO: 218038 - DNA, 25 bp, Homo sapien
tggtggagtcttccctcaaagcatg

SEQ ID NO: 218039 - DNA, 25 bp, Homo sapien
aaagcatgccttacccagctgggaa

SEQ ID NO: 218040 - DNA, 25 bp, Homo sapien
ccagctgggaagtctctgccctgat

SEQ ID NO: 218041 - DNA, 25 bp, Homo sapien
tgccctgatctggtactccttgtag

SEQ ID NO: 218042 - DNA, 25 bp, Homo sapien
gatctggtactccttgtagtaagct

SEQ ID NO: 218043 - DNA, 25 bp, Homo sapien
gtagtaagctgttttctgctcagcc

SEQ ID NO: 218044 - DNA, 25 bp, Homo sapien
tttctgctcagccactgggctcttt

SEQ ID NO: 218045 - DNA, 25 bp, Homo sapien
cactgggctctttcacttttttagt

SEQ ID NO: 218046 - DNA, 25 bp, Homo sapien
ttcctcacgcggctcttcgaaggct

SEQ ID NO: 218047 - DNA, 25 bp, Homo sapien
tcacgcggctcttcgaaggctctgg

SEQ ID NO: 218048 - DNA, 25 bp, Homo sapien
ggcggccgctctagggaagggacca

SEQ ID NO: 218049 - DNA, 25 bp, Homo sapien
tctagggaagggaccatggagctcc

SEQ ID NO: 218050 - DNA, 25 bp, Homo sapien
ggaagggaccatggagctccgaact

SEQ ID NO: 218051 - DNA, 25 bp, Homo sapien
aagggaccatggagctccgaactac

SEQ ID NO: 218052 - DNA, 25 bp, Homo sapien
gggaccatggagctccgaactaccc

SEQ ID NO: 218053 - DNA, 25 bp, Homo sapien
gaactacccctcagctgaaagtggt

SEQ ID NO: 218054 - DNA, 25 bp, Homo sapien
actacccctcagctgaaagtggtgg

SEQ ID NO: 218055 - DNA, 25 bp, Homo sapien
ctacccctcagctgaaagtggtggg

SEQ ID NO: 218056 - DNA, 25 bp, Homo sapien
agggccgcggcaatggagacccggg

SEQ ID NO: 218057 - DNA, 25 bp, Homo sapien
tcttgtgctcagtcgccctgttctt

SEQ ID NO: 218058 - DNA, 25 bp, Homo sapien
tgctcagtcgccctgttcttgaggt

SEQ ID NO: 218059 - DNA, 25 bp, Homo sapien
agtcgccctgttcttgaggtctctt

SEQ ID NO: 218060 - DNA, 25 bp, Homo sapien
tgttcttgaggtctcttttctctac

SEQ ID NO: 218061 - DNA, 25 bp, Homo sapien
ttgaggtctcttttctctactccat

SEQ ID NO: 218062 - DNA, 25 bp, Homo sapien
ttctctactccatggttctcaattt

SEQ ID NO: 218063 - DNA, 25 bp, Homo sapien
tactccatggttctcaatttatttg

SEQ ID NO: 218064 - DNA, 25 bp, Homo sapien
ccttgagcagaatacaatgggaaaa

SEQ ID NO: 218065 - DNA, 25 bp, Homo sapien
atacaatgggaaaagagtctctacc

SEQ ID NO: 218066 - DNA, 25 bp, Homo sapien
tctacccctttctgttcgaagttca

SEQ ID NO: 218067 - DNA, 25 bp, Homo sapien
ctacccctttctgttcgaagttcat

SEQ ID NO: 218068 - DNA, 25 bp, Homo sapien
caatgaatccattttatgaacccaa

SEQ ID NO: 218069 - DNA, 25 bp, Homo sapien
ttatgaacccaattctcctattcga

SEQ ID NO: 218070 - DNA, 25 bp, Homo sapien
atgaacccaattctcctattcgatc

SEQ ID NO: 218071 - DNA, 25 bp, Homo sapien
gaacccaattctcctattcgatcaa

SEQ ID NO: 218072 - DNA, 25 bp, Homo sapien
acccaattctcctattcgatcaagt

SEQ ID NO: 218073 - DNA, 25 bp, Homo sapien
ccaattctcctattcgatcaagtgc

SEQ ID NO: 218074 - DNA, 25 bp, Homo sapien
aattctcctattcgatcaagtgcat

SEQ ID NO: 218075 - DNA, 25 bp, Homo sapien
ttctcctattcgatcaagtgcattt

SEQ ID NO: 218076 - DNA, 25 bp, Homo sapien
tctcctattcgatcaagtgcatttg

SEQ ID NO: 218077 - DNA, 25 bp, Homo sapien
tattcgatcaagtgcatttgacaga

SEQ ID NO: 218078 - DNA, 25 bp, Homo sapien
gtgcatttgacagaaaagttcagtt

SEQ ID NO: 218079 - DNA, 25 bp, Homo sapien
gaaagtcctggaatagattatgtac

SEQ ID NO: 218080 - DNA, 25 bp, Homo sapien
gcaacagtaactagtgtcttggaat

SEQ ID NO: 218081 - DNA, 25 bp, Homo sapien
ctagtgtcttggaatatctgagtaa

SEQ ID NO: 218082 - DNA, 25 bp, Homo sapien
aagagactttactccagaattggga

SEQ ID NO: 218083 - DNA, 25 bp, Homo sapien
ttatgctttattggcttgtcttgaa

SEQ ID NO: 218084 - DNA, 25 bp, Homo sapien
aaagcctttgttacctgaggctcat

SEQ ID NO: 218085 - DNA, 25 bp, Homo sapien
tgaggctcattcactgattcggcag

SEQ ID NO: 218086 - DNA, 25 bp, Homo sapien
tcactgattcggcagcttgcaagaa

SEQ ID NO: 218087 - DNA, 25 bp, Homo sapien
gcagcttgcaagaaggtgctctgaa

SEQ ID NO: 218088 - DNA, 25 bp, Homo sapien
ggtgctctgaagtgaggctcttagt

SEQ ID NO: 218089 - DNA, 25 bp, Homo sapien
attttgaccaacgtgatttagctga

SEQ ID NO: 218090 - DNA, 25 bp, Homo sapien
tatcgccctctgcaagtggcgaatg

SEQ ID NO: 218091 - DNA, 25 bp, Homo sapien
gtggcgaatgaacaaaatcctgggc

SEQ ID NO: 218092 - DNA, 25 bp, Homo sapien
aaatcctgggcttcatcatgtttgg

SEQ ID NO: 218093 - DNA, 25 bp, Homo sapien
atgtttggcctctactttgtgttcc

SEQ ID NO: 218094 - DNA, 25 bp, Homo sapien
tgtgttcctggtggtgagcgttctc

SEQ ID NO: 218095 - DNA, 25 bp, Homo sapien
gtgagcgttctcctagaagacagaa

SEQ ID NO: 218096 - DNA, 25 bp, Homo sapien
agacagaattcttacatgccccgtc

SEQ ID NO: 218097 - DNA, 25 bp, Homo sapien
ccccgtctccatctagcaggaaaag

SEQ ID NO: 218098 - DNA, 25 bp, Homo sapien
gaaaagccatatcttgcaccagcag

SEQ ID NO: 218099 - DNA, 25 bp, Homo sapien
gggctccttgacctcttgagaagag

SEQ ID NO: 218100 - DNA, 25 bp, Homo sapien
aagtgtccctccttggtgaatttga

SEQ ID NO: 218101 - DNA, 25 bp, Homo sapien
agaagctggacttgaaggcccccaa

SEQ ID NO: 218102 - DNA, 25 bp, Homo sapien
gaatttttgaacacagcattctgct

SEQ ID NO: 218103 - DNA, 25 bp, Homo sapien
tgaacacagcattctgcttcccatt

SEQ ID NO: 218104 - DNA, 25 bp, Homo sapien
caagttttgacgcagccaaccattt

SEQ ID NO: 218105 - DNA, 25 bp, Homo sapien
gacgcagccaaccatttttaaggga

SEQ ID NO: 218106 - DNA, 25 bp, Homo sapien
gccaaccatttttaagggattcctg

SEQ ID NO: 218107 - DNA, 25 bp, Homo sapien
ttcctgccccaaattgcggttggaa

SEQ ID NO: 218108 - DNA, 25 bp, Homo sapien
cccaaattgcggttggaagcgccaa

SEQ ID NO: 218109 - DNA, 25 bp, Homo sapien
ttggaagcgccaattgacccctgga

SEQ ID NO: 218110 - DNA, 25 bp, Homo sapien
aagcgccaattgacccctggaggaa

SEQ ID NO: 218111 - DNA, 25 bp, Homo sapien
gccaattgacccctggaggaaagcc

SEQ ID NO: 218112 - DNA, 25 bp, Homo sapien
aaacgggctcgctcgtgccaggaca

SEQ ID NO: 218113 - DNA, 25 bp, Homo sapien
tcgctcgtgccaggacacagcagtg

SEQ ID NO: 218114 - DNA, 25 bp, Homo sapien
aaaccagaagttttatcagcagcag

SEQ ID NO: 218115 - DNA, 25 bp, Homo sapien
gaagttttatcagcagcaggaagga

SEQ ID NO: 218116 - DNA, 25 bp, Homo sapien
catcaagccactggctgtggaagga

SEQ ID NO: 218117 - DNA, 25 bp, Homo sapien
aaggagtttgtccaacagggtcagt

SEQ ID NO: 218118 - DNA, 25 bp, Homo sapien
gtccaacagggtcagtgtcacagcc

SEQ ID NO: 218119 - DNA, 25 bp, Homo sapien
tgtcacagccacaacttcagaaagc

SEQ ID NO: 218120 - DNA, 25 bp, Homo sapien
agccacaacttcagaaagcagccat

SEQ ID NO: 218121 - DNA, 25 bp, Homo sapien
tcccgcgtgtcgtccaaacagcagt

SEQ ID NO: 218122 - DNA, 25 bp, Homo sapien
gtcgtccaaacagcagtgcctgcgt

SEQ ID NO: 218123 - DNA, 25 bp, Homo sapien
caagatcagtatgtgtatggcgtac

SEQ ID NO: 218124 - DNA, 25 bp, Homo sapien
tatggcgtacattggttcagtcagc

SEQ ID NO: 218125 - DNA, 25 bp, Homo sapien
attggttcagtcagccttccactga

SEQ ID NO: 218126 - DNA, 25 bp, Homo sapien
aatacacgattgagtctggcccagt

SEQ ID NO: 218127 - DNA, 25 bp, Homo sapien
tggcccagtgaatccgcatttttat

SEQ ID NO: 218128 - DNA, 25 bp, Homo sapien
gtgaatccgcatttttatgtaaaca

SEQ ID NO: 218129 - DNA, 25 bp, Homo sapien
aatcatataagcgtttgtctcaggg

SEQ ID NO: 218130 - DNA, 25 bp, Homo sapien
agagggatgacttccagttccgtct

SEQ ID NO: 218131 - DNA, 25 bp, Homo sapien
caaggaatttccctgggcgctaatt

SEQ ID NO: 218132 - DNA, 25 bp, Homo sapien
gagggaggcgtgtagcttcttatca

SEQ ID NO: 218133 - DNA, 25 bp, Homo sapien
ggcgtgtagcttcttatcattgtag

SEQ ID NO: 218134 - DNA, 25 bp, Homo sapien
gatgctttagatcagactaggtttt

SEQ ID NO: 218135 - DNA, 25 bp, Homo sapien
gttttaatcattaacttccacaaag

SEQ ID NO: 218136 - DNA, 25 bp, Homo sapien
catactttgcgttaggtgtgctggt

SEQ ID NO: 218137 - DNA, 25 bp, Homo sapien
tgctggttggatgtgcaggaacttc

SEQ ID NO: 218138 - DNA, 25 bp, Homo sapien
acttcagcaagcagtaggttttact

SEQ ID NO: 218139 - DNA, 25 bp, Homo sapien
tttactaagcagatggtcgggcact

SEQ ID NO: 218140 - DNA, 25 bp, Homo sapien
aggcaggatcctagggcgcctctta

SEQ ID NO: 218141 - DNA, 25 bp, Homo sapien
tagggcgcctcttattctgcgttag

SEQ ID NO: 218142 - DNA, 25 bp, Homo sapien
tctgcgttagcatctggtttgctgt

SEQ ID NO: 218143 - DNA, 25 bp, Homo sapien
gtttgctgtatgaccttgcacaagt

SEQ ID NO: 218144 - DNA, 25 bp, Homo sapien
ttgcacaagtcacttccttctgagc

SEQ ID NO: 218145 - DNA, 25 bp, Homo sapien
agaagctcagagagtcctctctaat

SEQ ID NO: 218146 - DNA, 25 bp, Homo sapien
gagagtcctctctaatgctcctaga

SEQ ID NO: 218147 - DNA, 25 bp, Homo sapien
aatgctcctagaccagggacttgac

SEQ ID NO: 218148 - DNA, 25 bp, Homo sapien
gaccagggacttgacccattagggt

SEQ ID NO: 218149 - DNA, 25 bp, Homo sapien
gacccattagggtatgaaattcagt

SEQ ID NO: 218150 - DNA, 25 bp, Homo sapien
gtttaatctttgtaatctcactaat

SEQ ID NO: 218151 - DNA, 25 bp, Homo sapien
gtacttttcagaatattatcgtgac

SEQ ID NO: 218152 - DNA, 25 bp, Homo sapien
tatcgtgacactttcaacatgtagg

SEQ ID NO: 218153 - DNA, 25 bp, Homo sapien
acatgtagggatatcagcgtttctc

SEQ ID NO: 218154 - DNA, 25 bp, Homo sapien
ggatatcagcgtttctctgtgtgct

SEQ ID NO: 218155 - DNA, 25 bp, Homo sapien
ttctctgtgtgcttgttaataaaac

SEQ ID NO: 218156 - DNA, 25 bp, Homo sapien
ttctgtagttgcagctgatgcctga

SEQ ID NO: 218157 - DNA, 25 bp, Homo sapien
gcagctgatgcctgaatgtatccta

SEQ ID NO: 218158 - DNA, 25 bp, Homo sapien
gcctgaatgtatcctagctgacaaa

SEQ ID NO: 218159 - DNA, 25 bp, Homo sapien
ggaagattcttactgttaaccaaat

SEQ ID NO: 218160 - DNA, 25 bp, Homo sapien
gcaaggagtctcaaaggtaattctg

SEQ ID NO: 218161 - DNA, 25 bp, Homo sapien
gaacagtgtaccttttaacagtgta

SEQ ID NO: 218162 - DNA, 25 bp, Homo sapien
acagtgtaaatcacggaatatccgt

SEQ ID NO: 218163 - DNA, 25 bp, Homo sapien
tccgtgaagggatttcttaatttat

SEQ ID NO: 218164 - DNA, 25 bp, Homo sapien
gaaatatcagttaaaggttgccagc

SEQ ID NO: 218165 - DNA, 25 bp, Homo sapien
aaggttgccagcatggttgcagata

SEQ ID NO: 218166 - DNA, 25 bp, Homo sapien
taaactgatgtttgaaattcgctga

SEQ ID NO: 218167 - DNA, 25 bp, Homo sapien
attttgttagccaataaattcctag

SEQ ID NO: 218168 - DNA, 25 bp, Homo sapien
gatgctacaacagaataatcaccat

SEQ ID NO: 218169 - DNA, 25 bp, Homo sapien
ttctgatctcccaggaattctgaag

SEQ ID NO: 218170 - DNA, 25 bp, Homo sapien
ggaattctgaaggaccctctatcct

SEQ ID NO: 218171 - DNA, 25 bp, Homo sapien
aggaccctctatccttgacaacaat

SEQ ID NO: 218172 - DNA, 25 bp, Homo sapien
tttgcagccaggtagcaacggcggt

SEQ ID NO: 218173 - DNA, 25 bp, Homo sapien
caacggcggtagtcagaggagctat

SEQ ID NO: 218174 - DNA, 25 bp, Homo sapien
ggagctatgatagaccacacccaag

SEQ ID NO: 218175 - DNA, 25 bp, Homo sapien
tgatagaccacacccaagcaaggct

SEQ ID NO: 218176 - DNA, 25 bp, Homo sapien
gccctcaaataacatctcaagatct

SEQ ID NO: 218177 - DNA, 25 bp, Homo sapien
gttcttatgcattccatcagtcaga

SEQ ID NO: 218178 - DNA, 25 bp, Homo sapien
aagcttttaactggttttcatatct

SEQ ID NO: 218179 - DNA, 25 bp, Homo sapien
gcttttaactggttttcatatctta

SEQ ID NO: 218180 - DNA, 25 bp, Homo sapien
tttaactggttttcatatcttacta

SEQ ID NO: 218181 - DNA, 25 bp, Homo sapien
ttaactggttttcatatcttactaa

SEQ ID NO: 218182 - DNA, 25 bp, Homo sapien
taactggttttcatatcttactaat

SEQ ID NO: 218183 - DNA, 25 bp, Homo sapien
tactgaagaatgactaagacctact

SEQ ID NO: 218184 - DNA, 25 bp, Homo sapien
ggacaccccattttccctgatgtaa

SEQ ID NO: 218185 - DNA, 25 bp, Homo sapien
acaccccattttccctgatgtaatt

SEQ ID NO: 218186 - DNA, 25 bp, Homo sapien
ccattttccctgatgtaattattat

SEQ ID NO: 218187 - DNA, 25 bp, Homo sapien
atgtaattattatacattgtatgcc

SEQ ID NO: 218188 - DNA, 25 bp, Homo sapien
atgtacctcatgaatatatacatgt

SEQ ID NO: 218189 - DNA, 25 bp, Homo sapien
tgtacttcaccatcatttctgactt

SEQ ID NO: 218190 - DNA, 25 bp, Homo sapien
atttctgactttgaccagctgtaag

SEQ ID NO: 218191 - DNA, 25 bp, Homo sapien
atcccctacttactatcactacaag

SEQ ID NO: 218192 - DNA, 25 bp, Homo sapien
agaaaactgagtcacttgcagtggg

SEQ ID NO: 218193 - DNA, 25 bp, Homo sapien
tacaaggctgaatggtgcagccgct

SEQ ID NO: 218194 - DNA, 25 bp, Homo sapien
agccgctggacctgatagtaaggtg

SEQ ID NO: 218195 - DNA, 25 bp, Homo sapien
ggtgcaaaggtccaaacctgggctt

SEQ ID NO: 218196 - DNA, 25 bp, Homo sapien
aggtccaaacctgggcttgtctcca

SEQ ID NO: 218197 - DNA, 25 bp, Homo sapien
ttgtctccacttcacgtcacaaaaa

SEQ ID NO: 218198 - DNA, 25 bp, Homo sapien
aaaacgtttggagctaaatgcagat

SEQ ID NO: 218199 - DNA, 25 bp, Homo sapien
ggagctaaatgcagataaccatcat

SEQ ID NO: 218200 - DNA, 25 bp, Homo sapien
gagaatgagttcgtcgcggtgacca

SEQ ID NO: 218201 - DNA, 25 bp, Homo sapien
gttcgtcgcggtgaccagtacaaat

SEQ ID NO: 218202 - DNA, 25 bp, Homo sapien
ggtgaccagtacaaatgctgccaaa

SEQ ID NO: 218203 - DNA, 25 bp, Homo sapien
aatgctgccaaaatcttcaattttt

SEQ ID NO: 218204 - DNA, 25 bp, Homo sapien
tgacctggtcatatggaaccccaag

SEQ ID NO: 218205 - DNA, 25 bp, Homo sapien
aggccaccaagatcatctctgccaa

SEQ ID NO: 218206 - DNA, 25 bp, Homo sapien
tgccaagacccacaatctgaacgtg

SEQ ID NO: 218207 - DNA, 25 bp, Homo sapien
caatctgaacgtggagtacaacatc

SEQ ID NO: 218208 - DNA, 25 bp, Homo sapien
gagcgcctgccgtggtcataagtca

SEQ ID NO: 218209 - DNA, 25 bp, Homo sapien
ccgtggtcataagtcagggccgagt

SEQ ID NO: 218210 - DNA, 25 bp, Homo sapien
gacgggaagatgtttgtcaccccgg

SEQ ID NO: 218211 - DNA, 25 bp, Homo sapien
aaatagtagcaagagctgcaaagca

SEQ ID NO: 218212 - DNA, 25 bp, Homo sapien
gggaagagccatcgaagtttcagtc

SEQ ID NO: 218213 - DNA, 25 bp, Homo sapien
aagtttcagtcggtgagccttgggc

SEQ ID NO: 218214 - DNA, 25 bp, Homo sapien
tgagccttgggcacctcacccatgt

SEQ ID NO: 218215 - DNA, 25 bp, Homo sapien
atgtcacatcctgtctcctgcaatt

SEQ ID NO: 218216 - DNA, 25 bp, Homo sapien
ctgtctcctgcaattggaattccac

SEQ ID NO: 218217 - DNA, 25 bp, Homo sapien
tgcaattggaattccaccttgtcca

SEQ ID NO: 218218 - DNA, 25 bp, Homo sapien
tccagccctccccagttaaagtggg

SEQ ID NO: 218219 - DNA, 25 bp, Homo sapien
gaagacagactttaggatcacgtgt

SEQ ID NO: 218220 - DNA, 25 bp, Homo sapien
atcacgtgtgtgactaatacagaaa

SEQ ID NO: 218221 - DNA, 25 bp, Homo sapien
tacagaaaggaaacatggcgtcggg

SEQ ID NO: 218222 - DNA, 25 bp, Homo sapien
agaaccagcagctgaaagtcgggat

SEQ ID NO: 218223 - DNA, 25 bp, Homo sapien
gacagaagaagatcaggatacagct

SEQ ID NO: 218224 - DNA, 25 bp, Homo sapien
tgagatcccagtgcgcgacatggaa

SEQ ID NO: 218225 - DNA, 25 bp, Homo sapien
gcgcgacatggaaggtgatctgcaa

SEQ ID NO: 218226 - DNA, 25 bp, Homo sapien
ggtgatctgcaagagctgcatcagt

SEQ ID NO: 218227 - DNA, 25 bp, Homo sapien
agagctgcatcagtcaaacaccggg

SEQ ID NO: 218228 - DNA, 25 bp, Homo sapien
ataaatctggatttgggttccggcg

SEQ ID NO: 218229 - DNA, 25 bp, Homo sapien
atctggatttgggttccggcgtcaa

SEQ ID NO: 218230 - DNA, 25 bp, Homo sapien
ggttccggcgtcaaggtgaagataa

SEQ ID NO: 218231 - DNA, 25 bp, Homo sapien
gaggaacactgtaaaatgccagaag

SEQ ID NO: 218232 - DNA, 25 bp, Homo sapien
gcaggtgaagagcaaccacaagttt

SEQ ID NO: 218233 - DNA, 25 bp, Homo sapien
agacctttgccggtcccattattgg

SEQ ID NO: 218234 - DNA, 25 bp, Homo sapien
attattggtcctggtggtacagcca

SEQ ID NO: 218235 - DNA, 25 bp, Homo sapien
tggtacagccagtgccaacttcgct

SEQ ID NO: 218236 - DNA, 25 bp, Homo sapien
aacttcgctgccaactttggtgcca

SEQ ID NO: 218237 - DNA, 25 bp, Homo sapien
gccattggtttcttctgggttgagt

SEQ ID NO: 218238 - DNA, 25 bp, Homo sapien
tatcaatcgcagtagtctttcccct

SEQ ID NO: 218239 - DNA, 25 bp, Homo sapien
tctttcccctgtgtgagctgaagcc

SEQ ID NO: 218240 - DNA, 25 bp, Homo sapien
gattccttctaaacacagctatcta

SEQ ID NO: 218241 - DNA, 25 bp, Homo sapien
gagagccacatcctgttgactgaaa

SEQ ID NO: 218242 - DNA, 25 bp, Homo sapien
atttatttgctgttccttgtctact

SEQ ID NO: 218243 - DNA, 25 bp, Homo sapien
tttttccccttgtgtgctgtcaagt

SEQ ID NO: 218244 - DNA, 25 bp, Homo sapien
tgctcctggacttctgcctggcgct

SEQ ID NO: 218245 - DNA, 25 bp, Homo sapien
acagcaaggctgtacagtctcgccc

SEQ ID NO: 218246 - DNA, 25 bp, Homo sapien
agcaaggctgtacagtctcgccctt

SEQ ID NO: 218247 - DNA, 25 bp, Homo sapien
aaggctgtacagtctcgcccttgga

SEQ ID NO: 218248 - DNA, 25 bp, Homo sapien
aggctgtacagtctcgcccttggaa

SEQ ID NO: 218249 - DNA, 25 bp, Homo sapien
gctgtacagtctcgcccttggaaga

SEQ ID NO: 218250 - DNA, 25 bp, Homo sapien
tacagtctcgcccttggaagactga

SEQ ID NO: 218251 - DNA, 25 bp, Homo sapien
agtctcgcccttggaagactgagct

SEQ ID NO: 218252 - DNA, 25 bp, Homo sapien
gtctcgcccttggaagactgagctg

SEQ ID NO: 218253 - DNA, 25 bp, Homo sapien
ccttggaagactgagctgggacccc

SEQ ID NO: 218254 - DNA, 25 bp, Homo sapien
ggaagactgagctgggacccccaca

SEQ ID NO: 218255 - DNA, 25 bp, Homo sapien
agaagcttgtttaagtttacacagc

SEQ ID NO: 218256 - DNA, 25 bp, Homo sapien
gcttgtttaagtttacacagctagt

SEQ ID NO: 218257 - DNA, 25 bp, Homo sapien
tacacagctagtaagagttttaaaa

SEQ ID NO: 218258 - DNA, 25 bp, Homo sapien
ttaaaaatctctgtgcagaagtgtt

SEQ ID NO: 218259 - DNA, 25 bp, Homo sapien
ttggttgaaagtctgaataaaagct

SEQ ID NO: 218260 - DNA, 25 bp, Homo sapien
tgaataaaagctgtcctttcctacc

SEQ ID NO: 218261 - DNA, 25 bp, Homo sapien
ctcactctcacaagaaaaccaaaag

SEQ ID NO: 218262 - DNA, 25 bp, Homo sapien
gtttctcttcagagttgttgactca

SEQ ID NO: 218263 - DNA, 25 bp, Homo sapien
gagttgttgactcatagtacagtaa

SEQ ID NO: 218264 - DNA, 25 bp, Homo sapien
gactcatagtacagtaaagggtgga

SEQ ID NO: 218265 - DNA, 25 bp, Homo sapien
aagggtggaggtgatatggcattct

SEQ ID NO: 218266 - DNA, 25 bp, Homo sapien
gaggtcatttgacctgccaggcgcc

SEQ ID NO: 218267 - DNA, 25 bp, Homo sapien
gccaggcgcccttcgcaaagagtga

SEQ ID NO: 218268 - DNA, 25 bp, Homo sapien
ttcgcaaagagtgacgaggccccgt

SEQ ID NO: 218269 - DNA, 25 bp, Homo sapien
gtgggagaacggactcctcagactc

SEQ ID NO: 218270 - DNA, 25 bp, Homo sapien
tcagactctccccaatagcggaagt

SEQ ID NO: 218271 - DNA, 25 bp, Homo sapien
tccccaatagcggaagtcgatcttc

SEQ ID NO: 218272 - DNA, 25 bp, Homo sapien
gaagtcgatcttctgaaggatggcc

SEQ ID NO: 218273 - DNA, 25 bp, Homo sapien
tgaaggatggccaatctgctccggc

SEQ ID NO: 218274 - DNA, 25 bp, Homo sapien
cagacttaacgatccttgctgcagt

SEQ ID NO: 218275 - DNA, 25 bp, Homo sapien
gtggagacagtctacggaaagcgct

SEQ ID NO: 218276 - DNA, 25 bp, Homo sapien
acagtctacggaaagcgctagcaga

SEQ ID NO: 218277 - DNA, 25 bp, Homo sapien
tatttattttctacatctggccagt

SEQ ID NO: 218278 - DNA, 25 bp, Homo sapien
gctctggtgctagatgccactgtag

SEQ ID NO: 218279 - DNA, 25 bp, Homo sapien
tgtagccagatctccaacagtgcct

SEQ ID NO: 218280 - DNA, 25 bp, Homo sapien
agtgccttggaccatggactcatac

SEQ ID NO: 218281 - DNA, 25 bp, Homo sapien
gtggctgagctggtccttaataggt

SEQ ID NO: 218282 - DNA, 25 bp, Homo sapien
ataggttgtttcttggtcttgcttt

SEQ ID NO: 218283 - DNA, 25 bp, Homo sapien
gctcctgccacctttagataagttt

SEQ ID NO: 218284 - DNA, 25 bp, Homo sapien
agtttctctagctaattttgtggcc

SEQ ID NO: 218285 - DNA, 25 bp, Homo sapien
tttgtggccaatgtaaaattcgtca

SEQ ID NO: 218286 - DNA, 25 bp, Homo sapien
gtaaaattcgtcatcaacctaacaa

SEQ ID NO: 218287 - DNA, 25 bp, Homo sapien
aaacacaaccttctcagcagcattt

SEQ ID NO: 218288 - DNA, 25 bp, Homo sapien
caaagttctggtgccacatagtggt

SEQ ID NO: 218289 - DNA, 25 bp, Homo sapien
gaagctgtcttaagccttgttcaag

SEQ ID NO: 218290 - DNA, 25 bp, Homo sapien
gttcaagaagcaggaaaggcatcag

SEQ ID NO: 218291 - DNA, 25 bp, Homo sapien
gaagtaacagttggcagagggtctc

SEQ ID NO: 218292 - DNA, 25 bp, Homo sapien
aaacatcttccttctgatcttttgc

SEQ ID NO: 218293 - DNA, 25 bp, Homo sapien
gatcttttgcatagcaccttttgga

SEQ ID NO: 218294 - DNA, 25 bp, Homo sapien
gtttgcttattaaacaaagctccta

SEQ ID NO: 218295 - DNA, 25 bp, Homo sapien
aaagctcctactgccatcatactaa

SEQ ID NO: 218296 - DNA, 25 bp, Homo sapien
actgccatcatactaatcatgcaaa

SEQ ID NO: 218297 - DNA, 25 bp, Homo sapien
aatcatgtttggtaggaggactttt

SEQ ID NO: 218298 - DNA, 25 bp, Homo sapien
ggacttttgaggtagcttttgaaca

SEQ ID NO: 218299 - DNA, 25 bp, Homo sapien
ggcagaggagccagataacttcagc

SEQ ID NO: 218300 - DNA, 25 bp, Homo sapien
gataacttcagcacgcacaagtagt

SEQ ID NO: 218301 - DNA, 25 bp, Homo sapien
ttcagcacgcacaagtagtgcagag

SEQ ID NO: 218302 - DNA, 25 bp, Homo sapien
gggctcgagagttctttgaacagca

SEQ ID NO: 218303 - DNA, 25 bp, Homo sapien
gcaacgggaacttcctgtacagaat

SEQ ID NO: 218304 - DNA, 25 bp, Homo sapien
gggcttggcttatggagattctcgt

SEQ ID NO: 218305 - DNA, 25 bp, Homo sapien
gagattctcgtgaaacaagctggca

SEQ ID NO: 218306 - DNA, 25 bp, Homo sapien
ttctcgtgaaacaagctggcaagta

SEQ ID NO: 218307 - DNA, 25 bp, Homo sapien
gaaacaagctggcaagtattaatgt

SEQ ID NO: 218308 - DNA, 25 bp, Homo sapien
agaagagcctggataagtttgcctt

SEQ ID NO: 218309 - DNA, 25 bp, Homo sapien
gagcctggataagtttgccttctga

SEQ ID NO: 218310 - DNA, 25 bp, Homo sapien
ggcagaggagccagataacttcagc

SEQ ID NO: 218311 - DNA, 25 bp, Homo sapien
gcagaggagccagataacttcagca

SEQ ID NO: 218312 - DNA, 25 bp, Homo sapien
acagcaacgggaacttcctgtacag

SEQ ID NO: 218313 - DNA, 25 bp, Homo sapien
cagcaacgggaacttcctgtacaga

SEQ ID NO: 218314 - DNA, 25 bp, Homo sapien
agcaacgggaacttcctgtacagaa

SEQ ID NO: 218315 - DNA, 25 bp, Homo sapien
gcaacgggaacttcctgtacagaat

SEQ ID NO: 218316 - DNA, 25 bp, Homo sapien
caacgggaacttcctgtacagaatt

SEQ ID NO: 218317 - DNA, 25 bp, Homo sapien
acgggaacttcctgtacagaatttg

SEQ ID NO: 218318 - DNA, 25 bp, Homo sapien
aaagatcgacttggactagaaattc

SEQ ID NO: 218319 - DNA, 25 bp, Homo sapien
ctaatattgaccctaagaatcctga

SEQ ID NO: 218320 - DNA, 25 bp, Homo sapien
ctaagaatcctgagagcccatttat

SEQ ID NO: 218321 - DNA, 25 bp, Homo sapien
gagagcccatttatgttttccttac

SEQ ID NO: 218322 - DNA, 25 bp, Homo sapien
gttttccttacatctcaatgaagca

SEQ ID NO: 218323 - DNA, 25 bp, Homo sapien
tgaagtgtcagatagtgcccctcat

SEQ ID NO: 218324 - DNA, 25 bp, Homo sapien
tcttgagggcctagcagaatttcaa

SEQ ID NO: 218325 - DNA, 25 bp, Homo sapien
ggaagaccaacaatttttcagcttt

SEQ ID NO: 218326 - DNA, 25 bp, Homo sapien
tcagcttttcttgccaatgttcgga

SEQ ID NO: 218327 - DNA, 25 bp, Homo sapien
gttcggaaagcttttactgccacgg

SEQ ID NO: 218328 - DNA, 25 bp, Homo sapien
gcttttactgccacggtttataatt

SEQ ID NO: 218329 - DNA, 25 bp, Homo sapien
agctcgcaagccagcgccctcagat

SEQ ID NO: 218330 - DNA, 25 bp, Homo sapien
agcgccctcagatccacacggtggt

SEQ ID NO: 218331 - DNA, 25 bp, Homo sapien
gccctcagatccacacggtggtctt

SEQ ID NO: 218332 - DNA, 25 bp, Homo sapien
agatccacacggtggtcttcccgtc

SEQ ID NO: 218333 - DNA, 25 bp, Homo sapien
cttctcggagccagccctgggcttg

SEQ ID NO: 218334 - DNA, 25 bp, Homo sapien
ggcttggctcctggccgctcgtggg

SEQ ID NO: 218335 - DNA, 25 bp, Homo sapien
cgacagtgcccgcagaggtagcact

SEQ ID NO: 218336 - DNA, 25 bp, Homo sapien
tgcccgcagaggtagcactgcccgt

SEQ ID NO: 218337 - DNA, 25 bp, Homo sapien
cgcagaggtagcactgcccgtccgg

SEQ ID NO: 218338 - DNA, 25 bp, Homo sapien
tctgggcagagtctgcctgaggcca

SEQ ID NO: 218339 - DNA, 25 bp, Homo sapien
gagaaggggtcgcaggtttccaccg

SEQ ID NO: 218340 - DNA, 25 bp, Homo sapien
acaatacttcgggtgagtccaccta

SEQ ID NO: 218341 - DNA, 25 bp, Homo sapien
gagtccacctatcccaaagtcgtat

SEQ ID NO: 218342 - DNA, 25 bp, Homo sapien
aagtcgtatcaaagaagtggctgca

SEQ ID NO: 218343 - DNA, 25 bp, Homo sapien
aagtggctgcagattggagcccaaa

SEQ ID NO: 218344 - DNA, 25 bp, Homo sapien
gcccaaagcctttggttcctcagtt

SEQ ID NO: 218345 - DNA, 25 bp, Homo sapien
aaatggattctcactaggtgggatc

SEQ ID NO: 218346 - DNA, 25 bp, Homo sapien
ttggacaccccaaattctaactatt

SEQ ID NO: 218347 - DNA, 25 bp, Homo sapien
ttgtttcttacatcctttccctctt

SEQ ID NO: 218348 - DNA, 25 bp, Homo sapien
tacacctcttgctggtttgagacgt

SEQ ID NO: 218349 - DNA, 25 bp, Homo sapien
ttgagacgtcaatcaccactgagaa

SEQ ID NO: 218350 - DNA, 25 bp, Homo sapien
gagctggcaaaattcttagcctagt

SEQ ID NO: 218351 - DNA, 25 bp, Homo sapien
gcatggagtattaccgtgccctcaa

SEQ ID NO: 218352 - DNA, 25 bp, Homo sapien
tcaagacccggaatgtgcctgttcg

SEQ ID NO: 218353 - DNA, 25 bp, Homo sapien
agcacccacgcattatcagaggtgg

SEQ ID NO: 218354 - DNA, 25 bp, Homo sapien
cagacagcttcatgaatgctgtgct

SEQ ID NO: 218355 - DNA, 25 bp, Homo sapien
ctgtgctctggctacgcacacactt

SEQ ID NO: 218356 - DNA, 25 bp, Homo sapien
tgggcagctgaagccctgccattct

SEQ ID NO: 218357 - DNA, 25 bp, Homo sapien
cctgccattctgcatgagctgatca

SEQ ID NO: 218358 - DNA, 25 bp, Homo sapien
tgcatgagctgatcagcctgtgcca

SEQ ID NO: 218359 - DNA, 25 bp, Homo sapien
ttcgctcttgaggagctcaacggtc

SEQ ID NO: 218360 - DNA, 25 bp, Homo sapien
agctcaacggtctggcagggcagca

SEQ ID NO: 218361 - DNA, 25 bp, Homo sapien
ggcagcaggaggctttctgggctct

SEQ ID NO: 218362 - DNA, 25 bp, Homo sapien
gatattgatgttatggagtgctgta

SEQ ID NO: 218363 - DNA, 25 bp, Homo sapien
ggagtgctgtaatccaaagttttta

SEQ ID NO: 218364 - DNA, 25 bp, Homo sapien
aattgtgaggcatgttctgatatgt

SEQ ID NO: 218365 - DNA, 25 bp, Homo sapien
gcatgttctgatatgtttataggca

SEQ ID NO: 218366 - DNA, 25 bp, Homo sapien
aacttttttgccacatgtttgctag

SEQ ID NO: 218367 - DNA, 25 bp, Homo sapien
tttgccacatgtttgctagaaaatg

SEQ ID NO: 218368 - DNA, 25 bp, Homo sapien
gattatactttattggagtgacatg

SEQ ID NO: 218369 - DNA, 25 bp, Homo sapien
gacatgaagtttgaacactaaacag

SEQ ID NO: 218370 - DNA, 25 bp, Homo sapien
tatgagaattactacagatacatgt

SEQ ID NO: 218371 - DNA, 25 bp, Homo sapien
gagctgttttatagaagatgatggt

SEQ ID NO: 218372 - DNA, 25 bp, Homo sapien
tgtcggtgagtgttggatgaaatac

SEQ ID NO: 218373 - DNA, 25 bp, Homo sapien
gggaccgcagcaaggcttccattga

SEQ ID NO: 218374 - DNA, 25 bp, Homo sapien
accgcagcaaggcttccattgaagc

SEQ ID NO: 218375 - DNA, 25 bp, Homo sapien
agcaaggcttccattgaagcccacc

SEQ ID NO: 218376 - DNA, 25 bp, Homo sapien
gctgaagcattaaccggtgggcccc

SEQ ID NO: 218377 - DNA, 25 bp, Homo sapien
aggacaaagtgccctcaaagggaat

SEQ ID NO: 218378 - DNA, 25 bp, Homo sapien
ttttttacacacttaatcttagcgg

SEQ ID NO: 218379 - DNA, 25 bp, Homo sapien
ttttacacacttaatcttagcggat

SEQ ID NO: 218380 - DNA, 25 bp, Homo sapien
cttagcggattacttcagatgtttt

SEQ ID NO: 218381 - DNA, 25 bp, Homo sapien
ggtggacttgaacagatggccttat

SEQ ID NO: 218382 - DNA, 25 bp, Homo sapien
ggacttgaacagatggccttatatt

SEQ ID NO: 218383 - DNA, 25 bp, Homo sapien
gaacagatggccttatattaccaaa

SEQ ID NO: 218384 - DNA, 25 bp, Homo sapien
ggctgtttgggcattaattttgctt

SEQ ID NO: 218385 - DNA, 25 bp, Homo sapien
tgctttttgagccttaagtgtgtta

SEQ ID NO: 218386 - DNA, 25 bp, Homo sapien
tctgattttaggtcactgttccctg

SEQ ID NO: 218387 - DNA, 25 bp, Homo sapien
tgattttaggtcactgttccctggg

SEQ ID NO: 218388 - DNA, 25 bp, Homo sapien
ggcctgtttttgtgagcccttacac

SEQ ID NO: 218389 - DNA, 25 bp, Homo sapien
tttttgtgagcccttacacaggaag

SEQ ID NO: 218390 - DNA, 25 bp, Homo sapien
gagcccttacacaggaagatataaa

SEQ ID NO: 218391 - DNA, 25 bp, Homo sapien
agagttctttcatttccctgctaaa

SEQ ID NO: 218392 - DNA, 25 bp, Homo sapien
gttctttcatttccctgctaaaatc

SEQ ID NO: 218393 - DNA, 25 bp, Homo sapien
ctttcatttccctgctaaaatcagt

SEQ ID NO: 218394 - DNA, 25 bp, Homo sapien
aacagaatcaggagagtgggcaaag

SEQ ID NO: 218395 - DNA, 25 bp, Homo sapien
agcacccacgcattatcagaggtgg

SEQ ID NO: 218396 - DNA, 25 bp, Homo sapien
gcacccacgcattatcagaggtgga

SEQ ID NO: 218397 - DNA, 25 bp, Homo sapien
cctgccattctgcatgagctgatca

SEQ ID NO: 218398 - DNA, 25 bp, Homo sapien
ctgccattctgcatgagctgatcag

SEQ ID NO: 218399 - DNA, 25 bp, Homo sapien
tgccattctgcatgagctgatcagc

SEQ ID NO: 218400 - DNA, 25 bp, Homo sapien
gccattctgcatgagctgatcagcc

SEQ ID NO: 218401 - DNA, 25 bp, Homo sapien
ccattctgcatgagctgatcagcct

SEQ ID NO: 218402 - DNA, 25 bp, Homo sapien
cattctgcatgagctgatcagcctg

SEQ ID NO: 218403 - DNA, 25 bp, Homo sapien
attctgcatgagctgatcagcctgt

SEQ ID NO: 218404 - DNA, 25 bp, Homo sapien
tctgcatgagctgatcagcctgtgc

SEQ ID NO: 218405 - DNA, 25 bp, Homo sapien
tgcatgagctgatcagcctgtgcca

SEQ ID NO: 218406 - DNA, 25 bp, Homo sapien
agacaaaaccctgcacctctttgag

SEQ ID NO: 218407 - DNA, 25 bp, Homo sapien
tttgagccttggctgccttggtgca

SEQ ID NO: 218408 - DNA, 25 bp, Homo sapien
tgccttggtgcagcagggtcatctg

SEQ ID NO: 218409 - DNA, 25 bp, Homo sapien
agggtcatctgtagggccaccccac

SEQ ID NO: 218410 - DNA, 25 bp, Homo sapien
gggtgggcacctgaggcccaataat

SEQ ID NO: 218411 - DNA, 25 bp, Homo sapien
gcacctgaggcccaataatatttgg

SEQ ID NO: 218412 - DNA, 25 bp, Homo sapien
gaggcccaataatatttggaccaag

SEQ ID NO: 218413 - DNA, 25 bp, Homo sapien
atatttggaccaagtgggaaacaag

SEQ ID NO: 218414 - DNA, 25 bp, Homo sapien
agtgggaaacaagaacactcggagg

SEQ ID NO: 218415 - DNA, 25 bp, Homo sapien
gagcctggaaaaagacctagcccaa

SEQ ID NO: 218416 - DNA, 25 bp, Homo sapien
agacctagcccaacttcccttgtgg

SEQ ID NO: 218417 - DNA, 25 bp, Homo sapien
gaagcaatatccaaggcagtgtcat

SEQ ID NO: 218418 - DNA, 25 bp, Homo sapien
cagtgtcatctgcaacaatgctgtg

SEQ ID NO: 218419 - DNA, 25 bp, Homo sapien
acaatgctgtgatcgagaagggtgc

SEQ ID NO: 218420 - DNA, 25 bp, Homo sapien
cgagaagggtgcagacatcaaggac

SEQ ID NO: 218421 - DNA, 25 bp, Homo sapien
aggactgcttgattggaagtggcca

SEQ ID NO: 218422 - DNA, 25 bp, Homo sapien
aagtggccagaggattgaagccaaa

SEQ ID NO: 218423 - DNA, 25 bp, Homo sapien
gaagccaaagctaaacgagtgaatg

SEQ ID NO: 218424 - DNA, 25 bp, Homo sapien
agctcatggagatctgagttctgag

SEQ ID NO: 218425 - DNA, 25 bp, Homo sapien
ctgagttctgagcaagtcagactcc

SEQ ID NO: 218426 - DNA, 25 bp, Homo sapien
aaagccacagatgttggccggccca

SEQ ID NO: 218427 - DNA, 25 bp, Homo sapien
gcccacctgtttaactctgtattta

SEQ ID NO: 218428 - DNA, 25 bp, Homo sapien
gcagtccctccggagaggatctgga

SEQ ID NO: 218429 - DNA, 25 bp, Homo sapien
cagtccctccggagaggatctggac

SEQ ID NO: 218430 - DNA, 25 bp, Homo sapien
agtccctccggagaggatctggact

SEQ ID NO: 218431 - DNA, 25 bp, Homo sapien
gtccctccggagaggatctggactg

SEQ ID NO: 218432 - DNA, 25 bp, Homo sapien
tccctccggagaggatctggactgg

SEQ ID NO: 218433 - DNA, 25 bp, Homo sapien
ccctccggagaggatctggactggc

SEQ ID NO: 218434 - DNA, 25 bp, Homo sapien
cctccggagaggatctggactggct

SEQ ID NO: 218435 - DNA, 25 bp, Homo sapien
ctccggagaggatctggactggctg

SEQ ID NO: 218436 - DNA, 25 bp, Homo sapien
tccggagaggatctggactggctgg

SEQ ID NO: 218437 - DNA, 25 bp, Homo sapien
cggagaggatctggactggctggga

SEQ ID NO: 218438 - DNA, 25 bp, Homo sapien
ggagaggatctggactggctgggag

SEQ ID NO: 218439 - DNA, 25 bp, Homo sapien
aaggtttttcagatctaggtctagt

SEQ ID NO: 218440 - DNA, 25 bp, Homo sapien
gtgaacaaactatacctacttattt

SEQ ID NO: 218441 - DNA, 25 bp, Homo sapien
cctacttatttgtggttcggtacag

SEQ ID NO: 218442 - DNA, 25 bp, Homo sapien
gagaacatgctaagtctaatcattg

SEQ ID NO: 218443 - DNA, 25 bp, Homo sapien
tagtcaaaaccatcttccttcaatt

SEQ ID NO: 218444 - DNA, 25 bp, Homo sapien
caaaaccatcttccttcaattcaaa

SEQ ID NO: 218445 - DNA, 25 bp, Homo sapien
tcagtagtactgactcgtgtttcct

SEQ ID NO: 218446 - DNA, 25 bp, Homo sapien
tactgactcgtgtttcctaggtggt

SEQ ID NO: 218447 - DNA, 25 bp, Homo sapien
gtttcctaggtggtgttagcagata

SEQ ID NO: 218448 - DNA, 25 bp, Homo sapien
gttagcagatataaatacggtttca

SEQ ID NO: 218449 - DNA, 25 bp, Homo sapien
atacggtttcatacggtatcacaat

SEQ ID NO: 218450 - DNA, 25 bp, Homo sapien
agcaacaccctcacctgcttcagag

SEQ ID NO: 218451 - DNA, 25 bp, Homo sapien
ttcagagcccgaaccctctggagct

SEQ ID NO: 218452 - DNA, 25 bp, Homo sapien
ggagcccgggagagcacagacgcct

SEQ ID NO: 218453 - DNA, 25 bp, Homo sapien
agcgacggccttgtctggagctcga

SEQ ID NO: 218454 - DNA, 25 bp, Homo sapien
gacggccttgtctggagctcgaaag

SEQ ID NO: 218455 - DNA, 25 bp, Homo sapien
ggccttgtctggagctcgaaagccg

SEQ ID NO: 218456 - DNA, 25 bp, Homo sapien
ccttgtctggagctcgaaagccgag

SEQ ID NO: 218457 - DNA, 25 bp, Homo sapien
ggcgggtgatgaatccagccccttc

SEQ ID NO: 218458 - DNA, 25 bp, Homo sapien
gagaacccagaaagcatgccataaa

SEQ ID NO: 218459 - DNA, 25 bp, Homo sapien
aagcatgccataaatccgacagccc

SEQ ID NO: 218460 - DNA, 25 bp, Homo sapien
caggagactgcaggtggccgagctt

SEQ ID NO: 218461 - DNA, 25 bp, Homo sapien
gagctgaggctctgtgctgcacccc

SEQ ID NO: 218462 - DNA, 25 bp, Homo sapien
gggcatctcactggagctgttccag

SEQ ID NO: 218463 - DNA, 25 bp, Homo sapien
gacctgatcccccactagagaggtc

SEQ ID NO: 218464 - DNA, 25 bp, Homo sapien
ccactagagaggtccggtgtgcaca

SEQ ID NO: 218465 - DNA, 25 bp, Homo sapien
tagagaggtccggtgtgcacagccg

SEQ ID NO: 218466 - DNA, 25 bp, Homo sapien
gcctctggtatccttccttttgaaa

SEQ ID NO: 218467 - DNA, 25 bp, Homo sapien
ctctggtatccttccttttgaaacg

SEQ ID NO: 218468 - DNA, 25 bp, Homo sapien
tctggtatccttccttttgaaacga

SEQ ID NO: 218469 - DNA, 25 bp, Homo sapien
tggtatccttccttttgaaacgaag

SEQ ID NO: 218470 - DNA, 25 bp, Homo sapien
gtatccttccttttgaaacgaagct

SEQ ID NO: 218471 - DNA, 25 bp, Homo sapien
atccttccttttgaaacgaagctca

SEQ ID NO: 218472 - DNA, 25 bp, Homo sapien
ggaggcgccactttgtatatttcag

SEQ ID NO: 218473 - DNA, 25 bp, Homo sapien
atatttcaggactgggacctactcc

SEQ ID NO: 218474 - DNA, 25 bp, Homo sapien
aggactgggacctactccccagatg

SEQ ID NO: 218475 - DNA, 25 bp, Homo sapien
cccagatgccacctgagaggagctt

SEQ ID NO: 218476 - DNA, 25 bp, Homo sapien
tgagaggagcttctgtttggcattc

SEQ ID NO: 218477 - DNA, 25 bp, Homo sapien
ttccagatggaaggacaggcagcac

SEQ ID NO: 218478 - DNA, 25 bp, Homo sapien
tgtggacagggtctgtccacgcacc

SEQ ID NO: 218479 - DNA, 25 bp, Homo sapien
aagaccaccgtcatctctgctgtgg

SEQ ID NO: 218480 - DNA, 25 bp, Homo sapien
ctgtgggcaccattgtgaagaaggc

SEQ ID NO: 218481 - DNA, 25 bp, Homo sapien
gccaccctaggacttgaaaggaccg

SEQ ID NO: 218482 - DNA, 25 bp, Homo sapien
ttgaaaggaccgtgcagcccagtga

SEQ ID NO: 218483 - DNA, 25 bp, Homo sapien
ccaaactgagacagactgggagctg

SEQ ID NO: 218484 - DNA, 25 bp, Homo sapien
ggtggacaggaccataccctctttg

SEQ ID NO: 218485 - DNA, 25 bp, Homo sapien
ataccctctttgagcttctgcgatg

SEQ ID NO: 218486 - DNA, 25 bp, Homo sapien
ttgagcttctgcgatgccggccttc

SEQ ID NO: 218487 - DNA, 25 bp, Homo sapien
gatgccggccttccgttcctctggg

SEQ ID NO: 218488 - DNA, 25 bp, Homo sapien
tcctctgggaggcttgaagttctgc

SEQ ID NO: 218489 - DNA, 25 bp, Homo sapien
gcttgaagttctgcagagatgttga

SEQ ID NO: 218490 - DNA, 25 bp, Homo sapien
agagatgttgatatgccttgcagct

SEQ ID NO: 218491 - DNA, 25 bp, Homo sapien
atatgccttgcagcttggacccaat

SEQ ID NO: 218492 - DNA, 25 bp, Homo sapien
cttgcagcttggacccaatgggtgg

SEQ ID NO: 218493 - DNA, 25 bp, Homo sapien
tgtctgtcctcctccctaattcaga

SEQ ID NO: 218494 - DNA, 25 bp, Homo sapien
ttgtgcctttgcatatggtgttttc

SEQ ID NO: 218495 - DNA, 25 bp, Homo sapien
gttttcttgcccattttctgctcga

SEQ ID NO: 218496 - DNA, 25 bp, Homo sapien
actcgcccctgattttcaagttcaa

SEQ ID NO: 218497 - DNA, 25 bp, Homo sapien
taactcagggttcaggtcttccagg

SEQ ID NO: 218498 - DNA, 25 bp, Homo sapien
aggaggccttacttatgtcgtcagt

SEQ ID NO: 218499 - DNA, 25 bp, Homo sapien
gggaactctccatgtgcttctatca

SEQ ID NO: 218500 - DNA, 25 bp, Homo sapien
tatcactgtgcggttacctctttca

SEQ ID NO: 218501 - DNA, 25 bp, Homo sapien
tacctctttcacagcccttttaaag

SEQ ID NO: 218502 - DNA, 25 bp, Homo sapien
tttttgaccttccactagaccatga

SEQ ID NO: 218503 - DNA, 25 bp, Homo sapien
tagaccatgagcacctgggcggaaa

SEQ ID NO: 218504 - DNA, 25 bp, Homo sapien
gggcggaaagccatatatcttatta

SEQ ID NO: 218505 - DNA, 25 bp, Homo sapien
aaaaccatcattcacagcatcaatg

SEQ ID NO: 218506 - DNA, 25 bp, Homo sapien
cgaagcctccaaacattcccatgat

SEQ ID NO: 218507 - DNA, 25 bp, Homo sapien
cctccaaacattcccatgatcatgt

SEQ ID NO: 218508 - DNA, 25 bp, Homo sapien
gggttgtcctactgtgcatctggaa

SEQ ID NO: 218509 - DNA, 25 bp, Homo sapien
cctactgtgcatctggaagctactg

SEQ ID NO: 218510 - DNA, 25 bp, Homo sapien
gaagctactggtgtcatttcatgat

SEQ ID NO: 218511 - DNA, 25 bp, Homo sapien
actggtgtcatttcatgatcgtaaa

SEQ ID NO: 218512 - DNA, 25 bp, Homo sapien
gaagcagaacgatcaaaagccaagt

SEQ ID NO: 218513 - DNA, 25 bp, Homo sapien
tggcaaacgggaaccaatccactct

SEQ ID NO: 218514 - DNA, 25 bp, Homo sapien
aatccactctacagaggatccacaa

SEQ ID NO: 218515 - DNA, 25 bp, Homo sapien
acagaggatccacaagtacttttaa

SEQ ID NO: 218516 - DNA, 25 bp, Homo sapien
aaattacttggtttgtgaatccatc

SEQ ID NO: 218517 - DNA, 25 bp, Homo sapien
cttggtttgtgaatccatcttgctt

SEQ ID NO: 218518 - DNA, 25 bp, Homo sapien
ttgtgaatccatcttgctttcccca

SEQ ID NO: 218519 - DNA, 25 bp, Homo sapien
aatccatcttgctttccccattgga

SEQ ID NO: 218520 - DNA, 25 bp, Homo sapien
tcttgctttccccattggaactagt

SEQ ID NO: 218521 - DNA, 25 bp, Homo sapien
gctttccccattggaactagtcatt

SEQ ID NO: 218522 - DNA, 25 bp, Homo sapien
tgaagagctagtctatcagcatctg

SEQ ID NO: 218523 - DNA, 25 bp, Homo sapien
ggttctcagaaccatttcacccaga

SEQ ID NO: 218524 - DNA, 25 bp, Homo sapien
agaaccatttcacccagacagcctg

SEQ ID NO: 218525 - DNA, 25 bp, Homo sapien
ccctgctccaatctgtcacataaaa

SEQ ID NO: 218526 - DNA, 25 bp, Homo sapien
tgaagtttagtcagcacccccacca

SEQ ID NO: 218527 - DNA, 25 bp, Homo sapien
cctgatgtttttcccggccagtgtt

SEQ ID NO: 218528 - DNA, 25 bp, Homo sapien
cggccagtgttgacatcttccctga

SEQ ID NO: 218529 - DNA, 25 bp, Homo sapien
cctgaacacattcctcagtgagatg

SEQ ID NO: 218530 - DNA, 25 bp, Homo sapien
aagtgtccaccaactacctgctaag

SEQ ID NO: 218531 - DNA, 25 bp, Homo sapien
actacctgctaagagccgggagcat

SEQ ID NO: 218532 - DNA, 25 bp, Homo sapien
agaaaagagttcacttcctgctccc

SEQ ID NO: 218533 - DNA, 25 bp, Homo sapien
ctgctcccaggatatttctcttttc

SEQ ID NO: 218534 - DNA, 25 bp, Homo sapien
ttctcttttctgtttatgaagtaca

SEQ ID NO: 218535 - DNA, 25 bp, Homo sapien
gaagtacaacccatgctgctaagat

SEQ ID NO: 218536 - DNA, 25 bp, Homo sapien
agaggcatcctttgctaaatcctgt

SEQ ID NO: 218537 - DNA, 25 bp, Homo sapien
aaatcctgtttgaatgtcattgtaa

SEQ ID NO: 218538 - DNA, 25 bp, Homo sapien
ctcacccataactcaggtcaacgtg

SEQ ID NO: 218539 - DNA, 25 bp, Homo sapien
aggtcaacgtgaccaaccttccttg

SEQ ID NO: 218540 - DNA, 25 bp, Homo sapien
aaccttccttgcttacacataaact

SEQ ID NO: 218541 - DNA, 25 bp, Homo sapien
acttgtatatatttggatgtagccc

SEQ ID NO: 218542 - DNA, 25 bp, Homo sapien
gtagcccttatttaatggctgtcat

SEQ ID NO: 218543 - DNA, 25 bp, Homo sapien
agatatgtctatccttgctacttgg

SEQ ID NO: 218544 - DNA, 25 bp, Homo sapien
ttgctacttggttgtgagtttctcc

SEQ ID NO: 218545 - DNA, 25 bp, Homo sapien
tacttggttgtgagtttctccaggg

SEQ ID NO: 218546 - DNA, 25 bp, Homo sapien
tctgtttctcagcagtgtctgaaat

SEQ ID NO: 218547 - DNA, 25 bp, Homo sapien
aaatttaatgggttctactgatgtt

SEQ ID NO: 218548 - DNA, 25 bp, Homo sapien
aatgggttctactgatgtttattag

SEQ ID NO: 218549 - DNA, 25 bp, Homo sapien
gaagccctggacaaagccagagaag

SEQ ID NO: 218550 - DNA, 25 bp, Homo sapien
gacaaagccagagaaggccgcacct

SEQ ID NO: 218551 - DNA, 25 bp, Homo sapien
cagagaaggccgcacctgcattgtg

SEQ ID NO: 218552 - DNA, 25 bp, Homo sapien
gcacctgcattgtgattgctcaccg

SEQ ID NO: 218553 - DNA, 25 bp, Homo sapien
attgtgattgctcaccgcctgtcca

SEQ ID NO: 218554 - DNA, 25 bp, Homo sapien
caccatccagaatgcagacttaata

SEQ ID NO: 218555 - DNA, 25 bp, Homo sapien
gcagacttaatagtggtgtttcaga

SEQ ID NO: 218556 - DNA, 25 bp, Homo sapien
gagtcaaggagcatggcacgcatca

SEQ ID NO: 218557 - DNA, 25 bp, Homo sapien
atggcacgcatcagcagctgctggc

SEQ ID NO: 218558 - DNA, 25 bp, Homo sapien
atctatttttcaatggtcagtgtcc

SEQ ID NO: 218559 - DNA, 25 bp, Homo sapien
tttttcaatggtcagtgtccaggct

SEQ ID NO: 218560 - DNA, 25 bp, Homo sapien
ccttcataccatgagaacatttctg

SEQ ID NO: 218561 - DNA, 25 bp, Homo sapien
gggatgttacccttgcgttcaacca

SEQ ID NO: 218562 - DNA, 25 bp, Homo sapien
ttacccttgcgttcaaccaaaattg

SEQ ID NO: 218563 - DNA, 25 bp, Homo sapien
aagattacaacccaaagtctcccag

SEQ ID NO: 218564 - DNA, 25 bp, Homo sapien
gaagtgaagccagtgaagagcccac

SEQ ID NO: 218565 - DNA, 25 bp, Homo sapien
gaagagcccacctgtggaaggacat

SEQ ID NO: 218566 - DNA, 25 bp, Homo sapien
cagtgcattcctgcctgcgaacagg

SEQ ID NO: 218567 - DNA, 25 bp, Homo sapien
tttgccgcctctccatcgtcttggg

SEQ ID NO: 218568 - DNA, 25 bp, Homo sapien
tcgtcttgggcccttgctcaaatag

SEQ ID NO: 218569 - DNA, 25 bp, Homo sapien
cttgctcaaatagctgtgggactga

SEQ ID NO: 218570 - DNA, 25 bp, Homo sapien
aaatagctgtgggactgaatttcac

SEQ ID NO: 218571 - DNA, 25 bp, Homo sapien
gtagtacaggttaacaataccagat

SEQ ID NO: 218572 - DNA, 25 bp, Homo sapien
aataccagatttatgtcctgttcaa

SEQ ID NO: 218573 - DNA, 25 bp, Homo sapien
gtcctgttcaacaactcagtactct

SEQ ID NO: 218574 - DNA, 25 bp, Homo sapien
cagtactctaaatgttgttatgctt

SEQ ID NO: 218575 - DNA, 25 bp, Homo sapien
atgcttttaataagaccttcccaga

SEQ ID NO: 218576 - DNA, 25 bp, Homo sapien
agaccttcccagataataatcttgg

SEQ ID NO: 218577 - DNA, 25 bp, Homo sapien
ataatcttggagctcttttcccagc

SEQ ID NO: 218578 - DNA, 25 bp, Homo sapien
ccagctgtctaccatgcatttgcaa

SEQ ID NO: 218579 - DNA, 25 bp, Homo sapien
catgcatttgcaacaggaggaagat

SEQ ID NO: 218580 - DNA, 25 bp, Homo sapien
tgaacagtgctttgatatgccaaag

SEQ ID NO: 218581 - DNA, 25 bp, Homo sapien
gaaaactgtcccacttaaattagat

SEQ ID NO: 218582 - DNA, 25 bp, Homo sapien
attgactatatttttggagtcccat

SEQ ID NO: 218583 - DNA, 25 bp, Homo sapien
ttttggagtcccattgtttcagtgg

SEQ ID NO: 218584 - DNA, 25 bp, Homo sapien
gagtcccattgtttcagtgggcatt

SEQ ID NO: 218585 - DNA, 25 bp, Homo sapien
cccattgtttcagtgggcattaaca

SEQ ID NO: 218586 - DNA, 25 bp, Homo sapien
cagtgggcattaacagaatgcttta

SEQ ID NO: 218587 - DNA, 25 bp, Homo sapien
gaatgctttaaaaacttctaagaca

SEQ ID NO: 218588 - DNA, 25 bp, Homo sapien
atagcattagtatacactggcacat

SEQ ID NO: 218589 - DNA, 25 bp, Homo sapien
gtatacactggcacataatttttta

SEQ ID NO: 218590 - DNA, 25 bp, Homo sapien
ttcacagtataaaatttcctcacct

SEQ ID NO: 218591 - DNA, 25 bp, Homo sapien
atttcctcacctgaagtaactttgt

SEQ ID NO: 218592 - DNA, 25 bp, Homo sapien
cacctgaagtaactttgtttgccaa

SEQ ID NO: 218593 - DNA, 25 bp, Homo sapien
ggagaagaagtacccatgccctgaa

SEQ ID NO: 218594 - DNA, 25 bp, Homo sapien
gaatgtgggagcttcttccgctcta

SEQ ID NO: 218595 - DNA, 25 bp, Homo sapien
ttccgctctaagtcctacttgaaca

SEQ ID NO: 218596 - DNA, 25 bp, Homo sapien
atccagaaggtgcatgtccgggctc

SEQ ID NO: 218597 - DNA, 25 bp, Homo sapien
tttctctcctcagcagaacatgtct

SEQ ID NO: 218598 - DNA, 25 bp, Homo sapien
agcagaacatgtctctcctcgagtc

SEQ ID NO: 218599 - DNA, 25 bp, Homo sapien
tcctcgagtcctttgggtttcagat

SEQ ID NO: 218600 - DNA, 25 bp, Homo sapien
ggtttcagattgttcagtcggcatt

SEQ ID NO: 218601 - DNA, 25 bp, Homo sapien
gtcggcatttgcgtcatctttagta

SEQ ID NO: 218602 - DNA, 25 bp, Homo sapien
gtcatctttagtagatcctgaggtt

SEQ ID NO: 218603 - DNA, 25 bp, Homo sapien
ctgaggttgaccagcagcccatggg

SEQ ID NO: 218604 - DNA, 25 bp, Homo sapien
tttatcaccagaatgaggaactcct

SEQ ID NO: 218605 - DNA, 25 bp, Homo sapien
atcaccagaatgaggaactcctgga

SEQ ID NO: 218606 - DNA, 25 bp, Homo sapien
aactcctggaagttaactgcaccat

SEQ ID NO: 218607 - DNA, 25 bp, Homo sapien
atccaactctttgaaccagacgtct

SEQ ID NO: 218608 - DNA, 25 bp, Homo sapien
aactctttgaaccagacgtctgcac

SEQ ID NO: 218609 - DNA, 25 bp, Homo sapien
ggtattgatgactttattattctgc

SEQ ID NO: 218610 - DNA, 25 bp, Homo sapien
tgaaccagacgtctgcacccttttt

SEQ ID NO: 218611 - DNA, 25 bp, Homo sapien
atgactttattattctgcaggtaca

SEQ ID NO: 218612 - DNA, 25 bp, Homo sapien
gtcatccctgtagacggcatggaaa

SEQ ID NO: 218613 - DNA, 25 bp, Homo sapien
cctgtagacggcatggaaattcccc

SEQ ID NO: 218614 - DNA, 25 bp, Homo sapien
tattattctgcaggtacatgtccag

SEQ ID NO: 218615 - DNA, 25 bp, Homo sapien
ggaatcttttagtattataacagca

SEQ ID NO: 218616 - DNA, 25 bp, Homo sapien
gtattataacagcatcactttagat

SEQ ID NO: 218617 - DNA, 25 bp, Homo sapien
ttatatataaattagcacctgagct

SEQ ID NO: 218618 - DNA, 25 bp, Homo sapien
tagcacctgagctaaggttaaggct

SEQ ID NO: 218619 - DNA, 25 bp, Homo sapien
cctgagctaaggttaaggctggtct

SEQ ID NO: 218620 - DNA, 25 bp, Homo sapien
gagctaaggttaaggctggtctaaa

SEQ ID NO: 218621 - DNA, 25 bp, Homo sapien
ggctggtctaaacttattttcactt

SEQ ID NO: 218622 - DNA, 25 bp, Homo sapien
gagatgcaggaattactgtaacaaa

SEQ ID NO: 218623 - DNA, 25 bp, Homo sapien
caaggatatatataagaccactgct

SEQ ID NO: 218624 - DNA, 25 bp, Homo sapien
tataagaccactgcttatctgtatc

SEQ ID NO: 218625 - DNA, 25 bp, Homo sapien
actgcttatctgtatcttcccattt

SEQ ID NO: 218626 - DNA, 25 bp, Homo sapien
ggctgcaaacccagtgctgtgaggt

SEQ ID NO: 218627 - DNA, 25 bp, Homo sapien
ggtgacttatatgaggttccagatc

SEQ ID NO: 218628 - DNA, 25 bp, Homo sapien
gttccagatcaaagacaggccgtgt

SEQ ID NO: 218629 - DNA, 25 bp, Homo sapien
agacaggccgtgtgagccagtccag

SEQ ID NO: 218630 - DNA, 25 bp, Homo sapien
gccagtccaggagggtgtaagttct

SEQ ID NO: 218631 - DNA, 25 bp, Homo sapien
aagttctgaatggttccttgctgac

SEQ ID NO: 218632 - DNA, 25 bp, Homo sapien
tccttgctgactttgggtgacacat

SEQ ID NO: 218633 - DNA, 25 bp, Homo sapien
gacacatgtaccacatactggctca

SEQ ID NO: 218634 - DNA, 25 bp, Homo sapien
ggctcagtttaagtcatggttctat

SEQ ID NO: 218635 - DNA, 25 bp, Homo sapien
gaaaatcttgtcactcttttggttt

SEQ ID NO: 218636 - DNA, 25 bp, Homo sapien
aaatctctgttttatgtcctgtcct

SEQ ID NO: 218637 - DNA, 25 bp, Homo sapien
cagataacttcagcacgcacaagta

SEQ ID NO: 218638 - DNA, 25 bp, Homo sapien
gataacttcagcacgcacaagtagt

SEQ ID NO: 218639 - DNA, 25 bp, Homo sapien
ttcagcacgcacaagtagtgcagag

SEQ ID NO: 218640 - DNA, 25 bp, Homo sapien
gggctcgagagttctttgaacagca

SEQ ID NO: 218641 - DNA, 25 bp, Homo sapien
atggagattctcgtgaaacaagctg

SEQ ID NO: 218642 - DNA, 25 bp, Homo sapien
gattctcgtgaaacaagctggcaag

SEQ ID NO: 218643 - DNA, 25 bp, Homo sapien
ttctcgtgaaacaagctggcaagta

SEQ ID NO: 218644 - DNA, 25 bp, Homo sapien
gaaacaagctggcaagtattaatgt

SEQ ID NO: 218645 - DNA, 25 bp, Homo sapien
agaagagcctggataagtttgcctt

SEQ ID NO: 218646 - DNA, 25 bp, Homo sapien
aagagcctggataagtttgccttct

SEQ ID NO: 218647 - DNA, 25 bp, Homo sapien
gagcctggataagtttgccttctga

SEQ ID NO: 218648 - DNA, 25 bp, Homo sapien
agagcccttcgaagcaaagcgtgcc

SEQ ID NO: 218649 - DNA, 25 bp, Homo sapien
aaagcgtgccgaagttagttgtctt

SEQ ID NO: 218650 - DNA, 25 bp, Homo sapien
aagttagttgtcttctctgtgctgg

SEQ ID NO: 218651 - DNA, 25 bp, Homo sapien
tggtcctttcttatgtcctcataaa

SEQ ID NO: 218652 - DNA, 25 bp, Homo sapien
ttatgtcctcataaaagctcagatg

SEQ ID NO: 218653 - DNA, 25 bp, Homo sapien
aaagctcagatgatggtatctgtga

SEQ ID NO: 218654 - DNA, 25 bp, Homo sapien
ttaaaaagaactgctgtacagagct

SEQ ID NO: 218655 - DNA, 25 bp, Homo sapien
gtacagagctagtactttgtccatt

SEQ ID NO: 218656 - DNA, 25 bp, Homo sapien
gatactttctagataccgctctttg

SEQ ID NO: 218657 - DNA, 25 bp, Homo sapien
tctagataccgctctttgctggcca

SEQ ID NO: 218658 - DNA, 25 bp, Homo sapien
tctttgctggccagagtctgtcctg

SEQ ID NO: 218659 - DNA, 25 bp, Homo sapien
agtttcattaatgttgagtcctaat

SEQ ID NO: 218660 - DNA, 25 bp, Homo sapien
gagtcctaatatggcaattctgttt

SEQ ID NO: 218661 - DNA, 25 bp, Homo sapien
cttttctgccttctatcactgatag

SEQ ID NO: 218662 - DNA, 25 bp, Homo sapien
gtttcagattctacagcctagtcag

SEQ ID NO: 218663 - DNA, 25 bp, Homo sapien
tacagcctagtcagcagatttatct

SEQ ID NO: 218664 - DNA, 25 bp, Homo sapien
agcagatttatctttgacagcataa

SEQ ID NO: 218665 - DNA, 25 bp, Homo sapien
atatagttacttactgtcactagct

SEQ ID NO: 218666 - DNA, 25 bp, Homo sapien
cagtatttttcgtcagttaaaactg

SEQ ID NO: 218667 - DNA, 25 bp, Homo sapien
gttaaaactgttagatctctttagt

SEQ ID NO: 218668 - DNA, 25 bp, Homo sapien
aatgtgtttttcagtaggcttcaat

SEQ ID NO: 218669 - DNA, 25 bp, Homo sapien
gtaggcttcaattacaaacagttaa

SEQ ID NO: 218670 - DNA, 25 bp, Homo sapien
tgtcatgcgaccctaggactttttt

SEQ ID NO: 218671 - DNA, 25 bp, Homo sapien
gtcatgcgaccctaggacttttttt

SEQ ID NO: 218672 - DNA, 25 bp, Homo sapien
tcatgcgaccctaggacttttttta

SEQ ID NO: 218673 - DNA, 25 bp, Homo sapien
tttttaacatgtaatcactgggctg

SEQ ID NO: 218674 - DNA, 25 bp, Homo sapien
ttttaacatgtaatcactgggctgg

SEQ ID NO: 218675 - DNA, 25 bp, Homo sapien
tttaacatgtaatcactgggctggg

SEQ ID NO: 218676 - DNA, 25 bp, Homo sapien
ttaacatgtaatcactgggctgggt

SEQ ID NO: 218677 - DNA, 25 bp, Homo sapien
taacatgtaatcactgggctgggtg

SEQ ID NO: 218678 - DNA, 25 bp, Homo sapien
aacatgtaatcactgggctgggtgc

SEQ ID NO: 218679 - DNA, 25 bp, Homo sapien
acatgtaatcactgggctgggtgca

SEQ ID NO: 218680 - DNA, 25 bp, Homo sapien
catgtaatcactgggctgggtgcag

SEQ ID NO: 218681 - DNA, 25 bp, Homo sapien
caaagcgtgccgaagttagttgtct

SEQ ID NO: 218682 - DNA, 25 bp, Homo sapien
aaagcgtgccgaagttagttgtctt

SEQ ID NO: 218683 - DNA, 25 bp, Homo sapien
gcgtgccgaagttagttgtcttctc

SEQ ID NO: 218684 - DNA, 25 bp, Homo sapien
gtgccgaagttagttgtcttctctg

SEQ ID NO: 218685 - DNA, 25 bp, Homo sapien
gccgaagttagttgtcttctctgtg

SEQ ID NO: 218686 - DNA, 25 bp, Homo sapien
tggtcctttcttatgtcctcataaa

SEQ ID NO: 218687 - DNA, 25 bp, Homo sapien
gtcctttcttatgtcctcataaaag

SEQ ID NO: 218688 - DNA, 25 bp, Homo sapien
ttatgtcctcataaaagctcagatg

SEQ ID NO: 218689 - DNA, 25 bp, Homo sapien
agctcagatgatggtatctgtgagt

SEQ ID NO: 218690 - DNA, 25 bp, Homo sapien
agatgatggtatctgtgagtatgtt

SEQ ID NO: 218691 - DNA, 25 bp, Homo sapien
ttaaaaagaactgctgtacagagct

SEQ ID NO: 218692 - DNA, 25 bp, Homo sapien
atcctggaattgatccttcagtagt

SEQ ID NO: 218693 - DNA, 25 bp, Homo sapien
gaggagctggatatagttattaacc

SEQ ID NO: 218694 - DNA, 25 bp, Homo sapien
ctaggttctgaactcattgcggcat

SEQ ID NO: 218695 - DNA, 25 bp, Homo sapien
gttctgaactcattgcggcatgtgg

SEQ ID NO: 218696 - DNA, 25 bp, Homo sapien
aaattcagcgatgggattctctaaa

SEQ ID NO: 218697 - DNA, 25 bp, Homo sapien
aagcttggaaagaccggattgacca

SEQ ID NO: 218698 - DNA, 25 bp, Homo sapien
gaccggattgaccaacttgagagca

SEQ ID NO: 218699 - DNA, 25 bp, Homo sapien
ttgagagcaatgcagctgccgtcag

SEQ ID NO: 218700 - DNA, 25 bp, Homo sapien
gcagctgccgtcagtacagatggac

SEQ ID NO: 218701 - DNA, 25 bp, Homo sapien
acagatggactgcaggcggtatttt

SEQ ID NO: 218702 - DNA, 25 bp, Homo sapien
ctgcaggcggtatttttctgggtag

SEQ ID NO: 218703 - DNA, 25 bp, Homo sapien
gaagttctttttgagctcccattcc

SEQ ID NO: 218704 - DNA, 25 bp, Homo sapien
ccattcctccagctgcaagaaggga

SEQ ID NO: 218705 - DNA, 25 bp, Homo sapien
gccagaaggaggcccctttccacag

SEQ ID NO: 218706 - DNA, 25 bp, Homo sapien
ccacaggcagcgtctccacagggag

SEQ ID NO: 218707 - DNA, 25 bp, Homo sapien
aatagggggaacctcaccagatgcc

SEQ ID NO: 218708 - DNA, 25 bp, Homo sapien
tgccctaccagcctgcacatgggta

SEQ ID NO: 218709 - DNA, 25 bp, Homo sapien
cctgcacatgggtagaagaggccaa

SEQ ID NO: 218710 - DNA, 25 bp, Homo sapien
gaagaggccaaattgaggcacccaa

SEQ ID NO: 218711 - DNA, 25 bp, Homo sapien
ttgaggcacccaagtgatccactgg

SEQ ID NO: 218712 - DNA, 25 bp, Homo sapien
tggccccacgtcacacagttacagt

SEQ ID NO: 218713 - DNA, 25 bp, Homo sapien
gtcacacagttacagtgaagcccaa

SEQ ID NO: 218714 - DNA, 25 bp, Homo sapien
aatgaaaaagattgtccgaagcctc

SEQ ID NO: 218715 - DNA, 25 bp, Homo sapien
ggtttccctggctattcttctcatc

SEQ ID NO: 218716 - DNA, 25 bp, Homo sapien
gtttccctggctattcttctcatcg

SEQ ID NO: 218717 - DNA, 25 bp, Homo sapien
tttccctggctattcttctcatcgg

SEQ ID NO: 218718 - DNA, 25 bp, Homo sapien
ttccctggctattcttctcatcggg

SEQ ID NO: 218719 - DNA, 25 bp, Homo sapien
tccctggctattcttctcatcgggg

SEQ ID NO: 218720 - DNA, 25 bp, Homo sapien
cctggctattcttctcatcggggtt

SEQ ID NO: 218721 - DNA, 25 bp, Homo sapien
ctggctattcttctcatcggggttg

SEQ ID NO: 218722 - DNA, 25 bp, Homo sapien
tggctattcttctcatcggggttgt

SEQ ID NO: 218723 - DNA, 25 bp, Homo sapien
tattcttctcatcggggttgtccta

SEQ ID NO: 218724 - DNA, 25 bp, Homo sapien
cttctcatcggggttgtcctactgt

SEQ ID NO: 218725 - DNA, 25 bp, Homo sapien
atcagacaacctcaaatcctcctgt

SEQ ID NO: 218726 - DNA, 25 bp, Homo sapien
gacaacctcaaatcctcctgttgga

SEQ ID NO: 218727 - DNA, 25 bp, Homo sapien
aacctcaaatcctcctgttggatga

SEQ ID NO: 218728 - DNA, 25 bp, Homo sapien
caaatcctcctgttggatgaagcta

SEQ ID NO: 218729 - DNA, 25 bp, Homo sapien
atcctcctgttggatgaagctacat

SEQ ID NO: 218730 - DNA, 25 bp, Homo sapien
gttggatgaagctacatcagctctg

SEQ ID NO: 218731 - DNA, 25 bp, Homo sapien
gaagctacatcagctctggatactg

SEQ ID NO: 218732 - DNA, 25 bp, Homo sapien
tacatcagctctggatactgaaagt

SEQ ID NO: 218733 - DNA, 25 bp, Homo sapien
tgggacacagaacttatgaactttt

SEQ ID NO: 218734 - DNA, 25 bp, Homo sapien
cagaacttatgaacttttgctacag

SEQ ID NO: 218735 - DNA, 25 bp, Homo sapien
acttatgaacttttgctacagtata

SEQ ID NO: 218736 - DNA, 25 bp, Homo sapien
aaataacactttgagcaagcccacc

SEQ ID NO: 218737 - DNA, 25 bp, Homo sapien
taccagaaaatcatgaaacggctca

SEQ ID NO: 218738 - DNA, 25 bp, Homo sapien
cggctcataaaaagatacgtcctga

SEQ ID NO: 218739 - DNA, 25 bp, Homo sapien
tacgtcctgaaagcccaggtggaca

SEQ ID NO: 218740 - DNA, 25 bp, Homo sapien
gacgaagtcaatgaaggcgagctga

SEQ ID NO: 218741 - DNA, 25 bp, Homo sapien
gatatctccagcctgcgctatgagc

SEQ ID NO: 218742 - DNA, 25 bp, Homo sapien
agcctgcgctatgagcttcttgagg

SEQ ID NO: 218743 - DNA, 25 bp, Homo sapien
gcgctatgagcttcttgaggaaaaa

SEQ ID NO: 218744 - DNA, 25 bp, Homo sapien
aggaaaaatctcaagctactggtga

SEQ ID NO: 218745 - DNA, 25 bp, Homo sapien
aagctactggtgagctggcagacct

SEQ ID NO: 218746 - DNA, 25 bp, Homo sapien
gattcaacaactcagcgagaagttt

SEQ ID NO: 218747 - DNA, 25 bp, Homo sapien
gatgccaaccaaatctatcctgagt

SEQ ID NO: 218748 - DNA, 25 bp, Homo sapien
atttcacttccaaatctcggtggtc

SEQ ID NO: 218749 - DNA, 25 bp, Homo sapien
aatctcggtggtcaaggaagcttta

SEQ ID NO: 218750 - DNA, 25 bp, Homo sapien
attccaaattcatggtgtcagcttg

SEQ ID NO: 218751 - DNA, 25 bp, Homo sapien
tggtgtcagcttgcaacagcggcat

SEQ ID NO: 218752 - DNA, 25 bp, Homo sapien
cagcggcatctgtttagaacatata

SEQ ID NO: 218753 - DNA, 25 bp, Homo sapien
aatctatgtttcttgctcgagtgct

SEQ ID NO: 218754 - DNA, 25 bp, Homo sapien
cggagactccaaatacatgcgacct

SEQ ID NO: 218755 - DNA, 25 bp, Homo sapien
atgcgacctccttccaaagacggga

SEQ ID NO: 218756 - DNA, 25 bp, Homo sapien
gctgtgtggatgatacctggaaccc

SEQ ID NO: 218757 - DNA, 25 bp, Homo sapien
tacctggaacccaaagatctttgtg

SEQ ID NO: 218758 - DNA, 25 bp, Homo sapien
aattgcccagtattatgctgtcgcc

SEQ ID NO: 218759 - DNA, 25 bp, Homo sapien
agtattatgctgtcgccccagttgt

SEQ ID NO: 218760 - DNA, 25 bp, Homo sapien
gccccagttgtcaaactgctgtgca

SEQ ID NO: 218761 - DNA, 25 bp, Homo sapien
tgctgtgcagatggctccagcccag

SEQ ID NO: 218762 - DNA, 25 bp, Homo sapien
cagtcaacttcaccttctttttaat

SEQ ID NO: 218763 - DNA, 25 bp, Homo sapien
ttgtaatcacttatcctttccagag

SEQ ID NO: 218764 - DNA, 25 bp, Homo sapien
aaaagcgagcgttctgtgtactgag

SEQ ID NO: 218765 - DNA, 25 bp, Homo sapien
gtgtactgaggccacttggtgataa

SEQ ID NO: 218766 - DNA, 25 bp, Homo sapien
ataaagagatggagcgctcccctca

SEQ ID NO: 218767 - DNA, 25 bp, Homo sapien
ctcccctcacagacttcaattaaga

SEQ ID NO: 218768 - DNA, 25 bp, Homo sapien
tcaattaagaacctccctttggaca

SEQ ID NO: 218769 - DNA, 25 bp, Homo sapien
gagccactgcactgtgtaaccatta

SEQ ID NO: 218770 - DNA, 25 bp, Homo sapien
gtaaccattagtgcaactactacct

SEQ ID NO: 218771 - DNA, 25 bp, Homo sapien
aaatgggtaagcatagccactggtg

SEQ ID NO: 218772 - DNA, 25 bp, Homo sapien
cactggtgggatattttgggatgtc

SEQ ID NO: 218773 - DNA, 25 bp, Homo sapien
ggcagagcacaagtcacaccagaaa

SEQ ID NO: 218774 - DNA, 25 bp, Homo sapien
aagtcacaccagaaactgcttttta

SEQ ID NO: 218775 - DNA, 25 bp, Homo sapien
ggaaacaagcctatttcctccagcc

SEQ ID NO: 218776 - DNA, 25 bp, Homo sapien
ttcctccagccagtttcactgaatg

SEQ ID NO: 218777 - DNA, 25 bp, Homo sapien
tcactgaatgctgcaccacatgcta

SEQ ID NO: 218778 - DNA, 25 bp, Homo sapien
acatgctacaccagttcagcgtgag

SEQ ID NO: 218779 - DNA, 25 bp, Homo sapien
accagttcagcgtgagaattttcta

SEQ ID NO: 218780 - DNA, 25 bp, Homo sapien
tcattggtatatggtggctgtttac

SEQ ID NO: 218781 - DNA, 25 bp, Homo sapien
ataaaagacacttgcaatatactgt

SEQ ID NO: 218782 - DNA, 25 bp, Homo sapien
aattttgttatgttagcctctagaa

SEQ ID NO: 218783 - DNA, 25 bp, Homo sapien
gttatgttagcctctagaaaattta

SEQ ID NO: 218784 - DNA, 25 bp, Homo sapien
tagcctctagaaaatttaagttcag

SEQ ID NO: 218785 - DNA, 25 bp, Homo sapien
aaaaatgcactatgaccggttcgta

SEQ ID NO: 218786 - DNA, 25 bp, Homo sapien
aatgcactatgaccggttcgtaatt

SEQ ID NO: 218787 - DNA, 25 bp, Homo sapien
gcactatgaccggttcgtaattttt

SEQ ID NO: 218788 - DNA, 25 bp, Homo sapien
ttttaatgccacacataggttgtat

SEQ ID NO: 218789 - DNA, 25 bp, Homo sapien
tgccacacataggttgtattgtaat

SEQ ID NO: 218790 - DNA, 25 bp, Homo sapien
ttgcaaagtctgtattccagctctt

SEQ ID NO: 218791 - DNA, 25 bp, Homo sapien
caatgttgagctagcctttgagact

SEQ ID NO: 218792 - DNA, 25 bp, Homo sapien
tgttgagctagcctttgagactgtc

SEQ ID NO: 218793 - DNA, 25 bp, Homo sapien
gagactgtcctgaaagaaatctttg

SEQ ID NO: 218794 - DNA, 25 bp, Homo sapien
gaaatctttgcgaaggtgtccaagc

SEQ ID NO: 218795 - DNA, 25 bp, Homo sapien
gaaggtgtccaagcagagacagaac

SEQ ID NO: 218796 - DNA, 25 bp, Homo sapien
gagacagaacagcatccggaccaat

SEQ ID NO: 218797 - DNA, 25 bp, Homo sapien
aacagcatccggaccaatgccatca

SEQ ID NO: 218798 - DNA, 25 bp, Homo sapien
ggaccaatgccatcactctgggcag

SEQ ID NO: 218799 - DNA, 25 bp, Homo sapien
atgccatcactctgggcagtgccag

SEQ ID NO: 218800 - DNA, 25 bp, Homo sapien
ccactggctttttgtgccccttgtc

SEQ ID NO: 218801 - DNA, 25 bp, Homo sapien
caccctcagggtcttaaggtcttca

SEQ ID NO: 218802 - DNA, 25 bp, Homo sapien
gcaacagctgcaagctgtccagcag

SEQ ID NO: 218803 - DNA, 25 bp, Homo sapien
aacagctgcaagctgtccagcagct

SEQ ID NO: 218804 - DNA, 25 bp, Homo sapien
agcagcttcatcatcacccagaaca

SEQ ID NO: 218805 - DNA, 25 bp, Homo sapien
gtgccggctacgacaccaagcagga

SEQ ID NO: 218806 - DNA, 25 bp, Homo sapien
aaggacacctacttcgtgacaggca

SEQ ID NO: 218807 - DNA, 25 bp, Homo sapien
ggaagtacgggatctacaccaaggt

SEQ ID NO: 218808 - DNA, 25 bp, Homo sapien
aagtacgggatctacaccaaggtca

SEQ ID NO: 218809 - DNA, 25 bp, Homo sapien
gtacgggatctacaccaaggtcacc

SEQ ID NO: 218810 - DNA, 25 bp, Homo sapien
acgggatctacaccaaggtcaccgc

SEQ ID NO: 218811 - DNA, 25 bp, Homo sapien
gtccatgaaaaccaggggcttgccc

SEQ ID NO: 218812 - DNA, 25 bp, Homo sapien
gggcttgcccaaggccaagagccat

SEQ ID NO: 218813 - DNA, 25 bp, Homo sapien
ccaccttcctgactgggaaggacat

SEQ ID NO: 218814 - DNA, 25 bp, Homo sapien
gggtcaaactacattgagcccctga

SEQ ID NO: 218815 - DNA, 25 bp, Homo sapien
caaactacattgagcccctgaggac

SEQ ID NO: 218816 - DNA, 25 bp, Homo sapien
gcatctctgggctgagcctactgtc

SEQ ID NO: 218817 - DNA, 25 bp, Homo sapien
tctgggctgagcctactgtctcctt

SEQ ID NO: 218818 - DNA, 25 bp, Homo sapien
tgtcctttctccaggccctcagatg

SEQ ID NO: 218819 - DNA, 25 bp, Homo sapien
tccaggccctcagatggcacattag

SEQ ID NO: 218820 - DNA, 25 bp, Homo sapien
tgcgggtgggtatcccacctccagc

SEQ ID NO: 218821 - DNA, 25 bp, Homo sapien
agcccacagtgctcagttgtacttt

SEQ ID NO: 218822 - DNA, 25 bp, Homo sapien
cacagtgctcagttgtactttttat

SEQ ID NO: 218823 - DNA, 25 bp, Homo sapien
taagctgtaatatctatttttgttt

SEQ ID NO: 218824 - DNA, 25 bp, Homo sapien
ggccctggggctatttcacgtggaa

SEQ ID NO: 218825 - DNA, 25 bp, Homo sapien
gggctatttcacgtggaagttcatg

SEQ ID NO: 218826 - DNA, 25 bp, Homo sapien
ggctatttcacgtggaagttcatgt

SEQ ID NO: 218827 - DNA, 25 bp, Homo sapien
ctatttcacgtggaagttcatgtcc

SEQ ID NO: 218828 - DNA, 25 bp, Homo sapien
acgtggaagttcatgtccttcagct

SEQ ID NO: 218829 - DNA, 25 bp, Homo sapien
gtggaagttcatgtccttcagctca

SEQ ID NO: 218830 - DNA, 25 bp, Homo sapien
tggaagttcatgtccttcagctcag

SEQ ID NO: 218831 - DNA, 25 bp, Homo sapien
ggaagttcatgtccttcagctcagg

SEQ ID NO: 218832 - DNA, 25 bp, Homo sapien
ttcagctcaggtcaaccctcttctt

SEQ ID NO: 218833 - DNA, 25 bp, Homo sapien
tcaggtcaaccctcttcttccattt

SEQ ID NO: 218834 - DNA, 25 bp, Homo sapien
ctcacttcctcttctctgtcctgtg

SEQ ID NO: 218835 - DNA, 25 bp, Homo sapien
gtatctacatacctacacctatcta

SEQ ID NO: 218836 - DNA, 25 bp, Homo sapien
cacctatctatatataagctcatgg

SEQ ID NO: 218837 - DNA, 25 bp, Homo sapien
gtagaaaaccatagctaagtagcat

SEQ ID NO: 218838 - DNA, 25 bp, Homo sapien
aagtagcatcgcagacttaagcgta

SEQ ID NO: 218839 - DNA, 25 bp, Homo sapien
gcgtacaaagtgatcttgttcacaa

SEQ ID NO: 218840 - DNA, 25 bp, Homo sapien
gttcacaagtaatctgttgacagtg

SEQ ID NO: 218841 - DNA, 25 bp, Homo sapien
tgttgacagtgccaataaatgataa

SEQ ID NO: 218842 - DNA, 25 bp, Homo sapien
ttaacatgtcacaatgtaacggatg

SEQ ID NO: 218843 - DNA, 25 bp, Homo sapien
gtaacggatgaccatatgcacaatt

SEQ ID NO: 218844 - DNA, 25 bp, Homo sapien
cggatgaccatatgcacaattccat

SEQ ID NO: 218845 - DNA, 25 bp, Homo sapien
cctgtgttagtcagtattcttaaat

SEQ ID NO: 218846 - DNA, 25 bp, Homo sapien
aaaatagtgggcaatgatccataag

SEQ ID NO: 218847 - DNA, 25 bp, Homo sapien
aaatagtgggcaatgatccataaga

SEQ ID NO: 218848 - DNA, 25 bp, Homo sapien
aatagtgggcaatgatccataagaa

SEQ ID NO: 218849 - DNA, 25 bp, Homo sapien
atagtgggcaatgatccataagaag

SEQ ID NO: 218850 - DNA, 25 bp, Homo sapien
tagtgggcaatgatccataagaaga

SEQ ID NO: 218851 - DNA, 25 bp, Homo sapien
agtgggcaatgatccataagaagat

SEQ ID NO: 218852 - DNA, 25 bp, Homo sapien
gtgggcaatgatccataagaagata

SEQ ID NO: 218853 - DNA, 25 bp, Homo sapien
tgggcaatgatccataagaagataa

SEQ ID NO: 218854 - DNA, 25 bp, Homo sapien
aagaagataaacatctcaggccggg

SEQ ID NO: 218855 - DNA, 25 bp, Homo sapien
agaagataaacatctcaggccggga

SEQ ID NO: 218856 - DNA, 25 bp, Homo sapien
agaggcttaggtaggagaagtgctt

SEQ ID NO: 218857 - DNA, 25 bp, Homo sapien
tgtcatcatcactggcgttgtgtgt

SEQ ID NO: 218858 - DNA, 25 bp, Homo sapien
gtctcatgatgttggcagctgccat

SEQ ID NO: 218859 - DNA, 25 bp, Homo sapien
atgttggcagctgccatctatggct

SEQ ID NO: 218860 - DNA, 25 bp, Homo sapien
atctatggctgcacctatgcggcaa

SEQ ID NO: 218861 - DNA, 25 bp, Homo sapien
tatgcggcaatcacagcccagtacc

SEQ ID NO: 218862 - DNA, 25 bp, Homo sapien
gggacccttggctcaaaccaatgat

SEQ ID NO: 218863 - DNA, 25 bp, Homo sapien
gagcgatttgacagctcaccagcct

SEQ ID NO: 218864 - DNA, 25 bp, Homo sapien
ataggattggtcattgcaggccaga

SEQ ID NO: 218865 - DNA, 25 bp, Homo sapien
gctgatgtgtttcctgttagtctga

SEQ ID NO: 218866 - DNA, 25 bp, Homo sapien
gttagtctgattttgcttttgccaa

SEQ ID NO: 218867 - DNA, 25 bp, Homo sapien
tcatgccattgccactgtcatcatc

SEQ ID NO: 218868 - DNA, 25 bp, Homo sapien
ggacttagttattcattgccaggac

SEQ ID NO: 218869 - DNA, 25 bp, Homo sapien
ttgccaggacttacagacagcagag

SEQ ID NO: 218870 - DNA, 25 bp, Homo sapien
attacccttgttggccaatgattct

SEQ ID NO: 218871 - DNA, 25 bp, Homo sapien
gttggccaatgattctcagttacag

SEQ ID NO: 218872 - DNA, 25 bp, Homo sapien
tctcagttacagaatttgccactaa

SEQ ID NO: 218873 - DNA, 25 bp, Homo sapien
tgccactaacctatattcttacttg

SEQ ID NO: 218874 - DNA, 25 bp, Homo sapien
tattcttacttgtcaacatgatctc

SEQ ID NO: 218875 - DNA, 25 bp, Homo sapien
gatgatggacttatgtatgttacaa

SEQ ID NO: 218876 - DNA, 25 bp, Homo sapien
gttggagtccaagttgttcatgaac

SEQ ID NO: 218877 - DNA, 25 bp, Homo sapien
atggagctttatcattcatgacttc

SEQ ID NO: 218878 - DNA, 25 bp, Homo sapien
cattttatttacgtctaggtcttag

SEQ ID NO: 218879 - DNA, 25 bp, Homo sapien
tgcccttctacctttgggtttacag

SEQ ID NO: 218880 - DNA, 25 bp, Homo sapien
aattcagtatttctgcactcttagc

SEQ ID NO: 218881 - DNA, 25 bp, Homo sapien
atttctgcactcttagctggattct

SEQ ID NO: 218882 - DNA, 25 bp, Homo sapien
tagctggattctaaagttctgtata

SEQ ID NO: 218883 - DNA, 25 bp, Homo sapien
gttctgtatagctcgtaatgatggt

SEQ ID NO: 218884 - DNA, 25 bp, Homo sapien
atagcagccttttaacagaactagt

SEQ ID NO: 218885 - DNA, 25 bp, Homo sapien
atttcgtgtatatgaatctttctcg

SEQ ID NO: 218886 - DNA, 25 bp, Homo sapien
gaatctttctcgaagatctggtcaa

SEQ ID NO: 218887 - DNA, 25 bp, Homo sapien
gaagatctggtcaaaactgtattca

SEQ ID NO: 218888 - DNA, 25 bp, Homo sapien
aactgtattcagtttcctgcccaga

SEQ ID NO: 218889 - DNA, 25 bp, Homo sapien
gtttcctgcccagaatgatcagatt

SEQ ID NO: 218890 - DNA, 25 bp, Homo sapien
acaaggcttctgactttggccaggt

SEQ ID NO: 218891 - DNA, 25 bp, Homo sapien
ctttggccaggtaggacttgactta

SEQ ID NO: 218892 - DNA, 25 bp, Homo sapien
caaagacgtgctcggttttcatgaa

SEQ ID NO: 218893 - DNA, 25 bp, Homo sapien
ttttcatgaagccaatgacggcggt

SEQ ID NO: 218894 - DNA, 25 bp, Homo sapien
aatgacggcggtttctggactcttc

SEQ ID NO: 218895 - DNA, 25 bp, Homo sapien
cttccttgaccctgttctgtaaaga

SEQ ID NO: 218896 - DNA, 25 bp, Homo sapien
ggattcagctgatgggaccctggct

SEQ ID NO: 218897 - DNA, 25 bp, Homo sapien
gaccctggcttggactgttgattgc

SEQ ID NO: 218898 - DNA, 25 bp, Homo sapien
ggatgtaattggctgccctcaggac

SEQ ID NO: 218899 - DNA, 25 bp, Homo sapien
aaacccagacacttcataggattat

SEQ ID NO: 218900 - DNA, 25 bp, Homo sapien
ataggattatcacaccctccatctt

SEQ ID NO: 218901 - DNA, 25 bp, Homo sapien
tgccttggtgcagcagggtcatctg

SEQ ID NO: 218902 - DNA, 25 bp, Homo sapien
agggtcatctgtagggccaccccac

SEQ ID NO: 218903 - DNA, 25 bp, Homo sapien
gggtgggcacctgaggcccaataat

SEQ ID NO: 218904 - DNA, 25 bp, Homo sapien
gcacctgaggcccaataatatttgg

SEQ ID NO: 218905 - DNA, 25 bp, Homo sapien
gaggcccaataatatttggaccaag

SEQ ID NO: 218906 - DNA, 25 bp, Homo sapien
atatttggaccaagtgggaaacaag

SEQ ID NO: 218907 - DNA, 25 bp, Homo sapien
agtgggaaacaagaacactcggagg

SEQ ID NO: 218908 - DNA, 25 bp, Homo sapien
gggcgggaatcagaagagcctggaa

SEQ ID NO: 218909 - DNA, 25 bp, Homo sapien
gagcctggaaaaagacctagcccaa

SEQ ID NO: 218910 - DNA, 25 bp, Homo sapien
aagacctagcccaacttcccttgtg

SEQ ID NO: 218911 - DNA, 25 bp, Homo sapien
gacctagcccaacttcccttgtggg

SEQ ID NO: 218912 - DNA, 25 bp, Homo sapien
aaagactagtgcttcccagtacttg

SEQ ID NO: 218913 - DNA, 25 bp, Homo sapien
tagtgcttcccagtacttgcatggg

SEQ ID NO: 218914 - DNA, 25 bp, Homo sapien
tagttttcttgggagtatcacagga

SEQ ID NO: 218915 - DNA, 25 bp, Homo sapien
ggaaaatcacaattacaccacttta

SEQ ID NO: 218916 - DNA, 25 bp, Homo sapien
acaccactttagaccctatgtgtag

SEQ ID NO: 218917 - DNA, 25 bp, Homo sapien
actttagaccctatgtgtagcaggt

SEQ ID NO: 218918 - DNA, 25 bp, Homo sapien
gtgtagcaggtcacaacttaccctt

SEQ ID NO: 218919 - DNA, 25 bp, Homo sapien
aggtcacaacttacccttgtgtgtt

SEQ ID NO: 218920 - DNA, 25 bp, Homo sapien
cttacccttgtgtgtttagatgtgt

SEQ ID NO: 218921 - DNA, 25 bp, Homo sapien
gaaatacctgtatacgttagtgaaa

SEQ ID NO: 218922 - DNA, 25 bp, Homo sapien
gtgaaagctgtttactgttaacggg

SEQ ID NO: 218923 - DNA, 25 bp, Homo sapien
acaagaactaccatcatgcaggctt

SEQ ID NO: 218924 - DNA, 25 bp, Homo sapien
tcatgcaggcttcttgcccagctga

SEQ ID NO: 218925 - DNA, 25 bp, Homo sapien
aggcttcttgcccagctgaccactg

SEQ ID NO: 218926 - DNA, 25 bp, Homo sapien
aggccaccaggctcaagccactgct

SEQ ID NO: 218927 - DNA, 25 bp, Homo sapien
aagccactgctgttgcattacaccc

SEQ ID NO: 218928 - DNA, 25 bp, Homo sapien
tgctgttgcattacacccatccctt

SEQ ID NO: 218929 - DNA, 25 bp, Homo sapien
tgcattacacccatccctttgcaaa

SEQ ID NO: 218930 - DNA, 25 bp, Homo sapien
atccctttgcaaaatccctatggag

SEQ ID NO: 218931 - DNA, 25 bp, Homo sapien
tttgcaaaatccctatggagcctgt

SEQ ID NO: 218932 - DNA, 25 bp, Homo sapien
gcaaaatccctatggagcctgtcac

SEQ ID NO: 218933 - DNA, 25 bp, Homo sapien
aaatccctatggagcctgtcaccac

SEQ ID NO: 218934 - DNA, 25 bp, Homo sapien
ctcccgtagtctcctgggtgtgttt

SEQ ID NO: 218935 - DNA, 25 bp, Homo sapien
ccgtagtctcctgggtgtgtttggc

SEQ ID NO: 218936 - DNA, 25 bp, Homo sapien
gggtgtgtttggcttggccttggca

SEQ ID NO: 218937 - DNA, 25 bp, Homo sapien
tggcttggccttggcatgggcgcag

SEQ ID NO: 218938 - DNA, 25 bp, Homo sapien
gggcgcaggcccagtgacaaagact

SEQ ID NO: 218939 - DNA, 25 bp, Homo sapien
tgacaaagactcctctgggcctggg

SEQ ID NO: 218940 - DNA, 25 bp, Homo sapien
ggcaccgggctccatgcctctggag

SEQ ID NO: 218941 - DNA, 25 bp, Homo sapien
tctggccctcggtggctgcacagaa

SEQ ID NO: 218942 - DNA, 25 bp, Homo sapien
ctcggtggctgcacagaagggctct

SEQ ID NO: 218943 - DNA, 25 bp, Homo sapien
gtggctgcacagaagggctctttct

SEQ ID NO: 218944 - DNA, 25 bp, Homo sapien
gatttccagtgagtgtaaataattt

SEQ ID NO: 218945 - DNA, 25 bp, Homo sapien
gaagcagcctgtgtatattcctaac

SEQ ID NO: 218946 - DNA, 25 bp, Homo sapien
attcctaacactttgttcactagca

SEQ ID NO: 218947 - DNA, 25 bp, Homo sapien
tagaataagcccaagtaagacaatg

SEQ ID NO: 218948 - DNA, 25 bp, Homo sapien
gaactcttagttcttacatgattta

SEQ ID NO: 218949 - DNA, 25 bp, Homo sapien
atcgatacatgaatttaacttactt

SEQ ID NO: 218950 - DNA, 25 bp, Homo sapien
acttactttaatgtaggcaaactat

SEQ ID NO: 218951 - DNA, 25 bp, Homo sapien
gcaaactatcaattttttgtccatt

SEQ ID NO: 218952 - DNA, 25 bp, Homo sapien
gttaaaataacatacctctcctacg

SEQ ID NO: 218953 - DNA, 25 bp, Homo sapien
acctctcctacgtattattttcttg

SEQ ID NO: 218954 - DNA, 25 bp, Homo sapien
tcctacgtattattttcttgaccca

SEQ ID NO: 218955 - DNA, 25 bp, Homo sapien
taacctaaggtcaagctgggagaga

SEQ ID NO: 218956 - DNA, 25 bp, Homo sapien
acagatactgtgagagtcgacgaag

SEQ ID NO: 218957 - DNA, 25 bp, Homo sapien
gtcgacgaagggttttgttacagca

SEQ ID NO: 218958 - DNA, 25 bp, Homo sapien
aagggttttgttacagcatgtgcat

SEQ ID NO: 218959 - DNA, 25 bp, Homo sapien
cagcatgtgcatgaaggctatgaaa

SEQ ID NO: 218960 - DNA, 25 bp, Homo sapien
aaagatctgtgggagtacattgagg

SEQ ID NO: 218961 - DNA, 25 bp, Homo sapien
cattgaggactgagaatggccctgc

SEQ ID NO: 218962 - DNA, 25 bp, Homo sapien
gagaatggccctgcataaaatgaac

SEQ ID NO: 218963 - DNA, 25 bp, Homo sapien
aactttaccatctagagtgctcatg

SEQ ID NO: 218964 - DNA, 25 bp, Homo sapien
aggcactaagcctattctgacacca

SEQ ID NO: 218965 - DNA, 25 bp, Homo sapien
attctgacaccactggtctgtagta

SEQ ID NO: 218966 - DNA, 25 bp, Homo sapien
ggtctgtagtaccagaattgttttg

SEQ ID NO: 218967 - DNA, 25 bp, Homo sapien
gacgcctgtgttcacccatggtgcc

SEQ ID NO: 218968 - DNA, 25 bp, Homo sapien
gttcacccatggtgcccatgtcgtt

SEQ ID NO: 218969 - DNA, 25 bp, Homo sapien
atgtcgttcttctctccctgtgaca

SEQ ID NO: 218970 - DNA, 25 bp, Homo sapien
gtgacacagcttgtacagtctgatt

SEQ ID NO: 218971 - DNA, 25 bp, Homo sapien
gtacagtctgattctttttatctgg

SEQ ID NO: 218972 - DNA, 25 bp, Homo sapien
ggcttttatgtttgtccgatggaga

SEQ ID NO: 218973 - DNA, 25 bp, Homo sapien
ttgtccgatggagatttgttttgtt

SEQ ID NO: 218974 - DNA, 25 bp, Homo sapien
tgatgttctgaggtttgctttggtt

SEQ ID NO: 218975 - DNA, 25 bp, Homo sapien
ggcatttatttattcgtgcttcaaa

SEQ ID NO: 218976 - DNA, 25 bp, Homo sapien
tcgtgcttcaaatcacagtcatatt

SEQ ID NO: 218977 - DNA, 25 bp, Homo sapien
gtcatattaaaagctggtcttgtgg

SEQ ID NO: 218978 - DNA, 25 bp, Homo sapien
gggacgacacgaggctctgttgtcc

SEQ ID NO: 218979 - DNA, 25 bp, Homo sapien
gacacgaggctctgttgtcccgagg

SEQ ID NO: 218980 - DNA, 25 bp, Homo sapien
cacgaggctctgttgtcccgaggtg

SEQ ID NO: 218981 - DNA, 25 bp, Homo sapien
ctcagaccatggaacggtgacaaaa

SEQ ID NO: 218982 - DNA, 25 bp, Homo sapien
gtgacaaaagtttggccacttccct

SEQ ID NO: 218983 - DNA, 25 bp, Homo sapien
aagtttggccacttccctctcaaag

SEQ ID NO: 218984 - DNA, 25 bp, Homo sapien
tggccacttccctctcaaagactaa

SEQ ID NO: 218985 - DNA, 25 bp, Homo sapien
agactaacccagaagggaataagat

SEQ ID NO: 218986 - DNA, 25 bp, Homo sapien
tgtctcctttccctggcttatttca

SEQ ID NO: 218987 - DNA, 25 bp, Homo sapien
tcctttccctggcttatttcatcct

SEQ ID NO: 218988 - DNA, 25 bp, Homo sapien
cttatttcatcctggtcttggggta

SEQ ID NO: 218989 - DNA, 25 bp, Homo sapien
aaggacatggacaaggtcgagacat

SEQ ID NO: 218990 - DNA, 25 bp, Homo sapien
aggacatggacaaggtcgagacatt

SEQ ID NO: 218991 - DNA, 25 bp, Homo sapien
ggacatggacaaggtcgagacattc

SEQ ID NO: 218992 - DNA, 25 bp, Homo sapien
gacatggacaaggtcgagacattcc

SEQ ID NO: 218993 - DNA, 25 bp, Homo sapien
acatggacaaggtcgagacattcct

SEQ ID NO: 218994 - DNA, 25 bp, Homo sapien
catggacaaggtcgagacattcctg

SEQ ID NO: 218995 - DNA, 25 bp, Homo sapien
atggacaaggtcgagacattcctgc

SEQ ID NO: 218996 - DNA, 25 bp, Homo sapien
tggacaaggtcgagacattcctgcg

SEQ ID NO: 218997 - DNA, 25 bp, Homo sapien
ggacaaggtcgagacattcctgcgc

SEQ ID NO: 218998 - DNA, 25 bp, Homo sapien
gacaaggtcgagacattcctgcgca

SEQ ID NO: 218999 - DNA, 25 bp, Homo sapien
acaaggtcgagacattcctgcgcat

SEQ ID NO: 219000 - DNA, 25 bp, Homo sapien
gaactgttgtttgaattttcctgag

SEQ ID NO: 219001 - DNA, 25 bp, Homo sapien
gtttgaattttcctgagagcctggc

SEQ ID NO: 219002 - DNA, 25 bp, Homo sapien
gaattttcctgagagcctggcttag

SEQ ID NO: 219003 - DNA, 25 bp, Homo sapien
agagcctggcttagtgctgggcctt

SEQ ID NO: 219004 - DNA, 25 bp, Homo sapien
cctggcttagtgctgggccttctct

SEQ ID NO: 219005 - DNA, 25 bp, Homo sapien
tgaggttagtacttttagtccctgt

SEQ ID NO: 219006 - DNA, 25 bp, Homo sapien
ttcgtgaaatctgccaccactttat

SEQ ID NO: 219007 - DNA, 25 bp, Homo sapien
gtgaaatctgccaccactttataac

SEQ ID NO: 219008 - DNA, 25 bp, Homo sapien
aaatctgccaccactttataaccag

SEQ ID NO: 219009 - DNA, 25 bp, Homo sapien
gccaccactttataaccagatggtt

SEQ ID NO: 219010 - DNA, 25 bp, Homo sapien
taatttggcctataatgttaaaaga

SEQ ID NO: 219011 - DNA, 25 bp, Homo sapien
ttttaatcttagtctcgggtaggca

SEQ ID NO: 219012 - DNA, 25 bp, Homo sapien
tcttagtctcgggtaggcagaaaat

SEQ ID NO: 219013 - DNA, 25 bp, Homo sapien
ataattatttccacttagagggctg

SEQ ID NO: 219014 - DNA, 25 bp, Homo sapien
cacttagagggctggagaaatattc

SEQ ID NO: 219015 - DNA, 25 bp, Homo sapien
aatattcttatgtagaaccttcaga

SEQ ID NO: 219016 - DNA, 25 bp, Homo sapien
attaattgactaacagctagacttc

SEQ ID NO: 219017 - DNA, 25 bp, Homo sapien
gactaacagctagacttcaaagcaa

SEQ ID NO: 219018 - DNA, 25 bp, Homo sapien
gtatgtatactgtcacctctagtga

SEQ ID NO: 219019 - DNA, 25 bp, Homo sapien
actgtcacctctagtgatttgtcaa

SEQ ID NO: 219020 - DNA, 25 bp, Homo sapien
cctctagtgatttgtcaatttggct

SEQ ID NO: 219021 - DNA, 25 bp, Homo sapien
aatctctagggaggttatatatagc

SEQ ID NO: 219022 - DNA, 25 bp, Homo sapien
gctttcctttatctccagggactct

SEQ ID NO: 219023 - DNA, 25 bp, Homo sapien
cagggactctcaggctaacctttga

SEQ ID NO: 219024 - DNA, 25 bp, Homo sapien
caggctaacctttgagatcactcag

SEQ ID NO: 219025 - DNA, 25 bp, Homo sapien
aggtcctcctctagaagtttcaaat

SEQ ID NO: 219026 - DNA, 25 bp, Homo sapien
agaagtttcaaatctctcccaactc

SEQ ID NO: 219027 - DNA, 25 bp, Homo sapien
ccaactctgttctgcatcttccaga

SEQ ID NO: 219028 - DNA, 25 bp, Homo sapien
cagggattgattctcaccagcgttt

SEQ ID NO: 219029 - DNA, 25 bp, Homo sapien
ttctcaccagcgtttctgatggaaa

SEQ ID NO: 219030 - DNA, 25 bp, Homo sapien
tggcggtttcaagtccccgattccg

SEQ ID NO: 219031 - DNA, 25 bp, Homo sapien
agcagattctgcgaaagcaccaaat

SEQ ID NO: 219032 - DNA, 25 bp, Homo sapien
aagcaccaaatttctcaagaccctc

SEQ ID NO: 219033 - DNA, 25 bp, Homo sapien
cctgtacctataaatcgtgcaataa

SEQ ID NO: 219034 - DNA, 25 bp, Homo sapien
cgtgcaataaccatatgcgactatt

SEQ ID NO: 219035 - DNA, 25 bp, Homo sapien
aaccatatgcgactattttgccatg

SEQ ID NO: 219036 - DNA, 25 bp, Homo sapien
atgcgactattttgccatggagaaa

SEQ ID NO: 219037 - DNA, 25 bp, Homo sapien
ttgccatggagaaatctgacagcat

SEQ ID NO: 219038 - DNA, 25 bp, Homo sapien
gaaatctgacagcattgcaaacaat

SEQ ID NO: 219039 - DNA, 25 bp, Homo sapien
agtattgtttgatgtagttaacctt

SEQ ID NO: 219040 - DNA, 25 bp, Homo sapien
aacagctttaaacacttccaatgag

SEQ ID NO: 219041 - DNA, 25 bp, Homo sapien
tcatacattatgtaagcccatatgt

SEQ ID NO: 219042 - DNA, 25 bp, Homo sapien
gtaagcccatatgtatttacatcca

SEQ ID NO: 219043 - DNA, 25 bp, Homo sapien
atgtatttacatccagagtcataat

SEQ ID NO: 219044 - DNA, 25 bp, Homo sapien
tccagcctctggaggaactcagggc

SEQ ID NO: 219045 - DNA, 25 bp, Homo sapien
aggcatgaggccaaggctccactga

SEQ ID NO: 219046 - DNA, 25 bp, Homo sapien
gaggccaaggctccactgaccagga

SEQ ID NO: 219047 - DNA, 25 bp, Homo sapien
ggaggccgaggtctctaactcttat

SEQ ID NO: 219048 - DNA, 25 bp, Homo sapien
gaggtctctaactcttatcttccac

SEQ ID NO: 219049 - DNA, 25 bp, Homo sapien
taactcttatcttccacagggtcca

SEQ ID NO: 219050 - DNA, 25 bp, Homo sapien
cttccacagggtccaagagttcatc

SEQ ID NO: 219051 - DNA, 25 bp, Homo sapien
cacagggtccaagagttcatcagga

SEQ ID NO: 219052 - DNA, 25 bp, Homo sapien
gggcaaggctctggcacaaaacctc

SEQ ID NO: 219053 - DNA, 25 bp, Homo sapien
tcctcccaggcactcatttatattg

SEQ ID NO: 219054 - DNA, 25 bp, Homo sapien
tgctctgaaagagctttccaaagta

SEQ ID NO: 219055 - DNA, 25 bp, Homo sapien
ctactctggcagtctagcttctaag

SEQ ID NO: 219056 - DNA, 25 bp, Homo sapien
tctggcagtctagcttctaagctga

SEQ ID NO: 219057 - DNA, 25 bp, Homo sapien
agtttggccttcgctccaggtgcgg

SEQ ID NO: 219058 - DNA, 25 bp, Homo sapien
atttgattcgcgcttgagaaagatc

SEQ ID NO: 219059 - DNA, 25 bp, Homo sapien
ttcgcgcttgagaaagatcgctccg

SEQ ID NO: 219060 - DNA, 25 bp, Homo sapien
tgagaaagatcgctccgctcctgta

SEQ ID NO: 219061 - DNA, 25 bp, Homo sapien
agatcgctccgctcctgtaaggaag

SEQ ID NO: 219062 - DNA, 25 bp, Homo sapien
tcgctccgctcctgtaaggaagaga

SEQ ID NO: 219063 - DNA, 25 bp, Homo sapien
agacacagtcagaagctccgaggct

SEQ ID NO: 219064 - DNA, 25 bp, Homo sapien
gtcagaagctccgaggctaccgcga

SEQ ID NO: 219065 - DNA, 25 bp, Homo sapien
aagctccgaggctaccgcgatggtc

SEQ ID NO: 219066 - DNA, 25 bp, Homo sapien
aacagataccttgtggttttgtact

SEQ ID NO: 219067 - DNA, 25 bp, Homo sapien
gtggttttgtactataatgccaaca

SEQ ID NO: 219068 - DNA, 25 bp, Homo sapien
tgccaacagggcatttcagaagatg

SEQ ID NO: 219069 - DNA, 25 bp, Homo sapien
ggcatttcagaagatggacacaaag

SEQ ID NO: 219070 - DNA, 25 bp, Homo sapien
tatggcatcaacacagatccaccaa

SEQ ID NO: 219071 - DNA, 25 bp, Homo sapien
ttttctacattttcatttggactaa

SEQ ID NO: 219072 - DNA, 25 bp, Homo sapien
ttttcatttggactaaatcccacga

SEQ ID NO: 219073 - DNA, 25 bp, Homo sapien
aaatcccacgaatgacaactaccac

SEQ ID NO: 219074 - DNA, 25 bp, Homo sapien
cacgaatgacaactaccaccttttt

SEQ ID NO: 219075 - DNA, 25 bp, Homo sapien
tgtgatttcttatttgaggttcaaa

SEQ ID NO: 219076 - DNA, 25 bp, Homo sapien
aatgacctgcttgaaactttgatac

SEQ ID NO: 219077 - DNA, 25 bp, Homo sapien
acatcatttcaccttaatgttgagg

SEQ ID NO: 219078 - DNA, 25 bp, Homo sapien
tactatttttcctactttgcttttg

SEQ ID NO: 219079 - DNA, 25 bp, Homo sapien
ttcctactttgcttttgagaaaatt

SEQ ID NO: 219080 - DNA, 25 bp, Homo sapien
gaaaattgacactcagacttgccct

SEQ ID NO: 219081 - DNA, 25 bp, Homo sapien
aattgacactcagacttgccctaat

SEQ ID NO: 219082 - DNA, 25 bp, Homo sapien
agacttgccctaatcatgcacttta

SEQ ID NO: 219083 - DNA, 25 bp, Homo sapien
gccctaatcatgcactttacttaag

SEQ ID NO: 219084 - DNA, 25 bp, Homo sapien
gaaatcaaatgaagttctcctgact

SEQ ID NO: 219085 - DNA, 25 bp, Homo sapien
gttctcctgactctctggtttagtg

SEQ ID NO: 219086 - DNA, 25 bp, Homo sapien
actctctggtttagtgctcttttgt

SEQ ID NO: 219087 - DNA, 25 bp, Homo sapien
tatcctttaaatcaaactgggctat

SEQ ID NO: 219088 - DNA, 25 bp, Homo sapien
gatattggtaaattgctgtctgaag

SEQ ID NO: 219089 - DNA, 25 bp, Homo sapien
gaagcaaatgtagcagttcacactg

SEQ ID NO: 219090 - DNA, 25 bp, Homo sapien
gttcacactgctgtctagaattttc

SEQ ID NO: 219091 - DNA, 25 bp, Homo sapien
tttctcatatccttattagattttg

SEQ ID NO: 219092 - DNA, 25 bp, Homo sapien
gattttgaattgtcagaccctgcga

SEQ ID NO: 219093 - DNA, 25 bp, Homo sapien
ttgtcagaccctgcgatttttactc

SEQ ID NO: 219094 - DNA, 25 bp, Homo sapien
gatttttactcttatgatggctgtg

SEQ ID NO: 219095 - DNA, 25 bp, Homo sapien
gatggctgtgatatgctttttgttt

SEQ ID NO: 219096 - DNA, 25 bp, Homo sapien
gttcttctgtcaacaacatatataa

SEQ ID NO: 219097 - DNA, 25 bp, Homo sapien
tttgtcaccaaatcagcttttttga

SEQ ID NO: 219098 - DNA, 25 bp, Homo sapien
gcttttttgaggtatgacttacatg

SEQ ID NO: 219099 - DNA, 25 bp, Homo sapien
tttcagctaagttactcaccaccaa

SEQ ID NO: 219100 - DNA, 25 bp, Homo sapien
accaaggcttgctcagactgctaga

SEQ ID NO: 219101 - DNA, 25 bp, Homo sapien
agaacttgacgcaggagtggccagt

SEQ ID NO: 219102 - DNA, 25 bp, Homo sapien
agtggccagtgacgacgtagccatc

SEQ ID NO: 219103 - DNA, 25 bp, Homo sapien
gtagccatccctgccggttctgaag

SEQ ID NO: 219104 - DNA, 25 bp, Homo sapien
atgtgggcttccaagccttgcacta

SEQ ID NO: 219105 - DNA, 25 bp, Homo sapien
ccaagccttgcactagggcatgagt

SEQ ID NO: 219106 - DNA, 25 bp, Homo sapien
tggaaaggtttcagagcctcctact

SEQ ID NO: 219107 - DNA, 25 bp, Homo sapien
tcctactcatcgctgctttcatttt

SEQ ID NO: 219108 - DNA, 25 bp, Homo sapien
acatctgagtgtcttgacttctaaa

SEQ ID NO: 219109 - DNA, 25 bp, Homo sapien
gcattgggccacattatactttgac

SEQ ID NO: 219110 - DNA, 25 bp, Homo sapien
acaggacacagcctaacagaggccc

SEQ ID NO: 219111 - DNA, 25 bp, Homo sapien
caggacacagcctaacagaggccca

SEQ ID NO: 219112 - DNA, 25 bp, Homo sapien
aggacacagcctaacagaggcccag

SEQ ID NO: 219113 - DNA, 25 bp, Homo sapien
ggacacagcctaacagaggcccagg

SEQ ID NO: 219114 - DNA, 25 bp, Homo sapien
gacacagcctaacagaggcccaggt

SEQ ID NO: 219115 - DNA, 25 bp, Homo sapien
acacagcctaacagaggcccaggtt

SEQ ID NO: 219116 - DNA, 25 bp, Homo sapien
cacagcctaacagaggcccaggttg

SEQ ID NO: 219117 - DNA, 25 bp, Homo sapien
acagcctaacagaggcccaggttgg

SEQ ID NO: 219118 - DNA, 25 bp, Homo sapien
cagcctaacagaggcccaggttgga

SEQ ID NO: 219119 - DNA, 25 bp, Homo sapien
ccaggttggagccatggaccatgga

SEQ ID NO: 219120 - DNA, 25 bp, Homo sapien
ttggagccatggaccatggagtcat

SEQ ID NO: 219121 - DNA, 25 bp, Homo sapien
ccctgctgctcatccaaacgctgat

SEQ ID NO: 219122 - DNA, 25 bp, Homo sapien
aagttcgacacaaactcacacaacg

SEQ ID NO: 219123 - DNA, 25 bp, Homo sapien
agttcgacacaaactcacacaacga

SEQ ID NO: 219124 - DNA, 25 bp, Homo sapien
gttcgacacaaactcacacaacgat

SEQ ID NO: 219125 - DNA, 25 bp, Homo sapien
ttcgacacaaactcacacaacgatg

SEQ ID NO: 219126 - DNA, 25 bp, Homo sapien
tcgacacaaactcacacaacgatga

SEQ ID NO: 219127 - DNA, 25 bp, Homo sapien
tagctgcccgggtggcatccctgtg

SEQ ID NO: 219128 - DNA, 25 bp, Homo sapien
agctgcccgggtggcatccctgtga

SEQ ID NO: 219129 - DNA, 25 bp, Homo sapien
ctgcccgggtggcatccctgtgacc

SEQ ID NO: 219130 - DNA, 25 bp, Homo sapien
tgcccgggtggcatccctgtgaccc

SEQ ID NO: 219131 - DNA, 25 bp, Homo sapien
cccgggtggcatccctgtgacccct

SEQ ID NO: 219132 - DNA, 25 bp, Homo sapien
gagactggaataattatggccggaa

SEQ ID NO: 219133 - DNA, 25 bp, Homo sapien
ttttaagtaagacatggttttccat

SEQ ID NO: 219134 - DNA, 25 bp, Homo sapien
gcatcttcacctagaagatctcaat

SEQ ID NO: 219135 - DNA, 25 bp, Homo sapien
agatctcaattgtcttagtcacaga

SEQ ID NO: 219136 - DNA, 25 bp, Homo sapien
gtcttagtcacagagtaggtttatc

SEQ ID NO: 219137 - DNA, 25 bp, Homo sapien
gagtgttctgtatcaacatttgggt

SEQ ID NO: 219138 - DNA, 25 bp, Homo sapien
atttgggttggtattcagatgggaa

SEQ ID NO: 219139 - DNA, 25 bp, Homo sapien
tcaaatatgaatcctctctggagag

SEQ ID NO: 219140 - DNA, 25 bp, Homo sapien
gagggtccaactgggaatcctgcta

SEQ ID NO: 219141 - DNA, 25 bp, Homo sapien
ggagcaaagccttgtattacctctg

SEQ ID NO: 219142 - DNA, 25 bp, Homo sapien
agccttgtattacctctggaagaca

SEQ ID NO: 219143 - DNA, 25 bp, Homo sapien
ttcccgatcatctttgttccaattc

SEQ ID NO: 219144 - DNA, 25 bp, Homo sapien
gtacaactagaggtttctcatctat

SEQ ID NO: 219145 - DNA, 25 bp, Homo sapien
atctatatccaatcttctttctccg

SEQ ID NO: 219146 - DNA, 25 bp, Homo sapien
atacttgggagaggacagcattcgc

SEQ ID NO: 219147 - DNA, 25 bp, Homo sapien
ggacagcattcgcatatcaggtcga

SEQ ID NO: 219148 - DNA, 25 bp, Homo sapien
atcaggtcgaaatttctccgcgagc

SEQ ID NO: 219149 - DNA, 25 bp, Homo sapien
tccgcgagcgtttcgattacatctt

SEQ ID NO: 219150 - DNA, 25 bp, Homo sapien
attacatcttgagtggtggcagtac

SEQ ID NO: 219151 - DNA, 25 bp, Homo sapien
gtggcagtactagagacccgaatac

SEQ ID NO: 219152 - DNA, 25 bp, Homo sapien
ctgcttttcaggtccattactttga

SEQ ID NO: 219153 - DNA, 25 bp, Homo sapien
aatggcgtcattctcattcttaaga

SEQ ID NO: 219154 - DNA, 25 bp, Homo sapien
tgagcactgcaatggcgtcctcgat

SEQ ID NO: 219155 - DNA, 25 bp, Homo sapien
actgcaatggcgtcctcgatggtgc

SEQ ID NO: 219156 - DNA, 25 bp, Homo sapien
agcacgcggcggttcacgttctcct

SEQ ID NO: 219157 - DNA, 25 bp, Homo sapien
tcttggctttctcggctgtgtccgg

SEQ ID NO: 219158 - DNA, 25 bp, Homo sapien
tggtctcggcgcagcgtgtcctcga

SEQ ID NO: 219159 - DNA, 25 bp, Homo sapien
tcggcgcagcgtgtcctcgatctgg

SEQ ID NO: 219160 - DNA, 25 bp, Homo sapien
tgtcctcgatctgggcccgggtgac

SEQ ID NO: 219161 - DNA, 25 bp, Homo sapien
ggtgaccttgctggacgtggccacc

SEQ ID NO: 219162 - DNA, 25 bp, Homo sapien
ttgccgcccttgagcttggagtcct

SEQ ID NO: 219163 - DNA, 25 bp, Homo sapien
agtaggcgctgcgtctccttcttac

SEQ ID NO: 219164 - DNA, 25 bp, Homo sapien
gtctccttcttacgttccagctggt

SEQ ID NO: 219165 - DNA, 25 bp, Homo sapien
gtagttgattcactctcgaagtccc

SEQ ID NO: 219166 - DNA, 25 bp, Homo sapien
tgattcactctcgaagtccctgagt

SEQ ID NO: 219167 - DNA, 25 bp, Homo sapien
gtccctgagtgtgagctcttcatcc

SEQ ID NO: 219168 - DNA, 25 bp, Homo sapien
gagctcttcatcctagcactgtgaa

SEQ ID NO: 219169 - DNA, 25 bp, Homo sapien
cactgtgaagtggtttgcctgctgg

SEQ ID NO: 219170 - DNA, 25 bp, Homo sapien
attccctttaacaaagcttcactga

SEQ ID NO: 219171 - DNA, 25 bp, Homo sapien
tttaacaaagcttcactgagtgctg

SEQ ID NO: 219172 - DNA, 25 bp, Homo sapien
cactgagtgctgcagttctcaaaat

SEQ ID NO: 219173 - DNA, 25 bp, Homo sapien
ttcaaacaggttaggaagcaattcc

SEQ ID NO: 219174 - DNA, 25 bp, Homo sapien
gaagcaattcccatagccatcaata

SEQ ID NO: 219175 - DNA, 25 bp, Homo sapien
agccatcaatacttaaattcaggag

SEQ ID NO: 219176 - DNA, 25 bp, Homo sapien
ggaatcttttagtattataacagca

SEQ ID NO: 219177 - DNA, 25 bp, Homo sapien
gtattataacagcatcactttagat

SEQ ID NO: 219178 - DNA, 25 bp, Homo sapien
attataacagcatcactttagattt

SEQ ID NO: 219179 - DNA, 25 bp, Homo sapien
ttgaaatgaatgcacatagatttat

SEQ ID NO: 219180 - DNA, 25 bp, Homo sapien
ttatatataaattagcacctgagct

SEQ ID NO: 219181 - DNA, 25 bp, Homo sapien
tagcacctgagctaaggttaaggct

SEQ ID NO: 219182 - DNA, 25 bp, Homo sapien
cctgagctaaggttaaggctggtct

SEQ ID NO: 219183 - DNA, 25 bp, Homo sapien
gagctaaggttaaggctggtctaaa

SEQ ID NO: 219184 - DNA, 25 bp, Homo sapien
gagatgcaggaattactgtaacaaa

SEQ ID NO: 219185 - DNA, 25 bp, Homo sapien
caaggatatatataagaccactgct

SEQ ID NO: 219186 - DNA, 25 bp, Homo sapien
tataagaccactgcttatctgtatc

SEQ ID NO: 219187 - DNA, 25 bp, Homo sapien
gtttgagccagttagactagtcccc

SEQ ID NO: 219188 - DNA, 25 bp, Homo sapien
tctcccgattcccaactgagtgtta

SEQ ID NO: 219189 - DNA, 25 bp, Homo sapien
gattcccaactgagtgttatttgca

SEQ ID NO: 219190 - DNA, 25 bp, Homo sapien
gagtgttatttgcacactgcactgt

SEQ ID NO: 219191 - DNA, 25 bp, Homo sapien
cactgttttcaaataacgattttat

SEQ ID NO: 219192 - DNA, 25 bp, Homo sapien
tatgaaatgacctctgtcctccctc

SEQ ID NO: 219193 - DNA, 25 bp, Homo sapien
ctctgtcctccctctgatttttcat

SEQ ID NO: 219194 - DNA, 25 bp, Homo sapien
ggaacagaagacagctgctgggtca

SEQ ID NO: 219195 - DNA, 25 bp, Homo sapien
tgggtcaggccacccctaggaactc

SEQ ID NO: 219196 - DNA, 25 bp, Homo sapien
taggaactcagtcctgtactctggg

SEQ ID NO: 219197 - DNA, 25 bp, Homo sapien
gggtgctgcctgaatccattaaaaa

SEQ ID NO: 219198 - DNA, 25 bp, Homo sapien
aagaacaatcaatgctgttattact

SEQ ID NO: 219199 - DNA, 25 bp, Homo sapien
agatggcctcatgggaatttgacct

SEQ ID NO: 219200 - DNA, 25 bp, Homo sapien
catgggaatttgaccttgactagaa

SEQ ID NO: 219201 - DNA, 25 bp, Homo sapien
aatagagactgagagtgagcaacca

SEQ ID NO: 219202 - DNA, 25 bp, Homo sapien
tgagcaaccagctggaaggtactat

SEQ ID NO: 219203 - DNA, 25 bp, Homo sapien
aaggtactatgccagtcctagcaga

SEQ ID NO: 219204 - DNA, 25 bp, Homo sapien
gccagtcctagcagaaaaatgtgtt

SEQ ID NO: 219205 - DNA, 25 bp, Homo sapien
gcagtgttggttgcttacagtgttg

SEQ ID NO: 219206 - DNA, 25 bp, Homo sapien
tacagtgttgattgattttgttctt

SEQ ID NO: 219207 - DNA, 25 bp, Homo sapien
ttttctttccctctcatggtacctg

SEQ ID NO: 219208 - DNA, 25 bp, Homo sapien
tctcatggtacctgctcatggttat

SEQ ID NO: 219209 - DNA, 25 bp, Homo sapien
aagcctttaagtgctgcttctgtca

SEQ ID NO: 219210 - DNA, 25 bp, Homo sapien
taagtgctgcttctgtcagtcaaac

SEQ ID NO: 219211 - DNA, 25 bp, Homo sapien
gtgctgcttctgtcagtcaaacgtt

SEQ ID NO: 219212 - DNA, 25 bp, Homo sapien
gcttctgtcagtcaaacgttaaaaa

SEQ ID NO: 219213 - DNA, 25 bp, Homo sapien
tttcaaagtgcccagactgtgtaca

SEQ ID NO: 219214 - DNA, 25 bp, Homo sapien
agtgcccagactgtgtacaaagaca

SEQ ID NO: 219215 - DNA, 25 bp, Homo sapien
caaagacacatgtaatggagattgt

SEQ ID NO: 219216 - DNA, 25 bp, Homo sapien
taatggagattgtacaggttgtttt

SEQ ID NO: 219217 - DNA, 25 bp, Homo sapien
tactgttttcatttcattacagaat

SEQ ID NO: 219218 - DNA, 25 bp, Homo sapien
ccacagcatttgtactgttcctttt

SEQ ID NO: 219219 - DNA, 25 bp, Homo sapien
agcatttgtactgttcctttttaat

SEQ ID NO: 219220 - DNA, 25 bp, Homo sapien
tgtcatgcgaccctaggactttttt

SEQ ID NO: 219221 - DNA, 25 bp, Homo sapien
gtcatgcgaccctaggacttttttt

SEQ ID NO: 219222 - DNA, 25 bp, Homo sapien
tcatgcgaccctaggacttttttta

SEQ ID NO: 219223 - DNA, 25 bp, Homo sapien
tttttaacatgtaatcactgggctg

SEQ ID NO: 219224 - DNA, 25 bp, Homo sapien
ttttaacatgtaatcactgggctgg

SEQ ID NO: 219225 - DNA, 25 bp, Homo sapien
tttaacatgtaatcactgggctggg

SEQ ID NO: 219226 - DNA, 25 bp, Homo sapien
ttaacatgtaatcactgggctgggt

SEQ ID NO: 219227 - DNA, 25 bp, Homo sapien
taacatgtaatcactgggctgggtg

SEQ ID NO: 219228 - DNA, 25 bp, Homo sapien
aacatgtaatcactgggctgggtgc

SEQ ID NO: 219229 - DNA, 25 bp, Homo sapien
acatgtaatcactgggctgggtgca

SEQ ID NO: 219230 - DNA, 25 bp, Homo sapien
aggagccttgcactgggacttatat

SEQ ID NO: 219231 - DNA, 25 bp, Homo sapien
gccttgcactgggacttatatttaa

SEQ ID NO: 219232 - DNA, 25 bp, Homo sapien
taggatgaaaagttcttccactatt

SEQ ID NO: 219233 - DNA, 25 bp, Homo sapien
cttccactattaacggcctccagag

SEQ ID NO: 219234 - DNA, 25 bp, Homo sapien
ggcctccagagaaggaaatcctcca

SEQ ID NO: 219235 - DNA, 25 bp, Homo sapien
ctccagccttccttggaagaataat

SEQ ID NO: 219236 - DNA, 25 bp, Homo sapien
agaataatgtttgctgtctctaagg

SEQ ID NO: 219237 - DNA, 25 bp, Homo sapien
cagattaacatgctccagtccagtg

SEQ ID NO: 219238 - DNA, 25 bp, Homo sapien
gagctatgagaagcaatgccaccca

SEQ ID NO: 219239 - DNA, 25 bp, Homo sapien
gagaagcaatgccacccaaaactgg

SEQ ID NO: 219240 - DNA, 25 bp, Homo sapien
acccaaaactggctggttgctctct

SEQ ID NO: 219241 - DNA, 25 bp, Homo sapien
ctgctggagagagggccgctggtga

SEQ ID NO: 219242 - DNA, 25 bp, Homo sapien
ggccgctggtgaccgcccggtggaa

SEQ ID NO: 219243 - DNA, 25 bp, Homo sapien
gtgaccgcccggtggaagaagtggg

SEQ ID NO: 219244 - DNA, 25 bp, Homo sapien
tccagccgcggctaaaggagcagga

SEQ ID NO: 219245 - DNA, 25 bp, Homo sapien
tgccagcgcctggtggccttgctga

SEQ ID NO: 219246 - DNA, 25 bp, Homo sapien
tttttggagaaaacagctggtccag

SEQ ID NO: 219247 - DNA, 25 bp, Homo sapien
ttctgtcatgcttgttaacaacagc

SEQ ID NO: 219248 - DNA, 25 bp, Homo sapien
gtcatgcttgttaacaacagccttc

SEQ ID NO: 219249 - DNA, 25 bp, Homo sapien
catgcttgttaacaacagccttcat

SEQ ID NO: 219250 - DNA, 25 bp, Homo sapien
ttcatttatctctggacacgattat

SEQ ID NO: 219251 - DNA, 25 bp, Homo sapien
ttatctctggacacgattattatga

SEQ ID NO: 219252 - DNA, 25 bp, Homo sapien
aaaggcgggctatacgccgagctca

SEQ ID NO: 219253 - DNA, 25 bp, Homo sapien
gggctatacgccgagctcatccgga

SEQ ID NO: 219254 - DNA, 25 bp, Homo sapien
atacgccgagctcatccggaggcag

SEQ ID NO: 219255 - DNA, 25 bp, Homo sapien
ccaggagccaccagcacaagtcctg

SEQ ID NO: 219256 - DNA, 25 bp, Homo sapien
aagtcctgagaagggccccctgagg

SEQ ID NO: 219257 - DNA, 25 bp, Homo sapien
cctgaggtgtggtcgctgccaagca

SEQ ID NO: 219258 - DNA, 25 bp, Homo sapien
gtcgctgccaagcatcagtgttagg

SEQ ID NO: 219259 - DNA, 25 bp, Homo sapien
tgccaagcatcagtgttagggctgg

SEQ ID NO: 219260 - DNA, 25 bp, Homo sapien
catgtggagagtcgctgcggctgct

SEQ ID NO: 219261 - DNA, 25 bp, Homo sapien
ggctgctcctgctcacaataaagcc

SEQ ID NO: 219262 - DNA, 25 bp, Homo sapien
tgctcctgctcacaataaagccggg

SEQ ID NO: 219263 - DNA, 25 bp, Homo sapien
ctatgctgggaatctgtcaagcaaa

SEQ ID NO: 219264 - DNA, 25 bp, Homo sapien
aaagatgcccagaaagagaacttgc

SEQ ID NO: 219265 - DNA, 25 bp, Homo sapien
gagaacttgcagctcaatccacaaa

SEQ ID NO: 219266 - DNA, 25 bp, Homo sapien
gcagctcaatccacaaatcaagata

SEQ ID NO: 219267 - DNA, 25 bp, Homo sapien
aatttatatactgcacaaactggtg

SEQ ID NO: 219268 - DNA, 25 bp, Homo sapien
gcacaaactggtgatcaacccctaa

SEQ ID NO: 219269 - DNA, 25 bp, Homo sapien
tgatcaacccctaacttaaacactt

SEQ ID NO: 219270 - DNA, 25 bp, Homo sapien
ttttcttctctgtgttacctgtgaa

SEQ ID NO: 219271 - DNA, 25 bp, Homo sapien
atttatcacacatggacacttggga

SEQ ID NO: 219272 - DNA, 25 bp, Homo sapien
ttacatggaggcatttgactttttc

SEQ ID NO: 219273 - DNA, 25 bp, Homo sapien
gactttttcaagaggcttgactcgt

SEQ ID NO: 219274 - DNA, 25 bp, Homo sapien
aagcaccttgaaaaagacttggcag

SEQ ID NO: 219275 - DNA, 25 bp, Homo sapien
aaaaagacttggcagcttcctgata

SEQ ID NO: 219276 - DNA, 25 bp, Homo sapien
agcttcctgataaagcgtgctgtgc

SEQ ID NO: 219277 - DNA, 25 bp, Homo sapien
gataaagcgtgctgtgctgtgcagt

SEQ ID NO: 219278 - DNA, 25 bp, Homo sapien
ctgtgctgtgcagtaggaacacatc

SEQ ID NO: 219279 - DNA, 25 bp, Homo sapien
aaactctgttccatacacttgtata

SEQ ID NO: 219280 - DNA, 25 bp, Homo sapien
cagaagtatgtctcttaaccagttc

SEQ ID NO: 219281 - DNA, 25 bp, Homo sapien
taaccagttcacttattgtactctg

SEQ ID NO: 219282 - DNA, 25 bp, Homo sapien
gttcacttattgtactctggcaatt

SEQ ID NO: 219283 - DNA, 25 bp, Homo sapien
aaatgcttaatatcgtgcctaggtt

SEQ ID NO: 219284 - DNA, 25 bp, Homo sapien
cgtgcctaggttatgtggtgactat

SEQ ID NO: 219285 - DNA, 25 bp, Homo sapien
gtccaagtacagttggcattttcca

SEQ ID NO: 219286 - DNA, 25 bp, Homo sapien
agaataattttaccaccctgctaga

SEQ ID NO: 219287 - DNA, 25 bp, Homo sapien
attttaccaccctgctagatgtcat

SEQ ID NO: 219288 - DNA, 25 bp, Homo sapien
ctagatgtcatctctggattgcaca

SEQ ID NO: 219289 - DNA, 25 bp, Homo sapien
tctggattgcacatggatgatgaag

SEQ ID NO: 219290 - DNA, 25 bp, Homo sapien
gatgatgaaggaactcagcattgaa

SEQ ID NO: 219291 - DNA, 25 bp, Homo sapien
aatggctattggtaagatactgtat

SEQ ID NO: 219292 - DNA, 25 bp, Homo sapien
ttttagtatctcatccagtgcttag

SEQ ID NO: 219293 - DNA, 25 bp, Homo sapien
gtatctcatccagtgcttagaagaa

SEQ ID NO: 219294 - DNA, 25 bp, Homo sapien
aatggtttataattcccagtacatg

SEQ ID NO: 219295 - DNA, 25 bp, Homo sapien
attcccagtacatgtttatattgac

SEQ ID NO: 219296 - DNA, 25 bp, Homo sapien
aaaaaagcctacattctccagttga

SEQ ID NO: 219297 - DNA, 25 bp, Homo sapien
aaaaagcctacattctccagttgat

SEQ ID NO: 219298 - DNA, 25 bp, Homo sapien
gttgattatttccaactaatgtgta

SEQ ID NO: 219299 - DNA, 25 bp, Homo sapien
tgtgtattatgtgcctaattttcta

SEQ ID NO: 219300 - DNA, 25 bp, Homo sapien
tatgtgcctaattttctatcagaag

SEQ ID NO: 219301 - DNA, 25 bp, Homo sapien
tgtgcctaattttctatcagaagtt

SEQ ID NO: 219302 - DNA, 25 bp, Homo sapien
tcagaagttgtattaagcccgtttt

SEQ ID NO: 219303 - DNA, 25 bp, Homo sapien
tgtattaagcccgttttcacactgc

SEQ ID NO: 219304 - DNA, 25 bp, Homo sapien
aataggttcaatggacccacaggtc

SEQ ID NO: 219305 - DNA, 25 bp, Homo sapien
aggttcaatggacccacaggtccgc

SEQ ID NO: 219306 - DNA, 25 bp, Homo sapien
atggacccacaggtccgcgtggctg

SEQ ID NO: 219307 - DNA, 25 bp, Homo sapien
gctatctacgaccacatcaacgagg

SEQ ID NO: 219308 - DNA, 25 bp, Homo sapien
tggaaacacatcaagcacaagtatg

SEQ ID NO: 219309 - DNA, 25 bp, Homo sapien
gagaacaagtagttccttggaggcc

SEQ ID NO: 219310 - DNA, 25 bp, Homo sapien
atccaggccagaaggaccaggtcca

SEQ ID NO: 219311 - DNA, 25 bp, Homo sapien
gatgatgctcaaggtactcttcatg

SEQ ID NO: 219312 - DNA, 25 bp, Homo sapien
aaggtactcttcatggaccaccatt

SEQ ID NO: 219313 - DNA, 25 bp, Homo sapien
gaccaccattcgctgttggcaagaa

SEQ ID NO: 219314 - DNA, 25 bp, Homo sapien
ggctttacttacaaaacagactctt

SEQ ID NO: 219315 - DNA, 25 bp, Homo sapien
agactctttaccttctgctgtgttt

SEQ ID NO: 219316 - DNA, 25 bp, Homo sapien
taccttctgctgtgtttgaagtatg

SEQ ID NO: 219317 - DNA, 25 bp, Homo sapien
agtatgtttagtcagcatgctcagg

SEQ ID NO: 219318 - DNA, 25 bp, Homo sapien
agataaacgcaagggaagagagcct

SEQ ID NO: 219319 - DNA, 25 bp, Homo sapien
agagccttgtggaagagctgtcccc

SEQ ID NO: 219320 - DNA, 25 bp, Homo sapien
gccttgtggaagagctgtcccctgc

SEQ ID NO: 219321 - DNA, 25 bp, Homo sapien
gagaagaagcccgtgccgccgtctg

SEQ ID NO: 219322 - DNA, 25 bp, Homo sapien
gccgccgtctgagggcaagtctaga

SEQ ID NO: 219323 - DNA, 25 bp, Homo sapien
ctgagggcaagtctagactgtcccc

SEQ ID NO: 219324 - DNA, 25 bp, Homo sapien
cccgccggtgagatgaagcccatgc

SEQ ID NO: 219325 - DNA, 25 bp, Homo sapien
agatgaagcccatgccgctgtctga

SEQ ID NO: 219326 - DNA, 25 bp, Homo sapien
gccgctgtctgagggcaagtctata

SEQ ID NO: 219327 - DNA, 25 bp, Homo sapien
gagggcaagtctatactgctgtttg

SEQ ID NO: 219328 - DNA, 25 bp, Homo sapien
tgctgctgttgccatcctggcagtg

SEQ ID NO: 219329 - DNA, 25 bp, Homo sapien
gttccaggaggactataagtctaat

SEQ ID NO: 219330 - DNA, 25 bp, Homo sapien
taagtctaatttgtactccaaacca

SEQ ID NO: 219331 - DNA, 25 bp, Homo sapien
cagtgcagttcgctactactgaggc

SEQ ID NO: 219332 - DNA, 25 bp, Homo sapien
ttacttgaatacatagatgatcctt

SEQ ID NO: 219333 - DNA, 25 bp, Homo sapien
ccttcagagattttacctataacct

SEQ ID NO: 219334 - DNA, 25 bp, Homo sapien
gattttacctataacctatttcttg

SEQ ID NO: 219335 - DNA, 25 bp, Homo sapien
ttacctataacctatttcttgatga

SEQ ID NO: 219336 - DNA, 25 bp, Homo sapien
tatttaatgcactggagataactgt

SEQ ID NO: 219337 - DNA, 25 bp, Homo sapien
tggagataactgtgacttactgatc

SEQ ID NO: 219338 - DNA, 25 bp, Homo sapien
gtgacttactgatcaaatacttgaa

SEQ ID NO: 219339 - DNA, 25 bp, Homo sapien
caaatacttgaatacttatacttac

SEQ ID NO: 219340 - DNA, 25 bp, Homo sapien
tcccacctcccccaaccccatgaca

SEQ ID NO: 219341 - DNA, 25 bp, Homo sapien
cccacctcccccaaccccatgacag

SEQ ID NO: 219342 - DNA, 25 bp, Homo sapien
ccacctcccccaaccccatgacagg

SEQ ID NO: 219343 - DNA, 25 bp, Homo sapien
cacctcccccaaccccatgacaggc

SEQ ID NO: 219344 - DNA, 25 bp, Homo sapien
tcccccaaccccatgacaggccccg

SEQ ID NO: 219345 - DNA, 25 bp, Homo sapien
tttctgtctttgcgatagtttgctc

SEQ ID NO: 219346 - DNA, 25 bp, Homo sapien
ttctgtctttgcgatagtttgctca

SEQ ID NO: 219347 - DNA, 25 bp, Homo sapien
tctgtctttgcgatagtttgctcag

SEQ ID NO: 219348 - DNA, 25 bp, Homo sapien
ctgtctttgcgatagtttgctcaga

SEQ ID NO: 219349 - DNA, 25 bp, Homo sapien
ttctcccatggaacgaggatgcaaa

SEQ ID NO: 219350 - DNA, 25 bp, Homo sapien
gctgtcgaaatcaatctttctgcaa

SEQ ID NO: 219351 - DNA, 25 bp, Homo sapien
ataagatctagaagcctgggccctt

SEQ ID NO: 219352 - DNA, 25 bp, Homo sapien
tgggcccttgcttgttttgactcag

SEQ ID NO: 219353 - DNA, 25 bp, Homo sapien
gcttgttttgactcaggcagtaaaa

SEQ ID NO: 219354 - DNA, 25 bp, Homo sapien
gtaaaaagcctccatcactctattt

SEQ ID NO: 219355 - DNA, 25 bp, Homo sapien
catcactctatttggctcattttat

SEQ ID NO: 219356 - DNA, 25 bp, Homo sapien
ttatatttagttccttccccagtca

SEQ ID NO: 219357 - DNA, 25 bp, Homo sapien
atgctcaaacatcctatctttcttc

SEQ ID NO: 219358 - DNA, 25 bp, Homo sapien
aacatcctatctttcttcttctatt

SEQ ID NO: 219359 - DNA, 25 bp, Homo sapien
tcttcttctattcatgcttttatcc

SEQ ID NO: 219360 - DNA, 25 bp, Homo sapien
cggcccatgtctgtctgtcttgatg

SEQ ID NO: 219361 - DNA, 25 bp, Homo sapien
gcccatgtctgtctgtcttgatgtg

SEQ ID NO: 219362 - DNA, 25 bp, Homo sapien
ccatgtctgtctgtcttgatgtgtg

SEQ ID NO: 219363 - DNA, 25 bp, Homo sapien
atgtctgtctgtcttgatgtgtgag

SEQ ID NO: 219364 - DNA, 25 bp, Homo sapien
tctgtcttgatgtgtgagcagcagc

SEQ ID NO: 219365 - DNA, 25 bp, Homo sapien
ctgtcttgatgtgtgagcagcagct

SEQ ID NO: 219366 - DNA, 25 bp, Homo sapien
agctgtggtcattaaaccattagtt

SEQ ID NO: 219367 - DNA, 25 bp, Homo sapien
tgtggtcattaaaccattagtttac

SEQ ID NO: 219368 - DNA, 25 bp, Homo sapien
tattctgtgacaatgacaggtgaaa

SEQ ID NO: 219369 - DNA, 25 bp, Homo sapien
tgtgacaatgacaggtgaaatttat

SEQ ID NO: 219370 - DNA, 25 bp, Homo sapien
caggtgaaatttatatgtgacaagt

SEQ ID NO: 219371 - DNA, 25 bp, Homo sapien
gaagcagcagccaactaagtgggaa

SEQ ID NO: 219372 - DNA, 25 bp, Homo sapien
atagtggaacatcaggacctagtgg

SEQ ID NO: 219373 - DNA, 25 bp, Homo sapien
gacctagtggaagtactaccagcaa

SEQ ID NO: 219374 - DNA, 25 bp, Homo sapien
aaaactacttcagaatccagcagct

SEQ ID NO: 219375 - DNA, 25 bp, Homo sapien
tcagcatcccttaaaggcccaactt

SEQ ID NO: 219376 - DNA, 25 bp, Homo sapien
aaggcccaacttcacaagatcacag

SEQ ID NO: 219377 - DNA, 25 bp, Homo sapien
aagatcacagctcaatgctatgaag

SEQ ID NO: 219378 - DNA, 25 bp, Homo sapien
tgctatgaagcgattacagatggtc

SEQ ID NO: 219379 - DNA, 25 bp, Homo sapien
gaaagctgcccaaaagaaactcaag

SEQ ID NO: 219380 - DNA, 25 bp, Homo sapien
atgtggccaagtaggtttttgtatc

SEQ ID NO: 219381 - DNA, 25 bp, Homo sapien
ggtttttgtatcatattagcctaaa

SEQ ID NO: 219382 - DNA, 25 bp, Homo sapien
agcccgcggagatcatcactcagag

SEQ ID NO: 219383 - DNA, 25 bp, Homo sapien
ggagatcatcactcagagcaagctg

SEQ ID NO: 219384 - DNA, 25 bp, Homo sapien
tcactcagagcaagctggtcatcat

SEQ ID NO: 219385 - DNA, 25 bp, Homo sapien
gaagctggtggacacgctgtgcatg

SEQ ID NO: 219386 - DNA, 25 bp, Homo sapien
agacccaggagagggacgtgcgcaa

SEQ ID NO: 219387 - DNA, 25 bp, Homo sapien
ctctgcagcctgctcaaggacgtag

SEQ ID NO: 219388 - DNA, 25 bp, Homo sapien
aaggacgtagcgctggccactaaga

SEQ ID NO: 219389 - DNA, 25 bp, Homo sapien
tggccactaagaatgccgtgctcac

SEQ ID NO: 219390 - DNA, 25 bp, Homo sapien
gaagctggagcaacacacgcggcag

SEQ ID NO: 219391 - DNA, 25 bp, Homo sapien
tggagcaacacacgcggcagttcag

SEQ ID NO: 219392 - DNA, 25 bp, Homo sapien
acacgcggcagttcagagggacact

SEQ ID NO: 219393 - DNA, 25 bp, Homo sapien
cccttggtcttccatgggatggtta

SEQ ID NO: 219394 - DNA, 25 bp, Homo sapien
gagatatagattgtccggccgcttt

SEQ ID NO: 219395 - DNA, 25 bp, Homo sapien
cggccgctttgtgattccatggatt

SEQ ID NO: 219396 - DNA, 25 bp, Homo sapien
gattccatggattgattcagtcttc

SEQ ID NO: 219397 - DNA, 25 bp, Homo sapien
ttatattttgggtactggagctttt

SEQ ID NO: 219398 - DNA, 25 bp, Homo sapien
ggtttcaggtatttttattcatgtg

SEQ ID NO: 219399 - DNA, 25 bp, Homo sapien
aagtgtatatgattctcttgagata

SEQ ID NO: 219400 - DNA, 25 bp, Homo sapien
taagctaaaatgttactccctgttt

SEQ ID NO: 219401 - DNA, 25 bp, Homo sapien
atgttactccctgttttagtttctg

SEQ ID NO: 219402 - DNA, 25 bp, Homo sapien
gaactctgacagattgacagggact

SEQ ID NO: 219403 - DNA, 25 bp, Homo sapien
cagggactttgctggtgtagtcttt

SEQ ID NO: 219404 - DNA, 25 bp, Homo sapien
aaatggatcctttttgacgatcact

SEQ ID NO: 219405 - DNA, 25 bp, Homo sapien
tgacgatcacttatatcactctgta

SEQ ID NO: 219406 - DNA, 25 bp, Homo sapien
tcactctgtatatgactaagtaaac

SEQ ID NO: 219407 - DNA, 25 bp, Homo sapien
ggaattactcatatacagggtggaa

SEQ ID NO: 219408 - DNA, 25 bp, Homo sapien
gggtggaattttatcctgttatcac

SEQ ID NO: 219409 - DNA, 25 bp, Homo sapien
gaattttatcctgttatcacaccaa

SEQ ID NO: 219410 - DNA, 25 bp, Homo sapien
tgttatcacaccaacagttgattat

SEQ ID NO: 219411 - DNA, 25 bp, Homo sapien
gaatatcagcccctaataggacaat

SEQ ID NO: 219412 - DNA, 25 bp, Homo sapien
cagcccctaataggacaattctatt

SEQ ID NO: 219413 - DNA, 25 bp, Homo sapien
tctatttgttgaccatttctacaat

SEQ ID NO: 219414 - DNA, 25 bp, Homo sapien
gtaaaagtccaatctgtgctaactt

SEQ ID NO: 219415 - DNA, 25 bp, Homo sapien
aggcctggagcctgtagggctggac

SEQ ID NO: 219416 - DNA, 25 bp, Homo sapien
cctggagcctgtagggctggactga

SEQ ID NO: 219417 - DNA, 25 bp, Homo sapien
agcctgtagggctggactgaggttc

SEQ ID NO: 219418 - DNA, 25 bp, Homo sapien
ggctggactgaggttcaggtctccc

SEQ ID NO: 219419 - DNA, 25 bp, Homo sapien
gctggactgaggttcaggtctcccc

SEQ ID NO: 219420 - DNA, 25 bp, Homo sapien
ggactgaggttcaggtctcccccca

SEQ ID NO: 219421 - DNA, 25 bp, Homo sapien
cactttgtccccactctagagcagg

SEQ ID NO: 219422 - DNA, 25 bp, Homo sapien
actttgtccccactctagagcaggg

SEQ ID NO: 219423 - DNA, 25 bp, Homo sapien
ctttgtccccactctagagcaggga

SEQ ID NO: 219424 - DNA, 25 bp, Homo sapien
tttgtccccactctagagcagggag

SEQ ID NO: 219425 - DNA, 25 bp, Homo sapien
ttgtccccactctagagcagggagg

SEQ ID NO: 219426 - DNA, 25 bp, Homo sapien
cacgtgcgacctggaggactggtca

SEQ ID NO: 219427 - DNA, 25 bp, Homo sapien
ggactggtcagaaccgttactgtga

SEQ ID NO: 219428 - DNA, 25 bp, Homo sapien
tgaatgagtgaagatcctggaggac

SEQ ID NO: 219429 - DNA, 25 bp, Homo sapien
gaacggccatgtgttaatgttacga

SEQ ID NO: 219430 - DNA, 25 bp, Homo sapien
gggaaaaacatccaagcactttaat

SEQ ID NO: 219431 - DNA, 25 bp, Homo sapien
aagcactttaattccaatgtaccag

SEQ ID NO: 219432 - DNA, 25 bp, Homo sapien
gtaccaggtgaactgacggagctca

SEQ ID NO: 219433 - DNA, 25 bp, Homo sapien
gacggagctcagaagttttccttta

SEQ ID NO: 219434 - DNA, 25 bp, Homo sapien
gttttcctttacaccaactgtcaat

SEQ ID NO: 219435 - DNA, 25 bp, Homo sapien
tacaccaactgtcaatgccggaatt

SEQ ID NO: 219436 - DNA, 25 bp, Homo sapien
gtcaatgccggaattttgtattctg

SEQ ID NO: 219437 - DNA, 25 bp, Homo sapien
aagatgtatcaattagcatatagaa

SEQ ID NO: 219438 - DNA, 25 bp, Homo sapien
aaatacctgtgtactgagggttatg

SEQ ID NO: 219439 - DNA, 25 bp, Homo sapien
acctgtgtactgagggttatgattt

SEQ ID NO: 219440 - DNA, 25 bp, Homo sapien
aattgacataagtgcttttacaagc

SEQ ID NO: 219441 - DNA, 25 bp, Homo sapien
agtgcttttacaagcaccaaagttg

SEQ ID NO: 219442 - DNA, 25 bp, Homo sapien
attaaagtctatgttttcagttatg

SEQ ID NO: 219443 - DNA, 25 bp, Homo sapien
gttttcagttatgactcaggttaag

SEQ ID NO: 219444 - DNA, 25 bp, Homo sapien
ttaggatctacttgctggtttttct

SEQ ID NO: 219445 - DNA, 25 bp, Homo sapien
gatccaaatgtgtgatctgccctga

SEQ ID NO: 219446 - DNA, 25 bp, Homo sapien
atctgccctgataaataacaagtta

SEQ ID NO: 219447 - DNA, 25 bp, Homo sapien
taacaagttatagtaccatctcccc

SEQ ID NO: 219448 - DNA, 25 bp, Homo sapien
atggcgtctttctctccaactcatt

SEQ ID NO: 219449 - DNA, 25 bp, Homo sapien
ctcagccaaagccaacagtactgct

SEQ ID NO: 219450 - DNA, 25 bp, Homo sapien
aaagccaacagtactgctcacaaaa

SEQ ID NO: 219451 - DNA, 25 bp, Homo sapien
agtactgctcacaaaaaaggccagc

SEQ ID NO: 219452 - DNA, 25 bp, Homo sapien
tgctcacaaaaaaggccagcccctg

SEQ ID NO: 219453 - DNA, 25 bp, Homo sapien
ttggagcccatgacgcctgtcggga

SEQ ID NO: 219454 - DNA, 25 bp, Homo sapien
ccatgacgcctgtcgggatgcaaaa

SEQ ID NO: 219455 - DNA, 25 bp, Homo sapien
tcgggatgcaaaagagaagcgctct

SEQ ID NO: 219456 - DNA, 25 bp, Homo sapien
gaagcgctctaaaagccaagatgca

SEQ ID NO: 219457 - DNA, 25 bp, Homo sapien
aagccaagatgcagattcacctgga

SEQ ID NO: 219458 - DNA, 25 bp, Homo sapien
tgcagattcacctggaagttctggg

SEQ ID NO: 219459 - DNA, 25 bp, Homo sapien
ggtttgcggcaggacctcaggcaaa

SEQ ID NO: 219460 - DNA, 25 bp, Homo sapien
tcaggcaaagccaggaagcaagcaa

SEQ ID NO: 219461 - DNA, 25 bp, Homo sapien
aggaagcaagcaaccacagctccca

SEQ ID NO: 219462 - DNA, 25 bp, Homo sapien
cacacagctcaaacaccagggattt

SEQ ID NO: 219463 - DNA, 25 bp, Homo sapien
tttaactggatctgaagagtctgca

SEQ ID NO: 219464 - DNA, 25 bp, Homo sapien
gaagagtctgcagcccttaatcagt

SEQ ID NO: 219465 - DNA, 25 bp, Homo sapien
tgcagcccttaatcagtacccatga

SEQ ID NO: 219466 - DNA, 25 bp, Homo sapien
gtacccatgatcacaggcctttgga

SEQ ID NO: 219467 - DNA, 25 bp, Homo sapien
atgatcacaggcctttggagcactt

SEQ ID NO: 219468 - DNA, 25 bp, Homo sapien
gcacttttactctctgagaagaact

SEQ ID NO: 219469 - DNA, 25 bp, Homo sapien
gaagaactggagctagagatgtaaa

SEQ ID NO: 219470 - DNA, 25 bp, Homo sapien
tttaacttgcctagatccctgtatt

SEQ ID NO: 219471 - DNA, 25 bp, Homo sapien
ttgcctagatccctgtattccaaaa

SEQ ID NO: 219472 - DNA, 25 bp, Homo sapien
tagatccctgtattccaaaacctgc

SEQ ID NO: 219473 - DNA, 25 bp, Homo sapien
gtattccaaaacctgctgcatcata

SEQ ID NO: 219474 - DNA, 25 bp, Homo sapien
gcataagacgtgatatttttaattt

SEQ ID NO: 219475 - DNA, 25 bp, Homo sapien
aaaaattatatttgtctcttagagt

SEQ ID NO: 219476 - DNA, 25 bp, Homo sapien
gtcatagttttaatacaattcacat

SEQ ID NO: 219477 - DNA, 25 bp, Homo sapien
catgatttctatgtttcttaatgat

SEQ ID NO: 219478 - DNA, 25 bp, Homo sapien
ggaatttgtgcgttcatgctttttc

SEQ ID NO: 219479 - DNA, 25 bp, Homo sapien
gtgcgttcatgctttttcgtattct

SEQ ID NO: 219480 - DNA, 25 bp, Homo sapien
gttcatgctttttcgtattctttat

SEQ ID NO: 219481 - DNA, 25 bp, Homo sapien
taaaacatgtttctataggtgagtg

SEQ ID NO: 219482 - DNA, 25 bp, Homo sapien
ctataggtgagtgttggaccttcac

SEQ ID NO: 219483 - DNA, 25 bp, Homo sapien
tgagtgttggaccttcacacctccc

SEQ ID NO: 219484 - DNA, 25 bp, Homo sapien
cttccctgtacatttgtctttggtg

SEQ ID NO: 219485 - DNA, 25 bp, Homo sapien
ctgtacatttgtctttggtgctgga

SEQ ID NO: 219486 - DNA, 25 bp, Homo sapien
atttgtctttggtgctggacgtggc

SEQ ID NO: 219487 - DNA, 25 bp, Homo sapien
atgtgaggccaggttgaggcccttt

SEQ ID NO: 219488 - DNA, 25 bp, Homo sapien
aggccaggttgaggccctttgtaga

SEQ ID NO: 219489 - DNA, 25 bp, Homo sapien
ggttgaggccctttgtagacaacat

SEQ ID NO: 219490 - DNA, 25 bp, Homo sapien
gaggccctttgtagacaacatacag

SEQ ID NO: 219491 - DNA, 25 bp, Homo sapien
tgtagacaacatacagttgctcagc

SEQ ID NO: 219492 - DNA, 25 bp, Homo sapien
ctgctggagagagggccgctggtga

SEQ ID NO: 219493 - DNA, 25 bp, Homo sapien
ggccgctggtgaccgcccggtggaa

SEQ ID NO: 219494 - DNA, 25 bp, Homo sapien
tccagccgcggctaaaggagcagga

SEQ ID NO: 219495 - DNA, 25 bp, Homo sapien
tgccagcgcctggtggccttgctga

SEQ ID NO: 219496 - DNA, 25 bp, Homo sapien
gccttgctgagctcgcggctcatgg

SEQ ID NO: 219497 - DNA, 25 bp, Homo sapien
tgggatggcttttgtcacttcttca

SEQ ID NO: 219498 - DNA, 25 bp, Homo sapien
tttttggagaaaacagctggtccag

SEQ ID NO: 219499 - DNA, 25 bp, Homo sapien
gtcatgcttgttaacaacagccttc

SEQ ID NO: 219500 - DNA, 25 bp, Homo sapien
gttaacaacagccttcatttatctc

SEQ ID NO: 219501 - DNA, 25 bp, Homo sapien
ttcatttatctctggacacgattat

SEQ ID NO: 219502 - DNA, 25 bp, Homo sapien
ttatctctggacacgattattatga

SEQ ID NO: 219503 - DNA, 25 bp, Homo sapien
atggccaggagctaaattataagga

SEQ ID NO: 219504 - DNA, 25 bp, Homo sapien
gtttctcagaaaaagcatcttccgt

SEQ ID NO: 219505 - DNA, 25 bp, Homo sapien
gcatcttccgtccaaagaaacagtg

SEQ ID NO: 219506 - DNA, 25 bp, Homo sapien
ggaggtcatcttgggcaaaggaaac

SEQ ID NO: 219507 - DNA, 25 bp, Homo sapien
ggaaacggcagctataaatatttgt

SEQ ID NO: 219508 - DNA, 25 bp, Homo sapien
gaattaacagatatgcttccctgca

SEQ ID NO: 219509 - DNA, 25 bp, Homo sapien
atgcttccctgcacaatgaattacc

SEQ ID NO: 219510 - DNA, 25 bp, Homo sapien
atgaattaccctttttgtctccagt

SEQ ID NO: 219511 - DNA, 25 bp, Homo sapien
ttttgtctccagtaagcacccagat

SEQ ID NO: 219512 - DNA, 25 bp, Homo sapien
gcacccagatcttaatgtcagcttt

SEQ ID NO: 219513 - DNA, 25 bp, Homo sapien
aatgtcagcttttgcaagttttgaa

SEQ ID NO: 219514 - DNA, 25 bp, Homo sapien
ttggagcccatgacgcctgtcggga

SEQ ID NO: 219515 - DNA, 25 bp, Homo sapien
agcccatgacgcctgtcgggatgca

SEQ ID NO: 219516 - DNA, 25 bp, Homo sapien
gcccatgacgcctgtcgggatgcaa

SEQ ID NO: 219517 - DNA, 25 bp, Homo sapien
ccatgacgcctgtcgggatgcaaaa

SEQ ID NO: 219518 - DNA, 25 bp, Homo sapien
gacgcctgtcgggatgcaaaagaga

SEQ ID NO: 219519 - DNA, 25 bp, Homo sapien
acgcctgtcgggatgcaaaagagaa

SEQ ID NO: 219520 - DNA, 25 bp, Homo sapien
cgcctgtcgggatgcaaaagagaag

SEQ ID NO: 219521 - DNA, 25 bp, Homo sapien
tcgggatgcaaaagagaagcgctct

SEQ ID NO: 219522 - DNA, 25 bp, Homo sapien
agagaagcgctctaaaagccaagat

SEQ ID NO: 219523 - DNA, 25 bp, Homo sapien
gaagcgctctaaaagccaagatgca

SEQ ID NO: 219524 - DNA, 25 bp, Homo sapien
tgcagattcacctggaagttctggg

SEQ ID NO: 219525 - DNA, 25 bp, Homo sapien
ttccagcagcagcacgacgtggctt

SEQ ID NO: 219526 - DNA, 25 bp, Homo sapien
gcagcagcacgacgtggctttttga

SEQ ID NO: 219527 - DNA, 25 bp, Homo sapien
gctttttgaaaggagagcccggaga

SEQ ID NO: 219528 - DNA, 25 bp, Homo sapien
gagagcccggagagtggcggccagc

SEQ ID NO: 219529 - DNA, 25 bp, Homo sapien
tttttccagcaacgctccttttaat

SEQ ID NO: 219530 - DNA, 25 bp, Homo sapien
cctctggccagctacaaagtggaat

SEQ ID NO: 219531 - DNA, 25 bp, Homo sapien
acaaagtggaatgcttctcgaaggg

SEQ ID NO: 219532 - DNA, 25 bp, Homo sapien
gcaacgctccttttaatatccggat

SEQ ID NO: 219533 - DNA, 25 bp, Homo sapien
taatatccggatgtccagagccaca

SEQ ID NO: 219534 - DNA, 25 bp, Homo sapien
acagcctgtgtgttgagccccgggt

SEQ ID NO: 219535 - DNA, 25 bp, Homo sapien
ctgctggccggaggctgttggcttc

SEQ ID NO: 219536 - DNA, 25 bp, Homo sapien
atttcgttttgcttttggttgcctg

SEQ ID NO: 219537 - DNA, 25 bp, Homo sapien
tcgttttgcttttggttgcctgaat

SEQ ID NO: 219538 - DNA, 25 bp, Homo sapien
gcttttggttgcctgaatgttgtca

SEQ ID NO: 219539 - DNA, 25 bp, Homo sapien
tggttgcctgaatgttgtcaccaag

SEQ ID NO: 219540 - DNA, 25 bp, Homo sapien
gttttactgatgttaaacgttctca

SEQ ID NO: 219541 - DNA, 25 bp, Homo sapien
gatgttaaacgttctcagtgccaat

SEQ ID NO: 219542 - DNA, 25 bp, Homo sapien
aaacgttctcagtgccaatgtcaga

SEQ ID NO: 219543 - DNA, 25 bp, Homo sapien
agtgccaatgtcagactgtgctcct

SEQ ID NO: 219544 - DNA, 25 bp, Homo sapien
aatgtcagactgtgctcctccctct

SEQ ID NO: 219545 - DNA, 25 bp, Homo sapien
ctcaccctgagctgtcttgttgaaa

SEQ ID NO: 219546 - DNA, 25 bp, Homo sapien
accctgagctgtcttgttgaaaaca

SEQ ID NO: 219547 - DNA, 25 bp, Homo sapien
agcctcatctcaaggacactgcttg

SEQ ID NO: 219548 - DNA, 25 bp, Homo sapien
gacactgcttgctggataaatccct

SEQ ID NO: 219549 - DNA, 25 bp, Homo sapien
tgcttgctggataaatccctcacca

SEQ ID NO: 219550 - DNA, 25 bp, Homo sapien
gataaatccctcaccaccctagaga

SEQ ID NO: 219551 - DNA, 25 bp, Homo sapien
ggccaggcttgttgcacgtaagcgc

SEQ ID NO: 219552 - DNA, 25 bp, Homo sapien
aggcttgttgcacgtaagcgcctcc

SEQ ID NO: 219553 - DNA, 25 bp, Homo sapien
agcgcctcccgcagaaaccagtgag

SEQ ID NO: 219554 - DNA, 25 bp, Homo sapien
ccagaggaaatgatgtagggacaga

SEQ ID NO: 219555 - DNA, 25 bp, Homo sapien
agccccagagtcttccctagaatca

SEQ ID NO: 219556 - DNA, 25 bp, Homo sapien
gagtcttccctagaatcagacttta

SEQ ID NO: 219557 - DNA, 25 bp, Homo sapien
gaatcagactttaagcacaagcagg

SEQ ID NO: 219558 - DNA, 25 bp, Homo sapien
aatgccacggttcaccatcaattta

SEQ ID NO: 219559 - DNA, 25 bp, Homo sapien
aaaaggtttgctaatctgatagtta

SEQ ID NO: 219560 - DNA, 25 bp, Homo sapien
ctgatagttaatttgttcttaccaa

SEQ ID NO: 219561 - DNA, 25 bp, Homo sapien
attactttgtaaatagcagttcaca

SEQ ID NO: 219562 - DNA, 25 bp, Homo sapien
gttcacatttttccacagtataatg

SEQ ID NO: 219563 - DNA, 25 bp, Homo sapien
gggtgcattgcttattgaagtacat

SEQ ID NO: 219564 - DNA, 25 bp, Homo sapien
gaagtacatttttgtcggtttgtga

SEQ ID NO: 219565 - DNA, 25 bp, Homo sapien
taaacaattatccttgttactgctt

SEQ ID NO: 219566 - DNA, 25 bp, Homo sapien
ttactgctttgccagttctacgtta

SEQ ID NO: 219567 - DNA, 25 bp, Homo sapien
gctttgccagttctacgttatttac

SEQ ID NO: 219568 - DNA, 25 bp, Homo sapien
gccagttctacgttatttacaatta

SEQ ID NO: 219569 - DNA, 25 bp, Homo sapien
ggagattcgggaggccctctgtcct

SEQ ID NO: 219570 - DNA, 25 bp, Homo sapien
atgaggtctggcatctggtaggcat

SEQ ID NO: 219571 - DNA, 25 bp, Homo sapien
catctggtaggcatcacgagctggg

SEQ ID NO: 219572 - DNA, 25 bp, Homo sapien
agggagcggccaggtgtttacacca

SEQ ID NO: 219573 - DNA, 25 bp, Homo sapien
ggtgtttacaccaacgtggtcgagt

SEQ ID NO: 219574 - DNA, 25 bp, Homo sapien
accaacgtggtcgagtacgtggact

SEQ ID NO: 219575 - DNA, 25 bp, Homo sapien
gtacgtggactggattctggagaaa

SEQ ID NO: 219576 - DNA, 25 bp, Homo sapien
tcaagcagtgtgaatgggttcccag

SEQ ID NO: 219577 - DNA, 25 bp, Homo sapien
agagggtgttgagttcactgtgcca

SEQ ID NO: 219578 - DNA, 25 bp, Homo sapien
tgagttcactgtgccagcatgcttc

SEQ ID NO: 219579 - DNA, 25 bp, Homo sapien
ttcctccacagtaacacgctgaagg

SEQ ID NO: 219580 - DNA, 25 bp, Homo sapien
ggcattgttaacatgaaagtcaacc

SEQ ID NO: 219581 - DNA, 25 bp, Homo sapien
aaagtcaaccactggctttgtgaaa

SEQ ID NO: 219582 - DNA, 25 bp, Homo sapien
tgctatgtcactattcagaatatgc

SEQ ID NO: 219583 - DNA, 25 bp, Homo sapien
tgctgggtaaattaacttgcctagt

SEQ ID NO: 219584 - DNA, 25 bp, Homo sapien
gaacttctggttctataatcatatt

SEQ ID NO: 219585 - DNA, 25 bp, Homo sapien
tgaaagttctttgcatggattaatg

SEQ ID NO: 219586 - DNA, 25 bp, Homo sapien
tacccttgttgcactcgaaatctga

SEQ ID NO: 219587 - DNA, 25 bp, Homo sapien
aatctgaggtgtatctagccctgcc

SEQ ID NO: 219588 - DNA, 25 bp, Homo sapien
tagccctgccactattggctactta

SEQ ID NO: 219589 - DNA, 25 bp, Homo sapien
actattggctacttaccctcattaa

SEQ ID NO: 219590 - DNA, 25 bp, Homo sapien
ttaccctcattaatatcccacttga

SEQ ID NO: 219591 - DNA, 25 bp, Homo sapien
tggcccacacagaaaggtggcaaga

SEQ ID NO: 219592 - DNA, 25 bp, Homo sapien
gcagggctgcccagaagtctcagag

SEQ ID NO: 219593 - DNA, 25 bp, Homo sapien
aagtctcagaggcacctcacgccag

SEQ ID NO: 219594 - DNA, 25 bp, Homo sapien
ccagccatcgcggagagctcagagg

SEQ ID NO: 219595 - DNA, 25 bp, Homo sapien
cggagagctcagagggccgtcccca

SEQ ID NO: 219596 - DNA, 25 bp, Homo sapien
attcacttccttggccagagtcagg

SEQ ID NO: 219597 - DNA, 25 bp, Homo sapien
gggagggagctccacactgtaacca

SEQ ID NO: 219598 - DNA, 25 bp, Homo sapien
acactgtaaccactgggtctgggct

SEQ ID NO: 219599 - DNA, 25 bp, Homo sapien
gtaaccactgggtctgggctccatc

SEQ ID NO: 219600 - DNA, 25 bp, Homo sapien
aagacatccacccagacctcattat

SEQ ID NO: 219601 - DNA, 25 bp, Homo sapien
gacctcattatttcttgctctatca

SEQ ID NO: 219602 - DNA, 25 bp, Homo sapien
aataagataatgcaccgtctccacc

SEQ ID NO: 219603 - DNA, 25 bp, Homo sapien
ataagataatgcaccgtctccaccc

SEQ ID NO: 219604 - DNA, 25 bp, Homo sapien
gtctccacccctctcatatttactt

SEQ ID NO: 219605 - DNA, 25 bp, Homo sapien
aaggaaatgttaggtcttctcaagg

SEQ ID NO: 219606 - DNA, 25 bp, Homo sapien
aatgttaggtcttctcaaggtaaag

SEQ ID NO: 219607 - DNA, 25 bp, Homo sapien
ggtcttctcaaggtaaagttctata

SEQ ID NO: 219608 - DNA, 25 bp, Homo sapien
ttatagcgtttaggcatttcttgac

SEQ ID NO: 219609 - DNA, 25 bp, Homo sapien
ttcttgaccatctaatgagtgtaaa

SEQ ID NO: 219610 - DNA, 25 bp, Homo sapien
gtgtaaaactgtaccactgggccaa

SEQ ID NO: 219611 - DNA, 25 bp, Homo sapien
gtaaaactgtaccactgggccaagt

SEQ ID NO: 219612 - DNA, 25 bp, Homo sapien
aactgtaccactgggccaagtgcag

SEQ ID NO: 219613 - DNA, 25 bp, Homo sapien
tcctcctcaaggaaggccacaagga

SEQ ID NO: 219614 - DNA, 25 bp, Homo sapien
gtcctcctcgaggaaggccacaagg

SEQ ID NO: 219615 - DNA, 25 bp, Homo sapien
tcctcctcgaggaaggccacaagga

SEQ ID NO: 219616 - DNA, 25 bp, Homo sapien
accccaacagggaggccatcagcaa

SEQ ID NO: 219617 - DNA, 25 bp, Homo sapien
caacagggaggccatcagcaaggtc

SEQ ID NO: 219618 - DNA, 25 bp, Homo sapien
aacagggaggccatcagcaaggtcc

SEQ ID NO: 219619 - DNA, 25 bp, Homo sapien
acagggaggccatcagcaaggtcct

SEQ ID NO: 219620 - DNA, 25 bp, Homo sapien
cagggaggccatcagcaaggtcctc

SEQ ID NO: 219621 - DNA, 25 bp, Homo sapien
agggaggccatcagcaaggtcctcc

SEQ ID NO: 219622 - DNA, 25 bp, Homo sapien
gggccgcccacaaggacctccacag

SEQ ID NO: 219623 - DNA, 25 bp, Homo sapien
acaaggacctccacaggggcagtct

SEQ ID NO: 219624 - DNA, 25 bp, Homo sapien
gagggtccataaacccgagtgtgcc

SEQ ID NO: 219625 - DNA, 25 bp, Homo sapien
ataaacccgagtgtgcctttgcttt

SEQ ID NO: 219626 - DNA, 25 bp, Homo sapien
gagtgtgcctttgctttccaccctt

SEQ ID NO: 219627 - DNA, 25 bp, Homo sapien
ttccacccttgctagacactggtag

SEQ ID NO: 219628 - DNA, 25 bp, Homo sapien
cccttgctagacactggtagatgca

SEQ ID NO: 219629 - DNA, 25 bp, Homo sapien
gacactggtagatgcaacaaactca

SEQ ID NO: 219630 - DNA, 25 bp, Homo sapien
gtagatgcaacaaactcagatttat

SEQ ID NO: 219631 - DNA, 25 bp, Homo sapien
gttgtaaaaatattgtgatgtcacc

SEQ ID NO: 219632 - DNA, 25 bp, Homo sapien
acatcccctaacatctgattcacga

SEQ ID NO: 219633 - DNA, 25 bp, Homo sapien
gattcacgacttaatgtatgttgta

SEQ ID NO: 219634 - DNA, 25 bp, Homo sapien
ataaaacctgactgttctatattaa

SEQ ID NO: 219635 - DNA, 25 bp, Homo sapien
tgctcaccatcctcgagatcctaga

SEQ ID NO: 219636 - DNA, 25 bp, Homo sapien
gagatcctagactacctctgtgagg

SEQ ID NO: 219637 - DNA, 25 bp, Homo sapien
acctctgtgaggtgttccgagacaa

SEQ ID NO: 219638 - DNA, 25 bp, Homo sapien
gtgttccgagacaaggtcctgggat

SEQ ID NO: 219639 - DNA, 25 bp, Homo sapien
ggtcctgggatatttctggaaccga

SEQ ID NO: 219640 - DNA, 25 bp, Homo sapien
atatttctggaaccgacagcactcc

SEQ ID NO: 219641 - DNA, 25 bp, Homo sapien
ggaaccgacagcactcccaaaggca

SEQ ID NO: 219642 - DNA, 25 bp, Homo sapien
tgctaccttgtcacacagctctaga

SEQ ID NO: 219643 - DNA, 25 bp, Homo sapien
agctctagacctgctgtctgtgtcc

SEQ ID NO: 219644 - DNA, 25 bp, Homo sapien
tgacatcctggacatgcctagcctg

SEQ ID NO: 219645 - DNA, 25 bp, Homo sapien
tagcctgcacgtagcttttccgtct

SEQ ID NO: 219646 - DNA, 25 bp, Homo sapien
agagctctttgtaaaccgcagtcac

SEQ ID NO: 219647 - DNA, 25 bp, Homo sapien
tgtaaaccgcagtcacacattaggg

SEQ ID NO: 219648 - DNA, 25 bp, Homo sapien
gcagtcacacattagggttagtatt

SEQ ID NO: 219649 - DNA, 25 bp, Homo sapien
gatgtaccataattaacttggctag

SEQ ID NO: 219650 - DNA, 25 bp, Homo sapien
ttggctagttgattgtttgaagtct

SEQ ID NO: 219651 - DNA, 25 bp, Homo sapien
aatgccagtctggtcagggaagtag

SEQ ID NO: 219652 - DNA, 25 bp, Homo sapien
gtttcaatgctgttgggaaccagga

SEQ ID NO: 219653 - DNA, 25 bp, Homo sapien
tagggacattgtgtacctcagttgt

SEQ ID NO: 219654 - DNA, 25 bp, Homo sapien
gtgtacctcagttgtgtcacatgtg

SEQ ID NO: 219655 - DNA, 25 bp, Homo sapien
ccaggttgaccttgtgatgtgaatt

SEQ ID NO: 219656 - DNA, 25 bp, Homo sapien
gtgatgtgaattgatctgatcagac

SEQ ID NO: 219657 - DNA, 25 bp, Homo sapien
agagcccaacttttatgacacgata

SEQ ID NO: 219658 - DNA, 25 bp, Homo sapien
gattcgtttaagacaacaactggaa

SEQ ID NO: 219659 - DNA, 25 bp, Homo sapien
agaaagtacgactatcagcagccac

SEQ ID NO: 219660 - DNA, 25 bp, Homo sapien
agccacaaaaccaagctgacagtgt

SEQ ID NO: 219661 - DNA, 25 bp, Homo sapien
gacagtgtgcaactctcattggaat

SEQ ID NO: 219662 - DNA, 25 bp, Homo sapien
agtaattgtttcaagctcctgattc

SEQ ID NO: 219663 - DNA, 25 bp, Homo sapien
caagctcctgattctttctactaaa

SEQ ID NO: 219664 - DNA, 25 bp, Homo sapien
tccttgttagcttcggtctcttcat

SEQ ID NO: 219665 - DNA, 25 bp, Homo sapien
ttcggtctcttcatgtatgccaaaa

SEQ ID NO: 219666 - DNA, 25 bp, Homo sapien
tattcagtgtgccacctacagagga

SEQ ID NO: 219667 - DNA, 25 bp, Homo sapien
gaggaaactttgtcagagcccaact

SEQ ID NO: 219668 - DNA, 25 bp, Homo sapien
tgagctgctaaccagcaaacctcac

SEQ ID NO: 219669 - DNA, 25 bp, Homo sapien
gcaaacctcacccataagcttaggt

SEQ ID NO: 219670 - DNA, 25 bp, Homo sapien
aagcttaggtcaggatcatctgtcc

SEQ ID NO: 219671 - DNA, 25 bp, Homo sapien
aggatcatctgtcctcgggatgcca

SEQ ID NO: 219672 - DNA, 25 bp, Homo sapien
cgggatgccatagagcctggtttca

SEQ ID NO: 219673 - DNA, 25 bp, Homo sapien
gcctggtttcagaagcagaacaatc

SEQ ID NO: 219674 - DNA, 25 bp, Homo sapien
aaaatgtcgtgttctggcctacagc

SEQ ID NO: 219675 - DNA, 25 bp, Homo sapien
agaaacacatcttactggcctatag

SEQ ID NO: 219676 - DNA, 25 bp, Homo sapien
actggcctatagagaagacgaactt

SEQ ID NO: 219677 - DNA, 25 bp, Homo sapien
caggtgatggcgattcatggattca

SEQ ID NO: 219678 - DNA, 25 bp, Homo sapien
gttagggactccactttattgttcg

SEQ ID NO: 219679 - DNA, 25 bp, Homo sapien
ctgccgagacgggacagtggatcca

SEQ ID NO: 219680 - DNA, 25 bp, Homo sapien
gatccagtaggaacatagatgcatc

SEQ ID NO: 219681 - DNA, 25 bp, Homo sapien
gaacatagatgcatccaaactcatt

SEQ ID NO: 219682 - DNA, 25 bp, Homo sapien
gatgcatccaaactcattagactac

SEQ ID NO: 219683 - DNA, 25 bp, Homo sapien
ctcattagactacaaggatcacgga

SEQ ID NO: 219684 - DNA, 25 bp, Homo sapien
acaaggatcacggaaactgttggtt

SEQ ID NO: 219685 - DNA, 25 bp, Homo sapien
aactgttggttgacaatagcatacg

SEQ ID NO: 219686 - DNA, 25 bp, Homo sapien
atagcatacgggaactgcaatacac

SEQ ID NO: 219687 - DNA, 25 bp, Homo sapien
gggaactgcaatacacaaaaactgg

SEQ ID NO: 219688 - DNA, 25 bp, Homo sapien
aggctgaggcctgtgtgacaaatga

SEQ ID NO: 219689 - DNA, 25 bp, Homo sapien
tgaggcctgtgtgacaaatgatacg

SEQ ID NO: 219690 - DNA, 25 bp, Homo sapien
gtaactttcactccctgcttaaagg

SEQ ID NO: 219691 - DNA, 25 bp, Homo sapien
gaactgatgagagttgcctggcaca

SEQ ID NO: 219692 - DNA, 25 bp, Homo sapien
tgagagttgcctggcacagatctgt

SEQ ID NO: 219693 - DNA, 25 bp, Homo sapien
gcccaggtgtgctaggaactccaga

SEQ ID NO: 219694 - DNA, 25 bp, Homo sapien
agtgacccctgctccaggccaggaa

SEQ ID NO: 219695 - DNA, 25 bp, Homo sapien
ggccaggaatgagcaccttgtgcct

SEQ ID NO: 219696 - DNA, 25 bp, Homo sapien
tgctggctgcccattgctgtggatg

SEQ ID NO: 219697 - DNA, 25 bp, Homo sapien
agagctggagtcacacatggaggct

SEQ ID NO: 219698 - DNA, 25 bp, Homo sapien
agtcacacatggaggctggacagct

SEQ ID NO: 219699 - DNA, 25 bp, Homo sapien
gggacactctggatggcatgtacca

SEQ ID NO: 219700 - DNA, 25 bp, Homo sapien
ggatggcatgtaccatgtttttatt

SEQ ID NO: 219701 - DNA, 25 bp, Homo sapien
tttgcccttcctgctaactctatta

SEQ ID NO: 219702 - DNA, 25 bp, Homo sapien
ctgacctcataacctaatggccttg

SEQ ID NO: 219703 - DNA, 25 bp, Homo sapien
aatggccttggacaccagattcttt

SEQ ID NO: 219704 - DNA, 25 bp, Homo sapien
tggacaccagattctttcccattct

SEQ ID NO: 219705 - DNA, 25 bp, Homo sapien
ctttcccattctgtccatgaatcat

SEQ ID NO: 219706 - DNA, 25 bp, Homo sapien
atgaatcatcttccccacacacaat

SEQ ID NO: 219707 - DNA, 25 bp, Homo sapien
aatcattcatatctactcacctaac

SEQ ID NO: 219708 - DNA, 25 bp, Homo sapien
tctactcacctaacagcaacactgg

SEQ ID NO: 219709 - DNA, 25 bp, Homo sapien
gagcctggagcatccggacttgccc

SEQ ID NO: 219710 - DNA, 25 bp, Homo sapien
gcatccggacttgccctatgggaga

SEQ ID NO: 219711 - DNA, 25 bp, Homo sapien
tgtatctgataatacagaccctgtc

SEQ ID NO: 219712 - DNA, 25 bp, Homo sapien
gggaccactgattggcagaaaactt

SEQ ID NO: 219713 - DNA, 25 bp, Homo sapien
ttggcagaaaacttccctacgttca

SEQ ID NO: 219714 - DNA, 25 bp, Homo sapien
ggcagaaaacttccctacgttcagt

SEQ ID NO: 219715 - DNA, 25 bp, Homo sapien
acttccctacgttcagttgttagat

SEQ ID NO: 219716 - DNA, 25 bp, Homo sapien
ctacgttcagttgttagatatgcaa

SEQ ID NO: 219717 - DNA, 25 bp, Homo sapien
gcaaattgataaggatctaacacta

SEQ ID NO: 219718 - DNA, 25 bp, Homo sapien
gataaggatctaacactaggaaaat

SEQ ID NO: 219719 - DNA, 25 bp, Homo sapien
gtatcactgtgtggaaaatacctcc

SEQ ID NO: 219720 - DNA, 25 bp, Homo sapien
gtggaaaatacctccaaagctgaaa

SEQ ID NO: 219721 - DNA, 25 bp, Homo sapien
agctgaaagagccaggtatttacct

SEQ ID NO: 219722 - DNA, 25 bp, Homo sapien
aggtatttacctgatgagcagaggg

SEQ ID NO: 219723 - DNA, 25 bp, Homo sapien
tgcctggctgctggtgacatcctag

SEQ ID NO: 219724 - DNA, 25 bp, Homo sapien
gacatcctagccctggtttttggcc

SEQ ID NO: 219725 - DNA, 25 bp, Homo sapien
tttttgctgtcaccagcgtcgcgtt

SEQ ID NO: 219726 - DNA, 25 bp, Homo sapien
agcgtcgcgttccttgtgcagatga

SEQ ID NO: 219727 - DNA, 25 bp, Homo sapien
tgtgagctaccgcccagcagaggta

SEQ ID NO: 219728 - DNA, 25 bp, Homo sapien
cagaggtagccgagactggagccta

SEQ ID NO: 219729 - DNA, 25 bp, Homo sapien
gactggagcctagaggctggatctt

SEQ ID NO: 219730 - DNA, 25 bp, Homo sapien
ggagccggtaactgtcctgtcctgc

SEQ ID NO: 219731 - DNA, 25 bp, Homo sapien
taactgtcctgtcctgctcattatg

SEQ ID NO: 219732 - DNA, 25 bp, Homo sapien
tgctcattatgccacttccttttaa

SEQ ID NO: 219733 - DNA, 25 bp, Homo sapien
tcattatgccacttccttttaactg

SEQ ID NO: 219734 - DNA, 25 bp, Homo sapien
gttcaggccggccactcttctactg

SEQ ID NO: 219735 - DNA, 25 bp, Homo sapien
atgaaacagggtgcgggtgcaccgt

SEQ ID NO: 219736 - DNA, 25 bp, Homo sapien
gcgggtgcaccgtggagtcattcca

SEQ ID NO: 219737 - DNA, 25 bp, Homo sapien
gggtgcaccgtggagtcattccaag

SEQ ID NO: 219738 - DNA, 25 bp, Homo sapien
ggtgcaccgtggagtcattccaaga

SEQ ID NO: 219739 - DNA, 25 bp, Homo sapien
tgcaccgtggagtcattccaagact

SEQ ID NO: 219740 - DNA, 25 bp, Homo sapien
tggagtcattccaagactcctgtcc

SEQ ID NO: 219741 - DNA, 25 bp, Homo sapien
tggttcctgtctgttatttgtaaac

SEQ ID NO: 219742 - DNA, 25 bp, Homo sapien
gttcctgtctgttatttgtaaactg

SEQ ID NO: 219743 - DNA, 25 bp, Homo sapien
tgtaaactgaggaccacaataaaga

SEQ ID NO: 219744 - DNA, 25 bp, Homo sapien
tgaggaccacaataaagaaatcttt

SEQ ID NO: 219745 - DNA, 25 bp, Homo sapien
agccagtttacaagcatgtctcaag

SEQ ID NO: 219746 - DNA, 25 bp, Homo sapien
gcatgtctcaagctagtgtgttcca

SEQ ID NO: 219747 - DNA, 25 bp, Homo sapien
gtgtgttccattatgctcacagcag

SEQ ID NO: 219748 - DNA, 25 bp, Homo sapien
gcctacctctgtgtttgacatctga

SEQ ID NO: 219749 - DNA, 25 bp, Homo sapien
gcatttgtttttctggcttagtaat

SEQ ID NO: 219750 - DNA, 25 bp, Homo sapien
atctaatagatttccttaagggcag

SEQ ID NO: 219751 - DNA, 25 bp, Homo sapien
aggagatagactctggcccttgttt

SEQ ID NO: 219752 - DNA, 25 bp, Homo sapien
ctagcctccttccttgcagtgttta

SEQ ID NO: 219753 - DNA, 25 bp, Homo sapien
atagccagtgtttacagcatagcag

SEQ ID NO: 219754 - DNA, 25 bp, Homo sapien
gatgctgctgctggttaagagaata

SEQ ID NO: 219755 - DNA, 25 bp, Homo sapien
acaaggcatgcatttggccaaaata

SEQ ID NO: 219756 - DNA, 25 bp, Homo sapien
acttctgcacgcagcctctctgttg

SEQ ID NO: 219757 - DNA, 25 bp, Homo sapien
tgttgcctcagctctccaagttcca

SEQ ID NO: 219758 - DNA, 25 bp, Homo sapien
cacagagaacagatcctggcattct

SEQ ID NO: 219759 - DNA, 25 bp, Homo sapien
agaacagatcctggcattctctcag

SEQ ID NO: 219760 - DNA, 25 bp, Homo sapien
acagatcctggcattctctcagaag

SEQ ID NO: 219761 - DNA, 25 bp, Homo sapien
tgtactacgacaaggaacagacagt

SEQ ID NO: 219762 - DNA, 25 bp, Homo sapien
acgacaaggaacagacagtgagcat

SEQ ID NO: 219763 - DNA, 25 bp, Homo sapien
tggccggcttcctgcgatgatggct

SEQ ID NO: 219764 - DNA, 25 bp, Homo sapien
ggcttcctgcgatgatggctcactt

SEQ ID NO: 219765 - DNA, 25 bp, Homo sapien
ttcctgcgatgatggctcacttctg

SEQ ID NO: 219766 - DNA, 25 bp, Homo sapien
gatgatggctcacttctgcacgcag

SEQ ID NO: 219767 - DNA, 25 bp, Homo sapien
gtggcccttgtttacagtgaggact

SEQ ID NO: 219768 - DNA, 25 bp, Homo sapien
gccactgtgtctctgtttcctgaaa

SEQ ID NO: 219769 - DNA, 25 bp, Homo sapien
ataaactgtagcgaccccagactgt

SEQ ID NO: 219770 - DNA, 25 bp, Homo sapien
gaccccagactgtagagatttttat

SEQ ID NO: 219771 - DNA, 25 bp, Homo sapien
ttatgtgtttggaacatctgctgtg

SEQ ID NO: 219772 - DNA, 25 bp, Homo sapien
aactgtattctagtggctgttcatg

SEQ ID NO: 219773 - DNA, 25 bp, Homo sapien
ggctgttcatgctccaagactttag

SEQ ID NO: 219774 - DNA, 25 bp, Homo sapien
caagactttagttaccgagacatga

SEQ ID NO: 219775 - DNA, 25 bp, Homo sapien
gttaccgagacatgaatactatcca

SEQ ID NO: 219776 - DNA, 25 bp, Homo sapien
tatccatgtaataagcacttgcctg

SEQ ID NO: 219777 - DNA, 25 bp, Homo sapien
aaacctgcactgaaacctgagatgg

SEQ ID NO: 219778 - DNA, 25 bp, Homo sapien
gggaccactgattggcagaaaactt

SEQ ID NO: 219779 - DNA, 25 bp, Homo sapien
ttggcagaaaacttccctacgttca

SEQ ID NO: 219780 - DNA, 25 bp, Homo sapien
acttccctacgttcagttgttagat

SEQ ID NO: 219781 - DNA, 25 bp, Homo sapien
ctacgttcagttgttagatatgcaa

SEQ ID NO: 219782 - DNA, 25 bp, Homo sapien
aattgataaggatctaacactagga

SEQ ID NO: 219783 - DNA, 25 bp, Homo sapien
tttggttggtttcagtcatttgttt

SEQ ID NO: 219784 - DNA, 25 bp, Homo sapien
aacaaaaccctttgctgtatcactg

SEQ ID NO: 219785 - DNA, 25 bp, Homo sapien
gtatcactgtgtggaaaatacctcc

SEQ ID NO: 219786 - DNA, 25 bp, Homo sapien
gtggaaaatacctccaaagctgaaa

SEQ ID NO: 219787 - DNA, 25 bp, Homo sapien
agctgaaagagccaggtatttacct

SEQ ID NO: 219788 - DNA, 25 bp, Homo sapien
aggtatttacctgatgagcagaggg

SEQ ID NO: 219789 - DNA, 25 bp, Homo sapien
tcccgcaggtgagaaccctgtggag

SEQ ID NO: 219790 - DNA, 25 bp, Homo sapien
ccctgtggagatgagtcagtgccat

SEQ ID NO: 219791 - DNA, 25 bp, Homo sapien
atgactgagaaggaaccgaccccta

SEQ ID NO: 219792 - DNA, 25 bp, Homo sapien
aggaaccgacccctagttgagagca

SEQ ID NO: 219793 - DNA, 25 bp, Homo sapien
tagttgagagcaccttgcagttccc

SEQ ID NO: 219794 - DNA, 25 bp, Homo sapien
tgcagttccccgagaactttctgat

SEQ ID NO: 219795 - DNA, 25 bp, Homo sapien
gagaactttctgattcacagtctca

SEQ ID NO: 219796 - DNA, 25 bp, Homo sapien
cagcatgaaatgtcctcttgaagca

SEQ ID NO: 219797 - DNA, 25 bp, Homo sapien
aatgtcctcttgaagcatagctttt

SEQ ID NO: 219798 - DNA, 25 bp, Homo sapien
tccctctgactctaagaattctctc

SEQ ID NO: 219799 - DNA, 25 bp, Homo sapien
aattctctcttctggaatcgcttga

SEQ ID NO: 219800 - DNA, 25 bp, Homo sapien
attggatttctaaggatggtggttt

SEQ ID NO: 219801 - DNA, 25 bp, Homo sapien
atggtggtttgagccttgattagac

SEQ ID NO: 219802 - DNA, 25 bp, Homo sapien
ggtttgagccttgattagacttttg

SEQ ID NO: 219803 - DNA, 25 bp, Homo sapien
agacttttgatgtgctaagccagac

SEQ ID NO: 219804 - DNA, 25 bp, Homo sapien
atgtgctaagccagacaggcagtct

SEQ ID NO: 219805 - DNA, 25 bp, Homo sapien
acaggcagtctgtacattgatggcc

SEQ ID NO: 219806 - DNA, 25 bp, Homo sapien
ttgatggccatcacaatgcagcttt

SEQ ID NO: 219807 - DNA, 25 bp, Homo sapien
cacaatgcagctttggtttaattta

SEQ ID NO: 219808 - DNA, 25 bp, Homo sapien
gtttaatttaattcaggcctgctgc

SEQ ID NO: 219809 - DNA, 25 bp, Homo sapien
ggcctgctgctgagttatgcacaga

SEQ ID NO: 219810 - DNA, 25 bp, Homo sapien
atgcacagactttttgttgaccaaa

SEQ ID NO: 219811 - DNA, 25 bp, Homo sapien
aatggaatgctctggtctatataac

SEQ ID NO: 219812 - DNA, 25 bp, Homo sapien
atataaccacatttctgagcctttg

SEQ ID NO: 219813 - DNA, 25 bp, Homo sapien
tgagcctttgagactgttcctgagc

SEQ ID NO: 219814 - DNA, 25 bp, Homo sapien
tgagccttcagcactaacctatgag

SEQ ID NO: 219815 - DNA, 25 bp, Homo sapien
aacctatgagggtgagctggtcccc

SEQ ID NO: 219816 - DNA, 25 bp, Homo sapien
gagctggtcccctctatatatacat

SEQ ID NO: 219817 - DNA, 25 bp, Homo sapien
ggtcccctctatatatacatcatac

SEQ ID NO: 219818 - DNA, 25 bp, Homo sapien
atctcacagcatttgccaagtctcc

SEQ ID NO: 219819 - DNA, 25 bp, Homo sapien
gccaagtctcccaatatccaatttt

SEQ ID NO: 219820 - DNA, 25 bp, Homo sapien
aatgcattttgctagacagttaaac

SEQ ID NO: 219821 - DNA, 25 bp, Homo sapien
ttaaactggcttaacttagtatatt

SEQ ID NO: 219822 - DNA, 25 bp, Homo sapien
gggctcccaaaaccagcttacaata

SEQ ID NO: 219823 - DNA, 25 bp, Homo sapien
ttacaatagccttttgcgctgcctg

SEQ ID NO: 219824 - DNA, 25 bp, Homo sapien
cctgtcctgtgggagctgataaacc

SEQ ID NO: 219825 - DNA, 25 bp, Homo sapien
accaagtcacatttgcattctgttg

SEQ ID NO: 219826 - DNA, 25 bp, Homo sapien
gcattctgttgcaggcttagtgaaa

SEQ ID NO: 219827 - DNA, 25 bp, Homo sapien
gtgaaaaaggactgctgtctttcct

SEQ ID NO: 219828 - DNA, 25 bp, Homo sapien
gctgtctttccttggttcaagtgtt

SEQ ID NO: 219829 - DNA, 25 bp, Homo sapien
aatggagagctggagttcgttcaga

SEQ ID NO: 219830 - DNA, 25 bp, Homo sapien
atagtgctgtgtgttaccacgtctc

SEQ ID NO: 219831 - DNA, 25 bp, Homo sapien
ctaccttgtagctcatgaccattgt

SEQ ID NO: 219832 - DNA, 25 bp, Homo sapien
gaccattgtgtatagcatttctaca

SEQ ID NO: 219833 - DNA, 25 bp, Homo sapien
cagtgagcatgaaggacaatgtcag

SEQ ID NO: 219834 - DNA, 25 bp, Homo sapien
agtgagcatgaaggacaatgtcagg

SEQ ID NO: 219835 - DNA, 25 bp, Homo sapien
gtgagcatgaaggacaatgtcaggc

SEQ ID NO: 219836 - DNA, 25 bp, Homo sapien
gcatgaaggacaatgtcaggcccct

SEQ ID NO: 219837 - DNA, 25 bp, Homo sapien
catgaaggacaatgtcaggcccctg

SEQ ID NO: 219838 - DNA, 25 bp, Homo sapien
atgaaggacaatgtcaggcccctgc

SEQ ID NO: 219839 - DNA, 25 bp, Homo sapien
tgaaggacaatgtcaggcccctgca

SEQ ID NO: 219840 - DNA, 25 bp, Homo sapien
gaaggacaatgtcaggcccctgcag

SEQ ID NO: 219841 - DNA, 25 bp, Homo sapien
gccccgggtcggccgctgccctggg

SEQ ID NO: 219842 - DNA, 25 bp, Homo sapien
tgggccccatgctggcctgcctgct

SEQ ID NO: 219843 - DNA, 25 bp, Homo sapien
gggccccatgctggcctgcctgctg

SEQ ID NO: 219844 - DNA, 25 bp, Homo sapien
agagcagcctgcgacagtgtggacc

SEQ ID NO: 219845 - DNA, 25 bp, Homo sapien
agcctgcgacagtgtggacctacct

SEQ ID NO: 219846 - DNA, 25 bp, Homo sapien
tgcgacagtgtggacctacctgtag

SEQ ID NO: 219847 - DNA, 25 bp, Homo sapien
acagtgtggacctacctgtagcagc

SEQ ID NO: 219848 - DNA, 25 bp, Homo sapien
atgcaaaatgcaaaggagtcctggt

SEQ ID NO: 219849 - DNA, 25 bp, Homo sapien
gcaaaggagtcctggtgacctacct

SEQ ID NO: 219850 - DNA, 25 bp, Homo sapien
gaacaaccagagactacacaggaga

SEQ ID NO: 219851 - DNA, 25 bp, Homo sapien
gatgcaaaatcttgggtggcttcac

SEQ ID NO: 219852 - DNA, 25 bp, Homo sapien
caaaatcttgggtggcttcaccgtt

SEQ ID NO: 219853 - DNA, 25 bp, Homo sapien
aatcttgggtggcttcaccgttcag

SEQ ID NO: 219854 - DNA, 25 bp, Homo sapien
cttgggtggcttcaccgttcagttt

SEQ ID NO: 219855 - DNA, 25 bp, Homo sapien
ggagctattacgaataagtctacgt

SEQ ID NO: 219856 - DNA, 25 bp, Homo sapien
gtctacgtgagttggaattggctga

SEQ ID NO: 219857 - DNA, 25 bp, Homo sapien
atgatgttgaccttgcaagtatagc

SEQ ID NO: 219858 - DNA, 25 bp, Homo sapien
aaggttattcaggtgcggacattac

SEQ ID NO: 219859 - DNA, 25 bp, Homo sapien
ggacattaccaacgtgtgcagggat

SEQ ID NO: 219860 - DNA, 25 bp, Homo sapien
tgcagggatgcgtccttgatggcaa

SEQ ID NO: 219861 - DNA, 25 bp, Homo sapien
gaaggcgcattgaaggtttgactcc

SEQ ID NO: 219862 - DNA, 25 bp, Homo sapien
gaaatccgaaatctttccaaagaag

SEQ ID NO: 219863 - DNA, 25 bp, Homo sapien
aatgcacatgcctacaactatggag

SEQ ID NO: 219864 - DNA, 25 bp, Homo sapien
ctatggaggatttcgagatggcttt

SEQ ID NO: 219865 - DNA, 25 bp, Homo sapien
gtctgctgcagacattgaaagatac

SEQ ID NO: 219866 - DNA, 25 bp, Homo sapien
atttatgtaaagtatggtctcttac

SEQ ID NO: 219867 - DNA, 25 bp, Homo sapien
gtatggtctcttactttttagtttg

SEQ ID NO: 219868 - DNA, 25 bp, Homo sapien
tattgttttgtagtcttcctgtccc

SEQ ID NO: 219869 - DNA, 25 bp, Homo sapien
ttgtagtcttcctgtccccttcagt

SEQ ID NO: 219870 - DNA, 25 bp, Homo sapien
cattctccaatgaaataatagggca

SEQ ID NO: 219871 - DNA, 25 bp, Homo sapien
aatagggcatttaacaaagatcgct

SEQ ID NO: 219872 - DNA, 25 bp, Homo sapien
caaagatcgctatgtgcaatactgt

SEQ ID NO: 219873 - DNA, 25 bp, Homo sapien
gatcgctatgtgcaatactgtattt

SEQ ID NO: 219874 - DNA, 25 bp, Homo sapien
gcaatactgtatttagtgtttctat

SEQ ID NO: 219875 - DNA, 25 bp, Homo sapien
gtgtttctatttcaatttttctagg

SEQ ID NO: 219876 - DNA, 25 bp, Homo sapien
tatttcaatttttctaggatgttaa

SEQ ID NO: 219877 - DNA, 25 bp, Homo sapien
ggagatacttatccagctgaattat

SEQ ID NO: 219878 - DNA, 25 bp, Homo sapien
gctgaattatatattactggatcta

SEQ ID NO: 219879 - DNA, 25 bp, Homo sapien
tactggatctatacttagaatgcaa

SEQ ID NO: 219880 - DNA, 25 bp, Homo sapien
gcaatgtgacagagggcagttaaaa

SEQ ID NO: 219881 - DNA, 25 bp, Homo sapien
gggcagttaaaatatccaagatgta

SEQ ID NO: 219882 - DNA, 25 bp, Homo sapien
atccaagatgtattccaagacaaag

SEQ ID NO: 219883 - DNA, 25 bp, Homo sapien
gacaaagcactctgtcttatcaaga

SEQ ID NO: 219884 - DNA, 25 bp, Homo sapien
gcactctgtcttatcaagaaccctt

SEQ ID NO: 219885 - DNA, 25 bp, Homo sapien
agaacccttaagaacatagaaatga

SEQ ID NO: 219886 - DNA, 25 bp, Homo sapien
gaggagtcatatttcaatacatcat

SEQ ID NO: 219887 - DNA, 25 bp, Homo sapien
gaatctaaattatttgtgctgaaca

SEQ ID NO: 219888 - DNA, 25 bp, Homo sapien
acatttgtgtgggacagacgagcgt

SEQ ID NO: 219889 - DNA, 25 bp, Homo sapien
agccaggcacaaagttagtttccaa

SEQ ID NO: 219890 - DNA, 25 bp, Homo sapien
ttttttgcacagaagctggtaatct

SEQ ID NO: 219891 - DNA, 25 bp, Homo sapien
aagctggtaatctaggacctacgtg

SEQ ID NO: 219892 - DNA, 25 bp, Homo sapien
ggacctacgtgtgaacaactttata

SEQ ID NO: 219893 - DNA, 25 bp, Homo sapien
tacttggtttacttgggttggtatg

SEQ ID NO: 219894 - DNA, 25 bp, Homo sapien
aagttccttgaacactgtggatccc

SEQ ID NO: 219895 - DNA, 25 bp, Homo sapien
actgtggatcccctaatgtgtatga

SEQ ID NO: 219896 - DNA, 25 bp, Homo sapien
gatcccctaatgtgtatgaatgact

SEQ ID NO: 219897 - DNA, 25 bp, Homo sapien
gaatgactgaggctttgtaaattaa

SEQ ID NO: 219898 - DNA, 25 bp, Homo sapien
taaattaagggacgtttgtgtgaat

SEQ ID NO: 219899 - DNA, 25 bp, Homo sapien
tgaactgtattcagaccgactgggt

SEQ ID NO: 219900 - DNA, 25 bp, Homo sapien
gaccgactgggtatctagcttactg

SEQ ID NO: 219901 - DNA, 25 bp, Homo sapien
atcattgttgaaaccagaccctgta

SEQ ID NO: 219902 - DNA, 25 bp, Homo sapien
agaccctgtagtccagtggtgctgc

SEQ ID NO: 219903 - DNA, 25 bp, Homo sapien
tggtgctgccctgttgtgcaaactg

SEQ ID NO: 219904 - DNA, 25 bp, Homo sapien
tgctcctttttctcgtgtttttgta

SEQ ID NO: 219905 - DNA, 25 bp, Homo sapien
taaagagcttccatctgggctggac

SEQ ID NO: 219906 - DNA, 25 bp, Homo sapien
tggacccagttcttgcacatacaag

SEQ ID NO: 219907 - DNA, 25 bp, Homo sapien
aagacaccgctgcagtcagctagga

SEQ ID NO: 219908 - DNA, 25 bp, Homo sapien
ctttccgccatgtattctattctgt

SEQ ID NO: 219909 - DNA, 25 bp, Homo sapien
ggtttaacacacactgattcatact

SEQ ID NO: 219910 - DNA, 25 bp, Homo sapien
ggaagcatgtaaacagctaactgtt

SEQ ID NO: 219911 - DNA, 25 bp, Homo sapien
aatgaggaggtttggctattgtcac

SEQ ID NO: 219912 - DNA, 25 bp, Homo sapien
gaggtttggctattgtcacatgaca

SEQ ID NO: 219913 - DNA, 25 bp, Homo sapien
gtcacatgacagactgttagccaag

SEQ ID NO: 219914 - DNA, 25 bp, Homo sapien
gacagactgttagccaaggacaaag

SEQ ID NO: 219915 - DNA, 25 bp, Homo sapien
aaagaagttctgcaaacctcccctg

SEQ ID NO: 219916 - DNA, 25 bp, Homo sapien
tgctggtgtccagatgtctgcggtt

SEQ ID NO: 219917 - DNA, 25 bp, Homo sapien
ggtgtccagatgtctgcggttgtca

SEQ ID NO: 219918 - DNA, 25 bp, Homo sapien
aacataaaagacaaggcaaagcccg

SEQ ID NO: 219919 - DNA, 25 bp, Homo sapien
ggcaaagcccgcataattttaagac

SEQ ID NO: 219920 - DNA, 25 bp, Homo sapien
taagacggttctttaggacattagt

SEQ ID NO: 219921 - DNA, 25 bp, Homo sapien
agagatgcagatgaattacttttct

SEQ ID NO: 219922 - DNA, 25 bp, Homo sapien
tatttgtatgtgtggttgtgaaacc

SEQ ID NO: 219923 - DNA, 25 bp, Homo sapien
gtggttgtgaaacccatacacaagt

SEQ ID NO: 219924 - DNA, 25 bp, Homo sapien
atacacaagtggatttggccatctt

SEQ ID NO: 219925 - DNA, 25 bp, Homo sapien
gtggatttggccatctttgggcagt

SEQ ID NO: 219926 - DNA, 25 bp, Homo sapien
ccatctttgggcagtgaggtcaaat

SEQ ID NO: 219927 - DNA, 25 bp, Homo sapien
aagtgcttttcagaactgcattact

SEQ ID NO: 219928 - DNA, 25 bp, Homo sapien
gagaaaacatcaaaactgctgtagt

SEQ ID NO: 219929 - DNA, 25 bp, Homo sapien
ctgctgtagttttccatttctactg

SEQ ID NO: 219930 - DNA, 25 bp, Homo sapien
actgtatttcagttgcaacctattt

SEQ ID NO: 219931 - DNA, 25 bp, Homo sapien
ttcagttgcaacctatttttaataa

SEQ ID NO: 219932 - DNA, 25 bp, Homo sapien
agaactaggtaatgactggaatgtc

SEQ ID NO: 219933 - DNA, 25 bp, Homo sapien
gagtggattaatgattccggatctt

SEQ ID NO: 219934 - DNA, 25 bp, Homo sapien
atgattccggatctttggctaggca

SEQ ID NO: 219935 - DNA, 25 bp, Homo sapien
ttccggatctttggctaggcaaaat

SEQ ID NO: 219936 - DNA, 25 bp, Homo sapien
atgaaactataactgatctaaacgg

SEQ ID NO: 219937 - DNA, 25 bp, Homo sapien
tgatctaaacggttccttccttctt

SEQ ID NO: 219938 - DNA, 25 bp, Homo sapien
ccttccttcttctactgtgcaagga

SEQ ID NO: 219939 - DNA, 25 bp, Homo sapien
gtaaggaaaaactcgcacactatct

SEQ ID NO: 219940 - DNA, 25 bp, Homo sapien
gaaaaactcgcacactatctgtgga

SEQ ID NO: 219941 - DNA, 25 bp, Homo sapien
atctgtggaactcatttaaattcaa

SEQ ID NO: 219942 - DNA, 25 bp, Homo sapien
aatcctagataaacatttcgcattg

SEQ ID NO: 219943 - DNA, 25 bp, Homo sapien
gttttcaaaatcatgcactttctaa

SEQ ID NO: 219944 - DNA, 25 bp, Homo sapien
ttctaaaatggtgtcatcctgaaaa

SEQ ID NO: 219945 - DNA, 25 bp, Homo sapien
aaaacccagtgtttgcacacacaca

SEQ ID NO: 219946 - DNA, 25 bp, Homo sapien
acacacaaaatcttgaccccgttat

SEQ ID NO: 219947 - DNA, 25 bp, Homo sapien
tcttgaccccgttatctatatttta

SEQ ID NO: 219948 - DNA, 25 bp, Homo sapien
taaatgctttttgcccaacactgac

SEQ ID NO: 219949 - DNA, 25 bp, Homo sapien
tttttgcccaacactgaccctatgt

SEQ ID NO: 219950 - DNA, 25 bp, Homo sapien
gaccctatgttcaactttgtgtcat

SEQ ID NO: 219951 - DNA, 25 bp, Homo sapien
gttcaactttgtgtcatttacctta

SEQ ID NO: 219952 - DNA, 25 bp, Homo sapien
ttgggcctcagtgttacaaattact

SEQ ID NO: 219953 - DNA, 25 bp, Homo sapien
caaattactagtgctattttcatta

SEQ ID NO: 219954 - DNA, 25 bp, Homo sapien
tggcttcagtgcaactcttttcctt

SEQ ID NO: 219955 - DNA, 25 bp, Homo sapien
tcagtgcaactcttttccttcagct

SEQ ID NO: 219956 - DNA, 25 bp, Homo sapien
tttccttcagctgcatgtgattttg

SEQ ID NO: 219957 - DNA, 25 bp, Homo sapien
ttcagctgcatgtgattttgtgata

SEQ ID NO: 219958 - DNA, 25 bp, Homo sapien
ttcaggtaacaggatgggcagtgat

SEQ ID NO: 219959 - DNA, 25 bp, Homo sapien
gatggagaatcactgttgattgaga

SEQ ID NO: 219960 - DNA, 25 bp, Homo sapien
gttgattgagattttggtttccatg

SEQ ID NO: 219961 - DNA, 25 bp, Homo sapien
tgttttcttcaatagtcttattttc

SEQ ID NO: 219962 - DNA, 25 bp, Homo sapien
tcaaatacagccaacttaaagtttt

SEQ ID NO: 219963 - DNA, 25 bp, Homo sapien
aatactaggagaagactgaatcatt

SEQ ID NO: 219964 - DNA, 25 bp, Homo sapien
gaatcattaatgatgtctcacaaat

SEQ ID NO: 219965 - DNA, 25 bp, Homo sapien
aatacatttcccaattcaactcaaa

SEQ ID NO: 219966 - DNA, 25 bp, Homo sapien
attggtgtattttgtctattctgga

SEQ ID NO: 219967 - DNA, 25 bp, Homo sapien
ctattctggatatttgatctgttta

SEQ ID NO: 219968 - DNA, 25 bp, Homo sapien
gatctgtttaatgtactgtgctagt

SEQ ID NO: 219969 - DNA, 25 bp, Homo sapien
tactgtgctagtgactggaggccct

SEQ ID NO: 219970 - DNA, 25 bp, Homo sapien
tggaggccctgctactgcaaatata

SEQ ID NO: 219971 - DNA, 25 bp, Homo sapien
aaataccctttgctttgtgcctcaa

SEQ ID NO: 219972 - DNA, 25 bp, Homo sapien
ccctttgctttgtgcctcaaagtga

SEQ ID NO: 219973 - DNA, 25 bp, Homo sapien
gtgcctcaaagtgatgtaatgtgat

SEQ ID NO: 219974 - DNA, 25 bp, Homo sapien
gtgatcacagcttttgttgtgttga

SEQ ID NO: 219975 - DNA, 25 bp, Homo sapien
gtggactgtcattttgttgcagcaa

SEQ ID NO: 219976 - DNA, 25 bp, Homo sapien
aagaagagggttgacctgagctgaa

SEQ ID NO: 219977 - DNA, 25 bp, Homo sapien
agagggttgacctgagctgaaggac

SEQ ID NO: 219978 - DNA, 25 bp, Homo sapien
gctgaaggacatgaacttccacgtg

SEQ ID NO: 219979 - DNA, 25 bp, Homo sapien
tgaaggacatgaacttccacgtgaa

SEQ ID NO: 219980 - DNA, 25 bp, Homo sapien
aaggacatgaacttccacgtgaaat

SEQ ID NO: 219981 - DNA, 25 bp, Homo sapien
aggacatgaacttccacgtgaaata

SEQ ID NO: 219982 - DNA, 25 bp, Homo sapien
gacatgaacttccacgtgaaatagc

SEQ ID NO: 219983 - DNA, 25 bp, Homo sapien
atgaacttccacgtgaaatagcccc

SEQ ID NO: 219984 - DNA, 25 bp, Homo sapien
tgaacttccacgtgaaatagcccca

SEQ ID NO: 219985 - DNA, 25 bp, Homo sapien
gaacttccacgtgaaatagccccag

SEQ ID NO: 219986 - DNA, 25 bp, Homo sapien
cagggccgggcacacgaggtcagga

SEQ ID NO: 219987 - DNA, 25 bp, Homo sapien
tgcagtcaaacaggctgaaacactt

SEQ ID NO: 219988 - DNA, 25 bp, Homo sapien
acttttccaggaaatctgccccaat

SEQ ID NO: 219989 - DNA, 25 bp, Homo sapien
tctgccccaatgaagatttctgtcc

SEQ ID NO: 219990 - DNA, 25 bp, Homo sapien
ctccaccaaatcctgaagacattat

SEQ ID NO: 219991 - DNA, 25 bp, Homo sapien
atccttgatggagacagtttacagc

SEQ ID NO: 219992 - DNA, 25 bp, Homo sapien
gtgccataccagaggctaactcgga

SEQ ID NO: 219993 - DNA, 25 bp, Homo sapien
ggctaactcggagactttcaaggaa

SEQ ID NO: 219994 - DNA, 25 bp, Homo sapien
gaaagcacaaaccttggaaacctag

SEQ ID NO: 219995 - DNA, 25 bp, Homo sapien
acaccaaactggatacccaactttg

SEQ ID NO: 219996 - DNA, 25 bp, Homo sapien
gaaattctgactggtctcagagtct

SEQ ID NO: 219997 - DNA, 25 bp, Homo sapien
ctggtctcagagtctacttgataga

SEQ ID NO: 219998 - DNA, 25 bp, Homo sapien
ataaaagacacttgcaatatactgt

SEQ ID NO: 219999 - DNA, 25 bp, Homo sapien
aattttgttatgttagcctctagaa

SEQ ID NO: 220000 - DNA, 25 bp, Homo sapien
gttatgttagcctctagaaaattta

SEQ ID NO: 220001 - DNA, 25 bp, Homo sapien
tagcctctagaaaatttaagttcag

SEQ ID NO: 220002 - DNA, 25 bp, Homo sapien
gaaaaatgcactatgaccggttcgt

SEQ ID NO: 220003 - DNA, 25 bp, Homo sapien
aaaatgcactatgaccggttcgtaa

SEQ ID NO: 220004 - DNA, 25 bp, Homo sapien
aatgcactatgaccggttcgtaatt

SEQ ID NO: 220005 - DNA, 25 bp, Homo sapien
gcactatgaccggttcgtaattttt

SEQ ID NO: 220006 - DNA, 25 bp, Homo sapien
ttttaatgccacacataggttgtat

SEQ ID NO: 220007 - DNA, 25 bp, Homo sapien
taatgccacacataggttgtattgt

SEQ ID NO: 220008 - DNA, 25 bp, Homo sapien
tgccacacataggttgtattgtaat

SEQ ID NO: 220009 - DNA, 25 bp, Homo sapien
gccaatctaagccagtctcactgtg

SEQ ID NO: 220010 - DNA, 25 bp, Homo sapien
taagccagtctcactgtgaaccaca

SEQ ID NO: 220011 - DNA, 25 bp, Homo sapien
tgtgaaccacacgaaacctcaactg

SEQ ID NO: 220012 - DNA, 25 bp, Homo sapien
tgaaccacacgaaacctcaactggg

SEQ ID NO: 220013 - DNA, 25 bp, Homo sapien
gaggccacgtggatgttcatgagat

SEQ ID NO: 220014 - DNA, 25 bp, Homo sapien
ccacgtggatgttcatgagatgcat

SEQ ID NO: 220015 - DNA, 25 bp, Homo sapien
tgagatgcattctcttctgtctttg

SEQ ID NO: 220016 - DNA, 25 bp, Homo sapien
tgcattctcttctgtctttggtgga

SEQ ID NO: 220017 - DNA, 25 bp, Homo sapien
tctcttctgtctttggtggatggga

SEQ ID NO: 220018 - DNA, 25 bp, Homo sapien
gctttgccagaggttgcaacatgtt

SEQ ID NO: 220019 - DNA, 25 bp, Homo sapien
aggttgcaacatgttgagagaaccc

SEQ ID NO: 220020 - DNA, 25 bp, Homo sapien
actaagcgcagggagacgctgctcc

SEQ ID NO: 220021 - DNA, 25 bp, Homo sapien
taagcgcagggagacgctgctccct

SEQ ID NO: 220022 - DNA, 25 bp, Homo sapien
tgagtaacacctcattctggccgag

SEQ ID NO: 220023 - DNA, 25 bp, Homo sapien
gagtaacacctcattctggccgaga

SEQ ID NO: 220024 - DNA, 25 bp, Homo sapien
agtaacacctcattctggccgagag

SEQ ID NO: 220025 - DNA, 25 bp, Homo sapien
gtaacacctcattctggccgagagt

SEQ ID NO: 220026 - DNA, 25 bp, Homo sapien
taacacctcattctggccgagagta

SEQ ID NO: 220027 - DNA, 25 bp, Homo sapien
aacacctcattctggccgagagtag

SEQ ID NO: 220028 - DNA, 25 bp, Homo sapien
acacctcattctggccgagagtagg

SEQ ID NO: 220029 - DNA, 25 bp, Homo sapien
acctcattctggccgagagtagggc

SEQ ID NO: 220030 - DNA, 25 bp, Homo sapien
atttggggctcagaaggccctgctc

SEQ ID NO: 220031 - DNA, 25 bp, Homo sapien
ccggaaccgacgagtcctgaggaga

SEQ ID NO: 220032 - DNA, 25 bp, Homo sapien
tcctgaggagagaaccggtgcgtcc

SEQ ID NO: 220033 - DNA, 25 bp, Homo sapien
accggtgcgtcctgaggagagaacc

SEQ ID NO: 220034 - DNA, 25 bp, Homo sapien
gcgctgggcaacacgggcctgcaaa

SEQ ID NO: 220035 - DNA, 25 bp, Homo sapien
aacacgggcctgcaaactcgacagg

SEQ ID NO: 220036 - DNA, 25 bp, Homo sapien
ggcctgcaaactcgacaggaccctg

SEQ ID NO: 220037 - DNA, 25 bp, Homo sapien
caggcccagaccacgtgggacagaa

SEQ ID NO: 220038 - DNA, 25 bp, Homo sapien
agaccacgtgggacagaactcctgc

SEQ ID NO: 220039 - DNA, 25 bp, Homo sapien
cgagggaggcgaacccgcacttcca

SEQ ID NO: 220040 - DNA, 25 bp, Homo sapien
acccgcacttccaggcttgggagga

SEQ ID NO: 220041 - DNA, 25 bp, Homo sapien
gcacaatgcggtccagaccctgctg

SEQ ID NO: 220042 - DNA, 25 bp, Homo sapien
ctataagcaatttatgcaactgtct

SEQ ID NO: 220043 - DNA, 25 bp, Homo sapien
agcaatttatgcaactgtcttactg

SEQ ID NO: 220044 - DNA, 25 bp, Homo sapien
gcaatttatgcaactgtcttactgt

SEQ ID NO: 220045 - DNA, 25 bp, Homo sapien
caatttatgcaactgtcttactgtt

SEQ ID NO: 220046 - DNA, 25 bp, Homo sapien
tttatgcaactgtcttactgttgtt

SEQ ID NO: 220047 - DNA, 25 bp, Homo sapien
gcaactgtcttactgttgttggaca

SEQ ID NO: 220048 - DNA, 25 bp, Homo sapien
caactgtcttactgttgttggacat

SEQ ID NO: 220049 - DNA, 25 bp, Homo sapien
actgtcttactgttgttggacattc

SEQ ID NO: 220050 - DNA, 25 bp, Homo sapien
gtcttactgttgttggacattcaga

SEQ ID NO: 220051 - DNA, 25 bp, Homo sapien
gttggacattcagaagttttttcta

SEQ ID NO: 220052 - DNA, 25 bp, Homo sapien
ggacattcagaagttttttctaatt

SEQ ID NO: 220053 - DNA, 25 bp, Homo sapien
ggctcaccctgcaaggcatcatcag

SEQ ID NO: 220054 - DNA, 25 bp, Homo sapien
caccctgcaaggcatcatcagctgg

SEQ ID NO: 220055 - DNA, 25 bp, Homo sapien
gatcgggctgtggtgaccgcaacaa

SEQ ID NO: 220056 - DNA, 25 bp, Homo sapien
gcgtctacaccgatgtggcctacta

SEQ ID NO: 220057 - DNA, 25 bp, Homo sapien
acctggcctggatccgggagcacac

SEQ ID NO: 220058 - DNA, 25 bp, Homo sapien
gggagcacaccgtttcctgattgct

SEQ ID NO: 220059 - DNA, 25 bp, Homo sapien
acaccgtttcctgattgctcaggga

SEQ ID NO: 220060 - DNA, 25 bp, Homo sapien
tgattgctcagggactcatctttcc

SEQ ID NO: 220061 - DNA, 25 bp, Homo sapien
tttccctccttggtgattccgcagt

SEQ ID NO: 220062 - DNA, 25 bp, Homo sapien
tccttggtgattccgcagtgagaga

SEQ ID NO: 220063 - DNA, 25 bp, Homo sapien
gaaggcaagattgtgtcccattccc

SEQ ID NO: 220064 - DNA, 25 bp, Homo sapien
tgcagacccccctcatggagtatgg

SEQ ID NO: 220065 - DNA, 25 bp, Homo sapien
agggtcctctctcaaccactagact

SEQ ID NO: 220066 - DNA, 25 bp, Homo sapien
aaccactagacttggctctcaggaa

SEQ ID NO: 220067 - DNA, 25 bp, Homo sapien
actagacttggctctcaggaactct

SEQ ID NO: 220068 - DNA, 25 bp, Homo sapien
agacttggctctcaggaactctgct

SEQ ID NO: 220069 - DNA, 25 bp, Homo sapien
ttggctctcaggaactctgcttcct

SEQ ID NO: 220070 - DNA, 25 bp, Homo sapien
tggcccagcgctcgtgaccaaggat

SEQ ID NO: 220071 - DNA, 25 bp, Homo sapien
gcgctcgtgaccaaggatacaccaa

SEQ ID NO: 220072 - DNA, 25 bp, Homo sapien
ggatacaccaaagcccttaagacct

SEQ ID NO: 220073 - DNA, 25 bp, Homo sapien
acaccaaagcccttaagacctcagg

SEQ ID NO: 220074 - DNA, 25 bp, Homo sapien
ggtgctggggtcttctccaataaat

SEQ ID NO: 220075 - DNA, 25 bp, Homo sapien
aaaatgtaattcaagctggttagct

SEQ ID NO: 220076 - DNA, 25 bp, Homo sapien
attttgtgccattctttaacataag

SEQ ID NO: 220077 - DNA, 25 bp, Homo sapien
aaattgctgaggtttccttaggcag

SEQ ID NO: 220078 - DNA, 25 bp, Homo sapien
ggtttccttaggcagcttatttatt

SEQ ID NO: 220079 - DNA, 25 bp, Homo sapien
gactatctgagtaaatggttctttg

SEQ ID NO: 220080 - DNA, 25 bp, Homo sapien
aatggttctttgtggacctaggcag

SEQ ID NO: 220081 - DNA, 25 bp, Homo sapien
tggacctaggcagttcctgactgtt

SEQ ID NO: 220082 - DNA, 25 bp, Homo sapien
gactgttccacatgtagtacattgt

SEQ ID NO: 220083 - DNA, 25 bp, Homo sapien
agtacattgtaccaaagttcttaat

SEQ ID NO: 220084 - DNA, 25 bp, Homo sapien
attccccacaatcctgttctctaaa

SEQ ID NO: 220085 - DNA, 25 bp, Homo sapien
aatcctgttctctaaatgtcaaata

SEQ ID NO: 220086 - DNA, 25 bp, Homo sapien
gtgaatttgtgtttttagttatatc

SEQ ID NO: 220087 - DNA, 25 bp, Homo sapien
tagttatatccagaattgtttgtta

SEQ ID NO: 220088 - DNA, 25 bp, Homo sapien
ctataagcaatttatgcaactgtct

SEQ ID NO: 220089 - DNA, 25 bp, Homo sapien
gcaatttatgcaactgtcttactgt

SEQ ID NO: 220090 - DNA, 25 bp, Homo sapien
atttatgcaactgtcttactgttgt

SEQ ID NO: 220091 - DNA, 25 bp, Homo sapien
gcaactgtcttactgttgttggaca

SEQ ID NO: 220092 - DNA, 25 bp, Homo sapien
actgtcttactgttgttggacattc

SEQ ID NO: 220093 - DNA, 25 bp, Homo sapien
gtcttactgttgttggacattcaga

SEQ ID NO: 220094 - DNA, 25 bp, Homo sapien
gttggacattcagaagttttttcta

SEQ ID NO: 220095 - DNA, 25 bp, Homo sapien
ggacattcagaagttttttctaatt

SEQ ID NO: 220096 - DNA, 25 bp, Homo sapien
aataaagttttagtgagagtcgcaa

SEQ ID NO: 220097 - DNA, 25 bp, Homo sapien
gttggcagtagctgccgatgtctgt

SEQ ID NO: 220098 - DNA, 25 bp, Homo sapien
agtagctgccgatgtctgtccccag

SEQ ID NO: 220099 - DNA, 25 bp, Homo sapien
tggctgtgccatgctcgtggtttca

SEQ ID NO: 220100 - DNA, 25 bp, Homo sapien
atgctcgtggtttcagtgtccgtgt

SEQ ID NO: 220101 - DNA, 25 bp, Homo sapien
ttcagtgtccgtgtgtccatgtgtc

SEQ ID NO: 220102 - DNA, 25 bp, Homo sapien
tgcccttcaggagctcgcagctggt

SEQ ID NO: 220103 - DNA, 25 bp, Homo sapien
tcaggagctcgcagctggtgtgctt

SEQ ID NO: 220104 - DNA, 25 bp, Homo sapien
aggcctgtgtagtgtctctcccctg

SEQ ID NO: 220105 - DNA, 25 bp, Homo sapien
agcagcatgctgaggtgtccatgtt

SEQ ID NO: 220106 - DNA, 25 bp, Homo sapien
atgctgaggtgtccatgttgtctgc

SEQ ID NO: 220107 - DNA, 25 bp, Homo sapien
tgaggtgtccatgttgtctgccttt

SEQ ID NO: 220108 - DNA, 25 bp, Homo sapien
ggtggcctataacttacttgtcaac

SEQ ID NO: 220109 - DNA, 25 bp, Homo sapien
gaacattttgtgacattgcttcgct

SEQ ID NO: 220110 - DNA, 25 bp, Homo sapien
tgtgacattgcttcgctatggagaa

SEQ ID NO: 220111 - DNA, 25 bp, Homo sapien
agagcaggccaaccgagcgataagt

SEQ ID NO: 220112 - DNA, 25 bp, Homo sapien
aaccgagcgataagtaccgttgagt

SEQ ID NO: 220113 - DNA, 25 bp, Homo sapien
gtaccgttgagtttgtgacagctgc

SEQ ID NO: 220114 - DNA, 25 bp, Homo sapien
gctgctgttggtgtcttctcattcc

SEQ ID NO: 220115 - DNA, 25 bp, Homo sapien
tcattcctgggcttgtttccaaaag

SEQ ID NO: 220116 - DNA, 25 bp, Homo sapien
atacttattttcagtgcatcattac

SEQ ID NO: 220117 - DNA, 25 bp, Homo sapien
atcattactgttccagattcctatg

SEQ ID NO: 220118 - DNA, 25 bp, Homo sapien
tccagattcctatgatggatggcag

SEQ ID NO: 220119 - DNA, 25 bp, Homo sapien
gcaacagctgcaagctgtccagcag

SEQ ID NO: 220120 - DNA, 25 bp, Homo sapien
aacagctgcaagctgtccagcagct

SEQ ID NO: 220121 - DNA, 25 bp, Homo sapien
agcagcttcatcatcacccagaaca

SEQ ID NO: 220122 - DNA, 25 bp, Homo sapien
gggaagtacgggatctacaccaagg

SEQ ID NO: 220123 - DNA, 25 bp, Homo sapien
gaagtacgggatctacaccaaggtc

SEQ ID NO: 220124 - DNA, 25 bp, Homo sapien
aagtacgggatctacaccaaggtca

SEQ ID NO: 220125 - DNA, 25 bp, Homo sapien
agtacgggatctacaccaaggtcac

SEQ ID NO: 220126 - DNA, 25 bp, Homo sapien
gtacgggatctacaccaaggtcacc

SEQ ID NO: 220127 - DNA, 25 bp, Homo sapien
acgggatctacaccaaggtcaccgc

SEQ ID NO: 220128 - DNA, 25 bp, Homo sapien
gtccatgaaaaccaggggcttgccc

SEQ ID NO: 220129 - DNA, 25 bp, Homo sapien
gggcttgcccaaggccaagagccat

SEQ ID NO: 220130 - DNA, 25 bp, Homo sapien
tacgtgggaatgatcctcagtgtgc

SEQ ID NO: 220131 - DNA, 25 bp, Homo sapien
gaatgatcctcagtgtgctcacggg

SEQ ID NO: 220132 - DNA, 25 bp, Homo sapien
tgctgttcggcagcgatggctacta

SEQ ID NO: 220133 - DNA, 25 bp, Homo sapien
atggctactacgtggcgctggcctg

SEQ ID NO: 220134 - DNA, 25 bp, Homo sapien
tggcctggacctcatcggcgctcat

SEQ ID NO: 220135 - DNA, 25 bp, Homo sapien
acctcatcggcgctcatgtacttca

SEQ ID NO: 220136 - DNA, 25 bp, Homo sapien
atgtacttcattgtgcgctctttgc

SEQ ID NO: 220137 - DNA, 25 bp, Homo sapien
attgtgcgctctttgcggacagcag

SEQ ID NO: 220138 - DNA, 25 bp, Homo sapien
cgctctttgcggacagcagccctgg

SEQ ID NO: 220139 - DNA, 25 bp, Homo sapien
tctccagctctacctgactctggga

SEQ ID NO: 220140 - DNA, 25 bp, Homo sapien
cagcccctcatcatatactggctga

SEQ ID NO: 220141 - DNA, 25 bp, Homo sapien
gggacgacacgaggctctgttgtcc

SEQ ID NO: 220142 - DNA, 25 bp, Homo sapien
cacgaggctctgttgtcccgaggtg

SEQ ID NO: 220143 - DNA, 25 bp, Homo sapien
tgaagacactaagcctcagaccatg

SEQ ID NO: 220144 - DNA, 25 bp, Homo sapien
ctcagaccatggaacggtgacaaaa

SEQ ID NO: 220145 - DNA, 25 bp, Homo sapien
gtgacaaaagtttggccacttccct

SEQ ID NO: 220146 - DNA, 25 bp, Homo sapien
aagtttggccacttccctctcaaag

SEQ ID NO: 220147 - DNA, 25 bp, Homo sapien
tggccacttccctctcaaagactaa

SEQ ID NO: 220148 - DNA, 25 bp, Homo sapien
tccctctcaaagactaacccagaag

SEQ ID NO: 220149 - DNA, 25 bp, Homo sapien
tgtctcctttccctggcttatttca

SEQ ID NO: 220150 - DNA, 25 bp, Homo sapien
tcctttccctggcttatttcatcct

SEQ ID NO: 220151 - DNA, 25 bp, Homo sapien
cttatttcatcctggtcttggggta

SEQ ID NO: 220152 - DNA, 25 bp, Homo sapien
cccggcgcgtgtgtgtagagcctca

SEQ ID NO: 220153 - DNA, 25 bp, Homo sapien
gcccaataaaggtggcggcaaggct

SEQ ID NO: 220154 - DNA, 25 bp, Homo sapien
gaaccagcgggccgtgcccttcaat

SEQ ID NO: 220155 - DNA, 25 bp, Homo sapien
tgcccccaagtgagcccagaacttg

SEQ ID NO: 220156 - DNA, 25 bp, Homo sapien
agccagttcacccacgggtggtcca

SEQ ID NO: 220157 - DNA, 25 bp, Homo sapien
gggtggtccaggtcacgactctgca

SEQ ID NO: 220158 - DNA, 25 bp, Homo sapien
aggtcacgactctgcacgcccttag

SEQ ID NO: 220159 - DNA, 25 bp, Homo sapien
tctgcacgcccttaggccaggtcag

SEQ ID NO: 220160 - DNA, 25 bp, Homo sapien
gcccttaggccaggtcagctgcgag

SEQ ID NO: 220161 - DNA, 25 bp, Homo sapien
cagctgcgagggtcacagagcgttc

SEQ ID NO: 220162 - DNA, 25 bp, Homo sapien
agagggtccctgccccgagtgacac

SEQ ID NO: 220163 - DNA, 25 bp, Homo sapien
gaaaccctctaggtctctagaacac

SEQ ID NO: 220164 - DNA, 25 bp, Homo sapien
gaacactgaggacagtttcttttga

SEQ ID NO: 220165 - DNA, 25 bp, Homo sapien
tttgcacattaaaatgccctagcag

SEQ ID NO: 220166 - DNA, 25 bp, Homo sapien
aatgccctagcagtatctaattaaa

SEQ ID NO: 220167 - DNA, 25 bp, Homo sapien
gtatctaattaaaaaccatggtcag

SEQ ID NO: 220168 - DNA, 25 bp, Homo sapien
ccatggtcaggttcaattgtacttt

SEQ ID NO: 220169 - DNA, 25 bp, Homo sapien
gaactggagcgtgaattctgtaaaa

SEQ ID NO: 220170 - DNA, 25 bp, Homo sapien
gcagacactgttctatttaagtggt

SEQ ID NO: 220171 - DNA, 25 bp, Homo sapien
atgatggtgaatactttcttaacac

SEQ ID NO: 220172 - DNA, 25 bp, Homo sapien
ttcttaacactggtttgtctgcatg

SEQ ID NO: 220173 - DNA, 25 bp, Homo sapien
ggtttgtctgcatgtgtaaagattt

SEQ ID NO: 220174 - DNA, 25 bp, Homo sapien
tgagttccagcacgtcatctcccgt

SEQ ID NO: 220175 - DNA, 25 bp, Homo sapien
gtcatctcccgttctccagactttg

SEQ ID NO: 220176 - DNA, 25 bp, Homo sapien
agactttgccagctcctttaagatt

SEQ ID NO: 220177 - DNA, 25 bp, Homo sapien
agctcctttaagattgtcctgtgac

SEQ ID NO: 220178 - DNA, 25 bp, Homo sapien
agattgtcctgtgacagcagcccca

SEQ ID NO: 220179 - DNA, 25 bp, Homo sapien
ggcaccctgtccaagaacctttcta

SEQ ID NO: 220180 - DNA, 25 bp, Homo sapien
aagaacctttctactgctgagctgt

SEQ ID NO: 220181 - DNA, 25 bp, Homo sapien
tttctactgctgagctgtggccaag

SEQ ID NO: 220182 - DNA, 25 bp, Homo sapien
ctgtgttgccagtgcgggccaagct

SEQ ID NO: 220183 - DNA, 25 bp, Homo sapien
ggcggccctcgttgtcagggcctct

SEQ ID NO: 220184 - DNA, 25 bp, Homo sapien
tgctccgtttgtgtttgtactaatc

SEQ ID NO: 220185 - DNA, 25 bp, Homo sapien
ggcaaatgcccaccaggcgggactc

SEQ ID NO: 220186 - DNA, 25 bp, Homo sapien
caaatgcccaccaggcgggactcgg

SEQ ID NO: 220187 - DNA, 25 bp, Homo sapien
tcgccggttcaccaagaagcctggt

SEQ ID NO: 220188 - DNA, 25 bp, Homo sapien
gttcaccaagaagcctggtgtccag

SEQ ID NO: 220189 - DNA, 25 bp, Homo sapien
caagaagcctggtgtccagctgctc

SEQ ID NO: 220190 - DNA, 25 bp, Homo sapien
gaagcctggtgtccagctgctccca

SEQ ID NO: 220191 - DNA, 25 bp, Homo sapien
ctgtgagcccggcaggttccctgtc

SEQ ID NO: 220192 - DNA, 25 bp, Homo sapien
aggctgccggcattgtccctgccat

SEQ ID NO: 220193 - DNA, 25 bp, Homo sapien
agcggctgcgggagtgtagggctct

SEQ ID NO: 220194 - DNA, 25 bp, Homo sapien
gtagggctctgcgaggcagtgactg

SEQ ID NO: 220195 - DNA, 25 bp, Homo sapien
aggcggcggcaaatgcccaccaggc

SEQ ID NO: 220196 - DNA, 25 bp, Homo sapien
tacagtggtaagtgatcctctggat

SEQ ID NO: 220197 - DNA, 25 bp, Homo sapien
ggatatgcatatcttcaactgtggc

SEQ ID NO: 220198 - DNA, 25 bp, Homo sapien
caactgtggcagatcctggagtcag

SEQ ID NO: 220199 - DNA, 25 bp, Homo sapien
aagagctagacattgttagccctga

SEQ ID NO: 220200 - DNA, 25 bp, Homo sapien
acattgttagccctgaagatctggc

SEQ ID NO: 220201 - DNA, 25 bp, Homo sapien
gaagatctggctaccccaataggaa

SEQ ID NO: 220202 - DNA, 25 bp, Homo sapien
tggctaccccaataggaaggctgaa

SEQ ID NO: 220203 - DNA, 25 bp, Homo sapien
aaggctgaaggtttcccttcaagca

SEQ ID NO: 220204 - DNA, 25 bp, Homo sapien
gctgtcctccatgctatttacaagg

SEQ ID NO: 220205 - DNA, 25 bp, Homo sapien
gaacaagtgctattccaatctaaaa

SEQ ID NO: 220206 - DNA, 25 bp, Homo sapien
attccaatctaaaagtctctgaggg

SEQ ID NO: 220207 - DNA, 25 bp, Homo sapien
aagtttgccctcaacttctgtatcg

SEQ ID NO: 220208 - DNA, 25 bp, Homo sapien
tcaacttctgtatcgagcttcaggg

SEQ ID NO: 220209 - DNA, 25 bp, Homo sapien
ggagcaacttactcactgtactggc

SEQ ID NO: 220210 - DNA, 25 bp, Homo sapien
ttctacatgcgagccgaccaaagtg

SEQ ID NO: 220211 - DNA, 25 bp, Homo sapien
aaagtggcaccctgttggcagacag

SEQ ID NO: 220212 - DNA, 25 bp, Homo sapien
gcagacagtgaagacattaccagag

SEQ ID NO: 220213 - DNA, 25 bp, Homo sapien
gaattttaggtcaatgggatgtcac

SEQ ID NO: 220214 - DNA, 25 bp, Homo sapien
atgtcacctaccaaaatccaaatcc

SEQ ID NO: 220215 - DNA, 25 bp, Homo sapien
aaactactacactaaatggaccagg

SEQ ID NO: 220216 - DNA, 25 bp, Homo sapien
ccaggaacctcagagtcaagatcca

SEQ ID NO: 220217 - DNA, 25 bp, Homo sapien
atctgttacaacttttcctacccag

SEQ ID NO: 220218 - DNA, 25 bp, Homo sapien
gggaacgattataacttaaatgatt

SEQ ID NO: 220219 - DNA, 25 bp, Homo sapien
tccagggctttcagggaagcgccat

SEQ ID NO: 220220 - DNA, 25 bp, Homo sapien
agggctttcagggaagcgccatcca

SEQ ID NO: 220221 - DNA, 25 bp, Homo sapien
gctttcagggaagcgccatccattt

SEQ ID NO: 220222 - DNA, 25 bp, Homo sapien
cgccatccattttcaaagatgtcaa

SEQ ID NO: 220223 - DNA, 25 bp, Homo sapien
agatgtcaaacgtcacttcttcctg

SEQ ID NO: 220224 - DNA, 25 bp, Homo sapien
atgtcaaacgtcacttcttcctgta

SEQ ID NO: 220225 - DNA, 25 bp, Homo sapien
ttcttcctgtagggcccgagtcctg

SEQ ID NO: 220226 - DNA, 25 bp, Homo sapien
tgcctcctatcagggccagatcata

SEQ ID NO: 220227 - DNA, 25 bp, Homo sapien
gggccagatcatagaaggctatttt

SEQ ID NO: 220228 - DNA, 25 bp, Homo sapien
ggctattttctattctggggaacga

SEQ ID NO: 220229 - DNA, 25 bp, Homo sapien
aatcagccaattatgttaaactagc

SEQ ID NO: 220230 - DNA, 25 bp, Homo sapien
gttaaactagcatatctgcctttat

SEQ ID NO: 220231 - DNA, 25 bp, Homo sapien
atatctgcctttattgtgtttgtca

SEQ ID NO: 220232 - DNA, 25 bp, Homo sapien
tgtgtttgtcattagcctgagtaga

SEQ ID NO: 220233 - DNA, 25 bp, Homo sapien
cattagcctgagtagaaaggccttt

SEQ ID NO: 220234 - DNA, 25 bp, Homo sapien
gaatgcattttgtttggtattgtat

SEQ ID NO: 220235 - DNA, 25 bp, Homo sapien
gttgctaagccccagcaagcaatcc

SEQ ID NO: 220236 - DNA, 25 bp, Homo sapien
agccccagcaagcaatcctaggtag

SEQ ID NO: 220237 - DNA, 25 bp, Homo sapien
gcaagcaatcctaggtagggtttaa

SEQ ID NO: 220238 - DNA, 25 bp, Homo sapien
gtttaatccccagtaaaattgccat

SEQ ID NO: 220239 - DNA, 25 bp, Homo sapien
aaaattgccatattgcacatgtctt

SEQ ID NO: 220240 - DNA, 25 bp, Homo sapien
aatatgctgaaaacgctaaaagtat

SEQ ID NO: 220241 - DNA, 25 bp, Homo sapien
cgctaaaagtatacgtattggttct

SEQ ID NO: 220242 - DNA, 25 bp, Homo sapien
aaatcattattcatgatcatggcat

SEQ ID NO: 220243 - DNA, 25 bp, Homo sapien
tctttatttatgactgtcactgagt

SEQ ID NO: 220244 - DNA, 25 bp, Homo sapien
gacagacatgtctgaatgaagtaaa

SEQ ID NO: 220245 - DNA, 25 bp, Homo sapien
caatggaagacagtcgggatctttt

SEQ ID NO: 220246 - DNA, 25 bp, Homo sapien
gcttcatgcaaaaaacttggagtga

SEQ ID NO: 220247 - DNA, 25 bp, Homo sapien
cttggagtgaagtctcaatgataac

SEQ ID NO: 220248 - DNA, 25 bp, Homo sapien
gaagtctcaatgataactgggaaat

SEQ ID NO: 220249 - DNA, 25 bp, Homo sapien
tttttcttcctctttatctaactat

SEQ ID NO: 220250 - DNA, 25 bp, Homo sapien
actatattacacttatccatcaggt

SEQ ID NO: 220251 - DNA, 25 bp, Homo sapien
tccccatagcacgaggatgtgttgc

SEQ ID NO: 220252 - DNA, 25 bp, Homo sapien
ctgggcacggtgactgcggttattc

SEQ ID NO: 220253 - DNA, 25 bp, Homo sapien
tgactgcggttattcctggaggtcg

SEQ ID NO: 220254 - DNA, 25 bp, Homo sapien
ggaggtcggcagacatgccaacctt

SEQ ID NO: 220255 - DNA, 25 bp, Homo sapien
ccaaccttgggctatttgagctgga

SEQ ID NO: 220256 - DNA, 25 bp, Homo sapien
tatgtgatgctagccggtggctttc

SEQ ID NO: 220257 - DNA, 25 bp, Homo sapien
gggctaggccccagtttgaggctcc

SEQ ID NO: 220258 - DNA, 25 bp, Homo sapien
tttgaggctcccctgggaactagag

SEQ ID NO: 220259 - DNA, 25 bp, Homo sapien
gagtccaaggcgttattgggccacc

SEQ ID NO: 220260 - DNA, 25 bp, Homo sapien
gggccacctgacagctggacagaaa

SEQ ID NO: 220261 - DNA, 25 bp, Homo sapien
agacacaccgaggatgcgatttaaa

SEQ ID NO: 220262 - DNA, 25 bp, Homo sapien
gtgtggaagggcaagctgcaccaaa

SEQ ID NO: 220263 - DNA, 25 bp, Homo sapien
aagggcaagctgcaccaaagacggt

SEQ ID NO: 220264 - DNA, 25 bp, Homo sapien
aagacggtggatatagccaccgccc

SEQ ID NO: 220265 - DNA, 25 bp, Homo sapien
tgcttggccaattagttcagcctca

SEQ ID NO: 220266 - DNA, 25 bp, Homo sapien
ccaattagttcagcctcagaccatg

SEQ ID NO: 220267 - DNA, 25 bp, Homo sapien
gcctcagaccatggcactttgaggg

SEQ ID NO: 220268 - DNA, 25 bp, Homo sapien
agctggtgcttgctgcgattcctgt

SEQ ID NO: 220269 - DNA, 25 bp, Homo sapien
tgcgattcctgtgccttatgtaact

SEQ ID NO: 220270 - DNA, 25 bp, Homo sapien
gtgccttatgtaactgcccttcctt

SEQ ID NO: 220271 - DNA, 25 bp, Homo sapien
ttcccttgccctaggaaaaaggctg

SEQ ID NO: 220272 - DNA, 25 bp, Homo sapien
ggaaaaaggctgcatctttatatgt

SEQ ID NO: 220273 - DNA, 25 bp, Homo sapien
aactcacatgggtaaaaaagataca

SEQ ID NO: 220274 - DNA, 25 bp, Homo sapien
gtgacaaatgatacgtaagggacat

SEQ ID NO: 220275 - DNA, 25 bp, Homo sapien
caaatgatacgtaagggacatctat

SEQ ID NO: 220276 - DNA, 25 bp, Homo sapien
aatgatacgtaagggacatctattt

SEQ ID NO: 220277 - DNA, 25 bp, Homo sapien
tgatacgtaagggacatctatttgt

SEQ ID NO: 220278 - DNA, 25 bp, Homo sapien
gatacgtaagggacatctatttgtt

SEQ ID NO: 220279 - DNA, 25 bp, Homo sapien
tacgtaagggacatctatttgttgg

SEQ ID NO: 220280 - DNA, 25 bp, Homo sapien
cgtaagggacatctatttgttggga

SEQ ID NO: 220281 - DNA, 25 bp, Homo sapien
gtaagggacatctatttgttgggaa

SEQ ID NO: 220282 - DNA, 25 bp, Homo sapien
taagggacatctatttgttgggaaa

SEQ ID NO: 220283 - DNA, 25 bp, Homo sapien
ggacatctatttgttgggaaaaaat

SEQ ID NO: 220284 - DNA, 25 bp, Homo sapien
tatggacatctggttgctttggcct

SEQ ID NO: 220285 - DNA, 25 bp, Homo sapien
gggtcctaagcccacaatcatgcct

SEQ ID NO: 220286 - DNA, 25 bp, Homo sapien
aatcatgcctccctaagaccttggc

SEQ ID NO: 220287 - DNA, 25 bp, Homo sapien
tggcatccttccctctaagccgttg

SEQ ID NO: 220288 - DNA, 25 bp, Homo sapien
taagccgttggcacctctgtgccac

SEQ ID NO: 220289 - DNA, 25 bp, Homo sapien
actggctccagacacacagcctgtg

SEQ ID NO: 220290 - DNA, 25 bp, Homo sapien
cacagcctgtgcttttggagctgag

SEQ ID NO: 220291 - DNA, 25 bp, Homo sapien
ttggagctgagatcactcgcttcac

SEQ ID NO: 220292 - DNA, 25 bp, Homo sapien
ctcctcatctttgttctccaagtaa

SEQ ID NO: 220293 - DNA, 25 bp, Homo sapien
gttctccaagtaaagccacgaggtc

SEQ ID NO: 220294 - DNA, 25 bp, Homo sapien
agaggtgatcacctgcgtgtcccat

SEQ ID NO: 220295 - DNA, 25 bp, Homo sapien
tgaacatctctggaagttcctccgt

SEQ ID NO: 220296 - DNA, 25 bp, Homo sapien
aagttcctccgtctgatatgtgtat

SEQ ID NO: 220297 - DNA, 25 bp, Homo sapien
cctccgtctgatatgtgtattctga

SEQ ID NO: 220298 - DNA, 25 bp, Homo sapien
tgacataacagaatttcccaagact

SEQ ID NO: 220299 - DNA, 25 bp, Homo sapien
tttgaggaaggctgtccacgcttca

SEQ ID NO: 220300 - DNA, 25 bp, Homo sapien
tgtccacgcttcaggcaaagtttac

SEQ ID NO: 220301 - DNA, 25 bp, Homo sapien
caggcaaagtttacccattattatt

SEQ ID NO: 220302 - DNA, 25 bp, Homo sapien
gaatattccttgttcattacagtcc

SEQ ID NO: 220303 - DNA, 25 bp, Homo sapien
gaaaatctgcagaagttctccatgt

SEQ ID NO: 220304 - DNA, 25 bp, Homo sapien
gttctccatgttcagtggttgacca

SEQ ID NO: 220305 - DNA, 25 bp, Homo sapien
gtggttgaccagaatctgattgttg

SEQ ID NO: 220306 - DNA, 25 bp, Homo sapien
gtcttcttattcactggtccctaga

SEQ ID NO: 220307 - DNA, 25 bp, Homo sapien
gtccctagaccgcaccttctggtat

SEQ ID NO: 220308 - DNA, 25 bp, Homo sapien
cttctggtatcttctaaggcaattc

SEQ ID NO: 220309 - DNA, 25 bp, Homo sapien
taaggcaattctggtaccgcactgt

SEQ ID NO: 220310 - DNA, 25 bp, Homo sapien
agcctgatcacagcctcggtagtat

SEQ ID NO: 220311 - DNA, 25 bp, Homo sapien
ctggtaccgcactgtgtctgggttg

SEQ ID NO: 220312 - DNA, 25 bp, Homo sapien
gtctgggttggcctatttaaatgtc

SEQ ID NO: 220313 - DNA, 25 bp, Homo sapien
gccagctgttccaggatttcaatga

SEQ ID NO: 220314 - DNA, 25 bp, Homo sapien
atttcaatgagtttctcctcttcgg

SEQ ID NO: 220315 - DNA, 25 bp, Homo sapien
agtgtgtagaaactggcttccgatc

SEQ ID NO: 220316 - DNA, 25 bp, Homo sapien
tgaaataaaagttcccatcccttgt

SEQ ID NO: 220317 - DNA, 25 bp, Homo sapien
attcggggtgtctctgaatgccagc

SEQ ID NO: 220318 - DNA, 25 bp, Homo sapien
aatgccagcataaaaattcacggaa

SEQ ID NO: 220319 - DNA, 25 bp, Homo sapien
tagaaattggcctgtcttaatgacc

SEQ ID NO: 220320 - DNA, 25 bp, Homo sapien
tggcctgtcttaatgacctatggtt

SEQ ID NO: 220321 - DNA, 25 bp, Homo sapien
gtcttaatgacctatggtttctttt

SEQ ID NO: 220322 - DNA, 25 bp, Homo sapien
taaagagagtttagtcacacaggga

SEQ ID NO: 220323 - DNA, 25 bp, Homo sapien
gtatattactggacaaccttttaca

SEQ ID NO: 220324 - DNA, 25 bp, Homo sapien
ttactggacaaccttttacacattc

SEQ ID NO: 220325 - DNA, 25 bp, Homo sapien
tacacattcctctttctaaaatcga

SEQ ID NO: 220326 - DNA, 25 bp, Homo sapien
tcctctttctaaaatcgaattggac

SEQ ID NO: 220327 - DNA, 25 bp, Homo sapien
aattggacaattacagttctctggt

SEQ ID NO: 220328 - DNA, 25 bp, Homo sapien
tacttggtgataatgaaattctttt

SEQ ID NO: 220329 - DNA, 25 bp, Homo sapien
aaaaatctaaattcaagcagccagg

SEQ ID NO: 220330 - DNA, 25 bp, Homo sapien
aaatctaaattcaagcagccaggtg

SEQ ID NO: 220331 - DNA, 25 bp, Homo sapien
tctaaattcaagcagccaggtgcag

SEQ ID NO: 220332 - DNA, 25 bp, Homo sapien
ttaaccagtctcataacccggtcta

SEQ ID NO: 220333 - DNA, 25 bp, Homo sapien
taaccagtctcataacccggtctat

SEQ ID NO: 220334 - DNA, 25 bp, Homo sapien
aaccagtctcataacccggtctata

SEQ ID NO: 220335 - DNA, 25 bp, Homo sapien
accagtctcataacccggtctatag

SEQ ID NO: 220336 - DNA, 25 bp, Homo sapien
ccagtctcataacccggtctataga

SEQ ID NO: 220337 - DNA, 25 bp, Homo sapien
tctcataacccggtctatagattaa

SEQ ID NO: 220338 - DNA, 25 bp, Homo sapien
tcataacccggtctatagattaagg

SEQ ID NO: 220339 - DNA, 25 bp, Homo sapien
aagctacagttcttatccttggcct

SEQ ID NO: 220340 - DNA, 25 bp, Homo sapien
tctgtgcaaagccacaatgggtata

SEQ ID NO: 220341 - DNA, 25 bp, Homo sapien
ggcctcttgaagtattgattatcct

SEQ ID NO: 220342 - DNA, 25 bp, Homo sapien
gattatcctccagggctttatgatt

SEQ ID NO: 220343 - DNA, 25 bp, Homo sapien
catagggcctaataagaacctttct

SEQ ID NO: 220344 - DNA, 25 bp, Homo sapien
tttgtatataattctggcttttccc

SEQ ID NO: 220345 - DNA, 25 bp, Homo sapien
tggcttttcccagtacttgagtaaa

SEQ ID NO: 220346 - DNA, 25 bp, Homo sapien
acaatacggaagttcatttctctgc

SEQ ID NO: 220347 - DNA, 25 bp, Homo sapien
taatgtgcctttcagaagcctaaca

SEQ ID NO: 220348 - DNA, 25 bp, Homo sapien
aacaccgtccaacatcaaggtagag

SEQ ID NO: 220349 - DNA, 25 bp, Homo sapien
ggaaccgtccagatgcaagagataa

SEQ ID NO: 220350 - DNA, 25 bp, Homo sapien
cttttaagtggcacacgacacgtgt

SEQ ID NO: 220351 - DNA, 25 bp, Homo sapien
tgtgatcgtgacctcgtgtaaaccc

SEQ ID NO: 220352 - DNA, 25 bp, Homo sapien
cagcctgcccaaatgtaccaataat

SEQ ID NO: 220353 - DNA, 25 bp, Homo sapien
aagttaaatggtcacgagctagtta

SEQ ID NO: 220354 - DNA, 25 bp, Homo sapien
ttccatctctgaagtgtacttgcca

SEQ ID NO: 220355 - DNA, 25 bp, Homo sapien
tgaagtgtacttgccagtccactac

SEQ ID NO: 220356 - DNA, 25 bp, Homo sapien
tgtaccaataatcctgtcagtcaag

SEQ ID NO: 220357 - DNA, 25 bp, Homo sapien
aatcctgtcagtcaagatagtctaa

SEQ ID NO: 220358 - DNA, 25 bp, Homo sapien
gatagtctaacaaaagcaggcataa

SEQ ID NO: 220359 - DNA, 25 bp, Homo sapien
aggcataagtaaactcagactgctt

SEQ ID NO: 220360 - DNA, 25 bp, Homo sapien
cagactgctttgtgcttttaagtgg

SEQ ID NO: 220361 - DNA, 25 bp, Homo sapien
ttacaaacccacagaggccttcatt

SEQ ID NO: 220362 - DNA, 25 bp, Homo sapien
acagaggccttcatttctggcctgc

SEQ ID NO: 220363 - DNA, 25 bp, Homo sapien
gaagaagtgagggtccccgacccag

SEQ ID NO: 220364 - DNA, 25 bp, Homo sapien
aacggtggctcccacaggacaatcg

SEQ ID NO: 220365 - DNA, 25 bp, Homo sapien
acggtggctcccacaggacaatcgc

SEQ ID NO: 220366 - DNA, 25 bp, Homo sapien
caacctcgtagcaacagcaataccg

SEQ ID NO: 220367 - DNA, 25 bp, Homo sapien
acctcgtagcaacagcaataccggg

SEQ ID NO: 220368 - DNA, 25 bp, Homo sapien
tagcaacagcaataccgggggaccc

SEQ ID NO: 220369 - DNA, 25 bp, Homo sapien
gcctggtgccatgagcagggctcct

SEQ ID NO: 220370 - DNA, 25 bp, Homo sapien
ctggtgccatgagcagggctcctcg

SEQ ID NO: 220371 - DNA, 25 bp, Homo sapien
gtgccatgagcagggctcctcgtgc

SEQ ID NO: 220372 - DNA, 25 bp, Homo sapien
aacctgaaagcaagcaacaaaacat

SEQ ID NO: 220373 - DNA, 25 bp, Homo sapien
aaacatacactttgtcagagaagaa

SEQ ID NO: 220374 - DNA, 25 bp, Homo sapien
atggaaacatatcactcaaggggga

SEQ ID NO: 220375 - DNA, 25 bp, Homo sapien
gcttattcttctaaagccaccagca

SEQ ID NO: 220376 - DNA, 25 bp, Homo sapien
tattcttctaaagccaccagcaaat

SEQ ID NO: 220377 - DNA, 25 bp, Homo sapien
tcttctaaagccaccagcaaattgt

SEQ ID NO: 220378 - DNA, 25 bp, Homo sapien
taaagccaccagcaaattgtgccta

SEQ ID NO: 220379 - DNA, 25 bp, Homo sapien
aagccaccagcaaattgtgcctaag

SEQ ID NO: 220380 - DNA, 25 bp, Homo sapien
caccagcaaattgtgcctaagcgaa

SEQ ID NO: 220381 - DNA, 25 bp, Homo sapien
agcaaattgtgcctaagcgaaatat

SEQ ID NO: 220382 - DNA, 25 bp, Homo sapien
aattgtgcctaagcgaaatattttt

SEQ ID NO: 220383 - DNA, 25 bp, Homo sapien
ggtcaccctcagtccagccagtggg

SEQ ID NO: 220384 - DNA, 25 bp, Homo sapien
gaatgtttttccaagtccttccagt

SEQ ID NO: 220385 - DNA, 25 bp, Homo sapien
cagtctttttagaacgtggtggagg

SEQ ID NO: 220386 - DNA, 25 bp, Homo sapien
gaggagggttgtgtgtgccccaggg

SEQ ID NO: 220387 - DNA, 25 bp, Homo sapien
gcagggaggatcttagcatttgttg

SEQ ID NO: 220388 - DNA, 25 bp, Homo sapien
gaggatcttagcatttgttgttttc

SEQ ID NO: 220389 - DNA, 25 bp, Homo sapien
catttgttgttttctagtgcagggc

SEQ ID NO: 220390 - DNA, 25 bp, Homo sapien
tgttgttttctagtgcagggcttta

SEQ ID NO: 220391 - DNA, 25 bp, Homo sapien
gttttctagtgcagggctttagcca

SEQ ID NO: 220392 - DNA, 25 bp, Homo sapien
ctagtgcagggctttagccacaatt

SEQ ID NO: 220393 - DNA, 25 bp, Homo sapien
tgcagggctttagccacaattgtaa

SEQ ID NO: 220394 - DNA, 25 bp, Homo sapien
gtaccagccttcacaggataagagg

SEQ ID NO: 220395 - DNA, 25 bp, Homo sapien
aagtcagatgtaatgtgaccctaga

SEQ ID NO: 220396 - DNA, 25 bp, Homo sapien
gaccctagaaaactgtagcaagctt

SEQ ID NO: 220397 - DNA, 25 bp, Homo sapien
tttgatctttccctatcttgattag

SEQ ID NO: 220398 - DNA, 25 bp, Homo sapien
ttccctatcttgattagatccaaag

SEQ ID NO: 220399 - DNA, 25 bp, Homo sapien
gtcaaagcaaccatacttcacctag

SEQ ID NO: 220400 - DNA, 25 bp, Homo sapien
cacctagagaagacagtattggcaa

SEQ ID NO: 220401 - DNA, 25 bp, Homo sapien
gtattggcaatcatgacacctgtaa

SEQ ID NO: 220402 - DNA, 25 bp, Homo sapien
caagatacaaatgtgctgcctgcag

SEQ ID NO: 220403 - DNA, 25 bp, Homo sapien
aaatgtgctgcctgcagttagtcct

SEQ ID NO: 220404 - DNA, 25 bp, Homo sapien
gcctgcagttagtcctgcatgggaa

SEQ ID NO: 220405 - DNA, 25 bp, Homo sapien
gttatatcactgattttcttttctc

SEQ ID NO: 220406 - DNA, 25 bp, Homo sapien
ttctgaagctgttgtgaatgtccac

SEQ ID NO: 220407 - DNA, 25 bp, Homo sapien
gctgttgtgaatgtccactttgcca

SEQ ID NO: 220408 - DNA, 25 bp, Homo sapien
gtgaatgtccactttgccatgatta

SEQ ID NO: 220409 - DNA, 25 bp, Homo sapien
aatgtccactttgccatgattaaaa

SEQ ID NO: 220410 - DNA, 25 bp, Homo sapien
gaaccataaattttctcaaacatga

SEQ ID NO: 220411 - DNA, 25 bp, Homo sapien
tgatcatacatgagaatcccaaaag

SEQ ID NO: 220412 - DNA, 25 bp, Homo sapien
atgagaatcccaaaagtaaatactt

SEQ ID NO: 220413 - DNA, 25 bp, Homo sapien
gtaaatacttccaaaccatagaggg

SEQ ID NO: 220414 - DNA, 25 bp, Homo sapien
aaccatagagggataaccactgtat

SEQ ID NO: 220415 - DNA, 25 bp, Homo sapien
tagagggataaccactgtattttta

SEQ ID NO: 220416 - DNA, 25 bp, Homo sapien
gcagttctgaccaccttagtggtgt

SEQ ID NO: 220417 - DNA, 25 bp, Homo sapien
caccttagtggtgtactgttttcta

SEQ ID NO: 220418 - DNA, 25 bp, Homo sapien
agtggtgtactgttttctaggcaaa

SEQ ID NO: 220419 - DNA, 25 bp, Homo sapien
ctgtctgttgtactgtatagccttt

SEQ ID NO: 220420 - DNA, 25 bp, Homo sapien
tgttgtactgtatagcctttaaaat

SEQ ID NO: 220421 - DNA, 25 bp, Homo sapien
tccaggaatgagactcttttaagaa

SEQ ID NO: 220422 - DNA, 25 bp, Homo sapien
atcctgcttctgcaattccagagag

SEQ ID NO: 220423 - DNA, 25 bp, Homo sapien
gcttctgcaattccagagagtgctg

SEQ ID NO: 220424 - DNA, 25 bp, Homo sapien
tggagctgaatagcttttcttgttc

SEQ ID NO: 220425 - DNA, 25 bp, Homo sapien
gttcctggactaggcaatgaataag

SEQ ID NO: 220426 - DNA, 25 bp, Homo sapien
taagcaacaatgtatcttttctgtg

SEQ ID NO: 220427 - DNA, 25 bp, Homo sapien
aactcctgcgtaagaagatcgagaa

SEQ ID NO: 220428 - DNA, 25 bp, Homo sapien
gaagcggaacctcaaattgcggcag

SEQ ID NO: 220429 - DNA, 25 bp, Homo sapien
ttgcggcagcggaacctaaagtttc

SEQ ID NO: 220430 - DNA, 25 bp, Homo sapien
gggcctcaaatctgaccctatcgga

SEQ ID NO: 220431 - DNA, 25 bp, Homo sapien
gaccctatcggaaactcaaaatgga

SEQ ID NO: 220432 - DNA, 25 bp, Homo sapien
gcccatgaatgtgggcttatcagaa

SEQ ID NO: 220433 - DNA, 25 bp, Homo sapien
aactcaaaatggaggcatgtctcaa

SEQ ID NO: 220434 - DNA, 25 bp, Homo sapien
catgtctcaagaagcagtgggaaat

SEQ ID NO: 220435 - DNA, 25 bp, Homo sapien
tataaaagttacaaagtctccccag

SEQ ID NO: 220436 - DNA, 25 bp, Homo sapien
agcagcaatgcagtcttccaattca

SEQ ID NO: 220437 - DNA, 25 bp, Homo sapien
gcaatgcagtcttccaattcagaat

SEQ ID NO: 220438 - DNA, 25 bp, Homo sapien
gtttcaaaccctctggtctaagatt

SEQ ID NO: 220439 - DNA, 25 bp, Homo sapien
accctctggtctaagattattgaga

SEQ ID NO: 220440 - DNA, 25 bp, Homo sapien
ctcctccctcaaatatgttatctct

SEQ ID NO: 220441 - DNA, 25 bp, Homo sapien
cctccctcaaatatgttatctcttc

SEQ ID NO: 220442 - DNA, 25 bp, Homo sapien
ataagttattccatgcttttcagga

SEQ ID NO: 220443 - DNA, 25 bp, Homo sapien
tccatgcttttcaggaactgtaaaa

SEQ ID NO: 220444 - DNA, 25 bp, Homo sapien
aaagttttctctattctggacacaa

SEQ ID NO: 220445 - DNA, 25 bp, Homo sapien
ttctctattctggacacaaatgctt

SEQ ID NO: 220446 - DNA, 25 bp, Homo sapien
ctggacacaaatgcttccatttatt

SEQ ID NO: 220447 - DNA, 25 bp, Homo sapien
atatgtagtagtatctgctatgaga

SEQ ID NO: 220448 - DNA, 25 bp, Homo sapien
atctgctatgagatattcagtctct

SEQ ID NO: 220449 - DNA, 25 bp, Homo sapien
gaagaagtgagggtccccgacccag

SEQ ID NO: 220450 - DNA, 25 bp, Homo sapien
gaagtgagggtccccgacccaggag

SEQ ID NO: 220451 - DNA, 25 bp, Homo sapien
aacggtggctcccacaggacaatcg

SEQ ID NO: 220452 - DNA, 25 bp, Homo sapien
acggtggctcccacaggacaatcgc

SEQ ID NO: 220453 - DNA, 25 bp, Homo sapien
acaggacaatcgctgccccccaacc

SEQ ID NO: 220454 - DNA, 25 bp, Homo sapien
ctcgtagcaacagcaataccggggg

SEQ ID NO: 220455 - DNA, 25 bp, Homo sapien
tagcaacagcaataccgggggaccc

SEQ ID NO: 220456 - DNA, 25 bp, Homo sapien
gcctggtgccatgagcagggctcct

SEQ ID NO: 220457 - DNA, 25 bp, Homo sapien
cctggtgccatgagcagggctcctc

SEQ ID NO: 220458 - DNA, 25 bp, Homo sapien
ctggtgccatgagcagggctcctcg

SEQ ID NO: 220459 - DNA, 25 bp, Homo sapien
gtgccatgagcagggctcctcgtgc

SEQ ID NO: 220460 - DNA, 25 bp, Homo sapien
gtggttcatggatgttgataaggaa

SEQ ID NO: 220461 - DNA, 25 bp, Homo sapien
tcttagaaatgggcctatagtttag

SEQ ID NO: 220462 - DNA, 25 bp, Homo sapien
gtttgttttcagatggattttggtt

SEQ ID NO: 220463 - DNA, 25 bp, Homo sapien
agatggattttggttctgtgagcta

SEQ ID NO: 220464 - DNA, 25 bp, Homo sapien
tgcattaaagccttcgtcctcacac

SEQ ID NO: 220465 - DNA, 25 bp, Homo sapien
attaaagccttcgtcctcacacatt

SEQ ID NO: 220466 - DNA, 25 bp, Homo sapien
taaagccttcgtcctcacacattgt

SEQ ID NO: 220467 - DNA, 25 bp, Homo sapien
aagccttcgtcctcacacattgttt

SEQ ID NO: 220468 - DNA, 25 bp, Homo sapien
ccttcgtcctcacacattgttttga

SEQ ID NO: 220469 - DNA, 25 bp, Homo sapien
tcgtcctcacacattgttttgacat

SEQ ID NO: 220470 - DNA, 25 bp, Homo sapien
gtcctcacacattgttttgacatat

SEQ ID NO: 220471 - DNA, 25 bp, Homo sapien
ctggtgaaaaatagaccttggccta

SEQ ID NO: 220472 - DNA, 25 bp, Homo sapien
agaccttggcctaacagtgtgactc

SEQ ID NO: 220473 - DNA, 25 bp, Homo sapien
tggcctaacagtgtgactctctcca

SEQ ID NO: 220474 - DNA, 25 bp, Homo sapien
tctccaccgcctcagtgtagggaag

SEQ ID NO: 220475 - DNA, 25 bp, Homo sapien
ccgcctcagtgtagggaagggtcca

SEQ ID NO: 220476 - DNA, 25 bp, Homo sapien
gaattcttaggtcgagctgatgcaa

SEQ ID NO: 220477 - DNA, 25 bp, Homo sapien
gctgatgcaagaaactccggtagcc

SEQ ID NO: 220478 - DNA, 25 bp, Homo sapien
aactccggtagccagcctctgtgac

SEQ ID NO: 220479 - DNA, 25 bp, Homo sapien
gcctctgtgaccttgtacatgagtt

SEQ ID NO: 220480 - DNA, 25 bp, Homo sapien
accttgtacatgagtttggtgtgcc

SEQ ID NO: 220481 - DNA, 25 bp, Homo sapien
gagatctctttattacatggacatt

SEQ ID NO: 220482 - DNA, 25 bp, Homo sapien
agtctgcccagttctgcccgtggct

SEQ ID NO: 220483 - DNA, 25 bp, Homo sapien
cttgggtggcactgtcaaaggctct

SEQ ID NO: 220484 - DNA, 25 bp, Homo sapien
actgtcaaaggctctggaggtccca

SEQ ID NO: 220485 - DNA, 25 bp, Homo sapien
tcccagagggccaagggtctgaaga

SEQ ID NO: 220486 - DNA, 25 bp, Homo sapien
gccaagggtctgaagactcgggttt

SEQ ID NO: 220487 - DNA, 25 bp, Homo sapien
aagactcgggtttgaatgtagttga

SEQ ID NO: 220488 - DNA, 25 bp, Homo sapien
gagagattcttggagcaatgatgct

SEQ ID NO: 220489 - DNA, 25 bp, Homo sapien
gcaatgatgcttgttacggaaggaa

SEQ ID NO: 220490 - DNA, 25 bp, Homo sapien
aaaggtggcattagtctgggatgat

SEQ ID NO: 220491 - DNA, 25 bp, Homo sapien
ggagttttaaccatttgagtccatg

SEQ ID NO: 220492 - DNA, 25 bp, Homo sapien
ccatttgagtccatggtatgggaaa

SEQ ID NO: 220493 - DNA, 25 bp, Homo sapien
tcacgtgatttgagccccgttttta

SEQ ID NO: 220494 - DNA, 25 bp, Homo sapien
gtttttattttctgtgagccacgtc

SEQ ID NO: 220495 - DNA, 25 bp, Homo sapien
tttattttctgtgagccacgtcctc

SEQ ID NO: 220496 - DNA, 25 bp, Homo sapien
tgtgagccacgtcctcctcgagcgg

SEQ ID NO: 220497 - DNA, 25 bp, Homo sapien
caaaaggagtgatgcgcttcgcctg

SEQ ID NO: 220498 - DNA, 25 bp, Homo sapien
gagtgatgcgcttcgcctggaccgt

SEQ ID NO: 220499 - DNA, 25 bp, Homo sapien
tggaccgtgctcctgctcgggcctt

SEQ ID NO: 220500 - DNA, 25 bp, Homo sapien
ggcctttgcagctctgcgcgctagt

SEQ ID NO: 220501 - DNA, 25 bp, Homo sapien
agctctgcgcgctagtgcactgcgc

SEQ ID NO: 220502 - DNA, 25 bp, Homo sapien
gcgcctggcgccagcagatccaatg

SEQ ID NO: 220503 - DNA, 25 bp, Homo sapien
cgggcaggtgttcagcttgctgagc

SEQ ID NO: 220504 - DNA, 25 bp, Homo sapien
agggtcacacagtaaattaattgta

SEQ ID NO: 220505 - DNA, 25 bp, Homo sapien
ggtcacacagtaaattaattgtatc

SEQ ID NO: 220506 - DNA, 25 bp, Homo sapien
gtaaattaattgtatcttaaccatt

SEQ ID NO: 220507 - DNA, 25 bp, Homo sapien
ttgtatcttaaccattaaaaatgtc

SEQ ID NO: 220508 - DNA, 25 bp, Homo sapien
ttaaaaatgtcatatgaggccgggt

SEQ ID NO: 220509 - DNA, 25 bp, Homo sapien
taaaaatgtcatatgaggccgggtg

SEQ ID NO: 220510 - DNA, 25 bp, Homo sapien
gcagtgaaccgtaagcgagccactg

SEQ ID NO: 220511 - DNA, 25 bp, Homo sapien
agtgaaccgtaagcgagccactgta

SEQ ID NO: 220512 - DNA, 25 bp, Homo sapien
tgaaccgtaagcgagccactgtact

SEQ ID NO: 220513 - DNA, 25 bp, Homo sapien
gaaccgtaagcgagccactgtactc

SEQ ID NO: 220514 - DNA, 25 bp, Homo sapien
aaccgtaagcgagccactgtactcc

SEQ ID NO: 220515 - DNA, 25 bp, Homo sapien
gctgccaggccactgaggatgggca

SEQ ID NO: 220516 - DNA, 25 bp, Homo sapien
atgggcagggtctcttctcatcaag

SEQ ID NO: 220517 - DNA, 25 bp, Homo sapien
tcttctcatcaagccttgtaccagg

SEQ ID NO: 220518 - DNA, 25 bp, Homo sapien
tcatcaagccttgtaccaggcaaaa

SEQ ID NO: 220519 - DNA, 25 bp, Homo sapien
accaggcaaaagacaggccctgctt

SEQ ID NO: 220520 - DNA, 25 bp, Homo sapien
cctgcttggccgtggtcactggccg

SEQ ID NO: 220521 - DNA, 25 bp, Homo sapien
tcactggccgccaagatcagggcta

SEQ ID NO: 220522 - DNA, 25 bp, Homo sapien
ggccgccaagatcagggctacagat

SEQ ID NO: 220523 - DNA, 25 bp, Homo sapien
aggggcattttcattgcaagtcaaa

SEQ ID NO: 220524 - DNA, 25 bp, Homo sapien
gcaagacaggcttccataaagtccc

SEQ ID NO: 220525 - DNA, 25 bp, Homo sapien
caggcagcacagtagggcgccgggc

SEQ ID NO: 220526 - DNA, 25 bp, Homo sapien
ccacagttttatttcggtgacaaat

SEQ ID NO: 220527 - DNA, 25 bp, Homo sapien
tactaatttggatttcattgtgccc

SEQ ID NO: 220528 - DNA, 25 bp, Homo sapien
ataaatgcccctgcaatttctgatt

SEQ ID NO: 220529 - DNA, 25 bp, Homo sapien
aaatgcccctgcaatttctgatttt

SEQ ID NO: 220530 - DNA, 25 bp, Homo sapien
tctgattttcataacaattcataat

SEQ ID NO: 220531 - DNA, 25 bp, Homo sapien
ggatttcattgtgcccattgagcgg

SEQ ID NO: 220532 - DNA, 25 bp, Homo sapien
attgtgcccattgagcggcttttgt

SEQ ID NO: 220533 - DNA, 25 bp, Homo sapien
cattgagcggcttttgttctttggc

SEQ ID NO: 220534 - DNA, 25 bp, Homo sapien
tgagcggcttttgttctttggctgt

SEQ ID NO: 220535 - DNA, 25 bp, Homo sapien
tgttctttggctgtgagtttaatta

SEQ ID NO: 220536 - DNA, 25 bp, Homo sapien
ttagttatttatgagtgcatctggg

SEQ ID NO: 220537 - DNA, 25 bp, Homo sapien
caggagctcgaaaatgcatcaatta

SEQ ID NO: 220538 - DNA, 25 bp, Homo sapien
aaatgcatcaattaccagtgggtga

SEQ ID NO: 220539 - DNA, 25 bp, Homo sapien
ccagtgggtgaaatttgatgtgtgc

SEQ ID NO: 220540 - DNA, 25 bp, Homo sapien
ttgatgtgtgcaaacctggagatgg

SEQ ID NO: 220541 - DNA, 25 bp, Homo sapien
gcagctatgagctttgaagcctttc

SEQ ID NO: 220542 - DNA, 25 bp, Homo sapien
gatcagaatgatccccttctgccag

SEQ ID NO: 220543 - DNA, 25 bp, Homo sapien
aggatccttggacctcccagagctt

SEQ ID NO: 220544 - DNA, 25 bp, Homo sapien
ttgtgtcttcttaccagcccatgta

SEQ ID NO: 220545 - DNA, 25 bp, Homo sapien
cagctggagctgacttttttggatt

SEQ ID NO: 220546 - DNA, 25 bp, Homo sapien
gagctgacttttttggattttctca

SEQ ID NO: 220547 - DNA, 25 bp, Homo sapien
tttggattttctcatccagccatcc

SEQ ID NO: 220548 - DNA, 25 bp, Homo sapien
aaactgccagcaaactttctaactt

SEQ ID NO: 220549 - DNA, 25 bp, Homo sapien
gccagcaaactttctaacttgtatt

SEQ ID NO: 220550 - DNA, 25 bp, Homo sapien
aaaacttcggctttggacatgtcca

SEQ ID NO: 220551 - DNA, 25 bp, Homo sapien
tcggctttggacatgtccacattat

SEQ ID NO: 220552 - DNA, 25 bp, Homo sapien
atgtccacattatggactgtcatct

SEQ ID NO: 220553 - DNA, 25 bp, Homo sapien
taaaaaccttctgaggtattgatgt

SEQ ID NO: 220554 - DNA, 25 bp, Homo sapien
attgatgtagtccaccgtgtaaatg

SEQ ID NO: 220555 - DNA, 25 bp, Homo sapien
caccgtgtaaatgttaccttctctc

SEQ ID NO: 220556 - DNA, 25 bp, Homo sapien
tctccatgctgccattatgccaaaa

SEQ ID NO: 220557 - DNA, 25 bp, Homo sapien
tgctgccattatgccaaaacaaaag

SEQ ID NO: 220558 - DNA, 25 bp, Homo sapien
agtgcttgagagagtgtgttgataa

SEQ ID NO: 220559 - DNA, 25 bp, Homo sapien
ggcccaaggtggtgatgatttctct

SEQ ID NO: 220560 - DNA, 25 bp, Homo sapien
caaggtggtgatgatttctctgctc

SEQ ID NO: 220561 - DNA, 25 bp, Homo sapien
ggcagacagcaggacacatcctgga

SEQ ID NO: 220562 - DNA, 25 bp, Homo sapien
caggacacatcctggagacaaggtt

SEQ ID NO: 220563 - DNA, 25 bp, Homo sapien
gggagacaaacaggtgcccaggtca

SEQ ID NO: 220564 - DNA, 25 bp, Homo sapien
agacaaacaggtgcccaggtcaggg

SEQ ID NO: 220565 - DNA, 25 bp, Homo sapien
caggtcagggctgatcacagcagtt

SEQ ID NO: 220566 - DNA, 25 bp, Homo sapien
tcagggctgatcacagcagttacaa

SEQ ID NO: 220567 - DNA, 25 bp, Homo sapien
agcagttacaaaagcatcccgtgaa

SEQ ID NO: 220568 - DNA, 25 bp, Homo sapien
gttacaaaagcatcccgtgaagacg

SEQ ID NO: 220569 - DNA, 25 bp, Homo sapien
gcaagacggtgctggcaaaggaaca

SEQ ID NO: 220570 - DNA, 25 bp, Homo sapien
cttacacagatgaagtccactttcg

SEQ ID NO: 220571 - DNA, 25 bp, Homo sapien
gatgaagtccactttcgaaaagaag

SEQ ID NO: 220572 - DNA, 25 bp, Homo sapien
gtccactttcgaaaagaagatgcaa

SEQ ID NO: 220573 - DNA, 25 bp, Homo sapien
gatgcaaaggcagcatgaacttagt

SEQ ID NO: 220574 - DNA, 25 bp, Homo sapien
gcatgaacttagtgagagctgtagt

SEQ ID NO: 220575 - DNA, 25 bp, Homo sapien
gcaagtgcccttcaggcaagattga

SEQ ID NO: 220576 - DNA, 25 bp, Homo sapien
tgcccttcaggcaagattgaaagta

SEQ ID NO: 220577 - DNA, 25 bp, Homo sapien
gataatattgcagaagacttcttgg

SEQ ID NO: 220578 - DNA, 25 bp, Homo sapien
agatgattttctcagtagcttcatg

SEQ ID NO: 220579 - DNA, 25 bp, Homo sapien
gattttctcagtagcttcatggaaa

SEQ ID NO: 220580 - DNA, 25 bp, Homo sapien
cgatagcaatgcacagccaatttca

SEQ ID NO: 220581 - DNA, 25 bp, Homo sapien
gggagtgggctggttcttcccacca

SEQ ID NO: 220582 - DNA, 25 bp, Homo sapien
acttcccaggctctgacagccgaga

SEQ ID NO: 220583 - DNA, 25 bp, Homo sapien
tgacagccgagactcatttccaagg

SEQ ID NO: 220584 - DNA, 25 bp, Homo sapien
gagactcatttccaaggcacagcag

SEQ ID NO: 220585 - DNA, 25 bp, Homo sapien
ggcacagcagctttctaaagggact

SEQ ID NO: 220586 - DNA, 25 bp, Homo sapien
gctttctaaagggactgagtttgga

SEQ ID NO: 220587 - DNA, 25 bp, Homo sapien
tgagtttggactgggttttggacct

SEQ ID NO: 220588 - DNA, 25 bp, Homo sapien
ttggactgggttttggacctccagg

SEQ ID NO: 220589 - DNA, 25 bp, Homo sapien
gggctggagcttcatcacctgggca

SEQ ID NO: 220590 - DNA, 25 bp, Homo sapien
cacctgggcagtgtcttttctcaga

SEQ ID NO: 220591 - DNA, 25 bp, Homo sapien
ggcagtgtcttttctcagagagcag

SEQ ID NO: 220592 - DNA, 25 bp, Homo sapien
ttgccccttagaaagtagctgtagg

SEQ ID NO: 220593 - DNA, 25 bp, Homo sapien
tttccaattacagtctcagctctag

SEQ ID NO: 220594 - DNA, 25 bp, Homo sapien
gtatctctaattctttggttccctt

SEQ ID NO: 220595 - DNA, 25 bp, Homo sapien
aaatatattagcacctgccagccag

SEQ ID NO: 220596 - DNA, 25 bp, Homo sapien
cagtgtgggcagatcccaccgtgga

SEQ ID NO: 220597 - DNA, 25 bp, Homo sapien
atcccaccgtggagacatctgtagt

SEQ ID NO: 220598 - DNA, 25 bp, Homo sapien
atctgtagtgtgtatgtccttgtaa

SEQ ID NO: 220599 - DNA, 25 bp, Homo sapien
gtaacactctgttttcagggactac

SEQ ID NO: 220600 - DNA, 25 bp, Homo sapien
gactacaacctttttccttctgtga

SEQ ID NO: 220601 - DNA, 25 bp, Homo sapien
agccccggattcaggctgtactaat

SEQ ID NO: 220602 - DNA, 25 bp, Homo sapien
caggctgtactaataccaggtatat

SEQ ID NO: 220603 - DNA, 25 bp, Homo sapien
aatcctcggccagaaggtgtggctt

SEQ ID NO: 220604 - DNA, 25 bp, Homo sapien
cggccagaaggtgtggcttgttaaa

SEQ ID NO: 220605 - DNA, 25 bp, Homo sapien
gcttgttaaagcattgagattcaga

SEQ ID NO: 220606 - DNA, 25 bp, Homo sapien
tttgttttgccggtgtagataggca

SEQ ID NO: 220607 - DNA, 25 bp, Homo sapien
ccggtgtagataggcatgtatttat

SEQ ID NO: 220608 - DNA, 25 bp, Homo sapien
tacttaaaggtacttgggcagaatc

SEQ ID NO: 220609 - DNA, 25 bp, Homo sapien
aggtacttgggcagaatctaaagct

SEQ ID NO: 220610 - DNA, 25 bp, Homo sapien
gaatctaaagctgctacaatgtttg

SEQ ID NO: 220611 - DNA, 25 bp, Homo sapien
aagctgctacaatgtttgattatga

SEQ ID NO: 220612 - DNA, 25 bp, Homo sapien
ttcggtagtgtttcaaattgtcttc

SEQ ID NO: 220613 - DNA, 25 bp, Homo sapien
aattgtcttctgaacaggaatttaa

SEQ ID NO: 220614 - DNA, 25 bp, Homo sapien
actgatctgctttcacaataaccgt

SEQ ID NO: 220615 - DNA, 25 bp, Homo sapien
gatctgctttcacaataaccgtatg

SEQ ID NO: 220616 - DNA, 25 bp, Homo sapien
tctgctttcacaataaccgtatggg

SEQ ID NO: 220617 - DNA, 25 bp, Homo sapien
tgtgagcggtatttaattcctttgc

SEQ ID NO: 220618 - DNA, 25 bp, Homo sapien
agcggtatttaattcctttgctcta

SEQ ID NO: 220619 - DNA, 25 bp, Homo sapien
attcctttgctctaatatgtaatat

SEQ ID NO: 220620 - DNA, 25 bp, Homo sapien
gtaaaaataatctacacctcatgga

SEQ ID NO: 220621 - DNA, 25 bp, Homo sapien
aaataatctacacctcatggaaaga

SEQ ID NO: 220622 - DNA, 25 bp, Homo sapien
taatctacacctcatggaaagaatg

SEQ ID NO: 220623 - DNA, 25 bp, Homo sapien
tctacacctcatggaaagaatgaag

SEQ ID NO: 220624 - DNA, 25 bp, Homo sapien
gaagagccagaaatagattctattc

SEQ ID NO: 220625 - DNA, 25 bp, Homo sapien
taaaaaggtggccaacgccctgaag

SEQ ID NO: 220626 - DNA, 25 bp, Homo sapien
tggccaacgccctgaaggaacacca

SEQ ID NO: 220627 - DNA, 25 bp, Homo sapien
aacaccaggaaaccatcgtgcctgt

SEQ ID NO: 220628 - DNA, 25 bp, Homo sapien
aggaaaccatcgtgcctgtgaccta

SEQ ID NO: 220629 - DNA, 25 bp, Homo sapien
tgacctaccaactctcagaactgaa

SEQ ID NO: 220630 - DNA, 25 bp, Homo sapien
tcagaactgaatcagggcaggacgt

SEQ ID NO: 220631 - DNA, 25 bp, Homo sapien
gggtcctaacgagaagagataatta

SEQ ID NO: 220632 - DNA, 25 bp, Homo sapien
gctaccagaggaagcctttggtcct

SEQ ID NO: 220633 - DNA, 25 bp, Homo sapien
gaagcctttggtcctaacgagaaga

SEQ ID NO: 220634 - DNA, 25 bp, Homo sapien
ggctaccaaaggaagcactaacttt

SEQ ID NO: 220635 - DNA, 25 bp, Homo sapien
tggtgctttcaagttggcaaggagt

SEQ ID NO: 220636 - DNA, 25 bp, Homo sapien
gcagtatattttggtacctggtaca

SEQ ID NO: 220637 - DNA, 25 bp, Homo sapien
cagtatattttggtacctggtacag

SEQ ID NO: 220638 - DNA, 25 bp, Homo sapien
agtatattttggtacctggtacagt

SEQ ID NO: 220639 - DNA, 25 bp, Homo sapien
tattttggtacctggtacagtcaac

SEQ ID NO: 220640 - DNA, 25 bp, Homo sapien
ttggtacctggtacagtcaacgtgc

SEQ ID NO: 220641 - DNA, 25 bp, Homo sapien
ctgagtgttagggttccattaaagg

SEQ ID NO: 220642 - DNA, 25 bp, Homo sapien
tgagtgttagggttccattaaagga

SEQ ID NO: 220643 - DNA, 25 bp, Homo sapien
aaacaggatatcatgtacataatgc

SEQ ID NO: 220644 - DNA, 25 bp, Homo sapien
caggatatcatgtacataatgcatt

SEQ ID NO: 220645 - DNA, 25 bp, Homo sapien
gatatcatgtacataatgcatttga

SEQ ID NO: 220646 - DNA, 25 bp, Homo sapien
aatgcatttgatttagaagttgagt

SEQ ID NO: 220647 - DNA, 25 bp, Homo sapien
gtagcacaggagctgttctttgtaa

SEQ ID NO: 220648 - DNA, 25 bp, Homo sapien
agcacaggagctgttctttgtaagc

SEQ ID NO: 220649 - DNA, 25 bp, Homo sapien
gcacaggagctgttctttgtaagca

SEQ ID NO: 220650 - DNA, 25 bp, Homo sapien
cacaggagctgttctttgtaagcag

SEQ ID NO: 220651 - DNA, 25 bp, Homo sapien
acaggagctgttctttgtaagcagg

SEQ ID NO: 220652 - DNA, 25 bp, Homo sapien
caggagctgttctttgtaagcaggt

SEQ ID NO: 220653 - DNA, 25 bp, Homo sapien
aggagctgttctttgtaagcaggtt

SEQ ID NO: 220654 - DNA, 25 bp, Homo sapien
ggagctgttctttgtaagcaggttg

SEQ ID NO: 220655 - DNA, 25 bp, Homo sapien
gagctgttctttgtaagcaggttgt

SEQ ID NO: 220656 - DNA, 25 bp, Homo sapien
gctgttctttgtaagcaggttgtat

SEQ ID NO: 220657 - DNA, 25 bp, Homo sapien
tgttctttgtaagcaggttgtatgg

SEQ ID NO: 220658 - DNA, 25 bp, Homo sapien
aagagtgccgagctcttctggccca

SEQ ID NO: 220659 - DNA, 25 bp, Homo sapien
gaaactggagaactctcctggccat

SEQ ID NO: 220660 - DNA, 25 bp, Homo sapien
gagaactctcctggccatgggaagt

SEQ ID NO: 220661 - DNA, 25 bp, Homo sapien
tggccatgggaagtcgcctgaccac

SEQ ID NO: 220662 - DNA, 25 bp, Homo sapien
tgggaagtcgcctgaccacagaggc

SEQ ID NO: 220663 - DNA, 25 bp, Homo sapien
acagaggccgggtcagcagcttgct

SEQ ID NO: 220664 - DNA, 25 bp, Homo sapien
gcagcttgctgcacaagcccgagtt

SEQ ID NO: 220665 - DNA, 25 bp, Homo sapien
agcccgagttccctgatggagagat

SEQ ID NO: 220666 - DNA, 25 bp, Homo sapien
gatggaagtcctcatctaactgcca

SEQ ID NO: 220667 - DNA, 25 bp, Homo sapien
atctaactgccatccctgtggaatt

SEQ ID NO: 220668 - DNA, 25 bp, Homo sapien
gccatccctgtggaatttcagtaca

SEQ ID NO: 220669 - DNA, 25 bp, Homo sapien
aaagtggtacaccacttcttctggg

SEQ ID NO: 220670 - DNA, 25 bp, Homo sapien
ggagcagaaagcaaccttccgggta

SEQ ID NO: 220671 - DNA, 25 bp, Homo sapien
gaaagcaaccttccgggtacaggtg

SEQ ID NO: 220672 - DNA, 25 bp, Homo sapien
ttccgggtacaggtgagccaaggtt

SEQ ID NO: 220673 - DNA, 25 bp, Homo sapien
gccaaggttgatgggcagttatgca

SEQ ID NO: 220674 - DNA, 25 bp, Homo sapien
cagcagggctgtatgaaggtgttca

SEQ ID NO: 220675 - DNA, 25 bp, Homo sapien
aactactgatagtgtggcaggagct

SEQ ID NO: 220676 - DNA, 25 bp, Homo sapien
ggcaggagctagaaaacaccccttt

SEQ ID NO: 220677 - DNA, 25 bp, Homo sapien
gagctagaaaacacccctttcttct

SEQ ID NO: 220678 - DNA, 25 bp, Homo sapien
tttcttcttagatatccctccagca

SEQ ID NO: 220679 - DNA, 25 bp, Homo sapien
tccagcacctctactggcaaagttt

SEQ ID NO: 220680 - DNA, 25 bp, Homo sapien
gccaagagaagccatagggatactg

SEQ ID NO: 220681 - DNA, 25 bp, Homo sapien
gaagccatagggatactgtgacctt

SEQ ID NO: 220682 - DNA, 25 bp, Homo sapien
catagggatactgtgacctttgtct

SEQ ID NO: 220683 - DNA, 25 bp, Homo sapien
gtgacctttgtctagagttgatggg

SEQ ID NO: 220684 - DNA, 25 bp, Homo sapien
aataaaacaggaccgtactgcttgg

SEQ ID NO: 220685 - DNA, 25 bp, Homo sapien
aaaacaggaccgtactgcttggaag

SEQ ID NO: 220686 - DNA, 25 bp, Homo sapien
acaggaccgtactgcttggaagaag

SEQ ID NO: 220687 - DNA, 25 bp, Homo sapien
gaccgtactgcttggaagaaggaaa

SEQ ID NO: 220688 - DNA, 25 bp, Homo sapien
agaaggaaacggaagctgacataat

SEQ ID NO: 220689 - DNA, 25 bp, Homo sapien
agttgattgctgttgagatggtaac

SEQ ID NO: 220690 - DNA, 25 bp, Homo sapien
agatggtaacagatttgctcctaaa

SEQ ID NO: 220691 - DNA, 25 bp, Homo sapien
gctctgtaataagtcagtgcttctc

SEQ ID NO: 220692 - DNA, 25 bp, Homo sapien
ttttcttgaatttccaatttgccac

SEQ ID NO: 220693 - DNA, 25 bp, Homo sapien
tgaatttccaatttgccacagatca

SEQ ID NO: 220694 - DNA, 25 bp, Homo sapien
tttgccacagatcaatatttctgca

SEQ ID NO: 220695 - DNA, 25 bp, Homo sapien
gatcaatatttctgcaaagtacttt

SEQ ID NO: 220696 - DNA, 25 bp, Homo sapien
agttacttcctatgagcttttacag

SEQ ID NO: 220697 - DNA, 25 bp, Homo sapien
cttcctatgagcttttacagtgaca

SEQ ID NO: 220698 - DNA, 25 bp, Homo sapien
atgagcttttacagtgacaaatgaa

SEQ ID NO: 220699 - DNA, 25 bp, Homo sapien
ttcactgaacacttccctatttggc

SEQ ID NO: 220700 - DNA, 25 bp, Homo sapien
cactgaacacttccctatttggctg

SEQ ID NO: 220701 - DNA, 25 bp, Homo sapien
aggcagagctctgtaataagtcagt

SEQ ID NO: 220702 - DNA, 25 bp, Homo sapien
ggttgacaaatctgtgtgttatttc

SEQ ID NO: 220703 - DNA, 25 bp, Homo sapien
gtgttatttcttttctacctaccat

SEQ ID NO: 220704 - DNA, 25 bp, Homo sapien
gagtatcaaccgaggacatagtcaa

SEQ ID NO: 220705 - DNA, 25 bp, Homo sapien
gaggacatagtcaaaccttcgatga

SEQ ID NO: 220706 - DNA, 25 bp, Homo sapien
aaccttcgatgatgaacattcctga

SEQ ID NO: 220707 - DNA, 25 bp, Homo sapien
aacattcctgattttttgcctgatt

SEQ ID NO: 220708 - DNA, 25 bp, Homo sapien
ttgcctgattattctctgttgagct

SEQ ID NO: 220709 - DNA, 25 bp, Homo sapien
ctctgttgagctctacttgtggtca

SEQ ID NO: 220710 - DNA, 25 bp, Homo sapien
gggtgatgatagtctcaccactata

SEQ ID NO: 220711 - DNA, 25 bp, Homo sapien
gtctcaccactataaaactgtcaat

SEQ ID NO: 220712 - DNA, 25 bp, Homo sapien
gttaaagatatccatcattgtgatt

SEQ ID NO: 220713 - DNA, 25 bp, Homo sapien
gtgttccaagtgtttcttcctttct

SEQ ID NO: 220714 - DNA, 25 bp, Homo sapien
cctttcttttattgtagaagcactg

SEQ ID NO: 220715 - DNA, 25 bp, Homo sapien
ttgtagaagcactggatttattgag

SEQ ID NO: 220716 - DNA, 25 bp, Homo sapien
ataaacttaatatagcttgccagcc

SEQ ID NO: 220717 - DNA, 25 bp, Homo sapien
tatagcttgccagccataactttat

SEQ ID NO: 220718 - DNA, 25 bp, Homo sapien
tatattagaatagtttggcttgcct

SEQ ID NO: 220719 - DNA, 25 bp, Homo sapien
ctcttctctctaccaaaagcttgaa

SEQ ID NO: 220720 - DNA, 25 bp, Homo sapien
aaagcttgaacgtctctcagcattt

SEQ ID NO: 220721 - DNA, 25 bp, Homo sapien
cttgaacgtctctcagcatttttgg

SEQ ID NO: 220722 - DNA, 25 bp, Homo sapien
atacacattccaaaagcacttattc

SEQ ID NO: 220723 - DNA, 25 bp, Homo sapien
agcacttattcagcacttgctatgt

SEQ ID NO: 220724 - DNA, 25 bp, Homo sapien
gtagaaggcgatgttcttgggcacg

SEQ ID NO: 220725 - DNA, 25 bp, Homo sapien
agccgtagtgcagcgcacggtgtca

SEQ ID NO: 220726 - DNA, 25 bp, Homo sapien
gcacggtgtcaatgaaggtcttcca

SEQ ID NO: 220727 - DNA, 25 bp, Homo sapien
agcaccacggagttatgccgcatgc

SEQ ID NO: 220728 - DNA, 25 bp, Homo sapien
ggagttatgccgcatgcctcccagg

SEQ ID NO: 220729 - DNA, 25 bp, Homo sapien
gcctcccaggccacaggactggatg

SEQ ID NO: 220730 - DNA, 25 bp, Homo sapien
ggcagaagcatgagcatgccaccat

SEQ ID NO: 220731 - DNA, 25 bp, Homo sapien
tgagcatgccaccatcgtgcacgat

SEQ ID NO: 220732 - DNA, 25 bp, Homo sapien
gcacgatccaccacacgtctatgtg

SEQ ID NO: 220733 - DNA, 25 bp, Homo sapien
gtctatgtggccctccaggtagcgc

SEQ ID NO: 220734 - DNA, 25 bp, Homo sapien
gccctccaggtagcgctcgtggttg

SEQ ID NO: 220735 - DNA, 25 bp, Homo sapien
ccccagtgcaaatctctgtgttttg

SEQ ID NO: 220736 - DNA, 25 bp, Homo sapien
aaatctctgtgttttgctctctcct

SEQ ID NO: 220737 - DNA, 25 bp, Homo sapien
gttttgctctctcctgaacaaaaat

SEQ ID NO: 220738 - DNA, 25 bp, Homo sapien
tgctctctcctgaacaaaaatgtaa

SEQ ID NO: 220739 - DNA, 25 bp, Homo sapien
accgacgccggaaagcaaatggtat

SEQ ID NO: 220740 - DNA, 25 bp, Homo sapien
ggtatcgaatacctttcttgcccat

SEQ ID NO: 220741 - DNA, 25 bp, Homo sapien
gaatacctttcttgcccataagggt

SEQ ID NO: 220742 - DNA, 25 bp, Homo sapien
aagaacgtgtctcactaggaactag

SEQ ID NO: 220743 - DNA, 25 bp, Homo sapien
taggaactaggacactcatcggccc

SEQ ID NO: 220744 - DNA, 25 bp, Homo sapien
aactaggacactcatcggcccgaga

SEQ ID NO: 220745 - DNA, 25 bp, Homo sapien
gcccgagaccaactcctggataaaa

SEQ ID NO: 220746 - DNA, 25 bp, Homo sapien
gagaaacaaggctagaacacatcta

SEQ ID NO: 220747 - DNA, 25 bp, Homo sapien
ggctagaacacatctacatcctgaa

SEQ ID NO: 220748 - DNA, 25 bp, Homo sapien
acatcctgaagagccgtttataact

SEQ ID NO: 220749 - DNA, 25 bp, Homo sapien
ctgaagagccgtttataacttcata

SEQ ID NO: 220750 - DNA, 25 bp, Homo sapien
tttccttaaagttgagcaattgact

SEQ ID NO: 220751 - DNA, 25 bp, Homo sapien
gagcaattgacttttatggtccaat

SEQ ID NO: 220752 - DNA, 25 bp, Homo sapien
atggtccaatgatgaacttattatt

SEQ ID NO: 220753 - DNA, 25 bp, Homo sapien
gagttaactgtgaggcttctcatta

SEQ ID NO: 220754 - DNA, 25 bp, Homo sapien
acaatattgcagctatcagttggag

SEQ ID NO: 220755 - DNA, 25 bp, Homo sapien
attgcagctatcagttggagaatat

SEQ ID NO: 220756 - DNA, 25 bp, Homo sapien
gtattacttaatgcttctttacaga

SEQ ID NO: 220757 - DNA, 25 bp, Homo sapien
gaagccttcaccttccagcttttgt

SEQ ID NO: 220758 - DNA, 25 bp, Homo sapien
ttccagcttttgtctggcctgtgct

SEQ ID NO: 220759 - DNA, 25 bp, Homo sapien
gtgggagccactggtctgtgcacat

SEQ ID NO: 220760 - DNA, 25 bp, Homo sapien
tggtctgtgcacatccacggtgggt

SEQ ID NO: 220761 - DNA, 25 bp, Homo sapien
cacatccacggtgggtgagtggcca

SEQ ID NO: 220762 - DNA, 25 bp, Homo sapien
tgagtggccaagacaagcagtgtga

SEQ ID NO: 220763 - DNA, 25 bp, Homo sapien
aagcagtgtgatagagtccttggtg

SEQ ID NO: 220764 - DNA, 25 bp, Homo sapien
agtccttggtgggtttagtcatctc

SEQ ID NO: 220765 - DNA, 25 bp, Homo sapien
gggtttagtcatctcggaagtcgta

SEQ ID NO: 220766 - DNA, 25 bp, Homo sapien
atctcggaagtcgtagggcagctat

SEQ ID NO: 220767 - DNA, 25 bp, Homo sapien
ggcagctatggaaaccactgggttc

SEQ ID NO: 220768 - DNA, 25 bp, Homo sapien
cattcagtattagttgatgatttct

SEQ ID NO: 220769 - DNA, 25 bp, Homo sapien
tctgctattaagtgatgagaaagtc

SEQ ID NO: 220770 - DNA, 25 bp, Homo sapien
gagaaagtcagcagactagtcaaaa

SEQ ID NO: 220771 - DNA, 25 bp, Homo sapien
aattaacttagcatgcaacttaccg

SEQ ID NO: 220772 - DNA, 25 bp, Homo sapien
aaaactgccatatttaccagatgtt

SEQ ID NO: 220773 - DNA, 25 bp, Homo sapien
actgccatatttaccagatgttttc

SEQ ID NO: 220774 - DNA, 25 bp, Homo sapien
gccatatttaccagatgttttcttt

SEQ ID NO: 220775 - DNA, 25 bp, Homo sapien
cagatgttttctttaaccgaacttg

SEQ ID NO: 220776 - DNA, 25 bp, Homo sapien
tctttaaccgaacttgtctgtaaat

SEQ ID NO: 220777 - DNA, 25 bp, Homo sapien
ttaaccgaacttgtctgtaaatata

SEQ ID NO: 220778 - DNA, 25 bp, Homo sapien
gtataaaaagagtctaatttaccat

SEQ ID NO: 220779 - DNA, 25 bp, Homo sapien
tgaatagcacttgtctacactaaat

SEQ ID NO: 220780 - DNA, 25 bp, Homo sapien
tacactaaattgtctctcttccttt

SEQ ID NO: 220781 - DNA, 25 bp, Homo sapien
atcagcctcaggtagcacaggagct

SEQ ID NO: 220782 - DNA, 25 bp, Homo sapien
aggttgtatggatctgttctcaggt

SEQ ID NO: 220783 - DNA, 25 bp, Homo sapien
agaacttcagttccttagttgtgcc

SEQ ID NO: 220784 - DNA, 25 bp, Homo sapien
acttcagttccttagttgtgccagc

SEQ ID NO: 220785 - DNA, 25 bp, Homo sapien
ttcagttccttagttgtgccagctt

SEQ ID NO: 220786 - DNA, 25 bp, Homo sapien
gtgccagcttcatttcaattgctca

SEQ ID NO: 220787 - DNA, 25 bp, Homo sapien
gcttcatttcaattgctcagcagct

SEQ ID NO: 220788 - DNA, 25 bp, Homo sapien
atttcaattgctcagcagctgtctg

SEQ ID NO: 220789 - DNA, 25 bp, Homo sapien
aattgctcagcagctgtctgtggct

SEQ ID NO: 220790 - DNA, 25 bp, Homo sapien
aaattgtaatcttttctaacagaga

SEQ ID NO: 220791 - DNA, 25 bp, Homo sapien
gtattaatactgagccagactggca

SEQ ID NO: 220792 - DNA, 25 bp, Homo sapien
gagccagactggcatctacagattt

SEQ ID NO: 220793 - DNA, 25 bp, Homo sapien
gatttcagatctatcattttattga

SEQ ID NO: 220794 - DNA, 25 bp, Homo sapien
aaaactaggcaatatcatcatggat

SEQ ID NO: 220795 - DNA, 25 bp, Homo sapien
ggatacataggagaagacacattta

SEQ ID NO: 220796 - DNA, 25 bp, Homo sapien
gacacatttacaatcattcattggg

SEQ ID NO: 220797 - DNA, 25 bp, Homo sapien
ttcattgggccttttatctgtctat

SEQ ID NO: 220798 - DNA, 25 bp, Homo sapien
gccttttatctgtctatccatccat

SEQ ID NO: 220799 - DNA, 25 bp, Homo sapien
catccatcatcatttgaaggcctaa

SEQ ID NO: 220800 - DNA, 25 bp, Homo sapien
gccaagtactcacatggtatgcatt

SEQ ID NO: 220801 - DNA, 25 bp, Homo sapien
gtgctgtccgctgggtgaggcaggc

SEQ ID NO: 220802 - DNA, 25 bp, Homo sapien
tgcctccctctgtcagggaacctgg

SEQ ID NO: 220803 - DNA, 25 bp, Homo sapien
cactgcctgcacagaggaccctgac

SEQ ID NO: 220804 - DNA, 25 bp, Homo sapien
agaggaccctgaccctcggccagca

SEQ ID NO: 220805 - DNA, 25 bp, Homo sapien
gccccaggtccatgttgggcactag

SEQ ID NO: 220806 - DNA, 25 bp, Homo sapien
gcactagggcaggttccgtgccaga

SEQ ID NO: 220807 - DNA, 25 bp, Homo sapien
actagggcaggttccgtgccagagt

SEQ ID NO: 220808 - DNA, 25 bp, Homo sapien
cacacgagggcctggtgccggtgag

SEQ ID NO: 220809 - DNA, 25 bp, Homo sapien
ctgtccaccgtgtgggccgtgctgt

SEQ ID NO: 220810 - DNA, 25 bp, Homo sapien
gctgtgtccttatgtcattgtaata

SEQ ID NO: 220811 - DNA, 25 bp, Homo sapien
gtgtccttatgtcattgtaatataa

SEQ ID NO: 220812 - DNA, 25 bp, Homo sapien
ttgatacatgcacgaagtccctctg

SEQ ID NO: 220813 - DNA, 25 bp, Homo sapien
gccctactccctattcaaggatatt

SEQ ID NO: 220814 - DNA, 25 bp, Homo sapien
aggatattactcactgcacatcata

SEQ ID NO: 220815 - DNA, 25 bp, Homo sapien
ctgcacatcataaatctccatcatc

SEQ ID NO: 220816 - DNA, 25 bp, Homo sapien
aaatctccatcatctgtcttaaagt

SEQ ID NO: 220817 - DNA, 25 bp, Homo sapien
agttcatttattactgagctgtatt

SEQ ID NO: 220818 - DNA, 25 bp, Homo sapien
gctgtattactgtggagctctaaca

SEQ ID NO: 220819 - DNA, 25 bp, Homo sapien
gagctctaacagtatttgtttcctg

SEQ ID NO: 220820 - DNA, 25 bp, Homo sapien
ttgtttcctgatttcaaactcaatg

SEQ ID NO: 220821 - DNA, 25 bp, Homo sapien
aaactcaatgctacagagcactttg

SEQ ID NO: 220822 - DNA, 25 bp, Homo sapien
gagcactttgaatacatcacacctt

SEQ ID NO: 220823 - DNA, 25 bp, Homo sapien
cagcttcatttcaattgctcagcag

SEQ ID NO: 220824 - DNA, 25 bp, Homo sapien
agcttcatttcaattgctcagcagc

SEQ ID NO: 220825 - DNA, 25 bp, Homo sapien
gcttcatttcaattgctcagcagct

SEQ ID NO: 220826 - DNA, 25 bp, Homo sapien
cttcatttcaattgctcagcagctg

SEQ ID NO: 220827 - DNA, 25 bp, Homo sapien
tcatttcaattgctcagcagctgtc

SEQ ID NO: 220828 - DNA, 25 bp, Homo sapien
atttcaattgctcagcagctgtctg

SEQ ID NO: 220829 - DNA, 25 bp, Homo sapien
tttcaattgctcagcagctgtctgt

SEQ ID NO: 220830 - DNA, 25 bp, Homo sapien
ttcaattgctcagcagctgtctgtg

SEQ ID NO: 220831 - DNA, 25 bp, Homo sapien
tcaattgctcagcagctgtctgtgg

SEQ ID NO: 220832 - DNA, 25 bp, Homo sapien
caattgctcagcagctgtctgtggc

SEQ ID NO: 220833 - DNA, 25 bp, Homo sapien
aattgctcagcagctgtctgtggct

SEQ ID NO: 220834 - DNA, 25 bp, Homo sapien
gttttgctctctcctgaacaaaaat

SEQ ID NO: 220835 - DNA, 25 bp, Homo sapien
tgctctctcctgaacaaaaatgtaa

SEQ ID NO: 220836 - DNA, 25 bp, Homo sapien
accgacgccggaaagcaaatggtat

SEQ ID NO: 220837 - DNA, 25 bp, Homo sapien
ggtatcgaatacctttcttgcccat

SEQ ID NO: 220838 - DNA, 25 bp, Homo sapien
atcgaatacctttcttgcccataag

SEQ ID NO: 220839 - DNA, 25 bp, Homo sapien
gaatacctttcttgcccataagggt

SEQ ID NO: 220840 - DNA, 25 bp, Homo sapien
aaagaacgtgtctcactaggaacta

SEQ ID NO: 220841 - DNA, 25 bp, Homo sapien
gaacgtgtctcactaggaactagga

SEQ ID NO: 220842 - DNA, 25 bp, Homo sapien
taggaactaggacactcatcggccc

SEQ ID NO: 220843 - DNA, 25 bp, Homo sapien
aactaggacactcatcggcccgaga

SEQ ID NO: 220844 - DNA, 25 bp, Homo sapien
taggacactcatcggcccgagacca

SEQ ID NO: 220845 - DNA, 25 bp, Homo sapien
ctacttccttggtattggtatcctt

SEQ ID NO: 220846 - DNA, 25 bp, Homo sapien
ccttggtattggtatccttgataga

SEQ ID NO: 220847 - DNA, 25 bp, Homo sapien
attggtatccttgatagagggaata

SEQ ID NO: 220848 - DNA, 25 bp, Homo sapien
gagggaatataacatctggcagtaa

SEQ ID NO: 220849 - DNA, 25 bp, Homo sapien
aacatctggcagtaatctcattcag

SEQ ID NO: 220850 - DNA, 25 bp, Homo sapien
ggcagtaatctcattcaggttatac

SEQ ID NO: 220851 - DNA, 25 bp, Homo sapien
gtaatctcattcaggttatactacc

SEQ ID NO: 220852 - DNA, 25 bp, Homo sapien
gttatactacctgactaaatttaat

SEQ ID NO: 220853 - DNA, 25 bp, Homo sapien
ttgtttcctcagttggacctaagtt

SEQ ID NO: 220854 - DNA, 25 bp, Homo sapien
agttggacctaagttactgtatttg

SEQ ID NO: 220855 - DNA, 25 bp, Homo sapien
aaaaaccactcataacaattactgt

SEQ ID NO: 220856 - DNA, 25 bp, Homo sapien
tgtgaggagccgctgaggtgttcag

SEQ ID NO: 220857 - DNA, 25 bp, Homo sapien
tgctgcctggaggtcggtttcttcc

SEQ ID NO: 220858 - DNA, 25 bp, Homo sapien
ttcttcctgggtgttacgggcaact

SEQ ID NO: 220859 - DNA, 25 bp, Homo sapien
gtgttacgggcaactgctcacacag

SEQ ID NO: 220860 - DNA, 25 bp, Homo sapien
actgctcacacagttgtttctctgt

SEQ ID NO: 220861 - DNA, 25 bp, Homo sapien
tttccagtgtttaatccaaaatgaa

SEQ ID NO: 220862 - DNA, 25 bp, Homo sapien
aatgcttttgctaacttcagtgcct

SEQ ID NO: 220863 - DNA, 25 bp, Homo sapien
gctaacttcagtgccttttataaat

SEQ ID NO: 220864 - DNA, 25 bp, Homo sapien
gaacttgctttttgaggatatacag

SEQ ID NO: 220865 - DNA, 25 bp, Homo sapien
cagggatattaagtagacgcaggat

SEQ ID NO: 220866 - DNA, 25 bp, Homo sapien
aagtagacgcaggattgtttttgtt

SEQ ID NO: 220867 - DNA, 25 bp, Homo sapien
tcactgttctgcttgctataaaaga

SEQ ID NO: 220868 - DNA, 25 bp, Homo sapien
cactgttctgcttgctataaaagac

SEQ ID NO: 220869 - DNA, 25 bp, Homo sapien
actgttctgcttgctataaaagaca

SEQ ID NO: 220870 - DNA, 25 bp, Homo sapien
tgttctgcttgctataaaagacagc

SEQ ID NO: 220871 - DNA, 25 bp, Homo sapien
gcaatgagcaaataatactcctctg

SEQ ID NO: 220872 - DNA, 25 bp, Homo sapien
atgagcaaataatactcctctgttc

SEQ ID NO: 220873 - DNA, 25 bp, Homo sapien
gagcaaataatactcctctgttctc

SEQ ID NO: 220874 - DNA, 25 bp, Homo sapien
agcaaataatactcctctgttctca

SEQ ID NO: 220875 - DNA, 25 bp, Homo sapien
gcaaataatactcctctgttctcaa

SEQ ID NO: 220876 - DNA, 25 bp, Homo sapien
tcctctgttctcaagaagatcacat

SEQ ID NO: 220877 - DNA, 25 bp, Homo sapien
ctctgttctcaagaagatcacattt

SEQ ID NO: 220878 - DNA, 25 bp, Homo sapien
tggacttccaaccttgactgctgag

SEQ ID NO: 220879 - DNA, 25 bp, Homo sapien
gacttccaaccttgactgctgagct

SEQ ID NO: 220880 - DNA, 25 bp, Homo sapien
ggcttagcttcttgggttcctaatt

SEQ ID NO: 220881 - DNA, 25 bp, Homo sapien
tagcttcttgggttcctaattcctg

SEQ ID NO: 220882 - DNA, 25 bp, Homo sapien
ttcctaattcctggtgtttaataat

SEQ ID NO: 220883 - DNA, 25 bp, Homo sapien
gtttaataattctctccacgatcat

SEQ ID NO: 220884 - DNA, 25 bp, Homo sapien
aattctctccacgatcatgtttttc

SEQ ID NO: 220885 - DNA, 25 bp, Homo sapien
ctccacgatcatgtttttctgattt

SEQ ID NO: 220886 - DNA, 25 bp, Homo sapien
agaatatttaattactgagcagaag

SEQ ID NO: 220887 - DNA, 25 bp, Homo sapien
tactgttggtattttgtacataatc

SEQ ID NO: 220888 - DNA, 25 bp, Homo sapien
tatcaaaaattaagtcatctaccta

SEQ ID NO: 220889 - DNA, 25 bp, Homo sapien
ttaacgaaccgggtcgacatcacaa

SEQ ID NO: 220890 - DNA, 25 bp, Homo sapien
aaccgggtcgacatcacaaaggagg

SEQ ID NO: 220891 - DNA, 25 bp, Homo sapien
ggtggagactctttttactaacttg

SEQ ID NO: 220892 - DNA, 25 bp, Homo sapien
gagactctttttactaacttgaatg

SEQ ID NO: 220893 - DNA, 25 bp, Homo sapien
aaagcagtggtgtcagtttataatc

SEQ ID NO: 220894 - DNA, 25 bp, Homo sapien
gtgtcagtttataatcctgatgcat

SEQ ID NO: 220895 - DNA, 25 bp, Homo sapien
aaaagttccaacacacagccatgag

SEQ ID NO: 220896 - DNA, 25 bp, Homo sapien
gttccaacacacagccatgaggagc

SEQ ID NO: 220897 - DNA, 25 bp, Homo sapien
gtgcataataaaactactaaccaga

SEQ ID NO: 220898 - DNA, 25 bp, Homo sapien
actaaccagaggagtctatgccatt

SEQ ID NO: 220899 - DNA, 25 bp, Homo sapien
agaggagtctatgccattttaagaa

SEQ ID NO: 220900 - DNA, 25 bp, Homo sapien
ttgcagctaggaatagctttgtggc

SEQ ID NO: 220901 - DNA, 25 bp, Homo sapien
agctttgtggctaagttttgtcaaa

SEQ ID NO: 220902 - DNA, 25 bp, Homo sapien
atttttgctgccattcaggctgaca

SEQ ID NO: 220903 - DNA, 25 bp, Homo sapien
gaaaatgcttcccagtatccattct

SEQ ID NO: 220904 - DNA, 25 bp, Homo sapien
attcaggctgacacaggagtaaaca

SEQ ID NO: 220905 - DNA, 25 bp, Homo sapien
cacaggagtaaacatgccaggctat

SEQ ID NO: 220906 - DNA, 25 bp, Homo sapien
aacatgccaggctatgagaagggag

SEQ ID NO: 220907 - DNA, 25 bp, Homo sapien
ttacattcatcctcagtgttacaat

SEQ ID NO: 220908 - DNA, 25 bp, Homo sapien
atcctcagtgttacaatttctaaag

SEQ ID NO: 220909 - DNA, 25 bp, Homo sapien
ttaggtgtccattttctgattattg

SEQ ID NO: 220910 - DNA, 25 bp, Homo sapien
tctgattattgttgcagctaggaat

SEQ ID NO: 220911 - DNA, 25 bp, Homo sapien
tgctgtagcaactgccaaatgcctt

SEQ ID NO: 220912 - DNA, 25 bp, Homo sapien
actgccaaatgccttgcacagagga

SEQ ID NO: 220913 - DNA, 25 bp, Homo sapien
gggtgcccatgatattactctgcaa

SEQ ID NO: 220914 - DNA, 25 bp, Homo sapien
ttactctgcaagtgacattgccttc

SEQ ID NO: 220915 - DNA, 25 bp, Homo sapien
gtgacattgccttctagggctttaa

SEQ ID NO: 220916 - DNA, 25 bp, Homo sapien
tctagggctttaatctcccagaaag

SEQ ID NO: 220917 - DNA, 25 bp, Homo sapien
agatggaatatctcagtgcttctga

SEQ ID NO: 220918 - DNA, 25 bp, Homo sapien
agcattctgcagcttgatctataat

SEQ ID NO: 220919 - DNA, 25 bp, Homo sapien
gggccaaggactccctgtacctgtc

SEQ ID NO: 220920 - DNA, 25 bp, Homo sapien
tgtacctgtctcatctggagacgaa

SEQ ID NO: 220921 - DNA, 25 bp, Homo sapien
tggagacgaaactcacctgggacta

SEQ ID NO: 220922 - DNA, 25 bp, Homo sapien
aatacacatatgtcagactctttat

SEQ ID NO: 220923 - DNA, 25 bp, Homo sapien
ggtaaaagcacaaaacaggtcatct

SEQ ID NO: 220924 - DNA, 25 bp, Homo sapien
acaggtcatctttttgtggaaatgc

SEQ ID NO: 220925 - DNA, 25 bp, Homo sapien
ttatcttctgatttttgttcctaaa

SEQ ID NO: 220926 - DNA, 25 bp, Homo sapien
aatcccaagtgatgttgcctcattc

SEQ ID NO: 220927 - DNA, 25 bp, Homo sapien
aagtgatgttgcctcattccaagtc

SEQ ID NO: 220928 - DNA, 25 bp, Homo sapien
atgttgcctcattccaagtcagttt

SEQ ID NO: 220929 - DNA, 25 bp, Homo sapien
tccaagtcagttttgtagaccatgt

SEQ ID NO: 220930 - DNA, 25 bp, Homo sapien
gaagtaagtcttcctatggcatgtt

SEQ ID NO: 220931 - DNA, 25 bp, Homo sapien
aagtcttcctatggcatgttcaggc

SEQ ID NO: 220932 - DNA, 25 bp, Homo sapien
tatggcatgttcaggccctcctttt

SEQ ID NO: 220933 - DNA, 25 bp, Homo sapien
aggagatcctggactgcctgactcc

SEQ ID NO: 220934 - DNA, 25 bp, Homo sapien
gcctgggccccatggtagatgcaag

SEQ ID NO: 220935 - DNA, 25 bp, Homo sapien
cctgggccccatggtagatgcaagg

SEQ ID NO: 220936 - DNA, 25 bp, Homo sapien
ggccccatggtagatgcaagggaaa

SEQ ID NO: 220937 - DNA, 25 bp, Homo sapien
tagatgcaagggaaacctcaaggcc

SEQ ID NO: 220938 - DNA, 25 bp, Homo sapien
cgccctgggagtttgatctcttaag

SEQ ID NO: 220939 - DNA, 25 bp, Homo sapien
tgggagtttgatctcttaagggaac

SEQ ID NO: 220940 - DNA, 25 bp, Homo sapien
gtttgatctcttaagggaacttgcc

SEQ ID NO: 220941 - DNA, 25 bp, Homo sapien
gatctcttaagggaacttgcctctc

SEQ ID NO: 220942 - DNA, 25 bp, Homo sapien
atctcttaagggaacttgcctctcc

SEQ ID NO: 220943 - DNA, 25 bp, Homo sapien
cttaagggaacttgcctctccctct

SEQ ID NO: 220944 - DNA, 25 bp, Homo sapien
gggaccaagccggaacctcctgctc

SEQ ID NO: 220945 - DNA, 25 bp, Homo sapien
gaacctcctgctcaacgggaagtcc

SEQ ID NO: 220946 - DNA, 25 bp, Homo sapien
acctcctgctcaacgggaagtccta

SEQ ID NO: 220947 - DNA, 25 bp, Homo sapien
tgctcaacgggaagtcctaccccac

SEQ ID NO: 220948 - DNA, 25 bp, Homo sapien
cctaccccaccaaagtgcgcctgat

SEQ ID NO: 220949 - DNA, 25 bp, Homo sapien
aagatccgcaagctgctctcatcct

SEQ ID NO: 220950 - DNA, 25 bp, Homo sapien
gcaagctgctctcatcctcggaaac

SEQ ID NO: 220951 - DNA, 25 bp, Homo sapien
gctgctctcatcctcggaaaccaag

SEQ ID NO: 220952 - DNA, 25 bp, Homo sapien
tcatcctcggaaaccaagcgtgctg

SEQ ID NO: 220953 - DNA, 25 bp, Homo sapien
atcctcggaaaccaagcgtgctgcc

SEQ ID NO: 220954 - DNA, 25 bp, Homo sapien
ggaaaccaagcgtgctgcccgccgg

SEQ ID NO: 220955 - DNA, 25 bp, Homo sapien
agggtcacacagtaaattaattgta

SEQ ID NO: 220956 - DNA, 25 bp, Homo sapien
ggtcacacagtaaattaattgtatc

SEQ ID NO: 220957 - DNA, 25 bp, Homo sapien
gtaaattaattgtatcttaaccatt

SEQ ID NO: 220958 - DNA, 25 bp, Homo sapien
ttgtatcttaaccattaaaaatgtc

SEQ ID NO: 220959 - DNA, 25 bp, Homo sapien
ttaaaaatgtcatatgaggccgggt

SEQ ID NO: 220960 - DNA, 25 bp, Homo sapien
taaaaatgtcatatgaggccgggtg

SEQ ID NO: 220961 - DNA, 25 bp, Homo sapien
aatgtcatatgaggccgggtgtagt

SEQ ID NO: 220962 - DNA, 25 bp, Homo sapien
agcctgcagtgaaccgtaagcgagc

SEQ ID NO: 220963 - DNA, 25 bp, Homo sapien
agtgaaccgtaagcgagccactgta

SEQ ID NO: 220964 - DNA, 25 bp, Homo sapien
tgaaccgtaagcgagccactgtact

SEQ ID NO: 220965 - DNA, 25 bp, Homo sapien
gaaccgtaagcgagccactgtactc

SEQ ID NO: 220966 - DNA, 25 bp, Homo sapien
ttccaaatttaagtcagtacagttc

SEQ ID NO: 220967 - DNA, 25 bp, Homo sapien
atttaagtcagtacagttctgtatt

SEQ ID NO: 220968 - DNA, 25 bp, Homo sapien
gtacagttctgtatttgtaaattct

SEQ ID NO: 220969 - DNA, 25 bp, Homo sapien
ctgtctttcaaaaagttgttcgtgt

SEQ ID NO: 220970 - DNA, 25 bp, Homo sapien
gatgtccaaaggaaaggagcttctt

SEQ ID NO: 220971 - DNA, 25 bp, Homo sapien
tcttttaagtacttttggtgtatgt

SEQ ID NO: 220972 - DNA, 25 bp, Homo sapien
aagtacttttggtgtatgttgaata

SEQ ID NO: 220973 - DNA, 25 bp, Homo sapien
ttatttgctatgatattctagaaga

SEQ ID NO: 220974 - DNA, 25 bp, Homo sapien
caaaagttactgaagatgtcttgga

SEQ ID NO: 220975 - DNA, 25 bp, Homo sapien
gtcttggaataacaattgtcatgct

SEQ ID NO: 220976 - DNA, 25 bp, Homo sapien
aaaagcaccatggagaaacatttta

SEQ ID NO: 220977 - DNA, 25 bp, Homo sapien
tcatgttccagctctctacagggcc

SEQ ID NO: 220978 - DNA, 25 bp, Homo sapien
tctacagggccacatactcttctgg

SEQ ID NO: 220979 - DNA, 25 bp, Homo sapien
atactcttctggcatatctctcctg

SEQ ID NO: 220980 - DNA, 25 bp, Homo sapien
ttctggcatatctctcctgtctctt

SEQ ID NO: 220981 - DNA, 25 bp, Homo sapien
tcttccactgctctctatgttttaa

SEQ ID NO: 220982 - DNA, 25 bp, Homo sapien
ggtagaagtcttgggatcttgccat

SEQ ID NO: 220983 - DNA, 25 bp, Homo sapien
gggatcttgccatgggacagagtcc

SEQ ID NO: 220984 - DNA, 25 bp, Homo sapien
gacagagtccccaaggttcctgttg

SEQ ID NO: 220985 - DNA, 25 bp, Homo sapien
tccttcctaagcctcatatgtatat

SEQ ID NO: 220986 - DNA, 25 bp, Homo sapien
gcctcatatgtatatatcagttcag

SEQ ID NO: 220987 - DNA, 25 bp, Homo sapien
ttgaactttaggtccttcctcttct

SEQ ID NO: 220988 - DNA, 25 bp, Homo sapien
tgctaatcccagtcatgagggcaga

SEQ ID NO: 220989 - DNA, 25 bp, Homo sapien
agggcagagtctcccgtaaggctta

SEQ ID NO: 220990 - DNA, 25 bp, Homo sapien
gtaaggcttaacctcctaatgccat

SEQ ID NO: 220991 - DNA, 25 bp, Homo sapien
tcctaatgccatcaccttgagggtt

SEQ ID NO: 220992 - DNA, 25 bp, Homo sapien
gaaggcctgctttctcatagaggct

SEQ ID NO: 220993 - DNA, 25 bp, Homo sapien
aacgttcattccatagcaccagggt

SEQ ID NO: 220994 - DNA, 25 bp, Homo sapien
gtctcctcatgtcaaggtctttacc

SEQ ID NO: 220995 - DNA, 25 bp, Homo sapien
cacatgcatgatgtaccgttttcat

SEQ ID NO: 220996 - DNA, 25 bp, Homo sapien
catagaggcttccttcttgctgtgt

SEQ ID NO: 220997 - DNA, 25 bp, Homo sapien
cttgctgtgtcttcgcatggtgaga

SEQ ID NO: 220998 - DNA, 25 bp, Homo sapien
gagaggaacaaacaagctcccttgt

SEQ ID NO: 220999 - DNA, 25 bp, Homo sapien
aatgtcagccaggatcgctaaaatg

SEQ ID NO: 221000 - DNA, 25 bp, Homo sapien
tcgctaaaatgtccttgagtcccag

SEQ ID NO: 221001 - DNA, 25 bp, Homo sapien
aggatcagctcgaggtcaccaggga

SEQ ID NO: 221002 - DNA, 25 bp, Homo sapien
agaggagccatcaaaactcgatcag

SEQ ID NO: 221003 - DNA, 25 bp, Homo sapien
actcgatcaggatgttttggccgct

SEQ ID NO: 221004 - DNA, 25 bp, Homo sapien
ttttggccgctcttgaatgtgcaga

SEQ ID NO: 221005 - DNA, 25 bp, Homo sapien
tcttgaatgtgcagacgtcgacccc

SEQ ID NO: 221006 - DNA, 25 bp, Homo sapien
agttcccggccgtgcacagatggaa

SEQ ID NO: 221007 - DNA, 25 bp, Homo sapien
cagatggaagagtgctgtcctgtgc

SEQ ID NO: 221008 - DNA, 25 bp, Homo sapien
ccctcggacagacagagttggccca

SEQ ID NO: 221009 - DNA, 25 bp, Homo sapien
gagttggcccagtcccgcggtgaaa

SEQ ID NO: 221010 - DNA, 25 bp, Homo sapien
tttcgttagttgtcattttattttg

SEQ ID NO: 221011 - DNA, 25 bp, Homo sapien
tttattttgtactatgctggtaaac

SEQ ID NO: 221012 - DNA, 25 bp, Homo sapien
actatgctggtaaactaattgtggt

SEQ ID NO: 221013 - DNA, 25 bp, Homo sapien
tttagaatagttttatgttcactcc

SEQ ID NO: 221014 - DNA, 25 bp, Homo sapien
tttatgttcactcctgataactgag

SEQ ID NO: 221015 - DNA, 25 bp, Homo sapien
atgttcactcctgataactgagaaa

SEQ ID NO: 221016 - DNA, 25 bp, Homo sapien
acattgctaaatggataaacctcat

SEQ ID NO: 221017 - DNA, 25 bp, Homo sapien
aatggataaacctcatattcaataa

SEQ ID NO: 221018 - DNA, 25 bp, Homo sapien
acttgactgattgcgtaaatcgtgt

SEQ ID NO: 221019 - DNA, 25 bp, Homo sapien
attgcgtaaatcgtgttaaaacatt

SEQ ID NO: 221020 - DNA, 25 bp, Homo sapien
gcttataaaagtctaacttcaccca

SEQ ID NO: 221021 - DNA, 25 bp, Homo sapien
tcctggccccttagtgtctggaatg

SEQ ID NO: 221022 - DNA, 25 bp, Homo sapien
cctggccccttagtgtctggaatgt

SEQ ID NO: 221023 - DNA, 25 bp, Homo sapien
gtgtctggaatgtggccttccacgg

SEQ ID NO: 221024 - DNA, 25 bp, Homo sapien
tggaatgtggccttccacggttgcc

SEQ ID NO: 221025 - DNA, 25 bp, Homo sapien
aatgtggccttccacggttgcccca

SEQ ID NO: 221026 - DNA, 25 bp, Homo sapien
accactgggttctggaacgttccag

SEQ ID NO: 221027 - DNA, 25 bp, Homo sapien
actgggttctggaacgttccagcca

SEQ ID NO: 221028 - DNA, 25 bp, Homo sapien
gttctggaacgttccagccaggcag

SEQ ID NO: 221029 - DNA, 25 bp, Homo sapien
tggaacgttccagccaggcagtggt

SEQ ID NO: 221030 - DNA, 25 bp, Homo sapien
aacgttccagccaggcagtggttgt

SEQ ID NO: 221031 - DNA, 25 bp, Homo sapien
ttccagccaggcagtggttgttcct

SEQ ID NO: 221032 - DNA, 25 bp, Homo sapien
aattgtgccctaagtcaggtacaaa

SEQ ID NO: 221033 - DNA, 25 bp, Homo sapien
aatgtacacatcaaaatgcccatat

SEQ ID NO: 221034 - DNA, 25 bp, Homo sapien
atgcccatattgtatctatctgtag

SEQ ID NO: 221035 - DNA, 25 bp, Homo sapien
atctatctgtagtcgtttaatgtga

SEQ ID NO: 221036 - DNA, 25 bp, Homo sapien
accagaattctgttataggcaccta

SEQ ID NO: 221037 - DNA, 25 bp, Homo sapien
taggcacctaaccacgcagcatgag

SEQ ID NO: 221038 - DNA, 25 bp, Homo sapien
taaccacgcagcatgaggaaaacgg

SEQ ID NO: 221039 - DNA, 25 bp, Homo sapien
gaggaaaacggcacaacacaatctt

SEQ ID NO: 221040 - DNA, 25 bp, Homo sapien
aacacaatcttgaggtgccttctga

SEQ ID NO: 221041 - DNA, 25 bp, Homo sapien
atcttgaggtgccttctgaatcatc

SEQ ID NO: 221042 - DNA, 25 bp, Homo sapien
attatgcttcatatgtttttgcttt

SEQ ID NO: 221043 - DNA, 25 bp, Homo sapien
tcgcaagctactgaccgtactcggg

SEQ ID NO: 221044 - DNA, 25 bp, Homo sapien
tactgaccgtactcgggcgtattag

SEQ ID NO: 221045 - DNA, 25 bp, Homo sapien
tactcgggcgtattaggagccgcgt

SEQ ID NO: 221046 - DNA, 25 bp, Homo sapien
ggcgtattaggagccgcgttccagc

SEQ ID NO: 221047 - DNA, 25 bp, Homo sapien
ttaggagccgcgttccagcctcaca

SEQ ID NO: 221048 - DNA, 25 bp, Homo sapien
cacggtgctgttttcgacttcagaa

SEQ ID NO: 221049 - DNA, 25 bp, Homo sapien
gttttcgacttcagaaaggatctag

SEQ ID NO: 221050 - DNA, 25 bp, Homo sapien
agaagcgcctcaggcgcggcgcaaa

SEQ ID NO: 221051 - DNA, 25 bp, Homo sapien
aggcgcggcgcaaagctcgagcgga

SEQ ID NO: 221052 - DNA, 25 bp, Homo sapien
ggaagaacccccctgacgcgactgg

SEQ ID NO: 221053 - DNA, 25 bp, Homo sapien
gacgcgactggcgtgtgcttctgcc

SEQ ID NO: 221054 - DNA, 25 bp, Homo sapien
acagagactttcagggcatacgtgg

SEQ ID NO: 221055 - DNA, 25 bp, Homo sapien
tcactcgctcgatggcctcagtgtg

SEQ ID NO: 221056 - DNA, 25 bp, Homo sapien
tcagtgtgctcctcaaggctggtgc

SEQ ID NO: 221057 - DNA, 25 bp, Homo sapien
aaggctggtgccaaacacctgctgg

SEQ ID NO: 221058 - DNA, 25 bp, Homo sapien
aaacacctgctggagatagctgagc

SEQ ID NO: 221059 - DNA, 25 bp, Homo sapien
tggtcagggcccatggtacccgcgc

SEQ ID NO: 221060 - DNA, 25 bp, Homo sapien
gtacccgcgcggtaaagcaccgtgt

SEQ ID NO: 221061 - DNA, 25 bp, Homo sapien
taaagcaccgtgtacagggcctcct

SEQ ID NO: 221062 - DNA, 25 bp, Homo sapien
tacagggcctcctcgtagagcatct

SEQ ID NO: 221063 - DNA, 25 bp, Homo sapien
gctctcaggccgaggctgggatcca

SEQ ID NO: 221064 - DNA, 25 bp, Homo sapien
ggacctcgaggcacggcaagccctg

SEQ ID NO: 221065 - DNA, 25 bp, Homo sapien
ggaagataaatgaacatcagatttc

SEQ ID NO: 221066 - DNA, 25 bp, Homo sapien
gaagataaatgaacatcagatttct

SEQ ID NO: 221067 - DNA, 25 bp, Homo sapien
agataaatgaacatcagatttctag

SEQ ID NO: 221068 - DNA, 25 bp, Homo sapien
catcagatttctaggtatagaacta

SEQ ID NO: 221069 - DNA, 25 bp, Homo sapien
tcagatttctaggtatagaactatg

SEQ ID NO: 221070 - DNA, 25 bp, Homo sapien
cagatttctaggtatagaactatgt

SEQ ID NO: 221071 - DNA, 25 bp, Homo sapien
gatttctaggtatagaactatgtta

SEQ ID NO: 221072 - DNA, 25 bp, Homo sapien
ttctaggtatagaactatgttattg

SEQ ID NO: 221073 - DNA, 25 bp, Homo sapien
ctaggtatagaactatgttattgaa

SEQ ID NO: 221074 - DNA, 25 bp, Homo sapien
ggtatagaactatgttattgaaagg

SEQ ID NO: 221075 - DNA, 25 bp, Homo sapien
tagaactatgttattgaaaggaaaa

SEQ ID NO: 221076 - DNA, 25 bp, Homo sapien
tggcttcttgctggcgatctggccc

SEQ ID NO: 221077 - DNA, 25 bp, Homo sapien
ttcctgttcccctacttagtggact

SEQ ID NO: 221078 - DNA, 25 bp, Homo sapien
tgttggggaccttgtgcctggcctc

SEQ ID NO: 221079 - DNA, 25 bp, Homo sapien
ttgtgcctggcctccccggttgctg

SEQ ID NO: 221080 - DNA, 25 bp, Homo sapien
tccccggttgctgctcacgtgttag

SEQ ID NO: 221081 - DNA, 25 bp, Homo sapien
tgttcccctacttagtggactcgcc

SEQ ID NO: 221082 - DNA, 25 bp, Homo sapien
ggttgctgctcacgtgttagcacca

SEQ ID NO: 221083 - DNA, 25 bp, Homo sapien
ttgctgctcacgtgttagcaccact

SEQ ID NO: 221084 - DNA, 25 bp, Homo sapien
tacttagtggactcgccctggccat

SEQ ID NO: 221085 - DNA, 25 bp, Homo sapien
ctgtgcccagacaccctgctgggag

SEQ ID NO: 221086 - DNA, 25 bp, Homo sapien
accctgctgggagggtggcgagcta

SEQ ID NO: 221087 - DNA, 25 bp, Homo sapien
ttacaaactgacaatctctcctctg

SEQ ID NO: 221088 - DNA, 25 bp, Homo sapien
aatctctcctctgtatttgtgttca

SEQ ID NO: 221089 - DNA, 25 bp, Homo sapien
tctgtatttgtgttcatagtggctg

SEQ ID NO: 221090 - DNA, 25 bp, Homo sapien
ggctgggagtttaattatatgcaca

SEQ ID NO: 221091 - DNA, 25 bp, Homo sapien
agttaggagccacttgtttctgcac

SEQ ID NO: 221092 - DNA, 25 bp, Homo sapien
gtttctgcacagactgtaggagcaa

SEQ ID NO: 221093 - DNA, 25 bp, Homo sapien
ggtggacaggcatacttgtggcatt

SEQ ID NO: 221094 - DNA, 25 bp, Homo sapien
tacttgtggcattgggtgcggcatt

SEQ ID NO: 221095 - DNA, 25 bp, Homo sapien
ggcattgctgggaggaccacgtctt

SEQ ID NO: 221096 - DNA, 25 bp, Homo sapien
accacgtcttgggaggcgattgact

SEQ ID NO: 221097 - DNA, 25 bp, Homo sapien
gaggcgattgacttttggtttgtaa

SEQ ID NO: 221098 - DNA, 25 bp, Homo sapien
gttctttgcctagtatacagtttta

SEQ ID NO: 221099 - DNA, 25 bp, Homo sapien
tttatttcattgacaccgatctgta

SEQ ID NO: 221100 - DNA, 25 bp, Homo sapien
atttcattgacaccgatctgtacac

SEQ ID NO: 221101 - DNA, 25 bp, Homo sapien
tcattgacaccgatctgtacacagt

SEQ ID NO: 221102 - DNA, 25 bp, Homo sapien
attgacaccgatctgtacacagtaa

SEQ ID NO: 221103 - DNA, 25 bp, Homo sapien
gacaccgatctgtacacagtaaaaa

SEQ ID NO: 221104 - DNA, 25 bp, Homo sapien
ttgcttatagaaagctaatcatggc

SEQ ID NO: 221105 - DNA, 25 bp, Homo sapien
gtaatatggctgataacctttggaa

SEQ ID NO: 221106 - DNA, 25 bp, Homo sapien
tggctgataacctttggaatttgat

SEQ ID NO: 221107 - DNA, 25 bp, Homo sapien
cttggacactgcagctcttttcagt

SEQ ID NO: 221108 - DNA, 25 bp, Homo sapien
acactgcagctcttttcagtttttg

SEQ ID NO: 221109 - DNA, 25 bp, Homo sapien
ataaggtggaggcaactgactagtt

SEQ ID NO: 221110 - DNA, 25 bp, Homo sapien
gaaactcttaatagctcatactctt

SEQ ID NO: 221111 - DNA, 25 bp, Homo sapien
tcttgataccaaaagcagccctgat

SEQ ID NO: 221112 - DNA, 25 bp, Homo sapien
aagcagccctgattgttaaagcaca

SEQ ID NO: 221113 - DNA, 25 bp, Homo sapien
tgttaaagcacacacctgcacaaga

SEQ ID NO: 221114 - DNA, 25 bp, Homo sapien
ggttgcatttacatttcctgggtgc

SEQ ID NO: 221115 - DNA, 25 bp, Homo sapien
aagcaaggacttacgctttttgcaa

SEQ ID NO: 221116 - DNA, 25 bp, Homo sapien
tacgctttttgcaaagcctttgaga

SEQ ID NO: 221117 - DNA, 25 bp, Homo sapien
tactggatcataggaagcttataac

SEQ ID NO: 221118 - DNA, 25 bp, Homo sapien
ataactcactttctttggtatccag

SEQ ID NO: 221119 - DNA, 25 bp, Homo sapien
ttggtatccagtaacagtagatgtt

SEQ ID NO: 221120 - DNA, 25 bp, Homo sapien
attaccatcgattcagtgcctggat

SEQ ID NO: 221121 - DNA, 25 bp, Homo sapien
gcttacttgtttaatggcagccaca

SEQ ID NO: 221122 - DNA, 25 bp, Homo sapien
ggcagccacatgcacgaagatgcta

SEQ ID NO: 221123 - DNA, 25 bp, Homo sapien
gaattccaaatcctcaacttttgag

SEQ ID NO: 221124 - DNA, 25 bp, Homo sapien
caacttttgaggtttcggctctcca

SEQ ID NO: 221125 - DNA, 25 bp, Homo sapien
ttcggctctccaatttaactctttg

SEQ ID NO: 221126 - DNA, 25 bp, Homo sapien
actctttggcaacaggaaacaggtt

SEQ ID NO: 221127 - DNA, 25 bp, Homo sapien
caggttttgcaagttcaaggttcac

SEQ ID NO: 221128 - DNA, 25 bp, Homo sapien
gttcaaggttcactccctatatgtg

SEQ ID NO: 221129 - DNA, 25 bp, Homo sapien
ggaaatggattaacatacccgtcta

SEQ ID NO: 221130 - DNA, 25 bp, Homo sapien
atacccgtctatgcctaaaagataa

SEQ ID NO: 221131 - DNA, 25 bp, Homo sapien
ttccaggaagtggtaccactctggg

SEQ ID NO: 221132 - DNA, 25 bp, Homo sapien
aagtggtaccactctggggtcaaga

SEQ ID NO: 221133 - DNA, 25 bp, Homo sapien
aaatgagcacacatgaccttccttt

SEQ ID NO: 221134 - DNA, 25 bp, Homo sapien
aatgagcacacatgaccttcctttc

SEQ ID NO: 221135 - DNA, 25 bp, Homo sapien
cacatgaccttcctttcctataaaa

SEQ ID NO: 221136 - DNA, 25 bp, Homo sapien
aaaactcccccatgatttcctcatg

SEQ ID NO: 221137 - DNA, 25 bp, Homo sapien
gttgcttagaatagtgtgtatttca

SEQ ID NO: 221138 - DNA, 25 bp, Homo sapien
tggaccacagttgactgaaactgag

SEQ ID NO: 221139 - DNA, 25 bp, Homo sapien
gcccctagtcaagtgaattctaatg

SEQ ID NO: 221140 - DNA, 25 bp, Homo sapien
tataaaaattgaacctctgttttga

SEQ ID NO: 221141 - DNA, 25 bp, Homo sapien
ttgaaaacaaatctttccaggaagt

SEQ ID NO: 221142 - DNA, 25 bp, Homo sapien
ttaacccatggttgagacgttccaa

SEQ ID NO: 221143 - DNA, 25 bp, Homo sapien
gacgttccaagttagatctgctgct

SEQ ID NO: 221144 - DNA, 25 bp, Homo sapien
tagatctgctgctcttaggtgtggg

SEQ ID NO: 221145 - DNA, 25 bp, Homo sapien
gggctgtccacattagggaacttgc

SEQ ID NO: 221146 - DNA, 25 bp, Homo sapien
gtccacattagggaacttgcctcaa

SEQ ID NO: 221147 - DNA, 25 bp, Homo sapien
tagggaacttgcctcaaaaacagtc

SEQ ID NO: 221148 - DNA, 25 bp, Homo sapien
aacagtccacagtggcaataccgga

SEQ ID NO: 221149 - DNA, 25 bp, Homo sapien
tggcaataccggacttctgttcaag

SEQ ID NO: 221150 - DNA, 25 bp, Homo sapien
taccggacttctgttcaagcttttt

SEQ ID NO: 221151 - DNA, 25 bp, Homo sapien
tctgttcaagctttttaaagtgctg

SEQ ID NO: 221152 - DNA, 25 bp, Homo sapien
gtgaccctttaagagaggatcatct

SEQ ID NO: 221153 - DNA, 25 bp, Homo sapien
gcccaagtgaacaactgtggcagct

SEQ ID NO: 221154 - DNA, 25 bp, Homo sapien
aagtgaacaactgtggcagctcctc

SEQ ID NO: 221155 - DNA, 25 bp, Homo sapien
gtgaacaactgtggcagctcctcct

SEQ ID NO: 221156 - DNA, 25 bp, Homo sapien
gaacaactgtggcagctcctcctag

SEQ ID NO: 221157 - DNA, 25 bp, Homo sapien
aacaactgtggcagctcctcctagt

SEQ ID NO: 221158 - DNA, 25 bp, Homo sapien
aactgtggcagctcctcctagtctg

SEQ ID NO: 221159 - DNA, 25 bp, Homo sapien
cgtggctgccacagactccaggagg

SEQ ID NO: 221160 - DNA, 25 bp, Homo sapien
tggctgccacagactccaggaggga

SEQ ID NO: 221161 - DNA, 25 bp, Homo sapien
ggaagcacagacaacaggagacccc

SEQ ID NO: 221162 - DNA, 25 bp, Homo sapien
acctgaggctcaacccacccgtggg

SEQ ID NO: 221163 - DNA, 25 bp, Homo sapien
cacccgtgggggagtttactgtctg

SEQ ID NO: 221164 - DNA, 25 bp, Homo sapien
catgtaatatggctgataacctttg

SEQ ID NO: 221165 - DNA, 25 bp, Homo sapien
atgtaatatggctgataacctttgg

SEQ ID NO: 221166 - DNA, 25 bp, Homo sapien
tgtaatatggctgataacctttgga

SEQ ID NO: 221167 - DNA, 25 bp, Homo sapien
gtaatatggctgataacctttggaa

SEQ ID NO: 221168 - DNA, 25 bp, Homo sapien
taatatggctgataacctttggaat

SEQ ID NO: 221169 - DNA, 25 bp, Homo sapien
aatatggctgataacctttggaatt

SEQ ID NO: 221170 - DNA, 25 bp, Homo sapien
atatggctgataacctttggaattt

SEQ ID NO: 221171 - DNA, 25 bp, Homo sapien
tatggctgataacctttggaatttg

SEQ ID NO: 221172 - DNA, 25 bp, Homo sapien
atggctgataacctttggaatttga

SEQ ID NO: 221173 - DNA, 25 bp, Homo sapien
tggctgataacctttggaatttgat

SEQ ID NO: 221174 - DNA, 25 bp, Homo sapien
acactgcagctcttttcagtttttg

SEQ ID NO: 221175 - DNA, 25 bp, Homo sapien
gaatatccgaaagtgtataaccctc

SEQ ID NO: 221176 - DNA, 25 bp, Homo sapien
gtgtataaccctcttcaacaatctg

SEQ ID NO: 221177 - DNA, 25 bp, Homo sapien
cagatccttaagagctgagcagctg

SEQ ID NO: 221178 - DNA, 25 bp, Homo sapien
gagctgagcagctgtgtaacaacag

SEQ ID NO: 221179 - DNA, 25 bp, Homo sapien
tcaattgtctttgcatcagctcctt

SEQ ID NO: 221180 - DNA, 25 bp, Homo sapien
ttgcagccgcaaccagtctataagc

SEQ ID NO: 221181 - DNA, 25 bp, Homo sapien
agtctataagctctttatctgttct

SEQ ID NO: 221182 - DNA, 25 bp, Homo sapien
gggcctgctgggttctctgtaatac

SEQ ID NO: 221183 - DNA, 25 bp, Homo sapien
gggttctctgtaatacctgtaacga

SEQ ID NO: 221184 - DNA, 25 bp, Homo sapien
atacctgtaacgattggcaatttgt

SEQ ID NO: 221185 - DNA, 25 bp, Homo sapien
gtctaaccataaaactcttcaaaag

SEQ ID NO: 221186 - DNA, 25 bp, Homo sapien
agctgtttgacacgttgaatctttt

SEQ ID NO: 221187 - DNA, 25 bp, Homo sapien
gacacgttgaatcttttccaaaagc

SEQ ID NO: 221188 - DNA, 25 bp, Homo sapien
acttccctggtctcaaccaagagag

SEQ ID NO: 221189 - DNA, 25 bp, Homo sapien
gagagttggctccactaaagcagaa

SEQ ID NO: 221190 - DNA, 25 bp, Homo sapien
atccacaatcactgacttcttctaa

SEQ ID NO: 221191 - DNA, 25 bp, Homo sapien
gacttcttctaacaagtcttctgaa

SEQ ID NO: 221192 - DNA, 25 bp, Homo sapien
gtcttctgaaaatctctttactaat

SEQ ID NO: 221193 - DNA, 25 bp, Homo sapien
cctaccaaggtagcccatgtaagaa

SEQ ID NO: 221194 - DNA, 25 bp, Homo sapien
taaggaaccaccaaaatcacgcata

SEQ ID NO: 221195 - DNA, 25 bp, Homo sapien
atcacgcatatcagttcaggagaga

SEQ ID NO: 221196 - DNA, 25 bp, Homo sapien
gagaaagttatcatttagctgtttg

SEQ ID NO: 221197 - DNA, 25 bp, Homo sapien
ttcacctgtgtaagcagagtgctga

SEQ ID NO: 221198 - DNA, 25 bp, Homo sapien
gcagagtgctgagccatcactgttt

SEQ ID NO: 221199 - DNA, 25 bp, Homo sapien
atcactgtttcagcaccactgggag

SEQ ID NO: 221200 - DNA, 25 bp, Homo sapien
tttcagcaccactgggagtctgagt

SEQ ID NO: 221201 - DNA, 25 bp, Homo sapien
ccactgggagtctgagtgcgattca

SEQ ID NO: 221202 - DNA, 25 bp, Homo sapien
gattcagaagatgacgcgggtacga

SEQ ID NO: 221203 - DNA, 25 bp, Homo sapien
tacgagtggtggacaacagtgccct

SEQ ID NO: 221204 - DNA, 25 bp, Homo sapien
gcaaggtgggcgaccagatactact

SEQ ID NO: 221205 - DNA, 25 bp, Homo sapien
tgggcgaccagatactactggccat

SEQ ID NO: 221206 - DNA, 25 bp, Homo sapien
gatactactggccatcaagggacag

SEQ ID NO: 221207 - DNA, 25 bp, Homo sapien
aaaggcgctcattgtggggcactgc

SEQ ID NO: 221208 - DNA, 25 bp, Homo sapien
gtagccacttgccaagtgtcagtgt

SEQ ID NO: 221209 - DNA, 25 bp, Homo sapien
ttgccaagtgtcagtgttcagtcta

SEQ ID NO: 221210 - DNA, 25 bp, Homo sapien
tgggttaaccacatgaacagcactg

SEQ ID NO: 221211 - DNA, 25 bp, Homo sapien
cactggcccatgtgagaatggtgtg

SEQ ID NO: 221212 - DNA, 25 bp, Homo sapien
gaatggtgtgaaggcctcctttgta

SEQ ID NO: 221213 - DNA, 25 bp, Homo sapien
tgaaggcctcctttgtaccattttc

SEQ ID NO: 221214 - DNA, 25 bp, Homo sapien
ttgtaccattttccatttctctaac

SEQ ID NO: 221215 - DNA, 25 bp, Homo sapien
ttccatttctctaactcacatgtgt

SEQ ID NO: 221216 - DNA, 25 bp, Homo sapien
tcagcactgcagaggacagatttgt

SEQ ID NO: 221217 - DNA, 25 bp, Homo sapien
gacagatttgtttgtgccctctgag

SEQ ID NO: 221218 - DNA, 25 bp, Homo sapien
gccctctgagactggttggttggtt

SEQ ID NO: 221219 - DNA, 25 bp, Homo sapien
gggcagttttactattttactcaca

SEQ ID NO: 221220 - DNA, 25 bp, Homo sapien
ttcatgattggtttagagcaaggcc

SEQ ID NO: 221221 - DNA, 25 bp, Homo sapien
aacgctacaactagattgtcacatg

SEQ ID NO: 221222 - DNA, 25 bp, Homo sapien
tatgttctgtaattccaaagcacgg

SEQ ID NO: 221223 - DNA, 25 bp, Homo sapien
ccaaagcacggatctgtagagaaca

SEQ ID NO: 221224 - DNA, 25 bp, Homo sapien
gagaacagagtgtctatcccatgca

SEQ ID NO: 221225 - DNA, 25 bp, Homo sapien
cagagtgtctatcccatgcatgttg

SEQ ID NO: 221226 - DNA, 25 bp, Homo sapien
gcatgttgtcatgtacttatcccac

SEQ ID NO: 221227 - DNA, 25 bp, Homo sapien
ttatcccacaccctattgaaatcac

SEQ ID NO: 221228 - DNA, 25 bp, Homo sapien
gagcaaggccacagtatcaggctta

SEQ ID NO: 221229 - DNA, 25 bp, Homo sapien
gtatcaggcttacatccatattata

SEQ ID NO: 221230 - DNA, 25 bp, Homo sapien
tccgtgttactcattcctggagttg

SEQ ID NO: 221231 - DNA, 25 bp, Homo sapien
actttcaagagcttgggcttggccc

SEQ ID NO: 221232 - DNA, 25 bp, Homo sapien
ggcttggcccaaatcttagactgtc

SEQ ID NO: 221233 - DNA, 25 bp, Homo sapien
ttagactgtccaattctgcctctat

SEQ ID NO: 221234 - DNA, 25 bp, Homo sapien
ccaattctgcctctattaccaattt

SEQ ID NO: 221235 - DNA, 25 bp, Homo sapien
gcctctattaccaatttaaatctat

SEQ ID NO: 221236 - DNA, 25 bp, Homo sapien
aaatctatggcttgaacctgtgcac

SEQ ID NO: 221237 - DNA, 25 bp, Homo sapien
ctatggcttgaacctgtgcactgaa

SEQ ID NO: 221238 - DNA, 25 bp, Homo sapien
attagaagccctagtcattttttgg

SEQ ID NO: 221239 - DNA, 25 bp, Homo sapien
gctgtccattgaagactttgaacat

SEQ ID NO: 221240 - DNA, 25 bp, Homo sapien
ttgaagactttgaacatgccgcctt

SEQ ID NO: 221241 - DNA, 25 bp, Homo sapien
attccccctagcaaaaggaagcagc

SEQ ID NO: 221242 - DNA, 25 bp, Homo sapien
ccatggtattactctggatactagc

SEQ ID NO: 221243 - DNA, 25 bp, Homo sapien
ttactctggatactagccattcctt

SEQ ID NO: 221244 - DNA, 25 bp, Homo sapien
ggatactagccattccttaggattt

SEQ ID NO: 221245 - DNA, 25 bp, Homo sapien
ttaggattttaaggtcacattttat

SEQ ID NO: 221246 - DNA, 25 bp, Homo sapien
caacttctactctttgttttatcca

SEQ ID NO: 221247 - DNA, 25 bp, Homo sapien
ctactctttgttttatccacctatc

SEQ ID NO: 221248 - DNA, 25 bp, Homo sapien
tctttgttttatccacctatcccta

SEQ ID NO: 221249 - DNA, 25 bp, Homo sapien
ttatccacctatccctattacctga

SEQ ID NO: 221250 - DNA, 25 bp, Homo sapien
tatccctattacctgaccctttgtc

SEQ ID NO: 221251 - DNA, 25 bp, Homo sapien
tattacctgaccctttgtcttccct

SEQ ID NO: 221252 - DNA, 25 bp, Homo sapien
ccccggtattgctgttgctacgagg

SEQ ID NO: 221253 - DNA, 25 bp, Homo sapien
cggtattgctgttgctacgaggttg

SEQ ID NO: 221254 - DNA, 25 bp, Homo sapien
gcgattgtcctgtgggagccaccgt

SEQ ID NO: 221255 - DNA, 25 bp, Homo sapien
gggaccctcacttcttctggggtgt

SEQ ID NO: 221256 - DNA, 25 bp, Homo sapien
gggtgtgctcagcttctgcatgccc

SEQ ID NO: 221257 - DNA, 25 bp, Homo sapien
tcagcttctgcatgccccggatctt

SEQ ID NO: 221258 - DNA, 25 bp, Homo sapien
gcatgccccggatcttgtccagcag

SEQ ID NO: 221259 - DNA, 25 bp, Homo sapien
cccggatcttgtccagcaggccaga

SEQ ID NO: 221260 - DNA, 25 bp, Homo sapien
aggccagaaatgaaggcctctgtgg

SEQ ID NO: 221261 - DNA, 25 bp, Homo sapien
tctgtgggtttgtaacagtcaacca

SEQ ID NO: 221262 - DNA, 25 bp, Homo sapien
tttgtaacagtcaaccagcagctcc

SEQ ID NO: 221263 - DNA, 25 bp, Homo sapien
tgcttgttttccttcggtcaaccca

SEQ ID NO: 221264 - DNA, 25 bp, Homo sapien
tgttttccttcggtcaacccacatg

SEQ ID NO: 221265 - DNA, 25 bp, Homo sapien
tttccttcggtcaacccacatgtaa

SEQ ID NO: 221266 - DNA, 25 bp, Homo sapien
cttcggtcaacccacatgtaactag

SEQ ID NO: 221267 - DNA, 25 bp, Homo sapien
ttcggtcaacccacatgtaactagg

SEQ ID NO: 221268 - DNA, 25 bp, Homo sapien
cggtcaacccacatgtaactaggtc

SEQ ID NO: 221269 - DNA, 25 bp, Homo sapien
gtcaacccacatgtaactaggtcct

SEQ ID NO: 221270 - DNA, 25 bp, Homo sapien
caacccacatgtaactaggtcctgt

SEQ ID NO: 221271 - DNA, 25 bp, Homo sapien
acccacatgtaactaggtcctgtgt

SEQ ID NO: 221272 - DNA, 25 bp, Homo sapien
acatgtaactaggtcctgtgttgct

SEQ ID NO: 221273 - DNA, 25 bp, Homo sapien
tgtaactaggtcctgtgttgctgct

SEQ ID NO: 221274 - DNA, 25 bp, Homo sapien
attcctctagcaaatttctcagcgt

SEQ ID NO: 221275 - DNA, 25 bp, Homo sapien
ttctcagcgtcttctctggtagaaa

SEQ ID NO: 221276 - DNA, 25 bp, Homo sapien
aaatcgggaccctttgatcatcttg

SEQ ID NO: 221277 - DNA, 25 bp, Homo sapien
gaccctttgatcatcttgacagctt

SEQ ID NO: 221278 - DNA, 25 bp, Homo sapien
cttgacagcttgcaatgcttccttt

SEQ ID NO: 221279 - DNA, 25 bp, Homo sapien
atcctttcatttctcgctgggacgt

SEQ ID NO: 221280 - DNA, 25 bp, Homo sapien
tgggacgtcctcatacactggacac

SEQ ID NO: 221281 - DNA, 25 bp, Homo sapien
acactggacacaccccatagtacag

SEQ ID NO: 221282 - DNA, 25 bp, Homo sapien
gggcggctccttagacgcagtcgct

SEQ ID NO: 221283 - DNA, 25 bp, Homo sapien
tccagctctgtaggtgtcggtgtca

SEQ ID NO: 221284 - DNA, 25 bp, Homo sapien
caccgagcaggtcttggatgtcaca

SEQ ID NO: 221285 - DNA, 25 bp, Homo sapien
actccatttataggcacatctcctt

SEQ ID NO: 221286 - DNA, 25 bp, Homo sapien
atctccttcatttcctaggtcactg

SEQ ID NO: 221287 - DNA, 25 bp, Homo sapien
actgcccctttgtttacagctcctg

SEQ ID NO: 221288 - DNA, 25 bp, Homo sapien
cttgaccacagcctggtttacaaat

SEQ ID NO: 221289 - DNA, 25 bp, Homo sapien
aggtttacaagccacgcttacttgc

SEQ ID NO: 221290 - DNA, 25 bp, Homo sapien
aagccacgcttacttgctgtgtctg

SEQ ID NO: 221291 - DNA, 25 bp, Homo sapien
tgtgtctgcgtggaattctctcctc

SEQ ID NO: 221292 - DNA, 25 bp, Homo sapien
atggcagggtacactctccccacag

SEQ ID NO: 221293 - DNA, 25 bp, Homo sapien
gggactctcgggatttaagcactcg

SEQ ID NO: 221294 - DNA, 25 bp, Homo sapien
ttaagcactcgtctctctgggaggc

SEQ ID NO: 221295 - DNA, 25 bp, Homo sapien
agaccccactccatttataggcaca

SEQ ID NO: 221296 - DNA, 25 bp, Homo sapien
aacaacgcaggatataattgccaaa

SEQ ID NO: 221297 - DNA, 25 bp, Homo sapien
gcttgaggttggtgactcttgaaag

SEQ ID NO: 221298 - DNA, 25 bp, Homo sapien
tttctttcttcaggcctagatcaga

SEQ ID NO: 221299 - DNA, 25 bp, Homo sapien
gtgcagcaatatcatgaattctcag

SEQ ID NO: 221300 - DNA, 25 bp, Homo sapien
ctttcagggagccagtgagtcatac

SEQ ID NO: 221301 - DNA, 25 bp, Homo sapien
gagccagtgagtcatacagtatcca

SEQ ID NO: 221302 - DNA, 25 bp, Homo sapien
acagtatccacagttgagtcactta

SEQ ID NO: 221303 - DNA, 25 bp, Homo sapien
gagtcacttaaagatgtcagtatac

SEQ ID NO: 221304 - DNA, 25 bp, Homo sapien
acattattcacaatccttgggcaat

SEQ ID NO: 221305 - DNA, 25 bp, Homo sapien
caatccttgggcaatctcatttttt

SEQ ID NO: 221306 - DNA, 25 bp, Homo sapien
catacatttctatccttgagttagt

SEQ ID NO: 221307 - DNA, 25 bp, Homo sapien
ctaggcttagctcttacgtggatca

SEQ ID NO: 221308 - DNA, 25 bp, Homo sapien
tacgtggatcaaaaggccctaattc

SEQ ID NO: 221309 - DNA, 25 bp, Homo sapien
taattcctcctcctcttttgaagtg

SEQ ID NO: 221310 - DNA, 25 bp, Homo sapien
atatacggttctaagtggactgtgt

SEQ ID NO: 221311 - DNA, 25 bp, Homo sapien
gtgtttttctctgcgcatgttaagg

SEQ ID NO: 221312 - DNA, 25 bp, Homo sapien
gcgcatgttaaggtggttctattca

SEQ ID NO: 221313 - DNA, 25 bp, Homo sapien
ggttctattcatgctgttttctact

SEQ ID NO: 221314 - DNA, 25 bp, Homo sapien
gtgaaatctcttacttctgactata

SEQ ID NO: 221315 - DNA, 25 bp, Homo sapien
tggactttggccgtttgtgatgcac

SEQ ID NO: 221316 - DNA, 25 bp, Homo sapien
tgtgatgcacctgggtctagctttc

SEQ ID NO: 221317 - DNA, 25 bp, Homo sapien
aaactgagctacttcgacctgaggg

SEQ ID NO: 221318 - DNA, 25 bp, Homo sapien
gaataggaataatactttgccactt

SEQ ID NO: 221319 - DNA, 25 bp, Homo sapien
tttgccacttctgcattatttagaa

SEQ ID NO: 221320 - DNA, 25 bp, Homo sapien
gccacttctgcattatttagaaaca

SEQ ID NO: 221321 - DNA, 25 bp, Homo sapien
gaaacatacgttattgtacatttgt

SEQ ID NO: 221322 - DNA, 25 bp, Homo sapien
tacatttgtaaaccatttactgtct

SEQ ID NO: 221323 - DNA, 25 bp, Homo sapien
tgggcaatagtgactccgtttaata

SEQ ID NO: 221324 - DNA, 25 bp, Homo sapien
atagtgactccgtttaataaaagct

SEQ ID NO: 221325 - DNA, 25 bp, Homo sapien
taataaaagcttccgtagtgcattg

SEQ ID NO: 221326 - DNA, 25 bp, Homo sapien
aaagcttccgtagtgcattggtatg

SEQ ID NO: 221327 - DNA, 25 bp, Homo sapien
gcttccgtagtgcattggtatggat

SEQ ID NO: 221328 - DNA, 25 bp, Homo sapien
ccgtagtgcattggtatggattaaa

SEQ ID NO: 221329 - DNA, 25 bp, Homo sapien
gaactcaacgttcaggctaatattt

SEQ ID NO: 221330 - DNA, 25 bp, Homo sapien
taactcctgtatgctttatccaaag

SEQ ID NO: 221331 - DNA, 25 bp, Homo sapien
ttatccaaaggacacccacagtttt

SEQ ID NO: 221332 - DNA, 25 bp, Homo sapien
cacccacagttttccagcatagata

SEQ ID NO: 221333 - DNA, 25 bp, Homo sapien
gattccttcaaagaactgggaggca

SEQ ID NO: 221334 - DNA, 25 bp, Homo sapien
ctgggaggcacggatattgcatttt

SEQ ID NO: 221335 - DNA, 25 bp, Homo sapien
gtttacatccagtagccaagacgcc

SEQ ID NO: 221336 - DNA, 25 bp, Homo sapien
agacgcctcagtgagccagtcttgg

SEQ ID NO: 221337 - DNA, 25 bp, Homo sapien
agtcttgggcagaggctgtcacatt

SEQ ID NO: 221338 - DNA, 25 bp, Homo sapien
gtatgttctaattctcactctggac

SEQ ID NO: 221339 - DNA, 25 bp, Homo sapien
actctggactacagtgaggctgaat

SEQ ID NO: 221340 - DNA, 25 bp, Homo sapien
tggcttcttgctggcgatctggccc

SEQ ID NO: 221341 - DNA, 25 bp, Homo sapien
ttcctgttcccctacttagtggact

SEQ ID NO: 221342 - DNA, 25 bp, Homo sapien
ttgtgcctggcctccccggttgctg

SEQ ID NO: 221343 - DNA, 25 bp, Homo sapien
ggttgctgctcacgtgttagcacca

SEQ ID NO: 221344 - DNA, 25 bp, Homo sapien
ttgctgctcacgtgttagcaccact

SEQ ID NO: 221345 - DNA, 25 bp, Homo sapien
cgtgttagcaccacttgcagcagct

SEQ ID NO: 221346 - DNA, 25 bp, Homo sapien
agacagcgcgcgaattcagctcggt

SEQ ID NO: 221347 - DNA, 25 bp, Homo sapien
tacttagtggactcgccctggccat

SEQ ID NO: 221348 - DNA, 25 bp, Homo sapien
aattcagctcggtggtcactggcaa

SEQ ID NO: 221349 - DNA, 25 bp, Homo sapien
ctgtgcccagacaccctgctgggag

SEQ ID NO: 221350 - DNA, 25 bp, Homo sapien
accctgctgggagggtggcgagcta

SEQ ID NO: 221351 - DNA, 25 bp, Homo sapien
aaccacaccgttggtggcgatggca

SEQ ID NO: 221352 - DNA, 25 bp, Homo sapien
gcactcatggagatggccgtcagca

SEQ ID NO: 221353 - DNA, 25 bp, Homo sapien
tggccgtcagcagggtacaacagca

SEQ ID NO: 221354 - DNA, 25 bp, Homo sapien
acagcagcagataagcacgatgagg

SEQ ID NO: 221355 - DNA, 25 bp, Homo sapien
atgaggagggcctgtagcacacctg

SEQ ID NO: 221356 - DNA, 25 bp, Homo sapien
gaggataaccccaaagatattctgc

SEQ ID NO: 221357 - DNA, 25 bp, Homo sapien
accccaaagatattctgcaggcagg

SEQ ID NO: 221358 - DNA, 25 bp, Homo sapien
ccccatgagggtgcccatgctgggt

SEQ ID NO: 221359 - DNA, 25 bp, Homo sapien
ctcatgctctttggcgccctgggtg

SEQ ID NO: 221360 - DNA, 25 bp, Homo sapien
gttggtgtagctgacgagctttccc

SEQ ID NO: 221361 - DNA, 25 bp, Homo sapien
tgtagctgacgagctttcccagaag

SEQ ID NO: 221362 - DNA, 25 bp, Homo sapien
ttgcagctaggaatagctttgtggc

SEQ ID NO: 221363 - DNA, 25 bp, Homo sapien
gaagtagaattggtgtgtgaaagat

SEQ ID NO: 221364 - DNA, 25 bp, Homo sapien
gaaaatgcttcccagtatccattct

SEQ ID NO: 221365 - DNA, 25 bp, Homo sapien
attcaggctgacacaggagtaaaca

SEQ ID NO: 221366 - DNA, 25 bp, Homo sapien
cacaggagtaaacatgccaggctat

SEQ ID NO: 221367 - DNA, 25 bp, Homo sapien
aacatgccaggctatgagaagggag

SEQ ID NO: 221368 - DNA, 25 bp, Homo sapien
ttacattcatcctcagtgttacaat

SEQ ID NO: 221369 - DNA, 25 bp, Homo sapien
cattcatcctcagtgttacaatttc

SEQ ID NO: 221370 - DNA, 25 bp, Homo sapien
tcatcctcagtgttacaatttctaa

SEQ ID NO: 221371 - DNA, 25 bp, Homo sapien
ctcagtgttacaatttctaaagttt

SEQ ID NO: 221372 - DNA, 25 bp, Homo sapien
tctgattattgttgcagctaggaat

SEQ ID NO: 221373 - DNA, 25 bp, Homo sapien
tggtatcccgagaacaggctcttca

SEQ ID NO: 221374 - DNA, 25 bp, Homo sapien
agaccctgaagattgcattagccct

SEQ ID NO: 221375 - DNA, 25 bp, Homo sapien
attagccctggccagcagactggga

SEQ ID NO: 221376 - DNA, 25 bp, Homo sapien
tgggagatcccgtctatgattctac

SEQ ID NO: 221377 - DNA, 25 bp, Homo sapien
gtctatgattctaccatcactgaga

SEQ ID NO: 221378 - DNA, 25 bp, Homo sapien
tcagcaaggtggaggccgcctacct

SEQ ID NO: 221379 - DNA, 25 bp, Homo sapien
gggccatatcaatgactcccaggca

SEQ ID NO: 221380 - DNA, 25 bp, Homo sapien
cactcctgcctgtctatgaactaga

SEQ ID NO: 221381 - DNA, 25 bp, Homo sapien
atgaactagacggagctcccacggc

SEQ ID NO: 221382 - DNA, 25 bp, Homo sapien
acggctgcccaggtgctgatcatgg

SEQ ID NO: 221383 - DNA, 25 bp, Homo sapien
tgggacctgatgacttcattgtggc

SEQ ID NO: 221384 - DNA, 25 bp, Homo sapien
gttatcattaggcagtgtcccctta

SEQ ID NO: 221385 - DNA, 25 bp, Homo sapien
attaggcagtgtccccttaatgttg

SEQ ID NO: 221386 - DNA, 25 bp, Homo sapien
aatgttgagttcctttgttgtgtaa

SEQ ID NO: 221387 - DNA, 25 bp, Homo sapien
ttgcaattggttttgtacagatagt

SEQ ID NO: 221388 - DNA, 25 bp, Homo sapien
agaaacataccagccagtagaggtt

SEQ ID NO: 221389 - DNA, 25 bp, Homo sapien
taccagccagtagaggtttcagttt

SEQ ID NO: 221390 - DNA, 25 bp, Homo sapien
tcatcttttttcccttactggaggt

SEQ ID NO: 221391 - DNA, 25 bp, Homo sapien
gaggtaggatggaatcaaaacacac

SEQ ID NO: 221392 - DNA, 25 bp, Homo sapien
agcccagcatggacagaattactat

SEQ ID NO: 221393 - DNA, 25 bp, Homo sapien
tactattcagtaaagctcctgcccc

SEQ ID NO: 221394 - DNA, 25 bp, Homo sapien
tcctgccccagtgagctgtttttac

SEQ ID NO: 221395 - DNA, 25 bp, Homo sapien
cgtgttagcaccacttgcagcagct

SEQ ID NO: 221396 - DNA, 25 bp, Homo sapien
cagacagcgcgcgaattcagctcgg

SEQ ID NO: 221397 - DNA, 25 bp, Homo sapien
agacagcgcgcgaattcagctcggt

SEQ ID NO: 221398 - DNA, 25 bp, Homo sapien
gacagcgcgcgaattcagctcggtg

SEQ ID NO: 221399 - DNA, 25 bp, Homo sapien
acagcgcgcgaattcagctcggtgg

SEQ ID NO: 221400 - DNA, 25 bp, Homo sapien
cagcgcgcgaattcagctcggtggt

SEQ ID NO: 221401 - DNA, 25 bp, Homo sapien
gcgcgcgaattcagctcggtggtca

SEQ ID NO: 221402 - DNA, 25 bp, Homo sapien
gcgcgaattcagctcggtggtcact

SEQ ID NO: 221403 - DNA, 25 bp, Homo sapien
cgcgaattcagctcggtggtcactg

SEQ ID NO: 221404 - DNA, 25 bp, Homo sapien
gaattcagctcggtggtcactggca

SEQ ID NO: 221405 - DNA, 25 bp, Homo sapien
aattcagctcggtggtcactggcaa

SEQ ID NO: 221406 - DNA, 25 bp, Homo sapien
cacaagagcctttaactgtaccctt

SEQ ID NO: 221407 - DNA, 25 bp, Homo sapien
aagagcctttaactgtacccttgtg

SEQ ID NO: 221408 - DNA, 25 bp, Homo sapien
gagcctttaactgtacccttgtgtt

SEQ ID NO: 221409 - DNA, 25 bp, Homo sapien
gcctttaactgtacccttgtgttgg

SEQ ID NO: 221410 - DNA, 25 bp, Homo sapien
aactgtacccttgtgttgggattga

SEQ ID NO: 221411 - DNA, 25 bp, Homo sapien
tacccttgtgttgggattgacatct

SEQ ID NO: 221412 - DNA, 25 bp, Homo sapien
gtgttgggattgacatcttgtgact

SEQ ID NO: 221413 - DNA, 25 bp, Homo sapien
gggattgacatcttgtgactgtggc

SEQ ID NO: 221414 - DNA, 25 bp, Homo sapien
attgacatcttgtgactgtggcttt

SEQ ID NO: 221415 - DNA, 25 bp, Homo sapien
acatcttgtgactgtggcttttcca

SEQ ID NO: 221416 - DNA, 25 bp, Homo sapien
tcttgtgactgtggcttttccacaa

SEQ ID NO: 221417 - DNA, 25 bp, Homo sapien
tggaacccctctttgagcagcagtt

SEQ ID NO: 221418 - DNA, 25 bp, Homo sapien
gttcctttagaaagcttgcaattgt

SEQ ID NO: 221419 - DNA, 25 bp, Homo sapien
ttagaaagcttgcaattgtgggcca

SEQ ID NO: 221420 - DNA, 25 bp, Homo sapien
gaaagcttgcaattgtgggccaggc

SEQ ID NO: 221421 - DNA, 25 bp, Homo sapien
aaagcttgcaattgtgggccaggca

SEQ ID NO: 221422 - DNA, 25 bp, Homo sapien
aagcttgcaattgtgggccaggcat

SEQ ID NO: 221423 - DNA, 25 bp, Homo sapien
agcttgcaattgtgggccaggcatg

SEQ ID NO: 221424 - DNA, 25 bp, Homo sapien
tggatcacttgtcataggagttcag

SEQ ID NO: 221425 - DNA, 25 bp, Homo sapien
ggatcacttgtcataggagttcagg

SEQ ID NO: 221426 - DNA, 25 bp, Homo sapien
tcacttgtcataggagttcaggacc

SEQ ID NO: 221427 - DNA, 25 bp, Homo sapien
cacttgtcataggagttcaggacca

SEQ ID NO: 221428 - DNA, 25 bp, Homo sapien
tcgtggaattgaacagaaccttgat

SEQ ID NO: 221429 - DNA, 25 bp, Homo sapien
aaccttgatggaatgcagttgcctg

SEQ ID NO: 221430 - DNA, 25 bp, Homo sapien
ctcagaccacatgcctatctagaga

SEQ ID NO: 221431 - DNA, 25 bp, Homo sapien
gagggacattttgtggatgccttaa

SEQ ID NO: 221432 - DNA, 25 bp, Homo sapien
atgccttaaagatgaccagtggtgg

SEQ ID NO: 221433 - DNA, 25 bp, Homo sapien
atatacactcatctggactaggcca

SEQ ID NO: 221434 - DNA, 25 bp, Homo sapien
ctaggccaatggaagcagtctcttt

SEQ ID NO: 221435 - DNA, 25 bp, Homo sapien
ggaagcagtctctttcagttcacct

SEQ ID NO: 221436 - DNA, 25 bp, Homo sapien
agttcacctccgtacagcacaagtt

SEQ ID NO: 221437 - DNA, 25 bp, Homo sapien
agcacaagttgttcctgctcatgac

SEQ ID NO: 221438 - DNA, 25 bp, Homo sapien
aatgagaattgtggtgctggtgact

SEQ ID NO: 221439 - DNA, 25 bp, Homo sapien
gccagaggggatgcttagcaaaccc

SEQ ID NO: 221440 - DNA, 25 bp, Homo sapien
tagcaaacccaatcccagagtaact

SEQ ID NO: 221441 - DNA, 25 bp, Homo sapien
agcaaacccaatcccagagtaactg

SEQ ID NO: 221442 - DNA, 25 bp, Homo sapien
caaacccaatcccagagtaactgga

SEQ ID NO: 221443 - DNA, 25 bp, Homo sapien
atcccagagtaactggaaaattctc

SEQ ID NO: 221444 - DNA, 25 bp, Homo sapien
gaaaattctccatcaggaggcctgt

SEQ ID NO: 221445 - DNA, 25 bp, Homo sapien
aaattctccatcaggaggcctgtgg

SEQ ID NO: 221446 - DNA, 25 bp, Homo sapien
attctccatcaggaggcctgtggtg

SEQ ID NO: 221447 - DNA, 25 bp, Homo sapien
accttgaggaatcagactatctgtc

SEQ ID NO: 221448 - DNA, 25 bp, Homo sapien
ggaatcagactatctgtctgtgtgt

SEQ ID NO: 221449 - DNA, 25 bp, Homo sapien
atctgtctgtgtgtcacctctcctc

SEQ ID NO: 221450 - DNA, 25 bp, Homo sapien
gtggtatgtcaatacattctgtgag

SEQ ID NO: 221451 - DNA, 25 bp, Homo sapien
atgtcaatacattctgtgagtgtgt

SEQ ID NO: 221452 - DNA, 25 bp, Homo sapien
cattctgtgagtgtgtacagtctga

SEQ ID NO: 221453 - DNA, 25 bp, Homo sapien
ataacttgtcgtatcccatttaaag

SEQ ID NO: 221454 - DNA, 25 bp, Homo sapien
cttgtcgtatcccatttaaaggcca

SEQ ID NO: 221455 - DNA, 25 bp, Homo sapien
gtcgtatcccatttaaaggccaatt

SEQ ID NO: 221456 - DNA, 25 bp, Homo sapien
atcccatttaaaggccaatttctgt

SEQ ID NO: 221457 - DNA, 25 bp, Homo sapien
gccaatttctgtattcaggcaggca

SEQ ID NO: 221458 - DNA, 25 bp, Homo sapien
tttctgtattcaggcaggcatatgt

SEQ ID NO: 221459 - DNA, 25 bp, Homo sapien
tctgtattcaggcaggcatatgtac

SEQ ID NO: 221460 - DNA, 25 bp, Homo sapien
attcaggcaggcatatgtacataca

SEQ ID NO: 221461 - DNA, 25 bp, Homo sapien
ttaacaaaggcgtccgaagaaatcg

SEQ ID NO: 221462 - DNA, 25 bp, Homo sapien
aaagagacgttgctttggccctgca

SEQ ID NO: 221463 - DNA, 25 bp, Homo sapien
tagcctgaaggagtaacactaaatt

SEQ ID NO: 221464 - DNA, 25 bp, Homo sapien
ttttttaccaaccagcgaaagcaga

SEQ ID NO: 221465 - DNA, 25 bp, Homo sapien
caaccagcgaaagcagatgttcaaa

SEQ ID NO: 221466 - DNA, 25 bp, Homo sapien
gatattggccagagtctgtcacact

SEQ ID NO: 221467 - DNA, 25 bp, Homo sapien
ggccagagtctgtcacactaagatg

SEQ ID NO: 221468 - DNA, 25 bp, Homo sapien
gtcacactaagatgagaaatgtcct

SEQ ID NO: 221469 - DNA, 25 bp, Homo sapien
gactcggccgccatgttaggagtac

SEQ ID NO: 221470 - DNA, 25 bp, Homo sapien
gccatgttaggagtactgggacgat

SEQ ID NO: 221471 - DNA, 25 bp, Homo sapien
gaatgattaacaaaggcgtccgaag

SEQ ID NO: 221472 - DNA, 25 bp, Homo sapien
attctgcggccttactttgatattg

SEQ ID NO: 221473 - DNA, 25 bp, Homo sapien
tgatattgacacctgcactgtgcca

SEQ ID NO: 221474 - DNA, 25 bp, Homo sapien
tgcactgtgccattcctgattattc

SEQ ID NO: 221475 - DNA, 25 bp, Homo sapien
aaagccaggtgattcctttgtgtgt

SEQ ID NO: 221476 - DNA, 25 bp, Homo sapien
gattcctttgtgtgttatgtcgtaa

SEQ ID NO: 221477 - DNA, 25 bp, Homo sapien
atgtcgtaagtggagtgacttcatc

SEQ ID NO: 221478 - DNA, 25 bp, Homo sapien
tggagtgacttcatcatatatggaa

SEQ ID NO: 221479 - DNA, 25 bp, Homo sapien
cagctttttctgcaggttggagtca

SEQ ID NO: 221480 - DNA, 25 bp, Homo sapien
gttggagtcagcatagagttggaaa

SEQ ID NO: 221481 - DNA, 25 bp, Homo sapien
gtctcatttcctctagtgttctcct

SEQ ID NO: 221482 - DNA, 25 bp, Homo sapien
tagtgttctcctttttattgtcatc

SEQ ID NO: 221483 - DNA, 25 bp, Homo sapien
aagtagtatgtgttggtgtcatcca

SEQ ID NO: 221484 - DNA, 25 bp, Homo sapien
ggtgtcatccatgaatacaacaatg

SEQ ID NO: 221485 - DNA, 25 bp, Homo sapien
cagaactttctttaagtaatggtgg

SEQ ID NO: 221486 - DNA, 25 bp, Homo sapien
tacaggaaaaggagcaatgtctacc

SEQ ID NO: 221487 - DNA, 25 bp, Homo sapien
tctttctaaccttcgatttaactat

SEQ ID NO: 221488 - DNA, 25 bp, Homo sapien
aaccttcgatttaactattgtaatg

SEQ ID NO: 221489 - DNA, 25 bp, Homo sapien
gtaatgttgtaagcttaacagagac

SEQ ID NO: 221490 - DNA, 25 bp, Homo sapien
taacagagacttacacttaggctta

SEQ ID NO: 221491 - DNA, 25 bp, Homo sapien
gacttacacttaggcttaatttcaa

SEQ ID NO: 221492 - DNA, 25 bp, Homo sapien
tcaatcatttttcccggttggtgat

SEQ ID NO: 221493 - DNA, 25 bp, Homo sapien
ttcccggttggtgattcaggtgtat

SEQ ID NO: 221494 - DNA, 25 bp, Homo sapien
aatatttgtgcctagcaagggatca

SEQ ID NO: 221495 - DNA, 25 bp, Homo sapien
caagggatcaagaagcaatgtgcca

SEQ ID NO: 221496 - DNA, 25 bp, Homo sapien
caatgtgccaaaggtcatgattctt

SEQ ID NO: 221497 - DNA, 25 bp, Homo sapien
gtcatgattcttatcacggatggga

SEQ ID NO: 221498 - DNA, 25 bp, Homo sapien
gatgctttcagagatcctgcgataa

SEQ ID NO: 221499 - DNA, 25 bp, Homo sapien
ttggtgtgaaggatgccgttcgctc

SEQ ID NO: 221500 - DNA, 25 bp, Homo sapien
gatgccgttcgctcagaattggaag

SEQ ID NO: 221501 - DNA, 25 bp, Homo sapien
gaattggaagctattgcctctcctc

SEQ ID NO: 221502 - DNA, 25 bp, Homo sapien
cctgcagagacccatgtgttcacag

SEQ ID NO: 221503 - DNA, 25 bp, Homo sapien
tttgatgcttttcagaggatatctt

SEQ ID NO: 221504 - DNA, 25 bp, Homo sapien
ggatatcttttgaactcacacagtc

SEQ ID NO: 221505 - DNA, 25 bp, Homo sapien
acactgcagctcttttcagtttttg

SEQ ID NO: 221506 - DNA, 25 bp, Homo sapien
ttatacacaattcattctttgcagc

SEQ ID NO: 221507 - DNA, 25 bp, Homo sapien
attctttgcagctaattaagccgaa

SEQ ID NO: 221508 - DNA, 25 bp, Homo sapien
tctttgcagctaattaagccgaaga

SEQ ID NO: 221509 - DNA, 25 bp, Homo sapien
gccgaagaagcctgggaatcaagtt

SEQ ID NO: 221510 - DNA, 25 bp, Homo sapien
tgatgatgaagttccagatcttgtg

SEQ ID NO: 221511 - DNA, 25 bp, Homo sapien
atgatgaagttccagatcttgtgga

SEQ ID NO: 221512 - DNA, 25 bp, Homo sapien
gatgaagttccagatcttgtggaga

SEQ ID NO: 221513 - DNA, 25 bp, Homo sapien
atgaagttccagatcttgtggagaa

SEQ ID NO: 221514 - DNA, 25 bp, Homo sapien
tgaagttccagatcttgtggagaat

SEQ ID NO: 221515 - DNA, 25 bp, Homo sapien
gaagaagttactgggagctgctatt

SEQ ID NO: 221516 - DNA, 25 bp, Homo sapien
gttattgattaccttgattagggca

SEQ ID NO: 221517 - DNA, 25 bp, Homo sapien
gattaccttgattagggcagtttta

SEQ ID NO: 221518 - DNA, 25 bp, Homo sapien
gggcagttttatttccagatcctaa

SEQ ID NO: 221519 - DNA, 25 bp, Homo sapien
cagatcctaataattcctaaaaaat

SEQ ID NO: 221520 - DNA, 25 bp, Homo sapien
ttttttcaatcattgtaccttgata

SEQ ID NO: 221521 - DNA, 25 bp, Homo sapien
gtttcaaggaaatgattgtcacaca

SEQ ID NO: 221522 - DNA, 25 bp, Homo sapien
gattgtcacacatgtcactgtagcc

SEQ ID NO: 221523 - DNA, 25 bp, Homo sapien
cacacatgtcactgtagcctcttgg

SEQ ID NO: 221524 - DNA, 25 bp, Homo sapien
agcctcttggtgtagcaagctcaca

SEQ ID NO: 221525 - DNA, 25 bp, Homo sapien
gcaagctcacatacaaaatactttt

SEQ ID NO: 221526 - DNA, 25 bp, Homo sapien
aaatcatctcatgtggatatgaaac

SEQ ID NO: 221527 - DNA, 25 bp, Homo sapien
gaaaagaggcctcctcagacactct

SEQ ID NO: 221528 - DNA, 25 bp, Homo sapien
gagatgacatcacttgggtacaaac

SEQ ID NO: 221529 - DNA, 25 bp, Homo sapien
aatggttattcatcacctggaggat

SEQ ID NO: 221530 - DNA, 25 bp, Homo sapien
gaggattgtcaatactctcaagcac

SEQ ID NO: 221531 - DNA, 25 bp, Homo sapien
agcactaaagaaagtatttgcccaa

SEQ ID NO: 221532 - DNA, 25 bp, Homo sapien
atggctcagaataagttcatcatgc

SEQ ID NO: 221533 - DNA, 25 bp, Homo sapien
agttcatcatgctaaaccttatgca

SEQ ID NO: 221534 - DNA, 25 bp, Homo sapien
aaaccttatgcatgaaaccactgat

SEQ ID NO: 221535 - DNA, 25 bp, Homo sapien
gaatttatcacctgatgggcaatat

SEQ ID NO: 221536 - DNA, 25 bp, Homo sapien
ggcaatatgtgcctagaatcatgtt

SEQ ID NO: 221537 - DNA, 25 bp, Homo sapien
tagaatcatgtttgtagacccttct

SEQ ID NO: 221538 - DNA, 25 bp, Homo sapien
ggacttctgtttgagggagacgtta

SEQ ID NO: 221539 - DNA, 25 bp, Homo sapien
ggagacgttactgatccagctggtc

SEQ ID NO: 221540 - DNA, 25 bp, Homo sapien
tactgatccagctggtcctcatgtt

SEQ ID NO: 221541 - DNA, 25 bp, Homo sapien
catgttccttactgacttcacaggt

SEQ ID NO: 221542 - DNA, 25 bp, Homo sapien
gacttcacaggtgagcattgtgttt

SEQ ID NO: 221543 - DNA, 25 bp, Homo sapien
agggattgttgcctgcccgcctttc

SEQ ID NO: 221544 - DNA, 25 bp, Homo sapien
aaatgggcagcatttttctgggagc

SEQ ID NO: 221545 - DNA, 25 bp, Homo sapien
tttctgggagcaaggctcagtctta

SEQ ID NO: 221546 - DNA, 25 bp, Homo sapien
aggctcagtcttagggaagtcacaa

SEQ ID NO: 221547 - DNA, 25 bp, Homo sapien
gaagtcacaagctactacccaggga

SEQ ID NO: 221548 - DNA, 25 bp, Homo sapien
gcaagccaacagaagatactctcct

SEQ ID NO: 221549 - DNA, 25 bp, Homo sapien
ttccaacttgagttcaacccaaagc

SEQ ID NO: 221550 - DNA, 25 bp, Homo sapien
aggaatgcattaccacatgaccaca

SEQ ID NO: 221551 - DNA, 25 bp, Homo sapien
atgaccacatgctgagaccccatgg

SEQ ID NO: 221552 - DNA, 25 bp, Homo sapien
tctaacacgggacctaagaaagtct

SEQ ID NO: 221553 - DNA, 25 bp, Homo sapien
aagaaagtctctgcagccagatagt

SEQ ID NO: 221554 - DNA, 25 bp, Homo sapien
gccagatagtacatggtgtctccac

SEQ ID NO: 221555 - DNA, 25 bp, Homo sapien
ggtgtctccacaaaactaggcattc

SEQ ID NO: 221556 - DNA, 25 bp, Homo sapien
taggcattctggagattgcccagaa

SEQ ID NO: 221557 - DNA, 25 bp, Homo sapien
ggaccgttaagatctgtcttgctta

SEQ ID NO: 221558 - DNA, 25 bp, Homo sapien
gtcttgcttatctcatgcactcaca

SEQ ID NO: 221559 - DNA, 25 bp, Homo sapien
gatttcccaatagcttgtggatcag

SEQ ID NO: 221560 - DNA, 25 bp, Homo sapien
gtaacatgacctgtatgaaattcaa

SEQ ID NO: 221561 - DNA, 25 bp, Homo sapien
acatggaagtgctatttattgtttt

SEQ ID NO: 221562 - DNA, 25 bp, Homo sapien
atttctgcacatttcagaacacctt

SEQ ID NO: 221563 - DNA, 25 bp, Homo sapien
tttcagaacacctttctctgctgtt

SEQ ID NO: 221564 - DNA, 25 bp, Homo sapien
ctgctgttccaaacaatgattagga

SEQ ID NO: 221565 - DNA, 25 bp, Homo sapien
ggatattgttcatacagaaattgat

SEQ ID NO: 221566 - DNA, 25 bp, Homo sapien
gatagacaattttttagttcatgtg

SEQ ID NO: 221567 - DNA, 25 bp, Homo sapien
tttagttcatgtgatatcactgagc

SEQ ID NO: 221568 - DNA, 25 bp, Homo sapien
gtgatatcactgagcttacaattct

SEQ ID NO: 221569 - DNA, 25 bp, Homo sapien
ttctcttaattctttccttggaatt

SEQ ID NO: 221570 - DNA, 25 bp, Homo sapien
ttaatatgacctgtgtaacatgacc

SEQ ID NO: 221571 - DNA, 25 bp, Homo sapien
acatccggagccctggtcagcatag

SEQ ID NO: 221572 - DNA, 25 bp, Homo sapien
catccggagccctggtcagcatagc

SEQ ID NO: 221573 - DNA, 25 bp, Homo sapien
ccacggtctgttctcagattcctaa

SEQ ID NO: 221574 - DNA, 25 bp, Homo sapien
cacggtctgttctcagattcctaat

SEQ ID NO: 221575 - DNA, 25 bp, Homo sapien
acggtctgttctcagattcctaatc

SEQ ID NO: 221576 - DNA, 25 bp, Homo sapien
cggtctgttctcagattcctaatca

SEQ ID NO: 221577 - DNA, 25 bp, Homo sapien
cagattcctaatcattccagaagta

SEQ ID NO: 221578 - DNA, 25 bp, Homo sapien
agattcctaatcattccagaagtat

SEQ ID NO: 221579 - DNA, 25 bp, Homo sapien
gattcctaatcattccagaagtatt

SEQ ID NO: 221580 - DNA, 25 bp, Homo sapien
attcctaatcattccagaagtatta

SEQ ID NO: 221581 - DNA, 25 bp, Homo sapien
agaagtattaaacgtcattgctgca

SEQ ID NO: 221582 - DNA, 25 bp, Homo sapien
ctgatggatcaaccggtacaatctt

SEQ ID NO: 221583 - DNA, 25 bp, Homo sapien
ttgcttataaacaaccgtattcaca

SEQ ID NO: 221584 - DNA, 25 bp, Homo sapien
atatcttgttgttgtgctacttcac

SEQ ID NO: 221585 - DNA, 25 bp, Homo sapien
ttgtgctacttcacctggtacacta

SEQ ID NO: 221586 - DNA, 25 bp, Homo sapien
acctggtacactattgcggtcagta

SEQ ID NO: 221587 - DNA, 25 bp, Homo sapien
gcggtcagtatagtagcccttaata

SEQ ID NO: 221588 - DNA, 25 bp, Homo sapien
gcccttaataggatcaactttgaca

SEQ ID NO: 221589 - DNA, 25 bp, Homo sapien
atgccatgcttcatctggattcaag

SEQ ID NO: 221590 - DNA, 25 bp, Homo sapien
gatttcaccagtagccttatcgaca

SEQ ID NO: 221591 - DNA, 25 bp, Homo sapien
acaatcaatgttcgtgtccaatttg

SEQ ID NO: 221592 - DNA, 25 bp, Homo sapien
tcgtgtagtttattaccgttttcat

SEQ ID NO: 221593 - DNA, 25 bp, Homo sapien
caccacaggcctcctgatggagaat

SEQ ID NO: 221594 - DNA, 25 bp, Homo sapien
ggcctcctgatggagaattttccag

SEQ ID NO: 221595 - DNA, 25 bp, Homo sapien
gagaattttccagttactctgggat

SEQ ID NO: 221596 - DNA, 25 bp, Homo sapien
cagttactctgggattgggtttgct

SEQ ID NO: 221597 - DNA, 25 bp, Homo sapien
attgggtttgctaagcatcccctct

SEQ ID NO: 221598 - DNA, 25 bp, Homo sapien
gggtttgctaagcatcccctctggc

SEQ ID NO: 221599 - DNA, 25 bp, Homo sapien
aaggagggactctgggaacatgcaa

SEQ ID NO: 221600 - DNA, 25 bp, Homo sapien
agggactctgggaacatgcaaagtg

SEQ ID NO: 221601 - DNA, 25 bp, Homo sapien
gacagatagtctgattcctcaaggt

SEQ ID NO: 221602 - DNA, 25 bp, Homo sapien
atagtctgattcctcaaggtcctgc

SEQ ID NO: 221603 - DNA, 25 bp, Homo sapien
aaggtcctgcctgcctggctgtact

SEQ ID NO: 221604 - DNA, 25 bp, Homo sapien
aagggataatgcatgtgccactcaa

SEQ ID NO: 221605 - DNA, 25 bp, Homo sapien
gttagcaccgcatatctccaaagag

SEQ ID NO: 221606 - DNA, 25 bp, Homo sapien
aagagcacaatcaacactggagcgc

SEQ ID NO: 221607 - DNA, 25 bp, Homo sapien
aatcaacactggagcgcacatctca

SEQ ID NO: 221608 - DNA, 25 bp, Homo sapien
gcacatctcactgcagacaggtcag

SEQ ID NO: 221609 - DNA, 25 bp, Homo sapien
agacaggtcagtggcgttcctgccc

SEQ ID NO: 221610 - DNA, 25 bp, Homo sapien
tgccctgcacgcgattgcttagcag

SEQ ID NO: 221611 - DNA, 25 bp, Homo sapien
attgcttagcagtgaggtgagctca

SEQ ID NO: 221612 - DNA, 25 bp, Homo sapien
gtgaggtgagctcatggctctctta

SEQ ID NO: 221613 - DNA, 25 bp, Homo sapien
gagctcatggctctcttacagagaa

SEQ ID NO: 221614 - DNA, 25 bp, Homo sapien
tctcttacagagaaatgggccttaa

SEQ ID NO: 221615 - DNA, 25 bp, Homo sapien
gtgcataaatgttaaaccttccaaa

SEQ ID NO: 221616 - DNA, 25 bp, Homo sapien
tttgcagtaagatgtctctagcact

SEQ ID NO: 221617 - DNA, 25 bp, Homo sapien
gtaagatgtctctagcactgctcaa

SEQ ID NO: 221618 - DNA, 25 bp, Homo sapien
atgtctctagcactgctcaaagggc

SEQ ID NO: 221619 - DNA, 25 bp, Homo sapien
gggcaaattttaaaacttcagtctg

SEQ ID NO: 221620 - DNA, 25 bp, Homo sapien
gggtgaaagatttgctagttttaca

SEQ ID NO: 221621 - DNA, 25 bp, Homo sapien
gatttgctatcttaaactcaagctg

SEQ ID NO: 221622 - DNA, 25 bp, Homo sapien
actcaagctggtttttctgttctca

SEQ ID NO: 221623 - DNA, 25 bp, Homo sapien
ttttctgttctcatgtaagtgactg

SEQ ID NO: 221624 - DNA, 25 bp, Homo sapien
gtaagtgactgggatgctgtcttat

SEQ ID NO: 221625 - DNA, 25 bp, Homo sapien
gatgctgtcttatgaattcttccaa

SEQ ID NO: 221626 - DNA, 25 bp, Homo sapien
tgtaacctctttcagcagtatattt

SEQ ID NO: 221627 - DNA, 25 bp, Homo sapien
gcagtatattttggtacctggtaca

SEQ ID NO: 221628 - DNA, 25 bp, Homo sapien
cagtatattttggtacctggtacag

SEQ ID NO: 221629 - DNA, 25 bp, Homo sapien
ttggtacctggtacagtcaacgtgc

SEQ ID NO: 221630 - DNA, 25 bp, Homo sapien
ggtacagtcaacgtgctgagtgtta

SEQ ID NO: 221631 - DNA, 25 bp, Homo sapien
ctgagtgttagggttccattaaagg

SEQ ID NO: 221632 - DNA, 25 bp, Homo sapien
tgagtgttagggttccattaaagga

SEQ ID NO: 221633 - DNA, 25 bp, Homo sapien
aaacaggatatcatgtacataatgc

SEQ ID NO: 221634 - DNA, 25 bp, Homo sapien
caggatatcatgtacataatgcatt

SEQ ID NO: 221635 - DNA, 25 bp, Homo sapien
gatatcatgtacataatgcatttga

SEQ ID NO: 221636 - DNA, 25 bp, Homo sapien
aatgcatttgatttagaagttgagt

SEQ ID NO: 221637 - DNA, 25 bp, Homo sapien
cctggcaggaacgtcacagtggcct

SEQ ID NO: 221638 - DNA, 25 bp, Homo sapien
ggcaggaacgtcacagtggcctcga

SEQ ID NO: 221639 - DNA, 25 bp, Homo sapien
ggaacgtcacagtggcctcgagcag

SEQ ID NO: 221640 - DNA, 25 bp, Homo sapien
gtcacagtggcctcgagcaggagcc

SEQ ID NO: 221641 - DNA, 25 bp, Homo sapien
tgccttatcgcccagctacgacggg

SEQ ID NO: 221642 - DNA, 25 bp, Homo sapien
ggcctgcagagtaagatagaagacc

SEQ ID NO: 221643 - DNA, 25 bp, Homo sapien
atagaagaccacctggacgaggcca

SEQ ID NO: 221644 - DNA, 25 bp, Homo sapien
agaagaccacctggacgaggccatc

SEQ ID NO: 221645 - DNA, 25 bp, Homo sapien
gcgacatgcacacgctgctgcctgg

SEQ ID NO: 221646 - DNA, 25 bp, Homo sapien
gggcggcacgcaggcctggttggag

SEQ ID NO: 221647 - DNA, 25 bp, Homo sapien
aggcctggttggaggcagccacccc

SEQ ID NO: 221648 - DNA, 25 bp, Homo sapien
gtgtaacatgacctgtatgaaattc

SEQ ID NO: 221649 - DNA, 25 bp, Homo sapien
taacatgacctgtatgaaattcaac

SEQ ID NO: 221650 - DNA, 25 bp, Homo sapien
gaaattcaacttgcaaatttattat

SEQ ID NO: 221651 - DNA, 25 bp, Homo sapien
acatggaagtgctatttattgtttt

SEQ ID NO: 221652 - DNA, 25 bp, Homo sapien
atttctgcacatttcagaacacctt

SEQ ID NO: 221653 - DNA, 25 bp, Homo sapien
ctgctgttccaaacaatgattagga

SEQ ID NO: 221654 - DNA, 25 bp, Homo sapien
ggatattgttcatacagaaattgat

SEQ ID NO: 221655 - DNA, 25 bp, Homo sapien
gatagacaattttttagttcatgtg

SEQ ID NO: 221656 - DNA, 25 bp, Homo sapien
tttagttcatgtgatatcactgagc

SEQ ID NO: 221657 - DNA, 25 bp, Homo sapien
gtgatatcactgagcttacaattct

SEQ ID NO: 221658 - DNA, 25 bp, Homo sapien
ttaatatgacctgtgtaacatgacc

SEQ ID NO: 221659 - DNA, 25 bp, Homo sapien
ttcagctacaccgaggtggaagagt

SEQ ID NO: 221660 - DNA, 25 bp, Homo sapien
gaagagtgcggctgcatgggccggc

SEQ ID NO: 221661 - DNA, 25 bp, Homo sapien
aggcggaacccgagcccagccagga

SEQ ID NO: 221662 - DNA, 25 bp, Homo sapien
aggagaacctcccatatgtcctctg

SEQ ID NO: 221663 - DNA, 25 bp, Homo sapien
gaacctcccatatgtcctctgagct

SEQ ID NO: 221664 - DNA, 25 bp, Homo sapien
aaggccagtggaacttgtgcccctg

SEQ ID NO: 221665 - DNA, 25 bp, Homo sapien
cagtggaacttgtgcccctgtccag

SEQ ID NO: 221666 - DNA, 25 bp, Homo sapien
aacttgtgcccctgtccaggcggct

SEQ ID NO: 221667 - DNA, 25 bp, Homo sapien
aggcggctgcagctttgaacacact

SEQ ID NO: 221668 - DNA, 25 bp, Homo sapien
gcggctgcagctttgaacacactgt

SEQ ID NO: 221669 - DNA, 25 bp, Homo sapien
tgcagctttgaacacactgtccacg

SEQ ID NO: 221670 - DNA, 25 bp, Homo sapien
ttgccattcttccatgtgagttagt

SEQ ID NO: 221671 - DNA, 25 bp, Homo sapien
tatggttcgtaagtattcctggtga

SEQ ID NO: 221672 - DNA, 25 bp, Homo sapien
ttcctggtgatacgctagtattggc

SEQ ID NO: 221673 - DNA, 25 bp, Homo sapien
attaggagacctctgggtcttgaca

SEQ ID NO: 221674 - DNA, 25 bp, Homo sapien
agtgccctggccactaagcaaaggc

SEQ ID NO: 221675 - DNA, 25 bp, Homo sapien
aagcaaaggcagttcatccttggag

SEQ ID NO: 221676 - DNA, 25 bp, Homo sapien
atccttggagtctcaatgtgctttt

SEQ ID NO: 221677 - DNA, 25 bp, Homo sapien
gatatgcttgaagtatcagccctaa

SEQ ID NO: 221678 - DNA, 25 bp, Homo sapien
agccctaaatagtctgattctgtga

SEQ ID NO: 221679 - DNA, 25 bp, Homo sapien
tgtgacctacaaacccttacttaat

SEQ ID NO: 221680 - DNA, 25 bp, Homo sapien
gttactataaatgattcttccctta

SEQ ID NO: 221681 - DNA, 25 bp, Homo sapien
ttccaggaagtggtaccactctggg

SEQ ID NO: 221682 - DNA, 25 bp, Homo sapien
aaatgagcacacatgaccttccttt

SEQ ID NO: 221683 - DNA, 25 bp, Homo sapien
cacatgaccttcctttcctataaaa

SEQ ID NO: 221684 - DNA, 25 bp, Homo sapien
tgaagcagaaaactcccccatgatt

SEQ ID NO: 221685 - DNA, 25 bp, Homo sapien
atgatttcctcatgttgcttagaat

SEQ ID NO: 221686 - DNA, 25 bp, Homo sapien
gttgcttagaatagtgtgtatttca

SEQ ID NO: 221687 - DNA, 25 bp, Homo sapien
gtgtatttcagaacttttccattta

SEQ ID NO: 221688 - DNA, 25 bp, Homo sapien
tggaccacagttgactgaaactgag

SEQ ID NO: 221689 - DNA, 25 bp, Homo sapien
gcccctagtcaagtgaattctaatg

SEQ ID NO: 221690 - DNA, 25 bp, Homo sapien
tataaaaattgaacctctgttttga

SEQ ID NO: 221691 - DNA, 25 bp, Homo sapien
ttgaaaacaaatctttccaggaagt

SEQ ID NO: 221692 - DNA, 25 bp, Homo sapien
gagatcataccactgtgttctagcc

SEQ ID NO: 221693 - DNA, 25 bp, Homo sapien
cactgtgttctagcctgggccatag

SEQ ID NO: 221694 - DNA, 25 bp, Homo sapien
tttggtttagtctacaactatacct

SEQ ID NO: 221695 - DNA, 25 bp, Homo sapien
gtttagtctacaactataccttcct

SEQ ID NO: 221696 - DNA, 25 bp, Homo sapien
tataccttccttataacttaaccat

SEQ ID NO: 221697 - DNA, 25 bp, Homo sapien
accttccttataacttaaccatatg

SEQ ID NO: 221698 - DNA, 25 bp, Homo sapien
ccttataacttaaccatatgcattt

SEQ ID NO: 221699 - DNA, 25 bp, Homo sapien
ataacttaaccatatgcatttatta

SEQ ID NO: 221700 - DNA, 25 bp, Homo sapien
aaagtttatgtaatgcagacaggaa

SEQ ID NO: 221701 - DNA, 25 bp, Homo sapien
gcagacaggaagctctatgttccct

SEQ ID NO: 221702 - DNA, 25 bp, Homo sapien
gacaggaagctctatgttcccttct

SEQ ID NO: 221703 - DNA, 25 bp, Homo sapien
tctgaaccccacatgagaactagaa

SEQ ID NO: 221704 - DNA, 25 bp, Homo sapien
agaaatcaaggtcgaaggacagctt

SEQ ID NO: 221705 - DNA, 25 bp, Homo sapien
tttctataatgaggatgactctgaa

SEQ ID NO: 221706 - DNA, 25 bp, Homo sapien
ggagcaaaggcagctgttgttcgaa

SEQ ID NO: 221707 - DNA, 25 bp, Homo sapien
ggcagctgttgttcgaagacacctc

SEQ ID NO: 221708 - DNA, 25 bp, Homo sapien
agctgttgttcgaagacacctcttt

SEQ ID NO: 221709 - DNA, 25 bp, Homo sapien
gttgttcgaagacacctctttaact

SEQ ID NO: 221710 - DNA, 25 bp, Homo sapien
tcgaagacacctctttaacttttgg

SEQ ID NO: 221711 - DNA, 25 bp, Homo sapien
aacttctagtagaggacgagtccga

SEQ ID NO: 221712 - DNA, 25 bp, Homo sapien
ggacgagtccgaaagttgactgaaa

SEQ ID NO: 221713 - DNA, 25 bp, Homo sapien
aatctataaagcaggtacagttaag

SEQ ID NO: 221714 - DNA, 25 bp, Homo sapien
ggcattggcaaagcaactgcccttg

SEQ ID NO: 221715 - DNA, 25 bp, Homo sapien
aagcaactgcccttgaaatcgccaa

SEQ ID NO: 221716 - DNA, 25 bp, Homo sapien
agaacatttttctgcacattgtgga

SEQ ID NO: 221717 - DNA, 25 bp, Homo sapien
tgtggacttgtctgatcccaagcaa

SEQ ID NO: 221718 - DNA, 25 bp, Homo sapien
gtctgatcccaagcaaatctggaaa

SEQ ID NO: 221719 - DNA, 25 bp, Homo sapien
cataaactccatgttctgatcaata

SEQ ID NO: 221720 - DNA, 25 bp, Homo sapien
atgcaggttgcatggtcaataaaag

SEQ ID NO: 221721 - DNA, 25 bp, Homo sapien
aactttgctgccaatactctgggtg

SEQ ID NO: 221722 - DNA, 25 bp, Homo sapien
actctgggtgtgtacattctcacga

SEQ ID NO: 221723 - DNA, 25 bp, Homo sapien
tgtacattctcacgaccggcctgat

SEQ ID NO: 221724 - DNA, 25 bp, Homo sapien
gagtgataaccgtctcctcaggagg

SEQ ID NO: 221725 - DNA, 25 bp, Homo sapien
acagcttggtatattactacgaaag

SEQ ID NO: 221726 - DNA, 25 bp, Homo sapien
tatattactacgaaagataaccacc

SEQ ID NO: 221727 - DNA, 25 bp, Homo sapien
agaatcatacagtttgcacacgaca

SEQ ID NO: 221728 - DNA, 25 bp, Homo sapien
tacagtttgcacacgacaagtaggt

SEQ ID NO: 221729 - DNA, 25 bp, Homo sapien
acaagtaggtaataactgtctctaa

SEQ ID NO: 221730 - DNA, 25 bp, Homo sapien
aaatgttttctccttagtccgcaat

SEQ ID NO: 221731 - DNA, 25 bp, Homo sapien
tttctccttagtccgcaatgagcta

SEQ ID NO: 221732 - DNA, 25 bp, Homo sapien
tccttagtccgcaatgagctaagat

SEQ ID NO: 221733 - DNA, 25 bp, Homo sapien
agattcagaatagtgtcaacagcat

SEQ ID NO: 221734 - DNA, 25 bp, Homo sapien
gtcaacagcatgctcctatatgaag

SEQ ID NO: 221735 - DNA, 25 bp, Homo sapien
agcatgctcctatatgaagttgttt

SEQ ID NO: 221736 - DNA, 25 bp, Homo sapien
gcttattgtctcattctgacttcat

SEQ ID NO: 221737 - DNA, 25 bp, Homo sapien
ttattgtctcattctgacttcatgg

SEQ ID NO: 221738 - DNA, 25 bp, Homo sapien
gacttcatggagaattaatcccacc

SEQ ID NO: 221739 - DNA, 25 bp, Homo sapien
ttcatggagaattaatcccaccttt

SEQ ID NO: 221740 - DNA, 25 bp, Homo sapien
catggagaattaatcccacctttaa

SEQ ID NO: 221741 - DNA, 25 bp, Homo sapien
atggagaattaatcccacctttaag

SEQ ID NO: 221742 - DNA, 25 bp, Homo sapien
tggagaattaatcccacctttaagc

SEQ ID NO: 221743 - DNA, 25 bp, Homo sapien
ccacctttaagcaaaggctactaag

SEQ ID NO: 221744 - DNA, 25 bp, Homo sapien
aatggtattttctgtgcagaaatta

SEQ ID NO: 221745 - DNA, 25 bp, Homo sapien
ttagcccaggaattcttccagtagg

SEQ ID NO: 221746 - DNA, 25 bp, Homo sapien
tagcccaggaattcttccagtaggt

SEQ ID NO: 221747 - DNA, 25 bp, Homo sapien
aaccttgtcaggttggtgttggctc

SEQ ID NO: 221748 - DNA, 25 bp, Homo sapien
cttgtcaggttggtgttggctcgat

SEQ ID NO: 221749 - DNA, 25 bp, Homo sapien
gttggtgttggctcgatgctgacaa

SEQ ID NO: 221750 - DNA, 25 bp, Homo sapien
ttggctcgatgctgacaacaggtgt

SEQ ID NO: 221751 - DNA, 25 bp, Homo sapien
ctcgatgctgacaacaggtgtgtga

SEQ ID NO: 221752 - DNA, 25 bp, Homo sapien
tcttctcgccgtttcaaacaggctg

SEQ ID NO: 221753 - DNA, 25 bp, Homo sapien
tcgccgtttcaaacaggctgctttg

SEQ ID NO: 221754 - DNA, 25 bp, Homo sapien
gccgtttcaaacaggctgctttggg

SEQ ID NO: 221755 - DNA, 25 bp, Homo sapien
ggctgctttgggattcaggttccgc

SEQ ID NO: 221756 - DNA, 25 bp, Homo sapien
tgctttgggattcaggttccgctct

SEQ ID NO: 221757 - DNA, 25 bp, Homo sapien
ttgggattcaggttccgctctcgca

SEQ ID NO: 221758 - DNA, 25 bp, Homo sapien
gatataccctgccttaagccgctga

SEQ ID NO: 221759 - DNA, 25 bp, Homo sapien
aagccgctgaggtgatgagtccact

SEQ ID NO: 221760 - DNA, 25 bp, Homo sapien
tgatgagtccactgctcatgtgacc

SEQ ID NO: 221761 - DNA, 25 bp, Homo sapien
atgtgaccctccacctttgtggatc

SEQ ID NO: 221762 - DNA, 25 bp, Homo sapien
tgtggatccctcttggtttgtgacc

SEQ ID NO: 221763 - DNA, 25 bp, Homo sapien
gtttgtgaccagtgtgtctgtttgt

SEQ ID NO: 221764 - DNA, 25 bp, Homo sapien
gtattttctgcactgttgcactctc

SEQ ID NO: 221765 - DNA, 25 bp, Homo sapien
tgcactgttgcactctccaaatggc

SEQ ID NO: 221766 - DNA, 25 bp, Homo sapien
caaatggccccttgagtatttttat

SEQ ID NO: 221767 - DNA, 25 bp, Homo sapien
tgatgtctacattttttcctttaat

SEQ ID NO: 221768 - DNA, 25 bp, Homo sapien
ggttacctgctgttggatttaataa

SEQ ID NO: 221769 - DNA, 25 bp, Homo sapien
tgcagcttcatttgcgagagcgccg

SEQ ID NO: 221770 - DNA, 25 bp, Homo sapien
ttcatttgcgagagcgccgaggcag

SEQ ID NO: 221771 - DNA, 25 bp, Homo sapien
gcgccgaggcaggacacagagcaca

SEQ ID NO: 221772 - DNA, 25 bp, Homo sapien
ggagaacccggacagctcagtcctg

SEQ ID NO: 221773 - DNA, 25 bp, Homo sapien
cagtcctgccagcagccgcaaagag

SEQ ID NO: 221774 - DNA, 25 bp, Homo sapien
ccagcagccgcaaagagccgaggct

SEQ ID NO: 221775 - DNA, 25 bp, Homo sapien
tgccaggcccatttatgtccctcat

SEQ ID NO: 221776 - DNA, 25 bp, Homo sapien
atttatgtccctcatgtctctagat

SEQ ID NO: 221777 - DNA, 25 bp, Homo sapien
atgtccctcatgtctctagattttc

SEQ ID NO: 221778 - DNA, 25 bp, Homo sapien
tcatgtctctagattttctcgtcac

SEQ ID NO: 221779 - DNA, 25 bp, Homo sapien
tgtctctagattttctcgtcaccca

SEQ ID NO: 221780 - DNA, 25 bp, Homo sapien
ttactcgctggcagccattgtctgt

SEQ ID NO: 221781 - DNA, 25 bp, Homo sapien
agccattgtctgtgggcacctcatg

SEQ ID NO: 221782 - DNA, 25 bp, Homo sapien
tgggcacctcatgtttttccacact

SEQ ID NO: 221783 - DNA, 25 bp, Homo sapien
tctactgggccgtggaggtaacgat

SEQ ID NO: 221784 - DNA, 25 bp, Homo sapien
ggaggtaacgatcacccaggccagt

SEQ ID NO: 221785 - DNA, 25 bp, Homo sapien
ctctggacacatgcctcctttaaag

SEQ ID NO: 221786 - DNA, 25 bp, Homo sapien
cctcctttaaagtgtccgggtgcag

SEQ ID NO: 221787 - DNA, 25 bp, Homo sapien
aaagtgtccgggtgcagctcaggtt

SEQ ID NO: 221788 - DNA, 25 bp, Homo sapien
acagacatgtttaccacgcgttttc

SEQ ID NO: 221789 - DNA, 25 bp, Homo sapien
tgtttaccacgcgttttccaaagct

SEQ ID NO: 221790 - DNA, 25 bp, Homo sapien
gttttccaaagctcctgatctttcc

SEQ ID NO: 221791 - DNA, 25 bp, Homo sapien
ggaataccaagccaatgactctgac

SEQ ID NO: 221792 - DNA, 25 bp, Homo sapien
aatgactctgactcggacgggccta

SEQ ID NO: 221793 - DNA, 25 bp, Homo sapien
gggcctatcttgtacaccgatgatg

SEQ ID NO: 221794 - DNA, 25 bp, Homo sapien
aagtgctttggcaagtaaaatacgc

SEQ ID NO: 221795 - DNA, 25 bp, Homo sapien
atacgccggagggatactcttgcta

SEQ ID NO: 221796 - DNA, 25 bp, Homo sapien
gatactcttgctatcaaacttggca

SEQ ID NO: 221797 - DNA, 25 bp, Homo sapien
aaacttggcaacagaccatctaaga

SEQ ID NO: 221798 - DNA, 25 bp, Homo sapien
gaggacaaaaacatcttgcagcgta

SEQ ID NO: 221799 - DNA, 25 bp, Homo sapien
acatcttgcagcgtacatctgaaga

SEQ ID NO: 221800 - DNA, 25 bp, Homo sapien
tccgacaacaaattggaaccaagtt

SEQ ID NO: 221801 - DNA, 25 bp, Homo sapien
gagccagaggcccacaactgaagaa

SEQ ID NO: 221802 - DNA, 25 bp, Homo sapien
tgccacctcctgtctactcattgtt

SEQ ID NO: 221803 - DNA, 25 bp, Homo sapien
cacctcctgtctactcattgttgca

SEQ ID NO: 221804 - DNA, 25 bp, Homo sapien
ttgcatgagccctgtctgccagccc

SEQ ID NO: 221805 - DNA, 25 bp, Homo sapien
caagaggtgagggtgcacgtcttcc

SEQ ID NO: 221806 - DNA, 25 bp, Homo sapien
aagaggtgagggtgcacgtcttccc

SEQ ID NO: 221807 - DNA, 25 bp, Homo sapien
aggtgagggtgcacgtcttccctcc

SEQ ID NO: 221808 - DNA, 25 bp, Homo sapien
gtgagggtgcacgtcttccctcctg

SEQ ID NO: 221809 - DNA, 25 bp, Homo sapien
gagggtgcacgtcttccctcctgtc

SEQ ID NO: 221810 - DNA, 25 bp, Homo sapien
ccagcctggcgtagagcacccctcc

SEQ ID NO: 221811 - DNA, 25 bp, Homo sapien
gggaagccttcctctcaatttgttg

SEQ ID NO: 221812 - DNA, 25 bp, Homo sapien
aagccttcctctcaatttgttgtca

SEQ ID NO: 221813 - DNA, 25 bp, Homo sapien
gcgtaacaaatgaaggttccaattt

SEQ ID NO: 221814 - DNA, 25 bp, Homo sapien
atttttctacaatgctcaccaacac

SEQ ID NO: 221815 - DNA, 25 bp, Homo sapien
ttcctttgaactgctgggtaatatt

SEQ ID NO: 221816 - DNA, 25 bp, Homo sapien
gatcacatttatctactcatcagtt

SEQ ID NO: 221817 - DNA, 25 bp, Homo sapien
ctgctaactcatatacaggtttttg

SEQ ID NO: 221818 - DNA, 25 bp, Homo sapien
atattttttgaattctcttgggtat

SEQ ID NO: 221819 - DNA, 25 bp, Homo sapien
aaatttctgggtcatatggttactc

SEQ ID NO: 221820 - DNA, 25 bp, Homo sapien
tatggttactcagcttatctttttg

SEQ ID NO: 221821 - DNA, 25 bp, Homo sapien
gaggaattaccaaaatcagtcacac

SEQ ID NO: 221822 - DNA, 25 bp, Homo sapien
atcagtcacactatcttacattcct

SEQ ID NO: 221823 - DNA, 25 bp, Homo sapien
actatcttacattcctagcgtaaca

SEQ ID NO: 221824 - DNA, 25 bp, Homo sapien
tatattagtcatcaccctgtaaggt

SEQ ID NO: 221825 - DNA, 25 bp, Homo sapien
tctcagcacactttaggagtgaatg

SEQ ID NO: 221826 - DNA, 25 bp, Homo sapien
ttacaggcttcagttctactgctgg

SEQ ID NO: 221827 - DNA, 25 bp, Homo sapien
actgctggccaccattggatttgta

SEQ ID NO: 221828 - DNA, 25 bp, Homo sapien
aagatccaggatgtgtattgaccac

SEQ ID NO: 221829 - DNA, 25 bp, Homo sapien
gtattgaccacatgtgtccagaccc

SEQ ID NO: 221830 - DNA, 25 bp, Homo sapien
acatgtgtccagacccaggcttagg

SEQ ID NO: 221831 - DNA, 25 bp, Homo sapien
gacccaggcttagggcatctggaat

SEQ ID NO: 221832 - DNA, 25 bp, Homo sapien
accctgtaaggtggatgacatatta

SEQ ID NO: 221833 - DNA, 25 bp, Homo sapien
tgacatattattcccattattccaa

SEQ ID NO: 221834 - DNA, 25 bp, Homo sapien
attgggccatagaaaactgaggagc

SEQ ID NO: 221835 - DNA, 25 bp, Homo sapien
cagccctgcaggtcttccttctgtg

SEQ ID NO: 221836 - DNA, 25 bp, Homo sapien
tccttctgtgggaagcttcctagca

SEQ ID NO: 221837 - DNA, 25 bp, Homo sapien
tgggaagcttcctagcaagatggct

SEQ ID NO: 221838 - DNA, 25 bp, Homo sapien
agcaagatggcttggagtcctggtc

SEQ ID NO: 221839 - DNA, 25 bp, Homo sapien
gccctctcgttcgtttctgtttctg

SEQ ID NO: 221840 - DNA, 25 bp, Homo sapien
tctgtttctgtttacacgttggagt

SEQ ID NO: 221841 - DNA, 25 bp, Homo sapien
tgtcgtccggcctcttgtgctcgag

SEQ ID NO: 221842 - DNA, 25 bp, Homo sapien
tgctcgagcccctttccgagttgga

SEQ ID NO: 221843 - DNA, 25 bp, Homo sapien
ttccgagttggactcgaccatccct

SEQ ID NO: 221844 - DNA, 25 bp, Homo sapien
cccaccaaggaccacactgtgaagt

SEQ ID NO: 221845 - DNA, 25 bp, Homo sapien
gaccacactgtgaagtgataactgc

SEQ ID NO: 221846 - DNA, 25 bp, Homo sapien
aagcaccaggagcttcctcactctt

SEQ ID NO: 221847 - DNA, 25 bp, Homo sapien
gaaagacctcatgcacgcgctcagg

SEQ ID NO: 221848 - DNA, 25 bp, Homo sapien
atgcacgcgctcaggaagaccggaa

SEQ ID NO: 221849 - DNA, 25 bp, Homo sapien
caggaagaccggaacggcgaatgct

SEQ ID NO: 221850 - DNA, 25 bp, Homo sapien
gaaggtaacgggagccgacctgact

SEQ ID NO: 221851 - DNA, 25 bp, Homo sapien
taacgggagccgacctgacttggaa

SEQ ID NO: 221852 - DNA, 25 bp, Homo sapien
aagaggaagcatcgactccacgagc

SEQ ID NO: 221853 - DNA, 25 bp, Homo sapien
aggaagcatcgactccacgagcctc

SEQ ID NO: 221854 - DNA, 25 bp, Homo sapien
tccttcggattagcctttgtggttg

SEQ ID NO: 221855 - DNA, 25 bp, Homo sapien
gattagcctttgtggttgcacccgc

SEQ ID NO: 221856 - DNA, 25 bp, Homo sapien
tttgtggttgcacccgccgcggcca

SEQ ID NO: 221857 - DNA, 25 bp, Homo sapien
aaaatagtgggcaatgatccataag

SEQ ID NO: 221858 - DNA, 25 bp, Homo sapien
aaatagtgggcaatgatccataaga

SEQ ID NO: 221859 - DNA, 25 bp, Homo sapien
aatagtgggcaatgatccataagaa

SEQ ID NO: 221860 - DNA, 25 bp, Homo sapien
atagtgggcaatgatccataagaag

SEQ ID NO: 221861 - DNA, 25 bp, Homo sapien
agtgggcaatgatccataagaagat

SEQ ID NO: 221862 - DNA, 25 bp, Homo sapien
gtgggcaatgatccataagaagata

SEQ ID NO: 221863 - DNA, 25 bp, Homo sapien
tgggcaatgatccataagaagataa

SEQ ID NO: 221864 - DNA, 25 bp, Homo sapien
aagaagataaacatctcaggccggg

SEQ ID NO: 221865 - DNA, 25 bp, Homo sapien
agaagataaacatctcaggccggga

SEQ ID NO: 221866 - DNA, 25 bp, Homo sapien
ttccatctacttgagaggcttaggt

SEQ ID NO: 221867 - DNA, 25 bp, Homo sapien
agaggcttaggtaggagaagtgctt

SEQ ID NO: 221868 - DNA, 25 bp, Homo sapien
atctcacatttgacaagactctaag

SEQ ID NO: 221869 - DNA, 25 bp, Homo sapien
ttaaagatgcactacatgttttttg

SEQ ID NO: 221870 - DNA, 25 bp, Homo sapien
agcattgtgaaaacagtcaaggcaa

SEQ ID NO: 221871 - DNA, 25 bp, Homo sapien
gcaatatgaatatctccgtgtagct

SEQ ID NO: 221872 - DNA, 25 bp, Homo sapien
gaatatctccgtgtagctaattgaa

SEQ ID NO: 221873 - DNA, 25 bp, Homo sapien
ggaactggaaaaatgcagacctcta

SEQ ID NO: 221874 - DNA, 25 bp, Homo sapien
aacagctaatagcagagccccaatg

SEQ ID NO: 221875 - DNA, 25 bp, Homo sapien
gcagagccccaatgaaatatcttta

SEQ ID NO: 221876 - DNA, 25 bp, Homo sapien
tctttatcatcaccttgcttcattt

SEQ ID NO: 221877 - DNA, 25 bp, Homo sapien
tatcatcaccttgcttcattttctt

SEQ ID NO: 221878 - DNA, 25 bp, Homo sapien
tttcttgaaactcaggcttgtaaat

SEQ ID NO: 221879 - DNA, 25 bp, Homo sapien
gaagctcccggaaagagcagaggga

SEQ ID NO: 221880 - DNA, 25 bp, Homo sapien
gtaggcggctgtgtgactctagtct

SEQ ID NO: 221881 - DNA, 25 bp, Homo sapien
aggcggctgtgtgactctagtcttg

SEQ ID NO: 221882 - DNA, 25 bp, Homo sapien
ctgtgtgactctagtcttggcccca

SEQ ID NO: 221883 - DNA, 25 bp, Homo sapien
cttggccccaggaagcgaaggaaca

SEQ ID NO: 221884 - DNA, 25 bp, Homo sapien
tatttataagagatcctttcccatt

SEQ ID NO: 221885 - DNA, 25 bp, Homo sapien
cctttcccatttattctgggaagat

SEQ ID NO: 221886 - DNA, 25 bp, Homo sapien
tttcaaactcagagacaaggacttt

SEQ ID NO: 221887 - DNA, 25 bp, Homo sapien
ctcagagacaaggactttggttttt

SEQ ID NO: 221888 - DNA, 25 bp, Homo sapien
agacaaacgatgatatgaaggcctt

SEQ ID NO: 221889 - DNA, 25 bp, Homo sapien
acaaacgatgatatgaaggcctttt

SEQ ID NO: 221890 - DNA, 25 bp, Homo sapien
tgctgcctaagagtggttgccactg

SEQ ID NO: 221891 - DNA, 25 bp, Homo sapien
tggttgccactgacgaaagcttgaa

SEQ ID NO: 221892 - DNA, 25 bp, Homo sapien
gggtattggcattgctgcatgtcat

SEQ ID NO: 221893 - DNA, 25 bp, Homo sapien
aattgggacctcttgcaacaactca

SEQ ID NO: 221894 - DNA, 25 bp, Homo sapien
ggcagcccacaaatgcaggatacgt

SEQ ID NO: 221895 - DNA, 25 bp, Homo sapien
aaacatagctagcaggctgttctcc

SEQ ID NO: 221896 - DNA, 25 bp, Homo sapien
tgttctccatatcgtcgcattattt

SEQ ID NO: 221897 - DNA, 25 bp, Homo sapien
gtaaacttcacaaacgcatcatatt

SEQ ID NO: 221898 - DNA, 25 bp, Homo sapien
attgttctgcaagttttgtgttcaa

SEQ ID NO: 221899 - DNA, 25 bp, Homo sapien
atattcttctcgaactttctcttca

SEQ ID NO: 221900 - DNA, 25 bp, Homo sapien
actttctcttcacgttctttcaaca

SEQ ID NO: 221901 - DNA, 25 bp, Homo sapien
tttggtttagtctacaactatacct

SEQ ID NO: 221902 - DNA, 25 bp, Homo sapien
gtttagtctacaactataccttcct

SEQ ID NO: 221903 - DNA, 25 bp, Homo sapien
tataccttccttataacttaaccat

SEQ ID NO: 221904 - DNA, 25 bp, Homo sapien
accttccttataacttaaccatatg

SEQ ID NO: 221905 - DNA, 25 bp, Homo sapien
ttccttataacttaaccatatgcat

SEQ ID NO: 221906 - DNA, 25 bp, Homo sapien
ccttataacttaaccatatgcattt

SEQ ID NO: 221907 - DNA, 25 bp, Homo sapien
ataacttaaccatatgcatttatta

SEQ ID NO: 221908 - DNA, 25 bp, Homo sapien
aaagtttatgtaatgcagacaggaa

SEQ ID NO: 221909 - DNA, 25 bp, Homo sapien
gcagacaggaagctctatgttccct

SEQ ID NO: 221910 - DNA, 25 bp, Homo sapien
agacaggaagctctatgttcccttc

SEQ ID NO: 221911 - DNA, 25 bp, Homo sapien
gacaggaagctctatgttcccttct

SEQ ID NO: 221912 - DNA, 25 bp, Homo sapien
gcctggttcttcaaggccaagagaa

SEQ ID NO: 221913 - DNA, 25 bp, Homo sapien
gaagccatagggatactgtgacctt

SEQ ID NO: 221914 - DNA, 25 bp, Homo sapien
catagggatactgtgacctttgtct

SEQ ID NO: 221915 - DNA, 25 bp, Homo sapien
gtgacctttgtctagagttgatggg

SEQ ID NO: 221916 - DNA, 25 bp, Homo sapien
aataaaacaggaccgtactgcttgg

SEQ ID NO: 221917 - DNA, 25 bp, Homo sapien
aacaggaccgtactgcttggaagaa

SEQ ID NO: 221918 - DNA, 25 bp, Homo sapien
gaccgtactgcttggaagaaggaaa

SEQ ID NO: 221919 - DNA, 25 bp, Homo sapien
agaaggaaacggaagctgacataat

SEQ ID NO: 221920 - DNA, 25 bp, Homo sapien
agttgattgctgttgagatggtaac

SEQ ID NO: 221921 - DNA, 25 bp, Homo sapien
agatggtaacagatttgctcctaaa

SEQ ID NO: 221922 - DNA, 25 bp, Homo sapien
acagtgtgaatacccggctgatcct

SEQ ID NO: 221923 - DNA, 25 bp, Homo sapien
gtgtgtggtagttcacaagccacca

SEQ ID NO: 221924 - DNA, 25 bp, Homo sapien
aagccaccacaaggtgaccatgctg

SEQ ID NO: 221925 - DNA, 25 bp, Homo sapien
gtgaccatgctgtgatattcaagat

SEQ ID NO: 221926 - DNA, 25 bp, Homo sapien
tataaggaactaaatacccacctca

SEQ ID NO: 221927 - DNA, 25 bp, Homo sapien
tcaccccactagtgtatgaggcaag

SEQ ID NO: 221928 - DNA, 25 bp, Homo sapien
actagtgtatgaggcaagtgtccta

SEQ ID NO: 221929 - DNA, 25 bp, Homo sapien
agtgtcctaagtgaatgggtatgta

SEQ ID NO: 221930 - DNA, 25 bp, Homo sapien
agtgtttcaaatacccatcttatgc

SEQ ID NO: 221931 - DNA, 25 bp, Homo sapien
atacccatcttatgccaagagcgaa

SEQ ID NO: 221932 - DNA, 25 bp, Homo sapien
aaggtgccacttaatgataaactca

SEQ ID NO: 221933 - DNA, 25 bp, Homo sapien
cagattgttaagttgcctagaagtg

SEQ ID NO: 221934 - DNA, 25 bp, Homo sapien
ccttgactttgtgtcactgtgaggc

SEQ ID NO: 221935 - DNA, 25 bp, Homo sapien
gaggtgcagtaaaggtccattgtgt

SEQ ID NO: 221936 - DNA, 25 bp, Homo sapien
cattgtgtggcttgagacctatgat

SEQ ID NO: 221937 - DNA, 25 bp, Homo sapien
gacctatgatctgaggcttgtgcat

SEQ ID NO: 221938 - DNA, 25 bp, Homo sapien
taataagatggcagctgttacctac

SEQ ID NO: 221939 - DNA, 25 bp, Homo sapien
tacctacagagcaaggagtttcctc

SEQ ID NO: 221940 - DNA, 25 bp, Homo sapien
gagtttcctctttcagggtagatta

SEQ ID NO: 221941 - DNA, 25 bp, Homo sapien
taagaatcaattccctggtcccagg

SEQ ID NO: 221942 - DNA, 25 bp, Homo sapien
gttaatttaagaactcactcagcag

SEQ ID NO: 221943 - DNA, 25 bp, Homo sapien
ctcactcagcagaaggacatgtaat

SEQ ID NO: 221944 - DNA, 25 bp, Homo sapien
gtaatgtctgagtaatcttgatgga

SEQ ID NO: 221945 - DNA, 25 bp, Homo sapien
agctcaggctagtctccccactggg

SEQ ID NO: 221946 - DNA, 25 bp, Homo sapien
gggacggttccgtgggcagccccat

SEQ ID NO: 221947 - DNA, 25 bp, Homo sapien
gccccatcactgtgttcaatagtgt

SEQ ID NO: 221948 - DNA, 25 bp, Homo sapien
gtgtgagaatgtagctaaagcccct

SEQ ID NO: 221949 - DNA, 25 bp, Homo sapien
gaatgtagctaaagcccctgctgct

SEQ ID NO: 221950 - DNA, 25 bp, Homo sapien
tgcacatgccacagcaggcggtggg

SEQ ID NO: 221951 - DNA, 25 bp, Homo sapien
aatccatcgtggagtgttctctcag

SEQ ID NO: 221952 - DNA, 25 bp, Homo sapien
atcgtggagtgttctctcagcttag

SEQ ID NO: 221953 - DNA, 25 bp, Homo sapien
gtgttctctcagcttaggtctggac

SEQ ID NO: 221954 - DNA, 25 bp, Homo sapien
cagcttaggtctggacaggagactt

SEQ ID NO: 221955 - DNA, 25 bp, Homo sapien
ggaggctatctctgacctcccgaca

SEQ ID NO: 221956 - DNA, 25 bp, Homo sapien
gaccttgggcgagttacttcgcaca

SEQ ID NO: 221957 - DNA, 25 bp, Homo sapien
agttacttcgcacagccacccaggg

SEQ ID NO: 221958 - DNA, 25 bp, Homo sapien
gggcctcttctccaacacgatagca

SEQ ID NO: 221959 - DNA, 25 bp, Homo sapien
acacgatagcactgcacccggaggg

SEQ ID NO: 221960 - DNA, 25 bp, Homo sapien
gagggccttcagacctgagctgaaa

SEQ ID NO: 221961 - DNA, 25 bp, Homo sapien
tgagctgaaatctacaccaccggct

SEQ ID NO: 221962 - DNA, 25 bp, Homo sapien
ggctctctgactatcaggctttgga

SEQ ID NO: 221963 - DNA, 25 bp, Homo sapien
tttcctgggtctcttacctggcaga

SEQ ID NO: 221964 - DNA, 25 bp, Homo sapien
tgggtctcttacctggcagacagca

SEQ ID NO: 221965 - DNA, 25 bp, Homo sapien
ggcagacagcagattttggaacttt

SEQ ID NO: 221966 - DNA, 25 bp, Homo sapien
cagcagattttggaacttttcagcc

SEQ ID NO: 221967 - DNA, 25 bp, Homo sapien
tgccacctcctgtctactcattgtt

SEQ ID NO: 221968 - DNA, 25 bp, Homo sapien
cacctcctgtctactcattgttgca

SEQ ID NO: 221969 - DNA, 25 bp, Homo sapien
tactcattgttgcatgagccctgtc

SEQ ID NO: 221970 - DNA, 25 bp, Homo sapien
tcattgttgcatgagccctgtctgc

SEQ ID NO: 221971 - DNA, 25 bp, Homo sapien
attgttgcatgagccctgtctgcca

SEQ ID NO: 221972 - DNA, 25 bp, Homo sapien
gttgcatgagccctgtctgccagcc

SEQ ID NO: 221973 - DNA, 25 bp, Homo sapien
aagaggtgagggtgcacgtcttccc

SEQ ID NO: 221974 - DNA, 25 bp, Homo sapien
aggtgagggtgcacgtcttccctcc

SEQ ID NO: 221975 - DNA, 25 bp, Homo sapien
tgagggtgcacgtcttccctcctgt

SEQ ID NO: 221976 - DNA, 25 bp, Homo sapien
gggaagccttcctctcaatttgttg

SEQ ID NO: 221977 - DNA, 25 bp, Homo sapien
aagccttcctctcaatttgttgtca

SEQ ID NO: 221978 - DNA, 25 bp, Homo sapien
actgctcaaatgttagctgtcgtat

SEQ ID NO: 221979 - DNA, 25 bp, Homo sapien
gctgtcgtattaatattgtcacttt

SEQ ID NO: 221980 - DNA, 25 bp, Homo sapien
gtcacttttgcacactgatgtacat

SEQ ID NO: 221981 - DNA, 25 bp, Homo sapien
gttgaccaggctcattctttaagca

SEQ ID NO: 221982 - DNA, 25 bp, Homo sapien
gctcattctttaagcattctccatg

SEQ ID NO: 221983 - DNA, 25 bp, Homo sapien
attctccatgcttaaaccagttcca

SEQ ID NO: 221984 - DNA, 25 bp, Homo sapien
cagttccataatccctaggcctgta

SEQ ID NO: 221985 - DNA, 25 bp, Homo sapien
taggcctgtactccagggattgaga

SEQ ID NO: 221986 - DNA, 25 bp, Homo sapien
aggatcatttatgccatgtttctct

SEQ ID NO: 221987 - DNA, 25 bp, Homo sapien
agcatcattgctggaagacttttga

SEQ ID NO: 221988 - DNA, 25 bp, Homo sapien
atgtgtctcaagctattctcaggcc

SEQ ID NO: 221989 - DNA, 25 bp, Homo sapien
tggtcagctgtccttcacgcacata

SEQ ID NO: 221990 - DNA, 25 bp, Homo sapien
agctgtccttcacgcacatatccgt

SEQ ID NO: 221991 - DNA, 25 bp, Homo sapien
tgtccttcacgcacatatccgtggc

SEQ ID NO: 221992 - DNA, 25 bp, Homo sapien
cgcacatatccgtggccacctgaga

SEQ ID NO: 221993 - DNA, 25 bp, Homo sapien
catatccgtggccacctgagacctg

SEQ ID NO: 221994 - DNA, 25 bp, Homo sapien
tatccgtggccacctgagacctgct

SEQ ID NO: 221995 - DNA, 25 bp, Homo sapien
aggcagagccgagagttcgccccaa

SEQ ID NO: 221996 - DNA, 25 bp, Homo sapien
ggcagagccgagagttcgccccaac

SEQ ID NO: 221997 - DNA, 25 bp, Homo sapien
ggcccagtgtgaaaaacagactcac

SEQ ID NO: 221998 - DNA, 25 bp, Homo sapien
aaaacagactcacaaggggcttctt

SEQ ID NO: 221999 - DNA, 25 bp, Homo sapien
tcacaaggggcttcttggcctgcag

SEQ ID NO: 222000 - DNA, 25 bp, Homo sapien
agcagagttggctcctatgtgtcaa

SEQ ID NO: 222001 - DNA, 25 bp, Homo sapien
cagagttggctcctatgtgtcaaga

SEQ ID NO: 222002 - DNA, 25 bp, Homo sapien
gagttggctcctatgtgtcaagaaa

SEQ ID NO: 222003 - DNA, 25 bp, Homo sapien
gttggctcctatgtgtcaagaaaag

SEQ ID NO: 222004 - DNA, 25 bp, Homo sapien
catatgtttcagttatcagaggtga

SEQ ID NO: 222005 - DNA, 25 bp, Homo sapien
tcagaggtgaaggagcttggccaca

SEQ ID NO: 222006 - DNA, 25 bp, Homo sapien
ggtgaaggagcttggccacaaagtt

SEQ ID NO: 222007 - DNA, 25 bp, Homo sapien
ggccacaaagttgagcacagactga

SEQ ID NO: 222008 - DNA, 25 bp, Homo sapien
gttgagcacagactgagtatcccct

SEQ ID NO: 222009 - DNA, 25 bp, Homo sapien
tgagcacagactgagtatcccctat

SEQ ID NO: 222010 - DNA, 25 bp, Homo sapien
agcacagactgagtatcccctatct

SEQ ID NO: 222011 - DNA, 25 bp, Homo sapien
aagactttttagttatgctgaacat

SEQ ID NO: 222012 - DNA, 25 bp, Homo sapien
attcattaaatggagacatcgcttc

SEQ ID NO: 222013 - DNA, 25 bp, Homo sapien
tggagacatcgcttcaccataaggg

SEQ ID NO: 222014 - DNA, 25 bp, Homo sapien
taagggtttggtagtcctactcact

SEQ ID NO: 222015 - DNA, 25 bp, Homo sapien
gtcctactcacttgctattgtcaaa

SEQ ID NO: 222016 - DNA, 25 bp, Homo sapien
cacttgctattgtcaaatcatttgt

SEQ ID NO: 222017 - DNA, 25 bp, Homo sapien
gaatacttaagaagaggcatgactt

SEQ ID NO: 222018 - DNA, 25 bp, Homo sapien
gactttgtcattggtgtggagccta

SEQ ID NO: 222019 - DNA, 25 bp, Homo sapien
gtgtggagcctataattatgtgcaa

SEQ ID NO: 222020 - DNA, 25 bp, Homo sapien
attatgtgcaattccctacttaaga

SEQ ID NO: 222021 - DNA, 25 bp, Homo sapien
gtgcaattccctacttaagactttt

SEQ ID NO: 222022 - DNA, 25 bp, Homo sapien
gagaaccagtcattggatctccctt

SEQ ID NO: 222023 - DNA, 25 bp, Homo sapien
attggatctcccttctctactttgt

SEQ ID NO: 222024 - DNA, 25 bp, Homo sapien
tctctactttgttactgaaatcttg

SEQ ID NO: 222025 - DNA, 25 bp, Homo sapien
actgaaatcttgaacctgtagaaca

SEQ ID NO: 222026 - DNA, 25 bp, Homo sapien
ctgtagaacattacttatcactgtg

SEQ ID NO: 222027 - DNA, 25 bp, Homo sapien
gcttgatggtagataacacatttgc

SEQ ID NO: 222028 - DNA, 25 bp, Homo sapien
aaaccaatcctcaaaagacctctca

SEQ ID NO: 222029 - DNA, 25 bp, Homo sapien
agacctctcaattagaattcttaaa

SEQ ID NO: 222030 - DNA, 25 bp, Homo sapien
aaataatgcttgactatctgaaata

SEQ ID NO: 222031 - DNA, 25 bp, Homo sapien
cctatcataaaatctctgcctggta

SEQ ID NO: 222032 - DNA, 25 bp, Homo sapien
tctgcctggtagaacagctgactgt

SEQ ID NO: 222033 - DNA, 25 bp, Homo sapien
aacccacacgttccggcagtcggat

SEQ ID NO: 222034 - DNA, 25 bp, Homo sapien
cggcagtcggatacgcctcgaaaaa

SEQ ID NO: 222035 - DNA, 25 bp, Homo sapien
gacaggttcacaatatgtgcctaaa

SEQ ID NO: 222036 - DNA, 25 bp, Homo sapien
tcagaggacaactttgactttcaag

SEQ ID NO: 222037 - DNA, 25 bp, Homo sapien
ttgactttcaagaggagattccaag

SEQ ID NO: 222038 - DNA, 25 bp, Homo sapien
agtgacatcttgaaaccacctcacc

SEQ ID NO: 222039 - DNA, 25 bp, Homo sapien
aaccacctcaccagaaccattggag

SEQ ID NO: 222040 - DNA, 25 bp, Homo sapien
agaaccattggagcacctgtggcct

SEQ ID NO: 222041 - DNA, 25 bp, Homo sapien
tcggcacactgcttatcacttgaaa

SEQ ID NO: 222042 - DNA, 25 bp, Homo sapien
gttatatttatctgtgtgtctgaca

SEQ ID NO: 222043 - DNA, 25 bp, Homo sapien
gacagtgtgagatgttagaccgaga

SEQ ID NO: 222044 - DNA, 25 bp, Homo sapien
tgtttcttccgactggaatgccttc

SEQ ID NO: 222045 - DNA, 25 bp, Homo sapien
tgccttgtctgcctggcaagttcat

SEQ ID NO: 222046 - DNA, 25 bp, Homo sapien
gcctggcaagttcatctctcacgat

SEQ ID NO: 222047 - DNA, 25 bp, Homo sapien
aggctacctctgcactttgtcaatg

SEQ ID NO: 222048 - DNA, 25 bp, Homo sapien
tttgtcaatgcttctcttgtggcac

SEQ ID NO: 222049 - DNA, 25 bp, Homo sapien
cttgtggcacttatcacactgtatt

SEQ ID NO: 222050 - DNA, 25 bp, Homo sapien
ttgtctccccttctagactgtgaat

SEQ ID NO: 222051 - DNA, 25 bp, Homo sapien
gactgtgaatccttaagggcatgga

SEQ ID NO: 222052 - DNA, 25 bp, Homo sapien
ggactgtatcttatgcatctctgta

SEQ ID NO: 222053 - DNA, 25 bp, Homo sapien
atgcatctctgtatttctgcgccta

SEQ ID NO: 222054 - DNA, 25 bp, Homo sapien
atttctgcgcctagcacggtgccta

SEQ ID NO: 222055 - DNA, 25 bp, Homo sapien
gtgaacctcgcctgtgcggtgcaga

SEQ ID NO: 222056 - DNA, 25 bp, Homo sapien
tggcggccccggttcaagtactatc

SEQ ID NO: 222057 - DNA, 25 bp, Homo sapien
gttcaagtactatcactgggcgctg

SEQ ID NO: 222058 - DNA, 25 bp, Homo sapien
agtactatcactgggcgctgtcctt

SEQ ID NO: 222059 - DNA, 25 bp, Homo sapien
tctgcctggcccttatgtttgtctc

SEQ ID NO: 222060 - DNA, 25 bp, Homo sapien
tatgtttgtctcctcctggtactat

SEQ ID NO: 222061 - DNA, 25 bp, Homo sapien
tggtactatgccctggtggccatgc

SEQ ID NO: 222062 - DNA, 25 bp, Homo sapien
tggtggccatgctcatcgccggcat

SEQ ID NO: 222063 - DNA, 25 bp, Homo sapien
atcgccggcatgatctacaaataca

SEQ ID NO: 222064 - DNA, 25 bp, Homo sapien
ctacaaatacatcgagtaccaaggg

SEQ ID NO: 222065 - DNA, 25 bp, Homo sapien
gtgacgggatccgaggcctgtccct

SEQ ID NO: 222066 - DNA, 25 bp, Homo sapien
gttctttgcctagtatacagtttta

SEQ ID NO: 222067 - DNA, 25 bp, Homo sapien
tttatttcattgacaccgatctgta

SEQ ID NO: 222068 - DNA, 25 bp, Homo sapien
tatttcattgacaccgatctgtaca

SEQ ID NO: 222069 - DNA, 25 bp, Homo sapien
atttcattgacaccgatctgtacac

SEQ ID NO: 222070 - DNA, 25 bp, Homo sapien
ttcattgacaccgatctgtacacag

SEQ ID NO: 222071 - DNA, 25 bp, Homo sapien
tcattgacaccgatctgtacacagt

SEQ ID NO: 222072 - DNA, 25 bp, Homo sapien
cattgacaccgatctgtacacagta

SEQ ID NO: 222073 - DNA, 25 bp, Homo sapien
attgacaccgatctgtacacagtaa

SEQ ID NO: 222074 - DNA, 25 bp, Homo sapien
ttgacaccgatctgtacacagtaaa

SEQ ID NO: 222075 - DNA, 25 bp, Homo sapien
gacaccgatctgtacacagtaaaaa

SEQ ID NO: 222076 - DNA, 25 bp, Homo sapien
ttgcttatagaaagctaatcatggc

SEQ ID NO: 222077 - DNA, 25 bp, Homo sapien
gttacatagcaaggccacacatctg

SEQ ID NO: 222078 - DNA, 25 bp, Homo sapien
acacatctgtggctaggagtcattt

SEQ ID NO: 222079 - DNA, 25 bp, Homo sapien
attgctaggagtaggaccagtgacc

SEQ ID NO: 222080 - DNA, 25 bp, Homo sapien
ggaccagtgaccagatttagcttaa

SEQ ID NO: 222081 - DNA, 25 bp, Homo sapien
ggaagatttattccagggacctgat

SEQ ID NO: 222082 - DNA, 25 bp, Homo sapien
tgatcacagaaagcagggccctgca

SEQ ID NO: 222083 - DNA, 25 bp, Homo sapien
ccaggaagccatcagggtctcattc

SEQ ID NO: 222084 - DNA, 25 bp, Homo sapien
gcatttgtcttgtttcctgcctctg

SEQ ID NO: 222085 - DNA, 25 bp, Homo sapien
acttggcccggcactagctctgtgg

SEQ ID NO: 222086 - DNA, 25 bp, Homo sapien
tggcccctactttacattacttctt

SEQ ID NO: 222087 - DNA, 25 bp, Homo sapien
attacttctttgtccagagctctca

SEQ ID NO: 222088 - DNA, 25 bp, Homo sapien
attcatgacacacctttttcttagt

SEQ ID NO: 222089 - DNA, 25 bp, Homo sapien
catgacacacctttttcttagtttt

SEQ ID NO: 222090 - DNA, 25 bp, Homo sapien
agtttttcagtatttctaagctaca

SEQ ID NO: 222091 - DNA, 25 bp, Homo sapien
gtatttctaagctacatggtgcatc

SEQ ID NO: 222092 - DNA, 25 bp, Homo sapien
ctaagctacatggtgcatctgcaag

SEQ ID NO: 222093 - DNA, 25 bp, Homo sapien
gctacatggtgcatctgcaagtttt

SEQ ID NO: 222094 - DNA, 25 bp, Homo sapien
ggtgcatctgcaagttttttaaatt

SEQ ID NO: 222095 - DNA, 25 bp, Homo sapien
aaaatatgcatataagcggtcctat

SEQ ID NO: 222096 - DNA, 25 bp, Homo sapien
ataagcggtcctatgcagttcaaac

SEQ ID NO: 222097 - DNA, 25 bp, Homo sapien
caaacccgtgtttgagaatcaactt

SEQ ID NO: 222098 - DNA, 25 bp, Homo sapien
gagaatcaactttatgacttccagt

SEQ ID NO: 222099 - DNA, 25 bp, Homo sapien
gtccacgaggagacggtgcccttgc

SEQ ID NO: 222100 - DNA, 25 bp, Homo sapien
agacggtgcccttgcactgtcctaa

SEQ ID NO: 222101 - DNA, 25 bp, Homo sapien
tgcactgtcctaacggctcagccat

SEQ ID NO: 222102 - DNA, 25 bp, Homo sapien
acacctacacccacgtggatgagtg

SEQ ID NO: 222103 - DNA, 25 bp, Homo sapien
gatgagtgtggctgcacgcccttct

SEQ ID NO: 222104 - DNA, 25 bp, Homo sapien
caggaggccactgctgtctgagaac

SEQ ID NO: 222105 - DNA, 25 bp, Homo sapien
gccactgctgtctgagaacgttctg

SEQ ID NO: 222106 - DNA, 25 bp, Homo sapien
tgtctgagaacgttctgcctccatc

SEQ ID NO: 222107 - DNA, 25 bp, Homo sapien
catgctctgtccacctggagccagg

SEQ ID NO: 222108 - DNA, 25 bp, Homo sapien
gtgcattgtctgatcatgaaaacct

SEQ ID NO: 222109 - DNA, 25 bp, Homo sapien
gtctgatcatgaaaaccttgggcct

SEQ ID NO: 222110 - DNA, 25 bp, Homo sapien
gatccccgtccgaaagcattaagtt

SEQ ID NO: 222111 - DNA, 25 bp, Homo sapien
gaaggcgtttagtcataattcattt

SEQ ID NO: 222112 - DNA, 25 bp, Homo sapien
acaacagcttggctgagccgcggat

SEQ ID NO: 222113 - DNA, 25 bp, Homo sapien
tgagccgcggatgccatgaacagtt

SEQ ID NO: 222114 - DNA, 25 bp, Homo sapien
atgaacagttcagggcctcggcgtc

SEQ ID NO: 222115 - DNA, 25 bp, Homo sapien
ggcgtcattttatctcctccttatt

SEQ ID NO: 222116 - DNA, 25 bp, Homo sapien
tttcctttctagcataagagccctg

SEQ ID NO: 222117 - DNA, 25 bp, Homo sapien
aagagccctgaaagaggcgttttga

SEQ ID NO: 222118 - DNA, 25 bp, Homo sapien
ggcgttttgagccaagagaaccgct

SEQ ID NO: 222119 - DNA, 25 bp, Homo sapien
gagaaccgcttgtaggcgatcattt

SEQ ID NO: 222120 - DNA, 25 bp, Homo sapien
ggcgatcattttaagcgtaaccaag

SEQ ID NO: 222121 - DNA, 25 bp, Homo sapien
aatatattcctgcttcaaacacctc

SEQ ID NO: 222122 - DNA, 25 bp, Homo sapien
tcagaaaaccagttccgcgagggtt

SEQ ID NO: 222123 - DNA, 25 bp, Homo sapien
ttatatccccacaaagttgttgaga

SEQ ID NO: 222124 - DNA, 25 bp, Homo sapien
gagagacaatgatgaccctggaagt

SEQ ID NO: 222125 - DNA, 25 bp, Homo sapien
tgagaaacagcaacctctctcctga

SEQ ID NO: 222126 - DNA, 25 bp, Homo sapien
gggtagccatgagatttctctagct

SEQ ID NO: 222127 - DNA, 25 bp, Homo sapien
atttctctagctatatccaacttgg

SEQ ID NO: 222128 - DNA, 25 bp, Homo sapien
acttggcatctgtacatcatctttg

SEQ ID NO: 222129 - DNA, 25 bp, Homo sapien
catcatctttggaggaacatcttat

SEQ ID NO: 222130 - DNA, 25 bp, Homo sapien
ggaccttgacaagccgtttgagatg

SEQ ID NO: 222131 - DNA, 25 bp, Homo sapien
atgtaggccctgatgttatgcttca

SEQ ID NO: 222132 - DNA, 25 bp, Homo sapien
aatactgaagagacaatcatcctgt

SEQ ID NO: 222133 - DNA, 25 bp, Homo sapien
gagacaatcatcctgtatcttttat

SEQ ID NO: 222134 - DNA, 25 bp, Homo sapien
tgcttctgagtgtcgttctacaatg

SEQ ID NO: 222135 - DNA, 25 bp, Homo sapien
ttctgagtgtcgttctacaatgccc

SEQ ID NO: 222136 - DNA, 25 bp, Homo sapien
agtgtcgttctacaatgcccgttga

SEQ ID NO: 222137 - DNA, 25 bp, Homo sapien
aatgcccgttgacttattccattgc

SEQ ID NO: 222138 - DNA, 25 bp, Homo sapien
tgacttattccattgcgtctctgct

SEQ ID NO: 222139 - DNA, 25 bp, Homo sapien
attccattgcgtctctgctttaggg

SEQ ID NO: 222140 - DNA, 25 bp, Homo sapien
ttgcgtctctgctttagggtatggt

SEQ ID NO: 222141 - DNA, 25 bp, Homo sapien
ctctgctttagggtatggtttggtc

SEQ ID NO: 222142 - DNA, 25 bp, Homo sapien
tttagggtatggtttggtcgctttg

SEQ ID NO: 222143 - DNA, 25 bp, Homo sapien
acctcactgctgtttcctaagtaca

SEQ ID NO: 222144 - DNA, 25 bp, Homo sapien
gtggttcatggatgttgataaggaa

SEQ ID NO: 222145 - DNA, 25 bp, Homo sapien
tcttagaaatgggcctatagtttag

SEQ ID NO: 222146 - DNA, 25 bp, Homo sapien
gtttgttttcagatggattttggtt

SEQ ID NO: 222147 - DNA, 25 bp, Homo sapien
agatggattttggttctgtgagcta

SEQ ID NO: 222148 - DNA, 25 bp, Homo sapien
ttttgcattaaagccttcgtcctca

SEQ ID NO: 222149 - DNA, 25 bp, Homo sapien
attaaagccttcgtcctcacacatt

SEQ ID NO: 222150 - DNA, 25 bp, Homo sapien
aaagccttcgtcctcacacattgtt

SEQ ID NO: 222151 - DNA, 25 bp, Homo sapien
cttcgtcctcacacattgttttgac

SEQ ID NO: 222152 - DNA, 25 bp, Homo sapien
gtcctcacacattgttttgacatat

SEQ ID NO: 222153 - DNA, 25 bp, Homo sapien
tgacatatttctagtcttcataaac

SEQ ID NO: 222154 - DNA, 25 bp, Homo sapien
aaaatccggcggtcgagtagctccg

SEQ ID NO: 222155 - DNA, 25 bp, Homo sapien
gagtagctccgcatcccggagggct

SEQ ID NO: 222156 - DNA, 25 bp, Homo sapien
gagggctcccggtgcaaaactgagt

SEQ ID NO: 222157 - DNA, 25 bp, Homo sapien
gccttttccggcgagctctgagttt

SEQ ID NO: 222158 - DNA, 25 bp, Homo sapien
gcgagctctgagtttccagggctca

SEQ ID NO: 222159 - DNA, 25 bp, Homo sapien
gcccctccaagtcgaattacagaaa

SEQ ID NO: 222160 - DNA, 25 bp, Homo sapien
attacagaaactcctcattgccatg

SEQ ID NO: 222161 - DNA, 25 bp, Homo sapien
agaaactcctcattgccatgctaat

SEQ ID NO: 222162 - DNA, 25 bp, Homo sapien
actcctcattgccatgctaatgacg

SEQ ID NO: 222163 - DNA, 25 bp, Homo sapien
cattgccatgctaatgacgagaggg

SEQ ID NO: 222164 - DNA, 25 bp, Homo sapien
gagagggtttcgaagaccctcctgg

SEQ ID NO: 222165 - DNA, 25 bp, Homo sapien
agatttctgagagagcagacaccat

SEQ ID NO: 222166 - DNA, 25 bp, Homo sapien
gagagagcagacaccatcttatttc

SEQ ID NO: 222167 - DNA, 25 bp, Homo sapien
agagcagacaccatcttatttctgt

SEQ ID NO: 222168 - DNA, 25 bp, Homo sapien
aaaaggcatataccaagctgtcaga

SEQ ID NO: 222169 - DNA, 25 bp, Homo sapien
ctgtcagaagcagcttcatttaaaa

SEQ ID NO: 222170 - DNA, 25 bp, Homo sapien
ataaaatttctagtcctgcctgaag

SEQ ID NO: 222171 - DNA, 25 bp, Homo sapien
ctgcctgaagtttaagctagcccat

SEQ ID NO: 222172 - DNA, 25 bp, Homo sapien
gaagtttaagctagcccatgactac

SEQ ID NO: 222173 - DNA, 25 bp, Homo sapien
taagctagcccatgactacacaagt

SEQ ID NO: 222174 - DNA, 25 bp, Homo sapien
tgtatttcccaggtagatgccggta

SEQ ID NO: 222175 - DNA, 25 bp, Homo sapien
ttcccaggtagatgccggtagattg

SEQ ID NO: 222176 - DNA, 25 bp, Homo sapien
gacatcaggacctttttaaagctcc

SEQ ID NO: 222177 - DNA, 25 bp, Homo sapien
tgattctacgttccccaagtttgag

SEQ ID NO: 222178 - DNA, 25 bp, Homo sapien
ggaccacttttctgtgcattggctt

SEQ ID NO: 222179 - DNA, 25 bp, Homo sapien
taatgcttttcctgagctggatccc

SEQ ID NO: 222180 - DNA, 25 bp, Homo sapien
tggatcccagtgttgccttaacagg

SEQ ID NO: 222181 - DNA, 25 bp, Homo sapien
ttaacagggtgtctgtcgtgccgca

SEQ ID NO: 222182 - DNA, 25 bp, Homo sapien
gtgccgcagtagagcactgctgctt

SEQ ID NO: 222183 - DNA, 25 bp, Homo sapien
tgttcctaagtaagtcaggtcccta

SEQ ID NO: 222184 - DNA, 25 bp, Homo sapien
taagccccgtcccaagaagtgacac

SEQ ID NO: 222185 - DNA, 25 bp, Homo sapien
gagccacacctcagatcaatgcagt

SEQ ID NO: 222186 - DNA, 25 bp, Homo sapien
gatcaatgcagtcagaacctgggaa

SEQ ID NO: 222187 - DNA, 25 bp, Homo sapien
gttcctttagaaagcttgcaattgt

SEQ ID NO: 222188 - DNA, 25 bp, Homo sapien
tttagaaagcttgcaattgtgggcc

SEQ ID NO: 222189 - DNA, 25 bp, Homo sapien
tagaaagcttgcaattgtgggccag

SEQ ID NO: 222190 - DNA, 25 bp, Homo sapien
gaaagcttgcaattgtgggccaggc

SEQ ID NO: 222191 - DNA, 25 bp, Homo sapien
aaagcttgcaattgtgggccaggca

SEQ ID NO: 222192 - DNA, 25 bp, Homo sapien
aagcttgcaattgtgggccaggcat

SEQ ID NO: 222193 - DNA, 25 bp, Homo sapien
agcttgcaattgtgggccaggcatg

SEQ ID NO: 222194 - DNA, 25 bp, Homo sapien
tggatcacttgtcataggagttcag

SEQ ID NO: 222195 - DNA, 25 bp, Homo sapien
ggatcacttgtcataggagttcagg

SEQ ID NO: 222196 - DNA, 25 bp, Homo sapien
tcacttgtcataggagttcaggacc

SEQ ID NO: 222197 - DNA, 25 bp, Homo sapien
cacttgtcataggagttcaggacca

SEQ ID NO: 222198 - DNA, 25 bp, Homo sapien
tctcggtgcagctcctgtacctggt

SEQ ID NO: 222199 - DNA, 25 bp, Homo sapien
cgtcatgccctctaaagaaggcgtg

SEQ ID NO: 222200 - DNA, 25 bp, Homo sapien
tgtacctggtcctttaggctctgca

SEQ ID NO: 222201 - DNA, 25 bp, Homo sapien
aggctctgcatctctgcctgcaggt

SEQ ID NO: 222202 - DNA, 25 bp, Homo sapien
agtcctcatagtggcggcagtgctc

SEQ ID NO: 222203 - DNA, 25 bp, Homo sapien
agtgctctgcgaagggcgtgttctc

SEQ ID NO: 222204 - DNA, 25 bp, Homo sapien
taaagaaggcgtgctccaaggcgat

SEQ ID NO: 222205 - DNA, 25 bp, Homo sapien
accttggtgctgatggaccggtgca

SEQ ID NO: 222206 - DNA, 25 bp, Homo sapien
aaggcgtgctccaaggcgatgtgca

SEQ ID NO: 222207 - DNA, 25 bp, Homo sapien
gcagggacttgtgcaggacgtctcc

SEQ ID NO: 222208 - DNA, 25 bp, Homo sapien
gatctccgccttgatgagcgagtgg

SEQ ID NO: 222209 - DNA, 25 bp, Homo sapien
atccactgtgagcaccaacctgctg

SEQ ID NO: 222210 - DNA, 25 bp, Homo sapien
tgctgcagtctcttgggcccctgct

SEQ ID NO: 222211 - DNA, 25 bp, Homo sapien
cacacagccatgcattgtcactctg

SEQ ID NO: 222212 - DNA, 25 bp, Homo sapien
acagccatgcattgtcactctgcct

SEQ ID NO: 222213 - DNA, 25 bp, Homo sapien
atgcattgtcactctgcctccggga

SEQ ID NO: 222214 - DNA, 25 bp, Homo sapien
tccgggaccccagcttgggagctgt

SEQ ID NO: 222215 - DNA, 25 bp, Homo sapien
gagctgtgggtctgccaggtcccac

SEQ ID NO: 222216 - DNA, 25 bp, Homo sapien
acaacctgggctcctggctacagca

SEQ ID NO: 222217 - DNA, 25 bp, Homo sapien
acctgggctcctggctacagcaggg

SEQ ID NO: 222218 - DNA, 25 bp, Homo sapien
tggctacagcagggctccagggact

SEQ ID NO: 222219 - DNA, 25 bp, Homo sapien
tccagggactccaaataaatgttca

SEQ ID NO: 222220 - DNA, 25 bp, Homo sapien
gtctcggtgcagctcctgtacctgg

SEQ ID NO: 222221 - DNA, 25 bp, Homo sapien
agctcctgtacctggtcctttaggc

SEQ ID NO: 222222 - DNA, 25 bp, Homo sapien
tgtacctggtcctttaggctctgca

SEQ ID NO: 222223 - DNA, 25 bp, Homo sapien
tggtcctttaggctctgcatctctg

SEQ ID NO: 222224 - DNA, 25 bp, Homo sapien
gtcctttaggctctgcatctctgcc

SEQ ID NO: 222225 - DNA, 25 bp, Homo sapien
agtcctcatagtggcggcagtgctc

SEQ ID NO: 222226 - DNA, 25 bp, Homo sapien
catagtggcggcagtgctctgcgaa

SEQ ID NO: 222227 - DNA, 25 bp, Homo sapien
tgatggaccggtgcagcgtgggctt

SEQ ID NO: 222228 - DNA, 25 bp, Homo sapien
gaccggtgcagcgtgggcttttgga

SEQ ID NO: 222229 - DNA, 25 bp, Homo sapien
gatctccgccttgatgagcgagtgg

SEQ ID NO: 222230 - DNA, 25 bp, Homo sapien
ccgccttgatgagcgagtggtgctt

SEQ ID NO: 222231 - DNA, 25 bp, Homo sapien
gagtggatggaagtaatcaacaaca

SEQ ID NO: 222232 - DNA, 25 bp, Homo sapien
ggaagtaatcaacaacaagaggaca

SEQ ID NO: 222233 - DNA, 25 bp, Homo sapien
aacaagaggacaacaacattagcca

SEQ ID NO: 222234 - DNA, 25 bp, Homo sapien
acattagccactgctgagcagaaaa

SEQ ID NO: 222235 - DNA, 25 bp, Homo sapien
actgctgagcagaaaattagaaaga

SEQ ID NO: 222236 - DNA, 25 bp, Homo sapien
ggttgtcaggttttgtctctcctgt

SEQ ID NO: 222237 - DNA, 25 bp, Homo sapien
gtcaggttttgtctctcctgtcttc

SEQ ID NO: 222238 - DNA, 25 bp, Homo sapien
caggttttgtctctcctgtcttcca

SEQ ID NO: 222239 - DNA, 25 bp, Homo sapien
ctgtcttccactggtacaccataaa

SEQ ID NO: 222240 - DNA, 25 bp, Homo sapien
ggtacaccataaatcagcagctaaa

SEQ ID NO: 222241 - DNA, 25 bp, Homo sapien
aatcagcagctaaaatgaaatttcc

SEQ ID NO: 222242 - DNA, 25 bp, Homo sapien
tagcaaggatgctgcctttggtctc

SEQ ID NO: 222243 - DNA, 25 bp, Homo sapien
ttttgcatatgttttgtaagcaaca

SEQ ID NO: 222244 - DNA, 25 bp, Homo sapien
ttgtataaaagtcccgtgtctctcg

SEQ ID NO: 222245 - DNA, 25 bp, Homo sapien
aaaagtcccgtgtctctcgctattt

SEQ ID NO: 222246 - DNA, 25 bp, Homo sapien
tgtctctcgctatttctgctgctgt

SEQ ID NO: 222247 - DNA, 25 bp, Homo sapien
ctgttcctagactgagcattgcatt

SEQ ID NO: 222248 - DNA, 25 bp, Homo sapien
gactgagcattgcatttcttgatca

SEQ ID NO: 222249 - DNA, 25 bp, Homo sapien
aaccagatgattaaacgttgtatta

SEQ ID NO: 222250 - DNA, 25 bp, Homo sapien
cttattcttctaaagccaccagcaa

SEQ ID NO: 222251 - DNA, 25 bp, Homo sapien
aagccaccagcaaattgtgcctaag

SEQ ID NO: 222252 - DNA, 25 bp, Homo sapien
aattgtgcctaagcgaaatattttt

SEQ ID NO: 222253 - DNA, 25 bp, Homo sapien
tagattcctagaggcccgattccgc

SEQ ID NO: 222254 - DNA, 25 bp, Homo sapien
tagaggcccgattccgctagcccgg

SEQ ID NO: 222255 - DNA, 25 bp, Homo sapien
gctagcccggaacagacaaagccag

SEQ ID NO: 222256 - DNA, 25 bp, Homo sapien
gcccggaacagacaaagccagcgct

SEQ ID NO: 222257 - DNA, 25 bp, Homo sapien
ggaacagacaaagccagcgctcccg

SEQ ID NO: 222258 - DNA, 25 bp, Homo sapien
ccgacttaggatccgatgccggcag

SEQ ID NO: 222259 - DNA, 25 bp, Homo sapien
gacttaggatccgatgccggcagcg

SEQ ID NO: 222260 - DNA, 25 bp, Homo sapien
ttaggatccgatgccggcagcgtcc

SEQ ID NO: 222261 - DNA, 25 bp, Homo sapien
gccagaatgagaagtaccggctgaa

SEQ ID NO: 222262 - DNA, 25 bp, Homo sapien
aagtaccggctgaagtacctgcggc

SEQ ID NO: 222263 - DNA, 25 bp, Homo sapien
gtaccggctgaagtacctgcggctg

SEQ ID NO: 222264 - DNA, 25 bp, Homo sapien
gatgattctgaaactttaacttaga

SEQ ID NO: 222265 - DNA, 25 bp, Homo sapien
ctttaacttagagcttcattacttt

SEQ ID NO: 222266 - DNA, 25 bp, Homo sapien
aagaatggaaaacaacctctgagtt

SEQ ID NO: 222267 - DNA, 25 bp, Homo sapien
acaacctctgagtttgatttcccaa

SEQ ID NO: 222268 - DNA, 25 bp, Homo sapien
ctgagtttgatttcccaaagtttca

SEQ ID NO: 222269 - DNA, 25 bp, Homo sapien
caaagtttcataaagcccctaagct

SEQ ID NO: 222270 - DNA, 25 bp, Homo sapien
agcccctaagctcatgattttcatc

SEQ ID NO: 222271 - DNA, 25 bp, Homo sapien
tttcatcaactctttgcccacatag

SEQ ID NO: 222272 - DNA, 25 bp, Homo sapien
tctttgcccacatagtcatttacct

SEQ ID NO: 222273 - DNA, 25 bp, Homo sapien
atagtcatttacctccacagccgtt

SEQ ID NO: 222274 - DNA, 25 bp, Homo sapien
tccacagccgtttgttgtcatagaa

SEQ ID NO: 222275 - DNA, 25 bp, Homo sapien
gcaagcataaccaaagatcatcagc

SEQ ID NO: 222276 - DNA, 25 bp, Homo sapien
aatctaggctgtggctgagagaacc

SEQ ID NO: 222277 - DNA, 25 bp, Homo sapien
agaaccagaggcctctaaaatggac

SEQ ID NO: 222278 - DNA, 25 bp, Homo sapien
gagtcgatcttcagaacagggatct

SEQ ID NO: 222279 - DNA, 25 bp, Homo sapien
ttcagaacagggatctaccatgcag

SEQ ID NO: 222280 - DNA, 25 bp, Homo sapien
tctaccatgcaggagcttcttgtgc

SEQ ID NO: 222281 - DNA, 25 bp, Homo sapien
aggagcttcttgtgctcacacaaat

SEQ ID NO: 222282 - DNA, 25 bp, Homo sapien
aatgggaacattgtacattgtcgaa

SEQ ID NO: 222283 - DNA, 25 bp, Homo sapien
tttctcaagctatttttgttactat

SEQ ID NO: 222284 - DNA, 25 bp, Homo sapien
tatttgcagggagcacttatacttt

SEQ ID NO: 222285 - DNA, 25 bp, Homo sapien
gtctgtataacaaatttctatgcaa

SEQ ID NO: 222286 - DNA, 25 bp, Homo sapien
aatgtccagttttgcctcttttaag

SEQ ID NO: 222287 - DNA, 25 bp, Homo sapien
gcctcttttaagtactgtccagttg

SEQ ID NO: 222288 - DNA, 25 bp, Homo sapien
gtactgtccagttgaaacctcctga

SEQ ID NO: 222289 - DNA, 25 bp, Homo sapien
agttgaaacctcctgactcatgtac

SEQ ID NO: 222290 - DNA, 25 bp, Homo sapien
aaacctcctgactcatgtactacta

SEQ ID NO: 222291 - DNA, 25 bp, Homo sapien
tgactcatgtactactacacaaact

SEQ ID NO: 222292 - DNA, 25 bp, Homo sapien
tacacaaactagaaaatgcccattt

SEQ ID NO: 222293 - DNA, 25 bp, Homo sapien
gttgattcaacactccagatacaga

SEQ ID NO: 222294 - DNA, 25 bp, Homo sapien
gtatttaacagcagtctcagacatt

SEQ ID NO: 222295 - DNA, 25 bp, Homo sapien
gcagtctcagacatttgtcttttca

SEQ ID NO: 222296 - DNA, 25 bp, Homo sapien
atttgtcttttcaactcagttgagt

SEQ ID NO: 222297 - DNA, 25 bp, Homo sapien
tcatgctgtgccacttggtcatagt

SEQ ID NO: 222298 - DNA, 25 bp, Homo sapien
gtgccacttggtcatagtggttacc

SEQ ID NO: 222299 - DNA, 25 bp, Homo sapien
gcctgggactttgtagttatggagc

SEQ ID NO: 222300 - DNA, 25 bp, Homo sapien
gactttgtagttatggagcctgcac

SEQ ID NO: 222301 - DNA, 25 bp, Homo sapien
ttgtagttatggagcctgcacacgc

SEQ ID NO: 222302 - DNA, 25 bp, Homo sapien
tgtgaggctagcagggcagggctac

SEQ ID NO: 222303 - DNA, 25 bp, Homo sapien
gcagggctacgtagcttgcctggaa

SEQ ID NO: 222304 - DNA, 25 bp, Homo sapien
gctacgtagcttgcctggaacatcg

SEQ ID NO: 222305 - DNA, 25 bp, Homo sapien
gtagcttgcctggaacatcggccga

SEQ ID NO: 222306 - DNA, 25 bp, Homo sapien
ttgcctggaacatcggccgagggac

SEQ ID NO: 222307 - DNA, 25 bp, Homo sapien
gcccaatatagagcaaggctcccag

SEQ ID NO: 222308 - DNA, 25 bp, Homo sapien
tgccatattatcactaaatcccctg

SEQ ID NO: 222309 - DNA, 25 bp, Homo sapien
ctaaatcccctgacagttgtgacac

SEQ ID NO: 222310 - DNA, 25 bp, Homo sapien
agaagcaagtcacctgtcacttaag

SEQ ID NO: 222311 - DNA, 25 bp, Homo sapien
gtcacttaagcttgaggtctcttta

SEQ ID NO: 222312 - DNA, 25 bp, Homo sapien
tggaattcgcaccaggctgtcttta

SEQ ID NO: 222313 - DNA, 25 bp, Homo sapien
gctgtctttaatttgaggcctttat

SEQ ID NO: 222314 - DNA, 25 bp, Homo sapien
attggaattctgaaacctctctgcc

SEQ ID NO: 222315 - DNA, 25 bp, Homo sapien
agatctattctgagagctgttacag

SEQ ID NO: 222316 - DNA, 25 bp, Homo sapien
aataaccaacagagggattcggaga

SEQ ID NO: 222317 - DNA, 25 bp, Homo sapien
agggctggagctctgtttatttaac

SEQ ID NO: 222318 - DNA, 25 bp, Homo sapien
actctagagggatttttgtgcttat

SEQ ID NO: 222319 - DNA, 25 bp, Homo sapien
tgttctcattcatttggatgccctc

SEQ ID NO: 222320 - DNA, 25 bp, Homo sapien
tttggatgccctccagaaatctggg

SEQ ID NO: 222321 - DNA, 25 bp, Homo sapien
gggagccatacacctttagagcctt

SEQ ID NO: 222322 - DNA, 25 bp, Homo sapien
gccatacacctttagagcctttttt

SEQ ID NO: 222323 - DNA, 25 bp, Homo sapien
agccttttttgctccttatcaagtt

SEQ ID NO: 222324 - DNA, 25 bp, Homo sapien
gctccttatcaagttggcaaggctt

SEQ ID NO: 222325 - DNA, 25 bp, Homo sapien
caaggcttggccaattcctgttcaa

SEQ ID NO: 222326 - DNA, 25 bp, Homo sapien
ggccaattcctgttcaaggctgcat

SEQ ID NO: 222327 - DNA, 25 bp, Homo sapien
aattcctgttcaaggctgcattaaa

SEQ ID NO: 222328 - DNA, 25 bp, Homo sapien
ggctgcattaaaggcatgttcacca

SEQ ID NO: 222329 - DNA, 25 bp, Homo sapien
attaaaggcatgttcaccatcctgg

SEQ ID NO: 222330 - DNA, 25 bp, Homo sapien
tagaaacgacacataacaccgggaa

SEQ ID NO: 222331 - DNA, 25 bp, Homo sapien
taacaccgggaaaagccatgctgtc

SEQ ID NO: 222332 - DNA, 25 bp, Homo sapien
aaagccatgctgtcaagcatctcag

SEQ ID NO: 222333 - DNA, 25 bp, Homo sapien
tgctgtcaagcatctcagaatctca

SEQ ID NO: 222334 - DNA, 25 bp, Homo sapien
tgtcaagcatctcagaatctcaacc

SEQ ID NO: 222335 - DNA, 25 bp, Homo sapien
gggctcaggaagctgtattatttca

SEQ ID NO: 222336 - DNA, 25 bp, Homo sapien
gtattatttcaaaggacgcagtgtt

SEQ ID NO: 222337 - DNA, 25 bp, Homo sapien
ttcaaaggacgcagtgtttccacag

SEQ ID NO: 222338 - DNA, 25 bp, Homo sapien
gctggagttcacacggcccaccaga

SEQ ID NO: 222339 - DNA, 25 bp, Homo sapien
acagaagggtcctcctgcagccagt

SEQ ID NO: 222340 - DNA, 25 bp, Homo sapien
caggcttaaggatagaaacgacaca

SEQ ID NO: 222341 - DNA, 25 bp, Homo sapien
gcctcccgcagatgcaaaagcttta

SEQ ID NO: 222342 - DNA, 25 bp, Homo sapien
ttttaataaagcagccatggaggct

SEQ ID NO: 222343 - DNA, 25 bp, Homo sapien
agccatggaggctaagaacatgcaa

SEQ ID NO: 222344 - DNA, 25 bp, Homo sapien
gaacatgcaagaccaatattctaaa

SEQ ID NO: 222345 - DNA, 25 bp, Homo sapien
tttgcaacaatgaagtgctttactt

SEQ ID NO: 222346 - DNA, 25 bp, Homo sapien
gaagtgctttacttaagtgttgatt

SEQ ID NO: 222347 - DNA, 25 bp, Homo sapien
aagtgttgattgtgcctgttgtaaa

SEQ ID NO: 222348 - DNA, 25 bp, Homo sapien
gattgtgcctgttgtaaagctaatg

SEQ ID NO: 222349 - DNA, 25 bp, Homo sapien
gtaaagctaatgaaccctttccaat

SEQ ID NO: 222350 - DNA, 25 bp, Homo sapien
gaaccctttccaattatatgctaat

SEQ ID NO: 222351 - DNA, 25 bp, Homo sapien
taataaaaactcctatttgctaact

SEQ ID NO: 222352 - DNA, 25 bp, Homo sapien
agtgtttaaggttgccattggttga

SEQ ID NO: 222353 - DNA, 25 bp, Homo sapien
aaacataagtgtctctggccatcaa

SEQ ID NO: 222354 - DNA, 25 bp, Homo sapien
ataagtgtctctggccatcaaagtg

SEQ ID NO: 222355 - DNA, 25 bp, Homo sapien
ggccatcaaagtgatcttgtttaca

SEQ ID NO: 222356 - DNA, 25 bp, Homo sapien
gtgatcttgtttacagcagtgcttt

SEQ ID NO: 222357 - DNA, 25 bp, Homo sapien
gtttacagcagtgcttttgtgaaac

SEQ ID NO: 222358 - DNA, 25 bp, Homo sapien
tttgctgaaagagctcttctgaact

SEQ ID NO: 222359 - DNA, 25 bp, Homo sapien
gctcttctgaactgtgtccttttaa

SEQ ID NO: 222360 - DNA, 25 bp, Homo sapien
aggaaatatgaaggcacttcctttt

SEQ ID NO: 222361 - DNA, 25 bp, Homo sapien
ggaagttgctagatgattccttcat

SEQ ID NO: 222362 - DNA, 25 bp, Homo sapien
gattccttcatcacacttacttaaa

SEQ ID NO: 222363 - DNA, 25 bp, Homo sapien
ggtcaccctcagtccagccagtggg

SEQ ID NO: 222364 - DNA, 25 bp, Homo sapien
cagtctttttagaacgtggtggagg

SEQ ID NO: 222365 - DNA, 25 bp, Homo sapien
gaggagggttgtgtgtgccccaggg

SEQ ID NO: 222366 - DNA, 25 bp, Homo sapien
ggatgcagggaggatcttagcattt

SEQ ID NO: 222367 - DNA, 25 bp, Homo sapien
cagggaggatcttagcatttgttgt

SEQ ID NO: 222368 - DNA, 25 bp, Homo sapien
gaggatcttagcatttgttgttttc

SEQ ID NO: 222369 - DNA, 25 bp, Homo sapien
catttgttgttttctagtgcagggc

SEQ ID NO: 222370 - DNA, 25 bp, Homo sapien
tgttgttttctagtgcagggcttta

SEQ ID NO: 222371 - DNA, 25 bp, Homo sapien
gttttctagtgcagggctttagcca

SEQ ID NO: 222372 - DNA, 25 bp, Homo sapien
ctagtgcagggctttagccacaatt

SEQ ID NO: 222373 - DNA, 25 bp, Homo sapien
tgcagggctttagccacaattgtaa

SEQ ID NO: 222374 - DNA, 25 bp, Homo sapien
gaaatctagtcatttggtttaagaa

SEQ ID NO: 222375 - DNA, 25 bp, Homo sapien
ttggtgtgcgtgataataggttaat

SEQ ID NO: 222376 - DNA, 25 bp, Homo sapien
ttttaggtgcaaattagccaacgat

SEQ ID NO: 222377 - DNA, 25 bp, Homo sapien
gtgcaaattagccaacgatatatca

SEQ ID NO: 222378 - DNA, 25 bp, Homo sapien
ccagttaaaactgcgcctcaagttg

SEQ ID NO: 222379 - DNA, 25 bp, Homo sapien
aaactgcgcctcaagttgaaaaagt

SEQ ID NO: 222380 - DNA, 25 bp, Homo sapien
gttaaggcgccagaattaccacaaa

SEQ ID NO: 222381 - DNA, 25 bp, Homo sapien
ataaggcgttaactgccgtcggtgc

SEQ ID NO: 222382 - DNA, 25 bp, Homo sapien
actgccgtcggtgcatctattatga

SEQ ID NO: 222383 - DNA, 25 bp, Homo sapien
ggtgcatctattatgactggtctat

SEQ ID NO: 222384 - DNA, 25 bp, Homo sapien
gactggtctattaggaatccttgcc

SEQ ID NO: 222385 - DNA, 25 bp, Homo sapien
tgaatctcacaacacaagagctgtt

SEQ ID NO: 222386 - DNA, 25 bp, Homo sapien
gaacagtgcctagccatagaaatca

SEQ ID NO: 222387 - DNA, 25 bp, Homo sapien
aaagattagctgtctggaccctgct

SEQ ID NO: 222388 - DNA, 25 bp, Homo sapien
ttctgtcccttcttttcctatcata

SEQ ID NO: 222389 - DNA, 25 bp, Homo sapien
ttcctatcatagctggcaccgtgtt

SEQ ID NO: 222390 - DNA, 25 bp, Homo sapien
gcaccgtgttcatgcctgtggtatt

SEQ ID NO: 222391 - DNA, 25 bp, Homo sapien
tcatgcctgtggtattccctgtatc

SEQ ID NO: 222392 - DNA, 25 bp, Homo sapien
gtatccctattcctgggaagcagcc

SEQ ID NO: 222393 - DNA, 25 bp, Homo sapien
cttggcctctccagggtcaggtcac

SEQ ID NO: 222394 - DNA, 25 bp, Homo sapien
gtcacctttcccttcattagtgtga

SEQ ID NO: 222395 - DNA, 25 bp, Homo sapien
ccttcattagtgtgatgggaccttc

SEQ ID NO: 222396 - DNA, 25 bp, Homo sapien
atcctgcccaggactgaaggagccg

SEQ ID NO: 222397 - DNA, 25 bp, Homo sapien
agctcccgggaggtgtgtggacatc

SEQ ID NO: 222398 - DNA, 25 bp, Homo sapien
cctgcaggcctgaaccagggtgatg

SEQ ID NO: 222399 - DNA, 25 bp, Homo sapien
agatgatgaccttcttccaaggcct

SEQ ID NO: 222400 - DNA, 25 bp, Homo sapien
aaggcctctagagccatcagcctgt

SEQ ID NO: 222401 - DNA, 25 bp, Homo sapien
aggcaccctcgacttgcctagaggc

SEQ ID NO: 222402 - DNA, 25 bp, Homo sapien
ccccaaaagttgcagtccacatcag

SEQ ID NO: 222403 - DNA, 25 bp, Homo sapien
ttgcagtccacatcagaggcagagt

SEQ ID NO: 222404 - DNA, 25 bp, Homo sapien
cgacacaggccgagtcacttctctg

SEQ ID NO: 222405 - DNA, 25 bp, Homo sapien
aggccgagtcacttctctgcccgtg

SEQ ID NO: 222406 - DNA, 25 bp, Homo sapien
ggatgggtgcgccttccacatcctg

SEQ ID NO: 222407 - DNA, 25 bp, Homo sapien
gaaccatttgagattcaatgcctgt

SEQ ID NO: 222408 - DNA, 25 bp, Homo sapien
atttgagattcaatgcctgtgtcca

SEQ ID NO: 222409 - DNA, 25 bp, Homo sapien
atgcctgtgtccagctcccaggagt

SEQ ID NO: 222410 - DNA, 25 bp, Homo sapien
ggaagaatccatcccctgcgtgtct

SEQ ID NO: 222411 - DNA, 25 bp, Homo sapien
tcccaggagtccaaccgtgaaatcc

SEQ ID NO: 222412 - DNA, 25 bp, Homo sapien
gagtccaaccgtgaaatccacaagt

SEQ ID NO: 222413 - DNA, 25 bp, Homo sapien
tctctttcccttatgataatgtggt

SEQ ID NO: 222414 - DNA, 25 bp, Homo sapien
gataatgtggttgagtcctttgtca

SEQ ID NO: 222415 - DNA, 25 bp, Homo sapien
tgtggttgagtcctttgtcactccc

SEQ ID NO: 222416 - DNA, 25 bp, Homo sapien
agaaatgacctcagcccaggccaga

SEQ ID NO: 222417 - DNA, 25 bp, Homo sapien
ggccagagaccccagctctggcaag

SEQ ID NO: 222418 - DNA, 25 bp, Homo sapien
tacaataattagatctttttccaag

SEQ ID NO: 222419 - DNA, 25 bp, Homo sapien
tagatctttttccaagttaattggg

SEQ ID NO: 222420 - DNA, 25 bp, Homo sapien
tcccttctcccagtcataggtggtt

SEQ ID NO: 222421 - DNA, 25 bp, Homo sapien
cttctcccagtcataggtggttttt

SEQ ID NO: 222422 - DNA, 25 bp, Homo sapien
cagtcataggtggtttttatcatca

SEQ ID NO: 222423 - DNA, 25 bp, Homo sapien
gtggtttttatcatcaagacagact

SEQ ID NO: 222424 - DNA, 25 bp, Homo sapien
gacagactgatattttgtcaggata

SEQ ID NO: 222425 - DNA, 25 bp, Homo sapien
acagtgtttgatgtgcataatgcca

SEQ ID NO: 222426 - DNA, 25 bp, Homo sapien
gtgcataatgccagagttatttttt

SEQ ID NO: 222427 - DNA, 25 bp, Homo sapien
ttctctctttttgttcaatatgaga

SEQ ID NO: 222428 - DNA, 25 bp, Homo sapien
gagattcaggatcatatttgtttaa

SEQ ID NO: 222429 - DNA, 25 bp, Homo sapien
gaggcacgctggacgctgagaggga

SEQ ID NO: 222430 - DNA, 25 bp, Homo sapien
acgctgagagggaggcccggactcg

SEQ ID NO: 222431 - DNA, 25 bp, Homo sapien
gctacaagctgatctgctgaggtgt

SEQ ID NO: 222432 - DNA, 25 bp, Homo sapien
agctgatctgctgaggtgtcaggcc

SEQ ID NO: 222433 - DNA, 25 bp, Homo sapien
actggttgagaagggacaggattcc

SEQ ID NO: 222434 - DNA, 25 bp, Homo sapien
ccaagtgggttgaagagaagcagct

SEQ ID NO: 222435 - DNA, 25 bp, Homo sapien
aagcagctgctcatcagaacaaacc

SEQ ID NO: 222436 - DNA, 25 bp, Homo sapien
ggaagagaaccagctgaagaatgaa

SEQ ID NO: 222437 - DNA, 25 bp, Homo sapien
aatgaaatgcaagacgccaaggatc

SEQ ID NO: 222438 - DNA, 25 bp, Homo sapien
agacgccaaggatcagaacgagctg

SEQ ID NO: 222439 - DNA, 25 bp, Homo sapien
aaggatcagaacgagctgttagaat

SEQ ID NO: 222440 - DNA, 25 bp, Homo sapien
gactactttgtaaagtggccaacat

SEQ ID NO: 222441 - DNA, 25 bp, Homo sapien
gagtaagttttcatcacatttataa

SEQ ID NO: 222442 - DNA, 25 bp, Homo sapien
gtgtacttacattagcttgcaaagc

SEQ ID NO: 222443 - DNA, 25 bp, Homo sapien
ataagcagcaagagttaaaccacgt

SEQ ID NO: 222444 - DNA, 25 bp, Homo sapien
aaaccacgttggtccaagtgaactg

SEQ ID NO: 222445 - DNA, 25 bp, Homo sapien
cagacttctgtgttacatgtgtatg

SEQ ID NO: 222446 - DNA, 25 bp, Homo sapien
gtatgagttactgaacatgttccat

SEQ ID NO: 222447 - DNA, 25 bp, Homo sapien
ccataatacaggagtgtgagcacac

SEQ ID NO: 222448 - DNA, 25 bp, Homo sapien
gtgtgagcacactaacaggtaagtg

SEQ ID NO: 222449 - DNA, 25 bp, Homo sapien
aaaagtacactgagcatgggagaat

SEQ ID NO: 222450 - DNA, 25 bp, Homo sapien
agaattgttttgacattttgctcaa

SEQ ID NO: 222451 - DNA, 25 bp, Homo sapien
aagatgatgaccttcttccaaggcc

SEQ ID NO: 222452 - DNA, 25 bp, Homo sapien
tgatgaccttcttccaaggcctcta

SEQ ID NO: 222453 - DNA, 25 bp, Homo sapien
gaccttcttccaaggcctctagagc

SEQ ID NO: 222454 - DNA, 25 bp, Homo sapien
ttccaaggcctctagagccatcagc

SEQ ID NO: 222455 - DNA, 25 bp, Homo sapien
aaggcctctagagccatcagcctgt

SEQ ID NO: 222456 - DNA, 25 bp, Homo sapien
ctctagagccatcagcctgtgccag

SEQ ID NO: 222457 - DNA, 25 bp, Homo sapien
aggcaccctcgacttgcctagaggc

SEQ ID NO: 222458 - DNA, 25 bp, Homo sapien
gacttgcctagaggcccccaaaagt

SEQ ID NO: 222459 - DNA, 25 bp, Homo sapien
ccccaaaagttgcagtccacatcag

SEQ ID NO: 222460 - DNA, 25 bp, Homo sapien
aaaagttgcagtccacatcagaggc

SEQ ID NO: 222461 - DNA, 25 bp, Homo sapien
aagttgcagtccacatcagaggcag

SEQ ID NO: 222462 - DNA, 25 bp, Homo sapien
ctccagctctacgttgttcatgtaa

SEQ ID NO: 222463 - DNA, 25 bp, Homo sapien
catgtaagtttcatccacatccttc

SEQ ID NO: 222464 - DNA, 25 bp, Homo sapien
atccacatccttcttgatgaggaca

SEQ ID NO: 222465 - DNA, 25 bp, Homo sapien
aattctccatctctgtaggcttatt

SEQ ID NO: 222466 - DNA, 25 bp, Homo sapien
taggcttattgatctcatcctcata

SEQ ID NO: 222467 - DNA, 25 bp, Homo sapien
atcctcatacttgttcctgaagtcc

SEQ ID NO: 222468 - DNA, 25 bp, Homo sapien
tccagcagccgcctaaggttgttga

SEQ ID NO: 222469 - DNA, 25 bp, Homo sapien
taaggttgttgatatagctcccgaa

SEQ ID NO: 222470 - DNA, 25 bp, Homo sapien
atagctcccgaacatgttgtccatg

SEQ ID NO: 222471 - DNA, 25 bp, Homo sapien
atgttgtccatgttgctcccagcca

SEQ ID NO: 222472 - DNA, 25 bp, Homo sapien
agccatcttgtgctgctgcagaagg

SEQ ID NO: 222473 - DNA, 25 bp, Homo sapien
aaaggtggaaacacgtgcctacgct

SEQ ID NO: 222474 - DNA, 25 bp, Homo sapien
ggaaacacgtgcctacgctgtaaag

SEQ ID NO: 222475 - DNA, 25 bp, Homo sapien
acgtgcctacgctgtaaagaaatcc

SEQ ID NO: 222476 - DNA, 25 bp, Homo sapien
gaaatcctgttccagagcatacctg

SEQ ID NO: 222477 - DNA, 25 bp, Homo sapien
atcctgttccagagcatacctgttg

SEQ ID NO: 222478 - DNA, 25 bp, Homo sapien
aacagacactgttcctaacgagagg

SEQ ID NO: 222479 - DNA, 25 bp, Homo sapien
gttcctaacgagaggagtgacgtat

SEQ ID NO: 222480 - DNA, 25 bp, Homo sapien
gtgacgtattttcatcaccgttttt

SEQ ID NO: 222481 - DNA, 25 bp, Homo sapien
gaattttgattctatcagcctgagt

SEQ ID NO: 222482 - DNA, 25 bp, Homo sapien
agcctgagtgagttcagcctgtaaa

SEQ ID NO: 222483 - DNA, 25 bp, Homo sapien
aaggatgttaagctgtgggtaaaat

SEQ ID NO: 222484 - DNA, 25 bp, Homo sapien
tatgtgaatcaggtctcttgaggcc

SEQ ID NO: 222485 - DNA, 25 bp, Homo sapien
gtctcttgaggcctgccaaatgact

SEQ ID NO: 222486 - DNA, 25 bp, Homo sapien
gatggattatgtatgctgaggctat

SEQ ID NO: 222487 - DNA, 25 bp, Homo sapien
tattattcaaggaccattactatgg

SEQ ID NO: 222488 - DNA, 25 bp, Homo sapien
ttacacaagcgataattcagtctct

SEQ ID NO: 222489 - DNA, 25 bp, Homo sapien
attcagtctctagttctccaatatt

SEQ ID NO: 222490 - DNA, 25 bp, Homo sapien
gttctccaatatttatgatactgca

SEQ ID NO: 222491 - DNA, 25 bp, Homo sapien
gaaaagtcacagctccaaatacgtt

SEQ ID NO: 222492 - DNA, 25 bp, Homo sapien
tacgttgaatctcatgacgcgatgc

SEQ ID NO: 222493 - DNA, 25 bp, Homo sapien
gacgcgatgcatgtcgaaggtccaa

SEQ ID NO: 222494 - DNA, 25 bp, Homo sapien
gcatgtcgaaggtccaagggcatgt

SEQ ID NO: 222495 - DNA, 25 bp, Homo sapien
ggccaggaagtagcgcttcatgctt

SEQ ID NO: 222496 - DNA, 25 bp, Homo sapien
gtagcgcttcatgcttagtacatcc

SEQ ID NO: 222497 - DNA, 25 bp, Homo sapien
gcttagtacatcctccaaattgtct

SEQ ID NO: 222498 - DNA, 25 bp, Homo sapien
agaaaaccgtactcagccaaaagat

SEQ ID NO: 222499 - DNA, 25 bp, Homo sapien
gtccacaaggacacaaacacctgag

SEQ ID NO: 222500 - DNA, 25 bp, Homo sapien
gcccttggcagggtctaagccagga

SEQ ID NO: 222501 - DNA, 25 bp, Homo sapien
taggacacactcacataggcaggta

SEQ ID NO: 222502 - DNA, 25 bp, Homo sapien
taggcaggtacacgttagtcaacaa

SEQ ID NO: 222503 - DNA, 25 bp, Homo sapien
aattggaactgcctcttggatcact

SEQ ID NO: 222504 - DNA, 25 bp, Homo sapien
tcttggatcactcagctgtgctttc

SEQ ID NO: 222505 - DNA, 25 bp, Homo sapien
agctgtgctttcatggctggatgat

SEQ ID NO: 222506 - DNA, 25 bp, Homo sapien
gccttggttttgcttcctgctggag

SEQ ID NO: 222507 - DNA, 25 bp, Homo sapien
tgcgacccagattcttctgcaggat

SEQ ID NO: 222508 - DNA, 25 bp, Homo sapien
ccagattcttctgcaggatgtgtct

SEQ ID NO: 222509 - DNA, 25 bp, Homo sapien
gcaggatgtgtctgtctttgtcacg

SEQ ID NO: 222510 - DNA, 25 bp, Homo sapien
gtgtctgtctttgtcacggtggaca

SEQ ID NO: 222511 - DNA, 25 bp, Homo sapien
ggtgacatcataggagcagctcgct

SEQ ID NO: 222512 - DNA, 25 bp, Homo sapien
cataggagcagctcgctggccagaa

SEQ ID NO: 222513 - DNA, 25 bp, Homo sapien
agctcctgctgctcttagggaaagg

SEQ ID NO: 222514 - DNA, 25 bp, Homo sapien
ctgctgctcttagggaaaggaggcc

SEQ ID NO: 222515 - DNA, 25 bp, Homo sapien
tgggtcaagccagcatccccttggt

SEQ ID NO: 222516 - DNA, 25 bp, Homo sapien
agccagcatccccttggtaaagacc

SEQ ID NO: 222517 - DNA, 25 bp, Homo sapien
tgaagaacgaggaacactgcccggg

SEQ ID NO: 222518 - DNA, 25 bp, Homo sapien
ggggagtttcttcctctgcaaaata

SEQ ID NO: 222519 - DNA, 25 bp, Homo sapien
tctgcaaaataagggagtgtgtact

SEQ ID NO: 222520 - DNA, 25 bp, Homo sapien
gagtgtgtactgaattaccgtttcc

SEQ ID NO: 222521 - DNA, 25 bp, Homo sapien
tgaattaccgtttccagctccaaca

SEQ ID NO: 222522 - DNA, 25 bp, Homo sapien
cgtttccagctccaacatccaggat

SEQ ID NO: 222523 - DNA, 25 bp, Homo sapien
caacatccaggatttcagcactacc

SEQ ID NO: 222524 - DNA, 25 bp, Homo sapien
ggatttcagcactacctgcagagta

SEQ ID NO: 222525 - DNA, 25 bp, Homo sapien
gaagataagaaaccactcgaagccg

SEQ ID NO: 222526 - DNA, 25 bp, Homo sapien
gaaaccactcgaagccggtgtctgg

SEQ ID NO: 222527 - DNA, 25 bp, Homo sapien
cactcgaagccggtgtctggtgctg

SEQ ID NO: 222528 - DNA, 25 bp, Homo sapien
gttctcttctccataatgtccttat

SEQ ID NO: 222529 - DNA, 25 bp, Homo sapien
tcagttggcggagtgtttgcagaac

SEQ ID NO: 222530 - DNA, 25 bp, Homo sapien
gaacaagcacaaggccctagctcag

SEQ ID NO: 222531 - DNA, 25 bp, Homo sapien
tagctcagccctaagcaccctatga

SEQ ID NO: 222532 - DNA, 25 bp, Homo sapien
gcaccctatgaagctaggcatgatt

SEQ ID NO: 222533 - DNA, 25 bp, Homo sapien
aatgaggaaggcaccgaagcagctg

SEQ ID NO: 222534 - DNA, 25 bp, Homo sapien
gaagcagctgcgaccactgcagtga

SEQ ID NO: 222535 - DNA, 25 bp, Homo sapien
gcagtgatcaggaatacccggagct

SEQ ID NO: 222536 - DNA, 25 bp, Homo sapien
acccggagctgcagaatagagccaa

SEQ ID NO: 222537 - DNA, 25 bp, Homo sapien
agagccaaggttctgtcgtgaccgc

SEQ ID NO: 222538 - DNA, 25 bp, Homo sapien
gaaaaccagcagcatcttgttctgt

SEQ ID NO: 222539 - DNA, 25 bp, Homo sapien
agcttttccatatcagctcaaccac

SEQ ID NO: 222540 - DNA, 25 bp, Homo sapien
acgccgccagtccattcttaaggaa

SEQ ID NO: 222541 - DNA, 25 bp, Homo sapien
tcttaaggaactgccgactaggact

SEQ ID NO: 222542 - DNA, 25 bp, Homo sapien
ggaactgccgactaggactgatgat

SEQ ID NO: 222543 - DNA, 25 bp, Homo sapien
gccgactaggactgatgatgcattt

SEQ ID NO: 222544 - DNA, 25 bp, Homo sapien
aggactgatgatgcattttagcttt

SEQ ID NO: 222545 - DNA, 25 bp, Homo sapien
tgcattttagctttgagcttttggg

SEQ ID NO: 222546 - DNA, 25 bp, Homo sapien
acagtccctggaattaacagatcag

SEQ ID NO: 222547 - DNA, 25 bp, Homo sapien
ttaacagatcagaatgttcacactg

SEQ ID NO: 222548 - DNA, 25 bp, Homo sapien
gaatgttcacactggttaatctttt

SEQ ID NO: 222549 - DNA, 25 bp, Homo sapien
caatgagcatgaaggtagcagaagc

SEQ ID NO: 222550 - DNA, 25 bp, Homo sapien
tgtgtcttgttcatccttagcaaat

SEQ ID NO: 222551 - DNA, 25 bp, Homo sapien
tgttcatccttagcaaattgccaat

SEQ ID NO: 222552 - DNA, 25 bp, Homo sapien
gatgaagtaccagccaatttgaaat

SEQ ID NO: 222553 - DNA, 25 bp, Homo sapien
aatttgaaattggtgtggacttcca

SEQ ID NO: 222554 - DNA, 25 bp, Homo sapien
gtgtggacttccatcaaggtatatt

SEQ ID NO: 222555 - DNA, 25 bp, Homo sapien
ggcagtgctaaattggttgaaacct

SEQ ID NO: 222556 - DNA, 25 bp, Homo sapien
gatgattcgaaattagttgcttttt

SEQ ID NO: 222557 - DNA, 25 bp, Homo sapien
ttcttcatgttcttcttgtcatgtc

SEQ ID NO: 222558 - DNA, 25 bp, Homo sapien
tgtcatgtcagccaaatcctatagt

SEQ ID NO: 222559 - DNA, 25 bp, Homo sapien
aaccttatttgaggcagttcctgaa

SEQ ID NO: 222560 - DNA, 25 bp, Homo sapien
gggtaggtgaaatttcctgctgata

SEQ ID NO: 222561 - DNA, 25 bp, Homo sapien
aactggtgcttccaaaggacttgca

SEQ ID NO: 222562 - DNA, 25 bp, Homo sapien
gccaatcagagggacttgtgcattc

SEQ ID NO: 222563 - DNA, 25 bp, Homo sapien
agaacatagcacgacccagaaattt

SEQ ID NO: 222564 - DNA, 25 bp, Homo sapien
gctgtttgagtaattttcctcctcc

SEQ ID NO: 222565 - DNA, 25 bp, Homo sapien
ttcctcctccaaccagttattgggt

SEQ ID NO: 222566 - DNA, 25 bp, Homo sapien
cagttattgggtgggtcagcttttc

SEQ ID NO: 222567 - DNA, 25 bp, Homo sapien
ggtcagcttttcaggacagcatact

SEQ ID NO: 222568 - DNA, 25 bp, Homo sapien
ggacttgtgcattctcatttcgaga

SEQ ID NO: 222569 - DNA, 25 bp, Homo sapien
tgaaattgcagcaaatggccatgca

SEQ ID NO: 222570 - DNA, 25 bp, Homo sapien
gaaggtaacccagctacaacacagg

SEQ ID NO: 222571 - DNA, 25 bp, Homo sapien
tacaacacaggcaattccatcaaag

SEQ ID NO: 222572 - DNA, 25 bp, Homo sapien
gaggccctagggtctacttgtggtg

SEQ ID NO: 222573 - DNA, 25 bp, Homo sapien
tttgtagaatgtgtaggcttgagaa

SEQ ID NO: 222574 - DNA, 25 bp, Homo sapien
taaagccaaaaaagcatcacttgct

SEQ ID NO: 222575 - DNA, 25 bp, Homo sapien
aagcatcacttgcttacatttttaa

SEQ ID NO: 222576 - DNA, 25 bp, Homo sapien
aaacaatctttctaatgcggccggt

SEQ ID NO: 222577 - DNA, 25 bp, Homo sapien
caatctttctaatgcggccggtaaa

SEQ ID NO: 222578 - DNA, 25 bp, Homo sapien
aggtctaaggtttctctacagaaat

SEQ ID NO: 222579 - DNA, 25 bp, Homo sapien
agaaattacatgcttctcaggtctt

SEQ ID NO: 222580 - DNA, 25 bp, Homo sapien
ttctcaggtctttgtttagtaaaat

SEQ ID NO: 222581 - DNA, 25 bp, Homo sapien
gcatttattattaaagctaaccgtt

SEQ ID NO: 222582 - DNA, 25 bp, Homo sapien
gaaataatttgtgcctatggtagga

SEQ ID NO: 222583 - DNA, 25 bp, Homo sapien
atgcatttcacattttgtctttccc

SEQ ID NO: 222584 - DNA, 25 bp, Homo sapien
tgtctttccctgttacgattttaat

SEQ ID NO: 222585 - DNA, 25 bp, Homo sapien
atagcagaactgtatgacaagttta

SEQ ID NO: 222586 - DNA, 25 bp, Homo sapien
gacaagtttaggtgatcctagcata

SEQ ID NO: 222587 - DNA, 25 bp, Homo sapien
taggtgatcctagcatatgttaaat

SEQ ID NO: 222588 - DNA, 25 bp, Homo sapien
aaactgtctatttgagtgaagtcat

SEQ ID NO: 222589 - DNA, 25 bp, Homo sapien
gagtgaagtcatgctttctattata

SEQ ID NO: 222590 - DNA, 25 bp, Homo sapien
tctattataataacttggcttcggt

SEQ ID NO: 222591 - DNA, 25 bp, Homo sapien
acttggcttcggttatccatcaaat

SEQ ID NO: 222592 - DNA, 25 bp, Homo sapien
atccatcaaatgcacacttatactg

SEQ ID NO: 222593 - DNA, 25 bp, Homo sapien
gcacacttatactgttatctgattg

SEQ ID NO: 222594 - DNA, 25 bp, Homo sapien
gaagccttagcagctgctgatgagc

SEQ ID NO: 222595 - DNA, 25 bp, Homo sapien
gctgatgagctttcgaaacaagata

SEQ ID NO: 222596 - DNA, 25 bp, Homo sapien
tatttttatccgtgtcatcgacctg

SEQ ID NO: 222597 - DNA, 25 bp, Homo sapien
gacctgtttaccattaaacctctgg

SEQ ID NO: 222598 - DNA, 25 bp, Homo sapien
aacctctggatgtcgccaccatcgt

SEQ ID NO: 222599 - DNA, 25 bp, Homo sapien
cagagggccggatcattacagtgga

SEQ ID NO: 222600 - DNA, 25 bp, Homo sapien
gtggaggatcactacccgcaaggtg

SEQ ID NO: 222601 - DNA, 25 bp, Homo sapien
gtctccatggatcctgacattcagg

SEQ ID NO: 222602 - DNA, 25 bp, Homo sapien
gacattcaggttcattcgctggcag

SEQ ID NO: 222603 - DNA, 25 bp, Homo sapien
ggaagtccgaggaattgctggatat

SEQ ID NO: 222604 - DNA, 25 bp, Homo sapien
gtatggaattagtgccagacatatc

SEQ ID NO: 222605 - DNA, 25 bp, Homo sapien
atttaactgagttaactctgtcaga

SEQ ID NO: 222606 - DNA, 25 bp, Homo sapien
aactctgtcagattgctgcaaacat

SEQ ID NO: 222607 - DNA, 25 bp, Homo sapien
gtcagattgctgcaaacatttctaa

SEQ ID NO: 222608 - DNA, 25 bp, Homo sapien
gattgctgcaaacatttctaaatac

SEQ ID NO: 222609 - DNA, 25 bp, Homo sapien
aacatttctaaatacttgctcttgg

SEQ ID NO: 222610 - DNA, 25 bp, Homo sapien
tttctaaatacttgctcttggtatc

SEQ ID NO: 222611 - DNA, 25 bp, Homo sapien
ggtatctataacttttgcagagacc

SEQ ID NO: 222612 - DNA, 25 bp, Homo sapien
atctataacttttgcagagaccaga

SEQ ID NO: 222613 - DNA, 25 bp, Homo sapien
tataacttttgcagagaccagaagc

SEQ ID NO: 222614 - DNA, 25 bp, Homo sapien
gcagagaccagaagcaaacaatttg

SEQ ID NO: 222615 - DNA, 25 bp, Homo sapien
gcaaacaatttgtgggccagtgtca

SEQ ID NO: 222616 - DNA, 25 bp, Homo sapien
gtggcagatggagacgtataaagca

SEQ ID NO: 222617 - DNA, 25 bp, Homo sapien
gagacgtataaagcagggatcctgt

SEQ ID NO: 222618 - DNA, 25 bp, Homo sapien
ggatcctgttatgaaaagccctaaa

SEQ ID NO: 222619 - DNA, 25 bp, Homo sapien
aatagggtatagagtttgggccata

SEQ ID NO: 222620 - DNA, 25 bp, Homo sapien
gtttgggccatatttcagaggtaat

SEQ ID NO: 222621 - DNA, 25 bp, Homo sapien
aagcattctgcatttttaaagtaag

SEQ ID NO: 222622 - DNA, 25 bp, Homo sapien
tagagatacagcaaagttggtgtga

SEQ ID NO: 222623 - DNA, 25 bp, Homo sapien
gggatctcctagcagaggaaacaac

SEQ ID NO: 222624 - DNA, 25 bp, Homo sapien
gaggaaacaacatgcgccaatcaag

SEQ ID NO: 222625 - DNA, 25 bp, Homo sapien
tgcgccaatcaagcaaagatatttt

SEQ ID NO: 222626 - DNA, 25 bp, Homo sapien
tttgtgcattcaaggaacacagaga

SEQ ID NO: 222627 - DNA, 25 bp, Homo sapien
ggatgttttctattacctcattcag

SEQ ID NO: 222628 - DNA, 25 bp, Homo sapien
gttttctattacctcattcagcaac

SEQ ID NO: 222629 - DNA, 25 bp, Homo sapien
ttcagcaactttatgtttcacaatg

SEQ ID NO: 222630 - DNA, 25 bp, Homo sapien
gtttcacaatgactcaatgatgctt

SEQ ID NO: 222631 - DNA, 25 bp, Homo sapien
acagacatttcactttgcttgttat

SEQ ID NO: 222632 - DNA, 25 bp, Homo sapien
cactttgcttgttatttcatatgat

SEQ ID NO: 222633 - DNA, 25 bp, Homo sapien
ttttgattaaatatgccagtttgta

SEQ ID NO: 222634 - DNA, 25 bp, Homo sapien
tttgtgtccgctgtacagtattcta

SEQ ID NO: 222635 - DNA, 25 bp, Homo sapien
taaagtaacagagagaggtggctat

SEQ ID NO: 222636 - DNA, 25 bp, Homo sapien
gtggctatggtgtagagacctcttt

SEQ ID NO: 222637 - DNA, 25 bp, Homo sapien
ggtgtagagacctctttctaataaa

SEQ ID NO: 222638 - DNA, 25 bp, Homo sapien
accggcccgaccacaagcttggagc

SEQ ID NO: 222639 - DNA, 25 bp, Homo sapien
ctggtggtgcccgagaacgagaaca

SEQ ID NO: 222640 - DNA, 25 bp, Homo sapien
gccaaagaccatcacatctccggag

SEQ ID NO: 222641 - DNA, 25 bp, Homo sapien
aaagaccatcacatctccggagctg

SEQ ID NO: 222642 - DNA, 25 bp, Homo sapien
agaccatcacatctccggagctgag

SEQ ID NO: 222643 - DNA, 25 bp, Homo sapien
accatcacatctccggagctgaggt

SEQ ID NO: 222644 - DNA, 25 bp, Homo sapien
tagcatgacaatggccccgttgtgt

SEQ ID NO: 222645 - DNA, 25 bp, Homo sapien
gcagtcggccttcacgtaaactaag

SEQ ID NO: 222646 - DNA, 25 bp, Homo sapien
aagtaggcaggtaggatctgaagaa

SEQ ID NO: 222647 - DNA, 25 bp, Homo sapien
aggcacaggtgcaagtaaaattcgt

SEQ ID NO: 222648 - DNA, 25 bp, Homo sapien
acaggtgcaagtaaaattcgtcaat

SEQ ID NO: 222649 - DNA, 25 bp, Homo sapien
gatggtgtcctggagcagcccagca

SEQ ID NO: 222650 - DNA, 25 bp, Homo sapien
tgggcccagaaggtcttgacttcgg

SEQ ID NO: 222651 - DNA, 25 bp, Homo sapien
gaaggtcttgacttcggacacttac

SEQ ID NO: 222652 - DNA, 25 bp, Homo sapien
ttgacttcggacacttacccctgtt

SEQ ID NO: 222653 - DNA, 25 bp, Homo sapien
ttacccctgtttcacaagtgtttat

SEQ ID NO: 222654 - DNA, 25 bp, Homo sapien
tttctcctaaataatccttacttgg

SEQ ID NO: 222655 - DNA, 25 bp, Homo sapien
taaataatccttacttggtagttat

SEQ ID NO: 222656 - DNA, 25 bp, Homo sapien
tggtagttattaatccttctttggg

SEQ ID NO: 222657 - DNA, 25 bp, Homo sapien
gagggacagggctttaaaactgaag

SEQ ID NO: 222658 - DNA, 25 bp, Homo sapien
aaaccaaatggcagctgttgagaat

SEQ ID NO: 222659 - DNA, 25 bp, Homo sapien
aaatggcagctgttgagaatctcaa

SEQ ID NO: 222660 - DNA, 25 bp, Homo sapien
ggccagcctggaagtgactgattta

SEQ ID NO: 222661 - DNA, 25 bp, Homo sapien
gatttattgctcactgctttggaaa

SEQ ID NO: 222662 - DNA, 25 bp, Homo sapien
attgctcactgctttggaaaatcca

SEQ ID NO: 222663 - DNA, 25 bp, Homo sapien
ccacctgatgggaagaaagctagaa

SEQ ID NO: 222664 - DNA, 25 bp, Homo sapien
ggacacagacagaattatttgttca

SEQ ID NO: 222665 - DNA, 25 bp, Homo sapien
aaaactgatcagacactccgaagga

SEQ ID NO: 222666 - DNA, 25 bp, Homo sapien
actccgaaggattgtatctcagaca

SEQ ID NO: 222667 - DNA, 25 bp, Homo sapien
atgaacaagtgcttcctcacaactt

SEQ ID NO: 222668 - DNA, 25 bp, Homo sapien
ttgggaacacaacagcctcacaatt

SEQ ID NO: 222669 - DNA, 25 bp, Homo sapien
acaattccgagtccagcatgtgctt

SEQ ID NO: 222670 - DNA, 25 bp, Homo sapien
catgtgcttcggaggccagcctgga

SEQ ID NO: 222671 - DNA, 25 bp, Homo sapien
tcagccagcttcatgacgtaaccaa

SEQ ID NO: 222672 - DNA, 25 bp, Homo sapien
tgacgtaaccaatctttctacccct

SEQ ID NO: 222673 - DNA, 25 bp, Homo sapien
tcacgcaattctctctgctgccaat

SEQ ID NO: 222674 - DNA, 25 bp, Homo sapien
gccaatcctaccagtgctgctggga

SEQ ID NO: 222675 - DNA, 25 bp, Homo sapien
ggaagaataagcctccccagctcgg

SEQ ID NO: 222676 - DNA, 25 bp, Homo sapien
ttctctctttcgcagtcttgcattc

SEQ ID NO: 222677 - DNA, 25 bp, Homo sapien
tttcgcagtcttgcattccgatcac

SEQ ID NO: 222678 - DNA, 25 bp, Homo sapien
ttgcattccgatcaccgtggctttt

SEQ ID NO: 222679 - DNA, 25 bp, Homo sapien
gatcaccgtggcttttctgttcttt

SEQ ID NO: 222680 - DNA, 25 bp, Homo sapien
caccgtggcttttctgttctttctt

SEQ ID NO: 222681 - DNA, 25 bp, Homo sapien
cccagacggtgtctctcgaaagcca

SEQ ID NO: 222682 - DNA, 25 bp, Homo sapien
ttctcagtttttgctgattgctaag

SEQ ID NO: 222683 - DNA, 25 bp, Homo sapien
tttgctgattgctaagggaaataac

SEQ ID NO: 222684 - DNA, 25 bp, Homo sapien
aacagtatttccacaatagggttca

SEQ ID NO: 222685 - DNA, 25 bp, Homo sapien
acaatagggttcaaattcctgcaaa

SEQ ID NO: 222686 - DNA, 25 bp, Homo sapien
attcctgcaaaattacctaccccag

SEQ ID NO: 222687 - DNA, 25 bp, Homo sapien
aattacctaccccagttcatctctg

SEQ ID NO: 222688 - DNA, 25 bp, Homo sapien
tctctgctgaacatttggaaaccat

SEQ ID NO: 222689 - DNA, 25 bp, Homo sapien
tggaaaccatgcactagccaaccca

SEQ ID NO: 222690 - DNA, 25 bp, Homo sapien
aacccaactgacttctgctaggtag

SEQ ID NO: 222691 - DNA, 25 bp, Homo sapien
gctaggtagaggcatttgtcttaga

SEQ ID NO: 222692 - DNA, 25 bp, Homo sapien
gtgagagcacaaagataacgcagga

SEQ ID NO: 222693 - DNA, 25 bp, Homo sapien
agcggttcagttcagggtgctgtgc

SEQ ID NO: 222694 - DNA, 25 bp, Homo sapien
ttcagggtgctgtgcgccggcggtc

SEQ ID NO: 222695 - DNA, 25 bp, Homo sapien
ggtcttcggtcctcagccagcttca

SEQ ID NO: 222696 - DNA, 25 bp, Homo sapien
gtcctcagccagcttcatgacgtaa

SEQ ID NO: 222697 - DNA, 25 bp, Homo sapien
tcagccagcttcatgacgtaaccaa

SEQ ID NO: 222698 - DNA, 25 bp, Homo sapien
gccagcttcatgacgtaaccaatct

SEQ ID NO: 222699 - DNA, 25 bp, Homo sapien
gcttcatgacgtaaccaatctttct

SEQ ID NO: 222700 - DNA, 25 bp, Homo sapien
tgacgtaaccaatctttctacccct

SEQ ID NO: 222701 - DNA, 25 bp, Homo sapien
tcacgcaattctctctgctgccaat

SEQ ID NO: 222702 - DNA, 25 bp, Homo sapien
tctgctgccaatcctaccagtgctg

SEQ ID NO: 222703 - DNA, 25 bp, Homo sapien
gccaatcctaccagtgctgctggga

SEQ ID NO: 222704 - DNA, 25 bp, Homo sapien
tcctgaatgcctcccctttctgatg

SEQ ID NO: 222705 - DNA, 25 bp, Homo sapien
tgatgaaaggatcctgagtgctgct

SEQ ID NO: 222706 - DNA, 25 bp, Homo sapien
ctgagtgctgctgttgctctgccct

SEQ ID NO: 222707 - DNA, 25 bp, Homo sapien
tccgtacacattttgcaagactata

SEQ ID NO: 222708 - DNA, 25 bp, Homo sapien
cacattttgcaagactatactcttt

SEQ ID NO: 222709 - DNA, 25 bp, Homo sapien
tatttcttcacatatttcgtctctc

SEQ ID NO: 222710 - DNA, 25 bp, Homo sapien
atatttcgtctctctgttgaaagat

SEQ ID NO: 222711 - DNA, 25 bp, Homo sapien
tatccttatttgactcttcactttt

SEQ ID NO: 222712 - DNA, 25 bp, Homo sapien
tgaacacctttttctcaactgaagt

SEQ ID NO: 222713 - DNA, 25 bp, Homo sapien
tttttctcaactgaagtcttcctga

SEQ ID NO: 222714 - DNA, 25 bp, Homo sapien
aactgaagtcttcctgaatgcctcc

SEQ ID NO: 222715 - DNA, 25 bp, Homo sapien
gaggctttaatttcaaaagtgaagg

SEQ ID NO: 222716 - DNA, 25 bp, Homo sapien
agtgaaggaaggaggccaggcgccg

SEQ ID NO: 222717 - DNA, 25 bp, Homo sapien
tcacctaggtcaagagtttcaaacc

SEQ ID NO: 222718 - DNA, 25 bp, Homo sapien
acctaggtcaagagtttcaaaccag

SEQ ID NO: 222719 - DNA, 25 bp, Homo sapien
ctaggtcaagagtttcaaaccagac

SEQ ID NO: 222720 - DNA, 25 bp, Homo sapien
taggtcaagagtttcaaaccagacg

SEQ ID NO: 222721 - DNA, 25 bp, Homo sapien
aggtcaagagtttcaaaccagacgg

SEQ ID NO: 222722 - DNA, 25 bp, Homo sapien
gtcaagagtttcaaaccagacgggc

SEQ ID NO: 222723 - DNA, 25 bp, Homo sapien
tcaagagtttcaaaccagacgggcc

SEQ ID NO: 222724 - DNA, 25 bp, Homo sapien
caagagtttcaaaccagacgggcca

SEQ ID NO: 222725 - DNA, 25 bp, Homo sapien
gtttcaaaccagacgggccaacatg

SEQ ID NO: 222726 - DNA, 25 bp, Homo sapien
ccctgggagattcagcctattcact

SEQ ID NO: 222727 - DNA, 25 bp, Homo sapien
gattcagcctattcactgatgagga

SEQ ID NO: 222728 - DNA, 25 bp, Homo sapien
tgaggaaagtgaagccgggtctcct

SEQ ID NO: 222729 - DNA, 25 bp, Homo sapien
aagtgaagccgggtctcctgtctcc

SEQ ID NO: 222730 - DNA, 25 bp, Homo sapien
tccccaaattcattgcacctacgat

SEQ ID NO: 222731 - DNA, 25 bp, Homo sapien
tgcacctacgatatagtccaggatt

SEQ ID NO: 222732 - DNA, 25 bp, Homo sapien
gtccaggattgggtagcaagattaa

SEQ ID NO: 222733 - DNA, 25 bp, Homo sapien
gcaagattaaacacaagcgcttcaa

SEQ ID NO: 222734 - DNA, 25 bp, Homo sapien
aaacacaagcgcttcaaattgatga

SEQ ID NO: 222735 - DNA, 25 bp, Homo sapien
cccaggtagcagagtttggacccag

SEQ ID NO: 222736 - DNA, 25 bp, Homo sapien
agcagagtttggacccagcgttctc

SEQ ID NO: 222737 - DNA, 25 bp, Homo sapien
tgagcggaggcaccagatcaatgtt

SEQ ID NO: 222738 - DNA, 25 bp, Homo sapien
tggttctttgcactggtgagattct

SEQ ID NO: 222739 - DNA, 25 bp, Homo sapien
gtgagattctgcctgatgaatatta

SEQ ID NO: 222740 - DNA, 25 bp, Homo sapien
aaagatatcctgctttctgagaact

SEQ ID NO: 222741 - DNA, 25 bp, Homo sapien
gagaactctatcaccagatggcagt

SEQ ID NO: 222742 - DNA, 25 bp, Homo sapien
gggaggaactaaagcatcctgtttt

SEQ ID NO: 222743 - DNA, 25 bp, Homo sapien
gcatcctgttttgtatctgtccaga

SEQ ID NO: 222744 - DNA, 25 bp, Homo sapien
gtccagatcattatttctgtctctt

SEQ ID NO: 222745 - DNA, 25 bp, Homo sapien
ttttcttcctggttcaggatacttt

SEQ ID NO: 222746 - DNA, 25 bp, Homo sapien
gaagattttccaaaagcgttcatga

SEQ ID NO: 222747 - DNA, 25 bp, Homo sapien
aatttagagcattccacccaatata

SEQ ID NO: 222748 - DNA, 25 bp, Homo sapien
ccaacccctcatatcagcaagggaa

SEQ ID NO: 222749 - DNA, 25 bp, Homo sapien
aatcagtagatagaatgaggtcccc

SEQ ID NO: 222750 - DNA, 25 bp, Homo sapien
gaggtccccattctgaaatatttag

SEQ ID NO: 222751 - DNA, 25 bp, Homo sapien
agcagactggaaccaccacgcaagc

SEQ ID NO: 222752 - DNA, 25 bp, Homo sapien
aaccaccacgcaagcctctgtaggg

SEQ ID NO: 222753 - DNA, 25 bp, Homo sapien
ggatggagacacttctaactttaat

SEQ ID NO: 222754 - DNA, 25 bp, Homo sapien
aagcagctgtttaccgaaggcacca

SEQ ID NO: 222755 - DNA, 25 bp, Homo sapien
cgaaggcaccagttcagccaggagt

SEQ ID NO: 222756 - DNA, 25 bp, Homo sapien
tgaaatccggagaggagcaacgcca

SEQ ID NO: 222757 - DNA, 25 bp, Homo sapien
aggagcaacgccagcctgggtcaca

SEQ ID NO: 222758 - DNA, 25 bp, Homo sapien
agcctgggtcacagtccatcaaacc

SEQ ID NO: 222759 - DNA, 25 bp, Homo sapien
aacggaaatgtcagaattgtatgga

SEQ ID NO: 222760 - DNA, 25 bp, Homo sapien
acggaaatgtcagaattgtatggaa

SEQ ID NO: 222761 - DNA, 25 bp, Homo sapien
cggaaatgtcagaattgtatggaaa

SEQ ID NO: 222762 - DNA, 25 bp, Homo sapien
ggaaatgtcagaattgtatggaaat

SEQ ID NO: 222763 - DNA, 25 bp, Homo sapien
gaaatgtcagaattgtatggaaata

SEQ ID NO: 222764 - DNA, 25 bp, Homo sapien
aaatgtcagaattgtatggaaataa

SEQ ID NO: 222765 - DNA, 25 bp, Homo sapien
aatgtcagaattgtatggaaataaa

SEQ ID NO: 222766 - DNA, 25 bp, Homo sapien
atgtcagaattgtatggaaataaaa

SEQ ID NO: 222767 - DNA, 25 bp, Homo sapien
tgtcagaattgtatggaaataaaac

SEQ ID NO: 222768 - DNA, 25 bp, Homo sapien
gtcagaattgtatggaaataaaact

SEQ ID NO: 222769 - DNA, 25 bp, Homo sapien
gtatttttctgactactttgtgcaa

SEQ ID NO: 222770 - DNA, 25 bp, Homo sapien
ttttctgactactttgtgcaattga

SEQ ID NO: 222771 - DNA, 25 bp, Homo sapien
gactactttgtgcaattgaggattg

SEQ ID NO: 222772 - DNA, 25 bp, Homo sapien
ttgaggattgttttggtctattggc

SEQ ID NO: 222773 - DNA, 25 bp, Homo sapien
ggattgttttggtctattggccatt

SEQ ID NO: 222774 - DNA, 25 bp, Homo sapien
ttttggtctattggccatttggctt

SEQ ID NO: 222775 - DNA, 25 bp, Homo sapien
atatcctttgtccagttttctttag

SEQ ID NO: 222776 - DNA, 25 bp, Homo sapien
atagatatagccaaattccttcccc

SEQ ID NO: 222777 - DNA, 25 bp, Homo sapien
tccttttcgtatcaatttgtaaaca

SEQ ID NO: 222778 - DNA, 25 bp, Homo sapien
gattataaagtgtcctagtcctacc

SEQ ID NO: 222779 - DNA, 25 bp, Homo sapien
tagtcctaccagcaaaatcattaag

SEQ ID NO: 222780 - DNA, 25 bp, Homo sapien
tgcgaacctctccagtgtcattcca

SEQ ID NO: 222781 - DNA, 25 bp, Homo sapien
acccagatcacatgacttcgtaact

SEQ ID NO: 222782 - DNA, 25 bp, Homo sapien
tccatcctcctttcagtgcacgatg

SEQ ID NO: 222783 - DNA, 25 bp, Homo sapien
gccatctttcggttcctgatacaaa

SEQ ID NO: 222784 - DNA, 25 bp, Homo sapien
ttttccatggaaagcaggtcaccct

SEQ ID NO: 222785 - DNA, 25 bp, Homo sapien
catggaaagcaggtcacccttgtta

SEQ ID NO: 222786 - DNA, 25 bp, Homo sapien
gtatcgatgacaactctttaaactt

SEQ ID NO: 222787 - DNA, 25 bp, Homo sapien
cttcgtaacttaaacctcttcactg

SEQ ID NO: 222788 - DNA, 25 bp, Homo sapien
taacttaaacctcttcactggcttc

SEQ ID NO: 222789 - DNA, 25 bp, Homo sapien
cactggcttcccaaagacttaaaat

SEQ ID NO: 222790 - DNA, 25 bp, Homo sapien
ttgctttacatgaacagggccctgc

SEQ ID NO: 222791 - DNA, 25 bp, Homo sapien
gtggtgtccgctgcaacagctacta

SEQ ID NO: 222792 - DNA, 25 bp, Homo sapien
tgcaacagctactagccacgtgtag

SEQ ID NO: 222793 - DNA, 25 bp, Homo sapien
agccacgtgtagctaattacattaa

SEQ ID NO: 222794 - DNA, 25 bp, Homo sapien
taaaagctcagtttctcagttgcgc

SEQ ID NO: 222795 - DNA, 25 bp, Homo sapien
cagtttctcagttgcgctaatcaca

SEQ ID NO: 222796 - DNA, 25 bp, Homo sapien
gttgcgctaatcacatttcaagtgc

SEQ ID NO: 222797 - DNA, 25 bp, Homo sapien
gtgtctactactacacagtgcagac

SEQ ID NO: 222798 - DNA, 25 bp, Homo sapien
agtgcagacacagaacatatcatca

SEQ ID NO: 222799 - DNA, 25 bp, Homo sapien
gttctactggacaatgttacgctag

SEQ ID NO: 222800 - DNA, 25 bp, Homo sapien
aaggcagtcagttaaggcagctatg

SEQ ID NO: 222801 - DNA, 25 bp, Homo sapien
aaggcatacggacagagtctgctta

SEQ ID NO: 222802 - DNA, 25 bp, Homo sapien
agctgcagagcccacgctacacccg

SEQ ID NO: 222803 - DNA, 25 bp, Homo sapien
ctacacccgcctccgggactggcac

SEQ ID NO: 222804 - DNA, 25 bp, Homo sapien
gggactggcaccaccagcgctctgc

SEQ ID NO: 222805 - DNA, 25 bp, Homo sapien
tctgcccacgtgctcaacgtgcagt

SEQ ID NO: 222806 - DNA, 25 bp, Homo sapien
tgcccacgtgctcaacgtgcagtcg

SEQ ID NO: 222807 - DNA, 25 bp, Homo sapien
gcccacgtgctcaacgtgcagtcgt

SEQ ID NO: 222808 - DNA, 25 bp, Homo sapien
ccacgtgctcaacgtgcagtcgtag

SEQ ID NO: 222809 - DNA, 25 bp, Homo sapien
acgtgctcaacgtgcagtcgtagcc

SEQ ID NO: 222810 - DNA, 25 bp, Homo sapien
gtgctcaacgtgcagtcgtagcccg

SEQ ID NO: 222811 - DNA, 25 bp, Homo sapien
tgctcaacgtgcagtcgtagcccgg

SEQ ID NO: 222812 - DNA, 25 bp, Homo sapien
gctcaacgtgcagtcgtagcccggc

SEQ ID NO: 222813 - DNA, 25 bp, Homo sapien
aagtctctttgtcttcatcgtttcc

SEQ ID NO: 222814 - DNA, 25 bp, Homo sapien
atcgtttccggcactgatgtgagca

SEQ ID NO: 222815 - DNA, 25 bp, Homo sapien
gagcacatcataagcacaagacctg

SEQ ID NO: 222816 - DNA, 25 bp, Homo sapien
agcacaagacctggacacctttaca

SEQ ID NO: 222817 - DNA, 25 bp, Homo sapien
acacctttacaatcagagggcctag

SEQ ID NO: 222818 - DNA, 25 bp, Homo sapien
atcagagggcctaggactggagctc

SEQ ID NO: 222819 - DNA, 25 bp, Homo sapien
actggagctctggatctgaccggag

SEQ ID NO: 222820 - DNA, 25 bp, Homo sapien
gaagcacgcaaatccggacatgacg

SEQ ID NO: 222821 - DNA, 25 bp, Homo sapien
agtagagacccatcctcaactgtgc

SEQ ID NO: 222822 - DNA, 25 bp, Homo sapien
aactgtgcccttgttgagctgcttg

SEQ ID NO: 222823 - DNA, 25 bp, Homo sapien
gcttgaggcagaaggcacagacgaa

SEQ ID NO: 222824 - DNA, 25 bp, Homo sapien
ttcttccctgaagacattactgtgg

SEQ ID NO: 222825 - DNA, 25 bp, Homo sapien
aatgggcagccagcggagaactaca

SEQ ID NO: 222826 - DNA, 25 bp, Homo sapien
agaactacaagaacactcagcccat

SEQ ID NO: 222827 - DNA, 25 bp, Homo sapien
actcagcccatcatggacacagatg

SEQ ID NO: 222828 - DNA, 25 bp, Homo sapien
agatggctcttacttcgtctacagc

SEQ ID NO: 222829 - DNA, 25 bp, Homo sapien
gtctacagcaagctcaatgtgcaga

SEQ ID NO: 222830 - DNA, 25 bp, Homo sapien
actgggaggcaggaaatactttcac

SEQ ID NO: 222831 - DNA, 25 bp, Homo sapien
atactttcacctgctctgtgttaca

SEQ ID NO: 222832 - DNA, 25 bp, Homo sapien
ctctgtgttacatgagggcctgcac

SEQ ID NO: 222833 - DNA, 25 bp, Homo sapien
tgcacaaccaccatactgagaagag

SEQ ID NO: 222834 - DNA, 25 bp, Homo sapien
tctcccactctcctggtaaatgatc

SEQ ID NO: 222835 - DNA, 25 bp, Homo sapien
agtgactacctgttcttggctgtcc

SEQ ID NO: 222836 - DNA, 25 bp, Homo sapien
aacagcacatgttcttcttctcctg

SEQ ID NO: 222837 - DNA, 25 bp, Homo sapien
tcctgccttgagactgcgtgttagt

SEQ ID NO: 222838 - DNA, 25 bp, Homo sapien
agactgcgtgttagtcttccattca

SEQ ID NO: 222839 - DNA, 25 bp, Homo sapien
agcagctcagtccttcttatgtcta

SEQ ID NO: 222840 - DNA, 25 bp, Homo sapien
gtccttcttatgtctagtctcagtt

SEQ ID NO: 222841 - DNA, 25 bp, Homo sapien
gtctcagttcattcagccaaagctc

SEQ ID NO: 222842 - DNA, 25 bp, Homo sapien
ccaaagctcatttttgtcctatcca

SEQ ID NO: 222843 - DNA, 25 bp, Homo sapien
aacttgaagaatgtgcctcctctta

SEQ ID NO: 222844 - DNA, 25 bp, Homo sapien
aatgtgcctcctcttagcatctgtt

SEQ ID NO: 222845 - DNA, 25 bp, Homo sapien
agcatctgtttctgactcccagtta

SEQ ID NO: 222846 - DNA, 25 bp, Homo sapien
tgctggcattcatatgtacaggatt

SEQ ID NO: 222847 - DNA, 25 bp, Homo sapien
gtacaggatttgttctagcaagcta

SEQ ID NO: 222848 - DNA, 25 bp, Homo sapien
gcaagctatgcttcagtatgtggtt

SEQ ID NO: 222849 - DNA, 25 bp, Homo sapien
cttcagtatgtggttgatatttttc

SEQ ID NO: 222850 - DNA, 25 bp, Homo sapien
atttttctgtcacaatgatttcttt

SEQ ID NO: 222851 - DNA, 25 bp, Homo sapien
atttctttatgcatgcagagcctgg

SEQ ID NO: 222852 - DNA, 25 bp, Homo sapien
cagagcctgggaaagtcatgggatt

SEQ ID NO: 222853 - DNA, 25 bp, Homo sapien
catgggattaacttgagggtcacta

SEQ ID NO: 222854 - DNA, 25 bp, Homo sapien
gagggtcactattgagcctattaat

SEQ ID NO: 222855 - DNA, 25 bp, Homo sapien
gtttatgtggtatctgacaatgtgt

SEQ ID NO: 222856 - DNA, 25 bp, Homo sapien
caatggtaatatgcctgtctttaaa

SEQ ID NO: 222857 - DNA, 25 bp, Homo sapien
tggaattctcatcttcgaacctaga

SEQ ID NO: 222858 - DNA, 25 bp, Homo sapien
ctcatcttcgaacctagagaaatag

SEQ ID NO: 222859 - DNA, 25 bp, Homo sapien
aatgctggatgctatagatctttta

SEQ ID NO: 222860 - DNA, 25 bp, Homo sapien
gctatagatcttttaattgtcttaa

SEQ ID NO: 222861 - DNA, 25 bp, Homo sapien
tacaggctgtagatttcttagttct

SEQ ID NO: 222862 - DNA, 25 bp, Homo sapien
gttctcacagaacttctatcatttt

SEQ ID NO: 222863 - DNA, 25 bp, Homo sapien
aatcttcagtaggatgttttgtact

SEQ ID NO: 222864 - DNA, 25 bp, Homo sapien
gttttgtactattgctagaccctct

SEQ ID NO: 222865 - DNA, 25 bp, Homo sapien
attgctagaccctcttctgtaatgg

SEQ ID NO: 222866 - DNA, 25 bp, Homo sapien
ctcttctgtaatgggtaatgcgttt

SEQ ID NO: 222867 - DNA, 25 bp, Homo sapien
atgggtaatgcgtttgattgtttga

SEQ ID NO: 222868 - DNA, 25 bp, Homo sapien
gtgaggttctaaccaaaccaggtgt

SEQ ID NO: 222869 - DNA, 25 bp, Homo sapien
acaacctctgtaaatcactcaactt

SEQ ID NO: 222870 - DNA, 25 bp, Homo sapien
tcactcaacttgtctgtaagtcagt

SEQ ID NO: 222871 - DNA, 25 bp, Homo sapien
gtaagtcagtttgctcatgtgtgaa

SEQ ID NO: 222872 - DNA, 25 bp, Homo sapien
gtgaaatgatctcaaaaattccctc

SEQ ID NO: 222873 - DNA, 25 bp, Homo sapien
acacagtccatttgtagtttcccgg

SEQ ID NO: 222874 - DNA, 25 bp, Homo sapien
gggcctctgataacatctccaatct

SEQ ID NO: 222875 - DNA, 25 bp, Homo sapien
acatctccaatctgagttacttaag

SEQ ID NO: 222876 - DNA, 25 bp, Homo sapien
ctgccaaattaggaagcgtgttcaa

SEQ ID NO: 222877 - DNA, 25 bp, Homo sapien
gaagcgtgttcaaagaaacccctag

SEQ ID NO: 222878 - DNA, 25 bp, Homo sapien
caaagaaacccctagagagcctgag

SEQ ID NO: 222879 - DNA, 25 bp, Homo sapien
gaaagggagaaatggccctcacagt

SEQ ID NO: 222880 - DNA, 25 bp, Homo sapien
agaaatggccctcacagtagcgctg

SEQ ID NO: 222881 - DNA, 25 bp, Homo sapien
aaatggccctcacagtagcgctgcg

SEQ ID NO: 222882 - DNA, 25 bp, Homo sapien
cacagtagcgctgcgcctgaggcag

SEQ ID NO: 222883 - DNA, 25 bp, Homo sapien
caggtggaagatctcgtccatgtag

SEQ ID NO: 222884 - DNA, 25 bp, Homo sapien
gaagatctcgtccatgtagggctct

SEQ ID NO: 222885 - DNA, 25 bp, Homo sapien
tctcgtccatgtagggctctcgcaa

SEQ ID NO: 222886 - DNA, 25 bp, Homo sapien
atgtagggctctcgcaacgcccggc

SEQ ID NO: 222887 - DNA, 25 bp, Homo sapien
gcaacgcccggctgaaggcggagaa

SEQ ID NO: 222888 - DNA, 25 bp, Homo sapien
gcggccgagaaatagtaaccttcca

SEQ ID NO: 222889 - DNA, 25 bp, Homo sapien
gaaatagtaaccttccagctgcgcc

SEQ ID NO: 222890 - DNA, 25 bp, Homo sapien
ccagtctgtgcccaggtcggtttct

SEQ ID NO: 222891 - DNA, 25 bp, Homo sapien
aggtcggtttcttcatcgctgacgc

SEQ ID NO: 222892 - DNA, 25 bp, Homo sapien
tctgattctccagcaactccgggat

SEQ ID NO: 222893 - DNA, 25 bp, Homo sapien
actccgggatccacaaattccatgg

SEQ ID NO: 222894 - DNA, 25 bp, Homo sapien
atggactcctcaaggtctgctcgta

SEQ ID NO: 222895 - DNA, 25 bp, Homo sapien
aggtctgctcgtacttcaaagggcc

SEQ ID NO: 222896 - DNA, 25 bp, Homo sapien
aaagggccctgacctgtgtgcagac

SEQ ID NO: 222897 - DNA, 25 bp, Homo sapien
gtgtgcagacaatgagggtctcttt

SEQ ID NO: 222898 - DNA, 25 bp, Homo sapien
atgagggtctctttaggataacaac

SEQ ID NO: 222899 - DNA, 25 bp, Homo sapien
ggataacaaccattctcaacaccag

SEQ ID NO: 222900 - DNA, 25 bp, Homo sapien
gcagcactccgtgttgacatatgat

SEQ ID NO: 222901 - DNA, 25 bp, Homo sapien
gtatgtctgcaaagtattctgactt

SEQ ID NO: 222902 - DNA, 25 bp, Homo sapien
aatggtatgtgatctggttctttaa

SEQ ID NO: 222903 - DNA, 25 bp, Homo sapien
gtgatctggttctttaaacaaattt

SEQ ID NO: 222904 - DNA, 25 bp, Homo sapien
aagcttcaaagctggaacaaccaag

SEQ ID NO: 222905 - DNA, 25 bp, Homo sapien
tgattttcctttgaatcttgcaaaa

SEQ ID NO: 222906 - DNA, 25 bp, Homo sapien
gaatcttgcaaaacctatcctctga

SEQ ID NO: 222907 - DNA, 25 bp, Homo sapien
tgcaaaacctatcctctgagacaaa

SEQ ID NO: 222908 - DNA, 25 bp, Homo sapien
gaaagccaccttgtaagtagtttct

SEQ ID NO: 222909 - DNA, 25 bp, Homo sapien
tagtttcttactacaatacagattc

SEQ ID NO: 222910 - DNA, 25 bp, Homo sapien
atacagattctatctagtgaacaag

SEQ ID NO: 222911 - DNA, 25 bp, Homo sapien
gttttccaaatatgtatgtctgcaa

SEQ ID NO: 222912 - DNA, 25 bp, Homo sapien
gggccagaaattcccaagttggtca

SEQ ID NO: 222913 - DNA, 25 bp, Homo sapien
ttcccaagttggtcacaggtggctt

SEQ ID NO: 222914 - DNA, 25 bp, Homo sapien
acaggtggcttagaagtgtgtgtta

SEQ ID NO: 222915 - DNA, 25 bp, Homo sapien
tgtgtgttatggttttacggatttc

SEQ ID NO: 222916 - DNA, 25 bp, Homo sapien
ttctctgcctacaaagaccctatac

SEQ ID NO: 222917 - DNA, 25 bp, Homo sapien
acaaagaccctatactctcagtctc

SEQ ID NO: 222918 - DNA, 25 bp, Homo sapien
actggacttagctccctaggtgcca

SEQ ID NO: 222919 - DNA, 25 bp, Homo sapien
tagctccctaggtgccacagtcaga

SEQ ID NO: 222920 - DNA, 25 bp, Homo sapien
taggtgccacagtcagatgccggac

SEQ ID NO: 222921 - DNA, 25 bp, Homo sapien
gccacagtcagatgccggacacgga

SEQ ID NO: 222922 - DNA, 25 bp, Homo sapien
cagatgccggacacggatttatata

SEQ ID NO: 222923 - DNA, 25 bp, Homo sapien
gttctcctctcctagctccatctgg

SEQ ID NO: 222924 - DNA, 25 bp, Homo sapien
agctccatctggtcgccgtccagag

SEQ ID NO: 222925 - DNA, 25 bp, Homo sapien
tcgccgtccagagcggagattcctt

SEQ ID NO: 222926 - DNA, 25 bp, Homo sapien
cgtccagagcggagattccttcctc

SEQ ID NO: 222927 - DNA, 25 bp, Homo sapien
tccagagcggagattccttcctcct

SEQ ID NO: 222928 - DNA, 25 bp, Homo sapien
gcctgctcccgagcgcccagcggaa

SEQ ID NO: 222929 - DNA, 25 bp, Homo sapien
ccaggtctaggctgccgttcccggg

SEQ ID NO: 222930 - DNA, 25 bp, Homo sapien
taggctgccgttcccgggctccatg

SEQ ID NO: 222931 - DNA, 25 bp, Homo sapien
agcgcagcctggagtcgctccatga

SEQ ID NO: 222932 - DNA, 25 bp, Homo sapien
gcgcagcctggagtcgctccatgag

SEQ ID NO: 222933 - DNA, 25 bp, Homo sapien
gcagcctggagtcgctccatgagct

SEQ ID NO: 222934 - DNA, 25 bp, Homo sapien
ctccttcagggtgagttgcaggact

SEQ ID NO: 222935 - DNA, 25 bp, Homo sapien
ggactgtttcacactatgcgcagct

SEQ ID NO: 222936 - DNA, 25 bp, Homo sapien
gtttcacactatgcgcagctgggct

SEQ ID NO: 222937 - DNA, 25 bp, Homo sapien
gctgtgtctctaaaggtcaggcttc

SEQ ID NO: 222938 - DNA, 25 bp, Homo sapien
taaaggtcaggcttcctgcacacac

SEQ ID NO: 222939 - DNA, 25 bp, Homo sapien
ttcctgcacacacatggtccatgtc

SEQ ID NO: 222940 - DNA, 25 bp, Homo sapien
acacacatggtccatgtccctgctg

SEQ ID NO: 222941 - DNA, 25 bp, Homo sapien
acagtcaccattcagttagggccgc

SEQ ID NO: 222942 - DNA, 25 bp, Homo sapien
ccccaataagccgtagtggtctttg

SEQ ID NO: 222943 - DNA, 25 bp, Homo sapien
agccgtagtggtctttgtcactcta

SEQ ID NO: 222944 - DNA, 25 bp, Homo sapien
ccccatggatttcacttgcctgctg

SEQ ID NO: 222945 - DNA, 25 bp, Homo sapien
tgtaactccagttcctagaacaatt

SEQ ID NO: 222946 - DNA, 25 bp, Homo sapien
ctccagttcctagaacaatttccag

SEQ ID NO: 222947 - DNA, 25 bp, Homo sapien
aaatatttgctgcttgaatctgctc

SEQ ID NO: 222948 - DNA, 25 bp, Homo sapien
atttgctgcttgaatctgctccaga

SEQ ID NO: 222949 - DNA, 25 bp, Homo sapien
gctgcttgaatctgctccagaatta

SEQ ID NO: 222950 - DNA, 25 bp, Homo sapien
aatctgctccagaattaacaagaaa

SEQ ID NO: 222951 - DNA, 25 bp, Homo sapien
agaattaacaagaaagccatctctt

SEQ ID NO: 222952 - DNA, 25 bp, Homo sapien
gttttgttcattactttgttcactc

SEQ ID NO: 222953 - DNA, 25 bp, Homo sapien
tgttcattactttgttcactccttc

SEQ ID NO: 222954 - DNA, 25 bp, Homo sapien
tttgttcactccttcttccatttat

SEQ ID NO: 222955 - DNA, 25 bp, Homo sapien
ctccttcttccatttattcattcaa

SEQ ID NO: 222956 - DNA, 25 bp, Homo sapien
aatatttcactatcaattcaattaa

SEQ ID NO: 222957 - DNA, 25 bp, Homo sapien
aattccatgtgaaatgtattcaaca

SEQ ID NO: 222958 - DNA, 25 bp, Homo sapien
tgaacgtattttaaaccatgccaaa

SEQ ID NO: 222959 - DNA, 25 bp, Homo sapien
aaaccatgccaaactactgctttaa

SEQ ID NO: 222960 - DNA, 25 bp, Homo sapien
atgccaaactactgctttaatgtca

SEQ ID NO: 222961 - DNA, 25 bp, Homo sapien
actactgctttaatgtcaagtttgc

SEQ ID NO: 222962 - DNA, 25 bp, Homo sapien
gtcaagtttgcagaattgtctctga

SEQ ID NO: 222963 - DNA, 25 bp, Homo sapien
aagttagctacttggtatacggaga

SEQ ID NO: 222964 - DNA, 25 bp, Homo sapien
ggatatggaggcatttttatcttct

SEQ ID NO: 222965 - DNA, 25 bp, Homo sapien
ttttatcttctgtcactactactta

SEQ ID NO: 222966 - DNA, 25 bp, Homo sapien
tcttctgtcactactacttaaaact

SEQ ID NO: 222967 - DNA, 25 bp, Homo sapien
ccctttagcgttcagattgtaagtg

SEQ ID NO: 222968 - DNA, 25 bp, Homo sapien
ttagcgttcagattgtaagtgtgtc

SEQ ID NO: 222969 - DNA, 25 bp, Homo sapien
aatgatcatcttggcagttcttgtg

SEQ ID NO: 222970 - DNA, 25 bp, Homo sapien
taagtgtgtctttattcgcgggagg

SEQ ID NO: 222971 - DNA, 25 bp, Homo sapien
agtgtgtctttattcgcgggaggcc

SEQ ID NO: 222972 - DNA, 25 bp, Homo sapien
tgtgtctttattcgcgggaggccac

SEQ ID NO: 222973 - DNA, 25 bp, Homo sapien
gatcatcttggcagttcttgtgctt

SEQ ID NO: 222974 - DNA, 25 bp, Homo sapien
tcatcttggcagttcttgtgctttt

SEQ ID NO: 222975 - DNA, 25 bp, Homo sapien
cacagtgtgtggagtatttgatgta

SEQ ID NO: 222976 - DNA, 25 bp, Homo sapien
ggagtatttgatgtactacagtacc

SEQ ID NO: 222977 - DNA, 25 bp, Homo sapien
gaaatggagacttaaactagttatt

SEQ ID NO: 222978 - DNA, 25 bp, Homo sapien
ggctacgactgcacgttgagcacgt

SEQ ID NO: 222979 - DNA, 25 bp, Homo sapien
actgcacgttgagcacgtgggcaga

SEQ ID NO: 222980 - DNA, 25 bp, Homo sapien
cacgtgggcagagcgctggtggtgc

SEQ ID NO: 222981 - DNA, 25 bp, Homo sapien
ggtggtgccagtcccggaggcgggt

SEQ ID NO: 222982 - DNA, 25 bp, Homo sapien
gcgggtgtagcgtgggctctgcagc

SEQ ID NO: 222983 - DNA, 25 bp, Homo sapien
tgcagctccaggacatacttttccc

SEQ ID NO: 222984 - DNA, 25 bp, Homo sapien
ccaggacatacttttcccttgattt

SEQ ID NO: 222985 - DNA, 25 bp, Homo sapien
ttgatttcttcaggtgctcctcatc

SEQ ID NO: 222986 - DNA, 25 bp, Homo sapien
tcctcatccgggtcttgcatgaact

SEQ ID NO: 222987 - DNA, 25 bp, Homo sapien
gggtcttgcatgaactcggtgcctg

SEQ ID NO: 222988 - DNA, 25 bp, Homo sapien
tgcatgaactcggtgcctgtgaggt

SEQ ID NO: 222989 - DNA, 25 bp, Homo sapien
aggagctttttatggcggactgatt

SEQ ID NO: 222990 - DNA, 25 bp, Homo sapien
tttatggcggactgattaaaactct

SEQ ID NO: 222991 - DNA, 25 bp, Homo sapien
cgatatgatgtgtggatttcactac

SEQ ID NO: 222992 - DNA, 25 bp, Homo sapien
gatttcactacatttggctcctgga

SEQ ID NO: 222993 - DNA, 25 bp, Homo sapien
tggctcctggatgctataaaaggac

SEQ ID NO: 222994 - DNA, 25 bp, Homo sapien
aaggacttggatttctgacttggct

SEQ ID NO: 222995 - DNA, 25 bp, Homo sapien
ggatttctgacttggctcagggact

SEQ ID NO: 222996 - DNA, 25 bp, Homo sapien
tttcacctgtgttttcttccgatcc

SEQ ID NO: 222997 - DNA, 25 bp, Homo sapien
gttttcttccgatcccagctctggt

SEQ ID NO: 222998 - DNA, 25 bp, Homo sapien
tcagccgcattcatatttactctcc

SEQ ID NO: 222999 - DNA, 25 bp, Homo sapien
atctcaacccgaagccaagatctga

SEQ ID NO: 223000 - DNA, 25 bp, Homo sapien
gacagtggaagactttgaatttctc

SEQ ID NO: 223001 - DNA, 25 bp, Homo sapien
gaatttctcatatatggtatgtttg

SEQ ID NO: 223002 - DNA, 25 bp, Homo sapien
gtatgtttgatgtaggacctcactg

SEQ ID NO: 223003 - DNA, 25 bp, Homo sapien
gtttgatgtaggacctcactgttaa

SEQ ID NO: 223004 - DNA, 25 bp, Homo sapien
gatgtaggacctcactgttaaggca

SEQ ID NO: 223005 - DNA, 25 bp, Homo sapien
gtaggacctcactgttaaggcacaa

SEQ ID NO: 223006 - DNA, 25 bp, Homo sapien
ggacctcactgttaaggcacaaatt

SEQ ID NO: 223007 - DNA, 25 bp, Homo sapien
cactgttaaggcacaaattatttca

SEQ ID NO: 223008 - DNA, 25 bp, Homo sapien
ggaagttactctaaagacactcaga

SEQ ID NO: 223009 - DNA, 25 bp, Homo sapien
gttactctaaagacactcagattat

SEQ ID NO: 223010 - DNA, 25 bp, Homo sapien
tctaaagacactcagattatttcag

SEQ ID NO: 223011 - DNA, 25 bp, Homo sapien
atccaaaaaaggcaggatccggccg

SEQ ID NO: 223012 - DNA, 25 bp, Homo sapien
aaggtgattattctgtctgatgagg

SEQ ID NO: 223013 - DNA, 25 bp, Homo sapien
gaataagagccagtttgtggtattg

SEQ ID NO: 223014 - DNA, 25 bp, Homo sapien
gtaaagttcaaccaatctacaaagg

SEQ ID NO: 223015 - DNA, 25 bp, Homo sapien
caaaggccaaaaatattttcacagg

SEQ ID NO: 223016 - DNA, 25 bp, Homo sapien
aaagatgaactccaatctgctgccc

SEQ ID NO: 223017 - DNA, 25 bp, Homo sapien
aatctgctgcccctaaacgcattct

SEQ ID NO: 223018 - DNA, 25 bp, Homo sapien
taaacgcattctccactgtctggaa

SEQ ID NO: 223019 - DNA, 25 bp, Homo sapien
gcattctccactgtctggaagatgt

SEQ ID NO: 223020 - DNA, 25 bp, Homo sapien
aagacagaagtgcttgccttggtga

SEQ ID NO: 223021 - DNA, 25 bp, Homo sapien
gaagtgcttgccttggtgatccaaa

SEQ ID NO: 223022 - DNA, 25 bp, Homo sapien
gaacaatattttgcctatgccattt

SEQ ID NO: 223023 - DNA, 25 bp, Homo sapien
tttgcctatgccatttaattcccac

SEQ ID NO: 223024 - DNA, 25 bp, Homo sapien
gcctatgccatttaattcccacaaa

SEQ ID NO: 223025 - DNA, 25 bp, Homo sapien
aattcccacaaatttgcaaagtgag

SEQ ID NO: 223026 - DNA, 25 bp, Homo sapien
atttgcaaagtgagcattgttattc

SEQ ID NO: 223027 - DNA, 25 bp, Homo sapien
gtgagcattgttattctcagtttcc

SEQ ID NO: 223028 - DNA, 25 bp, Homo sapien
ggatatttatcctctccaaatttca

SEQ ID NO: 223029 - DNA, 25 bp, Homo sapien
tttatcctctccaaatttcatgttg

SEQ ID NO: 223030 - DNA, 25 bp, Homo sapien
ggaggtgttttggtttactcagcca

SEQ ID NO: 223031 - DNA, 25 bp, Homo sapien
gaggtgttttggtttactcagccaa

SEQ ID NO: 223032 - DNA, 25 bp, Homo sapien
tactcagccaaagaatttagcttct

SEQ ID NO: 223033 - DNA, 25 bp, Homo sapien
gaaccactcctttctagggaatttg

SEQ ID NO: 223034 - DNA, 25 bp, Homo sapien
gggaatttggttagggctgactcat

SEQ ID NO: 223035 - DNA, 25 bp, Homo sapien
gctgactcatttcctggcttcaggg

SEQ ID NO: 223036 - DNA, 25 bp, Homo sapien
gcccagatttccagggcccggatta

SEQ ID NO: 223037 - DNA, 25 bp, Homo sapien
ggcccggattaccagtgaagcgtca

SEQ ID NO: 223038 - DNA, 25 bp, Homo sapien
agtgaagcgtcaatccctggatttt

SEQ ID NO: 223039 - DNA, 25 bp, Homo sapien
attgaaaccattggagaagagccat

SEQ ID NO: 223040 - DNA, 25 bp, Homo sapien
taaatctgccaagtatcctagctct

SEQ ID NO: 223041 - DNA, 25 bp, Homo sapien
tagctctttgcaactcactgtgtag

SEQ ID NO: 223042 - DNA, 25 bp, Homo sapien
gcaactcactgtgtagtttttgggc

SEQ ID NO: 223043 - DNA, 25 bp, Homo sapien
tccccttatggaaaatacctctttg

SEQ ID NO: 223044 - DNA, 25 bp, Homo sapien
agaatttcattctttgtcattataa

SEQ ID NO: 223045 - DNA, 25 bp, Homo sapien
aaacaatgtccacatcagacttgga

SEQ ID NO: 223046 - DNA, 25 bp, Homo sapien
cagacttggaacttctcacttcaaa

SEQ ID NO: 223047 - DNA, 25 bp, Homo sapien
acagatttagcagtgttgtacataa

SEQ ID NO: 223048 - DNA, 25 bp, Homo sapien
atgtccaagcatttttccacctgtt

SEQ ID NO: 223049 - DNA, 25 bp, Homo sapien
gcatttttccacctgtttactgagt

SEQ ID NO: 223050 - DNA, 25 bp, Homo sapien
gagttttccaaccatttactatgtg

SEQ ID NO: 223051 - DNA, 25 bp, Homo sapien
agattggtgggttttctggctgttt

SEQ ID NO: 223052 - DNA, 25 bp, Homo sapien
ggctgtttttctgaggtgaatgact

SEQ ID NO: 223053 - DNA, 25 bp, Homo sapien
ggtgaatgacttgttacagagcctc

SEQ ID NO: 223054 - DNA, 25 bp, Homo sapien
cagagcctcagtaagaaatttcaac

SEQ ID NO: 223055 - DNA, 25 bp, Homo sapien
cttgatttcttcaggtgctcctcat

SEQ ID NO: 223056 - DNA, 25 bp, Homo sapien
ttgatttcttcaggtgctcctcatc

SEQ ID NO: 223057 - DNA, 25 bp, Homo sapien
tgatttcttcaggtgctcctcatcc

SEQ ID NO: 223058 - DNA, 25 bp, Homo sapien
tcctcatccgggtcttgcatgaact

SEQ ID NO: 223059 - DNA, 25 bp, Homo sapien
tcatccgggtcttgcatgaactcgg

SEQ ID NO: 223060 - DNA, 25 bp, Homo sapien
atccgggtcttgcatgaactcggtg

SEQ ID NO: 223061 - DNA, 25 bp, Homo sapien
tccgggtcttgcatgaactcggtgc

SEQ ID NO: 223062 - DNA, 25 bp, Homo sapien
cgggtcttgcatgaactcggtgcct

SEQ ID NO: 223063 - DNA, 25 bp, Homo sapien
gggtcttgcatgaactcggtgcctg

SEQ ID NO: 223064 - DNA, 25 bp, Homo sapien
ggtcttgcatgaactcggtgcctgt

SEQ ID NO: 223065 - DNA, 25 bp, Homo sapien
tcttgcatgaactcggtgcctgtga

SEQ ID NO: 223066 - DNA, 25 bp, Homo sapien
ccatggcggtgtacaccagcgagcg

SEQ ID NO: 223067 - DNA, 25 bp, Homo sapien
tgtacaccagcgagcggtgggacca

SEQ ID NO: 223068 - DNA, 25 bp, Homo sapien
gcgagcggtgggaccagcctccaca

SEQ ID NO: 223069 - DNA, 25 bp, Homo sapien
tgggctgggtctcagctatcctctt

SEQ ID NO: 223070 - DNA, 25 bp, Homo sapien
agctatcctcttgctctgtacaggt

SEQ ID NO: 223071 - DNA, 25 bp, Homo sapien
tcttgctctgtacaggtgccctgag

SEQ ID NO: 223072 - DNA, 25 bp, Homo sapien
ggcggtccccgtcctggctatgaaa

SEQ ID NO: 223073 - DNA, 25 bp, Homo sapien
ccgtcctggctatgaaaccttgtga

SEQ ID NO: 223074 - DNA, 25 bp, Homo sapien
ggctatgaaaccttgtgagcagaag

SEQ ID NO: 223075 - DNA, 25 bp, Homo sapien
gatgagttttgagcgttgtattcca

SEQ ID NO: 223076 - DNA, 25 bp, Homo sapien
tttgagcgttgtattccaaaggcct

SEQ ID NO: 223077 - DNA, 25 bp, Homo sapien
aaatgggaaatttctcaggaagaga

SEQ ID NO: 223078 - DNA, 25 bp, Homo sapien
gagacatttaggacttcagaacttt

SEQ ID NO: 223079 - DNA, 25 bp, Homo sapien
aacttttaacttgtagtcacattgt

SEQ ID NO: 223080 - DNA, 25 bp, Homo sapien
gtcacattgttgatatggaaaccac

SEQ ID NO: 223081 - DNA, 25 bp, Homo sapien
tgttgatatggaaaccactgactta

SEQ ID NO: 223082 - DNA, 25 bp, Homo sapien
tcccagtcctgaattggtgaaagga

SEQ ID NO: 223083 - DNA, 25 bp, Homo sapien
ggtgaaaggaacctgctgtccagtt

SEQ ID NO: 223084 - DNA, 25 bp, Homo sapien
gaacctgctgtccagtttgcagaga

SEQ ID NO: 223085 - DNA, 25 bp, Homo sapien
tttgcagagaacgaggaatgccaag

SEQ ID NO: 223086 - DNA, 25 bp, Homo sapien
ggaatgccaagtgattccccagaga

SEQ ID NO: 223087 - DNA, 25 bp, Homo sapien
gattccccagagaagcgctaataaa

SEQ ID NO: 223088 - DNA, 25 bp, Homo sapien
cctcgaggcattcttgatacccctt

SEQ ID NO: 223089 - DNA, 25 bp, Homo sapien
acctgcatttctgtcccagggatac

SEQ ID NO: 223090 - DNA, 25 bp, Homo sapien
cagatgcagccactacctaactagg

SEQ ID NO: 223091 - DNA, 25 bp, Homo sapien
actacctaactaggcttgtcctggg

SEQ ID NO: 223092 - DNA, 25 bp, Homo sapien
gagtgagccgtgaacctggagacat

SEQ ID NO: 223093 - DNA, 25 bp, Homo sapien
cgtgaacctggagacatggctttga

SEQ ID NO: 223094 - DNA, 25 bp, Homo sapien
atggctttgacccacagctactgtt

SEQ ID NO: 223095 - DNA, 25 bp, Homo sapien
tactgttcatttcctcaggctttgc

SEQ ID NO: 223096 - DNA, 25 bp, Homo sapien
aggctttgcgctgattccctcaata

SEQ ID NO: 223097 - DNA, 25 bp, Homo sapien
gcgctgattccctcaataatatgac

SEQ ID NO: 223098 - DNA, 25 bp, Homo sapien
gacagtaaggcaagtagtctccttg

SEQ ID NO: 223099 - DNA, 25 bp, Homo sapien
aaagcaggctgagatgcagctcctg

SEQ ID NO: 223100 - DNA, 25 bp, Homo sapien
atgcagctcctggtggtccatctga

SEQ ID NO: 223101 - DNA, 25 bp, Homo sapien
tggtccatctgagcgggtcgtttga

SEQ ID NO: 223102 - DNA, 25 bp, Homo sapien
gagcgggtcgtttgaggtcatctct

SEQ ID NO: 223103 - DNA, 25 bp, Homo sapien
tttgaggtcatctctggacgcttac

SEQ ID NO: 223104 - DNA, 25 bp, Homo sapien
gtcatctctggacgcttactcaaaa

SEQ ID NO: 223105 - DNA, 25 bp, Homo sapien
gggacattttatgccccctgaatta

SEQ ID NO: 223106 - DNA, 25 bp, Homo sapien
ccctgaattattgcagtcccagttt

SEQ ID NO: 223107 - DNA, 25 bp, Homo sapien
agcagctccagaaaactttatccaa

SEQ ID NO: 223108 - DNA, 25 bp, Homo sapien
attgctacaattatggaaaccctaa

SEQ ID NO: 223109 - DNA, 25 bp, Homo sapien
gtggtccaaacagaactaagcataa

SEQ ID NO: 223110 - DNA, 25 bp, Homo sapien
accaagggcctaatgtttgttacag

SEQ ID NO: 223111 - DNA, 25 bp, Homo sapien
gtttgttacagaaatgatcccagag

SEQ ID NO: 223112 - DNA, 25 bp, Homo sapien
tgatcccagagacctacaagatgtg

SEQ ID NO: 223113 - DNA, 25 bp, Homo sapien
gtgggaatcagcataacagggcaat

SEQ ID NO: 223114 - DNA, 25 bp, Homo sapien
ggcaatgcagcaattaaccccacat

SEQ ID NO: 223115 - DNA, 25 bp, Homo sapien
taaccccacatcgttttctgtagtt

SEQ ID NO: 223116 - DNA, 25 bp, Homo sapien
tcttctgtctcacctcgttagaaaa

SEQ ID NO: 223117 - DNA, 25 bp, Homo sapien
gttagaaaattcctcccagtcaggg

SEQ ID NO: 223118 - DNA, 25 bp, Homo sapien
ggacccaagggtctcaagcctgcaa

SEQ ID NO: 223119 - DNA, 25 bp, Homo sapien
agcctgcaagtccagaaggtgacaa

SEQ ID NO: 223120 - DNA, 25 bp, Homo sapien
gtccagaaggtgacaaacccaggag

SEQ ID NO: 223121 - DNA, 25 bp, Homo sapien
ccacttgaacgttggtcataggtca

SEQ ID NO: 223122 - DNA, 25 bp, Homo sapien
gtcataggtcagttggtcatagtat

SEQ ID NO: 223123 - DNA, 25 bp, Homo sapien
actacccatatagatattccaagaa

SEQ ID NO: 223124 - DNA, 25 bp, Homo sapien
aagccaagtttgacttctgaatcca

SEQ ID NO: 223125 - DNA, 25 bp, Homo sapien
gaatccagcattcatactattactc

SEQ ID NO: 223126 - DNA, 25 bp, Homo sapien
gcattcatactattactccttcagt

SEQ ID NO: 223127 - DNA, 25 bp, Homo sapien
actccttcagttgttaacttcacta

SEQ ID NO: 223128 - DNA, 25 bp, Homo sapien
aactgggtgcagtatctgcatcaga

SEQ ID NO: 223129 - DNA, 25 bp, Homo sapien
gttgctgaaagcctaagtactagtt

SEQ ID NO: 223130 - DNA, 25 bp, Homo sapien
gcctaagtactagtttgcagtccaa

SEQ ID NO: 223131 - DNA, 25 bp, Homo sapien
gtactagtttgcagtccaaaccatt

SEQ ID NO: 223132 - DNA, 25 bp, Homo sapien
aatgcaggcccaatgtgacaaattt

SEQ ID NO: 223133 - DNA, 25 bp, Homo sapien
gtaactggcttgtatgatattttct

SEQ ID NO: 223134 - DNA, 25 bp, Homo sapien
atgttggatgtccaggctagcaccc

SEQ ID NO: 223135 - DNA, 25 bp, Homo sapien
aggctagcaccctcccttcagatga

SEQ ID NO: 223136 - DNA, 25 bp, Homo sapien
tcccttcagatgaccattgctagca

SEQ ID NO: 223137 - DNA, 25 bp, Homo sapien
ttgctagcaagaaacaggaggcggt

SEQ ID NO: 223138 - DNA, 25 bp, Homo sapien
gaggcggtggccatattccaaaaac

SEQ ID NO: 223139 - DNA, 25 bp, Homo sapien
tgtcccatttcaccaggatgactaa

SEQ ID NO: 223140 - DNA, 25 bp, Homo sapien
ttcaccaggatgactaaggcaagct

SEQ ID NO: 223141 - DNA, 25 bp, Homo sapien
ctgccagatttcagggactgttttt

SEQ ID NO: 223142 - DNA, 25 bp, Homo sapien
tttcctgttttctaatgcaggccca

SEQ ID NO: 223143 - DNA, 25 bp, Homo sapien
actgatagcttgttaaactgtggta

SEQ ID NO: 223144 - DNA, 25 bp, Homo sapien
gggtgctacaacgttaatcaaatat

SEQ ID NO: 223145 - DNA, 25 bp, Homo sapien
caaatataattgagctgttctgttt

SEQ ID NO: 223146 - DNA, 25 bp, Homo sapien
agctgttctgtttccagtcagtgta

SEQ ID NO: 223147 - DNA, 25 bp, Homo sapien
gttctgtttccagtcagtgtaacca

SEQ ID NO: 223148 - DNA, 25 bp, Homo sapien
gtttccagtcagtgtaaccatttaa

SEQ ID NO: 223149 - DNA, 25 bp, Homo sapien
aataccttggcaaaacaagctagga

SEQ ID NO: 223150 - DNA, 25 bp, Homo sapien
caagctaggagctagttcatgctaa

SEQ ID NO: 223151 - DNA, 25 bp, Homo sapien
gttcatgctaatattcttaaggaca

SEQ ID NO: 223152 - DNA, 25 bp, Homo sapien
gattcatttatagactgaagcctct

SEQ ID NO: 223153 - DNA, 25 bp, Homo sapien
gactgaagcctctatgacttcaaaa

SEQ ID NO: 223154 - DNA, 25 bp, Homo sapien
ttcatcgaccgccagaagtgcatgg

SEQ ID NO: 223155 - DNA, 25 bp, Homo sapien
atcgaccgccagaagtgcatggccc

SEQ ID NO: 223156 - DNA, 25 bp, Homo sapien
gaccgccagaagtgcatggcccatc

SEQ ID NO: 223157 - DNA, 25 bp, Homo sapien
cgccagaagtgcatggcccatcgta

SEQ ID NO: 223158 - DNA, 25 bp, Homo sapien
ccagaagtgcatggcccatcgtact

SEQ ID NO: 223159 - DNA, 25 bp, Homo sapien
aagtgcatggcccatcgtacttgct

SEQ ID NO: 223160 - DNA, 25 bp, Homo sapien
agtgcatggcccatcgtacttgcta

SEQ ID NO: 223161 - DNA, 25 bp, Homo sapien
gtgcatggcccatcgtacttgctac

SEQ ID NO: 223162 - DNA, 25 bp, Homo sapien
ctgcagctggctggctaccagtgag

SEQ ID NO: 223163 - DNA, 25 bp, Homo sapien
taccagtgagcagcggcacggtgct

SEQ ID NO: 223164 - DNA, 25 bp, Homo sapien
gtgagcagcggcacggtgcttcccc

SEQ ID NO: 223165 - DNA, 25 bp, Homo sapien
aaatgagccaaaacaattaagtaat

SEQ ID NO: 223166 - DNA, 25 bp, Homo sapien
aaatcatgactacttttatcaaaga

SEQ ID NO: 223167 - DNA, 25 bp, Homo sapien
attaatcctattaatcatgaaagcg

SEQ ID NO: 223168 - DNA, 25 bp, Homo sapien
aatcatgaaagcgtagcattgtaaa

SEQ ID NO: 223169 - DNA, 25 bp, Homo sapien
gcgtagcattgtaaattaaaggttt

SEQ ID NO: 223170 - DNA, 25 bp, Homo sapien
ggctcttgaaagtgatcccattgct

SEQ ID NO: 223171 - DNA, 25 bp, Homo sapien
attttatgctctttatttccacttc

SEQ ID NO: 223172 - DNA, 25 bp, Homo sapien
ttttatgctctttatttccacttct

SEQ ID NO: 223173 - DNA, 25 bp, Homo sapien
atttccacttctgtgaatgtgatat

SEQ ID NO: 223174 - DNA, 25 bp, Homo sapien
cacttctgtgaatgtgatatttcta

SEQ ID NO: 223175 - DNA, 25 bp, Homo sapien
tactgaataaacaaacttgctacat

SEQ ID NO: 223176 - DNA, 25 bp, Homo sapien
tgggcctggcgctgcagacctgagc

SEQ ID NO: 223177 - DNA, 25 bp, Homo sapien
ggacccatttgaggactgaactagg

SEQ ID NO: 223178 - DNA, 25 bp, Homo sapien
gaactaggcaggcaatggctccagt

SEQ ID NO: 223179 - DNA, 25 bp, Homo sapien
ggcaggcaatggctccagtgccctc

SEQ ID NO: 223180 - DNA, 25 bp, Homo sapien
tctgcttgtacagagcccatggtcg

SEQ ID NO: 223181 - DNA, 25 bp, Homo sapien
gtacagagcccatggtcgggacagt

SEQ ID NO: 223182 - DNA, 25 bp, Homo sapien
atggtcgggacagtgccctggcctt

SEQ ID NO: 223183 - DNA, 25 bp, Homo sapien
ggctggcaacccctgaagagaacac

SEQ ID NO: 223184 - DNA, 25 bp, Homo sapien
ctggcaacccctgaagagaacactt

SEQ ID NO: 223185 - DNA, 25 bp, Homo sapien
agagaacacttcctgttggtctgtc

SEQ ID NO: 223186 - DNA, 25 bp, Homo sapien
aacacttcctgttggtctgtctctt

SEQ ID NO: 223187 - DNA, 25 bp, Homo sapien
tctaccccaggatttcacacagtac

SEQ ID NO: 223188 - DNA, 25 bp, Homo sapien
ctcccagagctatgagaacgctcat

SEQ ID NO: 223189 - DNA, 25 bp, Homo sapien
gagaacgctcatgggcaccaaaatt

SEQ ID NO: 223190 - DNA, 25 bp, Homo sapien
tcatgggcaccaaaatttcagacca

SEQ ID NO: 223191 - DNA, 25 bp, Homo sapien
tttcagaccaaaatccgggacacgg

SEQ ID NO: 223192 - DNA, 25 bp, Homo sapien
atccgggacacggttcagaactagt

SEQ ID NO: 223193 - DNA, 25 bp, Homo sapien
acggttcagaactagtggtcaggaa

SEQ ID NO: 223194 - DNA, 25 bp, Homo sapien
aacgacggcgaaccttcgcgctctg

SEQ ID NO: 223195 - DNA, 25 bp, Homo sapien
ttcgcgctctgttcagcaccaggag

SEQ ID NO: 223196 - DNA, 25 bp, Homo sapien
aggagcaacgctcacgtcctcaata

SEQ ID NO: 223197 - DNA, 25 bp, Homo sapien
acgtcctcaataaagatggcggcaa

SEQ ID NO: 223198 - DNA, 25 bp, Homo sapien
gatgaggagcacctgaagaaatcaa

SEQ ID NO: 223199 - DNA, 25 bp, Homo sapien
agttcatgcaagacccggatgagga

SEQ ID NO: 223200 - DNA, 25 bp, Homo sapien
atgcaagacccggatgaggagcacc

SEQ ID NO: 223201 - DNA, 25 bp, Homo sapien
tgcaagacccggatgaggagcacct

SEQ ID NO: 223202 - DNA, 25 bp, Homo sapien
gcaagacccggatgaggagcacctg

SEQ ID NO: 223203 - DNA, 25 bp, Homo sapien
caagacccggatgaggagcacctga

SEQ ID NO: 223204 - DNA, 25 bp, Homo sapien
aagacccggatgaggagcacctgaa

SEQ ID NO: 223205 - DNA, 25 bp, Homo sapien
agacccggatgaggagcacctgaag

SEQ ID NO: 223206 - DNA, 25 bp, Homo sapien
gacccggatgaggagcacctgaaga

SEQ ID NO: 223207 - DNA, 25 bp, Homo sapien
acccggatgaggagcacctgaagaa

SEQ ID NO: 223208 - DNA, 25 bp, Homo sapien
ccggatgaggagcacctgaagaaat

SEQ ID NO: 223209 - DNA, 25 bp, Homo sapien
tgtgggctatgggtcacctgctgcc

SEQ ID NO: 223210 - DNA, 25 bp, Homo sapien
tggccgagctcctctggccatgcat

SEQ ID NO: 223211 - DNA, 25 bp, Homo sapien
tctggccatgcatccagcctgctgt

SEQ ID NO: 223212 - DNA, 25 bp, Homo sapien
catgcatccagcctgctgttctggg

SEQ ID NO: 223213 - DNA, 25 bp, Homo sapien
gacgtgagcatcacctgagggtctc

SEQ ID NO: 223214 - DNA, 25 bp, Homo sapien
cgtgagcatcacctgagggtctcag

SEQ ID NO: 223215 - DNA, 25 bp, Homo sapien
ctgagggtctcaggaatgacgcttg

SEQ ID NO: 223216 - DNA, 25 bp, Homo sapien
ggtctcaggaatgacgcttggacat

SEQ ID NO: 223217 - DNA, 25 bp, Homo sapien
gaatgacgcttggacatggtgatca

SEQ ID NO: 223218 - DNA, 25 bp, Homo sapien
cttggacatggtgatcagctgcctg

SEQ ID NO: 223219 - DNA, 25 bp, Homo sapien
gttgcataaatacacttgagcattt

SEQ ID NO: 223220 - DNA, 25 bp, Homo sapien
tattttccctcctgacaggcaaagg

SEQ ID NO: 223221 - DNA, 25 bp, Homo sapien
ctcaggtctcctccctgtgacttgg

SEQ ID NO: 223222 - DNA, 25 bp, Homo sapien
gtgacttggtgcacacctgggcatc

SEQ ID NO: 223223 - DNA, 25 bp, Homo sapien
ttggtgcacacctgggcatcactgt

SEQ ID NO: 223224 - DNA, 25 bp, Homo sapien
tgggcatcactgtcttttacacact

SEQ ID NO: 223225 - DNA, 25 bp, Homo sapien
tacacactgatgtgtccctcgcttt

SEQ ID NO: 223226 - DNA, 25 bp, Homo sapien
tgatgtgtccctcgctttctttttt

SEQ ID NO: 223227 - DNA, 25 bp, Homo sapien
gcctccctcttgtctttatggactg

SEQ ID NO: 223228 - DNA, 25 bp, Homo sapien
tgatgtcccaccatatggatgctct

SEQ ID NO: 223229 - DNA, 25 bp, Homo sapien
gtcccaccatatggatgctctcggg

SEQ ID NO: 223230 - DNA, 25 bp, Homo sapien
acttaaagtcagtcatcttcctgcc

SEQ ID NO: 223231 - DNA, 25 bp, Homo sapien
gggactcaatcacacgctcttcaag

SEQ ID NO: 223232 - DNA, 25 bp, Homo sapien
aatcacacgctcttcaagtccggct

SEQ ID NO: 223233 - DNA, 25 bp, Homo sapien
aagtccggctcccatatttcctaat

SEQ ID NO: 223234 - DNA, 25 bp, Homo sapien
cggctcccatatttcctaattgcaa

SEQ ID NO: 223235 - DNA, 25 bp, Homo sapien
attgcaagccaaatttaatgtacct

SEQ ID NO: 223236 - DNA, 25 bp, Homo sapien
aatttaatgtaccttgttccacaat

SEQ ID NO: 223237 - DNA, 25 bp, Homo sapien
ctttaactattgtcatttgcctctt

SEQ ID NO: 223238 - DNA, 25 bp, Homo sapien
ttgtcatttgcctctttcacatcat

SEQ ID NO: 223239 - DNA, 25 bp, Homo sapien
atgaatttgctttatgtgctggaaa

SEQ ID NO: 223240 - DNA, 25 bp, Homo sapien
acatagctatcacagggcctggacc

SEQ ID NO: 223241 - DNA, 25 bp, Homo sapien
gggcctggacctctaaaattttgca

SEQ ID NO: 223242 - DNA, 25 bp, Homo sapien
tgtcttttcttggtctaggtggtgt

SEQ ID NO: 223243 - DNA, 25 bp, Homo sapien
gatacagtctgattagttcgtaggc

SEQ ID NO: 223244 - DNA, 25 bp, Homo sapien
acatttccactcctctctgtgtgtt

SEQ ID NO: 223245 - DNA, 25 bp, Homo sapien
tgtgtgttcctctctgcatctgctg

SEQ ID NO: 223246 - DNA, 25 bp, Homo sapien
tttctccttagccacattgagttct

SEQ ID NO: 223247 - DNA, 25 bp, Homo sapien
gccacattgagttctttaacagttt

SEQ ID NO: 223248 - DNA, 25 bp, Homo sapien
tagttcgtaggcttaacacttcctt

SEQ ID NO: 223249 - DNA, 25 bp, Homo sapien
tttttctttctccttggaatgcctc

SEQ ID NO: 223250 - DNA, 25 bp, Homo sapien
ggaatgcctcttgggatatgcatta

SEQ ID NO: 223251 - DNA, 25 bp, Homo sapien
ctcttgggatatgcattagttggtc

SEQ ID NO: 223252 - DNA, 25 bp, Homo sapien
ttagttggtcttatgtcttttcttg

SEQ ID NO: 223253 - DNA, 25 bp, Homo sapien
tgaaacttcaagctccccttgtgat

SEQ ID NO: 223254 - DNA, 25 bp, Homo sapien
gctccccttgtgataagacttggtc

SEQ ID NO: 223255 - DNA, 25 bp, Homo sapien
gataactgagtctggtcaatggaat

SEQ ID NO: 223256 - DNA, 25 bp, Homo sapien
ccttcctgccgggtggaatgtgaat

SEQ ID NO: 223257 - DNA, 25 bp, Homo sapien
gaatatgatggcacctgggacccaa

SEQ ID NO: 223258 - DNA, 25 bp, Homo sapien
gacaggagccacatcttgagagata

SEQ ID NO: 223259 - DNA, 25 bp, Homo sapien
atagatggcagatctgcccctgtgg

SEQ ID NO: 223260 - DNA, 25 bp, Homo sapien
ccctgtggctttggatcatttacct

SEQ ID NO: 223261 - DNA, 25 bp, Homo sapien
ggatcatttacctcagtgaacacaa

SEQ ID NO: 223262 - DNA, 25 bp, Homo sapien
gcattatccatgaaaccataggttt

SEQ ID NO: 223263 - DNA, 25 bp, Homo sapien
ccataggttttgtgtgctagttcta

SEQ ID NO: 223264 - DNA, 25 bp, Homo sapien
acaattccgtttactggcaggaatt

SEQ ID NO: 223265 - DNA, 25 bp, Homo sapien
atacctgtgtctatgagtgtctgga

SEQ ID NO: 223266 - DNA, 25 bp, Homo sapien
ggcaaagactgtcagagcttcttct

SEQ ID NO: 223267 - DNA, 25 bp, Homo sapien
gatcctggaggaaagggcgtattca

SEQ ID NO: 223268 - DNA, 25 bp, Homo sapien
gggcgtattcacatagacatcttgg

SEQ ID NO: 223269 - DNA, 25 bp, Homo sapien
gagctggactcgtactcccgggtct

SEQ ID NO: 223270 - DNA, 25 bp, Homo sapien
tgctctttaacctggtctactgggt

SEQ ID NO: 223271 - DNA, 25 bp, Homo sapien
gtctactgggttggatacctgtatc

SEQ ID NO: 223272 - DNA, 25 bp, Homo sapien
tacctgtatctctaagtgttgctca

SEQ ID NO: 223273 - DNA, 25 bp, Homo sapien
gaagagcatttggtacacacttgac

SEQ ID NO: 223274 - DNA, 25 bp, Homo sapien
tggtacacacttgaccttctgtcgt

SEQ ID NO: 223275 - DNA, 25 bp, Homo sapien
attgcttgagattagtctcctattg

SEQ ID NO: 223276 - DNA, 25 bp, Homo sapien
tctcctattgtatattagagccaaa

SEQ ID NO: 223277 - DNA, 25 bp, Homo sapien
acacataataactttggcaacaggg

SEQ ID NO: 223278 - DNA, 25 bp, Homo sapien
gcaacagggagttgtctagactcaa

SEQ ID NO: 223279 - DNA, 25 bp, Homo sapien
ctagactcaattttcagaggtccca

SEQ ID NO: 223280 - DNA, 25 bp, Homo sapien
cagaggtcccattgtagtgagttaa

SEQ ID NO: 223281 - DNA, 25 bp, Homo sapien
attgctaatcatgtcaatcacttga

SEQ ID NO: 223282 - DNA, 25 bp, Homo sapien
gacatggaagtcagtggcaaatctt

SEQ ID NO: 223283 - DNA, 25 bp, Homo sapien
gtttctcattttgtctcccaagtca

SEQ ID NO: 223284 - DNA, 25 bp, Homo sapien
tttgtctcccaagtcatttttctgc

SEQ ID NO: 223285 - DNA, 25 bp, Homo sapien
gaccaggcttgtaggaagactcatc

SEQ ID NO: 223286 - DNA, 25 bp, Homo sapien
cctatgtttgtgctgattgtgggag

SEQ ID NO: 223287 - DNA, 25 bp, Homo sapien
tgggagggccttcatccagaagtca

SEQ ID NO: 223288 - DNA, 25 bp, Homo sapien
aaatgtcctgactgtgagaaatcct

SEQ ID NO: 223289 - DNA, 25 bp, Homo sapien
aatgtcctgactgtgagaaatcctt

SEQ ID NO: 223290 - DNA, 25 bp, Homo sapien
catctcaaagtacatcaacgaattc

SEQ ID NO: 223291 - DNA, 25 bp, Homo sapien
atctcaaagtacatcaacgaattca

SEQ ID NO: 223292 - DNA, 25 bp, Homo sapien
tctcaaagtacatcaacgaattcac

SEQ ID NO: 223293 - DNA, 25 bp, Homo sapien
gggagaaaccatatatatgtgcaga

SEQ ID NO: 223294 - DNA, 25 bp, Homo sapien
ctgataggtcaaatttcaataaaca

SEQ ID NO: 223295 - DNA, 25 bp, Homo sapien
taggtcaaatttcaataaacatcag

SEQ ID NO: 223296 - DNA, 25 bp, Homo sapien
tggaaaggggttcacccagaaatca

SEQ ID NO: 223297 - DNA, 25 bp, Homo sapien
ataagtggttattcctcaaattagt

SEQ ID NO: 223298 - DNA, 25 bp, Homo sapien
gtggttattcctcaaattagtttca

SEQ ID NO: 223299 - DNA, 25 bp, Homo sapien
ggataaatcattgttccctcccata

SEQ ID NO: 223300 - DNA, 25 bp, Homo sapien
attgttccctcccataggtacattt

SEQ ID NO: 223301 - DNA, 25 bp, Homo sapien
ttccctcccataggtacattttcta

SEQ ID NO: 223302 - DNA, 25 bp, Homo sapien
atttaaccagttgccagttctcaga

SEQ ID NO: 223303 - DNA, 25 bp, Homo sapien
acaccacacaggctgcagattgtag

SEQ ID NO: 223304 - DNA, 25 bp, Homo sapien
caggctgcagattgtagggatagat

SEQ ID NO: 223305 - DNA, 25 bp, Homo sapien
atgggaggctcatctcactctctat

SEQ ID NO: 223306 - DNA, 25 bp, Homo sapien
tcatctcactctctatttcaatacg

SEQ ID NO: 223307 - DNA, 25 bp, Homo sapien
ctctctatttcaatacgttctactt

SEQ ID NO: 223308 - DNA, 25 bp, Homo sapien
agttttttccaacacccagtcattg

SEQ ID NO: 223309 - DNA, 25 bp, Homo sapien
ccagtcattgatgcgtttcctgcac

SEQ ID NO: 223310 - DNA, 25 bp, Homo sapien
tttcctgcacccttcagtgtcttta

SEQ ID NO: 223311 - DNA, 25 bp, Homo sapien
aacaaaggacatctcttctatccca

SEQ ID NO: 223312 - DNA, 25 bp, Homo sapien
tatcccagcctggtagaacttctgg

SEQ ID NO: 223313 - DNA, 25 bp, Homo sapien
agaacttctggcaggattccttgaa

SEQ ID NO: 223314 - DNA, 25 bp, Homo sapien
ggaaatcacatgattcctctccact

SEQ ID NO: 223315 - DNA, 25 bp, Homo sapien
gaatcattgtttctgtcacctgact

SEQ ID NO: 223316 - DNA, 25 bp, Homo sapien
tgtcacctgacttttcagctagtgt

SEQ ID NO: 223317 - DNA, 25 bp, Homo sapien
cagctagtgtctggagccctctgaa

SEQ ID NO: 223318 - DNA, 25 bp, Homo sapien
gaactccagcgtaatctctagggtg

SEQ ID NO: 223319 - DNA, 25 bp, Homo sapien
cccgcctgcagaatcacaagtgaaa

SEQ ID NO: 223320 - DNA, 25 bp, Homo sapien
gattgttgctttgagtcagaggtca

SEQ ID NO: 223321 - DNA, 25 bp, Homo sapien
agaggtcagcggaccttttctgtaa

SEQ ID NO: 223322 - DNA, 25 bp, Homo sapien
ccacatagtaaatatctttggcttt

SEQ ID NO: 223323 - DNA, 25 bp, Homo sapien
tttggctttgtgagccacaccatgt

SEQ ID NO: 223324 - DNA, 25 bp, Homo sapien
agccacaccatgtctgtcacattag

SEQ ID NO: 223325 - DNA, 25 bp, Homo sapien
gtcacattagtgaaccctgctattg

SEQ ID NO: 223326 - DNA, 25 bp, Homo sapien
gtgaaccctgctattgtattgcaag

SEQ ID NO: 223327 - DNA, 25 bp, Homo sapien
gtattgcaagatgagccgtggacaa

SEQ ID NO: 223328 - DNA, 25 bp, Homo sapien
gacaatgtgtcatccagtgggcttg

SEQ ID NO: 223329 - DNA, 25 bp, Homo sapien
tccagtgggcttggctgtgtgccaa

SEQ ID NO: 223330 - DNA, 25 bp, Homo sapien
gggatagtagcaggtcttacttgaa

SEQ ID NO: 223331 - DNA, 25 bp, Homo sapien
agtctgatatttgctgatggcagaa

SEQ ID NO: 223332 - DNA, 25 bp, Homo sapien
cctggttgatgtgtagagtagattg

SEQ ID NO: 223333 - DNA, 25 bp, Homo sapien
gagtagattgtctggtgctctcagt

SEQ ID NO: 223334 - DNA, 25 bp, Homo sapien
gtctggtgctctcagttgtttttat

SEQ ID NO: 223335 - DNA, 25 bp, Homo sapien
gtttttatttacatttgtcacgttg

SEQ ID NO: 223336 - DNA, 25 bp, Homo sapien
tctgtgacaagataagcctcctgct

SEQ ID NO: 223337 - DNA, 25 bp, Homo sapien
gataagcctcctgctttatataact

SEQ ID NO: 223338 - DNA, 25 bp, Homo sapien
tcttgaatccagctaagagatttat

SEQ ID NO: 223339 - DNA, 25 bp, Homo sapien
tggcataaatgtctggagccaacct

SEQ ID NO: 223340 - DNA, 25 bp, Homo sapien
agccaaccttggcagttatagcagg

SEQ ID NO: 223341 - DNA, 25 bp, Homo sapien
cagcttcagggcattttcttctaga

SEQ ID NO: 223342 - DNA, 25 bp, Homo sapien
gcattttcttctagatgaggcccct

SEQ ID NO: 223343 - DNA, 25 bp, Homo sapien
atgaggcccctcttgatcgcttata

SEQ ID NO: 223344 - DNA, 25 bp, Homo sapien
ccctcttgatcgcttatagcagata

SEQ ID NO: 223345 - DNA, 25 bp, Homo sapien
aacgagggtgctgagcaaggctact

SEQ ID NO: 223346 - DNA, 25 bp, Homo sapien
gcaaggctactttatcacctcattt

SEQ ID NO: 223347 - DNA, 25 bp, Homo sapien
tttcctctagatgcttgtgtgtgta

SEQ ID NO: 223348 - DNA, 25 bp, Homo sapien
gtataactttgactcatgagttgtc

SEQ ID NO: 223349 - DNA, 25 bp, Homo sapien
actcatgagttgtcaaagagattca

SEQ ID NO: 223350 - DNA, 25 bp, Homo sapien
gtggacaaaaggacaggccaagctg

SEQ ID NO: 223351 - DNA, 25 bp, Homo sapien
aggaggaggctcacaaatggaataa

SEQ ID NO: 223352 - DNA, 25 bp, Homo sapien
ttttttcgcaggagatactggttat

SEQ ID NO: 223353 - DNA, 25 bp, Homo sapien
ggagatactggttattgccctgctt

SEQ ID NO: 223354 - DNA, 25 bp, Homo sapien
atactggttattgccctgcttttga

SEQ ID NO: 223355 - DNA, 25 bp, Homo sapien
gccctgcttttgaagagataggaaa

SEQ ID NO: 223356 - DNA, 25 bp, Homo sapien
ctattcccatcggagcttatgaacc

SEQ ID NO: 223357 - DNA, 25 bp, Homo sapien
cggagcttatgaaccgaggtggttt

SEQ ID NO: 223358 - DNA, 25 bp, Homo sapien
gaaataccagcatgtagacccagaa

SEQ ID NO: 223359 - DNA, 25 bp, Homo sapien
aaggattcacactgatgtccaaaca

SEQ ID NO: 223360 - DNA, 25 bp, Homo sapien
aaagaaatctatggcaattcactgg

SEQ ID NO: 223361 - DNA, 25 bp, Homo sapien
gagcattacttagagcctccagtga

SEQ ID NO: 223362 - DNA, 25 bp, Homo sapien
gagagatacggacttaacgctgaag

SEQ ID NO: 223363 - DNA, 25 bp, Homo sapien
cattgtgtaacttctataaacggct

SEQ ID NO: 223364 - DNA, 25 bp, Homo sapien
tataaacggctattttcttgtaact

SEQ ID NO: 223365 - DNA, 25 bp, Homo sapien
ctgtcagtgaaatgaatgtgtacat

SEQ ID NO: 223366 - DNA, 25 bp, Homo sapien
attgttttcttgtatttctctgggt

SEQ ID NO: 223367 - DNA, 25 bp, Homo sapien
ttttcttgtatttctctgggttgtt

SEQ ID NO: 223368 - DNA, 25 bp, Homo sapien
ttttccaagggttaacatagaatgt

SEQ ID NO: 223369 - DNA, 25 bp, Homo sapien
aaaaattatctttggccaatgactt

SEQ ID NO: 223370 - DNA, 25 bp, Homo sapien
ttggccaatgactttttcatctaga

SEQ ID NO: 223371 - DNA, 25 bp, Homo sapien
atgactttttcatctagatcttact

SEQ ID NO: 223372 - DNA, 25 bp, Homo sapien
ccttctaaagaagttcgtttctcat

SEQ ID NO: 223373 - DNA, 25 bp, Homo sapien
tgttctgtcaacttgcctgaaaaac

SEQ ID NO: 223374 - DNA, 25 bp, Homo sapien
gaaaagtatgtcctggagctgcaga

SEQ ID NO: 223375 - DNA, 25 bp, Homo sapien
agctgcagagcccacgctacacccg

SEQ ID NO: 223376 - DNA, 25 bp, Homo sapien
gctacacccgcctccgggactggca

SEQ ID NO: 223377 - DNA, 25 bp, Homo sapien
gggactggcaccaccagcgctctgc

SEQ ID NO: 223378 - DNA, 25 bp, Homo sapien
tctgcccacgtgctcaacgtgcagt

SEQ ID NO: 223379 - DNA, 25 bp, Homo sapien
tgcccacgtgctcaacgtgcagtcg

SEQ ID NO: 223380 - DNA, 25 bp, Homo sapien
gcccacgtgctcaacgtgcagtcgt

SEQ ID NO: 223381 - DNA, 25 bp, Homo sapien
ccacgtgctcaacgtgcagtcgtag

SEQ ID NO: 223382 - DNA, 25 bp, Homo sapien
acgtgctcaacgtgcagtcgtagcc

SEQ ID NO: 223383 - DNA, 25 bp, Homo sapien
gtgctcaacgtgcagtcgtagcccg

SEQ ID NO: 223384 - DNA, 25 bp, Homo sapien
tgctcaacgtgcagtcgtagcccgg

SEQ ID NO: 223385 - DNA, 25 bp, Homo sapien
gaggccgcctcggaagacgagaacg

SEQ ID NO: 223386 - DNA, 25 bp, Homo sapien
ctcggaagacgagaacggcgacgat

SEQ ID NO: 223387 - DNA, 25 bp, Homo sapien
cggaagacgagaacggcgacgatca

SEQ ID NO: 223388 - DNA, 25 bp, Homo sapien
acgagaacggcgacgatcagggttt

SEQ ID NO: 223389 - DNA, 25 bp, Homo sapien
gagaacggcgacgatcagggtttcc

SEQ ID NO: 223390 - DNA, 25 bp, Homo sapien
agaacggcgacgatcagggtttcca

SEQ ID NO: 223391 - DNA, 25 bp, Homo sapien
gaacggcgacgatcagggtttccag

SEQ ID NO: 223392 - DNA, 25 bp, Homo sapien
aaggcgcgggcgacgagaacgggca

SEQ ID NO: 223393 - DNA, 25 bp, Homo sapien
tcaaccgccggcgacgcagcagcaa

SEQ ID NO: 223394 - DNA, 25 bp, Homo sapien
agcaacagccccaacagcagcgcgg

SEQ ID NO: 223395 - DNA, 25 bp, Homo sapien
ccacctcgctgttcgcggtgacggt

SEQ ID NO: 223396 - DNA, 25 bp, Homo sapien
attcaatatgcttttcccgcttttc

SEQ ID NO: 223397 - DNA, 25 bp, Homo sapien
tgcttttcccgcttttctaagagga

SEQ ID NO: 223398 - DNA, 25 bp, Homo sapien
ttataaacagttcccctactactat

SEQ ID NO: 223399 - DNA, 25 bp, Homo sapien
actactatctcccactctagataaa

SEQ ID NO: 223400 - DNA, 25 bp, Homo sapien
ttattccttatagtattatgccaaa

SEQ ID NO: 223401 - DNA, 25 bp, Homo sapien
gaagcttgttatagccataatgatt

SEQ ID NO: 223402 - DNA, 25 bp, Homo sapien
gagtcagtataccattttacctata

SEQ ID NO: 223403 - DNA, 25 bp, Homo sapien
tgcaaaattcatccttgcaacccca

SEQ ID NO: 223404 - DNA, 25 bp, Homo sapien
aaccccattcaccaggagccttgaa

SEQ ID NO: 223405 - DNA, 25 bp, Homo sapien
ttcaccaggagccttgaagcatttt

SEQ ID NO: 223406 - DNA, 25 bp, Homo sapien
cttgaagcattttgtttactccaaa

SEQ ID NO: 223407 - DNA, 25 bp, Homo sapien
tgaaatacacccactctcttggaat

SEQ ID NO: 223408 - DNA, 25 bp, Homo sapien
aatgacgtaccactcagttggaccc

SEQ ID NO: 223409 - DNA, 25 bp, Homo sapien
agttggaccctcaagagtcactgct

SEQ ID NO: 223410 - DNA, 25 bp, Homo sapien
agtcactgctttgtctgtgctggta

SEQ ID NO: 223411 - DNA, 25 bp, Homo sapien
ttgtgagaagtgacccgcacgcttc

SEQ ID NO: 223412 - DNA, 25 bp, Homo sapien
gcacgcttccatttgatgcatttga

SEQ ID NO: 223413 - DNA, 25 bp, Homo sapien
gagtgaatccatacatttgaatgtc

SEQ ID NO: 223414 - DNA, 25 bp, Homo sapien
aatgtcattgtccttgagaccctac

SEQ ID NO: 223415 - DNA, 25 bp, Homo sapien
gagaccctacatgtgcagtttggct

SEQ ID NO: 223416 - DNA, 25 bp, Homo sapien
gtgcagtttggctcatctcattaaa

SEQ ID NO: 223417 - DNA, 25 bp, Homo sapien
ttcctgcaggcttttccatgagtat

SEQ ID NO: 223418 - DNA, 25 bp, Homo sapien
acgcctggtctctcagtggcaataa

SEQ ID NO: 223419 - DNA, 25 bp, Homo sapien
gtctctcagtggcaataagggcaat

SEQ ID NO: 223420 - DNA, 25 bp, Homo sapien
gcaataagggcaatgtgtggcagca

SEQ ID NO: 223421 - DNA, 25 bp, Homo sapien
tggcagcaggcccatgtgcccatca

SEQ ID NO: 223422 - DNA, 25 bp, Homo sapien
cagtgggcccttccagattattttt

SEQ ID NO: 223423 - DNA, 25 bp, Homo sapien
tgggcccttccagattatttttgag

SEQ ID NO: 223424 - DNA, 25 bp, Homo sapien
gggatattgccatagatgacgtcac

SEQ ID NO: 223425 - DNA, 25 bp, Homo sapien
attgccatagatgacgtcacactga

SEQ ID NO: 223426 - DNA, 25 bp, Homo sapien
tagatgacgtcacactgaagaaggg

SEQ ID NO: 223427 - DNA, 25 bp, Homo sapien
gtccccggaagcagacggatcccaa

SEQ ID NO: 223428 - DNA, 25 bp, Homo sapien
acggatcccaataaagtggtggtga

SEQ ID NO: 223429 - DNA, 25 bp, Homo sapien
gaaataccagcatgtagacccagaa

SEQ ID NO: 223430 - DNA, 25 bp, Homo sapien
aataccagcatgtagacccagaaga

SEQ ID NO: 223431 - DNA, 25 bp, Homo sapien
acccagaagaagctgtaaggattca

SEQ ID NO: 223432 - DNA, 25 bp, Homo sapien
taaggattcacactgatgtccaaac

SEQ ID NO: 223433 - DNA, 25 bp, Homo sapien
gattcacactgatgtccaaacaaag

SEQ ID NO: 223434 - DNA, 25 bp, Homo sapien
cactgatgtccaaacaaagaaatct

SEQ ID NO: 223435 - DNA, 25 bp, Homo sapien
aaagaaatctatggcaattcactgg

SEQ ID NO: 223436 - DNA, 25 bp, Homo sapien
atgagcattacttagagcctccagt

SEQ ID NO: 223437 - DNA, 25 bp, Homo sapien
gcattacttagagcctccagtgaag

SEQ ID NO: 223438 - DNA, 25 bp, Homo sapien
aagctctagagagatacggacttaa

SEQ ID NO: 223439 - DNA, 25 bp, Homo sapien
gagagatacggacttaacgctgaag

SEQ ID NO: 223440 - DNA, 25 bp, Homo sapien
cagtcagatcggctttcaatgcttt

SEQ ID NO: 223441 - DNA, 25 bp, Homo sapien
agtcagatcggctttcaatgctttc

SEQ ID NO: 223442 - DNA, 25 bp, Homo sapien
gtcagatcggctttcaatgctttcc

SEQ ID NO: 223443 - DNA, 25 bp, Homo sapien
tcagatcggctttcaatgctttccc

SEQ ID NO: 223444 - DNA, 25 bp, Homo sapien
agatcggctttcaatgctttcccag

SEQ ID NO: 223445 - DNA, 25 bp, Homo sapien
atcggctttcaatgctttcccagga

SEQ ID NO: 223446 - DNA, 25 bp, Homo sapien
tcggctttcaatgctttcccaggaa

SEQ ID NO: 223447 - DNA, 25 bp, Homo sapien
ggctttcaatgctttcccaggaaat

SEQ ID NO: 223448 - DNA, 25 bp, Homo sapien
gctttacgagatgaactggagtttg

SEQ ID NO: 223449 - DNA, 25 bp, Homo sapien
gtgaaaaacagctttatttctgttc

SEQ ID NO: 223450 - DNA, 25 bp, Homo sapien
atttctgttcttattgaagtgcaaa

SEQ ID NO: 223451 - DNA, 25 bp, Homo sapien
ggtcttgccagctggacgttcttgt

SEQ ID NO: 223452 - DNA, 25 bp, Homo sapien
aggagtgccgtggactttggattca

SEQ ID NO: 223453 - DNA, 25 bp, Homo sapien
gactttggattcaaacagccccagc

SEQ ID NO: 223454 - DNA, 25 bp, Homo sapien
agctcttctgcttgctagctgggtg

SEQ ID NO: 223455 - DNA, 25 bp, Homo sapien
actttgggcaaattaacatctcgaa

SEQ ID NO: 223456 - DNA, 25 bp, Homo sapien
aacatctcgaaaatctgtttcctca

SEQ ID NO: 223457 - DNA, 25 bp, Homo sapien
tcctcattcctaaaatgcgggtctg

SEQ ID NO: 223458 - DNA, 25 bp, Homo sapien
tgcctgtaaagccatctcatatcca

SEQ ID NO: 223459 - DNA, 25 bp, Homo sapien
ctcatatccatggttctagaagcat

SEQ ID NO: 223460 - DNA, 25 bp, Homo sapien
gttctagaagcatggtgagcacctc

SEQ ID NO: 223461 - DNA, 25 bp, Homo sapien
taatcagtgccatgctttagctacc

SEQ ID NO: 223462 - DNA, 25 bp, Homo sapien
aggctggctttccacgtgaatgaga

SEQ ID NO: 223463 - DNA, 25 bp, Homo sapien
agggtttggtgctacagccagtcag

SEQ ID NO: 223464 - DNA, 25 bp, Homo sapien
agccagtcagaagatttgcaaatgc

SEQ ID NO: 223465 - DNA, 25 bp, Homo sapien
ttgcaaatgcgaacacattcctgtg

SEQ ID NO: 223466 - DNA, 25 bp, Homo sapien
acattcctgtgtgaggcacgttacc

SEQ ID NO: 223467 - DNA, 25 bp, Homo sapien
tgaggcacgttaccctttgtcagtt

SEQ ID NO: 223468 - DNA, 25 bp, Homo sapien
gcaataagattcagctggtcagact

SEQ ID NO: 223469 - DNA, 25 bp, Homo sapien
gtcagacttttctgggcagtctcag

SEQ ID NO: 223470 - DNA, 25 bp, Homo sapien
gcagtctcagtgacgcatttcctgt

SEQ ID NO: 223471 - DNA, 25 bp, Homo sapien
atttcctgtgctgtgattgttctga

SEQ ID NO: 223472 - DNA, 25 bp, Homo sapien
gacagagtggctctaaccactgtga

SEQ ID NO: 223473 - DNA, 25 bp, Homo sapien
tgtttggcagggtccgggctccgtc

SEQ ID NO: 223474 - DNA, 25 bp, Homo sapien
gacgccacggagtcagcacaagtct

SEQ ID NO: 223475 - DNA, 25 bp, Homo sapien
agtcagcacaagtctcatcagagaa

SEQ ID NO: 223476 - DNA, 25 bp, Homo sapien
tcatcagagaaaccccgttcaccaa

SEQ ID NO: 223477 - DNA, 25 bp, Homo sapien
gagaaaccccgttcaccaaggccat

SEQ ID NO: 223478 - DNA, 25 bp, Homo sapien
ggtttaccttggctaaagcatgtct

SEQ ID NO: 223479 - DNA, 25 bp, Homo sapien
ggctaaagcatgtcttcctcaaaga

SEQ ID NO: 223480 - DNA, 25 bp, Homo sapien
ttcctcaaagagatatgcatcaaca

SEQ ID NO: 223481 - DNA, 25 bp, Homo sapien
tatgcatcaacattccaattcctcc

SEQ ID NO: 223482 - DNA, 25 bp, Homo sapien
tccaattcctccaaccctgggtaag

SEQ ID NO: 223483 - DNA, 25 bp, Homo sapien
caaccctgggtaagaaagcaacagt

SEQ ID NO: 223484 - DNA, 25 bp, Homo sapien
gctatggatgttgcacaagactgtg

SEQ ID NO: 223485 - DNA, 25 bp, Homo sapien
aacatttccaaagcgcacattcatc

SEQ ID NO: 223486 - DNA, 25 bp, Homo sapien
aaagcgcacattcatcttaatgttt

SEQ ID NO: 223487 - DNA, 25 bp, Homo sapien
catcttaatgttttcacactatttt

SEQ ID NO: 223488 - DNA, 25 bp, Homo sapien
ttcagtcaaggcaagagaacccgat

SEQ ID NO: 223489 - DNA, 25 bp, Homo sapien
gagaacccgataaagatcattgcta

SEQ ID NO: 223490 - DNA, 25 bp, Homo sapien
aagatcattgctagagacgtttaat

SEQ ID NO: 223491 - DNA, 25 bp, Homo sapien
agacgtttaatgttacctgtagcgg

SEQ ID NO: 223492 - DNA, 25 bp, Homo sapien
tacctgtagcggtacacttgttaaa

SEQ ID NO: 223493 - DNA, 25 bp, Homo sapien
aattctgatcatagctttgattgat

SEQ ID NO: 223494 - DNA, 25 bp, Homo sapien
agctttgattgataccatgaaggta

SEQ ID NO: 223495 - DNA, 25 bp, Homo sapien
taattcaattgctacaaatgccgtg

SEQ ID NO: 223496 - DNA, 25 bp, Homo sapien
attcaattgctacaaatgccgtgac

SEQ ID NO: 223497 - DNA, 25 bp, Homo sapien
ttcaattgctacaaatgccgtgaca

SEQ ID NO: 223498 - DNA, 25 bp, Homo sapien
tcaattgctacaaatgccgtgacat

SEQ ID NO: 223499 - DNA, 25 bp, Homo sapien
caattgctacaaatgccgtgacatt

SEQ ID NO: 223500 - DNA, 25 bp, Homo sapien
aattgctacaaatgccgtgacattg

SEQ ID NO: 223501 - DNA, 25 bp, Homo sapien
attgctacaaatgccgtgacattgg

SEQ ID NO: 223502 - DNA, 25 bp, Homo sapien
gctacaaatgccgtgacattggaac

SEQ ID NO: 223503 - DNA, 25 bp, Homo sapien
ctacaaatgccgtgacattggaaca

SEQ ID NO: 223504 - DNA, 25 bp, Homo sapien
tacaaatgccgtgacattggaacaa

SEQ ID NO: 223505 - DNA, 25 bp, Homo sapien
acaaatgccgtgacattggaacaag

SEQ ID NO: 223506 - DNA, 25 bp, Homo sapien
aaagtaagtttgtagcatgctgtct

SEQ ID NO: 223507 - DNA, 25 bp, Homo sapien
ttgtagcatgctgtctgaattctgg

SEQ ID NO: 223508 - DNA, 25 bp, Homo sapien
gttgctttcgttttttatgatgtag

SEQ ID NO: 223509 - DNA, 25 bp, Homo sapien
gtaggacttcctttgatatccctgt

SEQ ID NO: 223510 - DNA, 25 bp, Homo sapien
tgatatccctgttggaagtccatta

SEQ ID NO: 223511 - DNA, 25 bp, Homo sapien
gaagtccattagcagtcctttgcat

SEQ ID NO: 223512 - DNA, 25 bp, Homo sapien
ctggtagtgtttcttttgcaagaat

SEQ ID NO: 223513 - DNA, 25 bp, Homo sapien
caattcaaggtaaaacagggtcagt

SEQ ID NO: 223514 - DNA, 25 bp, Homo sapien
gcaagaatgcatttctaaggcaaaa

SEQ ID NO: 223515 - DNA, 25 bp, Homo sapien
aaattattttgtccgtcttttgatg

SEQ ID NO: 223516 - DNA, 25 bp, Homo sapien
gtccgtcttttgatgtactttctga

SEQ ID NO: 223517 - DNA, 25 bp, Homo sapien
tttgtttacaatatgagtttttcca

SEQ ID NO: 223518 - DNA, 25 bp, Homo sapien
aatacaaggtttcaataatcacatg

SEQ ID NO: 223519 - DNA, 25 bp, Homo sapien
ggtttcaataatcacatgaggagtt

SEQ ID NO: 223520 - DNA, 25 bp, Homo sapien
atcacatgaggagtttaaagtttta

SEQ ID NO: 223521 - DNA, 25 bp, Homo sapien
atatactcagacattcattgtaaca

SEQ ID NO: 223522 - DNA, 25 bp, Homo sapien
cattcattgtaacacagagtgtatg

SEQ ID NO: 223523 - DNA, 25 bp, Homo sapien
aacacagagtgtatgtaaaatcatt

SEQ ID NO: 223524 - DNA, 25 bp, Homo sapien
tttattgcagactttttgttcagca

SEQ ID NO: 223525 - DNA, 25 bp, Homo sapien
atctatttatgatttcgggagtaac

SEQ ID NO: 223526 - DNA, 25 bp, Homo sapien
gatttcgggagtaacctaaccatga

SEQ ID NO: 223527 - DNA, 25 bp, Homo sapien
ttcgggagtaacctaaccatgaata

SEQ ID NO: 223528 - DNA, 25 bp, Homo sapien
caggaggcaagaggaggtccaactt

SEQ ID NO: 223529 - DNA, 25 bp, Homo sapien
gaggtccaacttgttctgtttgtca

SEQ ID NO: 223530 - DNA, 25 bp, Homo sapien
tccaacttgttctgtttgtcactga

SEQ ID NO: 223531 - DNA, 25 bp, Homo sapien
gtcactgacaaaaccaataacgtgg

SEQ ID NO: 223532 - DNA, 25 bp, Homo sapien
gcaaaaatgaacttccccacttcca

SEQ ID NO: 223533 - DNA, 25 bp, Homo sapien
ttccccacttccactaggctgaaaa

SEQ ID NO: 223534 - DNA, 25 bp, Homo sapien
tccactaggctgaaaactccagtgt

SEQ ID NO: 223535 - DNA, 25 bp, Homo sapien
gttgggcccatgcaaccacgggcaa

SEQ ID NO: 223536 - DNA, 25 bp, Homo sapien
aaggcaggctcagggtcaggcctaa

SEQ ID NO: 223537 - DNA, 25 bp, Homo sapien
aggctcagggtcaggcctaacgcag

SEQ ID NO: 223538 - DNA, 25 bp, Homo sapien
ggcggctccatttttggttccaaat

SEQ ID NO: 223539 - DNA, 25 bp, Homo sapien
taacatctggaggaagcatcatttg

SEQ ID NO: 223540 - DNA, 25 bp, Homo sapien
gcatcatttgttcagctacctaggg

SEQ ID NO: 223541 - DNA, 25 bp, Homo sapien
gctacctagggtttactttcagact

SEQ ID NO: 223542 - DNA, 25 bp, Homo sapien
gacttttcctacagtttaaagcact

SEQ ID NO: 223543 - DNA, 25 bp, Homo sapien
aaagcacttgcgttcagtgtggtac

SEQ ID NO: 223544 - DNA, 25 bp, Homo sapien
cagtgtggtacgatctgtttgtaat

SEQ ID NO: 223545 - DNA, 25 bp, Homo sapien
aatcattgactattgttctgctact

SEQ ID NO: 223546 - DNA, 25 bp, Homo sapien
ttgttctgctacttggatgttgata

SEQ ID NO: 223547 - DNA, 25 bp, Homo sapien
gagaacaatttatcatcgtttatta

SEQ ID NO: 223548 - DNA, 25 bp, Homo sapien
ttatgagtcactatgcacgcaacta

SEQ ID NO: 223549 - DNA, 25 bp, Homo sapien
aatcttgtgagttgtgacctaggtg

SEQ ID NO: 223550 - DNA, 25 bp, Homo sapien
acagtcaccgctcagccttggacag

SEQ ID NO: 223551 - DNA, 25 bp, Homo sapien
tgcgcagcccagagtctctgcatgg

SEQ ID NO: 223552 - DNA, 25 bp, Homo sapien
gggcgtcccattacattctagaggc

SEQ ID NO: 223553 - DNA, 25 bp, Homo sapien
gtcccattacattctagaggcgctc

SEQ ID NO: 223554 - DNA, 25 bp, Homo sapien
attacattctagaggcgctccccac

SEQ ID NO: 223555 - DNA, 25 bp, Homo sapien
cagccttggacagccggttcgtagt

SEQ ID NO: 223556 - DNA, 25 bp, Homo sapien
gcctgcgctcccgaggtatctagga

SEQ ID NO: 223557 - DNA, 25 bp, Homo sapien
tcccgaggtatctaggaggccgcag

SEQ ID NO: 223558 - DNA, 25 bp, Homo sapien
tggacagccggttcgtagttttcct

SEQ ID NO: 223559 - DNA, 25 bp, Homo sapien
ttcgtagttttcctttgttgcgctg

SEQ ID NO: 223560 - DNA, 25 bp, Homo sapien
agttttcctttgttgcgctgggctt

SEQ ID NO: 223561 - DNA, 25 bp, Homo sapien
ttaaaggtttcttcccgaatctcag

SEQ ID NO: 223562 - DNA, 25 bp, Homo sapien
taaaggtttcttcccgaatctcagg

SEQ ID NO: 223563 - DNA, 25 bp, Homo sapien
ggtttcttcccgaatctcaggccct

SEQ ID NO: 223564 - DNA, 25 bp, Homo sapien
tcaggccctcagctacctgcaggtt

SEQ ID NO: 223565 - DNA, 25 bp, Homo sapien
agctacctgcaggtttcgtcgcgag

SEQ ID NO: 223566 - DNA, 25 bp, Homo sapien
tacctgcaggtttcgtcgcgagccg

SEQ ID NO: 223567 - DNA, 25 bp, Homo sapien
ctgcaggtttcgtcgcgagccggct

SEQ ID NO: 223568 - DNA, 25 bp, Homo sapien
agaggtttgttaatacgttcgccat

SEQ ID NO: 223569 - DNA, 25 bp, Homo sapien
gtttgttaatacgttcgccatgtgc

SEQ ID NO: 223570 - DNA, 25 bp, Homo sapien
tgttaatacgttcgccatgtgctac

SEQ ID NO: 223571 - DNA, 25 bp, Homo sapien
aatacgttcgccatgtgctacgatc

SEQ ID NO: 223572 - DNA, 25 bp, Homo sapien
cacccaagggctcccaagggttgag

SEQ ID NO: 223573 - DNA, 25 bp, Homo sapien
gatttctgcagacctatagccagca

SEQ ID NO: 223574 - DNA, 25 bp, Homo sapien
tatagccagcacacttagtcctgcc

SEQ ID NO: 223575 - DNA, 25 bp, Homo sapien
tagtcctgccctatatagagttcct

SEQ ID NO: 223576 - DNA, 25 bp, Homo sapien
tagagttcctcttcgggaagctttt

SEQ ID NO: 223577 - DNA, 25 bp, Homo sapien
taaggaattctcagaccgataggat

SEQ ID NO: 223578 - DNA, 25 bp, Homo sapien
accgataggatgtctgtctgggctt

SEQ ID NO: 223579 - DNA, 25 bp, Homo sapien
aggatgtctgtctgggctttgctgc

SEQ ID NO: 223580 - DNA, 25 bp, Homo sapien
ctttgctgcgggacagtctaactgt

SEQ ID NO: 223581 - DNA, 25 bp, Homo sapien
gtatcgatcaaagagtaagccacac

SEQ ID NO: 223582 - DNA, 25 bp, Homo sapien
gtaagccacacacggataatcagtt

SEQ ID NO: 223583 - DNA, 25 bp, Homo sapien
tatttttctggtacttgtattttca

SEQ ID NO: 223584 - DNA, 25 bp, Homo sapien
tgaaatgtgttagtagtctggctgt

SEQ ID NO: 223585 - DNA, 25 bp, Homo sapien
gtgttagtagtctggctgtgtgccc

SEQ ID NO: 223586 - DNA, 25 bp, Homo sapien
ttagtagtctggctgtgtgcccaaa

SEQ ID NO: 223587 - DNA, 25 bp, Homo sapien
gtagtctggctgtgtgcccaaaatt

SEQ ID NO: 223588 - DNA, 25 bp, Homo sapien
ggctgtgtgcccaaaattctgtttc

SEQ ID NO: 223589 - DNA, 25 bp, Homo sapien
ctgtgtgcccaaaattctgtttcgc

SEQ ID NO: 223590 - DNA, 25 bp, Homo sapien
gtgcccaaaattctgtttcgcagca

SEQ ID NO: 223591 - DNA, 25 bp, Homo sapien
tgtttcgcagcaaaagtgaagacct

SEQ ID NO: 223592 - DNA, 25 bp, Homo sapien
gcaaaagtgaagacctgtatgtaaa

SEQ ID NO: 223593 - DNA, 25 bp, Homo sapien
gaaaatttggaatagtgctgctgcc

SEQ ID NO: 223594 - DNA, 25 bp, Homo sapien
gacatttctacatcaatacagggca

SEQ ID NO: 223595 - DNA, 25 bp, Homo sapien
gggcaatcctattttgccttttgaa

SEQ ID NO: 223596 - DNA, 25 bp, Homo sapien
aagacagtgttctcctgctataact

SEQ ID NO: 223597 - DNA, 25 bp, Homo sapien
gttctcctgctataactgccaaggt

SEQ ID NO: 223598 - DNA, 25 bp, Homo sapien
gccaaggttggctccagacatttat

SEQ ID NO: 223599 - DNA, 25 bp, Homo sapien
gctccagacatttatgccattagtt

SEQ ID NO: 223600 - DNA, 25 bp, Homo sapien
ataaatctcttagctggattcaaga

SEQ ID NO: 223601 - DNA, 25 bp, Homo sapien
agcaggaggcttatcttgtcacaga

SEQ ID NO: 223602 - DNA, 25 bp, Homo sapien
ggaggcttatcttgtcacagagttt

SEQ ID NO: 223603 - DNA, 25 bp, Homo sapien
ttgacccagcaaaccatacaagctc

SEQ ID NO: 223604 - DNA, 25 bp, Homo sapien
gcaaaccatacaagctctgtttaca

SEQ ID NO: 223605 - DNA, 25 bp, Homo sapien
catgtatgattagtcaagccttcag

SEQ ID NO: 223606 - DNA, 25 bp, Homo sapien
gggttcttagacagtcatgcttatt

SEQ ID NO: 223607 - DNA, 25 bp, Homo sapien
gacagtcatgcttatttctaatctt

SEQ ID NO: 223608 - DNA, 25 bp, Homo sapien
tgacttataactaaccccagtgttt

SEQ ID NO: 223609 - DNA, 25 bp, Homo sapien
tttcagcttcctttttcttcatcca

SEQ ID NO: 223610 - DNA, 25 bp, Homo sapien
aaatgtgaccattagttatcccgcc

SEQ ID NO: 223611 - DNA, 25 bp, Homo sapien
taggccaaattttttcagttcttct

SEQ ID NO: 223612 - DNA, 25 bp, Homo sapien
tcagttcttcttgagagtggattat

SEQ ID NO: 223613 - DNA, 25 bp, Homo sapien
tggattataccatgctttctgtctg

SEQ ID NO: 223614 - DNA, 25 bp, Homo sapien
ctttctgtctggaaaatctcctgat

SEQ ID NO: 223615 - DNA, 25 bp, Homo sapien
atctcctgatagcaaaaacttacta

SEQ ID NO: 223616 - DNA, 25 bp, Homo sapien
gagatgcctgaaaagactggtaagt

SEQ ID NO: 223617 - DNA, 25 bp, Homo sapien
agtgcgtttcttaatcgttcagtaa

SEQ ID NO: 223618 - DNA, 25 bp, Homo sapien
gcttttctatcgctacataatgcct

SEQ ID NO: 223619 - DNA, 25 bp, Homo sapien
gttcagtaactatttgagtgcctac

SEQ ID NO: 223620 - DNA, 25 bp, Homo sapien
gagtgcctactgcagccaaggcact

SEQ ID NO: 223621 - DNA, 25 bp, Homo sapien
aatttggagtccctgcaagttcaca

SEQ ID NO: 223622 - DNA, 25 bp, Homo sapien
gtccctgcaagttcacaagctattt

SEQ ID NO: 223623 - DNA, 25 bp, Homo sapien
ggttgtgttggagcattgtccttaa

SEQ ID NO: 223624 - DNA, 25 bp, Homo sapien
ttgtccttaaagatggtaccatggt

SEQ ID NO: 223625 - DNA, 25 bp, Homo sapien
gttgagtatataaaccctgccatgt

SEQ ID NO: 223626 - DNA, 25 bp, Homo sapien
aaccctgccatgtagcttgagatgc

SEQ ID NO: 223627 - DNA, 25 bp, Homo sapien
gaaactgacaaacataaccttctca

SEQ ID NO: 223628 - DNA, 25 bp, Homo sapien
taaccttctcagacttacaaaacta

SEQ ID NO: 223629 - DNA, 25 bp, Homo sapien
cttaataaagtaccttcaaacagtg

SEQ ID NO: 223630 - DNA, 25 bp, Homo sapien
caaacagtgtgtgtacttacttgaa

SEQ ID NO: 223631 - DNA, 25 bp, Homo sapien
gaaaattgtttttgcacttggatat

SEQ ID NO: 223632 - DNA, 25 bp, Homo sapien
tgtttttgcacttggatattctatt

SEQ ID NO: 223633 - DNA, 25 bp, Homo sapien
tattgtgatctattccattatacta

SEQ ID NO: 223634 - DNA, 25 bp, Homo sapien
cattatactatttcccatggtagaa

SEQ ID NO: 223635 - DNA, 25 bp, Homo sapien
tactatttcccatggtagaacaaat

SEQ ID NO: 223636 - DNA, 25 bp, Homo sapien
atattttctactgtgatatgaagtg

SEQ ID NO: 223637 - DNA, 25 bp, Homo sapien
gtgatgtaattgaacttgccatgtc

SEQ ID NO: 223638 - DNA, 25 bp, Homo sapien
ttcctggccgtgagtacccttcggt

SEQ ID NO: 223639 - DNA, 25 bp, Homo sapien
gtgagtacccttcggttcccttctg

SEQ ID NO: 223640 - DNA, 25 bp, Homo sapien
tgcagaagcagttatgaaccccctt

SEQ ID NO: 223641 - DNA, 25 bp, Homo sapien
aggcattcattcagtcgctcatttc

SEQ ID NO: 223642 - DNA, 25 bp, Homo sapien
cattcagtcgctcatttcaccagga

SEQ ID NO: 223643 - DNA, 25 bp, Homo sapien
tcagtcgctcatttcaccaggactc

SEQ ID NO: 223644 - DNA, 25 bp, Homo sapien
ggactcccagcaaccgataaaacag

SEQ ID NO: 223645 - DNA, 25 bp, Homo sapien
ccagcaaccgataaaacagaccaaa

SEQ ID NO: 223646 - DNA, 25 bp, Homo sapien
acagaccaaaattcctccccttgtg

SEQ ID NO: 223647 - DNA, 25 bp, Homo sapien
tccccttgtggccttaataccataa

SEQ ID NO: 223648 - DNA, 25 bp, Homo sapien
tgtggccttaataccataagccttg

SEQ ID NO: 223649 - DNA, 25 bp, Homo sapien
tcccctcctgctaaagaaccagtta

SEQ ID NO: 223650 - DNA, 25 bp, Homo sapien
ggaattttgagccaagctttaagca

SEQ ID NO: 223651 - DNA, 25 bp, Homo sapien
aagctttaagcaagtctggactcct

SEQ ID NO: 223652 - DNA, 25 bp, Homo sapien
aagcaagtctggactcctgagacct

SEQ ID NO: 223653 - DNA, 25 bp, Homo sapien
cctgagacctcctgggtctagtcag

SEQ ID NO: 223654 - DNA, 25 bp, Homo sapien
aggaattctaagatcccattggaag

SEQ ID NO: 223655 - DNA, 25 bp, Homo sapien
attggaaggaatgctctacctcaca

SEQ ID NO: 223656 - DNA, 25 bp, Homo sapien
ctcacagaactctgaaccctacaga

SEQ ID NO: 223657 - DNA, 25 bp, Homo sapien
agaaatatgggcctgctgccatttc

SEQ ID NO: 223658 - DNA, 25 bp, Homo sapien
gataaaggatacaacctgcacaggg

SEQ ID NO: 223659 - DNA, 25 bp, Homo sapien
gctgcaaagtccagccaccctgaag

SEQ ID NO: 223660 - DNA, 25 bp, Homo sapien
ggaagagactggaacctttctttga

SEQ ID NO: 223661 - DNA, 25 bp, Homo sapien
tggaacctttctttgacagccaggc

SEQ ID NO: 223662 - DNA, 25 bp, Homo sapien
ggaacctttctttgacagccaggcc

SEQ ID NO: 223663 - DNA, 25 bp, Homo sapien
tgacagccaggcctagacagacagg

SEQ ID NO: 223664 - DNA, 25 bp, Homo sapien
gcaggcgcacgaggtccagggaggc

SEQ ID NO: 223665 - DNA, 25 bp, Homo sapien
ccagggaggcccttttctgatcatg

SEQ ID NO: 223666 - DNA, 25 bp, Homo sapien
agggaggcccttttctgatcatgcc

SEQ ID NO: 223667 - DNA, 25 bp, Homo sapien
gaggcccttttctgatcatgcccct

SEQ ID NO: 223668 - DNA, 25 bp, Homo sapien
ctggcctcccctagagggtgggcct

SEQ ID NO: 223669 - DNA, 25 bp, Homo sapien
tcccctagagggtgggcctcaacca

SEQ ID NO: 223670 - DNA, 25 bp, Homo sapien
agagggtgggcctcaaccacctgct

SEQ ID NO: 223671 - DNA, 25 bp, Homo sapien
acatccccgtagacagtgaaaccaa

SEQ ID NO: 223672 - DNA, 25 bp, Homo sapien
tgcttgtttttactctagggcaaag

SEQ ID NO: 223673 - DNA, 25 bp, Homo sapien
gggcaaaggtgcataacttcttgta

SEQ ID NO: 223674 - DNA, 25 bp, Homo sapien
aacttcttgtaatactcctgaatag

SEQ ID NO: 223675 - DNA, 25 bp, Homo sapien
gaatagttcttcaaatcaggacaga

SEQ ID NO: 223676 - DNA, 25 bp, Homo sapien
agttggcaactgatggaatagctac

SEQ ID NO: 223677 - DNA, 25 bp, Homo sapien
ggaatagctaccttgatgtgcaaat

SEQ ID NO: 223678 - DNA, 25 bp, Homo sapien
atgtgcaaatggttgggtctttaat

SEQ ID NO: 223679 - DNA, 25 bp, Homo sapien
taaggtttacagtcatgcaaatgtc

SEQ ID NO: 223680 - DNA, 25 bp, Homo sapien
gtccatttaactttgtttgagccaa

SEQ ID NO: 223681 - DNA, 25 bp, Homo sapien
taattagactggcttacatccccgt

SEQ ID NO: 223682 - DNA, 25 bp, Homo sapien
gcagaactgtgcgtgacatgatctt

SEQ ID NO: 223683 - DNA, 25 bp, Homo sapien
ctgtgcgtgacatgatcttcgtaac

SEQ ID NO: 223684 - DNA, 25 bp, Homo sapien
cgtgacatgatcttcgtaacggcct

SEQ ID NO: 223685 - DNA, 25 bp, Homo sapien
atgatcttcgtaacggcctcggcac

SEQ ID NO: 223686 - DNA, 25 bp, Homo sapien
ccatgtgctgctgagtggccaagat

SEQ ID NO: 223687 - DNA, 25 bp, Homo sapien
atgcacacccgtctttccatgatgg

SEQ ID NO: 223688 - DNA, 25 bp, Homo sapien
acccgtctttccatgatggcagaga

SEQ ID NO: 223689 - DNA, 25 bp, Homo sapien
tggcagagacatccagtcaggacct

SEQ ID NO: 223690 - DNA, 25 bp, Homo sapien
agagacatccagtcaggacctgacc

SEQ ID NO: 223691 - DNA, 25 bp, Homo sapien
ggacccaggctcctaaataaaccag

SEQ ID NO: 223692 - DNA, 25 bp, Homo sapien
taaataaaccagcaactccctcgaa

SEQ ID NO: 223693 - DNA, 25 bp, Homo sapien
gagtgctggttttgagagttgtttt

SEQ ID NO: 223694 - DNA, 25 bp, Homo sapien
gattatttctagatgggtagtgctt

SEQ ID NO: 223695 - DNA, 25 bp, Homo sapien
ggtagtgctttgtgctggtttctgc

SEQ ID NO: 223696 - DNA, 25 bp, Homo sapien
ggtttctgcttccatatatttccca

SEQ ID NO: 223697 - DNA, 25 bp, Homo sapien
gcttccatatatttcccagtcattt

SEQ ID NO: 223698 - DNA, 25 bp, Homo sapien
actctatggtagaactaaggccttt

SEQ ID NO: 223699 - DNA, 25 bp, Homo sapien
ttcttggccaaagtctttaccctat

SEQ ID NO: 223700 - DNA, 25 bp, Homo sapien
taaccctttgtatatttctgactgc

SEQ ID NO: 223701 - DNA, 25 bp, Homo sapien
atatttctgactgctcactgttcat

SEQ ID NO: 223702 - DNA, 25 bp, Homo sapien
gactgctcactgttcatattatagg

SEQ ID NO: 223703 - DNA, 25 bp, Homo sapien
aattctgtccaagccagcatggtgg

SEQ ID NO: 223704 - DNA, 25 bp, Homo sapien
accagtccccggtcgccagccggag

SEQ ID NO: 223705 - DNA, 25 bp, Homo sapien
ccagtccccggtcgccagccggagt

SEQ ID NO: 223706 - DNA, 25 bp, Homo sapien
gtccccggtcgccagccggagtctc

SEQ ID NO: 223707 - DNA, 25 bp, Homo sapien
ggtcgccagccggagtctcctctct

SEQ ID NO: 223708 - DNA, 25 bp, Homo sapien
gtcgccagccggagtctcctctcta

SEQ ID NO: 223709 - DNA, 25 bp, Homo sapien
tcgccagccggagtctcctctctac

SEQ ID NO: 223710 - DNA, 25 bp, Homo sapien
gccagccggagtctcctctctaccg

SEQ ID NO: 223711 - DNA, 25 bp, Homo sapien
agccggagtctcctctctaccgcca

SEQ ID NO: 223712 - DNA, 25 bp, Homo sapien
ggagtctcctctctaccgccactgt

SEQ ID NO: 223713 - DNA, 25 bp, Homo sapien
agtctcctctctaccgccactgtca

SEQ ID NO: 223714 - DNA, 25 bp, Homo sapien
actgtcacaccgtagcccacatgga

SEQ ID NO: 223715 - DNA, 25 bp, Homo sapien
ttcccggctcactcctgggggcaaa

SEQ ID NO: 223716 - DNA, 25 bp, Homo sapien
tgctgagcatcgatggcgagaatgc

SEQ ID NO: 223717 - DNA, 25 bp, Homo sapien
gagaatgcgggtagcctcacacaca

SEQ ID NO: 223718 - DNA, 25 bp, Homo sapien
agaatgcgggtagcctcacacacat

SEQ ID NO: 223719 - DNA, 25 bp, Homo sapien
tgcgggtagcctcacacacatcgaa

SEQ ID NO: 223720 - DNA, 25 bp, Homo sapien
gggtagcctcacacacatcgaagct

SEQ ID NO: 223721 - DNA, 25 bp, Homo sapien
gcctcacacacatcgaagctcagaa

SEQ ID NO: 223722 - DNA, 25 bp, Homo sapien
tcacacacatcgaagctcagaacaa

SEQ ID NO: 223723 - DNA, 25 bp, Homo sapien
gaagctcagaacaagatccgggcct

SEQ ID NO: 223724 - DNA, 25 bp, Homo sapien
ctcagaacaagatccgggcctgcgg

SEQ ID NO: 223725 - DNA, 25 bp, Homo sapien
aggacttcaatgtgcccctctccat

SEQ ID NO: 223726 - DNA, 25 bp, Homo sapien
agaaaattcacaactctagccttga

SEQ ID NO: 223727 - DNA, 25 bp, Homo sapien
aactctagccttgagttagctccct

SEQ ID NO: 223728 - DNA, 25 bp, Homo sapien
gaggtcatgcagatagaatcataca

SEQ ID NO: 223729 - DNA, 25 bp, Homo sapien
caaaagtagttgatgttaaccgagt

SEQ ID NO: 223730 - DNA, 25 bp, Homo sapien
gatgttaaccgagtaatcagtttta

SEQ ID NO: 223731 - DNA, 25 bp, Homo sapien
agtaatcagttttatctgtgttcct

SEQ ID NO: 223732 - DNA, 25 bp, Homo sapien
gagcgtgagcaagtgagtgcacata

SEQ ID NO: 223733 - DNA, 25 bp, Homo sapien
aagtgagtgcacatactattgttaa

SEQ ID NO: 223734 - DNA, 25 bp, Homo sapien
actattgttaaagtcttctctctaa

SEQ ID NO: 223735 - DNA, 25 bp, Homo sapien
tgttaaagtcttctctctaaagttt

SEQ ID NO: 223736 - DNA, 25 bp, Homo sapien
ctgatataccataaacacccagata

SEQ ID NO: 223737 - DNA, 25 bp, Homo sapien
accctcacgttgaccaaggacgagt

SEQ ID NO: 223738 - DNA, 25 bp, Homo sapien
tatgaacgacataacagctatacct

SEQ ID NO: 223739 - DNA, 25 bp, Homo sapien
tacctgtgaggccactcacaagaca

SEQ ID NO: 223740 - DNA, 25 bp, Homo sapien
atcaccttcacccattgtcaagagc

SEQ ID NO: 223741 - DNA, 25 bp, Homo sapien
cacccattgtcaagagcttcaacag

SEQ ID NO: 223742 - DNA, 25 bp, Homo sapien
agacaaaggtcctgagacgccacca

SEQ ID NO: 223743 - DNA, 25 bp, Homo sapien
ctatcttcccttctaaggtcttgga

SEQ ID NO: 223744 - DNA, 25 bp, Homo sapien
taaggtcttggaggcttccccacaa

SEQ ID NO: 223745 - DNA, 25 bp, Homo sapien
acaagcgacctaccactgttgcggt

SEQ ID NO: 223746 - DNA, 25 bp, Homo sapien
actgttgcggtgctccaaacctcct

SEQ ID NO: 223747 - DNA, 25 bp, Homo sapien
cctttccttggcttttatcatgcta

SEQ ID NO: 223748 - DNA, 25 bp, Homo sapien
gtgtgataaaacaaggctggttgca

SEQ ID NO: 223749 - DNA, 25 bp, Homo sapien
tagtaccatcacagtaaccatgaag

SEQ ID NO: 223750 - DNA, 25 bp, Homo sapien
aaccatgaaggtattcaagagacga

SEQ ID NO: 223751 - DNA, 25 bp, Homo sapien
gagacgatatttttacttgacccaa

SEQ ID NO: 223752 - DNA, 25 bp, Homo sapien
gacggttcatatattctcaattcct

SEQ ID NO: 223753 - DNA, 25 bp, Homo sapien
gaatcgaaaggttgcatctacttgg

SEQ ID NO: 223754 - DNA, 25 bp, Homo sapien
aaggttgcatctacttggacgcctg

SEQ ID NO: 223755 - DNA, 25 bp, Homo sapien
acttggacgcctgcattgatgttgt

SEQ ID NO: 223756 - DNA, 25 bp, Homo sapien
attgatgttgttcagtgccccaaaa

SEQ ID NO: 223757 - DNA, 25 bp, Homo sapien
tgttcagtgccccaaaatgcgccgt

SEQ ID NO: 223758 - DNA, 25 bp, Homo sapien
aaatgcgccgtcatgcttttgaact

SEQ ID NO: 223759 - DNA, 25 bp, Homo sapien
agattgtatgtttggatcgccctca

SEQ ID NO: 223760 - DNA, 25 bp, Homo sapien
gtatgtttggatcgccctcacctgt

SEQ ID NO: 223761 - DNA, 25 bp, Homo sapien
gaaaccaactggtttatttgttcag

SEQ ID NO: 223762 - DNA, 25 bp, Homo sapien
atttgttcaggtaaacctagctcaa

SEQ ID NO: 223763 - DNA, 25 bp, Homo sapien
caggtaaacctagctcaaacggaga

SEQ ID NO: 223764 - DNA, 25 bp, Homo sapien
ctagctcaaacggagaaggaggcgt

SEQ ID NO: 223765 - DNA, 25 bp, Homo sapien
aaggaggcgtgtctgtcatctgttc

SEQ ID NO: 223766 - DNA, 25 bp, Homo sapien
gtctgtcatctgttcactcaggagc

SEQ ID NO: 223767 - DNA, 25 bp, Homo sapien
gtcatctgttcactcaggagctgct

SEQ ID NO: 223768 - DNA, 25 bp, Homo sapien
agctctgcaccatgtccttgcgctg

SEQ ID NO: 223769 - DNA, 25 bp, Homo sapien
atgtccttgcgctgtgctggcagtg

SEQ ID NO: 223770 - DNA, 25 bp, Homo sapien
tgctggtcacaacccgctgtctgga

SEQ ID NO: 223771 - DNA, 25 bp, Homo sapien
ggtcacaacccgctgtctggacctg

SEQ ID NO: 223772 - DNA, 25 bp, Homo sapien
gaaactgcacaaaataagcagccca

SEQ ID NO: 223773 - DNA, 25 bp, Homo sapien
ctggttgctgttagtggtggctttt

SEQ ID NO: 223774 - DNA, 25 bp, Homo sapien
gttgctgttagtggtggcttttctt

SEQ ID NO: 223775 - DNA, 25 bp, Homo sapien
ttttcttctcactttgtgtagcccc

SEQ ID NO: 223776 - DNA, 25 bp, Homo sapien
ttgtgtagcccccagaaccgtgagg

SEQ ID NO: 223777 - DNA, 25 bp, Homo sapien
atccgagtgggtgagcacaggcgtc

SEQ ID NO: 223778 - DNA, 25 bp, Homo sapien
acaggcgtccgctgaagagccgcct

SEQ ID NO: 223779 - DNA, 25 bp, Homo sapien
aagcagcccatgaaaaacaacctag

SEQ ID NO: 223780 - DNA, 25 bp, Homo sapien
atgaacagcaaaccggaccctgctt

SEQ ID NO: 223781 - DNA, 25 bp, Homo sapien
gaacaatattttgcctatgccattt

SEQ ID NO: 223782 - DNA, 25 bp, Homo sapien
tttgcctatgccatttaattcccac

SEQ ID NO: 223783 - DNA, 25 bp, Homo sapien
gcctatgccatttaattcccacaaa

SEQ ID NO: 223784 - DNA, 25 bp, Homo sapien
aattcccacaaatttgcaaagtgag

SEQ ID NO: 223785 - DNA, 25 bp, Homo sapien
gtgagcattgttattctcagtttcc

SEQ ID NO: 223786 - DNA, 25 bp, Homo sapien
ttctcagtttccagatgaatgcact

SEQ ID NO: 223787 - DNA, 25 bp, Homo sapien
ggatatttatcctctccaaatttca

SEQ ID NO: 223788 - DNA, 25 bp, Homo sapien
tttatcctctccaaatttcatgttg

SEQ ID NO: 223789 - DNA, 25 bp, Homo sapien
ggaggtgttttggtttactcagcca

SEQ ID NO: 223790 - DNA, 25 bp, Homo sapien
tactcagccaaagaatttagcttct

SEQ ID NO: 223791 - DNA, 25 bp, Homo sapien
gatttgaacccagggtcctttgatt

SEQ ID NO: 223792 - DNA, 25 bp, Homo sapien
gggctgttgctgctgcgtcgccggc

SEQ ID NO: 223793 - DNA, 25 bp, Homo sapien
ttgctgctgcgtcgccggcggttga

SEQ ID NO: 223794 - DNA, 25 bp, Homo sapien
gcgtcgccggcggttgaggctgctg

SEQ ID NO: 223795 - DNA, 25 bp, Homo sapien
ggcggttgaggctgctgctccccgt

SEQ ID NO: 223796 - DNA, 25 bp, Homo sapien
ttcctggaaaccctgatcgtcgccg

SEQ ID NO: 223797 - DNA, 25 bp, Homo sapien
tggaaaccctgatcgtcgccgttct

SEQ ID NO: 223798 - DNA, 25 bp, Homo sapien
aaaccctgatcgtcgccgttctcgt

SEQ ID NO: 223799 - DNA, 25 bp, Homo sapien
atcgtcgccgttctcgtcttccgag

SEQ ID NO: 223800 - DNA, 25 bp, Homo sapien
tcgccgttctcgtcttccgaggcgg

SEQ ID NO: 223801 - DNA, 25 bp, Homo sapien
gttctcctctcctagctccatctgg

SEQ ID NO: 223802 - DNA, 25 bp, Homo sapien
agctccatctggtcgccgtccagag

SEQ ID NO: 223803 - DNA, 25 bp, Homo sapien
aagcaaaattatattgtgccccaat

SEQ ID NO: 223804 - DNA, 25 bp, Homo sapien
gtctttgatgaaacaggtatgccca

SEQ ID NO: 223805 - DNA, 25 bp, Homo sapien
aagattttcagctaagtgcctccca

SEQ ID NO: 223806 - DNA, 25 bp, Homo sapien
agtgcctcccaaattcaccctgtag

SEQ ID NO: 223807 - DNA, 25 bp, Homo sapien
accctgtagccttgagatccaggct

SEQ ID NO: 223808 - DNA, 25 bp, Homo sapien
tgagatccaggctacgaagcttgag

SEQ ID NO: 223809 - DNA, 25 bp, Homo sapien
atcacaatcctttgtctgctggctg

SEQ ID NO: 223810 - DNA, 25 bp, Homo sapien
gctggctgcaggttctcctggtgaa

SEQ ID NO: 223811 - DNA, 25 bp, Homo sapien
gttctcctggtgaagaagtcgccca

SEQ ID NO: 223812 - DNA, 25 bp, Homo sapien
gaagaagtcgcccagactccaaaac

SEQ ID NO: 223813 - DNA, 25 bp, Homo sapien
gactccaaaacatcttgtcagaggg

SEQ ID NO: 223814 - DNA, 25 bp, Homo sapien
gacagccaggccacccttcagttag

SEQ ID NO: 223815 - DNA, 25 bp, Homo sapien
cttcagttagggtcacttctctgtt

SEQ ID NO: 223816 - DNA, 25 bp, Homo sapien
cagttagggtcacttctctgttatt

SEQ ID NO: 223817 - DNA, 25 bp, Homo sapien
tattttaaacatttgactactcttt

SEQ ID NO: 223818 - DNA, 25 bp, Homo sapien
gactactctttaatttatgacctct

SEQ ID NO: 223819 - DNA, 25 bp, Homo sapien
ttccttttattccatagggtagaat

SEQ ID NO: 223820 - DNA, 25 bp, Homo sapien
aaacctgctttctgactgattttgc

SEQ ID NO: 223821 - DNA, 25 bp, Homo sapien
ttctgactgattttgccttgaagga

SEQ ID NO: 223822 - DNA, 25 bp, Homo sapien
catcatttaccaatcatgccacaca

SEQ ID NO: 223823 - DNA, 25 bp, Homo sapien
atcatgccacacaagcatttatttt

SEQ ID NO: 223824 - DNA, 25 bp, Homo sapien
gctaatgccaaagctttgtattaaa

SEQ ID NO: 223825 - DNA, 25 bp, Homo sapien
caatcattttcctttggacctacaa

SEQ ID NO: 223826 - DNA, 25 bp, Homo sapien
ggacctacaatttttgcctatgctg

SEQ ID NO: 223827 - DNA, 25 bp, Homo sapien
acaatttttgcctatgctgcagcca

SEQ ID NO: 223828 - DNA, 25 bp, Homo sapien
gctgcagccactttgtgagtgagaa

SEQ ID NO: 223829 - DNA, 25 bp, Homo sapien
gaatgaatatgtctgtgtgaacaca

SEQ ID NO: 223830 - DNA, 25 bp, Homo sapien
tgtgtgaacacacaggcatgcgtgt

SEQ ID NO: 223831 - DNA, 25 bp, Homo sapien
tatgtgcacgtacatgggccagaat

SEQ ID NO: 223832 - DNA, 25 bp, Homo sapien
gtgtgagggatacctcagatttttc

SEQ ID NO: 223833 - DNA, 25 bp, Homo sapien
gtgtgaaaatctcttttctacagat

SEQ ID NO: 223834 - DNA, 25 bp, Homo sapien
gattttccagggtttaagcattgct

SEQ ID NO: 223835 - DNA, 25 bp, Homo sapien
gcattgcttgctgtataaaaaactt

SEQ ID NO: 223836 - DNA, 25 bp, Homo sapien
caaaggacaacaaacccagagcatg

SEQ ID NO: 223837 - DNA, 25 bp, Homo sapien
caacaaacccagagcatgcatttct

SEQ ID NO: 223838 - DNA, 25 bp, Homo sapien
aaattcaactctgttcaatctgggt

SEQ ID NO: 223839 - DNA, 25 bp, Homo sapien
caactctgttcaatctgggtttaac

SEQ ID NO: 223840 - DNA, 25 bp, Homo sapien
taacaaaatgtaactccctggtctc

SEQ ID NO: 223841 - DNA, 25 bp, Homo sapien
aaatgtaactccctggtctccagtg

SEQ ID NO: 223842 - DNA, 25 bp, Homo sapien
tggtctccagtgcaagcccttagac

SEQ ID NO: 223843 - DNA, 25 bp, Homo sapien
gtgcaagcccttagactggctaatt

SEQ ID NO: 223844 - DNA, 25 bp, Homo sapien
gtatatgtggtgcttatttataaac

SEQ ID NO: 223845 - DNA, 25 bp, Homo sapien
caaagtaactacaattctaccaagt

SEQ ID NO: 223846 - DNA, 25 bp, Homo sapien
aagttatcagtagcatcatttatca

SEQ ID NO: 223847 - DNA, 25 bp, Homo sapien
gtggaatttaacacccagccagttt

SEQ ID NO: 223848 - DNA, 25 bp, Homo sapien
ccagccagtttgtgttcaaccagac

SEQ ID NO: 223849 - DNA, 25 bp, Homo sapien
gtgttcaaccagacagcgtcattat

SEQ ID NO: 223850 - DNA, 25 bp, Homo sapien
aaaagttgacatcccaagagtgaag

SEQ ID NO: 223851 - DNA, 25 bp, Homo sapien
gtgaagcctacttattcagtacaga

SEQ ID NO: 223852 - DNA, 25 bp, Homo sapien
agagttccagacatgtacctgccaa

SEQ ID NO: 223853 - DNA, 25 bp, Homo sapien
acatgtacctgccaaatttggttct

SEQ ID NO: 223854 - DNA, 25 bp, Homo sapien
atttggttctggttgtcttatcgta

SEQ ID NO: 223855 - DNA, 25 bp, Homo sapien
gttgtcttatcgtatgcaggctgga

SEQ ID NO: 223856 - DNA, 25 bp, Homo sapien
aggctggatacctgctactgtgctt

SEQ ID NO: 223857 - DNA, 25 bp, Homo sapien
ggatacctgctactgtgcttctaca

SEQ ID NO: 223858 - DNA, 25 bp, Homo sapien
gcagctcccattagcgcacgaagga

SEQ ID NO: 223859 - DNA, 25 bp, Homo sapien
gcgcacgaaggataccacgctggtg

SEQ ID NO: 223860 - DNA, 25 bp, Homo sapien
gagtaggctgcagcgaagccttgca

SEQ ID NO: 223861 - DNA, 25 bp, Homo sapien
gcagcgaagccttgcaggccgatga

SEQ ID NO: 223862 - DNA, 25 bp, Homo sapien
gccttgcaggccgatgaccacgtag

SEQ ID NO: 223863 - DNA, 25 bp, Homo sapien
aggccgatgaccacgtagcggcatc

SEQ ID NO: 223864 - DNA, 25 bp, Homo sapien
accacgtagcggcatcctttgatga

SEQ ID NO: 223865 - DNA, 25 bp, Homo sapien
gatgatgaccttcccgacattcttg

SEQ ID NO: 223866 - DNA, 25 bp, Homo sapien
gacattcttgccgtacttcttcagc

SEQ ID NO: 223867 - DNA, 25 bp, Homo sapien
attcttgccgtacttcttcagcttc

SEQ ID NO: 223868 - DNA, 25 bp, Homo sapien
tccagtggctcgtagcgctcgggca

SEQ ID NO: 223869 - DNA, 25 bp, Homo sapien
ctggattatccaggtaggctcaatg

SEQ ID NO: 223870 - DNA, 25 bp, Homo sapien
atccaggtaggctcaatgtaatcag

SEQ ID NO: 223871 - DNA, 25 bp, Homo sapien
gctcaatgtaatcaggaagggcctt

SEQ ID NO: 223872 - DNA, 25 bp, Homo sapien
caggaagggcctttaaagtgagaga

SEQ ID NO: 223873 - DNA, 25 bp, Homo sapien
gaacgtggaaaagggtcactgaaat

SEQ ID NO: 223874 - DNA, 25 bp, Homo sapien
gaaatgggacgacatgaactcaagg

SEQ ID NO: 223875 - DNA, 25 bp, Homo sapien
gacgacatgaactcaaggaggctat

SEQ ID NO: 223876 - DNA, 25 bp, Homo sapien
aggaggctatttatgaccatgtcat

SEQ ID NO: 223877 - DNA, 25 bp, Homo sapien
ttatgaccatgtcatttgcaacatg

SEQ ID NO: 223878 - DNA, 25 bp, Homo sapien
catgaagaaagcttatctggagtga

SEQ ID NO: 223879 - DNA, 25 bp, Homo sapien
gaaagcttatctggagtgaaagtaa

SEQ ID NO: 223880 - DNA, 25 bp, Homo sapien
ggaaagccttcatccggaagaatga

SEQ ID NO: 223881 - DNA, 25 bp, Homo sapien
tcatccggaagaatgacctcattaa

SEQ ID NO: 223882 - DNA, 25 bp, Homo sapien
aatcaatgtggcattatcttcagcc

SEQ ID NO: 223883 - DNA, 25 bp, Homo sapien
ggcattatcttcagccagaactctc

SEQ ID NO: 223884 - DNA, 25 bp, Homo sapien
agaactctccatttatagttcatca

SEQ ID NO: 223885 - DNA, 25 bp, Homo sapien
gttcatcaaatagctcacactggag

SEQ ID NO: 223886 - DNA, 25 bp, Homo sapien
tagctcacactggagagcagttctt

SEQ ID NO: 223887 - DNA, 25 bp, Homo sapien
gagagcagttcttaacatgcaatca

SEQ ID NO: 223888 - DNA, 25 bp, Homo sapien
catgcaatcaatgtgggacagcgct

SEQ ID NO: 223889 - DNA, 25 bp, Homo sapien
gggacagcgcttgttaatacctcta

SEQ ID NO: 223890 - DNA, 25 bp, Homo sapien
gttaatacctctaaccttattggat

SEQ ID NO: 223891 - DNA, 25 bp, Homo sapien
aaacctgctttctgactgattttgc

SEQ ID NO: 223892 - DNA, 25 bp, Homo sapien
ttctgactgattttgccttgaagga

SEQ ID NO: 223893 - DNA, 25 bp, Homo sapien
catcatttaccaatcatgccacaca

SEQ ID NO: 223894 - DNA, 25 bp, Homo sapien
catttaccaatcatgccacacaagc

SEQ ID NO: 223895 - DNA, 25 bp, Homo sapien
tttaccaatcatgccacacaagcat

SEQ ID NO: 223896 - DNA, 25 bp, Homo sapien
taccaatcatgccacacaagcattt

SEQ ID NO: 223897 - DNA, 25 bp, Homo sapien
caatcatgccacacaagcatttatt

SEQ ID NO: 223898 - DNA, 25 bp, Homo sapien
atcatgccacacaagcatttatttt

SEQ ID NO: 223899 - DNA, 25 bp, Homo sapien
catgccacacaagcatttattttta

SEQ ID NO: 223900 - DNA, 25 bp, Homo sapien
tgctaatgccaaagctttgtattaa

SEQ ID NO: 223901 - DNA, 25 bp, Homo sapien
gctaatgccaaagctttgtattaaa

SEQ ID NO: 223902 - DNA, 25 bp, Homo sapien
gggaagtgtcggcacatctaaattt

SEQ ID NO: 223903 - DNA, 25 bp, Homo sapien
ttatctagtctgtgacggagggaat

SEQ ID NO: 223904 - DNA, 25 bp, Homo sapien
agtttttcatgtatcaaccacctcc

SEQ ID NO: 223905 - DNA, 25 bp, Homo sapien
tcaggtttctccctttttgagatta

SEQ ID NO: 223906 - DNA, 25 bp, Homo sapien
aagctgagacatacttcttaaggag

SEQ ID NO: 223907 - DNA, 25 bp, Homo sapien
catacttcttaaggaggtcgtgttt

SEQ ID NO: 223908 - DNA, 25 bp, Homo sapien
aaaggcagaggctatccatcattat

SEQ ID NO: 223909 - DNA, 25 bp, Homo sapien
gaggctatccatcattatgctggct

SEQ ID NO: 223910 - DNA, 25 bp, Homo sapien
tatgctggctagatgcgcttctgaa

SEQ ID NO: 223911 - DNA, 25 bp, Homo sapien
agccggattctgatgttcttaacca

SEQ ID NO: 223912 - DNA, 25 bp, Homo sapien
caaaatggtgaggtcatggaagtcc

SEQ ID NO: 223913 - DNA, 25 bp, Homo sapien
actaggaagtttaaagctgatggaa

SEQ ID NO: 223914 - DNA, 25 bp, Homo sapien
gatggaacaggatacttgcaatctt

SEQ ID NO: 223915 - DNA, 25 bp, Homo sapien
ggatacttgcaatcttgaagaggaa

SEQ ID NO: 223916 - DNA, 25 bp, Homo sapien
gagcgaaaagcaagtaccaaaatca

SEQ ID NO: 223917 - DNA, 25 bp, Homo sapien
aataaagatttgtacttctttgcat

SEQ ID NO: 223918 - DNA, 25 bp, Homo sapien
ttctccaaaatactacagtgatctc

SEQ ID NO: 223919 - DNA, 25 bp, Homo sapien
aaatactacagtgatctctgagaag

SEQ ID NO: 223920 - DNA, 25 bp, Homo sapien
tagaatcagattatatggccgcatc

SEQ ID NO: 223921 - DNA, 25 bp, Homo sapien
tatatggccgcatcttcacaactcc

SEQ ID NO: 223922 - DNA, 25 bp, Homo sapien
atcttcacaactccgtcttacagag

SEQ ID NO: 223923 - DNA, 25 bp, Homo sapien
cacaactccgtcttacagagcaaca

SEQ ID NO: 223924 - DNA, 25 bp, Homo sapien
gaagtatagattccagtagcctagt

SEQ ID NO: 223925 - DNA, 25 bp, Homo sapien
agtagcctagtttccacagcacgat

SEQ ID NO: 223926 - DNA, 25 bp, Homo sapien
gtttccacagcacgataacaccatg

SEQ ID NO: 223927 - DNA, 25 bp, Homo sapien
ataacaccatgacgcctactgctgt

SEQ ID NO: 223928 - DNA, 25 bp, Homo sapien
tcccaccttgggattctgtgtgctg

SEQ ID NO: 223929 - DNA, 25 bp, Homo sapien
tggaattcccttcgctgtttgcctt

SEQ ID NO: 223930 - DNA, 25 bp, Homo sapien
ttcatctccctccacgtttgagagg

SEQ ID NO: 223931 - DNA, 25 bp, Homo sapien
ctccacgtttgagaggctgtcaggc

SEQ ID NO: 223932 - DNA, 25 bp, Homo sapien
gcgaaagcttgttaggatgtcctgt

SEQ ID NO: 223933 - DNA, 25 bp, Homo sapien
tgatgagagcctccacactgtactg

SEQ ID NO: 223934 - DNA, 25 bp, Homo sapien
cacactgtactgttcaagtcaatgt

SEQ ID NO: 223935 - DNA, 25 bp, Homo sapien
caggaggcaagaggaggtccaactt

SEQ ID NO: 223936 - DNA, 25 bp, Homo sapien
gaggtccaacttgttctgtttgtca

SEQ ID NO: 223937 - DNA, 25 bp, Homo sapien
tccaacttgttctgtttgtcactga

SEQ ID NO: 223938 - DNA, 25 bp, Homo sapien
ttgtcactgacaaaaccaataacgt

SEQ ID NO: 223939 - DNA, 25 bp, Homo sapien
ccaataacgtggcaaaaatgaactt

SEQ ID NO: 223940 - DNA, 25 bp, Homo sapien
aatgaacttccccacttccactagg

SEQ ID NO: 223941 - DNA, 25 bp, Homo sapien
cttccactaggctgaaaactccagt

SEQ ID NO: 223942 - DNA, 25 bp, Homo sapien
atgcaaccacgggcaaggcaggctc

SEQ ID NO: 223943 - DNA, 25 bp, Homo sapien
aaggcaggctcagggtcaggcctaa

SEQ ID NO: 223944 - DNA, 25 bp, Homo sapien
aggctcagggtcaggcctaacgcag

SEQ ID NO: 223945 - DNA, 25 bp, Homo sapien
gaggctgtgggaaccgcagcgccag

SEQ ID NO: 223946 - DNA, 25 bp, Homo sapien
ggaattcttgataagtgggtcatct

SEQ ID NO: 223947 - DNA, 25 bp, Homo sapien
gataagtgggtcatctaaaaaccag

SEQ ID NO: 223948 - DNA, 25 bp, Homo sapien
ggtcatctaaaaaccagttctgtga

SEQ ID NO: 223949 - DNA, 25 bp, Homo sapien
actttgaagcaaggtttcttatgag

SEQ ID NO: 223950 - DNA, 25 bp, Homo sapien
aaaccagttctgtgatcctgggcgg

SEQ ID NO: 223951 - DNA, 25 bp, Homo sapien
accagttctgtgatcctgggcggcg

SEQ ID NO: 223952 - DNA, 25 bp, Homo sapien
tgaagcaaggtttcttatgagaggg

SEQ ID NO: 223953 - DNA, 25 bp, Homo sapien
gaaaaatcctaacagcttcagggac

SEQ ID NO: 223954 - DNA, 25 bp, Homo sapien
agaggggttgttacttgtgcaaatc

SEQ ID NO: 223955 - DNA, 25 bp, Homo sapien
tgtgcaaatctgtaattatttaggc

SEQ ID NO: 223956 - DNA, 25 bp, Homo sapien
aaaggcctgttgatacatattcaag

SEQ ID NO: 223957 - DNA, 25 bp, Homo sapien
gcctcagcctgtttagttgttttca

SEQ ID NO: 223958 - DNA, 25 bp, Homo sapien
gctcgcttttctgggacggtattta

SEQ ID NO: 223959 - DNA, 25 bp, Homo sapien
gacggtatttattatcagactggca

SEQ ID NO: 223960 - DNA, 25 bp, Homo sapien
atcagactggcaagcctaactccat

SEQ ID NO: 223961 - DNA, 25 bp, Homo sapien
gcctaactccataggtttacaggaa

SEQ ID NO: 223962 - DNA, 25 bp, Homo sapien
ataaaacaattgtgtcctccccaca

SEQ ID NO: 223963 - DNA, 25 bp, Homo sapien
cctccccacattttgctatgttaat

SEQ ID NO: 223964 - DNA, 25 bp, Homo sapien
tttgcttctaacaatttgcagctgt

SEQ ID NO: 223965 - DNA, 25 bp, Homo sapien
ttgcagctgtttcactttttcctca

SEQ ID NO: 223966 - DNA, 25 bp, Homo sapien
cactttttcctcatttgtctctaag

SEQ ID NO: 223967 - DNA, 25 bp, Homo sapien
ggaacagccttgacagtctgtaatt

SEQ ID NO: 223968 - DNA, 25 bp, Homo sapien
acaaacagtatgtccccaaacagca

SEQ ID NO: 223969 - DNA, 25 bp, Homo sapien
atcttacataaatccatcaacccca

SEQ ID NO: 223970 - DNA, 25 bp, Homo sapien
atgcatgttatcagatttcaagctc

SEQ ID NO: 223971 - DNA, 25 bp, Homo sapien
ttaattctataaagcctctacgtgg

SEQ ID NO: 223972 - DNA, 25 bp, Homo sapien
tataaagcctctacgtggccttgga

SEQ ID NO: 223973 - DNA, 25 bp, Homo sapien
aaagcctctacgtggccttggacat

SEQ ID NO: 223974 - DNA, 25 bp, Homo sapien
ctctacgtggccttggacatgggta

SEQ ID NO: 223975 - DNA, 25 bp, Homo sapien
cttggacatgggtaggtgcttaatt

SEQ ID NO: 223976 - DNA, 25 bp, Homo sapien
tgcttaattacccaagatgctcctt

SEQ ID NO: 223977 - DNA, 25 bp, Homo sapien
taattacccaagatgctccttgaat

SEQ ID NO: 223978 - DNA, 25 bp, Homo sapien
acccaagatgctccttgaatacaga

SEQ ID NO: 223979 - DNA, 25 bp, Homo sapien
agcaaacccacacaagttgtgtttt

SEQ ID NO: 223980 - DNA, 25 bp, Homo sapien
agttgtgttttctatgatacctgtc

SEQ ID NO: 223981 - DNA, 25 bp, Homo sapien
gttttctatgatacctgtctgtgat

SEQ ID NO: 223982 - DNA, 25 bp, Homo sapien
tttctttttataccagtggatctgg

SEQ ID NO: 223983 - DNA, 25 bp, Homo sapien
agtggatctggacccaagacattac

SEQ ID NO: 223984 - DNA, 25 bp, Homo sapien
caagacattacccacactggaaggg

SEQ ID NO: 223985 - DNA, 25 bp, Homo sapien
aaactgaacccatgtgttgctgctc

SEQ ID NO: 223986 - DNA, 25 bp, Homo sapien
aacccatgtgttgctgctctgtctg

SEQ ID NO: 223987 - DNA, 25 bp, Homo sapien
tgaggacccacacctctagtcaaga

SEQ ID NO: 223988 - DNA, 25 bp, Homo sapien
aacataccttgggaatagcctgtga

SEQ ID NO: 223989 - DNA, 25 bp, Homo sapien
tagcctgtgatagtgtcatctgttt

SEQ ID NO: 223990 - DNA, 25 bp, Homo sapien
ttctcttaggcttttgtttctattt

SEQ ID NO: 223991 - DNA, 25 bp, Homo sapien
tctcttaggcttttgtttctatttc

SEQ ID NO: 223992 - DNA, 25 bp, Homo sapien
ctcttaggcttttgtttctatttca

SEQ ID NO: 223993 - DNA, 25 bp, Homo sapien
gtttctatttcaaacatactttctt

SEQ ID NO: 223994 - DNA, 25 bp, Homo sapien
tttctatttcaaacatactttcttg

SEQ ID NO: 223995 - DNA, 25 bp, Homo sapien
ggagtatatagtttagtcatttcac

SEQ ID NO: 223996 - DNA, 25 bp, Homo sapien
gagtatatagtttagtcatttcaca

SEQ ID NO: 223997 - DNA, 25 bp, Homo sapien
ttagtcatttcacagactctggcct

SEQ ID NO: 223998 - DNA, 25 bp, Homo sapien
tagtcatttcacagactctggcctc

SEQ ID NO: 223999 - DNA, 25 bp, Homo sapien
gtcatttcacagactctggcctcct

SEQ ID NO: 224000 - DNA, 25 bp, Homo sapien
atttcacagactctggcctcctctc

SEQ ID NO: 224001 - DNA, 25 bp, Homo sapien
tgatctcgcacttttgaaagcctct

SEQ ID NO: 224002 - DNA, 25 bp, Homo sapien
agttccctctgagcttttgcgagtt

SEQ ID NO: 224003 - DNA, 25 bp, Homo sapien
gcgagttcttcttttaatcgttcat

SEQ ID NO: 224004 - DNA, 25 bp, Homo sapien
taatcgttcatagcccttttctcta

SEQ ID NO: 224005 - DNA, 25 bp, Homo sapien
aaacagatgggcttcgtaaacgaga

SEQ ID NO: 224006 - DNA, 25 bp, Homo sapien
gacagactatcagtactcaacccaa

SEQ ID NO: 224007 - DNA, 25 bp, Homo sapien
aaaatatcatcactgccatcgcaag

SEQ ID NO: 224008 - DNA, 25 bp, Homo sapien
aagcctctgttatagtagcaccctg

SEQ ID NO: 224009 - DNA, 25 bp, Homo sapien
ctgtaaaaactctctctctgcatta

SEQ ID NO: 224010 - DNA, 25 bp, Homo sapien
gcattatagttgtcctttcttgtag

SEQ ID NO: 224011 - DNA, 25 bp, Homo sapien
atttagttaatccagctgtgactcc

SEQ ID NO: 224012 - DNA, 25 bp, Homo sapien
aattagaacagtacatttttatcag

SEQ ID NO: 224013 - DNA, 25 bp, Homo sapien
aaatcatgactacttttatcaaaga

SEQ ID NO: 224014 - DNA, 25 bp, Homo sapien
aatcatgaaagcgtagcattgtaaa

SEQ ID NO: 224015 - DNA, 25 bp, Homo sapien
gcgtagcattgtaaattaaaggttt

SEQ ID NO: 224016 - DNA, 25 bp, Homo sapien
taaaggttttctttgaggctcttga

SEQ ID NO: 224017 - DNA, 25 bp, Homo sapien
ggctcttgaaagtgatcccattgct

SEQ ID NO: 224018 - DNA, 25 bp, Homo sapien
gatcccattgctttcctgttttaaa

SEQ ID NO: 224019 - DNA, 25 bp, Homo sapien
ttttatgctctttatttccacttct

SEQ ID NO: 224020 - DNA, 25 bp, Homo sapien
atttccacttctgtgaatgtgatat

SEQ ID NO: 224021 - DNA, 25 bp, Homo sapien
cacttctgtgaatgtgatatttcta

SEQ ID NO: 224022 - DNA, 25 bp, Homo sapien
tactgaataaacaaacttgctacat

SEQ ID NO: 224023 - DNA, 25 bp, Homo sapien
cactcctgggcccatgtggatgtaa

SEQ ID NO: 224024 - DNA, 25 bp, Homo sapien
gggcccatgtggatgtaaccttcga

SEQ ID NO: 224025 - DNA, 25 bp, Homo sapien
atgtggatgtaaccttcgagtgccg

SEQ ID NO: 224026 - DNA, 25 bp, Homo sapien
ggatgtaaccttcgagtgccggaat

SEQ ID NO: 224027 - DNA, 25 bp, Homo sapien
gtaaccttcgagtgccggaatgcct

SEQ ID NO: 224028 - DNA, 25 bp, Homo sapien
gagtgccggaatgcctcgtctccat

SEQ ID NO: 224029 - DNA, 25 bp, Homo sapien
ccggaatgcctcgtctccatggaga

SEQ ID NO: 224030 - DNA, 25 bp, Homo sapien
tgactggcccagtctaccgagacca

SEQ ID NO: 224031 - DNA, 25 bp, Homo sapien
tggcccagtctaccgagaccatgag

SEQ ID NO: 224032 - DNA, 25 bp, Homo sapien
agtctaccgagaccatgagacctgc

SEQ ID NO: 224033 - DNA, 25 bp, Homo sapien
ctcggccaggccaacccaaattctt

SEQ ID NO: 224034 - DNA, 25 bp, Homo sapien
agagctaggatttcaacttaggatg

SEQ ID NO: 224035 - DNA, 25 bp, Homo sapien
ggatttcaacttaggatgtctggat

SEQ ID NO: 224036 - DNA, 25 bp, Homo sapien
taggatgtctggatccacagtctgc

SEQ ID NO: 224037 - DNA, 25 bp, Homo sapien
actatgctacactgcctctaactat

SEQ ID NO: 224038 - DNA, 25 bp, Homo sapien
atgctacactgcctctaactatgag

SEQ ID NO: 224039 - DNA, 25 bp, Homo sapien
actgcctctaactatgaggaagcaa

SEQ ID NO: 224040 - DNA, 25 bp, Homo sapien
aagagttcaagtatgtggctcctga

SEQ ID NO: 224041 - DNA, 25 bp, Homo sapien
gtatgtggctcctgataatctaact

SEQ ID NO: 224042 - DNA, 25 bp, Homo sapien
gtggctcctgataatctaacttata

SEQ ID NO: 224043 - DNA, 25 bp, Homo sapien
aatctaacttatacagcctggaaaa

SEQ ID NO: 224044 - DNA, 25 bp, Homo sapien
gagaagttcagtgatggacctcaga

SEQ ID NO: 224045 - DNA, 25 bp, Homo sapien
cccagacaagggtggcccgggcctg

SEQ ID NO: 224046 - DNA, 25 bp, Homo sapien
ccagacaagggtggcccgggcctgc

SEQ ID NO: 224047 - DNA, 25 bp, Homo sapien
tctgagagccctggccagctcttcg

SEQ ID NO: 224048 - DNA, 25 bp, Homo sapien
cttcgcccctcacctctttgaaact

SEQ ID NO: 224049 - DNA, 25 bp, Homo sapien
cccctcacctctttgaaactctgga

SEQ ID NO: 224050 - DNA, 25 bp, Homo sapien
ctcccccgtcagtgggatgactggg

SEQ ID NO: 224051 - DNA, 25 bp, Homo sapien
gggagggttgctgcagggaagagga

SEQ ID NO: 224052 - DNA, 25 bp, Homo sapien
agggaagaggagagccccctgccct

SEQ ID NO: 224053 - DNA, 25 bp, Homo sapien
agtgcccctcccttctgtttgtgcc

SEQ ID NO: 224054 - DNA, 25 bp, Homo sapien
gtgcccctcccttctgtttgtgccc

SEQ ID NO: 224055 - DNA, 25 bp, Homo sapien
ctcccttctgtttgtgcccctctcc

SEQ ID NO: 224056 - DNA, 25 bp, Homo sapien
gtatctggcgcacgacaccttcaaa

SEQ ID NO: 224057 - DNA, 25 bp, Homo sapien
aacagcgcctggacattgtggtgca

SEQ ID NO: 224058 - DNA, 25 bp, Homo sapien
ggtgcaatgccgctgatgtctcaat

SEQ ID NO: 224059 - DNA, 25 bp, Homo sapien
gatgtctcaatgaacttgcagtcaa

SEQ ID NO: 224060 - DNA, 25 bp, Homo sapien
ttgcagtcaaagaccaccgcgcagg

SEQ ID NO: 224061 - DNA, 25 bp, Homo sapien
gagacctcacgagagcgcaccaggt

SEQ ID NO: 224062 - DNA, 25 bp, Homo sapien
gctcttgttgcccacgaggatgatg

SEQ ID NO: 224063 - DNA, 25 bp, Homo sapien
gatgggcacatcatctgtttgccgt

SEQ ID NO: 224064 - DNA, 25 bp, Homo sapien
agctggacccgcagttctgaggcct

SEQ ID NO: 224065 - DNA, 25 bp, Homo sapien
agttctgaggccttctcgaagctgc

SEQ ID NO: 224066 - DNA, 25 bp, Homo sapien
ccttgtccgtcactgagtacacaat

SEQ ID NO: 224067 - DNA, 25 bp, Homo sapien
actaacaacattgcactttctgtat

SEQ ID NO: 224068 - DNA, 25 bp, Homo sapien
ataacttatttttctccattgctgt

SEQ ID NO: 224069 - DNA, 25 bp, Homo sapien
tatttttctccattgctgttcttaa

SEQ ID NO: 224070 - DNA, 25 bp, Homo sapien
gtagctgtaatataccagtaccaat

SEQ ID NO: 224071 - DNA, 25 bp, Homo sapien
taccagtaccaatatgttcttgcaa

SEQ ID NO: 224072 - DNA, 25 bp, Homo sapien
tgttcttgcaattgcttcagcccaa

SEQ ID NO: 224073 - DNA, 25 bp, Homo sapien
gtgatgattcatttagcataaagag

SEQ ID NO: 224074 - DNA, 25 bp, Homo sapien
gacggaagggttttcctatgtatca

SEQ ID NO: 224075 - DNA, 25 bp, Homo sapien
ttttcctatgtatcaaaacttgtct

SEQ ID NO: 224076 - DNA, 25 bp, Homo sapien
aaacttgtctataattatgtcatct

SEQ ID NO: 224077 - DNA, 25 bp, Homo sapien
aattatgtcatctatgtacctagaa

SEQ ID NO: 224078 - DNA, 25 bp, Homo sapien
tacggttttagttcagtgttgaaga

SEQ ID NO: 224079 - DNA, 25 bp, Homo sapien
aactgaacagttccttgtatatatt

SEQ ID NO: 224080 - DNA, 25 bp, Homo sapien
atatattttgcctattcactgttga

SEQ ID NO: 224081 - DNA, 25 bp, Homo sapien
attttgcctattcactgttgatatg

SEQ ID NO: 224082 - DNA, 25 bp, Homo sapien
attcactgttgatatgtatgtagca

SEQ ID NO: 224083 - DNA, 25 bp, Homo sapien
taacactaaaatatggtaccaggag

SEQ ID NO: 224084 - DNA, 25 bp, Homo sapien
aaagttaataggagctttgctgaaa

SEQ ID NO: 224085 - DNA, 25 bp, Homo sapien
gagctttgctgaaacagaagcatat

SEQ ID NO: 224086 - DNA, 25 bp, Homo sapien
gctgaaacagaagcatatgtgtaaa

SEQ ID NO: 224087 - DNA, 25 bp, Homo sapien
atatgtgtaaataagcttgggcttc

SEQ ID NO: 224088 - DNA, 25 bp, Homo sapien
agcttgggcttccagttataaattt

SEQ ID NO: 224089 - DNA, 25 bp, Homo sapien
gggtcgcaccatatggaaatgttga

SEQ ID NO: 224090 - DNA, 25 bp, Homo sapien
cttttgtgtcattcatgtcgatgac

SEQ ID NO: 224091 - DNA, 25 bp, Homo sapien
tgtcgatgacatgaaagtgaagtaa

SEQ ID NO: 224092 - DNA, 25 bp, Homo sapien
accagtacagtaccataagtagaat

SEQ ID NO: 224093 - DNA, 25 bp, Homo sapien
gaatacatgtaagaatcacctagtc

SEQ ID NO: 224094 - DNA, 25 bp, Homo sapien
gtaagaatcacctagtcttcactat

SEQ ID NO: 224095 - DNA, 25 bp, Homo sapien
cacctagtcttcactatattgagta

SEQ ID NO: 224096 - DNA, 25 bp, Homo sapien
ctaaacttttaaacatctccattat

SEQ ID NO: 224097 - DNA, 25 bp, Homo sapien
ctccattatatctacatccttttga

SEQ ID NO: 224098 - DNA, 25 bp, Homo sapien
atatctacatccttttgaaggtatt

SEQ ID NO: 224099 - DNA, 25 bp, Homo sapien
gaaggtatttatcatagttgccaat

SEQ ID NO: 224100 - DNA, 25 bp, Homo sapien
cccagacaagggtggcccgggcctg

SEQ ID NO: 224101 - DNA, 25 bp, Homo sapien
ccagacaagggtggcccgggcctgc

SEQ ID NO: 224102 - DNA, 25 bp, Homo sapien
cttcgcccctcacctctttgaaact

SEQ ID NO: 224103 - DNA, 25 bp, Homo sapien
agtgcccctcccttctgtttgtgcc

SEQ ID NO: 224104 - DNA, 25 bp, Homo sapien
gtgcccctcccttctgtttgtgccc

SEQ ID NO: 224105 - DNA, 25 bp, Homo sapien
gcccctcccttctgtttgtgcccct

SEQ ID NO: 224106 - DNA, 25 bp, Homo sapien
cctcccttctgtttgtgcccctctc

SEQ ID NO: 224107 - DNA, 25 bp, Homo sapien
ctcccttctgtttgtgcccctctcc

SEQ ID NO: 224108 - DNA, 25 bp, Homo sapien
accggcccgaccacaagcttggagc

SEQ ID NO: 224109 - DNA, 25 bp, Homo sapien
gccaaagaccatcacatctccggag

SEQ ID NO: 224110 - DNA, 25 bp, Homo sapien
aaagaccatcacatctccggagctg

SEQ ID NO: 224111 - DNA, 25 bp, Homo sapien
aagaccatcacatctccggagctga

SEQ ID NO: 224112 - DNA, 25 bp, Homo sapien
agaccatcacatctccggagctgag

SEQ ID NO: 224113 - DNA, 25 bp, Homo sapien
gaccatcacatctccggagctgagg

SEQ ID NO: 224114 - DNA, 25 bp, Homo sapien
accatcacatctccggagctgaggt

SEQ ID NO: 224115 - DNA, 25 bp, Homo sapien
aagtaggcaggtaggatctgaagaa

SEQ ID NO: 224116 - DNA, 25 bp, Homo sapien
aggcacaggtgcaagtaaaattcgt

SEQ ID NO: 224117 - DNA, 25 bp, Homo sapien
gcacaggtgcaagtaaaattcgtca

SEQ ID NO: 224118 - DNA, 25 bp, Homo sapien
acaggtgcaagtaaaattcgtcaat

SEQ ID NO: 224119 - DNA, 25 bp, Homo sapien
atgcaacaccgtttgctttccataa

SEQ ID NO: 224120 - DNA, 25 bp, Homo sapien
tcttccccacaatgttgctcacagt

SEQ ID NO: 224121 - DNA, 25 bp, Homo sapien
tgttgctcacagtatatttgtattg

SEQ ID NO: 224122 - DNA, 25 bp, Homo sapien
gaacaggtttggcagttctctacca

SEQ ID NO: 224123 - DNA, 25 bp, Homo sapien
agttctctaccagtggaccaatctt

SEQ ID NO: 224124 - DNA, 25 bp, Homo sapien
ggaccaatcttttcatccccgtgta

SEQ ID NO: 224125 - DNA, 25 bp, Homo sapien
cgtgtacctcaccatcagagcaaaa

SEQ ID NO: 224126 - DNA, 25 bp, Homo sapien
atattttttggttcccatgattgct

SEQ ID NO: 224127 - DNA, 25 bp, Homo sapien
gttcccatgattgctttatctactg

SEQ ID NO: 224128 - DNA, 25 bp, Homo sapien
tgttgtaacatgaaaggtcacctgc

SEQ ID NO: 224129 - DNA, 25 bp, Homo sapien
actacttcaagggtctatgcaacac

SEQ ID NO: 224130 - DNA, 25 bp, Homo sapien
cccttcaaccagagccccgtggtga

SEQ ID NO: 224131 - DNA, 25 bp, Homo sapien
tgtgtggccaccgaccccgacagca

SEQ ID NO: 224132 - DNA, 25 bp, Homo sapien
gggccgcccacctgatcttctgctg

SEQ ID NO: 224133 - DNA, 25 bp, Homo sapien
tgcttccgagacctctgcaactcgg

SEQ ID NO: 224134 - DNA, 25 bp, Homo sapien
gagacctctgcaactcggaactctg

SEQ ID NO: 224135 - DNA, 25 bp, Homo sapien
gacctctgcaactcggaactctgaa

SEQ ID NO: 224136 - DNA, 25 bp, Homo sapien
tctgcaactcggaactctgaaccca

SEQ ID NO: 224137 - DNA, 25 bp, Homo sapien
gcaactcggaactctgaacccaggg

SEQ ID NO: 224138 - DNA, 25 bp, Homo sapien
ggaaggtgctcctcaggcacctcct

SEQ ID NO: 224139 - DNA, 25 bp, Homo sapien
gtggcacagctcactcatggggtct

SEQ ID NO: 224140 - DNA, 25 bp, Homo sapien
gagaagcacaccaggggcgccctct

SEQ ID NO: 224141 - DNA, 25 bp, Homo sapien
gcagttgaaagaatatccaagtatg

SEQ ID NO: 224142 - DNA, 25 bp, Homo sapien
gaattatagctgttattgccttgta

SEQ ID NO: 224143 - DNA, 25 bp, Homo sapien
gttattgccttgtatttatagccct

SEQ ID NO: 224144 - DNA, 25 bp, Homo sapien
ttatagcccttgtttcaggttttat

SEQ ID NO: 224145 - DNA, 25 bp, Homo sapien
ggttttatgattcaagtcttagtcc

SEQ ID NO: 224146 - DNA, 25 bp, Homo sapien
caagtcttagtccaatctttctttt

SEQ ID NO: 224147 - DNA, 25 bp, Homo sapien
ggacatttgcaatatttaccagttg

SEQ ID NO: 224148 - DNA, 25 bp, Homo sapien
ttttgtgtagtctgaatttgctttc

SEQ ID NO: 224149 - DNA, 25 bp, Homo sapien
gctttctgtagttgagcaaacgtct

SEQ ID NO: 224150 - DNA, 25 bp, Homo sapien
gagcaaacgtcttaaaaagtcattt

SEQ ID NO: 224151 - DNA, 25 bp, Homo sapien
actttctatgatgttctatagagca

SEQ ID NO: 224152 - DNA, 25 bp, Homo sapien
aactgcagttttcttaatctttgaa

SEQ ID NO: 224153 - DNA, 25 bp, Homo sapien
gaagactatttctaggattaactga

SEQ ID NO: 224154 - DNA, 25 bp, Homo sapien
gagagattaaaggaacagcagcact

SEQ ID NO: 224155 - DNA, 25 bp, Homo sapien
aggaacagcagcacttaggctcaaa

SEQ ID NO: 224156 - DNA, 25 bp, Homo sapien
ttaggctcaaaatcgcccctacaaa

SEQ ID NO: 224157 - DNA, 25 bp, Homo sapien
atcgcccctacaaagcagtagttgt

SEQ ID NO: 224158 - DNA, 25 bp, Homo sapien
gcagtagttgtttcttaattgctaa

SEQ ID NO: 224159 - DNA, 25 bp, Homo sapien
tgctaagtaatctgtttgcactcta

SEQ ID NO: 224160 - DNA, 25 bp, Homo sapien
ctgtttgcactctaggaaaagtaaa

SEQ ID NO: 224161 - DNA, 25 bp, Homo sapien
gatgatgtagatttttcggatgggt

SEQ ID NO: 224162 - DNA, 25 bp, Homo sapien
tcggatgggtgggtatattttattt

SEQ ID NO: 224163 - DNA, 25 bp, Homo sapien
gagcaccagctgtttacctgccctg

SEQ ID NO: 224164 - DNA, 25 bp, Homo sapien
cacttcctcggatactttactcaat

SEQ ID NO: 224165 - DNA, 25 bp, Homo sapien
ttttctctgggcattacgatttgtt

SEQ ID NO: 224166 - DNA, 25 bp, Homo sapien
ggcattacgatttgttcccctacaa

SEQ ID NO: 224167 - DNA, 25 bp, Homo sapien
atttgttcccctacaacagtgacct

SEQ ID NO: 224168 - DNA, 25 bp, Homo sapien
agtgacctgtgcattctgctgtggc

SEQ ID NO: 224169 - DNA, 25 bp, Homo sapien
tgctgtgtctgcaggtggctctcag

SEQ ID NO: 224170 - DNA, 25 bp, Homo sapien
tctgcaggtggctctcagcgaggta

SEQ ID NO: 224171 - DNA, 25 bp, Homo sapien
agggcgtcaccctgcagaacggcag

SEQ ID NO: 224172 - DNA, 25 bp, Homo sapien
agaacggcagagtgacgcgtcctct

SEQ ID NO: 224173 - DNA, 25 bp, Homo sapien
agtgacgcgtcctctcgctgctgag

SEQ ID NO: 224174 - DNA, 25 bp, Homo sapien
cataggccacaagaagttttaaact

SEQ ID NO: 224175 - DNA, 25 bp, Homo sapien
aggacatgttccaaggctcttttca

SEQ ID NO: 224176 - DNA, 25 bp, Homo sapien
tccaaggctcttttcatattatgtc

SEQ ID NO: 224177 - DNA, 25 bp, Homo sapien
atgtcagactagcaagtcttgcctc

SEQ ID NO: 224178 - DNA, 25 bp, Homo sapien
agactagcaagtcttgcctcagctt

SEQ ID NO: 224179 - DNA, 25 bp, Homo sapien
ttggactgatgggttgctccactgg

SEQ ID NO: 224180 - DNA, 25 bp, Homo sapien
tgatgggttgctccactgggcacaa

SEQ ID NO: 224181 - DNA, 25 bp, Homo sapien
ctgggcacaagcatcatgggttctt

SEQ ID NO: 224182 - DNA, 25 bp, Homo sapien
tataaacatgcataggagtcacctg

SEQ ID NO: 224183 - DNA, 25 bp, Homo sapien
atgcagcttctgattcaatagtctc

SEQ ID NO: 224184 - DNA, 25 bp, Homo sapien
tgattcaatagtctcaaacaggacc

SEQ ID NO: 224185 - DNA, 25 bp, Homo sapien
gctccagccgggttctcatggtgct

SEQ ID NO: 224186 - DNA, 25 bp, Homo sapien
tccagccgggttctcatggtgctca

SEQ ID NO: 224187 - DNA, 25 bp, Homo sapien
ccagccgggttctcatggtgctcaa

SEQ ID NO: 224188 - DNA, 25 bp, Homo sapien
cagccgggttctcatggtgctcaaa

SEQ ID NO: 224189 - DNA, 25 bp, Homo sapien
agccgggttctcatggtgctcaaac

SEQ ID NO: 224190 - DNA, 25 bp, Homo sapien
gccgggttctcatggtgctcaaacc

SEQ ID NO: 224191 - DNA, 25 bp, Homo sapien
gggttctcatggtgctcaaacccgc

SEQ ID NO: 224192 - DNA, 25 bp, Homo sapien
ggttctcatggtgctcaaacccgct

SEQ ID NO: 224193 - DNA, 25 bp, Homo sapien
gttctcatggtgctcaaacccgctc

SEQ ID NO: 224194 - DNA, 25 bp, Homo sapien
tcatggtgctcaaacccgctcccct

SEQ ID NO: 224195 - DNA, 25 bp, Homo sapien
gtcctgcactttctcggaccagtcc

SEQ ID NO: 224196 - DNA, 25 bp, Homo sapien
acctgagggtgagcaactcctgtac

SEQ ID NO: 224197 - DNA, 25 bp, Homo sapien
cctgagggtgagcaactcctgtact

SEQ ID NO: 224198 - DNA, 25 bp, Homo sapien
ctgagggtgagcaactcctgtactg

SEQ ID NO: 224199 - DNA, 25 bp, Homo sapien
tgagggtgagcaactcctgtactgt

SEQ ID NO: 224200 - DNA, 25 bp, Homo sapien
gagggtgagcaactcctgtactgta

SEQ ID NO: 224201 - DNA, 25 bp, Homo sapien
agggtgagcaactcctgtactgtag

SEQ ID NO: 224202 - DNA, 25 bp, Homo sapien
gggtgagcaactcctgtactgtagg

SEQ ID NO: 224203 - DNA, 25 bp, Homo sapien
ggtgagcaactcctgtactgtaggg

SEQ ID NO: 224204 - DNA, 25 bp, Homo sapien
gtgagcaactcctgtactgtagggg

SEQ ID NO: 224205 - DNA, 25 bp, Homo sapien
gagcaactcctgtactgtaggggaa

SEQ ID NO: 224206 - DNA, 25 bp, Homo sapien
gcaactcctgtactgtaggggaaga

SEQ ID NO: 224207 - DNA, 25 bp, Homo sapien
acagatttacaagggtcccgactct

SEQ ID NO: 224208 - DNA, 25 bp, Homo sapien
gtattccagccttcagctgaactgt

SEQ ID NO: 224209 - DNA, 25 bp, Homo sapien
gctgaactgtgaatatcgcttccgt

SEQ ID NO: 224210 - DNA, 25 bp, Homo sapien
aatatcgcttccgtgtatgtgccat

SEQ ID NO: 224211 - DNA, 25 bp, Homo sapien
ttccgtgtatgtgccattcgccagt

SEQ ID NO: 224212 - DNA, 25 bp, Homo sapien
attcgccagtgccaagactctctgg

SEQ ID NO: 224213 - DNA, 25 bp, Homo sapien
acagtgctcttcatctctcagagga

SEQ ID NO: 224214 - DNA, 25 bp, Homo sapien
atctctcagaggactgaaccaccag

SEQ ID NO: 224215 - DNA, 25 bp, Homo sapien
gaaagcacaaggacccgacgggcac

SEQ ID NO: 224216 - DNA, 25 bp, Homo sapien
actgagtgacgagcagtgtgctgcc

SEQ ID NO: 224217 - DNA, 25 bp, Homo sapien
agtgtgctgccgtcatccttgtgct

SEQ ID NO: 224218 - DNA, 25 bp, Homo sapien
ttgccattcacttttagaatcttgt

SEQ ID NO: 224219 - DNA, 25 bp, Homo sapien
tcaaatgttctgcttcatgtgtctg

SEQ ID NO: 224220 - DNA, 25 bp, Homo sapien
gaaagtgtacactgcagaactgccc

SEQ ID NO: 224221 - DNA, 25 bp, Homo sapien
agaactgcccattctcattactgtg

SEQ ID NO: 224222 - DNA, 25 bp, Homo sapien
cccattctcattactgtgtcctatt

SEQ ID NO: 224223 - DNA, 25 bp, Homo sapien
tgtgtcctattttattcatgcctgt

SEQ ID NO: 224224 - DNA, 25 bp, Homo sapien
tttattcatgcctgtgtgtttttct

SEQ ID NO: 224225 - DNA, 25 bp, Homo sapien
gatacagctacttatggattcatca

SEQ ID NO: 224226 - DNA, 25 bp, Homo sapien
ggattcatcaatatcatgagcactt

SEQ ID NO: 224227 - DNA, 25 bp, Homo sapien
tcatgagcacttttgctggttccag

SEQ ID NO: 224228 - DNA, 25 bp, Homo sapien
ggttccagtcaaatcaatggcattt

SEQ ID NO: 224229 - DNA, 25 bp, Homo sapien
gagatgttttctgtccttccttgaa

SEQ ID NO: 224230 - DNA, 25 bp, Homo sapien
tgaaaaccccactagtgttacctgc

SEQ ID NO: 224231 - DNA, 25 bp, Homo sapien
gtgttacctgccacgaggagagcta

SEQ ID NO: 224232 - DNA, 25 bp, Homo sapien
ttcctagaagcattccttcattctt

SEQ ID NO: 224233 - DNA, 25 bp, Homo sapien
ctctctcttacaacgcttcattaat

SEQ ID NO: 224234 - DNA, 25 bp, Homo sapien
aatcaagtacccttttttggagcat

SEQ ID NO: 224235 - DNA, 25 bp, Homo sapien
attttttgatgtctattacgtgcca

SEQ ID NO: 224236 - DNA, 25 bp, Homo sapien
attcttccttcatctttcatgacac

SEQ ID NO: 224237 - DNA, 25 bp, Homo sapien
atctttcatgacactgacactttta

SEQ ID NO: 224238 - DNA, 25 bp, Homo sapien
gacacttttaattacaggccagctg

SEQ ID NO: 224239 - DNA, 25 bp, Homo sapien
gctgatgtgtagaatgtccttcctt

SEQ ID NO: 224240 - DNA, 25 bp, Homo sapien
attcattttctatccgttctctttt

SEQ ID NO: 224241 - DNA, 25 bp, Homo sapien
ttatattccaaatacctctccatct

SEQ ID NO: 224242 - DNA, 25 bp, Homo sapien
cctctccatctccatgttcaaatat

SEQ ID NO: 224243 - DNA, 25 bp, Homo sapien
gttcaaatatttcaatcccgtccca

SEQ ID NO: 224244 - DNA, 25 bp, Homo sapien
accagttcctggtaggatccatcac

SEQ ID NO: 224245 - DNA, 25 bp, Homo sapien
ggatccatcactgtgtctatgaaca

SEQ ID NO: 224246 - DNA, 25 bp, Homo sapien
actggatgcaggtgctggtgtttct

SEQ ID NO: 224247 - DNA, 25 bp, Homo sapien
agctactcacatgaggctccagcat

SEQ ID NO: 224248 - DNA, 25 bp, Homo sapien
tgccctttaacctcaactgtagcct

SEQ ID NO: 224249 - DNA, 25 bp, Homo sapien
aactgtagcctctccagcgtggtca

SEQ ID NO: 224250 - DNA, 25 bp, Homo sapien
aacctaagggttcatgttcttgaca

SEQ ID NO: 224251 - DNA, 25 bp, Homo sapien
agtcctccacgcgtggaggagaatc

SEQ ID NO: 224252 - DNA, 25 bp, Homo sapien
tggaggagaatccggcctccagaca

SEQ ID NO: 224253 - DNA, 25 bp, Homo sapien
ggcctccagacacaatctccagggc

SEQ ID NO: 224254 - DNA, 25 bp, Homo sapien
ttcctggctgaagaacctgcaccag

SEQ ID NO: 224255 - DNA, 25 bp, Homo sapien
tggctgaagaacctgcaccagccgc

SEQ ID NO: 224256 - DNA, 25 bp, Homo sapien
tcctgtcattcactccgagacgcag

SEQ ID NO: 224257 - DNA, 25 bp, Homo sapien
attcactccgagacgcagcagcgtt

SEQ ID NO: 224258 - DNA, 25 bp, Homo sapien
aataacccaaagtcaagccagaggg

SEQ ID NO: 224259 - DNA, 25 bp, Homo sapien
acccaaagtcaagccagagggagcc

SEQ ID NO: 224260 - DNA, 25 bp, Homo sapien
gagggagcctcgctaaccaccaagg

SEQ ID NO: 224261 - DNA, 25 bp, Homo sapien
gagcctcgctaaccaccaaggcggt

SEQ ID NO: 224262 - DNA, 25 bp, Homo sapien
agccgttggctgcaggcatatcaca

SEQ ID NO: 224263 - DNA, 25 bp, Homo sapien
ccgttggctgcaggcatatcacaga

SEQ ID NO: 224264 - DNA, 25 bp, Homo sapien
cccttgtccttggtccactgtggga

SEQ ID NO: 224265 - DNA, 25 bp, Homo sapien
gctccgagtagaccaaaagattcct

SEQ ID NO: 224266 - DNA, 25 bp, Homo sapien
agtagaccaaaagattcctgcccac

SEQ ID NO: 224267 - DNA, 25 bp, Homo sapien
gagcaggcaggcaacggcgattccc

SEQ ID NO: 224268 - DNA, 25 bp, Homo sapien
caggcaacggcgattccccgggaag

SEQ ID NO: 224269 - DNA, 25 bp, Homo sapien
ttggtccactgtgggactggtcctg

SEQ ID NO: 224270 - DNA, 25 bp, Homo sapien
gaaccctgggccactgtgctgttaa

SEQ ID NO: 224271 - DNA, 25 bp, Homo sapien
cctgggccactgtgctgttaaccac

SEQ ID NO: 224272 - DNA, 25 bp, Homo sapien
tgtgggactggtcctgtctgtctcc

SEQ ID NO: 224273 - DNA, 25 bp, Homo sapien
aagaagtatcagtgacagcgatgaa

SEQ ID NO: 224274 - DNA, 25 bp, Homo sapien
cagcgatgaattagcttcagggttt

SEQ ID NO: 224275 - DNA, 25 bp, Homo sapien
ttttgtgttcccttacccatatcca

SEQ ID NO: 224276 - DNA, 25 bp, Homo sapien
ttccaccaattccatttccaagatt

SEQ ID NO: 224277 - DNA, 25 bp, Homo sapien
aagatttccatggtttagacgtaat

SEQ ID NO: 224278 - DNA, 25 bp, Homo sapien
tgaagaaagttctcctcctgatcac

SEQ ID NO: 224279 - DNA, 25 bp, Homo sapien
gtaattttcctattccaatacctga

SEQ ID NO: 224280 - DNA, 25 bp, Homo sapien
aatacctgaatctgcccctacaact

SEQ ID NO: 224281 - DNA, 25 bp, Homo sapien
tgatcacagccatcttggcagtggc

SEQ ID NO: 224282 - DNA, 25 bp, Homo sapien
ttggcagtggctgttggtttcccag

SEQ ID NO: 224283 - DNA, 25 bp, Homo sapien
tgttggtttcccagtctctcaagac

SEQ ID NO: 224284 - DNA, 25 bp, Homo sapien
aggagtacactgtcccggtgaccca

SEQ ID NO: 224285 - DNA, 25 bp, Homo sapien
gtgacccacaccaaggtggctccaa

SEQ ID NO: 224286 - DNA, 25 bp, Homo sapien
aaggtggctccaagtgtaaacaaag

SEQ ID NO: 224287 - DNA, 25 bp, Homo sapien
aggttgaagcagctttcctcccagt

SEQ ID NO: 224288 - DNA, 25 bp, Homo sapien
gatgcagcctgatgtgaggttttca

SEQ ID NO: 224289 - DNA, 25 bp, Homo sapien
agtgaaatgacctagcaccaggttg

SEQ ID NO: 224290 - DNA, 25 bp, Homo sapien
caccaggttgggattgcttgggtct

SEQ ID NO: 224291 - DNA, 25 bp, Homo sapien
gattgcttgggtctgcacagcagtc

SEQ ID NO: 224292 - DNA, 25 bp, Homo sapien
cttcactgatctccacagggagaaa

SEQ ID NO: 224293 - DNA, 25 bp, Homo sapien
aacagaagtccccacaagtaccaag

SEQ ID NO: 224294 - DNA, 25 bp, Homo sapien
gaagtccccacaagtaccaagctct

SEQ ID NO: 224295 - DNA, 25 bp, Homo sapien
aacagtctgctttgccccaagtctt

SEQ ID NO: 224296 - DNA, 25 bp, Homo sapien
ggcctagcactggaagatgcctcag

SEQ ID NO: 224297 - DNA, 25 bp, Homo sapien
aagatgcctcaggtgtgtttggagt

SEQ ID NO: 224298 - DNA, 25 bp, Homo sapien
tagggcacgctctcagagaccagga

SEQ ID NO: 224299 - DNA, 25 bp, Homo sapien
accaggatagagagtcagggaacct

SEQ ID NO: 224300 - DNA, 25 bp, Homo sapien
cctgggaaagagtagtgccagttcc

SEQ ID NO: 224301 - DNA, 25 bp, Homo sapien
tgccagttccgggtaggctgctgca

SEQ ID NO: 224302 - DNA, 25 bp, Homo sapien
cagttccgggtaggctgctgcacca

SEQ ID NO: 224303 - DNA, 25 bp, Homo sapien
aggccctaccagctcaggctataaa

SEQ ID NO: 224304 - DNA, 25 bp, Homo sapien
agctcaggctataaacagtctgctt

SEQ ID NO: 224305 - DNA, 25 bp, Homo sapien
tataaacagtctgctttgccccaag

SEQ ID NO: 224306 - DNA, 25 bp, Homo sapien
gtcttgttaaatagttgtatcaatg

SEQ ID NO: 224307 - DNA, 25 bp, Homo sapien
gttaaatagttgtatcaatgacttg

SEQ ID NO: 224308 - DNA, 25 bp, Homo sapien
agttgtatcaatgacttgatttaga

SEQ ID NO: 224309 - DNA, 25 bp, Homo sapien
caatgacttgatttagattaatgag

SEQ ID NO: 224310 - DNA, 25 bp, Homo sapien
tcaaatttatgccttttacaaaatt

SEQ ID NO: 224311 - DNA, 25 bp, Homo sapien
taaagagtaggtaatgtcggtgata

SEQ ID NO: 224312 - DNA, 25 bp, Homo sapien
aagagtaggtaatgtcggtgataga

SEQ ID NO: 224313 - DNA, 25 bp, Homo sapien
gagtaggtaatgtcggtgatagata

SEQ ID NO: 224314 - DNA, 25 bp, Homo sapien
aggtaatgtcggtgatagatataaa

SEQ ID NO: 224315 - DNA, 25 bp, Homo sapien
gtaatgtcggtgatagatataaaga

SEQ ID NO: 224316 - DNA, 25 bp, Homo sapien
gaaaggaaaagatctccagatgtgg

SEQ ID NO: 224317 - DNA, 25 bp, Homo sapien
cccttcaaccagagccccgtggtga

SEQ ID NO: 224318 - DNA, 25 bp, Homo sapien
tgtgtggccaccgaccccgacagca

SEQ ID NO: 224319 - DNA, 25 bp, Homo sapien
cacctgatcttctgctgcttccgag

SEQ ID NO: 224320 - DNA, 25 bp, Homo sapien
tgcttccgagacctctgcaactcgg

SEQ ID NO: 224321 - DNA, 25 bp, Homo sapien
gagacctctgcaactcggaactctg

SEQ ID NO: 224322 - DNA, 25 bp, Homo sapien
gacctctgcaactcggaactctgaa

SEQ ID NO: 224323 - DNA, 25 bp, Homo sapien
gcaactcggaactctgaacccaggg

SEQ ID NO: 224324 - DNA, 25 bp, Homo sapien
aactctgaacccagggcggcagggc

SEQ ID NO: 224325 - DNA, 25 bp, Homo sapien
ggaaggtgctcctcaggcacctcct

SEQ ID NO: 224326 - DNA, 25 bp, Homo sapien
tgctgtggcacagctcactcatggg

SEQ ID NO: 224327 - DNA, 25 bp, Homo sapien
gagaagcacaccaggggcgccctct

SEQ ID NO: 224328 - DNA, 25 bp, Homo sapien
gatagtcctttatgcaatgtcttag

SEQ ID NO: 224329 - DNA, 25 bp, Homo sapien
gcaatgtcttagcaatagtctctat

SEQ ID NO: 224330 - DNA, 25 bp, Homo sapien
aatagtctctataatgcccatccag

SEQ ID NO: 224331 - DNA, 25 bp, Homo sapien
tataatgcccatccaggagaagtgg

SEQ ID NO: 224332 - DNA, 25 bp, Homo sapien
catatttagtatcttccctttgcag

SEQ ID NO: 224333 - DNA, 25 bp, Homo sapien
tcttccctttgcagtattgcacttt

SEQ ID NO: 224334 - DNA, 25 bp, Homo sapien
gtattgcacttttgtttaactagaa

SEQ ID NO: 224335 - DNA, 25 bp, Homo sapien
gaatacacctatgagatagccaaag

SEQ ID NO: 224336 - DNA, 25 bp, Homo sapien
cagttatcttagtttaccggtggag

SEQ ID NO: 224337 - DNA, 25 bp, Homo sapien
ggagtatttcaacaccaaccacatt

SEQ ID NO: 224338 - DNA, 25 bp, Homo sapien
tctacccacatgatctttattcctt

SEQ ID NO: 224339 - DNA, 25 bp, Homo sapien
tccacccaagttaggcctgctctgg

SEQ ID NO: 224340 - DNA, 25 bp, Homo sapien
ggcctaatggatcttactgtatgag

SEQ ID NO: 224341 - DNA, 25 bp, Homo sapien
cttactgtatgagcaggacggctgc

SEQ ID NO: 224342 - DNA, 25 bp, Homo sapien
ggacggctgcattggattgtacaac

SEQ ID NO: 224343 - DNA, 25 bp, Homo sapien
ttgtacaactgttttgtgatgcccc

SEQ ID NO: 224344 - DNA, 25 bp, Homo sapien
gacactgtcatcctaggccgagaag

SEQ ID NO: 224345 - DNA, 25 bp, Homo sapien
ggccgagaagaacctgctagcttga

SEQ ID NO: 224346 - DNA, 25 bp, Homo sapien
tagcttgacataccccatgggctta

SEQ ID NO: 224347 - DNA, 25 bp, Homo sapien
tggtcaacagtgaggcagtctccct

SEQ ID NO: 224348 - DNA, 25 bp, Homo sapien
ttctccacccagtcacagataaggg

SEQ ID NO: 224349 - DNA, 25 bp, Homo sapien
accttggccatatatttgctcaata

SEQ ID NO: 224350 - DNA, 25 bp, Homo sapien
aacgctgaatgaagaacgaagtcgc

SEQ ID NO: 224351 - DNA, 25 bp, Homo sapien
gaacgaagtcgcgtggaaaccctcg

SEQ ID NO: 224352 - DNA, 25 bp, Homo sapien
gaagtcgcgtggaaaccctcgccgc

SEQ ID NO: 224353 - DNA, 25 bp, Homo sapien
agcggacagcgcagcccgggaggtt

SEQ ID NO: 224354 - DNA, 25 bp, Homo sapien
ggctgcgctgcgagcggccacgcat

SEQ ID NO: 224355 - DNA, 25 bp, Homo sapien
acgcatggcggctggacccgggcgg

SEQ ID NO: 224356 - DNA, 25 bp, Homo sapien
cgagccatctccctgaactgacaag

SEQ ID NO: 224357 - DNA, 25 bp, Homo sapien
gccatctccctgaactgacaagcag

SEQ ID NO: 224358 - DNA, 25 bp, Homo sapien
tgacaagcaggactcccgggtccag

SEQ ID NO: 224359 - DNA, 25 bp, Homo sapien
gctgccggaggagcccactgtaaat

SEQ ID NO: 224360 - DNA, 25 bp, Homo sapien
cggaggagcccactgtaaatgccgc

SEQ ID NO: 224361 - DNA, 25 bp, Homo sapien
gattctgtacataccattgttatta

SEQ ID NO: 224362 - DNA, 25 bp, Homo sapien
gcaattgcactcagcgtggtatggt

SEQ ID NO: 224363 - DNA, 25 bp, Homo sapien
gcgtggtatggtaaaagtttgtcct

SEQ ID NO: 224364 - DNA, 25 bp, Homo sapien
tttgtcctcccgtagattcttactg

SEQ ID NO: 224365 - DNA, 25 bp, Homo sapien
attcttactgtgttgtagatacggt

SEQ ID NO: 224366 - DNA, 25 bp, Homo sapien
gatacggtagggttcctagacaaat

SEQ ID NO: 224367 - DNA, 25 bp, Homo sapien
tatttatgtactcaagccctttatt

SEQ ID NO: 224368 - DNA, 25 bp, Homo sapien
acttattaactgtagaggcttccga

SEQ ID NO: 224369 - DNA, 25 bp, Homo sapien
agaggcttccgaaaccttcaagata

SEQ ID NO: 224370 - DNA, 25 bp, Homo sapien
attgttaccacttttccttgctatc

SEQ ID NO: 224371 - DNA, 25 bp, Homo sapien
cacttttccttgctatctagtggag

SEQ ID NO: 224372 - DNA, 25 bp, Homo sapien
tcacctaggtcaagagtttcaaacc

SEQ ID NO: 224373 - DNA, 25 bp, Homo sapien
cacctaggtcaagagtttcaaacca

SEQ ID NO: 224374 - DNA, 25 bp, Homo sapien
acctaggtcaagagtttcaaaccag

SEQ ID NO: 224375 - DNA, 25 bp, Homo sapien
cctaggtcaagagtttcaaaccaga

SEQ ID NO: 224376 - DNA, 25 bp, Homo sapien
ctaggtcaagagtttcaaaccagac

SEQ ID NO: 224377 - DNA, 25 bp, Homo sapien
taggtcaagagtttcaaaccagacg

SEQ ID NO: 224378 - DNA, 25 bp, Homo sapien
aggtcaagagtttcaaaccagacgg

SEQ ID NO: 224379 - DNA, 25 bp, Homo sapien
ggtcaagagtttcaaaccagacggg

SEQ ID NO: 224380 - DNA, 25 bp, Homo sapien
gtcaagagtttcaaaccagacgggc

SEQ ID NO: 224381 - DNA, 25 bp, Homo sapien
tcaagagtttcaaaccagacgggcc

SEQ ID NO: 224382 - DNA, 25 bp, Homo sapien
caagagtttcaaaccagacgggcca

SEQ ID NO: 224383 - DNA, 25 bp, Homo sapien
attggatgagatcccttgtgtgtga

SEQ ID NO: 224384 - DNA, 25 bp, Homo sapien
ctgcagagagtgaaagattgagcct

SEQ ID NO: 224385 - DNA, 25 bp, Homo sapien
tgagcctgaagcactatggttccta

SEQ ID NO: 224386 - DNA, 25 bp, Homo sapien
aagcactatggttcctaaacactga

SEQ ID NO: 224387 - DNA, 25 bp, Homo sapien
tgaagccagaaggatcgaggatgtt

SEQ ID NO: 224388 - DNA, 25 bp, Homo sapien
gatgttaatgggtcgggctgactcc

SEQ ID NO: 224389 - DNA, 25 bp, Homo sapien
gggctgactcccaggcagacatccg

SEQ ID NO: 224390 - DNA, 25 bp, Homo sapien
gcagacatccgtggccattcaggga

SEQ ID NO: 224391 - DNA, 25 bp, Homo sapien
atccgtggccattcagggactgtgg

SEQ ID NO: 224392 - DNA, 25 bp, Homo sapien
ttgacaccacagatggctccccatt

SEQ ID NO: 224393 - DNA, 25 bp, Homo sapien
gtggtgtgttttagcttcataggaa

SEQ ID NO: 224394 - DNA, 25 bp, Homo sapien
gccagaaagacacagcagcgttaat

SEQ ID NO: 224395 - DNA, 25 bp, Homo sapien
gaccttttggaagcgaactcctaca

SEQ ID NO: 224396 - DNA, 25 bp, Homo sapien
gcgaactcctacaaactgtcatcaa

SEQ ID NO: 224397 - DNA, 25 bp, Homo sapien
tgagcaaagacctcaacccagccat

SEQ ID NO: 224398 - DNA, 25 bp, Homo sapien
cagccatccttgtagtaattccatc

SEQ ID NO: 224399 - DNA, 25 bp, Homo sapien
gtaattccatcttcaggtggaggga

SEQ ID NO: 224400 - DNA, 25 bp, Homo sapien
aggagcatactcatagctatgtgaa

SEQ ID NO: 224401 - DNA, 25 bp, Homo sapien
gctatgtgaaaatatctcggccttt

SEQ ID NO: 224402 - DNA, 25 bp, Homo sapien
aatatctcggccttttttaatgaag

SEQ ID NO: 224403 - DNA, 25 bp, Homo sapien
tattgtgagcaaggcatcttctggt

SEQ ID NO: 224404 - DNA, 25 bp, Homo sapien
gtgggcagagcaatccaggttcttc

SEQ ID NO: 224405 - DNA, 25 bp, Homo sapien
gaaatgaggatgtctgtccctgtct

SEQ ID NO: 224406 - DNA, 25 bp, Homo sapien
gtctgcctgggcaggccagattcct

SEQ ID NO: 224407 - DNA, 25 bp, Homo sapien
ggtctctccagaccctgattcggtg

SEQ ID NO: 224408 - DNA, 25 bp, Homo sapien
ccctgattcggtgcctttctgttta

SEQ ID NO: 224409 - DNA, 25 bp, Homo sapien
tttaccagctacttcaatcccaaag

SEQ ID NO: 224410 - DNA, 25 bp, Homo sapien
tgaatctgcagataccttactccca

SEQ ID NO: 224411 - DNA, 25 bp, Homo sapien
gtgtgtttttcctggtgcttcaaga

SEQ ID NO: 224412 - DNA, 25 bp, Homo sapien
tcctggtgcttcaagagcgtgtgca

SEQ ID NO: 224413 - DNA, 25 bp, Homo sapien
agggcaagtgccgtcactgggaact

SEQ ID NO: 224414 - DNA, 25 bp, Homo sapien
gaactgcaccagatgctcagacttg

SEQ ID NO: 224415 - DNA, 25 bp, Homo sapien
cagacttggttgtcttatgtttacc

SEQ ID NO: 224416 - DNA, 25 bp, Homo sapien
ggctccagccgggttctcatggtgc

SEQ ID NO: 224417 - DNA, 25 bp, Homo sapien
ggttctcatggtgctcaaacccgct

SEQ ID NO: 224418 - DNA, 25 bp, Homo sapien
acctgagggtgagcaactcctgtac

SEQ ID NO: 224419 - DNA, 25 bp, Homo sapien
cctgagggtgagcaactcctgtact

SEQ ID NO: 224420 - DNA, 25 bp, Homo sapien
ctgagggtgagcaactcctgtactg

SEQ ID NO: 224421 - DNA, 25 bp, Homo sapien
tgagggtgagcaactcctgtactgt

SEQ ID NO: 224422 - DNA, 25 bp, Homo sapien
gagggtgagcaactcctgtactgta

SEQ ID NO: 224423 - DNA, 25 bp, Homo sapien
agggtgagcaactcctgtactgtag

SEQ ID NO: 224424 - DNA, 25 bp, Homo sapien
ggtgagcaactcctgtactgtaggg

SEQ ID NO: 224425 - DNA, 25 bp, Homo sapien
gagcaactcctgtactgtaggggaa

SEQ ID NO: 224426 - DNA, 25 bp, Homo sapien
gcaactcctgtactgtaggggaaga

SEQ ID NO: 224427 - DNA, 25 bp, Homo sapien
gtttgttgctctctcataagttaag

SEQ ID NO: 224428 - DNA, 25 bp, Homo sapien
gttgctctctcataagttaagaatc

SEQ ID NO: 224429 - DNA, 25 bp, Homo sapien
ggatttcaagtctatagtgtaacac

SEQ ID NO: 224430 - DNA, 25 bp, Homo sapien
atagtgtaacactcttgttcataat

SEQ ID NO: 224431 - DNA, 25 bp, Homo sapien
acactcttgttcataatttcttatt

SEQ ID NO: 224432 - DNA, 25 bp, Homo sapien
ttttttcaaactatttgggcttgct

SEQ ID NO: 224433 - DNA, 25 bp, Homo sapien
aactatttgggcttgctattgaaca

SEQ ID NO: 224434 - DNA, 25 bp, Homo sapien
gggcttgctattgaacaaatgttct

SEQ ID NO: 224435 - DNA, 25 bp, Homo sapien
gaaggtgctaaaaagcatcactaaa

SEQ ID NO: 224436 - DNA, 25 bp, Homo sapien
ggttaatacattatactgactactt

SEQ ID NO: 224437 - DNA, 25 bp, Homo sapien
acattatactgactacttttttctc

SEQ ID NO: 224438 - DNA, 25 bp, Homo sapien
aattcactggtgctaatgtagctac

SEQ ID NO: 224439 - DNA, 25 bp, Homo sapien
gctacagaagagcttgtgttaacat

SEQ ID NO: 224440 - DNA, 25 bp, Homo sapien
gaagagcttgtgttaacattttctc

SEQ ID NO: 224441 - DNA, 25 bp, Homo sapien
gttaacattttctcttgaagatatg

SEQ ID NO: 224442 - DNA, 25 bp, Homo sapien
gaaaagtcacatttggaagggtagt

SEQ ID NO: 224443 - DNA, 25 bp, Homo sapien
ggtagtaattttggtggaagctgat

SEQ ID NO: 224444 - DNA, 25 bp, Homo sapien
gaagctgatgggaaagtcacagatg

SEQ ID NO: 224445 - DNA, 25 bp, Homo sapien
atggaatttgggttgtagccactaa

SEQ ID NO: 224446 - DNA, 25 bp, Homo sapien
tagccactaaggtagggttgaccac

SEQ ID NO: 224447 - DNA, 25 bp, Homo sapien
agggttgaccacactgctattttta

SEQ ID NO: 224448 - DNA, 25 bp, Homo sapien
ttttatctggatgtttaggtggctg

SEQ ID NO: 224449 - DNA, 25 bp, Homo sapien
tttctaaccctcagagagcaacaca

SEQ ID NO: 224450 - DNA, 25 bp, Homo sapien
accctcagagagcaacacagcaaat

SEQ ID NO: 224451 - DNA, 25 bp, Homo sapien
tcaaccaaaacttcccattaaatag

SEQ ID NO: 224452 - DNA, 25 bp, Homo sapien
gataaaacaaccacattttcacaaa

SEQ ID NO: 224453 - DNA, 25 bp, Homo sapien
attggtcattcactaaattggctgc

SEQ ID NO: 224454 - DNA, 25 bp, Homo sapien
cattcactaaattggctgcttggca

SEQ ID NO: 224455 - DNA, 25 bp, Homo sapien
aaattggctgcttggcaaactaatt

SEQ ID NO: 224456 - DNA, 25 bp, Homo sapien
ggctgcttggcaaactaattttcaa

SEQ ID NO: 224457 - DNA, 25 bp, Homo sapien
gaattagcatgttcttggttggaaa

SEQ ID NO: 224458 - DNA, 25 bp, Homo sapien
agatctctaaagctgggtgttgccc

SEQ ID NO: 224459 - DNA, 25 bp, Homo sapien
aagctgggtgttgcccaaaagcagc

SEQ ID NO: 224460 - DNA, 25 bp, Homo sapien
cctgcacccggccaaaagttgattt

SEQ ID NO: 224461 - DNA, 25 bp, Homo sapien
ctgcacccggccaaaagttgatttt

SEQ ID NO: 224462 - DNA, 25 bp, Homo sapien
tgcacccggccaaaagttgattttt

SEQ ID NO: 224463 - DNA, 25 bp, Homo sapien
gccaaaagttgatttttaattacat

SEQ ID NO: 224464 - DNA, 25 bp, Homo sapien
cttctagtaaaaacttgatttggtg

SEQ ID NO: 224465 - DNA, 25 bp, Homo sapien
ttctagtaaaaacttgatttggtga

SEQ ID NO: 224466 - DNA, 25 bp, Homo sapien
tctagtaaaaacttgatttggtgaa

SEQ ID NO: 224467 - DNA, 25 bp, Homo sapien
ctagtaaaaacttgatttggtgaat

SEQ ID NO: 224468 - DNA, 25 bp, Homo sapien
tagtaaaaacttgatttggtgaata

SEQ ID NO: 224469 - DNA, 25 bp, Homo sapien
atatgcatcgggaaacataccccac

SEQ ID NO: 224470 - DNA, 25 bp, Homo sapien
atcgggaaacataccccacacggtg

SEQ ID NO: 224471 - DNA, 25 bp, Homo sapien
cccacacggtgccatggtttaatta

SEQ ID NO: 224472 - DNA, 25 bp, Homo sapien
ggtttaattattccccagctctact

SEQ ID NO: 224473 - DNA, 25 bp, Homo sapien
tattccccagctctacttttgggag

SEQ ID NO: 224474 - DNA, 25 bp, Homo sapien
ctggaacttgtcagggttgtgaaat

SEQ ID NO: 224475 - DNA, 25 bp, Homo sapien
gggttgtgaaatagatctcagacta

SEQ ID NO: 224476 - DNA, 25 bp, Homo sapien
cagactattaaggacattcagaaac

SEQ ID NO: 224477 - DNA, 25 bp, Homo sapien
gaaactggctaagccattcaaggaa

SEQ ID NO: 224478 - DNA, 25 bp, Homo sapien
ggaatttacgtaatatattggacta

SEQ ID NO: 224479 - DNA, 25 bp, Homo sapien
ttggactacagtctcaaaggacaga

SEQ ID NO: 224480 - DNA, 25 bp, Homo sapien
ttcatatacatcagactcaaaggta

SEQ ID NO: 224481 - DNA, 25 bp, Homo sapien
gggcatgcattccattgaggaaatt

SEQ ID NO: 224482 - DNA, 25 bp, Homo sapien
gcattccattgaggaaattctaggg

SEQ ID NO: 224483 - DNA, 25 bp, Homo sapien
gacaaatgaccattaagcttcttgg

SEQ ID NO: 224484 - DNA, 25 bp, Homo sapien
gaccattaagcttcttggaccttga

SEQ ID NO: 224485 - DNA, 25 bp, Homo sapien
ttaagcttcttggaccttgagtact

SEQ ID NO: 224486 - DNA, 25 bp, Homo sapien
gcttcttggaccttgagtacttcac

SEQ ID NO: 224487 - DNA, 25 bp, Homo sapien
ttggaccttgagtacttcacacagt

SEQ ID NO: 224488 - DNA, 25 bp, Homo sapien
gaccttgagtacttcacacagtgtt

SEQ ID NO: 224489 - DNA, 25 bp, Homo sapien
gagtacttcacacagtgttaagata

SEQ ID NO: 224490 - DNA, 25 bp, Homo sapien
gattttcttgtgaaacttgtgttct

SEQ ID NO: 224491 - DNA, 25 bp, Homo sapien
attgctaacaaagagaccacccctt

SEQ ID NO: 224492 - DNA, 25 bp, Homo sapien
taacaaagagaccaccccttctaat

SEQ ID NO: 224493 - DNA, 25 bp, Homo sapien
aatacagaagagtgcactgcgtggt

SEQ ID NO: 224494 - DNA, 25 bp, Homo sapien
atgagggcacagacctagaggtttt

SEQ ID NO: 224495 - DNA, 25 bp, Homo sapien
aatggtccgcgggtggactttcaga

SEQ ID NO: 224496 - DNA, 25 bp, Homo sapien
tccgcgggtggactttcagattctg

SEQ ID NO: 224497 - DNA, 25 bp, Homo sapien
tttcagattctgaacactcctccac

SEQ ID NO: 224498 - DNA, 25 bp, Homo sapien
ttctgtggagaattcgggacacggt

SEQ ID NO: 224499 - DNA, 25 bp, Homo sapien
ggacacggtggagtttaaccagtat

SEQ ID NO: 224500 - DNA, 25 bp, Homo sapien
taaccagtatcttaaatccccaggg

SEQ ID NO: 224501 - DNA, 25 bp, Homo sapien
aaatccccagggacagggtggagat

SEQ ID NO: 224502 - DNA, 25 bp, Homo sapien
gggttgaactatatccaatataaag

SEQ ID NO: 224503 - DNA, 25 bp, Homo sapien
gattagcccccatgggtgacaccaa

SEQ ID NO: 224504 - DNA, 25 bp, Homo sapien
gggaaggctcagaaccaggcggcag

SEQ ID NO: 224505 - DNA, 25 bp, Homo sapien
caggagacagagtcaggtcccagag

SEQ ID NO: 224506 - DNA, 25 bp, Homo sapien
aaggcctacccccaaattgcagtca

SEQ ID NO: 224507 - DNA, 25 bp, Homo sapien
aattgcagtcaggttgggaagtaga

SEQ ID NO: 224508 - DNA, 25 bp, Homo sapien
gaagtagaatcatggctaggcccgc

SEQ ID NO: 224509 - DNA, 25 bp, Homo sapien
tagaatcatggctaggcccgcggcc

SEQ ID NO: 224510 - DNA, 25 bp, Homo sapien
aaccaggcggcagggtcaggatcgg

SEQ ID NO: 224511 - DNA, 25 bp, Homo sapien
tcaggatcgggagaggaaccagatc

SEQ ID NO: 224512 - DNA, 25 bp, Homo sapien
gagaggaaccagatctaaggatagt

SEQ ID NO: 224513 - DNA, 25 bp, Homo sapien
tggctgagtaaaccaaaacacctcc

SEQ ID NO: 224514 - DNA, 25 bp, Homo sapien
tccaaattatttcagtgcattcatc

SEQ ID NO: 224515 - DNA, 25 bp, Homo sapien
tatttcagtgcattcatctggaaac

SEQ ID NO: 224516 - DNA, 25 bp, Homo sapien
agtgcattcatctggaaactgagaa

SEQ ID NO: 224517 - DNA, 25 bp, Homo sapien
tgagaataacaatgctcactttgca

SEQ ID NO: 224518 - DNA, 25 bp, Homo sapien
ttaaatggcataggcaaaatattgt

SEQ ID NO: 224519 - DNA, 25 bp, Homo sapien
gtggtaaatatctgggcttggaatc

SEQ ID NO: 224520 - DNA, 25 bp, Homo sapien
tcttctcttactcctctgagttttg

SEQ ID NO: 224521 - DNA, 25 bp, Homo sapien
cttactcctctgagttttgctttct

SEQ ID NO: 224522 - DNA, 25 bp, Homo sapien
tctgggcttggaatcaaaggaccct

SEQ ID NO: 224523 - DNA, 25 bp, Homo sapien
tcaaaggaccctgggttcaaatctc

SEQ ID NO: 224524 - DNA, 25 bp, Homo sapien
tcattcctaggccaactttgaccag

SEQ ID NO: 224525 - DNA, 25 bp, Homo sapien
attcctaggccaactttgaccagtt

SEQ ID NO: 224526 - DNA, 25 bp, Homo sapien
tcctaggccaactttgaccagtttt

SEQ ID NO: 224527 - DNA, 25 bp, Homo sapien
ctaggccaactttgaccagttttat

SEQ ID NO: 224528 - DNA, 25 bp, Homo sapien
gttttatacagaaacatgtgccaac

SEQ ID NO: 224529 - DNA, 25 bp, Homo sapien
tatacagaaacatgtgccaactttt

SEQ ID NO: 224530 - DNA, 25 bp, Homo sapien
acagaaacatgtgccaacttttctg

SEQ ID NO: 224531 - DNA, 25 bp, Homo sapien
acttttctgtttgcaaggataatat

SEQ ID NO: 224532 - DNA, 25 bp, Homo sapien
tttctgtttgcaaggataatatcaa

SEQ ID NO: 224533 - DNA, 25 bp, Homo sapien
agcaaacaccagaaagttatatctt

SEQ ID NO: 224534 - DNA, 25 bp, Homo sapien
gaaagttatatctttgatgcatttt

SEQ ID NO: 224535 - DNA, 25 bp, Homo sapien
gagagatcataatgcccccaggatt

SEQ ID NO: 224536 - DNA, 25 bp, Homo sapien
atttaaccataaagggcaaggcaag

SEQ ID NO: 224537 - DNA, 25 bp, Homo sapien
gcaaggcaagagctgaacctgatcg

SEQ ID NO: 224538 - DNA, 25 bp, Homo sapien
acacccaagtgctcagcgatgcttg

SEQ ID NO: 224539 - DNA, 25 bp, Homo sapien
gatgcttgggaggagactgctcact

SEQ ID NO: 224540 - DNA, 25 bp, Homo sapien
ggaggagactgctcactctgcggct

SEQ ID NO: 224541 - DNA, 25 bp, Homo sapien
actctgcggctctgagggcatcatc

SEQ ID NO: 224542 - DNA, 25 bp, Homo sapien
tgagggcatcatccccaccaacagg

SEQ ID NO: 224543 - DNA, 25 bp, Homo sapien
gaggccccatcagccaatagcagga

SEQ ID NO: 224544 - DNA, 25 bp, Homo sapien
ggactgaaaatcctcctttatccaa

SEQ ID NO: 224545 - DNA, 25 bp, Homo sapien
atcctcctttatccaagacaacgtg

SEQ ID NO: 224546 - DNA, 25 bp, Homo sapien
acacacacacgaaataataatatat

SEQ ID NO: 224547 - DNA, 25 bp, Homo sapien
gtcttgttaaatagttgtatcaatg

SEQ ID NO: 224548 - DNA, 25 bp, Homo sapien
gttaaatagttgtatcaatgacttg

SEQ ID NO: 224549 - DNA, 25 bp, Homo sapien
agttgtatcaatgacttgatttaga

SEQ ID NO: 224550 - DNA, 25 bp, Homo sapien
caatgacttgatttagattaatgag

SEQ ID NO: 224551 - DNA, 25 bp, Homo sapien
tcaaatttatgccttttacaaaatt

SEQ ID NO: 224552 - DNA, 25 bp, Homo sapien
taaagagtaggtaatgtcggtgata

SEQ ID NO: 224553 - DNA, 25 bp, Homo sapien
gagtaggtaatgtcggtgatagata

SEQ ID NO: 224554 - DNA, 25 bp, Homo sapien
aggtaatgtcggtgatagatataaa

SEQ ID NO: 224555 - DNA, 25 bp, Homo sapien
gaaaggaaaagatctccagatgtgg

SEQ ID NO: 224556 - DNA, 25 bp, Homo sapien
gaaagaagacattaggctgggcgca

SEQ ID NO: 224557 - DNA, 25 bp, Homo sapien
catttcaaagtgtctcccaaaaaag

SEQ ID NO: 224558 - DNA, 25 bp, Homo sapien
agagcaattgctcccttaagcaaca

SEQ ID NO: 224559 - DNA, 25 bp, Homo sapien
aacagattcatatttaccctgggtt

SEQ ID NO: 224560 - DNA, 25 bp, Homo sapien
aaggcctgtataattgtcttttcat

SEQ ID NO: 224561 - DNA, 25 bp, Homo sapien
attgtcttttcattgttaacaccca

SEQ ID NO: 224562 - DNA, 25 bp, Homo sapien
tgttaacacccaaaatagcatctat

SEQ ID NO: 224563 - DNA, 25 bp, Homo sapien
atagcatctatctagacagtatccc

SEQ ID NO: 224564 - DNA, 25 bp, Homo sapien
caccgaccctatgatttgcactttt

SEQ ID NO: 224565 - DNA, 25 bp, Homo sapien
ctttttatttctatgtgtgccacac

SEQ ID NO: 224566 - DNA, 25 bp, Homo sapien
gtgtgccacacacaatgcagtatta

SEQ ID NO: 224567 - DNA, 25 bp, Homo sapien
tgcagtattaatggcaaccaggtaa

SEQ ID NO: 224568 - DNA, 25 bp, Homo sapien
gaatatgctgtcagtaacttaacaa

SEQ ID NO: 224569 - DNA, 25 bp, Homo sapien
aacatggaggcatttagttcagcat

SEQ ID NO: 224570 - DNA, 25 bp, Homo sapien
ggaggcatttagttcagcatttgct

SEQ ID NO: 224571 - DNA, 25 bp, Homo sapien
tgctttacttaatagagtgcagaaa

SEQ ID NO: 224572 - DNA, 25 bp, Homo sapien
gagtgcagaaaatgtggcccttttc

SEQ ID NO: 224573 - DNA, 25 bp, Homo sapien
gcccttttctcagttagggtgtatg

SEQ ID NO: 224574 - DNA, 25 bp, Homo sapien
aactcttttttgtctaccatcattt

SEQ ID NO: 224575 - DNA, 25 bp, Homo sapien
agactagtaaatacttctctgataa

SEQ ID NO: 224576 - DNA, 25 bp, Homo sapien
taccatcatttcatatttttcttgc

SEQ ID NO: 224577 - DNA, 25 bp, Homo sapien
tttttcttgctatttcaaacctata

SEQ ID NO: 224578 - DNA, 25 bp, Homo sapien
cgactaacgtaatcattcatagaat

SEQ ID NO: 224579 - DNA, 25 bp, Homo sapien
taattcaattgctacaaatgccgtg

SEQ ID NO: 224580 - DNA, 25 bp, Homo sapien
attcaattgctacaaatgccgtgac

SEQ ID NO: 224581 - DNA, 25 bp, Homo sapien
ttcaattgctacaaatgccgtgaca

SEQ ID NO: 224582 - DNA, 25 bp, Homo sapien
tcaattgctacaaatgccgtgacat

SEQ ID NO: 224583 - DNA, 25 bp, Homo sapien
caattgctacaaatgccgtgacatt

SEQ ID NO: 224584 - DNA, 25 bp, Homo sapien
aattgctacaaatgccgtgacattg

SEQ ID NO: 224585 - DNA, 25 bp, Homo sapien
attgctacaaatgccgtgacattgg

SEQ ID NO: 224586 - DNA, 25 bp, Homo sapien
gctacaaatgccgtgacattggaac

SEQ ID NO: 224587 - DNA, 25 bp, Homo sapien
tacaaatgccgtgacattggaacaa

SEQ ID NO: 224588 - DNA, 25 bp, Homo sapien
acaaatgccgtgacattggaacaag

SEQ ID NO: 224589 - DNA, 25 bp, Homo sapien
gccgtgacattggaacaaggtcatc

SEQ ID NO: 224590 - DNA, 25 bp, Homo sapien
actttctttacatacaggtcttcac

SEQ ID NO: 224591 - DNA, 25 bp, Homo sapien
ctttacatacaggtcttcacttttg

SEQ ID NO: 224592 - DNA, 25 bp, Homo sapien
gaaacagaattttgggcacacagcc

SEQ ID NO: 224593 - DNA, 25 bp, Homo sapien
ttttgggcacacagccagactacta

SEQ ID NO: 224594 - DNA, 25 bp, Homo sapien
cacagccagactactaacacatttc

SEQ ID NO: 224595 - DNA, 25 bp, Homo sapien
ttgttttttctcagaaactcaaaat

SEQ ID NO: 224596 - DNA, 25 bp, Homo sapien
agctggcagcagcactattccaaat

SEQ ID NO: 224597 - DNA, 25 bp, Homo sapien
ggcagcagcactattccaaattttc

SEQ ID NO: 224598 - DNA, 25 bp, Homo sapien
gcagcactattccaaattttcaaac

SEQ ID NO: 224599 - DNA, 25 bp, Homo sapien
tcaaacaagttttatttccatacaa

SEQ ID NO: 224600 - DNA, 25 bp, Homo sapien
ttccatacaattctgacatttccgt

SEQ ID NO: 224601 - DNA, 25 bp, Homo sapien
ggctttaaaaagactggatctcgaa

SEQ ID NO: 224602 - DNA, 25 bp, Homo sapien
aagattttcacaagacgcttccgaa

SEQ ID NO: 224603 - DNA, 25 bp, Homo sapien
gacgcttccgaaacagacgtttgag

SEQ ID NO: 224604 - DNA, 25 bp, Homo sapien
tttgagtcggaaaccttggagtgca

SEQ ID NO: 224605 - DNA, 25 bp, Homo sapien
ggagtgcagtgaacccgctgctcag

SEQ ID NO: 224606 - DNA, 25 bp, Homo sapien
gccacttaaacgtgctgtgcgacgt

SEQ ID NO: 224607 - DNA, 25 bp, Homo sapien
taaacgtgctgtgcgacgtgtctgg

SEQ ID NO: 224608 - DNA, 25 bp, Homo sapien
ggaaaggccccgtcactgcctgtga

SEQ ID NO: 224609 - DNA, 25 bp, Homo sapien
agcctgcagcctgacaagcggctag

SEQ ID NO: 224610 - DNA, 25 bp, Homo sapien
caagcggctagaaaacctcctgcag

SEQ ID NO: 224611 - DNA, 25 bp, Homo sapien
ctcctgcagcaagtgagtgccgagg

SEQ ID NO: 224612 - DNA, 25 bp, Homo sapien
aactgccctgctgacatcctgttag

SEQ ID NO: 224613 - DNA, 25 bp, Homo sapien
gctgacatcctgttaggtttcctag

SEQ ID NO: 224614 - DNA, 25 bp, Homo sapien
ttaggtttcctagcttaacatgtgg

SEQ ID NO: 224615 - DNA, 25 bp, Homo sapien
atatcaagcatatcgggcggcacca

SEQ ID NO: 224616 - DNA, 25 bp, Homo sapien
ggagtgagtcttttccacttacagt

SEQ ID NO: 224617 - DNA, 25 bp, Homo sapien
ttccacttacagtaggacccctttg

SEQ ID NO: 224618 - DNA, 25 bp, Homo sapien
gacccctttgcctcaatcaaaagtg

SEQ ID NO: 224619 - DNA, 25 bp, Homo sapien
tcaatcaaaagtgaccctacagttt

SEQ ID NO: 224620 - DNA, 25 bp, Homo sapien
tagctttagcttcttggcccaggaa

SEQ ID NO: 224621 - DNA, 25 bp, Homo sapien
ttttcctggcattcaggttctgtgc

SEQ ID NO: 224622 - DNA, 25 bp, Homo sapien
ggttctgtgctgaaaccacaaggga

SEQ ID NO: 224623 - DNA, 25 bp, Homo sapien
agtacaattacaacaagcatcaatg

SEQ ID NO: 224624 - DNA, 25 bp, Homo sapien
ttaatgagcagctgttaatttctga

SEQ ID NO: 224625 - DNA, 25 bp, Homo sapien
gagcagctgttaatttctgaagcag

SEQ ID NO: 224626 - DNA, 25 bp, Homo sapien
cagctgttaatttctgaagcagaaa

SEQ ID NO: 224627 - DNA, 25 bp, Homo sapien
aaaagtgaaggctaactgttagctc

SEQ ID NO: 224628 - DNA, 25 bp, Homo sapien
ctgttagctcaagaaatactttatg

SEQ ID NO: 224629 - DNA, 25 bp, Homo sapien
gaaatactttatgtttgtcctatat

SEQ ID NO: 224630 - DNA, 25 bp, Homo sapien
atactttatgtttgtcctatatgaa

SEQ ID NO: 224631 - DNA, 25 bp, Homo sapien
atgtttgtcctatatgaaagtgttg

SEQ ID NO: 224632 - DNA, 25 bp, Homo sapien
gaaagtgttgattgcacctggttct

SEQ ID NO: 224633 - DNA, 25 bp, Homo sapien
aagtgttgattgcacctggttcttt

SEQ ID NO: 224634 - DNA, 25 bp, Homo sapien
aaccaagtcttaagttttgattatg

SEQ ID NO: 224635 - DNA, 25 bp, Homo sapien
cttaagttttgattatgacatggga

SEQ ID NO: 224636 - DNA, 25 bp, Homo sapien
atgacatgggattagatgcaccaaa

SEQ ID NO: 224637 - DNA, 25 bp, Homo sapien
accctacaaggatcagaagctgcca

SEQ ID NO: 224638 - DNA, 25 bp, Homo sapien
gggcattctattgcctgagaatgtt

SEQ ID NO: 224639 - DNA, 25 bp, Homo sapien
attctattgcctgagaatgttcaag

SEQ ID NO: 224640 - DNA, 25 bp, Homo sapien
gagtcctgatatgacctgttgtttt

SEQ ID NO: 224641 - DNA, 25 bp, Homo sapien
atatgacctgttgtttttatcctaa

SEQ ID NO: 224642 - DNA, 25 bp, Homo sapien
ggaacaaggagaagacgctcccctt

SEQ ID NO: 224643 - DNA, 25 bp, Homo sapien
aaggagaagacgctccccttcctca

SEQ ID NO: 224644 - DNA, 25 bp, Homo sapien
cacatggcttctcagtcggggaaaa

SEQ ID NO: 224645 - DNA, 25 bp, Homo sapien
aaaagtatcccatgagaccattatg

SEQ ID NO: 224646 - DNA, 25 bp, Homo sapien
gaccattatgagcaggacacgacat

SEQ ID NO: 224647 - DNA, 25 bp, Homo sapien
ggacacgacattgtttcacaccttg

SEQ ID NO: 224648 - DNA, 25 bp, Homo sapien
ttgtttcacaccttgggctgtgact

SEQ ID NO: 224649 - DNA, 25 bp, Homo sapien
ggctgtgactatttacttctcggta

SEQ ID NO: 224650 - DNA, 25 bp, Homo sapien
ttacttctcggtacagattactctg

SEQ ID NO: 224651 - DNA, 25 bp, Homo sapien
gattactctggttaaatcactcagt

SEQ ID NO: 224652 - DNA, 25 bp, Homo sapien
gaaatcttttcatgctcacaatctg

SEQ ID NO: 224653 - DNA, 25 bp, Homo sapien
gctcacaatctgaacctgaaggcta

SEQ ID NO: 224654 - DNA, 25 bp, Homo sapien
actgaagagaattgcatctgacaac

SEQ ID NO: 224655 - DNA, 25 bp, Homo sapien
ttggttcttttaggccttaacagca

SEQ ID NO: 224656 - DNA, 25 bp, Homo sapien
agccacggtgatcggaatgcaagac

SEQ ID NO: 224657 - DNA, 25 bp, Homo sapien
gtgatcggaatgcaagactgcgaaa

SEQ ID NO: 224658 - DNA, 25 bp, Homo sapien
gggaggcttattcttccccagagat

SEQ ID NO: 224659 - DNA, 25 bp, Homo sapien
attcttccccagagatgccatttat

SEQ ID NO: 224660 - DNA, 25 bp, Homo sapien
cagcactggtaggattggcagcaga

SEQ ID NO: 224661 - DNA, 25 bp, Homo sapien
gattggttacgtcatgaagctggct

SEQ ID NO: 224662 - DNA, 25 bp, Homo sapien
tgaagctggctgaggaccgaagacc

SEQ ID NO: 224663 - DNA, 25 bp, Homo sapien
gaatatggctttcgagagacaccgt

SEQ ID NO: 224664 - DNA, 25 bp, Homo sapien
atggctttcgagagacaccgtctgg

SEQ ID NO: 224665 - DNA, 25 bp, Homo sapien
ctttcgagagacaccgtctgggcgg

SEQ ID NO: 224666 - DNA, 25 bp, Homo sapien
gaaagaacagaaaagccacggtgat

SEQ ID NO: 224667 - DNA, 25 bp, Homo sapien
aatggagcccaggacaatgctgtct

SEQ ID NO: 224668 - DNA, 25 bp, Homo sapien
atgctgtcttcaatgtccataccat

SEQ ID NO: 224669 - DNA, 25 bp, Homo sapien
aatgggaacccaagatctatgagcc

SEQ ID NO: 224670 - DNA, 25 bp, Homo sapien
atgtccataccattagacttgttat

SEQ ID NO: 224671 - DNA, 25 bp, Homo sapien
atgatggctttctggttaattaaac

SEQ ID NO: 224672 - DNA, 25 bp, Homo sapien
attaaaccttctgaatgattctgtg

SEQ ID NO: 224673 - DNA, 25 bp, Homo sapien
ttctgtgtaacactgacttctgtga

SEQ ID NO: 224674 - DNA, 25 bp, Homo sapien
ccttctttcatggagtattactgtt

SEQ ID NO: 224675 - DNA, 25 bp, Homo sapien
gatctatgagcccttatggcatatg

SEQ ID NO: 224676 - DNA, 25 bp, Homo sapien
gaactctagatgaaaccaggccttt

SEQ ID NO: 224677 - DNA, 25 bp, Homo sapien
aaccaggcctttcccaacaatggag

SEQ ID NO: 224678 - DNA, 25 bp, Homo sapien
ggagggcagatgtcctgggcaaacc

SEQ ID NO: 224679 - DNA, 25 bp, Homo sapien
ggcagatgtcctgggcaaaccgggc

SEQ ID NO: 224680 - DNA, 25 bp, Homo sapien
gatgtcctgggcaaaccgggcccct

SEQ ID NO: 224681 - DNA, 25 bp, Homo sapien
cacacacctcacttgatccttttgc

SEQ ID NO: 224682 - DNA, 25 bp, Homo sapien
gggaactggcttcccagttgcccct

SEQ ID NO: 224683 - DNA, 25 bp, Homo sapien
catattccaagtccccctcagactt

SEQ ID NO: 224684 - DNA, 25 bp, Homo sapien
agacttcatgtctctgctcatcagc

SEQ ID NO: 224685 - DNA, 25 bp, Homo sapien
gacttcatgtctctgctcatcagca

SEQ ID NO: 224686 - DNA, 25 bp, Homo sapien
acttcatgtctctgctcatcagcac

SEQ ID NO: 224687 - DNA, 25 bp, Homo sapien
gctcatcagcactgtcccaggatcc

SEQ ID NO: 224688 - DNA, 25 bp, Homo sapien
gggggtctcccgtttcctgtgcctg

SEQ ID NO: 224689 - DNA, 25 bp, Homo sapien
taccgtctacaattttcttatactt

SEQ ID NO: 224690 - DNA, 25 bp, Homo sapien
attttcttatactttgatctgtctt

SEQ ID NO: 224691 - DNA, 25 bp, Homo sapien
atactttgatctgtcttttatttga

SEQ ID NO: 224692 - DNA, 25 bp, Homo sapien
gtcttttatttgattgtaagttgct

SEQ ID NO: 224693 - DNA, 25 bp, Homo sapien
gttgctgatggacagtgatcattag

SEQ ID NO: 224694 - DNA, 25 bp, Homo sapien
tattgcgctcaggttatgttccttt

SEQ ID NO: 224695 - DNA, 25 bp, Homo sapien
tcaggttatgttccttttacctcct

SEQ ID NO: 224696 - DNA, 25 bp, Homo sapien
ttccaagtactgtctgcaccttatc

SEQ ID NO: 224697 - DNA, 25 bp, Homo sapien
aagtactgtctgcaccttatcccac

SEQ ID NO: 224698 - DNA, 25 bp, Homo sapien
ttatgagatagtgcaaaaccctagc

SEQ ID NO: 224699 - DNA, 25 bp, Homo sapien
gtgcaaaaccctagcacagtctttt

SEQ ID NO: 224700 - DNA, 25 bp, Homo sapien
gcaagatggcctatttcagctgctt

SEQ ID NO: 224701 - DNA, 25 bp, Homo sapien
gcctatttcagctgcttttgacgaa

SEQ ID NO: 224702 - DNA, 25 bp, Homo sapien
tgacgaaaatgactggctccctgac

SEQ ID NO: 224703 - DNA, 25 bp, Homo sapien
gctccctgacttaacgttctataca

SEQ ID NO: 224704 - DNA, 25 bp, Homo sapien
tgtgctgaagcaaagtgcccatggt

SEQ ID NO: 224705 - DNA, 25 bp, Homo sapien
cccttccaatgctgtgggtttccaa

SEQ ID NO: 224706 - DNA, 25 bp, Homo sapien
ggaagggtcccttttgcattgccaa

SEQ ID NO: 224707 - DNA, 25 bp, Homo sapien
gcattgccaagtgccataaccatga

SEQ ID NO: 224708 - DNA, 25 bp, Homo sapien
ataaccatgagcactactctaccat

SEQ ID NO: 224709 - DNA, 25 bp, Homo sapien
tgagcactactctaccatggttctg

SEQ ID NO: 224710 - DNA, 25 bp, Homo sapien
ggccaagcaggctggtttgcaagaa

SEQ ID NO: 224711 - DNA, 25 bp, Homo sapien
gggcaagtgatgtgtaactgctcaa

SEQ ID NO: 224712 - DNA, 25 bp, Homo sapien
gagatgcttaaacctccatagagag

SEQ ID NO: 224713 - DNA, 25 bp, Homo sapien
gggcatctgtgtgtcccgtcacaca

SEQ ID NO: 224714 - DNA, 25 bp, Homo sapien
ccctggcatcagtggtttggtttaa

SEQ ID NO: 224715 - DNA, 25 bp, Homo sapien
ttattgccattgtcttttcctctgc

SEQ ID NO: 224716 - DNA, 25 bp, Homo sapien
ttgagccagcctaaggccctggagt

SEQ ID NO: 224717 - DNA, 25 bp, Homo sapien
ctggagtctgtttctttaggcggat

SEQ ID NO: 224718 - DNA, 25 bp, Homo sapien
ggatgaactgacatgctcctaccat

SEQ ID NO: 224719 - DNA, 25 bp, Homo sapien
gctcctaccatgaccaggctctggg

SEQ ID NO: 224720 - DNA, 25 bp, Homo sapien
aggctctgggcaaggctcctcacag

SEQ ID NO: 224721 - DNA, 25 bp, Homo sapien
aggctcctcacagtatccttgagag

SEQ ID NO: 224722 - DNA, 25 bp, Homo sapien
aatccgtgcaaatggctgtctcggg

SEQ ID NO: 224723 - DNA, 25 bp, Homo sapien
caaatggctgtctcgggttttcata

SEQ ID NO: 224724 - DNA, 25 bp, Homo sapien
ggctgtctcgggttttcatagaaca

SEQ ID NO: 224725 - DNA, 25 bp, Homo sapien
tctcgggttttcatagaacaagacg

SEQ ID NO: 224726 - DNA, 25 bp, Homo sapien
aggctgccaaggcatcactgggcat

SEQ ID NO: 224727 - DNA, 25 bp, Homo sapien
caaggcatcactgggcatctactta

SEQ ID NO: 224728 - DNA, 25 bp, Homo sapien
gggcatctacttaacactgaccaga

SEQ ID NO: 224729 - DNA, 25 bp, Homo sapien
acttaacactgaccagaggatgtga

SEQ ID NO: 224730 - DNA, 25 bp, Homo sapien
tttgattccacagttcttcttgact

SEQ ID NO: 224731 - DNA, 25 bp, Homo sapien
tccacagttcttcttgactttttga

SEQ ID NO: 224732 - DNA, 25 bp, Homo sapien
gactttttgatttcatcagaaacct

SEQ ID NO: 224733 - DNA, 25 bp, Homo sapien
tccaaagatttactttcccatccgt

SEQ ID NO: 224734 - DNA, 25 bp, Homo sapien
aagatttactttcccatccgtgact

SEQ ID NO: 224735 - DNA, 25 bp, Homo sapien
gtgactcctggaatgcaggcatcat

SEQ ID NO: 224736 - DNA, 25 bp, Homo sapien
ggaatgcaggcatcatgacggtgat

SEQ ID NO: 224737 - DNA, 25 bp, Homo sapien
atgacggtgatgtcagctctgtcgg

SEQ ID NO: 224738 - DNA, 25 bp, Homo sapien
ccaaggcccgcgagtactccaagga

SEQ ID NO: 224739 - DNA, 25 bp, Homo sapien
ggctgggagtatgtgaaggcgcgca

SEQ ID NO: 224740 - DNA, 25 bp, Homo sapien
aaggcgcgcaccaagtagcgagtca

SEQ ID NO: 224741 - DNA, 25 bp, Homo sapien
gcgcaccaagtagcgagtcagcagg

SEQ ID NO: 224742 - DNA, 25 bp, Homo sapien
actgacctgaagactccggactggg

SEQ ID NO: 224743 - DNA, 25 bp, Homo sapien
tgaagactccggactgggaccccac

SEQ ID NO: 224744 - DNA, 25 bp, Homo sapien
ggggtctccctctccatctccccag

SEQ ID NO: 224745 - DNA, 25 bp, Homo sapien
gggtctccctctccatctccccagt

SEQ ID NO: 224746 - DNA, 25 bp, Homo sapien
ggtctccctctccatctccccagtg

SEQ ID NO: 224747 - DNA, 25 bp, Homo sapien
gtctccctctccatctccccagtgg

SEQ ID NO: 224748 - DNA, 25 bp, Homo sapien
tctccctctccatctccccagtggc

SEQ ID NO: 224749 - DNA, 25 bp, Homo sapien
ctccctctccatctccccagtggcc

SEQ ID NO: 224750 - DNA, 25 bp, Homo sapien
tccctctccatctccccagtggcct

SEQ ID NO: 224751 - DNA, 25 bp, Homo sapien
ggtggggcgccaggatggctcctgg

SEQ ID NO: 224752 - DNA, 25 bp, Homo sapien
gtggggcgccaggatggctcctggg

SEQ ID NO: 224753 - DNA, 25 bp, Homo sapien
agtggcagtctgcacaacctagaag

SEQ ID NO: 224754 - DNA, 25 bp, Homo sapien
tgcacaacctagaagtggccagaag

SEQ ID NO: 224755 - DNA, 25 bp, Homo sapien
tcacaggcatggcacggaggcaaaa

SEQ ID NO: 224756 - DNA, 25 bp, Homo sapien
agaagggttgagacacgcccctgcc

SEQ ID NO: 224757 - DNA, 25 bp, Homo sapien
ggcttctacaagacaagcagataac

SEQ ID NO: 224758 - DNA, 25 bp, Homo sapien
gataacgatagaatcttgggcatct

SEQ ID NO: 224759 - DNA, 25 bp, Homo sapien
aatcttgggcatcttggctttcgga

SEQ ID NO: 224760 - DNA, 25 bp, Homo sapien
ttggctttcggattctcagtgtgga

SEQ ID NO: 224761 - DNA, 25 bp, Homo sapien
tggagggacgtagtaccccacacac

SEQ ID NO: 224762 - DNA, 25 bp, Homo sapien
ctgctgatctgacagtccatcgtag

SEQ ID NO: 224763 - DNA, 25 bp, Homo sapien
gacagtccatcgtagtaacaagagt

SEQ ID NO: 224764 - DNA, 25 bp, Homo sapien
ctgggtctgtgtccccgtcgctaca

SEQ ID NO: 224765 - DNA, 25 bp, Homo sapien
catggcccagcggttgcataggtcc

SEQ ID NO: 224766 - DNA, 25 bp, Homo sapien
agcggttgcataggtccctcggttt

SEQ ID NO: 224767 - DNA, 25 bp, Homo sapien
ataggtccctcggtttctgcagagc

SEQ ID NO: 224768 - DNA, 25 bp, Homo sapien
ggtttctgcagagcccgggagtcac

SEQ ID NO: 224769 - DNA, 25 bp, Homo sapien
agagcccgggagtcaccctattttg

SEQ ID NO: 224770 - DNA, 25 bp, Homo sapien
gagtcaccctattttggtaaaggtg

SEQ ID NO: 224771 - DNA, 25 bp, Homo sapien
ggtaaaggtgaattgctcctccatg

SEQ ID NO: 224772 - DNA, 25 bp, Homo sapien
aattgctcctccatgggtcgtgaaa

SEQ ID NO: 224773 - DNA, 25 bp, Homo sapien
gctcctccatgggtcgtgaaagaag

SEQ ID NO: 224774 - DNA, 25 bp, Homo sapien
ggtcgtgaaagaagatcatgtcagt

SEQ ID NO: 224775 - DNA, 25 bp, Homo sapien
tgcacggtccgtgttctgcaagggt

SEQ ID NO: 224776 - DNA, 25 bp, Homo sapien
tccgtgttctgcaagggtgatgatc

SEQ ID NO: 224777 - DNA, 25 bp, Homo sapien
caagggtgatgatccagggcctgcc

SEQ ID NO: 224778 - DNA, 25 bp, Homo sapien
atgatccagggcctgccgtgtccgt

SEQ ID NO: 224779 - DNA, 25 bp, Homo sapien
tgccgtgtccgtgagggtccctggg

SEQ ID NO: 224780 - DNA, 25 bp, Homo sapien
gtgccccgtccacaggcaggacaag

SEQ ID NO: 224781 - DNA, 25 bp, Homo sapien
gagaagccgtacctgtgccagcagt

SEQ ID NO: 224782 - DNA, 25 bp, Homo sapien
tttgcccacaactacgacctgaaga

SEQ ID NO: 224783 - DNA, 25 bp, Homo sapien
cgacctgaagaaccacatgcgcgtg

SEQ ID NO: 224784 - DNA, 25 bp, Homo sapien
gaagaaccacatgcgcgtgcacacg

SEQ ID NO: 224785 - DNA, 25 bp, Homo sapien
agctgctgcaagaccttcgtccgct

SEQ ID NO: 224786 - DNA, 25 bp, Homo sapien
aggaagctcctcaaaggaccatctc

SEQ ID NO: 224787 - DNA, 25 bp, Homo sapien
atctccaaggcctagatcctggtga

SEQ ID NO: 224788 - DNA, 25 bp, Homo sapien
gcctagatcctggtgagccaaataa

SEQ ID NO: 224789 - DNA, 25 bp, Homo sapien
gaaaatagtacgttcctcaggaggc

SEQ ID NO: 224790 - DNA, 25 bp, Homo sapien
ttcctcaggaggcagaatggacgca

SEQ ID NO: 224791 - DNA, 25 bp, Homo sapien
agaatggacgcacctgcttcagggt

SEQ ID NO: 224792 - DNA, 25 bp, Homo sapien
agggtctgcctgtagcggcctgaac

SEQ ID NO: 224793 - DNA, 25 bp, Homo sapien
tagcggcctgaacaagcaggagcct

SEQ ID NO: 224794 - DNA, 25 bp, Homo sapien
tagccatgggtctgagacagaagac

SEQ ID NO: 224795 - DNA, 25 bp, Homo sapien
gaagccttcccagcaagaaagaacg

SEQ ID NO: 224796 - DNA, 25 bp, Homo sapien
gaaagaacgatctgggaagtcccac

SEQ ID NO: 224797 - DNA, 25 bp, Homo sapien
gcattcatgagccacaatgtctgaa

SEQ ID NO: 224798 - DNA, 25 bp, Homo sapien
atggctctcacatcgacagaccaca

SEQ ID NO: 224799 - DNA, 25 bp, Homo sapien
gaccattactgccaaaggcttctat

SEQ ID NO: 224800 - DNA, 25 bp, Homo sapien
gcttctatgatcttgatgctttaaa

SEQ ID NO: 224801 - DNA, 25 bp, Homo sapien
tgaagctgcttggacaagtgcccac

SEQ ID NO: 224802 - DNA, 25 bp, Homo sapien
ggacaagtgcccacagccagttggt

SEQ ID NO: 224803 - DNA, 25 bp, Homo sapien
acagccagttggttccctgtaatgt

SEQ ID NO: 224804 - DNA, 25 bp, Homo sapien
cagaccacaacactaagccaacaat

SEQ ID NO: 224805 - DNA, 25 bp, Homo sapien
aatgatacggcgtccaccagcagtt

SEQ ID NO: 224806 - DNA, 25 bp, Homo sapien
caccagcagttgtttgctacatttg

SEQ ID NO: 224807 - DNA, 25 bp, Homo sapien
tgctacatttgtggtcgtgaatatg

SEQ ID NO: 224808 - DNA, 25 bp, Homo sapien
ttgccctaacaactcactgcagtgc

SEQ ID NO: 224809 - DNA, 25 bp, Homo sapien
tcactgcagtgctcttcatagacac

SEQ ID NO: 224810 - DNA, 25 bp, Homo sapien
agacacatcttgcagcatttttctt

SEQ ID NO: 224811 - DNA, 25 bp, Homo sapien
tcttaaggctatgcttcagtttttc

SEQ ID NO: 224812 - DNA, 25 bp, Homo sapien
tttgtaagccatcacaagccatagt

SEQ ID NO: 224813 - DNA, 25 bp, Homo sapien
aagccatagtggtaggtttgccctt

SEQ ID NO: 224814 - DNA, 25 bp, Homo sapien
gtaggtttgccctttggtacagaag

SEQ ID NO: 224815 - DNA, 25 bp, Homo sapien
ggaaaaggcttattgcattgcattc

SEQ ID NO: 224816 - DNA, 25 bp, Homo sapien
gcattgcattcagagtaacctgtgt

SEQ ID NO: 224817 - DNA, 25 bp, Homo sapien
gagtaacctgtgtgcatactctaga

SEQ ID NO: 224818 - DNA, 25 bp, Homo sapien
gcttgttacaattcgacctaatatg

SEQ ID NO: 224819 - DNA, 25 bp, Homo sapien
gttaacagttgctttatgacataat

SEQ ID NO: 224820 - DNA, 25 bp, Homo sapien
tatgacataataagtggctggtttt

SEQ ID NO: 224821 - DNA, 25 bp, Homo sapien
ggatgcttgaaaagagttctacagt

SEQ ID NO: 224822 - DNA, 25 bp, Homo sapien
gagttctacagttatttatgttcat

SEQ ID NO: 224823 - DNA, 25 bp, Homo sapien
aatcattttagtcatgttcattaat

SEQ ID NO: 224824 - DNA, 25 bp, Homo sapien
ttcattaattttcaagtcttcagta

SEQ ID NO: 224825 - DNA, 25 bp, Homo sapien
caagtcttcagtatccttagtgatg

SEQ ID NO: 224826 - DNA, 25 bp, Homo sapien
gtcttcagtatccttagtgatgatt

SEQ ID NO: 224827 - DNA, 25 bp, Homo sapien
ttttgtttttggtatatatctcttg

SEQ ID NO: 224828 - DNA, 25 bp, Homo sapien
tggtatatatctcttgattactaag

SEQ ID NO: 224829 - DNA, 25 bp, Homo sapien
gtgatcagatgatatattctctata

SEQ ID NO: 224830 - DNA, 25 bp, Homo sapien
taaatagcaatagggtctttcctcc

SEQ ID NO: 224831 - DNA, 25 bp, Homo sapien
aatagcaatagggtctttcctcctt

SEQ ID NO: 224832 - DNA, 25 bp, Homo sapien
atagcaatagggtctttcctccttt

SEQ ID NO: 224833 - DNA, 25 bp, Homo sapien
tagcaatagggtctttcctcctttc

SEQ ID NO: 224834 - DNA, 25 bp, Homo sapien
agcaatagggtctttcctcctttct

SEQ ID NO: 224835 - DNA, 25 bp, Homo sapien
gcaatagggtctttcctcctttctc

SEQ ID NO: 224836 - DNA, 25 bp, Homo sapien
ctcctttctccactccaatggttta

SEQ ID NO: 224837 - DNA, 25 bp, Homo sapien
actccaatggtttaatgggatagag

SEQ ID NO: 224838 - DNA, 25 bp, Homo sapien
ctccaatggtttaatgggatagagg

SEQ ID NO: 224839 - DNA, 25 bp, Homo sapien
ccaatggtttaatgggatagaggaa

SEQ ID NO: 224840 - DNA, 25 bp, Homo sapien
ggatagaggaatcaatgtttatatt

SEQ ID NO: 224841 - DNA, 25 bp, Homo sapien
catctgtgtaagtgaagggactcat

SEQ ID NO: 224842 - DNA, 25 bp, Homo sapien
tgtaagtgaagggactcatttttct

SEQ ID NO: 224843 - DNA, 25 bp, Homo sapien
ttctttgctttcagcccatgtaaat

SEQ ID NO: 224844 - DNA, 25 bp, Homo sapien
tgctttcagcccatgtaaataaata

SEQ ID NO: 224845 - DNA, 25 bp, Homo sapien
attaacattttcgtgctgcttccca

SEQ ID NO: 224846 - DNA, 25 bp, Homo sapien
acattttcgtgctgcttcccattag

SEQ ID NO: 224847 - DNA, 25 bp, Homo sapien
gcttcccattagcttgtagattgag

SEQ ID NO: 224848 - DNA, 25 bp, Homo sapien
tagcttgtagattgagccatactct

SEQ ID NO: 224849 - DNA, 25 bp, Homo sapien
agattgagccatactctggctgcct

SEQ ID NO: 224850 - DNA, 25 bp, Homo sapien
attttctttaacttccagaatagtg

SEQ ID NO: 224851 - DNA, 25 bp, Homo sapien
taaaccttacttacaagcataacag

SEQ ID NO: 224852 - DNA, 25 bp, Homo sapien
tagtattcacacttttaagtattat

SEQ ID NO: 224853 - DNA, 25 bp, Homo sapien
agcatcctgggatttgagtatctat

SEQ ID NO: 224854 - DNA, 25 bp, Homo sapien
atcctgggatttgagtatctatggg

SEQ ID NO: 224855 - DNA, 25 bp, Homo sapien
gatttgagtatctatgggggtccta

SEQ ID NO: 224856 - DNA, 25 bp, Homo sapien
gtcctagaaccaatctccctcaggt

SEQ ID NO: 224857 - DNA, 25 bp, Homo sapien
tagaaccaatctccctcaggtaccg

SEQ ID NO: 224858 - DNA, 25 bp, Homo sapien
tgctattgtacctagctgggcaacg

SEQ ID NO: 224859 - DNA, 25 bp, Homo sapien
tattgtacctagctgggcaacgagt

SEQ ID NO: 224860 - DNA, 25 bp, Homo sapien
ttgtacctagctgggcaacgagtga

SEQ ID NO: 224861 - DNA, 25 bp, Homo sapien
acctagctgggcaacgagtgagacc

SEQ ID NO: 224862 - DNA, 25 bp, Homo sapien
cctagctgggcaacgagtgagacct

SEQ ID NO: 224863 - DNA, 25 bp, Homo sapien
gcgagaagccgtacctgtgccagca

SEQ ID NO: 224864 - DNA, 25 bp, Homo sapien
ctgtgccagcagtgcggcgccgcct

SEQ ID NO: 224865 - DNA, 25 bp, Homo sapien
tttgcccacaactacgacctgaaga

SEQ ID NO: 224866 - DNA, 25 bp, Homo sapien
ttgcccacaactacgacctgaagaa

SEQ ID NO: 224867 - DNA, 25 bp, Homo sapien
tgcccacaactacgacctgaagaac

SEQ ID NO: 224868 - DNA, 25 bp, Homo sapien
cgacctgaagaaccacatgcgcgtg

SEQ ID NO: 224869 - DNA, 25 bp, Homo sapien
acctgaagaaccacatgcgcgtgca

SEQ ID NO: 224870 - DNA, 25 bp, Homo sapien
ctgaagaaccacatgcgcgtgcaca

SEQ ID NO: 224871 - DNA, 25 bp, Homo sapien
tgaagaaccacatgcgcgtgcacac

SEQ ID NO: 224872 - DNA, 25 bp, Homo sapien
gcccctaccagtgcgacagctgctg

SEQ ID NO: 224873 - DNA, 25 bp, Homo sapien
agctgctgcaagaccttcgtccgct

SEQ ID NO: 224874 - DNA, 25 bp, Homo sapien
ctgagtctaggcctaaagttcttgt

SEQ ID NO: 224875 - DNA, 25 bp, Homo sapien
ctaggcctaaagttcttgtgtgtgt

SEQ ID NO: 224876 - DNA, 25 bp, Homo sapien
gtgtgtttttcagtgctgatctgat

SEQ ID NO: 224877 - DNA, 25 bp, Homo sapien
ttaatttagcattgcatggaaacag

SEQ ID NO: 224878 - DNA, 25 bp, Homo sapien
aaacatacataatgggtggaggcat

SEQ ID NO: 224879 - DNA, 25 bp, Homo sapien
gaagcatattgtagtggccttttaa

SEQ ID NO: 224880 - DNA, 25 bp, Homo sapien
tgcattttgtcttaatcatttatat

SEQ ID NO: 224881 - DNA, 25 bp, Homo sapien
tgaattcttaatgccatatttacac

SEQ ID NO: 224882 - DNA, 25 bp, Homo sapien
atgccatatttacacttaaaacttg

SEQ ID NO: 224883 - DNA, 25 bp, Homo sapien
aaaacttgatgtcactatgcctgag

SEQ ID NO: 224884 - DNA, 25 bp, Homo sapien
tgatgtcactatgcctgagtctagg

SEQ ID NO: 224885 - DNA, 25 bp, Homo sapien
cctcttgatgtctgggatggcacgt

SEQ ID NO: 224886 - DNA, 25 bp, Homo sapien
tgggatggcacgtggcccgacctcc

SEQ ID NO: 224887 - DNA, 25 bp, Homo sapien
gcttacacgacaacgggccagacca

SEQ ID NO: 224888 - DNA, 25 bp, Homo sapien
tggccacagtgaacacccacgttta

SEQ ID NO: 224889 - DNA, 25 bp, Homo sapien
agtgaacacccacgtttattcctgc

SEQ ID NO: 224890 - DNA, 25 bp, Homo sapien
gaacacccacgtttattcctgcctg

SEQ ID NO: 224891 - DNA, 25 bp, Homo sapien
cttctccacacctgaacagttggct

SEQ ID NO: 224892 - DNA, 25 bp, Homo sapien
acacctgaacagttggctcaagggc

SEQ ID NO: 224893 - DNA, 25 bp, Homo sapien
acagttggctcaagggccaccagaa

SEQ ID NO: 224894 - DNA, 25 bp, Homo sapien
tattattttttaacctggacatgca

SEQ ID NO: 224895 - DNA, 25 bp, Homo sapien
taacctggacatgcattaaagggtc

SEQ ID NO: 224896 - DNA, 25 bp, Homo sapien
tatccagtgtgataatcttttcacg

SEQ ID NO: 224897 - DNA, 25 bp, Homo sapien
gtgtgataatcttttcacgttttat

SEQ ID NO: 224898 - DNA, 25 bp, Homo sapien
atcttttcacgttttatagagcaaa

SEQ ID NO: 224899 - DNA, 25 bp, Homo sapien
gcaaagacagagcagttactcttca

SEQ ID NO: 224900 - DNA, 25 bp, Homo sapien
cagagcagttactcttcatattgca

SEQ ID NO: 224901 - DNA, 25 bp, Homo sapien
agctgccagagctcaggcgagccat

SEQ ID NO: 224902 - DNA, 25 bp, Homo sapien
acccactgtgtgtctgggtccttga

SEQ ID NO: 224903 - DNA, 25 bp, Homo sapien
cactgtgtgtctgggtccttgaggt

SEQ ID NO: 224904 - DNA, 25 bp, Homo sapien
gtgtctgggtccttgaggtttgtac

SEQ ID NO: 224905 - DNA, 25 bp, Homo sapien
gtccttgaggtttgtacgtttctct

SEQ ID NO: 224906 - DNA, 25 bp, Homo sapien
gtttgtacgtttctctttgatgacc

SEQ ID NO: 224907 - DNA, 25 bp, Homo sapien
aggtaggtagcattactcttgatga

SEQ ID NO: 224908 - DNA, 25 bp, Homo sapien
attactcttgatgatgcaggcatga

SEQ ID NO: 224909 - DNA, 25 bp, Homo sapien
ctcgagccccttgaaatgctatttg

SEQ ID NO: 224910 - DNA, 25 bp, Homo sapien
ggaatgctatcaaaacaccagtgct

SEQ ID NO: 224911 - DNA, 25 bp, Homo sapien
acaccagtgctctttgagagaatgg

SEQ ID NO: 224912 - DNA, 25 bp, Homo sapien
cagcctttggctgggaatggttgtt

SEQ ID NO: 224913 - DNA, 25 bp, Homo sapien
aaagggtctcactgtgaatgtcacc

SEQ ID NO: 224914 - DNA, 25 bp, Homo sapien
tgggaatggttgttcacgcctataa

SEQ ID NO: 224915 - DNA, 25 bp, Homo sapien
gtcacccaggctagctattttcaaa

SEQ ID NO: 224916 - DNA, 25 bp, Homo sapien
aacatttattgctttggaaccagag

SEQ ID NO: 224917 - DNA, 25 bp, Homo sapien
ggaaccagagcccatatgtggataa

SEQ ID NO: 224918 - DNA, 25 bp, Homo sapien
gggtccacggtcaggagccctcgga

SEQ ID NO: 224919 - DNA, 25 bp, Homo sapien
aggagccctcggaccagctccttgg

SEQ ID NO: 224920 - DNA, 25 bp, Homo sapien
ttggcttcctcggatacaccctgcc

SEQ ID NO: 224921 - DNA, 25 bp, Homo sapien
caggcctccccgtcaagggagaagc

SEQ ID NO: 224922 - DNA, 25 bp, Homo sapien
cgtcaagggagaagcgcccctcgcg

SEQ ID NO: 224923 - DNA, 25 bp, Homo sapien
agaagcgcccctcgcggattttgca

SEQ ID NO: 224924 - DNA, 25 bp, Homo sapien
gcccctcgcggattttgcacatgat

SEQ ID NO: 224925 - DNA, 25 bp, Homo sapien
ctcgcggattttgcacatgatctcg

SEQ ID NO: 224926 - DNA, 25 bp, Homo sapien
gcggattttgcacatgatctcggcc

SEQ ID NO: 224927 - DNA, 25 bp, Homo sapien
ggattttgcacatgatctcggccgc

SEQ ID NO: 224928 - DNA, 25 bp, Homo sapien
attttgcacatgatctcggccgcct

SEQ ID NO: 224929 - DNA, 25 bp, Homo sapien
cgccctggattcctagagactagct

SEQ ID NO: 224930 - DNA, 25 bp, Homo sapien
gagaggaccggccacctgtccagca

SEQ ID NO: 224931 - DNA, 25 bp, Homo sapien
cacctgtccagcatgggctccagag

SEQ ID NO: 224932 - DNA, 25 bp, Homo sapien
tcacagggcagagctcttgtcggca

SEQ ID NO: 224933 - DNA, 25 bp, Homo sapien
ctggccagtttctctgctcagtgtt

SEQ ID NO: 224934 - DNA, 25 bp, Homo sapien
ttctctgctcagtgttctggtagca

SEQ ID NO: 224935 - DNA, 25 bp, Homo sapien
ggtagcagagctcagagccaactgt

SEQ ID NO: 224936 - DNA, 25 bp, Homo sapien
agagccaactgtttacctcttggtt

SEQ ID NO: 224937 - DNA, 25 bp, Homo sapien
cctcttggttgtccccgtgaagaag

SEQ ID NO: 224938 - DNA, 25 bp, Homo sapien
gaagaagccttcaaaccctgcacca

SEQ ID NO: 224939 - DNA, 25 bp, Homo sapien
gcaccataaatacatgtgtccatat

SEQ ID NO: 224940 - DNA, 25 bp, Homo sapien
tatcacctgggcttcaaggctttat

SEQ ID NO: 224941 - DNA, 25 bp, Homo sapien
cacctgggcttcaaggctttatcat

SEQ ID NO: 224942 - DNA, 25 bp, Homo sapien
gggcttcaaggctttatcattatct

SEQ ID NO: 224943 - DNA, 25 bp, Homo sapien
caaggctttatcattatctgaaatt

SEQ ID NO: 224944 - DNA, 25 bp, Homo sapien
tttattgtctatgtccactcctgta

SEQ ID NO: 224945 - DNA, 25 bp, Homo sapien
attgtctatgtccactcctgtagaa

SEQ ID NO: 224946 - DNA, 25 bp, Homo sapien
gtctatgtccactcctgtagaatgt

SEQ ID NO: 224947 - DNA, 25 bp, Homo sapien
tatgtccactcctgtagaatgtaat

SEQ ID NO: 224948 - DNA, 25 bp, Homo sapien
catggcagcagggactttgtataac

SEQ ID NO: 224949 - DNA, 25 bp, Homo sapien
ggcagcagggactttgtataacaat

SEQ ID NO: 224950 - DNA, 25 bp, Homo sapien
gggactataacatagaagctgttca

SEQ ID NO: 224951 - DNA, 25 bp, Homo sapien
aagtttgttttccaggtgagatgac

SEQ ID NO: 224952 - DNA, 25 bp, Homo sapien
tgttttccaggtgagatgacatttt

SEQ ID NO: 224953 - DNA, 25 bp, Homo sapien
tatgtgcttttatatccggaccagg

SEQ ID NO: 224954 - DNA, 25 bp, Homo sapien
gtgcttttatatccggaccaggttt

SEQ ID NO: 224955 - DNA, 25 bp, Homo sapien
tatatccggaccaggtttctcaagg

SEQ ID NO: 224956 - DNA, 25 bp, Homo sapien
ccggaccaggtttctcaaggaagca

SEQ ID NO: 224957 - DNA, 25 bp, Homo sapien
accaggtttctcaaggaagcagaat

SEQ ID NO: 224958 - DNA, 25 bp, Homo sapien
ccaagagaaacctcggctcctaagt

SEQ ID NO: 224959 - DNA, 25 bp, Homo sapien
gagaaacctcggctcctaagtgctc

SEQ ID NO: 224960 - DNA, 25 bp, Homo sapien
tgggctgcctctcgctgaatagctg

SEQ ID NO: 224961 - DNA, 25 bp, Homo sapien
tgcctctcgctgaatagctgcaggg

SEQ ID NO: 224962 - DNA, 25 bp, Homo sapien
ccaccaccccatcgctgggtttcgg

SEQ ID NO: 224963 - DNA, 25 bp, Homo sapien
caccaccccatcgctgggtttcggg

SEQ ID NO: 224964 - DNA, 25 bp, Homo sapien
cccatcgctgggtttcggggcttgg

SEQ ID NO: 224965 - DNA, 25 bp, Homo sapien
catcgctgggtttcggggcttggtt

SEQ ID NO: 224966 - DNA, 25 bp, Homo sapien
ttttttgtaggacacaaggaatccg

SEQ ID NO: 224967 - DNA, 25 bp, Homo sapien
tttttgtaggacacaaggaatccga

SEQ ID NO: 224968 - DNA, 25 bp, Homo sapien
gcacagccccctgggcacccggcat

SEQ ID NO: 224969 - DNA, 25 bp, Homo sapien
gggcccgatccgaggccctgggctg

SEQ ID NO: 224970 - DNA, 25 bp, Homo sapien
gcttttaatttcctcccctcgctgg

SEQ ID NO: 224971 - DNA, 25 bp, Homo sapien
tcctcccctcgctggttttctatga

SEQ ID NO: 224972 - DNA, 25 bp, Homo sapien
tgatttctgtctgctctgaacggaa

SEQ ID NO: 224973 - DNA, 25 bp, Homo sapien
cagacccctcggagagctttctgct

SEQ ID NO: 224974 - DNA, 25 bp, Homo sapien
ccatcagcagcttgctttctgggaa

SEQ ID NO: 224975 - DNA, 25 bp, Homo sapien
cagcagcttgctttctgggaacctt

SEQ ID NO: 224976 - DNA, 25 bp, Homo sapien
ttctgggaaccttttatctgcctta

SEQ ID NO: 224977 - DNA, 25 bp, Homo sapien
tgggaaccttttatctgccttactc

SEQ ID NO: 224978 - DNA, 25 bp, Homo sapien
tatctgccttactcccctttaaaca

SEQ ID NO: 224979 - DNA, 25 bp, Homo sapien
ttaaacacctgcggcatcgtcacat

SEQ ID NO: 224980 - DNA, 25 bp, Homo sapien
tttaaaacacctgcggcattgtcac

SEQ ID NO: 224981 - DNA, 25 bp, Homo sapien
gcggcattgtcacttggcttgtgat

SEQ ID NO: 224982 - DNA, 25 bp, Homo sapien
acttggcttgtgattaccatttcgt

SEQ ID NO: 224983 - DNA, 25 bp, Homo sapien
gtgatgcccaggtcatcctcgggag

SEQ ID NO: 224984 - DNA, 25 bp, Homo sapien
agatggcatacagcagttctgtgat

SEQ ID NO: 224985 - DNA, 25 bp, Homo sapien
agttctgtgatgacctggcactcga

SEQ ID NO: 224986 - DNA, 25 bp, Homo sapien
actcgatccagccagcattagtgtg

SEQ ID NO: 224987 - DNA, 25 bp, Homo sapien
ccagccagcattagtgtgttgatta

SEQ ID NO: 224988 - DNA, 25 bp, Homo sapien
gcagcaacacagtgcgagttctcca

SEQ ID NO: 224989 - DNA, 25 bp, Homo sapien
acagtgcgagttctccaaacaggag

SEQ ID NO: 224990 - DNA, 25 bp, Homo sapien
caaacaggagttcatggatggcatg

SEQ ID NO: 224991 - DNA, 25 bp, Homo sapien
atggatggcatgacagaattaggat

SEQ ID NO: 224992 - DNA, 25 bp, Homo sapien
aactaaaggcccagatacccaagat

SEQ ID NO: 224993 - DNA, 25 bp, Homo sapien
ggcccagatacccaagatggaacaa

SEQ ID NO: 224994 - DNA, 25 bp, Homo sapien
gaaagaaccaggacgatttaaggat

SEQ ID NO: 224995 - DNA, 25 bp, Homo sapien
agctctgcgtgcatggtgaccagca

SEQ ID NO: 224996 - DNA, 25 bp, Homo sapien
gaaagcacaggctgcctagctggag

SEQ ID NO: 224997 - DNA, 25 bp, Homo sapien
tggaggcacagtttccttgttggaa

SEQ ID NO: 224998 - DNA, 25 bp, Homo sapien
gtttctggcacatagccgggccttg

SEQ ID NO: 224999 - DNA, 25 bp, Homo sapien
atagccgggccttgtcatttaaagc

SEQ ID NO: 225000 - DNA, 25 bp, Homo sapien
cgggccttgtcatttaaagccattg

SEQ ID NO: 225001 - DNA, 25 bp, Homo sapien
gccattgtaaataactgggctactc

SEQ ID NO: 225002 - DNA, 25 bp, Homo sapien
gggccaccctgcctataggatagcc

SEQ ID NO: 225003 - DNA, 25 bp, Homo sapien
tgcctataggatagccctgctctgt

SEQ ID NO: 225004 - DNA, 25 bp, Homo sapien
tctgtctatggagcaagcagctgtt

SEQ ID NO: 225005 - DNA, 25 bp, Homo sapien
gagcaagcagctgttttactatata

SEQ ID NO: 225006 - DNA, 25 bp, Homo sapien
gacattggctgcaaacggtcagaga

SEQ ID NO: 225007 - DNA, 25 bp, Homo sapien
aaacggtcagagaggaacccagtca

SEQ ID NO: 225008 - DNA, 25 bp, Homo sapien
gaggaacccagtcaggtaccattga

SEQ ID NO: 225009 - DNA, 25 bp, Homo sapien
gtaccattgagggtggtcagatatt

SEQ ID NO: 225010 - DNA, 25 bp, Homo sapien
caaattagggttcttgctaaaactg

SEQ ID NO: 225011 - DNA, 25 bp, Homo sapien
aagagggccctaggagaagattcca

SEQ ID NO: 225012 - DNA, 25 bp, Homo sapien
gaagattccagagcctggccagagt

SEQ ID NO: 225013 - DNA, 25 bp, Homo sapien
cagagtttggccaagtagagaatct

SEQ ID NO: 225014 - DNA, 25 bp, Homo sapien
gagaatctttgtcagcacgccaaca

SEQ ID NO: 225015 - DNA, 25 bp, Homo sapien
acagagtccttgctgcaggcaggca

SEQ ID NO: 225016 - DNA, 25 bp, Homo sapien
cagggcgatcagacattggctgcaa

SEQ ID NO: 225017 - DNA, 25 bp, Homo sapien
gagttcaagactagtgtgctgtgat

SEQ ID NO: 225018 - DNA, 25 bp, Homo sapien
caagactagtgtgctgtgatcatac

SEQ ID NO: 225019 - DNA, 25 bp, Homo sapien
gactagtgtgctgtgatcatactat

SEQ ID NO: 225020 - DNA, 25 bp, Homo sapien
agtgtgctgtgatcatactatctag

SEQ ID NO: 225021 - DNA, 25 bp, Homo sapien
gtgctgtgatcatactatctagcct

SEQ ID NO: 225022 - DNA, 25 bp, Homo sapien
ctgtgatcatactatctagcctgga

SEQ ID NO: 225023 - DNA, 25 bp, Homo sapien
gtgatcatactatctagcctggaca

SEQ ID NO: 225024 - DNA, 25 bp, Homo sapien
gatcatactatctagcctggacaac

SEQ ID NO: 225025 - DNA, 25 bp, Homo sapien
aaaattgtttcttctaacagctatt

SEQ ID NO: 225026 - DNA, 25 bp, Homo sapien
ttgtttcttctaacagctattaaga

SEQ ID NO: 225027 - DNA, 25 bp, Homo sapien
tgagaccagcatggcgaaaacccgt

SEQ ID NO: 225028 - DNA, 25 bp, Homo sapien
tggtggcctcctacggtcccaggtg

SEQ ID NO: 225029 - DNA, 25 bp, Homo sapien
aggtgcctccatttgactctcatga

SEQ ID NO: 225030 - DNA, 25 bp, Homo sapien
ttgactctcatgaggttgccgaggt

SEQ ID NO: 225031 - DNA, 25 bp, Homo sapien
gttgccgaggttgggttcagctcca

SEQ ID NO: 225032 - DNA, 25 bp, Homo sapien
ggttgggttcagctccaatgatgat

SEQ ID NO: 225033 - DNA, 25 bp, Homo sapien
tgggaaatagctagggagcccctcc

SEQ ID NO: 225034 - DNA, 25 bp, Homo sapien
agcaggttgcccaccaagctggaag

SEQ ID NO: 225035 - DNA, 25 bp, Homo sapien
agtgatttagaccttttgagaatag

SEQ ID NO: 225036 - DNA, 25 bp, Homo sapien
tttgagaataggacacttggcagga

SEQ ID NO: 225037 - DNA, 25 bp, Homo sapien
tggttggccaaagtggcagagctct

SEQ ID NO: 225038 - DNA, 25 bp, Homo sapien
ggcagagctctgttgctgtttaaca

SEQ ID NO: 225039 - DNA, 25 bp, Homo sapien
gtgctttgctggctaatgtttcttc

SEQ ID NO: 225040 - DNA, 25 bp, Homo sapien
ctggctaatgtttcttcagcatttc

SEQ ID NO: 225041 - DNA, 25 bp, Homo sapien
tccacattttcataggctagcggcc

SEQ ID NO: 225042 - DNA, 25 bp, Homo sapien
taggctagcggccaagttgtccgac

SEQ ID NO: 225043 - DNA, 25 bp, Homo sapien
aagttgtccgacagtctggtacctc

SEQ ID NO: 225044 - DNA, 25 bp, Homo sapien
tggtagcactagcatgctcctgtat

SEQ ID NO: 225045 - DNA, 25 bp, Homo sapien
gctcctgtatgtcgccagttggcat

SEQ ID NO: 225046 - DNA, 25 bp, Homo sapien
gccccgccaacctggaagcatatag

SEQ ID NO: 225047 - DNA, 25 bp, Homo sapien
aacgatttatttgggtacattgaag

SEQ ID NO: 225048 - DNA, 25 bp, Homo sapien
gaacctaaacatttgattcagctgc

SEQ ID NO: 225049 - DNA, 25 bp, Homo sapien
ttcagctgccagtatgtgctttgct

SEQ ID NO: 225050 - DNA, 25 bp, Homo sapien
gtcagaatctctatcgatttagcta

SEQ ID NO: 225051 - DNA, 25 bp, Homo sapien
tcgatttagctattgtggaggcagt

SEQ ID NO: 225052 - DNA, 25 bp, Homo sapien
cagtaaatcatcttccagtgcagtg

SEQ ID NO: 225053 - DNA, 25 bp, Homo sapien
agtaggttgctctggataaatctga

SEQ ID NO: 225054 - DNA, 25 bp, Homo sapien
gaggaaatcagctcatttgaagaat

SEQ ID NO: 225055 - DNA, 25 bp, Homo sapien
atgggatgcgaagctttgacacgac

SEQ ID NO: 225056 - DNA, 25 bp, Homo sapien
tcatcttccagtgcagtgaaacgaa

SEQ ID NO: 225057 - DNA, 25 bp, Homo sapien
agctttgacacgacaatggcgagta

SEQ ID NO: 225058 - DNA, 25 bp, Homo sapien
ccccgcatctgagtaatctgaaggt

SEQ ID NO: 225059 - DNA, 25 bp, Homo sapien
gtaattttctagctagagcttctca

SEQ ID NO: 225060 - DNA, 25 bp, Homo sapien
gaggaagtccatatctttagtcaga

SEQ ID NO: 225061 - DNA, 25 bp, Homo sapien
tctcactcccgacaggacatgctgg

SEQ ID NO: 225062 - DNA, 25 bp, Homo sapien
ctcccgacaggacatgctggagtct

SEQ ID NO: 225063 - DNA, 25 bp, Homo sapien
accagaaacgcttagcacgtcacca

SEQ ID NO: 225064 - DNA, 25 bp, Homo sapien
gaaacgcttagcacgtcaccaaaga

SEQ ID NO: 225065 - DNA, 25 bp, Homo sapien
gcttagcacgtcaccaaagacactc

SEQ ID NO: 225066 - DNA, 25 bp, Homo sapien
accaaagacactccctgctccggaa

SEQ ID NO: 225067 - DNA, 25 bp, Homo sapien
tgctccggaagcctcaggacaagaa

SEQ ID NO: 225068 - DNA, 25 bp, Homo sapien
ctccggaagcctcaggacaagaaga

SEQ ID NO: 225069 - DNA, 25 bp, Homo sapien
tcaggacaagaagaggcaagcatct

SEQ ID NO: 225070 - DNA, 25 bp, Homo sapien
gaagaggcaagcatctcctcatctc

SEQ ID NO: 225071 - DNA, 25 bp, Homo sapien
agcatctcctcatctccaggatgtg

SEQ ID NO: 225072 - DNA, 25 bp, Homo sapien
gtgcccctatatttggcagccaaat

SEQ ID NO: 225073 - DNA, 25 bp, Homo sapien
aagttttttggaatgctggtgctaa

SEQ ID NO: 225074 - DNA, 25 bp, Homo sapien
ggtgctaaccacttgctagatttaa

SEQ ID NO: 225075 - DNA, 25 bp, Homo sapien
ttatatagcatcacagtgctctgct

SEQ ID NO: 225076 - DNA, 25 bp, Homo sapien
gtgctctgctaacagccagcataga

SEQ ID NO: 225077 - DNA, 25 bp, Homo sapien
gagatttacctacagctttttgcac

SEQ ID NO: 225078 - DNA, 25 bp, Homo sapien
acagctttttgcaccactgttctag

SEQ ID NO: 225079 - DNA, 25 bp, Homo sapien
accactgttctagcctttaatgcct

SEQ ID NO: 225080 - DNA, 25 bp, Homo sapien
gcctttaatgccttctacttaatat

SEQ ID NO: 225081 - DNA, 25 bp, Homo sapien
ttaagctgaccgcaatactaacgtg

SEQ ID NO: 225082 - DNA, 25 bp, Homo sapien
gcaatactaacgtgcccctatattt

SEQ ID NO: 225083 - DNA, 25 bp, Homo sapien
tcccagtctgttaaccatccttcta

SEQ ID NO: 225084 - DNA, 25 bp, Homo sapien
tccatctccataagactacactttc

SEQ ID NO: 225085 - DNA, 25 bp, Homo sapien
aagactacactttcattcaaaaaat

SEQ ID NO: 225086 - DNA, 25 bp, Homo sapien
aaatccaaattgctcaccataagca

SEQ ID NO: 225087 - DNA, 25 bp, Homo sapien
gctcaccataagcaaggcacagtta

SEQ ID NO: 225088 - DNA, 25 bp, Homo sapien
gcaaggcacagttacaaatatgagt

SEQ ID NO: 225089 - DNA, 25 bp, Homo sapien
tgagtaagttactgccccaaatgaa

SEQ ID NO: 225090 - DNA, 25 bp, Homo sapien
aaatgaactcttggtccaatggaaa

SEQ ID NO: 225091 - DNA, 25 bp, Homo sapien
cacaatagaggcagtatgttctata

SEQ ID NO: 225092 - DNA, 25 bp, Homo sapien
tgtcacattcaacatactatgagag

SEQ ID NO: 225093 - DNA, 25 bp, Homo sapien
tgaacccataaactatcccaacttt

SEQ ID NO: 225094 - DNA, 25 bp, Homo sapien
ctctcctaggcctgtttcttaagaa

SEQ ID NO: 225095 - DNA, 25 bp, Homo sapien
ggcctgtttcttaagaatgcggagt

SEQ ID NO: 225096 - DNA, 25 bp, Homo sapien
gaagtcatatgaaccactgaggcac

SEQ ID NO: 225097 - DNA, 25 bp, Homo sapien
gaaccactgaggcacatcatggaat

SEQ ID NO: 225098 - DNA, 25 bp, Homo sapien
gtgagcattaagacgttctcccaca

SEQ ID NO: 225099 - DNA, 25 bp, Homo sapien
gtactggagacactgttgaacttga

SEQ ID NO: 225100 - DNA, 25 bp, Homo sapien
tgaacttgatcaagacccagaccac

SEQ ID NO: 225101 - DNA, 25 bp, Homo sapien
aggtctccttcgtgggatgtcatga

SEQ ID NO: 225102 - DNA, 25 bp, Homo sapien
tcatgacgtttgacatacctttgga

SEQ ID NO: 225103 - DNA, 25 bp, Homo sapien
gacatacctttggaacgagcctcct

SEQ ID NO: 225104 - DNA, 25 bp, Homo sapien
atggaagaccgtgttcgtggccgac

SEQ ID NO: 225105 - DNA, 25 bp, Homo sapien
aattcctctgttccttagagcttgt

SEQ ID NO: 225106 - DNA, 25 bp, Homo sapien
ttggacggaattgccaacacccttt

SEQ ID NO: 225107 - DNA, 25 bp, Homo sapien
attgccaacacccttttttatagag

SEQ ID NO: 225108 - DNA, 25 bp, Homo sapien
ttatagagggttctccacttgacct

SEQ ID NO: 225109 - DNA, 25 bp, Homo sapien
ggttctccacttgaccttattaagg

SEQ ID NO: 225110 - DNA, 25 bp, Homo sapien
aaatgaacatgcatcatggcccctt

SEQ ID NO: 225111 - DNA, 25 bp, Homo sapien
atggccccttcaggagcagaatcat

SEQ ID NO: 225112 - DNA, 25 bp, Homo sapien
gctctgaaaagagaagctccgttgt

SEQ ID NO: 225113 - DNA, 25 bp, Homo sapien
agctccgttgtgtactgaggatatc

SEQ ID NO: 225114 - DNA, 25 bp, Homo sapien
gaggatatccatccatattcagcta

SEQ ID NO: 225115 - DNA, 25 bp, Homo sapien
tccatccatattcagctagctttca

SEQ ID NO: 225116 - DNA, 25 bp, Homo sapien
gctcccaaggcaggtgtccaggtgg

SEQ ID NO: 225117 - DNA, 25 bp, Homo sapien
aggtgtccaggtggcgggagcagca

SEQ ID NO: 225118 - DNA, 25 bp, Homo sapien
gtggcgggagcagcaccaaggacag

SEQ ID NO: 225119 - DNA, 25 bp, Homo sapien
caaggacagccaggcttacccggtg

SEQ ID NO: 225120 - DNA, 25 bp, Homo sapien
ggaggaacccctggcgaggcaggga

SEQ ID NO: 225121 - DNA, 25 bp, Homo sapien
gagcactgaagtagggaagcagcaa

SEQ ID NO: 225122 - DNA, 25 bp, Homo sapien
aaaaatacaggctcccaacgtggct

SEQ ID NO: 225123 - DNA, 25 bp, Homo sapien
aatacaggctcccaacgtggctcca

SEQ ID NO: 225124 - DNA, 25 bp, Homo sapien
aacgtggctccactgtctcatgaag

SEQ ID NO: 225125 - DNA, 25 bp, Homo sapien
ggctccactgtctcatgaagtgtca

SEQ ID NO: 225126 - DNA, 25 bp, Homo sapien
actgtctcatgaagtgtcaaaaatt

SEQ ID NO: 225127 - DNA, 25 bp, Homo sapien
agtctacccactactatcatgcttg

SEQ ID NO: 225128 - DNA, 25 bp, Homo sapien
ccactactatcatgcttgggaaaca

SEQ ID NO: 225129 - DNA, 25 bp, Homo sapien
caagcgtcagcttgtacatatgaca

SEQ ID NO: 225130 - DNA, 25 bp, Homo sapien
tacatatgacaagagaggaccctga

SEQ ID NO: 225131 - DNA, 25 bp, Homo sapien
caagagaggaccctgaatacaccct

SEQ ID NO: 225132 - DNA, 25 bp, Homo sapien
gaggaccctgaatacaccctctctt

SEQ ID NO: 225133 - DNA, 25 bp, Homo sapien
atcagcccaagccttactgaggtgg

SEQ ID NO: 225134 - DNA, 25 bp, Homo sapien
agccttactgaggtgggatgaagac

SEQ ID NO: 225135 - DNA, 25 bp, Homo sapien
ctgttctttaaaacatgtttcgtga

SEQ ID NO: 225136 - DNA, 25 bp, Homo sapien
gtttcgtgaactaatattggtccat

SEQ ID NO: 225137 - DNA, 25 bp, Homo sapien
cgtgaactaatattggtccatgtat

SEQ ID NO: 225138 - DNA, 25 bp, Homo sapien
tctctaatctgcatgtgttcagctg

SEQ ID NO: 225139 - DNA, 25 bp, Homo sapien
tgttcagctgcgtatcttctggata

SEQ ID NO: 225140 - DNA, 25 bp, Homo sapien
ggatacggaaggatcacactgcaca

SEQ ID NO: 225141 - DNA, 25 bp, Homo sapien
gatcacactgcacagagtgctggac

SEQ ID NO: 225142 - DNA, 25 bp, Homo sapien
ctcaacctccatcgctttatgaatg

SEQ ID NO: 225143 - DNA, 25 bp, Homo sapien
aacactttcagagatggagcctgtt

SEQ ID NO: 225144 - DNA, 25 bp, Homo sapien
ggagcctgttgagccacagtaccaa

SEQ ID NO: 225145 - DNA, 25 bp, Homo sapien
gagccacagtaccaactagtcaatg

SEQ ID NO: 225146 - DNA, 25 bp, Homo sapien
tcaatgctgaatcgacttctccctt

SEQ ID NO: 225147 - DNA, 25 bp, Homo sapien
ctccctttctacattgcctgagaga

SEQ ID NO: 225148 - DNA, 25 bp, Homo sapien
atactctgtacacgaattttcactg

SEQ ID NO: 225149 - DNA, 25 bp, Homo sapien
ttagccctggctctgcacttttcct

SEQ ID NO: 225150 - DNA, 25 bp, Homo sapien
tgccttctcccaggacggaggcttt

SEQ ID NO: 225151 - DNA, 25 bp, Homo sapien
tctcccaggacggaggcttttggac

SEQ ID NO: 225152 - DNA, 25 bp, Homo sapien
caggacggaggcttttggaccctcg

SEQ ID NO: 225153 - DNA, 25 bp, Homo sapien
atcccactcagccaagtgtctttct

SEQ ID NO: 225154 - DNA, 25 bp, Homo sapien
cactcagccaagtgtctttctgtgt

SEQ ID NO: 225155 - DNA, 25 bp, Homo sapien
ctcagccaagtgtctttctgtgtct

SEQ ID NO: 225156 - DNA, 25 bp, Homo sapien
tttttaagctccgtgagtgcgtggg

SEQ ID NO: 225157 - DNA, 25 bp, Homo sapien
ttaagctccgtgagtgcgtgggtca

SEQ ID NO: 225158 - DNA, 25 bp, Homo sapien
tgagtgcgtgggtcagtgtctgcat

SEQ ID NO: 225159 - DNA, 25 bp, Homo sapien
gcgtgggtcagtgtctgcatgaagt

SEQ ID NO: 225160 - DNA, 25 bp, Homo sapien
gaaggtctggttgattgacgtcagt

SEQ ID NO: 225161 - DNA, 25 bp, Homo sapien
gttgattgacgtcagtcagtcggta

SEQ ID NO: 225162 - DNA, 25 bp, Homo sapien
caacccatcctcatggcctggagtt

SEQ ID NO: 225163 - DNA, 25 bp, Homo sapien
agttcttattccgtgactgtaggaa

SEQ ID NO: 225164 - DNA, 25 bp, Homo sapien
ggagtaacggaagccctcaatgaac

SEQ ID NO: 225165 - DNA, 25 bp, Homo sapien
aagccctcaatgaacgggagctgtt

SEQ ID NO: 225166 - DNA, 25 bp, Homo sapien
gagctgttcaatgctgtttctggcc

SEQ ID NO: 225167 - DNA, 25 bp, Homo sapien
tgtttctggcctgaacatctcggca

SEQ ID NO: 225168 - DNA, 25 bp, Homo sapien
gaacatctcggcagacaatgaagct

SEQ ID NO: 225169 - DNA, 25 bp, Homo sapien
gcacgaggaccgaatgtacccttgt

SEQ ID NO: 225170 - DNA, 25 bp, Homo sapien
cgaatgtacccttgtgcatgctgac

SEQ ID NO: 225171 - DNA, 25 bp, Homo sapien
tgagcactgcaatgcccctcgcctg

SEQ ID NO: 225172 - DNA, 25 bp, Homo sapien
ctcgcctgcccagcaaggaagacag

SEQ ID NO: 225173 - DNA, 25 bp, Homo sapien
gaagacagacccttgggcttggcct

SEQ ID NO: 225174 - DNA, 25 bp, Homo sapien
agacagacccttgggcttggcctct

SEQ ID NO: 225175 - DNA, 25 bp, Homo sapien
gggtctcctccatgctagaaccaca

SEQ ID NO: 225176 - DNA, 25 bp, Homo sapien
cctccatgctagaaccacaaacgtg

SEQ ID NO: 225177 - DNA, 25 bp, Homo sapien
tgctagaaccacaaacgtgcttccc

SEQ ID NO: 225178 - DNA, 25 bp, Homo sapien
gaaccacaaacgtgcttccctgctt

SEQ ID NO: 225179 - DNA, 25 bp, Homo sapien
cttgcctccgcgtgccatgcaaggg

SEQ ID NO: 225180 - DNA, 25 bp, Homo sapien
gatatcagaggtccagaaggcagaa

SEQ ID NO: 225181 - DNA, 25 bp, Homo sapien
ggtccagaaggcagaaagtttattt

SEQ ID NO: 225182 - DNA, 25 bp, Homo sapien
agatcagctcctgcgttgctcctct

SEQ ID NO: 225183 - DNA, 25 bp, Homo sapien
ttgctcctctccagtgaccgcaagt

SEQ ID NO: 225184 - DNA, 25 bp, Homo sapien
gtgaccgcaagtttcaactgggtga

SEQ ID NO: 225185 - DNA, 25 bp, Homo sapien
gcaagtttcaactgggtgaggagct

SEQ ID NO: 225186 - DNA, 25 bp, Homo sapien
cagccctcggcatgtcccttttaga

SEQ ID NO: 225187 - DNA, 25 bp, Homo sapien
gcatgtcccttttagactccatggg

SEQ ID NO: 225188 - DNA, 25 bp, Homo sapien
tttagactccatgggattatccgtg

SEQ ID NO: 225189 - DNA, 25 bp, Homo sapien
gggattatccgtgggaagctttctc

SEQ ID NO: 225190 - DNA, 25 bp, Homo sapien
tgggaagctttctccatgtttcccc

SEQ ID NO: 225191 - DNA, 25 bp, Homo sapien
ctttttcctgtctttattgcgaaag

SEQ ID NO: 225192 - DNA, 25 bp, Homo sapien
ttcctgtctttattgcgaaagagag

SEQ ID NO: 225193 - DNA, 25 bp, Homo sapien
ttccatcttccagaggttgccactg

SEQ ID NO: 225194 - DNA, 25 bp, Homo sapien
atcttccagaggttgccactgtctg

SEQ ID NO: 225195 - DNA, 25 bp, Homo sapien
gtccccatccacagtcatctttttt

SEQ ID NO: 225196 - DNA, 25 bp, Homo sapien
atgacacattagttgtctagttctt

SEQ ID NO: 225197 - DNA, 25 bp, Homo sapien
gtctagttcttcatagttaatgtgg

SEQ ID NO: 225198 - DNA, 25 bp, Homo sapien
ggtttaagtctgacatcttttcttt

SEQ ID NO: 225199 - DNA, 25 bp, Homo sapien
ttgccatgaaatttacaccttagtg

SEQ ID NO: 225200 - DNA, 25 bp, Homo sapien
acaccttagtgttattctcactgaa

SEQ ID NO: 225201 - DNA, 25 bp, Homo sapien
aaactcttatcccagtgatattgac

SEQ ID NO: 225202 - DNA, 25 bp, Homo sapien
agatttatcaccatttctgagctgt

SEQ ID NO: 225203 - DNA, 25 bp, Homo sapien
atttctgagctgtgtagggccttaa

SEQ ID NO: 225204 - DNA, 25 bp, Homo sapien
tcaccatgagtcaggccctgtgcta

SEQ ID NO: 225205 - DNA, 25 bp, Homo sapien
ctggacctgtccttgtgaagagtgc

SEQ ID NO: 225206 - DNA, 25 bp, Homo sapien
ggacctgtccttgtgaagagtgcgt

SEQ ID NO: 225207 - DNA, 25 bp, Homo sapien
acctgtccttgtgaagagtgcgtct

SEQ ID NO: 225208 - DNA, 25 bp, Homo sapien
ctgtccttgtgaagagtgcgtctgt

SEQ ID NO: 225209 - DNA, 25 bp, Homo sapien
tccttgtgaagagtgcgtctgtgac

SEQ ID NO: 225210 - DNA, 25 bp, Homo sapien
gtgaagagtgcgtctgtgacacaga

SEQ ID NO: 225211 - DNA, 25 bp, Homo sapien
gaagagtgcgtctgtgacacagata

SEQ ID NO: 225212 - DNA, 25 bp, Homo sapien
gtctgtgacacagatactgtgccat

SEQ ID NO: 225213 - DNA, 25 bp, Homo sapien
acacagatactgtgccatgtggcaa

SEQ ID NO: 225214 - DNA, 25 bp, Homo sapien
cacagatactgtgccatgtggcaaa

SEQ ID NO: 225215 - DNA, 25 bp, Homo sapien
cgtgcctgtctggaggaagactgta

SEQ ID NO: 225216 - DNA, 25 bp, Homo sapien
tatggagtgtagtcatcaggccaga

SEQ ID NO: 225217 - DNA, 25 bp, Homo sapien
ggcagcatttggcaatgcatcctta

SEQ ID NO: 225218 - DNA, 25 bp, Homo sapien
gcatccttaatgacattcagggtaa

SEQ ID NO: 225219 - DNA, 25 bp, Homo sapien
aggccactgcgggtgctttgatgaa

SEQ ID NO: 225220 - DNA, 25 bp, Homo sapien
accaggatcctagccatctggtgat

SEQ ID NO: 225221 - DNA, 25 bp, Homo sapien
ggtgattctatgtctacagtctgga

SEQ ID NO: 225222 - DNA, 25 bp, Homo sapien
agtctggatagatggtttgggtaaa

SEQ ID NO: 225223 - DNA, 25 bp, Homo sapien
tgctttgatgaaatctctgggaggc

SEQ ID NO: 225224 - DNA, 25 bp, Homo sapien
agtgagcccaagtgtagtcggttgt

SEQ ID NO: 225225 - DNA, 25 bp, Homo sapien
tagtcggttgtatggcgtgcctgtc

SEQ ID NO: 225226 - DNA, 25 bp, Homo sapien
tgccctaccctgactgatcaatgtg

SEQ ID NO: 225227 - DNA, 25 bp, Homo sapien
gccctaccctgactgatcaatgtgc

SEQ ID NO: 225228 - DNA, 25 bp, Homo sapien
ccctaccctgactgatcaatgtgct

SEQ ID NO: 225229 - DNA, 25 bp, Homo sapien
cctaccctgactgatcaatgtgctt

SEQ ID NO: 225230 - DNA, 25 bp, Homo sapien
ctaccctgactgatcaatgtgcttt

SEQ ID NO: 225231 - DNA, 25 bp, Homo sapien
taccctgactgatcaatgtgctttg

SEQ ID NO: 225232 - DNA, 25 bp, Homo sapien
cccttcagaaggctctttgtaatcc

SEQ ID NO: 225233 - DNA, 25 bp, Homo sapien
ccttcagaaggctctttgtaatcct

SEQ ID NO: 225234 - DNA, 25 bp, Homo sapien
cttcagaaggctctttgtaatcctc

SEQ ID NO: 225235 - DNA, 25 bp, Homo sapien
aatggacttggtgagatccaccccc

SEQ ID NO: 225236 - DNA, 25 bp, Homo sapien
ggacttggtgagatccaccccctgc

SEQ ID NO: 225237 - DNA, 25 bp, Homo sapien
acctaaccctggaagtttgctcgct

SEQ ID NO: 225238 - DNA, 25 bp, Homo sapien
agtttgctcgctgcctgaaaatcat

SEQ ID NO: 225239 - DNA, 25 bp, Homo sapien
aaatcatatgcgtggtttttcctgt

SEQ ID NO: 225240 - DNA, 25 bp, Homo sapien
tttttcctgtttcctgctctgtagc

SEQ ID NO: 225241 - DNA, 25 bp, Homo sapien
gtttcctgctctgtagctgacatca

SEQ ID NO: 225242 - DNA, 25 bp, Homo sapien
gggagcaacgtgaacacaggaaaat

SEQ ID NO: 225243 - DNA, 25 bp, Homo sapien
tccacatatggaaaactgcaaatag

SEQ ID NO: 225244 - DNA, 25 bp, Homo sapien
tgcaaatagcagaagtatgtgactc

SEQ ID NO: 225245 - DNA, 25 bp, Homo sapien
ttattctggagtgaccacatcctct

SEQ ID NO: 225246 - DNA, 25 bp, Homo sapien
tggagtgaccacatcctctaactgc

SEQ ID NO: 225247 - DNA, 25 bp, Homo sapien
taactgcctcccaggacaagacgga

SEQ ID NO: 225248 - DNA, 25 bp, Homo sapien
gctgctatgctatagtctccccacc

SEQ ID NO: 225249 - DNA, 25 bp, Homo sapien
taccaataccttcctcatagggtac

SEQ ID NO: 225250 - DNA, 25 bp, Homo sapien
ataccttcctcatagggtacataag

SEQ ID NO: 225251 - DNA, 25 bp, Homo sapien
ttcctcatagggtacataagattaa

SEQ ID NO: 225252 - DNA, 25 bp, Homo sapien
acttaaaatgtagctctcaataaat

SEQ ID NO: 225253 - DNA, 25 bp, Homo sapien
attaggatacgaaatgcctctgctg

SEQ ID NO: 225254 - DNA, 25 bp, Homo sapien
gatacgaaatgcctctgctgacatt

SEQ ID NO: 225255 - DNA, 25 bp, Homo sapien
gaaatgcctctgctgacattcttgt

SEQ ID NO: 225256 - DNA, 25 bp, Homo sapien
atgcctctgctgacattcttgttac

SEQ ID NO: 225257 - DNA, 25 bp, Homo sapien
ctctgctgacattcttgttactctt

SEQ ID NO: 225258 - DNA, 25 bp, Homo sapien
ctgacattcttgttactcttttctc

SEQ ID NO: 225259 - DNA, 25 bp, Homo sapien
ggaagattaagaacttacccagtga

SEQ ID NO: 225260 - DNA, 25 bp, Homo sapien
gaacttacccagtgaataggaagat

SEQ ID NO: 225261 - DNA, 25 bp, Homo sapien
ttacagagaataacgtgggaaggca

SEQ ID NO: 225262 - DNA, 25 bp, Homo sapien
aagatggaatgagggctaacgtaca

SEQ ID NO: 225263 - DNA, 25 bp, Homo sapien
tgagggctaacgtacatttgatgga

SEQ ID NO: 225264 - DNA, 25 bp, Homo sapien
acatttgatggatgtcccagaggca

SEQ ID NO: 225265 - DNA, 25 bp, Homo sapien
ggcagaggaaacaatggctgtcaag

SEQ ID NO: 225266 - DNA, 25 bp, Homo sapien
acaatggctgtcaaggagtaggttg

SEQ ID NO: 225267 - DNA, 25 bp, Homo sapien
gaactggtgaaatatactgacctac

SEQ ID NO: 225268 - DNA, 25 bp, Homo sapien
ctgacctacagacagggagccctga

SEQ ID NO: 225269 - DNA, 25 bp, Homo sapien
cctgaagccgcctggcagaacaaag

SEQ ID NO: 225270 - DNA, 25 bp, Homo sapien
gggaccgagtttgtacattttccat

SEQ ID NO: 225271 - DNA, 25 bp, Homo sapien
gaccgagtttgtacattttccattt

SEQ ID NO: 225272 - DNA, 25 bp, Homo sapien
gagtttgtacattttccattttgga

SEQ ID NO: 225273 - DNA, 25 bp, Homo sapien
ttccattttggaattttgagttcca

SEQ ID NO: 225274 - DNA, 25 bp, Homo sapien
ttgagttccaattgttgtaaaactt

SEQ ID NO: 225275 - DNA, 25 bp, Homo sapien
tgggcggcgtcctcagtcgggtggt

SEQ ID NO: 225276 - DNA, 25 bp, Homo sapien
tgagacgctcgccccgacgcatgga

SEQ ID NO: 225277 - DNA, 25 bp, Homo sapien
acgcatggacccgagaggcgacgac

SEQ ID NO: 225278 - DNA, 25 bp, Homo sapien
catggacccgagaggcgacgacacg

SEQ ID NO: 225279 - DNA, 25 bp, Homo sapien
aggcgacgacacgagtgaataaagt

SEQ ID NO: 225280 - DNA, 25 bp, Homo sapien
gacacgagtgaataaagtgcacatg

SEQ ID NO: 225281 - DNA, 25 bp, Homo sapien
gggtggagcctgaaatctctgctgt

SEQ ID NO: 225282 - DNA, 25 bp, Homo sapien
atgtgattaggacccttcatctcaa

SEQ ID NO: 225283 - DNA, 25 bp, Homo sapien
ggacccttcatctcaaatttctagt

SEQ ID NO: 225284 - DNA, 25 bp, Homo sapien
gggttagaattcctgcccttcatcc

SEQ ID NO: 225285 - DNA, 25 bp, Homo sapien
tgcccttcatccacatctgagtgta

SEQ ID NO: 225286 - DNA, 25 bp, Homo sapien
catctgagtgtagtcctgtctttag

SEQ ID NO: 225287 - DNA, 25 bp, Homo sapien
ctgtctttagggagtataagccagg

SEQ ID NO: 225288 - DNA, 25 bp, Homo sapien
tataagccaggaattctttccttcc

SEQ ID NO: 225289 - DNA, 25 bp, Homo sapien
gggcattcaggacttcacagtcccc

SEQ ID NO: 225290 - DNA, 25 bp, Homo sapien
ttgcccctttctttctattgactat

SEQ ID NO: 225291 - DNA, 25 bp, Homo sapien
tttctattgactatgggtggagcct

SEQ ID NO: 225292 - DNA, 25 bp, Homo sapien
tccctagatcctaaccctttagtat

SEQ ID NO: 225293 - DNA, 25 bp, Homo sapien
taaccctttagtatgctggaattct

SEQ ID NO: 225294 - DNA, 25 bp, Homo sapien
tggaattctactcttcacttactgc

SEQ ID NO: 225295 - DNA, 25 bp, Homo sapien
cacttactgcattgactgttgttga

SEQ ID NO: 225296 - DNA, 25 bp, Homo sapien
ttattgcaaagcactgtcaccggcc

SEQ ID NO: 225297 - DNA, 25 bp, Homo sapien
ctgtcaccggcctcagggagtttat

SEQ ID NO: 225298 - DNA, 25 bp, Homo sapien
ataacacttagctcaagccacgcat

SEQ ID NO: 225299 - DNA, 25 bp, Homo sapien
caagccacgcatgtgtgaggcattt

SEQ ID NO: 225300 - DNA, 25 bp, Homo sapien
tgaggcatttggtatgtatctgaat

SEQ ID NO: 225301 - DNA, 25 bp, Homo sapien
aaattcagcaaaggacttgatagcc

SEQ ID NO: 225302 - DNA, 25 bp, Homo sapien
ctccccgccttttcaataaaggatg

SEQ ID NO: 225303 - DNA, 25 bp, Homo sapien
ggtctcgatcccatccagaggagcg

SEQ ID NO: 225304 - DNA, 25 bp, Homo sapien
gatcccatccagaggagcgtttccc

SEQ ID NO: 225305 - DNA, 25 bp, Homo sapien
ccgttctagaggtccttgagcccct

SEQ ID NO: 225306 - DNA, 25 bp, Homo sapien
gggttgtcccctcggtaccagctgt

SEQ ID NO: 225307 - DNA, 25 bp, Homo sapien
ccctcggtaccagctgtgcagggag

SEQ ID NO: 225308 - DNA, 25 bp, Homo sapien
gttccagccctgctttagcgtgggt

SEQ ID NO: 225309 - DNA, 25 bp, Homo sapien
tttagcgtgggtgccatgaggcccc

SEQ ID NO: 225310 - DNA, 25 bp, Homo sapien
catgaggccccgacgtttaaagtat

SEQ ID NO: 225311 - DNA, 25 bp, Homo sapien
gatctgcagccataggccggtgtgt

SEQ ID NO: 225312 - DNA, 25 bp, Homo sapien
ataggccggtgtgttccgcatttgt

SEQ ID NO: 225313 - DNA, 25 bp, Homo sapien
tgttccgcatttgtgctgctccagg

SEQ ID NO: 225314 - DNA, 25 bp, Homo sapien
agtctacccactactatcatgcttg

SEQ ID NO: 225315 - DNA, 25 bp, Homo sapien
ccactactatcatgcttgggaaaca

SEQ ID NO: 225316 - DNA, 25 bp, Homo sapien
caagcgtcagcttgtacatatgaca

SEQ ID NO: 225317 - DNA, 25 bp, Homo sapien
tacatatgacaagagaggaccctga

SEQ ID NO: 225318 - DNA, 25 bp, Homo sapien
gaggaccctgaatacaccctctctt

SEQ ID NO: 225319 - DNA, 25 bp, Homo sapien
atcagcccaagccttactgaggtgg

SEQ ID NO: 225320 - DNA, 25 bp, Homo sapien
agccttactgaggtgggatgaagac

SEQ ID NO: 225321 - DNA, 25 bp, Homo sapien
ctgttctttaaaacatgtttcgtga

SEQ ID NO: 225322 - DNA, 25 bp, Homo sapien
gtttcgtgaactaatattggtccat

SEQ ID NO: 225323 - DNA, 25 bp, Homo sapien
cgtgaactaatattggtccatgtat

SEQ ID NO: 225324 - DNA, 25 bp, Homo sapien
aattggcaccattttttcctgacta

SEQ ID NO: 225325 - DNA, 25 bp, Homo sapien
gagaagcaggagaatgttctctgtg

SEQ ID NO: 225326 - DNA, 25 bp, Homo sapien
aatgttctctgtggctacagtgagg

SEQ ID NO: 225327 - DNA, 25 bp, Homo sapien
aggcccagtggctagagaccagata

SEQ ID NO: 225328 - DNA, 25 bp, Homo sapien
tggctagagaccagataggcagtta

SEQ ID NO: 225329 - DNA, 25 bp, Homo sapien
gataggcagttacagtcttccagac

SEQ ID NO: 225330 - DNA, 25 bp, Homo sapien
agtcttccagactgcgagacaatct

SEQ ID NO: 225331 - DNA, 25 bp, Homo sapien
agactgcgagacaatctctctttag

SEQ ID NO: 225332 - DNA, 25 bp, Homo sapien
gagacaatctctctttagtgccaag

SEQ ID NO: 225333 - DNA, 25 bp, Homo sapien
gacaatctctctttagtgccaagat

SEQ ID NO: 225334 - DNA, 25 bp, Homo sapien
tctttagtgccaagattagcataaa

SEQ ID NO: 225335 - DNA, 25 bp, Homo sapien
agcattatataacccaattattctt

SEQ ID NO: 225336 - DNA, 25 bp, Homo sapien
ttcaaaccagatcagctcctgcgtt

SEQ ID NO: 225337 - DNA, 25 bp, Homo sapien
gttgctcctctccagtgaccgcaag

SEQ ID NO: 225338 - DNA, 25 bp, Homo sapien
gtgaccgcaagtttcaactgggtga

SEQ ID NO: 225339 - DNA, 25 bp, Homo sapien
gcaagtttcaactgggtgaggagct

SEQ ID NO: 225340 - DNA, 25 bp, Homo sapien
gcggctcctctgagcttcccaaagg

SEQ ID NO: 225341 - DNA, 25 bp, Homo sapien
cagccctcggcatgtcccttttaga

SEQ ID NO: 225342 - DNA, 25 bp, Homo sapien
gcatgtcccttttagactccatggg

SEQ ID NO: 225343 - DNA, 25 bp, Homo sapien
tttagactccatgggattatccgtg

SEQ ID NO: 225344 - DNA, 25 bp, Homo sapien
gggattatccgtgggaagctttctc

SEQ ID NO: 225345 - DNA, 25 bp, Homo sapien
tgggaagctttctccatgtttcccc

SEQ ID NO: 225346 - DNA, 25 bp, Homo sapien
ctttttcctgtctttattgcgaaag

SEQ ID NO: 225347 - DNA, 25 bp, Homo sapien
gccgtagtggccgttctgcgtggcg

SEQ ID NO: 225348 - DNA, 25 bp, Homo sapien
tctggccacagacccgggttgctgt

SEQ ID NO: 225349 - DNA, 25 bp, Homo sapien
agacccgggttgctgtcgccctcgt

SEQ ID NO: 225350 - DNA, 25 bp, Homo sapien
gggcccggcccatagaagtctaagc

SEQ ID NO: 225351 - DNA, 25 bp, Homo sapien
ggcccatagaagtctaagccgttgc

SEQ ID NO: 225352 - DNA, 25 bp, Homo sapien
atagaagtctaagccgttgcagtcg

SEQ ID NO: 225353 - DNA, 25 bp, Homo sapien
gaagtctaagccgttgcagtcgccc

SEQ ID NO: 225354 - DNA, 25 bp, Homo sapien
aagtctaagccgttgcagtcgcccg

SEQ ID NO: 225355 - DNA, 25 bp, Homo sapien
tctaagccgttgcagtcgcccgcgg

SEQ ID NO: 225356 - DNA, 25 bp, Homo sapien
tcccgacaggaagcccggagagtcg

SEQ ID NO: 225357 - DNA, 25 bp, Homo sapien
aagcccggagagtcgcccggctcgg

SEQ ID NO: 225358 - DNA, 25 bp, Homo sapien
aagtagatcttccagcctcagtcaa

SEQ ID NO: 225359 - DNA, 25 bp, Homo sapien
gcagccctgtctaatagcttgaccg

SEQ ID NO: 225360 - DNA, 25 bp, Homo sapien
gccctgtctaatagcttgaccgtaa

SEQ ID NO: 225361 - DNA, 25 bp, Homo sapien
atagcttgaccgtaatttcatgaga

SEQ ID NO: 225362 - DNA, 25 bp, Homo sapien
gaccgtaatttcatgagagaccttc

SEQ ID NO: 225363 - DNA, 25 bp, Homo sapien
taatttcatgagagaccttcagcca

SEQ ID NO: 225364 - DNA, 25 bp, Homo sapien
gagaccttcagccagaaaacccaag

SEQ ID NO: 225365 - DNA, 25 bp, Homo sapien
gaaaccattctggattcctcatcct

SEQ ID NO: 225366 - DNA, 25 bp, Homo sapien
agaagtgtttgttgtagtacgccgc

SEQ ID NO: 225367 - DNA, 25 bp, Homo sapien
gtgtttgttgtagtacgccgctaaa

SEQ ID NO: 225368 - DNA, 25 bp, Homo sapien
tttgttgtagtacgccgctaaattt

SEQ ID NO: 225369 - DNA, 25 bp, Homo sapien
gttagtggttcttattctgtctgct

SEQ ID NO: 225370 - DNA, 25 bp, Homo sapien
tattctgtctgcttcgtactaggta

SEQ ID NO: 225371 - DNA, 25 bp, Homo sapien
gtctgcttcgtactaggtatatggt

SEQ ID NO: 225372 - DNA, 25 bp, Homo sapien
gtaactgagaaagtcacttaacctc

SEQ ID NO: 225373 - DNA, 25 bp, Homo sapien
acctctctgaaccttaacttcgtca

SEQ ID NO: 225374 - DNA, 25 bp, Homo sapien
gaaccttaacttcgtcatctataaa

SEQ ID NO: 225375 - DNA, 25 bp, Homo sapien
cagacaaagggtcctgttacacagt

SEQ ID NO: 225376 - DNA, 25 bp, Homo sapien
gggtcctgttacacagttggaagtc

SEQ ID NO: 225377 - DNA, 25 bp, Homo sapien
gttggaagtcattccctcagatttt

SEQ ID NO: 225378 - DNA, 25 bp, Homo sapien
attccctcagattttgggcctagga

SEQ ID NO: 225379 - DNA, 25 bp, Homo sapien
ggtaggtgatttaaactcactgaaa

SEQ ID NO: 225380 - DNA, 25 bp, Homo sapien
atcgtttgcagcctgtcactgtaag

SEQ ID NO: 225381 - DNA, 25 bp, Homo sapien
gtcactgtaaggcacaaacatgata

SEQ ID NO: 225382 - DNA, 25 bp, Homo sapien
aaacatgataccaagatgcgatagt

SEQ ID NO: 225383 - DNA, 25 bp, Homo sapien
gagtcaattttccagacatctttaa

SEQ ID NO: 225384 - DNA, 25 bp, Homo sapien
atgcgatagtagatttaagccagtt

SEQ ID NO: 225385 - DNA, 25 bp, Homo sapien
ttccagacatctttaattagcaata

SEQ ID NO: 225386 - DNA, 25 bp, Homo sapien
taagtagttacaagccttccttctt

SEQ ID NO: 225387 - DNA, 25 bp, Homo sapien
tagttacaagccttccttcttttct

SEQ ID NO: 225388 - DNA, 25 bp, Homo sapien
tcttgtgacagtttgggttgaattc

SEQ ID NO: 225389 - DNA, 25 bp, Homo sapien
ggttgaattctatcgtttgcagcct

SEQ ID NO: 225390 - DNA, 25 bp, Homo sapien
gaattctatcgtttgcagcctgtca

SEQ ID NO: 225391 - DNA, 25 bp, Homo sapien
tagtgattaagaccaaaccctgaag

SEQ ID NO: 225392 - DNA, 25 bp, Homo sapien
aaccctgaagaacagcatcattaat

SEQ ID NO: 225393 - DNA, 25 bp, Homo sapien
gttctctactataaacccagcacat

SEQ ID NO: 225394 - DNA, 25 bp, Homo sapien
taaacccagcacatgacacaaaatc

SEQ ID NO: 225395 - DNA, 25 bp, Homo sapien
taaatggcagacaacagggagtagt

SEQ ID NO: 225396 - DNA, 25 bp, Homo sapien
agtgtctgtctgtcttacttaaaga

SEQ ID NO: 225397 - DNA, 25 bp, Homo sapien
taaagacattcacatcagttatttc

SEQ ID NO: 225398 - DNA, 25 bp, Homo sapien
tatttccaacactgttagccctgga

SEQ ID NO: 225399 - DNA, 25 bp, Homo sapien
gaaagctatccctgaactttgtcag

SEQ ID NO: 225400 - DNA, 25 bp, Homo sapien
actttgtcaggctagtttgtgatcc

SEQ ID NO: 225401 - DNA, 25 bp, Homo sapien
caggctagtttgtgatccctagaaa

SEQ ID NO: 225402 - DNA, 25 bp, Homo sapien
gagtaggtctgattcccttactgca

SEQ ID NO: 225403 - DNA, 25 bp, Homo sapien
gatccaaaagatttccttctaagca

SEQ ID NO: 225404 - DNA, 25 bp, Homo sapien
ccatgaggtctgatacggttcggct

SEQ ID NO: 225405 - DNA, 25 bp, Homo sapien
ggtctgatacggttcggctctgtgt

SEQ ID NO: 225406 - DNA, 25 bp, Homo sapien
cacgcaaatctcatctctaattgtt

SEQ ID NO: 225407 - DNA, 25 bp, Homo sapien
ttctcctgatactgaattctcccga

SEQ ID NO: 225408 - DNA, 25 bp, Homo sapien
aagcatctaacactgactgaggtca

SEQ ID NO: 225409 - DNA, 25 bp, Homo sapien
gaggtcactgaagaccacactggca

SEQ ID NO: 225410 - DNA, 25 bp, Homo sapien
agaccacactggcaggaatttcagg

SEQ ID NO: 225411 - DNA, 25 bp, Homo sapien
gaatttcagggactgatgacatctc

SEQ ID NO: 225412 - DNA, 25 bp, Homo sapien
atctccttcccttgtactcatgttt

SEQ ID NO: 225413 - DNA, 25 bp, Homo sapien
ctgggaaaacagacttagggacaat

SEQ ID NO: 225414 - DNA, 25 bp, Homo sapien
tagggacaatgatcttgagccatga

SEQ ID NO: 225415 - DNA, 25 bp, Homo sapien
gatcttgagccatgaaatgatgtcc

SEQ ID NO: 225416 - DNA, 25 bp, Homo sapien
atgaaatgatgtccaatgccccttg

SEQ ID NO: 225417 - DNA, 25 bp, Homo sapien
aaatgatgtccaatgccccttgtgc

SEQ ID NO: 225418 - DNA, 25 bp, Homo sapien
ttgtgccacctgacatcagcctgat

SEQ ID NO: 225419 - DNA, 25 bp, Homo sapien
acatcagcctgattaatgaacaaac

SEQ ID NO: 225420 - DNA, 25 bp, Homo sapien
ttatgtctctcacgctgtctcttgt

SEQ ID NO: 225421 - DNA, 25 bp, Homo sapien
ctcacgctgtctcttgtccttgttt

SEQ ID NO: 225422 - DNA, 25 bp, Homo sapien
tcttgtccttgtttttaactctgac

SEQ ID NO: 225423 - DNA, 25 bp, Homo sapien
gatgggcaccaccatttcccaataa

SEQ ID NO: 225424 - DNA, 25 bp, Homo sapien
tgccctaccctgactgatcaatgtg

SEQ ID NO: 225425 - DNA, 25 bp, Homo sapien
gccctaccctgactgatcaatgtgc

SEQ ID NO: 225426 - DNA, 25 bp, Homo sapien
cctaccctgactgatcaatgtgctt

SEQ ID NO: 225427 - DNA, 25 bp, Homo sapien
ctaccctgactgatcaatgtgcttt

SEQ ID NO: 225428 - DNA, 25 bp, Homo sapien
taccctgactgatcaatgtgctttg

SEQ ID NO: 225429 - DNA, 25 bp, Homo sapien
cccttcagaaggctctttgtaatcc

SEQ ID NO: 225430 - DNA, 25 bp, Homo sapien
cttcagaaggctctttgtaatcctc

SEQ ID NO: 225431 - DNA, 25 bp, Homo sapien
cagaaggctctttgtaatcctcccc

SEQ ID NO: 225432 - DNA, 25 bp, Homo sapien
aatggacttggtgagatccaccccc

SEQ ID NO: 225433 - DNA, 25 bp, Homo sapien
ggacttggtgagatccaccccctgc

SEQ ID NO: 225434 - DNA, 25 bp, Homo sapien
tgcctgcaaagcattgcccctaact

SEQ ID NO: 225435 - DNA, 25 bp, Homo sapien
tagaaatgaggctagacctggaagc

SEQ ID NO: 225436 - DNA, 25 bp, Homo sapien
gagacagacgagagctaagtagaat

SEQ ID NO: 225437 - DNA, 25 bp, Homo sapien
gaatgcaggcaatgacgccgtaaca

SEQ ID NO: 225438 - DNA, 25 bp, Homo sapien
aatgacgccgtaacagagatctgca

SEQ ID NO: 225439 - DNA, 25 bp, Homo sapien
agagatctgcacagcgaccattgca

SEQ ID NO: 225440 - DNA, 25 bp, Homo sapien
ctgcacagcgaccattgcacagcgt

SEQ ID NO: 225441 - DNA, 25 bp, Homo sapien
gcaggcttctgagaggaggtaacat

SEQ ID NO: 225442 - DNA, 25 bp, Homo sapien
agacagggctctaattcgtgacatc

SEQ ID NO: 225443 - DNA, 25 bp, Homo sapien
ggctctaattcgtgacatcgtggca

SEQ ID NO: 225444 - DNA, 25 bp, Homo sapien
attcgtgacatcgtggcaacaaact

SEQ ID NO: 225445 - DNA, 25 bp, Homo sapien
gacatcgtggcaacaaactattaga

SEQ ID NO: 225446 - DNA, 25 bp, Homo sapien
ttttcttttgaggtaaatttgatag

SEQ ID NO: 225447 - DNA, 25 bp, Homo sapien
gaggcgatacggcatggtgacagaa

SEQ ID NO: 225448 - DNA, 25 bp, Homo sapien
ggtgacagaaaagcgccggcttggt

SEQ ID NO: 225449 - DNA, 25 bp, Homo sapien
acagaaaagcgccggcttggttagc

SEQ ID NO: 225450 - DNA, 25 bp, Homo sapien
gcaggctgtgccacttaccaggcag

SEQ ID NO: 225451 - DNA, 25 bp, Homo sapien
aggctgtgccacttaccaggcaggg

SEQ ID NO: 225452 - DNA, 25 bp, Homo sapien
ggaccttgggccagctgcttggcct

SEQ ID NO: 225453 - DNA, 25 bp, Homo sapien
tgggccagctgcttggcctcactca

SEQ ID NO: 225454 - DNA, 25 bp, Homo sapien
gctgcaattgggatgaacagactgc

SEQ ID NO: 225455 - DNA, 25 bp, Homo sapien
caattgggatgaacagactgcctgc

SEQ ID NO: 225456 - DNA, 25 bp, Homo sapien
ttgggatgaacagactgcctgcttc

SEQ ID NO: 225457 - DNA, 25 bp, Homo sapien
acacgtttctcttgtggtcccattc

SEQ ID NO: 225458 - DNA, 25 bp, Homo sapien
gtggtcccattcaggctttaactgc

SEQ ID NO: 225459 - DNA, 25 bp, Homo sapien
agctccaccttcatcagaatggcgt

SEQ ID NO: 225460 - DNA, 25 bp, Homo sapien
tgctgggacggaaagaggacctcct

SEQ ID NO: 225461 - DNA, 25 bp, Homo sapien
cagcataactgtgaggacccttcca

SEQ ID NO: 225462 - DNA, 25 bp, Homo sapien
gacccttccaaactgtgggctattt

SEQ ID NO: 225463 - DNA, 25 bp, Homo sapien
tgggctattttaaatacggtctcca

SEQ ID NO: 225464 - DNA, 25 bp, Homo sapien
ggtctccaaccagggagtgatcgaa

SEQ ID NO: 225465 - DNA, 25 bp, Homo sapien
gtgatcgaactttccagtgaagctg

SEQ ID NO: 225466 - DNA, 25 bp, Homo sapien
atgaaggaccccagtcaggaaccaa

SEQ ID NO: 225467 - DNA, 25 bp, Homo sapien
ggaaacctgccagggccctgagtgt

SEQ ID NO: 225468 - DNA, 25 bp, Homo sapien
caatacataagttagggagtgttaa

SEQ ID NO: 225469 - DNA, 25 bp, Homo sapien
gggaagacatatgtgttaacctagt

SEQ ID NO: 225470 - DNA, 25 bp, Homo sapien
gacatatgtgttaacctagtgaggc

SEQ ID NO: 225471 - DNA, 25 bp, Homo sapien
aacctagtgaggcttgaatcagatg

SEQ ID NO: 225472 - DNA, 25 bp, Homo sapien
tgaggcttgaatcagatgtttggaa

SEQ ID NO: 225473 - DNA, 25 bp, Homo sapien
ggctcctggtgaccttgccattgag

SEQ ID NO: 225474 - DNA, 25 bp, Homo sapien
cctggtgaccttgccattgaggaca

SEQ ID NO: 225475 - DNA, 25 bp, Homo sapien
ggtgaccttgccattgaggacacat

SEQ ID NO: 225476 - DNA, 25 bp, Homo sapien
gaccttgccattgaggacacatata

SEQ ID NO: 225477 - DNA, 25 bp, Homo sapien
ttgccattgaggacacatatacttc

SEQ ID NO: 225478 - DNA, 25 bp, Homo sapien
attgaggacacatatacttctcccc

SEQ ID NO: 225479 - DNA, 25 bp, Homo sapien
gagtcactggtggtctcaaactgcc

SEQ ID NO: 225480 - DNA, 25 bp, Homo sapien
aggccatagcctcagccaatgttca

SEQ ID NO: 225481 - DNA, 25 bp, Homo sapien
aatgttcaccctgtccaggatggca

SEQ ID NO: 225482 - DNA, 25 bp, Homo sapien
caggatggcacctgctgttgtctgg

SEQ ID NO: 225483 - DNA, 25 bp, Homo sapien
attcgtgtcacgttgttccgcttga

SEQ ID NO: 225484 - DNA, 25 bp, Homo sapien
atcggccctggagtcttcctatagg

SEQ ID NO: 225485 - DNA, 25 bp, Homo sapien
gaagacatcggttcagttgcctgtt

SEQ ID NO: 225486 - DNA, 25 bp, Homo sapien
tcagttgcctgtttccgcagctatt

SEQ ID NO: 225487 - DNA, 25 bp, Homo sapien
agctattccttgtcacactcaacgc

SEQ ID NO: 225488 - DNA, 25 bp, Homo sapien
cgctgcttcagctgttcatgggaca

SEQ ID NO: 225489 - DNA, 25 bp, Homo sapien
gatgtaccagacatcctcggagtca

SEQ ID NO: 225490 - DNA, 25 bp, Homo sapien
ttcagctcccaaagttaggaaaagt

SEQ ID NO: 225491 - DNA, 25 bp, Homo sapien
gaaaagtgtcagtagtcgaatccat

SEQ ID NO: 225492 - DNA, 25 bp, Homo sapien
gtcgaatccatgaagccgtgaaagc

SEQ ID NO: 225493 - DNA, 25 bp, Homo sapien
aagccatcgtgctgtgtcacaacgt

SEQ ID NO: 225494 - DNA, 25 bp, Homo sapien
atcgtgctgtgtcacaacgtgaccc

SEQ ID NO: 225495 - DNA, 25 bp, Homo sapien
gttactgaggagactgagttcgcag

SEQ ID NO: 225496 - DNA, 25 bp, Homo sapien
gactgagttcgcagaggctgaccaa

SEQ ID NO: 225497 - DNA, 25 bp, Homo sapien
gaggctgaccaagacttcagtgatg

SEQ ID NO: 225498 - DNA, 25 bp, Homo sapien
tgatgagaatcgcacctaccaggct

SEQ ID NO: 225499 - DNA, 25 bp, Homo sapien
atgaggtcgctctggtgcagtggac

SEQ ID NO: 225500 - DNA, 25 bp, Homo sapien
gacctcacctccatgcagctgaaga

SEQ ID NO: 225501 - DNA, 25 bp, Homo sapien
tcatgagccacaaacggacgtcatt

SEQ ID NO: 225502 - DNA, 25 bp, Homo sapien
gacgtcattgagtgcagaggatgct

SEQ ID NO: 225503 - DNA, 25 bp, Homo sapien
gaagatatagagaccccaccaacaa

SEQ ID NO: 225504 - DNA, 25 bp, Homo sapien
agagaccccaccaacaagaaacatt

SEQ ID NO: 225505 - DNA, 25 bp, Homo sapien
agacacacggatccctgttatcaat

SEQ ID NO: 225506 - DNA, 25 bp, Homo sapien
ggatccctgttatcaatcttgaaga

SEQ ID NO: 225507 - DNA, 25 bp, Homo sapien
aatcttgaagatgggactaggctgg

SEQ ID NO: 225508 - DNA, 25 bp, Homo sapien
tggctgaagctgcaccctacttaca

SEQ ID NO: 225509 - DNA, 25 bp, Homo sapien
tgcaccctacttacactgttgatat

SEQ ID NO: 225510 - DNA, 25 bp, Homo sapien
gatatgccaagttatgtaccaaaga

SEQ ID NO: 225511 - DNA, 25 bp, Homo sapien
ttcctcatttcagaaaccgaaacag

SEQ ID NO: 225512 - DNA, 25 bp, Homo sapien
ctacagcgctaaccggtggccttga

SEQ ID NO: 225513 - DNA, 25 bp, Homo sapien
cagcgctaaccggtggccttgaagg

SEQ ID NO: 225514 - DNA, 25 bp, Homo sapien
taaccggtggccttgaagggatcct

SEQ ID NO: 225515 - DNA, 25 bp, Homo sapien
ggtggccttgaagggatcctcgaaa

SEQ ID NO: 225516 - DNA, 25 bp, Homo sapien
gggatcctcgaaaagccttaagcgg

SEQ ID NO: 225517 - DNA, 25 bp, Homo sapien
gggaggtgccctatcacagacggaa

SEQ ID NO: 225518 - DNA, 25 bp, Homo sapien
gtgccctatcacagacggaaatccc

SEQ ID NO: 225519 - DNA, 25 bp, Homo sapien
tcacagacggaaatccccgagagga

SEQ ID NO: 225520 - DNA, 25 bp, Homo sapien
gctttaaggtgacggtcgaagccca

SEQ ID NO: 225521 - DNA, 25 bp, Homo sapien
tacccagatcccttcgcacgaattt

SEQ ID NO: 225522 - DNA, 25 bp, Homo sapien
ttcgcacgaatttcacccttgatca

SEQ ID NO: 225523 - DNA, 25 bp, Homo sapien
aaaaaacagtttctcagtccatgta

SEQ ID NO: 225524 - DNA, 25 bp, Homo sapien
acagtttctcagtccatgtaaccac

SEQ ID NO: 225525 - DNA, 25 bp, Homo sapien
tttctcagtccatgtaaccaccttt

SEQ ID NO: 225526 - DNA, 25 bp, Homo sapien
tcagtccatgtaaccacctttcaaa

SEQ ID NO: 225527 - DNA, 25 bp, Homo sapien
gtccatgtaaccacctttcaaatga

SEQ ID NO: 225528 - DNA, 25 bp, Homo sapien
atgtaaccacctttcaaatgatcag

SEQ ID NO: 225529 - DNA, 25 bp, Homo sapien
accacctttcaaatgatcagtagcc

SEQ ID NO: 225530 - DNA, 25 bp, Homo sapien
gtggttaccatattagacaattgag

SEQ ID NO: 225531 - DNA, 25 bp, Homo sapien
atcatcacagaaagtacggttggac

SEQ ID NO: 225532 - DNA, 25 bp, Homo sapien
gaaagtacggttggactatgggcca

SEQ ID NO: 225533 - DNA, 25 bp, Homo sapien
acggttggactatgggccaaatcta

SEQ ID NO: 225534 - DNA, 25 bp, Homo sapien
ggcccatgggccattctggaatgta

SEQ ID NO: 225535 - DNA, 25 bp, Homo sapien
atttcgtgtgaagatcctggatcca

SEQ ID NO: 225536 - DNA, 25 bp, Homo sapien
atcctggatccaaactatagtttct

SEQ ID NO: 225537 - DNA, 25 bp, Homo sapien
gtaacctaacagctatgtttgcaat

SEQ ID NO: 225538 - DNA, 25 bp, Homo sapien
tgattcccagtccaagtgtctacct

SEQ ID NO: 225539 - DNA, 25 bp, Homo sapien
tggtagcttctttcctcttcgtcct

SEQ ID NO: 225540 - DNA, 25 bp, Homo sapien
tcttcgtcctgatgctgctcttctt

SEQ ID NO: 225541 - DNA, 25 bp, Homo sapien
cactattcttgttttgagctacttt

SEQ ID NO: 225542 - DNA, 25 bp, Homo sapien
gagctactttcggtacatgaggatt

SEQ ID NO: 225543 - DNA, 25 bp, Homo sapien
gacgatatatttatgaaccacttca

SEQ ID NO: 225544 - DNA, 25 bp, Homo sapien
gtaaccatatattttggcccatggg

SEQ ID NO: 225545 - DNA, 25 bp, Homo sapien
tctccctgttcttgcaactcaccct

SEQ ID NO: 225546 - DNA, 25 bp, Homo sapien
tatttctgtttctgattccctctct

SEQ ID NO: 225547 - DNA, 25 bp, Homo sapien
tctgtttctgattccctctctctgt

SEQ ID NO: 225548 - DNA, 25 bp, Homo sapien
ctctctctgtctcctgattttctct

SEQ ID NO: 225549 - DNA, 25 bp, Homo sapien
cctgattttctctctctccaacttt

SEQ ID NO: 225550 - DNA, 25 bp, Homo sapien
caactttctctctatacctctctga

SEQ ID NO: 225551 - DNA, 25 bp, Homo sapien
tttctctctatacctctctgattct

SEQ ID NO: 225552 - DNA, 25 bp, Homo sapien
tatacctctctgattctccctctgt

SEQ ID NO: 225553 - DNA, 25 bp, Homo sapien
gtccccacggagtctggaccatgga

SEQ ID NO: 225554 - DNA, 25 bp, Homo sapien
cccacggagtctggaccatggagga

SEQ ID NO: 225555 - DNA, 25 bp, Homo sapien
ccatggaggagcgaggtctggcccc

SEQ ID NO: 225556 - DNA, 25 bp, Homo sapien
cagagataaggagagccctggctct

SEQ ID NO: 225557 - DNA, 25 bp, Homo sapien
atgatgtgcccctgtggcgggataa

SEQ ID NO: 225558 - DNA, 25 bp, Homo sapien
atgtgcccctgtggcgggataattg

SEQ ID NO: 225559 - DNA, 25 bp, Homo sapien
cctgtggcgggataattgggaaaca

SEQ ID NO: 225560 - DNA, 25 bp, Homo sapien
tctgattcccagagaactaatgagc

SEQ ID NO: 225561 - DNA, 25 bp, Homo sapien
ttcccagagaactaatgagctgcaa

SEQ ID NO: 225562 - DNA, 25 bp, Homo sapien
tagacagggaagaattgctttcggg

SEQ ID NO: 225563 - DNA, 25 bp, Homo sapien
gggagaagccacttactcggctcgc

SEQ ID NO: 225564 - DNA, 25 bp, Homo sapien
gaagccacttactcggctcgccttg

SEQ ID NO: 225565 - DNA, 25 bp, Homo sapien
gggccgtggtcctgcctaaactctc

SEQ ID NO: 225566 - DNA, 25 bp, Homo sapien
gtggtcctgcctaaactctcacatc

SEQ ID NO: 225567 - DNA, 25 bp, Homo sapien
gggtccccacggagtctggaccatg

SEQ ID NO: 225568 - DNA, 25 bp, Homo sapien
ggtccccacggagtctggaccatgg

SEQ ID NO: 225569 - DNA, 25 bp, Homo sapien
gtccccacggagtctggaccatgga

SEQ ID NO: 225570 - DNA, 25 bp, Homo sapien
tccccacggagtctggaccatggag

SEQ ID NO: 225571 - DNA, 25 bp, Homo sapien
ccccacggagtctggaccatggagg

SEQ ID NO: 225572 - DNA, 25 bp, Homo sapien
cccacggagtctggaccatggagga

SEQ ID NO: 225573 - DNA, 25 bp, Homo sapien
gaccatggaggagcgaggtctggcc

SEQ ID NO: 225574 - DNA, 25 bp, Homo sapien
ccatggaggagcgaggtctggcccc

SEQ ID NO: 225575 - DNA, 25 bp, Homo sapien
atggaggagcgaggtctggccccca

SEQ ID NO: 225576 - DNA, 25 bp, Homo sapien
tggaggagcgaggtctggcccccaa

SEQ ID NO: 225577 - DNA, 25 bp, Homo sapien
ggaggagcgaggtctggcccccaag

SEQ ID NO: 225578 - DNA, 25 bp, Homo sapien
atttcttatgaaatgtctgaattgt

SEQ ID NO: 225579 - DNA, 25 bp, Homo sapien
atgaaatgtctgaattgtttttatt

SEQ ID NO: 225580 - DNA, 25 bp, Homo sapien
tttattgttcctttgtatgtaatgt

SEQ ID NO: 225581 - DNA, 25 bp, Homo sapien
attgttcctttgtatgtaatgtttg

SEQ ID NO: 225582 - DNA, 25 bp, Homo sapien
ctgtgatatgcctatgactgatatt

SEQ ID NO: 225583 - DNA, 25 bp, Homo sapien
gtgatatgcctatgactgatattct

SEQ ID NO: 225584 - DNA, 25 bp, Homo sapien
gatatgcctatgactgatattcttt

SEQ ID NO: 225585 - DNA, 25 bp, Homo sapien
tatgcctatgactgatattctttgt

SEQ ID NO: 225586 - DNA, 25 bp, Homo sapien
atgcctatgactgatattctttgta

SEQ ID NO: 225587 - DNA, 25 bp, Homo sapien
aagcaaaagaattctgtcaagatat

SEQ ID NO: 225588 - DNA, 25 bp, Homo sapien
aaaaatgtagttcatatcttcaggc

SEQ ID NO: 225589 - DNA, 25 bp, Homo sapien
tgtgctgttctaaatccttacaagc

SEQ ID NO: 225590 - DNA, 25 bp, Homo sapien
aagcacttcagatttcgtacattgg

SEQ ID NO: 225591 - DNA, 25 bp, Homo sapien
tttaatctgagagacccatctgcct

SEQ ID NO: 225592 - DNA, 25 bp, Homo sapien
gtaagatcaaaaggactagctggtt

SEQ ID NO: 225593 - DNA, 25 bp, Homo sapien
aggaagaatgtctgggacctggccc

SEQ ID NO: 225594 - DNA, 25 bp, Homo sapien
ggacctggcccattataatagtata

SEQ ID NO: 225595 - DNA, 25 bp, Homo sapien
atctggacttagattttgaactcta

SEQ ID NO: 225596 - DNA, 25 bp, Homo sapien
tgtacagttggaatggaacacttgt

SEQ ID NO: 225597 - DNA, 25 bp, Homo sapien
ctaagaaatgttttgtatctccttt

SEQ ID NO: 225598 - DNA, 25 bp, Homo sapien
gtatctcctttgttccgggtagtct

SEQ ID NO: 225599 - DNA, 25 bp, Homo sapien
ttccgggtagtctgtgctgttctaa

SEQ ID NO: 225600 - DNA, 25 bp, Homo sapien
gtttgtattgctctaagttgtattc

SEQ ID NO: 225601 - DNA, 25 bp, Homo sapien
tagcactttcatatgtttctgcatt

SEQ ID NO: 225602 - DNA, 25 bp, Homo sapien
gcatttgaaccttgcaataagcctg

SEQ ID NO: 225603 - DNA, 25 bp, Homo sapien
caataagcctgtgtggtaggccaca

SEQ ID NO: 225604 - DNA, 25 bp, Homo sapien
gtggtaggccacataggtccgaata

SEQ ID NO: 225605 - DNA, 25 bp, Homo sapien
tccgaataacctagttttacagttg

SEQ ID NO: 225606 - DNA, 25 bp, Homo sapien
gagctcagattcagttctttgccga

SEQ ID NO: 225607 - DNA, 25 bp, Homo sapien
ttgccgaagccctcatagctggtaa

SEQ ID NO: 225608 - DNA, 25 bp, Homo sapien
taagtggctttgcatattagaaccc

SEQ ID NO: 225609 - DNA, 25 bp, Homo sapien
ctctctaaatctaatgctcgctcta

SEQ ID NO: 225610 - DNA, 25 bp, Homo sapien
aatgctcgctctatgtggttatgta

SEQ ID NO: 225611 - DNA, 25 bp, Homo sapien
cgcagtctcactcctcattgggggg

SEQ ID NO: 225612 - DNA, 25 bp, Homo sapien
ggcccaggattacgtcatccagttt

SEQ ID NO: 225613 - DNA, 25 bp, Homo sapien
gcccaggattacgtcatccagtttg

SEQ ID NO: 225614 - DNA, 25 bp, Homo sapien
ccaggattacgtcatccagtttgct

SEQ ID NO: 225615 - DNA, 25 bp, Homo sapien
aggattacgtcatccagtttgctca

SEQ ID NO: 225616 - DNA, 25 bp, Homo sapien
gatacaggcacacctgtcatcgtag

SEQ ID NO: 225617 - DNA, 25 bp, Homo sapien
acaggcacacctgtcatcgtaggac

SEQ ID NO: 225618 - DNA, 25 bp, Homo sapien
aggcacacctgtcatcgtaggaccc

SEQ ID NO: 225619 - DNA, 25 bp, Homo sapien
ggcacacctgtcatcgtaggaccca

SEQ ID NO: 225620 - DNA, 25 bp, Homo sapien
acctgtcatcgtaggacccactgag

SEQ ID NO: 225621 - DNA, 25 bp, Homo sapien
ctgtcatcgtaggacccactgagga

SEQ ID NO: 225622 - DNA, 25 bp, Homo sapien
ctacgaccagctcatcatcgacggg

SEQ ID NO: 225623 - DNA, 25 bp, Homo sapien
tcatcgacgggctcctctcgaagat

SEQ ID NO: 225624 - DNA, 25 bp, Homo sapien
ggctcctctcgaagatcctgagcga

SEQ ID NO: 225625 - DNA, 25 bp, Homo sapien
aggacgccgacgagatcgagtacct

SEQ ID NO: 225626 - DNA, 25 bp, Homo sapien
agatcgagtacctggtggacggctc

SEQ ID NO: 225627 - DNA, 25 bp, Homo sapien
cgtggtgcccgatccgcgccgaaaa

SEQ ID NO: 225628 - DNA, 25 bp, Homo sapien
atccgcgccgaaaaggagcgcagct

SEQ ID NO: 225629 - DNA, 25 bp, Homo sapien
aaaaggagcgcagctgcagcccgca

SEQ ID NO: 225630 - DNA, 25 bp, Homo sapien
tgggcccctcggacgccaatgggct

SEQ ID NO: 225631 - DNA, 25 bp, Homo sapien
agcgtcaacgggagcggtgccctgg

SEQ ID NO: 225632 - DNA, 25 bp, Homo sapien
agccgggcgccgatgtggtggacct

SEQ ID NO: 225633 - DNA, 25 bp, Homo sapien
tcctgctgaaatacatctgcagctg

SEQ ID NO: 225634 - DNA, 25 bp, Homo sapien
ctgaaatacatctgcagctgacaat

SEQ ID NO: 225635 - DNA, 25 bp, Homo sapien
ctgcagctgacaatgagagaagaaa

SEQ ID NO: 225636 - DNA, 25 bp, Homo sapien
tgtctctccccaaagtcatcatggg

SEQ ID NO: 225637 - DNA, 25 bp, Homo sapien
ctccccaaagtcatcatgggttttg

SEQ ID NO: 225638 - DNA, 25 bp, Homo sapien
ggacattgggaatacccagccaact

SEQ ID NO: 225639 - DNA, 25 bp, Homo sapien
ttgggaatacccagccaactctcca

SEQ ID NO: 225640 - DNA, 25 bp, Homo sapien
agccaactctccaccatcaatgtaa

SEQ ID NO: 225641 - DNA, 25 bp, Homo sapien
tctccaccatcaatgtaactccatg

SEQ ID NO: 225642 - DNA, 25 bp, Homo sapien
gtaactccatggacattgctgctct

SEQ ID NO: 225643 - DNA, 25 bp, Homo sapien
aactccatggacattgctgctcttg

SEQ ID NO: 225644 - DNA, 25 bp, Homo sapien
atgcttttcttaagttgaaggcaca

SEQ ID NO: 225645 - DNA, 25 bp, Homo sapien
atggctgtattgttgctattccgtt

SEQ ID NO: 225646 - DNA, 25 bp, Homo sapien
gctattccgttgctgacatgttttt

SEQ ID NO: 225647 - DNA, 25 bp, Homo sapien
aaagctttaacattcctgctactaa

SEQ ID NO: 225648 - DNA, 25 bp, Homo sapien
acattcctgctactaattttggcgg

SEQ ID NO: 225649 - DNA, 25 bp, Homo sapien
gcggagagtgtttgccaggtttcaa

SEQ ID NO: 225650 - DNA, 25 bp, Homo sapien
aggtttcaatgtgggctgcagcttt

SEQ ID NO: 225651 - DNA, 25 bp, Homo sapien
tgggctgcagctttttgtgctcctt

SEQ ID NO: 225652 - DNA, 25 bp, Homo sapien
gctccttctctggtttgcagtgtaa

SEQ ID NO: 225653 - DNA, 25 bp, Homo sapien
gattatgcctcttatctacttgaga

SEQ ID NO: 225654 - DNA, 25 bp, Homo sapien
gagagcaacatgtcttttcaatcat

SEQ ID NO: 225655 - DNA, 25 bp, Homo sapien
gtctctcagtagtatagcggttact

SEQ ID NO: 225656 - DNA, 25 bp, Homo sapien
atagcggttacttcatgcctcaaga

SEQ ID NO: 225657 - DNA, 25 bp, Homo sapien
atgcctcaagatttgggtacctgga

SEQ ID NO: 225658 - DNA, 25 bp, Homo sapien
gatttgggtacctggattgctaaac

SEQ ID NO: 225659 - DNA, 25 bp, Homo sapien
acctggattgctaaactggattgtt

SEQ ID NO: 225660 - DNA, 25 bp, Homo sapien
taaaatgagccagtgagctacagca

SEQ ID NO: 225661 - DNA, 25 bp, Homo sapien
tgagctacagcactttggaaaattt

SEQ ID NO: 225662 - DNA, 25 bp, Homo sapien
gaagtgttatataccaaaatgccaa

SEQ ID NO: 225663 - DNA, 25 bp, Homo sapien
tttccacgacagacttaactgtata

SEQ ID NO: 225664 - DNA, 25 bp, Homo sapien
gacttaactgtataatttcgttgta

SEQ ID NO: 225665 - DNA, 25 bp, Homo sapien
taattaatagaaagaccaaccggca

SEQ ID NO: 225666 - DNA, 25 bp, Homo sapien
aggagagatgtcttaccagcagcag

SEQ ID NO: 225667 - DNA, 25 bp, Homo sapien
ggagagatgtcttaccagcagcagc

SEQ ID NO: 225668 - DNA, 25 bp, Homo sapien
ttgtccacctgagcattgcccacct

SEQ ID NO: 225669 - DNA, 25 bp, Homo sapien
cacctccaccatgccaggataaatg

SEQ ID NO: 225670 - DNA, 25 bp, Homo sapien
aggataaatgccctcctgtgcaacc

SEQ ID NO: 225671 - DNA, 25 bp, Homo sapien
ggataaatgccctcctgtgcaacca

SEQ ID NO: 225672 - DNA, 25 bp, Homo sapien
ataaatgccctcctgtgcaaccata

SEQ ID NO: 225673 - DNA, 25 bp, Homo sapien
ctgccagcagaagtatccacccaag

SEQ ID NO: 225674 - DNA, 25 bp, Homo sapien
caagagcaagtaacatcactagaat

SEQ ID NO: 225675 - DNA, 25 bp, Homo sapien
gtaacatcactagaattcatcagga

SEQ ID NO: 225676 - DNA, 25 bp, Homo sapien
taacatcactagaattcatcaggac

SEQ ID NO: 225677 - DNA, 25 bp, Homo sapien
tgaaattaatgttgaaagagcacca

SEQ ID NO: 225678 - DNA, 25 bp, Homo sapien
gagcaccagagagtatacatccaaa

SEQ ID NO: 225679 - DNA, 25 bp, Homo sapien
agaaaattagatcatcaccagactt

SEQ ID NO: 225680 - DNA, 25 bp, Homo sapien
agacttttcaacagcattgccttat

SEQ ID NO: 225681 - DNA, 25 bp, Homo sapien
ttttcaacagcattgccttatgctt

SEQ ID NO: 225682 - DNA, 25 bp, Homo sapien
ttgccttatgctttaagaaagtgtt

SEQ ID NO: 225683 - DNA, 25 bp, Homo sapien
gaaagtgttgtaccacatttgatat

SEQ ID NO: 225684 - DNA, 25 bp, Homo sapien
gttgtaccacatttgatatcctgat

SEQ ID NO: 225685 - DNA, 25 bp, Homo sapien
accacatttgatatcctgatggaaa

SEQ ID NO: 225686 - DNA, 25 bp, Homo sapien
gtgagccaaggattttacacccaac

SEQ ID NO: 225687 - DNA, 25 bp, Homo sapien
gagccaaggattttacacccaacaa

SEQ ID NO: 225688 - DNA, 25 bp, Homo sapien
taagtcattcacaaaaagccaggag

SEQ ID NO: 225689 - DNA, 25 bp, Homo sapien
taataatttgccttgtgtggtcagc

SEQ ID NO: 225690 - DNA, 25 bp, Homo sapien
gtgtggtcagcacttaactgtttac

SEQ ID NO: 225691 - DNA, 25 bp, Homo sapien
gcacttaactgtttacaaagccctt

SEQ ID NO: 225692 - DNA, 25 bp, Homo sapien
aaagccctttcacatgcacagcagg

SEQ ID NO: 225693 - DNA, 25 bp, Homo sapien
ggcctgtgctggaagcatatcccgt

SEQ ID NO: 225694 - DNA, 25 bp, Homo sapien
atatcccgtgaaaagtgttagtgcc

SEQ ID NO: 225695 - DNA, 25 bp, Homo sapien
gttagtgccttaggtgaaagcaaca

SEQ ID NO: 225696 - DNA, 25 bp, Homo sapien
atttctgacatagcttaagttttcc

SEQ ID NO: 225697 - DNA, 25 bp, Homo sapien
ttccagtaactctaaactccatctc

SEQ ID NO: 225698 - DNA, 25 bp, Homo sapien
actccatctcctttatcgtcattaa

SEQ ID NO: 225699 - DNA, 25 bp, Homo sapien
ccttcctttgtcctaatcctggaat

SEQ ID NO: 225700 - DNA, 25 bp, Homo sapien
ttcctttgtcctaatcctggaatta

SEQ ID NO: 225701 - DNA, 25 bp, Homo sapien
tgcaaagaaccccagtttcctattt

SEQ ID NO: 225702 - DNA, 25 bp, Homo sapien
gaaccccagtttcctatttggatgc

SEQ ID NO: 225703 - DNA, 25 bp, Homo sapien
agtttcctatttggatgcccctaca

SEQ ID NO: 225704 - DNA, 25 bp, Homo sapien
atttggatgcccctacactgttgtg

SEQ ID NO: 225705 - DNA, 25 bp, Homo sapien
ttggatgcccctacactgttgtgtt

SEQ ID NO: 225706 - DNA, 25 bp, Homo sapien
atgcccctacactgttgtgtttcag

SEQ ID NO: 225707 - DNA, 25 bp, Homo sapien
cctacactgttgtgtttcagtggaa

SEQ ID NO: 225708 - DNA, 25 bp, Homo sapien
agagaggctggtgggtccctctccc

SEQ ID NO: 225709 - DNA, 25 bp, Homo sapien
gctggtgggtccctctcccaaagga

SEQ ID NO: 225710 - DNA, 25 bp, Homo sapien
aagcaagaggtggaaccctccacgt

SEQ ID NO: 225711 - DNA, 25 bp, Homo sapien
gaggtggaaccctccacgtagcgag

SEQ ID NO: 225712 - DNA, 25 bp, Homo sapien
tgctggtcaccaccaagggcatttg

SEQ ID NO: 225713 - DNA, 25 bp, Homo sapien
aagggcatttggttgccaagctcca

SEQ ID NO: 225714 - DNA, 25 bp, Homo sapien
tttggttgccaagctccagctttga

SEQ ID NO: 225715 - DNA, 25 bp, Homo sapien
gaagaaccaaattaagctaccatga

SEQ ID NO: 225716 - DNA, 25 bp, Homo sapien
caggaaggttgggattctctgtgca

SEQ ID NO: 225717 - DNA, 25 bp, Homo sapien
cagagactttggttccccacgcagc

SEQ ID NO: 225718 - DNA, 25 bp, Homo sapien
cttggaagaagcacatgaccgtact

SEQ ID NO: 225719 - DNA, 25 bp, Homo sapien
agaagcacatgaccgtactctgcgt

SEQ ID NO: 225720 - DNA, 25 bp, Homo sapien
agcacatgaccgtactctgcgtggg

SEQ ID NO: 225721 - DNA, 25 bp, Homo sapien
cggagccttgcaccgaacgttttgc

SEQ ID NO: 225722 - DNA, 25 bp, Homo sapien
gttttgccccagacgaggcgtcctg

SEQ ID NO: 225723 - DNA, 25 bp, Homo sapien
aggctgtcaggcttcgctctgcctg

SEQ ID NO: 225724 - DNA, 25 bp, Homo sapien
aggcgtcctgtcagccgaggcgtaa

SEQ ID NO: 225725 - DNA, 25 bp, Homo sapien
agccgaggcgtaatcctgctgccca

SEQ ID NO: 225726 - DNA, 25 bp, Homo sapien
agtcaacccgaggtgctgtgctgca

SEQ ID NO: 225727 - DNA, 25 bp, Homo sapien
tgcaggacagtctccagcgcgtgct

SEQ ID NO: 225728 - DNA, 25 bp, Homo sapien
agcgcgtgctcgtttaccgccttaa

SEQ ID NO: 225729 - DNA, 25 bp, Homo sapien
gtttaccgccttaatgattcaccta

SEQ ID NO: 225730 - DNA, 25 bp, Homo sapien
gaccccgactctaattctgcctggg

SEQ ID NO: 225731 - DNA, 25 bp, Homo sapien
tgcagctggtgctcgccggaaccca

SEQ ID NO: 225732 - DNA, 25 bp, Homo sapien
gcagccttggataccagccttgaat

SEQ ID NO: 225733 - DNA, 25 bp, Homo sapien
ggataccagccttgaatcgagccga

SEQ ID NO: 225734 - DNA, 25 bp, Homo sapien
agccttgaatcgagccgactacggc

SEQ ID NO: 225735 - DNA, 25 bp, Homo sapien
cgggccagcctcttgatgcaccggg

SEQ ID NO: 225736 - DNA, 25 bp, Homo sapien
cagggccccatctgtgtctttcgct

SEQ ID NO: 225737 - DNA, 25 bp, Homo sapien
atctgtgtctttcgctctcgagccc

SEQ ID NO: 225738 - DNA, 25 bp, Homo sapien
cccagctagagttggcttcagcgga

SEQ ID NO: 225739 - DNA, 25 bp, Homo sapien
gagttggcttcagcggaatacctac

SEQ ID NO: 225740 - DNA, 25 bp, Homo sapien
ggcttcagcggaatacctactgtgc

SEQ ID NO: 225741 - DNA, 25 bp, Homo sapien
agcggaatacctactgtgcaggatt

SEQ ID NO: 225742 - DNA, 25 bp, Homo sapien
gtgcaggattattcaacaagccgat

SEQ ID NO: 225743 - DNA, 25 bp, Homo sapien
ccactggtgggtggtacacgcagcc

SEQ ID NO: 225744 - DNA, 25 bp, Homo sapien
gcagcagagccctatgtggcctggg

SEQ ID NO: 225745 - DNA, 25 bp, Homo sapien
gatgttttgcttcagagagcactgt

SEQ ID NO: 225746 - DNA, 25 bp, Homo sapien
ttgcttcagagagcactgttcctgc

SEQ ID NO: 225747 - DNA, 25 bp, Homo sapien
gctctgccgagggttaggtaaagaa

SEQ ID NO: 225748 - DNA, 25 bp, Homo sapien
gtaaagaacaggactcagggagctc

SEQ ID NO: 225749 - DNA, 25 bp, Homo sapien
agggagctcaacgtcagacctgtaa

SEQ ID NO: 225750 - DNA, 25 bp, Homo sapien
acgtcagacctgtaacctcttctct

SEQ ID NO: 225751 - DNA, 25 bp, Homo sapien
cctcttctctctggtgataaccaga

SEQ ID NO: 225752 - DNA, 25 bp, Homo sapien
ggtgataaccagaggcctcttagtc

SEQ ID NO: 225753 - DNA, 25 bp, Homo sapien
gaggcctcttagtcagagattcctt

SEQ ID NO: 225754 - DNA, 25 bp, Homo sapien
ctcatcaaagcagaatgctatcttg

SEQ ID NO: 225755 - DNA, 25 bp, Homo sapien
tggtcatttccctgttcacttactg

SEQ ID NO: 225756 - DNA, 25 bp, Homo sapien
atttccctgttcacttactgacatg

SEQ ID NO: 225757 - DNA, 25 bp, Homo sapien
ttccctgttcacttactgacatgtg

SEQ ID NO: 225758 - DNA, 25 bp, Homo sapien
tactgacatgtgaagaagggtttct

SEQ ID NO: 225759 - DNA, 25 bp, Homo sapien
gtgaagaagggtttcttgctttctt

SEQ ID NO: 225760 - DNA, 25 bp, Homo sapien
tcttgctttcttaaacatttccgta

SEQ ID NO: 225761 - DNA, 25 bp, Homo sapien
ttaaacatttccgtaaggcaggcta

SEQ ID NO: 225762 - DNA, 25 bp, Homo sapien
aacatttccgtaaggcaggctagaa

SEQ ID NO: 225763 - DNA, 25 bp, Homo sapien
ggcaggctagaaatgtaatacttca

SEQ ID NO: 225764 - DNA, 25 bp, Homo sapien
atgtttgatgattatggtcttttga

SEQ ID NO: 225765 - DNA, 25 bp, Homo sapien
actcctgcacgtttaaatattgttt

SEQ ID NO: 225766 - DNA, 25 bp, Homo sapien
gacaataagctactagtgattttta

SEQ ID NO: 225767 - DNA, 25 bp, Homo sapien
tagcaaataatatagcacactcatg

SEQ ID NO: 225768 - DNA, 25 bp, Homo sapien
agcacactcatgaacctaattccca

SEQ ID NO: 225769 - DNA, 25 bp, Homo sapien
cactcatgaacctaattcccacatt

SEQ ID NO: 225770 - DNA, 25 bp, Homo sapien
gaacctaattcccacatttgatagt

SEQ ID NO: 225771 - DNA, 25 bp, Homo sapien
ttgatagttgttacattttgccatg

SEQ ID NO: 225772 - DNA, 25 bp, Homo sapien
gccatgtttgtttaaaggtctaagt

SEQ ID NO: 225773 - DNA, 25 bp, Homo sapien
gcagtaagtgagaacttttattcta

SEQ ID NO: 225774 - DNA, 25 bp, Homo sapien
ttttattctatttactcctgcacgt

SEQ ID NO: 225775 - DNA, 25 bp, Homo sapien
attctatttactcctgcacgtttaa

SEQ ID NO: 225776 - DNA, 25 bp, Homo sapien
agcattgcaggattcctgggagcac

SEQ ID NO: 225777 - DNA, 25 bp, Homo sapien
agtttgctaactccagccctgggaa

SEQ ID NO: 225778 - DNA, 25 bp, Homo sapien
agccctgggaactctacagactcgg

SEQ ID NO: 225779 - DNA, 25 bp, Homo sapien
tctacagactcggaggtcagtgcct

SEQ ID NO: 225780 - DNA, 25 bp, Homo sapien
gtttcaggcagattctcaggcttga

SEQ ID NO: 225781 - DNA, 25 bp, Homo sapien
tctcaggcttgagctcctcagaaaa

SEQ ID NO: 225782 - DNA, 25 bp, Homo sapien
agctcccagcttgagaaggaaaaac

SEQ ID NO: 225783 - DNA, 25 bp, Homo sapien
gttttcgttgagtccccacctatat

SEQ ID NO: 225784 - DNA, 25 bp, Homo sapien
gagtccccacctatattttaaatct

SEQ ID NO: 225785 - DNA, 25 bp, Homo sapien
gatggacacttctgctgtttagctt

SEQ ID NO: 225786 - DNA, 25 bp, Homo sapien
tgtttagctttctctgcctcttgct

SEQ ID NO: 225787 - DNA, 25 bp, Homo sapien
gaccggccgcagccttggataccag

SEQ ID NO: 225788 - DNA, 25 bp, Homo sapien
ggccgcagccttggataccagcctt

SEQ ID NO: 225789 - DNA, 25 bp, Homo sapien
cgggccagcctcttgatgcaccggg

SEQ ID NO: 225790 - DNA, 25 bp, Homo sapien
cagcctcttgatgcaccggggacgg

SEQ ID NO: 225791 - DNA, 25 bp, Homo sapien
cccagctagagttggcttcagcgga

SEQ ID NO: 225792 - DNA, 25 bp, Homo sapien
ccagctagagttggcttcagcggaa

SEQ ID NO: 225793 - DNA, 25 bp, Homo sapien
gctagagttggcttcagcggaatac

SEQ ID NO: 225794 - DNA, 25 bp, Homo sapien
tagagttggcttcagcggaatacct

SEQ ID NO: 225795 - DNA, 25 bp, Homo sapien
gagttggcttcagcggaatacctac

SEQ ID NO: 225796 - DNA, 25 bp, Homo sapien
ttggcttcagcggaatacctactgt

SEQ ID NO: 225797 - DNA, 25 bp, Homo sapien
ggcttcagcggaatacctactgtgc

SEQ ID NO: 225798 - DNA, 25 bp, Homo sapien
gttggtgaacagttgctccagttat

SEQ ID NO: 225799 - DNA, 25 bp, Homo sapien
gttgctccagttatgggaacgtctt

SEQ ID NO: 225800 - DNA, 25 bp, Homo sapien
cagttatgggaacgtcttcccttgg

SEQ ID NO: 225801 - DNA, 25 bp, Homo sapien
aaaaaacacaactgattgacactca

SEQ ID NO: 225802 - DNA, 25 bp, Homo sapien
gaactcttagctgtggaagaacatc

SEQ ID NO: 225803 - DNA, 25 bp, Homo sapien
gctgtggaagaacatcatgcctatt

SEQ ID NO: 225804 - DNA, 25 bp, Homo sapien
catgcctatttataaccactgaatg

SEQ ID NO: 225805 - DNA, 25 bp, Homo sapien
taaccactgaatgcactgactttca

SEQ ID NO: 225806 - DNA, 25 bp, Homo sapien
gtgtgtgttacgaatgggcttttta

SEQ ID NO: 225807 - DNA, 25 bp, Homo sapien
gagtgttgctttagaactaccatct

SEQ ID NO: 225808 - DNA, 25 bp, Homo sapien
gaactaccatcttcatatacaggag

SEQ ID NO: 225809 - DNA, 25 bp, Homo sapien
gcacctttctctagaagttcatagc

SEQ ID NO: 225810 - DNA, 25 bp, Homo sapien
aagttcatagcactgtgtattcccc

SEQ ID NO: 225811 - DNA, 25 bp, Homo sapien
cccctttattgttcttatcacataa

SEQ ID NO: 225812 - DNA, 25 bp, Homo sapien
ttttgatggtttggacactagttgt

SEQ ID NO: 225813 - DNA, 25 bp, Homo sapien
ggacactagttgttattcctcacta

SEQ ID NO: 225814 - DNA, 25 bp, Homo sapien
gggtaagggcaccagctagcacaat

SEQ ID NO: 225815 - DNA, 25 bp, Homo sapien
agggcaccagctagcacaatgaatg

SEQ ID NO: 225816 - DNA, 25 bp, Homo sapien
atgaatgcacaatacttgtcagagt

SEQ ID NO: 225817 - DNA, 25 bp, Homo sapien
acaatacttgtcagagtgaatgcat

SEQ ID NO: 225818 - DNA, 25 bp, Homo sapien
caaggaaaggcggtatttcaagaag

SEQ ID NO: 225819 - DNA, 25 bp, Homo sapien
gagaagtatcaaatcttccagatta

SEQ ID NO: 225820 - DNA, 25 bp, Homo sapien
tatagggataatggcctccaattct

SEQ ID NO: 225821 - DNA, 25 bp, Homo sapien
ggataatggcctccaattctttatt

SEQ ID NO: 225822 - DNA, 25 bp, Homo sapien
ttagtatggtaggagatctttcaaa

SEQ ID NO: 225823 - DNA, 25 bp, Homo sapien
ggagatctttcaaatgatattgcat

SEQ ID NO: 225824 - DNA, 25 bp, Homo sapien
attgcatataaagtagctggcactt

SEQ ID NO: 225825 - DNA, 25 bp, Homo sapien
gtagctggcacttaagagctaatat

SEQ ID NO: 225826 - DNA, 25 bp, Homo sapien
gagctaatatttacaagggcctgtt

SEQ ID NO: 225827 - DNA, 25 bp, Homo sapien
cagagtcacagtacattaaaattat

SEQ ID NO: 225828 - DNA, 25 bp, Homo sapien
acagatttattgtccatcagctaac

SEQ ID NO: 225829 - DNA, 25 bp, Homo sapien
tttattgtccatcagctaacttgtt

SEQ ID NO: 225830 - DNA, 25 bp, Homo sapien
aataagtccttagtggagaccagat

SEQ ID NO: 225831 - DNA, 25 bp, Homo sapien
taaatagcaatagggtctttcctcc

SEQ ID NO: 225832 - DNA, 25 bp, Homo sapien
aatagcaatagggtctttcctcctt

SEQ ID NO: 225833 - DNA, 25 bp, Homo sapien
atagcaatagggtctttcctccttt

SEQ ID NO: 225834 - DNA, 25 bp, Homo sapien
tagcaatagggtctttcctcctttc

SEQ ID NO: 225835 - DNA, 25 bp, Homo sapien
agcaatagggtctttcctcctttct

SEQ ID NO: 225836 - DNA, 25 bp, Homo sapien
gcaatagggtctttcctcctttctc

SEQ ID NO: 225837 - DNA, 25 bp, Homo sapien
ctcctttctccactccaatggttta

SEQ ID NO: 225838 - DNA, 25 bp, Homo sapien
cctttctccactccaatggtttaat

SEQ ID NO: 225839 - DNA, 25 bp, Homo sapien
actccaatggtttaatgggatagag

SEQ ID NO: 225840 - DNA, 25 bp, Homo sapien
caatggtttaatgggatagaggaat

SEQ ID NO: 225841 - DNA, 25 bp, Homo sapien
ggatagaggaatcaatgtttatatt

SEQ ID NO: 225842 - DNA, 25 bp, Homo sapien
caacaacaagctgggttccggggat

SEQ ID NO: 225843 - DNA, 25 bp, Homo sapien
ggggatgacatctctgtcttcgtca

SEQ ID NO: 225844 - DNA, 25 bp, Homo sapien
ctgggagggccaggcagttactcct

SEQ ID NO: 225845 - DNA, 25 bp, Homo sapien
cctctcacagcccaaattctgaagt

SEQ ID NO: 225846 - DNA, 25 bp, Homo sapien
cacagcccaaattctgaagttgtct

SEQ ID NO: 225847 - DNA, 25 bp, Homo sapien
cccttctttagtggcaacttaactg

SEQ ID NO: 225848 - DNA, 25 bp, Homo sapien
cttaactgaagaagggatgtccgct

SEQ ID NO: 225849 - DNA, 25 bp, Homo sapien
aagaagggatgtccgctatatccaa

SEQ ID NO: 225850 - DNA, 25 bp, Homo sapien
gatgtccgctatatccaaaattaca

SEQ ID NO: 225851 - DNA, 25 bp, Homo sapien
ccgctatatccaaaattacagctat

SEQ ID NO: 225852 - DNA, 25 bp, Homo sapien
tacagctattggcaaataaacgaga

SEQ ID NO: 225853 - DNA, 25 bp, Homo sapien
gaaatcctgaccataaaagaactgc

SEQ ID NO: 225854 - DNA, 25 bp, Homo sapien
tttttgacgaccctgaggtagatgc

SEQ ID NO: 225855 - DNA, 25 bp, Homo sapien
agtacgaaaggttgatgctccaaaa

SEQ ID NO: 225856 - DNA, 25 bp, Homo sapien
gatgctccaaaagatcagatggaca

SEQ ID NO: 225857 - DNA, 25 bp, Homo sapien
gatggacaaagagtgggacgaattc

SEQ ID NO: 225858 - DNA, 25 bp, Homo sapien
gggacgaattccaaaaagccatgag

SEQ ID NO: 225859 - DNA, 25 bp, Homo sapien
gaggcaggtcaacactatttccgaa

SEQ ID NO: 225860 - DNA, 25 bp, Homo sapien
tatttccgaagccatagttgccgaa

SEQ ID NO: 225861 - DNA, 25 bp, Homo sapien
cgaagccatagttgccgaagaggat

SEQ ID NO: 225862 - DNA, 25 bp, Homo sapien
agcagatagagtgttaccgacgggt

SEQ ID NO: 225863 - DNA, 25 bp, Homo sapien
aaagctacggaatcgccaggatgaa

SEQ ID NO: 225864 - DNA, 25 bp, Homo sapien
gtagttcatatcttcaggctgtatt

SEQ ID NO: 225865 - DNA, 25 bp, Homo sapien
tcttcaggctgtattatttcttatg

SEQ ID NO: 225866 - DNA, 25 bp, Homo sapien
atttcttatgaaatgtctgaattgt

SEQ ID NO: 225867 - DNA, 25 bp, Homo sapien
gtctgaattgtttttattgttcctt

SEQ ID NO: 225868 - DNA, 25 bp, Homo sapien
attgttcctttgtatgtaatgtttg

SEQ ID NO: 225869 - DNA, 25 bp, Homo sapien
gtaatgtttgttttgacactaattt

SEQ ID NO: 225870 - DNA, 25 bp, Homo sapien
aatttgtctttggttacagaaactg

SEQ ID NO: 225871 - DNA, 25 bp, Homo sapien
ctgtgatatgcctatgactgatatt

SEQ ID NO: 225872 - DNA, 25 bp, Homo sapien
atgcctatgactgatattctttgta

SEQ ID NO: 225873 - DNA, 25 bp, Homo sapien
aagcaaaagaattctgtcaagatat

SEQ ID NO: 225874 - DNA, 25 bp, Homo sapien
aaaaatgtagttcatatcttcaggc

SEQ ID NO: 225875 - DNA, 25 bp, Homo sapien
tgtgaagatccaaatccaattcagc

SEQ ID NO: 225876 - DNA, 25 bp, Homo sapien
aattcagcaacctccatcaggcaga

SEQ ID NO: 225877 - DNA, 25 bp, Homo sapien
acctccatcaggcagaaaccttctg

SEQ ID NO: 225878 - DNA, 25 bp, Homo sapien
aaaccttctgcaatcctcacatgag

SEQ ID NO: 225879 - DNA, 25 bp, Homo sapien
tcctcacatgaggaactggttcaca

SEQ ID NO: 225880 - DNA, 25 bp, Homo sapien
actggttcacagtgtacacagcatg

SEQ ID NO: 225881 - DNA, 25 bp, Homo sapien
cagtgtacacagcatggagccatta

SEQ ID NO: 225882 - DNA, 25 bp, Homo sapien
acacagcatggagccattagtgacg

SEQ ID NO: 225883 - DNA, 25 bp, Homo sapien
aaattaggaacaggaatgctcttta

SEQ ID NO: 225884 - DNA, 25 bp, Homo sapien
ggaatgctctttaaactcaggaaga

SEQ ID NO: 225885 - DNA, 25 bp, Homo sapien
ctttaaactcaggaagatcttttgg

SEQ ID NO: 225886 - DNA, 25 bp, Homo sapien
agcttgcttccagaatggcctagga

SEQ ID NO: 225887 - DNA, 25 bp, Homo sapien
ttccagaatggcctaggaccctcct

SEQ ID NO: 225888 - DNA, 25 bp, Homo sapien
ttttggttcatgtggcataatcatc

SEQ ID NO: 225889 - DNA, 25 bp, Homo sapien
catgtggcataatcatctttcaaaa

SEQ ID NO: 225890 - DNA, 25 bp, Homo sapien
gaaaatgatgttaccactaaaatat

SEQ ID NO: 225891 - DNA, 25 bp, Homo sapien
tttctccaagaaggcatactgtaac

SEQ ID NO: 225892 - DNA, 25 bp, Homo sapien
taagaattgattgtgctgaatgttc

SEQ ID NO: 225893 - DNA, 25 bp, Homo sapien
ctgaatgttcaaactctggaaactg

SEQ ID NO: 225894 - DNA, 25 bp, Homo sapien
caaactctggaaactgttcacagta

SEQ ID NO: 225895 - DNA, 25 bp, Homo sapien
cacagtatgttgttcttagctgtta

SEQ ID NO: 225896 - DNA, 25 bp, Homo sapien
atgttgttcttagctgttatttata

SEQ ID NO: 225897 - DNA, 25 bp, Homo sapien
aggaatggcctcttcagaatggaga

SEQ ID NO: 225898 - DNA, 25 bp, Homo sapien
aaaagccttccccatgagaacatgc

SEQ ID NO: 225899 - DNA, 25 bp, Homo sapien
cggcaagtggaacagcgctgaatca

SEQ ID NO: 225900 - DNA, 25 bp, Homo sapien
aacagcgctgaatcagcctggtcat

SEQ ID NO: 225901 - DNA, 25 bp, Homo sapien
ccagtcaagcctccagacatgtaag

SEQ ID NO: 225902 - DNA, 25 bp, Homo sapien
agacatgtaagcaccctcctctgat

SEQ ID NO: 225903 - DNA, 25 bp, Homo sapien
agctgcctggcccaaatactgttga

SEQ ID NO: 225904 - DNA, 25 bp, Homo sapien
tgggactcattctgctcgacttgat

SEQ ID NO: 225905 - DNA, 25 bp, Homo sapien
cccaaatactgttgaccactcttga

SEQ ID NO: 225906 - DNA, 25 bp, Homo sapien
tgcccattgatcacatacacacgtt

SEQ ID NO: 225907 - DNA, 25 bp, Homo sapien
atcacatacacacgtttacacctgg

SEQ ID NO: 225908 - DNA, 25 bp, Homo sapien
agaaggaccacccagcagagccaag

SEQ ID NO: 225909 - DNA, 25 bp, Homo sapien
agagccaagccaaatcactgaccct

SEQ ID NO: 225910 - DNA, 25 bp, Homo sapien
aagccaaatcactgaccctcagagg

SEQ ID NO: 225911 - DNA, 25 bp, Homo sapien
ctcagaggcctgatgtgaatgctta

SEQ ID NO: 225912 - DNA, 25 bp, Homo sapien
gtgaatgcttatggcttcagtccat

SEQ ID NO: 225913 - DNA, 25 bp, Homo sapien
ggcttcagtccattggattctgcag

SEQ ID NO: 225914 - DNA, 25 bp, Homo sapien
gattctgcagtaatctgccgatcta

SEQ ID NO: 225915 - DNA, 25 bp, Homo sapien
gccgatctacagtattaccacagta

SEQ ID NO: 225916 - DNA, 25 bp, Homo sapien
accacagtaaataaccgatagacct

SEQ ID NO: 225917 - DNA, 25 bp, Homo sapien
gacctgaaaacgaatgcatgccttg

SEQ ID NO: 225918 - DNA, 25 bp, Homo sapien
acacaggaagcttaccttttcacct

SEQ ID NO: 225919 - DNA, 25 bp, Homo sapien
aagacattcggagaggagttgtcaa

SEQ ID NO: 225920 - DNA, 25 bp, Homo sapien
ggagttgtcaataaccaacagacag

SEQ ID NO: 225921 - DNA, 25 bp, Homo sapien
caacagacagactggtcgtttaagt

SEQ ID NO: 225922 - DNA, 25 bp, Homo sapien
agactggtcgtttaagttggatgga

SEQ ID NO: 225923 - DNA, 25 bp, Homo sapien
ttggatggagttcttcacgatgcct

SEQ ID NO: 225924 - DNA, 25 bp, Homo sapien
tggagttcttcacgatgcctcccag

SEQ ID NO: 225925 - DNA, 25 bp, Homo sapien
tgcctcccaggacttggtttatgag

SEQ ID NO: 225926 - DNA, 25 bp, Homo sapien
acttggtttatgagacagttgcaaa

SEQ ID NO: 225927 - DNA, 25 bp, Homo sapien
agacagttgcaaaggatgtggtttc

SEQ ID NO: 225928 - DNA, 25 bp, Homo sapien
gatgtggtttctcaggccctcgatg

SEQ ID NO: 225929 - DNA, 25 bp, Homo sapien
ctcaggccctcgatggctataatgg

SEQ ID NO: 225930 - DNA, 25 bp, Homo sapien
tcatcgacgggctcctctcgaagat

SEQ ID NO: 225931 - DNA, 25 bp, Homo sapien
ggctcctctcgaagatcctgagcga

SEQ ID NO: 225932 - DNA, 25 bp, Homo sapien
gaggacgccgacgagatcgagtacc

SEQ ID NO: 225933 - DNA, 25 bp, Homo sapien
ggacgccgacgagatcgagtacctg

SEQ ID NO: 225934 - DNA, 25 bp, Homo sapien
tggtggacggctcgtggtgcccgat

SEQ ID NO: 225935 - DNA, 25 bp, Homo sapien
cgtggtgcccgatccgcgccgaaaa

SEQ ID NO: 225936 - DNA, 25 bp, Homo sapien
atccgcgccgaaaaggagcgcagct

SEQ ID NO: 225937 - DNA, 25 bp, Homo sapien
aaaaggagcgcagctgcagcccgca

SEQ ID NO: 225938 - DNA, 25 bp, Homo sapien
tgggcccctcggacgccaatgggct

SEQ ID NO: 225939 - DNA, 25 bp, Homo sapien
agcgtcaacgggagcggtgccctgg

SEQ ID NO: 225940 - DNA, 25 bp, Homo sapien
agccgggcgccgatgtggtggacct

SEQ ID NO: 225941 - DNA, 25 bp, Homo sapien
tcagacttaaaccacattaactatg

SEQ ID NO: 225942 - DNA, 25 bp, Homo sapien
gacttaaaccacattaactatgaag

SEQ ID NO: 225943 - DNA, 25 bp, Homo sapien
attaactatgaagaactagacaact

SEQ ID NO: 225944 - DNA, 25 bp, Homo sapien
gcagacagtggcaacctctggaaga

SEQ ID NO: 225945 - DNA, 25 bp, Homo sapien
agacagtggcaacctctggaagatg

SEQ ID NO: 225946 - DNA, 25 bp, Homo sapien
acagtggcaacctctggaagatgga

SEQ ID NO: 225947 - DNA, 25 bp, Homo sapien
agtggcaacctctggaagatggaat

SEQ ID NO: 225948 - DNA, 25 bp, Homo sapien
ggcaacctctggaagatggaatctc

SEQ ID NO: 225949 - DNA, 25 bp, Homo sapien
caacctctggaagatggaatctctt

SEQ ID NO: 225950 - DNA, 25 bp, Homo sapien
ctggaagatggaatctcttctctct

SEQ ID NO: 225951 - DNA, 25 bp, Homo sapien
tcttctctctgctggtcctcacacc

SEQ ID NO: 225952 - DNA, 25 bp, Homo sapien
aggcctgtttctgtggccagagaca

SEQ ID NO: 225953 - DNA, 25 bp, Homo sapien
gagacaccgggcatcaatgttgaca

SEQ ID NO: 225954 - DNA, 25 bp, Homo sapien
tcaatgttgacagaaggcctagcct

SEQ ID NO: 225955 - DNA, 25 bp, Homo sapien
ctagctttaatacctcctcagtgta

SEQ ID NO: 225956 - DNA, 25 bp, Homo sapien
gtgtagggactgctattcctatctc

SEQ ID NO: 225957 - DNA, 25 bp, Homo sapien
atgaagacgctcaagctcaggtggc

SEQ ID NO: 225958 - DNA, 25 bp, Homo sapien
agtgccacccagtgaatcagctaga

SEQ ID NO: 225959 - DNA, 25 bp, Homo sapien
attcaaagctaggttcgtctgcctc

SEQ ID NO: 225960 - DNA, 25 bp, Homo sapien
gtctgcctcatttgggcaacggctg

SEQ ID NO: 225961 - DNA, 25 bp, Homo sapien
gctgctgcctctacaggccagtgga

SEQ ID NO: 225962 - DNA, 25 bp, Homo sapien
aaggagtgtgcggatctcaggcatt

SEQ ID NO: 225963 - DNA, 25 bp, Homo sapien
ttttctacttctaaccaatatcttg

SEQ ID NO: 225964 - DNA, 25 bp, Homo sapien
aatatcttgagcattcagtgggaca

SEQ ID NO: 225965 - DNA, 25 bp, Homo sapien
tgagcattcagtgggacaatacagt

SEQ ID NO: 225966 - DNA, 25 bp, Homo sapien
gacaatacagtcttgctgggtctct

SEQ ID NO: 225967 - DNA, 25 bp, Homo sapien
ttgctgggtctcttgaaatcctcta

SEQ ID NO: 225968 - DNA, 25 bp, Homo sapien
tgggtctcttgaaatcctctagcaa

SEQ ID NO: 225969 - DNA, 25 bp, Homo sapien
caggatggctgcttggttgctaaac

SEQ ID NO: 225970 - DNA, 25 bp, Homo sapien
gctgcttggttgctaaacccagaca

SEQ ID NO: 225971 - DNA, 25 bp, Homo sapien
cagacagggtccttccagtgcatct

SEQ ID NO: 225972 - DNA, 25 bp, Homo sapien
tgtcaggctctgtctcgagactggg

SEQ ID NO: 225973 - DNA, 25 bp, Homo sapien
ttccaggctggcttcattcgcggat

SEQ ID NO: 225974 - DNA, 25 bp, Homo sapien
actaataatgttaccctcacaaagg

SEQ ID NO: 225975 - DNA, 25 bp, Homo sapien
aagttattgctgattcttgaatgtc

SEQ ID NO: 225976 - DNA, 25 bp, Homo sapien
ggagttgtgaattcctgcacctgtg

SEQ ID NO: 225977 - DNA, 25 bp, Homo sapien
cctgcacctgtgtttgatgttattt

SEQ ID NO: 225978 - DNA, 25 bp, Homo sapien
ggattgctggccctttgttcctaag

SEQ ID NO: 225979 - DNA, 25 bp, Homo sapien
ttgttcctaagcaagagaagaccaa

SEQ ID NO: 225980 - DNA, 25 bp, Homo sapien
aagaccaaagatgcttccccatgac

SEQ ID NO: 225981 - DNA, 25 bp, Homo sapien
atgacctctccggtgaggatccgca

SEQ ID NO: 225982 - DNA, 25 bp, Homo sapien
ggacttgctctctgatgaagggcat

SEQ ID NO: 225983 - DNA, 25 bp, Homo sapien
aagggcatgtcgttcagtgccccag

SEQ ID NO: 225984 - DNA, 25 bp, Homo sapien
gccccagcagtcagaagcagttttt

SEQ ID NO: 225985 - DNA, 25 bp, Homo sapien
tacaattatttgtggctcaactgaa

SEQ ID NO: 225986 - DNA, 25 bp, Homo sapien
gaaaccagcaagcagcgggcagata

SEQ ID NO: 225987 - DNA, 25 bp, Homo sapien
agacgctgggtggttcaaggcttct

SEQ ID NO: 225988 - DNA, 25 bp, Homo sapien
ggtggttcaaggcttctgcatgatc

SEQ ID NO: 225989 - DNA, 25 bp, Homo sapien
tgcatgatcctcaaatgtcacccca

SEQ ID NO: 225990 - DNA, 25 bp, Homo sapien
ccccaatctgctgtgacatagctat

SEQ ID NO: 225991 - DNA, 25 bp, Homo sapien
gacatagctataccactcatcagaa

SEQ ID NO: 225992 - DNA, 25 bp, Homo sapien
cactcatcagaataccccaaaacaa

SEQ ID NO: 225993 - DNA, 25 bp, Homo sapien
aaaacaaattgtctgcctcccttat

SEQ ID NO: 225994 - DNA, 25 bp, Homo sapien
gcctcccttatgtacaacttttatt

SEQ ID NO: 225995 - DNA, 25 bp, Homo sapien
tattatttcttatctcggttggtta

SEQ ID NO: 225996 - DNA, 25 bp, Homo sapien
tctcggtttgggttgattcctctcc

SEQ ID NO: 225997 - DNA, 25 bp, Homo sapien
tcggtttgggttgattcctctcctt

SEQ ID NO: 225998 - DNA, 25 bp, Homo sapien
ttgggttgattcctctcctttttgc

SEQ ID NO: 225999 - DNA, 25 bp, Homo sapien
ggttgattcctctcctttttgctct

SEQ ID NO: 226000 - DNA, 25 bp, Homo sapien
ttgattcctctcctttttgctcttg

SEQ ID NO: 226001 - DNA, 25 bp, Homo sapien
gattcctctcctttttgctcttggt

SEQ ID NO: 226002 - DNA, 25 bp, Homo sapien
tgctcttggttttccgacgggtacg

SEQ ID NO: 226003 - DNA, 25 bp, Homo sapien
ttccgacgggtacgaggctggcccg

SEQ ID NO: 226004 - DNA, 25 bp, Homo sapien
gcctcactcttccagcaggaccaga

SEQ ID NO: 226005 - DNA, 25 bp, Homo sapien
tgcccttggcctcagggtccaacaa

SEQ ID NO: 226006 - DNA, 25 bp, Homo sapien
ggtccaacaactgggggagctacca

SEQ ID NO: 226007 - DNA, 25 bp, Homo sapien
ttgaattatattccactgtatgtgt

SEQ ID NO: 226008 - DNA, 25 bp, Homo sapien
ctgtatgtgtattatggctcttttc

SEQ ID NO: 226009 - DNA, 25 bp, Homo sapien
atggctcttttcctattagagcaac

SEQ ID NO: 226010 - DNA, 25 bp, Homo sapien
ttagagcaacttgtgtttccctgat

SEQ ID NO: 226011 - DNA, 25 bp, Homo sapien
gtgtttccctgataatgtgtacatt

SEQ ID NO: 226012 - DNA, 25 bp, Homo sapien
cattttttaggcatgtacttaatag

SEQ ID NO: 226013 - DNA, 25 bp, Homo sapien
gtacttaatagttcacaatgttcta

SEQ ID NO: 226014 - DNA, 25 bp, Homo sapien
cacaatgttctaaatttggaaggac

SEQ ID NO: 226015 - DNA, 25 bp, Homo sapien
ctgttttgtaatatctagctctata

SEQ ID NO: 226016 - DNA, 25 bp, Homo sapien
ctagctctatatgtaaatgatgggt

SEQ ID NO: 226017 - DNA, 25 bp, Homo sapien
gctgttttttggaagcgataaactt

SEQ ID NO: 226018 - DNA, 25 bp, Homo sapien
ttcatttttctgttcgatatataac

SEQ ID NO: 226019 - DNA, 25 bp, Homo sapien
cagttcaattttatgatggagcctc

SEQ ID NO: 226020 - DNA, 25 bp, Homo sapien
caattttatgatggagcctcttaca

SEQ ID NO: 226021 - DNA, 25 bp, Homo sapien
tgatggagcctcttacagaaacatt

SEQ ID NO: 226022 - DNA, 25 bp, Homo sapien
ggagcctcttacagaaacattaaca

SEQ ID NO: 226023 - DNA, 25 bp, Homo sapien
aaaatgcaggaatctgccacatttc

SEQ ID NO: 226024 - DNA, 25 bp, Homo sapien
taacttaatagcttaattaccattt

SEQ ID NO: 226025 - DNA, 25 bp, Homo sapien
aatcatgatcctaattagctgtcct

SEQ ID NO: 226026 - DNA, 25 bp, Homo sapien
gatcctaattagctgtccttacttt

SEQ ID NO: 226027 - DNA, 25 bp, Homo sapien
attagctgtccttactttaacttga

SEQ ID NO: 226028 - DNA, 25 bp, Homo sapien
aaactacagtttccatgataaaagg

SEQ ID NO: 226029 - DNA, 25 bp, Homo sapien
ggtaaggaagtcgtcccattttatg

SEQ ID NO: 226030 - DNA, 25 bp, Homo sapien
taaggaagtcgtcccattttatgga

SEQ ID NO: 226031 - DNA, 25 bp, Homo sapien
tgacttaaacttcccgtgacttgga

SEQ ID NO: 226032 - DNA, 25 bp, Homo sapien
ttaaacttcccgtgacttggagctc

SEQ ID NO: 226033 - DNA, 25 bp, Homo sapien
aacttcccgtgacttggagctctca

SEQ ID NO: 226034 - DNA, 25 bp, Homo sapien
gtgacttggagctctcacctcgaga

SEQ ID NO: 226035 - DNA, 25 bp, Homo sapien
ttggagctctcacctcgagacacct

SEQ ID NO: 226036 - DNA, 25 bp, Homo sapien
acacccacgatcaagttacacagct

SEQ ID NO: 226037 - DNA, 25 bp, Homo sapien
cccacgatcaagttacacagcttta

SEQ ID NO: 226038 - DNA, 25 bp, Homo sapien
caagttacacagctttattggcccc

SEQ ID NO: 226039 - DNA, 25 bp, Homo sapien
ttattggcccccagcagccacagtt

SEQ ID NO: 226040 - DNA, 25 bp, Homo sapien
agccacgccccgtccgtgtgggtgg

SEQ ID NO: 226041 - DNA, 25 bp, Homo sapien
gccggaccgaaattcccagactgct

SEQ ID NO: 226042 - DNA, 25 bp, Homo sapien
cggaccgaaattcccagactgctgc

SEQ ID NO: 226043 - DNA, 25 bp, Homo sapien
agactgctgcctcaggcaacgggct

SEQ ID NO: 226044 - DNA, 25 bp, Homo sapien
aggcaacgggctttccgactccttg

SEQ ID NO: 226045 - DNA, 25 bp, Homo sapien
tttccgactccttggcttcttatgt

SEQ ID NO: 226046 - DNA, 25 bp, Homo sapien
gactccttggcttcttatgtgagga

SEQ ID NO: 226047 - DNA, 25 bp, Homo sapien
cttggcttcttatgtgaggaaacca

SEQ ID NO: 226048 - DNA, 25 bp, Homo sapien
tatgtgaggaaaccacagcgcggcc

SEQ ID NO: 226049 - DNA, 25 bp, Homo sapien
tgaggaaaccacagcgcggccggca

SEQ ID NO: 226050 - DNA, 25 bp, Homo sapien
cggccggcatccagagagtcggtta

SEQ ID NO: 226051 - DNA, 25 bp, Homo sapien
ttacccagtcctccaaccttattgt

SEQ ID NO: 226052 - DNA, 25 bp, Homo sapien
atgtggttctcagacattaccaaac

SEQ ID NO: 226053 - DNA, 25 bp, Homo sapien
gtggttctcagacattaccaaacat

SEQ ID NO: 226054 - DNA, 25 bp, Homo sapien
ggttctcagacattaccaaacataa

SEQ ID NO: 226055 - DNA, 25 bp, Homo sapien
gttctcagacattaccaaacataag

SEQ ID NO: 226056 - DNA, 25 bp, Homo sapien
agttctcacacctgactgtacatga

SEQ ID NO: 226057 - DNA, 25 bp, Homo sapien
gttctcacacctgactgtacatgaa

SEQ ID NO: 226058 - DNA, 25 bp, Homo sapien
tctcacacctgactgtacatgaaag

SEQ ID NO: 226059 - DNA, 25 bp, Homo sapien
tcacacctgactgtacatgaaagca

SEQ ID NO: 226060 - DNA, 25 bp, Homo sapien
acacctgactgtacatgaaagcatt

SEQ ID NO: 226061 - DNA, 25 bp, Homo sapien
acctgactgtacatgaaagcattca

SEQ ID NO: 226062 - DNA, 25 bp, Homo sapien
tgtggtgtattcaagcagtagggtt

SEQ ID NO: 226063 - DNA, 25 bp, Homo sapien
ggtgtattcaagcagtagggttttt

SEQ ID NO: 226064 - DNA, 25 bp, Homo sapien
caagcagtagggtttttgcttttgt

SEQ ID NO: 226065 - DNA, 25 bp, Homo sapien
tttttgtctgactacattaaagata

SEQ ID NO: 226066 - DNA, 25 bp, Homo sapien
gactacattaaagataagactgact

SEQ ID NO: 226067 - DNA, 25 bp, Homo sapien
tcagctttgtgaaatcgaatttttt

SEQ ID NO: 226068 - DNA, 25 bp, Homo sapien
attttttttcatcagggctggttgg

SEQ ID NO: 226069 - DNA, 25 bp, Homo sapien
ccctgtaatccaagcgttaatagtt

SEQ ID NO: 226070 - DNA, 25 bp, Homo sapien
atccaagcgttaatagtttgttaga

SEQ ID NO: 226071 - DNA, 25 bp, Homo sapien
gaagatgggttattgcatgtcactt

SEQ ID NO: 226072 - DNA, 25 bp, Homo sapien
aagatgggttattgcatgtcacttt

SEQ ID NO: 226073 - DNA, 25 bp, Homo sapien
tagacaggcacgctctgtcttccaa

SEQ ID NO: 226074 - DNA, 25 bp, Homo sapien
tgtcttccaacgtgcaccagccttt

SEQ ID NO: 226075 - DNA, 25 bp, Homo sapien
ggtgcagatggatactgtgccctca

SEQ ID NO: 226076 - DNA, 25 bp, Homo sapien
tgcagatggatactgtgccctcacc

SEQ ID NO: 226077 - DNA, 25 bp, Homo sapien
tcaccctcctaagccaggtaatata

SEQ ID NO: 226078 - DNA, 25 bp, Homo sapien
gtaatatattgatgtgcagactttt

SEQ ID NO: 226079 - DNA, 25 bp, Homo sapien
tgatgtgcagacttttaagaaatct

SEQ ID NO: 226080 - DNA, 25 bp, Homo sapien
gaaatcttagtcttatcacaaatat

SEQ ID NO: 226081 - DNA, 25 bp, Homo sapien
aaagttagcctaggaagcctcccag

SEQ ID NO: 226082 - DNA, 25 bp, Homo sapien
ttagcctaggaagcctcccagtcat

SEQ ID NO: 226083 - DNA, 25 bp, Homo sapien
taggaagcctcccagtcatcctgaa

SEQ ID NO: 226084 - DNA, 25 bp, Homo sapien
agcgagagtcaaggcaattcattat

SEQ ID NO: 226085 - DNA, 25 bp, Homo sapien
tacgaactggatgcacacacggaga

SEQ ID NO: 226086 - DNA, 25 bp, Homo sapien
ggaatggcattcaacagctcttcgc

SEQ ID NO: 226087 - DNA, 25 bp, Homo sapien
agctcttcgcggtaaaactgtgact

SEQ ID NO: 226088 - DNA, 25 bp, Homo sapien
gcggtaaaactgtgactgccaagga

SEQ ID NO: 226089 - DNA, 25 bp, Homo sapien
gactgccaaggatctagaatcccaa

SEQ ID NO: 226090 - DNA, 25 bp, Homo sapien
aaggagcaaaccaggaggcctcaaa

SEQ ID NO: 226091 - DNA, 25 bp, Homo sapien
ggatcggtgtgaaagtctagcacta

SEQ ID NO: 226092 - DNA, 25 bp, Homo sapien
tctagcactaccatctgacagcgag

SEQ ID NO: 226093 - DNA, 25 bp, Homo sapien
gacagcgagctgcaaaactttgggc

SEQ ID NO: 226094 - DNA, 25 bp, Homo sapien
aactttgggctgcatattaagcgag

SEQ ID NO: 226095 - DNA, 25 bp, Homo sapien
aaatgactcagcaacttcaagaaat

SEQ ID NO: 226096 - DNA, 25 bp, Homo sapien
atggaacctgtaggttacagactta

SEQ ID NO: 226097 - DNA, 25 bp, Homo sapien
tacagacttatgagatacaactact

SEQ ID NO: 226098 - DNA, 25 bp, Homo sapien
gagatacaactactgaaagctatta

SEQ ID NO: 226099 - DNA, 25 bp, Homo sapien
gggacaaaatctcaatcaccgattt

SEQ ID NO: 226100 - DNA, 25 bp, Homo sapien
aaatgatcttccttaagaaacacat

SEQ ID NO: 226101 - DNA, 25 bp, Homo sapien
gaaacacattgttttagacaactga

SEQ ID NO: 226102 - DNA, 25 bp, Homo sapien
aatcaccgatttcatcaacatctag

SEQ ID NO: 226103 - DNA, 25 bp, Homo sapien
ttcatcaacatctagtgtacaagtt

SEQ ID NO: 226104 - DNA, 25 bp, Homo sapien
aatgttagagattcaataagccaca

SEQ ID NO: 226105 - DNA, 25 bp, Homo sapien
aagccacatctagaatacagcaaat

SEQ ID NO: 226106 - DNA, 25 bp, Homo sapien
ggagctagtagagattacccagcat

SEQ ID NO: 226107 - DNA, 25 bp, Homo sapien
cagctcaccatttgaaaccagccaa

SEQ ID NO: 226108 - DNA, 25 bp, Homo sapien
ttgaaaccagccaaatgaatatgtg

SEQ ID NO: 226109 - DNA, 25 bp, Homo sapien
atgtgacaagtctcttttaaaaatc

SEQ ID NO: 226110 - DNA, 25 bp, Homo sapien
aatgccagaattaccaaaagtcacg

SEQ ID NO: 226111 - DNA, 25 bp, Homo sapien
ttaaaaatcttgcactttgaaaagg

SEQ ID NO: 226112 - DNA, 25 bp, Homo sapien
gttataagtgttactcaatctggaa

SEQ ID NO: 226113 - DNA, 25 bp, Homo sapien
gttactcaatctggaagttgcaatg

SEQ ID NO: 226114 - DNA, 25 bp, Homo sapien
gttgcaatgagcttgacaatgtcaa

SEQ ID NO: 226115 - DNA, 25 bp, Homo sapien
aagtcacgaaacacaaacagcaaat

SEQ ID NO: 226116 - DNA, 25 bp, Homo sapien
tacagctataacaactcacataaag

SEQ ID NO: 226117 - DNA, 25 bp, Homo sapien
ccttcctttgtcctaatcctggaat

SEQ ID NO: 226118 - DNA, 25 bp, Homo sapien
taggttctatttcttcccaagagcc

SEQ ID NO: 226119 - DNA, 25 bp, Homo sapien
tgcaaagaaccccagtttcctattt

SEQ ID NO: 226120 - DNA, 25 bp, Homo sapien
gaaccccagtttcctatttggatgc

SEQ ID NO: 226121 - DNA, 25 bp, Homo sapien
agtttcctatttggatgcccctaca

SEQ ID NO: 226122 - DNA, 25 bp, Homo sapien
atttggatgcccctacactgttgtg

SEQ ID NO: 226123 - DNA, 25 bp, Homo sapien
atgcccctacactgttgtgtttcag

SEQ ID NO: 226124 - DNA, 25 bp, Homo sapien
cctacactgttgtgtttcagtggaa

SEQ ID NO: 226125 - DNA, 25 bp, Homo sapien
agagaggctggtgggtccctctccc

SEQ ID NO: 226126 - DNA, 25 bp, Homo sapien
gctggtgggtccctctcccaaagga

SEQ ID NO: 226127 - DNA, 25 bp, Homo sapien
gaaggcagacagtctctgctttgcc

SEQ ID NO: 226128 - DNA, 25 bp, Homo sapien
gtttatgtgacatttgatgccaata

SEQ ID NO: 226129 - DNA, 25 bp, Homo sapien
gatgccaatacatatgtcttcaagg

SEQ ID NO: 226130 - DNA, 25 bp, Homo sapien
gtcttcaaggtatgcttgttccctc

SEQ ID NO: 226131 - DNA, 25 bp, Homo sapien
cctcccagctcgtggaatatcaaaa

SEQ ID NO: 226132 - DNA, 25 bp, Homo sapien
atagatttggttctcaagtccacag

SEQ ID NO: 226133 - DNA, 25 bp, Homo sapien
ggttctcaagtccacagaatcgtat

SEQ ID NO: 226134 - DNA, 25 bp, Homo sapien
agaatcgtatctgctgtggtctccc

SEQ ID NO: 226135 - DNA, 25 bp, Homo sapien
ggtctccctttggtgctcatctggg

SEQ ID NO: 226136 - DNA, 25 bp, Homo sapien
tcatctgggagccatgtgtatggaa

SEQ ID NO: 226137 - DNA, 25 bp, Homo sapien
tggaagattctgtcacaggcggctg

SEQ ID NO: 226138 - DNA, 25 bp, Homo sapien
tacatagcatgtgtgttcccagctg

SEQ ID NO: 226139 - DNA, 25 bp, Homo sapien
gggtgtctcagaaatattcttagct

SEQ ID NO: 226140 - DNA, 25 bp, Homo sapien
ttagctgggttcaactttcctcgtt

SEQ ID NO: 226141 - DNA, 25 bp, Homo sapien
aatcctctcttactatttttgctca

SEQ ID NO: 226142 - DNA, 25 bp, Homo sapien
tttgctcatcaaaatgctgctgctt

SEQ ID NO: 226143 - DNA, 25 bp, Homo sapien
acagccttttttgagccattcccta

SEQ ID NO: 226144 - DNA, 25 bp, Homo sapien
ttttgagccattccctatttagtgt

SEQ ID NO: 226145 - DNA, 25 bp, Homo sapien
tagtgttttgggtaattggctgtta

SEQ ID NO: 226146 - DNA, 25 bp, Homo sapien
gttacagtatggaatttgtggccca

SEQ ID NO: 226147 - DNA, 25 bp, Homo sapien
atttgtggcccaaaggcagcgtggt

SEQ ID NO: 226148 - DNA, 25 bp, Homo sapien
gttagacactaggtgcacggtgccc

SEQ ID NO: 226149 - DNA, 25 bp, Homo sapien
gcacggtgccccattgttatgaagt

SEQ ID NO: 226150 - DNA, 25 bp, Homo sapien
gtgtatagtctagcacttctataaa

SEQ ID NO: 226151 - DNA, 25 bp, Homo sapien
taaacatagtgtctgggaggagctt

SEQ ID NO: 226152 - DNA, 25 bp, Homo sapien
gaggagcttgagagatttgtaatgt

SEQ ID NO: 226153 - DNA, 25 bp, Homo sapien
tttttgtctttattggtctttatga

SEQ ID NO: 226154 - DNA, 25 bp, Homo sapien
ggtctttatgactaacacttcatct

SEQ ID NO: 226155 - DNA, 25 bp, Homo sapien
tttatgactaacacttcatctctgc

SEQ ID NO: 226156 - DNA, 25 bp, Homo sapien
catcacttctgctttgctgtaaaac

SEQ ID NO: 226157 - DNA, 25 bp, Homo sapien
acttctgctttgctgtaaaacttag

SEQ ID NO: 226158 - DNA, 25 bp, Homo sapien
gtacattaggatagtggcaaataaa

SEQ ID NO: 226159 - DNA, 25 bp, Homo sapien
taactgggcgattttaagattatag

SEQ ID NO: 226160 - DNA, 25 bp, Homo sapien
agattataggtgtaacttgttaaga

SEQ ID NO: 226161 - DNA, 25 bp, Homo sapien
agcaaatgtgtctggttagatctca

SEQ ID NO: 226162 - DNA, 25 bp, Homo sapien
gtctggttagatctcagcagagccc

SEQ ID NO: 226163 - DNA, 25 bp, Homo sapien
agcagagcccattctgcaagacctg

SEQ ID NO: 226164 - DNA, 25 bp, Homo sapien
gcccattctgcaagacctggctgag

SEQ ID NO: 226165 - DNA, 25 bp, Homo sapien
ccttgggtcacacacaggaaccgag

SEQ ID NO: 226166 - DNA, 25 bp, Homo sapien
acacaggaaccgagacctggcttcc

SEQ ID NO: 226167 - DNA, 25 bp, Homo sapien
tgggttatctgctggaagttatcga

SEQ ID NO: 226168 - DNA, 25 bp, Homo sapien
tcgataggactgtgtggccaaccaa

SEQ ID NO: 226169 - DNA, 25 bp, Homo sapien
tttcccttcattcccttgagagtca

SEQ ID NO: 226170 - DNA, 25 bp, Homo sapien
acggaatacctgctaggttccagga

SEQ ID NO: 226171 - DNA, 25 bp, Homo sapien
ggttccaggaatgagctcacctaac

SEQ ID NO: 226172 - DNA, 25 bp, Homo sapien
ctgtcactagcagtcaaataaggac

SEQ ID NO: 226173 - DNA, 25 bp, Homo sapien
ataaggacaattttaccattctctc

SEQ ID NO: 226174 - DNA, 25 bp, Homo sapien
ggacaattttaccattctctcctgc

SEQ ID NO: 226175 - DNA, 25 bp, Homo sapien
acaattttaccattctctcctgctg

SEQ ID NO: 226176 - DNA, 25 bp, Homo sapien
aattttaccattctctcctgctgct

SEQ ID NO: 226177 - DNA, 25 bp, Homo sapien
tttttagtgccggtacatgaatttg

SEQ ID NO: 226178 - DNA, 25 bp, Homo sapien
ttagtgccggtacatgaatttgtta

SEQ ID NO: 226179 - DNA, 25 bp, Homo sapien
gtgccggtacatgaatttgttattc

SEQ ID NO: 226180 - DNA, 25 bp, Homo sapien
gccggtacatgaatttgttattctt

SEQ ID NO: 226181 - DNA, 25 bp, Homo sapien
ttccctttgaagttggaaatccaag

SEQ ID NO: 226182 - DNA, 25 bp, Homo sapien
gggaatctaaaaccgaccagatgtt

SEQ ID NO: 226183 - DNA, 25 bp, Homo sapien
cggccacgctgttggttcttaatga

SEQ ID NO: 226184 - DNA, 25 bp, Homo sapien
cacgctgttggttcttaatgacaca

SEQ ID NO: 226185 - DNA, 25 bp, Homo sapien
gttggttcttaatgacacagcttaa

SEQ ID NO: 226186 - DNA, 25 bp, Homo sapien
ggttcttaatgacacagcttaactt

SEQ ID NO: 226187 - DNA, 25 bp, Homo sapien
tgacacagcttaactttattgtgaa

SEQ ID NO: 226188 - DNA, 25 bp, Homo sapien
gattgcagcaacaaatgagatttta

SEQ ID NO: 226189 - DNA, 25 bp, Homo sapien
gcaacaaatgagattttacctgtat

SEQ ID NO: 226190 - DNA, 25 bp, Homo sapien
aaatgagattttacctgtatttgtt

SEQ ID NO: 226191 - DNA, 25 bp, Homo sapien
gttaaaaatgcttatccttgtctaa

SEQ ID NO: 226192 - DNA, 25 bp, Homo sapien
aatgcttatccttgtctaagactgg

SEQ ID NO: 226193 - DNA, 25 bp, Homo sapien
tgcttatccttgtctaagactggca

SEQ ID NO: 226194 - DNA, 25 bp, Homo sapien
gaactgttccattcttggtttcttc

SEQ ID NO: 226195 - DNA, 25 bp, Homo sapien
tgttccattcttggtttcttcttag

SEQ ID NO: 226196 - DNA, 25 bp, Homo sapien
gagatatttaagcattctttgagtt

SEQ ID NO: 226197 - DNA, 25 bp, Homo sapien
gttatagaattgtgatgcagggatt

SEQ ID NO: 226198 - DNA, 25 bp, Homo sapien
gaagtatatcacttctcaccaagtg

SEQ ID NO: 226199 - DNA, 25 bp, Homo sapien
acttctcaccaagtgggtagagtca

SEQ ID NO: 226200 - DNA, 25 bp, Homo sapien
gtagagtcagttggctgtttgtccc

SEQ ID NO: 226201 - DNA, 25 bp, Homo sapien
cagttggctgtttgtcccttgtttt

SEQ ID NO: 226202 - DNA, 25 bp, Homo sapien
cagtaatggaacgtacatttttatt

SEQ ID NO: 226203 - DNA, 25 bp, Homo sapien
gaagacaactttgattcaatctttc

SEQ ID NO: 226204 - DNA, 25 bp, Homo sapien
gattcaatctttcaagaactgttcc

SEQ ID NO: 226205 - DNA, 25 bp, Homo sapien
gggctcatatgacattaacagacaa

SEQ ID NO: 226206 - DNA, 25 bp, Homo sapien
ttttcttttgaggtaaatttgatag

SEQ ID NO: 226207 - DNA, 25 bp, Homo sapien
aggcgatacggcatggtgacagaaa

SEQ ID NO: 226208 - DNA, 25 bp, Homo sapien
acagaaaagcgccggcttggttagc

SEQ ID NO: 226209 - DNA, 25 bp, Homo sapien
gcaggctgtgccacttaccaggcag

SEQ ID NO: 226210 - DNA, 25 bp, Homo sapien
aggctgtgccacttaccaggcaggg

SEQ ID NO: 226211 - DNA, 25 bp, Homo sapien
ggaccttgggccagctgcttggcct

SEQ ID NO: 226212 - DNA, 25 bp, Homo sapien
tgggccagctgcttggcctcactca

SEQ ID NO: 226213 - DNA, 25 bp, Homo sapien
gctgcaattgggatgaacagactgc

SEQ ID NO: 226214 - DNA, 25 bp, Homo sapien
caattgggatgaacagactgcctgc

SEQ ID NO: 226215 - DNA, 25 bp, Homo sapien
ttgggatgaacagactgcctgcttc

SEQ ID NO: 226216 - DNA, 25 bp, Homo sapien
tccttcctcaggaaaatgctggtgt

SEQ ID NO: 226217 - DNA, 25 bp, Homo sapien
atacacacaaagctcttcaggcagc

SEQ ID NO: 226218 - DNA, 25 bp, Homo sapien
aggcagctgatagatttcccccaga

SEQ ID NO: 226219 - DNA, 25 bp, Homo sapien
cagagagctattcaaggacttccta

SEQ ID NO: 226220 - DNA, 25 bp, Homo sapien
tcaaggacttcctaaggtgggtgga

SEQ ID NO: 226221 - DNA, 25 bp, Homo sapien
gactgcagggttaggacacctgcta

SEQ ID NO: 226222 - DNA, 25 bp, Homo sapien
atagaggtgacatttttccaaggac

SEQ ID NO: 226223 - DNA, 25 bp, Homo sapien
ttttccaaggacaagcagggacttt

SEQ ID NO: 226224 - DNA, 25 bp, Homo sapien
gggtatccaaatatctagattctga

SEQ ID NO: 226225 - DNA, 25 bp, Homo sapien
attctgatcccttttgaggtcctag

SEQ ID NO: 226226 - DNA, 25 bp, Homo sapien
gatcccttttgaggtcctagaccct

SEQ ID NO: 226227 - DNA, 25 bp, Homo sapien
ttaaaaaactacacccacatccatt

SEQ ID NO: 226228 - DNA, 25 bp, Homo sapien
tacacccacatccattgtcactttt

SEQ ID NO: 226229 - DNA, 25 bp, Homo sapien
ttgtcactttttgtctatcacctgg

SEQ ID NO: 226230 - DNA, 25 bp, Homo sapien
tatcacctgggcttcaaggctttat

SEQ ID NO: 226231 - DNA, 25 bp, Homo sapien
gggcttcaaggctttatcattatct

SEQ ID NO: 226232 - DNA, 25 bp, Homo sapien
tttattgtctatgtccactcctgta

SEQ ID NO: 226233 - DNA, 25 bp, Homo sapien
tatgtccactcctgtagaatgtaat

SEQ ID NO: 226234 - DNA, 25 bp, Homo sapien
catggcagcagggactttgtataac

SEQ ID NO: 226235 - DNA, 25 bp, Homo sapien
gtataacaatctagttcattgccat

SEQ ID NO: 226236 - DNA, 25 bp, Homo sapien
tatggtactatctgactaaactgca

SEQ ID NO: 226237 - DNA, 25 bp, Homo sapien
aactgcagatatttatcactttggt

SEQ ID NO: 226238 - DNA, 25 bp, Homo sapien
gggcctctctctgagatcgggtcct

SEQ ID NO: 226239 - DNA, 25 bp, Homo sapien
ggcctctctctgagatcgggtcctc

SEQ ID NO: 226240 - DNA, 25 bp, Homo sapien
tgagatcgggtcctcctcctgcagg

SEQ ID NO: 226241 - DNA, 25 bp, Homo sapien
agcggcagtcctggacctaacggga

SEQ ID NO: 226242 - DNA, 25 bp, Homo sapien
cggcagtcctggacctaacgggaga

SEQ ID NO: 226243 - DNA, 25 bp, Homo sapien
cagtcctggacctaacgggagaagg

SEQ ID NO: 226244 - DNA, 25 bp, Homo sapien
agggactggagtccggctcccggtg

SEQ ID NO: 226245 - DNA, 25 bp, Homo sapien
accccgtccccagtgccagcggtgg

SEQ ID NO: 226246 - DNA, 25 bp, Homo sapien
tggcggcccggacaggccacgggtc

SEQ ID NO: 226247 - DNA, 25 bp, Homo sapien
gaagagggcgcaccccaagcccggg

SEQ ID NO: 226248 - DNA, 25 bp, Homo sapien
aagcccgggacccacagcagcccta

SEQ ID NO: 226249 - DNA, 25 bp, Homo sapien
ggtacattgtcatcctgcatttgat

SEQ ID NO: 226250 - DNA, 25 bp, Homo sapien
gtcatcctgcatttgattcatcttg

SEQ ID NO: 226251 - DNA, 25 bp, Homo sapien
gacattctccactaaattatggatt

SEQ ID NO: 226252 - DNA, 25 bp, Homo sapien
ttcttgtggctaaatgtttctggag

SEQ ID NO: 226253 - DNA, 25 bp, Homo sapien
gagttgacaaaacctcttcacaggt

SEQ ID NO: 226254 - DNA, 25 bp, Homo sapien
acaggttgctccttcttcctgaaat

SEQ ID NO: 226255 - DNA, 25 bp, Homo sapien
ttcttcctgaaatccttaatcctcc

SEQ ID NO: 226256 - DNA, 25 bp, Homo sapien
ttaatcctccgcatttcatgcttca

SEQ ID NO: 226257 - DNA, 25 bp, Homo sapien
gggaagcctgggtttagatgccttt

SEQ ID NO: 226258 - DNA, 25 bp, Homo sapien
ggtttagatgcctttctgactctca

SEQ ID NO: 226259 - DNA, 25 bp, Homo sapien
agctcctgcacttctgtcatcatac

SEQ ID NO: 226260 - DNA, 25 bp, Homo sapien
tccagttctattctgattgttacaa

SEQ ID NO: 226261 - DNA, 25 bp, Homo sapien
ctgattgttacaaatgctctttatt

SEQ ID NO: 226262 - DNA, 25 bp, Homo sapien
atgctctttatttatcagtaactct

SEQ ID NO: 226263 - DNA, 25 bp, Homo sapien
cagtaactctaattaactgggttag

SEQ ID NO: 226264 - DNA, 25 bp, Homo sapien
aactgggttagtacatgtaccagga

SEQ ID NO: 226265 - DNA, 25 bp, Homo sapien
atgtaccaggaacagcataagcccc

SEQ ID NO: 226266 - DNA, 25 bp, Homo sapien
gccacacttggtggtaattccacag

SEQ ID NO: 226267 - DNA, 25 bp, Homo sapien
attccacagagacaccaaatacttc

SEQ ID NO: 226268 - DNA, 25 bp, Homo sapien
agagacaccaaatacttcaatgtcc

SEQ ID NO: 226269 - DNA, 25 bp, Homo sapien
tgtcccagggactgtattagaatat

SEQ ID NO: 226270 - DNA, 25 bp, Homo sapien
gtattagaatatgttactttccttt

SEQ ID NO: 226271 - DNA, 25 bp, Homo sapien
gaggacaggccaagaaactccacat

SEQ ID NO: 226272 - DNA, 25 bp, Homo sapien
agaaactccacatcataacagcctc

SEQ ID NO: 226273 - DNA, 25 bp, Homo sapien
ataacagcctcctgatgcctgggct

SEQ ID NO: 226274 - DNA, 25 bp, Homo sapien
tggctggagctcacatgaggtgctt

SEQ ID NO: 226275 - DNA, 25 bp, Homo sapien
tttgatttcttctgcagactctcgg

SEQ ID NO: 226276 - DNA, 25 bp, Homo sapien
agactctcggtgatggatgctacaa

SEQ ID NO: 226277 - DNA, 25 bp, Homo sapien
tgctacaactgacttatcatctttg

SEQ ID NO: 226278 - DNA, 25 bp, Homo sapien
tgctggcgaccagggaaattccaaa

SEQ ID NO: 226279 - DNA, 25 bp, Homo sapien
aaactgctggacttcctatgcagga

SEQ ID NO: 226280 - DNA, 25 bp, Homo sapien
tgcaggaaaccaggagctggaccct

SEQ ID NO: 226281 - DNA, 25 bp, Homo sapien
ggacccttaatcttgggttggcaga

SEQ ID NO: 226282 - DNA, 25 bp, Homo sapien
acattccgtgagtcctgtaagaatc

SEQ ID NO: 226283 - DNA, 25 bp, Homo sapien
ttccgtgagtcctgtaagaatctct

SEQ ID NO: 226284 - DNA, 25 bp, Homo sapien
ccgtgagtcctgtaagaatctctat

SEQ ID NO: 226285 - DNA, 25 bp, Homo sapien
gtgagtcctgtaagaatctctatcc

SEQ ID NO: 226286 - DNA, 25 bp, Homo sapien
gagtcctgtaagaatctctatccat

SEQ ID NO: 226287 - DNA, 25 bp, Homo sapien
gtcctgtaagaatctctatccatgg

SEQ ID NO: 226288 - DNA, 25 bp, Homo sapien
gtaagaatctctatccatggcatgg

SEQ ID NO: 226289 - DNA, 25 bp, Homo sapien
aagaatctctatccatggcatggca

SEQ ID NO: 226290 - DNA, 25 bp, Homo sapien
gaatctctatccatggcatggcacg

SEQ ID NO: 226291 - DNA, 25 bp, Homo sapien
atctctatccatggcatggcacggt

SEQ ID NO: 226292 - DNA, 25 bp, Homo sapien
tatccatggcatggcacggtggctc

SEQ ID NO: 226293 - DNA, 25 bp, Homo sapien
gtgagtgcatgtgaacgttgagtac

SEQ ID NO: 226294 - DNA, 25 bp, Homo sapien
gtacacatgagtgcgtgtatgcccc

SEQ ID NO: 226295 - DNA, 25 bp, Homo sapien
tcagctcttctgtggattgcatggc

SEQ ID NO: 226296 - DNA, 25 bp, Homo sapien
gcatggcgtgtgattaaaagcccat

SEQ ID NO: 226297 - DNA, 25 bp, Homo sapien
cacacatccacatcatgggaaggtt

SEQ ID NO: 226298 - DNA, 25 bp, Homo sapien
taatgtgtgcctccttggaactggg

SEQ ID NO: 226299 - DNA, 25 bp, Homo sapien
aactgggtgttggtgtccatggaac

SEQ ID NO: 226300 - DNA, 25 bp, Homo sapien
tgtccatggaacttcctctctgtat

SEQ ID NO: 226301 - DNA, 25 bp, Homo sapien
tgtatctcaggtcagtaggcgcaga

SEQ ID NO: 226302 - DNA, 25 bp, Homo sapien
gcgcagaaacgcctcatgatgaaga

SEQ ID NO: 226303 - DNA, 25 bp, Homo sapien
attcttgagccccatttccaagacc

SEQ ID NO: 226304 - DNA, 25 bp, Homo sapien
ccactccttttctacggcgatttgt

SEQ ID NO: 226305 - DNA, 25 bp, Homo sapien
ttttctacggcgatttgtctgtgtc

SEQ ID NO: 226306 - DNA, 25 bp, Homo sapien
ctacggcgatttgtctgtgtctggc

SEQ ID NO: 226307 - DNA, 25 bp, Homo sapien
cattgttgtctggatgtggttctat

SEQ ID NO: 226308 - DNA, 25 bp, Homo sapien
tgtggttctattttttatcggtctc

SEQ ID NO: 226309 - DNA, 25 bp, Homo sapien
tggttctattttttatcggtctcct

SEQ ID NO: 226310 - DNA, 25 bp, Homo sapien
actaccctttgtctcttgctctttc

SEQ ID NO: 226311 - DNA, 25 bp, Homo sapien
ttcttgggcttctgtacaactcaac

SEQ ID NO: 226312 - DNA, 25 bp, Homo sapien
tgggcttctgtacaactcaacttgt

SEQ ID NO: 226313 - DNA, 25 bp, Homo sapien
aactcaacttgtatacactgtgtac

SEQ ID NO: 226314 - DNA, 25 bp, Homo sapien
cactgtgtacacacaaccagccaaa

SEQ ID NO: 226315 - DNA, 25 bp, Homo sapien
tttgtcccaagatttccttccagca

SEQ ID NO: 226316 - DNA, 25 bp, Homo sapien
tccttccagcaccttaatgaatgtt

SEQ ID NO: 226317 - DNA, 25 bp, Homo sapien
ttctcagaaggctaaacctgttttg

SEQ ID NO: 226318 - DNA, 25 bp, Homo sapien
cctgttttgggtatgatgctacttc

SEQ ID NO: 226319 - DNA, 25 bp, Homo sapien
gatgctacttcagaacatattgtct

SEQ ID NO: 226320 - DNA, 25 bp, Homo sapien
gaacatattgtctggcacaagattt

SEQ ID NO: 226321 - DNA, 25 bp, Homo sapien
tttaaactcaatttcggtggactgt

SEQ ID NO: 226322 - DNA, 25 bp, Homo sapien
gaaaaacaccaaaggagtcttcttg

SEQ ID NO: 226323 - DNA, 25 bp, Homo sapien
tcttcttgtctggagactggattgt

SEQ ID NO: 226324 - DNA, 25 bp, Homo sapien
cagttttaaatacctgtgcccataa

SEQ ID NO: 226325 - DNA, 25 bp, Homo sapien
gtgcccataagtatcccatttcatg

SEQ ID NO: 226326 - DNA, 25 bp, Homo sapien
gggagcttcggttacggcatttcga

SEQ ID NO: 226327 - DNA, 25 bp, Homo sapien
ttacggcatttcgagcattgagact

SEQ ID NO: 226328 - DNA, 25 bp, Homo sapien
gagcattgagactatctccagcctc

SEQ ID NO: 226329 - DNA, 25 bp, Homo sapien
agccagccggtcttcgggagcccag

SEQ ID NO: 226330 - DNA, 25 bp, Homo sapien
gcaaagcacatgcagacaagccccg

SEQ ID NO: 226331 - DNA, 25 bp, Homo sapien
gtgataacttgagcggagtgatttt

SEQ ID NO: 226332 - DNA, 25 bp, Homo sapien
gattttagagaaagcggtggccaat

SEQ ID NO: 226333 - DNA, 25 bp, Homo sapien
ggtggccaattcgaatttcttcctg

SEQ ID NO: 226334 - DNA, 25 bp, Homo sapien
caattcgaatttcttcctggccctc

SEQ ID NO: 226335 - DNA, 25 bp, Homo sapien
aggaacgccctgcacatatccaaca

SEQ ID NO: 226336 - DNA, 25 bp, Homo sapien
atatccaacacatccaggaatccag

SEQ ID NO: 226337 - DNA, 25 bp, Homo sapien
tgctcccaaggcaggtgtccaggtg

SEQ ID NO: 226338 - DNA, 25 bp, Homo sapien
aggtgtccaggtggcgggagcagca

SEQ ID NO: 226339 - DNA, 25 bp, Homo sapien
gtggcgggagcagcaccaaggacag

SEQ ID NO: 226340 - DNA, 25 bp, Homo sapien
caaggacagccaggcttacccggtg

SEQ ID NO: 226341 - DNA, 25 bp, Homo sapien
aacccctggcgaggcagggagcact

SEQ ID NO: 226342 - DNA, 25 bp, Homo sapien
gagcactgaagtagggaagcagcaa

SEQ ID NO: 226343 - DNA, 25 bp, Homo sapien
aaaaatacaggctcccaacgtggct

SEQ ID NO: 226344 - DNA, 25 bp, Homo sapien
aatacaggctcccaacgtggctcca

SEQ ID NO: 226345 - DNA, 25 bp, Homo sapien
aacgtggctccactgtctcatgaag

SEQ ID NO: 226346 - DNA, 25 bp, Homo sapien
ggctccactgtctcatgaagtgtca

SEQ ID NO: 226347 - DNA, 25 bp, Homo sapien
actgtctcatgaagtgtcaaaaatt

SEQ ID NO: 226348 - DNA, 25 bp, Homo sapien
tctcggtttgggttgattcctctcc

SEQ ID NO: 226349 - DNA, 25 bp, Homo sapien
tcggtttgggttgattcctctcctt

SEQ ID NO: 226350 - DNA, 25 bp, Homo sapien
ttgggttgattcctctcctttttgc

SEQ ID NO: 226351 - DNA, 25 bp, Homo sapien
ttgattcctctcctttttgctcttg

SEQ ID NO: 226352 - DNA, 25 bp, Homo sapien
gattcctctcctttttgctcttggt

SEQ ID NO: 226353 - DNA, 25 bp, Homo sapien
tgctcttggttttccgacgggtacg

SEQ ID NO: 226354 - DNA, 25 bp, Homo sapien
ttccgacgggtacgaggctggcccg

SEQ ID NO: 226355 - DNA, 25 bp, Homo sapien
gggagcctcactcttccagcaggac

SEQ ID NO: 226356 - DNA, 25 bp, Homo sapien
atgcccttggcctcagggtccaaca

SEQ ID NO: 226357 - DNA, 25 bp, Homo sapien
ttggcctcagggtccaacaactggg

SEQ ID NO: 226358 - DNA, 25 bp, Homo sapien
tctgccttcaggagcccacagctgg

SEQ ID NO: 226359 - DNA, 25 bp, Homo sapien
tgtgtcccctcctttgaactctgat

SEQ ID NO: 226360 - DNA, 25 bp, Homo sapien
tttgaactctgatccttctgctcag

SEQ ID NO: 226361 - DNA, 25 bp, Homo sapien
ggccctttctcccagtctgaagtaa

SEQ ID NO: 226362 - DNA, 25 bp, Homo sapien
cccagtctgaagtaaggagtgaaaa

SEQ ID NO: 226363 - DNA, 25 bp, Homo sapien
atgtgaattgttctactcatctgga

SEQ ID NO: 226364 - DNA, 25 bp, Homo sapien
gaattgttctactcatctggaaaag

SEQ ID NO: 226365 - DNA, 25 bp, Homo sapien
atctggaaaagagaaccctgaggca

SEQ ID NO: 226366 - DNA, 25 bp, Homo sapien
ccctgaggcaggaacaagtcgttaa

SEQ ID NO: 226367 - DNA, 25 bp, Homo sapien
acaagtcgttaattgcatgtgcgtt

SEQ ID NO: 226368 - DNA, 25 bp, Homo sapien
aattgcatgtgcgtttgtccacagc

SEQ ID NO: 226369 - DNA, 25 bp, Homo sapien
gcatgtgcgtttgtccacagctcac

SEQ ID NO: 226370 - DNA, 25 bp, Homo sapien
tgagcagattggaatagaaccgaga

SEQ ID NO: 226371 - DNA, 25 bp, Homo sapien
ggaaactgacagttgcgtccctggt

SEQ ID NO: 226372 - DNA, 25 bp, Homo sapien
gttgcgtccctggtgggaagactaa

SEQ ID NO: 226373 - DNA, 25 bp, Homo sapien
ggataggcaaaagcattgtgcacaa

SEQ ID NO: 226374 - DNA, 25 bp, Homo sapien
cagagcgccgggacagaaaccctta

SEQ ID NO: 226375 - DNA, 25 bp, Homo sapien
gaaacccttaggacattctgacacc

SEQ ID NO: 226376 - DNA, 25 bp, Homo sapien
tgggtgagatgggacccactaagtt

SEQ ID NO: 226377 - DNA, 25 bp, Homo sapien
ttctgacaccttgctgaacctggat

SEQ ID NO: 226378 - DNA, 25 bp, Homo sapien
gaacctggatccttacagaatatgt

SEQ ID NO: 226379 - DNA, 25 bp, Homo sapien
actaagttgtgggatcgaaatctca

SEQ ID NO: 226380 - DNA, 25 bp, Homo sapien
atcgaaatctcagtaggtccttggg

SEQ ID NO: 226381 - DNA, 25 bp, Homo sapien
gaatcccttttcatggtctgatctt

SEQ ID NO: 226382 - DNA, 25 bp, Homo sapien
catggtctgatcttaagttgtttga

SEQ ID NO: 226383 - DNA, 25 bp, Homo sapien
aaaagattcacgcttctgcatccac

SEQ ID NO: 226384 - DNA, 25 bp, Homo sapien
aattgtgtgtggactctgagaagcc

SEQ ID NO: 226385 - DNA, 25 bp, Homo sapien
gaagcctgcttgataacttgtctta

SEQ ID NO: 226386 - DNA, 25 bp, Homo sapien
acttgtcttaagttctattaaggca

SEQ ID NO: 226387 - DNA, 25 bp, Homo sapien
aaggcagttagactgagatttctaa

SEQ ID NO: 226388 - DNA, 25 bp, Homo sapien
accataaagattatacttctgcctg

SEQ ID NO: 226389 - DNA, 25 bp, Homo sapien
tctgcctggcgtcgtttctataaaa

SEQ ID NO: 226390 - DNA, 25 bp, Homo sapien
gtaacagcaacataaaccacatttt

SEQ ID NO: 226391 - DNA, 25 bp, Homo sapien
aatgagcacttttcattcacttgaa

SEQ ID NO: 226392 - DNA, 25 bp, Homo sapien
tcagacttaaaccacattaactatg

SEQ ID NO: 226393 - DNA, 25 bp, Homo sapien
gacttaaaccacattaactatgaag

SEQ ID NO: 226394 - DNA, 25 bp, Homo sapien
gaactagacaactaatgtgtcatta

SEQ ID NO: 226395 - DNA, 25 bp, Homo sapien
gcagacagtggcaacctctggaaga

SEQ ID NO: 226396 - DNA, 25 bp, Homo sapien
agacagtggcaacctctggaagatg

SEQ ID NO: 226397 - DNA, 25 bp, Homo sapien
agtggcaacctctggaagatggaat

SEQ ID NO: 226398 - DNA, 25 bp, Homo sapien
gcaacctctggaagatggaatctct

SEQ ID NO: 226399 - DNA, 25 bp, Homo sapien
ctggaagatggaatctcttctctct

SEQ ID NO: 226400 - DNA, 25 bp, Homo sapien
atggaatctcttctctctgctggtc

SEQ ID NO: 226401 - DNA, 25 bp, Homo sapien
tcccggtgcccttacggagggtgct

SEQ ID NO: 226402 - DNA, 25 bp, Homo sapien
cggagggtgctgtgcttctgcccaa

SEQ ID NO: 226403 - DNA, 25 bp, Homo sapien
gcagggtacagggtgagtctccttc

SEQ ID NO: 226404 - DNA, 25 bp, Homo sapien
tacagggtgagtctccttccagtgc

SEQ ID NO: 226405 - DNA, 25 bp, Homo sapien
gagtctccttccagtgccccagttt

SEQ ID NO: 226406 - DNA, 25 bp, Homo sapien
ccagtttcttccaggtcacgccagg

SEQ ID NO: 226407 - DNA, 25 bp, Homo sapien
ttcttccaggtcacgccaggccagg

SEQ ID NO: 226408 - DNA, 25 bp, Homo sapien
gctggagatggagcttcttgtgtcc

SEQ ID NO: 226409 - DNA, 25 bp, Homo sapien
cttcttgtgtcccagaactcggcgt

SEQ ID NO: 226410 - DNA, 25 bp, Homo sapien
ttgtgtcccagaactcggcgtccag

SEQ ID NO: 226411 - DNA, 25 bp, Homo sapien
aactcggcgtccagctccactaggg

SEQ ID NO: 226412 - DNA, 25 bp, Homo sapien
tggatccccatcacagcttgggtta

SEQ ID NO: 226413 - DNA, 25 bp, Homo sapien
atcacagcttgggttagccccggtc

SEQ ID NO: 226414 - DNA, 25 bp, Homo sapien
atttctgtgctgcaagggtggattc

SEQ ID NO: 226415 - DNA, 25 bp, Homo sapien
gtggattcatgctgattgggtgcat

SEQ ID NO: 226416 - DNA, 25 bp, Homo sapien
atggatggcaagaacaggcctggaa

SEQ ID NO: 226417 - DNA, 25 bp, Homo sapien
aggcctggaaaacatcgcgtagctc

SEQ ID NO: 226418 - DNA, 25 bp, Homo sapien
aacatcgcgtagctcaaactggcat

SEQ ID NO: 226419 - DNA, 25 bp, Homo sapien
aaactggcatcgattgaggctcatt

SEQ ID NO: 226420 - DNA, 25 bp, Homo sapien
tttcagatttcatgtgctaagtgca

SEQ ID NO: 226421 - DNA, 25 bp, Homo sapien
taggttcacaactgcttgactcaaa

SEQ ID NO: 226422 - DNA, 25 bp, Homo sapien
taatatgtgacctcacggtaccctg

SEQ ID NO: 226423 - DNA, 25 bp, Homo sapien
cacggtaccctgaagcaaacagatt

SEQ ID NO: 226424 - DNA, 25 bp, Homo sapien
gattaaaggcatgttcctcatgtgg

SEQ ID NO: 226425 - DNA, 25 bp, Homo sapien
ttggctgttgagtaggcagtgccca

SEQ ID NO: 226426 - DNA, 25 bp, Homo sapien
agtgcccagttgtgctgtatgggat

SEQ ID NO: 226427 - DNA, 25 bp, Homo sapien
gctgtatgggatgctgtttctcact

SEQ ID NO: 226428 - DNA, 25 bp, Homo sapien
gggtacaaaggcattatcctgtatt

SEQ ID NO: 226429 - DNA, 25 bp, Homo sapien
ctgtattcccaggttgtaactttct

SEQ ID NO: 226430 - DNA, 25 bp, Homo sapien
ggttgtaactttctgcctttgacat

SEQ ID NO: 226431 - DNA, 25 bp, Homo sapien
ttgacattcaaccttgagtccacct

SEQ ID NO: 226432 - DNA, 25 bp, Homo sapien
ttgagtccacctgtaagtgtaactg

SEQ ID NO: 226433 - DNA, 25 bp, Homo sapien
tgctgtcatccttgatagcctgtga

SEQ ID NO: 226434 - DNA, 25 bp, Homo sapien
atagcctgtgatgagcagagcccct

SEQ ID NO: 226435 - DNA, 25 bp, Homo sapien
gccgaccgcgatgcacatgtaatat

SEQ ID NO: 226436 - DNA, 25 bp, Homo sapien
acttcctgagactgctcgttactaa

SEQ ID NO: 226437 - DNA, 25 bp, Homo sapien
tggacatttccacgagtcaccttgt

SEQ ID NO: 226438 - DNA, 25 bp, Homo sapien
gagatgttggattgctttgcttcac

SEQ ID NO: 226439 - DNA, 25 bp, Homo sapien
ttggattgctttgcttcactgtttg

SEQ ID NO: 226440 - DNA, 25 bp, Homo sapien
actgtttggcctgaatcccgaggga

SEQ ID NO: 226441 - DNA, 25 bp, Homo sapien
ggatggaaatccgagcctgcaacct

SEQ ID NO: 226442 - DNA, 25 bp, Homo sapien
acctgctccgtcaaaggttcagaaa

SEQ ID NO: 226443 - DNA, 25 bp, Homo sapien
acgagtcaccttgtggtaacaccat

SEQ ID NO: 226444 - DNA, 25 bp, Homo sapien
gaacttccagacgaaatcactgcag

SEQ ID NO: 226445 - DNA, 25 bp, Homo sapien
gagtggtatccacaagagctttgag

SEQ ID NO: 226446 - DNA, 25 bp, Homo sapien
gagctttgaggtgctcggttatacc

SEQ ID NO: 226447 - DNA, 25 bp, Homo sapien
aacaggacgggcactgtggctgtct

SEQ ID NO: 226448 - DNA, 25 bp, Homo sapien
ggcactgtggctgtctcacttagaa

SEQ ID NO: 226449 - DNA, 25 bp, Homo sapien
tgtggctgtctcacttagaacactc

SEQ ID NO: 226450 - DNA, 25 bp, Homo sapien
tgtctcacttagaacactccaccat

SEQ ID NO: 226451 - DNA, 25 bp, Homo sapien
ctgttcccagttcactccacaaaga

SEQ ID NO: 226452 - DNA, 25 bp, Homo sapien
actccacaaagatgggcctgccatg

SEQ ID NO: 226453 - DNA, 25 bp, Homo sapien
gacacagcagggattcatactgaca

SEQ ID NO: 226454 - DNA, 25 bp, Homo sapien
ttcatactgacaagagccaggcatg

SEQ ID NO: 226455 - DNA, 25 bp, Homo sapien
cagtgaactgttatcgtgagaccgc

SEQ ID NO: 226456 - DNA, 25 bp, Homo sapien
gaactgttatcgtgagaccgcactc

SEQ ID NO: 226457 - DNA, 25 bp, Homo sapien
tgttatcgtgagaccgcactcctgc

SEQ ID NO: 226458 - DNA, 25 bp, Homo sapien
ccaccaccccatcgctgggtttcgg

SEQ ID NO: 226459 - DNA, 25 bp, Homo sapien
caccaccccatcgctgggtttcggg

SEQ ID NO: 226460 - DNA, 25 bp, Homo sapien
cccatcgctgggtttcggggcttgg

SEQ ID NO: 226461 - DNA, 25 bp, Homo sapien
ccatcgctgggtttcggggcttggt

SEQ ID NO: 226462 - DNA, 25 bp, Homo sapien
catcgctgggtttcggggcttggtt

SEQ ID NO: 226463 - DNA, 25 bp, Homo sapien
ttttttgtaggacacaaggaatccg

SEQ ID NO: 226464 - DNA, 25 bp, Homo sapien
tttttgtaggacacaaggaatccga

SEQ ID NO: 226465 - DNA, 25 bp, Homo sapien
gcacagccccctgggcacccggcat

SEQ ID NO: 226466 - DNA, 25 bp, Homo sapien
acagccccctgggcacccggcatgg

SEQ ID NO: 226467 - DNA, 25 bp, Homo sapien
gggcccgatccgaggccctgggctg

SEQ ID NO: 226468 - DNA, 25 bp, Homo sapien
tgatttctgtctgctctgaacggaa

SEQ ID NO: 226469 - DNA, 25 bp, Homo sapien
aagccggttggtgtgaagagacgtc

SEQ ID NO: 226470 - DNA, 25 bp, Homo sapien
gcgagggccctcattccactgggtg

SEQ ID NO: 226471 - DNA, 25 bp, Homo sapien
agaaaaccgcgatggcgcttctcat

SEQ ID NO: 226472 - DNA, 25 bp, Homo sapien
gcgatggcgcttctcatttgaaatg

SEQ ID NO: 226473 - DNA, 25 bp, Homo sapien
tttctttatggacagtgtttagcaa

SEQ ID NO: 226474 - DNA, 25 bp, Homo sapien
ggacagtgtttagcaattgttataa

SEQ ID NO: 226475 - DNA, 25 bp, Homo sapien
tgtgtacttttgttgattgatctgt

SEQ ID NO: 226476 - DNA, 25 bp, Homo sapien
gtaaaataatttgttctctgagtta

SEQ ID NO: 226477 - DNA, 25 bp, Homo sapien
tgttctctgagttaattttgttgga

SEQ ID NO: 226478 - DNA, 25 bp, Homo sapien
ggaacaaagactttagtgcttccta

SEQ ID NO: 226479 - DNA, 25 bp, Homo sapien
tagtgcttcctacattaaaacattt

SEQ ID NO: 226480 - DNA, 25 bp, Homo sapien
gtccggctccgggatgtggatcttc

SEQ ID NO: 226481 - DNA, 25 bp, Homo sapien
cggctccgggatgtggatcttcaga

SEQ ID NO: 226482 - DNA, 25 bp, Homo sapien
gggcctcttctttgtgatagagcga

SEQ ID NO: 226483 - DNA, 25 bp, Homo sapien
tcttctttgtgatagagcgacgtga

SEQ ID NO: 226484 - DNA, 25 bp, Homo sapien
agagcgacgtgaactggatcttgat

SEQ ID NO: 226485 - DNA, 25 bp, Homo sapien
gaactggatcttgatggccgtgctg

SEQ ID NO: 226486 - DNA, 25 bp, Homo sapien
atcttgatggccgtgctgggaaacc

SEQ ID NO: 226487 - DNA, 25 bp, Homo sapien
ggcaccgcgtggactggctgggcag

SEQ ID NO: 226488 - DNA, 25 bp, Homo sapien
aaggtacactgcttgggcagctgca

SEQ ID NO: 226489 - DNA, 25 bp, Homo sapien
tggaaggccccgtccacgaagacgc

SEQ ID NO: 226490 - DNA, 25 bp, Homo sapien
ggctgaccatgctccggaggtccgg

SEQ ID NO: 226491 - DNA, 25 bp, Homo sapien
gtgtatagtctagcacttctataaa

SEQ ID NO: 226492 - DNA, 25 bp, Homo sapien
taaacatagtgtctgggaggagctt

SEQ ID NO: 226493 - DNA, 25 bp, Homo sapien
gaggagcttgagagatttgtaatgt

SEQ ID NO: 226494 - DNA, 25 bp, Homo sapien
gaccgcagacagcacatcatttttt

SEQ ID NO: 226495 - DNA, 25 bp, Homo sapien
tttttgtctttattggtctttatga

SEQ ID NO: 226496 - DNA, 25 bp, Homo sapien
ggtctttatgactaacacttcatct

SEQ ID NO: 226497 - DNA, 25 bp, Homo sapien
tgactaacacttcatctctgcatca

SEQ ID NO: 226498 - DNA, 25 bp, Homo sapien
catcacttctgctttgctgtaaaac

SEQ ID NO: 226499 - DNA, 25 bp, Homo sapien
acttctgctttgctgtaaaacttag

SEQ ID NO: 226500 - DNA, 25 bp, Homo sapien
taactgggcgattttaagattatag

SEQ ID NO: 226501 - DNA, 25 bp, Homo sapien
agattataggtgtaacttgttaaga

SEQ ID NO: 226502 - DNA, 25 bp, Homo sapien
aaatggccaattttgttcctcagaa

SEQ ID NO: 226503 - DNA, 25 bp, Homo sapien
gtaatgagttgaagtccagggtaat

SEQ ID NO: 226504 - DNA, 25 bp, Homo sapien
ccagggtaatggaagctctagggca

SEQ ID NO: 226505 - DNA, 25 bp, Homo sapien
tgtattcagcaccaaacaatgctaa

SEQ ID NO: 226506 - DNA, 25 bp, Homo sapien
tgctaaaccaagaaacatccaatca

SEQ ID NO: 226507 - DNA, 25 bp, Homo sapien
tctctgggcttttccatgggcaggg

SEQ ID NO: 226508 - DNA, 25 bp, Homo sapien
ttttccatgggcagggtcgacagac

SEQ ID NO: 226509 - DNA, 25 bp, Homo sapien
gtcgacagactctcttttcagtgat

SEQ ID NO: 226510 - DNA, 25 bp, Homo sapien
gactctcttttcagtgatttctggc

SEQ ID NO: 226511 - DNA, 25 bp, Homo sapien
tttcagtgatttctggctctgagaa

SEQ ID NO: 226512 - DNA, 25 bp, Homo sapien
tgagaaacctctttactcactagaa

SEQ ID NO: 226513 - DNA, 25 bp, Homo sapien
agcaccaagcaccagaatcacatat

SEQ ID NO: 226514 - DNA, 25 bp, Homo sapien
aagagagagactactgcgcggaaga

SEQ ID NO: 226515 - DNA, 25 bp, Homo sapien
gcggaagaccagactatcgagagct

SEQ ID NO: 226516 - DNA, 25 bp, Homo sapien
gagaagaaggtttcccagtgggctt

SEQ ID NO: 226517 - DNA, 25 bp, Homo sapien
cagtgggcttgaagcttgctgtgct

SEQ ID NO: 226518 - DNA, 25 bp, Homo sapien
gcttgctgtgcttggtattttcatc

SEQ ID NO: 226519 - DNA, 25 bp, Homo sapien
ggtgtttgtctacctgactgtggaa

SEQ ID NO: 226520 - DNA, 25 bp, Homo sapien
ataagtcgctgtttggttaagtaat

SEQ ID NO: 226521 - DNA, 25 bp, Homo sapien
attgcagaaccaacttgagaagctt

SEQ ID NO: 226522 - DNA, 25 bp, Homo sapien
agaagcttggattttcacctggccc

SEQ ID NO: 226523 - DNA, 25 bp, Homo sapien
gtgggctgcaagagcaccaagcacc

SEQ ID NO: 226524 - DNA, 25 bp, Homo sapien
gcagccctgtctaatagcttgaccg

SEQ ID NO: 226525 - DNA, 25 bp, Homo sapien
gccctgtctaatagcttgaccgtaa

SEQ ID NO: 226526 - DNA, 25 bp, Homo sapien
atagcttgaccgtaatttcatgaga

SEQ ID NO: 226527 - DNA, 25 bp, Homo sapien
gaccgtaatttcatgagagaccttc

SEQ ID NO: 226528 - DNA, 25 bp, Homo sapien
taatttcatgagagaccttcagcca

SEQ ID NO: 226529 - DNA, 25 bp, Homo sapien
gaaaccattctggattcctcatcct

SEQ ID NO: 226530 - DNA, 25 bp, Homo sapien
accattctggattcctcatcctcag

SEQ ID NO: 226531 - DNA, 25 bp, Homo sapien
agaagtgtttgttgtagtacgccgc

SEQ ID NO: 226532 - DNA, 25 bp, Homo sapien
gtgtttgttgtagtacgccgctaaa

SEQ ID NO: 226533 - DNA, 25 bp, Homo sapien
tttgttgtagtacgccgctaaattt

SEQ ID NO: 226534 - DNA, 25 bp, Homo sapien
gtacgccgctaaatttggggcaatt

SEQ ID NO: 226535 - DNA, 25 bp, Homo sapien
cacatggcacagtatctgtgtcaca

SEQ ID NO: 226536 - DNA, 25 bp, Homo sapien
atctgtgtcacagacgcactcttca

SEQ ID NO: 226537 - DNA, 25 bp, Homo sapien
agacgcactcttcacaaggacaggt

SEQ ID NO: 226538 - DNA, 25 bp, Homo sapien
ttcacaaggacaggtccaggcctgt

SEQ ID NO: 226539 - DNA, 25 bp, Homo sapien
aggcctgtgtcagtcactgcttcat

SEQ ID NO: 226540 - DNA, 25 bp, Homo sapien
agcacagggcctgactcatggtgag

SEQ ID NO: 226541 - DNA, 25 bp, Homo sapien
cctgactcatggtgagctggccccg

SEQ ID NO: 226542 - DNA, 25 bp, Homo sapien
acagatccccgaggcgaggcgtcga

SEQ ID NO: 226543 - DNA, 25 bp, Homo sapien
cgatggctgcggtctgaggtctcta

SEQ ID NO: 226544 - DNA, 25 bp, Homo sapien
ctgtcaagcagaagagctgattgaa

SEQ ID NO: 226545 - DNA, 25 bp, Homo sapien
aagccagtagacttgagacccacaa

SEQ ID NO: 226546 - DNA, 25 bp, Homo sapien
taaaaagtcttgttttcacttatat

SEQ ID NO: 226547 - DNA, 25 bp, Homo sapien
tataccatctatactatttactctt

SEQ ID NO: 226548 - DNA, 25 bp, Homo sapien
catctatactatttactcttacaag

SEQ ID NO: 226549 - DNA, 25 bp, Homo sapien
actcttacaagtgcatttattcctt

SEQ ID NO: 226550 - DNA, 25 bp, Homo sapien
aagtgcatttattccttaacctagc

SEQ ID NO: 226551 - DNA, 25 bp, Homo sapien
ttattccttaacctagcaatccttc

SEQ ID NO: 226552 - DNA, 25 bp, Homo sapien
ttccttaacctagcaatccttctgg

SEQ ID NO: 226553 - DNA, 25 bp, Homo sapien
taacctagcaatccttctggacatc

SEQ ID NO: 226554 - DNA, 25 bp, Homo sapien
acctagcaatccttctggacatcta

SEQ ID NO: 226555 - DNA, 25 bp, Homo sapien
ggacatctataggtatacgttcaca

SEQ ID NO: 226556 - DNA, 25 bp, Homo sapien
tatacgttcacacacctgaaatgtt

SEQ ID NO: 226557 - DNA, 25 bp, Homo sapien
catgtcgggtgtgggatcttgagct

SEQ ID NO: 226558 - DNA, 25 bp, Homo sapien
gatcttgagctctggcagtgatgat

SEQ ID NO: 226559 - DNA, 25 bp, Homo sapien
agtgatgatggtacttcctgttgtc

SEQ ID NO: 226560 - DNA, 25 bp, Homo sapien
caagcccagctgcaaccagtctggg

SEQ ID NO: 226561 - DNA, 25 bp, Homo sapien
gtctggggccattcagccagggaca

SEQ ID NO: 226562 - DNA, 25 bp, Homo sapien
tcagggcctgactcacgtactgtag

SEQ ID NO: 226563 - DNA, 25 bp, Homo sapien
gcctgactcacgtactgtagtttgc

SEQ ID NO: 226564 - DNA, 25 bp, Homo sapien
gactcacgtactgtagtttgcactg

SEQ ID NO: 226565 - DNA, 25 bp, Homo sapien
gtactgtagtttgcactggacgccc

SEQ ID NO: 226566 - DNA, 25 bp, Homo sapien
tgtagtttgcactggacgcccgggc

SEQ ID NO: 226567 - DNA, 25 bp, Homo sapien
agtttgcactggacgcccgggccct

SEQ ID NO: 226568 - DNA, 25 bp, Homo sapien
aaagctttctttctctatacagtgt

SEQ ID NO: 226569 - DNA, 25 bp, Homo sapien
ttttcctcagttttagagaacatct

SEQ ID NO: 226570 - DNA, 25 bp, Homo sapien
atctggtggttctttgtttgaatgc

SEQ ID NO: 226571 - DNA, 25 bp, Homo sapien
ataactttcaagtctccggtgcaag

SEQ ID NO: 226572 - DNA, 25 bp, Homo sapien
gtctccggtgcaagagcataatcta

SEQ ID NO: 226573 - DNA, 25 bp, Homo sapien
gcataatctacagatcatgggcaaa

SEQ ID NO: 226574 - DNA, 25 bp, Homo sapien
gggcaaaatctagccacagtcctga

SEQ ID NO: 226575 - DNA, 25 bp, Homo sapien
gcccagctgggtataaaagtcccta

SEQ ID NO: 226576 - DNA, 25 bp, Homo sapien
tactaaccctgtttcaaattcagag

SEQ ID NO: 226577 - DNA, 25 bp, Homo sapien
tctttggtttagaatgcctcaatga

SEQ ID NO: 226578 - DNA, 25 bp, Homo sapien
gcctcaatgagattttgatacatcc

SEQ ID NO: 226579 - DNA, 25 bp, Homo sapien
gatgggaaaaatactctgccttgtg

SEQ ID NO: 226580 - DNA, 25 bp, Homo sapien
gaaaaatactctgccttgtgtcttt

SEQ ID NO: 226581 - DNA, 25 bp, Homo sapien
aatactctgccttgtgtcttttatg

SEQ ID NO: 226582 - DNA, 25 bp, Homo sapien
gtcttttatgaaatcgatcgtgaac

SEQ ID NO: 226583 - DNA, 25 bp, Homo sapien
ttatgaaatcgatcgtgaacttccg

SEQ ID NO: 226584 - DNA, 25 bp, Homo sapien
tttgaagtattagctgttcttgatt

SEQ ID NO: 226585 - DNA, 25 bp, Homo sapien
gttcttgattcagctgttacacctg

SEQ ID NO: 226586 - DNA, 25 bp, Homo sapien
agctgttacacctggcccatattat

SEQ ID NO: 226587 - DNA, 25 bp, Homo sapien
cacctggcccatattattcgaagac

SEQ ID NO: 226588 - DNA, 25 bp, Homo sapien
ggcccatattattcgaagacttttc

SEQ ID NO: 226589 - DNA, 25 bp, Homo sapien
aagacttttcttatgagggatggga

SEQ ID NO: 226590 - DNA, 25 bp, Homo sapien
taaggaccagccaagcttcagctgt

SEQ ID NO: 226591 - DNA, 25 bp, Homo sapien
cacacacacctttcaggcaggaagg

SEQ ID NO: 226592 - DNA, 25 bp, Homo sapien
tgagcttccagccccaagagtggag

SEQ ID NO: 226593 - DNA, 25 bp, Homo sapien
aagagtggaggctgccacatcctaa

SEQ ID NO: 226594 - DNA, 25 bp, Homo sapien
ggctgccacatcctaacatagtatc

SEQ ID NO: 226595 - DNA, 25 bp, Homo sapien
atgtagcaacacctctccatcttat

SEQ ID NO: 226596 - DNA, 25 bp, Homo sapien
aacacctctccatcttatcaaggaa

SEQ ID NO: 226597 - DNA, 25 bp, Homo sapien
tatcaaggaactcaactcggtctgg

SEQ ID NO: 226598 - DNA, 25 bp, Homo sapien
aggaactcaactcggtctgggtctc

SEQ ID NO: 226599 - DNA, 25 bp, Homo sapien
cactccatgttctctgttgcagtaa

SEQ ID NO: 226600 - DNA, 25 bp, Homo sapien
gttgcagtaaggaccagccaagctt

SEQ ID NO: 226601 - DNA, 25 bp, Homo sapien
cccctctccctgttcttgcaactca

SEQ ID NO: 226602 - DNA, 25 bp, Homo sapien
ccctctccctgttcttgcaactcac

SEQ ID NO: 226603 - DNA, 25 bp, Homo sapien
cctctccctgttcttgcaactcacc

SEQ ID NO: 226604 - DNA, 25 bp, Homo sapien
tctccctgttcttgcaactcaccct

SEQ ID NO: 226605 - DNA, 25 bp, Homo sapien
ctctctctgtctcctgattttctct

SEQ ID NO: 226606 - DNA, 25 bp, Homo sapien
tcctgattttctctctctccaactt

SEQ ID NO: 226607 - DNA, 25 bp, Homo sapien
cctgattttctctctctccaacttt

SEQ ID NO: 226608 - DNA, 25 bp, Homo sapien
caactttctctctatacctctctga

SEQ ID NO: 226609 - DNA, 25 bp, Homo sapien
atctctcccggcctgccaccttcag

SEQ ID NO: 226610 - DNA, 25 bp, Homo sapien
ctctcccggcctgccaccttcaggg

SEQ ID NO: 226611 - DNA, 25 bp, Homo sapien
ggcctgccaccttcaggggtcccca

SEQ ID NO: 226612 - DNA, 25 bp, Homo sapien
gagcaaaggtgagagcaggaagacc

SEQ ID NO: 226613 - DNA, 25 bp, Homo sapien
ggaagaccagttaggctataacaat

SEQ ID NO: 226614 - DNA, 25 bp, Homo sapien
agaccagttaggctataacaataat

SEQ ID NO: 226615 - DNA, 25 bp, Homo sapien
gttaggctataacaataattcaggt

SEQ ID NO: 226616 - DNA, 25 bp, Homo sapien
aattcaggtagcagtggaagtggta

SEQ ID NO: 226617 - DNA, 25 bp, Homo sapien
ttgggagcagatgtggtgtttgaat

SEQ ID NO: 226618 - DNA, 25 bp, Homo sapien
gatgtggtgtttgaattacaagtca

SEQ ID NO: 226619 - DNA, 25 bp, Homo sapien
gtggtgtttgaattacaagtcagta

SEQ ID NO: 226620 - DNA, 25 bp, Homo sapien
tacaaatgtatgaatccacctaaag

SEQ ID NO: 226621 - DNA, 25 bp, Homo sapien
atgtatgaatccacctaaagattag

SEQ ID NO: 226622 - DNA, 25 bp, Homo sapien
ttaggaaaacaaggacaaatgtctt

SEQ ID NO: 226623 - DNA, 25 bp, Homo sapien
ctgctgaaaaacactcttccagtcc

SEQ ID NO: 226624 - DNA, 25 bp, Homo sapien
cagtccaaaagcttcttgatacaga

SEQ ID NO: 226625 - DNA, 25 bp, Homo sapien
gaattccagatcgagtttacagttg

SEQ ID NO: 226626 - DNA, 25 bp, Homo sapien
acttaacttcactacagattgtcta

SEQ ID NO: 226627 - DNA, 25 bp, Homo sapien
acagattgtctagaagacctttcta

SEQ ID NO: 226628 - DNA, 25 bp, Homo sapien
gacctttctaggagttatctgattc

SEQ ID NO: 226629 - DNA, 25 bp, Homo sapien
gttatctgattctagaagggtctat

SEQ ID NO: 226630 - DNA, 25 bp, Homo sapien
ggtctatacttgtccttgtctttaa

SEQ ID NO: 226631 - DNA, 25 bp, Homo sapien
cttgtccttgtctttaagctatttg

SEQ ID NO: 226632 - DNA, 25 bp, Homo sapien
aagctatttgacaactctacgtgtt

SEQ ID NO: 226633 - DNA, 25 bp, Homo sapien
aaatgattgttgtccatggaaaggc

SEQ ID NO: 226634 - DNA, 25 bp, Homo sapien
cagtgaaaaggcaggcagggcatcc

SEQ ID NO: 226635 - DNA, 25 bp, Homo sapien
agacatagacacacaaatccagttt

SEQ ID NO: 226636 - DNA, 25 bp, Homo sapien
aatccagtttccctgatgagagagg

SEQ ID NO: 226637 - DNA, 25 bp, Homo sapien
gctatctcttcataagtgatgcaat

SEQ ID NO: 226638 - DNA, 25 bp, Homo sapien
caatgcaggcatgtacaagtacaag

SEQ ID NO: 226639 - DNA, 25 bp, Homo sapien
ggatgaataccagcaacagcacctg

SEQ ID NO: 226640 - DNA, 25 bp, Homo sapien
ataccagcaacagcacctgctaaag

SEQ ID NO: 226641 - DNA, 25 bp, Homo sapien
tgctaaagcaaacagcctgttcatt

SEQ ID NO: 226642 - DNA, 25 bp, Homo sapien
aactggacttgagggaatggagaaa

SEQ ID NO: 226643 - DNA, 25 bp, Homo sapien
agtgcagcccagcatttttctgttg

SEQ ID NO: 226644 - DNA, 25 bp, Homo sapien
ccagcatttttctgttgtgcatgga

SEQ ID NO: 226645 - DNA, 25 bp, Homo sapien
cagcagaacgtgtacgagatcgact

SEQ ID NO: 226646 - DNA, 25 bp, Homo sapien
tgtacgagatcgacttcgtcagcgc

SEQ ID NO: 226647 - DNA, 25 bp, Homo sapien
gagatcgacttcgtcagcgccgagg

SEQ ID NO: 226648 - DNA, 25 bp, Homo sapien
tcaccgtcagcacagccaacgtggg

SEQ ID NO: 226649 - DNA, 25 bp, Homo sapien
tcagcacagccaacgtgggtgacat

SEQ ID NO: 226650 - DNA, 25 bp, Homo sapien
cagccaacgtgggtgacatcctcag

SEQ ID NO: 226651 - DNA, 25 bp, Homo sapien
aacgtgggtgacatcctcagcgccg

SEQ ID NO: 226652 - DNA, 25 bp, Homo sapien
agatccccgccgtgagccacgtgtg

SEQ ID NO: 226653 - DNA, 25 bp, Homo sapien
atcaaattgatcagcgcaacctcct

SEQ ID NO: 226654 - DNA, 25 bp, Homo sapien
aaggagtacctcgagttcttccaga

SEQ ID NO: 226655 - DNA, 25 bp, Homo sapien
agtacctcgagttcttccagagcaa

SEQ ID NO: 226656 - DNA, 25 bp, Homo sapien
atgacggagtcttcaatattttgat

SEQ ID NO: 226657 - DNA, 25 bp, Homo sapien
aatatgttgtatacttcgctggctg

SEQ ID NO: 226658 - DNA, 25 bp, Homo sapien
ttgtatacttcgctggctgtgtgaa

SEQ ID NO: 226659 - DNA, 25 bp, Homo sapien
tcgctggctgtgtgaagtaaactaa

SEQ ID NO: 226660 - DNA, 25 bp, Homo sapien
aaaactctgatgaacactttggagt

SEQ ID NO: 226661 - DNA, 25 bp, Homo sapien
ggagtctgctttagtgaaggagacc

SEQ ID NO: 226662 - DNA, 25 bp, Homo sapien
ctgggtgtacttttcaatcctgtgt

SEQ ID NO: 226663 - DNA, 25 bp, Homo sapien
cctgtgtaatgtttaattcttgcaa

SEQ ID NO: 226664 - DNA, 25 bp, Homo sapien
ggcaatatttgcactttgggaatga

SEQ ID NO: 226665 - DNA, 25 bp, Homo sapien
ataactgtatgatcacactctgcaa

SEQ ID NO: 226666 - DNA, 25 bp, Homo sapien
gtatgatcacactctgcaaatgcca

SEQ ID NO: 226667 - DNA, 25 bp, Homo sapien
aaggttatgccttcaatatattcct

SEQ ID NO: 226668 - DNA, 25 bp, Homo sapien
ttatgccttcaatatattcctatac

SEQ ID NO: 226669 - DNA, 25 bp, Homo sapien
attcctatacaattctgtaaccatg

SEQ ID NO: 226670 - DNA, 25 bp, Homo sapien
atacaattctgtaaccatggtttaa

SEQ ID NO: 226671 - DNA, 25 bp, Homo sapien
aaccatggtttaaaatacacaagct

SEQ ID NO: 226672 - DNA, 25 bp, Homo sapien
aataacatgcttagaaatacacaat

SEQ ID NO: 226673 - DNA, 25 bp, Homo sapien
gaacagtatttcagccttaattgtg

SEQ ID NO: 226674 - DNA, 25 bp, Homo sapien
gtatttcagccttaattgtgaattt

SEQ ID NO: 226675 - DNA, 25 bp, Homo sapien
atgaaatcttttgagtttttagcca

SEQ ID NO: 226676 - DNA, 25 bp, Homo sapien
tttccttggaattataatgtactgt

SEQ ID NO: 226677 - DNA, 25 bp, Homo sapien
ataatgtactgtacctcttcttttt

SEQ ID NO: 226678 - DNA, 25 bp, Homo sapien
ggtgtccgtgggtcctcagcccagg

SEQ ID NO: 226679 - DNA, 25 bp, Homo sapien
tcagcccagggtgagctgcagtcag

SEQ ID NO: 226680 - DNA, 25 bp, Homo sapien
aggccagaggtcagccagctcctag

SEQ ID NO: 226681 - DNA, 25 bp, Homo sapien
gtcagccagctcctagcagagaaga

SEQ ID NO: 226682 - DNA, 25 bp, Homo sapien
agctcctagcagagaagagccagcc

SEQ ID NO: 226683 - DNA, 25 bp, Homo sapien
tgtctcttgtccatgccctttgtga

SEQ ID NO: 226684 - DNA, 25 bp, Homo sapien
cttgtccatgccctttgtgatttca

SEQ ID NO: 226685 - DNA, 25 bp, Homo sapien
gtcttggtagacttgtatttggagt

SEQ ID NO: 226686 - DNA, 25 bp, Homo sapien
cttgtatttggagttttgtgcttca

SEQ ID NO: 226687 - DNA, 25 bp, Homo sapien
gggatacagagcagctgatcaattt

SEQ ID NO: 226688 - DNA, 25 bp, Homo sapien
acagagcagctgatcaatttgtatt

SEQ ID NO: 226689 - DNA, 25 bp, Homo sapien
agatgagttgcttggacacagatca

SEQ ID NO: 226690 - DNA, 25 bp, Homo sapien
ttggacacagatcagcagaacagga

SEQ ID NO: 226691 - DNA, 25 bp, Homo sapien
agtctggtttagatggcgagattcc

SEQ ID NO: 226692 - DNA, 25 bp, Homo sapien
gagattccgaatctacaatgatcga

SEQ ID NO: 226693 - DNA, 25 bp, Homo sapien
acaatgatcgagtactggtggccac

SEQ ID NO: 226694 - DNA, 25 bp, Homo sapien
gatcgagtactggtggccacttttc

SEQ ID NO: 226695 - DNA, 25 bp, Homo sapien
gtggccacttttctccaacattaag

SEQ ID NO: 226696 - DNA, 25 bp, Homo sapien
agaggaggagattccaccttcagaa

SEQ ID NO: 226697 - DNA, 25 bp, Homo sapien
ggaagcattggctttcttcccacat

SEQ ID NO: 226698 - DNA, 25 bp, Homo sapien
gcattggctttcttcccacattggt

SEQ ID NO: 226699 - DNA, 25 bp, Homo sapien
aggaggaaaccagggtgcacatttc

SEQ ID NO: 226700 - DNA, 25 bp, Homo sapien
gagtacattttgcattctgagttat

SEQ ID NO: 226701 - DNA, 25 bp, Homo sapien
ctgagttatgcagaaagtgctttgc

SEQ ID NO: 226702 - DNA, 25 bp, Homo sapien
aagtgctttgcaacatagaggaaaa

SEQ ID NO: 226703 - DNA, 25 bp, Homo sapien
gaaaaagccctaactgttgtggtgg

SEQ ID NO: 226704 - DNA, 25 bp, Homo sapien
gccctaactgttgtggtggttgaga

SEQ ID NO: 226705 - DNA, 25 bp, Homo sapien
ttgagagttgattggaaagcctcat

SEQ ID NO: 226706 - DNA, 25 bp, Homo sapien
ggctgagtcttgatggagcagtact

SEQ ID NO: 226707 - DNA, 25 bp, Homo sapien
tagaagttctccttatcctttggac

SEQ ID NO: 226708 - DNA, 25 bp, Homo sapien
tatcctttggacttgcaatacacac

SEQ ID NO: 226709 - DNA, 25 bp, Homo sapien
tgcaatacacacaaaactttctggg

SEQ ID NO: 226710 - DNA, 25 bp, Homo sapien
gtgtgtaagtaaggccttgtcctaa

SEQ ID NO: 226711 - DNA, 25 bp, Homo sapien
atttacctccaagaggactcctgat

SEQ ID NO: 226712 - DNA, 25 bp, Homo sapien
gatggatttgactcagtgccgctga

SEQ ID NO: 226713 - DNA, 25 bp, Homo sapien
tggacctgtgagaggcactgcctgc

SEQ ID NO: 226714 - DNA, 25 bp, Homo sapien
gcatagcacctttgcaagcctgcgg

SEQ ID NO: 226715 - DNA, 25 bp, Homo sapien
caagcctgcggcgatttgggtgcca

SEQ ID NO: 226716 - DNA, 25 bp, Homo sapien
ttgggtgccagcatcctgcaacacc

SEQ ID NO: 226717 - DNA, 25 bp, Homo sapien
acccactgctggaaatctcttcatt

SEQ ID NO: 226718 - DNA, 25 bp, Homo sapien
ggaaatctcttcattgtggccttat

SEQ ID NO: 226719 - DNA, 25 bp, Homo sapien
gtggccttatcagatgtttgaattt

SEQ ID NO: 226720 - DNA, 25 bp, Homo sapien
gcttgcctcaaacctgccaaatata

SEQ ID NO: 226721 - DNA, 25 bp, Homo sapien
gccaaatatacccacactttgtttg

SEQ ID NO: 226722 - DNA, 25 bp, Homo sapien
gatgcgacacatgccggcagtaaca

SEQ ID NO: 226723 - DNA, 25 bp, Homo sapien
gtaacagcggctcacttgggtacga

SEQ ID NO: 226724 - DNA, 25 bp, Homo sapien
acttgggtacgatttcttgtgcaca

SEQ ID NO: 226725 - DNA, 25 bp, Homo sapien
tttcttgtgcacagatcctgccttt

SEQ ID NO: 226726 - DNA, 25 bp, Homo sapien
tgcctttcccagataagcagtgaat

SEQ ID NO: 226727 - DNA, 25 bp, Homo sapien
agtgaatctagtcctaatcaccccg

SEQ ID NO: 226728 - DNA, 25 bp, Homo sapien
aatcaccccgttacacagagtggag

SEQ ID NO: 226729 - DNA, 25 bp, Homo sapien
gggtttgcccaggtattatgctgca

SEQ ID NO: 226730 - DNA, 25 bp, Homo sapien
gggccagaatccagatagcctgtcc

SEQ ID NO: 226731 - DNA, 25 bp, Homo sapien
agatagcctgtccttagtcccatgc

SEQ ID NO: 226732 - DNA, 25 bp, Homo sapien
tgttaaacacagaacttggcttttg

SEQ ID NO: 226733 - DNA, 25 bp, Homo sapien
aaaacaattcagacatttcataaga

SEQ ID NO: 226734 - DNA, 25 bp, Homo sapien
atttcataagaaataatacagcctg

SEQ ID NO: 226735 - DNA, 25 bp, Homo sapien
aatacagcctgaagatatgaactac

SEQ ID NO: 226736 - DNA, 25 bp, Homo sapien
tacagcctgaagatatgaactacat

SEQ ID NO: 226737 - DNA, 25 bp, Homo sapien
cagcctgaagatatgaactacattt

SEQ ID NO: 226738 - DNA, 25 bp, Homo sapien
gcctgaagatatgaactacattttt

SEQ ID NO: 226739 - DNA, 25 bp, Homo sapien
agatatgaactacatttttaaggta

SEQ ID NO: 226740 - DNA, 25 bp, Homo sapien
aatatcttgacagaattcttttgct

SEQ ID NO: 226741 - DNA, 25 bp, Homo sapien
tatcttgacagaattcttttgcttt

SEQ ID NO: 226742 - DNA, 25 bp, Homo sapien
caaagaatatcagtcataggcatat

SEQ ID NO: 226743 - DNA, 25 bp, Homo sapien
cagtttctgtaaccaaagacaaatt

SEQ ID NO: 226744 - DNA, 25 bp, Homo sapien
acatcgtggagcgtgagtgatcatt

SEQ ID NO: 226745 - DNA, 25 bp, Homo sapien
gtaccaaagggtcattcctttagca

SEQ ID NO: 226746 - DNA, 25 bp, Homo sapien
attcctttagcatcattcatctttg

SEQ ID NO: 226747 - DNA, 25 bp, Homo sapien
gcatcattcatctttggtttcttca

SEQ ID NO: 226748 - DNA, 25 bp, Homo sapien
ttggtttcttcaagttgccactgaa

SEQ ID NO: 226749 - DNA, 25 bp, Homo sapien
ttgccactgaaaagctagacctttg

SEQ ID NO: 226750 - DNA, 25 bp, Homo sapien
ctagacctttgcctattatctgcta

SEQ ID NO: 226751 - DNA, 25 bp, Homo sapien
ctattatctgctaatctacccagtc

SEQ ID NO: 226752 - DNA, 25 bp, Homo sapien
taatctacccagtctcacattctat

SEQ ID NO: 226753 - DNA, 25 bp, Homo sapien
gtctcacattctattgactcattgt

SEQ ID NO: 226754 - DNA, 25 bp, Homo sapien
aatttcctttgcacatttgtatttt

SEQ ID NO: 226755 - DNA, 25 bp, Homo sapien
tcttttccctccagtgaattcagaa

SEQ ID NO: 226756 - DNA, 25 bp, Homo sapien
ggcccaccatggagcttgtgttctc

SEQ ID NO: 226757 - DNA, 25 bp, Homo sapien
caccatggagcttgtgttctcagaa

SEQ ID NO: 226758 - DNA, 25 bp, Homo sapien
gagcttgtgttctcagaatctgatg

SEQ ID NO: 226759 - DNA, 25 bp, Homo sapien
gaatctgatgctttctgatcaacaa

SEQ ID NO: 226760 - DNA, 25 bp, Homo sapien
gagcaaggaagatcccaacactgaa

SEQ ID NO: 226761 - DNA, 25 bp, Homo sapien
gggcatggagagtgcagctccatta

SEQ ID NO: 226762 - DNA, 25 bp, Homo sapien
agagtgcagctccattatagtgaag

SEQ ID NO: 226763 - DNA, 25 bp, Homo sapien
agtgaagagccaaacatatgtgaac

SEQ ID NO: 226764 - DNA, 25 bp, Homo sapien
aaacatatgtgaactgtttgctgtg

SEQ ID NO: 226765 - DNA, 25 bp, Homo sapien
gcccagggaatggtacctggctgca

SEQ ID NO: 226766 - DNA, 25 bp, Homo sapien
aagtctttatgatggctctaagctc

SEQ ID NO: 226767 - DNA, 25 bp, Homo sapien
taagctcagctttagaccatggagt

SEQ ID NO: 226768 - DNA, 25 bp, Homo sapien
gttacagcaggcaggctggttgact

SEQ ID NO: 226769 - DNA, 25 bp, Homo sapien
ctggttgactagagagtctcacttt

SEQ ID NO: 226770 - DNA, 25 bp, Homo sapien
tgtaaggcatttgtccaacttcccc

SEQ ID NO: 226771 - DNA, 25 bp, Homo sapien
tcccctttttcattagcctcaagga

SEQ ID NO: 226772 - DNA, 25 bp, Homo sapien
agggttactgtactcaaagcatcga

SEQ ID NO: 226773 - DNA, 25 bp, Homo sapien
gagagtcctgaatcataagctctta

SEQ ID NO: 226774 - DNA, 25 bp, Homo sapien
cataagctcttatgaggattctcaa

SEQ ID NO: 226775 - DNA, 25 bp, Homo sapien
tcaattttccagtacgtttttgagt

SEQ ID NO: 226776 - DNA, 25 bp, Homo sapien
gagtattttctcttggattagttaa

SEQ ID NO: 226777 - DNA, 25 bp, Homo sapien
aagactttctcacccgtattggaga

SEQ ID NO: 226778 - DNA, 25 bp, Homo sapien
tcacccgtattggagaagcacatca

SEQ ID NO: 226779 - DNA, 25 bp, Homo sapien
agatgaccccagaataatctggaaa

SEQ ID NO: 226780 - DNA, 25 bp, Homo sapien
agaaaagtcatatcagatactctgg

SEQ ID NO: 226781 - DNA, 25 bp, Homo sapien
gatactctggttttgaaagatcaga

SEQ ID NO: 226782 - DNA, 25 bp, Homo sapien
gcgagatggaaatagtgcttgtcat

SEQ ID NO: 226783 - DNA, 25 bp, Homo sapien
gtgcttgtcatttaccattttctct

SEQ ID NO: 226784 - DNA, 25 bp, Homo sapien
tcatttaccattttctctgccattt

SEQ ID NO: 226785 - DNA, 25 bp, Homo sapien
tctgccatttctcaagcgacttact

SEQ ID NO: 226786 - DNA, 25 bp, Homo sapien
aagcgacttactctaatcaaaccag

SEQ ID NO: 226787 - DNA, 25 bp, Homo sapien
accagagctggtgattgttaatgat

SEQ ID NO: 226788 - DNA, 25 bp, Homo sapien
ggaaggagattgatgccagagaaca

SEQ ID NO: 226789 - DNA, 25 bp, Homo sapien
atgccagagaacacaaacgcttcag

SEQ ID NO: 226790 - DNA, 25 bp, Homo sapien
gaacacaaacgcttcaggagaaatt

SEQ ID NO: 226791 - DNA, 25 bp, Homo sapien
aagcctgtgtcacccgatcgctcag

SEQ ID NO: 226792 - DNA, 25 bp, Homo sapien
gatcgctcagaccagtgcggctctg

SEQ ID NO: 226793 - DNA, 25 bp, Homo sapien
cagtgcggctctggctggaggagtc

SEQ ID NO: 226794 - DNA, 25 bp, Homo sapien
agcactgggtcatttcttgccaata

SEQ ID NO: 226795 - DNA, 25 bp, Homo sapien
tgggtcatttcttgccaataggaag

SEQ ID NO: 226796 - DNA, 25 bp, Homo sapien
tcttgccaataggaaggctggtgct

SEQ ID NO: 226797 - DNA, 25 bp, Homo sapien
tcgggaccctcttcattctctgatc

SEQ ID NO: 226798 - DNA, 25 bp, Homo sapien
cttcattctctgatctcatcctgga

SEQ ID NO: 226799 - DNA, 25 bp, Homo sapien
catgcctggctcttgtcagtatgaa

SEQ ID NO: 226800 - DNA, 25 bp, Homo sapien
ggctcttgtcagtatgaatccctgc

SEQ ID NO: 226801 - DNA, 25 bp, Homo sapien
gtcagtatgaatccctgctgtgtcc

SEQ ID NO: 226802 - DNA, 25 bp, Homo sapien
tggcacatggcaggcccatctttgt

SEQ ID NO: 226803 - DNA, 25 bp, Homo sapien
atggcaggcccatctttgtggagtg

SEQ ID NO: 226804 - DNA, 25 bp, Homo sapien
tctttgtggagtgaactgggaacag

SEQ ID NO: 226805 - DNA, 25 bp, Homo sapien
agcgctgggatggtggagtgttcta

SEQ ID NO: 226806 - DNA, 25 bp, Homo sapien
gagtgttctaagtgagacagccaca

SEQ ID NO: 226807 - DNA, 25 bp, Homo sapien
gttctaagtgagacagccacagtgc

SEQ ID NO: 226808 - DNA, 25 bp, Homo sapien
ctaggcaggagtgcggtctcacgat

SEQ ID NO: 226809 - DNA, 25 bp, Homo sapien
gcggtctcacgataacagttcactg

SEQ ID NO: 226810 - DNA, 25 bp, Homo sapien
gtttgggaatatccaattctgctgt

SEQ ID NO: 226811 - DNA, 25 bp, Homo sapien
tatccaattctgctgtagaagacag

SEQ ID NO: 226812 - DNA, 25 bp, Homo sapien
tattcgtgtgtacagagatcaaaag

SEQ ID NO: 226813 - DNA, 25 bp, Homo sapien
aggaggcactaaatattcacggtac

SEQ ID NO: 226814 - DNA, 25 bp, Homo sapien
ggcactaaatattcacggtacccta

SEQ ID NO: 226815 - DNA, 25 bp, Homo sapien
taaaaatgggcagggcttgctgact

SEQ ID NO: 226816 - DNA, 25 bp, Homo sapien
ggcagggcttgctgactgtttgaaa

SEQ ID NO: 226817 - DNA, 25 bp, Homo sapien
agggcttgctgactgtttgaaacta

SEQ ID NO: 226818 - DNA, 25 bp, Homo sapien
tgaagggaggcagcactctaggata

SEQ ID NO: 226819 - DNA, 25 bp, Homo sapien
gaggcagcactctaggataaacacc

SEQ ID NO: 226820 - DNA, 25 bp, Homo sapien
actctaggataaacaccagacttgc

SEQ ID NO: 226821 - DNA, 25 bp, Homo sapien
acccccgcatagatcaattcattca

SEQ ID NO: 226822 - DNA, 25 bp, Homo sapien
gcgatgcaaccaaggctgtgcgccc

SEQ ID NO: 226823 - DNA, 25 bp, Homo sapien
gggaagagccagtgcaatgcctcaa

SEQ ID NO: 226824 - DNA, 25 bp, Homo sapien
gagccagtgcaatgcctcaaaatgg

SEQ ID NO: 226825 - DNA, 25 bp, Homo sapien
gtgcaatgcctcaaaatggagacat

SEQ ID NO: 226826 - DNA, 25 bp, Homo sapien
cctcaaaatggagacatggtgtatt

SEQ ID NO: 226827 - DNA, 25 bp, Homo sapien
gacatggtgtattaatggagaagca

SEQ ID NO: 226828 - DNA, 25 bp, Homo sapien
gaagcagcaggacttgtgaaagcct

SEQ ID NO: 226829 - DNA, 25 bp, Homo sapien
caggacttgtgaaagcctgggacga

SEQ ID NO: 226830 - DNA, 25 bp, Homo sapien
gggcttggggttttattctcaatat

SEQ ID NO: 226831 - DNA, 25 bp, Homo sapien
agaaaatgattcaaggctgagagca

SEQ ID NO: 226832 - DNA, 25 bp, Homo sapien
gtaaggtacagaacaagcgcatagt

SEQ ID NO: 226833 - DNA, 25 bp, Homo sapien
gaacaagcgcatagtattcaatgaa

SEQ ID NO: 226834 - DNA, 25 bp, Homo sapien
atgaatgttagctatatgtacatgt

SEQ ID NO: 226835 - DNA, 25 bp, Homo sapien
gtgtatgtgcaatacattgtattac

SEQ ID NO: 226836 - DNA, 25 bp, Homo sapien
attacgtgggtttcattaatgtcaa

SEQ ID NO: 226837 - DNA, 25 bp, Homo sapien
ggctgagtagtattatttttgcttc

SEQ ID NO: 226838 - DNA, 25 bp, Homo sapien
tatttttgcttctcaagttctgcac

SEQ ID NO: 226839 - DNA, 25 bp, Homo sapien
tgcttctcaagttctgcacatttat

SEQ ID NO: 226840 - DNA, 25 bp, Homo sapien
tatttgagcctgaagttggctgacc

SEQ ID NO: 226841 - DNA, 25 bp, Homo sapien
gttggctgaccaaggactgtggata

SEQ ID NO: 226842 - DNA, 25 bp, Homo sapien
caaggactgtggataagtgtagcat

SEQ ID NO: 226843 - DNA, 25 bp, Homo sapien
ggagggcagatgtcctgggcaaacc

SEQ ID NO: 226844 - DNA, 25 bp, Homo sapien
gatgtcctgggcaaaccgggcccct

SEQ ID NO: 226845 - DNA, 25 bp, Homo sapien
cacacacctcacttgatccttttgc

SEQ ID NO: 226846 - DNA, 25 bp, Homo sapien
gggaactggcttcccagttgcccct

SEQ ID NO: 226847 - DNA, 25 bp, Homo sapien
agacttcatgtctctgctcatcagc

SEQ ID NO: 226848 - DNA, 25 bp, Homo sapien
tgctcatcagcactgtcccaggatc

SEQ ID NO: 226849 - DNA, 25 bp, Homo sapien
aggatcctggagagggagaacccct

SEQ ID NO: 226850 - DNA, 25 bp, Homo sapien
gggtctcccgtttcctgtgcctgca

SEQ ID NO: 226851 - DNA, 25 bp, Homo sapien
tgcgtctgcacacccctgcgtgtaa

SEQ ID NO: 226852 - DNA, 25 bp, Homo sapien
tgcgtgtaactgcattccaaccact

SEQ ID NO: 226853 - DNA, 25 bp, Homo sapien
tgtaactgcattccaaccactaata

SEQ ID NO: 226854 - DNA, 25 bp, Homo sapien
gaatgccttgcttttggtcttttct

SEQ ID NO: 226855 - DNA, 25 bp, Homo sapien
tttaacctgaatgcgatcgaatgcc

SEQ ID NO: 226856 - DNA, 25 bp, Homo sapien
gggtggacattgaccgattcgacaa

SEQ ID NO: 226857 - DNA, 25 bp, Homo sapien
ggacattgaccgattcgacaacgtt

SEQ ID NO: 226858 - DNA, 25 bp, Homo sapien
gaatgcgatcgaatgccgactccca

SEQ ID NO: 226859 - DNA, 25 bp, Homo sapien
gattcgacaacgttcgggctctaag

SEQ ID NO: 226860 - DNA, 25 bp, Homo sapien
caacgttcgggctctaagggctcgg

SEQ ID NO: 226861 - DNA, 25 bp, Homo sapien
aatgccgactcccagaagagattag

SEQ ID NO: 226862 - DNA, 25 bp, Homo sapien
aagagattagcagggtccgcccggc

SEQ ID NO: 226863 - DNA, 25 bp, Homo sapien
gccaggactcggaatgccttgcttt

SEQ ID NO: 226864 - DNA, 25 bp, Homo sapien
actcggaatgccttgcttttggtct

SEQ ID NO: 226865 - DNA, 25 bp, Homo sapien
gtagaaactctgttcagcttcatgc

SEQ ID NO: 226866 - DNA, 25 bp, Homo sapien
cttcatgcaggagcgccagaaaaga

SEQ ID NO: 226867 - DNA, 25 bp, Homo sapien
aagatacgccaagtatgccgagcag

SEQ ID NO: 226868 - DNA, 25 bp, Homo sapien
caagtatgccgagcagatccagaaa

SEQ ID NO: 226869 - DNA, 25 bp, Homo sapien
aagtgaacgagatgtccgccatcct

SEQ ID NO: 226870 - DNA, 25 bp, Homo sapien
atcctccgccgcatacagatgggca

SEQ ID NO: 226871 - DNA, 25 bp, Homo sapien
cagatgggcatcgaccagactgtgc

SEQ ID NO: 226872 - DNA, 25 bp, Homo sapien
tcaacagcatgctgcccgagggcga

SEQ ID NO: 226873 - DNA, 25 bp, Homo sapien
tggagcccttcagcatgaagcccga

SEQ ID NO: 226874 - DNA, 25 bp, Homo sapien
gaccgcgagctcaggctgtagctgc

SEQ ID NO: 226875 - DNA, 25 bp, Homo sapien
aggacgtgtggagctaaggtcatat

SEQ ID NO: 226876 - DNA, 25 bp, Homo sapien
gcattgtaaatttcacttaaacctg

SEQ ID NO: 226877 - DNA, 25 bp, Homo sapien
tgtaaatttcacttaaacctgttgg

SEQ ID NO: 226878 - DNA, 25 bp, Homo sapien
atttcacttaaacctgttggttatg

SEQ ID NO: 226879 - DNA, 25 bp, Homo sapien
acctgttggttatgaaaatttgaag

SEQ ID NO: 226880 - DNA, 25 bp, Homo sapien
aagacttttgtcctaagaagaatat

SEQ ID NO: 226881 - DNA, 25 bp, Homo sapien
aataattttgagctacctgacgaca

SEQ ID NO: 226882 - DNA, 25 bp, Homo sapien
ttgagctacctgacgacaaatcata

SEQ ID NO: 226883 - DNA, 25 bp, Homo sapien
gctacctgacgacaaatcatatctt

SEQ ID NO: 226884 - DNA, 25 bp, Homo sapien
gacaaatcatatctttaaccagcca

SEQ ID NO: 226885 - DNA, 25 bp, Homo sapien
atatctttaaccagccagttttcca

SEQ ID NO: 226886 - DNA, 25 bp, Homo sapien
tttaaccagccagttttccaatgca

SEQ ID NO: 226887 - DNA, 25 bp, Homo sapien
cagcagctgctgatcgcctacaagc

SEQ ID NO: 226888 - DNA, 25 bp, Homo sapien
agcagctgctgatcgcctacaagcc

SEQ ID NO: 226889 - DNA, 25 bp, Homo sapien
gcagctgctgatcgcctacaagcca

SEQ ID NO: 226890 - DNA, 25 bp, Homo sapien
agatgcaggctcagcaccctccgga

SEQ ID NO: 226891 - DNA, 25 bp, Homo sapien
tgcaggctcagcaccctccggaggg

SEQ ID NO: 226892 - DNA, 25 bp, Homo sapien
ctacatcatgaagatagctccagag

SEQ ID NO: 226893 - DNA, 25 bp, Homo sapien
tacatcatgaagatagctccagaga

SEQ ID NO: 226894 - DNA, 25 bp, Homo sapien
acatcatgaagatagctccagagag

SEQ ID NO: 226895 - DNA, 25 bp, Homo sapien
catcatgaagatagctccagagagc

SEQ ID NO: 226896 - DNA, 25 bp, Homo sapien
atcatgaagatagctccagagagca

SEQ ID NO: 226897 - DNA, 25 bp, Homo sapien
atgaagatagctccagagagcatcc

SEQ ID NO: 226898 - DNA, 25 bp, Homo sapien
tttgcgtgatgtgaataccctctcc

SEQ ID NO: 226899 - DNA, 25 bp, Homo sapien
taccctctcccatcaatatttgtat

SEQ ID NO: 226900 - DNA, 25 bp, Homo sapien
ggtgctatatattggtaatgatcct

SEQ ID NO: 226901 - DNA, 25 bp, Homo sapien
aatactgtgattaaactgggtttct

SEQ ID NO: 226902 - DNA, 25 bp, Homo sapien
tgattaaactgggtttcttcctttg

SEQ ID NO: 226903 - DNA, 25 bp, Homo sapien
aagaaaagcatctgtccctgggcaa

SEQ ID NO: 226904 - DNA, 25 bp, Homo sapien
ctgtccctgggcaaatcttttgagg

SEQ ID NO: 226905 - DNA, 25 bp, Homo sapien
gcaaatcttttgaggacagaggtca

SEQ ID NO: 226906 - DNA, 25 bp, Homo sapien
caacttcttattctacgatactaac

SEQ ID NO: 226907 - DNA, 25 bp, Homo sapien
ttattctacgatactaacacgggtt

SEQ ID NO: 226908 - DNA, 25 bp, Homo sapien
tactaacacgggttttcagtgtttg

SEQ ID NO: 226909 - DNA, 25 bp, Homo sapien
gctttaggaacagctcaagaacctt

SEQ ID NO: 226910 - DNA, 25 bp, Homo sapien
aaccttggagttcatatttcacaaa

SEQ ID NO: 226911 - DNA, 25 bp, Homo sapien
atataagtccaagagctgtcagcct

SEQ ID NO: 226912 - DNA, 25 bp, Homo sapien
gctgtcagcctaatctgtaggagca

SEQ ID NO: 226913 - DNA, 25 bp, Homo sapien
gagcagaacctctgattgaccaaaa

SEQ ID NO: 226914 - DNA, 25 bp, Homo sapien
tttgatgtcatatgtctctgatggg

SEQ ID NO: 226915 - DNA, 25 bp, Homo sapien
tgcaagtgctacctcgcgcttgtac

SEQ ID NO: 226916 - DNA, 25 bp, Homo sapien
tcgcgcttgtacactgctgctgtgg

SEQ ID NO: 226917 - DNA, 25 bp, Homo sapien
cgcctgccggtgaagagctgcagat

SEQ ID NO: 226918 - DNA, 25 bp, Homo sapien
aagagctgcagatgccgagaagcca

SEQ ID NO: 226919 - DNA, 25 bp, Homo sapien
agccagcaaacacagggcccactgg

SEQ ID NO: 226920 - DNA, 25 bp, Homo sapien
aatggatgatgtttaccgctacttg

SEQ ID NO: 226921 - DNA, 25 bp, Homo sapien
ggatgatgtttaccgctacttgctg

SEQ ID NO: 226922 - DNA, 25 bp, Homo sapien
atgtttaccgctacttgctgacaaa

SEQ ID NO: 226923 - DNA, 25 bp, Homo sapien
ttaccgctacttgctgacaaagaaa

SEQ ID NO: 226924 - DNA, 25 bp, Homo sapien
caaagaaaaatgttcacttgtgtta

SEQ ID NO: 226925 - DNA, 25 bp, Homo sapien
gaaagacaggtctcagaacagcaac

SEQ ID NO: 226926 - DNA, 25 bp, Homo sapien
agggatttatcgtgagatgctcata

SEQ ID NO: 226927 - DNA, 25 bp, Homo sapien
aactacctacacatttcccttgtga

SEQ ID NO: 226928 - DNA, 25 bp, Homo sapien
taggaatctgccctgaagatacaac

SEQ ID NO: 226929 - DNA, 25 bp, Homo sapien
cctgaagatacaactccacctatta

SEQ ID NO: 226930 - DNA, 25 bp, Homo sapien
gatacaactccacctattaaaaaat

SEQ ID NO: 226931 - DNA, 25 bp, Homo sapien
gatttttcagctcacagacctacat

SEQ ID NO: 226932 - DNA, 25 bp, Homo sapien
gacctacattctgcagtcttgtgta

SEQ ID NO: 226933 - DNA, 25 bp, Homo sapien
tctgcagtcttgtgtatttgagctt

SEQ ID NO: 226934 - DNA, 25 bp, Homo sapien
gtatttgagcttacaatggtaccca

SEQ ID NO: 226935 - DNA, 25 bp, Homo sapien
caatggtacccattaaatttggcta

SEQ ID NO: 226936 - DNA, 25 bp, Homo sapien
ttggctaaaacacttgggttgctgt

SEQ ID NO: 226937 - DNA, 25 bp, Homo sapien
ttgctgttttccctaaagaaacact

SEQ ID NO: 226938 - DNA, 25 bp, Homo sapien
cactattaagtcacatccccaaaac

SEQ ID NO: 226939 - DNA, 25 bp, Homo sapien
acttagtggtcatgacgcatattag

SEQ ID NO: 226940 - DNA, 25 bp, Homo sapien
gacgcatattagtcagtgtactgaa

SEQ ID NO: 226941 - DNA, 25 bp, Homo sapien
aaacccacctcattcagggcaataa

SEQ ID NO: 226942 - DNA, 25 bp, Homo sapien
gccatcgtgtgctgaaagcctgccg

SEQ ID NO: 226943 - DNA, 25 bp, Homo sapien
aagcctgccgtctgccggacactga

SEQ ID NO: 226944 - DNA, 25 bp, Homo sapien
aggccgagggtctttaagaagcatg

SEQ ID NO: 226945 - DNA, 25 bp, Homo sapien
agggtctttaagaagcatggccgtg

SEQ ID NO: 226946 - DNA, 25 bp, Homo sapien
gacaggacaggttactgagactgaa

SEQ ID NO: 226947 - DNA, 25 bp, Homo sapien
gactgaattttgtctgaagagtagg

SEQ ID NO: 226948 - DNA, 25 bp, Homo sapien
gagagctgtagtggttcccctttgc

SEQ ID NO: 226949 - DNA, 25 bp, Homo sapien
tggttcccctttgctggttgttggt

SEQ ID NO: 226950 - DNA, 25 bp, Homo sapien
aatcttgcctgatgtatatgtgtac

SEQ ID NO: 226951 - DNA, 25 bp, Homo sapien
tatgtgtacatgtggaaggctgaag

SEQ ID NO: 226952 - DNA, 25 bp, Homo sapien
ataaatgccccattcgtaagtattc

SEQ ID NO: 226953 - DNA, 25 bp, Homo sapien
tactagttgttttacactctctttt

SEQ ID NO: 226954 - DNA, 25 bp, Homo sapien
ctagttgttttacactctcttttct

SEQ ID NO: 226955 - DNA, 25 bp, Homo sapien
tagttgttttacactctcttttctt

SEQ ID NO: 226956 - DNA, 25 bp, Homo sapien
gttgttttacactctcttttcttat

SEQ ID NO: 226957 - DNA, 25 bp, Homo sapien
ttgttttacactctcttttcttatt

SEQ ID NO: 226958 - DNA, 25 bp, Homo sapien
tcttttcttattcttagggcttttg

SEQ ID NO: 226959 - DNA, 25 bp, Homo sapien
ttttcttattcttagggcttttgtg

SEQ ID NO: 226960 - DNA, 25 bp, Homo sapien
tttcttattcttagggcttttgtgt

SEQ ID NO: 226961 - DNA, 25 bp, Homo sapien
ttcttattcttagggcttttgtgta

SEQ ID NO: 226962 - DNA, 25 bp, Homo sapien
tattcttagggcttttgtgtatgtc

SEQ ID NO: 226963 - DNA, 25 bp, Homo sapien
attcttagggcttttgtgtatgtct

SEQ ID NO: 226964 - DNA, 25 bp, Homo sapien
cagcctgtcccatgaggaataaagg

SEQ ID NO: 226965 - DNA, 25 bp, Homo sapien
catgaggaataaaggcccctggccc

SEQ ID NO: 226966 - DNA, 25 bp, Homo sapien
ggaggccaccttttaaggcaccact

SEQ ID NO: 226967 - DNA, 25 bp, Homo sapien
cttttaaggcaccactagcagtcag

SEQ ID NO: 226968 - DNA, 25 bp, Homo sapien
actagcagtcaggatatggtggcat

SEQ ID NO: 226969 - DNA, 25 bp, Homo sapien
gtcaggatatggtggcatcagccct

SEQ ID NO: 226970 - DNA, 25 bp, Homo sapien
tcacaggccctgcagtgctcatttg

SEQ ID NO: 226971 - DNA, 25 bp, Homo sapien
tgcagtgctcatttggaattcctcc

SEQ ID NO: 226972 - DNA, 25 bp, Homo sapien
gctcatttggaattcctcccaagac

SEQ ID NO: 226973 - DNA, 25 bp, Homo sapien
ccattcttcctaacactggcaataa

SEQ ID NO: 226974 - DNA, 25 bp, Homo sapien
acactggcaataaaccctcaactgt

SEQ ID NO: 226975 - DNA, 25 bp, Homo sapien
aaggctgggctctcgggcatccact

SEQ ID NO: 226976 - DNA, 25 bp, Homo sapien
tcgggcatccactctgcggaggaat

SEQ ID NO: 226977 - DNA, 25 bp, Homo sapien
ggcatccactctgcggaggaatgac

SEQ ID NO: 226978 - DNA, 25 bp, Homo sapien
actctgcggaggaatgactccatct

SEQ ID NO: 226979 - DNA, 25 bp, Homo sapien
gaggaatgactccatctacgaggcc

SEQ ID NO: 226980 - DNA, 25 bp, Homo sapien
ggaatgactccatctacgaggcctc

SEQ ID NO: 226981 - DNA, 25 bp, Homo sapien
atgactccatctacgaggcctccag

SEQ ID NO: 226982 - DNA, 25 bp, Homo sapien
gcctccagcctctatggcatctcag

SEQ ID NO: 226983 - DNA, 25 bp, Homo sapien
aggaggagtataactacggcttcgt

SEQ ID NO: 226984 - DNA, 25 bp, Homo sapien
tataactacggcttcgtggtggaga

SEQ ID NO: 226985 - DNA, 25 bp, Homo sapien
aactacggcttcgtggtggagaaga

SEQ ID NO: 226986 - DNA, 25 bp, Homo sapien
ctgctgaggcgttgacagcgcctga

SEQ ID NO: 226987 - DNA, 25 bp, Homo sapien
gaggatgctgggaggcccgctgtca

SEQ ID NO: 226988 - DNA, 25 bp, Homo sapien
tgtcaactccccagcaaatcagagc

SEQ ID NO: 226989 - DNA, 25 bp, Homo sapien
gcgggaaccaatgcaagctctttca

SEQ ID NO: 226990 - DNA, 25 bp, Homo sapien
aaccaatgcaagctctttcatcctt

SEQ ID NO: 226991 - DNA, 25 bp, Homo sapien
atgcaagctctttcatccttcatta

SEQ ID NO: 226992 - DNA, 25 bp, Homo sapien
tttcatccttcattaccccagttac

SEQ ID NO: 226993 - DNA, 25 bp, Homo sapien
ttaccccagttaccttctgaggaag

SEQ ID NO: 226994 - DNA, 25 bp, Homo sapien
agagagagtcccatagaaggtcaga

SEQ ID NO: 226995 - DNA, 25 bp, Homo sapien
gtcccatagaaggtcagaggagtga

SEQ ID NO: 226996 - DNA, 25 bp, Homo sapien
gggagctccctaaatctcacctgga

SEQ ID NO: 226997 - DNA, 25 bp, Homo sapien
ctcattgtgtttcttctgagtgagc

SEQ ID NO: 226998 - DNA, 25 bp, Homo sapien
taaaagtccctgaaggaaggtcctg

SEQ ID NO: 226999 - DNA, 25 bp, Homo sapien
tggaatgtgactcccttgctcctct

SEQ ID NO: 227000 - DNA, 25 bp, Homo sapien
tgttgctctctttggcattcatttc

SEQ ID NO: 227001 - DNA, 25 bp, Homo sapien
tcatttctttggaccctacgcaagg

SEQ ID NO: 227002 - DNA, 25 bp, Homo sapien
ggaccctacgcaaggactgtaattg

SEQ ID NO: 227003 - DNA, 25 bp, Homo sapien
tgctgggcttcacacacggtgtcct

SEQ ID NO: 227004 - DNA, 25 bp, Homo sapien
taggccagtgcctctggagtcagaa

SEQ ID NO: 227005 - DNA, 25 bp, Homo sapien
gtgcctctggagtcagaactctggt

SEQ ID NO: 227006 - DNA, 25 bp, Homo sapien
agaactctggtggtatttccctcaa

SEQ ID NO: 227007 - DNA, 25 bp, Homo sapien
ggtggtatttccctcaatgaagtgg

SEQ ID NO: 227008 - DNA, 25 bp, Homo sapien
aaaatagacaaaggactcgctgggc

SEQ ID NO: 227009 - DNA, 25 bp, Homo sapien
aaatagacaaaggactcgctgggcg

SEQ ID NO: 227010 - DNA, 25 bp, Homo sapien
aatagacaaaggactcgctgggcgt

SEQ ID NO: 227011 - DNA, 25 bp, Homo sapien
atagacaaaggactcgctgggcgtg

SEQ ID NO: 227012 - DNA, 25 bp, Homo sapien
tagacaaaggactcgctgggcgtgg

SEQ ID NO: 227013 - DNA, 25 bp, Homo sapien
agacaaaggactcgctgggcgtggt

SEQ ID NO: 227014 - DNA, 25 bp, Homo sapien
gacaaaggactcgctgggcgtggtg

SEQ ID NO: 227015 - DNA, 25 bp, Homo sapien
acaaaggactcgctgggcgtggtgg

SEQ ID NO: 227016 - DNA, 25 bp, Homo sapien
caaaggactcgctgggcgtggtggt

SEQ ID NO: 227017 - DNA, 25 bp, Homo sapien
aaaggactcgctgggcgtggtggtt

SEQ ID NO: 227018 - DNA, 25 bp, Homo sapien
aggactcgctgggcgtggtggttca

SEQ ID NO: 227019 - DNA, 25 bp, Homo sapien
atataatacttgttcatgagcactg

SEQ ID NO: 227020 - DNA, 25 bp, Homo sapien
ttgttcatgagcactgaaatcctga

SEQ ID NO: 227021 - DNA, 25 bp, Homo sapien
tcctgaagaggagagatttggttat

SEQ ID NO: 227022 - DNA, 25 bp, Homo sapien
gggtgatcttaagtgcctcagttaa

SEQ ID NO: 227023 - DNA, 25 bp, Homo sapien
gcctcagttaatgcacgtacagtat

SEQ ID NO: 227024 - DNA, 25 bp, Homo sapien
aatgcacgtacagtattcatttggt

SEQ ID NO: 227025 - DNA, 25 bp, Homo sapien
tggttggttgtactacctctcagaa

SEQ ID NO: 227026 - DNA, 25 bp, Homo sapien
gtaaaatttgtcaccttatggaatg

SEQ ID NO: 227027 - DNA, 25 bp, Homo sapien
tttgttgttgcttggtttggtattt

SEQ ID NO: 227028 - DNA, 25 bp, Homo sapien
ttttctgtataattagcccaggctg

SEQ ID NO: 227029 - DNA, 25 bp, Homo sapien
agcccaggctgatgtaactataaaa

SEQ ID NO: 227030 - DNA, 25 bp, Homo sapien
atcacacagatttgaagagatcagt

SEQ ID NO: 227031 - DNA, 25 bp, Homo sapien
aaaatttgcaatctgtctttctata

SEQ ID NO: 227032 - DNA, 25 bp, Homo sapien
aatttgcaatctgtctttctataaa

SEQ ID NO: 227033 - DNA, 25 bp, Homo sapien
gtctttctataaattattattccct

SEQ ID NO: 227034 - DNA, 25 bp, Homo sapien
ttattattccctaaatgtgtatttt

SEQ ID NO: 227035 - DNA, 25 bp, Homo sapien
atgttaatttaactacctgaatatt

SEQ ID NO: 227036 - DNA, 25 bp, Homo sapien
taagccatagtttctagattaccta

SEQ ID NO: 227037 - DNA, 25 bp, Homo sapien
catagtttctagattacctactttt

SEQ ID NO: 227038 - DNA, 25 bp, Homo sapien
agtaaacatttagattccttttctg

SEQ ID NO: 227039 - DNA, 25 bp, Homo sapien
tttctccatttctatcacacagatt

SEQ ID NO: 227040 - DNA, 25 bp, Homo sapien
tccatttctatcacacagatttgaa

SEQ ID NO: 227041 - DNA, 25 bp, Homo sapien
gaaaggcaaaactgtaaagcttcta

SEQ ID NO: 227042 - DNA, 25 bp, Homo sapien
aggcaaaactgtaaagcttctaaag

SEQ ID NO: 227043 - DNA, 25 bp, Homo sapien
ggcaaaactgtaaagcttctaaagt

SEQ ID NO: 227044 - DNA, 25 bp, Homo sapien
gcaaaactgtaaagcttctaaagta

SEQ ID NO: 227045 - DNA, 25 bp, Homo sapien
caaaactgtaaagcttctaaagtat

SEQ ID NO: 227046 - DNA, 25 bp, Homo sapien
aactgtaaagcttctaaagtataat

SEQ ID NO: 227047 - DNA, 25 bp, Homo sapien
actgtaaagcttctaaagtataatc

SEQ ID NO: 227048 - DNA, 25 bp, Homo sapien
gtaaagcttctaaagtataatcaga

SEQ ID NO: 227049 - DNA, 25 bp, Homo sapien
aagcttctaaagtataatcagaaac

SEQ ID NO: 227050 - DNA, 25 bp, Homo sapien
atcagaaacttacagaagactttaa

SEQ ID NO: 227051 - DNA, 25 bp, Homo sapien
tcagaaacttacagaagactttaaa

SEQ ID NO: 227052 - DNA, 25 bp, Homo sapien
gagggagttttataaattgttcaca

SEQ ID NO: 227053 - DNA, 25 bp, Homo sapien
acagagcatctgttccaaggagacc

SEQ ID NO: 227054 - DNA, 25 bp, Homo sapien
caaggagaccttgatgttcatagat

SEQ ID NO: 227055 - DNA, 25 bp, Homo sapien
acactgactcctctgcaaatgtctg

SEQ ID NO: 227056 - DNA, 25 bp, Homo sapien
ctcctctgcaaatgtctgagggttc

SEQ ID NO: 227057 - DNA, 25 bp, Homo sapien
taaggtagcatttcatccacacgat

SEQ ID NO: 227058 - DNA, 25 bp, Homo sapien
gggtttgatcgcagagtaaataaat

SEQ ID NO: 227059 - DNA, 25 bp, Homo sapien
aatatattctagcaagatgcagccc

SEQ ID NO: 227060 - DNA, 25 bp, Homo sapien
gcatttcatccacacgatggagtgt

SEQ ID NO: 227061 - DNA, 25 bp, Homo sapien
cgatggagtgtgttttattcagtaa

SEQ ID NO: 227062 - DNA, 25 bp, Homo sapien
atcaacctaagtgtctaacaggagg

SEQ ID NO: 227063 - DNA, 25 bp, Homo sapien
gggtcacgtatgctttgtccaagga

SEQ ID NO: 227064 - DNA, 25 bp, Homo sapien
cacgtatgctttgtccaaggaggag

SEQ ID NO: 227065 - DNA, 25 bp, Homo sapien
agagctgtcggatgtgcgggatgat

SEQ ID NO: 227066 - DNA, 25 bp, Homo sapien
aggcgagccttccagacaggaatgg

SEQ ID NO: 227067 - DNA, 25 bp, Homo sapien
ggaaagctggaagggctctcccagc

SEQ ID NO: 227068 - DNA, 25 bp, Homo sapien
gggcaacgctggtaacaactcactg

SEQ ID NO: 227069 - DNA, 25 bp, Homo sapien
acgctggtaacaactcactggtatt

SEQ ID NO: 227070 - DNA, 25 bp, Homo sapien
ggtaacaactcactggtatttccta

SEQ ID NO: 227071 - DNA, 25 bp, Homo sapien
cactggtatttcctatttcttcatg

SEQ ID NO: 227072 - DNA, 25 bp, Homo sapien
tttcctatttcttcatggataactg

SEQ ID NO: 227073 - DNA, 25 bp, Homo sapien
ttcttcatggataactgtgtacaca

SEQ ID NO: 227074 - DNA, 25 bp, Homo sapien
tggggtgccccgttgcatcatgctc

SEQ ID NO: 227075 - DNA, 25 bp, Homo sapien
gttgcatcatgctcgccctgcatca

SEQ ID NO: 227076 - DNA, 25 bp, Homo sapien
cagagcaccgctggcagggaaagct

SEQ ID NO: 227077 - DNA, 25 bp, Homo sapien
agcaccgctggcagggaaagctgga

SEQ ID NO: 227078 - DNA, 25 bp, Homo sapien
gggaccagcgcgtgacagacgatgt

SEQ ID NO: 227079 - DNA, 25 bp, Homo sapien
tgacagacgatgtggagagaagccg

SEQ ID NO: 227080 - DNA, 25 bp, Homo sapien
agagaagccgagatggccgcactgc

SEQ ID NO: 227081 - DNA, 25 bp, Homo sapien
agaagccgagatggccgcactgctg

SEQ ID NO: 227082 - DNA, 25 bp, Homo sapien
cgagatggccgcactgctgtaagca

SEQ ID NO: 227083 - DNA, 25 bp, Homo sapien
agatggccgcactgctgtaagcagc

SEQ ID NO: 227084 - DNA, 25 bp, Homo sapien
gatggccgcactgctgtaagcagca

SEQ ID NO: 227085 - DNA, 25 bp, Homo sapien
atatttaccacacgcttttgctgcc

SEQ ID NO: 227086 - DNA, 25 bp, Homo sapien
taccacacgcttttgctgccagaga

SEQ ID NO: 227087 - DNA, 25 bp, Homo sapien
aaatgggagcagtagcttctcatca

SEQ ID NO: 227088 - DNA, 25 bp, Homo sapien
gtagcttctcatcagcctccacatt

SEQ ID NO: 227089 - DNA, 25 bp, Homo sapien
tcatcagcctccacatttcattact

SEQ ID NO: 227090 - DNA, 25 bp, Homo sapien
gcctccacatttcattactcataat

SEQ ID NO: 227091 - DNA, 25 bp, Homo sapien
acatttcattactcataattgtggc

SEQ ID NO: 227092 - DNA, 25 bp, Homo sapien
cttcctaatgtctcatgcccctaag

SEQ ID NO: 227093 - DNA, 25 bp, Homo sapien
tcctaatgtctcatgcccctaagca

SEQ ID NO: 227094 - DNA, 25 bp, Homo sapien
attacaatgtctcaacagccttctc

SEQ ID NO: 227095 - DNA, 25 bp, Homo sapien
tacaatgtctcaacagccttctctc

SEQ ID NO: 227096 - DNA, 25 bp, Homo sapien
ctcgtccaactatgcccaggctgaa

SEQ ID NO: 227097 - DNA, 25 bp, Homo sapien
ctcttaaagcggcaccaacgtgaga

SEQ ID NO: 227098 - DNA, 25 bp, Homo sapien
gggaaactctggaacccagacaaga

SEQ ID NO: 227099 - DNA, 25 bp, Homo sapien
agacaagaatcttttcgctgggaaa

SEQ ID NO: 227100 - DNA, 25 bp, Homo sapien
cttttcgctgggaaagactcagata

SEQ ID NO: 227101 - DNA, 25 bp, Homo sapien
gactcagatatccttgtttgcacag

SEQ ID NO: 227102 - DNA, 25 bp, Homo sapien
tatccttgtttgcacaggactggtg

SEQ ID NO: 227103 - DNA, 25 bp, Homo sapien
tggtggaaaatctcccatgcgaccc

SEQ ID NO: 227104 - DNA, 25 bp, Homo sapien
ccagagccatctgggtctgatgttc

SEQ ID NO: 227105 - DNA, 25 bp, Homo sapien
ggtctgatgttctgttccattgtac

SEQ ID NO: 227106 - DNA, 25 bp, Homo sapien
gttctgttccattgtacatcgaaga

SEQ ID NO: 227107 - DNA, 25 bp, Homo sapien
aatagggtagctgttattgctctgg

SEQ ID NO: 227108 - DNA, 25 bp, Homo sapien
gtagctgttattgctctggagtgtt

SEQ ID NO: 227109 - DNA, 25 bp, Homo sapien
gctctggagtgttttgtcacccttc

SEQ ID NO: 227110 - DNA, 25 bp, Homo sapien
ggagtgttttgtcacccttccatga

SEQ ID NO: 227111 - DNA, 25 bp, Homo sapien
gttttgtcacccttccatgacgcct

SEQ ID NO: 227112 - DNA, 25 bp, Homo sapien
atgacgcctcctctgtgcatttgag

SEQ ID NO: 227113 - DNA, 25 bp, Homo sapien
ctcctctgtgcatttgagttcactg

SEQ ID NO: 227114 - DNA, 25 bp, Homo sapien
gagttcactgtttatgctcaacact

SEQ ID NO: 227115 - DNA, 25 bp, Homo sapien
tatgctcaacactgaatttcaacaa

SEQ ID NO: 227116 - DNA, 25 bp, Homo sapien
tcttatttcttgtttccacaaaacg

SEQ ID NO: 227117 - DNA, 25 bp, Homo sapien
tccctactcccagggaacagaaaat

SEQ ID NO: 227118 - DNA, 25 bp, Homo sapien
tccctaggaggaataatctgcataa

SEQ ID NO: 227119 - DNA, 25 bp, Homo sapien
aacctcttttctaatgttgtgaatt

SEQ ID NO: 227120 - DNA, 25 bp, Homo sapien
attttataccagtggaaatgctcac

SEQ ID NO: 227121 - DNA, 25 bp, Homo sapien
gtggaaatgctcaccttgggtctaa

SEQ ID NO: 227122 - DNA, 25 bp, Homo sapien
gaagttaaagggtgtaggcatgtaa

SEQ ID NO: 227123 - DNA, 25 bp, Homo sapien
tattctatacatgggactggctgcg

SEQ ID NO: 227124 - DNA, 25 bp, Homo sapien
atacatgggactggctgcggaaaca

SEQ ID NO: 227125 - DNA, 25 bp, Homo sapien
gcggaaacaggtgcaagcccttgct

SEQ ID NO: 227126 - DNA, 25 bp, Homo sapien
caagcccttgctacctttcatgaga

SEQ ID NO: 227127 - DNA, 25 bp, Homo sapien
gaaaggaaggatgactcagagcaga

SEQ ID NO: 227128 - DNA, 25 bp, Homo sapien
aggagagtccagtgggcagagtcct

SEQ ID NO: 227129 - DNA, 25 bp, Homo sapien
gaggagggcgactcgtgcacaggga

SEQ ID NO: 227130 - DNA, 25 bp, Homo sapien
gctgtccttttctagttgtttactt

SEQ ID NO: 227131 - DNA, 25 bp, Homo sapien
tggcagccagtctgaccttgtctgt

SEQ ID NO: 227132 - DNA, 25 bp, Homo sapien
gggctctgctctccttgttgagaca

SEQ ID NO: 227133 - DNA, 25 bp, Homo sapien
ctgtggtctgactgttcctaagtgt

SEQ ID NO: 227134 - DNA, 25 bp, Homo sapien
gttcctaagtgtgtaactttcagta

SEQ ID NO: 227135 - DNA, 25 bp, Homo sapien
ctttcagtattatctgtgacagatg

SEQ ID NO: 227136 - DNA, 25 bp, Homo sapien
ctccttgttgagacactaacaggca

SEQ ID NO: 227137 - DNA, 25 bp, Homo sapien
taacaggcagttgggaggaaaatct

SEQ ID NO: 227138 - DNA, 25 bp, Homo sapien
aaaatctgcatttgactccaccctc

SEQ ID NO: 227139 - DNA, 25 bp, Homo sapien
tgcatttgactccaccctctttggg

SEQ ID NO: 227140 - DNA, 25 bp, Homo sapien
tctgcagtatcactggataggactg

SEQ ID NO: 227141 - DNA, 25 bp, Homo sapien
aaatgtggagaatatggcatccctc

SEQ ID NO: 227142 - DNA, 25 bp, Homo sapien
gcatccctccacctatatttgatgt

SEQ ID NO: 227143 - DNA, 25 bp, Homo sapien
ggatcccttatcctgaccaaagact

SEQ ID NO: 227144 - DNA, 25 bp, Homo sapien
gccatttgaaaatcgcagggttgca

SEQ ID NO: 227145 - DNA, 25 bp, Homo sapien
gaatacaatcttacttgcaggtgga

SEQ ID NO: 227146 - DNA, 25 bp, Homo sapien
cttacttgcaggtggatattctcta

SEQ ID NO: 227147 - DNA, 25 bp, Homo sapien
ttctctatactctcttttaatgcat

SEQ ID NO: 227148 - DNA, 25 bp, Homo sapien
aaacatcccctggttggtgatcact

SEQ ID NO: 227149 - DNA, 25 bp, Homo sapien
gatcacttacagttgtgtccacctt

SEQ ID NO: 227150 - DNA, 25 bp, Homo sapien
acagttgtgtccacctttattttat

SEQ ID NO: 227151 - DNA, 25 bp, Homo sapien
acttcccgggtctccattgtgcgtg

SEQ ID NO: 227152 - DNA, 25 bp, Homo sapien
attgtgcgtgggtggcgtgttccag

SEQ ID NO: 227153 - DNA, 25 bp, Homo sapien
caggcgtggctggagctggcttcct

SEQ ID NO: 227154 - DNA, 25 bp, Homo sapien
ctccctcagaagcacgttggcagga

SEQ ID NO: 227155 - DNA, 25 bp, Homo sapien
aagcacgttggcaggaggccgatca

SEQ ID NO: 227156 - DNA, 25 bp, Homo sapien
tggcaggaggccgatcagaacccta

SEQ ID NO: 227157 - DNA, 25 bp, Homo sapien
aggaggccgatcagaaccctagcgc

SEQ ID NO: 227158 - DNA, 25 bp, Homo sapien
gatcagaaccctagcgcctttggtc

SEQ ID NO: 227159 - DNA, 25 bp, Homo sapien
ctagcgcctttggtcctaagaatgg

SEQ ID NO: 227160 - DNA, 25 bp, Homo sapien
ggtcctaagaatgggaggctgcctt

SEQ ID NO: 227161 - DNA, 25 bp, Homo sapien
ctaagaatgggaggctgccttcctt

SEQ ID NO: 227162 - DNA, 25 bp, Homo sapien
ttgtacagaccaacgcggaccgatg

SEQ ID NO: 227163 - DNA, 25 bp, Homo sapien
tttctatctctgtctgtctccgtct

SEQ ID NO: 227164 - DNA, 25 bp, Homo sapien
tttctcacttgttgccaatgtcttg

SEQ ID NO: 227165 - DNA, 25 bp, Homo sapien
gttgccaatgtcttgttgctgagaa

SEQ ID NO: 227166 - DNA, 25 bp, Homo sapien
gaacactctattcagatgccatcca

SEQ ID NO: 227167 - DNA, 25 bp, Homo sapien
atggatggagggtccactgtgtata

SEQ ID NO: 227168 - DNA, 25 bp, Homo sapien
gagggtccactgtgtatatttgtac

SEQ ID NO: 227169 - DNA, 25 bp, Homo sapien
ggaccgatggtccatattcttttct

SEQ ID NO: 227170 - DNA, 25 bp, Homo sapien
tattcttttctccatgtttgtttgt

SEQ ID NO: 227171 - DNA, 25 bp, Homo sapien
ctccatgtttgtttgtgtcgactgt

SEQ ID NO: 227172 - DNA, 25 bp, Homo sapien
ttgtgtcgactgttgcagagtgagt

SEQ ID NO: 227173 - DNA, 25 bp, Homo sapien
gggctgtccatcagggtccaggcac

SEQ ID NO: 227174 - DNA, 25 bp, Homo sapien
gaaggaacctctcaaagccagccga

SEQ ID NO: 227175 - DNA, 25 bp, Homo sapien
agacccacgctgtcagacatctctg

SEQ ID NO: 227176 - DNA, 25 bp, Homo sapien
gtcagacatctctgtggccaccaga

SEQ ID NO: 227177 - DNA, 25 bp, Homo sapien
actgccactctcacgggtgtgatga

SEQ ID NO: 227178 - DNA, 25 bp, Homo sapien
gtgtgatgacatgggacctgcctac

SEQ ID NO: 227179 - DNA, 25 bp, Homo sapien
gctctggactcatagcggttcagca

SEQ ID NO: 227180 - DNA, 25 bp, Homo sapien
gactcatagcggttcagcacggcca

SEQ ID NO: 227181 - DNA, 25 bp, Homo sapien
atagcggttcagcacggccacgaca

SEQ ID NO: 227182 - DNA, 25 bp, Homo sapien
gtagggaccgcagcacctcagagaa

SEQ ID NO: 227183 - DNA, 25 bp, Homo sapien
ggtcacttctggcaccctctgcaaa

SEQ ID NO: 227184 - DNA, 25 bp, Homo sapien
tttctcaaatcatgggcggatcttg

SEQ ID NO: 227185 - DNA, 25 bp, Homo sapien
gatcttggaggtctagtttcccata

SEQ ID NO: 227186 - DNA, 25 bp, Homo sapien
gtttcccatagatgctgtaaccaat

SEQ ID NO: 227187 - DNA, 25 bp, Homo sapien
tgtaaccaattaccacaacttcagt

SEQ ID NO: 227188 - DNA, 25 bp, Homo sapien
ccaagatgtccttaggtctggttcc

SEQ ID NO: 227189 - DNA, 25 bp, Homo sapien
ctggaggctccagggagattcttcc

SEQ ID NO: 227190 - DNA, 25 bp, Homo sapien
tcacttctagagtctgctgacattc

SEQ ID NO: 227191 - DNA, 25 bp, Homo sapien
tagagtctgctgacattccttggtc

SEQ ID NO: 227192 - DNA, 25 bp, Homo sapien
acattccttggtcctggctacatca

SEQ ID NO: 227193 - DNA, 25 bp, Homo sapien
aatctctgttccatggtcacatact

SEQ ID NO: 227194 - DNA, 25 bp, Homo sapien
catggtcacatactcttctactata

SEQ ID NO: 227195 - DNA, 25 bp, Homo sapien
accgcgccaaaatcgacaactacat

SEQ ID NO: 227196 - DNA, 25 bp, Homo sapien
aaatcgacaactacatccctatctt

SEQ ID NO: 227197 - DNA, 25 bp, Homo sapien
acaactacatccctatcttctagcg

SEQ ID NO: 227198 - DNA, 25 bp, Homo sapien
tacatccctatcttctagcgtcctg

SEQ ID NO: 227199 - DNA, 25 bp, Homo sapien
tatcttctagcgtcctggcccaagg

SEQ ID NO: 227200 - DNA, 25 bp, Homo sapien
tggcccaaggctctcaattgcactc

SEQ ID NO: 227201 - DNA, 25 bp, Homo sapien
caaggctctcaattgcactctttgt

SEQ ID NO: 227202 - DNA, 25 bp, Homo sapien
gtgtatgtggtctgtgacaagcctg

SEQ ID NO: 227203 - DNA, 25 bp, Homo sapien
gtggtctgtgacaagcctgtggctc

SEQ ID NO: 227204 - DNA, 25 bp, Homo sapien
ctgtgacaagcctgtggctcacctg

SEQ ID NO: 227205 - DNA, 25 bp, Homo sapien
agtacgctgtcctagcggctgccca

SEQ ID NO: 227206 - DNA, 25 bp, Homo sapien
taagtcagcccaatggtgctatttt

SEQ ID NO: 227207 - DNA, 25 bp, Homo sapien
cagcccaatggtgctattttacata

SEQ ID NO: 227208 - DNA, 25 bp, Homo sapien
gctattttacatatcaacacagttg

SEQ ID NO: 227209 - DNA, 25 bp, Homo sapien
ttattttgggctgcagtgtttcctc

SEQ ID NO: 227210 - DNA, 25 bp, Homo sapien
cagtgtttcctccacatctaaagaa

SEQ ID NO: 227211 - DNA, 25 bp, Homo sapien
aagatttttctatctgccccatata

SEQ ID NO: 227212 - DNA, 25 bp, Homo sapien
tccacatctaaagaaagcccatttt

SEQ ID NO: 227213 - DNA, 25 bp, Homo sapien
gaaactggatactgcattaaaacaa

SEQ ID NO: 227214 - DNA, 25 bp, Homo sapien
tatctgccccatatagtttaccctt

SEQ ID NO: 227215 - DNA, 25 bp, Homo sapien
acccttccttgccttgaaaatgaat

SEQ ID NO: 227216 - DNA, 25 bp, Homo sapien
gagtacagctcttaaaagttattag

SEQ ID NO: 227217 - DNA, 25 bp, Homo sapien
aaattattggactcagcctccatat

SEQ ID NO: 227218 - DNA, 25 bp, Homo sapien
tcagcctccatatttgacagcaaaa

SEQ ID NO: 227219 - DNA, 25 bp, Homo sapien
attttcactaagatatgtcctctcc

SEQ ID NO: 227220 - DNA, 25 bp, Homo sapien
cctctcccagagtttagctgtttat

SEQ ID NO: 227221 - DNA, 25 bp, Homo sapien
tgtttatattgttctcatctgcata

SEQ ID NO: 227222 - DNA, 25 bp, Homo sapien
gttctcatctgcataaaaccagtct

SEQ ID NO: 227223 - DNA, 25 bp, Homo sapien
aaccagtctcttgcaataagcctgc

SEQ ID NO: 227224 - DNA, 25 bp, Homo sapien
taagcctgccgcagaatcaaagtct

SEQ ID NO: 227225 - DNA, 25 bp, Homo sapien
ggtaactgcaccaagggatgggaca

SEQ ID NO: 227226 - DNA, 25 bp, Homo sapien
acagtgtgcatcaccctgatctaat

SEQ ID NO: 227227 - DNA, 25 bp, Homo sapien
cctgatctaatcattgtgacgttgg

SEQ ID NO: 227228 - DNA, 25 bp, Homo sapien
ggatctccacgggttagttaccgct

SEQ ID NO: 227229 - DNA, 25 bp, Homo sapien
ttagttaccgctctcaaacctacca

SEQ ID NO: 227230 - DNA, 25 bp, Homo sapien
gctctcaaacctaccaaaactacaa

SEQ ID NO: 227231 - DNA, 25 bp, Homo sapien
taatagcagacggacagccagtgac

SEQ ID NO: 227232 - DNA, 25 bp, Homo sapien
agtgaccagccatggtctggactgt

SEQ ID NO: 227233 - DNA, 25 bp, Homo sapien
catggtctggactgtgaagttcact

SEQ ID NO: 227234 - DNA, 25 bp, Homo sapien
gaagttcactaccatttgtcaagaa

SEQ ID NO: 227235 - DNA, 25 bp, Homo sapien
tgtcaagaatcaccctttccaaatc

SEQ ID NO: 227236 - DNA, 25 bp, Homo sapien
tgactttttggcttccacttcaccc

SEQ ID NO: 227237 - DNA, 25 bp, Homo sapien
ttacttaattcatagccttccttgg

SEQ ID NO: 227238 - DNA, 25 bp, Homo sapien
atagccttccttggtttcatatttg

SEQ ID NO: 227239 - DNA, 25 bp, Homo sapien
gcaatatctgggatcactggtgtat

SEQ ID NO: 227240 - DNA, 25 bp, Homo sapien
gtattaaatgtcaggcctcgcatca

SEQ ID NO: 227241 - DNA, 25 bp, Homo sapien
tcgcatcattattctgccctgagct

SEQ ID NO: 227242 - DNA, 25 bp, Homo sapien
gggcacccagccttttagctttcat

SEQ ID NO: 227243 - DNA, 25 bp, Homo sapien
gagggaacttgccttcagatgtgac

SEQ ID NO: 227244 - DNA, 25 bp, Homo sapien
acggctccctcacttgtgaattaaa

SEQ ID NO: 227245 - DNA, 25 bp, Homo sapien
tcagagtcagctccaacgtctattg

SEQ ID NO: 227246 - DNA, 25 bp, Homo sapien
caacgtctattggatcccactctat

SEQ ID NO: 227247 - DNA, 25 bp, Homo sapien
ggatcccactctatcgcctttaaaa

SEQ ID NO: 227248 - DNA, 25 bp, Homo sapien
agacactgccgtaagttcttctggt

SEQ ID NO: 227249 - DNA, 25 bp, Homo sapien
ggttcctgctttgtggagaaagctt

SEQ ID NO: 227250 - DNA, 25 bp, Homo sapien
gttatgcagcaatgttggttgtgaa

SEQ ID NO: 227251 - DNA, 25 bp, Homo sapien
ttagaaggtgtggtattcactgctg

SEQ ID NO: 227252 - DNA, 25 bp, Homo sapien
attcactgctgggtggctgatccaa

SEQ ID NO: 227253 - DNA, 25 bp, Homo sapien
ggtggctgatccaacctttattccc

SEQ ID NO: 227254 - DNA, 25 bp, Homo sapien
ggcttccttttactctataggctag

SEQ ID NO: 227255 - DNA, 25 bp, Homo sapien
agaaatgctaaatgctcactctcca

SEQ ID NO: 227256 - DNA, 25 bp, Homo sapien
gcagctaaggctggctatggaacct

SEQ ID NO: 227257 - DNA, 25 bp, Homo sapien
gctactagctatgcaatactgagaa

SEQ ID NO: 227258 - DNA, 25 bp, Homo sapien
gagaaggccacttaatccttccatt

SEQ ID NO: 227259 - DNA, 25 bp, Homo sapien
taatccttccattcctatgtttctg

SEQ ID NO: 227260 - DNA, 25 bp, Homo sapien
ccattcctatgtttctgtgttgata

SEQ ID NO: 227261 - DNA, 25 bp, Homo sapien
aggaatgattgtgttgccgtgctca

SEQ ID NO: 227262 - DNA, 25 bp, Homo sapien
ttgtgttgccgtgctcagacagaaa

SEQ ID NO: 227263 - DNA, 25 bp, Homo sapien
gacagaaacggagtctcggaagtgt

SEQ ID NO: 227264 - DNA, 25 bp, Homo sapien
gaagtgctgatgtcacgtgggttat

SEQ ID NO: 227265 - DNA, 25 bp, Homo sapien
gaagaacgccttcatttcatgcaaa

SEQ ID NO: 227266 - DNA, 25 bp, Homo sapien
atgcaaatctataagctcctgcttt

SEQ ID NO: 227267 - DNA, 25 bp, Homo sapien
tcctgcttttggctttaccatatgt

SEQ ID NO: 227268 - DNA, 25 bp, Homo sapien
tggctttaccatatgttgtgtctaa

SEQ ID NO: 227269 - DNA, 25 bp, Homo sapien
tgttgtgtctaatctccttctgaga

SEQ ID NO: 227270 - DNA, 25 bp, Homo sapien
catgcctataatatgctggttgtgt

SEQ ID NO: 227271 - DNA, 25 bp, Homo sapien
ctggttgtgtatgctttgtctttta

SEQ ID NO: 227272 - DNA, 25 bp, Homo sapien
caactacaaaaatgtttggcaactt

SEQ ID NO: 227273 - DNA, 25 bp, Homo sapien
gtttggcaactttgtgtttacattt

SEQ ID NO: 227274 - DNA, 25 bp, Homo sapien
tggcaactttgtgtttacatttaaa

SEQ ID NO: 227275 - DNA, 25 bp, Homo sapien
taaagatcatttgcacctttttcaa

SEQ ID NO: 227276 - DNA, 25 bp, Homo sapien
ttttctagcatgtataactttttta

SEQ ID NO: 227277 - DNA, 25 bp, Homo sapien
tagctaatgctttttatccttgtac

SEQ ID NO: 227278 - DNA, 25 bp, Homo sapien
aatgctttttatccttgtacttttg

SEQ ID NO: 227279 - DNA, 25 bp, Homo sapien
tgctttttatccttgtacttttgtt

SEQ ID NO: 227280 - DNA, 25 bp, Homo sapien
tttaatttggaatttctgtttctat

SEQ ID NO: 227281 - DNA, 25 bp, Homo sapien
tgtaaagttacaagtgctttcaact

SEQ ID NO: 227282 - DNA, 25 bp, Homo sapien
aagttacaagtgctttcaacttgaa

SEQ ID NO: 227283 - DNA, 25 bp, Homo sapien
gaattggaagagatgggaccctcat

SEQ ID NO: 227284 - DNA, 25 bp, Homo sapien
atgggaccctcattggatctggttc

SEQ ID NO: 227285 - DNA, 25 bp, Homo sapien
atctggttctgaggaggacacacct

SEQ ID NO: 227286 - DNA, 25 bp, Homo sapien
gaggacacacctggcatcggatgac

SEQ ID NO: 227287 - DNA, 25 bp, Homo sapien
ctggcatcggatgacctttataaat

SEQ ID NO: 227288 - DNA, 25 bp, Homo sapien
gaaaatgccaaaagctctcaagcca

SEQ ID NO: 227289 - DNA, 25 bp, Homo sapien
atatttcccatgatacttttggtac

SEQ ID NO: 227290 - DNA, 25 bp, Homo sapien
atacttttggtacaacttatggaag

SEQ ID NO: 227291 - DNA, 25 bp, Homo sapien
ggaaggattcatatgcagaagcaag

SEQ ID NO: 227292 - DNA, 25 bp, Homo sapien
gaagcaagacctaagcaaactacaa

SEQ ID NO: 227293 - DNA, 25 bp, Homo sapien
gttgaagaagcgacctgcagaaagg

SEQ ID NO: 227294 - DNA, 25 bp, Homo sapien
aagctatttatcaggaagccaaaga

SEQ ID NO: 227295 - DNA, 25 bp, Homo sapien
gaagtccgttacaaaagaatatggt

SEQ ID NO: 227296 - DNA, 25 bp, Homo sapien
aaagacatgcagtcctgaaggaaca

SEQ ID NO: 227297 - DNA, 25 bp, Homo sapien
gagaacaactatgactagagcctag

SEQ ID NO: 227298 - DNA, 25 bp, Homo sapien
actatgactagagcctagagttcat

SEQ ID NO: 227299 - DNA, 25 bp, Homo sapien
gaatatggtaggtgatgcagagact

SEQ ID NO: 227300 - DNA, 25 bp, Homo sapien
gactcacaagagcacaaaagcagca

SEQ ID NO: 227301 - DNA, 25 bp, Homo sapien
aaagcagcagcagatgactatccga

SEQ ID NO: 227302 - DNA, 25 bp, Homo sapien
agatgactatccgagccactcagtt

SEQ ID NO: 227303 - DNA, 25 bp, Homo sapien
tatccgagccactcagttaaggtga

SEQ ID NO: 227304 - DNA, 25 bp, Homo sapien
gccactcagttaaggtgatttttaa

SEQ ID NO: 227305 - DNA, 25 bp, Homo sapien
tgagatcataggagtctgtcgtgtg

SEQ ID NO: 227306 - DNA, 25 bp, Homo sapien
ctgtcgtgtggggatcactgctgaa

SEQ ID NO: 227307 - DNA, 25 bp, Homo sapien
gcagggaccactggaacgagatgct

SEQ ID NO: 227308 - DNA, 25 bp, Homo sapien
gaccactggaacgagatgctggcat

SEQ ID NO: 227309 - DNA, 25 bp, Homo sapien
gagatgctggcatacccccggaagc

SEQ ID NO: 227310 - DNA, 25 bp, Homo sapien
actggcactccttggtggaggtaaa

SEQ ID NO: 227311 - DNA, 25 bp, Homo sapien
ggcactccttggtggaggtaaagaa

SEQ ID NO: 227312 - DNA, 25 bp, Homo sapien
agtgagagctcgtgcccatctccga

SEQ ID NO: 227313 - DNA, 25 bp, Homo sapien
tcatggactatgatcgagtgggcca

SEQ ID NO: 227314 - DNA, 25 bp, Homo sapien
ggactatgatcgagtgggccacaat

SEQ ID NO: 227315 - DNA, 25 bp, Homo sapien
cgagtgggccacaatgagatcatag

SEQ ID NO: 227316 - DNA, 25 bp, Homo sapien
caacaagcaaggtgactaactgaac

SEQ ID NO: 227317 - DNA, 25 bp, Homo sapien
gcaaggtgactaactgaacgctagc

SEQ ID NO: 227318 - DNA, 25 bp, Homo sapien
aaggtgactaactgaacgctagctt

SEQ ID NO: 227319 - DNA, 25 bp, Homo sapien
ggtgactaactgaacgctagcttac

SEQ ID NO: 227320 - DNA, 25 bp, Homo sapien
tgactaactgaacgctagcttacta

SEQ ID NO: 227321 - DNA, 25 bp, Homo sapien
aactgaacgctagcttactagcttt

SEQ ID NO: 227322 - DNA, 25 bp, Homo sapien
gctagcttactagctttaaactgct

SEQ ID NO: 227323 - DNA, 25 bp, Homo sapien
gcttactagctttaaactgcttacc

SEQ ID NO: 227324 - DNA, 25 bp, Homo sapien
tactagctttaaactgcttaccaaa

SEQ ID NO: 227325 - DNA, 25 bp, Homo sapien
tagctttaaactgcttaccaaaaat

SEQ ID NO: 227326 - DNA, 25 bp, Homo sapien
tttaaactgcttaccaaaaatactg

SEQ ID NO: 227327 - DNA, 25 bp, Homo sapien
atgcacatgcaagaaggagccctct

SEQ ID NO: 227328 - DNA, 25 bp, Homo sapien
caagaaggagccctcttcggtgtcc

SEQ ID NO: 227329 - DNA, 25 bp, Homo sapien
gtgtccccgagtgccacggtcaaga

SEQ ID NO: 227330 - DNA, 25 bp, Homo sapien
tggagggcgtccagtacattgcaga

SEQ ID NO: 227331 - DNA, 25 bp, Homo sapien
agtacattgcagaccacctgaaggc

SEQ ID NO: 227332 - DNA, 25 bp, Homo sapien
acctgaaggccgaagacacagactt

SEQ ID NO: 227333 - DNA, 25 bp, Homo sapien
gacttctcggtaagtcccgcccgtg

SEQ ID NO: 227334 - DNA, 25 bp, Homo sapien
taagtcccgcccgtggctgtgttgg

SEQ ID NO: 227335 - DNA, 25 bp, Homo sapien
ctctgacccagacggaaccggcgga

SEQ ID NO: 227336 - DNA, 25 bp, Homo sapien
cggacgccctttcttcctggtgtgt

SEQ ID NO: 227337 - DNA, 25 bp, Homo sapien
tttcttcctggtgtgtaatccagga

SEQ ID NO: 227338 - DNA, 25 bp, Homo sapien
ctgtatgacatagtgctggcactga

SEQ ID NO: 227339 - DNA, 25 bp, Homo sapien
gtgctggcactgatattatccatca

SEQ ID NO: 227340 - DNA, 25 bp, Homo sapien
gatattatccatcatctctttttgg

SEQ ID NO: 227341 - DNA, 25 bp, Homo sapien
ttttgctttgcatttggagaaaata

SEQ ID NO: 227342 - DNA, 25 bp, Homo sapien
aagcagggtatgttgtttcattcac

SEQ ID NO: 227343 - DNA, 25 bp, Homo sapien
ggtatgttgtttcattcaccttgaa

SEQ ID NO: 227344 - DNA, 25 bp, Homo sapien
atatagaatctctgaatagctcgct

SEQ ID NO: 227345 - DNA, 25 bp, Homo sapien
agaatctctgaatagctcgctaaaa

SEQ ID NO: 227346 - DNA, 25 bp, Homo sapien
tagctcgctaaaagattcaagcaag

SEQ ID NO: 227347 - DNA, 25 bp, Homo sapien
gggacatgaattttgttccatctat

SEQ ID NO: 227348 - DNA, 25 bp, Homo sapien
tccatctatcaataatatccagaag

SEQ ID NO: 227349 - DNA, 25 bp, Homo sapien
agagccgcctcctaggtcttggcaa

SEQ ID NO: 227350 - DNA, 25 bp, Homo sapien
ctcctaggtcttggcaaagaggcaa

SEQ ID NO: 227351 - DNA, 25 bp, Homo sapien
gaggcaagctgacgatagacatcta

SEQ ID NO: 227352 - DNA, 25 bp, Homo sapien
agacatctacctatattgttaagaa

SEQ ID NO: 227353 - DNA, 25 bp, Homo sapien
gggatcagccaaggtccatcattgc

SEQ ID NO: 227354 - DNA, 25 bp, Homo sapien
aaggtccatcattgcttttttgccg

SEQ ID NO: 227355 - DNA, 25 bp, Homo sapien
gtccatcattgcttttttgccgcgc

SEQ ID NO: 227356 - DNA, 25 bp, Homo sapien
ccccatagattgtcagctgtaagtg

SEQ ID NO: 227357 - DNA, 25 bp, Homo sapien
gtcagctgtaagtgaaactcctagt

SEQ ID NO: 227358 - DNA, 25 bp, Homo sapien
ggagccctgtgttaggagtccccat

SEQ ID NO: 227359 - DNA, 25 bp, Homo sapien
tgtgttaggagtccccataaacatg

SEQ ID NO: 227360 - DNA, 25 bp, Homo sapien
tcacgctgtccggtgctcagaaaac

SEQ ID NO: 227361 - DNA, 25 bp, Homo sapien
ggtgctcagaaaaccggtaatcgcg

SEQ ID NO: 227362 - DNA, 25 bp, Homo sapien
tgctcgccgccgttttttggccctg

SEQ ID NO: 227363 - DNA, 25 bp, Homo sapien
ttttggccctgggttccgtcgagtg

SEQ ID NO: 227364 - DNA, 25 bp, Homo sapien
ggttccgtcgagtggatccagcttg

SEQ ID NO: 227365 - DNA, 25 bp, Homo sapien
gatccagcttgtcagtctttgtgta

SEQ ID NO: 227366 - DNA, 25 bp, Homo sapien
tctttgtgtagatttggctgcgttc

SEQ ID NO: 227367 - DNA, 25 bp, Homo sapien
tgtagatttggctgcgttcgctccg

SEQ ID NO: 227368 - DNA, 25 bp, Homo sapien
cgttcgctccgcacttcggaggagg

SEQ ID NO: 227369 - DNA, 25 bp, Homo sapien
cacttcggaggaggtggcgtttcat

SEQ ID NO: 227370 - DNA, 25 bp, Homo sapien
tcatgggaagaaatgcgctctagca

SEQ ID NO: 227371 - DNA, 25 bp, Homo sapien
ctggatcacctggattcagccagtg

SEQ ID NO: 227372 - DNA, 25 bp, Homo sapien
gattttccatataatccaggacaag

SEQ ID NO: 227373 - DNA, 25 bp, Homo sapien
tataatccaggacaaggccaagcta

SEQ ID NO: 227374 - DNA, 25 bp, Homo sapien
tggagtcaacagaaactcggctatc

SEQ ID NO: 227375 - DNA, 25 bp, Homo sapien
actcggctatcattggaggcgtcat

SEQ ID NO: 227376 - DNA, 25 bp, Homo sapien
atcctgtgcaccctggtcttcctga

SEQ ID NO: 227377 - DNA, 25 bp, Homo sapien
tggtcttcctgatccggtacatgtt

SEQ ID NO: 227378 - DNA, 25 bp, Homo sapien
tgatccggtacatgttccgccacaa

SEQ ID NO: 227379 - DNA, 25 bp, Homo sapien
acatgttccgccacaagggcaccta

SEQ ID NO: 227380 - DNA, 25 bp, Homo sapien
aagggcacctaccataccaacgaag

SEQ ID NO: 227381 - DNA, 25 bp, Homo sapien
gcacctaccataccaacgaagcaaa

SEQ ID NO: 227382 - DNA, 25 bp, Homo sapien
cctccggtgagcaggtgtgatccca

SEQ ID NO: 227383 - DNA, 25 bp, Homo sapien
ctccggtgagcaggtgtgatcccag

SEQ ID NO: 227384 - DNA, 25 bp, Homo sapien
tccggtgagcaggtgtgatcccagg

SEQ ID NO: 227385 - DNA, 25 bp, Homo sapien
gagcaggtgtgatcccagggcccct

SEQ ID NO: 227386 - DNA, 25 bp, Homo sapien
ccagggcccctgatcagcagcggag

SEQ ID NO: 227387 - DNA, 25 bp, Homo sapien
agggcccctgatcagcagcggagga

SEQ ID NO: 227388 - DNA, 25 bp, Homo sapien
gggcccctgatcagcagcggaggag

SEQ ID NO: 227389 - DNA, 25 bp, Homo sapien
ccctgatcagcagcggaggagcgct

SEQ ID NO: 227390 - DNA, 25 bp, Homo sapien
aagcggggtcatccaggcaactcgg

SEQ ID NO: 227391 - DNA, 25 bp, Homo sapien
gggtcatccaggcaactcgggggag

SEQ ID NO: 227392 - DNA, 25 bp, Homo sapien
gggaggggaagctcacagaccggta

SEQ ID NO: 227393 - DNA, 25 bp, Homo sapien
ctgcttcaggatgggtatcacctgg

SEQ ID NO: 227394 - DNA, 25 bp, Homo sapien
tgggtatcacctggatgagattcca

SEQ ID NO: 227395 - DNA, 25 bp, Homo sapien
gattccagatgacgaggacttggac

SEQ ID NO: 227396 - DNA, 25 bp, Homo sapien
taagcccatggcctcttcaacatgc

SEQ ID NO: 227397 - DNA, 25 bp, Homo sapien
ttcctgtaccctccagtagacatta

SEQ ID NO: 227398 - DNA, 25 bp, Homo sapien
tccagtagacattaccctccaaggt

SEQ ID NO: 227399 - DNA, 25 bp, Homo sapien
ctgctcaccatgaggcctacagagc

SEQ ID NO: 227400 - DNA, 25 bp, Homo sapien
gctcacacagtgcagtgagcactga

SEQ ID NO: 227401 - DNA, 25 bp, Homo sapien
tgagcactgaagtcactgaccccta

SEQ ID NO: 227402 - DNA, 25 bp, Homo sapien
actgacccctagaaagtgacctgca

SEQ ID NO: 227403 - DNA, 25 bp, Homo sapien
tgcaggtagcccttacctgttgctt

SEQ ID NO: 227404 - DNA, 25 bp, Homo sapien
aatggaagaaaaatgcggatgccta

SEQ ID NO: 227405 - DNA, 25 bp, Homo sapien
gaaaaatgcggatgcctacagttaa

SEQ ID NO: 227406 - DNA, 25 bp, Homo sapien
cagttaacagattgcaaaatgtatc

SEQ ID NO: 227407 - DNA, 25 bp, Homo sapien
atggttctaaaaattgcattcaaac

SEQ ID NO: 227408 - DNA, 25 bp, Homo sapien
cataggaaatgtactgtgggaacta

SEQ ID NO: 227409 - DNA, 25 bp, Homo sapien
gtgggaactattctatggatatatg

SEQ ID NO: 227410 - DNA, 25 bp, Homo sapien
aactattctatggatatatggtaaa

SEQ ID NO: 227411 - DNA, 25 bp, Homo sapien
catgaagttttatatgctgcatttt

SEQ ID NO: 227412 - DNA, 25 bp, Homo sapien
gaagttttatatgctgcattttact

SEQ ID NO: 227413 - DNA, 25 bp, Homo sapien
attagagtatagatcatgtgaaatg

SEQ ID NO: 227414 - DNA, 25 bp, Homo sapien
tcatgtgaaatgaagggtgcctttg

SEQ ID NO: 227415 - DNA, 25 bp, Homo sapien
actgcctcctccagtgctgcgggag

SEQ ID NO: 227416 - DNA, 25 bp, Homo sapien
agtgctgcgggaggcgggccagggc

SEQ ID NO: 227417 - DNA, 25 bp, Homo sapien
acctggtggctttcacctgacccag

SEQ ID NO: 227418 - DNA, 25 bp, Homo sapien
tggtggctttcacctgacccagccc

SEQ ID NO: 227419 - DNA, 25 bp, Homo sapien
gtggctttcacctgacccagccctg

SEQ ID NO: 227420 - DNA, 25 bp, Homo sapien
cctgagtcctctccaagcctctctc

SEQ ID NO: 227421 - DNA, 25 bp, Homo sapien
ttgggatcgccccaaaatggacccg

SEQ ID NO: 227422 - DNA, 25 bp, Homo sapien
tgggatcgccccaaaatggacccgg

SEQ ID NO: 227423 - DNA, 25 bp, Homo sapien
tggacccggcccctcctgttatttg

SEQ ID NO: 227424 - DNA, 25 bp, Homo sapien
ggcccctcctgttatttgctgggaa

SEQ ID NO: 227425 - DNA, 25 bp, Homo sapien
ctcctgttatttgctgggaagtcca

SEQ ID NO: 227426 - DNA, 25 bp, Homo sapien
gcttctaagttagccagtgcctgaa

SEQ ID NO: 227427 - DNA, 25 bp, Homo sapien
attgccaccagaaaccgtcgttgta

SEQ ID NO: 227428 - DNA, 25 bp, Homo sapien
aggaaacgctgccacctgtgcctgg

SEQ ID NO: 227429 - DNA, 25 bp, Homo sapien
aaccgtcgttgtatggctttcttca

SEQ ID NO: 227430 - DNA, 25 bp, Homo sapien
gttgtatggctttcttcagaacggg

SEQ ID NO: 227431 - DNA, 25 bp, Homo sapien
aacaggtgaacatggcgtgtactgt

SEQ ID NO: 227432 - DNA, 25 bp, Homo sapien
tgggtcagcctcctaggctctcctg

SEQ ID NO: 227433 - DNA, 25 bp, Homo sapien
ctaggctctcctgactgagcataaa

SEQ ID NO: 227434 - DNA, 25 bp, Homo sapien
tgagcataaacaggcagcccactga

SEQ ID NO: 227435 - DNA, 25 bp, Homo sapien
agcccactgacatcccgggatgaga

SEQ ID NO: 227436 - DNA, 25 bp, Homo sapien
gacatcccgggatgagagagcagca

SEQ ID NO: 227437 - DNA, 25 bp, Homo sapien
atatttggtactgaggttcattgcc

SEQ ID NO: 227438 - DNA, 25 bp, Homo sapien
actgaggttcattgccagggcagga

SEQ ID NO: 227439 - DNA, 25 bp, Homo sapien
gccagggcaggaggtatttccagaa

SEQ ID NO: 227440 - DNA, 25 bp, Homo sapien
tctgttccttgctttcccaaatact

SEQ ID NO: 227441 - DNA, 25 bp, Homo sapien
cttgctttcccaaatactgcatgtg

SEQ ID NO: 227442 - DNA, 25 bp, Homo sapien
tcctaagcggcagctgaaagactcg

SEQ ID NO: 227443 - DNA, 25 bp, Homo sapien
tgaaagactcgagcccgtgctgtct

SEQ ID NO: 227444 - DNA, 25 bp, Homo sapien
gtctcctttggttattatgacatga

SEQ ID NO: 227445 - DNA, 25 bp, Homo sapien
atgaaagtgtatcaagaactcagca

SEQ ID NO: 227446 - DNA, 25 bp, Homo sapien
gaactcagcatttctttgcatccat

SEQ ID NO: 227447 - DNA, 25 bp, Homo sapien
gcatttctttgcatccatggacttg

SEQ ID NO: 227448 - DNA, 25 bp, Homo sapien
tttcccaaaacggtttgccagctga

SEQ ID NO: 227449 - DNA, 25 bp, Homo sapien
ttcccaaaacggtttgccagctgaa

SEQ ID NO: 227450 - DNA, 25 bp, Homo sapien
tcccaaaacggtttgccagctgaac

SEQ ID NO: 227451 - DNA, 25 bp, Homo sapien
ccaaaacggtttgccagctgaacag

SEQ ID NO: 227452 - DNA, 25 bp, Homo sapien
aaaacggtttgccagctgaacaggg

SEQ ID NO: 227453 - DNA, 25 bp, Homo sapien
aaacggtttgccagctgaacaggga

SEQ ID NO: 227454 - DNA, 25 bp, Homo sapien
aacggtttgccagctgaacagggat

SEQ ID NO: 227455 - DNA, 25 bp, Homo sapien
cggtttgccagctgaacagggatct

SEQ ID NO: 227456 - DNA, 25 bp, Homo sapien
gtttgccagctgaacagggatctcc

SEQ ID NO: 227457 - DNA, 25 bp, Homo sapien
ttgccagctgaacagggatctccac

SEQ ID NO: 227458 - DNA, 25 bp, Homo sapien
tgccagctgaacagggatctccacg

SEQ ID NO: 227459 - DNA, 25 bp, Homo sapien
actggctgactttaaattggaacat

SEQ ID NO: 227460 - DNA, 25 bp, Homo sapien
aagctgtgaaaggttgtgtgtccta

SEQ ID NO: 227461 - DNA, 25 bp, Homo sapien
ggttgtgtgtcctatcaatgagatt

SEQ ID NO: 227462 - DNA, 25 bp, Homo sapien
aaccaagagctgttcggatgattca

SEQ ID NO: 227463 - DNA, 25 bp, Homo sapien
tacgaaaatcacatccaaaaacggt

SEQ ID NO: 227464 - DNA, 25 bp, Homo sapien
ggtataacccagcttccttaaggca

SEQ ID NO: 227465 - DNA, 25 bp, Homo sapien
taacccagcttccttaaggcaattt

SEQ ID NO: 227466 - DNA, 25 bp, Homo sapien
aaggcaattttcttctctgaaacaa

SEQ ID NO: 227467 - DNA, 25 bp, Homo sapien
gaatatactcatatgttctttacta

SEQ ID NO: 227468 - DNA, 25 bp, Homo sapien
gtatatacgattgtgtgccttgcaa

SEQ ID NO: 227469 - DNA, 25 bp, Homo sapien
gattgtgtgccttgcaataaaatca

SEQ ID NO: 227470 - DNA, 25 bp, Homo sapien
tttgcaatatgcttacaggccttat

SEQ ID NO: 227471 - DNA, 25 bp, Homo sapien
aggccttatagcctcattttataat

SEQ ID NO: 227472 - DNA, 25 bp, Homo sapien
aattgtgagggtgcattgactctaa

SEQ ID NO: 227473 - DNA, 25 bp, Homo sapien
attgactctaaagactcagtgctga

SEQ ID NO: 227474 - DNA, 25 bp, Homo sapien
gactcagtgctgaaataaccctaat

SEQ ID NO: 227475 - DNA, 25 bp, Homo sapien
taaccctaataacagcccaactaat

SEQ ID NO: 227476 - DNA, 25 bp, Homo sapien
gcccaactaatggtcatatctcata

SEQ ID NO: 227477 - DNA, 25 bp, Homo sapien
gtcatatctcatatatacagtcttg

SEQ ID NO: 227478 - DNA, 25 bp, Homo sapien
gaaataacactcttatcctaccttg

SEQ ID NO: 227479 - DNA, 25 bp, Homo sapien
ttatcctaccttggccgtggattta

SEQ ID NO: 227480 - DNA, 25 bp, Homo sapien
ccttggccgtggatttaaacgtcat

SEQ ID NO: 227481 - DNA, 25 bp, Homo sapien
tcctgtgtgcgactctaggcaaggc

SEQ ID NO: 227482 - DNA, 25 bp, Homo sapien
atccagatgcccgtacagctgaagg

SEQ ID NO: 227483 - DNA, 25 bp, Homo sapien
gggtgtggcctttaagttaatcatt

SEQ ID NO: 227484 - DNA, 25 bp, Homo sapien
tggcctttaagttaatcattttcct

SEQ ID NO: 227485 - DNA, 25 bp, Homo sapien
atcattttcctccacaacttgctcg

SEQ ID NO: 227486 - DNA, 25 bp, Homo sapien
aacttgctcgcatctgctaacacag

SEQ ID NO: 227487 - DNA, 25 bp, Homo sapien
tgctcgcatctgctaacacagaaat

SEQ ID NO: 227488 - DNA, 25 bp, Homo sapien
ctaacacagaaatagccaaaagctt

SEQ ID NO: 227489 - DNA, 25 bp, Homo sapien
cttagtgttgtggtcacttcctgtg

SEQ ID NO: 227490 - DNA, 25 bp, Homo sapien
gttgtggtcacttcctgtgtgcgac

SEQ ID NO: 227491 - DNA, 25 bp, Homo sapien
ggtcacttcctgtgtgcgactctag

SEQ ID NO: 227492 - DNA, 25 bp, Homo sapien
ggagaatgtctgtgacttagctgca

SEQ ID NO: 227493 - DNA, 25 bp, Homo sapien
tgtgacttagctgcagactaggaga

SEQ ID NO: 227494 - DNA, 25 bp, Homo sapien
agactaggagactgccctgctaact

SEQ ID NO: 227495 - DNA, 25 bp, Homo sapien
ggagactgccctgctaactaattag

SEQ ID NO: 227496 - DNA, 25 bp, Homo sapien
tagcaagcagctttgacctcattaa

SEQ ID NO: 227497 - DNA, 25 bp, Homo sapien
aaagcagctctcagtatattccgtg

SEQ ID NO: 227498 - DNA, 25 bp, Homo sapien
agctctcagtatattccgtgtcgtg

SEQ ID NO: 227499 - DNA, 25 bp, Homo sapien
agtatattccgtgtcgtgtgtgtgt

SEQ ID NO: 227500 - DNA, 25 bp, Homo sapien
gaattagtcagggagttgttgtgaa

SEQ ID NO: 227501 - DNA, 25 bp, Homo sapien
aaaccccagtgcttgtgagggaact

SEQ ID NO: 227502 - DNA, 25 bp, Homo sapien
ttgcaatattgacgtgtatatggtc

SEQ ID NO: 227503 - DNA, 25 bp, Homo sapien
caggacctgcttgaggctttcttat

SEQ ID NO: 227504 - DNA, 25 bp, Homo sapien
aggctttcttattgtgggcctccca

SEQ ID NO: 227505 - DNA, 25 bp, Homo sapien
tcccactcgtgtttccgattgagga

SEQ ID NO: 227506 - DNA, 25 bp, Homo sapien
gtgtttccgattgaggaagccttcc

SEQ ID NO: 227507 - DNA, 25 bp, Homo sapien
gaggaagccttccatctgggccgaa

SEQ ID NO: 227508 - DNA, 25 bp, Homo sapien
catctgggccgaaggtgtctcctgg

SEQ ID NO: 227509 - DNA, 25 bp, Homo sapien
tctcctgggttctggctggtaaggt

SEQ ID NO: 227510 - DNA, 25 bp, Homo sapien
gcagtcttggctttacgatcagagg

SEQ ID NO: 227511 - DNA, 25 bp, Homo sapien
caaactcacagggacctcgctgtgg

SEQ ID NO: 227512 - DNA, 25 bp, Homo sapien
gacctcgctgtggtagggaattcca

SEQ ID NO: 227513 - DNA, 25 bp, Homo sapien
gaagcagcagtctttgcatctttgt

SEQ ID NO: 227514 - DNA, 25 bp, Homo sapien
cactctgcttttcgaggctccggag

SEQ ID NO: 227515 - DNA, 25 bp, Homo sapien
ttcgaggctccggagggctcttcct

SEQ ID NO: 227516 - DNA, 25 bp, Homo sapien
aagcctgtgggcaatggcaacctct

SEQ ID NO: 227517 - DNA, 25 bp, Homo sapien
aatggcaacctctgagtctggcatt

SEQ ID NO: 227518 - DNA, 25 bp, Homo sapien
gagtctggcattcttgccaatggct

SEQ ID NO: 227519 - DNA, 25 bp, Homo sapien
attcttgccaatggctggccagcga

SEQ ID NO: 227520 - DNA, 25 bp, Homo sapien
gcgaggagaatctcccgagccctga

SEQ ID NO: 227521 - DNA, 25 bp, Homo sapien
aaaggcattttgtggctgcagagga

SEQ ID NO: 227522 - DNA, 25 bp, Homo sapien
gaggaaatgggttggctctgaacaa

SEQ ID NO: 227523 - DNA, 25 bp, Homo sapien
ggctctgaacaaagatgcagtttct

SEQ ID NO: 227524 - DNA, 25 bp, Homo sapien
gcttccccgagagtgaattttaaca

SEQ ID NO: 227525 - DNA, 25 bp, Homo sapien
attcttctttgtcataacccattag

SEQ ID NO: 227526 - DNA, 25 bp, Homo sapien
atggatatagtcttcacggtttgga

SEQ ID NO: 227527 - DNA, 25 bp, Homo sapien
aaagagcactggattaactaacagt

SEQ ID NO: 227528 - DNA, 25 bp, Homo sapien
gtttagcatctggaatcttcacatc

SEQ ID NO: 227529 - DNA, 25 bp, Homo sapien
ctggaatcttcacatcattctggtg

SEQ ID NO: 227530 - DNA, 25 bp, Homo sapien
acatcattctggtgaaacactgtac

SEQ ID NO: 227531 - DNA, 25 bp, Homo sapien
aacactgtactcgtttctgcaagca

SEQ ID NO: 227532 - DNA, 25 bp, Homo sapien
tttctgcaagcatagcattgtaggt

SEQ ID NO: 227533 - DNA, 25 bp, Homo sapien
tataagtgtctgttgtggcctcatg

SEQ ID NO: 227534 - DNA, 25 bp, Homo sapien
tgtggcctcatggtacaatcgaatg

SEQ ID NO: 227535 - DNA, 25 bp, Homo sapien
caatcgaatgacatagccttttgta

SEQ ID NO: 227536 - DNA, 25 bp, Homo sapien
ccttgtagctgtgtttcctcctggc

SEQ ID NO: 227537 - DNA, 25 bp, Homo sapien
actctgccctggacccgggtggctg

SEQ ID NO: 227538 - DNA, 25 bp, Homo sapien
gctgaggacggcaggccccagtcct

SEQ ID NO: 227539 - DNA, 25 bp, Homo sapien
gccccagtcctaaccagcaaaggtg

SEQ ID NO: 227540 - DNA, 25 bp, Homo sapien
gtcctaaccagcaaaggtgcttcca

SEQ ID NO: 227541 - DNA, 25 bp, Homo sapien
aaccagcaaaggtgcttccagccca

SEQ ID NO: 227542 - DNA, 25 bp, Homo sapien
tttatataagttactctgggatggg

SEQ ID NO: 227543 - DNA, 25 bp, Homo sapien
tctgcagtggccactaactgccctt

SEQ ID NO: 227544 - DNA, 25 bp, Homo sapien
agtggccactaactgcccttgtagc

SEQ ID NO: 227545 - DNA, 25 bp, Homo sapien
actaactgcccttgtagctgtgttt

SEQ ID NO: 227546 - DNA, 25 bp, Homo sapien
aactgcccttgtagctgtgtttcct

SEQ ID NO: 227547 - DNA, 25 bp, Homo sapien
gcttatttattacagttacattgag

SEQ ID NO: 227548 - DNA, 25 bp, Homo sapien
ttgagagatttcatctactaaagag

SEQ ID NO: 227549 - DNA, 25 bp, Homo sapien
tctactaaagagcatttggtttttc

SEQ ID NO: 227550 - DNA, 25 bp, Homo sapien
tcaaaacatccctgaactgtataat

SEQ ID NO: 227551 - DNA, 25 bp, Homo sapien
gtctcgtctgagaactgtgaactgt

SEQ ID NO: 227552 - DNA, 25 bp, Homo sapien
agaactgtgaactgtggaagaaatc

SEQ ID NO: 227553 - DNA, 25 bp, Homo sapien
taaaaagccacgtaatgaaaccact

SEQ ID NO: 227554 - DNA, 25 bp, Homo sapien
caacaattaagtggattatgggaac

SEQ ID NO: 227555 - DNA, 25 bp, Homo sapien
aaccatcttactttggttccaggat

SEQ ID NO: 227556 - DNA, 25 bp, Homo sapien
ctttggttccaggatatactggtaa

SEQ ID NO: 227557 - DNA, 25 bp, Homo sapien
atactggtaatatagctaaggatgt

SEQ ID NO: 227558 - DNA, 25 bp, Homo sapien
gatgctgtacttgcaaaatcacatt

SEQ ID NO: 227559 - DNA, 25 bp, Homo sapien
gaaattccggcagtgtaccttgact

SEQ ID NO: 227560 - DNA, 25 bp, Homo sapien
taccttgactgctagctaccctgtg

SEQ ID NO: 227561 - DNA, 25 bp, Homo sapien
ctgtgccagaaaagcctcattcgtt

SEQ ID NO: 227562 - DNA, 25 bp, Homo sapien
aagcctcattcgttgtgcttgaacc

SEQ ID NO: 227563 - DNA, 25 bp, Homo sapien
gttgtgcttgaacccttgaatgcca

SEQ ID NO: 227564 - DNA, 25 bp, Homo sapien
tgaatgccaccagctgtcatcacta

SEQ ID NO: 227565 - DNA, 25 bp, Homo sapien
agccctcctaagaggcttcctggag

SEQ ID NO: 227566 - DNA, 25 bp, Homo sapien
gcttcctggaggtttcgagattcag

SEQ ID NO: 227567 - DNA, 25 bp, Homo sapien
cgagattcagatgccctgggagatc

SEQ ID NO: 227568 - DNA, 25 bp, Homo sapien
ggccatattctggtgtcaatgacaa

SEQ ID NO: 227569 - DNA, 25 bp, Homo sapien
gggaaaccctcggttgtgatttcat

SEQ ID NO: 227570 - DNA, 25 bp, Homo sapien
aaaccctcggttgtgatttcattca

SEQ ID NO: 227571 - DNA, 25 bp, Homo sapien
ccctcggttgtgatttcattcacgt

SEQ ID NO: 227572 - DNA, 25 bp, Homo sapien
tcggttgtgatttcattcacgtgga

SEQ ID NO: 227573 - DNA, 25 bp, Homo sapien
gatttcattcacgtggatgctgcaa

SEQ ID NO: 227574 - DNA, 25 bp, Homo sapien
tttcattcacgtggatgctgcaagc

SEQ ID NO: 227575 - DNA, 25 bp, Homo sapien
tcattcacgtggatgctgcaagcag

SEQ ID NO: 227576 - DNA, 25 bp, Homo sapien
ttcacgtggatgctgcaagcagaga

SEQ ID NO: 227577 - DNA, 25 bp, Homo sapien
cacgtggatgctgcaagcagagaga

SEQ ID NO: 227578 - DNA, 25 bp, Homo sapien
agactgccacctggagttaggatgg

SEQ ID NO: 227579 - DNA, 25 bp, Homo sapien
actgccacctggagttaggatggca

SEQ ID NO: 227580 - DNA, 25 bp, Homo sapien
gctcaatgagtaactctaatagtta

SEQ ID NO: 227581 - DNA, 25 bp, Homo sapien
ctaatagttactcttgaatctggat

SEQ ID NO: 227582 - DNA, 25 bp, Homo sapien
ggattgaaaaacaccatgcatctga

SEQ ID NO: 227583 - DNA, 25 bp, Homo sapien
aacaccatgcatctgatgagataat

SEQ ID NO: 227584 - DNA, 25 bp, Homo sapien
gataattcataaatgttgccccttt

SEQ ID NO: 227585 - DNA, 25 bp, Homo sapien
actgaattgcccaagtgcttgaaca

SEQ ID NO: 227586 - DNA, 25 bp, Homo sapien
gcccaagtgcttgaacatggcagag

SEQ ID NO: 227587 - DNA, 25 bp, Homo sapien
tattttgcagtttgtgcacttaaaa

SEQ ID NO: 227588 - DNA, 25 bp, Homo sapien
ctacagtgattgttactttactggg

SEQ ID NO: 227589 - DNA, 25 bp, Homo sapien
agatgaggtgaaacttcctcccaag

SEQ ID NO: 227590 - DNA, 25 bp, Homo sapien
tcctcccaaggaattaaaatatctg

SEQ ID NO: 227591 - DNA, 25 bp, Homo sapien
gatggattctctccaggccatggga

SEQ ID NO: 227592 - DNA, 25 bp, Homo sapien
gggatttgggaaccaccatgccaat

SEQ ID NO: 227593 - DNA, 25 bp, Homo sapien
tgagcccaagggacctgagtgctgc

SEQ ID NO: 227594 - DNA, 25 bp, Homo sapien
atctacaggcactcattgctactga

SEQ ID NO: 227595 - DNA, 25 bp, Homo sapien
gggacaccaatgctgctatccgcaa

SEQ ID NO: 227596 - DNA, 25 bp, Homo sapien
gctgctatccgcaagctcaagagat

SEQ ID NO: 227597 - DNA, 25 bp, Homo sapien
gagatcccagagattctaaccacca

SEQ ID NO: 227598 - DNA, 25 bp, Homo sapien
taaccaccatgcctacttgtttgct

SEQ ID NO: 227599 - DNA, 25 bp, Homo sapien
tacttgtttgcttgctacctgcctg

SEQ ID NO: 227600 - DNA, 25 bp, Homo sapien
ggaacagtcctgcagaggctacaat

SEQ ID NO: 227601 - DNA, 25 bp, Homo sapien
cctctgcaagctcctgagatttgtt

SEQ ID NO: 227602 - DNA, 25 bp, Homo sapien
ttgatgatggctgtcatgtctggga

SEQ ID NO: 227603 - DNA, 25 bp, Homo sapien
atgatggctgtcatgtctgggagcc

SEQ ID NO: 227604 - DNA, 25 bp, Homo sapien
tgatggctgtcatgtctgggagcct

SEQ ID NO: 227605 - DNA, 25 bp, Homo sapien
atggctgtcatgtctgggagcctgt

SEQ ID NO: 227606 - DNA, 25 bp, Homo sapien
gcggggcttcttctgcaggatggaa

SEQ ID NO: 227607 - DNA, 25 bp, Homo sapien
aaatggctctggacttggcggtagc

SEQ ID NO: 227608 - DNA, 25 bp, Homo sapien
aatggctctggacttggcggtagct

SEQ ID NO: 227609 - DNA, 25 bp, Homo sapien
atggctctggacttggcggtagctg

SEQ ID NO: 227610 - DNA, 25 bp, Homo sapien
ggctctggacttggcggtagctgat

SEQ ID NO: 227611 - DNA, 25 bp, Homo sapien
ctggacttggcggtagctgatgccc

SEQ ID NO: 227612 - DNA, 25 bp, Homo sapien
tagctgatgcccctcgctctgccgc

SEQ ID NO: 227613 - DNA, 25 bp, Homo sapien
atgagttaacatcctaatgtggtag

SEQ ID NO: 227614 - DNA, 25 bp, Homo sapien
gtaggtattaggtaatgtgctgtca

SEQ ID NO: 227615 - DNA, 25 bp, Homo sapien
ggtaatgtgctgtcatgagaaaaat

SEQ ID NO: 227616 - DNA, 25 bp, Homo sapien
agaaaactggacaccaggtgagggt

SEQ ID NO: 227617 - DNA, 25 bp, Homo sapien
gacggaataggtgtagctgcctttc

SEQ ID NO: 227618 - DNA, 25 bp, Homo sapien
ggtgtagctgcctttccttgaaaaa

SEQ ID NO: 227619 - DNA, 25 bp, Homo sapien
gctgcctttccttgaaaaacagtgt

SEQ ID NO: 227620 - DNA, 25 bp, Homo sapien
aaaacagtgtgtagagatggctgag

SEQ ID NO: 227621 - DNA, 25 bp, Homo sapien
ggaggatcagtatatcggtacgtct

SEQ ID NO: 227622 - DNA, 25 bp, Homo sapien
agtatatcggtacgtctgagcccaa

SEQ ID NO: 227623 - DNA, 25 bp, Homo sapien
atcggtacgtctgagcccaagagtt

SEQ ID NO: 227624 - DNA, 25 bp, Homo sapien
ataaatctgactctccagaatccga

SEQ ID NO: 227625 - DNA, 25 bp, Homo sapien
tgactctccagaatccgatgctgag

SEQ ID NO: 227626 - DNA, 25 bp, Homo sapien
ctccagaatccgatgctgagcgaga

SEQ ID NO: 227627 - DNA, 25 bp, Homo sapien
aatccgatgctgagcgagagaagga

SEQ ID NO: 227628 - DNA, 25 bp, Homo sapien
gacagaactagacaaagatcagaat

SEQ ID NO: 227629 - DNA, 25 bp, Homo sapien
gaatcaaaacacaaatcgcctaaga

SEQ ID NO: 227630 - DNA, 25 bp, Homo sapien
caaatcgcctaagaaaaagactgga

SEQ ID NO: 227631 - DNA, 25 bp, Homo sapien
aggattctggtaattgggatacttc

SEQ ID NO: 227632 - DNA, 25 bp, Homo sapien
aattgggatacttctggcagcgaac

SEQ ID NO: 227633 - DNA, 25 bp, Homo sapien
atacttctggcagcgaactgagtga

SEQ ID NO: 227634 - DNA, 25 bp, Homo sapien
gtatgatttaaagtctgattcagac

SEQ ID NO: 227635 - DNA, 25 bp, Homo sapien
gaaggcagctctcactcaggcaaag

SEQ ID NO: 227636 - DNA, 25 bp, Homo sapien
ggcaaagagccaaaggacgaaacaa

SEQ ID NO: 227637 - DNA, 25 bp, Homo sapien
gaaacaaagtacagtcctcgcccca

SEQ ID NO: 227638 - DNA, 25 bp, Homo sapien
gccccagtcattgacctgaagcgag

SEQ ID NO: 227639 - DNA, 25 bp, Homo sapien
tgacctgaagcgaggtggctcctca

SEQ ID NO: 227640 - DNA, 25 bp, Homo sapien
gatgaccggcaaattgtggacactc

SEQ ID NO: 227641 - DNA, 25 bp, Homo sapien
aattgtggacactccaccgcatgta

SEQ ID NO: 227642 - DNA, 25 bp, Homo sapien
caccgcatgtagcagctgggctgaa

SEQ ID NO: 227643 - DNA, 25 bp, Homo sapien
atatgaccctatgtttcctaatgat

SEQ ID NO: 227644 - DNA, 25 bp, Homo sapien
tgaccctatgtttcctaatgattat

SEQ ID NO: 227645 - DNA, 25 bp, Homo sapien
gaaagtagtgaagcgccaaagagag

SEQ ID NO: 227646 - DNA, 25 bp, Homo sapien
cgtgtgtggctcaaacattgttgaa

SEQ ID NO: 227647 - DNA, 25 bp, Homo sapien
ggctcaaacattgttgaacatcggg

SEQ ID NO: 227648 - DNA, 25 bp, Homo sapien
atcggggaatttatgctggtaggaa

SEQ ID NO: 227649 - DNA, 25 bp, Homo sapien
atattggcaggtctattctcatctt

SEQ ID NO: 227650 - DNA, 25 bp, Homo sapien
ggcaggtctattctcatcttataat

SEQ ID NO: 227651 - DNA, 25 bp, Homo sapien
ggtctattctcatcttataattcat

SEQ ID NO: 227652 - DNA, 25 bp, Homo sapien
gtcatttataggtttgtaataccaa

SEQ ID NO: 227653 - DNA, 25 bp, Homo sapien
attacttaatggttacagcactgac

SEQ ID NO: 227654 - DNA, 25 bp, Homo sapien
aatggttacagcactgacagcatga

SEQ ID NO: 227655 - DNA, 25 bp, Homo sapien
agcactgacagcatgaacttttata

SEQ ID NO: 227656 - DNA, 25 bp, Homo sapien
atatgatgcatttattctaatgtga

SEQ ID NO: 227657 - DNA, 25 bp, Homo sapien
aacgcacttaggatttgtcgtcagt

SEQ ID NO: 227658 - DNA, 25 bp, Homo sapien
aatgtgttcactttttagcaagcta

SEQ ID NO: 227659 - DNA, 25 bp, Homo sapien
tagcaagctaagctgctccttattt

SEQ ID NO: 227660 - DNA, 25 bp, Homo sapien
gctccttatttctcctgtagtagac

SEQ ID NO: 227661 - DNA, 25 bp, Homo sapien
gtagtagacacaatcacagttaatc

SEQ ID NO: 227662 - DNA, 25 bp, Homo sapien
tcacagttaatctttgcacaatgca

SEQ ID NO: 227663 - DNA, 25 bp, Homo sapien
acaatgcatcgcattctccatgcaa

SEQ ID NO: 227664 - DNA, 25 bp, Homo sapien
tctccatgcaacctaacagagcggt

SEQ ID NO: 227665 - DNA, 25 bp, Homo sapien
cggtctgggatagagcctgaacttt

SEQ ID NO: 227666 - DNA, 25 bp, Homo sapien
atttgtcgtcagtaatttgttatgc

SEQ ID NO: 227667 - DNA, 25 bp, Homo sapien
ttgttatgcactatctagactaaga

SEQ ID NO: 227668 - DNA, 25 bp, Homo sapien
accccatctatgtccttgacttagg

SEQ ID NO: 227669 - DNA, 25 bp, Homo sapien
tgttctctctcctttgtctgtttgt

SEQ ID NO: 227670 - DNA, 25 bp, Homo sapien
ctctctcctttgtctgtttgttgtc

SEQ ID NO: 227671 - DNA, 25 bp, Homo sapien
ctctcctttgtctgtttgttgtcaa

SEQ ID NO: 227672 - DNA, 25 bp, Homo sapien
tctcctttgtctgtttgttgtcaaa

SEQ ID NO: 227673 - DNA, 25 bp, Homo sapien
tcctttgtctgtttgttgtcaaaga

SEQ ID NO: 227674 - DNA, 25 bp, Homo sapien
ttgtcaaagatgctgctgggcagac

SEQ ID NO: 227675 - DNA, 25 bp, Homo sapien
aaagatgctgctgggcagacaggca

SEQ ID NO: 227676 - DNA, 25 bp, Homo sapien
cagggaaaggatctgtctgcccatc

SEQ ID NO: 227677 - DNA, 25 bp, Homo sapien
agggaaaggatctgtctgcccatct

SEQ ID NO: 227678 - DNA, 25 bp, Homo sapien
gtccgagaagggaagccttgggcaa

SEQ ID NO: 227679 - DNA, 25 bp, Homo sapien
actgaatgcatatatgtagaaccat

SEQ ID NO: 227680 - DNA, 25 bp, Homo sapien
taagggctagaaattttgagcaaca

SEQ ID NO: 227681 - DNA, 25 bp, Homo sapien
gcaacaaaatttgtcacttgaccag

SEQ ID NO: 227682 - DNA, 25 bp, Homo sapien
ttgtcacttgaccagattttatctt

SEQ ID NO: 227683 - DNA, 25 bp, Homo sapien
tctcctttgctgttgaggtaacttg

SEQ ID NO: 227684 - DNA, 25 bp, Homo sapien
gctgttgaggtaacttgcatattat

SEQ ID NO: 227685 - DNA, 25 bp, Homo sapien
gtattctgtatactcagttcataag

SEQ ID NO: 227686 - DNA, 25 bp, Homo sapien
ctcagttcataaggttatttagcac

SEQ ID NO: 227687 - DNA, 25 bp, Homo sapien
gttatttagcacaaagtatagcagc

SEQ ID NO: 227688 - DNA, 25 bp, Homo sapien
gtatagcagcttcacctggagagct

SEQ ID NO: 227689 - DNA, 25 bp, Homo sapien
gtaaattcaacttccatgttttatc

SEQ ID NO: 227690 - DNA, 25 bp, Homo sapien
ggaggaggcaagtatttcagcacca

SEQ ID NO: 227691 - DNA, 25 bp, Homo sapien
gcaccactgaagactacgaccatga

SEQ ID NO: 227692 - DNA, 25 bp, Homo sapien
gctgcgggtgtctgtaggtcttctc

SEQ ID NO: 227693 - DNA, 25 bp, Homo sapien
tctgtaggtcttctcctggtgaaaa

SEQ ID NO: 227694 - DNA, 25 bp, Homo sapien
gtccaggtgaaacttggagactcct

SEQ ID NO: 227695 - DNA, 25 bp, Homo sapien
ctgggacgtgaaactgggagcctta

SEQ ID NO: 227696 - DNA, 25 bp, Homo sapien
gaatacccaggaagtcaccctgcag

SEQ ID NO: 227697 - DNA, 25 bp, Homo sapien
tgcagccaggcgaatacatcacaaa

SEQ ID NO: 227698 - DNA, 25 bp, Homo sapien
agtctttgtcgccttccaagctttc

SEQ ID NO: 227699 - DNA, 25 bp, Homo sapien
gtcatgtacaccagcaaggaccgct

SEQ ID NO: 227700 - DNA, 25 bp, Homo sapien
caaggaccgctatttctattttggg

SEQ ID NO: 227701 - DNA, 25 bp, Homo sapien
ttctgggaacagcaccacctttggg

SEQ ID NO: 227702 - DNA, 25 bp, Homo sapien
atcaggcagaaatagcagctgtgcc

SEQ ID NO: 227703 - DNA, 25 bp, Homo sapien
gaactccttctctcatggggtttta

SEQ ID NO: 227704 - DNA, 25 bp, Homo sapien
ccccatatgcataggaacacttgtg

SEQ ID NO: 227705 - DNA, 25 bp, Homo sapien
aggaacacttgtgcaccagtcgcta

SEQ ID NO: 227706 - DNA, 25 bp, Homo sapien
gtgcaccagtcgctacatttgcaag

SEQ ID NO: 227707 - DNA, 25 bp, Homo sapien
cagtcgctacatttgcaagtggaag

SEQ ID NO: 227708 - DNA, 25 bp, Homo sapien
tcagctcccaacaggaagcccatgt

SEQ ID NO: 227709 - DNA, 25 bp, Homo sapien
tcccaacaggaagcccatgtgtgcg

SEQ ID NO: 227710 - DNA, 25 bp, Homo sapien
gtgcctggaaggacaggtgacatct

SEQ ID NO: 227711 - DNA, 25 bp, Homo sapien
aggacaggtgacatctgtgaagaaa

SEQ ID NO: 227712 - DNA, 25 bp, Homo sapien
gtcacctttgcagattgttcttatc

SEQ ID NO: 227713 - DNA, 25 bp, Homo sapien
ttgcagattgttcttatcaaagtga

SEQ ID NO: 227714 - DNA, 25 bp, Homo sapien
tatcaaagtgattcaggagaaggcc

SEQ ID NO: 227715 - DNA, 25 bp, Homo sapien
gaaggccaagtatgcatttagatta

SEQ ID NO: 227716 - DNA, 25 bp, Homo sapien
atgcagggtttgttggcttggccac

SEQ ID NO: 227717 - DNA, 25 bp, Homo sapien
gggtttgttggcttggccacccaag

SEQ ID NO: 227718 - DNA, 25 bp, Homo sapien
atctccccagcttactgttctaaag

SEQ ID NO: 227719 - DNA, 25 bp, Homo sapien
cccagcttactgttctaaagagaaa

SEQ ID NO: 227720 - DNA, 25 bp, Homo sapien
aatacatttctgtgtacacctgaaa

SEQ ID NO: 227721 - DNA, 25 bp, Homo sapien
acacctgaaaaattggcagcccatc

SEQ ID NO: 227722 - DNA, 25 bp, Homo sapien
taccaactattcaaagtaatgcaga

SEQ ID NO: 227723 - DNA, 25 bp, Homo sapien
ccttttctgtactgagccttggata

SEQ ID NO: 227724 - DNA, 25 bp, Homo sapien
gggtcaggctcctttttagttcaga

SEQ ID NO: 227725 - DNA, 25 bp, Homo sapien
ttagttcagagattcaggcagccac

SEQ ID NO: 227726 - DNA, 25 bp, Homo sapien
cagccactcccagtgggttgtagat

SEQ ID NO: 227727 - DNA, 25 bp, Homo sapien
aactattttctcttccaaatctaag

SEQ ID NO: 227728 - DNA, 25 bp, Homo sapien
tccaaatctaagtactaagctccta

SEQ ID NO: 227729 - DNA, 25 bp, Homo sapien
agctcctagtataaggtgttgttac

SEQ ID NO: 227730 - DNA, 25 bp, Homo sapien
gtgttgttacagaataccagagacc

SEQ ID NO: 227731 - DNA, 25 bp, Homo sapien
ataccagagaccatgttagagacaa

SEQ ID NO: 227732 - DNA, 25 bp, Homo sapien
gttagagacaactacatctcttcaa

SEQ ID NO: 227733 - DNA, 25 bp, Homo sapien
agtaagctgttcttcttaatcagaa

SEQ ID NO: 227734 - DNA, 25 bp, Homo sapien
agacatatgaatccaggctgactgc

SEQ ID NO: 227735 - DNA, 25 bp, Homo sapien
tgcccatctcgtttgatataaactg

SEQ ID NO: 227736 - DNA, 25 bp, Homo sapien
aaggcaagcactttgttctgagtct

SEQ ID NO: 227737 - DNA, 25 bp, Homo sapien
agcactttgttctgagtcttttatc

SEQ ID NO: 227738 - DNA, 25 bp, Homo sapien
gagtcttttatctccaaatacatag

SEQ ID NO: 227739 - DNA, 25 bp, Homo sapien
aatacatagttgtctcaaaccaagc

SEQ ID NO: 227740 - DNA, 25 bp, Homo sapien
ggcttatttgcagaatagttccaat

SEQ ID NO: 227741 - DNA, 25 bp, Homo sapien
gttccaatgatataaatgccaactg

SEQ ID NO: 227742 - DNA, 25 bp, Homo sapien
actggcaagtcattccaaactgctt

SEQ ID NO: 227743 - DNA, 25 bp, Homo sapien
gtcattccaaactgcttgaaggagt

SEQ ID NO: 227744 - DNA, 25 bp, Homo sapien
gcctccatttggctaaatatgacaa

SEQ ID NO: 227745 - DNA, 25 bp, Homo sapien
gaaaggcaaaactgtaaagcttcta

SEQ ID NO: 227746 - DNA, 25 bp, Homo sapien
aggcaaaactgtaaagcttctaaag

SEQ ID NO: 227747 - DNA, 25 bp, Homo sapien
ggcaaaactgtaaagcttctaaagt

SEQ ID NO: 227748 - DNA, 25 bp, Homo sapien
gcaaaactgtaaagcttctaaagta

SEQ ID NO: 227749 - DNA, 25 bp, Homo sapien
caaaactgtaaagcttctaaagtat

SEQ ID NO: 227750 - DNA, 25 bp, Homo sapien
aactgtaaagcttctaaagtataat

SEQ ID NO: 227751 - DNA, 25 bp, Homo sapien
gtaaagcttctaaagtataatcaga

SEQ ID NO: 227752 - DNA, 25 bp, Homo sapien
aagcttctaaagtataatcagaaac

SEQ ID NO: 227753 - DNA, 25 bp, Homo sapien
atcagaaacttacagaagactttaa

SEQ ID NO: 227754 - DNA, 25 bp, Homo sapien
tcagaaacttacagaagactttaaa

SEQ ID NO: 227755 - DNA, 25 bp, Homo sapien
gactttaaaaagttggccaggagca

SEQ ID NO: 227756 - DNA, 25 bp, Homo sapien
aactgtcatggaagcatgcctggaa

SEQ ID NO: 227757 - DNA, 25 bp, Homo sapien
gacagcaatagaacttggacctctg

SEQ ID NO: 227758 - DNA, 25 bp, Homo sapien
acttggacctctgtggtcaagttcc

SEQ ID NO: 227759 - DNA, 25 bp, Homo sapien
cccttttcaatactggattcctcaa

SEQ ID NO: 227760 - DNA, 25 bp, Homo sapien
gaatgctatttgaatctcttcacca

SEQ ID NO: 227761 - DNA, 25 bp, Homo sapien
tgaatctcttcaccatggtttggat

SEQ ID NO: 227762 - DNA, 25 bp, Homo sapien
tggtttggatgacattcagacccta

SEQ ID NO: 227763 - DNA, 25 bp, Homo sapien
aatctttgaatcagagtgtacgcct

SEQ ID NO: 227764 - DNA, 25 bp, Homo sapien
gtgtacgcctcaaagtcagttttca

SEQ ID NO: 227765 - DNA, 25 bp, Homo sapien
gtcagttttcaattcatgcatcttc

SEQ ID NO: 227766 - DNA, 25 bp, Homo sapien
aattcatgcatcttcaaatgtcaac

SEQ ID NO: 227767 - DNA, 25 bp, Homo sapien
gctgcagctgtgagtgtgatgggac

SEQ ID NO: 227768 - DNA, 25 bp, Homo sapien
tgatgggacagcagagtcactcctg

SEQ ID NO: 227769 - DNA, 25 bp, Homo sapien
ctcctgcatgggattctagggctgg

SEQ ID NO: 227770 - DNA, 25 bp, Homo sapien
gaggactgtcaccatgtcactacgg

SEQ ID NO: 227771 - DNA, 25 bp, Homo sapien
tgtcaccatgtcactacggcactct

SEQ ID NO: 227772 - DNA, 25 bp, Homo sapien
atgtcactacggcactctccagctg

SEQ ID NO: 227773 - DNA, 25 bp, Homo sapien
gcagccctgccatactctgggtctt

SEQ ID NO: 227774 - DNA, 25 bp, Homo sapien
atactctgggtctttcctctggagc

SEQ ID NO: 227775 - DNA, 25 bp, Homo sapien
ggtctttcctctggagcaaggtgaa

SEQ ID NO: 227776 - DNA, 25 bp, Homo sapien
gaggaaggctgacccctgcgtggga

SEQ ID NO: 227777 - DNA, 25 bp, Homo sapien
tgctggaaaggcatccttgctgcag

SEQ ID NO: 227778 - DNA, 25 bp, Homo sapien
agacttgagtttctatacttttaag

SEQ ID NO: 227779 - DNA, 25 bp, Homo sapien
gtttctatacttttaagaagagctc

SEQ ID NO: 227780 - DNA, 25 bp, Homo sapien
gggtgaattttactttcatctcaag

SEQ ID NO: 227781 - DNA, 25 bp, Homo sapien
tcatctcaagttattaaaaacccac

SEQ ID NO: 227782 - DNA, 25 bp, Homo sapien
tcaagaatcagcagttttagaattt

SEQ ID NO: 227783 - DNA, 25 bp, Homo sapien
tttcagatagtacttgctcagaagt

SEQ ID NO: 227784 - DNA, 25 bp, Homo sapien
cttgctcagaagtacatgctactca

SEQ ID NO: 227785 - DNA, 25 bp, Homo sapien
agtacatgctactcaagatattaag

SEQ ID NO: 227786 - DNA, 25 bp, Homo sapien
ctgtagatctgctattgaatcagaa

SEQ ID NO: 227787 - DNA, 25 bp, Homo sapien
aatcagaatctgtgtacttgaacaa

SEQ ID NO: 227788 - DNA, 25 bp, Homo sapien
gtacttgaacaaatgtgtgaatctc

SEQ ID NO: 227789 - DNA, 25 bp, Homo sapien
agaggcaccggcagactcaccacgc

SEQ ID NO: 227790 - DNA, 25 bp, Homo sapien
tgcaggcatgtcctgtgctgtgcca

SEQ ID NO: 227791 - DNA, 25 bp, Homo sapien
gggacagtggtcagcactgaagaca

SEQ ID NO: 227792 - DNA, 25 bp, Homo sapien
actgaagacagtcatacctgcccgg

SEQ ID NO: 227793 - DNA, 25 bp, Homo sapien
aagacagtcatacctgcccggccgg

SEQ ID NO: 227794 - DNA, 25 bp, Homo sapien
gacaatttgaacttaagctttaact

SEQ ID NO: 227795 - DNA, 25 bp, Homo sapien
cagcctcagtttgcctgctgcagaa

SEQ ID NO: 227796 - DNA, 25 bp, Homo sapien
gcctcagtttgcctgctgcagaata

SEQ ID NO: 227797 - DNA, 25 bp, Homo sapien
ttgcctgctgcagaataagcaccac

SEQ ID NO: 227798 - DNA, 25 bp, Homo sapien
tgctgcagaataagcaccacgctcc

SEQ ID NO: 227799 - DNA, 25 bp, Homo sapien
agaataagcaccacgctccctcgtg

SEQ ID NO: 227800 - DNA, 25 bp, Homo sapien
ccgagcgctggtcattttgtagtac

SEQ ID NO: 227801 - DNA, 25 bp, Homo sapien
tttgtagtacctgcatccagcttag

SEQ ID NO: 227802 - DNA, 25 bp, Homo sapien
gcatccagcttagctgctgctgaca

SEQ ID NO: 227803 - DNA, 25 bp, Homo sapien
gcctgggttccgtgagcgcgaactc

SEQ ID NO: 227804 - DNA, 25 bp, Homo sapien
ttccgtgagcgcgaactccgtggtg

SEQ ID NO: 227805 - DNA, 25 bp, Homo sapien
aactccgtggtggtgggtctggctc

SEQ ID NO: 227806 - DNA, 25 bp, Homo sapien
ggtgctgccatctacgcatgtggga

SEQ ID NO: 227807 - DNA, 25 bp, Homo sapien
tacgcatgtgggaccctcgttatcg

SEQ ID NO: 227808 - DNA, 25 bp, Homo sapien
cctcgttatcgctgttgctcaaaat

SEQ ID NO: 227809 - DNA, 25 bp, Homo sapien
atcgctgttgctcaaaatgtatttt

SEQ ID NO: 227810 - DNA, 25 bp, Homo sapien
ttcttactggattttgtacaaacat

SEQ ID NO: 227811 - DNA, 25 bp, Homo sapien
tgcagtgcagtttggcacctctctt

SEQ ID NO: 227812 - DNA, 25 bp, Homo sapien
tcttccaggccttcctaagtttttg

SEQ ID NO: 227813 - DNA, 25 bp, Homo sapien
gtttttgttagttgtgtcttcgaat

SEQ ID NO: 227814 - DNA, 25 bp, Homo sapien
agttgtgtcttcgaatttattgtag

SEQ ID NO: 227815 - DNA, 25 bp, Homo sapien
tttattgtagttcaccgctggtcag

SEQ ID NO: 227816 - DNA, 25 bp, Homo sapien
accgctggtcagtaatctggttcat

SEQ ID NO: 227817 - DNA, 25 bp, Homo sapien
aaaacacttcgttgatccatccagc

SEQ ID NO: 227818 - DNA, 25 bp, Homo sapien
tccatccagccctaaagttcattga

SEQ ID NO: 227819 - DNA, 25 bp, Homo sapien
ttgactaatagctcatgcatcttat

SEQ ID NO: 227820 - DNA, 25 bp, Homo sapien
tctggacttctacaatagtgtggaa

SEQ ID NO: 227821 - DNA, 25 bp, Homo sapien
aagccagtgcctattgagtatatca

SEQ ID NO: 227822 - DNA, 25 bp, Homo sapien
gggtgacgattgattctttcgacct

SEQ ID NO: 227823 - DNA, 25 bp, Homo sapien
gattctttcgacctaacattttggg

SEQ ID NO: 227824 - DNA, 25 bp, Homo sapien
taaccggtccaggagtgagcagctc

SEQ ID NO: 227825 - DNA, 25 bp, Homo sapien
gagtgagcagctccgttctgtcaga

SEQ ID NO: 227826 - DNA, 25 bp, Homo sapien
agcagctccgttctgtcagatgcta

SEQ ID NO: 227827 - DNA, 25 bp, Homo sapien
ggagacgctctattttttcacagtt

SEQ ID NO: 227828 - DNA, 25 bp, Homo sapien
gacagttgtagattgatacgcagtt

SEQ ID NO: 227829 - DNA, 25 bp, Homo sapien
attgatacgcagttgtgcatgggaa

SEQ ID NO: 227830 - DNA, 25 bp, Homo sapien
gggaaacgcacagctttatttactg

SEQ ID NO: 227831 - DNA, 25 bp, Homo sapien
gaaggcttgtgtgaaccgttgcgca

SEQ ID NO: 227832 - DNA, 25 bp, Homo sapien
cgttgcgcataaataaaccctttct

SEQ ID NO: 227833 - DNA, 25 bp, Homo sapien
gtagactgaatggaacactgaggca

SEQ ID NO: 227834 - DNA, 25 bp, Homo sapien
cactgaggcaggagcaggtactcct

SEQ ID NO: 227835 - DNA, 25 bp, Homo sapien
tgaggcaggagcaggtactcctccc

SEQ ID NO: 227836 - DNA, 25 bp, Homo sapien
ccacacaccctagaaatccaggagg

SEQ ID NO: 227837 - DNA, 25 bp, Homo sapien
atccaggaggcccagctaggtgatt

SEQ ID NO: 227838 - DNA, 25 bp, Homo sapien
gagagaggccaaggacttttggctt

SEQ ID NO: 227839 - DNA, 25 bp, Homo sapien
ccaaggacttttggcttgggccagg

SEQ ID NO: 227840 - DNA, 25 bp, Homo sapien
gccagggctgtttggagatgctttc

SEQ ID NO: 227841 - DNA, 25 bp, Homo sapien
agggctgtttggagatgctttcaac

SEQ ID NO: 227842 - DNA, 25 bp, Homo sapien
ggctgtttggagatgctttcaacaa

SEQ ID NO: 227843 - DNA, 25 bp, Homo sapien
tggagatgctttcaacaagtggaag

SEQ ID NO: 227844 - DNA, 25 bp, Homo sapien
atataaaacttcatgctgagcaaaa

SEQ ID NO: 227845 - DNA, 25 bp, Homo sapien
aaacaactttaccatatatccatag

SEQ ID NO: 227846 - DNA, 25 bp, Homo sapien
atatccatagaatagttcccacagt

SEQ ID NO: 227847 - DNA, 25 bp, Homo sapien
agttcccacagtacatttcctatgt

SEQ ID NO: 227848 - DNA, 25 bp, Homo sapien
atgcaatttttagaaccattttaag

SEQ ID NO: 227849 - DNA, 25 bp, Homo sapien
gatacattttgcaatctgttaactg

SEQ ID NO: 227850 - DNA, 25 bp, Homo sapien
atctgttaactgtaggcatccgcat

SEQ ID NO: 227851 - DNA, 25 bp, Homo sapien
gtaggcatccgcatttttcttccat

SEQ ID NO: 227852 - DNA, 25 bp, Homo sapien
tttttcttccattacataatctgtt

SEQ ID NO: 227853 - DNA, 25 bp, Homo sapien
gttggcaatatctgctaggatccac

SEQ ID NO: 227854 - DNA, 25 bp, Homo sapien
cacatgatctatactctaatgttct

SEQ ID NO: 227855 - DNA, 25 bp, Homo sapien
ggatgcatgacgtcacccaaatatt

SEQ ID NO: 227856 - DNA, 25 bp, Homo sapien
atatttaccacacgcttttgctgcc

SEQ ID NO: 227857 - DNA, 25 bp, Homo sapien
taccacacgcttttgctgccagaga

SEQ ID NO: 227858 - DNA, 25 bp, Homo sapien
aaatgggagcagtagcttctcatca

SEQ ID NO: 227859 - DNA, 25 bp, Homo sapien
gtagcttctcatcagcctccacatt

SEQ ID NO: 227860 - DNA, 25 bp, Homo sapien
gcctccacatttcattactcataat

SEQ ID NO: 227861 - DNA, 25 bp, Homo sapien
acatttcattactcataattgtggc

SEQ ID NO: 227862 - DNA, 25 bp, Homo sapien
ttgtggccttcctaatgtctcatgc

SEQ ID NO: 227863 - DNA, 25 bp, Homo sapien
tcctaatgtctcatgcccctaagca

SEQ ID NO: 227864 - DNA, 25 bp, Homo sapien
attacaatgtctcaacagccttctc

SEQ ID NO: 227865 - DNA, 25 bp, Homo sapien
tacaatgtctcaacagccttctctc

SEQ ID NO: 227866 - DNA, 25 bp, Homo sapien
aaattttttcagtgagcgtggtgac

SEQ ID NO: 227867 - DNA, 25 bp, Homo sapien
tttcagtgagcgtggtgactgcaga

SEQ ID NO: 227868 - DNA, 25 bp, Homo sapien
tgactgcagaggttagtgctgtgaa

SEQ ID NO: 227869 - DNA, 25 bp, Homo sapien
tagtgctgtgaaaagctgggctaaa

SEQ ID NO: 227870 - DNA, 25 bp, Homo sapien
gtaaagtcaaacaggattccatccc

SEQ ID NO: 227871 - DNA, 25 bp, Homo sapien
gattccatcccctgtgaaataacac

SEQ ID NO: 227872 - DNA, 25 bp, Homo sapien
tttcactctctaaaagcaacagcat

SEQ ID NO: 227873 - DNA, 25 bp, Homo sapien
gcaacagcatgtaaactagaatgaa

SEQ ID NO: 227874 - DNA, 25 bp, Homo sapien
aggaaattatgtacgtatgcctaat

SEQ ID NO: 227875 - DNA, 25 bp, Homo sapien
tgtacgtatgcctaatattctttgt

SEQ ID NO: 227876 - DNA, 25 bp, Homo sapien
attctttgtgaatgtctttcattta

SEQ ID NO: 227877 - DNA, 25 bp, Homo sapien
tgggatggcgagacagggctggcac

SEQ ID NO: 227878 - DNA, 25 bp, Homo sapien
gcgagacagggctggcacggctcac

SEQ ID NO: 227879 - DNA, 25 bp, Homo sapien
acagggctggcacggctcacgctgt

SEQ ID NO: 227880 - DNA, 25 bp, Homo sapien
ccacggaaaatgctctgccggcgaa

SEQ ID NO: 227881 - DNA, 25 bp, Homo sapien
cacggaaaatgctctgccggcgaaa

SEQ ID NO: 227882 - DNA, 25 bp, Homo sapien
acggaaaatgctctgccggcgaaag

SEQ ID NO: 227883 - DNA, 25 bp, Homo sapien
cggaaaatgctctgccggcgaaagc

SEQ ID NO: 227884 - DNA, 25 bp, Homo sapien
ggaaaatgctctgccggcgaaagcg

SEQ ID NO: 227885 - DNA, 25 bp, Homo sapien
tctgccggcgaaagcggctggcaat

SEQ ID NO: 227886 - DNA, 25 bp, Homo sapien
cggctggcaatggggttgatttcaa

SEQ ID NO: 227887 - DNA, 25 bp, Homo sapien
ctcctcggctgggatggcgagacag

SEQ ID NO: 227888 - DNA, 25 bp, Homo sapien
tataatagtctggtgggcttctgtt

SEQ ID NO: 227889 - DNA, 25 bp, Homo sapien
gggcttctgttagggaggcttatac

SEQ ID NO: 227890 - DNA, 25 bp, Homo sapien
aaggcttggactcagcctaggttca

SEQ ID NO: 227891 - DNA, 25 bp, Homo sapien
agcctaggttcaagtactgcatctt

SEQ ID NO: 227892 - DNA, 25 bp, Homo sapien
tgcatcttgacctggcctgtaggca

SEQ ID NO: 227893 - DNA, 25 bp, Homo sapien
tggcctgtaggcaagtcttttcact

SEQ ID NO: 227894 - DNA, 25 bp, Homo sapien
tcacttctctgagttttggctttct

SEQ ID NO: 227895 - DNA, 25 bp, Homo sapien
gttttggctttctcatttgtccaat

SEQ ID NO: 227896 - DNA, 25 bp, Homo sapien
aatacctcccatgcaggattgctag

SEQ ID NO: 227897 - DNA, 25 bp, Homo sapien
atatctaaacacctcacacaatgcc

SEQ ID NO: 227898 - DNA, 25 bp, Homo sapien
gcacatagcaggtgttcaattaggt

SEQ ID NO: 227899 - DNA, 25 bp, Homo sapien
agcacccagtcatgccaagttccgt

SEQ ID NO: 227900 - DNA, 25 bp, Homo sapien
aagttccgttccactggactagagc

SEQ ID NO: 227901 - DNA, 25 bp, Homo sapien
tagagctggagacaccatccttggt

SEQ ID NO: 227902 - DNA, 25 bp, Homo sapien
gaatgccagcacagtggtggtttct

SEQ ID NO: 227903 - DNA, 25 bp, Homo sapien
ggtggtttctgacaagtacaacctt

SEQ ID NO: 227904 - DNA, 25 bp, Homo sapien
gcaacgtagctgctccaggagatgc

SEQ ID NO: 227905 - DNA, 25 bp, Homo sapien
aagccactcaacacaacacctaatg

SEQ ID NO: 227906 - DNA, 25 bp, Homo sapien
aacacctaatgccaccaaagagatc

SEQ ID NO: 227907 - DNA, 25 bp, Homo sapien
aagtgaagatcatcccgccacagcc

SEQ ID NO: 227908 - DNA, 25 bp, Homo sapien
acagcctatggagggcctgggcttt

SEQ ID NO: 227909 - DNA, 25 bp, Homo sapien
cctgggctttctggatgctcttaat

SEQ ID NO: 227910 - DNA, 25 bp, Homo sapien
ttttcttctgcatcaagtgaggaaa

SEQ ID NO: 227911 - DNA, 25 bp, Homo sapien
aaaaatgtgcttttggccatgtctc

SEQ ID NO: 227912 - DNA, 25 bp, Homo sapien
tttggccatgtctcaaagacaggac

SEQ ID NO: 227913 - DNA, 25 bp, Homo sapien
agacaggaccaacttcagattccca

SEQ ID NO: 227914 - DNA, 25 bp, Homo sapien
caaagaagccagctacagagcctct

SEQ ID NO: 227915 - DNA, 25 bp, Homo sapien
gagcctctggaacactatggtctta

SEQ ID NO: 227916 - DNA, 25 bp, Homo sapien
aacactatggtcttacaagcagtac

SEQ ID NO: 227917 - DNA, 25 bp, Homo sapien
gcagtactaaaatcaaccctcagcc

SEQ ID NO: 227918 - DNA, 25 bp, Homo sapien
aatgggacttttatcagcaaatgga

SEQ ID NO: 227919 - DNA, 25 bp, Homo sapien
gattctgaagaggtactttcctgga

SEQ ID NO: 227920 - DNA, 25 bp, Homo sapien
ctttcctggaataattgtctacctg

SEQ ID NO: 227921 - DNA, 25 bp, Homo sapien
ggaattctctgtaatgagtgattct

SEQ ID NO: 227922 - DNA, 25 bp, Homo sapien
gattctgaagaggtactttcctgga

SEQ ID NO: 227923 - DNA, 25 bp, Homo sapien
tttcctggaataattgtctacctga

SEQ ID NO: 227924 - DNA, 25 bp, Homo sapien
accccctatacctggaagattgtca

SEQ ID NO: 227925 - DNA, 25 bp, Homo sapien
gtcagcatgtaaatcaggaacaact

SEQ ID NO: 227926 - DNA, 25 bp, Homo sapien
ggaacaactttctccttattgacaa

SEQ ID NO: 227927 - DNA, 25 bp, Homo sapien
taaaactcaggaaccaaggcaaaat

SEQ ID NO: 227928 - DNA, 25 bp, Homo sapien
aggcaaaatgaattggcttctaggg

SEQ ID NO: 227929 - DNA, 25 bp, Homo sapien
gtctgaaccttactgcccatacaag

SEQ ID NO: 227930 - DNA, 25 bp, Homo sapien
ctgcccatacaagtgttgattcatt

SEQ ID NO: 227931 - DNA, 25 bp, Homo sapien
ttttaatgctgtttatgatttctgc

SEQ ID NO: 227932 - DNA, 25 bp, Homo sapien
gtgtcacagtacatgttcaaattta

SEQ ID NO: 227933 - DNA, 25 bp, Homo sapien
ttaaacttgaatcctggttcatctt

SEQ ID NO: 227934 - DNA, 25 bp, Homo sapien
gcagttgaacttgatcttttaaaat

SEQ ID NO: 227935 - DNA, 25 bp, Homo sapien
ttgagacatgtaagctaatcagcaa

SEQ ID NO: 227936 - DNA, 25 bp, Homo sapien
aagctaatcagcaaaagacagaaac

SEQ ID NO: 227937 - DNA, 25 bp, Homo sapien
cagatagcaattctactgcacaatt

SEQ ID NO: 227938 - DNA, 25 bp, Homo sapien
agcaattctactgcacaattcattg

SEQ ID NO: 227939 - DNA, 25 bp, Homo sapien
aaagtatatgtattccttcagcatt

SEQ ID NO: 227940 - DNA, 25 bp, Homo sapien
gtattccttcagcattaccttaaag

SEQ ID NO: 227941 - DNA, 25 bp, Homo sapien
cgggataaatcttcagaaaagtgtc

SEQ ID NO: 227942 - DNA, 25 bp, Homo sapien
gtgtcaaaagtgtcacagtacatgt

SEQ ID NO: 227943 - DNA, 25 bp, Homo sapien
tagtctgtgcataaggtagtaatac

SEQ ID NO: 227944 - DNA, 25 bp, Homo sapien
aggtagtaatacatgtacacaaaga

SEQ ID NO: 227945 - DNA, 25 bp, Homo sapien
atttatacagttgacataatgctta

SEQ ID NO: 227946 - DNA, 25 bp, Homo sapien
ataatgcttattatgcccttgaata

SEQ ID NO: 227947 - DNA, 25 bp, Homo sapien
ttgtttttacttcttatccataagc

SEQ ID NO: 227948 - DNA, 25 bp, Homo sapien
ttcttatccataagcattggcctta

SEQ ID NO: 227949 - DNA, 25 bp, Homo sapien
taagcattggccttacattgcctca

SEQ ID NO: 227950 - DNA, 25 bp, Homo sapien
attggccttacattgcctcaagagg

SEQ ID NO: 227951 - DNA, 25 bp, Homo sapien
tggccttacattgcctcaagaggaa

SEQ ID NO: 227952 - DNA, 25 bp, Homo sapien
tgcctcaagaggaacagaatttatt

SEQ ID NO: 227953 - DNA, 25 bp, Homo sapien
cattttagtagtctgtgcataaggt

SEQ ID NO: 227954 - DNA, 25 bp, Homo sapien
gtgcacacaggatggattacctgca

SEQ ID NO: 227955 - DNA, 25 bp, Homo sapien
gcacacaggatggattacctgcact

SEQ ID NO: 227956 - DNA, 25 bp, Homo sapien
aggatggattacctgcactttgagg

SEQ ID NO: 227957 - DNA, 25 bp, Homo sapien
gtggtttgacatggatatggtgatc

SEQ ID NO: 227958 - DNA, 25 bp, Homo sapien
gtttgacatggatatggtgatcata

SEQ ID NO: 227959 - DNA, 25 bp, Homo sapien
attcagtgaactgggtcattggatt

SEQ ID NO: 227960 - DNA, 25 bp, Homo sapien
cagtgaactgggtcattggattcat

SEQ ID NO: 227961 - DNA, 25 bp, Homo sapien
gaactgggtcattggattcattgtt

SEQ ID NO: 227962 - DNA, 25 bp, Homo sapien
aactgggtcattggattcattgttt

SEQ ID NO: 227963 - DNA, 25 bp, Homo sapien
cattggattcattgttttctgcttt

SEQ ID NO: 227964 - DNA, 25 bp, Homo sapien
aaagctttcagaaatccaactctgc

SEQ ID NO: 227965 - DNA, 25 bp, Homo sapien
caaagaagccagctacagagcctct

SEQ ID NO: 227966 - DNA, 25 bp, Homo sapien
acagagcctctggaacactatggtc

SEQ ID NO: 227967 - DNA, 25 bp, Homo sapien
gagcctctggaacactatggtctta

SEQ ID NO: 227968 - DNA, 25 bp, Homo sapien
gcctctggaacactatggtcttaca

SEQ ID NO: 227969 - DNA, 25 bp, Homo sapien
tggaacactatggtcttacaagcag

SEQ ID NO: 227970 - DNA, 25 bp, Homo sapien
acactatggtcttacaagcagtact

SEQ ID NO: 227971 - DNA, 25 bp, Homo sapien
ccacatggtaatttttaatgggact

SEQ ID NO: 227972 - DNA, 25 bp, Homo sapien
ggaattctctgtaatgagtgattct

SEQ ID NO: 227973 - DNA, 25 bp, Homo sapien
gattctgaagaggtactttcctgga

SEQ ID NO: 227974 - DNA, 25 bp, Homo sapien
ctgaagaggtactttcctggaataa

SEQ ID NO: 227975 - DNA, 25 bp, Homo sapien
ctttcctggaataattgtctacctg

SEQ ID NO: 227976 - DNA, 25 bp, Homo sapien
gagagattacatagaggtgtccaaa

SEQ ID NO: 227977 - DNA, 25 bp, Homo sapien
tacatagaggtgtccaaaatgaaca

SEQ ID NO: 227978 - DNA, 25 bp, Homo sapien
atgaacacagtaaaaaccagttttg

SEQ ID NO: 227979 - DNA, 25 bp, Homo sapien
aaaccagttttgattaattctgcaa

SEQ ID NO: 227980 - DNA, 25 bp, Homo sapien
tgcaatattaagtaggcagccaaaa

SEQ ID NO: 227981 - DNA, 25 bp, Homo sapien
ttttggtctgcttaattcttagctc

SEQ ID NO: 227982 - DNA, 25 bp, Homo sapien
ttagctcatctaagtctccagttga

SEQ ID NO: 227983 - DNA, 25 bp, Homo sapien
gctcatctaagtctccagttgactg

SEQ ID NO: 227984 - DNA, 25 bp, Homo sapien
agtctccagttgactgattgattga

SEQ ID NO: 227985 - DNA, 25 bp, Homo sapien
gaatgacttattcaacatgcgctag

SEQ ID NO: 227986 - DNA, 25 bp, Homo sapien
gacttattcaacatgcgctagccag

SEQ ID NO: 227987 - DNA, 25 bp, Homo sapien
caggctgggagggacatactttcca

SEQ ID NO: 227988 - DNA, 25 bp, Homo sapien
atactttccataggacccagtgctt

SEQ ID NO: 227989 - DNA, 25 bp, Homo sapien
agtgctttcatctccgtgcaactga

SEQ ID NO: 227990 - DNA, 25 bp, Homo sapien
gtgcaactgaccaagagaaaccaaa

SEQ ID NO: 227991 - DNA, 25 bp, Homo sapien
cttcctttacacagacctatttgag

SEQ ID NO: 227992 - DNA, 25 bp, Homo sapien
acacagacctatttgagggaggctg

SEQ ID NO: 227993 - DNA, 25 bp, Homo sapien
tgtttgtgtatttcaacctaacaag

SEQ ID NO: 227994 - DNA, 25 bp, Homo sapien
gactcaagtgtcctgtcttttgcaa

SEQ ID NO: 227995 - DNA, 25 bp, Homo sapien
aagtgtcctgtcttttgcaaaaatg

SEQ ID NO: 227996 - DNA, 25 bp, Homo sapien
atgtcaaacgtagctactcagtctc

SEQ ID NO: 227997 - DNA, 25 bp, Homo sapien
agctactcagtctcttttttgtttt

SEQ ID NO: 227998 - DNA, 25 bp, Homo sapien
ctgctgaggcgttgacagcgcctga

SEQ ID NO: 227999 - DNA, 25 bp, Homo sapien
gaggatgctgggaggcccgctgtca

SEQ ID NO: 228000 - DNA, 25 bp, Homo sapien
gcgggaaccaatgcaagctctttca

SEQ ID NO: 228001 - DNA, 25 bp, Homo sapien
gaaccaatgcaagctctttcatcct

SEQ ID NO: 228002 - DNA, 25 bp, Homo sapien
aatgcaagctctttcatccttcatt

SEQ ID NO: 228003 - DNA, 25 bp, Homo sapien
tgcaagctctttcatccttcattac

SEQ ID NO: 228004 - DNA, 25 bp, Homo sapien
tttcatccttcattaccccagttac

SEQ ID NO: 228005 - DNA, 25 bp, Homo sapien
agagagagtcccatagaaggtcaga

SEQ ID NO: 228006 - DNA, 25 bp, Homo sapien
gtcccatagaaggtcagaggagtga

SEQ ID NO: 228007 - DNA, 25 bp, Homo sapien
gggagctccctaaatctcacctgga

SEQ ID NO: 228008 - DNA, 25 bp, Homo sapien
gagctccctaaatctcacctggact

SEQ ID NO: 228009 - DNA, 25 bp, Homo sapien
gaccctttgagtgtgtgaatagtaa

SEQ ID NO: 228010 - DNA, 25 bp, Homo sapien
taaaggctgtgataactgaaatgca

SEQ ID NO: 228011 - DNA, 25 bp, Homo sapien
aagggctaattagaagacttttgag

SEQ ID NO: 228012 - DNA, 25 bp, Homo sapien
tttgagacatgatttacctaaatgg

SEQ ID NO: 228013 - DNA, 25 bp, Homo sapien
gatttctgttcctcaaacaatttct

SEQ ID NO: 228014 - DNA, 25 bp, Homo sapien
aacaattatttgcatctattaagtg

SEQ ID NO: 228015 - DNA, 25 bp, Homo sapien
gcatctattaagtgtttgtagtcac

SEQ ID NO: 228016 - DNA, 25 bp, Homo sapien
gtgtttgtagtcactttgtataata

SEQ ID NO: 228017 - DNA, 25 bp, Homo sapien
gttggacaatgaaacatacctggac

SEQ ID NO: 228018 - DNA, 25 bp, Homo sapien
atgaaacatacctggaccctttgag

SEQ ID NO: 228019 - DNA, 25 bp, Homo sapien
tacctggaccctttgagtgtgtgaa

SEQ ID NO: 228020 - DNA, 25 bp, Homo sapien
gaaatttcttttcatcaacatgtag

SEQ ID NO: 228021 - DNA, 25 bp, Homo sapien
tcttttcatcaacatgtagagctgc

SEQ ID NO: 228022 - DNA, 25 bp, Homo sapien
gtagagctgctattttactatttgg

SEQ ID NO: 228023 - DNA, 25 bp, Homo sapien
ttggacctcaaagggtttccttgtg

SEQ ID NO: 228024 - DNA, 25 bp, Homo sapien
ccatcatcagtgagagtcttgagtt

SEQ ID NO: 228025 - DNA, 25 bp, Homo sapien
gagagtcttgagttcactaacattg

SEQ ID NO: 228026 - DNA, 25 bp, Homo sapien
gttcactaacattgtcaccttctgg

SEQ ID NO: 228027 - DNA, 25 bp, Homo sapien
aacattgtcaccttctggagagaga

SEQ ID NO: 228028 - DNA, 25 bp, Homo sapien
gtcaccttctggagagagagttaat

SEQ ID NO: 228029 - DNA, 25 bp, Homo sapien
acatgtgtttggtttctgattcaag

SEQ ID NO: 228030 - DNA, 25 bp, Homo sapien
gtttctgattcaagtgacacgcaca

SEQ ID NO: 228031 - DNA, 25 bp, Homo sapien
gaatcctgttagatagtgagcatct

SEQ ID NO: 228032 - DNA, 25 bp, Homo sapien
gtgagcatctgctgttagctagaca

SEQ ID NO: 228033 - DNA, 25 bp, Homo sapien
gctgttagctagacactgttgaatc

SEQ ID NO: 228034 - DNA, 25 bp, Homo sapien
acagacaggtaagcaggtggtttta

SEQ ID NO: 228035 - DNA, 25 bp, Homo sapien
ggtggttttaatgcctcattctaag

SEQ ID NO: 228036 - DNA, 25 bp, Homo sapien
ttgaaagatgaataaggcctgcctt

SEQ ID NO: 228037 - DNA, 25 bp, Homo sapien
aggcctgccttaagttctgctaaag

SEQ ID NO: 228038 - DNA, 25 bp, Homo sapien
tgaggaaggaccaagaagtctggct

SEQ ID NO: 228039 - DNA, 25 bp, Homo sapien
cagtgattgctggttgaattcttat

SEQ ID NO: 228040 - DNA, 25 bp, Homo sapien
tcttatatggacaggtttcccttcc

SEQ ID NO: 228041 - DNA, 25 bp, Homo sapien
cagtatcgcacatggttctagttag

SEQ ID NO: 228042 - DNA, 25 bp, Homo sapien
gggactaactcttgaaggcacagta

SEQ ID NO: 228043 - DNA, 25 bp, Homo sapien
aggcacagtattttgtctcgacccg

SEQ ID NO: 228044 - DNA, 25 bp, Homo sapien
cagtattttgtctcgacccgttaga

SEQ ID NO: 228045 - DNA, 25 bp, Homo sapien
attttgtctcgacccgttagacagt

SEQ ID NO: 228046 - DNA, 25 bp, Homo sapien
tctcgacccgttagacagtaggtgc

SEQ ID NO: 228047 - DNA, 25 bp, Homo sapien
acccgttagacagtaggtgctgaca

SEQ ID NO: 228048 - DNA, 25 bp, Homo sapien
gtaggtgctgacatcaagaacaaga

SEQ ID NO: 228049 - DNA, 25 bp, Homo sapien
gaacaagaaatcctgattcatgtta

SEQ ID NO: 228050 - DNA, 25 bp, Homo sapien
aagataggtattattcatgtgtcaa

SEQ ID NO: 228051 - DNA, 25 bp, Homo sapien
tttctcagttaaatttcctcacctt

SEQ ID NO: 228052 - DNA, 25 bp, Homo sapien
aaagtagatcatacttttatgttcc

SEQ ID NO: 228053 - DNA, 25 bp, Homo sapien
tgagcctgtctctgaattgttccct

SEQ ID NO: 228054 - DNA, 25 bp, Homo sapien
cgcaatgtgggcacttaccatgttc

SEQ ID NO: 228055 - DNA, 25 bp, Homo sapien
cacttaccatgttcctggcacactg

SEQ ID NO: 228056 - DNA, 25 bp, Homo sapien
agtcctcttgctgcccatggttcat

SEQ ID NO: 228057 - DNA, 25 bp, Homo sapien
tgctgcccatggttcataggtcata

SEQ ID NO: 228058 - DNA, 25 bp, Homo sapien
gttcataggtcatagaaggcagcaa

SEQ ID NO: 228059 - DNA, 25 bp, Homo sapien
aggcagcaatgcactgactgggcca

SEQ ID NO: 228060 - DNA, 25 bp, Homo sapien
gactgggccacatcttgaaaactcg

SEQ ID NO: 228061 - DNA, 25 bp, Homo sapien
ttgaccacacacagtgatgcctcac

SEQ ID NO: 228062 - DNA, 25 bp, Homo sapien
tgatgcctcacaccctgaaggtggg

SEQ ID NO: 228063 - DNA, 25 bp, Homo sapien
ggattttgtacctgtttgtacaact

SEQ ID NO: 228064 - DNA, 25 bp, Homo sapien
aacttctcctcaagggaggttgctc

SEQ ID NO: 228065 - DNA, 25 bp, Homo sapien
tggagggcttgcacagaccagcagt

SEQ ID NO: 228066 - DNA, 25 bp, Homo sapien
aatcattcttcctgctgtactgggc

SEQ ID NO: 228067 - DNA, 25 bp, Homo sapien
tgtactgggccttaactgcctgcaa

SEQ ID NO: 228068 - DNA, 25 bp, Homo sapien
ttaactgcctgcaaatgtccagcac

SEQ ID NO: 228069 - DNA, 25 bp, Homo sapien
aatgtccagcactactgcataggat

SEQ ID NO: 228070 - DNA, 25 bp, Homo sapien
ataggatgccagagccaccgaagga

SEQ ID NO: 228071 - DNA, 25 bp, Homo sapien
ggaaaaatctcagcctgcagaactc

SEQ ID NO: 228072 - DNA, 25 bp, Homo sapien
tggttttgacccaccatcggccaga

SEQ ID NO: 228073 - DNA, 25 bp, Homo sapien
agatgcacatcttcagggcctgttg

SEQ ID NO: 228074 - DNA, 25 bp, Homo sapien
ggcctgttgagcaccttctgaaaag

SEQ ID NO: 228075 - DNA, 25 bp, Homo sapien
ctttgcctttgagaaagttcaagaa

SEQ ID NO: 228076 - DNA, 25 bp, Homo sapien
gaactatggttggtcacgtctatct

SEQ ID NO: 228077 - DNA, 25 bp, Homo sapien
gttggtcacgtctatctacaaccta

SEQ ID NO: 228078 - DNA, 25 bp, Homo sapien
tctacaacctaatcctactctttgg

SEQ ID NO: 228079 - DNA, 25 bp, Homo sapien
tctttggtagtctctgcagcagcca

SEQ ID NO: 228080 - DNA, 25 bp, Homo sapien
gcagccacagccttagcagagctgg

SEQ ID NO: 228081 - DNA, 25 bp, Homo sapien
gttcctgtcttctgcacacgattga

SEQ ID NO: 228082 - DNA, 25 bp, Homo sapien
tctgcacacgattgactttcttgat

SEQ ID NO: 228083 - DNA, 25 bp, Homo sapien
taccaacagtggatcagctgggttt

SEQ ID NO: 228084 - DNA, 25 bp, Homo sapien
gttttggccaggaagttgtctttgt

SEQ ID NO: 228085 - DNA, 25 bp, Homo sapien
gactctgcctgcatggcttagtagt

SEQ ID NO: 228086 - DNA, 25 bp, Homo sapien
gaacatgtccacctcgctgcggaag

SEQ ID NO: 228087 - DNA, 25 bp, Homo sapien
aagccgcgggacgtggaatactcca

SEQ ID NO: 228088 - DNA, 25 bp, Homo sapien
tggaatactccaccagcatgttggc

SEQ ID NO: 228089 - DNA, 25 bp, Homo sapien
atactccaccagcatgttggcacag

SEQ ID NO: 228090 - DNA, 25 bp, Homo sapien
tccccgtccgctgagtgcagaaaat

SEQ ID NO: 228091 - DNA, 25 bp, Homo sapien
gaaaatgatacctcgactcacaata

SEQ ID NO: 228092 - DNA, 25 bp, Homo sapien
atgatacctcgactcacaatagttt

SEQ ID NO: 228093 - DNA, 25 bp, Homo sapien
atagttttgttctttccacagggtg

SEQ ID NO: 228094 - DNA, 25 bp, Homo sapien
actggaccacttcagggctctggac

SEQ ID NO: 228095 - DNA, 25 bp, Homo sapien
ttcagggctctggacacaaaggtca

SEQ ID NO: 228096 - DNA, 25 bp, Homo sapien
gacacaaaggtcacgcgctcaggag

SEQ ID NO: 228097 - DNA, 25 bp, Homo sapien
agattcttctggtcacagcatgggc

SEQ ID NO: 228098 - DNA, 25 bp, Homo sapien
agcatgggccttactggatactcag

SEQ ID NO: 228099 - DNA, 25 bp, Homo sapien
gggccttactggatactcaggattg

SEQ ID NO: 228100 - DNA, 25 bp, Homo sapien
ttgggctttaagcagacctctgggt

SEQ ID NO: 228101 - DNA, 25 bp, Homo sapien
aagcagacctctgggtgtgacacag

SEQ ID NO: 228102 - DNA, 25 bp, Homo sapien
tctgggtgtgacacagcctctttca

SEQ ID NO: 228103 - DNA, 25 bp, Homo sapien
caaattggagagtatatcttgctat

SEQ ID NO: 228104 - DNA, 25 bp, Homo sapien
ttgctatactctataccaagcctct

SEQ ID NO: 228105 - DNA, 25 bp, Homo sapien
tataccaagcctctttctagaattt

SEQ ID NO: 228106 - DNA, 25 bp, Homo sapien
tttggcttaactcagaaccatggtg

SEQ ID NO: 228107 - DNA, 25 bp, Homo sapien
catggtgagcgttctgctttgtttt

SEQ ID NO: 228108 - DNA, 25 bp, Homo sapien
aagtcacctacccttaagaggatca

SEQ ID NO: 228109 - DNA, 25 bp, Homo sapien
ctacccttaagaggatcatgctctg

SEQ ID NO: 228110 - DNA, 25 bp, Homo sapien
aacaaagctctcatgataaatgtgt

SEQ ID NO: 228111 - DNA, 25 bp, Homo sapien
gagtgtattactattgttgtctgtt

SEQ ID NO: 228112 - DNA, 25 bp, Homo sapien
gtattactattgttgtctgttctga

SEQ ID NO: 228113 - DNA, 25 bp, Homo sapien
actattgttgtctgttctgaacaca

SEQ ID NO: 228114 - DNA, 25 bp, Homo sapien
tgtctgttctgaacacattatcttc

SEQ ID NO: 228115 - DNA, 25 bp, Homo sapien
ggatataggtgctacttaggtttca

SEQ ID NO: 228116 - DNA, 25 bp, Homo sapien
aggtgctacttaggtttcactttca

SEQ ID NO: 228117 - DNA, 25 bp, Homo sapien
gctacttaggtttcactttcatata

SEQ ID NO: 228118 - DNA, 25 bp, Homo sapien
actagtaagataagcaaattggtgt

SEQ ID NO: 228119 - DNA, 25 bp, Homo sapien
gactttgtccaaacctcggctggaa

SEQ ID NO: 228120 - DNA, 25 bp, Homo sapien
ctggaaggctggtcttggcactcga

SEQ ID NO: 228121 - DNA, 25 bp, Homo sapien
ggcactcgacgtcttagctagtgga

SEQ ID NO: 228122 - DNA, 25 bp, Homo sapien
gatgacttgggtctcaatccttgga

SEQ ID NO: 228123 - DNA, 25 bp, Homo sapien
ggtctcaatccttggagcagctgaa

SEQ ID NO: 228124 - DNA, 25 bp, Homo sapien
acagctcgggccacctgtggatgca

SEQ ID NO: 228125 - DNA, 25 bp, Homo sapien
ggatgcacccacaatgaaatcagag

SEQ ID NO: 228126 - DNA, 25 bp, Homo sapien
agtggcctgcagttttaactcgggc

SEQ ID NO: 228127 - DNA, 25 bp, Homo sapien
taactcgggcactatggcaatgcag

SEQ ID NO: 228128 - DNA, 25 bp, Homo sapien
agacccaaaccaattgtgccagttc

SEQ ID NO: 228129 - DNA, 25 bp, Homo sapien
gtgccagttctttgctgggtggcaa

SEQ ID NO: 228130 - DNA, 25 bp, Homo sapien
atacaaaaatcatcccagtttggtg

SEQ ID NO: 228131 - DNA, 25 bp, Homo sapien
tacaaaaatcatcccagtttggtgg

SEQ ID NO: 228132 - DNA, 25 bp, Homo sapien
caaaaatcatcccagtttggtggtg

SEQ ID NO: 228133 - DNA, 25 bp, Homo sapien
aaaaatcatcccagtttggtggtgc

SEQ ID NO: 228134 - DNA, 25 bp, Homo sapien
aaaatcatcccagtttggtggtgca

SEQ ID NO: 228135 - DNA, 25 bp, Homo sapien
aaatcatcccagtttggtggtgcac

SEQ ID NO: 228136 - DNA, 25 bp, Homo sapien
aatcatcccagtttggtggtgcaca

SEQ ID NO: 228137 - DNA, 25 bp, Homo sapien
tggtgcacaccagtaaacccaacaa

SEQ ID NO: 228138 - DNA, 25 bp, Homo sapien
agatcacaccacttgacttcaacct

SEQ ID NO: 228139 - DNA, 25 bp, Homo sapien
tcacaccacttgacttcaacctggg

SEQ ID NO: 228140 - DNA, 25 bp, Homo sapien
acaccacttgacttcaacctgggcg

SEQ ID NO: 228141 - DNA, 25 bp, Homo sapien
tcaagggacacaaggctgggtgcct

SEQ ID NO: 228142 - DNA, 25 bp, Homo sapien
tgggtgcctgcctgtgcgcacctca

SEQ ID NO: 228143 - DNA, 25 bp, Homo sapien
tgcctgtgcgcacctcagggcagag

SEQ ID NO: 228144 - DNA, 25 bp, Homo sapien
ggcagaggaccgacatgggaccctg

SEQ ID NO: 228145 - DNA, 25 bp, Homo sapien
ctgtagggccagtgacaagctcact

SEQ ID NO: 228146 - DNA, 25 bp, Homo sapien
gtgacaagctcactgaacctcccga

SEQ ID NO: 228147 - DNA, 25 bp, Homo sapien
aagctcactgaacctcccgagggtc

SEQ ID NO: 228148 - DNA, 25 bp, Homo sapien
tgaacctcccgagggtcctctggaa

SEQ ID NO: 228149 - DNA, 25 bp, Homo sapien
tcccgagggtcctctggaacgtttg

SEQ ID NO: 228150 - DNA, 25 bp, Homo sapien
gacttcactccacgtccaggactgt

SEQ ID NO: 228151 - DNA, 25 bp, Homo sapien
ttcgactgaggcctatgctgggata

SEQ ID NO: 228152 - DNA, 25 bp, Homo sapien
gttctgcaaatagtgtgtgtcttat

SEQ ID NO: 228153 - DNA, 25 bp, Homo sapien
tactgttgaacagcaattgctattt

SEQ ID NO: 228154 - DNA, 25 bp, Homo sapien
attgcctagaacttcaacatgttgt

SEQ ID NO: 228155 - DNA, 25 bp, Homo sapien
ataggaatcctgtagtgccactagt

SEQ ID NO: 228156 - DNA, 25 bp, Homo sapien
gtagtgccactagttaaatgccgaa

SEQ ID NO: 228157 - DNA, 25 bp, Homo sapien
aaatgccgaattctcatctggatgt

SEQ ID NO: 228158 - DNA, 25 bp, Homo sapien
tctcatctggatgttaccatcaaac

SEQ ID NO: 228159 - DNA, 25 bp, Homo sapien
gttaccatcaaacatcagtacactt

SEQ ID NO: 228160 - DNA, 25 bp, Homo sapien
atcagtacacttgtcatttcacatg

SEQ ID NO: 228161 - DNA, 25 bp, Homo sapien
cacttgtcatttcacatgtgtttaa

SEQ ID NO: 228162 - DNA, 25 bp, Homo sapien
gacagtttttcagtactgtatgtgt

SEQ ID NO: 228163 - DNA, 25 bp, Homo sapien
ggaaagactctctcagctttgtgta

SEQ ID NO: 228164 - DNA, 25 bp, Homo sapien
gactctctcagctttgtgtaacaac

SEQ ID NO: 228165 - DNA, 25 bp, Homo sapien
ctttgtgtaacaactgtcagggtga

SEQ ID NO: 228166 - DNA, 25 bp, Homo sapien
caactgtcagggtgaattagctttt

SEQ ID NO: 228167 - DNA, 25 bp, Homo sapien
tgcccacttaccttttttcctgtat

SEQ ID NO: 228168 - DNA, 25 bp, Homo sapien
cacttaccttttttcctgtatcttg

SEQ ID NO: 228169 - DNA, 25 bp, Homo sapien
ttaccttttttcctgtatcttgcta

SEQ ID NO: 228170 - DNA, 25 bp, Homo sapien
cctgtatcttgctaatttggcatga

SEQ ID NO: 228171 - DNA, 25 bp, Homo sapien
tttggcatgaagatttttgttcttt

SEQ ID NO: 228172 - DNA, 25 bp, Homo sapien
ggagataacattttcccctaccagc

SEQ ID NO: 228173 - DNA, 25 bp, Homo sapien
taacattttcccctaccagccttgt

SEQ ID NO: 228174 - DNA, 25 bp, Homo sapien
ccaagagaagttttaggatttagtg

SEQ ID NO: 228175 - DNA, 25 bp, Homo sapien
atctttttggaattacattgctttg

SEQ ID NO: 228176 - DNA, 25 bp, Homo sapien
ttatactgcataaataccccgagga

SEQ ID NO: 228177 - DNA, 25 bp, Homo sapien
atactgcataaataccccgaggatc

SEQ ID NO: 228178 - DNA, 25 bp, Homo sapien
actgcataaataccccgaggatctt

SEQ ID NO: 228179 - DNA, 25 bp, Homo sapien
gttgtatcaaacctatgtcccttcc

SEQ ID NO: 228180 - DNA, 25 bp, Homo sapien
ttgtatcaaacctatgtcccttcct

SEQ ID NO: 228181 - DNA, 25 bp, Homo sapien
cagaaaatggacaaggtgaaggcaa

SEQ ID NO: 228182 - DNA, 25 bp, Homo sapien
ttcttacaagggtaaccaatgtaat

SEQ ID NO: 228183 - DNA, 25 bp, Homo sapien
gggtaaccaatgtaatggtcttgag

SEQ ID NO: 228184 - DNA, 25 bp, Homo sapien
ggtcttgagacatggaaattgtttc

SEQ ID NO: 228185 - DNA, 25 bp, Homo sapien
cttacggcggcatgccaggtagtgt

SEQ ID NO: 228186 - DNA, 25 bp, Homo sapien
gccaggtagtgtgtgtattctccca

SEQ ID NO: 228187 - DNA, 25 bp, Homo sapien
aggtagtgtgtgtattctcccaggc

SEQ ID NO: 228188 - DNA, 25 bp, Homo sapien
agtgtgtgtattctcccaggcactc

SEQ ID NO: 228189 - DNA, 25 bp, Homo sapien
ttcatagtcaccctctaaccacgtg

SEQ ID NO: 228190 - DNA, 25 bp, Homo sapien
taaccacgtgacattccgttccatg

SEQ ID NO: 228191 - DNA, 25 bp, Homo sapien
acattccgttccatgctaagcagta

SEQ ID NO: 228192 - DNA, 25 bp, Homo sapien
gctaagcagtattcacaggcctaaa

SEQ ID NO: 228193 - DNA, 25 bp, Homo sapien
gcagtattcacaggcctaaaatagg

SEQ ID NO: 228194 - DNA, 25 bp, Homo sapien
aaaataggtttgtatggtgatctac

SEQ ID NO: 228195 - DNA, 25 bp, Homo sapien
gtatggtgatctacaagattttaca

SEQ ID NO: 228196 - DNA, 25 bp, Homo sapien
gagcaagatctgtttatcaggatca

SEQ ID NO: 228197 - DNA, 25 bp, Homo sapien
atcaggatcacttttgataagcaca

SEQ ID NO: 228198 - DNA, 25 bp, Homo sapien
gaagtcatgccggatacgtttctac

SEQ ID NO: 228199 - DNA, 25 bp, Homo sapien
gatacgtttctactttaattccatg

SEQ ID NO: 228200 - DNA, 25 bp, Homo sapien
attccatgacccaaatccatgctag

SEQ ID NO: 228201 - DNA, 25 bp, Homo sapien
aatccatgctagttgagaatacgta

SEQ ID NO: 228202 - DNA, 25 bp, Homo sapien
gtagaaaaccatctgctcaaaccct

SEQ ID NO: 228203 - DNA, 25 bp, Homo sapien
catctgctcaaacccttaagtcttc

SEQ ID NO: 228204 - DNA, 25 bp, Homo sapien
aagtcttcaattcttgctgctatga

SEQ ID NO: 228205 - DNA, 25 bp, Homo sapien
gaagttgcagcaaacctcgtccaag

SEQ ID NO: 228206 - DNA, 25 bp, Homo sapien
agcaaacctcgtccaaggagacaaa

SEQ ID NO: 228207 - DNA, 25 bp, Homo sapien
tacctgcatacagtaggcactcact

SEQ ID NO: 228208 - DNA, 25 bp, Homo sapien
catacagtaggcactcactgctgga

SEQ ID NO: 228209 - DNA, 25 bp, Homo sapien
cactgctggagtgaggcactgactc

SEQ ID NO: 228210 - DNA, 25 bp, Homo sapien
agccgggaacgctttcgctccagct

SEQ ID NO: 228211 - DNA, 25 bp, Homo sapien
atctccctatttctgcatcctggtg

SEQ ID NO: 228212 - DNA, 25 bp, Homo sapien
tgcatcctggtgaccgtcagcaaga

SEQ ID NO: 228213 - DNA, 25 bp, Homo sapien
tgaccgtcagcaagagatgagtcgg

SEQ ID NO: 228214 - DNA, 25 bp, Homo sapien
gggagaccctctcctggagttctag

SEQ ID NO: 228215 - DNA, 25 bp, Homo sapien
tcctggagttctagcccctaattct

SEQ ID NO: 228216 - DNA, 25 bp, Homo sapien
agaccgttagtctctctttgcctgg

SEQ ID NO: 228217 - DNA, 25 bp, Homo sapien
tttgcctggctgactacctgcatac

SEQ ID NO: 228218 - DNA, 25 bp, Homo sapien
gaggtcaaggatgcattccaggaaa

SEQ ID NO: 228219 - DNA, 25 bp, Homo sapien
ggatgcattccaggaaagttctata

SEQ ID NO: 228220 - DNA, 25 bp, Homo sapien
aaatataccatcaactccaacctga

SEQ ID NO: 228221 - DNA, 25 bp, Homo sapien
aactccaacctgatatttgacctag

SEQ ID NO: 228222 - DNA, 25 bp, Homo sapien
aacctgatatttgacctagccatgg

SEQ ID NO: 228223 - DNA, 25 bp, Homo sapien
gacctagccatggaaaacctcattg

SEQ ID NO: 228224 - DNA, 25 bp, Homo sapien
catggaaaacctcattggctcctca

SEQ ID NO: 228225 - DNA, 25 bp, Homo sapien
attggctcctcactggatcagacca

SEQ ID NO: 228226 - DNA, 25 bp, Homo sapien
gctcctcactggatcagaccataaa

SEQ ID NO: 228227 - DNA, 25 bp, Homo sapien
aaatctaagataaattcccaccact

SEQ ID NO: 228228 - DNA, 25 bp, Homo sapien
aattcccaccacttcaagatgttct

SEQ ID NO: 228229 - DNA, 25 bp, Homo sapien
gaaagactagcagtttgacctgtta

SEQ ID NO: 228230 - DNA, 25 bp, Homo sapien
ctagcagtttgacctgttaaacagg

SEQ ID NO: 228231 - DNA, 25 bp, Homo sapien
aaacaggactagttcaagtcaagaa

SEQ ID NO: 228232 - DNA, 25 bp, Homo sapien
gaaactaaggttgttgtatacacct

SEQ ID NO: 228233 - DNA, 25 bp, Homo sapien
cacctggaggcatctgttattcagc

SEQ ID NO: 228234 - DNA, 25 bp, Homo sapien
ctggaggcatctgttattcagctta

SEQ ID NO: 228235 - DNA, 25 bp, Homo sapien
tgggtatttggcacaatgaggataa

SEQ ID NO: 228236 - DNA, 25 bp, Homo sapien
aggataaacttatgtgacccacttg

SEQ ID NO: 228237 - DNA, 25 bp, Homo sapien
gtgacccacttgaatggctgatcta

SEQ ID NO: 228238 - DNA, 25 bp, Homo sapien
tggctgatctaataatgttgacatt

SEQ ID NO: 228239 - DNA, 25 bp, Homo sapien
gacattatgcattctgtacttagtg

SEQ ID NO: 228240 - DNA, 25 bp, Homo sapien
aagagaataggctttgtcatcaaac

SEQ ID NO: 228241 - DNA, 25 bp, Homo sapien
gtcatcaaacttgggtcctaaccct

SEQ ID NO: 228242 - DNA, 25 bp, Homo sapien
taccacttagtagctatgcaacttt

SEQ ID NO: 228243 - DNA, 25 bp, Homo sapien
gctatgcaactttcagcaagctact

SEQ ID NO: 228244 - DNA, 25 bp, Homo sapien
agcaagctacttaactctacaagct

SEQ ID NO: 228245 - DNA, 25 bp, Homo sapien
ctggcacacaactgtactcaataga

SEQ ID NO: 228246 - DNA, 25 bp, Homo sapien
gtactcaatagattttcaggtattt

SEQ ID NO: 228247 - DNA, 25 bp, Homo sapien
acaacgaaattcattgagctagatt

SEQ ID NO: 228248 - DNA, 25 bp, Homo sapien
gattaaaaatcttactcataaccat

SEQ ID NO: 228249 - DNA, 25 bp, Homo sapien
tactcataaccatacttaagcctat

SEQ ID NO: 228250 - DNA, 25 bp, Homo sapien
aaccatacttaagcctatattttag

SEQ ID NO: 228251 - DNA, 25 bp, Homo sapien
tcttcctccgcctggagtctgctct

SEQ ID NO: 228252 - DNA, 25 bp, Homo sapien
tcgtcctcgtacagctgcaccgtct

SEQ ID NO: 228253 - DNA, 25 bp, Homo sapien
acgactcggccaccagcagtgcgta

SEQ ID NO: 228254 - DNA, 25 bp, Homo sapien
gactcggccaccagcagtgcgtagc

SEQ ID NO: 228255 - DNA, 25 bp, Homo sapien
ggacctgccgctcctcggcctgtat

SEQ ID NO: 228256 - DNA, 25 bp, Homo sapien
tcggccaccagcagtgcgtagctgt

SEQ ID NO: 228257 - DNA, 25 bp, Homo sapien
accagcagtgcgtagctgtcgtgca

SEQ ID NO: 228258 - DNA, 25 bp, Homo sapien
agcagtgcgtagctgtcgtgcacct

SEQ ID NO: 228259 - DNA, 25 bp, Homo sapien
agtgcgtagctgtcgtgcacctccc

SEQ ID NO: 228260 - DNA, 25 bp, Homo sapien
gtagctgtcgtgcacctcccgcagg

SEQ ID NO: 228261 - DNA, 25 bp, Homo sapien
gcgcgcagctgctccaacccgagcg

SEQ ID NO: 228262 - DNA, 25 bp, Homo sapien
atgcaagtttagacaagtggattta

SEQ ID NO: 228263 - DNA, 25 bp, Homo sapien
ttatactgtcttatgagtgcccgcc

SEQ ID NO: 228264 - DNA, 25 bp, Homo sapien
tgtcttatgagtgcccgcccctgat

SEQ ID NO: 228265 - DNA, 25 bp, Homo sapien
gcccctgatatattacctcattatg

SEQ ID NO: 228266 - DNA, 25 bp, Homo sapien
tatctttcatgactattttgacaaa

SEQ ID NO: 228267 - DNA, 25 bp, Homo sapien
atttcaggaaccaaggactgccaga

SEQ ID NO: 228268 - DNA, 25 bp, Homo sapien
ctgccagaaaatattagcctctaca

SEQ ID NO: 228269 - DNA, 25 bp, Homo sapien
ttagcctctacattacgcatgcatt

SEQ ID NO: 228270 - DNA, 25 bp, Homo sapien
acgcatgcatttagaagcttacctg

SEQ ID NO: 228271 - DNA, 25 bp, Homo sapien
agcttacctgaaatctgccttttat

SEQ ID NO: 228272 - DNA, 25 bp, Homo sapien
acattttttaaacttgattgccatt

SEQ ID NO: 228273 - DNA, 25 bp, Homo sapien
ttttagcatgatccgacccagttgt

SEQ ID NO: 228274 - DNA, 25 bp, Homo sapien
gacccagttgttttcttgactttgt

SEQ ID NO: 228275 - DNA, 25 bp, Homo sapien
tacaaggttcatatactcatcaaaa

SEQ ID NO: 228276 - DNA, 25 bp, Homo sapien
atgatacagccttctatccgcatat

SEQ ID NO: 228277 - DNA, 25 bp, Homo sapien
tccgcatattcacttgctcatagag

SEQ ID NO: 228278 - DNA, 25 bp, Homo sapien
atagagccacacctgaatccgcgat

SEQ ID NO: 228279 - DNA, 25 bp, Homo sapien
tatccttctcaacaatttctcactt

SEQ ID NO: 228280 - DNA, 25 bp, Homo sapien
gaatccgcgatctattttgtaagta

SEQ ID NO: 228281 - DNA, 25 bp, Homo sapien
ggttgatgggctgcaccataacctt

SEQ ID NO: 228282 - DNA, 25 bp, Homo sapien
gatcatttctagttggagacacttt

SEQ ID NO: 228283 - DNA, 25 bp, Homo sapien
gagtaatattatctccttttagcat

SEQ ID NO: 228284 - DNA, 25 bp, Homo sapien
ataaaccttgcatgacaaacctgca

SEQ ID NO: 228285 - DNA, 25 bp, Homo sapien
tttaagcaattgcttcctcagtgtc

SEQ ID NO: 228286 - DNA, 25 bp, Homo sapien
agggcacatgtgaatttccacacca

SEQ ID NO: 228287 - DNA, 25 bp, Homo sapien
gaatttccacaccaaacagagcatg

SEQ ID NO: 228288 - DNA, 25 bp, Homo sapien
cagagcatgaggaaccagttgacat

SEQ ID NO: 228289 - DNA, 25 bp, Homo sapien
agctttagcagcctcggtactgaag

SEQ ID NO: 228290 - DNA, 25 bp, Homo sapien
aagccacaccagtgtccggatggaa

SEQ ID NO: 228291 - DNA, 25 bp, Homo sapien
ggaagtctgcatctgaggttgctca

SEQ ID NO: 228292 - DNA, 25 bp, Homo sapien
tgaggttgctcagtgtcccggtcat

SEQ ID NO: 228293 - DNA, 25 bp, Homo sapien
tcagtgtcccggtcattcatttaca

SEQ ID NO: 228294 - DNA, 25 bp, Homo sapien
ttttctgtggcctagactcttttca

SEQ ID NO: 228295 - DNA, 25 bp, Homo sapien
ggattactccagagagctgcagcca

SEQ ID NO: 228296 - DNA, 25 bp, Homo sapien
gcagccagaactgtttatctcctga

SEQ ID NO: 228297 - DNA, 25 bp, Homo sapien
atctcctgagatatggactttctct

SEQ ID NO: 228298 - DNA, 25 bp, Homo sapien
ttaggtgttttctggttggttgctc

SEQ ID NO: 228299 - DNA, 25 bp, Homo sapien
ttggttgctcccttttctgatccta

SEQ ID NO: 228300 - DNA, 25 bp, Homo sapien
ttttctgatcctactactggcctct

SEQ ID NO: 228301 - DNA, 25 bp, Homo sapien
ggaagcgctctcatgcaggatctga

SEQ ID NO: 228302 - DNA, 25 bp, Homo sapien
ggatctgagggctttgctagaccat

SEQ ID NO: 228303 - DNA, 25 bp, Homo sapien
agggctttgctagaccatggttcaa

SEQ ID NO: 228304 - DNA, 25 bp, Homo sapien
ccatggttcaaggagtcagaatctt

SEQ ID NO: 228305 - DNA, 25 bp, Homo sapien
agaatcttggctaccctacatgctc

SEQ ID NO: 228306 - DNA, 25 bp, Homo sapien
ctctgggatgggagtcggacctaca

SEQ ID NO: 228307 - DNA, 25 bp, Homo sapien
ggagtcggacctacataccaagtga

SEQ ID NO: 228308 - DNA, 25 bp, Homo sapien
ggacctacataccaagtgacaagtt

SEQ ID NO: 228309 - DNA, 25 bp, Homo sapien
gtgacaagttcaccttaacatctgc

SEQ ID NO: 228310 - DNA, 25 bp, Homo sapien
ttcaccttaacatctgcttccagaa

SEQ ID NO: 228311 - DNA, 25 bp, Homo sapien
gccgtgccaggcaacagaacagggt

SEQ ID NO: 228312 - DNA, 25 bp, Homo sapien
agaacagggtcagactcctgctctg

SEQ ID NO: 228313 - DNA, 25 bp, Homo sapien
actcctgctctgttattggcttgaa

SEQ ID NO: 228314 - DNA, 25 bp, Homo sapien
tattggcttgaagactaggatccca

SEQ ID NO: 228315 - DNA, 25 bp, Homo sapien
tgtgaaagactgatttaccatgtac

SEQ ID NO: 228316 - DNA, 25 bp, Homo sapien
gattgtgaacgttgttgagtaaacc

SEQ ID NO: 228317 - DNA, 25 bp, Homo sapien
aataagtatgctgctttaaggcaag

SEQ ID NO: 228318 - DNA, 25 bp, Homo sapien
gctttaaggcaagtgggcatccatc

SEQ ID NO: 228319 - DNA, 25 bp, Homo sapien
aggcaagtgggcatccatcagttaa

SEQ ID NO: 228320 - DNA, 25 bp, Homo sapien
gtgggcatccatcagttaagagact

SEQ ID NO: 228321 - DNA, 25 bp, Homo sapien
gcatccatcagttaagagactcaaa

SEQ ID NO: 228322 - DNA, 25 bp, Homo sapien
ttaacattttgggtgaagtggaagc

SEQ ID NO: 228323 - DNA, 25 bp, Homo sapien
ttggaaagggtgattcttgacaaat

SEQ ID NO: 228324 - DNA, 25 bp, Homo sapien
cttgacaaatggtagtgaacttcac

SEQ ID NO: 228325 - DNA, 25 bp, Homo sapien
atttcatttcaattactcatgtaag

SEQ ID NO: 228326 - DNA, 25 bp, Homo sapien
actcatgtaagggtttcgctgtaaa

SEQ ID NO: 228327 - DNA, 25 bp, Homo sapien
atgtaagggtttcgctgtaaaatct

SEQ ID NO: 228328 - DNA, 25 bp, Homo sapien
ttacaccttgggaccagtgtacctt

SEQ ID NO: 228329 - DNA, 25 bp, Homo sapien
ttgggaccagtgtaccttctcgtgc

SEQ ID NO: 228330 - DNA, 25 bp, Homo sapien
accagtgtaccttctcgtgcagaat

SEQ ID NO: 228331 - DNA, 25 bp, Homo sapien
gtgtaccttctcgtgcagaatacat

SEQ ID NO: 228332 - DNA, 25 bp, Homo sapien
ccttctcgtgcagaatacatttaga

SEQ ID NO: 228333 - DNA, 25 bp, Homo sapien
gacgttattaatacattgcacagtt

SEQ ID NO: 228334 - DNA, 25 bp, Homo sapien
ctgctacatgaacggtcccagccga

SEQ ID NO: 228335 - DNA, 25 bp, Homo sapien
atgaacggtcccagccgaggcccag

SEQ ID NO: 228336 - DNA, 25 bp, Homo sapien
ttttttgcactgagtttcagcagag

SEQ ID NO: 228337 - DNA, 25 bp, Homo sapien
atgactcttaaagctttacaccttg

SEQ ID NO: 228338 - DNA, 25 bp, Homo sapien
taaagctttacaccttgggaccagt

SEQ ID NO: 228339 - DNA, 25 bp, Homo sapien
gttgacagaggcatgtccatttgtc

SEQ ID NO: 228340 - DNA, 25 bp, Homo sapien
gccaaaaattaaagctgtccatatg

SEQ ID NO: 228341 - DNA, 25 bp, Homo sapien
aaagctgtccatatggaggcatgta

SEQ ID NO: 228342 - DNA, 25 bp, Homo sapien
gaggcatgtagtggacaacttgaga

SEQ ID NO: 228343 - DNA, 25 bp, Homo sapien
tgagaaggccatttgtaaatctgtt

SEQ ID NO: 228344 - DNA, 25 bp, Homo sapien
gtaaatctgttcttagcaacggtga

SEQ ID NO: 228345 - DNA, 25 bp, Homo sapien
tctgttcttagcaacggtgatgcca

SEQ ID NO: 228346 - DNA, 25 bp, Homo sapien
atataatcgtgcatacttacagttg

SEQ ID NO: 228347 - DNA, 25 bp, Homo sapien
gcatacttacagttgtgacacctgg

SEQ ID NO: 228348 - DNA, 25 bp, Homo sapien
gtgacacctggataacgtcagttat

SEQ ID NO: 228349 - DNA, 25 bp, Homo sapien
gtgattattcacatcagcaatgagc

SEQ ID NO: 228350 - DNA, 25 bp, Homo sapien
agcattcctgactcgtaactctcat

SEQ ID NO: 228351 - DNA, 25 bp, Homo sapien
gtaactctcatagtccttgttccag

SEQ ID NO: 228352 - DNA, 25 bp, Homo sapien
gtccttgttccagtctttgttagaa

SEQ ID NO: 228353 - DNA, 25 bp, Homo sapien
agaatactgggtatgttagggcttg

SEQ ID NO: 228354 - DNA, 25 bp, Homo sapien
ggacaggcctctgacctctgggtat

SEQ ID NO: 228355 - DNA, 25 bp, Homo sapien
ctctgggtatcctttcactaatgtt

SEQ ID NO: 228356 - DNA, 25 bp, Homo sapien
ttcactaatgttcgcccaccttttt

SEQ ID NO: 228357 - DNA, 25 bp, Homo sapien
gagtgcttaggagtaacttgtttct

SEQ ID NO: 228358 - DNA, 25 bp, Homo sapien
gaccttcccatgagagggtctcaat

SEQ ID NO: 228359 - DNA, 25 bp, Homo sapien
gtaacttgtttctaacacctgtgtg

SEQ ID NO: 228360 - DNA, 25 bp, Homo sapien
ccaatgctgggtgtggtgttatgat

SEQ ID NO: 228361 - DNA, 25 bp, Homo sapien
acccgcgtatatggagggcctgcta

SEQ ID NO: 228362 - DNA, 25 bp, Homo sapien
gagggcctgctacatagagaagact

SEQ ID NO: 228363 - DNA, 25 bp, Homo sapien
gaagactgagggatattctgtgcat

SEQ ID NO: 228364 - DNA, 25 bp, Homo sapien
atattctgtgcatccgtttctacgg

SEQ ID NO: 228365 - DNA, 25 bp, Homo sapien
gtttctacggatcctctaaatcggc

SEQ ID NO: 228366 - DNA, 25 bp, Homo sapien
aatcggcctttgttttcagccagga

SEQ ID NO: 228367 - DNA, 25 bp, Homo sapien
agccaggatttagtgcccagctgtg

SEQ ID NO: 228368 - DNA, 25 bp, Homo sapien
agtgcccagctgtgtcctttggagg

SEQ ID NO: 228369 - DNA, 25 bp, Homo sapien
ggaggccccacatggagctagcaaa

SEQ ID NO: 228370 - DNA, 25 bp, Homo sapien
atcgggttttgcaagaggactgtct

SEQ ID NO: 228371 - DNA, 25 bp, Homo sapien
gactgtctgctccatactgggagta

SEQ ID NO: 228372 - DNA, 25 bp, Homo sapien
aaagatcatacattttctacctatg

SEQ ID NO: 228373 - DNA, 25 bp, Homo sapien
tttctacctatgaattttgctgcat

SEQ ID NO: 228374 - DNA, 25 bp, Homo sapien
tttgctgcatacagaaagtgccctt

SEQ ID NO: 228375 - DNA, 25 bp, Homo sapien
gcatacagaaagtgccctttcctca

SEQ ID NO: 228376 - DNA, 25 bp, Homo sapien
gaaagtgccctttcctcaggaagtt

SEQ ID NO: 228377 - DNA, 25 bp, Homo sapien
agtgccctttcctcaggaagttgct

SEQ ID NO: 228378 - DNA, 25 bp, Homo sapien
ggaagttgctgtgtttcatttcttt

SEQ ID NO: 228379 - DNA, 25 bp, Homo sapien
atagcagctctgcaaagaaacagtt

SEQ ID NO: 228380 - DNA, 25 bp, Homo sapien
aatgggaacttctacattgaaaagt

SEQ ID NO: 228381 - DNA, 25 bp, Homo sapien
cttctacattgaaaagtccccattt

SEQ ID NO: 228382 - DNA, 25 bp, Homo sapien
ttctatggcatatgtatggaagggt

SEQ ID NO: 228383 - DNA, 25 bp, Homo sapien
gtaatgtaagcagctcagataccat

SEQ ID NO: 228384 - DNA, 25 bp, Homo sapien
atgtaagcagctcagataccatgtg

SEQ ID NO: 228385 - DNA, 25 bp, Homo sapien
gcagctcagataccatgtgctatca

SEQ ID NO: 228386 - DNA, 25 bp, Homo sapien
gctcagataccatgtgctatcattt

SEQ ID NO: 228387 - DNA, 25 bp, Homo sapien
cagataccatgtgctatcatttttg

SEQ ID NO: 228388 - DNA, 25 bp, Homo sapien
aggatgtgaccactgtcagatcact

SEQ ID NO: 228389 - DNA, 25 bp, Homo sapien
gatgtgaccactgtcagatcactgt

SEQ ID NO: 228390 - DNA, 25 bp, Homo sapien
gtgaccactgtcagatcactgttct

SEQ ID NO: 228391 - DNA, 25 bp, Homo sapien
gaccactgtcagatcactgttcttt

SEQ ID NO: 228392 - DNA, 25 bp, Homo sapien
ccactgtcagatcactgttcttttc

SEQ ID NO: 228393 - DNA, 25 bp, Homo sapien
gaaaagcctatactacaatttgaag

SEQ ID NO: 228394 - DNA, 25 bp, Homo sapien
ggccctcaggcacttctggtaaaga

SEQ ID NO: 228395 - DNA, 25 bp, Homo sapien
gtaaagacattccacctgcaagcag

SEQ ID NO: 228396 - DNA, 25 bp, Homo sapien
attccacctgcaagcagcattttga

SEQ ID NO: 228397 - DNA, 25 bp, Homo sapien
aaagcactgctgtggtttgccgatt

SEQ ID NO: 228398 - DNA, 25 bp, Homo sapien
ggtttgccgatttatggtccattta

SEQ ID NO: 228399 - DNA, 25 bp, Homo sapien
ggtccatttaatgttaggctaaagc

SEQ ID NO: 228400 - DNA, 25 bp, Homo sapien
ggctaaagcacctttaatcattttt

SEQ ID NO: 228401 - DNA, 25 bp, Homo sapien
acactggaaatagggtgcttcttct

SEQ ID NO: 228402 - DNA, 25 bp, Homo sapien
tagggtgcttcttctggaaagttca

SEQ ID NO: 228403 - DNA, 25 bp, Homo sapien
ctttggcgggtttatctggctttat

SEQ ID NO: 228404 - DNA, 25 bp, Homo sapien
tctggctttataaacaagtctgaaa

SEQ ID NO: 228405 - DNA, 25 bp, Homo sapien
ggacaacgagaatatcttagtctac

SEQ ID NO: 228406 - DNA, 25 bp, Homo sapien
aacgagaatatcttagtctactaat

SEQ ID NO: 228407 - DNA, 25 bp, Homo sapien
attaatcttttttatcaccatagtc

SEQ ID NO: 228408 - DNA, 25 bp, Homo sapien
atcttttttatcaccatagtctacc

SEQ ID NO: 228409 - DNA, 25 bp, Homo sapien
ttttttatcaccatagtctaccaag

SEQ ID NO: 228410 - DNA, 25 bp, Homo sapien
ttttatcaccatagtctaccaagaa

SEQ ID NO: 228411 - DNA, 25 bp, Homo sapien
tatcaccatagtctaccaagaaaga

SEQ ID NO: 228412 - DNA, 25 bp, Homo sapien
caccatagtctaccaagaaagaaag

SEQ ID NO: 228413 - DNA, 25 bp, Homo sapien
ataaagatgattcattcctcagagt

SEQ ID NO: 228414 - DNA, 25 bp, Homo sapien
gtcgtattaaagtttggcgtaatat

SEQ ID NO: 228415 - DNA, 25 bp, Homo sapien
agtttggcgtaatatggccattctt

SEQ ID NO: 228416 - DNA, 25 bp, Homo sapien
cagcagagtcatcactacctttggg

SEQ ID NO: 228417 - DNA, 25 bp, Homo sapien
aggatcacccagcttggaactagat

SEQ ID NO: 228418 - DNA, 25 bp, Homo sapien
aatgctgttttgagagtgtactgaa

SEQ ID NO: 228419 - DNA, 25 bp, Homo sapien
atgtcccaccttctttgtttggcaa

SEQ ID NO: 228420 - DNA, 25 bp, Homo sapien
tgtttggcaagctcctattcatcct

SEQ ID NO: 228421 - DNA, 25 bp, Homo sapien
tattcatccttcaaagccctagctt

SEQ ID NO: 228422 - DNA, 25 bp, Homo sapien
aaagccctagcttcaatacctgcta

SEQ ID NO: 228423 - DNA, 25 bp, Homo sapien
atacctgctacttcatgcagccatt

SEQ ID NO: 228424 - DNA, 25 bp, Homo sapien
cagccattgcttatccttcaaggag

SEQ ID NO: 228425 - DNA, 25 bp, Homo sapien
aaggagagcctacttccctcaagga

SEQ ID NO: 228426 - DNA, 25 bp, Homo sapien
tcactcgggatccactgaactggga

SEQ ID NO: 228427 - DNA, 25 bp, Homo sapien
ctccaccccatctatgtccttgact

SEQ ID NO: 228428 - DNA, 25 bp, Homo sapien
ctctctcctttgtctgtttgttgtc

SEQ ID NO: 228429 - DNA, 25 bp, Homo sapien
ctctcctttgtctgtttgttgtcaa

SEQ ID NO: 228430 - DNA, 25 bp, Homo sapien
tctcctttgtctgtttgttgtcaaa

SEQ ID NO: 228431 - DNA, 25 bp, Homo sapien
tcctttgtctgtttgttgtcaaaga

SEQ ID NO: 228432 - DNA, 25 bp, Homo sapien
ttgtcaaagatgctgctgggcagac

SEQ ID NO: 228433 - DNA, 25 bp, Homo sapien
gtcaaagatgctgctgggcagacag

SEQ ID NO: 228434 - DNA, 25 bp, Homo sapien
aaagatgctgctgggcagacaggca

SEQ ID NO: 228435 - DNA, 25 bp, Homo sapien
cagggaaaggatctgtctgcccatc

SEQ ID NO: 228436 - DNA, 25 bp, Homo sapien
agggaaaggatctgtctgcccatct

SEQ ID NO: 228437 - DNA, 25 bp, Homo sapien
gtccgagaagggaagccttgggcaa

SEQ ID NO: 228438 - DNA, 25 bp, Homo sapien
tcttcaatcccatttgccatgtgac

SEQ ID NO: 228439 - DNA, 25 bp, Homo sapien
ataaatcacggctttcactggtccg

SEQ ID NO: 228440 - DNA, 25 bp, Homo sapien
tggttggctggaatccatctttgct

SEQ ID NO: 228441 - DNA, 25 bp, Homo sapien
ttgctttatctgaggctcgttcact

SEQ ID NO: 228442 - DNA, 25 bp, Homo sapien
gttcactttcagcaggatcttggaa

SEQ ID NO: 228443 - DNA, 25 bp, Homo sapien
tgagtgtaactccatttgtcttgcc

SEQ ID NO: 228444 - DNA, 25 bp, Homo sapien
tttgtcttgcccgattttccaccaa

SEQ ID NO: 228445 - DNA, 25 bp, Homo sapien
gattttccaccaattcgagcatttg

SEQ ID NO: 228446 - DNA, 25 bp, Homo sapien
ttttcatctcccaattcttgactat

SEQ ID NO: 228447 - DNA, 25 bp, Homo sapien
tgactattaattagtgctctctgga

SEQ ID NO: 228448 - DNA, 25 bp, Homo sapien
ggagaagctgctgtagacgtttctt

SEQ ID NO: 228449 - DNA, 25 bp, Homo sapien
gtcacgattgtcaggaaccttaaag

SEQ ID NO: 228450 - DNA, 25 bp, Homo sapien
ggaaccttaaagagccaagctagaa

SEQ ID NO: 228451 - DNA, 25 bp, Homo sapien
aagctagaaggacacgcggcaccaa

SEQ ID NO: 228452 - DNA, 25 bp, Homo sapien
acgcggcaccaaagctctagggagt

SEQ ID NO: 228453 - DNA, 25 bp, Homo sapien
gagtaaagctactgagccacccagc

SEQ ID NO: 228454 - DNA, 25 bp, Homo sapien
cagccccgatgcaggagagctgtcc

SEQ ID NO: 228455 - DNA, 25 bp, Homo sapien
attggtgcagcaaggactcctcact

SEQ ID NO: 228456 - DNA, 25 bp, Homo sapien
tcctcactccagacatgctgaaaca

SEQ ID NO: 228457 - DNA, 25 bp, Homo sapien
gagtctgggactcatccaaaaggga

SEQ ID NO: 228458 - DNA, 25 bp, Homo sapien
gaaggaacctgattcggactagttt

SEQ ID NO: 228459 - DNA, 25 bp, Homo sapien
tgattcggactagttttctgttcct

SEQ ID NO: 228460 - DNA, 25 bp, Homo sapien
taaacatcactgtctgaggtcaact

SEQ ID NO: 228461 - DNA, 25 bp, Homo sapien
gaggtcaactggcttgctcagctct

SEQ ID NO: 228462 - DNA, 25 bp, Homo sapien
agctctctgttatcaggcactgcca

SEQ ID NO: 228463 - DNA, 25 bp, Homo sapien
caccagcagcacttctatcagagtg

SEQ ID NO: 228464 - DNA, 25 bp, Homo sapien
tatcagagtgcgagctcctcaaggt

SEQ ID NO: 228465 - DNA, 25 bp, Homo sapien
gagctcctcaaggttaaaggcattt

SEQ ID NO: 228466 - DNA, 25 bp, Homo sapien
gaagggcttaccaagagtccagaca

SEQ ID NO: 228467 - DNA, 25 bp, Homo sapien
aaagttacttgtgcagtctgctttc

SEQ ID NO: 228468 - DNA, 25 bp, Homo sapien
cagacactgggaatgaagtcttcct

SEQ ID NO: 228469 - DNA, 25 bp, Homo sapien
caatccttggtctgcaggtaagcta

SEQ ID NO: 228470 - DNA, 25 bp, Homo sapien
ggcaccagggctcaatcaacagcaa

SEQ ID NO: 228471 - DNA, 25 bp, Homo sapien
agccagagacaagggacctgctgtc

SEQ ID NO: 228472 - DNA, 25 bp, Homo sapien
agagacaagggacctgctgtcatcc

SEQ ID NO: 228473 - DNA, 25 bp, Homo sapien
gagacaagggacctgctgtcatccc

SEQ ID NO: 228474 - DNA, 25 bp, Homo sapien
agacaagggacctgctgtcatcccc

SEQ ID NO: 228475 - DNA, 25 bp, Homo sapien
acaagggacctgctgtcatccccat

SEQ ID NO: 228476 - DNA, 25 bp, Homo sapien
agggacctgctgtcatccccatctg

SEQ ID NO: 228477 - DNA, 25 bp, Homo sapien
gacctgctgtcatccccatctgtgg

SEQ ID NO: 228478 - DNA, 25 bp, Homo sapien
gtggcctgggggtccttcctgacaa

SEQ ID NO: 228479 - DNA, 25 bp, Homo sapien
cctgggggtccttcctgacaacgag

SEQ ID NO: 228480 - DNA, 25 bp, Homo sapien
gtccttcctgacaacgagggggtag

SEQ ID NO: 228481 - DNA, 25 bp, Homo sapien
agcactggattcctcagtccaccag

SEQ ID NO: 228482 - DNA, 25 bp, Homo sapien
ctgtgcccggcttcattttcagagt

SEQ ID NO: 228483 - DNA, 25 bp, Homo sapien
gagtgagacatttgtactgtggcta

SEQ ID NO: 228484 - DNA, 25 bp, Homo sapien
ttgtactgtggctatgtaggagaac

SEQ ID NO: 228485 - DNA, 25 bp, Homo sapien
gtaggagaacattcttgttcttagc

SEQ ID NO: 228486 - DNA, 25 bp, Homo sapien
cttgttcttagcaaacatactgaag

SEQ ID NO: 228487 - DNA, 25 bp, Homo sapien
gtttttagatattaattaccacagt

SEQ ID NO: 228488 - DNA, 25 bp, Homo sapien
attaccacagtgtctgccactgaat

SEQ ID NO: 228489 - DNA, 25 bp, Homo sapien
gccactgaatttccagtgactaagt

SEQ ID NO: 228490 - DNA, 25 bp, Homo sapien
catggccagcttttttaagtgcgtt

SEQ ID NO: 228491 - DNA, 25 bp, Homo sapien
ggccagcttttttaagtgcgttata

SEQ ID NO: 228492 - DNA, 25 bp, Homo sapien
tttttaagtgcgttatagaagcggg

SEQ ID NO: 228493 - DNA, 25 bp, Homo sapien
tcacgtctggagactcggcatgctc

SEQ ID NO: 228494 - DNA, 25 bp, Homo sapien
ctgaacatcttgtacagggccagag

SEQ ID NO: 228495 - DNA, 25 bp, Homo sapien
ctggcttgttcgtgcagcgtgtcaa

SEQ ID NO: 228496 - DNA, 25 bp, Homo sapien
cttgttcgtgcagcgtgtcaagggt

SEQ ID NO: 228497 - DNA, 25 bp, Homo sapien
gtgggcctgtaattggcgatctctt

SEQ ID NO: 228498 - DNA, 25 bp, Homo sapien
taattggcgatctcttccgccacgt

SEQ ID NO: 228499 - DNA, 25 bp, Homo sapien
ttgtacagggccagagtgtcctgga

SEQ ID NO: 228500 - DNA, 25 bp, Homo sapien
gtggaatactcatcgtggcccacgt

SEQ ID NO: 228501 - DNA, 25 bp, Homo sapien
tggcccacgtcgctgctggagacaa

SEQ ID NO: 228502 - DNA, 25 bp, Homo sapien
acgtcgctgctggagacaatcttga

SEQ ID NO: 228503 - DNA, 25 bp, Homo sapien
gacaatcttgaggatgtccagcatc

SEQ ID NO: 228504 - DNA, 25 bp, Homo sapien
gccccaggtgccaggacaagaatgc

SEQ ID NO: 228505 - DNA, 25 bp, Homo sapien
gtgccaggacaagaatgccagcgct

SEQ ID NO: 228506 - DNA, 25 bp, Homo sapien
aatgccagcgctgggcatactgccg

SEQ ID NO: 228507 - DNA, 25 bp, Homo sapien
agcgctgggcatactgccggcccat

SEQ ID NO: 228508 - DNA, 25 bp, Homo sapien
gccagctcaggcttctaggtggaat

SEQ ID NO: 228509 - DNA, 25 bp, Homo sapien
ctcaggcttctaggtggaatgtgga

SEQ ID NO: 228510 - DNA, 25 bp, Homo sapien
tggagacgggtttcagccacactcc

SEQ ID NO: 228511 - DNA, 25 bp, Homo sapien
acactcccaaccttagctgttgaga

SEQ ID NO: 228512 - DNA, 25 bp, Homo sapien
caaccttagctgttgagactcaact

SEQ ID NO: 228513 - DNA, 25 bp, Homo sapien
aggagccgacctgggtctcacacag

SEQ ID NO: 228514 - DNA, 25 bp, Homo sapien
cgacctgggtctcacacaggtgtcc

SEQ ID NO: 228515 - DNA, 25 bp, Homo sapien
ttaagactgattctggaggtccatc

SEQ ID NO: 228516 - DNA, 25 bp, Homo sapien
tggaggtccatcagttctcaagaga

SEQ ID NO: 228517 - DNA, 25 bp, Homo sapien
gttctcaagagacgccagtgtggcc

SEQ ID NO: 228518 - DNA, 25 bp, Homo sapien
gctgcttggacaggagccgtaccta

SEQ ID NO: 228519 - DNA, 25 bp, Homo sapien
gagccgtacctatccagccgagaga

SEQ ID NO: 228520 - DNA, 25 bp, Homo sapien
tatccagccgagagataggccagag

SEQ ID NO: 228521 - DNA, 25 bp, Homo sapien
atcaagcgccacgaggcatttgaaa

SEQ ID NO: 228522 - DNA, 25 bp, Homo sapien
aaaagtctgcagcaacctgggatga

SEQ ID NO: 228523 - DNA, 25 bp, Homo sapien
gatgagaggttctctgccctggaaa

SEQ ID NO: 228524 - DNA, 25 bp, Homo sapien
aaggctgactacattggagttactg

SEQ ID NO: 228525 - DNA, 25 bp, Homo sapien
tggagttactggaagtgcgcagaca

SEQ ID NO: 228526 - DNA, 25 bp, Homo sapien
ggcagtgtctcagaggtcatgtgaa

SEQ ID NO: 228527 - DNA, 25 bp, Homo sapien
gaggtcatgtgaattgatcttgata

SEQ ID NO: 228528 - DNA, 25 bp, Homo sapien
agtgaccagagggaataagcaggct

SEQ ID NO: 228529 - DNA, 25 bp, Homo sapien
ggaataagcaggctctaggcttcaa

SEQ ID NO: 228530 - DNA, 25 bp, Homo sapien
caggctctaggcttcaaagcaccaa

SEQ ID NO: 228531 - DNA, 25 bp, Homo sapien
aaagcaccaaactcttccacacaga

SEQ ID NO: 228532 - DNA, 25 bp, Homo sapien
agaagctccatcaccacttaaagaa

SEQ ID NO: 228533 - DNA, 25 bp, Homo sapien
taagtaaaagtcacaggacttggcc

SEQ ID NO: 228534 - DNA, 25 bp, Homo sapien
acatgtccttctgcctttacaaaga

SEQ ID NO: 228535 - DNA, 25 bp, Homo sapien
gtccttctgcctttacaaagactag

SEQ ID NO: 228536 - DNA, 25 bp, Homo sapien
actaggctagtcagactgtgctcca

SEQ ID NO: 228537 - DNA, 25 bp, Homo sapien
ttatacaaaatcctctgcctagcac

SEQ ID NO: 228538 - DNA, 25 bp, Homo sapien
ctgctctttttgatgttgtagtgac

SEQ ID NO: 228539 - DNA, 25 bp, Homo sapien
ttttgatgttgtagtgacaccattt

SEQ ID NO: 228540 - DNA, 25 bp, Homo sapien
ttgaattaatgcttggtagcctggg

SEQ ID NO: 228541 - DNA, 25 bp, Homo sapien
gggctagatgtggaactccatggat

SEQ ID NO: 228542 - DNA, 25 bp, Homo sapien
actccatggatctgtgttctgactg

SEQ ID NO: 228543 - DNA, 25 bp, Homo sapien
gttctgactggcacctttggaatga

SEQ ID NO: 228544 - DNA, 25 bp, Homo sapien
aaagaaaagtgtgtgctgtccaaat

SEQ ID NO: 228545 - DNA, 25 bp, Homo sapien
tgtgtgctgtccaaattttttcccc

SEQ ID NO: 228546 - DNA, 25 bp, Homo sapien
ttaattctttccctcatcttctcac

SEQ ID NO: 228547 - DNA, 25 bp, Homo sapien
ttatttccattgtgagttctgacaa

SEQ ID NO: 228548 - DNA, 25 bp, Homo sapien
tgggaaggtcccacgggcgacaaga

SEQ ID NO: 228549 - DNA, 25 bp, Homo sapien
ggcgacaagacgctccatcgtggat

SEQ ID NO: 228550 - DNA, 25 bp, Homo sapien
aagacgctccatcgtggatgtgctg

SEQ ID NO: 228551 - DNA, 25 bp, Homo sapien
cgctccatcgtggatgtgctgcgga

SEQ ID NO: 228552 - DNA, 25 bp, Homo sapien
agggacgcgtcggacatggcccggg

SEQ ID NO: 228553 - DNA, 25 bp, Homo sapien
gggctgcgcaaacgcgggcagcgag

SEQ ID NO: 228554 - DNA, 25 bp, Homo sapien
gaggccgggcgcaagggagaccccg

SEQ ID NO: 228555 - DNA, 25 bp, Homo sapien
gtgtgcgagggacgcggcggctacc

SEQ ID NO: 228556 - DNA, 25 bp, Homo sapien
gtggactcttctgcgtcgggttcgc

SEQ ID NO: 228557 - DNA, 25 bp, Homo sapien
ttctgcgtcgggttcgcctgtctcg

SEQ ID NO: 228558 - DNA, 25 bp, Homo sapien
gttcgcctgtctcgtccggacggca

SEQ ID NO: 228559 - DNA, 25 bp, Homo sapien
gatgttgtagagtcttgggttcaaa

SEQ ID NO: 228560 - DNA, 25 bp, Homo sapien
tgagcctgctacaaggtcttggctt

SEQ ID NO: 228561 - DNA, 25 bp, Homo sapien
aaggtcttggcttgcaccctattgc

SEQ ID NO: 228562 - DNA, 25 bp, Homo sapien
gatcctccaaccagcaccaatgaag

SEQ ID NO: 228563 - DNA, 25 bp, Homo sapien
cccatgcagggtccttcagaaacaa

SEQ ID NO: 228564 - DNA, 25 bp, Homo sapien
gtgagatagcttccagtctcaggtg

SEQ ID NO: 228565 - DNA, 25 bp, Homo sapien
ggaatatttagacttgtgaacaggg

SEQ ID NO: 228566 - DNA, 25 bp, Homo sapien
ggaagtaacctccaatttgcagatg

SEQ ID NO: 228567 - DNA, 25 bp, Homo sapien
agaaagaaccaaccagagctggacc

SEQ ID NO: 228568 - DNA, 25 bp, Homo sapien
agagctggaccaaaaatcgaggcca

SEQ ID NO: 228569 - DNA, 25 bp, Homo sapien
tcgaggccaggatgttgtagagtct

SEQ ID NO: 228570 - DNA, 25 bp, Homo sapien
cacgaccaaattatgtagttaacca

SEQ ID NO: 228571 - DNA, 25 bp, Homo sapien
caatatctgtcttatatcagtcaat

SEQ ID NO: 228572 - DNA, 25 bp, Homo sapien
cagtcaataacattggatggcaatt

SEQ ID NO: 228573 - DNA, 25 bp, Homo sapien
tctactagtgaggtggtgaggatcc

SEQ ID NO: 228574 - DNA, 25 bp, Homo sapien
atggcaatttacacacatgaacttg

SEQ ID NO: 228575 - DNA, 25 bp, Homo sapien
ttacacacatgaacttgctgacaat

SEQ ID NO: 228576 - DNA, 25 bp, Homo sapien
gtgaggatccaatctgctctgcagg

SEQ ID NO: 228577 - DNA, 25 bp, Homo sapien
ccaatctgctctgcaggcgtttaat

SEQ ID NO: 228578 - DNA, 25 bp, Homo sapien
caggcgtttaatgccaaattgccaa

SEQ ID NO: 228579 - DNA, 25 bp, Homo sapien
aaacacaatggattatgacacgacc

SEQ ID NO: 228580 - DNA, 25 bp, Homo sapien
ggattatgacacgaccaaattatgt

SEQ ID NO: 228581 - DNA, 25 bp, Homo sapien
tttaatatccttttactgtctgtag

SEQ ID NO: 228582 - DNA, 25 bp, Homo sapien
tactgtctgtagaatctaatctgta

SEQ ID NO: 228583 - DNA, 25 bp, Homo sapien
ctaatctgtattgcagtctcttcat

SEQ ID NO: 228584 - DNA, 25 bp, Homo sapien
tattgcagtctcttcatattggtaa

SEQ ID NO: 228585 - DNA, 25 bp, Homo sapien
gtctcttcatattggtaatttgtgt

SEQ ID NO: 228586 - DNA, 25 bp, Homo sapien
ttctgttttttcctggatcagtcag

SEQ ID NO: 228587 - DNA, 25 bp, Homo sapien
ttcctggatcagtcagtctagctgg

SEQ ID NO: 228588 - DNA, 25 bp, Homo sapien
tcagtctagctggaggtttatcaat

SEQ ID NO: 228589 - DNA, 25 bp, Homo sapien
gctggaggtttatcaattctttata

SEQ ID NO: 228590 - DNA, 25 bp, Homo sapien
agtacaggggtattcaatcttttag

SEQ ID NO: 228591 - DNA, 25 bp, Homo sapien
tagaatacactaatgataagctgat

SEQ ID NO: 228592 - DNA, 25 bp, Homo sapien
gtatggccaacggatttatcttaaa

SEQ ID NO: 228593 - DNA, 25 bp, Homo sapien
gatttatcttaaaaccaatggagga

SEQ ID NO: 228594 - DNA, 25 bp, Homo sapien
aatgttgtggacttccatttgtcaa

SEQ ID NO: 228595 - DNA, 25 bp, Homo sapien
ggacttccatttgtcaaagaccaaa

SEQ ID NO: 228596 - DNA, 25 bp, Homo sapien
gaaccccaaccttacatgtaataca

SEQ ID NO: 228597 - DNA, 25 bp, Homo sapien
aactgaaaacagactatctttacaa

SEQ ID NO: 228598 - DNA, 25 bp, Homo sapien
ctatctttacaacctaggcgtaggt

SEQ ID NO: 228599 - DNA, 25 bp, Homo sapien
taggcgtaggtatagtttttagaca

SEQ ID NO: 228600 - DNA, 25 bp, Homo sapien
gacattacaccaaaagcacatgccg

SEQ ID NO: 228601 - DNA, 25 bp, Homo sapien
gggaatccataaatagacattcaga

SEQ ID NO: 228602 - DNA, 25 bp, Homo sapien
gacattcagaagtatggccaacgga

SEQ ID NO: 228603 - DNA, 25 bp, Homo sapien
atgtaaaggaaagcccgcggtagct

SEQ ID NO: 228604 - DNA, 25 bp, Homo sapien
cgcggtagctgagcgcttcataaca

SEQ ID NO: 228605 - DNA, 25 bp, Homo sapien
gagcgcttcataacagaatgttcta

SEQ ID NO: 228606 - DNA, 25 bp, Homo sapien
gaatgttctaatcaagtacgtggta

SEQ ID NO: 228607 - DNA, 25 bp, Homo sapien
ggatgtctccaatattgctcttgta

SEQ ID NO: 228608 - DNA, 25 bp, Homo sapien
tcttgtattctttctaattgggttt

SEQ ID NO: 228609 - DNA, 25 bp, Homo sapien
taacgccatttggttcacatgtgaa

SEQ ID NO: 228610 - DNA, 25 bp, Homo sapien
gaatggacatcaatctactttgcaa

SEQ ID NO: 228611 - DNA, 25 bp, Homo sapien
atgtgaagtgccctccatagccaaa

SEQ ID NO: 228612 - DNA, 25 bp, Homo sapien
gtgccctccatagccaaatgttggg

SEQ ID NO: 228613 - DNA, 25 bp, Homo sapien
ggaggctatttcaacattgcactgt

SEQ ID NO: 228614 - DNA, 25 bp, Homo sapien
aatttaggcaatgccttcgtgcaca

SEQ ID NO: 228615 - DNA, 25 bp, Homo sapien
tgccttcgtgcacataaaagtaaaa

SEQ ID NO: 228616 - DNA, 25 bp, Homo sapien
ctgtaatcctaccacacgcagatca

SEQ ID NO: 228617 - DNA, 25 bp, Homo sapien
cacacgcagatcagcacttgctaat

SEQ ID NO: 228618 - DNA, 25 bp, Homo sapien
gcacttgctaatcttttcacaggga

SEQ ID NO: 228619 - DNA, 25 bp, Homo sapien
tcttttcacagggatcctaagaata

SEQ ID NO: 228620 - DNA, 25 bp, Homo sapien
agggatcctaagaatatcctattct

SEQ ID NO: 228621 - DNA, 25 bp, Homo sapien
aattcttcagttttacattatgcta

SEQ ID NO: 228622 - DNA, 25 bp, Homo sapien
aaaaaggagccgtcactctacgtga

SEQ ID NO: 228623 - DNA, 25 bp, Homo sapien
tcactctacgtgacatttctgtata

SEQ ID NO: 228624 - DNA, 25 bp, Homo sapien
ctacgtgacatttctgtatattggt

SEQ ID NO: 228625 - DNA, 25 bp, Homo sapien
gtagggcaagatcaaagcatacatt

SEQ ID NO: 228626 - DNA, 25 bp, Homo sapien
gagacacgggaaatgcttctcgtga

SEQ ID NO: 228627 - DNA, 25 bp, Homo sapien
gcttctcgtgaagggcaaatgtaac

SEQ ID NO: 228628 - DNA, 25 bp, Homo sapien
gtagggaataaactgtgtcccacct

SEQ ID NO: 228629 - DNA, 25 bp, Homo sapien
gtcccacctgtttacttgtgtttat

SEQ ID NO: 228630 - DNA, 25 bp, Homo sapien
gatgagtatgcacctaccattttcc

SEQ ID NO: 228631 - DNA, 25 bp, Homo sapien
accattttcctttattgtgatcact

SEQ ID NO: 228632 - DNA, 25 bp, Homo sapien
gtgatcactaaaatgaggccaaggt

SEQ ID NO: 228633 - DNA, 25 bp, Homo sapien
ccttttacggattcagttcctgcta

SEQ ID NO: 228634 - DNA, 25 bp, Homo sapien
gttcctgctaggatgttgtatcaga

SEQ ID NO: 228635 - DNA, 25 bp, Homo sapien
gtatcagaatcatgtgagaactcag

SEQ ID NO: 228636 - DNA, 25 bp, Homo sapien
gatggcaccaatgcatgctggctcc

SEQ ID NO: 228637 - DNA, 25 bp, Homo sapien
aatgcatgctggctccctcattcct

SEQ ID NO: 228638 - DNA, 25 bp, Homo sapien
gggctgtggcttacggccagcaccc

SEQ ID NO: 228639 - DNA, 25 bp, Homo sapien
ttacggccagcaccctgtacctggg

SEQ ID NO: 228640 - DNA, 25 bp, Homo sapien
tgtacctgggactcagcccttatcc

SEQ ID NO: 228641 - DNA, 25 bp, Homo sapien
cccctctgctatctgtgctgggaga

SEQ ID NO: 228642 - DNA, 25 bp, Homo sapien
ggagggaaacagatatgaggacact

SEQ ID NO: 228643 - DNA, 25 bp, Homo sapien
tatgaggacactggcaccatctggg

SEQ ID NO: 228644 - DNA, 25 bp, Homo sapien
aggacactggcaccatctgggcctg

SEQ ID NO: 228645 - DNA, 25 bp, Homo sapien
catgggaggttggaaggcacccaca

SEQ ID NO: 228646 - DNA, 25 bp, Homo sapien
acccacatccttaaagccatcagta

SEQ ID NO: 228647 - DNA, 25 bp, Homo sapien
tgatctcggtgatgagcagcaggaa

SEQ ID NO: 228648 - DNA, 25 bp, Homo sapien
acagcagcacggagatgcacagcgt

SEQ ID NO: 228649 - DNA, 25 bp, Homo sapien
gagatgcacagcgtgatcttctcgc

SEQ ID NO: 228650 - DNA, 25 bp, Homo sapien
tcgccacactcggagggcaggtaga

SEQ ID NO: 228651 - DNA, 25 bp, Homo sapien
gcagccgccggatgacgaaggcata

SEQ ID NO: 228652 - DNA, 25 bp, Homo sapien
cataggtgatgtccgggtagatctc

SEQ ID NO: 228653 - DNA, 25 bp, Homo sapien
tagatctcggcgcagcactcgtact

SEQ ID NO: 228654 - DNA, 25 bp, Homo sapien
agcactcgtacttcctggtgttgta

SEQ ID NO: 228655 - DNA, 25 bp, Homo sapien
acttcctggtgttgtaggtgcccac

SEQ ID NO: 228656 - DNA, 25 bp, Homo sapien
tgtaggtgcccacggcgtccacgat

SEQ ID NO: 228657 - DNA, 25 bp, Homo sapien
cagaagtccagctggtccacgcggc

SEQ ID NO: 228658 - DNA, 25 bp, Homo sapien
tccaaaaaccttactacatcatcaa

SEQ ID NO: 228659 - DNA, 25 bp, Homo sapien
tactacatcatcaatattgttcctg

SEQ ID NO: 228660 - DNA, 25 bp, Homo sapien
aatattgttcctgtatacgccttca

SEQ ID NO: 228661 - DNA, 25 bp, Homo sapien
tgttcctgtatacgccttcaagtct

SEQ ID NO: 228662 - DNA, 25 bp, Homo sapien
tttctgcaggaaatcccatagcaat

SEQ ID NO: 228663 - DNA, 25 bp, Homo sapien
gcaggaaatcccatagcaataatgt

SEQ ID NO: 228664 - DNA, 25 bp, Homo sapien
gtcaagtctaagtcgaatccatcct

SEQ ID NO: 228665 - DNA, 25 bp, Homo sapien
ctaagtcgaatccatcctcttgata

SEQ ID NO: 228666 - DNA, 25 bp, Homo sapien
atcctcttgatatctccttttgttt

SEQ ID NO: 228667 - DNA, 25 bp, Homo sapien
tccttttgtttctgctaacgatctc

SEQ ID NO: 228668 - DNA, 25 bp, Homo sapien
aacgatctctttgatgatggctgtc

SEQ ID NO: 228669 - DNA, 25 bp, Homo sapien
tggccactgacctcagggccgaagg

SEQ ID NO: 228670 - DNA, 25 bp, Homo sapien
ataggaacgcgttgcggagtccgcc

SEQ ID NO: 228671 - DNA, 25 bp, Homo sapien
gggtcttgtacatactgtaacatac

SEQ ID NO: 228672 - DNA, 25 bp, Homo sapien
aagaatctatttaaggcgccgcggg

SEQ ID NO: 228673 - DNA, 25 bp, Homo sapien
gggagggctgcacggccgggcttgt

SEQ ID NO: 228674 - DNA, 25 bp, Homo sapien
ggcttgtggttctctagcgcggcgg

SEQ ID NO: 228675 - DNA, 25 bp, Homo sapien
ggctccacgggcactttctacttgt

SEQ ID NO: 228676 - DNA, 25 bp, Homo sapien
actttctacttgtgcatgggcttgg

SEQ ID NO: 228677 - DNA, 25 bp, Homo sapien
tgtgcatgggcttggtttatacgaa

SEQ ID NO: 228678 - DNA, 25 bp, Homo sapien
gggcttggtttatacgaattgccat

SEQ ID NO: 228679 - DNA, 25 bp, Homo sapien
gaattgccattaaacatcgctgcac

SEQ ID NO: 228680 - DNA, 25 bp, Homo sapien
gagtcaagatccaaacccaatgtgt

SEQ ID NO: 228681 - DNA, 25 bp, Homo sapien
aacccaatgtgtctgattccttagc

SEQ ID NO: 228682 - DNA, 25 bp, Homo sapien
aatgtgtctgattccttagcccttg

SEQ ID NO: 228683 - DNA, 25 bp, Homo sapien
tgtgtctgattccttagcccttggg

SEQ ID NO: 228684 - DNA, 25 bp, Homo sapien
gagaaagctgcaggcataccaccgc

SEQ ID NO: 228685 - DNA, 25 bp, Homo sapien
aaagctgcaggcataccaccgcaca

SEQ ID NO: 228686 - DNA, 25 bp, Homo sapien
tgggaactccctggacactagcaga

SEQ ID NO: 228687 - DNA, 25 bp, Homo sapien
gaactccctggacactagcagaata

SEQ ID NO: 228688 - DNA, 25 bp, Homo sapien
ggacactagcagaatatcatacact

SEQ ID NO: 228689 - DNA, 25 bp, Homo sapien
actcagtaggctctgtgtgattcta

SEQ ID NO: 228690 - DNA, 25 bp, Homo sapien
ggctctgtgtgattctagaaagact

SEQ ID NO: 228691 - DNA, 25 bp, Homo sapien
cttcaaggttagcactgggatcaaa

SEQ ID NO: 228692 - DNA, 25 bp, Homo sapien
ggatcaaattccgactttgcaactt

SEQ ID NO: 228693 - DNA, 25 bp, Homo sapien
tgagtaagttgctacacctctatta

SEQ ID NO: 228694 - DNA, 25 bp, Homo sapien
gctacacctctattagcctcagttt

SEQ ID NO: 228695 - DNA, 25 bp, Homo sapien
gggacggctaagtacctatttcatt

SEQ ID NO: 228696 - DNA, 25 bp, Homo sapien
agtacctatttcattgggctgttga

SEQ ID NO: 228697 - DNA, 25 bp, Homo sapien
gatggtctcatctatgcaagggctt

SEQ ID NO: 228698 - DNA, 25 bp, Homo sapien
tgcaagggcttagtaccagctgggt

SEQ ID NO: 228699 - DNA, 25 bp, Homo sapien
gtaccagctgggtgaaactcagtga

SEQ ID NO: 228700 - DNA, 25 bp, Homo sapien
aactcagtgaatggcaggcaaccct

SEQ ID NO: 228701 - DNA, 25 bp, Homo sapien
tggcaggcaaccctattatgactag

SEQ ID NO: 228702 - DNA, 25 bp, Homo sapien
atctggatctttatgtggggaccta

SEQ ID NO: 228703 - DNA, 25 bp, Homo sapien
attttacatgtagatagttattcag

SEQ ID NO: 228704 - DNA, 25 bp, Homo sapien
ttctcttaagagatatttcctttta

SEQ ID NO: 228705 - DNA, 25 bp, Homo sapien
ttccttttatttctgtacaataata

SEQ ID NO: 228706 - DNA, 25 bp, Homo sapien
atatgtatgaactcagttactaggg

SEQ ID NO: 228707 - DNA, 25 bp, Homo sapien
tactaggggactgtattgtgacatt

SEQ ID NO: 228708 - DNA, 25 bp, Homo sapien
tgtgacattatcaacctttattgct

SEQ ID NO: 228709 - DNA, 25 bp, Homo sapien
gacattatcaacctttattgctatt

SEQ ID NO: 228710 - DNA, 25 bp, Homo sapien
tatcaacctttattgctatttaaaa

SEQ ID NO: 228711 - DNA, 25 bp, Homo sapien
ttccattgatgtgaagcacaattta

SEQ ID NO: 228712 - DNA, 25 bp, Homo sapien
gatgtgaagcacaatttaatgaata

SEQ ID NO: 228713 - DNA, 25 bp, Homo sapien
cataaaacacaatactatgcagctg

SEQ ID NO: 228714 - DNA, 25 bp, Homo sapien
gcagaatgagacagtcctctatata

SEQ ID NO: 228715 - DNA, 25 bp, Homo sapien
aagccaggagagaatgttgtctata

SEQ ID NO: 228716 - DNA, 25 bp, Homo sapien
gaatgttgtctataatatgctgttg

SEQ ID NO: 228717 - DNA, 25 bp, Homo sapien
aatatgctgttgttgtgtacgggaa

SEQ ID NO: 228718 - DNA, 25 bp, Homo sapien
gctgttgttgtgtacgggaaaataa

SEQ ID NO: 228719 - DNA, 25 bp, Homo sapien
gaatatttgtgaaggtacagccaag

SEQ ID NO: 228720 - DNA, 25 bp, Homo sapien
ggtacagccaagaaactactatcac

SEQ ID NO: 228721 - DNA, 25 bp, Homo sapien
agccaagaaactactatcactgatt

SEQ ID NO: 228722 - DNA, 25 bp, Homo sapien
tacttggttatcatagcgtaaagat

SEQ ID NO: 228723 - DNA, 25 bp, Homo sapien
gatggtaatcaacccaaatgactat

SEQ ID NO: 228724 - DNA, 25 bp, Homo sapien
tcggtggagcagaccccgcgcaaga

SEQ ID NO: 228725 - DNA, 25 bp, Homo sapien
cagaccccgcgcaagaggctgcggt

SEQ ID NO: 228726 - DNA, 25 bp, Homo sapien
gctgcggtgagccaatttagagccc

SEQ ID NO: 228727 - DNA, 25 bp, Homo sapien
gcggtgagccaatttagagcccaaa

SEQ ID NO: 228728 - DNA, 25 bp, Homo sapien
ggtgagccaatttagagcccaaaga

SEQ ID NO: 228729 - DNA, 25 bp, Homo sapien
aatttagagcccaaagagccccgag

SEQ ID NO: 228730 - DNA, 25 bp, Homo sapien
tagagcccaaagagccccgagggaa

SEQ ID NO: 228731 - DNA, 25 bp, Homo sapien
caaagagccccgagggaacctgccg

SEQ ID NO: 228732 - DNA, 25 bp, Homo sapien
gtattctgcacgagaaggtacactg

SEQ ID NO: 228733 - DNA, 25 bp, Homo sapien
ttctgcacgagaaggtacactggtc

SEQ ID NO: 228734 - DNA, 25 bp, Homo sapien
gcacgagaaggtacactggtcccaa

SEQ ID NO: 228735 - DNA, 25 bp, Homo sapien
taaactttgcttctcttataagtta

SEQ ID NO: 228736 - DNA, 25 bp, Homo sapien
gcttctcttataagttattgtgatt

SEQ ID NO: 228737 - DNA, 25 bp, Homo sapien
gattcattttagttactgtgtttta

SEQ ID NO: 228738 - DNA, 25 bp, Homo sapien
ttaaatattgcacttctataaatag

SEQ ID NO: 228739 - DNA, 25 bp, Homo sapien
gcacagacaattgcagtaaattctt

SEQ ID NO: 228740 - DNA, 25 bp, Homo sapien
gacaattgcagtaaattctttttta

SEQ ID NO: 228741 - DNA, 25 bp, Homo sapien
gatatttgaaatgacaacctttggt

SEQ ID NO: 228742 - DNA, 25 bp, Homo sapien
acaacctttggttaagtgtgtcaag

SEQ ID NO: 228743 - DNA, 25 bp, Homo sapien
ggttaagtgtgtcaaggttgcaaca

SEQ ID NO: 228744 - DNA, 25 bp, Homo sapien
agtgtgtcaaggttgcaacagaatt

SEQ ID NO: 228745 - DNA, 25 bp, Homo sapien
ttgttgtttgcaaattgttactaat

SEQ ID NO: 228746 - DNA, 25 bp, Homo sapien
agatgcaggctcagcaccctccgga

SEQ ID NO: 228747 - DNA, 25 bp, Homo sapien
gatgcaggctcagcaccctccggag

SEQ ID NO: 228748 - DNA, 25 bp, Homo sapien
atgcaggctcagcaccctccggagg

SEQ ID NO: 228749 - DNA, 25 bp, Homo sapien
tgcaggctcagcaccctccggaggg

SEQ ID NO: 228750 - DNA, 25 bp, Homo sapien
gcaggctcagcaccctccggagggg

SEQ ID NO: 228751 - DNA, 25 bp, Homo sapien
caggctcagcaccctccggagggga

SEQ ID NO: 228752 - DNA, 25 bp, Homo sapien
aggctcagcaccctccggaggggac

SEQ ID NO: 228753 - DNA, 25 bp, Homo sapien
ggctcagcaccctccggaggggacc

SEQ ID NO: 228754 - DNA, 25 bp, Homo sapien
gctcagcaccctccggaggggaccc

SEQ ID NO: 228755 - DNA, 25 bp, Homo sapien
ctcagcaccctccggaggggacccg

SEQ ID NO: 228756 - DNA, 25 bp, Homo sapien
tcagcaccctccggaggggacccgg

SEQ ID NO: 228757 - DNA, 25 bp, Homo sapien
aacgaccttagtttgtgtcttcctg

SEQ ID NO: 228758 - DNA, 25 bp, Homo sapien
gtgtcttcctgtgttctcaagattg

SEQ ID NO: 228759 - DNA, 25 bp, Homo sapien
tgagaatcccagatgatcacgcgat

SEQ ID NO: 228760 - DNA, 25 bp, Homo sapien
acgcgatttcagacctatccatgta

SEQ ID NO: 228761 - DNA, 25 bp, Homo sapien
ggagagatttcttcatgcgattatg

SEQ ID NO: 228762 - DNA, 25 bp, Homo sapien
tgcgattatgccatcgacctttatc

SEQ ID NO: 228763 - DNA, 25 bp, Homo sapien
ttatccctctctatacaatggtcac

SEQ ID NO: 228764 - DNA, 25 bp, Homo sapien
caatggtcactttttccagaataag

SEQ ID NO: 228765 - DNA, 25 bp, Homo sapien
aagataccatgaggctgtgcagcgt

SEQ ID NO: 228766 - DNA, 25 bp, Homo sapien
gctgtgcagcgttggcattggcaaa

SEQ ID NO: 228767 - DNA, 25 bp, Homo sapien
caaaggactctttttcttgggatca

SEQ ID NO: 228768 - DNA, 25 bp, Homo sapien
ctgagtgtgtattgtcttgagatta

SEQ ID NO: 228769 - DNA, 25 bp, Homo sapien
tgttactgagtaattaagcccatgt

SEQ ID NO: 228770 - DNA, 25 bp, Homo sapien
ttgaaatatgtgataaccgaatgtc

SEQ ID NO: 228771 - DNA, 25 bp, Homo sapien
gtgataaccgaatgtcaaaagttcc

SEQ ID NO: 228772 - DNA, 25 bp, Homo sapien
aagttcctaaactctaacagtgcag

SEQ ID NO: 228773 - DNA, 25 bp, Homo sapien
ttcctaaactctaacagtgcaggtt

SEQ ID NO: 228774 - DNA, 25 bp, Homo sapien
aactctaacagtgcaggttgttcac

SEQ ID NO: 228775 - DNA, 25 bp, Homo sapien
acccttgtttcttactgtgggagag

SEQ ID NO: 228776 - DNA, 25 bp, Homo sapien
aatacagcactcatttcttgttttt

SEQ ID NO: 228777 - DNA, 25 bp, Homo sapien
gaaaatctatgtaaaatcaaaccaa

SEQ ID NO: 228778 - DNA, 25 bp, Homo sapien
gttggactgagtgtgtattgtcttg

SEQ ID NO: 228779 - DNA, 25 bp, Homo sapien
tatgtccaggcgtggaccgctctgc

SEQ ID NO: 228780 - DNA, 25 bp, Homo sapien
cacgcactagctcggttattggtta

SEQ ID NO: 228781 - DNA, 25 bp, Homo sapien
tggttatgccaaaggcactctccat

SEQ ID NO: 228782 - DNA, 25 bp, Homo sapien
catctcccacatctggttattgaca

SEQ ID NO: 228783 - DNA, 25 bp, Homo sapien
aactttattttcatcgcggactctg

SEQ ID NO: 228784 - DNA, 25 bp, Homo sapien
actcacaagctgtagctgccataca

SEQ ID NO: 228785 - DNA, 25 bp, Homo sapien
gtagctgccatacatgcccatctag

SEQ ID NO: 228786 - DNA, 25 bp, Homo sapien
atctagcttgcagtctcttcgcgct

SEQ ID NO: 228787 - DNA, 25 bp, Homo sapien
gctttcgctgtctctcttattatga

SEQ ID NO: 228788 - DNA, 25 bp, Homo sapien
gacaagtctgttaaaatggttcctg

SEQ ID NO: 228789 - DNA, 25 bp, Homo sapien
aaaatggttcctgagccgtctgtac

SEQ ID NO: 228790 - DNA, 25 bp, Homo sapien
taagagtggtacagttacaattcag

SEQ ID NO: 228791 - DNA, 25 bp, Homo sapien
ttcagtgtccattctcaggagatgc

SEQ ID NO: 228792 - DNA, 25 bp, Homo sapien
gtccattctcaggagatgctaagta

SEQ ID NO: 228793 - DNA, 25 bp, Homo sapien
atgctaagtagcactggtcatagac

SEQ ID NO: 228794 - DNA, 25 bp, Homo sapien
actggtcatagactcttgcctgaaa

SEQ ID NO: 228795 - DNA, 25 bp, Homo sapien
ctcttgcctgaaaaagttgccccta

SEQ ID NO: 228796 - DNA, 25 bp, Homo sapien
ttgcccctaaaaaccacacagtcaa

SEQ ID NO: 228797 - DNA, 25 bp, Homo sapien
cacagtcaaaacagccaacaagcaa

SEQ ID NO: 228798 - DNA, 25 bp, Homo sapien
aacaaaaatgcaccccaactgcaaa

SEQ ID NO: 228799 - DNA, 25 bp, Homo sapien
aaaactattccacaggcagcctgat

SEQ ID NO: 228800 - DNA, 25 bp, Homo sapien
tccaaaacacagaaagccttccttt

SEQ ID NO: 228801 - DNA, 25 bp, Homo sapien
catcctggacattcacagcacatta

SEQ ID NO: 228802 - DNA, 25 bp, Homo sapien
ggacattcacagcacattattataa

SEQ ID NO: 228803 - DNA, 25 bp, Homo sapien
tataagactgttcatgagccatggt

SEQ ID NO: 228804 - DNA, 25 bp, Homo sapien
ctgcccagagcctttactatgcaaa

SEQ ID NO: 228805 - DNA, 25 bp, Homo sapien
gaaatggagaaacctttttgcatct

SEQ ID NO: 228806 - DNA, 25 bp, Homo sapien
ggagaaacctttttgcatctaactt

SEQ ID NO: 228807 - DNA, 25 bp, Homo sapien
atttcccaaatttattcaacgcaga

SEQ ID NO: 228808 - DNA, 25 bp, Homo sapien
ttcaacgcagagctcttttctacat

SEQ ID NO: 228809 - DNA, 25 bp, Homo sapien
agagctcttttctacatcccttgaa

SEQ ID NO: 228810 - DNA, 25 bp, Homo sapien
gctcttttctacatcccttgaaagt

SEQ ID NO: 228811 - DNA, 25 bp, Homo sapien
ttctacatcccttgaaagtagtatt

SEQ ID NO: 228812 - DNA, 25 bp, Homo sapien
aatcacagtttaggtttgaatcgcc

SEQ ID NO: 228813 - DNA, 25 bp, Homo sapien
gtttgaatcgccttgttatgatgag

SEQ ID NO: 228814 - DNA, 25 bp, Homo sapien
gagaggaacttgatgttagtcagaa

SEQ ID NO: 228815 - DNA, 25 bp, Homo sapien
gtcagaaataaagtcacatgccctt

SEQ ID NO: 228816 - DNA, 25 bp, Homo sapien
gtcacatgccctttagataacttga

SEQ ID NO: 228817 - DNA, 25 bp, Homo sapien
ggtcctcaaacaattttgcaacact

SEQ ID NO: 228818 - DNA, 25 bp, Homo sapien
ctcttcctcttccatactatgtgga

SEQ ID NO: 228819 - DNA, 25 bp, Homo sapien
aaataccagtgttacggcagggcgt

SEQ ID NO: 228820 - DNA, 25 bp, Homo sapien
ttacggcagggcgtacttctaactc

SEQ ID NO: 228821 - DNA, 25 bp, Homo sapien
gtacttctaactcacagtaagccag

SEQ ID NO: 228822 - DNA, 25 bp, Homo sapien
aactcacagtaagccagatagatct

SEQ ID NO: 228823 - DNA, 25 bp, Homo sapien
gtgcctgcactcaaatagccgatgt

SEQ ID NO: 228824 - DNA, 25 bp, Homo sapien
atagccgatgttactgtccctagat

SEQ ID NO: 228825 - DNA, 25 bp, Homo sapien
tgattaagggcttgtttgtaccaaa

SEQ ID NO: 228826 - DNA, 25 bp, Homo sapien
caatgccatgacctgtgttttagtt

SEQ ID NO: 228827 - DNA, 25 bp, Homo sapien
gttttagtttggctgcaccacagat

SEQ ID NO: 228828 - DNA, 25 bp, Homo sapien
cagatcaaatctgcactgtgtctac

SEQ ID NO: 228829 - DNA, 25 bp, Homo sapien
aaggtcctggtgtgtgctaatgttc

SEQ ID NO: 228830 - DNA, 25 bp, Homo sapien
gctaatgttcccaatgcaggacttg

SEQ ID NO: 228831 - DNA, 25 bp, Homo sapien
agagctctgttatatgtttccattt

SEQ ID NO: 228832 - DNA, 25 bp, Homo sapien
gataaccaaaccttatggcccttat

SEQ ID NO: 228833 - DNA, 25 bp, Homo sapien
ggaggcactggctgcctcttaattt

SEQ ID NO: 228834 - DNA, 25 bp, Homo sapien
ggagcaaaacacttggaacccacaa

SEQ ID NO: 228835 - DNA, 25 bp, Homo sapien
gaacccacaagactcccagaaggtg

SEQ ID NO: 228836 - DNA, 25 bp, Homo sapien
ccagaaggtgaagttaagagctccc

SEQ ID NO: 228837 - DNA, 25 bp, Homo sapien
attagaacagcaaactggcacccca

SEQ ID NO: 228838 - DNA, 25 bp, Homo sapien
tggcaccccaaagaactttacggag

SEQ ID NO: 228839 - DNA, 25 bp, Homo sapien
gaactttacggagacttgcaaccta

SEQ ID NO: 228840 - DNA, 25 bp, Homo sapien
acggagacttgcaacctatcaacaa

SEQ ID NO: 228841 - DNA, 25 bp, Homo sapien
gattaaaagccttcaacaaccaaca

SEQ ID NO: 228842 - DNA, 25 bp, Homo sapien
aaacattctaaccttcacagacaga

SEQ ID NO: 228843 - DNA, 25 bp, Homo sapien
ggacctggctgaagacatctggaga

SEQ ID NO: 228844 - DNA, 25 bp, Homo sapien
gaaagttaagtaccagcttgcattt

SEQ ID NO: 228845 - DNA, 25 bp, Homo sapien
tccactgcatccgatctcattattt

SEQ ID NO: 228846 - DNA, 25 bp, Homo sapien
gatctcattatttcggtggttgctt

SEQ ID NO: 228847 - DNA, 25 bp, Homo sapien
ctcattatttcggtggttgcttggg

SEQ ID NO: 228848 - DNA, 25 bp, Homo sapien
ttttcccctataattctgacccgct

SEQ ID NO: 228849 - DNA, 25 bp, Homo sapien
aattctgacccgctcaggcttgagg

SEQ ID NO: 228850 - DNA, 25 bp, Homo sapien
gctcaggcttgagggtttctccggc

SEQ ID NO: 228851 - DNA, 25 bp, Homo sapien
caggcttgagggtttctccggcctc

SEQ ID NO: 228852 - DNA, 25 bp, Homo sapien
ctgttgcaaggctttaattcttgca

SEQ ID NO: 228853 - DNA, 25 bp, Homo sapien
ttgcaactgggacctgctcgcaggc

SEQ ID NO: 228854 - DNA, 25 bp, Homo sapien
cacctctctctacatttttgcaagt

SEQ ID NO: 228855 - DNA, 25 bp, Homo sapien
acctgctctacctgccagaaatttt

SEQ ID NO: 228856 - DNA, 25 bp, Homo sapien
gttttaactctcatatgagcaaact

SEQ ID NO: 228857 - DNA, 25 bp, Homo sapien
ctcatatgagcaaactgtccaactt

SEQ ID NO: 228858 - DNA, 25 bp, Homo sapien
gattaaacttcttacgatcaaattt

SEQ ID NO: 228859 - DNA, 25 bp, Homo sapien
cgatcaaatttgtctcttgcaatga

SEQ ID NO: 228860 - DNA, 25 bp, Homo sapien
aatttgtctcttgcaatgatgtgat

SEQ ID NO: 228861 - DNA, 25 bp, Homo sapien
aatgatgtgatgagttgccaaataa

SEQ ID NO: 228862 - DNA, 25 bp, Homo sapien
aaatgttttgttcatattcttgttt

SEQ ID NO: 228863 - DNA, 25 bp, Homo sapien
tttacattcagtgtgtatgggtttt

SEQ ID NO: 228864 - DNA, 25 bp, Homo sapien
ttttattttgactcttaatgtaagg

SEQ ID NO: 228865 - DNA, 25 bp, Homo sapien
gtcattttacatggtttcttactga

SEQ ID NO: 228866 - DNA, 25 bp, Homo sapien
ggtttcttactgagattttatatat

SEQ ID NO: 228867 - DNA, 25 bp, Homo sapien
atggaccagactctgcacccggtga

SEQ ID NO: 228868 - DNA, 25 bp, Homo sapien
actctgcacccggtgagtgaggaca

SEQ ID NO: 228869 - DNA, 25 bp, Homo sapien
gcacccggtgagtgaggacagtccc

SEQ ID NO: 228870 - DNA, 25 bp, Homo sapien
gtcccatcgatgttgaatctcatgc

SEQ ID NO: 228871 - DNA, 25 bp, Homo sapien
gatgttgaatctcatgccactgcaa

SEQ ID NO: 228872 - DNA, 25 bp, Homo sapien
tgaatctcatgccactgcaagtgcc

SEQ ID NO: 228873 - DNA, 25 bp, Homo sapien
tcatgccactgcaagtgccattcac

SEQ ID NO: 228874 - DNA, 25 bp, Homo sapien
aagtgccattcaccactgcgtcctg

SEQ ID NO: 228875 - DNA, 25 bp, Homo sapien
tgcgtcctgggctttacgagaccat

SEQ ID NO: 228876 - DNA, 25 bp, Homo sapien
ctgggctttacgagaccatgcaaga

SEQ ID NO: 228877 - DNA, 25 bp, Homo sapien
gctttacgagaccatgcaagacggg

SEQ ID NO: 228878 - DNA, 25 bp, Homo sapien
aaggcctttgtttgcgaagatttgt

SEQ ID NO: 228879 - DNA, 25 bp, Homo sapien
ggctttattttcaggtttggacaga

SEQ ID NO: 228880 - DNA, 25 bp, Homo sapien
aatggaacgctagaaggacagtttt

SEQ ID NO: 228881 - DNA, 25 bp, Homo sapien
gttttaaagcacaaaagctgcctct

SEQ ID NO: 228882 - DNA, 25 bp, Homo sapien
aaagctgcctcttagcatctgtaag

SEQ ID NO: 228883 - DNA, 25 bp, Homo sapien
cctcttagcatctgtaaggtgtcct

SEQ ID NO: 228884 - DNA, 25 bp, Homo sapien
ggactgctgtgccaactccagctgt

SEQ ID NO: 228885 - DNA, 25 bp, Homo sapien
cagctgtctccacgcagaaacttaa

SEQ ID NO: 228886 - DNA, 25 bp, Homo sapien
agaaacttaaccagggaaggcactg

SEQ ID NO: 228887 - DNA, 25 bp, Homo sapien
gaaggcactggtttgcttataccat

SEQ ID NO: 228888 - DNA, 25 bp, Homo sapien
tataccattgttagggctgtgtgcc

SEQ ID NO: 228889 - DNA, 25 bp, Homo sapien
tcacttgtggttctacattcctggt

SEQ ID NO: 228890 - DNA, 25 bp, Homo sapien
ttgtggttctacattcctggtgaat

SEQ ID NO: 228891 - DNA, 25 bp, Homo sapien
cctggtgaatgatgaatgttgctgt

SEQ ID NO: 228892 - DNA, 25 bp, Homo sapien
atgaatgttgctgtcaaagggctgc

SEQ ID NO: 228893 - DNA, 25 bp, Homo sapien
taccttataagggttgctgggcatt

SEQ ID NO: 228894 - DNA, 25 bp, Homo sapien
gcatttgaaggcaggaagattttta

SEQ ID NO: 228895 - DNA, 25 bp, Homo sapien
tattcctgtaaaccaacaataaagc

SEQ ID NO: 228896 - DNA, 25 bp, Homo sapien
gtaaataacactggtttcaaatagt

SEQ ID NO: 228897 - DNA, 25 bp, Homo sapien
gtgatgttagacttaacctaattta

SEQ ID NO: 228898 - DNA, 25 bp, Homo sapien
agattaatatctccatgcatagttt

SEQ ID NO: 228899 - DNA, 25 bp, Homo sapien
atctccatgcatagttttagacaaa

SEQ ID NO: 228900 - DNA, 25 bp, Homo sapien
gaaaggcggcttttagccaggtatt

SEQ ID NO: 228901 - DNA, 25 bp, Homo sapien
gtgtctgtagacaagatggaatcat

SEQ ID NO: 228902 - DNA, 25 bp, Homo sapien
gaatcatctccatttaatagacggc

SEQ ID NO: 228903 - DNA, 25 bp, Homo sapien
agacggcaatggacctcactatcat

SEQ ID NO: 228904 - DNA, 25 bp, Homo sapien
tcactatcattgagggtaacagcca

SEQ ID NO: 228905 - DNA, 25 bp, Homo sapien
gagggtaacagccaaagaactttct

SEQ ID NO: 228906 - DNA, 25 bp, Homo sapien
gccaaagaactttctcttgtcaaca

SEQ ID NO: 228907 - DNA, 25 bp, Homo sapien
gtcaacaagaacaagtcatcggcta

SEQ ID NO: 228908 - DNA, 25 bp, Homo sapien
caagtcatcggctattgtggaaata

SEQ ID NO: 228909 - DNA, 25 bp, Homo sapien
ggaaatattctccaagtaccagaaa

SEQ ID NO: 228910 - DNA, 25 bp, Homo sapien
tagagcgccgggacctgtgacaggg

SEQ ID NO: 228911 - DNA, 25 bp, Homo sapien
cctacgtctaagctgggccaggcag

SEQ ID NO: 228912 - DNA, 25 bp, Homo sapien
cctccggtgagcaggtgtgatccca

SEQ ID NO: 228913 - DNA, 25 bp, Homo sapien
ctccggtgagcaggtgtgatcccag

SEQ ID NO: 228914 - DNA, 25 bp, Homo sapien
gagcaggtgtgatcccagggcccct

SEQ ID NO: 228915 - DNA, 25 bp, Homo sapien
aggtgtgatcccagggcccctgatc

SEQ ID NO: 228916 - DNA, 25 bp, Homo sapien
ccagggcccctgatcagcagcggag

SEQ ID NO: 228917 - DNA, 25 bp, Homo sapien
agggcccctgatcagcagcggagga

SEQ ID NO: 228918 - DNA, 25 bp, Homo sapien
ccctgatcagcagcggaggagcgct

SEQ ID NO: 228919 - DNA, 25 bp, Homo sapien
aagcggggtcatccaggcaactcgg

SEQ ID NO: 228920 - DNA, 25 bp, Homo sapien
gggtcatccaggcaactcgggggag

SEQ ID NO: 228921 - DNA, 25 bp, Homo sapien
gggaggggaagctcacagaccggta

SEQ ID NO: 228922 - DNA, 25 bp, Homo sapien
agggatcaaatgtagcacagtgtaa

SEQ ID NO: 228923 - DNA, 25 bp, Homo sapien
agcaacacaggtagagggacccagt

SEQ ID NO: 228924 - DNA, 25 bp, Homo sapien
agtatagacctacatctctgttggg

SEQ ID NO: 228925 - DNA, 25 bp, Homo sapien
atggcctgggtgtttagcagcttct

SEQ ID NO: 228926 - DNA, 25 bp, Homo sapien
aaggccctctgcatcgttgttgtaa

SEQ ID NO: 228927 - DNA, 25 bp, Homo sapien
gccctctgcatcgttgttgtaataa

SEQ ID NO: 228928 - DNA, 25 bp, Homo sapien
gttgttgtaataatcagctctggca

SEQ ID NO: 228929 - DNA, 25 bp, Homo sapien
gctctggcatattcagctgcaactg

SEQ ID NO: 228930 - DNA, 25 bp, Homo sapien
agctgcaactgtccctgaagaagag

SEQ ID NO: 228931 - DNA, 25 bp, Homo sapien
tgaagaagaggtttctgagctggct

SEQ ID NO: 228932 - DNA, 25 bp, Homo sapien
ccccatgtaggagggtgttaccttg

SEQ ID NO: 228933 - DNA, 25 bp, Homo sapien
gtgcacacaggatggattacctgca

SEQ ID NO: 228934 - DNA, 25 bp, Homo sapien
gcacacaggatggattacctgcact

SEQ ID NO: 228935 - DNA, 25 bp, Homo sapien
aggatggattacctgcactttgagg

SEQ ID NO: 228936 - DNA, 25 bp, Homo sapien
gtggtttgacatggatatggtgatc

SEQ ID NO: 228937 - DNA, 25 bp, Homo sapien
gtttgacatggatatggtgatcata

SEQ ID NO: 228938 - DNA, 25 bp, Homo sapien
gacatggatatggtgatcatatata

SEQ ID NO: 228939 - DNA, 25 bp, Homo sapien
tttattcagtgaactgggtcattgg

SEQ ID NO: 228940 - DNA, 25 bp, Homo sapien
attcagtgaactgggtcattggatt

SEQ ID NO: 228941 - DNA, 25 bp, Homo sapien
cagtgaactgggtcattggattcat

SEQ ID NO: 228942 - DNA, 25 bp, Homo sapien
gaactgggtcattggattcattgtt

SEQ ID NO: 228943 - DNA, 25 bp, Homo sapien
aactgggtcattggattcattgttt

SEQ ID NO: 228944 - DNA, 25 bp, Homo sapien
ttaaaccaagtttacttcagtatgt

SEQ ID NO: 228945 - DNA, 25 bp, Homo sapien
accaagtttacttcagtatgttaat

SEQ ID NO: 228946 - DNA, 25 bp, Homo sapien
gaaaggtgaattcgagtattttaat

SEQ ID NO: 228947 - DNA, 25 bp, Homo sapien
gtattttaatgttatacctgccatt

SEQ ID NO: 228948 - DNA, 25 bp, Homo sapien
tttaatgttatacctgccatttttt

SEQ ID NO: 228949 - DNA, 25 bp, Homo sapien
tcttaaagcatattctttgcatcta

SEQ ID NO: 228950 - DNA, 25 bp, Homo sapien
attctttgcatctaactgccagtgc

SEQ ID NO: 228951 - DNA, 25 bp, Homo sapien
taaatcgttgtacatttcttattaa

SEQ ID NO: 228952 - DNA, 25 bp, Homo sapien
gtacatttcttattaaactaagtgc

SEQ ID NO: 228953 - DNA, 25 bp, Homo sapien
tgttgccatcatatagtgtataaaa

SEQ ID NO: 228954 - DNA, 25 bp, Homo sapien
gccaattgattgtaactattattta

SEQ ID NO: 228955 - DNA, 25 bp, Homo sapien
gtgcccttcacactgtgacattgtg

SEQ ID NO: 228956 - DNA, 25 bp, Homo sapien
attgtgacaagctccatgtccttta

SEQ ID NO: 228957 - DNA, 25 bp, Homo sapien
atgtcctttaaaatcagtcactctg

SEQ ID NO: 228958 - DNA, 25 bp, Homo sapien
atcagtcactctgcacacaagagaa

SEQ ID NO: 228959 - DNA, 25 bp, Homo sapien
agagaaatcaacttcgtggttggat

SEQ ID NO: 228960 - DNA, 25 bp, Homo sapien
ggccggaacacaaccagtctttttg

SEQ ID NO: 228961 - DNA, 25 bp, Homo sapien
acagtactcactgagtgtttttcag

SEQ ID NO: 228962 - DNA, 25 bp, Homo sapien
agtttcctactggtggttttgatat

SEQ ID NO: 228963 - DNA, 25 bp, Homo sapien
agaatgacatcatctaagaagctga

SEQ ID NO: 228964 - DNA, 25 bp, Homo sapien
gctgattttgctaaactcctgttcc

SEQ ID NO: 228965 - DNA, 25 bp, Homo sapien
taaactcctgttccctacaatggga

SEQ ID NO: 228966 - DNA, 25 bp, Homo sapien
gttatggatcactttttattcaaat

SEQ ID NO: 228967 - DNA, 25 bp, Homo sapien
agtgagtgcgtttacaattcattgg

SEQ ID NO: 228968 - DNA, 25 bp, Homo sapien
tccctacccacaatacagttatctt

SEQ ID NO: 228969 - DNA, 25 bp, Homo sapien
tacccacaatacagttatctttttt

SEQ ID NO: 228970 - DNA, 25 bp, Homo sapien
ttttattgtgttgtgttatgcctac

SEQ ID NO: 228971 - DNA, 25 bp, Homo sapien
tttattgtgttgtgttatgcctaca

SEQ ID NO: 228972 - DNA, 25 bp, Homo sapien
ttattgtgttgtgttatgcctacat

SEQ ID NO: 228973 - DNA, 25 bp, Homo sapien
tattgtgttgtgttatgcctacatg

SEQ ID NO: 228974 - DNA, 25 bp, Homo sapien
gtgttgtgttatgcctacatgtgat

SEQ ID NO: 228975 - DNA, 25 bp, Homo sapien
gttgtgttatgcctacatgtgatat

SEQ ID NO: 228976 - DNA, 25 bp, Homo sapien
gttatgcctacatgtgatataaatt

SEQ ID NO: 228977 - DNA, 25 bp, Homo sapien
aattctattaacaactcgacttgac

SEQ ID NO: 228978 - DNA, 25 bp, Homo sapien
tcgacttgacaaattgcaccgctca

SEQ ID NO: 228979 - DNA, 25 bp, Homo sapien
attgcaccgctcaatggaagcgttt

SEQ ID NO: 228980 - DNA, 25 bp, Homo sapien
attaattacgcattttattgcatta

SEQ ID NO: 228981 - DNA, 25 bp, Homo sapien
taatccaaaacctggctttgaacca

SEQ ID NO: 228982 - DNA, 25 bp, Homo sapien
ggccaaatatatacaatccactggt

SEQ ID NO: 228983 - DNA, 25 bp, Homo sapien
aatccactggtgtctgactatttcc

SEQ ID NO: 228984 - DNA, 25 bp, Homo sapien
ctggtgtctgactatttccattatt

SEQ ID NO: 228985 - DNA, 25 bp, Homo sapien
ttccattattattcaatgtgtcacc

SEQ ID NO: 228986 - DNA, 25 bp, Homo sapien
aaccagggaggcatacaatttcgta

SEQ ID NO: 228987 - DNA, 25 bp, Homo sapien
ggaggcatacaatttcgtaattaat

SEQ ID NO: 228988 - DNA, 25 bp, Homo sapien
aatacaaaaatcatcccagtttggt

SEQ ID NO: 228989 - DNA, 25 bp, Homo sapien
atacaaaaatcatcccagtttggtg

SEQ ID NO: 228990 - DNA, 25 bp, Homo sapien
tacaaaaatcatcccagtttggtgg

SEQ ID NO: 228991 - DNA, 25 bp, Homo sapien
acaaaaatcatcccagtttggtggt

SEQ ID NO: 228992 - DNA, 25 bp, Homo sapien
caaaaatcatcccagtttggtggtg

SEQ ID NO: 228993 - DNA, 25 bp, Homo sapien
aaaaatcatcccagtttggtggtgc

SEQ ID NO: 228994 - DNA, 25 bp, Homo sapien
aaaatcatcccagtttggtggtgca

SEQ ID NO: 228995 - DNA, 25 bp, Homo sapien
aaatcatcccagtttggtggtgcac

SEQ ID NO: 228996 - DNA, 25 bp, Homo sapien
aatcatcccagtttggtggtgcaca

SEQ ID NO: 228997 - DNA, 25 bp, Homo sapien
cgcttgaaccttggaaggggcagtt

SEQ ID NO: 228998 - DNA, 25 bp, Homo sapien
aaccttggaaggggcagttgcagtg

SEQ ID NO: 228999 - DNA, 25 bp, Homo sapien
agagtcttggtctctcgaacaggct

SEQ ID NO: 229000 - DNA, 25 bp, Homo sapien
gtcttggtctctcgaacaggctgga

SEQ ID NO: 229001 - DNA, 25 bp, Homo sapien
ttggtctctcgaacaggctggagtg

SEQ ID NO: 229002 - DNA, 25 bp, Homo sapien
gattccttaaattcagatatgacag

SEQ ID NO: 229003 - DNA, 25 bp, Homo sapien
ttcagatatgacagctaattacctc

SEQ ID NO: 229004 - DNA, 25 bp, Homo sapien
gatatgacagctaattacctcatca

SEQ ID NO: 229005 - DNA, 25 bp, Homo sapien
acagctaattacctcatcataaatt

SEQ ID NO: 229006 - DNA, 25 bp, Homo sapien
attacctcatcataaattactttta

SEQ ID NO: 229007 - DNA, 25 bp, Homo sapien
tccagggttttagagtagttgaatg

SEQ ID NO: 229008 - DNA, 25 bp, Homo sapien
gagatagagtcttggtctctcgaac

SEQ ID NO: 229009 - DNA, 25 bp, Homo sapien
gatagagtcttggtctctcgaacag

SEQ ID NO: 229010 - DNA, 25 bp, Homo sapien
atttgttttttgactaatgtgctat

SEQ ID NO: 229011 - DNA, 25 bp, Homo sapien
gtgagaaaagatactgatcgccaat

SEQ ID NO: 229012 - DNA, 25 bp, Homo sapien
gatactgatcgccaatatttcaaat

SEQ ID NO: 229013 - DNA, 25 bp, Homo sapien
atatttcaaataccgtcttgcaatg

SEQ ID NO: 229014 - DNA, 25 bp, Homo sapien
accgtcttgcaatgtatagttttta

SEQ ID NO: 229015 - DNA, 25 bp, Homo sapien
gacattgtagtataaagctgtaatt

SEQ ID NO: 229016 - DNA, 25 bp, Homo sapien
attagctatgtcaatgatatcttgc

SEQ ID NO: 229017 - DNA, 25 bp, Homo sapien
gatatcttgcaaagtgttcccattt

SEQ ID NO: 229018 - DNA, 25 bp, Homo sapien
cttgcaaagtgttcccatttataat

SEQ ID NO: 229019 - DNA, 25 bp, Homo sapien
aatagctttctgaagtaaattcgaa

SEQ ID NO: 229020 - DNA, 25 bp, Homo sapien
gtaaattcgaagttaatgtgcataa

SEQ ID NO: 229021 - DNA, 25 bp, Homo sapien
aaaaattccacccattttgcagatg

SEQ ID NO: 229022 - DNA, 25 bp, Homo sapien
ctggagctttgagggcactttctca

SEQ ID NO: 229023 - DNA, 25 bp, Homo sapien
ttctcagggtcacaagctagtacga

SEQ ID NO: 229024 - DNA, 25 bp, Homo sapien
agctgagtctcaaaagccttttccc

SEQ ID NO: 229025 - DNA, 25 bp, Homo sapien
gagctcccacccactgatgaagctt

SEQ ID NO: 229026 - DNA, 25 bp, Homo sapien
tgatgaagcttttcccctgacagag

SEQ ID NO: 229027 - DNA, 25 bp, Homo sapien
ggtgtgaccctggatgaacctcttc

SEQ ID NO: 229028 - DNA, 25 bp, Homo sapien
ggccctgttagtgtcttctatctgt

SEQ ID NO: 229029 - DNA, 25 bp, Homo sapien
tgtcttctatctgttgagctcttga

SEQ ID NO: 229030 - DNA, 25 bp, Homo sapien
gagctcttgatcgttcacaaagccc

SEQ ID NO: 229031 - DNA, 25 bp, Homo sapien
tcacaaagccccttcataactgtta

SEQ ID NO: 229032 - DNA, 25 bp, Homo sapien
ggatcacaatatgtctgggctctca

SEQ ID NO: 229033 - DNA, 25 bp, Homo sapien
atatgtctgggctctcattacccaa

SEQ ID NO: 229034 - DNA, 25 bp, Homo sapien
gggctctcattacccaaacatctga

SEQ ID NO: 229035 - DNA, 25 bp, Homo sapien
aacatctgagattccatttttgcca

SEQ ID NO: 229036 - DNA, 25 bp, Homo sapien
gagattccatttttgccatgtgtca

SEQ ID NO: 229037 - DNA, 25 bp, Homo sapien
tttgccatgtgtcatcgagtcgctc

SEQ ID NO: 229038 - DNA, 25 bp, Homo sapien
gtcgctccccaacagatgtttgtga

SEQ ID NO: 229039 - DNA, 25 bp, Homo sapien
ggctgtcaccatggtgggattcttt

SEQ ID NO: 229040 - DNA, 25 bp, Homo sapien
acaccatctacccttaaatatccaa

SEQ ID NO: 229041 - DNA, 25 bp, Homo sapien
tccaaccccagcaatttatacaacg

SEQ ID NO: 229042 - DNA, 25 bp, Homo sapien
gtataatgggagttctggatcacaa

SEQ ID NO: 229043 - DNA, 25 bp, Homo sapien
aaagcggttgttgacttgaatggga

SEQ ID NO: 229044 - DNA, 25 bp, Homo sapien
ttcagggtcttggatttggcagaac

SEQ ID NO: 229045 - DNA, 25 bp, Homo sapien
ggatttggcagaacaagtttgattt

SEQ ID NO: 229046 - DNA, 25 bp, Homo sapien
tttgattttaagaactagagcacga

SEQ ID NO: 229047 - DNA, 25 bp, Homo sapien
tagagcacgagtcatctccggtgat

SEQ ID NO: 229048 - DNA, 25 bp, Homo sapien
gagtcatctccggtgatccttaaat

SEQ ID NO: 229049 - DNA, 25 bp, Homo sapien
atctccggtgatccttaaatgaact

SEQ ID NO: 229050 - DNA, 25 bp, Homo sapien
gatccttaaatgaactgcaggctga

SEQ ID NO: 229051 - DNA, 25 bp, Homo sapien
aggaaaaaggtcacagcctccatgg

SEQ ID NO: 229052 - DNA, 25 bp, Homo sapien
actcttggaaggacttctaagatat

SEQ ID NO: 229053 - DNA, 25 bp, Homo sapien
gatatatgttgattgatcccttttt

SEQ ID NO: 229054 - DNA, 25 bp, Homo sapien
tggctctggactcaccaggcactga

SEQ ID NO: 229055 - DNA, 25 bp, Homo sapien
aggcactgaccactttgtcatcatt

SEQ ID NO: 229056 - DNA, 25 bp, Homo sapien
gtcatcattgcccaactgaaggaag

SEQ ID NO: 229057 - DNA, 25 bp, Homo sapien
ggctgattttcagtaccaggaatcg

SEQ ID NO: 229058 - DNA, 25 bp, Homo sapien
ttttcagtaccaggaatcgcagatg

SEQ ID NO: 229059 - DNA, 25 bp, Homo sapien
gaatcgcagatgagagccaaaatga

SEQ ID NO: 229060 - DNA, 25 bp, Homo sapien
tgcaggccaaaaaccgagagctcct

SEQ ID NO: 229061 - DNA, 25 bp, Homo sapien
aaaaccgagagctcctgaagcaggc

SEQ ID NO: 229062 - DNA, 25 bp, Homo sapien
agagctcctgaagcaggcagctgct

SEQ ID NO: 229063 - DNA, 25 bp, Homo sapien
agcaggcagctgctttgtccaagag

SEQ ID NO: 229064 - DNA, 25 bp, Homo sapien
gcagctgctttgtccaagagcaaga

SEQ ID NO: 229065 - DNA, 25 bp, Homo sapien
gaggtcaaggatgcattccaggaaa

SEQ ID NO: 229066 - DNA, 25 bp, Homo sapien
ggatgcattccaggaaagttctata

SEQ ID NO: 229067 - DNA, 25 bp, Homo sapien
aactccaacctgatatttgacctag

SEQ ID NO: 229068 - DNA, 25 bp, Homo sapien
aacctgatatttgacctagccatgg

SEQ ID NO: 229069 - DNA, 25 bp, Homo sapien
ctgatatttgacctagccatggaaa

SEQ ID NO: 229070 - DNA, 25 bp, Homo sapien
gacctagccatggaaaacctcattg

SEQ ID NO: 229071 - DNA, 25 bp, Homo sapien
catggaaaacctcattggctcctca

SEQ ID NO: 229072 - DNA, 25 bp, Homo sapien
attggctcctcactggatcagacca

SEQ ID NO: 229073 - DNA, 25 bp, Homo sapien
gctcctcactggatcagaccataaa

SEQ ID NO: 229074 - DNA, 25 bp, Homo sapien
atcagaccataaaaatgatccagga

SEQ ID NO: 229075 - DNA, 25 bp, Homo sapien
atctaagataaattcccaccacttc

SEQ ID NO: 229076 - DNA, 25 bp, Homo sapien
tctccttgaccagcgagaggccggg

SEQ ID NO: 229077 - DNA, 25 bp, Homo sapien
atggtgccaggccttggcaagaaat

SEQ ID NO: 229078 - DNA, 25 bp, Homo sapien
gcctgggatgaagtcaaacacgtct

SEQ ID NO: 229079 - DNA, 25 bp, Homo sapien
aaacacgtctttgatgcccacggag

SEQ ID NO: 229080 - DNA, 25 bp, Homo sapien
gatgcccacggagaccacctggatg

SEQ ID NO: 229081 - DNA, 25 bp, Homo sapien
acgttgagcggtgtggtgtccctct

SEQ ID NO: 229082 - DNA, 25 bp, Homo sapien
tgtccctctgagtgtctgagcgccc

SEQ ID NO: 229083 - DNA, 25 bp, Homo sapien
ctgagcgcccgtcagtgatgaccag

SEQ ID NO: 229084 - DNA, 25 bp, Homo sapien
gatgaccagggcgatgcggttgttc

SEQ ID NO: 229085 - DNA, 25 bp, Homo sapien
ggcagcagctggtcccgcgtgtact

SEQ ID NO: 229086 - DNA, 25 bp, Homo sapien
tggtcccgcgtgtactgcagggcct

SEQ ID NO: 229087 - DNA, 25 bp, Homo sapien
gatattatttgcttatgacactaac

SEQ ID NO: 229088 - DNA, 25 bp, Homo sapien
gacactaacactattaatgacagga

SEQ ID NO: 229089 - DNA, 25 bp, Homo sapien
ttaatgacaggagtcaatcagcctt

SEQ ID NO: 229090 - DNA, 25 bp, Homo sapien
gtcaatcagcctttacagctatcaa

SEQ ID NO: 229091 - DNA, 25 bp, Homo sapien
tcagcctttacagctatcaaaatat

SEQ ID NO: 229092 - DNA, 25 bp, Homo sapien
gatcccaatgatgattcttttttac

SEQ ID NO: 229093 - DNA, 25 bp, Homo sapien
gtttgggactttgattggctggcaa

SEQ ID NO: 229094 - DNA, 25 bp, Homo sapien
gactttgattggctggcaaacattt

SEQ ID NO: 229095 - DNA, 25 bp, Homo sapien
gatttcaaaaatagcttacaggatt

SEQ ID NO: 229096 - DNA, 25 bp, Homo sapien
taaacatggtgtggtattctaaagc

SEQ ID NO: 229097 - DNA, 25 bp, Homo sapien
tggtgtggtattctaaagccttttt

SEQ ID NO: 229098 - DNA, 25 bp, Homo sapien
tccgctttccttttctctactttgt

SEQ ID NO: 229099 - DNA, 25 bp, Homo sapien
gctttccttttctctactttgtaat

SEQ ID NO: 229100 - DNA, 25 bp, Homo sapien
tccttttctctactttgtaatttat

SEQ ID NO: 229101 - DNA, 25 bp, Homo sapien
atttattgatcagtttctgttggga

SEQ ID NO: 229102 - DNA, 25 bp, Homo sapien
attgatcagtttctgttgggagacg

SEQ ID NO: 229103 - DNA, 25 bp, Homo sapien
ttgatcagtttctgttgggagacgg

SEQ ID NO: 229104 - DNA, 25 bp, Homo sapien
tttctgttgggagacgggtgtcctt

SEQ ID NO: 229105 - DNA, 25 bp, Homo sapien
ttctgttgggagacgggtgtccttt

SEQ ID NO: 229106 - DNA, 25 bp, Homo sapien
caagtcttccttcttcgtccgaaag

SEQ ID NO: 229107 - DNA, 25 bp, Homo sapien
tcttccttcttcgtccgaaaggagg

SEQ ID NO: 229108 - DNA, 25 bp, Homo sapien
ggggggactcgctgctacaagcctc

SEQ ID NO: 229109 - DNA, 25 bp, Homo sapien
agcagtggactgtcactcatcagta

SEQ ID NO: 229110 - DNA, 25 bp, Homo sapien
tgtcactcatcagtatctgcagttc

SEQ ID NO: 229111 - DNA, 25 bp, Homo sapien
tctgcagttctgtttaccaaagcct

SEQ ID NO: 229112 - DNA, 25 bp, Homo sapien
ccaaagcctgcttgctagagacgtt

SEQ ID NO: 229113 - DNA, 25 bp, Homo sapien
gctagagacgtttcagggcctcctt

SEQ ID NO: 229114 - DNA, 25 bp, Homo sapien
aagcgtccactgtacctccatctgg

SEQ ID NO: 229115 - DNA, 25 bp, Homo sapien
tggatacaattagctggctccccac

SEQ ID NO: 229116 - DNA, 25 bp, Homo sapien
ccacttcctggactgacggtaacca

SEQ ID NO: 229117 - DNA, 25 bp, Homo sapien
tgacggtaaccaccttttccaatga

SEQ ID NO: 229118 - DNA, 25 bp, Homo sapien
caccttttccaatgaccctgaagaa

SEQ ID NO: 229119 - DNA, 25 bp, Homo sapien
ctggcctgcctacatgacacaaata

SEQ ID NO: 229120 - DNA, 25 bp, Homo sapien
ttctatacgtgtggtgatgtccacc

SEQ ID NO: 229121 - DNA, 25 bp, Homo sapien
atacgtgtggtgatgtccaccatct

SEQ ID NO: 229122 - DNA, 25 bp, Homo sapien
gtgtggtgatgtccaccatctctac

SEQ ID NO: 229123 - DNA, 25 bp, Homo sapien
gtggtgatgtccaccatctctacat

SEQ ID NO: 229124 - DNA, 25 bp, Homo sapien
ggtgatgtccaccatctctacatat

SEQ ID NO: 229125 - DNA, 25 bp, Homo sapien
tgatgtccaccatctctacatatca

SEQ ID NO: 229126 - DNA, 25 bp, Homo sapien
tgtccaccatctctacatatcaaat

SEQ ID NO: 229127 - DNA, 25 bp, Homo sapien
tccaccatctctacatatcaaatct

SEQ ID NO: 229128 - DNA, 25 bp, Homo sapien
gtaaatcagaaattcagtcaacaag

SEQ ID NO: 229129 - DNA, 25 bp, Homo sapien
cagtcaacaagtattcagaatttcc

SEQ ID NO: 229130 - DNA, 25 bp, Homo sapien
acaagtattcagaatttccagatgt

SEQ ID NO: 229131 - DNA, 25 bp, Homo sapien
ggaatagttatttgctgtctgtgaa

SEQ ID NO: 229132 - DNA, 25 bp, Homo sapien
gaaattgagccttttggtgcgccac

SEQ ID NO: 229133 - DNA, 25 bp, Homo sapien
gtggtgccagatcaacacttctatc

SEQ ID NO: 229134 - DNA, 25 bp, Homo sapien
tctgcactgaccacgttgtgaactg

SEQ ID NO: 229135 - DNA, 25 bp, Homo sapien
accacgttgtgaactgggagaccaa

SEQ ID NO: 229136 - DNA, 25 bp, Homo sapien
gggagaccaaatgcaagccatttca

SEQ ID NO: 229137 - DNA, 25 bp, Homo sapien
agccatttcatggacatagcaatat

SEQ ID NO: 229138 - DNA, 25 bp, Homo sapien
atattgtaaactcttgcaggtggga

SEQ ID NO: 229139 - DNA, 25 bp, Homo sapien
ggtgggagagcagttcacctcctta

SEQ ID NO: 229140 - DNA, 25 bp, Homo sapien
agttcacctccttagctctgtttgc

SEQ ID NO: 229141 - DNA, 25 bp, Homo sapien
tgtttgccagctcttacagggtaaa

SEQ ID NO: 229142 - DNA, 25 bp, Homo sapien
gtccgctttccttttctctactttg

SEQ ID NO: 229143 - DNA, 25 bp, Homo sapien
tccgctttccttttctctactttgt

SEQ ID NO: 229144 - DNA, 25 bp, Homo sapien
gctttccttttctctactttgtaat

SEQ ID NO: 229145 - DNA, 25 bp, Homo sapien
tccttttctctactttgtaatttat

SEQ ID NO: 229146 - DNA, 25 bp, Homo sapien
gggaggggggactcgctgctacaag

SEQ ID NO: 229147 - DNA, 25 bp, Homo sapien
ggaggggggactcgctgctacaagc

SEQ ID NO: 229148 - DNA, 25 bp, Homo sapien
ggggggactcgctgctacaagcctc

SEQ ID NO: 229149 - DNA, 25 bp, Homo sapien
ctgctacaagcctcgccccctgtgc

SEQ ID NO: 229150 - DNA, 25 bp, Homo sapien
aagcctcgccccctgtgccactcag

SEQ ID NO: 229151 - DNA, 25 bp, Homo sapien
cctgtgccactcagctccgccccgc

SEQ ID NO: 229152 - DNA, 25 bp, Homo sapien
ggtcccccgggtcatctgcgggcgg

SEQ ID NO: 229153 - DNA, 25 bp, Homo sapien
gcagtaagtgcaaagtctgccccca

SEQ ID NO: 229154 - DNA, 25 bp, Homo sapien
gtctgcccccaccataaagattatg

SEQ ID NO: 229155 - DNA, 25 bp, Homo sapien
tgaggagatacagaacacgaagtta

SEQ ID NO: 229156 - DNA, 25 bp, Homo sapien
atggtgttgactgtttgttaatagc

SEQ ID NO: 229157 - DNA, 25 bp, Homo sapien
gttaatagcaccattacagtgacta

SEQ ID NO: 229158 - DNA, 25 bp, Homo sapien
tacagtgactatatcccaatgctat

SEQ ID NO: 229159 - DNA, 25 bp, Homo sapien
gactatatcccaatgctattaacta

SEQ ID NO: 229160 - DNA, 25 bp, Homo sapien
tattaactaactttaccttggcctg

SEQ ID NO: 229161 - DNA, 25 bp, Homo sapien
taactttaccttggcctgggctagg

SEQ ID NO: 229162 - DNA, 25 bp, Homo sapien
cctgggctaggtctccattggaaat

SEQ ID NO: 229163 - DNA, 25 bp, Homo sapien
tggaaataataacggatggctgctg

SEQ ID NO: 229164 - DNA, 25 bp, Homo sapien
tgtccaaatgaaagctagtagatgt

SEQ ID NO: 229165 - DNA, 25 bp, Homo sapien
gtttacaattttataatctcagttg

SEQ ID NO: 229166 - DNA, 25 bp, Homo sapien
aatcactatatacaatacaccctta

SEQ ID NO: 229167 - DNA, 25 bp, Homo sapien
tacacccttaatttgttcattccag

SEQ ID NO: 229168 - DNA, 25 bp, Homo sapien
tgttcattccagaaacatactgaga

SEQ ID NO: 229169 - DNA, 25 bp, Homo sapien
aacatactgagatgtcagctactta

SEQ ID NO: 229170 - DNA, 25 bp, Homo sapien
gtcagctacttaaaaatggtcacaa

SEQ ID NO: 229171 - DNA, 25 bp, Homo sapien
ggtcacaaaaagctactgtttatat

SEQ ID NO: 229172 - DNA, 25 bp, Homo sapien
gtttatatttttcctcctgctattc

SEQ ID NO: 229173 - DNA, 25 bp, Homo sapien
gttgttcatttactgcactgctgag

SEQ ID NO: 229174 - DNA, 25 bp, Homo sapien
tgcactgctgagaactaattaaaat

SEQ ID NO: 229175 - DNA, 25 bp, Homo sapien
gtgggaatcggagatcccggacaaa

SEQ ID NO: 229176 - DNA, 25 bp, Homo sapien
gagatcccggacaaaggcagatttt

SEQ ID NO: 229177 - DNA, 25 bp, Homo sapien
gcccatgaagcagaactcagtgagt

SEQ ID NO: 229178 - DNA, 25 bp, Homo sapien
gaactcagtgagttggagaacaact

SEQ ID NO: 229179 - DNA, 25 bp, Homo sapien
gatcaacgtgtcacctggctatcaa

SEQ ID NO: 229180 - DNA, 25 bp, Homo sapien
tggagaacaactacaaagcagcctt

SEQ ID NO: 229181 - DNA, 25 bp, Homo sapien
aaggcagagaagttggctgcccaag

SEQ ID NO: 229182 - DNA, 25 bp, Homo sapien
gctgcccaagagaagctagaggaga

SEQ ID NO: 229183 - DNA, 25 bp, Homo sapien
gaatatgtttcgtacgtatcaggac

SEQ ID NO: 229184 - DNA, 25 bp, Homo sapien
gtttcgtacgtatcaggacagtatt

SEQ ID NO: 229185 - DNA, 25 bp, Homo sapien
tggctatcaacttgttcggaatcgg

SEQ ID NO: 229186 - DNA, 25 bp, Homo sapien
gtcacacctgagcttgccagccagg

SEQ ID NO: 229187 - DNA, 25 bp, Homo sapien
tgagggcctggacatagccaccttc

SEQ ID NO: 229188 - DNA, 25 bp, Homo sapien
ttcctagcccacaatgactcacata

SEQ ID NO: 229189 - DNA, 25 bp, Homo sapien
acaatgactcacataccttcttctg

SEQ ID NO: 229190 - DNA, 25 bp, Homo sapien
atgactcacataccttcttctgctg

SEQ ID NO: 229191 - DNA, 25 bp, Homo sapien
acagggatgacaggtaccaatgtca

SEQ ID NO: 229192 - DNA, 25 bp, Homo sapien
aggtaccaatgtcatggacacccac

SEQ ID NO: 229193 - DNA, 25 bp, Homo sapien
atgtcatggacacccacctcttgtt

SEQ ID NO: 229194 - DNA, 25 bp, Homo sapien
acctcttgttcctgcggcctcggtg

SEQ ID NO: 229195 - DNA, 25 bp, Homo sapien
ggcctcggtgatggcataggtcaca

SEQ ID NO: 229196 - DNA, 25 bp, Homo sapien
tgatggcataggtcacattttggga

SEQ ID NO: 229197 - DNA, 25 bp, Homo sapien
agtgctagggactcgtcatgagtgg

SEQ ID NO: 229198 - DNA, 25 bp, Homo sapien
gtcaaacagaaggtaaacagtctta

SEQ ID NO: 229199 - DNA, 25 bp, Homo sapien
tatttaatactgaactttggcctac

SEQ ID NO: 229200 - DNA, 25 bp, Homo sapien
tttaatactgaactttggcctactt

SEQ ID NO: 229201 - DNA, 25 bp, Homo sapien
taatactgaactttggcctactttg

SEQ ID NO: 229202 - DNA, 25 bp, Homo sapien
atactgaactttggcctactttgtg

SEQ ID NO: 229203 - DNA, 25 bp, Homo sapien
ctgaactttggcctactttgtgata

SEQ ID NO: 229204 - DNA, 25 bp, Homo sapien
gaggaaatcactatttctcacttct

SEQ ID NO: 229205 - DNA, 25 bp, Homo sapien
ggaaatcactatttctcacttctgt

SEQ ID NO: 229206 - DNA, 25 bp, Homo sapien
aaatcactatttctcacttctgtat

SEQ ID NO: 229207 - DNA, 25 bp, Homo sapien
atcactatttctcacttctgtattt

SEQ ID NO: 229208 - DNA, 25 bp, Homo sapien
tggaaagcatgactagaactggact

SEQ ID NO: 229209 - DNA, 25 bp, Homo sapien
gaactggacttgtttatcactgcaa

SEQ ID NO: 229210 - DNA, 25 bp, Homo sapien
gtttatcactgcaagtttctcccac

SEQ ID NO: 229211 - DNA, 25 bp, Homo sapien
tcactgcaagtttctcccactgttg

SEQ ID NO: 229212 - DNA, 25 bp, Homo sapien
actgtgtcttctcactactggaact

SEQ ID NO: 229213 - DNA, 25 bp, Homo sapien
gtgtcttctcactactggaacttag

SEQ ID NO: 229214 - DNA, 25 bp, Homo sapien
ctcactactggaacttagttagatt

SEQ ID NO: 229215 - DNA, 25 bp, Homo sapien
agttctggttcctgatttaacctca

SEQ ID NO: 229216 - DNA, 25 bp, Homo sapien
ggttcctgatttaacctcaggcttt

SEQ ID NO: 229217 - DNA, 25 bp, Homo sapien
ctcaggctttgtggaattagggatt

SEQ ID NO: 229218 - DNA, 25 bp, Homo sapien
gaattagggattcttaatctttcag

SEQ ID NO: 229219 - DNA, 25 bp, Homo sapien
gtgggaatcggagatcccggacaaa

SEQ ID NO: 229220 - DNA, 25 bp, Homo sapien
tcggagatcccggacaaaggcagat

SEQ ID NO: 229221 - DNA, 25 bp, Homo sapien
gagatcccggacaaaggcagatttt

SEQ ID NO: 229222 - DNA, 25 bp, Homo sapien
gatcccggacaaaggcagattttcc

SEQ ID NO: 229223 - DNA, 25 bp, Homo sapien
gaagaatatgtttcgtacgtatcag

SEQ ID NO: 229224 - DNA, 25 bp, Homo sapien
gaatatgtttcgtacgtatcaggac

SEQ ID NO: 229225 - DNA, 25 bp, Homo sapien
atatgtttcgtacgtatcaggacag

SEQ ID NO: 229226 - DNA, 25 bp, Homo sapien
atgtttcgtacgtatcaggacagta

SEQ ID NO: 229227 - DNA, 25 bp, Homo sapien
gtttcgtacgtatcaggacagtatt

SEQ ID NO: 229228 - DNA, 25 bp, Homo sapien
tcgtacgtatcaggacagtatttat

SEQ ID NO: 229229 - DNA, 25 bp, Homo sapien
tttgataggaaaaagcggtgggaat

SEQ ID NO: 229230 - DNA, 25 bp, Homo sapien
acctcttgttcctgcggcctcggtg

SEQ ID NO: 229231 - DNA, 25 bp, Homo sapien
cctcttgttcctgcggcctcggtga

SEQ ID NO: 229232 - DNA, 25 bp, Homo sapien
cggcctcggtgatggcataggtcac

SEQ ID NO: 229233 - DNA, 25 bp, Homo sapien
ggcctcggtgatggcataggtcaca

SEQ ID NO: 229234 - DNA, 25 bp, Homo sapien
cctcggtgatggcataggtcacatt

SEQ ID NO: 229235 - DNA, 25 bp, Homo sapien
ctcggtgatggcataggtcacattt

SEQ ID NO: 229236 - DNA, 25 bp, Homo sapien
tcggtgatggcataggtcacatttt

SEQ ID NO: 229237 - DNA, 25 bp, Homo sapien
cggtgatggcataggtcacattttg

SEQ ID NO: 229238 - DNA, 25 bp, Homo sapien
ggtgatggcataggtcacattttgg

SEQ ID NO: 229239 - DNA, 25 bp, Homo sapien
gtgatggcataggtcacattttggg

SEQ ID NO: 229240 - DNA, 25 bp, Homo sapien
tgatggcataggtcacattttggga

SEQ ID NO: 229241 - DNA, 25 bp, Homo sapien
aagtaaaggtcatggcttagctgaa

SEQ ID NO: 229242 - DNA, 25 bp, Homo sapien
gctgaaggaaatgctccagaaattg

SEQ ID NO: 229243 - DNA, 25 bp, Homo sapien
aatgctccagaaattggactgtgta

SEQ ID NO: 229244 - DNA, 25 bp, Homo sapien
ggactgtgtaaaccatcagtacaat

SEQ ID NO: 229245 - DNA, 25 bp, Homo sapien
atcagtacaataatacgctgtgtat

SEQ ID NO: 229246 - DNA, 25 bp, Homo sapien
attatggcataattggagcatttgc

SEQ ID NO: 229247 - DNA, 25 bp, Homo sapien
tggagcatttgcattaatcaacaaa

SEQ ID NO: 229248 - DNA, 25 bp, Homo sapien
tttacagctgtcttgattaaagcca

SEQ ID NO: 229249 - DNA, 25 bp, Homo sapien
taaagccaagtgttccatgttgctg

SEQ ID NO: 229250 - DNA, 25 bp, Homo sapien
gccaagtgttccatgttgctgtgaa

SEQ ID NO: 229251 - DNA, 25 bp, Homo sapien
gtgttccatgttgctgtgaagaata

SEQ ID NO: 229252 - DNA, 25 bp, Homo sapien
gtaaaaggatctgggctgcagtcca

SEQ ID NO: 229253 - DNA, 25 bp, Homo sapien
gctgcagtccagtctgagagatgcc

SEQ ID NO: 229254 - DNA, 25 bp, Homo sapien
ctgagagatgccagcaaaggcttcc

SEQ ID NO: 229255 - DNA, 25 bp, Homo sapien
aaaggcttcctaggccagttcagtc

SEQ ID NO: 229256 - DNA, 25 bp, Homo sapien
agttcagtccagtaaatccctcttc

SEQ ID NO: 229257 - DNA, 25 bp, Homo sapien
cagtaaatccctcttcgatcttctc

SEQ ID NO: 229258 - DNA, 25 bp, Homo sapien
tcgatcttctcttccacacagacag

SEQ ID NO: 229259 - DNA, 25 bp, Homo sapien
gagcatgcccatgaactcacatgat

SEQ ID NO: 229260 - DNA, 25 bp, Homo sapien
tgaggtagtaattccactttcaggg

SEQ ID NO: 229261 - DNA, 25 bp, Homo sapien
gattattttatcacccttcagtgag

SEQ ID NO: 229262 - DNA, 25 bp, Homo sapien
cacccttcagtgagttgtttttgtt

SEQ ID NO: 229263 - DNA, 25 bp, Homo sapien
gaagtttcagtgaccttgagggcta

SEQ ID NO: 229264 - DNA, 25 bp, Homo sapien
ccttgagggctaaagattgttcttc

SEQ ID NO: 229265 - DNA, 25 bp, Homo sapien
gattgttcttctgggtaagagctct

SEQ ID NO: 229266 - DNA, 25 bp, Homo sapien
ggctggtttttcagagcagagttct

SEQ ID NO: 229267 - DNA, 25 bp, Homo sapien
tcttgttgtgggtagactgtgacta

SEQ ID NO: 229268 - DNA, 25 bp, Homo sapien
tagactgtgactaggttcacagcct

SEQ ID NO: 229269 - DNA, 25 bp, Homo sapien
cacagcctttgtggaacattccgta

SEQ ID NO: 229270 - DNA, 25 bp, Homo sapien
ccgtataacggcattgtggaagcaa

SEQ ID NO: 229271 - DNA, 25 bp, Homo sapien
gaagcaataactagttcctatgaaa

SEQ ID NO: 229272 - DNA, 25 bp, Homo sapien
ttcctatgaaagaaccagagctggg

SEQ ID NO: 229273 - DNA, 25 bp, Homo sapien
aagatggctgggaagccaggccaaa

SEQ ID NO: 229274 - DNA, 25 bp, Homo sapien
ctggttacagtttcgactcctctct

SEQ ID NO: 229275 - DNA, 25 bp, Homo sapien
tggttacagtttcgactcctctctg

SEQ ID NO: 229276 - DNA, 25 bp, Homo sapien
tcgactcctctctgcaagtgaatag

SEQ ID NO: 229277 - DNA, 25 bp, Homo sapien
gactcctctctgcaagtgaataggc

SEQ ID NO: 229278 - DNA, 25 bp, Homo sapien
ctcctctctgcaagtgaataggccc

SEQ ID NO: 229279 - DNA, 25 bp, Homo sapien
cctctctgcaagtgaataggcccag

SEQ ID NO: 229280 - DNA, 25 bp, Homo sapien
acaagtttggctctggtaactgacc

SEQ ID NO: 229281 - DNA, 25 bp, Homo sapien
aagtttggctctggtaactgacctt

SEQ ID NO: 229282 - DNA, 25 bp, Homo sapien
agtttggctctggtaactgaccttc

SEQ ID NO: 229283 - DNA, 25 bp, Homo sapien
ggtaactgaccttcaaagctaaaat

SEQ ID NO: 229284 - DNA, 25 bp, Homo sapien
gtaactgaccttcaaagctaaaata

SEQ ID NO: 229285 - DNA, 25 bp, Homo sapien
atgcatatgcacgtgcaatttgcac

SEQ ID NO: 229286 - DNA, 25 bp, Homo sapien
aatttgcacggcagcatttcaccga

SEQ ID NO: 229287 - DNA, 25 bp, Homo sapien
caccgattgtggactgtattggcta

SEQ ID NO: 229288 - DNA, 25 bp, Homo sapien
attggctaatgtgtttcctggtctt

SEQ ID NO: 229289 - DNA, 25 bp, Homo sapien
gtgtttcctggtctttagatgcaaa

SEQ ID NO: 229290 - DNA, 25 bp, Homo sapien
atcttatctcatagttttttcaggg

SEQ ID NO: 229291 - DNA, 25 bp, Homo sapien
gggtgcttcttgattagtagggaat

SEQ ID NO: 229292 - DNA, 25 bp, Homo sapien
ttttgaacacctctttaaatacagc

SEQ ID NO: 229293 - DNA, 25 bp, Homo sapien
atttgcatatgatgccagcctcacg

SEQ ID NO: 229294 - DNA, 25 bp, Homo sapien
cctcacgcatttgtatatctccaga

SEQ ID NO: 229295 - DNA, 25 bp, Homo sapien
attcaggtatgcctcaccaatttgc

SEQ ID NO: 229296 - DNA, 25 bp, Homo sapien
taaaaggatctgggctgcagtccag

SEQ ID NO: 229297 - DNA, 25 bp, Homo sapien
gctgcagtccagtctgagagatgcc

SEQ ID NO: 229298 - DNA, 25 bp, Homo sapien
tttgaggtagtaattccactttcag

SEQ ID NO: 229299 - DNA, 25 bp, Homo sapien
tgaggtagtaattccactttcaggg

SEQ ID NO: 229300 - DNA, 25 bp, Homo sapien
aattccactttcaggggcaaataca

SEQ ID NO: 229301 - DNA, 25 bp, Homo sapien
ttttgattattttatcacccttcag

SEQ ID NO: 229302 - DNA, 25 bp, Homo sapien
gattattttatcacccttcagtgag

SEQ ID NO: 229303 - DNA, 25 bp, Homo sapien
attttatcacccttcagtgagttgt

SEQ ID NO: 229304 - DNA, 25 bp, Homo sapien
ttatcacccttcagtgagttgtttt

SEQ ID NO: 229305 - DNA, 25 bp, Homo sapien
cacccttcagtgagttgtttttgtt

SEQ ID NO: 229306 - DNA, 25 bp, Homo sapien
ctttaatcaaggatgtatgtttgaa

SEQ ID NO: 229307 - DNA, 25 bp, Homo sapien
ggcctgctccgatgaacgtcaggac

SEQ ID NO: 229308 - DNA, 25 bp, Homo sapien
aacgtcaggacggtggctgcagcag

SEQ ID NO: 229309 - DNA, 25 bp, Homo sapien
agggctggccttggatctgtccagt

SEQ ID NO: 229310 - DNA, 25 bp, Homo sapien
gatctgtccagtagggtcactgact

SEQ ID NO: 229311 - DNA, 25 bp, Homo sapien
cagagttggttgaaatggctacgaa

SEQ ID NO: 229312 - DNA, 25 bp, Homo sapien
tggctacgaagtgtggagaataacc

SEQ ID NO: 229313 - DNA, 25 bp, Homo sapien
gagaataaccactgaatcccaaaaa

SEQ ID NO: 229314 - DNA, 25 bp, Homo sapien
gaatcccaaaaagtcactgcgcttg

SEQ ID NO: 229315 - DNA, 25 bp, Homo sapien
aaagtcactgcgcttgatctgatcc

SEQ ID NO: 229316 - DNA, 25 bp, Homo sapien
actgcgcttgatctgatccaagtaa

SEQ ID NO: 229317 - DNA, 25 bp, Homo sapien
agaacagccacttgtgccgggaagg

SEQ ID NO: 229318 - DNA, 25 bp, Homo sapien
ttcacttaataaaacttctctattt

SEQ ID NO: 229319 - DNA, 25 bp, Homo sapien
acaatgccctgaatgttgcttttct

SEQ ID NO: 229320 - DNA, 25 bp, Homo sapien
atgttgcttttcttaaacctgagca

SEQ ID NO: 229321 - DNA, 25 bp, Homo sapien
gcttttcttaaacctgagcagcact

SEQ ID NO: 229322 - DNA, 25 bp, Homo sapien
tttcttaaacctgagcagcactgag

SEQ ID NO: 229323 - DNA, 25 bp, Homo sapien
taaacctgagcagcactgagatgtt

SEQ ID NO: 229324 - DNA, 25 bp, Homo sapien
acctgagcagcactgagatgttgaa

SEQ ID NO: 229325 - DNA, 25 bp, Homo sapien
agcagcactgagatgttgaaactgt

SEQ ID NO: 229326 - DNA, 25 bp, Homo sapien
gatgttgaaactgttccatatttct

SEQ ID NO: 229327 - DNA, 25 bp, Homo sapien
aactgttccatatttcttttccgtg

SEQ ID NO: 229328 - DNA, 25 bp, Homo sapien
actgttccatatttcttttccgtga

SEQ ID NO: 229329 - DNA, 25 bp, Homo sapien
tggctgtctgctcagcctggaacac

SEQ ID NO: 229330 - DNA, 25 bp, Homo sapien
tggccagctcctaggcctcctgtag

SEQ ID NO: 229331 - DNA, 25 bp, Homo sapien
ctcctgtaggtctcagcccaaatgt

SEQ ID NO: 229332 - DNA, 25 bp, Homo sapien
taggtctcagcccaaatgtcccttc

SEQ ID NO: 229333 - DNA, 25 bp, Homo sapien
gcccaaatgtcccttcctcaaagaa

SEQ ID NO: 229334 - DNA, 25 bp, Homo sapien
tcaaagaaaccttcctggagccacc

SEQ ID NO: 229335 - DNA, 25 bp, Homo sapien
agtgcctcccctttgcagtgctggg

SEQ ID NO: 229336 - DNA, 25 bp, Homo sapien
gtgtgggattttcccagtatgtgtc

SEQ ID NO: 229337 - DNA, 25 bp, Homo sapien
attttcccagtatgtgtccctgcac

SEQ ID NO: 229338 - DNA, 25 bp, Homo sapien
agtatgtgtccctgcaccaggctgt

SEQ ID NO: 229339 - DNA, 25 bp, Homo sapien
ggctctgctgccgagggaccttgat

SEQ ID NO: 229340 - DNA, 25 bp, Homo sapien
gtatctgtaggtgggctctgtgtcc

SEQ ID NO: 229341 - DNA, 25 bp, Homo sapien
ggagctggtagatagtctcccaccc

SEQ ID NO: 229342 - DNA, 25 bp, Homo sapien
tggtagatagtctcccacccctggc

SEQ ID NO: 229343 - DNA, 25 bp, Homo sapien
gcagagtccctgcataggtcttgac

SEQ ID NO: 229344 - DNA, 25 bp, Homo sapien
gtccctgcataggtcttgactagct

SEQ ID NO: 229345 - DNA, 25 bp, Homo sapien
ataggtcttgactagctgcctctgt

SEQ ID NO: 229346 - DNA, 25 bp, Homo sapien
gacccaggtctgtataactcggagc

SEQ ID NO: 229347 - DNA, 25 bp, Homo sapien
ccaggtctgtataactcggagctca

SEQ ID NO: 229348 - DNA, 25 bp, Homo sapien
gtataactcggagctcagaccctgg

SEQ ID NO: 229349 - DNA, 25 bp, Homo sapien
gagctcagaccctggctcctgcgag

SEQ ID NO: 229350 - DNA, 25 bp, Homo sapien
ccagcacaggatgtatctgtaggtg

SEQ ID NO: 229351 - DNA, 25 bp, Homo sapien
aaatgatgttcttggtgtttttcta

SEQ ID NO: 229352 - DNA, 25 bp, Homo sapien
tctataatgtagtcttgttagcttt

SEQ ID NO: 229353 - DNA, 25 bp, Homo sapien
gttactgtaacaatgctgatctcga

SEQ ID NO: 229354 - DNA, 25 bp, Homo sapien
tgctgatctcgaactgtaccaaaat

SEQ ID NO: 229355 - DNA, 25 bp, Homo sapien
tctcgaactgtaccaaaatacatgg

SEQ ID NO: 229356 - DNA, 25 bp, Homo sapien
aaatacatggagactaacaaacaga

SEQ ID NO: 229357 - DNA, 25 bp, Homo sapien
gaaccacatggaactttcaaactga

SEQ ID NO: 229358 - DNA, 25 bp, Homo sapien
ggtaattgaatatactcctttgaaa

SEQ ID NO: 229359 - DNA, 25 bp, Homo sapien
atttcatcaagtatgtttcctgctc

SEQ ID NO: 229360 - DNA, 25 bp, Homo sapien
caagtatgtttcctgctcattgtga

SEQ ID NO: 229361 - DNA, 25 bp, Homo sapien
gtatgtttcctgctcattgtgatac

SEQ ID NO: 229362 - DNA, 25 bp, Homo sapien
cagccggcgaggaagtgacgcttct

SEQ ID NO: 229363 - DNA, 25 bp, Homo sapien
gaagtgacgcttctgactttgacct

SEQ ID NO: 229364 - DNA, 25 bp, Homo sapien
gcttctgactttgacctcttagaga

SEQ ID NO: 229365 - DNA, 25 bp, Homo sapien
tgacctcttagagacgcagtctgct

SEQ ID NO: 229366 - DNA, 25 bp, Homo sapien
tagagacgcagtctgcttgttccga

SEQ ID NO: 229367 - DNA, 25 bp, Homo sapien
ctgcttgttccgacacttcagaaag

SEQ ID NO: 229368 - DNA, 25 bp, Homo sapien
gacacttcagaaagcagcgctgcag

SEQ ID NO: 229369 - DNA, 25 bp, Homo sapien
caaaatcccaaccatgtctaagaag

SEQ ID NO: 229370 - DNA, 25 bp, Homo sapien
atgtctaagaagaccaccactgcct

SEQ ID NO: 229371 - DNA, 25 bp, Homo sapien
ggtcccaagcgataacactgtctaa

SEQ ID NO: 229372 - DNA, 25 bp, Homo sapien
gggtgtatatttattctgaacggga

SEQ ID NO: 229373 - DNA, 25 bp, Homo sapien
tcaggcacagtctgtctgggtgcaa

SEQ ID NO: 229374 - DNA, 25 bp, Homo sapien
agtctgtctgggtgcaacttcttca

SEQ ID NO: 229375 - DNA, 25 bp, Homo sapien
ggtgcaacttcttcagctgtctggc

SEQ ID NO: 229376 - DNA, 25 bp, Homo sapien
gtctggccgcaccttaaaaactatt

SEQ ID NO: 229377 - DNA, 25 bp, Homo sapien
aaagccccaggcatttcagaaggtg

SEQ ID NO: 229378 - DNA, 25 bp, Homo sapien
ggcatttcagaaggtggcactcagg

SEQ ID NO: 229379 - DNA, 25 bp, Homo sapien
gaaggtggcactcaggtcaccctga

SEQ ID NO: 229380 - DNA, 25 bp, Homo sapien
tggcactcaggtcaccctgaaaagc

SEQ ID NO: 229381 - DNA, 25 bp, Homo sapien
attttgactagctgcttggctggat

SEQ ID NO: 229382 - DNA, 25 bp, Homo sapien
ctagctgcttggctggatgtacaaa

SEQ ID NO: 229383 - DNA, 25 bp, Homo sapien
acaataatgttgtcacttactgtaa

SEQ ID NO: 229384 - DNA, 25 bp, Homo sapien
aggcattccctacctgagcttcttg

SEQ ID NO: 229385 - DNA, 25 bp, Homo sapien
attccctacctgagcttcttgtctg

SEQ ID NO: 229386 - DNA, 25 bp, Homo sapien
tacctgagcttcttgtctgcttttc

SEQ ID NO: 229387 - DNA, 25 bp, Homo sapien
gagcttcttgtctgcttttccttct

SEQ ID NO: 229388 - DNA, 25 bp, Homo sapien
ttctcccactgcaagcggctgcttg

SEQ ID NO: 229389 - DNA, 25 bp, Homo sapien
gcctgcgggagccacacattcatct

SEQ ID NO: 229390 - DNA, 25 bp, Homo sapien
tgcgggagccacacattcatctcca

SEQ ID NO: 229391 - DNA, 25 bp, Homo sapien
tccacctggacacttgagccgcatg

SEQ ID NO: 229392 - DNA, 25 bp, Homo sapien
ctggacacttgagccgcatggccag

SEQ ID NO: 229393 - DNA, 25 bp, Homo sapien
cctcccacctgatgcggtggtgcgt

SEQ ID NO: 229394 - DNA, 25 bp, Homo sapien
acctgatgcggtggtgcgtgtgatt

SEQ ID NO: 229395 - DNA, 25 bp, Homo sapien
tgttcctgtgtcttcacgagctgtc

SEQ ID NO: 229396 - DNA, 25 bp, Homo sapien
ctgtgtcttcacgagctgtccctta

SEQ ID NO: 229397 - DNA, 25 bp, Homo sapien
tgtcttcacgagctgtcccttacag

SEQ ID NO: 229398 - DNA, 25 bp, Homo sapien
ttcacgagctgtcccttacaggcag

SEQ ID NO: 229399 - DNA, 25 bp, Homo sapien
cacgagctgtcccttacaggcaggg

SEQ ID NO: 229400 - DNA, 25 bp, Homo sapien
atgagctgggctggcaccacgactg

SEQ ID NO: 229401 - DNA, 25 bp, Homo sapien
tcttccccacagcaggctgctcaga

SEQ ID NO: 229402 - DNA, 25 bp, Homo sapien
gggtgaggttcctcaggagccctca

SEQ ID NO: 229403 - DNA, 25 bp, Homo sapien
tgtggacgctgcacctgccacttaa

SEQ ID NO: 229404 - DNA, 25 bp, Homo sapien
ggacgctgcacctgccacttaaaga

SEQ ID NO: 229405 - DNA, 25 bp, Homo sapien
ctgccacttaaagaccccaaagact

SEQ ID NO: 229406 - DNA, 25 bp, Homo sapien
agcacaacagttacgcctactgcat

SEQ ID NO: 229407 - DNA, 25 bp, Homo sapien
tctgcatctggaatgagtcctggat

SEQ ID NO: 229408 - DNA, 25 bp, Homo sapien
gtcctggattaggtgcatcagcctg

SEQ ID NO: 229409 - DNA, 25 bp, Homo sapien
aatacaaacatatgccttcctgcgg

SEQ ID NO: 229410 - DNA, 25 bp, Homo sapien
acttgatcgtattcttcactttctg

SEQ ID NO: 229411 - DNA, 25 bp, Homo sapien
actttctgcagagcccacatagata

SEQ ID NO: 229412 - DNA, 25 bp, Homo sapien
caagtcttcagacaggtcctcgatg

SEQ ID NO: 229413 - DNA, 25 bp, Homo sapien
ggtcctcgatgcactcgaaggtgat

SEQ ID NO: 229414 - DNA, 25 bp, Homo sapien
gtgatctcgaactggaacgggttgt

SEQ ID NO: 229415 - DNA, 25 bp, Homo sapien
ttatccagcaccactacattgttca

SEQ ID NO: 229416 - DNA, 25 bp, Homo sapien
ttcacctgaacctttgccatatttt

SEQ ID NO: 229417 - DNA, 25 bp, Homo sapien
cagggtgccaggacatttggccaaa

SEQ ID NO: 229418 - DNA, 25 bp, Homo sapien
tttggccaaacatgattctggttgt

SEQ ID NO: 229419 - DNA, 25 bp, Homo sapien
ggttgtgttccagagagtctttcag

SEQ ID NO: 229420 - DNA, 25 bp, Homo sapien
gagtctttcagatacgattaacatt

SEQ ID NO: 229421 - DNA, 25 bp, Homo sapien
atgggcagactaagtgaagcagatt

SEQ ID NO: 229422 - DNA, 25 bp, Homo sapien
gggtgggcctcatgcaatcaatcaa

SEQ ID NO: 229423 - DNA, 25 bp, Homo sapien
atgcaatcaatcaagggccaggaga

SEQ ID NO: 229424 - DNA, 25 bp, Homo sapien
ttaagaggcctaatgggaaacaaat

SEQ ID NO: 229425 - DNA, 25 bp, Homo sapien
atcaccatatgacaaaagggcatgt

SEQ ID NO: 229426 - DNA, 25 bp, Homo sapien
gggcatgtgtgatagttacttgtac

SEQ ID NO: 229427 - DNA, 25 bp, Homo sapien
gatagttacttgtacttgtcactgt

SEQ ID NO: 229428 - DNA, 25 bp, Homo sapien
ggaactaagagctagtatcttggat

SEQ ID NO: 229429 - DNA, 25 bp, Homo sapien
gtatcttggattaactgatgcctgc

SEQ ID NO: 229430 - DNA, 25 bp, Homo sapien
ggattaactgatgcctgctagtgct

SEQ ID NO: 229431 - DNA, 25 bp, Homo sapien
aactgatgcctgctagtgctttctg

SEQ ID NO: 229432 - DNA, 25 bp, Homo sapien
atgcctgctagtgctttctgattac

SEQ ID NO: 229433 - DNA, 25 bp, Homo sapien
gctagtgctttctgattactcgcat

SEQ ID NO: 229434 - DNA, 25 bp, Homo sapien
gctttctgattactcgcattctgtt

SEQ ID NO: 229435 - DNA, 25 bp, Homo sapien
ctgattactcgcattctgtttcttg

SEQ ID NO: 229436 - DNA, 25 bp, Homo sapien
attactcgcattctgtttcttgctt

SEQ ID NO: 229437 - DNA, 25 bp, Homo sapien
ctcgcattctgtttcttgctttaaa

SEQ ID NO: 229438 - DNA, 25 bp, Homo sapien
gtaaagacaagagtgttggaccagt

SEQ ID NO: 229439 - DNA, 25 bp, Homo sapien
tttgaatcagtattttaaaattggg

SEQ ID NO: 229440 - DNA, 25 bp, Homo sapien
taaaattgggtgattttggctgggc

SEQ ID NO: 229441 - DNA, 25 bp, Homo sapien
aaaattgggtgattttggctgggcg

SEQ ID NO: 229442 - DNA, 25 bp, Homo sapien
aaattgggtgattttggctgggcgc

SEQ ID NO: 229443 - DNA, 25 bp, Homo sapien
aattgggtgattttggctgggcgca

SEQ ID NO: 229444 - DNA, 25 bp, Homo sapien
attgggtgattttggctgggcgcag

SEQ ID NO: 229445 - DNA, 25 bp, Homo sapien
ttgggtgattttggctgggcgcagt

SEQ ID NO: 229446 - DNA, 25 bp, Homo sapien
tgggtgattttggctgggcgcagtg

SEQ ID NO: 229447 - DNA, 25 bp, Homo sapien
gggtgattttggctgggcgcagtgg

SEQ ID NO: 229448 - DNA, 25 bp, Homo sapien
atttttatttttgcagaggagccca

SEQ ID NO: 229449 - DNA, 25 bp, Homo sapien
tgtctcccggcctgataccagatac

SEQ ID NO: 229450 - DNA, 25 bp, Homo sapien
ccagatacaggttgttgatttcatc

SEQ ID NO: 229451 - DNA, 25 bp, Homo sapien
caggttgttgatttcatcgtgggta

SEQ ID NO: 229452 - DNA, 25 bp, Homo sapien
tgatttcatcgtgggtagcaagcta

SEQ ID NO: 229453 - DNA, 25 bp, Homo sapien
tttcatcgtgggtagcaagctagta

SEQ ID NO: 229454 - DNA, 25 bp, Homo sapien
ggtagcaagctagtaataaatttca

SEQ ID NO: 229455 - DNA, 25 bp, Homo sapien
aagtgctttctcttttcatgctttt

SEQ ID NO: 229456 - DNA, 25 bp, Homo sapien
gctttttgccaataactgttaccgc

SEQ ID NO: 229457 - DNA, 25 bp, Homo sapien
tttgccaataactgttaccgccgtt

SEQ ID NO: 229458 - DNA, 25 bp, Homo sapien
tttgacaaatagctgcaactgagac

SEQ ID NO: 229459 - DNA, 25 bp, Homo sapien
cacggctgcccgtttacacctttag

SEQ ID NO: 229460 - DNA, 25 bp, Homo sapien
ggctgcccgtttacacctttagcgt

SEQ ID NO: 229461 - DNA, 25 bp, Homo sapien
gcccgtttacacctttagcgtctgg

SEQ ID NO: 229462 - DNA, 25 bp, Homo sapien
gtttacacctttagcgtctggtcct

SEQ ID NO: 229463 - DNA, 25 bp, Homo sapien
tttacacctttagcgtctggtcctc

SEQ ID NO: 229464 - DNA, 25 bp, Homo sapien
agggccgttgcctgctcagaccttg

SEQ ID NO: 229465 - DNA, 25 bp, Homo sapien
gccgttgcctgctcagaccttgcag

SEQ ID NO: 229466 - DNA, 25 bp, Homo sapien
gcctgctcagaccttgcaggctgtg

SEQ ID NO: 229467 - DNA, 25 bp, Homo sapien
atccgttcacgtctctgcatccatt

SEQ ID NO: 229468 - DNA, 25 bp, Homo sapien
agcaagaggccctgggtctctccaa

SEQ ID NO: 229469 - DNA, 25 bp, Homo sapien
cattccttcatgtctttatttagtt

SEQ ID NO: 229470 - DNA, 25 bp, Homo sapien
tactttgcactaacatttgcaggat

SEQ ID NO: 229471 - DNA, 25 bp, Homo sapien
tttgcaggatgttcacacaatttta

SEQ ID NO: 229472 - DNA, 25 bp, Homo sapien
ttcccttgaccctagtaaaatatag

SEQ ID NO: 229473 - DNA, 25 bp, Homo sapien
gtttgccagaaacatcattcatgtg

SEQ ID NO: 229474 - DNA, 25 bp, Homo sapien
tgtgaactaggcaagttaccttttt

SEQ ID NO: 229475 - DNA, 25 bp, Homo sapien
ctaattgtaaactaggccaacctga

SEQ ID NO: 229476 - DNA, 25 bp, Homo sapien
ggccaacctgaaagccatggctgat

SEQ ID NO: 229477 - DNA, 25 bp, Homo sapien
aaagccatggctgatgctctagcca

SEQ ID NO: 229478 - DNA, 25 bp, Homo sapien
gctctagccatcaggttctttcaaa

SEQ ID NO: 229479 - DNA, 25 bp, Homo sapien
ggttctttcaaatgcatctttacac

SEQ ID NO: 229480 - DNA, 25 bp, Homo sapien
gcatctttacactcttgcacaaaag

SEQ ID NO: 229481 - DNA, 25 bp, Homo sapien
gtaggtagggtgtgcttacccacca

SEQ ID NO: 229482 - DNA, 25 bp, Homo sapien
taggtagggtgtgcttacccaccaa

SEQ ID NO: 229483 - DNA, 25 bp, Homo sapien
gtagggtgtgcttacccaccaaaat

SEQ ID NO: 229484 - DNA, 25 bp, Homo sapien
tagggtgtgcttacccaccaaaata

SEQ ID NO: 229485 - DNA, 25 bp, Homo sapien
agggtgtgcttacccaccaaaatag

SEQ ID NO: 229486 - DNA, 25 bp, Homo sapien
gtgtgcttacccaccaaaatagtga

SEQ ID NO: 229487 - DNA, 25 bp, Homo sapien
gtgcttacccaccaaaatagtgact

SEQ ID NO: 229488 - DNA, 25 bp, Homo sapien
gcttacccaccaaaatagtgactgg

SEQ ID NO: 229489 - DNA, 25 bp, Homo sapien
ttacccaccaaaatagtgactggta

SEQ ID NO: 229490 - DNA, 25 bp, Homo sapien
aatagtgactggtaacacttggtct

SEQ ID NO: 229491 - DNA, 25 bp, Homo sapien
tagtgactggtaacacttggtcttt

SEQ ID NO: 229492 - DNA, 25 bp, Homo sapien
atgcagcattgcacttgaactaaat

SEQ ID NO: 229493 - DNA, 25 bp, Homo sapien
gcacttgaactaaatgagcggctaa

SEQ ID NO: 229494 - DNA, 25 bp, Homo sapien
tcaagttgagtaccatgaagggcta

SEQ ID NO: 229495 - DNA, 25 bp, Homo sapien
ctgacattatccatgagcagatatt

SEQ ID NO: 229496 - DNA, 25 bp, Homo sapien
gaagacacaatgcattctccctgga

SEQ ID NO: 229497 - DNA, 25 bp, Homo sapien
tccctggatgagcaacacattacat

SEQ ID NO: 229498 - DNA, 25 bp, Homo sapien
attagtggtacatcaagtgaccgag

SEQ ID NO: 229499 - DNA, 25 bp, Homo sapien
gtgaccgaggttatggttccccaag

SEQ ID NO: 229500 - DNA, 25 bp, Homo sapien
ggttccccaagatacgctgaagtgt

SEQ ID NO: 229501 - DNA, 25 bp, Homo sapien
tgcagatgtacgtgacaatgagact

SEQ ID NO: 229502 - DNA, 25 bp, Homo sapien
gagactgacctttctcaggaatatt

SEQ ID NO: 229503 - DNA, 25 bp, Homo sapien
ctccacagggagttccaagctaact

SEQ ID NO: 229504 - DNA, 25 bp, Homo sapien
gagttccaagctaactcctcttcta

SEQ ID NO: 229505 - DNA, 25 bp, Homo sapien
tcctcttctaccagctccaaaaaat

SEQ ID NO: 229506 - DNA, 25 bp, Homo sapien
cttctaccagctccaaaaaatcaca

SEQ ID NO: 229507 - DNA, 25 bp, Homo sapien
aaatcacaattacctccaaccaaca

SEQ ID NO: 229508 - DNA, 25 bp, Homo sapien
tcacaattacctccaaccaacaaaa

SEQ ID NO: 229509 - DNA, 25 bp, Homo sapien
tacctccaaccaacaaaacctgttg

SEQ ID NO: 229510 - DNA, 25 bp, Homo sapien
gaaaatccattcagcaaggcaagaa

SEQ ID NO: 229511 - DNA, 25 bp, Homo sapien
gcaaggcaagaagagactaataaat

SEQ ID NO: 229512 - DNA, 25 bp, Homo sapien
gttcggaatcgggaacagatttctg

SEQ ID NO: 229513 - DNA, 25 bp, Homo sapien
aaggcagattttccaggaccaacat

SEQ ID NO: 229514 - DNA, 25 bp, Homo sapien
tcaagaccatcccactgcttgcctg

SEQ ID NO: 229515 - DNA, 25 bp, Homo sapien
cgcactcagccctgggtgcctgtga

SEQ ID NO: 229516 - DNA, 25 bp, Homo sapien
gtagcagctggtgggacactgatct

SEQ ID NO: 229517 - DNA, 25 bp, Homo sapien
agcagctggtgggacactgatctgt

SEQ ID NO: 229518 - DNA, 25 bp, Homo sapien
tggtgggacactgatctgtgagctc

SEQ ID NO: 229519 - DNA, 25 bp, Homo sapien
tgatctgtgagctctggaatgtctg

SEQ ID NO: 229520 - DNA, 25 bp, Homo sapien
tgtgagctctggaatgtctgcttag

SEQ ID NO: 229521 - DNA, 25 bp, Homo sapien
aggaactgctctgtctttgtaacta

SEQ ID NO: 229522 - DNA, 25 bp, Homo sapien
actactcaaggccaactgtcacatg

SEQ ID NO: 229523 - DNA, 25 bp, Homo sapien
tactcaaggccaactgtcacatgaa

SEQ ID NO: 229524 - DNA, 25 bp, Homo sapien
caaggccaactgtcacatgaaggaa

SEQ ID NO: 229525 - DNA, 25 bp, Homo sapien
tccatcacgcctgttaccagaggat

SEQ ID NO: 229526 - DNA, 25 bp, Homo sapien
gcctgttaccagaggatccccgaga

SEQ ID NO: 229527 - DNA, 25 bp, Homo sapien
gttaccagaggatccccgagagcca

SEQ ID NO: 229528 - DNA, 25 bp, Homo sapien
agaggatccccgagagccacaccag

SEQ ID NO: 229529 - DNA, 25 bp, Homo sapien
ggacatcaccgcccctggaactggg

SEQ ID NO: 229530 - DNA, 25 bp, Homo sapien
agccctgggcacgagatttgctctg

SEQ ID NO: 229531 - DNA, 25 bp, Homo sapien
ctgggcacgagatttgctctgactt

SEQ ID NO: 229532 - DNA, 25 bp, Homo sapien
ggcacgagatttgctctgactttat

SEQ ID NO: 229533 - DNA, 25 bp, Homo sapien
acgagatttgctctgactttattta

SEQ ID NO: 229534 - DNA, 25 bp, Homo sapien
gggaccaacagaaggtagtattgac

SEQ ID NO: 229535 - DNA, 25 bp, Homo sapien
agaaggtagtattgacaactgttcc

SEQ ID NO: 229536 - DNA, 25 bp, Homo sapien
taaaaatagtttccaagctgccgcg

SEQ ID NO: 229537 - DNA, 25 bp, Homo sapien
aaatagtttccaagctgccgcggac

SEQ ID NO: 229538 - DNA, 25 bp, Homo sapien
atagtttccaagctgccgcggacgc

SEQ ID NO: 229539 - DNA, 25 bp, Homo sapien
cgcggacgcccaggatgtgtttgca

SEQ ID NO: 229540 - DNA, 25 bp, Homo sapien
gacgcccaggatgtgtttgcagaga

SEQ ID NO: 229541 - DNA, 25 bp, Homo sapien
cccaggatgtgtttgcagagatcaa

SEQ ID NO: 229542 - DNA, 25 bp, Homo sapien
gaggcagctttgtaaaagttgcaga

SEQ ID NO: 229543 - DNA, 25 bp, Homo sapien
aaagttgcagaaagattagccgaga

SEQ ID NO: 229544 - DNA, 25 bp, Homo sapien
gcagaaagattagccgagaagcgtc

SEQ ID NO: 229545 - DNA, 25 bp, Homo sapien
gaaagcttggggacagctccatgtt

SEQ ID NO: 229546 - DNA, 25 bp, Homo sapien
agctccatgttccttggggcggaat

SEQ ID NO: 229547 - DNA, 25 bp, Homo sapien
gacaatcctttctatcactgtttgg

SEQ ID NO: 229548 - DNA, 25 bp, Homo sapien
tcctttctatcactgtttggtagca

SEQ ID NO: 229549 - DNA, 25 bp, Homo sapien
gtagcagagattcttccagcgcccg

SEQ ID NO: 229550 - DNA, 25 bp, Homo sapien
cagagattcttccagcgcccgggaa

SEQ ID NO: 229551 - DNA, 25 bp, Homo sapien
cgtggtgggctatgggatatactat

SEQ ID NO: 229552 - DNA, 25 bp, Homo sapien
tctacagtacatggaagggacgcac

SEQ ID NO: 229553 - DNA, 25 bp, Homo sapien
gaagggacgcaccatttatctggag

SEQ ID NO: 229554 - DNA, 25 bp, Homo sapien
gacgcaccatttatctggaggatat

SEQ ID NO: 229555 - DNA, 25 bp, Homo sapien
tatctatgtgatgccggaatatcgg

SEQ ID NO: 229556 - DNA, 25 bp, Homo sapien
gtcaagggattggttccaaaataat

SEQ ID NO: 229557 - DNA, 25 bp, Homo sapien
aggtggccttggataagggctgctc

SEQ ID NO: 229558 - DNA, 25 bp, Homo sapien
agacggactctatcccgctggtgga

SEQ ID NO: 229559 - DNA, 25 bp, Homo sapien
actctatcccgctggtggacgacat

SEQ ID NO: 229560 - DNA, 25 bp, Homo sapien
ggtggacgacatccgcttccacgtg

SEQ ID NO: 229561 - DNA, 25 bp, Homo sapien
ttccacgtggccagcacggtgcaga

SEQ ID NO: 229562 - DNA, 25 bp, Homo sapien
ggtgcagacctacagcgccatagag

SEQ ID NO: 229563 - DNA, 25 bp, Homo sapien
acctgctcgtgtccatcggtctgga

SEQ ID NO: 229564 - DNA, 25 bp, Homo sapien
atcggtctggactgttgagcccctg

SEQ ID NO: 229565 - DNA, 25 bp, Homo sapien
ccaggagctctcttggagacaagca

SEQ ID NO: 229566 - DNA, 25 bp, Homo sapien
gagacaagcatgtgtatgcgtttgt

SEQ ID NO: 229567 - DNA, 25 bp, Homo sapien
atgcgtttgtgtgcagctcttcttc

SEQ ID NO: 229568 - DNA, 25 bp, Homo sapien
ctgctccctgcacattgagggcttc

SEQ ID NO: 229569 - DNA, 25 bp, Homo sapien
taaacctcctcctctactgaagtca

SEQ ID NO: 229570 - DNA, 25 bp, Homo sapien
tcaggttggtcctcccaaaccttgt

SEQ ID NO: 229571 - DNA, 25 bp, Homo sapien
caaagactggagttattagttggct

SEQ ID NO: 229572 - DNA, 25 bp, Homo sapien
attagttggctgactcagccacata

SEQ ID NO: 229573 - DNA, 25 bp, Homo sapien
gactcagccacataatgggcccaag

SEQ ID NO: 229574 - DNA, 25 bp, Homo sapien
gggcccaagaaatgccagcgtccta

SEQ ID NO: 229575 - DNA, 25 bp, Homo sapien
cagcgtcctagcagttcccttggtt

SEQ ID NO: 229576 - DNA, 25 bp, Homo sapien
tcccttggttctgggtcagctgaaa

SEQ ID NO: 229577 - DNA, 25 bp, Homo sapien
gagcttggctcttttttaggaactt

SEQ ID NO: 229578 - DNA, 25 bp, Homo sapien
ttaggaactttggtgcctgaacatt

SEQ ID NO: 229579 - DNA, 25 bp, Homo sapien
tttggtgcctgaacattaagagtag

SEQ ID NO: 229580 - DNA, 25 bp, Homo sapien
gaaagaccctattgacaacatctat

SEQ ID NO: 229581 - DNA, 25 bp, Homo sapien
gtcatcttgaatatagcctccccaa

SEQ ID NO: 229582 - DNA, 25 bp, Homo sapien
tatagcctccccaagagagaacagg

SEQ ID NO: 229583 - DNA, 25 bp, Homo sapien
cagggtggtattctaagtatgtttc

SEQ ID NO: 229584 - DNA, 25 bp, Homo sapien
gtatgtttctttgtaacatctttag

SEQ ID NO: 229585 - DNA, 25 bp, Homo sapien
atctttagcagtaggacagagccat

SEQ ID NO: 229586 - DNA, 25 bp, Homo sapien
ggacagagccatacatgtgaaatct

SEQ ID NO: 229587 - DNA, 25 bp, Homo sapien
gaaatctgatttttatgtgtgttat

SEQ ID NO: 229588 - DNA, 25 bp, Homo sapien
gtgtgttattcgtttgtctggtttt

SEQ ID NO: 229589 - DNA, 25 bp, Homo sapien
tgtctggttttactacctttgcaaa

SEQ ID NO: 229590 - DNA, 25 bp, Homo sapien
gcatcttccctggatctaaatagta

SEQ ID NO: 229591 - DNA, 25 bp, Homo sapien
attttaaggttgttctttgagccat

SEQ ID NO: 229592 - DNA, 25 bp, Homo sapien
tttgagccataaattgcctctttgc

SEQ ID NO: 229593 - DNA, 25 bp, Homo sapien
ggaaagtgctggtcccactgacgtg

SEQ ID NO: 229594 - DNA, 25 bp, Homo sapien
gacgtggcctcctctacgttgaaaa

SEQ ID NO: 229595 - DNA, 25 bp, Homo sapien
tcctggaagcctctgaggttttagc

SEQ ID NO: 229596 - DNA, 25 bp, Homo sapien
ctggagtgccagctctatattttta

SEQ ID NO: 229597 - DNA, 25 bp, Homo sapien
agggttaacctgctgagtttctggc

SEQ ID NO: 229598 - DNA, 25 bp, Homo sapien
agtttctggcatgttctgcccttta

SEQ ID NO: 229599 - DNA, 25 bp, Homo sapien
cctttactcgtctcgacatttagca

SEQ ID NO: 229600 - DNA, 25 bp, Homo sapien
gacatttagcaagtcttttcttaag

SEQ ID NO: 229601 - DNA, 25 bp, Homo sapien
gttccccatttctgctagcggaaaa

SEQ ID NO: 229602 - DNA, 25 bp, Homo sapien
tcaagaccatcccactgcttgcctg

SEQ ID NO: 229603 - DNA, 25 bp, Homo sapien
atctcgcactcagccctgggtgcct

SEQ ID NO: 229604 - DNA, 25 bp, Homo sapien
gtagcagctggtgggacactgatct

SEQ ID NO: 229605 - DNA, 25 bp, Homo sapien
agcagctggtgggacactgatctgt

SEQ ID NO: 229606 - DNA, 25 bp, Homo sapien
tggtgggacactgatctgtgagctc

SEQ ID NO: 229607 - DNA, 25 bp, Homo sapien
tgatctgtgagctctggaatgtctg

SEQ ID NO: 229608 - DNA, 25 bp, Homo sapien
tctgtgagctctggaatgtctgctt

SEQ ID NO: 229609 - DNA, 25 bp, Homo sapien
tgtgagctctggaatgtctgcttag

SEQ ID NO: 229610 - DNA, 25 bp, Homo sapien
actactcaaggccaactgtcacatg

SEQ ID NO: 229611 - DNA, 25 bp, Homo sapien
tactcaaggccaactgtcacatgaa

SEQ ID NO: 229612 - DNA, 25 bp, Homo sapien
caaggccaactgtcacatgaaggaa

SEQ ID NO: 229613 - DNA, 25 bp, Homo sapien
tgtctcccggcctgataccagatac

SEQ ID NO: 229614 - DNA, 25 bp, Homo sapien
ccagatacaggttgttgatttcatc

SEQ ID NO: 229615 - DNA, 25 bp, Homo sapien
caggttgttgatttcatcgtgggta

SEQ ID NO: 229616 - DNA, 25 bp, Homo sapien
gttgttgatttcatcgtgggtagca

SEQ ID NO: 229617 - DNA, 25 bp, Homo sapien
tgatttcatcgtgggtagcaagcta

SEQ ID NO: 229618 - DNA, 25 bp, Homo sapien
tttcatcgtgggtagcaagctagta

SEQ ID NO: 229619 - DNA, 25 bp, Homo sapien
ggtagcaagctagtaataaatttca

SEQ ID NO: 229620 - DNA, 25 bp, Homo sapien
gctagtaataaatttcaaagtgctt

SEQ ID NO: 229621 - DNA, 25 bp, Homo sapien
gctttttgccaataactgttaccgc

SEQ ID NO: 229622 - DNA, 25 bp, Homo sapien
tttgccaataactgttaccgccgtt

SEQ ID NO: 229623 - DNA, 25 bp, Homo sapien
tttgacaaatagctgcaactgagac

SEQ ID NO: 229624 - DNA, 25 bp, Homo sapien
atcaagtgtgatgggctttgttccc

SEQ ID NO: 229625 - DNA, 25 bp, Homo sapien
gtgtgatgggctttgttcccaactc

SEQ ID NO: 229626 - DNA, 25 bp, Homo sapien
tttgttcccaactcttttacatctc

SEQ ID NO: 229627 - DNA, 25 bp, Homo sapien
tctctcttccatattctttggtttg

SEQ ID NO: 229628 - DNA, 25 bp, Homo sapien
ttctttggtttgtatgtggtttctc

SEQ ID NO: 229629 - DNA, 25 bp, Homo sapien
ggtttgtatgtggtttctcagttaa

SEQ ID NO: 229630 - DNA, 25 bp, Homo sapien
gtggtttctcagttaatacatagct

SEQ ID NO: 229631 - DNA, 25 bp, Homo sapien
aaccgcttaggtctatttggatgta

SEQ ID NO: 229632 - DNA, 25 bp, Homo sapien
aggtctatttggatgtaagggtgaa

SEQ ID NO: 229633 - DNA, 25 bp, Homo sapien
tcctctggagcttgtactttcaaga

SEQ ID NO: 229634 - DNA, 25 bp, Homo sapien
atctgtgtaataaactggttactac

SEQ ID NO: 229635 - DNA, 25 bp, Homo sapien
ttcatcctttttaatatcagccttg

SEQ ID NO: 229636 - DNA, 25 bp, Homo sapien
ccaataagcaggcttagtcaccctt

SEQ ID NO: 229637 - DNA, 25 bp, Homo sapien
tgacacagtttgcagttatccacct

SEQ ID NO: 229638 - DNA, 25 bp, Homo sapien
atcctttttaatatcagccttgtgt

SEQ ID NO: 229639 - DNA, 25 bp, Homo sapien
ccaagttcttaatatgttagatcca

SEQ ID NO: 229640 - DNA, 25 bp, Homo sapien
gttagatccagataactgccttgta

SEQ ID NO: 229641 - DNA, 25 bp, Homo sapien
gatccagataactgccttgtacagc

SEQ ID NO: 229642 - DNA, 25 bp, Homo sapien
tgcctccctaaaaaacagctagata

SEQ ID NO: 229643 - DNA, 25 bp, Homo sapien
acagctagatacactgaccccacag

SEQ ID NO: 229644 - DNA, 25 bp, Homo sapien
cacagcctatgtggaccacacagat

SEQ ID NO: 229645 - DNA, 25 bp, Homo sapien
gtggaccacacagatatactggctt

SEQ ID NO: 229646 - DNA, 25 bp, Homo sapien
ggaacactacatcaacactgttggc

SEQ ID NO: 229647 - DNA, 25 bp, Homo sapien
ggacacagaagactcctgtttcaag

SEQ ID NO: 229648 - DNA, 25 bp, Homo sapien
agactcctgtttcaagaaaatacaa

SEQ ID NO: 229649 - DNA, 25 bp, Homo sapien
caatcatctctcaaaggctgtaatt

SEQ ID NO: 229650 - DNA, 25 bp, Homo sapien
gcattttaaaactctaggcattgaa

SEQ ID NO: 229651 - DNA, 25 bp, Homo sapien
taggcattgaaaaccacccaagtgt

SEQ ID NO: 229652 - DNA, 25 bp, Homo sapien
accacccaagtgtcccaaatagaag

SEQ ID NO: 229653 - DNA, 25 bp, Homo sapien
cactcagtgtaatattatacatcct

SEQ ID NO: 229654 - DNA, 25 bp, Homo sapien
ttttatgatctgtaagtccaaggaa

SEQ ID NO: 229655 - DNA, 25 bp, Homo sapien
tctgtaagtccaaggaatcctctcc

SEQ ID NO: 229656 - DNA, 25 bp, Homo sapien
atacccacacttctttgttccaatt

SEQ ID NO: 229657 - DNA, 25 bp, Homo sapien
ctctcctgtcttcatagaaccattg

SEQ ID NO: 229658 - DNA, 25 bp, Homo sapien
gaaccattgccttagaattattgta

SEQ ID NO: 229659 - DNA, 25 bp, Homo sapien
gacacgttttttgttggttaagctg

SEQ ID NO: 229660 - DNA, 25 bp, Homo sapien
taagctgtaaggttttgttctttgt

SEQ ID NO: 229661 - DNA, 25 bp, Homo sapien
gttctttgtgaacatgggtattttg

SEQ ID NO: 229662 - DNA, 25 bp, Homo sapien
gtggtccttttacaagaattttgat

SEQ ID NO: 229663 - DNA, 25 bp, Homo sapien
gaattttgatgcataagtgtctatt

SEQ ID NO: 229664 - DNA, 25 bp, Homo sapien
gtctattgtagggtttggatgatct

SEQ ID NO: 229665 - DNA, 25 bp, Homo sapien
tttttatcccatgcaccattcagta

SEQ ID NO: 229666 - DNA, 25 bp, Homo sapien
atcacaattctgctaatgtcatttg

SEQ ID NO: 229667 - DNA, 25 bp, Homo sapien
gctaatgtcatttggaacttcaaaa

SEQ ID NO: 229668 - DNA, 25 bp, Homo sapien
tgggagcttgaagccctcccggcat

SEQ ID NO: 229669 - DNA, 25 bp, Homo sapien
tctcttgccgcagcatacacgaggg

SEQ ID NO: 229670 - DNA, 25 bp, Homo sapien
cgcagcatacacgagggcaggcagt

SEQ ID NO: 229671 - DNA, 25 bp, Homo sapien
gtcactgtatcttgcatcagagaca

SEQ ID NO: 229672 - DNA, 25 bp, Homo sapien
atcagagacaaaggaggacccgctt

SEQ ID NO: 229673 - DNA, 25 bp, Homo sapien
aaggaggacccgctttagccctgct

SEQ ID NO: 229674 - DNA, 25 bp, Homo sapien
ctttagccctgctgcgggaaatggg

SEQ ID NO: 229675 - DNA, 25 bp, Homo sapien
agggccagcgcattgtgcactggtt

SEQ ID NO: 229676 - DNA, 25 bp, Homo sapien
gcgcattgtgcactggtttacttta

SEQ ID NO: 229677 - DNA, 25 bp, Homo sapien
aaaatgtacagattcttctcgttaa

SEQ ID NO: 229678 - DNA, 25 bp, Homo sapien
gattcttctcgttaaattcttgata

SEQ ID NO: 229679 - DNA, 25 bp, Homo sapien
tccctcggcacactttgaccctttg

SEQ ID NO: 229680 - DNA, 25 bp, Homo sapien
ctttgaccctttgtaggattggaat

SEQ ID NO: 229681 - DNA, 25 bp, Homo sapien
accctttgtaggattggaattagca

SEQ ID NO: 229682 - DNA, 25 bp, Homo sapien
gtaggattggaattagcaggactcg

SEQ ID NO: 229683 - DNA, 25 bp, Homo sapien
gattggaattagcaggactcggcta

SEQ ID NO: 229684 - DNA, 25 bp, Homo sapien
tggaattagcaggactcggctattt

SEQ ID NO: 229685 - DNA, 25 bp, Homo sapien
ggactcggctatttaaagcaccagt

SEQ ID NO: 229686 - DNA, 25 bp, Homo sapien
ctcggctatttaaagcaccagtctg

SEQ ID NO: 229687 - DNA, 25 bp, Homo sapien
cggctatttaaagcaccagtctggg

SEQ ID NO: 229688 - DNA, 25 bp, Homo sapien
aaagcaccagtctggggtcgcctgg

SEQ ID NO: 229689 - DNA, 25 bp, Homo sapien
acaagacggacttcctctcccttcg

SEQ ID NO: 229690 - DNA, 25 bp, Homo sapien
gatatagaaacagatgaccgtggca

SEQ ID NO: 229691 - DNA, 25 bp, Homo sapien
acagatgaccgtggcatttagagtt

SEQ ID NO: 229692 - DNA, 25 bp, Homo sapien
tgaccgtggcatttagagttttggg

SEQ ID NO: 229693 - DNA, 25 bp, Homo sapien
gtaactccagaaaggattgatatct

SEQ ID NO: 229694 - DNA, 25 bp, Homo sapien
gattgatatctgtgaattgtcctga

SEQ ID NO: 229695 - DNA, 25 bp, Homo sapien
atctgtgaattgtcctgaagggtaa

SEQ ID NO: 229696 - DNA, 25 bp, Homo sapien
aagaaggaatcagcaaaactcccaa

SEQ ID NO: 229697 - DNA, 25 bp, Homo sapien
taccaaaaacatttcatcttagtgc

SEQ ID NO: 229698 - DNA, 25 bp, Homo sapien
aaacatttcatcttagtgctaagtc

SEQ ID NO: 229699 - DNA, 25 bp, Homo sapien
gtgctaagtctactattttctacaa

SEQ ID NO: 229700 - DNA, 25 bp, Homo sapien
acgcctggccataaatatgttaaaa

SEQ ID NO: 229701 - DNA, 25 bp, Homo sapien
gtgccaaaacctagtcctccacttt

SEQ ID NO: 229702 - DNA, 25 bp, Homo sapien
tttccagcacatcccagatgggctc

SEQ ID NO: 229703 - DNA, 25 bp, Homo sapien
gatgggctcaactctgccgagtggt

SEQ ID NO: 229704 - DNA, 25 bp, Homo sapien
gtgccgggtatcagtctgggacaca

SEQ ID NO: 229705 - DNA, 25 bp, Homo sapien
ctgggacacaccaaggtcagttcga

SEQ ID NO: 229706 - DNA, 25 bp, Homo sapien
gtcagttcgaccatggttctgggtc

SEQ ID NO: 229707 - DNA, 25 bp, Homo sapien
gggtccctgagtccatccaaaaaga

SEQ ID NO: 229708 - DNA, 25 bp, Homo sapien
gagtccatccaaaaagagccctgtg

SEQ ID NO: 229709 - DNA, 25 bp, Homo sapien
gagccctgtgggtaagagtccacca

SEQ ID NO: 229710 - DNA, 25 bp, Homo sapien
tgggtaagagtccaccatccactgg

SEQ ID NO: 229711 - DNA, 25 bp, Homo sapien
tcaggaggagcagcctatacaaaga

SEQ ID NO: 229712 - DNA, 25 bp, Homo sapien
ggattttattcatacaggcatgtgt

SEQ ID NO: 229713 - DNA, 25 bp, Homo sapien
caggcatgagaattctgtattgaaa

SEQ ID NO: 229714 - DNA, 25 bp, Homo sapien
aacgtatctttctgttccatcaact

SEQ ID NO: 229715 - DNA, 25 bp, Homo sapien
gaacattgagcttcttaggagagat

SEQ ID NO: 229716 - DNA, 25 bp, Homo sapien
tacatgcagctacttaggaccacct

SEQ ID NO: 229717 - DNA, 25 bp, Homo sapien
acttaggaccacctcagcaaaatgg

SEQ ID NO: 229718 - DNA, 25 bp, Homo sapien
caaaatggagttgcctgggtagata

SEQ ID NO: 229719 - DNA, 25 bp, Homo sapien
gttgcctgggtagatagcagcagca

SEQ ID NO: 229720 - DNA, 25 bp, Homo sapien
tggctgctgtccaccaggcagctgt

SEQ ID NO: 229721 - DNA, 25 bp, Homo sapien
gttgcagcagtatggttttgtgtct

SEQ ID NO: 229722 - DNA, 25 bp, Homo sapien
atggttttgtgtctggattttattc

SEQ ID NO: 229723 - DNA, 25 bp, Homo sapien
gcttcttgaaaggttctctgttaat

SEQ ID NO: 229724 - DNA, 25 bp, Homo sapien
acaaccctctgttgagagaattctg

SEQ ID NO: 229725 - DNA, 25 bp, Homo sapien
tttaaggccaaacgtaagaggtcat

SEQ ID NO: 229726 - DNA, 25 bp, Homo sapien
taagaggtcatactccctgtcacaa

SEQ ID NO: 229727 - DNA, 25 bp, Homo sapien
ctgtcacaaactccagctgaactaa

SEQ ID NO: 229728 - DNA, 25 bp, Homo sapien
gatcttccctgacagctctggaagg

SEQ ID NO: 229729 - DNA, 25 bp, Homo sapien
gagaattctgagagtgtcttaccac

SEQ ID NO: 229730 - DNA, 25 bp, Homo sapien
agtgtcttaccacagttctccagag

SEQ ID NO: 229731 - DNA, 25 bp, Homo sapien
atattattttgcacctcttctgtga

SEQ ID NO: 229732 - DNA, 25 bp, Homo sapien
acctcttctgtgaaggccggcaaaa

SEQ ID NO: 229733 - DNA, 25 bp, Homo sapien
aaggccggcaaaatagcttcttgaa

SEQ ID NO: 229734 - DNA, 25 bp, Homo sapien
cgtctcctgagggtcctgctggtga

SEQ ID NO: 229735 - DNA, 25 bp, Homo sapien
tggtgaccggcctggaccttggccc

SEQ ID NO: 229736 - DNA, 25 bp, Homo sapien
gaccttggccctacagccctggagg

SEQ ID NO: 229737 - DNA, 25 bp, Homo sapien
tggctgcactcaagaccctcgagat

SEQ ID NO: 229738 - DNA, 25 bp, Homo sapien
aagaccctcgagattaacggtgcta

SEQ ID NO: 229739 - DNA, 25 bp, Homo sapien
agattaacggtgctaaccccgtctg

SEQ ID NO: 229740 - DNA, 25 bp, Homo sapien
ggcctggactggacatgagagcccc

SEQ ID NO: 229741 - DNA, 25 bp, Homo sapien
gcctctgtctcgttttgggaaacca

SEQ ID NO: 229742 - DNA, 25 bp, Homo sapien
aaaccaaggtcaggaggccgttgca

SEQ ID NO: 229743 - DNA, 25 bp, Homo sapien
aggaggccgttgcagacataaatct

SEQ ID NO: 229744 - DNA, 25 bp, Homo sapien
agacataaatctcggcgactcggcc

SEQ ID NO: 229745 - DNA, 25 bp, Homo sapien
gacaaacaaccgagatgggacacat

SEQ ID NO: 229746 - DNA, 25 bp, Homo sapien
tcaaacctaaacagcgctcttcatc

SEQ ID NO: 229747 - DNA, 25 bp, Homo sapien
ttggctgcccttcttattaaacatc

SEQ ID NO: 229748 - DNA, 25 bp, Homo sapien
attaaacatcgacgcgttcactgac

SEQ ID NO: 229749 - DNA, 25 bp, Homo sapien
gacgcgttcactgacgaggacgtaa

SEQ ID NO: 229750 - DNA, 25 bp, Homo sapien
gaggacgtaaacaccgatctggcgt

SEQ ID NO: 229751 - DNA, 25 bp, Homo sapien
tctggcgtaccacgagcgtgtgtat

SEQ ID NO: 229752 - DNA, 25 bp, Homo sapien
gagcgtgtgtattttcgtttcacaa

SEQ ID NO: 229753 - DNA, 25 bp, Homo sapien
ttcgtttcacaaatactgcttcatt

SEQ ID NO: 229754 - DNA, 25 bp, Homo sapien
gctcagtccccacgacatagcagga

SEQ ID NO: 229755 - DNA, 25 bp, Homo sapien
atagcaggactaggttgacaaacaa

SEQ ID NO: 229756 - DNA, 25 bp, Homo sapien
ggagtgccacggctgcccgtttaca

SEQ ID NO: 229757 - DNA, 25 bp, Homo sapien
tgcccgtttacacctttagcgtctg

SEQ ID NO: 229758 - DNA, 25 bp, Homo sapien
gtttacacctttagcgtctggtcct

SEQ ID NO: 229759 - DNA, 25 bp, Homo sapien
tttagcgtctggtcctcctgcgtgt

SEQ ID NO: 229760 - DNA, 25 bp, Homo sapien
agggccgttgcctgctcagaccttg

SEQ ID NO: 229761 - DNA, 25 bp, Homo sapien
gttgcctgctcagaccttgcaggct

SEQ ID NO: 229762 - DNA, 25 bp, Homo sapien
tcagaccttgcaggctgtggagcaa

SEQ ID NO: 229763 - DNA, 25 bp, Homo sapien
atccgttcacgtctctgcatccatt

SEQ ID NO: 229764 - DNA, 25 bp, Homo sapien
agcaagaggccctgggtctctccaa

SEQ ID NO: 229765 - DNA, 25 bp, Homo sapien
tgggtctctccaagcagctgcagac

SEQ ID NO: 229766 - DNA, 25 bp, Homo sapien
cattccttcatgtctttatttagtt

SEQ ID NO: 229767 - DNA, 25 bp, Homo sapien
gtagacatccaagctggtatccatg

SEQ ID NO: 229768 - DNA, 25 bp, Homo sapien
tggtatccatgcacagagaacgctg

SEQ ID NO: 229769 - DNA, 25 bp, Homo sapien
gagaacgctgggacattccaccatt

SEQ ID NO: 229770 - DNA, 25 bp, Homo sapien
attccaccattgttgaccagaatgt

SEQ ID NO: 229771 - DNA, 25 bp, Homo sapien
gaatgtcgattctaccaaactcctg

SEQ ID NO: 229772 - DNA, 25 bp, Homo sapien
gtcgattctaccaaactcctggaga

SEQ ID NO: 229773 - DNA, 25 bp, Homo sapien
gcttcatgggaaccagtgtcggtca

SEQ ID NO: 229774 - DNA, 25 bp, Homo sapien
tgggaaccagtgtcggtcaggtcaa

SEQ ID NO: 229775 - DNA, 25 bp, Homo sapien
aattgccattctctaggcatcttct

SEQ ID NO: 229776 - DNA, 25 bp, Homo sapien
tctaggcatcttcttttcacccttt

SEQ ID NO: 229777 - DNA, 25 bp, Homo sapien
ctctcgatcatgtgaggcagaacac

SEQ ID NO: 229778 - DNA, 25 bp, Homo sapien
tcagctttggcgacattggctttga

SEQ ID NO: 229779 - DNA, 25 bp, Homo sapien
gcgacattggctttgatttcctggg

SEQ ID NO: 229780 - DNA, 25 bp, Homo sapien
accagcttctttgcctggacgaggt

SEQ ID NO: 229781 - DNA, 25 bp, Homo sapien
ctttgcctggacgaggttgatgcct

SEQ ID NO: 229782 - DNA, 25 bp, Homo sapien
tgatgccttggatgtagttcttgat

SEQ ID NO: 229783 - DNA, 25 bp, Homo sapien
ccttggatgtagttcttgatttcct

SEQ ID NO: 229784 - DNA, 25 bp, Homo sapien
ttgatcagcttcactttgtccacgg

SEQ ID NO: 229785 - DNA, 25 bp, Homo sapien
agcttcactttgtccacgggcttcg

SEQ ID NO: 229786 - DNA, 25 bp, Homo sapien
tgtccacgggcttcgcctcggtcag

SEQ ID NO: 229787 - DNA, 25 bp, Homo sapien
acggtgaaatgtgtccgttctttcg

SEQ ID NO: 229788 - DNA, 25 bp, Homo sapien
aatgtgtccgttctttcgctatggg

SEQ ID NO: 229789 - DNA, 25 bp, Homo sapien
gaatttacgacaatgagatatgatc

SEQ ID NO: 229790 - DNA, 25 bp, Homo sapien
acaaggcagttatctggatctaaca

SEQ ID NO: 229791 - DNA, 25 bp, Homo sapien
gagatatgatcacctttgtcccatg

SEQ ID NO: 229792 - DNA, 25 bp, Homo sapien
tatgatcacctttgtcccatgtttg

SEQ ID NO: 229793 - DNA, 25 bp, Homo sapien
tttgtcccatgtttgccctctcttg

SEQ ID NO: 229794 - DNA, 25 bp, Homo sapien
ttgccctctcttgttttattcatgt

SEQ ID NO: 229795 - DNA, 25 bp, Homo sapien
ggcagttatctggatctaacatatt

SEQ ID NO: 229796 - DNA, 25 bp, Homo sapien
gccctctcttgttttattcatgtgt

SEQ ID NO: 229797 - DNA, 25 bp, Homo sapien
cttgttttattcatgtgtttgttca

SEQ ID NO: 229798 - DNA, 25 bp, Homo sapien
tactcatttatgaacacccttaaac

SEQ ID NO: 229799 - DNA, 25 bp, Homo sapien
taagcctgcttctggaatgagaaag

SEQ ID NO: 229800 - DNA, 25 bp, Homo sapien
aagtctttattggtgggtgcatgct

SEQ ID NO: 229801 - DNA, 25 bp, Homo sapien
ggtgcatgctactgggaacaagttt

SEQ ID NO: 229802 - DNA, 25 bp, Homo sapien
gtttttgtacaaaagcttcaatcag

SEQ ID NO: 229803 - DNA, 25 bp, Homo sapien
gcttcaatcagaatcactgtgcatt

SEQ ID NO: 229804 - DNA, 25 bp, Homo sapien
cactgtgcattactgagactctgtt

SEQ ID NO: 229805 - DNA, 25 bp, Homo sapien
gagactctgtttatcactagccttc

SEQ ID NO: 229806 - DNA, 25 bp, Homo sapien
tgtttatcactagccttctgtccct

SEQ ID NO: 229807 - DNA, 25 bp, Homo sapien
gtccctcccgcagaagactgttgga

SEQ ID NO: 229808 - DNA, 25 bp, Homo sapien
ttgtaaatttcttagggacctgcca

SEQ ID NO: 229809 - DNA, 25 bp, Homo sapien
ggacctgccacttttgactgtggat

SEQ ID NO: 229810 - DNA, 25 bp, Homo sapien
actgtggatcagttgatgtacactt

SEQ ID NO: 229811 - DNA, 25 bp, Homo sapien
ggaccagggacccaatgctaataaa

SEQ ID NO: 229812 - DNA, 25 bp, Homo sapien
gaccagggacccaatgctaataaag

SEQ ID NO: 229813 - DNA, 25 bp, Homo sapien
accagggacccaatgctaataaaga

SEQ ID NO: 229814 - DNA, 25 bp, Homo sapien
ccagggacccaatgctaataaagac

SEQ ID NO: 229815 - DNA, 25 bp, Homo sapien
cagggacccaatgctaataaagact

SEQ ID NO: 229816 - DNA, 25 bp, Homo sapien
agggacccaatgctaataaagactg

SEQ ID NO: 229817 - DNA, 25 bp, Homo sapien
ggacccaatgctaataaagactgga

SEQ ID NO: 229818 - DNA, 25 bp, Homo sapien
cccaatgctaataaagactggactg

SEQ ID NO: 229819 - DNA, 25 bp, Homo sapien
ggtgggaccagggacccaatgctaa

SEQ ID NO: 229820 - DNA, 25 bp, Homo sapien
gtgggaccagggacccaatgctaat

SEQ ID NO: 229821 - DNA, 25 bp, Homo sapien
tgggaccagggacccaatgctaata

SEQ ID NO: 229822 - DNA, 25 bp, Homo sapien
tagctaaatttttcttagagtttct

SEQ ID NO: 229823 - DNA, 25 bp, Homo sapien
gggctggccatgaagtaactagtct

SEQ ID NO: 229824 - DNA, 25 bp, Homo sapien
ggccatgaagtaactagtctgactc

SEQ ID NO: 229825 - DNA, 25 bp, Homo sapien
atctggattcagaactccaggcaga

SEQ ID NO: 229826 - DNA, 25 bp, Homo sapien
actagtctgactcatttcttctggg

SEQ ID NO: 229827 - DNA, 25 bp, Homo sapien
cttctgggaaggctaaaagagacac

SEQ ID NO: 229828 - DNA, 25 bp, Homo sapien
gcaaaaatctgccatcttcactaca

SEQ ID NO: 229829 - DNA, 25 bp, Homo sapien
aaaaatctgccatcttcactacatt

SEQ ID NO: 229830 - DNA, 25 bp, Homo sapien
atctgccatcttcactacattttaa

SEQ ID NO: 229831 - DNA, 25 bp, Homo sapien
ctgccatcttcactacattttaaga

SEQ ID NO: 229832 - DNA, 25 bp, Homo sapien
ggtagaactaagagggatcagatat

SEQ ID NO: 229833 - DNA, 25 bp, Homo sapien
gtgcatcaaggccagtcctattcaa

SEQ ID NO: 229834 - DNA, 25 bp, Homo sapien
agtcctattcaacctagctttcgaa

SEQ ID NO: 229835 - DNA, 25 bp, Homo sapien
gctttcgaatgctgatatctggtta

SEQ ID NO: 229836 - DNA, 25 bp, Homo sapien
agtatgtcattttgaagttggcaca

SEQ ID NO: 229837 - DNA, 25 bp, Homo sapien
tgttgtttgcttcttccctacggat

SEQ ID NO: 229838 - DNA, 25 bp, Homo sapien
ttccctacggatgacttctaaaaat

SEQ ID NO: 229839 - DNA, 25 bp, Homo sapien
gatcatatcaacactgtaactgctg

SEQ ID NO: 229840 - DNA, 25 bp, Homo sapien
gtttgctttttattcggacaggcca

SEQ ID NO: 229841 - DNA, 25 bp, Homo sapien
gccacatgatgcatagagcctcttt

SEQ ID NO: 229842 - DNA, 25 bp, Homo sapien
agagcctctttcatgtgacttgtgt

SEQ ID NO: 229843 - DNA, 25 bp, Homo sapien
gtgacttgtgtctactgcttaaatc

SEQ ID NO: 229844 - DNA, 25 bp, Homo sapien
ggaatcttttccaataaccagctaa

SEQ ID NO: 229845 - DNA, 25 bp, Homo sapien
gaatcttttccaataaccagctaaa

SEQ ID NO: 229846 - DNA, 25 bp, Homo sapien
ttttccaataaccagctaaagattt

SEQ ID NO: 229847 - DNA, 25 bp, Homo sapien
caataaccagctaaagatttgcact

SEQ ID NO: 229848 - DNA, 25 bp, Homo sapien
accagctaaagatttgcactgaaat

SEQ ID NO: 229849 - DNA, 25 bp, Homo sapien
gaaatacaacttgtatgccttttgc

SEQ ID NO: 229850 - DNA, 25 bp, Homo sapien
atttttaaagcctgcttcctggatt

SEQ ID NO: 229851 - DNA, 25 bp, Homo sapien
gatttaagcagagtgatagtgttca

SEQ ID NO: 229852 - DNA, 25 bp, Homo sapien
atagtgttcaaagagccagttcagc

SEQ ID NO: 229853 - DNA, 25 bp, Homo sapien
agtgttcaaagagccagttcagcct

SEQ ID NO: 229854 - DNA, 25 bp, Homo sapien
aaaagatatgtctgcactttgaggt

SEQ ID NO: 229855 - DNA, 25 bp, Homo sapien
tttcagctggcgcagtccctcagcc

SEQ ID NO: 229856 - DNA, 25 bp, Homo sapien
tcagcctgaccaagtactcctccct

SEQ ID NO: 229857 - DNA, 25 bp, Homo sapien
tggctgtctgctcagcctggaacac

SEQ ID NO: 229858 - DNA, 25 bp, Homo sapien
tggccagctcctaggcctcctgtag

SEQ ID NO: 229859 - DNA, 25 bp, Homo sapien
cagctcctaggcctcctgtaggtct

SEQ ID NO: 229860 - DNA, 25 bp, Homo sapien
ctcctgtaggtctcagcccaaatgt

SEQ ID NO: 229861 - DNA, 25 bp, Homo sapien
taggtctcagcccaaatgtcccttc

SEQ ID NO: 229862 - DNA, 25 bp, Homo sapien
gcccaaatgtcccttcctcaaagaa

SEQ ID NO: 229863 - DNA, 25 bp, Homo sapien
tcccttcctcaaagaaaccttcctg

SEQ ID NO: 229864 - DNA, 25 bp, Homo sapien
gtgtgggattttcccagtatgtgtc

SEQ ID NO: 229865 - DNA, 25 bp, Homo sapien
attttcccagtatgtgtccctgcac

SEQ ID NO: 229866 - DNA, 25 bp, Homo sapien
tgtcatcgggctgcttgtggcctcc

SEQ ID NO: 229867 - DNA, 25 bp, Homo sapien
ggacttttgttcagcgtcgcctcaa

SEQ ID NO: 229868 - DNA, 25 bp, Homo sapien
acgcagaccccgtggcctgagatgt

SEQ ID NO: 229869 - DNA, 25 bp, Homo sapien
tggcctgagatgtgggcttcccagc

SEQ ID NO: 229870 - DNA, 25 bp, Homo sapien
gccgctcacggttttacagatacta

SEQ ID NO: 229871 - DNA, 25 bp, Homo sapien
acagatactatttacaggcggaaac

SEQ ID NO: 229872 - DNA, 25 bp, Homo sapien
aggcggaaactcctcggctgctttt

SEQ ID NO: 229873 - DNA, 25 bp, Homo sapien
atgcttaagccaggagtgctcagcc

SEQ ID NO: 229874 - DNA, 25 bp, Homo sapien
cccatcaacttcctgagtgtctaaa

SEQ ID NO: 229875 - DNA, 25 bp, Homo sapien
gcaggaagaaaactcccttgggaga

SEQ ID NO: 229876 - DNA, 25 bp, Homo sapien
ggagaacgcacaccctcccgtggtg

SEQ ID NO: 229877 - DNA, 25 bp, Homo sapien
atttatttttggcttccatttctgt

SEQ ID NO: 229878 - DNA, 25 bp, Homo sapien
ttttggcttccatttctgtataacc

SEQ ID NO: 229879 - DNA, 25 bp, Homo sapien
ggcttccatttctgtataaccaaaa

SEQ ID NO: 229880 - DNA, 25 bp, Homo sapien
aaccaaaatagttactgtatttgtg

SEQ ID NO: 229881 - DNA, 25 bp, Homo sapien
cattcctattattttgttgctaaaa

SEQ ID NO: 229882 - DNA, 25 bp, Homo sapien
gtaaccaattcaagcactttaagca

SEQ ID NO: 229883 - DNA, 25 bp, Homo sapien
gcactttaagcaataatgtcaatct

SEQ ID NO: 229884 - DNA, 25 bp, Homo sapien
gcaataatgtcaatcttgtgaaatt

SEQ ID NO: 229885 - DNA, 25 bp, Homo sapien
tttaatcagtttaacaccctgcctc

SEQ ID NO: 229886 - DNA, 25 bp, Homo sapien
aatcagtttaacaccctgcctctaa

SEQ ID NO: 229887 - DNA, 25 bp, Homo sapien
gtttaacaccctgcctctaaaattg

SEQ ID NO: 229888 - DNA, 25 bp, Homo sapien
ggggcgggggggacagagtctcact

SEQ ID NO: 229889 - DNA, 25 bp, Homo sapien
gggcgggggggacagagtctcactg

SEQ ID NO: 229890 - DNA, 25 bp, Homo sapien
cactgtgtcactcagactggagtac

SEQ ID NO: 229891 - DNA, 25 bp, Homo sapien
actgtgtcactcagactggagtaca

SEQ ID NO: 229892 - DNA, 25 bp, Homo sapien
ctgtgtcactcagactggagtacag

SEQ ID NO: 229893 - DNA, 25 bp, Homo sapien
gtcactcagactggagtacagtgat

SEQ ID NO: 229894 - DNA, 25 bp, Homo sapien
actcagactggagtacagtgatgcg

SEQ ID NO: 229895 - DNA, 25 bp, Homo sapien
ctcagactggagtacagtgatgcga

SEQ ID NO: 229896 - DNA, 25 bp, Homo sapien
tcagactggagtacagtgatgcgat

SEQ ID NO: 229897 - DNA, 25 bp, Homo sapien
cctgacctcgttcctgccttagcct

SEQ ID NO: 229898 - DNA, 25 bp, Homo sapien
ctgacctcgttcctgccttagcctc

SEQ ID NO: 229899 - DNA, 25 bp, Homo sapien
ttgtaatttcctataagctgtaata

SEQ ID NO: 229900 - DNA, 25 bp, Homo sapien
atagtggaggtattgtgggttcatt

SEQ ID NO: 229901 - DNA, 25 bp, Homo sapien
ggttcatttgagtaagccctccaaa

SEQ ID NO: 229902 - DNA, 25 bp, Homo sapien
gagtaagccctccaaagataccatt

SEQ ID NO: 229903 - DNA, 25 bp, Homo sapien
aagccctccaaagataccattcaaa

SEQ ID NO: 229904 - DNA, 25 bp, Homo sapien
gataccattcaaataacctgggaga

SEQ ID NO: 229905 - DNA, 25 bp, Homo sapien
ataacctgggagaatgtcataaatt

SEQ ID NO: 229906 - DNA, 25 bp, Homo sapien
tcagataattaacactgcatgaatc

SEQ ID NO: 229907 - DNA, 25 bp, Homo sapien
tttacatatgttgccctaattacca

SEQ ID NO: 229908 - DNA, 25 bp, Homo sapien
gttgccctaattaccatttgatgat

SEQ ID NO: 229909 - DNA, 25 bp, Homo sapien
tgaatgacattggacttttagtaac

SEQ ID NO: 229910 - DNA, 25 bp, Homo sapien
tcctggcccttgattgattgcatga

SEQ ID NO: 229911 - DNA, 25 bp, Homo sapien
ttgattgattgcatgaggcccaccc

SEQ ID NO: 229912 - DNA, 25 bp, Homo sapien
ccacccctattaaggagggcaatct

SEQ ID NO: 229913 - DNA, 25 bp, Homo sapien
aatctgcttcacttagtctgcccat

SEQ ID NO: 229914 - DNA, 25 bp, Homo sapien
ctgcccatcccaatgttaatcgtat

SEQ ID NO: 229915 - DNA, 25 bp, Homo sapien
aatcgtatctgaaagactctctgga

SEQ ID NO: 229916 - DNA, 25 bp, Homo sapien
tgaaagactctctggaacacaacca

SEQ ID NO: 229917 - DNA, 25 bp, Homo sapien
cagaatcatgtttggccaaatgtcc

SEQ ID NO: 229918 - DNA, 25 bp, Homo sapien
ccctggtgctcggtcacagtgacaa

SEQ ID NO: 229919 - DNA, 25 bp, Homo sapien
aagtaactatcacacatgccctttg

SEQ ID NO: 229920 - DNA, 25 bp, Homo sapien
tttgtttcccattaggcctcttaat

SEQ ID NO: 229921 - DNA, 25 bp, Homo sapien
gagcaggccaacgatgacgcgcgca

SEQ ID NO: 229922 - DNA, 25 bp, Homo sapien
gcaccttctacatcatcgagcgcga

SEQ ID NO: 229923 - DNA, 25 bp, Homo sapien
tcatcgagcgcgagccgctcatcaa

SEQ ID NO: 229924 - DNA, 25 bp, Homo sapien
aaggagaacagcacgctcaactgcg

SEQ ID NO: 229925 - DNA, 25 bp, Homo sapien
aactgcgccagcttcacggcgggca

SEQ ID NO: 229926 - DNA, 25 bp, Homo sapien
atcgtggaggcggtgctcacacaca

SEQ ID NO: 229927 - DNA, 25 bp, Homo sapien
aggcggtgctcacacacagcggctt

SEQ ID NO: 229928 - DNA, 25 bp, Homo sapien
gtcacggcgcactggcacaagggca

SEQ ID NO: 229929 - DNA, 25 bp, Homo sapien
aagggcaccacgctcatgatcaagt

SEQ ID NO: 229930 - DNA, 25 bp, Homo sapien
catgatcaagttcgaggaggcagtc

SEQ ID NO: 229931 - DNA, 25 bp, Homo sapien
aggaggcagtcatcgctcgagaccg

SEQ ID NO: 229932 - DNA, 25 bp, Homo sapien
aggatggcagggaccaacccctaat

SEQ ID NO: 229933 - DNA, 25 bp, Homo sapien
gatggcagggaccaacccctaatcc

SEQ ID NO: 229934 - DNA, 25 bp, Homo sapien
tcagagtgggcagagggttgcctat

SEQ ID NO: 229935 - DNA, 25 bp, Homo sapien
gttgcctatggtgggcactaggaat

SEQ ID NO: 229936 - DNA, 25 bp, Homo sapien
gcactaggaatgaggtcccctgcct

SEQ ID NO: 229937 - DNA, 25 bp, Homo sapien
ctaggaatgaggtcccctgcctcga

SEQ ID NO: 229938 - DNA, 25 bp, Homo sapien
gcctcgatgcgggtcctaggagaaa

SEQ ID NO: 229939 - DNA, 25 bp, Homo sapien
taggagaaaaagtcctacttttctg

SEQ ID NO: 229940 - DNA, 25 bp, Homo sapien
tcccggagactgtttctcccatggc

SEQ ID NO: 229941 - DNA, 25 bp, Homo sapien
atggcctcctgagtgatgggccctg

SEQ ID NO: 229942 - DNA, 25 bp, Homo sapien
tcatcctcaggctggttggagcaga

SEQ ID NO: 229943 - DNA, 25 bp, Homo sapien
gttgttatactcaaactgtggctat

SEQ ID NO: 229944 - DNA, 25 bp, Homo sapien
ttgttatactcaaactgtggctatg

SEQ ID NO: 229945 - DNA, 25 bp, Homo sapien
aaactgtggctatgatttaaaagga

SEQ ID NO: 229946 - DNA, 25 bp, Homo sapien
aaaggagctctcagatccataatat

SEQ ID NO: 229947 - DNA, 25 bp, Homo sapien
gagctctcagatccataatataaat

SEQ ID NO: 229948 - DNA, 25 bp, Homo sapien
aaatggtcacaagagaagtttgtac

SEQ ID NO: 229949 - DNA, 25 bp, Homo sapien
agaagtttgtacacaaggcacaaaa

SEQ ID NO: 229950 - DNA, 25 bp, Homo sapien
gtttgtacacaaggcacaaaatagt

SEQ ID NO: 229951 - DNA, 25 bp, Homo sapien
attaacatttatcacacttgcccat

SEQ ID NO: 229952 - DNA, 25 bp, Homo sapien
acatttatcacacttgcccattttg

SEQ ID NO: 229953 - DNA, 25 bp, Homo sapien
tttatcacacttgcccattttgttt

SEQ ID NO: 229954 - DNA, 25 bp, Homo sapien
atcagatacctcctttagtgaccag

SEQ ID NO: 229955 - DNA, 25 bp, Homo sapien
gatacctcctttagtgaccagttca

SEQ ID NO: 229956 - DNA, 25 bp, Homo sapien
gtgaccagttcaaattttaatagcg

SEQ ID NO: 229957 - DNA, 25 bp, Homo sapien
ttttaatagcgataggtagcccctg

SEQ ID NO: 229958 - DNA, 25 bp, Homo sapien
ggtagcccctgagaaatttatcact

SEQ ID NO: 229959 - DNA, 25 bp, Homo sapien
tttatcactataactccacaggaaa

SEQ ID NO: 229960 - DNA, 25 bp, Homo sapien
gacttggaagtgctctgtgtactaa

SEQ ID NO: 229961 - DNA, 25 bp, Homo sapien
atgtcttcccatgactcaagttttg

SEQ ID NO: 229962 - DNA, 25 bp, Homo sapien
actcaagttttgttaaatatgccca

SEQ ID NO: 229963 - DNA, 25 bp, Homo sapien
tttgattggcagtttcttcggttaa

SEQ ID NO: 229964 - DNA, 25 bp, Homo sapien
gcagtttcttcggttaattattcct

SEQ ID NO: 229965 - DNA, 25 bp, Homo sapien
tatcagatttttctaatgacacaga

SEQ ID NO: 229966 - DNA, 25 bp, Homo sapien
agatgcagtcaaagtcttttcagac

SEQ ID NO: 229967 - DNA, 25 bp, Homo sapien
agtcttttcagacatgcccaaactt

SEQ ID NO: 229968 - DNA, 25 bp, Homo sapien
ttcagacatgcccaaactttgagaa

SEQ ID NO: 229969 - DNA, 25 bp, Homo sapien
tgcccaaactttgagaatttcttca

SEQ ID NO: 229970 - DNA, 25 bp, Homo sapien
gaatttcttcaaccatctaatgcta

SEQ ID NO: 229971 - DNA, 25 bp, Homo sapien
aagatttttgttcttcctgttcaca

SEQ ID NO: 229972 - DNA, 25 bp, Homo sapien
ttcttcctgttcacaaccagttgta

SEQ ID NO: 229973 - DNA, 25 bp, Homo sapien
aatactagctactgttttccttcct

SEQ ID NO: 229974 - DNA, 25 bp, Homo sapien
tactagctactgttttccttcctgt

SEQ ID NO: 229975 - DNA, 25 bp, Homo sapien
tcctgtgtgtgaagtaatgaatcat

SEQ ID NO: 229976 - DNA, 25 bp, Homo sapien
gatgtgctgagttttagtaatttaa

SEQ ID NO: 229977 - DNA, 25 bp, Homo sapien
tgaattttcgttgtttctaagacaa

SEQ ID NO: 229978 - DNA, 25 bp, Homo sapien
attttcgttgtttctaagacaaatg

SEQ ID NO: 229979 - DNA, 25 bp, Homo sapien
tttcgttgtttctaagacaaatgat

SEQ ID NO: 229980 - DNA, 25 bp, Homo sapien
cgttgtttctaagacaaatgatatt

SEQ ID NO: 229981 - DNA, 25 bp, Homo sapien
ttttcaggtgtttaaacacaggtat

SEQ ID NO: 229982 - DNA, 25 bp, Homo sapien
ggtgtttaaacacaggtatgagata

SEQ ID NO: 229983 - DNA, 25 bp, Homo sapien
cacaggtatgagatatacaggatct

SEQ ID NO: 229984 - DNA, 25 bp, Homo sapien
gtatgagatatacaggatctcagaa

SEQ ID NO: 229985 - DNA, 25 bp, Homo sapien
tgaagttcattaaactatttgattg

SEQ ID NO: 229986 - DNA, 25 bp, Homo sapien
agatgtgctgagttttagtaattta

SEQ ID NO: 229987 - DNA, 25 bp, Homo sapien
gcaaccgcagccaagatgtctttag

SEQ ID NO: 229988 - DNA, 25 bp, Homo sapien
gattgaactctacagaaggaacatc

SEQ ID NO: 229989 - DNA, 25 bp, Homo sapien
gtcaatgttatcacaactgcatgtt

SEQ ID NO: 229990 - DNA, 25 bp, Homo sapien
acaactgcatgtttctctaaggtca

SEQ ID NO: 229991 - DNA, 25 bp, Homo sapien
ggtcaccaagatattagttgccgct

SEQ ID NO: 229992 - DNA, 25 bp, Homo sapien
ttagttgccgctttgacattctttc

SEQ ID NO: 229993 - DNA, 25 bp, Homo sapien
ccgctttgacattctttcttgggaa

SEQ ID NO: 229994 - DNA, 25 bp, Homo sapien
aacaggacagtgactccgaatctga

SEQ ID NO: 229995 - DNA, 25 bp, Homo sapien
aatctgaggatgatggaccaacagc

SEQ ID NO: 229996 - DNA, 25 bp, Homo sapien
tggaccaacagcaagagacctgcta

SEQ ID NO: 229997 - DNA, 25 bp, Homo sapien
gagacctgctagtacaatatgctac

SEQ ID NO: 229998 - DNA, 25 bp, Homo sapien
aaacaaataatcctgccttttacag

SEQ ID NO: 229999 - DNA, 25 bp, Homo sapien
acaaataatcctgccttttacaggt

SEQ ID NO: 230000 - DNA, 25 bp, Homo sapien
aaataatcctgccttttacaggtga

SEQ ID NO: 230001 - DNA, 25 bp, Homo sapien
aataatcctgccttttacaggtgaa

SEQ ID NO: 230002 - DNA, 25 bp, Homo sapien
ataatcctgccttttacaggtgaaa

SEQ ID NO: 230003 - DNA, 25 bp, Homo sapien
taatcctgccttttacaggtgaaac

SEQ ID NO: 230004 - DNA, 25 bp, Homo sapien
aatcctgccttttacaggtgaaact

SEQ ID NO: 230005 - DNA, 25 bp, Homo sapien
atcctgccttttacaggtgaaactc

SEQ ID NO: 230006 - DNA, 25 bp, Homo sapien
ctgccttttacaggtgaaactcggg

SEQ ID NO: 230007 - DNA, 25 bp, Homo sapien
aaactcggggctgtccatagcggct

SEQ ID NO: 230008 - DNA, 25 bp, Homo sapien
tgggaccccgtttcatccatccatg

SEQ ID NO: 230009 - DNA, 25 bp, Homo sapien
ctttggaccttatgcagctctacac

SEQ ID NO: 230010 - DNA, 25 bp, Homo sapien
agctctacacccacgtgtctgagaa

SEQ ID NO: 230011 - DNA, 25 bp, Homo sapien
tgtctgagaacttgccaccttatgc

SEQ ID NO: 230012 - DNA, 25 bp, Homo sapien
ggtacagcgccctcctggcaggaaa

SEQ ID NO: 230013 - DNA, 25 bp, Homo sapien
tcctggcaggaaaccttcgaatctg

SEQ ID NO: 230014 - DNA, 25 bp, Homo sapien
gaatctgagaacttccacacctgag

SEQ ID NO: 230015 - DNA, 25 bp, Homo sapien
ccgttgcaggtgtactgggctgtca

SEQ ID NO: 230016 - DNA, 25 bp, Homo sapien
gggctgtcagggatcttttctatac

SEQ ID NO: 230017 - DNA, 25 bp, Homo sapien
gatcttttctataccagaactgcgg

SEQ ID NO: 230018 - DNA, 25 bp, Homo sapien
agaactgcggtcactattttgtaat

SEQ ID NO: 230019 - DNA, 25 bp, Homo sapien
aataaatgtggctggagctgatcca

SEQ ID NO: 230020 - DNA, 25 bp, Homo sapien
cccatttgtgggacttctggaacat

SEQ ID NO: 230021 - DNA, 25 bp, Homo sapien
gggacttctggaacatagaaaccat

SEQ ID NO: 230022 - DNA, 25 bp, Homo sapien
ggaacatagaaaccattatcttacc

SEQ ID NO: 230023 - DNA, 25 bp, Homo sapien
attatcttacctggttatcccttga

SEQ ID NO: 230024 - DNA, 25 bp, Homo sapien
gcatatctgcaggaaaatatcttgt

SEQ ID NO: 230025 - DNA, 25 bp, Homo sapien
atcttgtttgtagtgatatgcccca

SEQ ID NO: 230026 - DNA, 25 bp, Homo sapien
agtgatatgccccaatagtgattga

SEQ ID NO: 230027 - DNA, 25 bp, Homo sapien
gtgattgatttcactcttgaaatga

SEQ ID NO: 230028 - DNA, 25 bp, Homo sapien
atgagttatatcacttaatttgtat

SEQ ID NO: 230029 - DNA, 25 bp, Homo sapien
atgagtggagagacatgtacatgtt

SEQ ID NO: 230030 - DNA, 25 bp, Homo sapien
aaagcatgttgcattatatattcat

SEQ ID NO: 230031 - DNA, 25 bp, Homo sapien
ctcgggtaagaagtccaacaggcag

SEQ ID NO: 230032 - DNA, 25 bp, Homo sapien
aagaagtccaacaggcagtccagca

SEQ ID NO: 230033 - DNA, 25 bp, Homo sapien
aagtccaacaggcagtccagcacga

SEQ ID NO: 230034 - DNA, 25 bp, Homo sapien
aacaggcagtccagcacgacgtcct

SEQ ID NO: 230035 - DNA, 25 bp, Homo sapien
gcacgacgtccttcacagtctgaaa

SEQ ID NO: 230036 - DNA, 25 bp, Homo sapien
gcgcagaagatgaggtccaggtcct

SEQ ID NO: 230037 - DNA, 25 bp, Homo sapien
aagatgaggtccaggtccttgtagc

SEQ ID NO: 230038 - DNA, 25 bp, Homo sapien
ggtgcaggacatggctggctgccga

SEQ ID NO: 230039 - DNA, 25 bp, Homo sapien
ctgccgagccgttgaggcgcacgtc

SEQ ID NO: 230040 - DNA, 25 bp, Homo sapien
ttgaggcgcacgtcgcggacgccaa

SEQ ID NO: 230041 - DNA, 25 bp, Homo sapien
gacgccaatgcgcttctcggccagg

SEQ ID NO: 230042 - DNA, 25 bp, Homo sapien
agcgggcaggcatcgagatcttcgt

SEQ ID NO: 230043 - DNA, 25 bp, Homo sapien
gcatcgagatcttcgtggtggtcgt

SEQ ID NO: 230044 - DNA, 25 bp, Homo sapien
tcgtgggccgccaggtgaatgagcc

SEQ ID NO: 230045 - DNA, 25 bp, Homo sapien
cgcgtcctggtcaccggcaagacgg

SEQ ID NO: 230046 - DNA, 25 bp, Homo sapien
aagacggccgagtacgacgtggcct

SEQ ID NO: 230047 - DNA, 25 bp, Homo sapien
ccgagtacgacgtggcctacggcga

SEQ ID NO: 230048 - DNA, 25 bp, Homo sapien
tacgacgtggcctacggcgagagcc

SEQ ID NO: 230049 - DNA, 25 bp, Homo sapien
acggcgagagccacctgttccgtgt

SEQ ID NO: 230050 - DNA, 25 bp, Homo sapien
tccgcggtgtcttccaccagacagt

SEQ ID NO: 230051 - DNA, 25 bp, Homo sapien
tccaccagacagtctccaggaaggt

SEQ ID NO: 230052 - DNA, 25 bp, Homo sapien
aggaaggtggcgctgggctagccca

SEQ ID NO: 230053 - DNA, 25 bp, Homo sapien
gtgatggaaatgtaccttgccttgt

SEQ ID NO: 230054 - DNA, 25 bp, Homo sapien
aatgtaccttgccttgtttagaggc

SEQ ID NO: 230055 - DNA, 25 bp, Homo sapien
gtttagaggcaatttcacatttata

SEQ ID NO: 230056 - DNA, 25 bp, Homo sapien
ttttcctccatgaaacttacgcagt

SEQ ID NO: 230057 - DNA, 25 bp, Homo sapien
aacttacgcagtaatcactacctgg

SEQ ID NO: 230058 - DNA, 25 bp, Homo sapien
cgcagtaatcactacctggaaggtg

SEQ ID NO: 230059 - DNA, 25 bp, Homo sapien
gaaggtgagttttgatctcttttta

SEQ ID NO: 230060 - DNA, 25 bp, Homo sapien
ttaaggagaggcactttccaactga

SEQ ID NO: 230061 - DNA, 25 bp, Homo sapien
atttgactgcaagttacaaagtttt

SEQ ID NO: 230062 - DNA, 25 bp, Homo sapien
aacatgatggttggtctctaatata

SEQ ID NO: 230063 - DNA, 25 bp, Homo sapien
gtctctaatatatttggaactgatt

SEQ ID NO: 230064 - DNA, 25 bp, Homo sapien
gaggtgattgccagtggccccaccg

SEQ ID NO: 230065 - DNA, 25 bp, Homo sapien
caccgtggccagtttccacaatgtg

SEQ ID NO: 230066 - DNA, 25 bp, Homo sapien
cagtttccacaatgtgcaagattgc

SEQ ID NO: 230067 - DNA, 25 bp, Homo sapien
cacgttctgtgaagactgtgctgtc

SEQ ID NO: 230068 - DNA, 25 bp, Homo sapien
aatgtgatcattggctctaatgtgc

SEQ ID NO: 230069 - DNA, 25 bp, Homo sapien
atcattggctctaatgtgctggcgc

SEQ ID NO: 230070 - DNA, 25 bp, Homo sapien
attggctctaatgtgctggcgctag

SEQ ID NO: 230071 - DNA, 25 bp, Homo sapien
gctctaatgtgctggcgctagctga

SEQ ID NO: 230072 - DNA, 25 bp, Homo sapien
atgtgctggcgctagctgaggccca

SEQ ID NO: 230073 - DNA, 25 bp, Homo sapien
ctaccaggctgtggtgctgagtgca

SEQ ID NO: 230074 - DNA, 25 bp, Homo sapien
tgtggtgctgagtgcagccatgcaa

SEQ ID NO: 230075 - DNA, 25 bp, Homo sapien
gactcctcaggagcagcatgggtga

SEQ ID NO: 230076 - DNA, 25 bp, Homo sapien
aggcagtggaatgtactaaggagaa

SEQ ID NO: 230077 - DNA, 25 bp, Homo sapien
gccaaattcacattctgtacctgac

SEQ ID NO: 230078 - DNA, 25 bp, Homo sapien
cctgacaaaatctttccgaagcgat

SEQ ID NO: 230079 - DNA, 25 bp, Homo sapien
aatctttccgaagcgatggtgacat

SEQ ID NO: 230080 - DNA, 25 bp, Homo sapien
ataaagacattttcatacacacaga

SEQ ID NO: 230081 - DNA, 25 bp, Homo sapien
tcatacacacagaaactaagagttt

SEQ ID NO: 230082 - DNA, 25 bp, Homo sapien
aaatcctaaaaccagtcagaggaca

SEQ ID NO: 230083 - DNA, 25 bp, Homo sapien
gttctgttgggaggcacaaagctga

SEQ ID NO: 230084 - DNA, 25 bp, Homo sapien
aaagctgatgaggatggctgactcc

SEQ ID NO: 230085 - DNA, 25 bp, Homo sapien
gatgaggatggctgactcctcagga

SEQ ID NO: 230086 - DNA, 25 bp, Homo sapien
agactgagctgatcccaacaggccc

SEQ ID NO: 230087 - DNA, 25 bp, Homo sapien
aggttaaagtcggtgtctcatacaa

SEQ ID NO: 230088 - DNA, 25 bp, Homo sapien
tgtctcatacaagctgaacgggaaa

SEQ ID NO: 230089 - DNA, 25 bp, Homo sapien
ggattccctatttcccagctaacca

SEQ ID NO: 230090 - DNA, 25 bp, Homo sapien
gttgagtatgaaacgctgcctgggt

SEQ ID NO: 230091 - DNA, 25 bp, Homo sapien
gctgcctgggtggaaagcagacacc

SEQ ID NO: 230092 - DNA, 25 bp, Homo sapien
ccagaactacatccgctttgtggag

SEQ ID NO: 230093 - DNA, 25 bp, Homo sapien
ccgctttgtggagaatcacgtggga

SEQ ID NO: 230094 - DNA, 25 bp, Homo sapien
aatcacgtgggagtcgcagtcaaat

SEQ ID NO: 230095 - DNA, 25 bp, Homo sapien
aaatgggttggtgttggcaagtcaa

SEQ ID NO: 230096 - DNA, 25 bp, Homo sapien
gagtcgatgatccagctgttttagt

SEQ ID NO: 230097 - DNA, 25 bp, Homo sapien
ctttgtctttccatgtagaccagat

SEQ ID NO: 230098 - DNA, 25 bp, Homo sapien
tttgaaagggcagacgatggctaga

SEQ ID NO: 230099 - DNA, 25 bp, Homo sapien
ctagaggtgtaatgtgcagcttgtt

SEQ ID NO: 230100 - DNA, 25 bp, Homo sapien
gtgcagcttgtttatacggtatttt

SEQ ID NO: 230101 - DNA, 25 bp, Homo sapien
tattttgggaaacttaccttggatg

SEQ ID NO: 230102 - DNA, 25 bp, Homo sapien
acttaccttggatgggaaatcgaat

SEQ ID NO: 230103 - DNA, 25 bp, Homo sapien
cgaatcgtggattcaccaggccggt

SEQ ID NO: 230104 - DNA, 25 bp, Homo sapien
ctccggttcagtacctattgtttct

SEQ ID NO: 230105 - DNA, 25 bp, Homo sapien
ttcagtacctattgtttctcctttc

SEQ ID NO: 230106 - DNA, 25 bp, Homo sapien
tatgtgattgtactagctctttcca

SEQ ID NO: 230107 - DNA, 25 bp, Homo sapien
ttgtactagctctttccatatgaaa

SEQ ID NO: 230108 - DNA, 25 bp, Homo sapien
taaatagcaagtgtaagctcagtgc

SEQ ID NO: 230109 - DNA, 25 bp, Homo sapien
gcaagtgtaagctcagtgctagagt

SEQ ID NO: 230110 - DNA, 25 bp, Homo sapien
gtaagctcagtgctagagtggatat

SEQ ID NO: 230111 - DNA, 25 bp, Homo sapien
gagtggatatacacaccgcatgttt

SEQ ID NO: 230112 - DNA, 25 bp, Homo sapien
catatgtggcacttttatgtatcat

SEQ ID NO: 230113 - DNA, 25 bp, Homo sapien
gtatcatgttgggttattgttctag

SEQ ID NO: 230114 - DNA, 25 bp, Homo sapien
gttgggttattgttctagactggac

SEQ ID NO: 230115 - DNA, 25 bp, Homo sapien
gttattgttctagactggactgtta

SEQ ID NO: 230116 - DNA, 25 bp, Homo sapien
tgttctagactggactgttaaatac

SEQ ID NO: 230117 - DNA, 25 bp, Homo sapien
gatacacagaatgagctgcatgcat

SEQ ID NO: 230118 - DNA, 25 bp, Homo sapien
cagaatgagctgcatgcatttatag

SEQ ID NO: 230119 - DNA, 25 bp, Homo sapien
gccaagactggctactgagttctca

SEQ ID NO: 230120 - DNA, 25 bp, Homo sapien
aagactggctactgagttctcaaag

SEQ ID NO: 230121 - DNA, 25 bp, Homo sapien
tactgagttctcaaagcgttttaat

SEQ ID NO: 230122 - DNA, 25 bp, Homo sapien
ttacgtatgagtgcctattttttcc

SEQ ID NO: 230123 - DNA, 25 bp, Homo sapien
atacccattttacttctgaaataat

SEQ ID NO: 230124 - DNA, 25 bp, Homo sapien
gttttgctttatgaccagctttaat

SEQ ID NO: 230125 - DNA, 25 bp, Homo sapien
gaccagctttaatttcaattgagga

SEQ ID NO: 230126 - DNA, 25 bp, Homo sapien
aggaataataacaaccctagagatt

SEQ ID NO: 230127 - DNA, 25 bp, Homo sapien
agatacctaaaaccatctacccagc

SEQ ID NO: 230128 - DNA, 25 bp, Homo sapien
aaccatctacccagcttagggttga

SEQ ID NO: 230129 - DNA, 25 bp, Homo sapien
cccagcttagggttgaactgaattt

SEQ ID NO: 230130 - DNA, 25 bp, Homo sapien
cctgtttccgcctcccaaatgctga

SEQ ID NO: 230131 - DNA, 25 bp, Homo sapien
ccagcccgcagcctcttttataagg

SEQ ID NO: 230132 - DNA, 25 bp, Homo sapien
attaatccccttcatgagggatatt

SEQ ID NO: 230133 - DNA, 25 bp, Homo sapien
taatccccttcatgagggatattct

SEQ ID NO: 230134 - DNA, 25 bp, Homo sapien
aatccccttcatgagggatattctc

SEQ ID NO: 230135 - DNA, 25 bp, Homo sapien
catgacttaatcacctgccaaagac

SEQ ID NO: 230136 - DNA, 25 bp, Homo sapien
atgacttaatcacctgccaaagacc

SEQ ID NO: 230137 - DNA, 25 bp, Homo sapien
acctcttaatactacatcagtgatg

SEQ ID NO: 230138 - DNA, 25 bp, Homo sapien
ctcttaatactacatcagtgatggg

SEQ ID NO: 230139 - DNA, 25 bp, Homo sapien
atcagtgatgggttcaatgtatcaa

SEQ ID NO: 230140 - DNA, 25 bp, Homo sapien
cagtgatgggttcaatgtatcaatt

SEQ ID NO: 230141 - DNA, 25 bp, Homo sapien
tgagctgcatcagcgcctgcgcgag

SEQ ID NO: 230142 - DNA, 25 bp, Homo sapien
cctgcgcgaggaagaagtagacgct

SEQ ID NO: 230143 - DNA, 25 bp, Homo sapien
agaagtagacgctgatgcagctgat

SEQ ID NO: 230144 - DNA, 25 bp, Homo sapien
acacatgctcttcctgctctatctg

SEQ ID NO: 230145 - DNA, 25 bp, Homo sapien
tgctcttcctgctctatctgcattt

SEQ ID NO: 230146 - DNA, 25 bp, Homo sapien
tctatctgcattttgcctaccacaa

SEQ ID NO: 230147 - DNA, 25 bp, Homo sapien
tttgcctaccacaaagtggtagagg

SEQ ID NO: 230148 - DNA, 25 bp, Homo sapien
cgcccatccagagggtccccagaga

SEQ ID NO: 230149 - DNA, 25 bp, Homo sapien
aacgccacagccaaagctgttgcgg

SEQ ID NO: 230150 - DNA, 25 bp, Homo sapien
agccaaagctgttgcggtgaccctg

SEQ ID NO: 230151 - DNA, 25 bp, Homo sapien
aagctgttgcggtgaccctgcagtc

SEQ ID NO: 230152 - DNA, 25 bp, Homo sapien
ttctctttagtgcttatcatgaaat

SEQ ID NO: 230153 - DNA, 25 bp, Homo sapien
gcttatcatgaaatgtgcttcactg

SEQ ID NO: 230154 - DNA, 25 bp, Homo sapien
actggttcagctctgttgtttcctt

SEQ ID NO: 230155 - DNA, 25 bp, Homo sapien
gttcagctctgttgtttccttaaac

SEQ ID NO: 230156 - DNA, 25 bp, Homo sapien
agctctgttgtttccttaaacataa

SEQ ID NO: 230157 - DNA, 25 bp, Homo sapien
ggaaatcagctatttaaaccagatc

SEQ ID NO: 230158 - DNA, 25 bp, Homo sapien
gctatttaaaccagatcacccttgt

SEQ ID NO: 230159 - DNA, 25 bp, Homo sapien
accagatcacccttgttaaaaatca

SEQ ID NO: 230160 - DNA, 25 bp, Homo sapien
aaatcattcttgttagcaaactaaa

SEQ ID NO: 230161 - DNA, 25 bp, Homo sapien
gattctaaaatagttgtctaggaca

SEQ ID NO: 230162 - DNA, 25 bp, Homo sapien
ggacaattttgggattcttaattat

SEQ ID NO: 230163 - DNA, 25 bp, Homo sapien
caccatggcaatgcgtggacgccgg

SEQ ID NO: 230164 - DNA, 25 bp, Homo sapien
accggaggccgggacttgtcactcg

SEQ ID NO: 230165 - DNA, 25 bp, Homo sapien
ggccgggacttgtcactcggagagg

SEQ ID NO: 230166 - DNA, 25 bp, Homo sapien
caggacatccgggtgccttggctca

SEQ ID NO: 230167 - DNA, 25 bp, Homo sapien
acatccgggtgccttggctcacgta

SEQ ID NO: 230168 - DNA, 25 bp, Homo sapien
atccgggtgccttggctcacgtagc

SEQ ID NO: 230169 - DNA, 25 bp, Homo sapien
gtgccttggctcacgtagccgctgg

SEQ ID NO: 230170 - DNA, 25 bp, Homo sapien
tcacgtagccgctgggcgccaagct

SEQ ID NO: 230171 - DNA, 25 bp, Homo sapien
ggaagggacgcacgtggaccaggcc

SEQ ID NO: 230172 - DNA, 25 bp, Homo sapien
acgcagggcacgtacgccgtctcag

SEQ ID NO: 230173 - DNA, 25 bp, Homo sapien
gcagggcacgtacgccgtctcagca

SEQ ID NO: 230174 - DNA, 25 bp, Homo sapien
cagtccagtctttattagcattggg

SEQ ID NO: 230175 - DNA, 25 bp, Homo sapien
agtccagtctttattagcattgggt

SEQ ID NO: 230176 - DNA, 25 bp, Homo sapien
gtccagtctttattagcattgggtc

SEQ ID NO: 230177 - DNA, 25 bp, Homo sapien
tccagtctttattagcattgggtcc

SEQ ID NO: 230178 - DNA, 25 bp, Homo sapien
cagtctttattagcattgggtccct

SEQ ID NO: 230179 - DNA, 25 bp, Homo sapien
agtctttattagcattgggtccctg

SEQ ID NO: 230180 - DNA, 25 bp, Homo sapien
gtctttattagcattgggtccctgg

SEQ ID NO: 230181 - DNA, 25 bp, Homo sapien
tctttattagcattgggtccctggt

SEQ ID NO: 230182 - DNA, 25 bp, Homo sapien
ctttattagcattgggtccctggtc

SEQ ID NO: 230183 - DNA, 25 bp, Homo sapien
tttattagcattgggtccctggtcc

SEQ ID NO: 230184 - DNA, 25 bp, Homo sapien
attagcattgggtccctggtcccac

SEQ ID NO: 230185 - DNA, 25 bp, Homo sapien
agtgttggaccagtattgcagttct

SEQ ID NO: 230186 - DNA, 25 bp, Homo sapien
gttggaccagtattgcagttctgta

SEQ ID NO: 230187 - DNA, 25 bp, Homo sapien
ggaccagtattgcagttctgtagtg

SEQ ID NO: 230188 - DNA, 25 bp, Homo sapien
ccagtattgcagttctgtagtgtca

SEQ ID NO: 230189 - DNA, 25 bp, Homo sapien
attgcagttctgtagtgtcatttct

SEQ ID NO: 230190 - DNA, 25 bp, Homo sapien
tgcagttctgtagtgtcatttctta

SEQ ID NO: 230191 - DNA, 25 bp, Homo sapien
tctgtagtgtcatttcttataaaaa

SEQ ID NO: 230192 - DNA, 25 bp, Homo sapien
ggcatatttaaagcctaacattcta

SEQ ID NO: 230193 - DNA, 25 bp, Homo sapien
tttttaatacttgtttcagcctctt

SEQ ID NO: 230194 - DNA, 25 bp, Homo sapien
tcagcctctttaatctctttataag

SEQ ID NO: 230195 - DNA, 25 bp, Homo sapien
gcctctttaatctctttataagtta

SEQ ID NO: 230196 - DNA, 25 bp, Homo sapien
cagtccagtctttattagcattggg

SEQ ID NO: 230197 - DNA, 25 bp, Homo sapien
agtccagtctttattagcattgggt

SEQ ID NO: 230198 - DNA, 25 bp, Homo sapien
gtccagtctttattagcattgggtc

SEQ ID NO: 230199 - DNA, 25 bp, Homo sapien
tccagtctttattagcattgggtcc

SEQ ID NO: 230200 - DNA, 25 bp, Homo sapien
cagtctttattagcattgggtccct

SEQ ID NO: 230201 - DNA, 25 bp, Homo sapien
agtctttattagcattgggtccctg

SEQ ID NO: 230202 - DNA, 25 bp, Homo sapien
gtctttattagcattgggtccctgg

SEQ ID NO: 230203 - DNA, 25 bp, Homo sapien
tctttattagcattgggtccctggt

SEQ ID NO: 230204 - DNA, 25 bp, Homo sapien
ctttattagcattgggtccctggtc

SEQ ID NO: 230205 - DNA, 25 bp, Homo sapien
tttattagcattgggtccctggtcc

SEQ ID NO: 230206 - DNA, 25 bp, Homo sapien
ttattagcattgggtccctggtccc

SEQ ID NO: 230207 - DNA, 25 bp, Homo sapien
gataattaggagtttgatcccatca

SEQ ID NO: 230208 - DNA, 25 bp, Homo sapien
gatcccatcaacactattcttgtag

SEQ ID NO: 230209 - DNA, 25 bp, Homo sapien
aacactattcttgtagcagttagga

SEQ ID NO: 230210 - DNA, 25 bp, Homo sapien
agcagttaggaatcttgagctattt

SEQ ID NO: 230211 - DNA, 25 bp, Homo sapien
ttctcatacgattactatagtccag

SEQ ID NO: 230212 - DNA, 25 bp, Homo sapien
tactatagtccagtttaccaaagtt

SEQ ID NO: 230213 - DNA, 25 bp, Homo sapien
tctttagatgtctgataatcttgag

SEQ ID NO: 230214 - DNA, 25 bp, Homo sapien
tcttgagatgattgcttaccttaaa

SEQ ID NO: 230215 - DNA, 25 bp, Homo sapien
ggtgaagctgaataaagttctactt

SEQ ID NO: 230216 - DNA, 25 bp, Homo sapien
gttctacttactgtattaactggca

SEQ ID NO: 230217 - DNA, 25 bp, Homo sapien
ctggcaacagttgagtttcttaaga

SEQ ID NO: 230218 - DNA, 25 bp, Homo sapien
tgaggtgtggtaaggagcaactcca

SEQ ID NO: 230219 - DNA, 25 bp, Homo sapien
aggagcaactccacgtgatacatgg

SEQ ID NO: 230220 - DNA, 25 bp, Homo sapien
gaacacaaggtggtcggaaaggcct

SEQ ID NO: 230221 - DNA, 25 bp, Homo sapien
aaggccttaaactcctccttgacat

SEQ ID NO: 230222 - DNA, 25 bp, Homo sapien
cttaaactcctccttgacatacaaa

SEQ ID NO: 230223 - DNA, 25 bp, Homo sapien
aactcctccttgacatacaaaaccg

SEQ ID NO: 230224 - DNA, 25 bp, Homo sapien
tcctccttgacatacaaaaccggtt

SEQ ID NO: 230225 - DNA, 25 bp, Homo sapien
aaagatccaagcagtttggtcccaa

SEQ ID NO: 230226 - DNA, 25 bp, Homo sapien
tcccaaactgaggtgaacacttcaa

SEQ ID NO: 230227 - DNA, 25 bp, Homo sapien
tgaggtgaacacttcaaagtttatt

SEQ ID NO: 230228 - DNA, 25 bp, Homo sapien
gaatcaaagtttcccaaattaaatg

SEQ ID NO: 230229 - DNA, 25 bp, Homo sapien
tcagcgtgtccatccaggtggagta

SEQ ID NO: 230230 - DNA, 25 bp, Homo sapien
gcgtgtccatccaggtggagtacat

SEQ ID NO: 230231 - DNA, 25 bp, Homo sapien
atccaggtggagtacatggaccgcg

SEQ ID NO: 230232 - DNA, 25 bp, Homo sapien
ccaatccgcacatcttccctgaggg

SEQ ID NO: 230233 - DNA, 25 bp, Homo sapien
tacgatatcctctacaaatagggct

SEQ ID NO: 230234 - DNA, 25 bp, Homo sapien
tcctctacaaatagggctggctcca

SEQ ID NO: 230235 - DNA, 25 bp, Homo sapien
ctctgccaggcgctagacatgtaca

SEQ ID NO: 230236 - DNA, 25 bp, Homo sapien
tgccaggcgctagacatgtacagag

SEQ ID NO: 230237 - DNA, 25 bp, Homo sapien
ggcgctagacatgtacagaggtttt

SEQ ID NO: 230238 - DNA, 25 bp, Homo sapien
gctagacatgtacagaggtttttct

SEQ ID NO: 230239 - DNA, 25 bp, Homo sapien
tacagaggtttttctgtggttgtaa

SEQ ID NO: 230240 - DNA, 25 bp, Homo sapien
ctttgcactttaaatcctaggaata

SEQ ID NO: 230241 - DNA, 25 bp, Homo sapien
gaaagaataacaggaccttctagtc

SEQ ID NO: 230242 - DNA, 25 bp, Homo sapien
ggaccttctagtcagcagggcatgt

SEQ ID NO: 230243 - DNA, 25 bp, Homo sapien
accttctagtcagcagggcatgttt

SEQ ID NO: 230244 - DNA, 25 bp, Homo sapien
ttctagtcagcagggcatgtttgga

SEQ ID NO: 230245 - DNA, 25 bp, Homo sapien
agtcagcagggcatgtttggaaaat

SEQ ID NO: 230246 - DNA, 25 bp, Homo sapien
ggaaaatgttaatacgccatgattt

SEQ ID NO: 230247 - DNA, 25 bp, Homo sapien
atgttaatacgccatgatttttgaa

SEQ ID NO: 230248 - DNA, 25 bp, Homo sapien
ttgaagaccaattttagttcaggag

SEQ ID NO: 230249 - DNA, 25 bp, Homo sapien
aaaacttacaggctgttttcaatat

SEQ ID NO: 230250 - DNA, 25 bp, Homo sapien
gttcattgtgaaatactgttggaag

SEQ ID NO: 230251 - DNA, 25 bp, Homo sapien
gacaagcagcccgaataccttgctg

SEQ ID NO: 230252 - DNA, 25 bp, Homo sapien
gaataccttgctggcatagcagctg

SEQ ID NO: 230253 - DNA, 25 bp, Homo sapien
tggcatagcagctgcctacctgcac

SEQ ID NO: 230254 - DNA, 25 bp, Homo sapien
tgcacccggagacctgagcagatat

SEQ ID NO: 230255 - DNA, 25 bp, Homo sapien
ttactagggtattatttgacagcca

SEQ ID NO: 230256 - DNA, 25 bp, Homo sapien
gacagccagcttagcagtcaagaag

SEQ ID NO: 230257 - DNA, 25 bp, Homo sapien
gtagcatggcagaccacttcattgg

SEQ ID NO: 230258 - DNA, 25 bp, Homo sapien
gggctgaagacctgcatttattgat

SEQ ID NO: 230259 - DNA, 25 bp, Homo sapien
gatcacttactacatgccacgtatt

SEQ ID NO: 230260 - DNA, 25 bp, Homo sapien
gccacgtatttcgtttaggatatat

SEQ ID NO: 230261 - DNA, 25 bp, Homo sapien
tataccccacggtagaggcagagct

SEQ ID NO: 230262 - DNA, 25 bp, Homo sapien
gggattggtctcagcgctacctaga

SEQ ID NO: 230263 - DNA, 25 bp, Homo sapien
tggtctcagcgctacctagaagaat

SEQ ID NO: 230264 - DNA, 25 bp, Homo sapien
ctcagcgctacctagaagaatcaaa

SEQ ID NO: 230265 - DNA, 25 bp, Homo sapien
aggtcatggcttccctcaatattgt

SEQ ID NO: 230266 - DNA, 25 bp, Homo sapien
atggcttccctcaatattgtcccag

SEQ ID NO: 230267 - DNA, 25 bp, Homo sapien
aatattgtcccagccatttctcata

SEQ ID NO: 230268 - DNA, 25 bp, Homo sapien
ttgtcccagccatttctcatatgta

SEQ ID NO: 230269 - DNA, 25 bp, Homo sapien
taaaccgtgacaaaacactgccttt

SEQ ID NO: 230270 - DNA, 25 bp, Homo sapien
aaacactgcctttatattatttagc

SEQ ID NO: 230271 - DNA, 25 bp, Homo sapien
gtaaatagcattattaagctctttt

SEQ ID NO: 230272 - DNA, 25 bp, Homo sapien
ttgtaataaagaccctttgatttga

SEQ ID NO: 230273 - DNA, 25 bp, Homo sapien
ttgtgctctgaaaaatgcttactca

SEQ ID NO: 230274 - DNA, 25 bp, Homo sapien
gaaaaatgcttactcaattgctttg

SEQ ID NO: 230275 - DNA, 25 bp, Homo sapien
ttatccttttccacagaaattcaag

SEQ ID NO: 230276 - DNA, 25 bp, Homo sapien
acaacaaagccttgtcatattagct

SEQ ID NO: 230277 - DNA, 25 bp, Homo sapien
tatttaatttcagtgctagtgagca

SEQ ID NO: 230278 - DNA, 25 bp, Homo sapien
agatgttttagggtgcaagagccat

SEQ ID NO: 230279 - DNA, 25 bp, Homo sapien
ggtgcaagagccatgttgctatttc

SEQ ID NO: 230280 - DNA, 25 bp, Homo sapien
catgttgctatttcagttatgatgt

SEQ ID NO: 230281 - DNA, 25 bp, Homo sapien
taagcaacaactgtctggcctgggt

SEQ ID NO: 230282 - DNA, 25 bp, Homo sapien
tgtctggcctgggtctacttcggtc

SEQ ID NO: 230283 - DNA, 25 bp, Homo sapien
ttcggtcccctttgcaggtcagttg

SEQ ID NO: 230284 - DNA, 25 bp, Homo sapien
gataatggaaccaaagttgttactt

SEQ ID NO: 230285 - DNA, 25 bp, Homo sapien
ttttgtgtacctctacagagaccaa

SEQ ID NO: 230286 - DNA, 25 bp, Homo sapien
ttgtgtacctctacagagaccaaaa

SEQ ID NO: 230287 - DNA, 25 bp, Homo sapien
aagagattttatggggctactgcag

SEQ ID NO: 230288 - DNA, 25 bp, Homo sapien
gggctactgcagataaaaataggac

SEQ ID NO: 230289 - DNA, 25 bp, Homo sapien
ggacacaatattaaaggagctacag

SEQ ID NO: 230290 - DNA, 25 bp, Homo sapien
atgaatgtatgccactgcaattaga

SEQ ID NO: 230291 - DNA, 25 bp, Homo sapien
gccactgcaattagagtatccaata

SEQ ID NO: 230292 - DNA, 25 bp, Homo sapien
aaggagacagtttagagtcaggaca

SEQ ID NO: 230293 - DNA, 25 bp, Homo sapien
gagtcaggacagaaaagcttccata

SEQ ID NO: 230294 - DNA, 25 bp, Homo sapien
gaaaagcttccataattgaactaga

SEQ ID NO: 230295 - DNA, 25 bp, Homo sapien
tttcctgaaaacatcgacatgggac

SEQ ID NO: 230296 - DNA, 25 bp, Homo sapien
gacatgggacatgttcaaaccaaat

SEQ ID NO: 230297 - DNA, 25 bp, Homo sapien
gagaatattacattatgttcccaca

SEQ ID NO: 230298 - DNA, 25 bp, Homo sapien
atgttcccacaatagcataaatgta

SEQ ID NO: 230299 - DNA, 25 bp, Homo sapien
gcataaatgtatgtcttatcacttg

SEQ ID NO: 230300 - DNA, 25 bp, Homo sapien
cttatcacttgaatggagcccagac

SEQ ID NO: 230301 - DNA, 25 bp, Homo sapien
aaagggcgcctgagagtggaaatac

SEQ ID NO: 230302 - DNA, 25 bp, Homo sapien
gagagtggaaatacgcctatgagaa

SEQ ID NO: 230303 - DNA, 25 bp, Homo sapien
agccagcctttcgtgataacagcag

SEQ ID NO: 230304 - DNA, 25 bp, Homo sapien
aagagtgcacagagctgaccacagc

SEQ ID NO: 230305 - DNA, 25 bp, Homo sapien
gctgaccacagcacaaatgtcgcag

SEQ ID NO: 230306 - DNA, 25 bp, Homo sapien
gggccctgtgcttctaaactgagtg

SEQ ID NO: 230307 - DNA, 25 bp, Homo sapien
gtgcttctaaactgagtggttgctg

SEQ ID NO: 230308 - DNA, 25 bp, Homo sapien
gtggttgctggttagtttggtattc

SEQ ID NO: 230309 - DNA, 25 bp, Homo sapien
ggtagattagttcattctcagcatg

SEQ ID NO: 230310 - DNA, 25 bp, Homo sapien
attctcagcatgtgtagctagacat

SEQ ID NO: 230311 - DNA, 25 bp, Homo sapien
gaaactgttagtacgcatacctcag

SEQ ID NO: 230312 - DNA, 25 bp, Homo sapien
tacgcatacctcagttcaaaccttt

SEQ ID NO: 230313 - DNA, 25 bp, Homo sapien
cctcagttcaaacctttagggaatg

SEQ ID NO: 230314 - DNA, 25 bp, Homo sapien
ttcactcagttgcacttagtcgtat

SEQ ID NO: 230315 - DNA, 25 bp, Homo sapien
cacttagtcgtatgtcttgcatgct

SEQ ID NO: 230316 - DNA, 25 bp, Homo sapien
gtatgtcttgcatgcttagtctaaa

SEQ ID NO: 230317 - DNA, 25 bp, Homo sapien
tctgggtttggaagagaccccaaag

SEQ ID NO: 230318 - DNA, 25 bp, Homo sapien
aaggctcaaaatagctattatttct

SEQ ID NO: 230319 - DNA, 25 bp, Homo sapien
ttctttttggccagctgttaaactt

SEQ ID NO: 230320 - DNA, 25 bp, Homo sapien
ggccagctgttaaacttaattcatt

SEQ ID NO: 230321 - DNA, 25 bp, Homo sapien
attcattagttcttaagctgtccag

SEQ ID NO: 230322 - DNA, 25 bp, Homo sapien
cagagcaccaggataagtcaagaca

SEQ ID NO: 230323 - DNA, 25 bp, Homo sapien
agtcaagacaagacactctttgtag

SEQ ID NO: 230324 - DNA, 25 bp, Homo sapien
aagacactctttgtagaacttcatg

SEQ ID NO: 230325 - DNA, 25 bp, Homo sapien
agaacttcatgaatgttaacatagt

SEQ ID NO: 230326 - DNA, 25 bp, Homo sapien
aaataggtactttatgctaaattag

SEQ ID NO: 230327 - DNA, 25 bp, Homo sapien
agtaaatctgacatacttttaaatg

SEQ ID NO: 230328 - DNA, 25 bp, Homo sapien
aaataggagattactgctgtatacc

SEQ ID NO: 230329 - DNA, 25 bp, Homo sapien
ggagattactgctgtataccttaca

SEQ ID NO: 230330 - DNA, 25 bp, Homo sapien
gattactgctgtataccttacaaaa

SEQ ID NO: 230331 - DNA, 25 bp, Homo sapien
tactgctgtataccttacaaaacca

SEQ ID NO: 230332 - DNA, 25 bp, Homo sapien
gctgtataccttacaaaaccaaatg

SEQ ID NO: 230333 - DNA, 25 bp, Homo sapien
tatggaatttatgataaggctttct

SEQ ID NO: 230334 - DNA, 25 bp, Homo sapien
gataaggctttctgtgagacaacac

SEQ ID NO: 230335 - DNA, 25 bp, Homo sapien
tcaggaagctgtttgaatcattagt

SEQ ID NO: 230336 - DNA, 25 bp, Homo sapien
gaatcattagtgttgctttcttcta

SEQ ID NO: 230337 - DNA, 25 bp, Homo sapien
gttgctttcttctaaatgaacaccc

SEQ ID NO: 230338 - DNA, 25 bp, Homo sapien
tttcttctaaatgaacacccttctg

SEQ ID NO: 230339 - DNA, 25 bp, Homo sapien
gtttgaactttagtccctccacact

SEQ ID NO: 230340 - DNA, 25 bp, Homo sapien
cagctctctcactgagttatcttca

SEQ ID NO: 230341 - DNA, 25 bp, Homo sapien
gagttatcttcactgtacctgttcc

SEQ ID NO: 230342 - DNA, 25 bp, Homo sapien
ttcactgtacctgttccagcatatc

SEQ ID NO: 230343 - DNA, 25 bp, Homo sapien
gtatacagagctggaagtggaccat

SEQ ID NO: 230344 - DNA, 25 bp, Homo sapien
gaagtggaccatggaaaacatcgat

SEQ ID NO: 230345 - DNA, 25 bp, Homo sapien
aacatcgataaccatgcatcctctt

SEQ ID NO: 230346 - DNA, 25 bp, Homo sapien
ataaccatgcatcctcttgcttggc

SEQ ID NO: 230347 - DNA, 25 bp, Homo sapien
ttgcttggccacctcctgaaactgc

SEQ ID NO: 230348 - DNA, 25 bp, Homo sapien
ctgaaactgctccacctttgaagtt

SEQ ID NO: 230349 - DNA, 25 bp, Homo sapien
ctgctccacctttgaagtttgaact

SEQ ID NO: 230350 - DNA, 25 bp, Homo sapien
atgctggccacaggacccagtgcag

SEQ ID NO: 230351 - DNA, 25 bp, Homo sapien
ccgtgggtctttcctgatagctgca

SEQ ID NO: 230352 - DNA, 25 bp, Homo sapien
ggcttgagattgcagcctcaggata

SEQ ID NO: 230353 - DNA, 25 bp, Homo sapien
ataggacacgttcagatgccttcca

SEQ ID NO: 230354 - DNA, 25 bp, Homo sapien
ttccagactacacacactatgctta

SEQ ID NO: 230355 - DNA, 25 bp, Homo sapien
tagattcgagagtctttcctgacct

SEQ ID NO: 230356 - DNA, 25 bp, Homo sapien
aatttgtcccttgcttactttcaca

SEQ ID NO: 230357 - DNA, 25 bp, Homo sapien
gcttactttcacactgcagaagatt

SEQ ID NO: 230358 - DNA, 25 bp, Homo sapien
tcatcattatttttgcagcagtaca

SEQ ID NO: 230359 - DNA, 25 bp, Homo sapien
aaatcattccctttcatgtcctggt

SEQ ID NO: 230360 - DNA, 25 bp, Homo sapien
atgtcctggtctttttaagtcttga

SEQ ID NO: 230361 - DNA, 25 bp, Homo sapien
cctattaatagggtttctgcgcggt

SEQ ID NO: 230362 - DNA, 25 bp, Homo sapien
attaatagggtttctgcgcggtgca

SEQ ID NO: 230363 - DNA, 25 bp, Homo sapien
tttctgcgcggtgcagggttgtaaa

SEQ ID NO: 230364 - DNA, 25 bp, Homo sapien
ctgcgcggtgcagggttgtaaacct

SEQ ID NO: 230365 - DNA, 25 bp, Homo sapien
gcggtgcagggttgtaaacctgctt

SEQ ID NO: 230366 - DNA, 25 bp, Homo sapien
cagggttgtaaacctgctttatctt

SEQ ID NO: 230367 - DNA, 25 bp, Homo sapien
gttgtaaacctgctttatcttttag

SEQ ID NO: 230368 - DNA, 25 bp, Homo sapien
gtaaacctgctttatcttttaggat

SEQ ID NO: 230369 - DNA, 25 bp, Homo sapien
taggattattcctaaatgcatcttc

SEQ ID NO: 230370 - DNA, 25 bp, Homo sapien
ttctttataaacttgacttgctatc

SEQ ID NO: 230371 - DNA, 25 bp, Homo sapien
tataaacttgacttgctatctcagc

SEQ ID NO: 230372 - DNA, 25 bp, Homo sapien
gaaactgcggtcatccagttcttcc

SEQ ID NO: 230373 - DNA, 25 bp, Homo sapien
tgcggtcatccagttcttcctgaca

SEQ ID NO: 230374 - DNA, 25 bp, Homo sapien
agttcttcctgacaccggatgggtg

SEQ ID NO: 230375 - DNA, 25 bp, Homo sapien
ttcctgacaccggatgggtgcttgg

SEQ ID NO: 230376 - DNA, 25 bp, Homo sapien
tgcttgggaaccgtttgagccttat

SEQ ID NO: 230377 - DNA, 25 bp, Homo sapien
ttgggaaccgtttgagccttataga

SEQ ID NO: 230378 - DNA, 25 bp, Homo sapien
ggaaccgtttgagccttatagatca

SEQ ID NO: 230379 - DNA, 25 bp, Homo sapien
gagccttatagatcatttacattca

SEQ ID NO: 230380 - DNA, 25 bp, Homo sapien
ttaactcagcaagtgagaacttaca

SEQ ID NO: 230381 - DNA, 25 bp, Homo sapien
gtagttactgtatatgtaccaagaa

SEQ ID NO: 230382 - DNA, 25 bp, Homo sapien
gtaccaagaaagatataacgttagg

SEQ ID NO: 230383 - DNA, 25 bp, Homo sapien
cacacagaagttcatttggttttcc

SEQ ID NO: 230384 - DNA, 25 bp, Homo sapien
tcctttgttttatggtgcatatagc

SEQ ID NO: 230385 - DNA, 25 bp, Homo sapien
cctttcctcactgaaggctgtgagt

SEQ ID NO: 230386 - DNA, 25 bp, Homo sapien
gaaggctgtgagttgctttcaatgt

SEQ ID NO: 230387 - DNA, 25 bp, Homo sapien
gttgctttcaatgtgacaacactat

SEQ ID NO: 230388 - DNA, 25 bp, Homo sapien
acaacactatgatgtcatttggaag

SEQ ID NO: 230389 - DNA, 25 bp, Homo sapien
tgccaggacagactgattctgagtc

SEQ ID NO: 230390 - DNA, 25 bp, Homo sapien
tgattctgagtcctgggtgccgtat

SEQ ID NO: 230391 - DNA, 25 bp, Homo sapien
tgagtcctgggtgccgtatgtgtat

SEQ ID NO: 230392 - DNA, 25 bp, Homo sapien
tatgcggcagtgttgtcaggcgatc

SEQ ID NO: 230393 - DNA, 25 bp, Homo sapien
gtgttgtcaggcgatcttgtttgaa

SEQ ID NO: 230394 - DNA, 25 bp, Homo sapien
tcctgcagtggatgcccaccgtgaa

SEQ ID NO: 230395 - DNA, 25 bp, Homo sapien
agtggatgcccaccgtgaatgccag

SEQ ID NO: 230396 - DNA, 25 bp, Homo sapien
atgcccaccgtgaatgccagcgtgg

SEQ ID NO: 230397 - DNA, 25 bp, Homo sapien
tcgaccccaagactttcaagtgcag

SEQ ID NO: 230398 - DNA, 25 bp, Homo sapien
aagactttcaagtgcagagccatag

SEQ ID NO: 230399 - DNA, 25 bp, Homo sapien
tttcaagtgcagagccataggtggg

SEQ ID NO: 230400 - DNA, 25 bp, Homo sapien
gcctggacacccttactcacgtgga

SEQ ID NO: 230401 - DNA, 25 bp, Homo sapien
ttactcacgtggacctccgcgggaa

SEQ ID NO: 230402 - DNA, 25 bp, Homo sapien
gcgggaacccgttccagtgtgactg

SEQ ID NO: 230403 - DNA, 25 bp, Homo sapien
ggaacccgttccagtgtgactgccg

SEQ ID NO: 230404 - DNA, 25 bp, Homo sapien
cgttccagtgtgactgccgcgtcct

SEQ ID NO: 230405 - DNA, 25 bp, Homo sapien
attaaaatatcatgtctgacttcag

SEQ ID NO: 230406 - DNA, 25 bp, Homo sapien
aaaatatcatgtctgacttcagtga

SEQ ID NO: 230407 - DNA, 25 bp, Homo sapien
aatatcatgtctgacttcagtgatc

SEQ ID NO: 230408 - DNA, 25 bp, Homo sapien
attgcatttactccacccaagagtg

SEQ ID NO: 230409 - DNA, 25 bp, Homo sapien
ttgcatttactccacccaagagtgg

SEQ ID NO: 230410 - DNA, 25 bp, Homo sapien
tgcatttactccacccaagagtgga

SEQ ID NO: 230411 - DNA, 25 bp, Homo sapien
gcatttactccacccaagagtggat

SEQ ID NO: 230412 - DNA, 25 bp, Homo sapien
tttactccacccaagagtggatttt

SEQ ID NO: 230413 - DNA, 25 bp, Homo sapien
cacccaagagtggattttcacataa

SEQ ID NO: 230414 - DNA, 25 bp, Homo sapien
ttcttatttatatactgacttttca

SEQ ID NO: 230415 - DNA, 25 bp, Homo sapien
tatatactgacttttcaaaatacaa

SEQ ID NO: 230416 - DNA, 25 bp, Homo sapien
ggcctacaggcgtgtaagacagctt

SEQ ID NO: 230417 - DNA, 25 bp, Homo sapien
acagcttggtctggtctgtgcagaa

SEQ ID NO: 230418 - DNA, 25 bp, Homo sapien
ctaacattgttcaggcgcatggccc

SEQ ID NO: 230419 - DNA, 25 bp, Homo sapien
atggcccctgcggtgtgtacacgaa

SEQ ID NO: 230420 - DNA, 25 bp, Homo sapien
gtgtacacgaactcggcttcttttg

SEQ ID NO: 230421 - DNA, 25 bp, Homo sapien
gcttcttttgtcctaggtacgccaa

SEQ ID NO: 230422 - DNA, 25 bp, Homo sapien
gggcaggtttctggagactcccttg

SEQ ID NO: 230423 - DNA, 25 bp, Homo sapien
gggcaccgggctggcgtttccacat

SEQ ID NO: 230424 - DNA, 25 bp, Homo sapien
gtttccacatctgtcttcattagca

SEQ ID NO: 230425 - DNA, 25 bp, Homo sapien
gatggattttatttcactcacactc

SEQ ID NO: 230426 - DNA, 25 bp, Homo sapien
atttcactcacactccagtttgtaa

SEQ ID NO: 230427 - DNA, 25 bp, Homo sapien
ggaaccaaatgtgaccttgtgcata

SEQ ID NO: 230428 - DNA, 25 bp, Homo sapien
caaatgtgaccttgtgcatatattg

SEQ ID NO: 230429 - DNA, 25 bp, Homo sapien
gcaagaatactcattttgacataat

SEQ ID NO: 230430 - DNA, 25 bp, Homo sapien
taggtcctcttgtcagagatcctct

SEQ ID NO: 230431 - DNA, 25 bp, Homo sapien
tcctcttgtcagagatcctctacca

SEQ ID NO: 230432 - DNA, 25 bp, Homo sapien
tctaccacagacattaatagctgag

SEQ ID NO: 230433 - DNA, 25 bp, Homo sapien
acattaatagctgagcaggagccac

SEQ ID NO: 230434 - DNA, 25 bp, Homo sapien
gcaggagccacatggattgattgta

SEQ ID NO: 230435 - DNA, 25 bp, Homo sapien
gattgattgtatccactcaccattg

SEQ ID NO: 230436 - DNA, 25 bp, Homo sapien
tgtatccactcaccattgacgatgg

SEQ ID NO: 230437 - DNA, 25 bp, Homo sapien
tcaccattgacgatggcattgagcg

SEQ ID NO: 230438 - DNA, 25 bp, Homo sapien
agtttggccgcactgaagacttatg

SEQ ID NO: 230439 - DNA, 25 bp, Homo sapien
gaagacttatggcagtgaacacatc

SEQ ID NO: 230440 - DNA, 25 bp, Homo sapien
agtgaacacatctgatttcccacag

SEQ ID NO: 230441 - DNA, 25 bp, Homo sapien
agcacaacagccctgcatgggtttg

SEQ ID NO: 230442 - DNA, 25 bp, Homo sapien
aacagccctgcatgggtttgtttgt

SEQ ID NO: 230443 - DNA, 25 bp, Homo sapien
ttttttactgctcactcccaacctt

SEQ ID NO: 230444 - DNA, 25 bp, Homo sapien
gagtgtagtctcagcttaaagttgt

SEQ ID NO: 230445 - DNA, 25 bp, Homo sapien
aatcacgagaacacctaaacaacaa

SEQ ID NO: 230446 - DNA, 25 bp, Homo sapien
aaatctattgtggtatgcacttgat

SEQ ID NO: 230447 - DNA, 25 bp, Homo sapien
gtggtatgcacttgattaacttata

SEQ ID NO: 230448 - DNA, 25 bp, Homo sapien
gttagaggaaactttcacatgaata

SEQ ID NO: 230449 - DNA, 25 bp, Homo sapien
aaatattttcagaacctggaagctt

SEQ ID NO: 230450 - DNA, 25 bp, Homo sapien
gaacctggaagcttatccatggcca

SEQ ID NO: 230451 - DNA, 25 bp, Homo sapien
ggaagcttatccatggccaccgtcg

SEQ ID NO: 230452 - DNA, 25 bp, Homo sapien
ttgattttggaagccaccagcgttc

SEQ ID NO: 230453 - DNA, 25 bp, Homo sapien
ggtgagcgtgcctgtcccctgcgtt

SEQ ID NO: 230454 - DNA, 25 bp, Homo sapien
gttgctcgtctctacactgacgatg

SEQ ID NO: 230455 - DNA, 25 bp, Homo sapien
tgacgatgcccctttccagagttga

SEQ ID NO: 230456 - DNA, 25 bp, Homo sapien
gagttgacactggaccaactttcac

SEQ ID NO: 230457 - DNA, 25 bp, Homo sapien
ggaccaactttcactgctttccttt

SEQ ID NO: 230458 - DNA, 25 bp, Homo sapien
ccagcgttccagacatttgcgataa

SEQ ID NO: 230459 - DNA, 25 bp, Homo sapien
ggagtgtcacacgtttatgcagaaa

SEQ ID NO: 230460 - DNA, 25 bp, Homo sapien
actgggaagagatgaaatgtttttt

SEQ ID NO: 230461 - DNA, 25 bp, Homo sapien
cagagaacagagggtccagggccct

SEQ ID NO: 230462 - DNA, 25 bp, Homo sapien
ttctcagttcccacttcctgctgag

SEQ ID NO: 230463 - DNA, 25 bp, Homo sapien
tgctgagctcttctggactcaggat

SEQ ID NO: 230464 - DNA, 25 bp, Homo sapien
agctcttctggactcaggatcgcag

SEQ ID NO: 230465 - DNA, 25 bp, Homo sapien
ttctggactcaggatcgcagatccg

SEQ ID NO: 230466 - DNA, 25 bp, Homo sapien
cagccgagcatccttcatgagcctg

SEQ ID NO: 230467 - DNA, 25 bp, Homo sapien
ttcatgagcctgcagaactgctttc

SEQ ID NO: 230468 - DNA, 25 bp, Homo sapien
gcagaactgctttcctatgtttacc

SEQ ID NO: 230469 - DNA, 25 bp, Homo sapien
gaactgctttcctatgtttacccag

SEQ ID NO: 230470 - DNA, 25 bp, Homo sapien
gggacctcctttcagatgaactggg

SEQ ID NO: 230471 - DNA, 25 bp, Homo sapien
cattgtttccttctgacttaagcaa

SEQ ID NO: 230472 - DNA, 25 bp, Homo sapien
aatttgttttggtactcttcagagg

SEQ ID NO: 230473 - DNA, 25 bp, Homo sapien
ggaattgtgctttggctcataactt

SEQ ID NO: 230474 - DNA, 25 bp, Homo sapien
ttggctcataacttggccatgttct

SEQ ID NO: 230475 - DNA, 25 bp, Homo sapien
gttctccatgaattagttctcctat

SEQ ID NO: 230476 - DNA, 25 bp, Homo sapien
aaagttctcctatcttgatttcact

SEQ ID NO: 230477 - DNA, 25 bp, Homo sapien
ctttaggagctctgtaaggctggta

SEQ ID NO: 230478 - DNA, 25 bp, Homo sapien
gtaaggctggtatttttgtctgttt

SEQ ID NO: 230479 - DNA, 25 bp, Homo sapien
gtctgttttatcttctactgtatcg

SEQ ID NO: 230480 - DNA, 25 bp, Homo sapien
tactgtatcgccagtgcctggaaca

SEQ ID NO: 230481 - DNA, 25 bp, Homo sapien
gcctggaacagtgtctggtgcacat

SEQ ID NO: 230482 - DNA, 25 bp, Homo sapien
cccttacttacatactagcttccaa

SEQ ID NO: 230483 - DNA, 25 bp, Homo sapien
agtggagaagcccagtctgtcctat

SEQ ID NO: 230484 - DNA, 25 bp, Homo sapien
gacaaagccaggtctaatggtactg

SEQ ID NO: 230485 - DNA, 25 bp, Homo sapien
gggcactgccaagacaataagctag

SEQ ID NO: 230486 - DNA, 25 bp, Homo sapien
taagctaggctactgggtccagcta

SEQ ID NO: 230487 - DNA, 25 bp, Homo sapien
ggtccagctactactttggtgggat

SEQ ID NO: 230488 - DNA, 25 bp, Homo sapien
gattcaggtgagtctccatgcactt

SEQ ID NO: 230489 - DNA, 25 bp, Homo sapien
atgcacttcacatgttacccagtgt

SEQ ID NO: 230490 - DNA, 25 bp, Homo sapien
tacccagtgttcttgttacttccaa

SEQ ID NO: 230491 - DNA, 25 bp, Homo sapien
aagaatggctctgtcacactcgaag

SEQ ID NO: 230492 - DNA, 25 bp, Homo sapien
gtcacactcgaagccaggtttgatc

SEQ ID NO: 230493 - DNA, 25 bp, Homo sapien
caggagttgattttggaagccacca

SEQ ID NO: 230494 - DNA, 25 bp, Homo sapien
gttgattttggaagccaccagcgtt

SEQ ID NO: 230495 - DNA, 25 bp, Homo sapien
attttggaagccaccagcgttccag

SEQ ID NO: 230496 - DNA, 25 bp, Homo sapien
gaagccaccagcgttccagacattt

SEQ ID NO: 230497 - DNA, 25 bp, Homo sapien
accagcgttccagacatttgcgata

SEQ ID NO: 230498 - DNA, 25 bp, Homo sapien
cagcgttccagacatttgcgataag

SEQ ID NO: 230499 - DNA, 25 bp, Homo sapien
gcgttccagacatttgcgataagtt

SEQ ID NO: 230500 - DNA, 25 bp, Homo sapien
gttccagacatttgcgataagttta

SEQ ID NO: 230501 - DNA, 25 bp, Homo sapien
gataagtttaagcagataaccaaag

SEQ ID NO: 230502 - DNA, 25 bp, Homo sapien
ttcgtgatggagtgtcacacgttta

SEQ ID NO: 230503 - DNA, 25 bp, Homo sapien
gatggagtgtcacacgtttatgcag

SEQ ID NO: 230504 - DNA, 25 bp, Homo sapien
gttctataacccaatgacaacctgt

SEQ ID NO: 230505 - DNA, 25 bp, Homo sapien
gacaacctgtctctttggtttactg

SEQ ID NO: 230506 - DNA, 25 bp, Homo sapien
tggtttactgtcctgtgaaatgtca

SEQ ID NO: 230507 - DNA, 25 bp, Homo sapien
gaaatgtcagctcaagtttcccaga

SEQ ID NO: 230508 - DNA, 25 bp, Homo sapien
gtttcccagaagtcgtgtgtttatg

SEQ ID NO: 230509 - DNA, 25 bp, Homo sapien
gagtgcttttcctcggtgggacagt

SEQ ID NO: 230510 - DNA, 25 bp, Homo sapien
tgctggccctcttaattttggtgta

SEQ ID NO: 230511 - DNA, 25 bp, Homo sapien
ggtgtatgtgcttccaagtatctaa

SEQ ID NO: 230512 - DNA, 25 bp, Homo sapien
gtatctaaacctccagtctgatctg

SEQ ID NO: 230513 - DNA, 25 bp, Homo sapien
gtatatgctatcctaactgttaatt

SEQ ID NO: 230514 - DNA, 25 bp, Homo sapien
gattatcttgcttgaaggttcatac

SEQ ID NO: 230515 - DNA, 25 bp, Homo sapien
tttgataggaaaaagcggtgggaat

SEQ ID NO: 230516 - DNA, 25 bp, Homo sapien
ttgataggaaaaagcggtgggaatc

SEQ ID NO: 230517 - DNA, 25 bp, Homo sapien
gtgggaatcggagatcccggacaaa

SEQ ID NO: 230518 - DNA, 25 bp, Homo sapien
tgggaatcggagatcccggacaaag

SEQ ID NO: 230519 - DNA, 25 bp, Homo sapien
gggaatcggagatcccggacaaagg

SEQ ID NO: 230520 - DNA, 25 bp, Homo sapien
tcggagatcccggacaaaggcagat

SEQ ID NO: 230521 - DNA, 25 bp, Homo sapien
cggagatcccggacaaaggcagatt

SEQ ID NO: 230522 - DNA, 25 bp, Homo sapien
ggagatcccggacaaaggcagattt

SEQ ID NO: 230523 - DNA, 25 bp, Homo sapien
gagatcccggacaaaggcagatttt

SEQ ID NO: 230524 - DNA, 25 bp, Homo sapien
agatcccggacaaaggcagattttc

SEQ ID NO: 230525 - DNA, 25 bp, Homo sapien
gatcccggacaaaggcagattttcc

SEQ ID NO: 230526 - DNA, 25 bp, Homo sapien
tattttgccatatcatttagctgga

SEQ ID NO: 230527 - DNA, 25 bp, Homo sapien
gacatttaaaagcaccctgcatcac

SEQ ID NO: 230528 - DNA, 25 bp, Homo sapien
aagcaccctgcatcactagtaatag

SEQ ID NO: 230529 - DNA, 25 bp, Homo sapien
tgtattttgctattctgcccttgta

SEQ ID NO: 230530 - DNA, 25 bp, Homo sapien
tgcccttgtaatcggtgtccctgta

SEQ ID NO: 230531 - DNA, 25 bp, Homo sapien
gtgtccctgtaaaacaatccccaca

SEQ ID NO: 230532 - DNA, 25 bp, Homo sapien
atccccacagattactttcagaaat

SEQ ID NO: 230533 - DNA, 25 bp, Homo sapien
ttctctacgtaagggccaggtttat

SEQ ID NO: 230534 - DNA, 25 bp, Homo sapien
gcttgcacatgttggttcttgaaac

SEQ ID NO: 230535 - DNA, 25 bp, Homo sapien
ttggttcttgaaaccttagctagaa

SEQ ID NO: 230536 - DNA, 25 bp, Homo sapien
tagaagaatttcaggtcataccaac

SEQ ID NO: 230537 - DNA, 25 bp, Homo sapien
gctccgagcccaaggtctaccttct

SEQ ID NO: 230538 - DNA, 25 bp, Homo sapien
aaggtctaccttctctaccggcctg

SEQ ID NO: 230539 - DNA, 25 bp, Homo sapien
ggtctaccttctctaccggcctgga

SEQ ID NO: 230540 - DNA, 25 bp, Homo sapien
ttctctaccggcctggacactacga

SEQ ID NO: 230541 - DNA, 25 bp, Homo sapien
tctctaccggcctggacactacgat

SEQ ID NO: 230542 - DNA, 25 bp, Homo sapien
tctaccggcctggacactacgatat

SEQ ID NO: 230543 - DNA, 25 bp, Homo sapien
ctaccggcctggacactacgatatc

SEQ ID NO: 230544 - DNA, 25 bp, Homo sapien
taccggcctggacactacgatatcc

SEQ ID NO: 230545 - DNA, 25 bp, Homo sapien
accggcctggacactacgatatcct

SEQ ID NO: 230546 - DNA, 25 bp, Homo sapien
ggcctggacactacgatatcctcta

SEQ ID NO: 230547 - DNA, 25 bp, Homo sapien
gcctggacactacgatatcctctac

SEQ ID NO: 230548 - DNA, 25 bp, Homo sapien
ccttgtgacctgtatactaacataa

SEQ ID NO: 230549 - DNA, 25 bp, Homo sapien
gacctgtatactaacataacttatt

SEQ ID NO: 230550 - DNA, 25 bp, Homo sapien
agacgtcaccgcagggcctctgaag

SEQ ID NO: 230551 - DNA, 25 bp, Homo sapien
gcctctgaagagtcaaggtctgctt

SEQ ID NO: 230552 - DNA, 25 bp, Homo sapien
gaagagtcaaggtctgctttaattt

SEQ ID NO: 230553 - DNA, 25 bp, Homo sapien
gtctgctttaatttattgtgtgcct

SEQ ID NO: 230554 - DNA, 25 bp, Homo sapien
gcctttctgtgtttacctcactcaa

SEQ ID NO: 230555 - DNA, 25 bp, Homo sapien
ttctgtgtttacctcactcaagctg

SEQ ID NO: 230556 - DNA, 25 bp, Homo sapien
gtgtttacctcactcaagctgacaa

SEQ ID NO: 230557 - DNA, 25 bp, Homo sapien
tacctcactcaagctgacaacattg

SEQ ID NO: 230558 - DNA, 25 bp, Homo sapien
ttgtttatgggaatctatccttctt

SEQ ID NO: 230559 - DNA, 25 bp, Homo sapien
gacagactttaaaccttatcaccat

SEQ ID NO: 230560 - DNA, 25 bp, Homo sapien
accatgctggctatccgggtgttag

SEQ ID NO: 230561 - DNA, 25 bp, Homo sapien
tatccgggtgttagctgaccaaaat

SEQ ID NO: 230562 - DNA, 25 bp, Homo sapien
aaatgtcattcctaatgtggctaat

SEQ ID NO: 230563 - DNA, 25 bp, Homo sapien
taatgtcacttgctattaccagcca

SEQ ID NO: 230564 - DNA, 25 bp, Homo sapien
cccctatgtagcagatgccaacttt

SEQ ID NO: 230565 - DNA, 25 bp, Homo sapien
tactacattgcacaggttcagccag

SEQ ID NO: 230566 - DNA, 25 bp, Homo sapien
aggttcagccagtattcacgtgcca

SEQ ID NO: 230567 - DNA, 25 bp, Homo sapien
tattcacgtgccagcaacagaccta

SEQ ID NO: 230568 - DNA, 25 bp, Homo sapien
gcaacagacctactccacttggcta

SEQ ID NO: 230569 - DNA, 25 bp, Homo sapien
cacttggctaccctgcaattaagaa

SEQ ID NO: 230570 - DNA, 25 bp, Homo sapien
gggtcctcattttactgcagttcct

SEQ ID NO: 230571 - DNA, 25 bp, Homo sapien
tgcagttcctgcacgccagtgaaag

SEQ ID NO: 230572 - DNA, 25 bp, Homo sapien
gatagaccctggaaggcagagctgc

SEQ ID NO: 230573 - DNA, 25 bp, Homo sapien
gatgctcatcatcaggtcaattctg

SEQ ID NO: 230574 - DNA, 25 bp, Homo sapien
tcaggtcaattctggagctacagtt

SEQ ID NO: 230575 - DNA, 25 bp, Homo sapien
tggagctacagttttgtttctgact

SEQ ID NO: 230576 - DNA, 25 bp, Homo sapien
gtttctgactggatagggatgcacc

SEQ ID NO: 230577 - DNA, 25 bp, Homo sapien
gtcacatcaagcagtccttttattc

SEQ ID NO: 230578 - DNA, 25 bp, Homo sapien
aagggcattaggcactatggttcca

SEQ ID NO: 230579 - DNA, 25 bp, Homo sapien
ggcactatggttccagagtttcttg

SEQ ID NO: 230580 - DNA, 25 bp, Homo sapien
cttgcagattcttattaattggttc

SEQ ID NO: 230581 - DNA, 25 bp, Homo sapien
tagctattagggaagcagtttgcca

SEQ ID NO: 230582 - DNA, 25 bp, Homo sapien
gcagtttgccattgttgcagagtta

SEQ ID NO: 230583 - DNA, 25 bp, Homo sapien
gttgcagagttatctgtactttgtt

SEQ ID NO: 230584 - DNA, 25 bp, Homo sapien
gatgatttgtcataggctttcccct

SEQ ID NO: 230585 - DNA, 25 bp, Homo sapien
ttgtcataggctttcccctttcttt

SEQ ID NO: 230586 - DNA, 25 bp, Homo sapien
ctttctttctgttctagcagcagga

SEQ ID NO: 230587 - DNA, 25 bp, Homo sapien
gttctagcagcaggaaaagtttctc

SEQ ID NO: 230588 - DNA, 25 bp, Homo sapien
agtttctctatatcctctccctcta

SEQ ID NO: 230589 - DNA, 25 bp, Homo sapien
tctccctctacctgtaacaattttg

SEQ ID NO: 230590 - DNA, 25 bp, Homo sapien
gttttctactgttaattacattgtg

SEQ ID NO: 230591 - DNA, 25 bp, Homo sapien
atagttctatgcttactgttgtgca

SEQ ID NO: 230592 - DNA, 25 bp, Homo sapien
gacattctggtagtctttgagcagc

SEQ ID NO: 230593 - DNA, 25 bp, Homo sapien
aaggaggtgggtcatcatccagcct

SEQ ID NO: 230594 - DNA, 25 bp, Homo sapien
tagactgggctggtttccggacgac

SEQ ID NO: 230595 - DNA, 25 bp, Homo sapien
ggtttccggacgacatatccgcgcg

SEQ ID NO: 230596 - DNA, 25 bp, Homo sapien
gagacttcgaggctgcaggccccac

SEQ ID NO: 230597 - DNA, 25 bp, Homo sapien
tgcaggccccactggttgaaaggaa

SEQ ID NO: 230598 - DNA, 25 bp, Homo sapien
tgaaaggaaacttggcgctcccacc

SEQ ID NO: 230599 - DNA, 25 bp, Homo sapien
gtactaggacctgggtaactgcccg

SEQ ID NO: 230600 - DNA, 25 bp, Homo sapien
taactgcccgggtccgaatcaaact

SEQ ID NO: 230601 - DNA, 25 bp, Homo sapien
gggtccgaatcaaactcagcgtcct

SEQ ID NO: 230602 - DNA, 25 bp, Homo sapien
cgaccctcagcatggtgacctctaa

SEQ ID NO: 230603 - DNA, 25 bp, Homo sapien
gaatccttgctctctaggatgcagg

SEQ ID NO: 230604 - DNA, 25 bp, Homo sapien
gctctctaggatgcaggtggcttga

SEQ ID NO: 230605 - DNA, 25 bp, Homo sapien
gaatgccacacctgcaagttgatta

SEQ ID NO: 230606 - DNA, 25 bp, Homo sapien
aagttgattagaactgcctttcttc

SEQ ID NO: 230607 - DNA, 25 bp, Homo sapien
ttcttcccaggcttgacataggtat

SEQ ID NO: 230608 - DNA, 25 bp, Homo sapien
aagcctctgaaagctgtaacaccct

SEQ ID NO: 230609 - DNA, 25 bp, Homo sapien
gctgtaacaccctcagtaataacaa

SEQ ID NO: 230610 - DNA, 25 bp, Homo sapien
agggatttttatttcacagctaaag

SEQ ID NO: 230611 - DNA, 25 bp, Homo sapien
aataatgtctgatcctgttcctaag

SEQ ID NO: 230612 - DNA, 25 bp, Homo sapien
gatcctgttcctaagttccaaacta

SEQ ID NO: 230613 - DNA, 25 bp, Homo sapien
ctatagccaacactctgatgctgct

SEQ ID NO: 230614 - DNA, 25 bp, Homo sapien
tgtttttcagttatctccccatttg

SEQ ID NO: 230615 - DNA, 25 bp, Homo sapien
gttatctccccatttgtcaaagttg

SEQ ID NO: 230616 - DNA, 25 bp, Homo sapien
agttgacctcaagataacatttttc

SEQ ID NO: 230617 - DNA, 25 bp, Homo sapien
tagctcattcacttattttgataac

SEQ ID NO: 230618 - DNA, 25 bp, Homo sapien
gatcacagctattatactactttct

SEQ ID NO: 230619 - DNA, 25 bp, Homo sapien
actactttctcgttattttgtgtgc

SEQ ID NO: 230620 - DNA, 25 bp, Homo sapien
ttttgtgtgcatgcctcatttccct

SEQ ID NO: 230621 - DNA, 25 bp, Homo sapien
tttccctgacttaaacctcactgag

SEQ ID NO: 230622 - DNA, 25 bp, Homo sapien
aacctcactgagagcgcaaaatgca

SEQ ID NO: 230623 - DNA, 25 bp, Homo sapien
atgcagctttatactttttactttc

SEQ ID NO: 230624 - DNA, 25 bp, Homo sapien
tttttactttcaattgcctagcaca

SEQ ID NO: 230625 - DNA, 25 bp, Homo sapien
tgtccaaatgaaagctagtagatgt

SEQ ID NO: 230626 - DNA, 25 bp, Homo sapien
gtttacaattttataatctcagttg

SEQ ID NO: 230627 - DNA, 25 bp, Homo sapien
aatcactatatacaatacaccctta

SEQ ID NO: 230628 - DNA, 25 bp, Homo sapien
tacacccttaatttgttcattccag

SEQ ID NO: 230629 - DNA, 25 bp, Homo sapien
tgttcattccagaaacatactgaga

SEQ ID NO: 230630 - DNA, 25 bp, Homo sapien
catactgagatgtcagctacttaaa

SEQ ID NO: 230631 - DNA, 25 bp, Homo sapien
aaatggtcacaaaaagctactgttt

SEQ ID NO: 230632 - DNA, 25 bp, Homo sapien
ggtcacaaaaagctactgtttatat

SEQ ID NO: 230633 - DNA, 25 bp, Homo sapien
aataagtgttgttcatttactgcac

SEQ ID NO: 230634 - DNA, 25 bp, Homo sapien
gttgttcatttactgcactgctgag

SEQ ID NO: 230635 - DNA, 25 bp, Homo sapien
tgcactgctgagaactaattaaaat

SEQ ID NO: 230636 - DNA, 25 bp, Homo sapien
caaacattttcattttggtcaataa

SEQ ID NO: 230637 - DNA, 25 bp, Homo sapien
ataattcaaactaccacttaggcaa

SEQ ID NO: 230638 - DNA, 25 bp, Homo sapien
aactaccacttaggcaaagtattcg

SEQ ID NO: 230639 - DNA, 25 bp, Homo sapien
gcaaagtattcgaacactgtgtcct

SEQ ID NO: 230640 - DNA, 25 bp, Homo sapien
gtattcgaacactgtgtcctttgtt

SEQ ID NO: 230641 - DNA, 25 bp, Homo sapien
cgaacactgtgtcctttgtttaagg

SEQ ID NO: 230642 - DNA, 25 bp, Homo sapien
cactgtgtcctttgtttaaggaaat

SEQ ID NO: 230643 - DNA, 25 bp, Homo sapien
gtataaagcaggatcatgttaagaa

SEQ ID NO: 230644 - DNA, 25 bp, Homo sapien
aaagatcatgagtcacttaaatatg

SEQ ID NO: 230645 - DNA, 25 bp, Homo sapien
gtatattgatggtagactctccata

SEQ ID NO: 230646 - DNA, 25 bp, Homo sapien
gatggtagactctccatattgaaat

SEQ ID NO: 230647 - DNA, 25 bp, Homo sapien
aaagccacgtaggaaattatccaca

SEQ ID NO: 230648 - DNA, 25 bp, Homo sapien
ggaaattatccacagcatcaattgg

SEQ ID NO: 230649 - DNA, 25 bp, Homo sapien
catcaattggacttgatcttggctc

SEQ ID NO: 230650 - DNA, 25 bp, Homo sapien
ggaccaggcccggtgccttgatatt

SEQ ID NO: 230651 - DNA, 25 bp, Homo sapien
gcccggtgccttgatattggtagat

SEQ ID NO: 230652 - DNA, 25 bp, Homo sapien
ggtagatttatttgccatcagacta

SEQ ID NO: 230653 - DNA, 25 bp, Homo sapien
tttgccatcagactaatgagctggg

SEQ ID NO: 230654 - DNA, 25 bp, Homo sapien
gggacattgactgtttcctggcaac

SEQ ID NO: 230655 - DNA, 25 bp, Homo sapien
attgactgtttcctggcaactgagt

SEQ ID NO: 230656 - DNA, 25 bp, Homo sapien
tcctggcaactgagtcctctgattg

SEQ ID NO: 230657 - DNA, 25 bp, Homo sapien
gagattgtacgcattccagcttggg

SEQ ID NO: 230658 - DNA, 25 bp, Homo sapien
tgtcatcaaaggcaaagttctctac

SEQ ID NO: 230659 - DNA, 25 bp, Homo sapien
ggcaaagttctctacacctacatgg

SEQ ID NO: 230660 - DNA, 25 bp, Homo sapien
ttctctacacctacatggccagtga

SEQ ID NO: 230661 - DNA, 25 bp, Homo sapien
cacctacatggccagtgaggacaaa

SEQ ID NO: 230662 - DNA, 25 bp, Homo sapien
gtggccttggagagtatgcctctgc

SEQ ID NO: 230663 - DNA, 25 bp, Homo sapien
tggagagtatgcctctgctaggctt

SEQ ID NO: 230664 - DNA, 25 bp, Homo sapien
ggcttcaccattgctccagaaaagg

SEQ ID NO: 230665 - DNA, 25 bp, Homo sapien
tgaagtaggacctatttttcacctt

SEQ ID NO: 230666 - DNA, 25 bp, Homo sapien
gaagataccaattcagctcagaggt

SEQ ID NO: 230667 - DNA, 25 bp, Homo sapien
agagggctctgcatcagtggctatc

SEQ ID NO: 230668 - DNA, 25 bp, Homo sapien
tcagtggctatctcagccggtgtaa

SEQ ID NO: 230669 - DNA, 25 bp, Homo sapien
tggcctggctacacactggagactg

SEQ ID NO: 230670 - DNA, 25 bp, Homo sapien
agactgccaacactcaatgccatga

SEQ ID NO: 230671 - DNA, 25 bp, Homo sapien
gccagtgaaggacatctatttccag

SEQ ID NO: 230672 - DNA, 25 bp, Homo sapien
tctatttccagtcctgtgtcttcga

SEQ ID NO: 230673 - DNA, 25 bp, Homo sapien
tcaccactggtgatgccaactttac

SEQ ID NO: 230674 - DNA, 25 bp, Homo sapien
aaggaaggaacgctggcacattttc

SEQ ID NO: 230675 - DNA, 25 bp, Homo sapien
ctggcacattttccccagcagtggc

SEQ ID NO: 230676 - DNA, 25 bp, Homo sapien
actccccgtggaggcagtgatttgt

SEQ ID NO: 230677 - DNA, 25 bp, Homo sapien
aggcagtgatttgtctgtcagtcta

SEQ ID NO: 230678 - DNA, 25 bp, Homo sapien
tgtctgtcagtctaggactcacctg

SEQ ID NO: 230679 - DNA, 25 bp, Homo sapien
acctgcttgatccttatcgtgtttt

SEQ ID NO: 230680 - DNA, 25 bp, Homo sapien
cgccctttagggtgagtctgcacac

SEQ ID NO: 230681 - DNA, 25 bp, Homo sapien
atccctgagaaacactggcggctct

SEQ ID NO: 230682 - DNA, 25 bp, Homo sapien
aacactggcggctctgccccgagag

SEQ ID NO: 230683 - DNA, 25 bp, Homo sapien
ccgagagggccagggtgtccaccga

SEQ ID NO: 230684 - DNA, 25 bp, Homo sapien
tgagtctgcacacccgtgttcaggg

SEQ ID NO: 230685 - DNA, 25 bp, Homo sapien
accgagcctggctgaagccagctgt

SEQ ID NO: 230686 - DNA, 25 bp, Homo sapien
ttcttgcagagcaggctcacactgg

SEQ ID NO: 230687 - DNA, 25 bp, Homo sapien
tgcagagcaggctcacactgggcct

SEQ ID NO: 230688 - DNA, 25 bp, Homo sapien
cggccggaagcggaaccataggcat

SEQ ID NO: 230689 - DNA, 25 bp, Homo sapien
agcggaaccataggcatgctgcggc

SEQ ID NO: 230690 - DNA, 25 bp, Homo sapien
cataggcatgctgcggccccagatg

SEQ ID NO: 230691 - DNA, 25 bp, Homo sapien
acaaggccgagatcatcactgtcag

SEQ ID NO: 230692 - DNA, 25 bp, Homo sapien
ggccgagatcatcactgtcagcgat

SEQ ID NO: 230693 - DNA, 25 bp, Homo sapien
atcactgtcagcgatggccgaggcg

SEQ ID NO: 230694 - DNA, 25 bp, Homo sapien
atggccgaggcgtcaagttcttcta

SEQ ID NO: 230695 - DNA, 25 bp, Homo sapien
caagttcttctagcagggacctgtc

SEQ ID NO: 230696 - DNA, 25 bp, Homo sapien
tttcaaaaggagacagacccagtgt

SEQ ID NO: 230697 - DNA, 25 bp, Homo sapien
aaagactggatctgtgactccacca

SEQ ID NO: 230698 - DNA, 25 bp, Homo sapien
ccaccagactcaaaaggactccagt

SEQ ID NO: 230699 - DNA, 25 bp, Homo sapien
accccatatgtctgtcccttggata

SEQ ID NO: 230700 - DNA, 25 bp, Homo sapien
tatgtctgtcccttggatagggtga

SEQ ID NO: 230701 - DNA, 25 bp, Homo sapien
aaaatatgtgcttcttctcgcccta

SEQ ID NO: 230702 - DNA, 25 bp, Homo sapien
gaaaactaaaacctcaaagacagat

SEQ ID NO: 230703 - DNA, 25 bp, Homo sapien
aaagacagatgttacagaatcagcc

SEQ ID NO: 230704 - DNA, 25 bp, Homo sapien
acagaatcagccagttctgtaaaac

SEQ ID NO: 230705 - DNA, 25 bp, Homo sapien
tgtaaaactgatattgtctattggt

SEQ ID NO: 230706 - DNA, 25 bp, Homo sapien
gtctattggttattgatcttgccat

SEQ ID NO: 230707 - DNA, 25 bp, Homo sapien
aaaaccatgtcccttctatgatccc

SEQ ID NO: 230708 - DNA, 25 bp, Homo sapien
tgtcccttctatgatcccttaagaa

SEQ ID NO: 230709 - DNA, 25 bp, Homo sapien
gaaagctgcaccaaatcatctgcct

SEQ ID NO: 230710 - DNA, 25 bp, Homo sapien
gctgcaccaaatcatctgcctgttt

SEQ ID NO: 230711 - DNA, 25 bp, Homo sapien
gcctgttttttcttgatacttactg

SEQ ID NO: 230712 - DNA, 25 bp, Homo sapien
tctttgttgtgaatgatgctttttt

SEQ ID NO: 230713 - DNA, 25 bp, Homo sapien
aggcctggcctgtcgctctcacttg

SEQ ID NO: 230714 - DNA, 25 bp, Homo sapien
gagcttcacgttgccgagtggaaga

SEQ ID NO: 230715 - DNA, 25 bp, Homo sapien
ggaagaaccatgacctccacttgct

SEQ ID NO: 230716 - DNA, 25 bp, Homo sapien
tccacttgcttccaaggtgctaggg

SEQ ID NO: 230717 - DNA, 25 bp, Homo sapien
tgctagggaagtttcagggtacgct

SEQ ID NO: 230718 - DNA, 25 bp, Homo sapien
tttcagggtacgctggttcccctct

SEQ ID NO: 230719 - DNA, 25 bp, Homo sapien
tactctgtgatcgattcaatgcccg

SEQ ID NO: 230720 - DNA, 25 bp, Homo sapien
tcaatgcccgatgcttctgtttcat

SEQ ID NO: 230721 - DNA, 25 bp, Homo sapien
tgcttctgtttcattcccgaccctt

SEQ ID NO: 230722 - DNA, 25 bp, Homo sapien
ttcccgaccctttctactatgcatt

SEQ ID NO: 230723 - DNA, 25 bp, Homo sapien
atgcattttccttttatcaggtgta

SEQ ID NO: 230724 - DNA, 25 bp, Homo sapien
ttggatttgtactcttaggactgga

SEQ ID NO: 230725 - DNA, 25 bp, Homo sapien
gagacggacctattactattcagta

SEQ ID NO: 230726 - DNA, 25 bp, Homo sapien
attcagtaaatacgcctgttaaggc

SEQ ID NO: 230727 - DNA, 25 bp, Homo sapien
cgcctgttaaggcagaactcttatt

SEQ ID NO: 230728 - DNA, 25 bp, Homo sapien
ctcttattctaagcttccgggtgga

SEQ ID NO: 230729 - DNA, 25 bp, Homo sapien
gggaaccatctaagtattctaactc

SEQ ID NO: 230730 - DNA, 25 bp, Homo sapien
gggctaagatcagggccttcattct

SEQ ID NO: 230731 - DNA, 25 bp, Homo sapien
ccttcattctggatcaggcgaaatt

SEQ ID NO: 230732 - DNA, 25 bp, Homo sapien
tcaggcgaaatttccttaaggatcc

SEQ ID NO: 230733 - DNA, 25 bp, Homo sapien
taaggatccagaataggccaggcgt

SEQ ID NO: 230734 - DNA, 25 bp, Homo sapien
gtggttgctcatacctgcaattcca

SEQ ID NO: 230735 - DNA, 25 bp, Homo sapien
tataaaattatttgtaaccccactg

SEQ ID NO: 230736 - DNA, 25 bp, Homo sapien
tatttgtaaccccactgtccttttg

SEQ ID NO: 230737 - DNA, 25 bp, Homo sapien
cactgtccttttgggcttctataaa

SEQ ID NO: 230738 - DNA, 25 bp, Homo sapien
gtccttttgggcttctataaatgaa

SEQ ID NO: 230739 - DNA, 25 bp, Homo sapien
gggcttctataaatgaatatacatc

SEQ ID NO: 230740 - DNA, 25 bp, Homo sapien
agcttaattgattgttttccataga

SEQ ID NO: 230741 - DNA, 25 bp, Homo sapien
gattgttttccatagaaactaggtt

SEQ ID NO: 230742 - DNA, 25 bp, Homo sapien
actaggttttatgggaagatggttg

SEQ ID NO: 230743 - DNA, 25 bp, Homo sapien
tgtttcacttaaaggtctgatttgt

SEQ ID NO: 230744 - DNA, 25 bp, Homo sapien
gtctgatttgtgtaggacaaaccca

SEQ ID NO: 230745 - DNA, 25 bp, Homo sapien
tgtgtaggacaaacccacatatgta

SEQ ID NO: 230746 - DNA, 25 bp, Homo sapien
attcttgtgaattagttatttttga

SEQ ID NO: 230747 - DNA, 25 bp, Homo sapien
taaatttataacttgcaggcacgtg

SEQ ID NO: 230748 - DNA, 25 bp, Homo sapien
aaatttataacttgcaggcacgtgc

SEQ ID NO: 230749 - DNA, 25 bp, Homo sapien
aatttataacttgcaggcacgtgcc

SEQ ID NO: 230750 - DNA, 25 bp, Homo sapien
atttataacttgcaggcacgtgcct

SEQ ID NO: 230751 - DNA, 25 bp, Homo sapien
ataacttgcaggcacgtgcctgtaa

SEQ ID NO: 230752 - DNA, 25 bp, Homo sapien
aattttatagatattagcacttcaa

SEQ ID NO: 230753 - DNA, 25 bp, Homo sapien
ttatagatattagcacttcaattta

SEQ ID NO: 230754 - DNA, 25 bp, Homo sapien
gatattagcacttcaatttaattac

SEQ ID NO: 230755 - DNA, 25 bp, Homo sapien
ttagcacttcaatttaattactatt

SEQ ID NO: 230756 - DNA, 25 bp, Homo sapien
agcacttcaatttaattactattaa

SEQ ID NO: 230757 - DNA, 25 bp, Homo sapien
acttcttgattctgccaccacttga

SEQ ID NO: 230758 - DNA, 25 bp, Homo sapien
accacttgatcccataacaggctac

SEQ ID NO: 230759 - DNA, 25 bp, Homo sapien
tgatcccataacaggctaccccttg

SEQ ID NO: 230760 - DNA, 25 bp, Homo sapien
gcctcatgctggagttgtgtgtgtc

SEQ ID NO: 230761 - DNA, 25 bp, Homo sapien
atgctggagttgtgtgtgtctgtct

SEQ ID NO: 230762 - DNA, 25 bp, Homo sapien
tgtttgcctccctcacagtgccttg

SEQ ID NO: 230763 - DNA, 25 bp, Homo sapien
acagtgccttggtcttagtggatgc

SEQ ID NO: 230764 - DNA, 25 bp, Homo sapien
gccttggtcttagtggatgcccagt

SEQ ID NO: 230765 - DNA, 25 bp, Homo sapien
gagaaaaatcctaccttatttgaat

SEQ ID NO: 230766 - DNA, 25 bp, Homo sapien
agtcatgtttttgttgcttaaaggt

SEQ ID NO: 230767 - DNA, 25 bp, Homo sapien
gttaatgtccattaaagccagtttt

SEQ ID NO: 230768 - DNA, 25 bp, Homo sapien
ttcagcgtcctgatacggcggaaga

SEQ ID NO: 230769 - DNA, 25 bp, Homo sapien
gaagatgctgtccaggtcccgtttc

SEQ ID NO: 230770 - DNA, 25 bp, Homo sapien
ggtcccgtttcatctctactagggt

SEQ ID NO: 230771 - DNA, 25 bp, Homo sapien
ctactagggtcctcgtgtggtgcag

SEQ ID NO: 230772 - DNA, 25 bp, Homo sapien
tgtggtgcaggaagcgttcgctcat

SEQ ID NO: 230773 - DNA, 25 bp, Homo sapien
gaagcgttcgctcatctgctgcagg

SEQ ID NO: 230774 - DNA, 25 bp, Homo sapien
tcatctgctgcaggcgggcactgga

SEQ ID NO: 230775 - DNA, 25 bp, Homo sapien
caggttgttgaagttgagcagcatc

SEQ ID NO: 230776 - DNA, 25 bp, Homo sapien
ggctggtgtcacatgagcccgtgct

SEQ ID NO: 230777 - DNA, 25 bp, Homo sapien
atgagcccgtgctctgttctgaggt

SEQ ID NO: 230778 - DNA, 25 bp, Homo sapien
aaggatgcctctgggatatggctga

SEQ ID NO: 230779 - DNA, 25 bp, Homo sapien
ctgggtcacacctgagcttgccagc

SEQ ID NO: 230780 - DNA, 25 bp, Homo sapien
gtcacacctgagcttgccagccagg

SEQ ID NO: 230781 - DNA, 25 bp, Homo sapien
ctgagggcctggacatagccacctt

SEQ ID NO: 230782 - DNA, 25 bp, Homo sapien
gggcctggacatagccaccttccta

SEQ ID NO: 230783 - DNA, 25 bp, Homo sapien
ttcctagcccacaatgactcacata

SEQ ID NO: 230784 - DNA, 25 bp, Homo sapien
tagcccacaatgactcacatacctt

SEQ ID NO: 230785 - DNA, 25 bp, Homo sapien
acaatgactcacataccttcttctg

SEQ ID NO: 230786 - DNA, 25 bp, Homo sapien
atgactcacataccttcttctgctg

SEQ ID NO: 230787 - DNA, 25 bp, Homo sapien
acagggatgacaggtaccaatgtca

SEQ ID NO: 230788 - DNA, 25 bp, Homo sapien
aggtaccaatgtcatggacacccac

SEQ ID NO: 230789 - DNA, 25 bp, Homo sapien
atgtcatggacacccacctcttgtt

SEQ ID NO: 230790 - DNA, 25 bp, Homo sapien
agaagtctgttcttggagagatgtt

SEQ ID NO: 230791 - DNA, 25 bp, Homo sapien
atgccttaagctgtggcactttaaa

SEQ ID NO: 230792 - DNA, 25 bp, Homo sapien
agctgtggcactttaaaaacatctt

SEQ ID NO: 230793 - DNA, 25 bp, Homo sapien
aattgctaaaaggactgttaatgct

SEQ ID NO: 230794 - DNA, 25 bp, Homo sapien
taatgcttttctcagacacattggc

SEQ ID NO: 230795 - DNA, 25 bp, Homo sapien
ggcattttacaattttgcacatggt

SEQ ID NO: 230796 - DNA, 25 bp, Homo sapien
tacaattttgcacatggtttatttg

SEQ ID NO: 230797 - DNA, 25 bp, Homo sapien
aagtctacctaatatctcatttttg

SEQ ID NO: 230798 - DNA, 25 bp, Homo sapien
atctcatttttgattctcatcgtta

SEQ ID NO: 230799 - DNA, 25 bp, Homo sapien
gattctcatcgttagcacagttttg

SEQ ID NO: 230800 - DNA, 25 bp, Homo sapien
gttagcacagttttgttgcttttat

SEQ ID NO: 230801 - DNA, 25 bp, Homo sapien
aaactgctcttaagcctctgttaac

SEQ ID NO: 230802 - DNA, 25 bp, Homo sapien
aagcctctgttaactgacacagcag

SEQ ID NO: 230803 - DNA, 25 bp, Homo sapien
tgacacagcagtagaactccaaggt

SEQ ID NO: 230804 - DNA, 25 bp, Homo sapien
aggtaaacgctgcatttctacaaca

SEQ ID NO: 230805 - DNA, 25 bp, Homo sapien
gtagaactccaaggtgttgatcctt

SEQ ID NO: 230806 - DNA, 25 bp, Homo sapien
gatccttggattcatgtttctcaac

SEQ ID NO: 230807 - DNA, 25 bp, Homo sapien
ccaccaggagctcctaatctgagag

SEQ ID NO: 230808 - DNA, 25 bp, Homo sapien
gagagctgttagaaatcctccaaaa

SEQ ID NO: 230809 - DNA, 25 bp, Homo sapien
aagttggtagcttctgctcaagatg

SEQ ID NO: 230810 - DNA, 25 bp, Homo sapien
tgtgcaggccctgcatgctctgtaa

SEQ ID NO: 230811 - DNA, 25 bp, Homo sapien
tttggtcttctgaaaagggcaccag

SEQ ID NO: 230812 - DNA, 25 bp, Homo sapien
aaacaaataatcctgccttttacag

SEQ ID NO: 230813 - DNA, 25 bp, Homo sapien
acaaataatcctgccttttacaggt

SEQ ID NO: 230814 - DNA, 25 bp, Homo sapien
aaataatcctgccttttacaggtga

SEQ ID NO: 230815 - DNA, 25 bp, Homo sapien
aataatcctgccttttacaggtgaa

SEQ ID NO: 230816 - DNA, 25 bp, Homo sapien
taatcctgccttttacaggtgaaac

SEQ ID NO: 230817 - DNA, 25 bp, Homo sapien
aatcctgccttttacaggtgaaact

SEQ ID NO: 230818 - DNA, 25 bp, Homo sapien
atcctgccttttacaggtgaaactc

SEQ ID NO: 230819 - DNA, 25 bp, Homo sapien
ctgccttttacaggtgaaactcggg

SEQ ID NO: 230820 - DNA, 25 bp, Homo sapien
aaactcggggctgtccatagcggct

SEQ ID NO: 230821 - DNA, 25 bp, Homo sapien
tgtccatagcggctgggaccccgtt

SEQ ID NO: 230822 - DNA, 25 bp, Homo sapien
tgggaccccgtttcatccatccatg

SEQ ID NO: 230823 - DNA, 25 bp, Homo sapien
tgagctcttcacatctctgactaat

SEQ ID NO: 230824 - DNA, 25 bp, Homo sapien
cacatctctgactaattatcatcat

SEQ ID NO: 230825 - DNA, 25 bp, Homo sapien
atcatcattaccatggagcccaaca

SEQ ID NO: 230826 - DNA, 25 bp, Homo sapien
tcattaccatggagcccaacagtcc

SEQ ID NO: 230827 - DNA, 25 bp, Homo sapien
ttgccgtgcctgtattccagagtca

SEQ ID NO: 230828 - DNA, 25 bp, Homo sapien
gccgtgcctgtattccagagtcaga

SEQ ID NO: 230829 - DNA, 25 bp, Homo sapien
agatcaggaaaagaagacctacacc

SEQ ID NO: 230830 - DNA, 25 bp, Homo sapien
ggaattacagaatgcatcccctaag

SEQ ID NO: 230831 - DNA, 25 bp, Homo sapien
gaatgcatcccctaagcaaaggaag

SEQ ID NO: 230832 - DNA, 25 bp, Homo sapien
aaaggaagcagagtgtgtacacacc

SEQ ID NO: 230833 - DNA, 25 bp, Homo sapien
gtacacaccacccaccataaaaggg

SEQ ID NO: 230834 - DNA, 25 bp, Homo sapien
gccgcatctctaaataggcaaattt

SEQ ID NO: 230835 - DNA, 25 bp, Homo sapien
ataggcaaattttcagtgctcagaa

SEQ ID NO: 230836 - DNA, 25 bp, Homo sapien
caaagtgctttgatggttgcctgct

SEQ ID NO: 230837 - DNA, 25 bp, Homo sapien
tgatggttgcctgcttgagtcactc

SEQ ID NO: 230838 - DNA, 25 bp, Homo sapien
gttgcctgcttgagtcactcccaat

SEQ ID NO: 230839 - DNA, 25 bp, Homo sapien
tcctgaagccctttctttataattc

SEQ ID NO: 230840 - DNA, 25 bp, Homo sapien
aattcttctgttgaaatagccatca

SEQ ID NO: 230841 - DNA, 25 bp, Homo sapien
aatagccatcatattcacagtacta

SEQ ID NO: 230842 - DNA, 25 bp, Homo sapien
cacagtactaatcacagcatctcac

SEQ ID NO: 230843 - DNA, 25 bp, Homo sapien
aatcacagcatctcacatttactaa

SEQ ID NO: 230844 - DNA, 25 bp, Homo sapien
gtaatttacgtgtcccaataatcct

SEQ ID NO: 230845 - DNA, 25 bp, Homo sapien
actgggaagagatgaaatgtttttt

SEQ ID NO: 230846 - DNA, 25 bp, Homo sapien
cagagaacagagggtccagggccct

SEQ ID NO: 230847 - DNA, 25 bp, Homo sapien
ctggctcccaacagcttctcagttc

SEQ ID NO: 230848 - DNA, 25 bp, Homo sapien
tgctgagctcttctggactcaggat

SEQ ID NO: 230849 - DNA, 25 bp, Homo sapien
agctcttctggactcaggatcgcag

SEQ ID NO: 230850 - DNA, 25 bp, Homo sapien
ttctggactcaggatcgcagatccg

SEQ ID NO: 230851 - DNA, 25 bp, Homo sapien
cagccgagcatccttcatgagcctg

SEQ ID NO: 230852 - DNA, 25 bp, Homo sapien
ttcatgagcctgcagaactgctttc

SEQ ID NO: 230853 - DNA, 25 bp, Homo sapien
gcagaactgctttcctatgtttacc

SEQ ID NO: 230854 - DNA, 25 bp, Homo sapien
gaactgctttcctatgtttacccag

SEQ ID NO: 230855 - DNA, 25 bp, Homo sapien
tacccaggggacctcctttcagatg

SEQ ID NO: 230856 - DNA, 25 bp, Homo sapien
ttaaatttataacttgcaggcacgt

SEQ ID NO: 230857 - DNA, 25 bp, Homo sapien
taaatttataacttgcaggcacgtg

SEQ ID NO: 230858 - DNA, 25 bp, Homo sapien
aaatttataacttgcaggcacgtgc

SEQ ID NO: 230859 - DNA, 25 bp, Homo sapien
aatttataacttgcaggcacgtgcc

SEQ ID NO: 230860 - DNA, 25 bp, Homo sapien
atttataacttgcaggcacgtgcct

SEQ ID NO: 230861 - DNA, 25 bp, Homo sapien
ataacttgcaggcacgtgcctgtaa

SEQ ID NO: 230862 - DNA, 25 bp, Homo sapien
aattttatagatattagcacttcaa

SEQ ID NO: 230863 - DNA, 25 bp, Homo sapien
ttatagatattagcacttcaattta

SEQ ID NO: 230864 - DNA, 25 bp, Homo sapien
gatattagcacttcaatttaattac

SEQ ID NO: 230865 - DNA, 25 bp, Homo sapien
ttagcacttcaatttaattactatt

SEQ ID NO: 230866 - DNA, 25 bp, Homo sapien
agcacttcaatttaattactattaa

SEQ ID NO: 230867 - DNA, 25 bp, Homo sapien
agtcacctgtaattcttctgttttt

SEQ ID NO: 230868 - DNA, 25 bp, Homo sapien
ggaatcttttccaataaccagctaa

SEQ ID NO: 230869 - DNA, 25 bp, Homo sapien
accagctaaagatttgcactgaaat

SEQ ID NO: 230870 - DNA, 25 bp, Homo sapien
gaaatacaacttgtatgccttttgc

SEQ ID NO: 230871 - DNA, 25 bp, Homo sapien
atttttaaagcctgcttcctggatt

SEQ ID NO: 230872 - DNA, 25 bp, Homo sapien
aaagcctgcttcctggatttaagca

SEQ ID NO: 230873 - DNA, 25 bp, Homo sapien
gatttaagcagagtgatagtgttca

SEQ ID NO: 230874 - DNA, 25 bp, Homo sapien
agtgttcaaagagccagttcagcct

SEQ ID NO: 230875 - DNA, 25 bp, Homo sapien
aaaagatatgtctgcactttgaggt

SEQ ID NO: 230876 - DNA, 25 bp, Homo sapien
tctgcactttgaggtcccttttgaa

SEQ ID NO: 230877 - DNA, 25 bp, Homo sapien
ctttgaggtcccttttgaatgccat

SEQ ID NO: 230878 - DNA, 25 bp, Homo sapien
tgaattcatgtagaggtggcaaacc

SEQ ID NO: 230879 - DNA, 25 bp, Homo sapien
gtggcaaacctctaccttgtgttga

SEQ ID NO: 230880 - DNA, 25 bp, Homo sapien
aaacctctaccttgtgttgatgaga

SEQ ID NO: 230881 - DNA, 25 bp, Homo sapien
gagaataatcttgggcagtctggga

SEQ ID NO: 230882 - DNA, 25 bp, Homo sapien
aaggcatctccttcttactcatgga

SEQ ID NO: 230883 - DNA, 25 bp, Homo sapien
ttactcatggagattcaactataga

SEQ ID NO: 230884 - DNA, 25 bp, Homo sapien
tatagagagttgaaacctaaacccg

SEQ ID NO: 230885 - DNA, 25 bp, Homo sapien
acccgccttccttttatagaagctg

SEQ ID NO: 230886 - DNA, 25 bp, Homo sapien
gaagctggactagagacggactgac

SEQ ID NO: 230887 - DNA, 25 bp, Homo sapien
gagacggactgaccatcagctctga

SEQ ID NO: 230888 - DNA, 25 bp, Homo sapien
gactgaccatcagctctgaactgtg

SEQ ID NO: 230889 - DNA, 25 bp, Homo sapien
tgccactcgactttccaacattttt

SEQ ID NO: 230890 - DNA, 25 bp, Homo sapien
ggcaacaaaccatggatttctcttc

SEQ ID NO: 230891 - DNA, 25 bp, Homo sapien
gaggaaagggtatccgcctcaccat

SEQ ID NO: 230892 - DNA, 25 bp, Homo sapien
tccgcctcaccattgctgaagagag

SEQ ID NO: 230893 - DNA, 25 bp, Homo sapien
gagagacaaaagactggcggccaaa

SEQ ID NO: 230894 - DNA, 25 bp, Homo sapien
gagacaaaagactggcggccaaaca

SEQ ID NO: 230895 - DNA, 25 bp, Homo sapien
agactggcggccaaacagagcagtg

SEQ ID NO: 230896 - DNA, 25 bp, Homo sapien
actggaggtgctaacctaggaagaa

SEQ ID NO: 230897 - DNA, 25 bp, Homo sapien
cctaggaagaattggtgtgatcacc

SEQ ID NO: 230898 - DNA, 25 bp, Homo sapien
agaggcaccctggatcttttgacgt

SEQ ID NO: 230899 - DNA, 25 bp, Homo sapien
cctggatcttttgacgtggttcacg

SEQ ID NO: 230900 - DNA, 25 bp, Homo sapien
gtatgtattctgtacaattcctatg

SEQ ID NO: 230901 - DNA, 25 bp, Homo sapien
tcctatgaaaatttgttgagacact

SEQ ID NO: 230902 - DNA, 25 bp, Homo sapien
gttgagacacttaagtgccgtgtaa

SEQ ID NO: 230903 - DNA, 25 bp, Homo sapien
tgccgtgtaattgcactgtctcaat

SEQ ID NO: 230904 - DNA, 25 bp, Homo sapien
taattgcactgtctcaatgagttgc

SEQ ID NO: 230905 - DNA, 25 bp, Homo sapien
tgtctcaatgagttgcagtgagtca

SEQ ID NO: 230906 - DNA, 25 bp, Homo sapien
gtaatattagagatttggtgcagaa

SEQ ID NO: 230907 - DNA, 25 bp, Homo sapien
atcagaagcccagataattacttgt

SEQ ID NO: 230908 - DNA, 25 bp, Homo sapien
gaagcccagataattacttgtaaag

SEQ ID NO: 230909 - DNA, 25 bp, Homo sapien
aagtgttttaatgctctcaggccaa

SEQ ID NO: 230910 - DNA, 25 bp, Homo sapien
ttaatgctctcaggccaagagtttg

SEQ ID NO: 230911 - DNA, 25 bp, Homo sapien
aagcccataatctctacccttacta

SEQ ID NO: 230912 - DNA, 25 bp, Homo sapien
ataatctctacccttactactacag

SEQ ID NO: 230913 - DNA, 25 bp, Homo sapien
aatctctacccttactactacaggc

SEQ ID NO: 230914 - DNA, 25 bp, Homo sapien
acaggccctaccctcaatatcatag

SEQ ID NO: 230915 - DNA, 25 bp, Homo sapien
taccctcaatatcataggcccagtc

SEQ ID NO: 230916 - DNA, 25 bp, Homo sapien
ctcaatatcataggcccagtccaga

SEQ ID NO: 230917 - DNA, 25 bp, Homo sapien
taggcccagtccagactaccacaag

SEQ ID NO: 230918 - DNA, 25 bp, Homo sapien
caccactacaggctctacctatagt

SEQ ID NO: 230919 - DNA, 25 bp, Homo sapien
actacaggctctacctatagtgcca

SEQ ID NO: 230920 - DNA, 25 bp, Homo sapien
ggctctacctatagtgccattacca

SEQ ID NO: 230921 - DNA, 25 bp, Homo sapien
tcactcacactactacaggctccac

SEQ ID NO: 230922 - DNA, 25 bp, Homo sapien
aggtaaactctgcattgtcatccca

SEQ ID NO: 230923 - DNA, 25 bp, Homo sapien
tcatcccagcgtacacctttaatgt

SEQ ID NO: 230924 - DNA, 25 bp, Homo sapien
gttttattgatttcactggcactgt

SEQ ID NO: 230925 - DNA, 25 bp, Homo sapien
tcactggcactgtatttggacctgt

SEQ ID NO: 230926 - DNA, 25 bp, Homo sapien
ggacctgtccttgtatatgtagaga

SEQ ID NO: 230927 - DNA, 25 bp, Homo sapien
gacatatgtggcttcattggtaatt

SEQ ID NO: 230928 - DNA, 25 bp, Homo sapien
aagatgacatgacgtgacacctgta

SEQ ID NO: 230929 - DNA, 25 bp, Homo sapien
gatgattgaactccctgtgtacagc

SEQ ID NO: 230930 - DNA, 25 bp, Homo sapien
taaaatgtctgcctctccagacatt

SEQ ID NO: 230931 - DNA, 25 bp, Homo sapien
taatagactctatgtgtgctgaatg

SEQ ID NO: 230932 - DNA, 25 bp, Homo sapien
ctgaatgttcctgtgtacatatgtg

SEQ ID NO: 230933 - DNA, 25 bp, Homo sapien
gctgtccaggtgagcgcgcatttcc

SEQ ID NO: 230934 - DNA, 25 bp, Homo sapien
gagcgcgcatttcccgtctcgtgtg

SEQ ID NO: 230935 - DNA, 25 bp, Homo sapien
tcgtgtgcccggtcaccagagacgc

SEQ ID NO: 230936 - DNA, 25 bp, Homo sapien
agcgtttctgagagcaaactcccaa

SEQ ID NO: 230937 - DNA, 25 bp, Homo sapien
tgagagcaaactcccaaggaagtaa

SEQ ID NO: 230938 - DNA, 25 bp, Homo sapien
ctccctgccacctaagtagcaagta

SEQ ID NO: 230939 - DNA, 25 bp, Homo sapien
cccgtacttagccttagaactcgag

SEQ ID NO: 230940 - DNA, 25 bp, Homo sapien
gccttagaactcgaggttcagtctc

SEQ ID NO: 230941 - DNA, 25 bp, Homo sapien
ctcgaggttcagtctcggtggagac

SEQ ID NO: 230942 - DNA, 25 bp, Homo sapien
tccccgtgttttttctggtggtcag

SEQ ID NO: 230943 - DNA, 25 bp, Homo sapien
ttctggtggtcagcgggctcttctg

SEQ ID NO: 230944 - DNA, 25 bp, Homo sapien
gtggccgatcagaccatttctatcg

SEQ ID NO: 230945 - DNA, 25 bp, Homo sapien
tcagaccatttctatcgtccgctga

SEQ ID NO: 230946 - DNA, 25 bp, Homo sapien
tgacctctggccacaggaagccagg

SEQ ID NO: 230947 - DNA, 25 bp, Homo sapien
tttcaggccatgtttctactcagtg

SEQ ID NO: 230948 - DNA, 25 bp, Homo sapien
ccatgtttctactcagtgtgctttt

SEQ ID NO: 230949 - DNA, 25 bp, Homo sapien
cagtgtgcttttcccaaatgatgtg

SEQ ID NO: 230950 - DNA, 25 bp, Homo sapien
caaatgatgtgtgtggtgtttctaa

SEQ ID NO: 230951 - DNA, 25 bp, Homo sapien
tttctaagagaaacagggcccataa

SEQ ID NO: 230952 - DNA, 25 bp, Homo sapien
gggcccataaccagtgggcagcttt

SEQ ID NO: 230953 - DNA, 25 bp, Homo sapien
atctgtttcagatctaggcataacc

SEQ ID NO: 230954 - DNA, 25 bp, Homo sapien
cagatctaggcataacctgtaaatc

SEQ ID NO: 230955 - DNA, 25 bp, Homo sapien
ggatgccactaaacaccctcaaatg

SEQ ID NO: 230956 - DNA, 25 bp, Homo sapien
aacaccctcaaatgcacaggtcagc

SEQ ID NO: 230957 - DNA, 25 bp, Homo sapien
aggtcagctcccacgaaaaacaatg

SEQ ID NO: 230958 - DNA, 25 bp, Homo sapien
gaaaaacaatgattcagtcccaaat

SEQ ID NO: 230959 - DNA, 25 bp, Homo sapien
aaaagcactgcatttcggaaaaccg

SEQ ID NO: 230960 - DNA, 25 bp, Homo sapien
tcggaaaaccgtcctagtggtagag

SEQ ID NO: 230961 - DNA, 25 bp, Homo sapien
ggagaaggactttttgcaggaaaat

SEQ ID NO: 230962 - DNA, 25 bp, Homo sapien
gtaatgtttcttactccaacacaaa

SEQ ID NO: 230963 - DNA, 25 bp, Homo sapien
atcagtgcattgctttgtgggcctc

SEQ ID NO: 230964 - DNA, 25 bp, Homo sapien
ctttgtgggcctcacatcagcctct

SEQ ID NO: 230965 - DNA, 25 bp, Homo sapien
agcctctgaggagacttgcatctct

SEQ ID NO: 230966 - DNA, 25 bp, Homo sapien
gtccgctttccttttctctactttg

SEQ ID NO: 230967 - DNA, 25 bp, Homo sapien
tccgctttccttttctctactttgt

SEQ ID NO: 230968 - DNA, 25 bp, Homo sapien
gctttccttttctctactttgtaat

SEQ ID NO: 230969 - DNA, 25 bp, Homo sapien
tccttttctctactttgtaatttat

SEQ ID NO: 230970 - DNA, 25 bp, Homo sapien
gggaggggggactcgctgctacaag

SEQ ID NO: 230971 - DNA, 25 bp, Homo sapien
ggaggggggactcgctgctacaagc

SEQ ID NO: 230972 - DNA, 25 bp, Homo sapien
ggggggactcgctgctacaagcctc

SEQ ID NO: 230973 - DNA, 25 bp, Homo sapien
ctgctacaagcctcgccccctgtgc

SEQ ID NO: 230974 - DNA, 25 bp, Homo sapien
tgctacaagcctcgccccctgtgcc

SEQ ID NO: 230975 - DNA, 25 bp, Homo sapien
aagcctcgccccctgtgccactcag

SEQ ID NO: 230976 - DNA, 25 bp, Homo sapien
cctgtgccactcagctccgccccgc

SEQ ID NO: 230977 - DNA, 25 bp, Homo sapien
gagagacaaaagactggcggccaaa

SEQ ID NO: 230978 - DNA, 25 bp, Homo sapien
agagacaaaagactggcggccaaac

SEQ ID NO: 230979 - DNA, 25 bp, Homo sapien
gagacaaaagactggcggccaaaca

SEQ ID NO: 230980 - DNA, 25 bp, Homo sapien
agacaaaagactggcggccaaacag

SEQ ID NO: 230981 - DNA, 25 bp, Homo sapien
gacaaaagactggcggccaaacaga

SEQ ID NO: 230982 - DNA, 25 bp, Homo sapien
acaaaagactggcggccaaacagag

SEQ ID NO: 230983 - DNA, 25 bp, Homo sapien
caaaagactggcggccaaacagagc

SEQ ID NO: 230984 - DNA, 25 bp, Homo sapien
aaaagactggcggccaaacagagca

SEQ ID NO: 230985 - DNA, 25 bp, Homo sapien
aaagactggcggccaaacagagcag

SEQ ID NO: 230986 - DNA, 25 bp, Homo sapien
aagactggcggccaaacagagcagt

SEQ ID NO: 230987 - DNA, 25 bp, Homo sapien
agactggcggccaaacagagcagtg

SEQ ID NO: 230988 - DNA, 25 bp, Homo sapien
cagtcaagacatcactctttcgagt

SEQ ID NO: 230989 - DNA, 25 bp, Homo sapien
actctttcgagtgaggaggaagcag

SEQ ID NO: 230990 - DNA, 25 bp, Homo sapien
gagaccaagtggtcctccataccag

SEQ ID NO: 230991 - DNA, 25 bp, Homo sapien
gtggtcctccataccagcttcgaag

SEQ ID NO: 230992 - DNA, 25 bp, Homo sapien
ataccagcttcgaagccacggaggg

SEQ ID NO: 230993 - DNA, 25 bp, Homo sapien
gggacagctcccacgaggaccgcag

SEQ ID NO: 230994 - DNA, 25 bp, Homo sapien
tggccaggcggtgtctctgttcgca

SEQ ID NO: 230995 - DNA, 25 bp, Homo sapien
aggcggtgtctctgttcgcacaggt

SEQ ID NO: 230996 - DNA, 25 bp, Homo sapien
tctgttcgcacaggtccggagaagc

SEQ ID NO: 230997 - DNA, 25 bp, Homo sapien
cgcacaggtccggagaagcgcagca

SEQ ID NO: 230998 - DNA, 25 bp, Homo sapien
ggaagggtgagcaggcctcctcgtc

SEQ ID NO: 230999 - DNA, 25 bp, Homo sapien
aagcagtgtatattttattcctatc

SEQ ID NO: 231000 - DNA, 25 bp, Homo sapien
gtgtatattttattcctatcttaga

SEQ ID NO: 231001 - DNA, 25 bp, Homo sapien
ctatcttagaaaatcacagtgcacc

SEQ ID NO: 231002 - DNA, 25 bp, Homo sapien
tcacagtgcaccctagaatatcaaa

SEQ ID NO: 231003 - DNA, 25 bp, Homo sapien
gcaccctagaatatcaaaagcctgt

SEQ ID NO: 231004 - DNA, 25 bp, Homo sapien
aaagcctgtgacatcttgaaggaga

SEQ ID NO: 231005 - DNA, 25 bp, Homo sapien
tctagttatattttcttcaatccag

SEQ ID NO: 231006 - DNA, 25 bp, Homo sapien
tcttcaatccagtattttccaagtt

SEQ ID NO: 231007 - DNA, 25 bp, Homo sapien
actatgtttgaggactatgtttttc

SEQ ID NO: 231008 - DNA, 25 bp, Homo sapien
gtttgaggactatgtttttcagaat

SEQ ID NO: 231009 - DNA, 25 bp, Homo sapien
aagcattgccatatcttcctctagg

SEQ ID NO: 231010 - DNA, 25 bp, Homo sapien
atcacaagcctcgatcctctagtgt

SEQ ID NO: 231011 - DNA, 25 bp, Homo sapien
acaagcctcgatcctctagtgtaga

SEQ ID NO: 231012 - DNA, 25 bp, Homo sapien
aagcctcgatcctctagtgtagacc

SEQ ID NO: 231013 - DNA, 25 bp, Homo sapien
gatcctctagtgtagacccggtggg

SEQ ID NO: 231014 - DNA, 25 bp, Homo sapien
cctctagtgtagacccggtgggaga

SEQ ID NO: 231015 - DNA, 25 bp, Homo sapien
caaggaggatcgtggtcttttccca

SEQ ID NO: 231016 - DNA, 25 bp, Homo sapien
tcgtcatcgagggagaccctctgta

SEQ ID NO: 231017 - DNA, 25 bp, Homo sapien
gagggagaccctctgtagccacgct

SEQ ID NO: 231018 - DNA, 25 bp, Homo sapien
ggagaccctctgtagccacgctgtg

SEQ ID NO: 231019 - DNA, 25 bp, Homo sapien
gggtccaataaataccagtcacagt

SEQ ID NO: 231020 - DNA, 25 bp, Homo sapien
ataaataccagtcacagtttgggag

SEQ ID NO: 231021 - DNA, 25 bp, Homo sapien
gatagccctgcttaaatgtttgtca

SEQ ID NO: 231022 - DNA, 25 bp, Homo sapien
aacaagagtcgtaatgtgtcagtac

SEQ ID NO: 231023 - DNA, 25 bp, Homo sapien
gtgtcagtacattgtagctcctttg

SEQ ID NO: 231024 - DNA, 25 bp, Homo sapien
gtagctcctttgaaatttaactctt

SEQ ID NO: 231025 - DNA, 25 bp, Homo sapien
aactctttctgtgttacatgaattg

SEQ ID NO: 231026 - DNA, 25 bp, Homo sapien
taaggagtccggcaaacatgtttct

SEQ ID NO: 231027 - DNA, 25 bp, Homo sapien
ggcaaacatgtttcttcacttccat

SEQ ID NO: 231028 - DNA, 25 bp, Homo sapien
gaatggtgccaagtgtcagactcta

SEQ ID NO: 231029 - DNA, 25 bp, Homo sapien
gtgtcagactctaatgagccctcag

SEQ ID NO: 231030 - DNA, 25 bp, Homo sapien
gagccctcagctcaggttttaattt

SEQ ID NO: 231031 - DNA, 25 bp, Homo sapien
aatcatatcggtttctgctgtatta

SEQ ID NO: 231032 - DNA, 25 bp, Homo sapien
gtatcttactttaaccatatgtctg

SEQ ID NO: 231033 - DNA, 25 bp, Homo sapien
atatgtctgctagcatccttcctta

SEQ ID NO: 231034 - DNA, 25 bp, Homo sapien
gcatccttccttactttgctggaaa

SEQ ID NO: 231035 - DNA, 25 bp, Homo sapien
tactttgctggaaatcttggtggct

SEQ ID NO: 231036 - DNA, 25 bp, Homo sapien
aaatcttggtggctggtcaaaatcc

SEQ ID NO: 231037 - DNA, 25 bp, Homo sapien
aatccattgaagaaacagcagcctc

SEQ ID NO: 231038 - DNA, 25 bp, Homo sapien
cagcagcctcttgtatacagttctt

SEQ ID NO: 231039 - DNA, 25 bp, Homo sapien
tagagaatcctcctgatgatgggtt

SEQ ID NO: 231040 - DNA, 25 bp, Homo sapien
gatgggtttgtaagcacattttaaa

SEQ ID NO: 231041 - DNA, 25 bp, Homo sapien
aggtcaactttcaattactggtaat

SEQ ID NO: 231042 - DNA, 25 bp, Homo sapien
cacttttaattccaagcacccttag

SEQ ID NO: 231043 - DNA, 25 bp, Homo sapien
aaatatctggttcacttacactaca

SEQ ID NO: 231044 - DNA, 25 bp, Homo sapien
ggttcacttacactacatttactgt

SEQ ID NO: 231045 - DNA, 25 bp, Homo sapien
attcttttatagcattaggtgcctt

SEQ ID NO: 231046 - DNA, 25 bp, Homo sapien
cattaggtgccttgtattttaaatc

SEQ ID NO: 231047 - DNA, 25 bp, Homo sapien
aaatctgtgacaaaccatggcaaat

SEQ ID NO: 231048 - DNA, 25 bp, Homo sapien
gacaaaccatggcaaatttttaaag

SEQ ID NO: 231049 - DNA, 25 bp, Homo sapien
tatttctaaaggctatattgctgta

SEQ ID NO: 231050 - DNA, 25 bp, Homo sapien
aacttaattgataaagctctgttta

SEQ ID NO: 231051 - DNA, 25 bp, Homo sapien
agagttttgaagaaatagtctccct

SEQ ID NO: 231052 - DNA, 25 bp, Homo sapien
gaaatagtctcccttcaattaagaa

SEQ ID NO: 231053 - DNA, 25 bp, Homo sapien
tagtctcccttcaattaagaaattt

SEQ ID NO: 231054 - DNA, 25 bp, Homo sapien
ccagtttccacaatgtgcaagattg

SEQ ID NO: 231055 - DNA, 25 bp, Homo sapien
aatgtgatcattggctctaatgtgc

SEQ ID NO: 231056 - DNA, 25 bp, Homo sapien
gtgatcattggctctaatgtgctgg

SEQ ID NO: 231057 - DNA, 25 bp, Homo sapien
gatcattggctctaatgtgctggcg

SEQ ID NO: 231058 - DNA, 25 bp, Homo sapien
tcattggctctaatgtgctggcgct

SEQ ID NO: 231059 - DNA, 25 bp, Homo sapien
attggctctaatgtgctggcgctag

SEQ ID NO: 231060 - DNA, 25 bp, Homo sapien
ttggctctaatgtgctggcgctagc

SEQ ID NO: 231061 - DNA, 25 bp, Homo sapien
tggctctaatgtgctggcgctagct

SEQ ID NO: 231062 - DNA, 25 bp, Homo sapien
gctctaatgtgctggcgctagctga

SEQ ID NO: 231063 - DNA, 25 bp, Homo sapien
ctctaatgtgctggcgctagctgag

SEQ ID NO: 231064 - DNA, 25 bp, Homo sapien
atgtgctggcgctagctgaggccca

SEQ ID NO: 231065 - DNA, 25 bp, Homo sapien
attgataggatttggtccctgctga

SEQ ID NO: 231066 - DNA, 25 bp, Homo sapien
ggatttggtccctgctgacctgtgg

SEQ ID NO: 231067 - DNA, 25 bp, Homo sapien
gcagaggagttgattctagtatttc

SEQ ID NO: 231068 - DNA, 25 bp, Homo sapien
tctagtatttctaagttgggccact

SEQ ID NO: 231069 - DNA, 25 bp, Homo sapien
aggaacaggcttagtggacccacag

SEQ ID NO: 231070 - DNA, 25 bp, Homo sapien
cagaagtgaccggacccaggagtct

SEQ ID NO: 231071 - DNA, 25 bp, Homo sapien
accctggcttctctgtgttggctta

SEQ ID NO: 231072 - DNA, 25 bp, Homo sapien
gcttctctgtgttggcttacccttt

SEQ ID NO: 231073 - DNA, 25 bp, Homo sapien
cttgagtgttaagggcacatgggaa

SEQ ID NO: 231074 - DNA, 25 bp, Homo sapien
agaccctgggccttgcaaaggacat

SEQ ID NO: 231075 - DNA, 25 bp, Homo sapien
aaggacattctcttttatcccaaag

SEQ ID NO: 231076 - DNA, 25 bp, Homo sapien
ttatcttatacttagctctctggct

SEQ ID NO: 231077 - DNA, 25 bp, Homo sapien
agctctctggctattgaacttcctt

SEQ ID NO: 231078 - DNA, 25 bp, Homo sapien
ggctattgaacttccttttcttgtt

SEQ ID NO: 231079 - DNA, 25 bp, Homo sapien
tattgaacttccttttcttgtttga

SEQ ID NO: 231080 - DNA, 25 bp, Homo sapien
gaagttagcttcaaatttgctccta

SEQ ID NO: 231081 - DNA, 25 bp, Homo sapien
gcttcaaatttgctcctatgctaaa

SEQ ID NO: 231082 - DNA, 25 bp, Homo sapien
tttgctcctatgctaaattacctgt

SEQ ID NO: 231083 - DNA, 25 bp, Homo sapien
aattacctgtaaatattctggatag

SEQ ID NO: 231084 - DNA, 25 bp, Homo sapien
tattctggataggaactacttgaaa

SEQ ID NO: 231085 - DNA, 25 bp, Homo sapien
tttaaaaatgccataacaatcttgc

SEQ ID NO: 231086 - DNA, 25 bp, Homo sapien
tatgattttggtggtaacgatcccc

SEQ ID NO: 231087 - DNA, 25 bp, Homo sapien
aaagttctggtgctatggttctctc

SEQ ID NO: 231088 - DNA, 25 bp, Homo sapien
tatggttctctctgacgcacacaca

SEQ ID NO: 231089 - DNA, 25 bp, Homo sapien
acacagaggccgttggagggcttct

SEQ ID NO: 231090 - DNA, 25 bp, Homo sapien
tctgaaaactcctgtgcatgcctga

SEQ ID NO: 231091 - DNA, 25 bp, Homo sapien
gtgcatgcctgatgagttcctgctg

SEQ ID NO: 231092 - DNA, 25 bp, Homo sapien
atgagttcctgctggcgacccaggg

SEQ ID NO: 231093 - DNA, 25 bp, Homo sapien
agaaccactgttctagtataaacca

SEQ ID NO: 231094 - DNA, 25 bp, Homo sapien
aaaactccacttttaatctgtgact

SEQ ID NO: 231095 - DNA, 25 bp, Homo sapien
atctgtgactgtaattgaggcgcca

SEQ ID NO: 231096 - DNA, 25 bp, Homo sapien
tgaggcgccagaggtctatacaaat

SEQ ID NO: 231097 - DNA, 25 bp, Homo sapien
attttcttgcctactgttttgctag

SEQ ID NO: 231098 - DNA, 25 bp, Homo sapien
gtactgactcactgcaaacagctgc

SEQ ID NO: 231099 - DNA, 25 bp, Homo sapien
agctgcaaaatgttgcccttgggat

SEQ ID NO: 231100 - DNA, 25 bp, Homo sapien
gatagaggttaactcggttgtgaaa

SEQ ID NO: 231101 - DNA, 25 bp, Homo sapien
ataatggccaaagcggtgcactctt

SEQ ID NO: 231102 - DNA, 25 bp, Homo sapien
aagcggtgcactcttaataactttt

SEQ ID NO: 231103 - DNA, 25 bp, Homo sapien
taataacttttttgtagccctggag

SEQ ID NO: 231104 - DNA, 25 bp, Homo sapien
gagaaagcttctggattgactgtga

SEQ ID NO: 231105 - DNA, 25 bp, Homo sapien
caggaggcctgggattgaaagctct

SEQ ID NO: 231106 - DNA, 25 bp, Homo sapien
gattgaaagctctcggtttgtacaa

SEQ ID NO: 231107 - DNA, 25 bp, Homo sapien
ctctcggtttgtacaagctcttttg

SEQ ID NO: 231108 - DNA, 25 bp, Homo sapien
agctcttttggatttgtaacacttt

SEQ ID NO: 231109 - DNA, 25 bp, Homo sapien
aatcatgcctgctttgaggtgttct

SEQ ID NO: 231110 - DNA, 25 bp, Homo sapien
tcatgcctgctttgaggtgttctgt

SEQ ID NO: 231111 - DNA, 25 bp, Homo sapien
agcaagctgcaccttgggtcactct

SEQ ID NO: 231112 - DNA, 25 bp, Homo sapien
caccttgggtcactcttttggaata

SEQ ID NO: 231113 - DNA, 25 bp, Homo sapien
cttgggtcactcttttggaatattt

SEQ ID NO: 231114 - DNA, 25 bp, Homo sapien
ggaatattttgactataggctgcgt

SEQ ID NO: 231115 - DNA, 25 bp, Homo sapien
ttgactataggctgcgtcacaggca

SEQ ID NO: 231116 - DNA, 25 bp, Homo sapien
gcgtcacaggcagaaaaggagttga

SEQ ID NO: 231117 - DNA, 25 bp, Homo sapien
gacatgtttgaatcagtgctagagg

SEQ ID NO: 231118 - DNA, 25 bp, Homo sapien
cagtgctagagggaacagattgtga

SEQ ID NO: 231119 - DNA, 25 bp, Homo sapien
tttgtttacagcatccaatatttgg

SEQ ID NO: 231120 - DNA, 25 bp, Homo sapien
aaagtctggacccactccatgctct

SEQ ID NO: 231121 - DNA, 25 bp, Homo sapien
tgccctcagacctggccaggtgatg

SEQ ID NO: 231122 - DNA, 25 bp, Homo sapien
ccaccgagagaagcgggctcctaat

SEQ ID NO: 231123 - DNA, 25 bp, Homo sapien
gctcctaatgaggtgggaaagccac

SEQ ID NO: 231124 - DNA, 25 bp, Homo sapien
aaagccacggcaggcagcgagcagc

SEQ ID NO: 231125 - DNA, 25 bp, Homo sapien
aggccagctttctgcatggatggtc

SEQ ID NO: 231126 - DNA, 25 bp, Homo sapien
gctttctgcatggatggtcagtctc

SEQ ID NO: 231127 - DNA, 25 bp, Homo sapien
ctgccagtcctagacaacttgggta

SEQ ID NO: 231128 - DNA, 25 bp, Homo sapien
gtcctagacaacttgggtacatctg

SEQ ID NO: 231129 - DNA, 25 bp, Homo sapien
gggacctagcagttaggcttgactt

SEQ ID NO: 231130 - DNA, 25 bp, Homo sapien
ggctgtgatgtttatgatccctgaa

SEQ ID NO: 231131 - DNA, 25 bp, Homo sapien
tgagcacccgcttcgggctgaccta

SEQ ID NO: 231132 - DNA, 25 bp, Homo sapien
gcttcgggctgacctagctgaagaa

SEQ ID NO: 231133 - DNA, 25 bp, Homo sapien
ttcgggctgacctagctgaagaata

SEQ ID NO: 231134 - DNA, 25 bp, Homo sapien
ggctgacctagctgaagaatactct

SEQ ID NO: 231135 - DNA, 25 bp, Homo sapien
gctgaagaatactctaaggaccgta

SEQ ID NO: 231136 - DNA, 25 bp, Homo sapien
tgaagaatactctaaggaccgtaaa

SEQ ID NO: 231137 - DNA, 25 bp, Homo sapien
ttctgtaagaatgctgaagagttta

SEQ ID NO: 231138 - DNA, 25 bp, Homo sapien
agtgtgagcagagaccccgtgcagt

SEQ ID NO: 231139 - DNA, 25 bp, Homo sapien
agacaccccgcaaagcaggactctg

SEQ ID NO: 231140 - DNA, 25 bp, Homo sapien
ttgtggcagttactaactttctaca

SEQ ID NO: 231141 - DNA, 25 bp, Homo sapien
ggcagttactaactttctacagttt

SEQ ID NO: 231142 - DNA, 25 bp, Homo sapien
cagaccgatggacacgagcaggtcc

SEQ ID NO: 231143 - DNA, 25 bp, Homo sapien
tctatggcgctgtaggtctgcaccg

SEQ ID NO: 231144 - DNA, 25 bp, Homo sapien
tggcgctgtaggtctgcaccgtgct

SEQ ID NO: 231145 - DNA, 25 bp, Homo sapien
acgtggaagcggatgtcgtccacca

SEQ ID NO: 231146 - DNA, 25 bp, Homo sapien
atgtcgtccaccagcgggatagagt

SEQ ID NO: 231147 - DNA, 25 bp, Homo sapien
tccaccagcgggatagagtccgtct

SEQ ID NO: 231148 - DNA, 25 bp, Homo sapien
gcttctcaatgaccttggccatgta

SEQ ID NO: 231149 - DNA, 25 bp, Homo sapien
aatgaccttggccatgtactcagtg

SEQ ID NO: 231150 - DNA, 25 bp, Homo sapien
atgtactcagtgcactggtcctcaa

SEQ ID NO: 231151 - DNA, 25 bp, Homo sapien
tcagtgcactggtcctcaagccgcg

SEQ ID NO: 231152 - DNA, 25 bp, Homo sapien
tcaagccgcgccaggcggaagagct

SEQ ID NO: 231153 - DNA, 25 bp, Homo sapien
acagagcatcgggattaggaaatta

SEQ ID NO: 231154 - DNA, 25 bp, Homo sapien
taggaaattagccattttggattct

SEQ ID NO: 231155 - DNA, 25 bp, Homo sapien
ccattttggattctgtctgccacaa

SEQ ID NO: 231156 - DNA, 25 bp, Homo sapien
ttttggattctgtctgccacaaaca

SEQ ID NO: 231157 - DNA, 25 bp, Homo sapien
gattctgtctgccacaaacagacct

SEQ ID NO: 231158 - DNA, 25 bp, Homo sapien
aaacagacctattctaaacagtgct

SEQ ID NO: 231159 - DNA, 25 bp, Homo sapien
gacctattctaaacagtgctattaa

SEQ ID NO: 231160 - DNA, 25 bp, Homo sapien
tattaaattttagactgttgttcaa

SEQ ID NO: 231161 - DNA, 25 bp, Homo sapien
ttctcctaaactactttttatggtg

SEQ ID NO: 231162 - DNA, 25 bp, Homo sapien
tctagacagactttggtatcaattt

SEQ ID NO: 231163 - DNA, 25 bp, Homo sapien
gacagactttggtatcaatttaaaa

SEQ ID NO: 231164 - DNA, 25 bp, Homo sapien
tgctgcagagagttaaaagtatcct

SEQ ID NO: 231165 - DNA, 25 bp, Homo sapien
taaaagtatcctaccagagtttggg

SEQ ID NO: 231166 - DNA, 25 bp, Homo sapien
ggaaactatatagagtagcctactt

SEQ ID NO: 231167 - DNA, 25 bp, Homo sapien
gcctactttaaaatactgactgaag

SEQ ID NO: 231168 - DNA, 25 bp, Homo sapien
ggcagcaaggctatgtgcaaaactt

SEQ ID NO: 231169 - DNA, 25 bp, Homo sapien
tgtgcaaaacttatcctgaaccctc

SEQ ID NO: 231170 - DNA, 25 bp, Homo sapien
tgaaccctctaattatcaggcacat

SEQ ID NO: 231171 - DNA, 25 bp, Homo sapien
ctctaattatcaggcacatgggttc

SEQ ID NO: 231172 - DNA, 25 bp, Homo sapien
gaaagtgaaactcacctcaaatcac

SEQ ID NO: 231173 - DNA, 25 bp, Homo sapien
aatcacccctgccaatgaagacaac

SEQ ID NO: 231174 - DNA, 25 bp, Homo sapien
atcaatactatattggacccatagt

SEQ ID NO: 231175 - DNA, 25 bp, Homo sapien
gtttaagttgaagcattctcagatg

SEQ ID NO: 231176 - DNA, 25 bp, Homo sapien
gaaacatcctcttaaaatgggtcct

SEQ ID NO: 231177 - DNA, 25 bp, Homo sapien
tcctcttaaaatgggtccttgtgct

SEQ ID NO: 231178 - DNA, 25 bp, Homo sapien
aaggcatttatgcatatgttatatg

SEQ ID NO: 231179 - DNA, 25 bp, Homo sapien
atgttatatgcggactgcacccacc

SEQ ID NO: 231180 - DNA, 25 bp, Homo sapien
tttgcctcttgggttgttgtgctgc

SEQ ID NO: 231181 - DNA, 25 bp, Homo sapien
cctcttgggttgttgtgctgctttc

SEQ ID NO: 231182 - DNA, 25 bp, Homo sapien
ttgttgtgctgctttccccttactt

SEQ ID NO: 231183 - DNA, 25 bp, Homo sapien
ccccttactttgctacatttctata

SEQ ID NO: 231184 - DNA, 25 bp, Homo sapien
actttgctacatttctatagttaag

SEQ ID NO: 231185 - DNA, 25 bp, Homo sapien
gttggttttacttgaatgattcatg

SEQ ID NO: 231186 - DNA, 25 bp, Homo sapien
ggaaacagccctaataattggtatc

SEQ ID NO: 231187 - DNA, 25 bp, Homo sapien
taaagtcatttttggttttcacact

SEQ ID NO: 231188 - DNA, 25 bp, Homo sapien
tggttttcacactaaattacgcttt

SEQ ID NO: 231189 - DNA, 25 bp, Homo sapien
cagccctaataattggtatccattt

SEQ ID NO: 231190 - DNA, 25 bp, Homo sapien
ccctttacttttgcatctattaact

SEQ ID NO: 231191 - DNA, 25 bp, Homo sapien
tttgcatctattaactctattcctt

SEQ ID NO: 231192 - DNA, 25 bp, Homo sapien
gcatctattaactctattccttaaa

SEQ ID NO: 231193 - DNA, 25 bp, Homo sapien
tacttttgtttctcaaggagttatc

SEQ ID NO: 231194 - DNA, 25 bp, Homo sapien
ggattgcagttgaagtattttgctt

SEQ ID NO: 231195 - DNA, 25 bp, Homo sapien
gtaaaatatacacatgccattcaat

SEQ ID NO: 231196 - DNA, 25 bp, Homo sapien
atacacatgccattcaatattcagt

SEQ ID NO: 231197 - DNA, 25 bp, Homo sapien
tggctggcacttggacccttggcaa

SEQ ID NO: 231198 - DNA, 25 bp, Homo sapien
gcacttggacccttggcaaggcagt

SEQ ID NO: 231199 - DNA, 25 bp, Homo sapien
gacccttggcaaggcagtccctaag

SEQ ID NO: 231200 - DNA, 25 bp, Homo sapien
ttggcaaggcagtccctaagctctc

SEQ ID NO: 231201 - DNA, 25 bp, Homo sapien
gcaaggcagtccctaagctctcagt

SEQ ID NO: 231202 - DNA, 25 bp, Homo sapien
aggcagtccctaagctctcagtcct

SEQ ID NO: 231203 - DNA, 25 bp, Homo sapien
gttttgtcatctgtgatacgggtgc

SEQ ID NO: 231204 - DNA, 25 bp, Homo sapien
tgtcatctgtgatacgggtgcatac

SEQ ID NO: 231205 - DNA, 25 bp, Homo sapien
tgatacgggtgcataccaaccctgt

SEQ ID NO: 231206 - DNA, 25 bp, Homo sapien
tgaagctactcggaatgggtaatgt

SEQ ID NO: 231207 - DNA, 25 bp, Homo sapien
actcggaatgggtaatgtgccccag

SEQ ID NO: 231208 - DNA, 25 bp, Homo sapien
attcagcaaggctttcatatccttg

SEQ ID NO: 231209 - DNA, 25 bp, Homo sapien
aaggagcttattcaggtttcctgcc

SEQ ID NO: 231210 - DNA, 25 bp, Homo sapien
aggtttcctgccctagctattagct

SEQ ID NO: 231211 - DNA, 25 bp, Homo sapien
tagctattagctccacttcacatgc

SEQ ID NO: 231212 - DNA, 25 bp, Homo sapien
acttcacatgctggagaccggcgta

SEQ ID NO: 231213 - DNA, 25 bp, Homo sapien
gatgtattcatcctggtgttactga

SEQ ID NO: 231214 - DNA, 25 bp, Homo sapien
ggtgtgatcctgttactgatactat

SEQ ID NO: 231215 - DNA, 25 bp, Homo sapien
gttactgatactataagtgacctaa

SEQ ID NO: 231216 - DNA, 25 bp, Homo sapien
taaaatgtcactgttcaaattagcc

SEQ ID NO: 231217 - DNA, 25 bp, Homo sapien
gtgttctaacaaactaaactcttca

SEQ ID NO: 231218 - DNA, 25 bp, Homo sapien
aaactaaactcttcaaatgcttgga

SEQ ID NO: 231219 - DNA, 25 bp, Homo sapien
ataatagttccaagccttctctgtc

SEQ ID NO: 231220 - DNA, 25 bp, Homo sapien
agctctagcccaactaggcagtttg

SEQ ID NO: 231221 - DNA, 25 bp, Homo sapien
gtttgctgttgagatacacccgctt

SEQ ID NO: 231222 - DNA, 25 bp, Homo sapien
ccattgccatggtgagggtcctcaa

SEQ ID NO: 231223 - DNA, 25 bp, Homo sapien
agggtcctcaaagggctcattctgg

SEQ ID NO: 231224 - DNA, 25 bp, Homo sapien
cggtcactctgttcatggctgtgtt

SEQ ID NO: 231225 - DNA, 25 bp, Homo sapien
atggctgtgtttgctgatcatgtac

SEQ ID NO: 231226 - DNA, 25 bp, Homo sapien
gctgtccaattttgtactcgtctac

SEQ ID NO: 231227 - DNA, 25 bp, Homo sapien
tcgtctacggtgagcggcatgcaga

SEQ ID NO: 231228 - DNA, 25 bp, Homo sapien
atgcagatccggtactctttcagca

SEQ ID NO: 231229 - DNA, 25 bp, Homo sapien
gtactctttcagcagcatggtcctg

SEQ ID NO: 231230 - DNA, 25 bp, Homo sapien
ctctttgtgacatagaggtcagaaa

SEQ ID NO: 231231 - DNA, 25 bp, Homo sapien
aggtcagaaattggtcgtttccata

SEQ ID NO: 231232 - DNA, 25 bp, Homo sapien
tggtcgtttccatagagtatgagag

SEQ ID NO: 231233 - DNA, 25 bp, Homo sapien
gacagaattgtgctcatcataagta

SEQ ID NO: 231234 - DNA, 25 bp, Homo sapien
ttagacttaataaaatgggctgcct

SEQ ID NO: 231235 - DNA, 25 bp, Homo sapien
ccttggtaggtggtgagttctctgt

SEQ ID NO: 231236 - DNA, 25 bp, Homo sapien
aggtggtgagttctctgtcacgaaa

SEQ ID NO: 231237 - DNA, 25 bp, Homo sapien
tgtcacgaaagagattcagccactt

SEQ ID NO: 231238 - DNA, 25 bp, Homo sapien
cgaaagagattcagccacttgctct

SEQ ID NO: 231239 - DNA, 25 bp, Homo sapien
tatcaacattgtaagggtcgaccac

SEQ ID NO: 231240 - DNA, 25 bp, Homo sapien
aagggtcgaccacctcatctctgag

SEQ ID NO: 231241 - DNA, 25 bp, Homo sapien
agtgctcttgtgagaggcagtccct

SEQ ID NO: 231242 - DNA, 25 bp, Homo sapien
agaggcagtccctgcgtggaaagtt

SEQ ID NO: 231243 - DNA, 25 bp, Homo sapien
cagtccctgcgtggaaagttgctgg

SEQ ID NO: 231244 - DNA, 25 bp, Homo sapien
gcatgcatccactgcggccggagga

SEQ ID NO: 231245 - DNA, 25 bp, Homo sapien
tggagcccgagtagctgcctggatc

SEQ ID NO: 231246 - DNA, 25 bp, Homo sapien
tagctgcctggatcgctcgacctcg

SEQ ID NO: 231247 - DNA, 25 bp, Homo sapien
tggatcgctcgacctcgcatgcgcg

SEQ ID NO: 231248 - DNA, 25 bp, Homo sapien
gcaccgcgtttccatagcagcatgt

SEQ ID NO: 231249 - DNA, 25 bp, Homo sapien
gtgtgtagagcctcgatcgtcatct

SEQ ID NO: 231250 - DNA, 25 bp, Homo sapien
gtagagcctcgatcgtcatctctgg

SEQ ID NO: 231251 - DNA, 25 bp, Homo sapien
gatcgtcatctctggttatttgttt

SEQ ID NO: 231252 - DNA, 25 bp, Homo sapien
attatttcctacttttctgcctaat

SEQ ID NO: 231253 - DNA, 25 bp, Homo sapien
ttcctacttttctgcctaattaaat

SEQ ID NO: 231254 - DNA, 25 bp, Homo sapien
atttatttttggcttccatttctgt

SEQ ID NO: 231255 - DNA, 25 bp, Homo sapien
ttttggcttccatttctgtataacc

SEQ ID NO: 231256 - DNA, 25 bp, Homo sapien
ggcttccatttctgtataaccaaaa

SEQ ID NO: 231257 - DNA, 25 bp, Homo sapien
cattcctattattttgttgctaaaa

SEQ ID NO: 231258 - DNA, 25 bp, Homo sapien
gtaaccaattcaagcactttaagca

SEQ ID NO: 231259 - DNA, 25 bp, Homo sapien
gcactttaagcaataatgtcaatct

SEQ ID NO: 231260 - DNA, 25 bp, Homo sapien
gcaataatgtcaatcttgtgaaatt

SEQ ID NO: 231261 - DNA, 25 bp, Homo sapien
tttaatcagtttaacaccctgcctc

SEQ ID NO: 231262 - DNA, 25 bp, Homo sapien
gtttaacaccctgcctctaaaattg

SEQ ID NO: 231263 - DNA, 25 bp, Homo sapien
ccattcatggaattctggccagcca

SEQ ID NO: 231264 - DNA, 25 bp, Homo sapien
agtggctgatgcctacacaagcttt

SEQ ID NO: 231265 - DNA, 25 bp, Homo sapien
gatgcctacacaagcttttcttcaa

SEQ ID NO: 231266 - DNA, 25 bp, Homo sapien
ttcaaaaagccccaatttctgacag

SEQ ID NO: 231267 - DNA, 25 bp, Homo sapien
atttctgacagccatggcagctttc

SEQ ID NO: 231268 - DNA, 25 bp, Homo sapien
gtgtgagcacggactatgcttcttc

SEQ ID NO: 231269 - DNA, 25 bp, Homo sapien
atgcttcttcccagaaagtagccgc

SEQ ID NO: 231270 - DNA, 25 bp, Homo sapien
aaagtagccgcctgcttgcttcttt

SEQ ID NO: 231271 - DNA, 25 bp, Homo sapien
tgcttctttgcattgacatttgcac

SEQ ID NO: 231272 - DNA, 25 bp, Homo sapien
tcccggcttctatttatatccacat

SEQ ID NO: 231273 - DNA, 25 bp, Homo sapien
ttatatccacatgtaaagccccaga

SEQ ID NO: 231274 - DNA, 25 bp, Homo sapien
tcatgaccccgctccgggattatgg

SEQ ID NO: 231275 - DNA, 25 bp, Homo sapien
ccgctccgggattatggccgggact

SEQ ID NO: 231276 - DNA, 25 bp, Homo sapien
gattatggccgggactgggctgctg

SEQ ID NO: 231277 - DNA, 25 bp, Homo sapien
tggcgctgcggacgctgccagggcc

SEQ ID NO: 231278 - DNA, 25 bp, Homo sapien
gggcccagctgggtgcgaggctcgg

SEQ ID NO: 231279 - DNA, 25 bp, Homo sapien
aggctcgggcccttccgtgctgagc

SEQ ID NO: 231280 - DNA, 25 bp, Homo sapien
ccgcctgcaggacgcggccgtggtg

SEQ ID NO: 231281 - DNA, 25 bp, Homo sapien
gacgcggccgtggtgcggcctggct

SEQ ID NO: 231282 - DNA, 25 bp, Homo sapien
cagaggaggagacgctgagccgaga

SEQ ID NO: 231283 - DNA, 25 bp, Homo sapien
tgagccgagaactggagcccgagct

SEQ ID NO: 231284 - DNA, 25 bp, Homo sapien
cgccgccgctacgaatacgatcact

SEQ ID NO: 231285 - DNA, 25 bp, Homo sapien
acagctaataaaggtgacactccag

SEQ ID NO: 231286 - DNA, 25 bp, Homo sapien
aataaaggtgacactccagggcagg

SEQ ID NO: 231287 - DNA, 25 bp, Homo sapien
tcagctgtgctattgggtttctttg

SEQ ID NO: 231288 - DNA, 25 bp, Homo sapien
tctttgacttggatgtcttgagcat

SEQ ID NO: 231289 - DNA, 25 bp, Homo sapien
atgtcttgagcatgaaatgggctat

SEQ ID NO: 231290 - DNA, 25 bp, Homo sapien
aatgggctatttagagtgttacctc

SEQ ID NO: 231291 - DNA, 25 bp, Homo sapien
tagagtgttacctctcactgtgact

SEQ ID NO: 231292 - DNA, 25 bp, Homo sapien
gtgttacctctcactgtgactgata

SEQ ID NO: 231293 - DNA, 25 bp, Homo sapien
cctctcactgtgactgatacgaatt

SEQ ID NO: 231294 - DNA, 25 bp, Homo sapien
cactgtgactgatacgaatttgttc

SEQ ID NO: 231295 - DNA, 25 bp, Homo sapien
gactgatacgaatttgttcatgaat

SEQ ID NO: 231296 - DNA, 25 bp, Homo sapien
gggaacaactggctattcagtacca

SEQ ID NO: 231297 - DNA, 25 bp, Homo sapien
acaactggctattcagtaccaaggg

SEQ ID NO: 231298 - DNA, 25 bp, Homo sapien
gagggtaggagtgccactctctctt

SEQ ID NO: 231299 - DNA, 25 bp, Homo sapien
taggagtgccactctctctttggtt

SEQ ID NO: 231300 - DNA, 25 bp, Homo sapien
agtgccactctctctttggtttagg

SEQ ID NO: 231301 - DNA, 25 bp, Homo sapien
gccactctctctttggtttaggttt

SEQ ID NO: 231302 - DNA, 25 bp, Homo sapien
tctgtacttaccacagtattttgca

SEQ ID NO: 231303 - DNA, 25 bp, Homo sapien
acttaccacagtattttgcacttga

SEQ ID NO: 231304 - DNA, 25 bp, Homo sapien
accacagtattttgcacttgattac

SEQ ID NO: 231305 - DNA, 25 bp, Homo sapien
gtattttgcacttgattacatatcc

SEQ ID NO: 231306 - DNA, 25 bp, Homo sapien
attttgcacttgattacatatcctt

SEQ ID NO: 231307 - DNA, 25 bp, Homo sapien
tggtgttacctcaccggggaccagg

SEQ ID NO: 231308 - DNA, 25 bp, Homo sapien
aaagctggaacaacagaggcgtgtt

SEQ ID NO: 231309 - DNA, 25 bp, Homo sapien
gggacaaaacctctgcctgagatcc

SEQ ID NO: 231310 - DNA, 25 bp, Homo sapien
tgcctgagatcccaccccaggtggg

SEQ ID NO: 231311 - DNA, 25 bp, Homo sapien
agatcccaccccaggtgggcatggg

SEQ ID NO: 231312 - DNA, 25 bp, Homo sapien
atgaaaatgccggtaccgtcagtgc

SEQ ID NO: 231313 - DNA, 25 bp, Homo sapien
aaaatgccggtaccgtcagtgcaca

SEQ ID NO: 231314 - DNA, 25 bp, Homo sapien
atgccggtaccgtcagtgcacagcc

SEQ ID NO: 231315 - DNA, 25 bp, Homo sapien
agtgcacagccctgttccagacagt

SEQ ID NO: 231316 - DNA, 25 bp, Homo sapien
gctggaaagagacagatggcaccct

SEQ ID NO: 231317 - DNA, 25 bp, Homo sapien
gagacagatggcaccctgagacagc

SEQ ID NO: 231318 - DNA, 25 bp, Homo sapien
ggagggtggatgaggtggaacaatc

SEQ ID NO: 231319 - DNA, 25 bp, Homo sapien
gtggaacaatcaccgaaacccaaga

SEQ ID NO: 231320 - DNA, 25 bp, Homo sapien
ggaacaatcaccgaaacccaagagg

SEQ ID NO: 231321 - DNA, 25 bp, Homo sapien
gaacaatcaccgaaacccaagaggc

SEQ ID NO: 231322 - DNA, 25 bp, Homo sapien
gcggatgaggtggaacaatcgccca

SEQ ID NO: 231323 - DNA, 25 bp, Homo sapien
cggatgaggtggaacaatcgcccaa

SEQ ID NO: 231324 - DNA, 25 bp, Homo sapien
aggtggaacaatcgcccaagcccaa

SEQ ID NO: 231325 - DNA, 25 bp, Homo sapien
ggaacaatcgcccaagcccaagagg

SEQ ID NO: 231326 - DNA, 25 bp, Homo sapien
gaacaatcgcccaagcccaagaggc

SEQ ID NO: 231327 - DNA, 25 bp, Homo sapien
gaggccgaggcacaacaattaccca

SEQ ID NO: 231328 - DNA, 25 bp, Homo sapien
gaggttgagtaagctgagaacacgc

SEQ ID NO: 231329 - DNA, 25 bp, Homo sapien
tcgaccctctgtcgtcctgggatgg

SEQ ID NO: 231330 - DNA, 25 bp, Homo sapien
ctctgtcgtcctgggatggctgtcg

SEQ ID NO: 231331 - DNA, 25 bp, Homo sapien
tgtatcacctgggttctgtcccctg

SEQ ID NO: 231332 - DNA, 25 bp, Homo sapien
acctgggttctgtcccctggctctg

SEQ ID NO: 231333 - DNA, 25 bp, Homo sapien
ctggctctgtatcaggcactttatt

SEQ ID NO: 231334 - DNA, 25 bp, Homo sapien
gcactttattaaagctgggcctcag

SEQ ID NO: 231335 - DNA, 25 bp, Homo sapien
gggtgtgtttgtctcctgctcttct

SEQ ID NO: 231336 - DNA, 25 bp, Homo sapien
cagcagctagccattgcacactggg

SEQ ID NO: 231337 - DNA, 25 bp, Homo sapien
gactgccccagacttggttttgtaa

SEQ ID NO: 231338 - DNA, 25 bp, Homo sapien
gccccagacttggttttgtaatgat

SEQ ID NO: 231339 - DNA, 25 bp, Homo sapien
gtacaggaataaacacacctacgct

SEQ ID NO: 231340 - DNA, 25 bp, Homo sapien
gaagatggactgttgaaattgtata

SEQ ID NO: 231341 - DNA, 25 bp, Homo sapien
ggactgttgaaattgtataggacca

SEQ ID NO: 231342 - DNA, 25 bp, Homo sapien
gaaattgtataggaccagtgtctta

SEQ ID NO: 231343 - DNA, 25 bp, Homo sapien
ggaccagtgtcttattaatatgatt

SEQ ID NO: 231344 - DNA, 25 bp, Homo sapien
gtgaaacccatgacaaaatgaatgt

SEQ ID NO: 231345 - DNA, 25 bp, Homo sapien
aatgaatgtgaatattctttctaaa

SEQ ID NO: 231346 - DNA, 25 bp, Homo sapien
atgccatgaaacatttgaactgatg

SEQ ID NO: 231347 - DNA, 25 bp, Homo sapien
ttgaactgatgagccacagaacttc

SEQ ID NO: 231348 - DNA, 25 bp, Homo sapien
gatgagccacagaacttcagttgaa

SEQ ID NO: 231349 - DNA, 25 bp, Homo sapien
gcatgctaaatatacatctgagttt

SEQ ID NO: 231350 - DNA, 25 bp, Homo sapien
catctgagtttaaatgttctgttta

SEQ ID NO: 231351 - DNA, 25 bp, Homo sapien
ggtgattgatttctatgctccttgg

SEQ ID NO: 231352 - DNA, 25 bp, Homo sapien
tccttggtgtggaccttgccagaat

SEQ ID NO: 231353 - DNA, 25 bp, Homo sapien
gaccttgccagaattttgctccaga

SEQ ID NO: 231354 - DNA, 25 bp, Homo sapien
cttgccagaattttgctccagaatt

SEQ ID NO: 231355 - DNA, 25 bp, Homo sapien
ctccagaatttgagctcttggctag

SEQ ID NO: 231356 - DNA, 25 bp, Homo sapien
atttgagctcttggctaggatgatt

SEQ ID NO: 231357 - DNA, 25 bp, Homo sapien
gtgaaagctggaaaagtagactgtc

SEQ ID NO: 231358 - DNA, 25 bp, Homo sapien
tagactgtcaggcttatgctcagac

SEQ ID NO: 231359 - DNA, 25 bp, Homo sapien
gtcaggcttatgctcagacatgcca

SEQ ID NO: 231360 - DNA, 25 bp, Homo sapien
tatgctcagacatgccagaaagctg

SEQ ID NO: 231361 - DNA, 25 bp, Homo sapien
ggatcagggcctatccaactgttaa

SEQ ID NO: 231362 - DNA, 25 bp, Homo sapien
agttcttaggatatgcccagcacca

SEQ ID NO: 231363 - DNA, 25 bp, Homo sapien
gatatgcccagcaccaggcggaaga

SEQ ID NO: 231364 - DNA, 25 bp, Homo sapien
agcaccaggcggaagatattgtgtc

SEQ ID NO: 231365 - DNA, 25 bp, Homo sapien
tattgtgtcagcaaattccatagca

SEQ ID NO: 231366 - DNA, 25 bp, Homo sapien
ggtcaagttgcaggaatcactgtct

SEQ ID NO: 231367 - DNA, 25 bp, Homo sapien
atcactgtctaagcatgacagccat

SEQ ID NO: 231368 - DNA, 25 bp, Homo sapien
ccatacaaagcttctctccatgagg

SEQ ID NO: 231369 - DNA, 25 bp, Homo sapien
ggagattccaaaccttagaccttca

SEQ ID NO: 231370 - DNA, 25 bp, Homo sapien
gaccttcactcagattagtgcagaa

SEQ ID NO: 231371 - DNA, 25 bp, Homo sapien
gcagaatctctgtgaaggtgcattg

SEQ ID NO: 231372 - DNA, 25 bp, Homo sapien
tgtgaaggtgcattgtccctggctg

SEQ ID NO: 231373 - DNA, 25 bp, Homo sapien
ctgtggatcgggaagcctggtgaca

SEQ ID NO: 231374 - DNA, 25 bp, Homo sapien
tgtggatcgggaagcctggtgacaa

SEQ ID NO: 231375 - DNA, 25 bp, Homo sapien
gtggatcgggaagcctggtgacaag

SEQ ID NO: 231376 - DNA, 25 bp, Homo sapien
ggatcgggaagcctggtgacaagcc

SEQ ID NO: 231377 - DNA, 25 bp, Homo sapien
ctcaggagactacgtggccagacct

SEQ ID NO: 231378 - DNA, 25 bp, Homo sapien
tcaggagactacgtggccagacctg

SEQ ID NO: 231379 - DNA, 25 bp, Homo sapien
caggagactacgtggccagacctgg

SEQ ID NO: 231380 - DNA, 25 bp, Homo sapien
aggagactacgtggccagacctgga

SEQ ID NO: 231381 - DNA, 25 bp, Homo sapien
agactacgtggccagacctggagac

SEQ ID NO: 231382 - DNA, 25 bp, Homo sapien
gactacgtggccagacctggagaca

SEQ ID NO: 231383 - DNA, 25 bp, Homo sapien
actacgtggccagacctggagacaa

SEQ ID NO: 231384 - DNA, 25 bp, Homo sapien
tccccagtttttctctaagatatac

SEQ ID NO: 231385 - DNA, 25 bp, Homo sapien
ttttctctaagatatacagtgcaat

SEQ ID NO: 231386 - DNA, 25 bp, Homo sapien
agatatacagtgcaatagctcccca

SEQ ID NO: 231387 - DNA, 25 bp, Homo sapien
atatacagtgcaatagctccccacc

SEQ ID NO: 231388 - DNA, 25 bp, Homo sapien
cagttgacgccagccctgtaaagct

SEQ ID NO: 231389 - DNA, 25 bp, Homo sapien
cgagagtcggcctggacttccctgg

SEQ ID NO: 231390 - DNA, 25 bp, Homo sapien
ggtgctccaggccagagctctttca

SEQ ID NO: 231391 - DNA, 25 bp, Homo sapien
tccaggccagagctctttcattggg

SEQ ID NO: 231392 - DNA, 25 bp, Homo sapien
gggacgtccttggtcttgcacgcac

SEQ ID NO: 231393 - DNA, 25 bp, Homo sapien
tggtcttgcacgcacactacctggg

SEQ ID NO: 231394 - DNA, 25 bp, Homo sapien
ggatgggtccgtagaggtcccacct

SEQ ID NO: 231395 - DNA, 25 bp, Homo sapien
aaattatagcaattaactgggcatt

SEQ ID NO: 231396 - DNA, 25 bp, Homo sapien
aactgggcattgtagagtatcctaa

SEQ ID NO: 231397 - DNA, 25 bp, Homo sapien
gagtatcctaaatatgttatcaagt

SEQ ID NO: 231398 - DNA, 25 bp, Homo sapien
gctttcatagaaattttcccactga

SEQ ID NO: 231399 - DNA, 25 bp, Homo sapien
cccactgatagttgatttttgaggc

SEQ ID NO: 231400 - DNA, 25 bp, Homo sapien
ttttgaggcatctaatatttacata

SEQ ID NO: 231401 - DNA, 25 bp, Homo sapien
ttacatatttgccttctgaactttg

SEQ ID NO: 231402 - DNA, 25 bp, Homo sapien
ctttgttttgacctgtatcctttat

SEQ ID NO: 231403 - DNA, 25 bp, Homo sapien
ttttggtttttcactcctgtccagt

SEQ ID NO: 231404 - DNA, 25 bp, Homo sapien
ttttcactcctgtccagtctattta

SEQ ID NO: 231405 - DNA, 25 bp, Homo sapien
ctcctgtccagtctatttattattc

SEQ ID NO: 231406 - DNA, 25 bp, Homo sapien
tttccggctccgaggcgcagagaag

SEQ ID NO: 231407 - DNA, 25 bp, Homo sapien
gaaggcaccatccatcagcccaggg

SEQ ID NO: 231408 - DNA, 25 bp, Homo sapien
aaggcaccatccatcagcccaggga

SEQ ID NO: 231409 - DNA, 25 bp, Homo sapien
gggagggtaccacctgggcacctgg

SEQ ID NO: 231410 - DNA, 25 bp, Homo sapien
ggctggatgtgagaggcctggacca

SEQ ID NO: 231411 - DNA, 25 bp, Homo sapien
tgtgagaggcctggaccagggcccg

SEQ ID NO: 231412 - DNA, 25 bp, Homo sapien
ctcatgtgttcctgggtgcagtgtc

SEQ ID NO: 231413 - DNA, 25 bp, Homo sapien
gttcctgggtgcagtgtctgtgttg

SEQ ID NO: 231414 - DNA, 25 bp, Homo sapien
gggtgcatggagggcatggccccag

SEQ ID NO: 231415 - DNA, 25 bp, Homo sapien
tccggctggttggtccctgtgctgc

SEQ ID NO: 231416 - DNA, 25 bp, Homo sapien
gtgtccacatttccggctccgaggc

SEQ ID NO: 231417 - DNA, 25 bp, Homo sapien
gtttgtcgtcgtcctacaaatgagg

SEQ ID NO: 231418 - DNA, 25 bp, Homo sapien
aggaaaccgagcctatggcgtgccc

SEQ ID NO: 231419 - DNA, 25 bp, Homo sapien
cgtgccctggtctgttgagatatgc

SEQ ID NO: 231420 - DNA, 25 bp, Homo sapien
atatgcaagcactgagctcctcttt

SEQ ID NO: 231421 - DNA, 25 bp, Homo sapien
tcttttgtcctctgagaccccatct

SEQ ID NO: 231422 - DNA, 25 bp, Homo sapien
acatttccctccttagagatccagg

SEQ ID NO: 231423 - DNA, 25 bp, Homo sapien
ttaaaattcaacacccaccaggctc

SEQ ID NO: 231424 - DNA, 25 bp, Homo sapien
accaggctctaagcggcgatctgtg

SEQ ID NO: 231425 - DNA, 25 bp, Homo sapien
agcggcgatctgtgctaagaggtca

SEQ ID NO: 231426 - DNA, 25 bp, Homo sapien
gaggtcaggacccagccgaagtcct

SEQ ID NO: 231427 - DNA, 25 bp, Homo sapien
gaagtcctcggcgttgacaggcagc

SEQ ID NO: 231428 - DNA, 25 bp, Homo sapien
ggaagccgctggacgtgatctccgt

SEQ ID NO: 231429 - DNA, 25 bp, Homo sapien
ctggacgtgatctccgtggcatgga

SEQ ID NO: 231430 - DNA, 25 bp, Homo sapien
acgtgatctccgtggcatggagctg

SEQ ID NO: 231431 - DNA, 25 bp, Homo sapien
aatggagcccctcagctcttggaca

SEQ ID NO: 231432 - DNA, 25 bp, Homo sapien
cctcagctcttggacaatgatgtgc

SEQ ID NO: 231433 - DNA, 25 bp, Homo sapien
aatgatgtgcaggtcatccacgtcc

SEQ ID NO: 231434 - DNA, 25 bp, Homo sapien
gtcatccacgtccacaaagtgcagg

SEQ ID NO: 231435 - DNA, 25 bp, Homo sapien
caaagtgcaggtgcttctcggcagg

SEQ ID NO: 231436 - DNA, 25 bp, Homo sapien
acagctccaggaagttgcctcggcc

SEQ ID NO: 231437 - DNA, 25 bp, Homo sapien
agccagccagcaagctcagggccag

SEQ ID NO: 231438 - DNA, 25 bp, Homo sapien
gccagcaagctcagggccaggccga

SEQ ID NO: 231439 - DNA, 25 bp, Homo sapien
ccggagaacccacaataatagaaat

SEQ ID NO: 231440 - DNA, 25 bp, Homo sapien
tagaaatcttttcgtgttccccatt

SEQ ID NO: 231441 - DNA, 25 bp, Homo sapien
gtgttccccattgagaaatgcttta

SEQ ID NO: 231442 - DNA, 25 bp, Homo sapien
gttagcatcttcatgcttggaaatc

SEQ ID NO: 231443 - DNA, 25 bp, Homo sapien
ggaattcggaaagcctgcagttgac

SEQ ID NO: 231444 - DNA, 25 bp, Homo sapien
gcagttgacattcagtcttcacttg

SEQ ID NO: 231445 - DNA, 25 bp, Homo sapien
aactgacactaggaacagcttcatg

SEQ ID NO: 231446 - DNA, 25 bp, Homo sapien
gctttatttgtagcttctgccttgt

SEQ ID NO: 231447 - DNA, 25 bp, Homo sapien
tctgccttgtttgacggcgtatcta

SEQ ID NO: 231448 - DNA, 25 bp, Homo sapien
gacggcgtatctattcagggaagcg

SEQ ID NO: 231449 - DNA, 25 bp, Homo sapien
gaagcgcacagtaaaagaattcctt

SEQ ID NO: 231450 - DNA, 25 bp, Homo sapien
tcagtatgatgatttttgcagccac

SEQ ID NO: 231451 - DNA, 25 bp, Homo sapien
ttttgcagccacttggctatggaga

SEQ ID NO: 231452 - DNA, 25 bp, Homo sapien
tggctatggagagcagccgacaccc

SEQ ID NO: 231453 - DNA, 25 bp, Homo sapien
ctcttacagccgtggatgtttcctg

SEQ ID NO: 231454 - DNA, 25 bp, Homo sapien
ggaagctgactcagtctgttcactg

SEQ ID NO: 231455 - DNA, 25 bp, Homo sapien
gactcagtctgttcactggttgagc

SEQ ID NO: 231456 - DNA, 25 bp, Homo sapien
tctgttcactggttgagctttgagt

SEQ ID NO: 231457 - DNA, 25 bp, Homo sapien
agcttgagtcagaggaagccgagac

SEQ ID NO: 231458 - DNA, 25 bp, Homo sapien
aagccgagacaatatccttcctcga

SEQ ID NO: 231459 - DNA, 25 bp, Homo sapien
aatatccttcctcgacaacgtgcga

SEQ ID NO: 231460 - DNA, 25 bp, Homo sapien
tcgacaacgtgcgagaaccctgacg

SEQ ID NO: 231461 - DNA, 25 bp, Homo sapien
acgtgacagccccttatgcagagga

SEQ ID NO: 231462 - DNA, 25 bp, Homo sapien
gacagccccttatgcagaggaggaa

SEQ ID NO: 231463 - DNA, 25 bp, Homo sapien
cagccccttatgcagaggaggaaag

SEQ ID NO: 231464 - DNA, 25 bp, Homo sapien
gggaacctgtccaaagtcacacggt

SEQ ID NO: 231465 - DNA, 25 bp, Homo sapien
acctgtccaaagtcacacggtgtgt

SEQ ID NO: 231466 - DNA, 25 bp, Homo sapien
ggtgagtcgaggctggcccctgagg

SEQ ID NO: 231467 - DNA, 25 bp, Homo sapien
atgctccctgaacgctggagaccac

SEQ ID NO: 231468 - DNA, 25 bp, Homo sapien
gaacgctggagaccactgtcggcta

SEQ ID NO: 231469 - DNA, 25 bp, Homo sapien
tggagaccactgtcggctagcagcg

SEQ ID NO: 231470 - DNA, 25 bp, Homo sapien
actgtcggctagcagcggctctcag

SEQ ID NO: 231471 - DNA, 25 bp, Homo sapien
gctctcagggaaggcctggtctcca

SEQ ID NO: 231472 - DNA, 25 bp, Homo sapien
ggaggcatagaaagtgccaacattt

SEQ ID NO: 231473 - DNA, 25 bp, Homo sapien
ccaacatttggctacacagggaaga

SEQ ID NO: 231474 - DNA, 25 bp, Homo sapien
cattggcatcacctgtagactcaaa

SEQ ID NO: 231475 - DNA, 25 bp, Homo sapien
catcacctgtagactcaaatcctgt

SEQ ID NO: 231476 - DNA, 25 bp, Homo sapien
aatcctgtgagtgaaggacctgagc

SEQ ID NO: 231477 - DNA, 25 bp, Homo sapien
ggattgaactcgtgattagccttct

SEQ ID NO: 231478 - DNA, 25 bp, Homo sapien
gattagccttcttcagcatatgtaa

SEQ ID NO: 231479 - DNA, 25 bp, Homo sapien
gtaaaatgatgtctgcttttcttct

SEQ ID NO: 231480 - DNA, 25 bp, Homo sapien
aacagaccatgtgcgctggagaaaa

SEQ ID NO: 231481 - DNA, 25 bp, Homo sapien
ggatggccagacttgcagaaacctg

SEQ ID NO: 231482 - DNA, 25 bp, Homo sapien
acctggaattggtgattggctttag

SEQ ID NO: 231483 - DNA, 25 bp, Homo sapien
aggctgtttctctgaggcggcaccg

SEQ ID NO: 231484 - DNA, 25 bp, Homo sapien
gcaccgccagatgcatgaggtccgt

SEQ ID NO: 231485 - DNA, 25 bp, Homo sapien
tggcaccttcgcctgcacagagtgc

SEQ ID NO: 231486 - DNA, 25 bp, Homo sapien
cagagtgcggtcaggactttgctca

SEQ ID NO: 231487 - DNA, 25 bp, Homo sapien
actttgctcaggaagcagggctgca

SEQ ID NO: 231488 - DNA, 25 bp, Homo sapien
agcagggctgcatcaacactacatt

SEQ ID NO: 231489 - DNA, 25 bp, Homo sapien
tcaacactacattcggcatgcccgg

SEQ ID NO: 231490 - DNA, 25 bp, Homo sapien
agctctgagtgcagcttaagcctct

SEQ ID NO: 231491 - DNA, 25 bp, Homo sapien
ttaagcctctccacggtgacgggtg

SEQ ID NO: 231492 - DNA, 25 bp, Homo sapien
ctctgtggctggtaggactcaccca

SEQ ID NO: 231493 - DNA, 25 bp, Homo sapien
ctgggaaggcagagggctcttaata

SEQ ID NO: 231494 - DNA, 25 bp, Homo sapien
gaccaaggacaacaggaggcatttg

SEQ ID NO: 231495 - DNA, 25 bp, Homo sapien
aacaggaggcatttgctcttccagg

SEQ ID NO: 231496 - DNA, 25 bp, Homo sapien
ggaggcatttgctcttccagggtaa

SEQ ID NO: 231497 - DNA, 25 bp, Homo sapien
gcatttgctcttccagggtaagcat

SEQ ID NO: 231498 - DNA, 25 bp, Homo sapien
attcagatctgggtggctcagggcc

SEQ ID NO: 231499 - DNA, 25 bp, Homo sapien
gcaggagattcagcacctagtgtct

SEQ ID NO: 231500 - DNA, 25 bp, Homo sapien
tcaggcttgaagtccaggttagggc

SEQ ID NO: 231501 - DNA, 25 bp, Homo sapien
gaagtccaggttagggctgccatcc

SEQ ID NO: 231502 - DNA, 25 bp, Homo sapien
gttagggctgccatcctcattgaga

SEQ ID NO: 231503 - DNA, 25 bp, Homo sapien
cctcattgagaattctccgggcagt

SEQ ID NO: 231504 - DNA, 25 bp, Homo sapien
ttctccgggcagtgtagccgacgat

SEQ ID NO: 231505 - DNA, 25 bp, Homo sapien
tttttggcagaacactcagatgaac

SEQ ID NO: 231506 - DNA, 25 bp, Homo sapien
agatgaacggattcctatgctgtgg

SEQ ID NO: 231507 - DNA, 25 bp, Homo sapien
tcattctttttgatggctgatagta

SEQ ID NO: 231508 - DNA, 25 bp, Homo sapien
tgatagtagaaagcacacagtaggt

SEQ ID NO: 231509 - DNA, 25 bp, Homo sapien
gtaggtactccataaatgtaagact

SEQ ID NO: 231510 - DNA, 25 bp, Homo sapien
aagactatggcagctgtctagtaca

SEQ ID NO: 231511 - DNA, 25 bp, Homo sapien
gctgtctagtacaagtgcttctcac

SEQ ID NO: 231512 - DNA, 25 bp, Homo sapien
gcttctcactgattcttggttacca

SEQ ID NO: 231513 - DNA, 25 bp, Homo sapien
agaaagcccgtcacttgccttgcct

SEQ ID NO: 231514 - DNA, 25 bp, Homo sapien
gcccttgtcactgatggtgacacta

SEQ ID NO: 231515 - DNA, 25 bp, Homo sapien
ggtgacactacttgtaattactgta

SEQ ID NO: 231516 - DNA, 25 bp, Homo sapien
tatgggccccgagaaacactgagga

SEQ ID NO: 231517 - DNA, 25 bp, Homo sapien
aacactgaggacacacggcgttctg

SEQ ID NO: 231518 - DNA, 25 bp, Homo sapien
acggcgttctgcacacagagtgggc

SEQ ID NO: 231519 - DNA, 25 bp, Homo sapien
acagagtgggctgtttctgtctgtt

SEQ ID NO: 231520 - DNA, 25 bp, Homo sapien
tgcacccttctcagatgcaatctca

SEQ ID NO: 231521 - DNA, 25 bp, Homo sapien
tcagatgcaatctcaagtcatagga

SEQ ID NO: 231522 - DNA, 25 bp, Homo sapien
gaacttgtgcaaatgtttctcctgg

SEQ ID NO: 231523 - DNA, 25 bp, Homo sapien
aatgtttctcctggatggtttcctt

SEQ ID NO: 231524 - DNA, 25 bp, Homo sapien
tggtttcctttagagcatgtgtcct

SEQ ID NO: 231525 - DNA, 25 bp, Homo sapien
gagcatgtgtcctataacttgaaat

SEQ ID NO: 231526 - DNA, 25 bp, Homo sapien
aacttgaaatggttgtctgagcaga

SEQ ID NO: 231527 - DNA, 25 bp, Homo sapien
catgcctaagtgacttcttgaggtg

SEQ ID NO: 231528 - DNA, 25 bp, Homo sapien
cttcttgaggtgagattgttctgtc

SEQ ID NO: 231529 - DNA, 25 bp, Homo sapien
ttgttctgtcagaaaaccctctccc

SEQ ID NO: 231530 - DNA, 25 bp, Homo sapien
tctgtcagaaaaccctctcccagtt

SEQ ID NO: 231531 - DNA, 25 bp, Homo sapien
tgctttgtttagaattcccacctca

SEQ ID NO: 231532 - DNA, 25 bp, Homo sapien
ttgtttagaattcccacctcatttt

SEQ ID NO: 231533 - DNA, 25 bp, Homo sapien
ttagaattcccacctcatttttcca

SEQ ID NO: 231534 - DNA, 25 bp, Homo sapien
aaaagtattctttatgtcctagtgc

SEQ ID NO: 231535 - DNA, 25 bp, Homo sapien
gtattctttatgtcctagtgcactt

SEQ ID NO: 231536 - DNA, 25 bp, Homo sapien
attctttatgtcctagtgcacttac

SEQ ID NO: 231537 - DNA, 25 bp, Homo sapien
ttatgtcctagtgcacttacaattt

SEQ ID NO: 231538 - DNA, 25 bp, Homo sapien
tctgtttcatgcattatggctcagt

SEQ ID NO: 231539 - DNA, 25 bp, Homo sapien
ttatggctcagtgagcagctggctg

SEQ ID NO: 231540 - DNA, 25 bp, Homo sapien
ccagagtcggccgttttatgattaa

SEQ ID NO: 231541 - DNA, 25 bp, Homo sapien
taatgacctaggtattcccctttgg

SEQ ID NO: 231542 - DNA, 25 bp, Homo sapien
cctttggccccaagatagctagatt

SEQ ID NO: 231543 - DNA, 25 bp, Homo sapien
gatagctagattagccacctgcttt

SEQ ID NO: 231544 - DNA, 25 bp, Homo sapien
gattagccacctgctttgatcaggt

SEQ ID NO: 231545 - DNA, 25 bp, Homo sapien
ttgatcaggtgactccacagctgtg

SEQ ID NO: 231546 - DNA, 25 bp, Homo sapien
cagctgtgcatgtgtgctttgtgct

SEQ ID NO: 231547 - DNA, 25 bp, Homo sapien
tgctgaagaagccaaaactaagaca

SEQ ID NO: 231548 - DNA, 25 bp, Homo sapien
gaacttcttgttatctaatagggaa

SEQ ID NO: 231549 - DNA, 25 bp, Homo sapien
tgatgtcaaaatggggctggtcttc

SEQ ID NO: 231550 - DNA, 25 bp, Homo sapien
tcaggcttgaagtccaggttagggc

SEQ ID NO: 231551 - DNA, 25 bp, Homo sapien
tgaagtccaggttagggctgccatc

SEQ ID NO: 231552 - DNA, 25 bp, Homo sapien
aagtccaggttagggctgccatcct

SEQ ID NO: 231553 - DNA, 25 bp, Homo sapien
caggttagggctgccatcctcattg

SEQ ID NO: 231554 - DNA, 25 bp, Homo sapien
gttagggctgccatcctcattgaga

SEQ ID NO: 231555 - DNA, 25 bp, Homo sapien
cctcattgagaattctccgggcagt

SEQ ID NO: 231556 - DNA, 25 bp, Homo sapien
attgagaattctccgggcagtgtag

SEQ ID NO: 231557 - DNA, 25 bp, Homo sapien
aattctccgggcagtgtagccgacg

SEQ ID NO: 231558 - DNA, 25 bp, Homo sapien
tctccgggcagtgtagccgacgatg

SEQ ID NO: 231559 - DNA, 25 bp, Homo sapien
cgatggggtatttggctttgtacac

SEQ ID NO: 231560 - DNA, 25 bp, Homo sapien
ttgcccaagtctggccaggctgatg

SEQ ID NO: 231561 - DNA, 25 bp, Homo sapien
agcgaggagtctctgcaccttgaca

SEQ ID NO: 231562 - DNA, 25 bp, Homo sapien
gagtctctgcaccttgacattcaga

SEQ ID NO: 231563 - DNA, 25 bp, Homo sapien
aaggagatctcccagttcgtatctg

SEQ ID NO: 231564 - DNA, 25 bp, Homo sapien
tcccagttcgtatctgaaggctaca

SEQ ID NO: 231565 - DNA, 25 bp, Homo sapien
atgaactggaggaccacattaccca

SEQ ID NO: 231566 - DNA, 25 bp, Homo sapien
acattacccagcttcacgagtacaa

SEQ ID NO: 231567 - DNA, 25 bp, Homo sapien
gcagatgctgatgggcaaactagct

SEQ ID NO: 231568 - DNA, 25 bp, Homo sapien
aaactagctgtgatccgaggtgtca

SEQ ID NO: 231569 - DNA, 25 bp, Homo sapien
tgatccgaggtgtcaccaccaaaga

SEQ ID NO: 231570 - DNA, 25 bp, Homo sapien
caccaaagagttgtatccagagttt

SEQ ID NO: 231571 - DNA, 25 bp, Homo sapien
tccccagtttttctctaagatatac

SEQ ID NO: 231572 - DNA, 25 bp, Homo sapien
ttttctctaagatatacagtgcaat

SEQ ID NO: 231573 - DNA, 25 bp, Homo sapien
agatatacagtgcaatagctcccca

SEQ ID NO: 231574 - DNA, 25 bp, Homo sapien
atatacagtgcaatagctccccacc

SEQ ID NO: 231575 - DNA, 25 bp, Homo sapien
cagttgacgccagccctgtaaagct

SEQ ID NO: 231576 - DNA, 25 bp, Homo sapien
ggtgctccaggccagagctctttca

SEQ ID NO: 231577 - DNA, 25 bp, Homo sapien
tccaggccagagctctttcattggg

SEQ ID NO: 231578 - DNA, 25 bp, Homo sapien
gggacgtccttggtcttgcacgcac

SEQ ID NO: 231579 - DNA, 25 bp, Homo sapien
acgtccttggtcttgcacgcacact

SEQ ID NO: 231580 - DNA, 25 bp, Homo sapien
tggtcttgcacgcacactacctggg

SEQ ID NO: 231581 - DNA, 25 bp, Homo sapien
gcacgcacactacctgggggagtca

SEQ ID NO: 231582 - DNA, 25 bp, Homo sapien
tagactaccacccactgtaaatgtt

SEQ ID NO: 231583 - DNA, 25 bp, Homo sapien
accacccactgtaaatgtttgcaag

SEQ ID NO: 231584 - DNA, 25 bp, Homo sapien
gtaaatgtttgcaagtggctgtgtt

SEQ ID NO: 231585 - DNA, 25 bp, Homo sapien
atgggattattacagttgatctcta

SEQ ID NO: 231586 - DNA, 25 bp, Homo sapien
acagttgatctctatgaatgtcaga

SEQ ID NO: 231587 - DNA, 25 bp, Homo sapien
ctatgaatgtcagagccctaacttt

SEQ ID NO: 231588 - DNA, 25 bp, Homo sapien
gtcagagccctaactttcaggcttt

SEQ ID NO: 231589 - DNA, 25 bp, Homo sapien
gaagaaatatgacaatcctaggtaa

SEQ ID NO: 231590 - DNA, 25 bp, Homo sapien
gacaatcctaggtaattaaaccata

SEQ ID NO: 231591 - DNA, 25 bp, Homo sapien
tttttcagcttcatctgcagttcta

SEQ ID NO: 231592 - DNA, 25 bp, Homo sapien
cagcttcatctgcagttctatgtga

SEQ ID NO: 231593 - DNA, 25 bp, Homo sapien
gtatgggtatcttctaagactaaat

SEQ ID NO: 231594 - DNA, 25 bp, Homo sapien
gagcaaatgttatgggttcttaccc

SEQ ID NO: 231595 - DNA, 25 bp, Homo sapien
tatgggttcttacccaaagagtcaa

SEQ ID NO: 231596 - DNA, 25 bp, Homo sapien
gagcagagttattcatgactgttct

SEQ ID NO: 231597 - DNA, 25 bp, Homo sapien
catgactgttctttatacactaaaa

SEQ ID NO: 231598 - DNA, 25 bp, Homo sapien
gcatgcatctaatctaatagtcctc

SEQ ID NO: 231599 - DNA, 25 bp, Homo sapien
atagtcctcttattatgcttttagt

SEQ ID NO: 231600 - DNA, 25 bp, Homo sapien
tgcttttagttgtatgagtctcttt

SEQ ID NO: 231601 - DNA, 25 bp, Homo sapien
gagtctctttctatgaactgaacac

SEQ ID NO: 231602 - DNA, 25 bp, Homo sapien
tggtggcttaattttagatcagtgc

SEQ ID NO: 231603 - DNA, 25 bp, Homo sapien
gatcagtgcttgtactaggcttagt

SEQ ID NO: 231604 - DNA, 25 bp, Homo sapien
tgattcataatttgtgacactgtaa

SEQ ID NO: 231605 - DNA, 25 bp, Homo sapien
tgtgacactgtaaatcctgaggttt

SEQ ID NO: 231606 - DNA, 25 bp, Homo sapien
aaggattcatgactttgtaatggag

SEQ ID NO: 231607 - DNA, 25 bp, Homo sapien
aaatcattatttccagatcctggaa

SEQ ID NO: 231608 - DNA, 25 bp, Homo sapien
ccagatcctggaagaatctatagaa

SEQ ID NO: 231609 - DNA, 25 bp, Homo sapien
aatccatcttaatgctttagagaac

SEQ ID NO: 231610 - DNA, 25 bp, Homo sapien
gaatgagcattgttgtagactccat

SEQ ID NO: 231611 - DNA, 25 bp, Homo sapien
gttgtagactccattatcatttaaa

SEQ ID NO: 231612 - DNA, 25 bp, Homo sapien
gttgttatctgcaaagtaagtacgc

SEQ ID NO: 231613 - DNA, 25 bp, Homo sapien
ctgcaaagtaagtacgcttcacata

SEQ ID NO: 231614 - DNA, 25 bp, Homo sapien
gtacgcttcacataaggaatctgca

SEQ ID NO: 231615 - DNA, 25 bp, Homo sapien
gtttgaccagggaaccacgggctgt

SEQ ID NO: 231616 - DNA, 25 bp, Homo sapien
gaaccacgggctgtcccttgaggtg

SEQ ID NO: 231617 - DNA, 25 bp, Homo sapien
ggctgtcccttgaggtgcctggaca

SEQ ID NO: 231618 - DNA, 25 bp, Homo sapien
taagggggtgcttccagcctcctaa

SEQ ID NO: 231619 - DNA, 25 bp, Homo sapien
agcctcctaacccaaagccagctgt

SEQ ID NO: 231620 - DNA, 25 bp, Homo sapien
gtgtggccaggctgctcctcgagga

SEQ ID NO: 231621 - DNA, 25 bp, Homo sapien
ctgctcctcgaggaggctgggagct

SEQ ID NO: 231622 - DNA, 25 bp, Homo sapien
ggccgactgcaaaagccagactggg

SEQ ID NO: 231623 - DNA, 25 bp, Homo sapien
caacactcggactccctctttaaga

SEQ ID NO: 231624 - DNA, 25 bp, Homo sapien
tcggactccctctttaagacctggc

SEQ ID NO: 231625 - DNA, 25 bp, Homo sapien
tctttaagacctggctcagtgctgg

SEQ ID NO: 231626 - DNA, 25 bp, Homo sapien
cttctctttgatctctgaatcccct

SEQ ID NO: 231627 - DNA, 25 bp, Homo sapien
tttgatctctgaatcccctctgact

SEQ ID NO: 231628 - DNA, 25 bp, Homo sapien
aacttctctttcaccctctatgagt

SEQ ID NO: 231629 - DNA, 25 bp, Homo sapien
tttcaccctctatgagtcccatttt

SEQ ID NO: 231630 - DNA, 25 bp, Homo sapien
atgagtcccattttacttctacacc

SEQ ID NO: 231631 - DNA, 25 bp, Homo sapien
attttacttctacacctgcaagtcc

SEQ ID NO: 231632 - DNA, 25 bp, Homo sapien
ttctacacctgcaagtcctggttta

SEQ ID NO: 231633 - DNA, 25 bp, Homo sapien
tacacctgcaagtcctggtttatat

SEQ ID NO: 231634 - DNA, 25 bp, Homo sapien
tgccgaccttagcttatctgggaga

SEQ ID NO: 231635 - DNA, 25 bp, Homo sapien
ccgaccttagcttatctgggagaga

SEQ ID NO: 231636 - DNA, 25 bp, Homo sapien
accttagcttatctgggagagaaac

SEQ ID NO: 231637 - DNA, 25 bp, Homo sapien
taaattcctcttttgagtgccctcc

SEQ ID NO: 231638 - DNA, 25 bp, Homo sapien
agtgccctcccttccggttgagagg

SEQ ID NO: 231639 - DNA, 25 bp, Homo sapien
gggttggcccgtagttgtacactca

SEQ ID NO: 231640 - DNA, 25 bp, Homo sapien
ttggcccgtagttgtacactcagtc

SEQ ID NO: 231641 - DNA, 25 bp, Homo sapien
gggcctcccttgtggactgatttgc

SEQ ID NO: 231642 - DNA, 25 bp, Homo sapien
cttgtggactgatttgcgtgggatt

SEQ ID NO: 231643 - DNA, 25 bp, Homo sapien
gatttgcgtgggatttggttgtttt

SEQ ID NO: 231644 - DNA, 25 bp, Homo sapien
aattcagatgacttactagtatgac

SEQ ID NO: 231645 - DNA, 25 bp, Homo sapien
gacttactagtatgactgttttgtc

SEQ ID NO: 231646 - DNA, 25 bp, Homo sapien
tgtcatatttgcttccaggttaata

SEQ ID NO: 231647 - DNA, 25 bp, Homo sapien
atttgcttccaggttaataaatgac

SEQ ID NO: 231648 - DNA, 25 bp, Homo sapien
gttctacaagggaaaaatcattggg

SEQ ID NO: 231649 - DNA, 25 bp, Homo sapien
tacaagggaaaaatcattgggtgat

SEQ ID NO: 231650 - DNA, 25 bp, Homo sapien
agaagagcagataaataccagagat

SEQ ID NO: 231651 - DNA, 25 bp, Homo sapien
gagcagataaataccagagatgcaa

SEQ ID NO: 231652 - DNA, 25 bp, Homo sapien
gagatgcaaaagcaatcgctgcctt

SEQ ID NO: 231653 - DNA, 25 bp, Homo sapien
gatgcaaaagcaatcgctgccttaa

SEQ ID NO: 231654 - DNA, 25 bp, Homo sapien
tgcaaaagcaatcgctgccttaata

SEQ ID NO: 231655 - DNA, 25 bp, Homo sapien
aaagcaatcgctgccttaataagtg

SEQ ID NO: 231656 - DNA, 25 bp, Homo sapien
agcaatcgctgccttaataagtgaa

SEQ ID NO: 231657 - DNA, 25 bp, Homo sapien
gcaatcgctgccttaataagtgaaa

SEQ ID NO: 231658 - DNA, 25 bp, Homo sapien
atcgctgccttaataagtgaaaaat

SEQ ID NO: 231659 - DNA, 25 bp, Homo sapien
cgcccttgtcctcgccaaaatgaaa

SEQ ID NO: 231660 - DNA, 25 bp, Homo sapien
gatgtgttcaatgcactggatctca

SEQ ID NO: 231661 - DNA, 25 bp, Homo sapien
caatgcactggatctcatggagaac

SEQ ID NO: 231662 - DNA, 25 bp, Homo sapien
acggcaacctgcagtattaccttta

SEQ ID NO: 231663 - DNA, 25 bp, Homo sapien
gtattacctttacaattggaaatgc

SEQ ID NO: 231664 - DNA, 25 bp, Homo sapien
aaggttggactggtgctacaataac

SEQ ID NO: 231665 - DNA, 25 bp, Homo sapien
gctacaataaccagtcaccagtgcg

SEQ ID NO: 231666 - DNA, 25 bp, Homo sapien
aataaccagtcaccagtgcgattct

SEQ ID NO: 231667 - DNA, 25 bp, Homo sapien
aagccactgaaaattcgaaccagga

SEQ ID NO: 231668 - DNA, 25 bp, Homo sapien
caggaaatggaaccccaccactgtt

SEQ ID NO: 231669 - DNA, 25 bp, Homo sapien
gaaccccaccactgttggtccaatt

SEQ ID NO: 231670 - DNA, 25 bp, Homo sapien
aagcaagtcccccatgagtgtccac

SEQ ID NO: 231671 - DNA, 25 bp, Homo sapien
catgagtgtccacttctttgccctg

SEQ ID NO: 231672 - DNA, 25 bp, Homo sapien
ctgccctctcagcttgtgagacaac

SEQ ID NO: 231673 - DNA, 25 bp, Homo sapien
gtgagacaacacaggagccttctat

SEQ ID NO: 231674 - DNA, 25 bp, Homo sapien
cacaggagccttctatagtatgttg

SEQ ID NO: 231675 - DNA, 25 bp, Homo sapien
atatgctagatctgtgccgttaata

SEQ ID NO: 231676 - DNA, 25 bp, Homo sapien
gccgttaataggcatcgtctctcag

SEQ ID NO: 231677 - DNA, 25 bp, Homo sapien
taggcatcgtctctcagcctgaggg

SEQ ID NO: 231678 - DNA, 25 bp, Homo sapien
gctggattctgggttcctgtagtca

SEQ ID NO: 231679 - DNA, 25 bp, Homo sapien
aaaatggacatgtatgtgcgtgtga

SEQ ID NO: 231680 - DNA, 25 bp, Homo sapien
ttatagtttttggtagtggcaggaa

SEQ ID NO: 231681 - DNA, 25 bp, Homo sapien
tgtacagaagactgacaacaggcca

SEQ ID NO: 231682 - DNA, 25 bp, Homo sapien
acaacaggccagtgcagactttgct

SEQ ID NO: 231683 - DNA, 25 bp, Homo sapien
aggccagtgcagactttgcttcctc

SEQ ID NO: 231684 - DNA, 25 bp, Homo sapien
ggaccttatctacccattaacactt

SEQ ID NO: 231685 - DNA, 25 bp, Homo sapien
accttatctacccattaacacttgt

SEQ ID NO: 231686 - DNA, 25 bp, Homo sapien
ttaacacttgttagagacacctcag

SEQ ID NO: 231687 - DNA, 25 bp, Homo sapien
tgttagagacacctcagtcgggcca

SEQ ID NO: 231688 - DNA, 25 bp, Homo sapien
agtcgggccacaactgtctctgttt

SEQ ID NO: 231689 - DNA, 25 bp, Homo sapien
gccacaactgtctctgtttcaactt

SEQ ID NO: 231690 - DNA, 25 bp, Homo sapien
gaaggctttttccaagtttgtcata

SEQ ID NO: 231691 - DNA, 25 bp, Homo sapien
tgttttcaccgtttaagacagttat

SEQ ID NO: 231692 - DNA, 25 bp, Homo sapien
ctaattaatgatccagctctcttgt

SEQ ID NO: 231693 - DNA, 25 bp, Homo sapien
cagctctcttgtgtaactttttgtt

SEQ ID NO: 231694 - DNA, 25 bp, Homo sapien
ttaagattgtatcccaaatctctgg

SEQ ID NO: 231695 - DNA, 25 bp, Homo sapien
aaatctctggctgttgctgccattc

SEQ ID NO: 231696 - DNA, 25 bp, Homo sapien
gctgttgctgccattctaatatagt

SEQ ID NO: 231697 - DNA, 25 bp, Homo sapien
tgccagtttaacagtcttatcctcc

SEQ ID NO: 231698 - DNA, 25 bp, Homo sapien
acagtcttatcctccagtaactggc

SEQ ID NO: 231699 - DNA, 25 bp, Homo sapien
tccagtaactggcaaattgttgttt

SEQ ID NO: 231700 - DNA, 25 bp, Homo sapien
gaacatacggcctgtagagctgaaa

SEQ ID NO: 231701 - DNA, 25 bp, Homo sapien
tttacccttcacataacctgtttgc

SEQ ID NO: 231702 - DNA, 25 bp, Homo sapien
ctgtttgccaaactcttgatctaat

SEQ ID NO: 231703 - DNA, 25 bp, Homo sapien
tcctcagagtcctgtggcgcgggaa

SEQ ID NO: 231704 - DNA, 25 bp, Homo sapien
gcgggaaggtgctgcaacctccgaa

SEQ ID NO: 231705 - DNA, 25 bp, Homo sapien
gaaggtgctgcaacctccgaaaggg

SEQ ID NO: 231706 - DNA, 25 bp, Homo sapien
gcggccgagtgtgtgcgaaacctaa

SEQ ID NO: 231707 - DNA, 25 bp, Homo sapien
gaaacctaaacgaacgcatccggcg

SEQ ID NO: 231708 - DNA, 25 bp, Homo sapien
taaacgaacgcatccggcgggacgt

SEQ ID NO: 231709 - DNA, 25 bp, Homo sapien
atccggcgggacgtcagggtctaca

SEQ ID NO: 231710 - DNA, 25 bp, Homo sapien
cgggacgtcagggtctacatcagcc

SEQ ID NO: 231711 - DNA, 25 bp, Homo sapien
ctgggcgatggactcaccttggcct

SEQ ID NO: 231712 - DNA, 25 bp, Homo sapien
accttggccttcaagatctagggct

SEQ ID NO: 231713 - DNA, 25 bp, Homo sapien
aagatctagggctggcccctagtga

SEQ ID NO: 231714 - DNA, 25 bp, Homo sapien
gcagccctgctgcaagtacctactg

SEQ ID NO: 231715 - DNA, 25 bp, Homo sapien
gcaagtacctactgtaagtctccct

SEQ ID NO: 231716 - DNA, 25 bp, Homo sapien
tactgtaagtctccctctaggccct

SEQ ID NO: 231717 - DNA, 25 bp, Homo sapien
tctaggccctactcagaagacctgt

SEQ ID NO: 231718 - DNA, 25 bp, Homo sapien
gacctgtgctatttacagagtgact

SEQ ID NO: 231719 - DNA, 25 bp, Homo sapien
ggaaagcaaactacccaggccttct

SEQ ID NO: 231720 - DNA, 25 bp, Homo sapien
ctacccaggccttctgagatgactg

SEQ ID NO: 231721 - DNA, 25 bp, Homo sapien
gctctgaattgatgttcatgcacgg

SEQ ID NO: 231722 - DNA, 25 bp, Homo sapien
gggacccaaagtgacagcgtggcca

SEQ ID NO: 231723 - DNA, 25 bp, Homo sapien
gacagcgtggccactagtcaaaatg

SEQ ID NO: 231724 - DNA, 25 bp, Homo sapien
aaagaatgaactctgcagccctgct

SEQ ID NO: 231725 - DNA, 25 bp, Homo sapien
aggatgcggtgcgtgcttctgccca

SEQ ID NO: 231726 - DNA, 25 bp, Homo sapien
ttctgcccagcgcatgggtgacacc

SEQ ID NO: 231727 - DNA, 25 bp, Homo sapien
actggcctggcgctggtctatgcca

SEQ ID NO: 231728 - DNA, 25 bp, Homo sapien
ggcgctggtctatgccaaggaacag

SEQ ID NO: 231729 - DNA, 25 bp, Homo sapien
gtctatgccaaggaacagctgtttg

SEQ ID NO: 231730 - DNA, 25 bp, Homo sapien
ggtgtgggtgacagatggcggctcc

SEQ ID NO: 231731 - DNA, 25 bp, Homo sapien
acagatggcggctccagcgaccctg

SEQ ID NO: 231732 - DNA, 25 bp, Homo sapien
aggacctgggcgtcaccgtgttcat

SEQ ID NO: 231733 - DNA, 25 bp, Homo sapien
gacctgggcgtcaccgtgttcattg

SEQ ID NO: 231734 - DNA, 25 bp, Homo sapien
gtgttcattgtcagcaccggccgag

SEQ ID NO: 231735 - DNA, 25 bp, Homo sapien
gttcattgtcagcaccggccgaggc

SEQ ID NO: 231736 - DNA, 25 bp, Homo sapien
tgcatcccctgtagatggtgagtgt

SEQ ID NO: 231737 - DNA, 25 bp, Homo sapien
tcccctgtagatggtgagtgttggc

SEQ ID NO: 231738 - DNA, 25 bp, Homo sapien
tgtgctgctgcctgtaggagggtgc

SEQ ID NO: 231739 - DNA, 25 bp, Homo sapien
cgggttgtgctgtcatcctcgggtt

SEQ ID NO: 231740 - DNA, 25 bp, Homo sapien
gtgctgtcatcctcgggtttgcacg

SEQ ID NO: 231741 - DNA, 25 bp, Homo sapien
tttgcacgcccttttttaggagcct

SEQ ID NO: 231742 - DNA, 25 bp, Homo sapien
gcacgcccttttttaggagcctgtg

SEQ ID NO: 231743 - DNA, 25 bp, Homo sapien
gcctgtggacatctgtggttttgta

SEQ ID NO: 231744 - DNA, 25 bp, Homo sapien
gtggacatctgtggttttgtacttt

SEQ ID NO: 231745 - DNA, 25 bp, Homo sapien
gggaggtgtttaactttctagtgat

SEQ ID NO: 231746 - DNA, 25 bp, Homo sapien
aactttctagtgattgatgattgtc

SEQ ID NO: 231747 - DNA, 25 bp, Homo sapien
aggcctacaagtacatgatcaagct

SEQ ID NO: 231748 - DNA, 25 bp, Homo sapien
tgcttgcagagatccacacactaca

SEQ ID NO: 231749 - DNA, 25 bp, Homo sapien
aacagttggctttggaaatccatct

SEQ ID NO: 231750 - DNA, 25 bp, Homo sapien
gaaatccatctttctgatacccctc

SEQ ID NO: 231751 - DNA, 25 bp, Homo sapien
tctgatacccctccagctgaacaat

SEQ ID NO: 231752 - DNA, 25 bp, Homo sapien
gaacaattttctgcatgggactctg

SEQ ID NO: 231753 - DNA, 25 bp, Homo sapien
tccttcccagagagttttaccgtat

SEQ ID NO: 231754 - DNA, 25 bp, Homo sapien
agttttaccgtatgaagcctggagc

SEQ ID NO: 231755 - DNA, 25 bp, Homo sapien
gagacccattcatttatttccattg

SEQ ID NO: 231756 - DNA, 25 bp, Homo sapien
ccattggctgtgttactggatgttt

SEQ ID NO: 231757 - DNA, 25 bp, Homo sapien
ctggatgttttactggttgacgaga

SEQ ID NO: 231758 - DNA, 25 bp, Homo sapien
aaggaatggtactagagcagtgtct

SEQ ID NO: 231759 - DNA, 25 bp, Homo sapien
agattaagtcaagtggttgggtcag

SEQ ID NO: 231760 - DNA, 25 bp, Homo sapien
tgccctggaggatcagcctcgaagt

SEQ ID NO: 231761 - DNA, 25 bp, Homo sapien
gatcagcctcgaagtatcgatccag

SEQ ID NO: 231762 - DNA, 25 bp, Homo sapien
tcgaagtatcgatccagcagggcct

SEQ ID NO: 231763 - DNA, 25 bp, Homo sapien
aagtatcgatccagcagggcctcca

SEQ ID NO: 231764 - DNA, 25 bp, Homo sapien
atagtcccacacctggaaccgagag

SEQ ID NO: 231765 - DNA, 25 bp, Homo sapien
acctggaaccgagagccatctgctg

SEQ ID NO: 231766 - DNA, 25 bp, Homo sapien
ctggaaccgagagccatctgctgct

SEQ ID NO: 231767 - DNA, 25 bp, Homo sapien
ctgctccccggatcatggccgaaag

SEQ ID NO: 231768 - DNA, 25 bp, Homo sapien
ttttaatttgctcctggggctaaga

SEQ ID NO: 231769 - DNA, 25 bp, Homo sapien
tggtgttacctcaccggggaccagg

SEQ ID NO: 231770 - DNA, 25 bp, Homo sapien
tcacacagcaaagctggaacaacag

SEQ ID NO: 231771 - DNA, 25 bp, Homo sapien
aaagctggaacaacagaggcgtgtt

SEQ ID NO: 231772 - DNA, 25 bp, Homo sapien
aggggacaaaacctctgcctgagat

SEQ ID NO: 231773 - DNA, 25 bp, Homo sapien
tgcctgagatcccaccccaggtggg

SEQ ID NO: 231774 - DNA, 25 bp, Homo sapien
agatcccaccccaggtgggcatggg

SEQ ID NO: 231775 - DNA, 25 bp, Homo sapien
atgaaaatgccggtaccgtcagtgc

SEQ ID NO: 231776 - DNA, 25 bp, Homo sapien
gaaaatgccggtaccgtcagtgcac

SEQ ID NO: 231777 - DNA, 25 bp, Homo sapien
aaaatgccggtaccgtcagtgcaca

SEQ ID NO: 231778 - DNA, 25 bp, Homo sapien
aatgccggtaccgtcagtgcacagc

SEQ ID NO: 231779 - DNA, 25 bp, Homo sapien
atgccggtaccgtcagtgcacagcc

SEQ ID NO: 231780 - DNA, 25 bp, Homo sapien
tgctccctgggacacgtggttctta

SEQ ID NO: 231781 - DNA, 25 bp, Homo sapien
tgggacacgtggttcttagtgtgca

SEQ ID NO: 231782 - DNA, 25 bp, Homo sapien
gggaaacccgcatgtggtcactgag

SEQ ID NO: 231783 - DNA, 25 bp, Homo sapien
gaaggaacaattcaatgtggccaat

SEQ ID NO: 231784 - DNA, 25 bp, Homo sapien
gtggccaatttgtttttctactatg

SEQ ID NO: 231785 - DNA, 25 bp, Homo sapien
tgtttttctactatggcaagcactt

SEQ ID NO: 231786 - DNA, 25 bp, Homo sapien
tgcacatttattctgcttctaatga

SEQ ID NO: 231787 - DNA, 25 bp, Homo sapien
gaaagtgtataggaactcagaggct

SEQ ID NO: 231788 - DNA, 25 bp, Homo sapien
ggcagggccttcctgagtctgggaa

SEQ ID NO: 231789 - DNA, 25 bp, Homo sapien
ggaacgaggacacatttgctccctg

SEQ ID NO: 231790 - DNA, 25 bp, Homo sapien
gaggacacatttgctccctgggaca

SEQ ID NO: 231791 - DNA, 25 bp, Homo sapien
ttggaaaattcctatgcatcttgca

SEQ ID NO: 231792 - DNA, 25 bp, Homo sapien
tatgcatcttgcaggcctgacataa

SEQ ID NO: 231793 - DNA, 25 bp, Homo sapien
gcctgacataagcatttcctctgtg

SEQ ID NO: 231794 - DNA, 25 bp, Homo sapien
tcctttgctccactcaaggagagtc

SEQ ID NO: 231795 - DNA, 25 bp, Homo sapien
tcaaggagagtcatctaacttccac

SEQ ID NO: 231796 - DNA, 25 bp, Homo sapien
tccactttcgtgtcaccactgtaat

SEQ ID NO: 231797 - DNA, 25 bp, Homo sapien
ccactgtaattacaacctacctcta

SEQ ID NO: 231798 - DNA, 25 bp, Homo sapien
acctacctctattgtatgtcactta

SEQ ID NO: 231799 - DNA, 25 bp, Homo sapien
gtcacttaaatcgtactgtattgtt

SEQ ID NO: 231800 - DNA, 25 bp, Homo sapien
tattttttgcatctccatagcatag

SEQ ID NO: 231801 - DNA, 25 bp, Homo sapien
gcatctccatagcatagtttttggc

SEQ ID NO: 231802 - DNA, 25 bp, Homo sapien
ggaagtgctccctcacgacggaagg

SEQ ID NO: 231803 - DNA, 25 bp, Homo sapien
agtgctccctcacgacggaaggttt

SEQ ID NO: 231804 - DNA, 25 bp, Homo sapien
tcacgacggaaggtttcctgtcagt

SEQ ID NO: 231805 - DNA, 25 bp, Homo sapien
ggaaggtttcctgtcagtgcggtcc

SEQ ID NO: 231806 - DNA, 25 bp, Homo sapien
aggtttcctgtcagtgcggtcccgg

SEQ ID NO: 231807 - DNA, 25 bp, Homo sapien
tctgattcccagtggctgctagctg

SEQ ID NO: 231808 - DNA, 25 bp, Homo sapien
cagtggctgctagctggacccagct

SEQ ID NO: 231809 - DNA, 25 bp, Homo sapien
gctagctggacccagctggtgtcct

SEQ ID NO: 231810 - DNA, 25 bp, Homo sapien
agctggtgtcctgggcatgaaggca

SEQ ID NO: 231811 - DNA, 25 bp, Homo sapien
gccagctgagcatcctggccaccat

SEQ ID NO: 231812 - DNA, 25 bp, Homo sapien
tggccaccatcagcgtccaggtgcc

SEQ ID NO: 231813 - DNA, 25 bp, Homo sapien
ataaccactggtcaacgattagaaa

SEQ ID NO: 231814 - DNA, 25 bp, Homo sapien
taccttctggaataccgctgattgt

SEQ ID NO: 231815 - DNA, 25 bp, Homo sapien
aataccgctgattgtgctcttttta

SEQ ID NO: 231816 - DNA, 25 bp, Homo sapien
gctgattgtgctctttttatcctac

SEQ ID NO: 231817 - DNA, 25 bp, Homo sapien
gctttcatgattagatttgagctat

SEQ ID NO: 231818 - DNA, 25 bp, Homo sapien
gagctatatcagttataccgattat

SEQ ID NO: 231819 - DNA, 25 bp, Homo sapien
taccttataatacacattcagttag

SEQ ID NO: 231820 - DNA, 25 bp, Homo sapien
ttattgatgcctgttgtttgcccag

SEQ ID NO: 231821 - DNA, 25 bp, Homo sapien
tgcccagccactgtgatggatattg

SEQ ID NO: 231822 - DNA, 25 bp, Homo sapien
gccctgacccttgagctgtgcttgg

SEQ ID NO: 231823 - DNA, 25 bp, Homo sapien
agctgtgcttggtcttgtagaggtt

SEQ ID NO: 231824 - DNA, 25 bp, Homo sapien
accatcttattcttgtctccaagca

SEQ ID NO: 231825 - DNA, 25 bp, Homo sapien
tcttgtctccaagcatgaacacagg

SEQ ID NO: 231826 - DNA, 25 bp, Homo sapien
aatctttactacttcttccatgcgg

SEQ ID NO: 231827 - DNA, 25 bp, Homo sapien
tcttccatgcggagaaatctacata

SEQ ID NO: 231828 - DNA, 25 bp, Homo sapien
attttgaattagaaacaccctcaca

SEQ ID NO: 231829 - DNA, 25 bp, Homo sapien
ccctcacacccacttgaagattttt

SEQ ID NO: 231830 - DNA, 25 bp, Homo sapien
ggaacattatgtcccgtagatcaga

SEQ ID NO: 231831 - DNA, 25 bp, Homo sapien
atgtcccgtagatcagaggtggtgt

SEQ ID NO: 231832 - DNA, 25 bp, Homo sapien
agaggtggtgttgtctttttgcttc

SEQ ID NO: 231833 - DNA, 25 bp, Homo sapien
ggtggtgttgtctttttgcttctac

SEQ ID NO: 231834 - DNA, 25 bp, Homo sapien
gcttctactggccattgagaaactt

SEQ ID NO: 231835 - DNA, 25 bp, Homo sapien
tagttaagaaagctgcctattggct

SEQ ID NO: 231836 - DNA, 25 bp, Homo sapien
agttaagaaagctgcctattggctg

SEQ ID NO: 231837 - DNA, 25 bp, Homo sapien
gttaagaaagctgcctattggctgg

SEQ ID NO: 231838 - DNA, 25 bp, Homo sapien
aagaaagctgcctattggctggagg

SEQ ID NO: 231839 - DNA, 25 bp, Homo sapien
aggcagaagccctattactttgcaa

SEQ ID NO: 231840 - DNA, 25 bp, Homo sapien
gcagaagccctattactttgcaagg

SEQ ID NO: 231841 - DNA, 25 bp, Homo sapien
actttgcaaggggcccttctgtcgt

SEQ ID NO: 231842 - DNA, 25 bp, Homo sapien
ctttatttccatttggtccaaggct

SEQ ID NO: 231843 - DNA, 25 bp, Homo sapien
tttatttccatttggtccaaggctt

SEQ ID NO: 231844 - DNA, 25 bp, Homo sapien
tccatttggtccaaggcttgttagg

SEQ ID NO: 231845 - DNA, 25 bp, Homo sapien
caaggcttgttaggatagttaagaa

SEQ ID NO: 231846 - DNA, 25 bp, Homo sapien
ggattttttttgaccatcttctaat

SEQ ID NO: 231847 - DNA, 25 bp, Homo sapien
gaccatcttctaataaacatagcaa

SEQ ID NO: 231848 - DNA, 25 bp, Homo sapien
ttaagagtttgcatatttcagaaat

SEQ ID NO: 231849 - DNA, 25 bp, Homo sapien
cagaaatgatctggtgtgagtgcat

SEQ ID NO: 231850 - DNA, 25 bp, Homo sapien
gatctggtgtgagtgcatggaaata

SEQ ID NO: 231851 - DNA, 25 bp, Homo sapien
gagtgcatggaaatattgcttaatt

SEQ ID NO: 231852 - DNA, 25 bp, Homo sapien
aatttttcttcaatcattgagtgaa

SEQ ID NO: 231853 - DNA, 25 bp, Homo sapien
atcattgagtgaaaaacctttaact

SEQ ID NO: 231854 - DNA, 25 bp, Homo sapien
tttaactttggcctgcaatagtcat

SEQ ID NO: 231855 - DNA, 25 bp, Homo sapien
actttggcctgcaatagtcatttga

SEQ ID NO: 231856 - DNA, 25 bp, Homo sapien
tggcctgcaatagtcatttgattat

SEQ ID NO: 231857 - DNA, 25 bp, Homo sapien
tttggagtctgggaactgatagctt

SEQ ID NO: 231858 - DNA, 25 bp, Homo sapien
gtctgggaactgatagcttgatata

SEQ ID NO: 231859 - DNA, 25 bp, Homo sapien
aatcacctggtgtcaattaaatata

SEQ ID NO: 231860 - DNA, 25 bp, Homo sapien
aatcttctttgtttgttcaataatt

SEQ ID NO: 231861 - DNA, 25 bp, Homo sapien
tgtaacttattatgtcaggtactaa

SEQ ID NO: 231862 - DNA, 25 bp, Homo sapien
caggtactaaattaacatccttaag

SEQ ID NO: 231863 - DNA, 25 bp, Homo sapien
acatccttaaggaggtcacaatcta

SEQ ID NO: 231864 - DNA, 25 bp, Homo sapien
gtcacaatctaggaggaacatgggc

SEQ ID NO: 231865 - DNA, 25 bp, Homo sapien
gaacatgggcaaacagttacttatt

SEQ ID NO: 231866 - DNA, 25 bp, Homo sapien
cagttacttattttatggcatacgc

SEQ ID NO: 231867 - DNA, 25 bp, Homo sapien
tatggcatacgctaactctgaaagt

SEQ ID NO: 231868 - DNA, 25 bp, Homo sapien
gtaggtgttaggcatgtcccaccca

SEQ ID NO: 231869 - DNA, 25 bp, Homo sapien
aggtgttaggcatgtcccacccacc

SEQ ID NO: 231870 - DNA, 25 bp, Homo sapien
ggacaccagagctgccgacttggag

SEQ ID NO: 231871 - DNA, 25 bp, Homo sapien
gacaccagagctgccgacttggaga

SEQ ID NO: 231872 - DNA, 25 bp, Homo sapien
accagagctgccgacttggagactc

SEQ ID NO: 231873 - DNA, 25 bp, Homo sapien
agagctgccgacttggagactcctg

SEQ ID NO: 231874 - DNA, 25 bp, Homo sapien
gggtctgcgcttggtctttctgtgc

SEQ ID NO: 231875 - DNA, 25 bp, Homo sapien
tctttctgtgcttggatttgcatat

SEQ ID NO: 231876 - DNA, 25 bp, Homo sapien
gtgcttggatttgcatatttattgc

SEQ ID NO: 231877 - DNA, 25 bp, Homo sapien
ttattgcattgctggtagagacccc

SEQ ID NO: 231878 - DNA, 25 bp, Homo sapien
tgctggtagagacccccaggcctgt

SEQ ID NO: 231879 - DNA, 25 bp, Homo sapien
ttagtactggaagaactctgtctcc

SEQ ID NO: 231880 - DNA, 25 bp, Homo sapien
tgtctccacagttgccagtaataaa

SEQ ID NO: 231881 - DNA, 25 bp, Homo sapien
tactatgagcaccaatcactgggtt

SEQ ID NO: 231882 - DNA, 25 bp, Homo sapien
attgatgctgcagtgctttagagct

SEQ ID NO: 231883 - DNA, 25 bp, Homo sapien
gtgctttagagctatttccttgaat

SEQ ID NO: 231884 - DNA, 25 bp, Homo sapien
aatcttaacagttttatggtgctga

SEQ ID NO: 231885 - DNA, 25 bp, Homo sapien
tatggtgctgatgcttagttgtctc

SEQ ID NO: 231886 - DNA, 25 bp, Homo sapien
gatgcttagttgtctcatgccatta

SEQ ID NO: 231887 - DNA, 25 bp, Homo sapien
gttgtctcatgccattaaattgtaa

SEQ ID NO: 231888 - DNA, 25 bp, Homo sapien
gtgagttgatgcaatacatgtgact

SEQ ID NO: 231889 - DNA, 25 bp, Homo sapien
acatgtgactttctgctataatgca

SEQ ID NO: 231890 - DNA, 25 bp, Homo sapien
gagtaaggaagatcccagtgtctga

SEQ ID NO: 231891 - DNA, 25 bp, Homo sapien
gatcccagtgtctgagtgaactaac

SEQ ID NO: 231892 - DNA, 25 bp, Homo sapien
gtgaactaacagtcctgctttcagc

SEQ ID NO: 231893 - DNA, 25 bp, Homo sapien
agtcctgctttcagccaccatttgc

SEQ ID NO: 231894 - DNA, 25 bp, Homo sapien
tttgcacaagacacccagcactgaa

SEQ ID NO: 231895 - DNA, 25 bp, Homo sapien
agcactgaaagtcccgctgccagga

SEQ ID NO: 231896 - DNA, 25 bp, Homo sapien
gagcaagggatcctttggaagcacc

SEQ ID NO: 231897 - DNA, 25 bp, Homo sapien
aagcacccgccctttgtgccttgtt

SEQ ID NO: 231898 - DNA, 25 bp, Homo sapien
gtgtggatacaccagagtttgcatt

SEQ ID NO: 231899 - DNA, 25 bp, Homo sapien
acaccagagtttgcattggaaggaa

SEQ ID NO: 231900 - DNA, 25 bp, Homo sapien
gggccagtggaccttttgtaagctt

SEQ ID NO: 231901 - DNA, 25 bp, Homo sapien
aactttaagcccacacactctgtag

SEQ ID NO: 231902 - DNA, 25 bp, Homo sapien
tttaagcccacacactctgtagctt

SEQ ID NO: 231903 - DNA, 25 bp, Homo sapien
gtagcttttctaaaacagtacattc

SEQ ID NO: 231904 - DNA, 25 bp, Homo sapien
cagtacattccattcatgcagtaga

SEQ ID NO: 231905 - DNA, 25 bp, Homo sapien
gtacattccattcatgcagtagata

SEQ ID NO: 231906 - DNA, 25 bp, Homo sapien
cattccattcatgcagtagatatga

SEQ ID NO: 231907 - DNA, 25 bp, Homo sapien
tttaatgggaatttgctgttgcaca

SEQ ID NO: 231908 - DNA, 25 bp, Homo sapien
aatgggaatttgctgttgcacaatt

SEQ ID NO: 231909 - DNA, 25 bp, Homo sapien
gggaatttgctgttgcacaatttga

SEQ ID NO: 231910 - DNA, 25 bp, Homo sapien
atttgctgttgcacaatttgagaac

SEQ ID NO: 231911 - DNA, 25 bp, Homo sapien
tgctgttgcacaatttgagaaccag

SEQ ID NO: 231912 - DNA, 25 bp, Homo sapien
aggttaattcacagatagatccaag

SEQ ID NO: 231913 - DNA, 25 bp, Homo sapien
tagatccaaggtctgggagccaatc

SEQ ID NO: 231914 - DNA, 25 bp, Homo sapien
gtctgggagccaatcaaaagcggag

SEQ ID NO: 231915 - DNA, 25 bp, Homo sapien
taaatcaccctgaatccatacggca

SEQ ID NO: 231916 - DNA, 25 bp, Homo sapien
cactgaccttcaccaggacgcaggg

SEQ ID NO: 231917 - DNA, 25 bp, Homo sapien
gaatccatacggcaacactgcgaga

SEQ ID NO: 231918 - DNA, 25 bp, Homo sapien
gcaacactgcgagagagagactatt

SEQ ID NO: 231919 - DNA, 25 bp, Homo sapien
gactattataccaggctaacgcacg

SEQ ID NO: 231920 - DNA, 25 bp, Homo sapien
ttataccaggctaacgcacgaggag

SEQ ID NO: 231921 - DNA, 25 bp, Homo sapien
aacgcacgaggagtccgaggctcaa

SEQ ID NO: 231922 - DNA, 25 bp, Homo sapien
gtccgaggctcaaaggttaattcac

SEQ ID NO: 231923 - DNA, 25 bp, Homo sapien
gaatctatgggccttcacagggccc

SEQ ID NO: 231924 - DNA, 25 bp, Homo sapien
ggacatgaggcttccctgaagcaag

SEQ ID NO: 231925 - DNA, 25 bp, Homo sapien
agcaaggatttcagccagatgccat

SEQ ID NO: 231926 - DNA, 25 bp, Homo sapien
atttcagccagatgccatagaccct

SEQ ID NO: 231927 - DNA, 25 bp, Homo sapien
atagaccctcagaacttgacctgga

SEQ ID NO: 231928 - DNA, 25 bp, Homo sapien
ttgacctggaagtccagacactgaa

SEQ ID NO: 231929 - DNA, 25 bp, Homo sapien
agacactgaacgcaggcctcaaaac

SEQ ID NO: 231930 - DNA, 25 bp, Homo sapien
aggcctcaaaactgctgcggccttc

SEQ ID NO: 231931 - DNA, 25 bp, Homo sapien
actcctggtatctgcatcggcgaat

SEQ ID NO: 231932 - DNA, 25 bp, Homo sapien
ggcgaatggcccttcttgccttgat

SEQ ID NO: 231933 - DNA, 25 bp, Homo sapien
ttcttgccttgatccacagggatgg

SEQ ID NO: 231934 - DNA, 25 bp, Homo sapien
gcattttatcatcattagacttaaa

SEQ ID NO: 231935 - DNA, 25 bp, Homo sapien
gtcagaagttgataggttgttaaat

SEQ ID NO: 231936 - DNA, 25 bp, Homo sapien
gtgaaattaatacaccttcctacat

SEQ ID NO: 231937 - DNA, 25 bp, Homo sapien
attaatacaccttcctacattttga

SEQ ID NO: 231938 - DNA, 25 bp, Homo sapien
gaaggtgatgcatagatcccatagt

SEQ ID NO: 231939 - DNA, 25 bp, Homo sapien
gatcccatagtgtgcatcatgttcc

SEQ ID NO: 231940 - DNA, 25 bp, Homo sapien
gtgtgcatcatgttccttatatgaa

SEQ ID NO: 231941 - DNA, 25 bp, Homo sapien
ttttccattaaactacttttgtatg

SEQ ID NO: 231942 - DNA, 25 bp, Homo sapien
tttgtatggcttagataaatcttcc

SEQ ID NO: 231943 - DNA, 25 bp, Homo sapien
gataaatcttccattagtgttcatt

SEQ ID NO: 231944 - DNA, 25 bp, Homo sapien
atgctgttaaaactactttaggtga

SEQ ID NO: 231945 - DNA, 25 bp, Homo sapien
tatctcatgctgtaattcttggaaa

SEQ ID NO: 231946 - DNA, 25 bp, Homo sapien
ttcttggaaagtatgctgtagctca

SEQ ID NO: 231947 - DNA, 25 bp, Homo sapien
gtagctcaagtgcagaattctcatc

SEQ ID NO: 231948 - DNA, 25 bp, Homo sapien
aagtgcagaattctcatcagtttta

SEQ ID NO: 231949 - DNA, 25 bp, Homo sapien
cagttttatctttatatctctccta

SEQ ID NO: 231950 - DNA, 25 bp, Homo sapien
tatctctcctaaacactttacctga

SEQ ID NO: 231951 - DNA, 25 bp, Homo sapien
ctttacctgatgaagagcctggcat

SEQ ID NO: 231952 - DNA, 25 bp, Homo sapien
agagcctggcatacacataaatata

SEQ ID NO: 231953 - DNA, 25 bp, Homo sapien
tgatggatctcctaaattttaactt

SEQ ID NO: 231954 - DNA, 25 bp, Homo sapien
tttgatacattcatgaccttacttt

SEQ ID NO: 231955 - DNA, 25 bp, Homo sapien
actttagcaagcaatgaacgtgatg

SEQ ID NO: 231956 - DNA, 25 bp, Homo sapien
acagggcaccctgggattttaatga

SEQ ID NO: 231957 - DNA, 25 bp, Homo sapien
ttttaatgagggaagagcacagttc

SEQ ID NO: 231958 - DNA, 25 bp, Homo sapien
gagcacagttcactataaaccatta

SEQ ID NO: 231959 - DNA, 25 bp, Homo sapien
ataaaccattatcaattctacattg

SEQ ID NO: 231960 - DNA, 25 bp, Homo sapien
attctacattgtaatttagcagcaa

SEQ ID NO: 231961 - DNA, 25 bp, Homo sapien
tttagcagcaaacatgttaacatgg

SEQ ID NO: 231962 - DNA, 25 bp, Homo sapien
acatgttaacatgggagcattaaga

SEQ ID NO: 231963 - DNA, 25 bp, Homo sapien
aaagtcacagttcttgatatgacag

SEQ ID NO: 231964 - DNA, 25 bp, Homo sapien
tatgacagtctttttatccccacct

SEQ ID NO: 231965 - DNA, 25 bp, Homo sapien
gacaaagcacactgaattatacatg

SEQ ID NO: 231966 - DNA, 25 bp, Homo sapien
atacatgtacatctaattttctttg

SEQ ID NO: 231967 - DNA, 25 bp, Homo sapien
aaacatccaagcttcttacctgtag

SEQ ID NO: 231968 - DNA, 25 bp, Homo sapien
tccaagcttcttacctgtagataga

SEQ ID NO: 231969 - DNA, 25 bp, Homo sapien
gtagatagaatcagccctcacttgg

SEQ ID NO: 231970 - DNA, 25 bp, Homo sapien
atcagccctcacttggtgcttatta

SEQ ID NO: 231971 - DNA, 25 bp, Homo sapien
cttggtgcttattaccagttattca

SEQ ID NO: 231972 - DNA, 25 bp, Homo sapien
agaagcacatattaggaccaaagat

SEQ ID NO: 231973 - DNA, 25 bp, Homo sapien
gaccaaagatagcatcaactgtatt

SEQ ID NO: 231974 - DNA, 25 bp, Homo sapien
ggaactgtagtttgcgcattttatg

SEQ ID NO: 231975 - DNA, 25 bp, Homo sapien
gtagtttgcgcattttatgacattt

SEQ ID NO: 231976 - DNA, 25 bp, Homo sapien
agtactgtaattctttcattgaggg

SEQ ID NO: 231977 - DNA, 25 bp, Homo sapien
gagacagactaactcattttgttat

SEQ ID NO: 231978 - DNA, 25 bp, Homo sapien
ggcagagtccatgcaacttcaacat

SEQ ID NO: 231979 - DNA, 25 bp, Homo sapien
gagtccatgcaacttcaacatatag

SEQ ID NO: 231980 - DNA, 25 bp, Homo sapien
caacatatagagaagcaacaccaga

SEQ ID NO: 231981 - DNA, 25 bp, Homo sapien
caccagaaaatgatcctaactactt

SEQ ID NO: 231982 - DNA, 25 bp, Homo sapien
gaaaatgatcctaactactttatga

SEQ ID NO: 231983 - DNA, 25 bp, Homo sapien
gatcctaactactttatgaatgaac

SEQ ID NO: 231984 - DNA, 25 bp, Homo sapien
tatacatctgatggtgttcctttca

SEQ ID NO: 231985 - DNA, 25 bp, Homo sapien
acatctgatggtgttcctttcactg

SEQ ID NO: 231986 - DNA, 25 bp, Homo sapien
atctgatggtgttcctttcactgca

SEQ ID NO: 231987 - DNA, 25 bp, Homo sapien
atggtgttcctttcactgcagctga

SEQ ID NO: 231988 - DNA, 25 bp, Homo sapien
gtgttcctttcactgcagctgatcc

SEQ ID NO: 231989 - DNA, 25 bp, Homo sapien
tggcgtaacacgaaccacatttaca

SEQ ID NO: 231990 - DNA, 25 bp, Homo sapien
cagctggacccaacgcagggcactg

SEQ ID NO: 231991 - DNA, 25 bp, Homo sapien
gcgtaacacgaaccacatttacaca

SEQ ID NO: 231992 - DNA, 25 bp, Homo sapien
gtgtgtggacaggtggctcgggatc

SEQ ID NO: 231993 - DNA, 25 bp, Homo sapien
acatttacacaactgttgcacggcg

SEQ ID NO: 231994 - DNA, 25 bp, Homo sapien
atttacacaactgttgcacggcggt

SEQ ID NO: 231995 - DNA, 25 bp, Homo sapien
tacacaactgttgcacggcggtagt

SEQ ID NO: 231996 - DNA, 25 bp, Homo sapien
cacaactgttgcacggcggtagtaa

SEQ ID NO: 231997 - DNA, 25 bp, Homo sapien
acaactgttgcacggcggtagtaaa

SEQ ID NO: 231998 - DNA, 25 bp, Homo sapien
gttgcacggcggtagtaaaagaatc

SEQ ID NO: 231999 - DNA, 25 bp, Homo sapien
gcacggcggtagtaaaagaatcatt

SEQ ID NO: 232000 - DNA, 25 bp, Homo sapien
agcctgtttgtaaacacactaaaca

SEQ ID NO: 232001 - DNA, 25 bp, Homo sapien
aaacacagtggcctagatagaaact

SEQ ID NO: 232002 - DNA, 25 bp, Homo sapien
gtagtttaaaatctgcctcgcggga

SEQ ID NO: 232003 - DNA, 25 bp, Homo sapien
tgcctcgcgggatgttactaaactc

SEQ ID NO: 232004 - DNA, 25 bp, Homo sapien
gggatgttactaaactcgctaatag

SEQ ID NO: 232005 - DNA, 25 bp, Homo sapien
gcaagttggacaattttgtggtgtt

SEQ ID NO: 232006 - DNA, 25 bp, Homo sapien
atgttagggcaaggcctagaggttc

SEQ ID NO: 232007 - DNA, 25 bp, Homo sapien
aaggcctagaggttcattttgaatc

SEQ ID NO: 232008 - DNA, 25 bp, Homo sapien
gaatcttggtttgtgactttagggt

SEQ ID NO: 232009 - DNA, 25 bp, Homo sapien
tagaaactttctacttaatgtacct

SEQ ID NO: 232010 - DNA, 25 bp, Homo sapien
gtataatctgaaactgtacatggaa

SEQ ID NO: 232011 - DNA, 25 bp, Homo sapien
ggagctggtctcataacctttgtga

SEQ ID NO: 232012 - DNA, 25 bp, Homo sapien
ggtctcataacctttgtgactagag

SEQ ID NO: 232013 - DNA, 25 bp, Homo sapien
atgctttatgagtttgtccctggag

SEQ ID NO: 232014 - DNA, 25 bp, Homo sapien
tccctggagagctgcttcttgaagt

SEQ ID NO: 232015 - DNA, 25 bp, Homo sapien
tgcttcttgaagtgtcttggcgctt

SEQ ID NO: 232016 - DNA, 25 bp, Homo sapien
agtgtcttggcgcttgcttcggaac

SEQ ID NO: 232017 - DNA, 25 bp, Homo sapien
gcttgcttcggaactttcttgagta

SEQ ID NO: 232018 - DNA, 25 bp, Homo sapien
gatcagctagatcataccaaaagta

SEQ ID NO: 232019 - DNA, 25 bp, Homo sapien
gtgtatttcatctcgattaccttgt

SEQ ID NO: 232020 - DNA, 25 bp, Homo sapien
tcatctcgattaccttgttcctaga

SEQ ID NO: 232021 - DNA, 25 bp, Homo sapien
taccttgttcctagagaagtttact

SEQ ID NO: 232022 - DNA, 25 bp, Homo sapien
ttagatccttttccccgaaggtatg

SEQ ID NO: 232023 - DNA, 25 bp, Homo sapien
ggttctaagggcatgtggacaattt

SEQ ID NO: 232024 - DNA, 25 bp, Homo sapien
ggacaatttacgttatcatagtatt

SEQ ID NO: 232025 - DNA, 25 bp, Homo sapien
tagtattgttcataacgtccatcat

SEQ ID NO: 232026 - DNA, 25 bp, Homo sapien
ataacgtccatcattattctgtaga

SEQ ID NO: 232027 - DNA, 25 bp, Homo sapien
tattctgtagactgtaagggcttac

SEQ ID NO: 232028 - DNA, 25 bp, Homo sapien
gtaagggcttacttagctcgtgtaa

SEQ ID NO: 232029 - DNA, 25 bp, Homo sapien
gctcgtgtaagaattatccttcaaa

SEQ ID NO: 232030 - DNA, 25 bp, Homo sapien
gctaatctataaactttgtgcaaga

SEQ ID NO: 232031 - DNA, 25 bp, Homo sapien
ttgtgcaagaagtcctaaagtcaat

SEQ ID NO: 232032 - DNA, 25 bp, Homo sapien
agtcctaaagtcaatagcaacattt

SEQ ID NO: 232033 - DNA, 25 bp, Homo sapien
aatcaatatctgcagccactgttac

SEQ ID NO: 232034 - DNA, 25 bp, Homo sapien
tatctgcagccactgttacttttaa

SEQ ID NO: 232035 - DNA, 25 bp, Homo sapien
attgacattaagagacacttcatag

SEQ ID NO: 232036 - DNA, 25 bp, Homo sapien
agagacacttcataggttcccacaa

SEQ ID NO: 232037 - DNA, 25 bp, Homo sapien
gacacttcataggttcccacaattc

SEQ ID NO: 232038 - DNA, 25 bp, Homo sapien
ttcataggttcccacaattcagtat

SEQ ID NO: 232039 - DNA, 25 bp, Homo sapien
cataggttcccacaattcagtatgg

SEQ ID NO: 232040 - DNA, 25 bp, Homo sapien
cacaattcagtatgggataggcttt

SEQ ID NO: 232041 - DNA, 25 bp, Homo sapien
tcagtatgggataggctttttaaaa

SEQ ID NO: 232042 - DNA, 25 bp, Homo sapien
ttttaaaaagcacatacagaccagg

SEQ ID NO: 232043 - DNA, 25 bp, Homo sapien
aaaagcacatacagaccaggcgtgg

SEQ ID NO: 232044 - DNA, 25 bp, Homo sapien
ttgcccaagaatggaagtgcttaat

SEQ ID NO: 232045 - DNA, 25 bp, Homo sapien
aaatgctttggacttcttaacaagc

SEQ ID NO: 232046 - DNA, 25 bp, Homo sapien
ggacttcttaacaagcaaatcatat

SEQ ID NO: 232047 - DNA, 25 bp, Homo sapien
tacaaagcaattcagtgttcctact

SEQ ID NO: 232048 - DNA, 25 bp, Homo sapien
gcaattcagtgttcctactaattga

SEQ ID NO: 232049 - DNA, 25 bp, Homo sapien
caagaagatgttatgcagcatgttt

SEQ ID NO: 232050 - DNA, 25 bp, Homo sapien
aaggctggctttcacaccatccaag

SEQ ID NO: 232051 - DNA, 25 bp, Homo sapien
tttcacaccatccaagggtcacagc

SEQ ID NO: 232052 - DNA, 25 bp, Homo sapien
aagggtcacagctcacgctacattg

SEQ ID NO: 232053 - DNA, 25 bp, Homo sapien
ggtcacagctcacgctacattgaag

SEQ ID NO: 232054 - DNA, 25 bp, Homo sapien
gctcacgctacattgaagcgtatga

SEQ ID NO: 232055 - DNA, 25 bp, Homo sapien
ggttgatcctgctgctattccgcct

SEQ ID NO: 232056 - DNA, 25 bp, Homo sapien
ctattccgccttcattaacagacta

SEQ ID NO: 232057 - DNA, 25 bp, Homo sapien
aacagactactcagtaccattccac

SEQ ID NO: 232058 - DNA, 25 bp, Homo sapien
tccaccatacgccaatatcaagcat

SEQ ID NO: 232059 - DNA, 25 bp, Homo sapien
aatatgactgccttattattgctag

SEQ ID NO: 232060 - DNA, 25 bp, Homo sapien
gactgccttattattgctagtgcca

SEQ ID NO: 232061 - DNA, 25 bp, Homo sapien
tgccttattattgctagtgccatat

SEQ ID NO: 232062 - DNA, 25 bp, Homo sapien
ctagtgccatattgtcaggtgcgaa

SEQ ID NO: 232063 - DNA, 25 bp, Homo sapien
atattgtcaggtgcgaatggtgctc

SEQ ID NO: 232064 - DNA, 25 bp, Homo sapien
caggtgcgaatggtgctcaaaagtt

SEQ ID NO: 232065 - DNA, 25 bp, Homo sapien
tggtgctcaaaagttgtatcattaa

SEQ ID NO: 232066 - DNA, 25 bp, Homo sapien
ccctcagggagggagcggcagatca

SEQ ID NO: 232067 - DNA, 25 bp, Homo sapien
agatcacggagatgcgccggccccg

SEQ ID NO: 232068 - DNA, 25 bp, Homo sapien
gcgttccccaaagaaggactcttca

SEQ ID NO: 232069 - DNA, 25 bp, Homo sapien
aagaaggactcttcatcccgaagga

SEQ ID NO: 232070 - DNA, 25 bp, Homo sapien
aaggactcttcatcccgaaggatct

SEQ ID NO: 232071 - DNA, 25 bp, Homo sapien
tcttcatcccgaaggatctcatggg

SEQ ID NO: 232072 - DNA, 25 bp, Homo sapien
aggatctcatgggagaagtcataac

SEQ ID NO: 232073 - DNA, 25 bp, Homo sapien
ctgagcccctaaggatgtagaggga

SEQ ID NO: 232074 - DNA, 25 bp, Homo sapien
ctaaggatgtagagggagcccggct

SEQ ID NO: 232075 - DNA, 25 bp, Homo sapien
ttattcacaaatctggtgtctgtag

SEQ ID NO: 232076 - DNA, 25 bp, Homo sapien
aatctggtgtctgtagaaagctggg

SEQ ID NO: 232077 - DNA, 25 bp, Homo sapien
ttagatgcaagagtgtccgtaggtc

SEQ ID NO: 232078 - DNA, 25 bp, Homo sapien
gtgtccgtaggtcattaggctcagt

SEQ ID NO: 232079 - DNA, 25 bp, Homo sapien
aggtcattaggctcagttcttgcta

SEQ ID NO: 232080 - DNA, 25 bp, Homo sapien
taggctcagttcttgctaaagtaga

SEQ ID NO: 232081 - DNA, 25 bp, Homo sapien
ggcacaaagagtcagtcaacataat

SEQ ID NO: 232082 - DNA, 25 bp, Homo sapien
gtcaacataattactggatccagtc

SEQ ID NO: 232083 - DNA, 25 bp, Homo sapien
ggatccagtcggtaattctcaatta

SEQ ID NO: 232084 - DNA, 25 bp, Homo sapien
ttctcaattaggaaacgtgcctctc

SEQ ID NO: 232085 - DNA, 25 bp, Homo sapien
gaaacgtgcctctcatgggaagggt

SEQ ID NO: 232086 - DNA, 25 bp, Homo sapien
ggaagggtgtatcacagtccctcaa

SEQ ID NO: 232087 - DNA, 25 bp, Homo sapien
acagtccctcaaagctatctcacat

SEQ ID NO: 232088 - DNA, 25 bp, Homo sapien
tgctcagttcaggaagaatgatcga

SEQ ID NO: 232089 - DNA, 25 bp, Homo sapien
gagacagtcgtgaaacagctgagaa

SEQ ID NO: 232090 - DNA, 25 bp, Homo sapien
tttggtgaatggtatgtcccagcac

SEQ ID NO: 232091 - DNA, 25 bp, Homo sapien
ggtatgtcccagcacatgtagacct

SEQ ID NO: 232092 - DNA, 25 bp, Homo sapien
atgtagacctcacatggcttgcact

SEQ ID NO: 232093 - DNA, 25 bp, Homo sapien
catggcttgcactcagtgacaccaa

SEQ ID NO: 232094 - DNA, 25 bp, Homo sapien
acaccaaatccatgattcaatgttg

SEQ ID NO: 232095 - DNA, 25 bp, Homo sapien
gattcaatgttgatcttgagcaagt

SEQ ID NO: 232096 - DNA, 25 bp, Homo sapien
gatcttgagcaagtattggtcatga

SEQ ID NO: 232097 - DNA, 25 bp, Homo sapien
ggtcatgatacagtaatttgtttac

SEQ ID NO: 232098 - DNA, 25 bp, Homo sapien
gagaagatacatgagggcttaaaca

SEQ ID NO: 232099 - DNA, 25 bp, Homo sapien
gagaagcaagatatcaatgtagcag

SEQ ID NO: 232100 - DNA, 25 bp, Homo sapien
gaagcaagatatcaatgtagcagaa

SEQ ID NO: 232101 - DNA, 25 bp, Homo sapien
tgtagcagaattgcacttgtgcctc

SEQ ID NO: 232102 - DNA, 25 bp, Homo sapien
tagcagaattgcacttgtgcctcac

SEQ ID NO: 232103 - DNA, 25 bp, Homo sapien
gcagaattgcacttgtgcctcacga

SEQ ID NO: 232104 - DNA, 25 bp, Homo sapien
agaattgcacttgtgcctcacgaac

SEQ ID NO: 232105 - DNA, 25 bp, Homo sapien
aattgcacttgtgcctcacgaacat

SEQ ID NO: 232106 - DNA, 25 bp, Homo sapien
ttgcacttgtgcctcacgaacatac

SEQ ID NO: 232107 - DNA, 25 bp, Homo sapien
gcacttgtgcctcacgaacatacat

SEQ ID NO: 232108 - DNA, 25 bp, Homo sapien
cttgtgcctcacgaacatacataaa

SEQ ID NO: 232109 - DNA, 25 bp, Homo sapien
gtgcctcacgaacatacataaattt

SEQ ID NO: 232110 - DNA, 25 bp, Homo sapien
ttcttttttcatttactccagtgag

SEQ ID NO: 232111 - DNA, 25 bp, Homo sapien
actccagtgagtttctgctgtcttt

SEQ ID NO: 232112 - DNA, 25 bp, Homo sapien
gctgtctttttcaagtatgtaccat

SEQ ID NO: 232113 - DNA, 25 bp, Homo sapien
aaaggtgatttggatgcgttgtaac

SEQ ID NO: 232114 - DNA, 25 bp, Homo sapien
ggatgcgttgtaacactgctaaata

SEQ ID NO: 232115 - DNA, 25 bp, Homo sapien
agaattttatctacagtactgtgag

SEQ ID NO: 232116 - DNA, 25 bp, Homo sapien
cagtcaattattgcctagggtagtt

SEQ ID NO: 232117 - DNA, 25 bp, Homo sapien
gatgtgagctagttaagcctttgct

SEQ ID NO: 232118 - DNA, 25 bp, Homo sapien
aagcctttgcttgactgatttcagt

SEQ ID NO: 232119 - DNA, 25 bp, Homo sapien
agtgtgtaccaatcaaggctcttta

SEQ ID NO: 232120 - DNA, 25 bp, Homo sapien
taaaatacggaacgactcacttaat

SEQ ID NO: 232121 - DNA, 25 bp, Homo sapien
cctgcctcattacccaattacataa

SEQ ID NO: 232122 - DNA, 25 bp, Homo sapien
gcctcattacccaattacataaata

SEQ ID NO: 232123 - DNA, 25 bp, Homo sapien
aggtgaaattgttgatctattattt

SEQ ID NO: 232124 - DNA, 25 bp, Homo sapien
tatttcaaagacttgtagactagca

SEQ ID NO: 232125 - DNA, 25 bp, Homo sapien
gtagactagcaaagattcattctga

SEQ ID NO: 232126 - DNA, 25 bp, Homo sapien
taaggtctatagctaaagatatttt

SEQ ID NO: 232127 - DNA, 25 bp, Homo sapien
catttgtaacattggatatgaagac

SEQ ID NO: 232128 - DNA, 25 bp, Homo sapien
atataaactcaattttatctgcatt

SEQ ID NO: 232129 - DNA, 25 bp, Homo sapien
aaataatctgattgcatgtatgaag

SEQ ID NO: 232130 - DNA, 25 bp, Homo sapien
ttgcatgtatgaaggactcctgcct

SEQ ID NO: 232131 - DNA, 25 bp, Homo sapien
tgtatgaaggactcctgcctcatta

SEQ ID NO: 232132 - DNA, 25 bp, Homo sapien
gcccttcgggaagtgggaatgtcct

SEQ ID NO: 232133 - DNA, 25 bp, Homo sapien
gtgggaatgtccttggcatcattgt

SEQ ID NO: 232134 - DNA, 25 bp, Homo sapien
catcattgtgacgtgtgtggcaaac

SEQ ID NO: 232135 - DNA, 25 bp, Homo sapien
tgtggcaaaccttcgacttcatttt

SEQ ID NO: 232136 - DNA, 25 bp, Homo sapien
tctgccccaattcgttctgtaagga

SEQ ID NO: 232137 - DNA, 25 bp, Homo sapien
ttcgttctgtaaggagcaccaggac

SEQ ID NO: 232138 - DNA, 25 bp, Homo sapien
accaggacgggacagccttcagctg

SEQ ID NO: 232139 - DNA, 25 bp, Homo sapien
acgggcggtcctactgctgtgagca

SEQ ID NO: 232140 - DNA, 25 bp, Homo sapien
gtcctactgctgtgagcatgactta

SEQ ID NO: 232141 - DNA, 25 bp, Homo sapien
gggcggcatcggtcagaagcaccaa

SEQ ID NO: 232142 - DNA, 25 bp, Homo sapien
agaagcaccaagactgagaagcccc

SEQ ID NO: 232143 - DNA, 25 bp, Homo sapien
tcatttctacttaatggaacttgtg

SEQ ID NO: 232144 - DNA, 25 bp, Homo sapien
ggaacttgtgttctgagggtcatta

SEQ ID NO: 232145 - DNA, 25 bp, Homo sapien
gtgttctgagggtcattatggtatc

SEQ ID NO: 232146 - DNA, 25 bp, Homo sapien
ctgagggtcattatggtatcgtaat

SEQ ID NO: 232147 - DNA, 25 bp, Homo sapien
taaagcttggatgatgttcctgatt

SEQ ID NO: 232148 - DNA, 25 bp, Homo sapien
gcttggatgatgttcctgattatct

SEQ ID NO: 232149 - DNA, 25 bp, Homo sapien
ggatgatgttcctgattatctgaga

SEQ ID NO: 232150 - DNA, 25 bp, Homo sapien
gatgttcctgattatctgagaaaca

SEQ ID NO: 232151 - DNA, 25 bp, Homo sapien
gaacatgctgccataacttagatta

SEQ ID NO: 232152 - DNA, 25 bp, Homo sapien
cataacttagattattcttggttaa

SEQ ID NO: 232153 - DNA, 25 bp, Homo sapien
gtaatcaataaaaccactcttatgt

SEQ ID NO: 232154 - DNA, 25 bp, Homo sapien
tgaaagacgtcattactctacggag

SEQ ID NO: 232155 - DNA, 25 bp, Homo sapien
taagaggaaggtgacaacgaaaatc

SEQ ID NO: 232156 - DNA, 25 bp, Homo sapien
ggtgacaacgaaaatcaaccatcat

SEQ ID NO: 232157 - DNA, 25 bp, Homo sapien
accgccagaaaacagtaagatgtgc

SEQ ID NO: 232158 - DNA, 25 bp, Homo sapien
gtaagatgtgccttgacacaaatac

SEQ ID NO: 232159 - DNA, 25 bp, Homo sapien
agatgtgccttgacacaaatactgt

SEQ ID NO: 232160 - DNA, 25 bp, Homo sapien
atgtgccttgacacaaatactgttg

SEQ ID NO: 232161 - DNA, 25 bp, Homo sapien
gtgccttgacacaaatactgttgta

SEQ ID NO: 232162 - DNA, 25 bp, Homo sapien
gccttgacacaaatactgttgtatg

SEQ ID NO: 232163 - DNA, 25 bp, Homo sapien
aatactgttgtatgaaccatgtgcc

SEQ ID NO: 232164 - DNA, 25 bp, Homo sapien
tactgttgtatgaaccatgtgccaa

SEQ ID NO: 232165 - DNA, 25 bp, Homo sapien
atcttccctttccacagataacttc

SEQ ID NO: 232166 - DNA, 25 bp, Homo sapien
gataacttctgttaacaacttgata

SEQ ID NO: 232167 - DNA, 25 bp, Homo sapien
atgtcattgacacctctcttcttta

SEQ ID NO: 232168 - DNA, 25 bp, Homo sapien
attgacacctctcttctttactttt

SEQ ID NO: 232169 - DNA, 25 bp, Homo sapien
ttttccccatatctaatcattcctc

SEQ ID NO: 232170 - DNA, 25 bp, Homo sapien
tatcagctagaatctatctccttat

SEQ ID NO: 232171 - DNA, 25 bp, Homo sapien
tatctccttatttctacctctattg

SEQ ID NO: 232172 - DNA, 25 bp, Homo sapien
tctattgccactctgatccaggcta

SEQ ID NO: 232173 - DNA, 25 bp, Homo sapien
tgatccaggctaccagcatttccct

SEQ ID NO: 232174 - DNA, 25 bp, Homo sapien
tccctcttaggcttctgaagcaact

SEQ ID NO: 232175 - DNA, 25 bp, Homo sapien
agcaacttcctaactcccacttgtg

SEQ ID NO: 232176 - DNA, 25 bp, Homo sapien
aatatgactgccttattattgctag

SEQ ID NO: 232177 - DNA, 25 bp, Homo sapien
gactgccttattattgctagtgcca

SEQ ID NO: 232178 - DNA, 25 bp, Homo sapien
tgccttattattgctagtgccatat

SEQ ID NO: 232179 - DNA, 25 bp, Homo sapien
gctagtgccatattgtcaggtgcga

SEQ ID NO: 232180 - DNA, 25 bp, Homo sapien
tagtgccatattgtcaggtgcgaat

SEQ ID NO: 232181 - DNA, 25 bp, Homo sapien
atattgtcaggtgcgaatggtgctc

SEQ ID NO: 232182 - DNA, 25 bp, Homo sapien
ttgtcaggtgcgaatggtgctcaaa

SEQ ID NO: 232183 - DNA, 25 bp, Homo sapien
caggtgcgaatggtgctcaaaagtt

SEQ ID NO: 232184 - DNA, 25 bp, Homo sapien
gtgcgaatggtgctcaaaagttgta

SEQ ID NO: 232185 - DNA, 25 bp, Homo sapien
gaatggtgctcaaaagttgtatcat

SEQ ID NO: 232186 - DNA, 25 bp, Homo sapien
tggtgctcaaaagttgtatcattaa

SEQ ID NO: 232187 - DNA, 25 bp, Homo sapien
ttttctcttaagtcacagttcccag

SEQ ID NO: 232188 - DNA, 25 bp, Homo sapien
tcacagttcccagaggtgcatgtgg

SEQ ID NO: 232189 - DNA, 25 bp, Homo sapien
cagtgacctttcatgtgtggttcct

SEQ ID NO: 232190 - DNA, 25 bp, Homo sapien
cctttcatgtgtggttcctgtctca

SEQ ID NO: 232191 - DNA, 25 bp, Homo sapien
gtgcaaaaagcccagcgtagttaag

SEQ ID NO: 232192 - DNA, 25 bp, Homo sapien
gcccagcgtagttaagcttttcaga

SEQ ID NO: 232193 - DNA, 25 bp, Homo sapien
tgtgctttattacagtcatacaaat

SEQ ID NO: 232194 - DNA, 25 bp, Homo sapien
gtcatacaaattttgtaacccctgt

SEQ ID NO: 232195 - DNA, 25 bp, Homo sapien
gataaaatgctgtccttgccaaatt

SEQ ID NO: 232196 - DNA, 25 bp, Homo sapien
tgccaaattgtggtttctgctttat

SEQ ID NO: 232197 - DNA, 25 bp, Homo sapien
gctttatctttcaagaagtctccat

SEQ ID NO: 232198 - DNA, 25 bp, Homo sapien
gagaaagtacacaggataggaaaga

SEQ ID NO: 232199 - DNA, 25 bp, Homo sapien
atagaatcttggagacgctgacgtc

SEQ ID NO: 232200 - DNA, 25 bp, Homo sapien
gacgctgacgtctgaggacaagcta

SEQ ID NO: 232201 - DNA, 25 bp, Homo sapien
gacgtctgaggacaagctatgcctt

SEQ ID NO: 232202 - DNA, 25 bp, Homo sapien
gaggacaagctatgccttcaagagg

SEQ ID NO: 232203 - DNA, 25 bp, Homo sapien
aggcaaaaatgcatgacccaatgaa

SEQ ID NO: 232204 - DNA, 25 bp, Homo sapien
aatgcatgacccaatgaacccagcc

SEQ ID NO: 232205 - DNA, 25 bp, Homo sapien
aaaggcctcctttcactgagtcata

SEQ ID NO: 232206 - DNA, 25 bp, Homo sapien
cactgagtcatatctgtgggctcct

SEQ ID NO: 232207 - DNA, 25 bp, Homo sapien
tattggctggagatataacttagag

SEQ ID NO: 232208 - DNA, 25 bp, Homo sapien
ttagagtaatcactgttataagcaa

SEQ ID NO: 232209 - DNA, 25 bp, Homo sapien
tcttcctttcgaggaaataaaattg

SEQ ID NO: 232210 - DNA, 25 bp, Homo sapien
cctgaaagacgtcattactctacgg

SEQ ID NO: 232211 - DNA, 25 bp, Homo sapien
ctgaaagacgtcattactctacgga

SEQ ID NO: 232212 - DNA, 25 bp, Homo sapien
tgaaagacgtcattactctacggag

SEQ ID NO: 232213 - DNA, 25 bp, Homo sapien
gtaagaggaaggtgacaacgaaaat

SEQ ID NO: 232214 - DNA, 25 bp, Homo sapien
taagaggaaggtgacaacgaaaatc

SEQ ID NO: 232215 - DNA, 25 bp, Homo sapien
aagaggaaggtgacaacgaaaatca

SEQ ID NO: 232216 - DNA, 25 bp, Homo sapien
agaggaaggtgacaacgaaaatcaa

SEQ ID NO: 232217 - DNA, 25 bp, Homo sapien
gaggaaggtgacaacgaaaatcaac

SEQ ID NO: 232218 - DNA, 25 bp, Homo sapien
aatcctacattcagccatcgggaca

SEQ ID NO: 232219 - DNA, 25 bp, Homo sapien
tacattcagccatcgggacaagtct

SEQ ID NO: 232220 - DNA, 25 bp, Homo sapien
tcagccatcgggacaagtctgtcgg

SEQ ID NO: 232221 - DNA, 25 bp, Homo sapien
ggaggtagttcatggtttacaagcc

SEQ ID NO: 232222 - DNA, 25 bp, Homo sapien
ggtagttcatggtttacaagccttt

SEQ ID NO: 232223 - DNA, 25 bp, Homo sapien
gttcatggtttacaagcctttgctt

SEQ ID NO: 232224 - DNA, 25 bp, Homo sapien
catggtttacaagcctttgcttttt

SEQ ID NO: 232225 - DNA, 25 bp, Homo sapien
ccaatttcctttaaagcacaactag

SEQ ID NO: 232226 - DNA, 25 bp, Homo sapien
agcacaactagctatttgtttacaa

SEQ ID NO: 232227 - DNA, 25 bp, Homo sapien
gtatagtgtatcatcatttttgcca

SEQ ID NO: 232228 - DNA, 25 bp, Homo sapien
gtgtatcatcatttttgccaaatat

SEQ ID NO: 232229 - DNA, 25 bp, Homo sapien
aagaatgaccatgttcttttctact

SEQ ID NO: 232230 - DNA, 25 bp, Homo sapien
tgagcagagcaaccttgtgttcaac

SEQ ID NO: 232231 - DNA, 25 bp, Homo sapien
gagcaaccttgtgttcaacattcag

SEQ ID NO: 232232 - DNA, 25 bp, Homo sapien
tgtgttcaacattcagccagcccca

SEQ ID NO: 232233 - DNA, 25 bp, Homo sapien
gattcttctgtatcaaacctggaaa

SEQ ID NO: 232234 - DNA, 25 bp, Homo sapien
aatcatgaaccatctgacatcgtga

SEQ ID NO: 232235 - DNA, 25 bp, Homo sapien
atctgacatcgtgaacagtctgcag

SEQ ID NO: 232236 - DNA, 25 bp, Homo sapien
tcgtgaacagtctgcagtgggctat

SEQ ID NO: 232237 - DNA, 25 bp, Homo sapien
caagtcttatttccttatcatccca

SEQ ID NO: 232238 - DNA, 25 bp, Homo sapien
gtcttatttccttatcatcccatta

SEQ ID NO: 232239 - DNA, 25 bp, Homo sapien
tatcatcccattaaatgttgtcatt

SEQ ID NO: 232240 - DNA, 25 bp, Homo sapien
atccttgtgcaaatttagattgggc

SEQ ID NO: 232241 - DNA, 25 bp, Homo sapien
tagattgggccaacttctagaggca

SEQ ID NO: 232242 - DNA, 25 bp, Homo sapien
tagaggcaccaatgccttcttagtg

SEQ ID NO: 232243 - DNA, 25 bp, Homo sapien
tgccttcttagtgtggaatcatttt

SEQ ID NO: 232244 - DNA, 25 bp, Homo sapien
ggaatcatttttctgccctttagtc

SEQ ID NO: 232245 - DNA, 25 bp, Homo sapien
aatcatttttctgccctttagtcgt

SEQ ID NO: 232246 - DNA, 25 bp, Homo sapien
gtagaaagtatctctcaaaatatat

SEQ ID NO: 232247 - DNA, 25 bp, Homo sapien
gtagaactatgttatagtccagtct

SEQ ID NO: 232248 - DNA, 25 bp, Homo sapien
atgttatagtccagtctacttcttt

SEQ ID NO: 232249 - DNA, 25 bp, Homo sapien
aaaaaccatttaaactgctagatag

SEQ ID NO: 232250 - DNA, 25 bp, Homo sapien
gaaaattcattctttataggtcttt

SEQ ID NO: 232251 - DNA, 25 bp, Homo sapien
aaataaatgactggccaaacttgga

SEQ ID NO: 232252 - DNA, 25 bp, Homo sapien
caaacttggagcaggtgtccatccc

SEQ ID NO: 232253 - DNA, 25 bp, Homo sapien
atcccagccctgtgtagttagagca

SEQ ID NO: 232254 - DNA, 25 bp, Homo sapien
gttagagcaggaatcaagatctcaa

SEQ ID NO: 232255 - DNA, 25 bp, Homo sapien
aatcaagatctcaacacaaatgtgg

SEQ ID NO: 232256 - DNA, 25 bp, Homo sapien
acaaatgtggctgccaagcactcag

SEQ ID NO: 232257 - DNA, 25 bp, Homo sapien
gacatcacaagatacgtgtgtaccc

SEQ ID NO: 232258 - DNA, 25 bp, Homo sapien
gatacgtgtgtacccaacaatctct

SEQ ID NO: 232259 - DNA, 25 bp, Homo sapien
tgtacccaacaatctctgatctctg

SEQ ID NO: 232260 - DNA, 25 bp, Homo sapien
tgatctctgctgatcttttgcttag

SEQ ID NO: 232261 - DNA, 25 bp, Homo sapien
gatcttttgcttagacgttaacttg

SEQ ID NO: 232262 - DNA, 25 bp, Homo sapien
atggtcactagagattgggacttac

SEQ ID NO: 232263 - DNA, 25 bp, Homo sapien
tcactagagattgggacttaccctt

SEQ ID NO: 232264 - DNA, 25 bp, Homo sapien
ggcttgagaatggaaggatcctcat

SEQ ID NO: 232265 - DNA, 25 bp, Homo sapien
aatggaaggatcctcatttctgccc

SEQ ID NO: 232266 - DNA, 25 bp, Homo sapien
tggaaggatcctcatttctgccctt

SEQ ID NO: 232267 - DNA, 25 bp, Homo sapien
tcagatctcctacctctccttaagt

SEQ ID NO: 232268 - DNA, 25 bp, Homo sapien
tcctacctctccttaagtcttgtag

SEQ ID NO: 232269 - DNA, 25 bp, Homo sapien
ctacctctccttaagtcttgtaggg

SEQ ID NO: 232270 - DNA, 25 bp, Homo sapien
caaggatggctcttctaaccagagg

SEQ ID NO: 232271 - DNA, 25 bp, Homo sapien
ggatggctcttctaaccagaggctg

SEQ ID NO: 232272 - DNA, 25 bp, Homo sapien
atggctcttctaaccagaggctggc

SEQ ID NO: 232273 - DNA, 25 bp, Homo sapien
tgtctctataattcgcaaactggga

SEQ ID NO: 232274 - DNA, 25 bp, Homo sapien
aactgggagttcatgggtacagagc

SEQ ID NO: 232275 - DNA, 25 bp, Homo sapien
gggtacagagcaacttcagccccag

SEQ ID NO: 232276 - DNA, 25 bp, Homo sapien
cagctcccaagtcccaaagtgtggt

SEQ ID NO: 232277 - DNA, 25 bp, Homo sapien
gtgcagacaaggaccaaccaagttc

SEQ ID NO: 232278 - DNA, 25 bp, Homo sapien
aagttcaaccaagtctctcgtatgc

SEQ ID NO: 232279 - DNA, 25 bp, Homo sapien
gaaatttattacaaggccctcatag

SEQ ID NO: 232280 - DNA, 25 bp, Homo sapien
aagtctctcgtatgcagacgccagc

SEQ ID NO: 232281 - DNA, 25 bp, Homo sapien
agacgccagctccagtctcaaggag

SEQ ID NO: 232282 - DNA, 25 bp, Homo sapien
atagatatctatgcttcccatctcg

SEQ ID NO: 232283 - DNA, 25 bp, Homo sapien
atctcgctctcagtggttcgaataa

SEQ ID NO: 232284 - DNA, 25 bp, Homo sapien
attggtgatagcagagctccaggcc

SEQ ID NO: 232285 - DNA, 25 bp, Homo sapien
ctcccttccagtcagaacagttgag

SEQ ID NO: 232286 - DNA, 25 bp, Homo sapien
gtcagaacagttgagcagtttacaa

SEQ ID NO: 232287 - DNA, 25 bp, Homo sapien
gtttacaaattagtgtcctgcctct

SEQ ID NO: 232288 - DNA, 25 bp, Homo sapien
tgtcctgcctctttgctagcaaatg

SEQ ID NO: 232289 - DNA, 25 bp, Homo sapien
agcaaatgcttttagacactgtggc

SEQ ID NO: 232290 - DNA, 25 bp, Homo sapien
actgtggcagtgagtcatcctctaa

SEQ ID NO: 232291 - DNA, 25 bp, Homo sapien
gtgagtcatcctctaatttctatga

SEQ ID NO: 232292 - DNA, 25 bp, Homo sapien
tcctctaatttctatgactgcattt

SEQ ID NO: 232293 - DNA, 25 bp, Homo sapien
cctaatgtgttctggtcatccctga

SEQ ID NO: 232294 - DNA, 25 bp, Homo sapien
ggtcatccctgattgatgctatctg

SEQ ID NO: 232295 - DNA, 25 bp, Homo sapien
gtaatacaggaattttgccacaacc

SEQ ID NO: 232296 - DNA, 25 bp, Homo sapien
ttgccacaaccagttgggacagtct

SEQ ID NO: 232297 - DNA, 25 bp, Homo sapien
gggacagtcttgttgcaaataccag

SEQ ID NO: 232298 - DNA, 25 bp, Homo sapien
taccagaacctcaagaatcgaacag

SEQ ID NO: 232299 - DNA, 25 bp, Homo sapien
atttaatagcccttccagcattttc

SEQ ID NO: 232300 - DNA, 25 bp, Homo sapien
ccagcattttcacaggtggaccctg

SEQ ID NO: 232301 - DNA, 25 bp, Homo sapien
tggaccctgaggtatttgctgccct

SEQ ID NO: 232302 - DNA, 25 bp, Homo sapien
tgcccttcctgctgaacttcagagg

SEQ ID NO: 232303 - DNA, 25 bp, Homo sapien
aggcagggcgagaacagcactcacc

SEQ ID NO: 232304 - DNA, 25 bp, Homo sapien
agccagcgcatctgtgccaaagaat

SEQ ID NO: 232305 - DNA, 25 bp, Homo sapien
tgtgccaaagaatcctttacttcat

SEQ ID NO: 232306 - DNA, 25 bp, Homo sapien
gaaaggctcactctcaagcacgact

SEQ ID NO: 232307 - DNA, 25 bp, Homo sapien
aaaggctcactctcaagcacgacta

SEQ ID NO: 232308 - DNA, 25 bp, Homo sapien
aaggctcactctcaagcacgactaa

SEQ ID NO: 232309 - DNA, 25 bp, Homo sapien
ctctcaagcacgactaagagccttc

SEQ ID NO: 232310 - DNA, 25 bp, Homo sapien
gccttctgagcccagcgacttctga

SEQ ID NO: 232311 - DNA, 25 bp, Homo sapien
ccttctgagcccagcgacttctgaa

SEQ ID NO: 232312 - DNA, 25 bp, Homo sapien
cttctgagcccagcgacttctgaag

SEQ ID NO: 232313 - DNA, 25 bp, Homo sapien
tctgagcccagcgacttctgaaggg

SEQ ID NO: 232314 - DNA, 25 bp, Homo sapien
ctgagcccagcgacttctgaagggc

SEQ ID NO: 232315 - DNA, 25 bp, Homo sapien
gagcccagcgacttctgaagggccc

SEQ ID NO: 232316 - DNA, 25 bp, Homo sapien
gcccagcgacttctgaagggcccct

SEQ ID NO: 232317 - DNA, 25 bp, Homo sapien
atgagcaccctcacctggcctgagt

SEQ ID NO: 232318 - DNA, 25 bp, Homo sapien
ctcacctggcctgagtgctgaaaaa

SEQ ID NO: 232319 - DNA, 25 bp, Homo sapien
cacctggcctgagtgctgaaaaaca

SEQ ID NO: 232320 - DNA, 25 bp, Homo sapien
ctggcctgagtgctgaaaaacagaa

SEQ ID NO: 232321 - DNA, 25 bp, Homo sapien
caaagatgaagcactggatggaagt

SEQ ID NO: 232322 - DNA, 25 bp, Homo sapien
aagcactggatggaagttgacctcc

SEQ ID NO: 232323 - DNA, 25 bp, Homo sapien
gaagttgacctccaagcagggagca

SEQ ID NO: 232324 - DNA, 25 bp, Homo sapien
aagcagggagcaggcaactcagcac

SEQ ID NO: 232325 - DNA, 25 bp, Homo sapien
gcagggagcaggcaactcagcacca

SEQ ID NO: 232326 - DNA, 25 bp, Homo sapien
agggagcaggcaactcagcaccagc

SEQ ID NO: 232327 - DNA, 25 bp, Homo sapien
gagcaggcaactcagcaccagccta

SEQ ID NO: 232328 - DNA, 25 bp, Homo sapien
tcaagccaaaaagccgggacctttg

SEQ ID NO: 232329 - DNA, 25 bp, Homo sapien
aaaaagccgggacctttgcgcagct

SEQ ID NO: 232330 - DNA, 25 bp, Homo sapien
tttgcgcagctctgtcgactctggt

SEQ ID NO: 232331 - DNA, 25 bp, Homo sapien
agctctgtcgactctggtgggtccc

SEQ ID NO: 232332 - DNA, 25 bp, Homo sapien
gggctgactgggtctggtccttacc

SEQ ID NO: 232333 - DNA, 25 bp, Homo sapien
tgggtctggtccttaccaacataga

SEQ ID NO: 232334 - DNA, 25 bp, Homo sapien
ggtccttaccaacatagacggtgca

SEQ ID NO: 232335 - DNA, 25 bp, Homo sapien
agacggtgcaaacactcttaacagt

SEQ ID NO: 232336 - DNA, 25 bp, Homo sapien
aacagtgttgtttttgtatcaatat

SEQ ID NO: 232337 - DNA, 25 bp, Homo sapien
tttgtatcaatatgtttgtgcagtg

SEQ ID NO: 232338 - DNA, 25 bp, Homo sapien
tatttatttctcagacttggggcga

SEQ ID NO: 232339 - DNA, 25 bp, Homo sapien
gaatgagtggctgctattctgtttc

SEQ ID NO: 232340 - DNA, 25 bp, Homo sapien
gtttccagaatcagaggtaacgcat

SEQ ID NO: 232341 - DNA, 25 bp, Homo sapien
ggtaacgcatagcttctagttcgaa

SEQ ID NO: 232342 - DNA, 25 bp, Homo sapien
cttctagttcgaacgcctctaagga

SEQ ID NO: 232343 - DNA, 25 bp, Homo sapien
atgtattcttccttgagatgactga

SEQ ID NO: 232344 - DNA, 25 bp, Homo sapien
atgactgaggtctctacggtgcaca

SEQ ID NO: 232345 - DNA, 25 bp, Homo sapien
aggtctctacggtgcacagggcgat

SEQ ID NO: 232346 - DNA, 25 bp, Homo sapien
acagggcgatgggacataccgtacc

SEQ ID NO: 232347 - DNA, 25 bp, Homo sapien
ataccgtacctcgagcagtgtagca

SEQ ID NO: 232348 - DNA, 25 bp, Homo sapien
tgtagcatgctgttactaaggcctt

SEQ ID NO: 232349 - DNA, 25 bp, Homo sapien
aaggagcatctcattccaccagaac

SEQ ID NO: 232350 - DNA, 25 bp, Homo sapien
agatcaaatttgactccactttagg

SEQ ID NO: 232351 - DNA, 25 bp, Homo sapien
tccactttaggagtcccaaagcaaa

SEQ ID NO: 232352 - DNA, 25 bp, Homo sapien
gcaaatgtccatgtctaagatgaat

SEQ ID NO: 232353 - DNA, 25 bp, Homo sapien
aacttgcatagtcattctgtgctat

SEQ ID NO: 232354 - DNA, 25 bp, Homo sapien
tgtgctatattgtaactgccagatg

SEQ ID NO: 232355 - DNA, 25 bp, Homo sapien
aaggcaacagtggactcagacttct

SEQ ID NO: 232356 - DNA, 25 bp, Homo sapien
tcagacttctgaggaatttgggttt

SEQ ID NO: 232357 - DNA, 25 bp, Homo sapien
gtttgttcccctttgtagactaatg

SEQ ID NO: 232358 - DNA, 25 bp, Homo sapien
taggttgctgttgtgcgaagatcgt

SEQ ID NO: 232359 - DNA, 25 bp, Homo sapien
gatcgtgtaactttagcagacatgt

SEQ ID NO: 232360 - DNA, 25 bp, Homo sapien
gacatgtatttcttgcacagctaat

SEQ ID NO: 232361 - DNA, 25 bp, Homo sapien
tcgcagaggcatttttggaacatct

SEQ ID NO: 232362 - DNA, 25 bp, Homo sapien
aagtaatcctgccatcatcaggcag

SEQ ID NO: 232363 - DNA, 25 bp, Homo sapien
tcaggcaggctgctggaaattatat

SEQ ID NO: 232364 - DNA, 25 bp, Homo sapien
atattggaagctttttggcaagagc

SEQ ID NO: 232365 - DNA, 25 bp, Homo sapien
agatcttttggttaactggctgcac

SEQ ID NO: 232366 - DNA, 25 bp, Homo sapien
taactggctgcacatataccttaat

SEQ ID NO: 232367 - DNA, 25 bp, Homo sapien
tataccttaataaccaggattcggg

SEQ ID NO: 232368 - DNA, 25 bp, Homo sapien
caggattcgggaacaaaggcattct

SEQ ID NO: 232369 - DNA, 25 bp, Homo sapien
aaggcattctgcgatgttgctctcc

SEQ ID NO: 232370 - DNA, 25 bp, Homo sapien
gatgttgctctccatggaccatttt

SEQ ID NO: 232371 - DNA, 25 bp, Homo sapien
gattccacggaaggattgtttaata

SEQ ID NO: 232372 - DNA, 25 bp, Homo sapien
gagggacaccgggatcgcactcctg

SEQ ID NO: 232373 - DNA, 25 bp, Homo sapien
gggacaccgggatcgcactcctgta

SEQ ID NO: 232374 - DNA, 25 bp, Homo sapien
gggatcgcactcctgtactggccac

SEQ ID NO: 232375 - DNA, 25 bp, Homo sapien
gccgctgtcacttgtcacattgagt

SEQ ID NO: 232376 - DNA, 25 bp, Homo sapien
cgctgtcacttgtcacattgagttc

SEQ ID NO: 232377 - DNA, 25 bp, Homo sapien
gaaaagcaattcaccaacgactgat

SEQ ID NO: 232378 - DNA, 25 bp, Homo sapien
agcaattcaccaacgactgatctct

SEQ ID NO: 232379 - DNA, 25 bp, Homo sapien
aattcaccaacgactgatctctcca

SEQ ID NO: 232380 - DNA, 25 bp, Homo sapien
ttcaccaacgactgatctctccatt

SEQ ID NO: 232381 - DNA, 25 bp, Homo sapien
cagaagtgtgcagtcttaaatgtac

SEQ ID NO: 232382 - DNA, 25 bp, Homo sapien
gtgtgcagtcttaaatgtacagcga

SEQ ID NO: 232383 - DNA, 25 bp, Homo sapien
tgaaagcacatgtttcagtgccact

SEQ ID NO: 232384 - DNA, 25 bp, Homo sapien
aaagcacatgtttcagtgccactca

SEQ ID NO: 232385 - DNA, 25 bp, Homo sapien
gtgccactcacataagaagtgcccg

SEQ ID NO: 232386 - DNA, 25 bp, Homo sapien
gaagtgcccggtaagtgttagctat

SEQ ID NO: 232387 - DNA, 25 bp, Homo sapien
attgtctacttgagttactactttc

SEQ ID NO: 232388 - DNA, 25 bp, Homo sapien
gtctacttgagttactactttctaa

SEQ ID NO: 232389 - DNA, 25 bp, Homo sapien
gaaaattgcctttgtctcatataat

SEQ ID NO: 232390 - DNA, 25 bp, Homo sapien
attgcctttgtctcatataatgctt

SEQ ID NO: 232391 - DNA, 25 bp, Homo sapien
gtctcatataatgcttttcatattg

SEQ ID NO: 232392 - DNA, 25 bp, Homo sapien
aactatattttgtctgctattaaat

SEQ ID NO: 232393 - DNA, 25 bp, Homo sapien
ttttgtctgctattaaatacttcca

SEQ ID NO: 232394 - DNA, 25 bp, Homo sapien
ctccaccaggacacatgtataggac

SEQ ID NO: 232395 - DNA, 25 bp, Homo sapien
acatgtataggacactgtgctgtgt

SEQ ID NO: 232396 - DNA, 25 bp, Homo sapien
ggaaagttcagacagtgcctctaga

SEQ ID NO: 232397 - DNA, 25 bp, Homo sapien
ttcagacagtgcctctagattgtgt

SEQ ID NO: 232398 - DNA, 25 bp, Homo sapien
agtgcctctagattgtgttttgcct

SEQ ID NO: 232399 - DNA, 25 bp, Homo sapien
tgcctcctccaatgtagagttgaca

SEQ ID NO: 232400 - DNA, 25 bp, Homo sapien
tcctccaatgtagagttgacatctg

SEQ ID NO: 232401 - DNA, 25 bp, Homo sapien
agcagggctttctgtcagacatgct

SEQ ID NO: 232402 - DNA, 25 bp, Homo sapien
ttctgtcagacatgctagggtggta

SEQ ID NO: 232403 - DNA, 25 bp, Homo sapien
tagggtggtagaaatgggccctcca

SEQ ID NO: 232404 - DNA, 25 bp, Homo sapien
actgggcagagacctccggaaagcc

SEQ ID NO: 232405 - DNA, 25 bp, Homo sapien
caccctctgatagatattcctttaa

SEQ ID NO: 232406 - DNA, 25 bp, Homo sapien
gatattcctttaatgcaccagactt

SEQ ID NO: 232407 - DNA, 25 bp, Homo sapien
aatgcaccagacttcatgtttgata

SEQ ID NO: 232408 - DNA, 25 bp, Homo sapien
ggttgaaattgtttctcttcttttg

SEQ ID NO: 232409 - DNA, 25 bp, Homo sapien
tttgtgttttcccagttaatagatg

SEQ ID NO: 232410 - DNA, 25 bp, Homo sapien
gttaatagatggtcactgtttccac

SEQ ID NO: 232411 - DNA, 25 bp, Homo sapien
gatggtcactgtttccacaatgttt

SEQ ID NO: 232412 - DNA, 25 bp, Homo sapien
aatgttttatactttcagctttttg

SEQ ID NO: 232413 - DNA, 25 bp, Homo sapien
gtgcataatgtttttctgagcttct

SEQ ID NO: 232414 - DNA, 25 bp, Homo sapien
ctgtaaatgccatcccaatgtggtt

SEQ ID NO: 232415 - DNA, 25 bp, Homo sapien
atgccatcccaatgtggtttggttt

SEQ ID NO: 232416 - DNA, 25 bp, Homo sapien
cagtgagcggacaggtgaagtacac

SEQ ID NO: 232417 - DNA, 25 bp, Homo sapien
acaggtgaagtacacgccaggcaca

SEQ ID NO: 232418 - DNA, 25 bp, Homo sapien
tctgggctcagataccacgttggtc

SEQ ID NO: 232419 - DNA, 25 bp, Homo sapien
ctcagataccacgttggtccctggg

SEQ ID NO: 232420 - DNA, 25 bp, Homo sapien
cccgctgacggtggcttcggcttga

SEQ ID NO: 232421 - DNA, 25 bp, Homo sapien
gtggcttcggcttgaagttcctttc

SEQ ID NO: 232422 - DNA, 25 bp, Homo sapien
ttcggcttgaagttcctttctcacc

SEQ ID NO: 232423 - DNA, 25 bp, Homo sapien
ttgaagttcctttctcacctggttt

SEQ ID NO: 232424 - DNA, 25 bp, Homo sapien
ttctcacctggtttcggatggtgtc

SEQ ID NO: 232425 - DNA, 25 bp, Homo sapien
ctggtttcggatggtgtcctgcgat

SEQ ID NO: 232426 - DNA, 25 bp, Homo sapien
ttgatgcaggcgtcccgctggtcct

SEQ ID NO: 232427 - DNA, 25 bp, Homo sapien
aatactgtcttaatacagagcagca

SEQ ID NO: 232428 - DNA, 25 bp, Homo sapien
tacagagcagcatttttgtaacaaa

SEQ ID NO: 232429 - DNA, 25 bp, Homo sapien
gactcgctggagctatttggtgctt

SEQ ID NO: 232430 - DNA, 25 bp, Homo sapien
cgctggagctatttggtgcttgaat

SEQ ID NO: 232431 - DNA, 25 bp, Homo sapien
gtgcttgaatgtgaccatccttttt

SEQ ID NO: 232432 - DNA, 25 bp, Homo sapien
catcctttttacttttgctaagcct

SEQ ID NO: 232433 - DNA, 25 bp, Homo sapien
taaattttgtataccgtggaatatg

SEQ ID NO: 232434 - DNA, 25 bp, Homo sapien
gtcaaatcattttagtgctgaaggt

SEQ ID NO: 232435 - DNA, 25 bp, Homo sapien
gtgctgaaggtttttgatttcttgt

SEQ ID NO: 232436 - DNA, 25 bp, Homo sapien
gtattgtaagatggcacttgctgat

SEQ ID NO: 232437 - DNA, 25 bp, Homo sapien
atggcacttgctgatataaatacta

SEQ ID NO: 232438 - DNA, 25 bp, Homo sapien
aagctttgacaaaataatagagtga

SEQ ID NO: 232439 - DNA, 25 bp, Homo sapien
gaaaattggtagatcagagttgagc

SEQ ID NO: 232440 - DNA, 25 bp, Homo sapien
agagttgagctgattggaggaccaa

SEQ ID NO: 232441 - DNA, 25 bp, Homo sapien
ttgagctgattggaggaccaaatta

SEQ ID NO: 232442 - DNA, 25 bp, Homo sapien
gaccaaattaaaagactggctgggc

SEQ ID NO: 232443 - DNA, 25 bp, Homo sapien
caagaccagcctagataacctgggt

SEQ ID NO: 232444 - DNA, 25 bp, Homo sapien
agaccagcctagataacctgggtat

SEQ ID NO: 232445 - DNA, 25 bp, Homo sapien
cagcctagataacctgggtatccca

SEQ ID NO: 232446 - DNA, 25 bp, Homo sapien
agcctagataacctgggtatcccag

SEQ ID NO: 232447 - DNA, 25 bp, Homo sapien
gcctagataacctgggtatcccagc

SEQ ID NO: 232448 - DNA, 25 bp, Homo sapien
ggaggctgagctgccgaggctacag

SEQ ID NO: 232449 - DNA, 25 bp, Homo sapien
gatcatatttctcaccaatgtaatt

SEQ ID NO: 232450 - DNA, 25 bp, Homo sapien
ttctcaccaatgtaatttcagtctc

SEQ ID NO: 232451 - DNA, 25 bp, Homo sapien
accaatgtaatttcagtctcagcag

SEQ ID NO: 232452 - DNA, 25 bp, Homo sapien
atgtaatttcagtctcagcagtgat

SEQ ID NO: 232453 - DNA, 25 bp, Homo sapien
tttcagtctcagcagtgattttcaa

SEQ ID NO: 232454 - DNA, 25 bp, Homo sapien
ttaaaatgatatcttacctgaacta

SEQ ID NO: 232455 - DNA, 25 bp, Homo sapien
ggagatggcctgaacccactttctg

SEQ ID NO: 232456 - DNA, 25 bp, Homo sapien
atggcctgaacccactttctgtctc

SEQ ID NO: 232457 - DNA, 25 bp, Homo sapien
ctttctgtctcaaatcatgctaccc

SEQ ID NO: 232458 - DNA, 25 bp, Homo sapien
gaggttttattggtgcacttggttc

SEQ ID NO: 232459 - DNA, 25 bp, Homo sapien
tttattggtgcacttggttcattta

SEQ ID NO: 232460 - DNA, 25 bp, Homo sapien
gcgactcttattgggctgtgcttaa

SEQ ID NO: 232461 - DNA, 25 bp, Homo sapien
ggctgtgcttaagagtaaaacttca

SEQ ID NO: 232462 - DNA, 25 bp, Homo sapien
aacttcagcgatgtttaccatttaa

SEQ ID NO: 232463 - DNA, 25 bp, Homo sapien
tacatttctgaaggaacccactcaa

SEQ ID NO: 232464 - DNA, 25 bp, Homo sapien
gaaggaacccactcaacagaagaag

SEQ ID NO: 232465 - DNA, 25 bp, Homo sapien
gtggaacagtgtgtccttgaacctg

SEQ ID NO: 232466 - DNA, 25 bp, Homo sapien
agtgtgtccttgaacctgactgata

SEQ ID NO: 232467 - DNA, 25 bp, Homo sapien
gaacctgactgatagctgttttaag

SEQ ID NO: 232468 - DNA, 25 bp, Homo sapien
agagccactggcctgtaattgtttg

SEQ ID NO: 232469 - DNA, 25 bp, Homo sapien
cactggcctgtaattgtttgatata

SEQ ID NO: 232470 - DNA, 25 bp, Homo sapien
tgtcagagactcatgtttaatacat

SEQ ID NO: 232471 - DNA, 25 bp, Homo sapien
agggagaccactgtggcgtacttct

SEQ ID NO: 232472 - DNA, 25 bp, Homo sapien
gtggcgtacttctccagcatcgcat

SEQ ID NO: 232473 - DNA, 25 bp, Homo sapien
agcatcgcatcccagtacagttcct

SEQ ID NO: 232474 - DNA, 25 bp, Homo sapien
gttccttctgtgaccggtccagcag

SEQ ID NO: 232475 - DNA, 25 bp, Homo sapien
tcctgcggatgtggcccatcactgt

SEQ ID NO: 232476 - DNA, 25 bp, Homo sapien
gtggcccatcactgtaggcgtcttt

SEQ ID NO: 232477 - DNA, 25 bp, Homo sapien
tgccctgtctggttcacattcttac

SEQ ID NO: 232478 - DNA, 25 bp, Homo sapien
tcacattcttacctattacccggaa

SEQ ID NO: 232479 - DNA, 25 bp, Homo sapien
acctattacccggaagagtcagcag

SEQ ID NO: 232480 - DNA, 25 bp, Homo sapien
aagagtcagcaggttacctacgcct

SEQ ID NO: 232481 - DNA, 25 bp, Homo sapien
agcaggttacctacgcctcatctgc

SEQ ID NO: 232482 - DNA, 25 bp, Homo sapien
tcaggcttgaagtccaggttagggc

SEQ ID NO: 232483 - DNA, 25 bp, Homo sapien
gaagtccaggttagggctgccatcc

SEQ ID NO: 232484 - DNA, 25 bp, Homo sapien
gttagggctgccatcctcattgaga

SEQ ID NO: 232485 - DNA, 25 bp, Homo sapien
cctcattgagaattctccgggcagt

SEQ ID NO: 232486 - DNA, 25 bp, Homo sapien
aattctccgggcagtgtagccgacg

SEQ ID NO: 232487 - DNA, 25 bp, Homo sapien
tctccgggcagtgtagccgacgatg

SEQ ID NO: 232488 - DNA, 25 bp, Homo sapien
gggtatttggctttgtacactttgg

SEQ ID NO: 232489 - DNA, 25 bp, Homo sapien
atttggctttgtacactttggtgaa

SEQ ID NO: 232490 - DNA, 25 bp, Homo sapien
ggctttgtacactttggtgaagacc

SEQ ID NO: 232491 - DNA, 25 bp, Homo sapien
ttggccgtgagacccgtagtgtcat

SEQ ID NO: 232492 - DNA, 25 bp, Homo sapien
ccgtgagacccgtagtgtcatgggt

SEQ ID NO: 232493 - DNA, 25 bp, Homo sapien
aggatgcggtgcgtgcttctgccca

SEQ ID NO: 232494 - DNA, 25 bp, Homo sapien
ttctgcccagcgcatgggtgacacc

SEQ ID NO: 232495 - DNA, 25 bp, Homo sapien
tggcctggcgctggtctatgccaag

SEQ ID NO: 232496 - DNA, 25 bp, Homo sapien
gtctatgccaaggaacagctgtttg

SEQ ID NO: 232497 - DNA, 25 bp, Homo sapien
agctgtttgctgaagcatcaggtgc

SEQ ID NO: 232498 - DNA, 25 bp, Homo sapien
gacagatggcggctccagcgaccct

SEQ ID NO: 232499 - DNA, 25 bp, Homo sapien
aggacctgggcgtcaccgtgttcat

SEQ ID NO: 232500 - DNA, 25 bp, Homo sapien
gtgttcattgtcagcaccggccgag

SEQ ID NO: 232501 - DNA, 25 bp, Homo sapien
ggccgaggcaacttcctggagctgt

SEQ ID NO: 232502 - DNA, 25 bp, Homo sapien
tgccgagaagcacctgcactttgtg

SEQ ID NO: 232503 - DNA, 25 bp, Homo sapien
gaagcacctgcactttgtggacgtg

SEQ ID NO: 232504 - DNA, 25 bp, Homo sapien
tcttattccctcctatatttcggtg

SEQ ID NO: 232505 - DNA, 25 bp, Homo sapien
ttcggtgcccagaatagcacttggc

SEQ ID NO: 232506 - DNA, 25 bp, Homo sapien
agcacttggcacacagtcttttgag

SEQ ID NO: 232507 - DNA, 25 bp, Homo sapien
tcttttgagtgagtggatgaccttg

SEQ ID NO: 232508 - DNA, 25 bp, Homo sapien
ggatgaccttgtgcacaatcagtta

SEQ ID NO: 232509 - DNA, 25 bp, Homo sapien
tcggtaaagcattaattgtggcatc

SEQ ID NO: 232510 - DNA, 25 bp, Homo sapien
aattgtggcatctttgtcagatgtt

SEQ ID NO: 232511 - DNA, 25 bp, Homo sapien
gtacgcatagtctgcatgttgtatt

SEQ ID NO: 232512 - DNA, 25 bp, Homo sapien
gtctgcatgttgtatttttagtctt

SEQ ID NO: 232513 - DNA, 25 bp, Homo sapien
aggtgagtgtcagttctattagaac

SEQ ID NO: 232514 - DNA, 25 bp, Homo sapien
gaacaggaacttggtcttattccct

SEQ ID NO: 232515 - DNA, 25 bp, Homo sapien
gtattgtatcgagccttttctgtgt

SEQ ID NO: 232516 - DNA, 25 bp, Homo sapien
agcagaacactagtttcctatttaa

SEQ ID NO: 232517 - DNA, 25 bp, Homo sapien
taacacaacatttggctttgttttc

SEQ ID NO: 232518 - DNA, 25 bp, Homo sapien
tttttcctttgatttccacatcagg

SEQ ID NO: 232519 - DNA, 25 bp, Homo sapien
tcctttgatttccacatcaggtgtg

SEQ ID NO: 232520 - DNA, 25 bp, Homo sapien
gtggagatgttaagagcctcacaag

SEQ ID NO: 232521 - DNA, 25 bp, Homo sapien
agcctcacaaggaaactgggttatt

SEQ ID NO: 232522 - DNA, 25 bp, Homo sapien
aaggcggcttacagttctctgcgtt

SEQ ID NO: 232523 - DNA, 25 bp, Homo sapien
agttctctgcgttcgtcacttaatt

SEQ ID NO: 232524 - DNA, 25 bp, Homo sapien
tgcgttcgtcacttaattcctgaat

SEQ ID NO: 232525 - DNA, 25 bp, Homo sapien
gtcacttaattcctgaatgtttcag

SEQ ID NO: 232526 - DNA, 25 bp, Homo sapien
ggagctgtcagccgctgcctcagcc

SEQ ID NO: 232527 - DNA, 25 bp, Homo sapien
cctgccgagaagcacctgcactttg

SEQ ID NO: 232528 - DNA, 25 bp, Homo sapien
ctgccgagaagcacctgcactttgt

SEQ ID NO: 232529 - DNA, 25 bp, Homo sapien
tgccgagaagcacctgcactttgtg

SEQ ID NO: 232530 - DNA, 25 bp, Homo sapien
gccgagaagcacctgcactttgtgg

SEQ ID NO: 232531 - DNA, 25 bp, Homo sapien
ccgagaagcacctgcactttgtgga

SEQ ID NO: 232532 - DNA, 25 bp, Homo sapien
cgagaagcacctgcactttgtggac

SEQ ID NO: 232533 - DNA, 25 bp, Homo sapien
gagaagcacctgcactttgtggacg

SEQ ID NO: 232534 - DNA, 25 bp, Homo sapien
agaagcacctgcactttgtggacgt

SEQ ID NO: 232535 - DNA, 25 bp, Homo sapien
gaagcacctgcactttgtggacgtg

SEQ ID NO: 232536 - DNA, 25 bp, Homo sapien
aaattgcactgaagaaaggccgggc

SEQ ID NO: 232537 - DNA, 25 bp, Homo sapien
aattgcactgaagaaaggccgggcg

SEQ ID NO: 232538 - DNA, 25 bp, Homo sapien
attgcactgaagaaaggccgggcgc

SEQ ID NO: 232539 - DNA, 25 bp, Homo sapien
ttgcactgaagaaaggccgggcgcg

SEQ ID NO: 232540 - DNA, 25 bp, Homo sapien
tgcactgaagaaaggccgggcgcgg

SEQ ID NO: 232541 - DNA, 25 bp, Homo sapien
gcactgaagaaaggccgggcgcggt

SEQ ID NO: 232542 - DNA, 25 bp, Homo sapien
cactgaagaaaggccgggcgcggtg

SEQ ID NO: 232543 - DNA, 25 bp, Homo sapien
actgaagaaaggccgggcgcggtgg

SEQ ID NO: 232544 - DNA, 25 bp, Homo sapien
tagccgggcatggtgacgtgcacct

SEQ ID NO: 232545 - DNA, 25 bp, Homo sapien
agccgggcatggtgacgtgcacctg

SEQ ID NO: 232546 - DNA, 25 bp, Homo sapien
tcgtgccactgaactccaacctgcc

SEQ ID NO: 232547 - DNA, 25 bp, Homo sapien
tgattggactgagaatttggccaca

SEQ ID NO: 232548 - DNA, 25 bp, Homo sapien
gaatttggccacaaccaaattgatg

SEQ ID NO: 232549 - DNA, 25 bp, Homo sapien
accaaattgatgctggctggaacca

SEQ ID NO: 232550 - DNA, 25 bp, Homo sapien
cagaggccagaaagcctggccttgt

SEQ ID NO: 232551 - DNA, 25 bp, Homo sapien
tgagctcagtgaattcccaccaggt

SEQ ID NO: 232552 - DNA, 25 bp, Homo sapien
gtgaattcccaccaggtgcccacag

SEQ ID NO: 232553 - DNA, 25 bp, Homo sapien
gctcctggacttcaaattctatata

SEQ ID NO: 232554 - DNA, 25 bp, Homo sapien
aaaggagttggtctatgcaatgtca

SEQ ID NO: 232555 - DNA, 25 bp, Homo sapien
gagttggtctatgcaatgtcagttt

SEQ ID NO: 232556 - DNA, 25 bp, Homo sapien
tgcaatgtcagtttggaatcttctt

SEQ ID NO: 232557 - DNA, 25 bp, Homo sapien
gtcagtttggaatcttcttgaaagt

SEQ ID NO: 232558 - DNA, 25 bp, Homo sapien
tttggttgaaagtttgcctttgatc

SEQ ID NO: 232559 - DNA, 25 bp, Homo sapien
aaagtttgcctttgatccagattct

SEQ ID NO: 232560 - DNA, 25 bp, Homo sapien
atccagattctttcggatgtcaggg

SEQ ID NO: 232561 - DNA, 25 bp, Homo sapien
cagattctttcggatgtcagggata

SEQ ID NO: 232562 - DNA, 25 bp, Homo sapien
tctttcggatgtcagggatattcac

SEQ ID NO: 232563 - DNA, 25 bp, Homo sapien
tcggatgtcagggatattcacattg

SEQ ID NO: 232564 - DNA, 25 bp, Homo sapien
tcagggatattcacattgacatgtc

SEQ ID NO: 232565 - DNA, 25 bp, Homo sapien
agggatattcacattgacatgtctt

SEQ ID NO: 232566 - DNA, 25 bp, Homo sapien
ttccaggagattttagtttgaatag

SEQ ID NO: 232567 - DNA, 25 bp, Homo sapien
tacaacaaaacttagaacggcttct

SEQ ID NO: 232568 - DNA, 25 bp, Homo sapien
ttagaacggcttctaacttatttct

SEQ ID NO: 232569 - DNA, 25 bp, Homo sapien
ggcaggcctggggtgaaatgagaaa

SEQ ID NO: 232570 - DNA, 25 bp, Homo sapien
catcatccctccctgatattgtatt

SEQ ID NO: 232571 - DNA, 25 bp, Homo sapien
atcatccctccctgatattgtattg

SEQ ID NO: 232572 - DNA, 25 bp, Homo sapien
tcatccctccctgatattgtattga

SEQ ID NO: 232573 - DNA, 25 bp, Homo sapien
catccctccctgatattgtattgaa

SEQ ID NO: 232574 - DNA, 25 bp, Homo sapien
atccctccctgatattgtattgaaa

SEQ ID NO: 232575 - DNA, 25 bp, Homo sapien
tccctccctgatattgtattgaaaa

SEQ ID NO: 232576 - DNA, 25 bp, Homo sapien
ccctccctgatattgtattgaaaat

SEQ ID NO: 232577 - DNA, 25 bp, Homo sapien
cctccctgatattgtattgaaaata

SEQ ID NO: 232578 - DNA, 25 bp, Homo sapien
ctccctgatattgtattgaaaatat

SEQ ID NO: 232579 - DNA, 25 bp, Homo sapien
ttgtattgaaaatattatgcacact

SEQ ID NO: 232580 - DNA, 25 bp, Homo sapien
ataaatactatctttctctctggcc

SEQ ID NO: 232581 - DNA, 25 bp, Homo sapien
atcctccagacaatcactgaattac

SEQ ID NO: 232582 - DNA, 25 bp, Homo sapien
tacaatatttgcttaacagtagatt

SEQ ID NO: 232583 - DNA, 25 bp, Homo sapien
acagtagattaatgtcaattttctg

SEQ ID NO: 232584 - DNA, 25 bp, Homo sapien
gactgatataacatgtttcctcttt

SEQ ID NO: 232585 - DNA, 25 bp, Homo sapien
tttcctcttttcatacctgagtact

SEQ ID NO: 232586 - DNA, 25 bp, Homo sapien
ttttcatacctgagtactctcctga

SEQ ID NO: 232587 - DNA, 25 bp, Homo sapien
agtactctcctgagccctatttatt

SEQ ID NO: 232588 - DNA, 25 bp, Homo sapien
ctctcctgagccctatttatttaga

SEQ ID NO: 232589 - DNA, 25 bp, Homo sapien
gagccctatttatttagatgttctt

SEQ ID NO: 232590 - DNA, 25 bp, Homo sapien
tatttagatgttcttcttttttctt

SEQ ID NO: 232591 - DNA, 25 bp, Homo sapien
tctggctatacttggactcaaactg

SEQ ID NO: 232592 - DNA, 25 bp, Homo sapien
acttggactcaaactgatcagtgtg

SEQ ID NO: 232593 - DNA, 25 bp, Homo sapien
atgtccaaaacagcttggcctggaa

SEQ ID NO: 232594 - DNA, 25 bp, Homo sapien
gcctggaagaggtaggccttatttt

SEQ ID NO: 232595 - DNA, 25 bp, Homo sapien
gccttattttttcagcctagtagtg

SEQ ID NO: 232596 - DNA, 25 bp, Homo sapien
tttcagcctagtagtgtcccatgca

SEQ ID NO: 232597 - DNA, 25 bp, Homo sapien
tgtcccatgcacatgctctttgtag

SEQ ID NO: 232598 - DNA, 25 bp, Homo sapien
gctctttgtagcattcaagtgttta

SEQ ID NO: 232599 - DNA, 25 bp, Homo sapien
tgttgttgaaacttcaaggtctcaa

SEQ ID NO: 232600 - DNA, 25 bp, Homo sapien
atagaacaactgttggtgtaccaaa

SEQ ID NO: 232601 - DNA, 25 bp, Homo sapien
gggcaccatttgtattgtcacacaa

SEQ ID NO: 232602 - DNA, 25 bp, Homo sapien
cattagattttgcttaactttatga

SEQ ID NO: 232603 - DNA, 25 bp, Homo sapien
tataaaggggcaactccatctggtc

SEQ ID NO: 232604 - DNA, 25 bp, Homo sapien
actccatctggtcctatagcatctt

SEQ ID NO: 232605 - DNA, 25 bp, Homo sapien
ccatctggtcctatagcatctttac

SEQ ID NO: 232606 - DNA, 25 bp, Homo sapien
atctggtcctatagcatctttacta

SEQ ID NO: 232607 - DNA, 25 bp, Homo sapien
tggtcctatagcatctttactactg

SEQ ID NO: 232608 - DNA, 25 bp, Homo sapien
gtcctatagcatctttactactgat

SEQ ID NO: 232609 - DNA, 25 bp, Homo sapien
atagcatctttactactgatttttt

SEQ ID NO: 232610 - DNA, 25 bp, Homo sapien
atatcaaaacatgtagtacacccta

SEQ ID NO: 232611 - DNA, 25 bp, Homo sapien
aacatgtagtacaccctaaatatat

SEQ ID NO: 232612 - DNA, 25 bp, Homo sapien
gtagtacaccctaaatatatataat

SEQ ID NO: 232613 - DNA, 25 bp, Homo sapien
aaaccacgcaaacccaagaggcaga

SEQ ID NO: 232614 - DNA, 25 bp, Homo sapien
agggcggctgagatggaaccacctc

SEQ ID NO: 232615 - DNA, 25 bp, Homo sapien
gggcggctgagatggaaccacctcc

SEQ ID NO: 232616 - DNA, 25 bp, Homo sapien
ggctgagatggaaccacctcccgaa

SEQ ID NO: 232617 - DNA, 25 bp, Homo sapien
gctgagatggaaccacctcccgaac

SEQ ID NO: 232618 - DNA, 25 bp, Homo sapien
ccaagaggcggagggtcggtgacgt

SEQ ID NO: 232619 - DNA, 25 bp, Homo sapien
gtcggtgacgtggaaccgtcacgca

SEQ ID NO: 232620 - DNA, 25 bp, Homo sapien
ggtgacgtggaaccgtcacgcaaac

SEQ ID NO: 232621 - DNA, 25 bp, Homo sapien
gtggaaccgtcacgcaaacccaaga

SEQ ID NO: 232622 - DNA, 25 bp, Homo sapien
ggaaccgtcacgcaaacccaagagg

SEQ ID NO: 232623 - DNA, 25 bp, Homo sapien
aaccgtcacgcaaacccaagaggcg

SEQ ID NO: 232624 - DNA, 25 bp, Homo sapien
agtgttaatgatcctgtcttagggc

SEQ ID NO: 232625 - DNA, 25 bp, Homo sapien
gatcctgtcttagggcagaggccac

SEQ ID NO: 232626 - DNA, 25 bp, Homo sapien
cttcttcttggtcctggctcccaag

SEQ ID NO: 232627 - DNA, 25 bp, Homo sapien
tcttcatctctgcatgagctctcct

SEQ ID NO: 232628 - DNA, 25 bp, Homo sapien
atgagctctccttcccagagaccaa

SEQ ID NO: 232629 - DNA, 25 bp, Homo sapien
ttcccagagaccaactcttttttat

SEQ ID NO: 232630 - DNA, 25 bp, Homo sapien
aatttatgtctggagcctggctact

SEQ ID NO: 232631 - DNA, 25 bp, Homo sapien
gtgtggtccatgttcagcgttctag

SEQ ID NO: 232632 - DNA, 25 bp, Homo sapien
tggtccatgttcagcgttctagcaa

SEQ ID NO: 232633 - DNA, 25 bp, Homo sapien
tgttcagcgttctagcaacacgtgt

SEQ ID NO: 232634 - DNA, 25 bp, Homo sapien
agcgttctagcaacacgtgtgtgtg

SEQ ID NO: 232635 - DNA, 25 bp, Homo sapien
gaaggcaaagagagacacaccctga

SEQ ID NO: 232636 - DNA, 25 bp, Homo sapien
gcaaagagagacacaccctgagccg

SEQ ID NO: 232637 - DNA, 25 bp, Homo sapien
aagagagacacaccctgagccggcg

SEQ ID NO: 232638 - DNA, 25 bp, Homo sapien
gtgtcatcccgctgccccagtggaa

SEQ ID NO: 232639 - DNA, 25 bp, Homo sapien
ccagtggaaggccaacccggagacg

SEQ ID NO: 232640 - DNA, 25 bp, Homo sapien
gccaacccggagacggaccctgagg

SEQ ID NO: 232641 - DNA, 25 bp, Homo sapien
gtggtcagttacagccatgccacca

SEQ ID NO: 232642 - DNA, 25 bp, Homo sapien
tggtcagttacagccatgccaccaa

SEQ ID NO: 232643 - DNA, 25 bp, Homo sapien
tcagttacagccatgccaccaacaa

SEQ ID NO: 232644 - DNA, 25 bp, Homo sapien
catgccaccaacaagtatgaggtag

SEQ ID NO: 232645 - DNA, 25 bp, Homo sapien
caagtatgaggtagatgacatcgat

SEQ ID NO: 232646 - DNA, 25 bp, Homo sapien
gttttattctttaaatgtgctgttt

SEQ ID NO: 232647 - DNA, 25 bp, Homo sapien
acagatgctaatttctgctgttctt

SEQ ID NO: 232648 - DNA, 25 bp, Homo sapien
tgctaatttctgctgttcttgattt

SEQ ID NO: 232649 - DNA, 25 bp, Homo sapien
taatttctgctgttcttgatttggt

SEQ ID NO: 232650 - DNA, 25 bp, Homo sapien
atttctgctgttcttgatttggttc

SEQ ID NO: 232651 - DNA, 25 bp, Homo sapien
ttctgctgttcttgatttggttctt

SEQ ID NO: 232652 - DNA, 25 bp, Homo sapien
ctgctgttcttgatttggttcttta

SEQ ID NO: 232653 - DNA, 25 bp, Homo sapien
gctgttcttgatttggttctttatt

SEQ ID NO: 232654 - DNA, 25 bp, Homo sapien
tgttcttgatttggttctttattta

SEQ ID NO: 232655 - DNA, 25 bp, Homo sapien
atttatcaaatgtaaactgtggatc

SEQ ID NO: 232656 - DNA, 25 bp, Homo sapien
gtaaactgtggatcacatgattctt

SEQ ID NO: 232657 - DNA, 25 bp, Homo sapien
aaactcctttattatcttaatgctc

SEQ ID NO: 232658 - DNA, 25 bp, Homo sapien
tcttaatgctcccatgttaacatgt

SEQ ID NO: 232659 - DNA, 25 bp, Homo sapien
gttaacatgtttgctgctaaattac

SEQ ID NO: 232660 - DNA, 25 bp, Homo sapien
gtttatagtgaactgtgctcttccc

SEQ ID NO: 232661 - DNA, 25 bp, Homo sapien
tagtgaactgtgctcttccctcatt

SEQ ID NO: 232662 - DNA, 25 bp, Homo sapien
tcattaaaatcccagggtgccctgt

SEQ ID NO: 232663 - DNA, 25 bp, Homo sapien
cagggtgccctgtaaagatgcagat

SEQ ID NO: 232664 - DNA, 25 bp, Homo sapien
agatgcagatgtttcttcctgaaaa

SEQ ID NO: 232665 - DNA, 25 bp, Homo sapien
aattcagtgtgctttgtctttctcc

SEQ ID NO: 232666 - DNA, 25 bp, Homo sapien
ctttctccagattaatatcggttac

SEQ ID NO: 232667 - DNA, 25 bp, Homo sapien
tatcggttacactgctgatgtttgt

SEQ ID NO: 232668 - DNA, 25 bp, Homo sapien
gaaggcaccatccatcagcccaggg

SEQ ID NO: 232669 - DNA, 25 bp, Homo sapien
aaggcaccatccatcagcccaggga

SEQ ID NO: 232670 - DNA, 25 bp, Homo sapien
gggagggtaccacctgggcacctgg

SEQ ID NO: 232671 - DNA, 25 bp, Homo sapien
ggctggatgtgagaggcctggacca

SEQ ID NO: 232672 - DNA, 25 bp, Homo sapien
ctggatgtgagaggcctggaccagg

SEQ ID NO: 232673 - DNA, 25 bp, Homo sapien
gatgtgagaggcctggaccagggcc

SEQ ID NO: 232674 - DNA, 25 bp, Homo sapien
tgtgagaggcctggaccagggcccg

SEQ ID NO: 232675 - DNA, 25 bp, Homo sapien
tgagaggcctggaccagggcccgcc

SEQ ID NO: 232676 - DNA, 25 bp, Homo sapien
gggtgcatggagggcatggccccag

SEQ ID NO: 232677 - DNA, 25 bp, Homo sapien
gtgtccacatttccggctccgaggc

SEQ ID NO: 232678 - DNA, 25 bp, Homo sapien
tgtccacatttccggctccgaggcg

SEQ ID NO: 232679 - DNA, 25 bp, Homo sapien
caaataaggttcttgccctcttgga

SEQ ID NO: 232680 - DNA, 25 bp, Homo sapien
gccctcttggaagtcgaatttcgtt

SEQ ID NO: 232681 - DNA, 25 bp, Homo sapien
aataattgggatggtctgttgggca

SEQ ID NO: 232682 - DNA, 25 bp, Homo sapien
tgttgggcatgtacttcaggtgatc

SEQ ID NO: 232683 - DNA, 25 bp, Homo sapien
tcaggtgatcggaaaggtctctaag

SEQ ID NO: 232684 - DNA, 25 bp, Homo sapien
aggtctctaaggaagtgccatttag

SEQ ID NO: 232685 - DNA, 25 bp, Homo sapien
atttagacacaccataaaggcctgg

SEQ ID NO: 232686 - DNA, 25 bp, Homo sapien
aaccagtttctgttgagcatccact

SEQ ID NO: 232687 - DNA, 25 bp, Homo sapien
agcatccactgacacgtagccgagg

SEQ ID NO: 232688 - DNA, 25 bp, Homo sapien
gtagccgaggctagtcactcagcta

SEQ ID NO: 232689 - DNA, 25 bp, Homo sapien
agtcactcagctacatgtcaggaat

SEQ ID NO: 232690 - DNA, 25 bp, Homo sapien
acgcttttcgacatgcacctggaaa

SEQ ID NO: 232691 - DNA, 25 bp, Homo sapien
cctggaaatcgggaagggccatgct

SEQ ID NO: 232692 - DNA, 25 bp, Homo sapien
agggccatgctgcagttgcttctag

SEQ ID NO: 232693 - DNA, 25 bp, Homo sapien
tgctgcagttgcttctagttgagac

SEQ ID NO: 232694 - DNA, 25 bp, Homo sapien
ctagttgagacgagaagagcgacaa

SEQ ID NO: 232695 - DNA, 25 bp, Homo sapien
gacaaggttgtgatccacgtggcag

SEQ ID NO: 232696 - DNA, 25 bp, Homo sapien
ccacgtggcaggtgttcagaaggct

SEQ ID NO: 232697 - DNA, 25 bp, Homo sapien
agagccctgggtacttcgaggagac

SEQ ID NO: 232698 - DNA, 25 bp, Homo sapien
tgggtacttcgaggagaccccgaag

SEQ ID NO: 232699 - DNA, 25 bp, Homo sapien
acatctgaagagaaccaacctgagg

SEQ ID NO: 232700 - DNA, 25 bp, Homo sapien
aacctgaggatttcacgctggctgc

SEQ ID NO: 232701 - DNA, 25 bp, Homo sapien
gtctttggtcttggataactaaact

SEQ ID NO: 232702 - DNA, 25 bp, Homo sapien
gtcttggataactaaactgcctttc

SEQ ID NO: 232703 - DNA, 25 bp, Homo sapien
ggataactaaactgcctttccagag

SEQ ID NO: 232704 - DNA, 25 bp, Homo sapien
actaaactgcctttccagagaacca

SEQ ID NO: 232705 - DNA, 25 bp, Homo sapien
gcctttccagagaaccaaatgtcag

SEQ ID NO: 232706 - DNA, 25 bp, Homo sapien
caaatgtcagagttactagaccaaa

SEQ ID NO: 232707 - DNA, 25 bp, Homo sapien
acctccaaaggaagtaatgtaatct

SEQ ID NO: 232708 - DNA, 25 bp, Homo sapien
aatgtaatcttattcataatgggat

SEQ ID NO: 232709 - DNA, 25 bp, Homo sapien
gggattaacatattttagacattca

SEQ ID NO: 232710 - DNA, 25 bp, Homo sapien
gacattcattttaaacactacctca

SEQ ID NO: 232711 - DNA, 25 bp, Homo sapien
aacactacctcagttaatatagagt

SEQ ID NO: 232712 - DNA, 25 bp, Homo sapien
gccaaaatttcttctactggaccaa

SEQ ID NO: 232713 - DNA, 25 bp, Homo sapien
gatgggaaatgtcttttataggtat

SEQ ID NO: 232714 - DNA, 25 bp, Homo sapien
gatgaattatcccttatcattccaa

SEQ ID NO: 232715 - DNA, 25 bp, Homo sapien
gctgtgttaaatatctccagggcaa

SEQ ID NO: 232716 - DNA, 25 bp, Homo sapien
tccagggcaaagtggtatgttgact

SEQ ID NO: 232717 - DNA, 25 bp, Homo sapien
tatgttgactgggacaaacgttaga

SEQ ID NO: 232718 - DNA, 25 bp, Homo sapien
gaaattgtattgttcattgcacttg

SEQ ID NO: 232719 - DNA, 25 bp, Homo sapien
gttcattgcacttgttgccctgttc

SEQ ID NO: 232720 - DNA, 25 bp, Homo sapien
tgttccccaagcttgtcaatgttta

SEQ ID NO: 232721 - DNA, 25 bp, Homo sapien
gatactattcgggttgctaaagcca

SEQ ID NO: 232722 - DNA, 25 bp, Homo sapien
ttcgggttgctaaagccattattca

SEQ ID NO: 232723 - DNA, 25 bp, Homo sapien
acatcctgtttaaactgtagaataa

SEQ ID NO: 232724 - DNA, 25 bp, Homo sapien
gaataaccagatattcccatcaggt

SEQ ID NO: 232725 - DNA, 25 bp, Homo sapien
cagatattcccatcaggttaaagac

SEQ ID NO: 232726 - DNA, 25 bp, Homo sapien
ccccagagatgcctttagtgtaagt

SEQ ID NO: 232727 - DNA, 25 bp, Homo sapien
cctttagtgtaagtagctggcttgg

SEQ ID NO: 232728 - DNA, 25 bp, Homo sapien
caggtacagggcctgcatactatta

SEQ ID NO: 232729 - DNA, 25 bp, Homo sapien
taaaccatagtttgtggcacccgct

SEQ ID NO: 232730 - DNA, 25 bp, Homo sapien
tagtttgtggcacccgcttttctaa

SEQ ID NO: 232731 - DNA, 25 bp, Homo sapien
cgcttttctaactccacctgttaga

SEQ ID NO: 232732 - DNA, 25 bp, Homo sapien
aactccacctgttagaagctatgtg

SEQ ID NO: 232733 - DNA, 25 bp, Homo sapien
gaagctatgtgtttgaaggaatgaa

SEQ ID NO: 232734 - DNA, 25 bp, Homo sapien
ctgcttagggactttgaacttaaat

SEQ ID NO: 232735 - DNA, 25 bp, Homo sapien
gaacttaaatatatccccttcctca

SEQ ID NO: 232736 - DNA, 25 bp, Homo sapien
cccttcctcaagtggtgctatttta

SEQ ID NO: 232737 - DNA, 25 bp, Homo sapien
cttcctcaagtggtgctattttaaa

SEQ ID NO: 232738 - DNA, 25 bp, Homo sapien
gaattcattatgatccccatattgg

SEQ ID NO: 232739 - DNA, 25 bp, Homo sapien
tccccatattgggtaatgctgaaca

SEQ ID NO: 232740 - DNA, 25 bp, Homo sapien
gctgaacatttatctgaaacagatg

SEQ ID NO: 232741 - DNA, 25 bp, Homo sapien
gggaaatttgactagtgtaatctga

SEQ ID NO: 232742 - DNA, 25 bp, Homo sapien
gactagtgtaatctgagatatgtca

SEQ ID NO: 232743 - DNA, 25 bp, Homo sapien
agatatgtcatagggatttctttct

SEQ ID NO: 232744 - DNA, 25 bp, Homo sapien
gacaaaagggtgctttgctgttctt

SEQ ID NO: 232745 - DNA, 25 bp, Homo sapien
atgacagtacagctaatgtgataac

SEQ ID NO: 232746 - DNA, 25 bp, Homo sapien
acagctaatgtgataacttttgcaa

SEQ ID NO: 232747 - DNA, 25 bp, Homo sapien
gctaatgtgataacttttgcaaaaa

SEQ ID NO: 232748 - DNA, 25 bp, Homo sapien
gtgctaatttgcagaccattgtcta

SEQ ID NO: 232749 - DNA, 25 bp, Homo sapien
ctaatttgcagaccattgtctacag

SEQ ID NO: 232750 - DNA, 25 bp, Homo sapien
accattgtctacagaagggataacc

SEQ ID NO: 232751 - DNA, 25 bp, Homo sapien
gtctacagaagggataaccaaaggt

SEQ ID NO: 232752 - DNA, 25 bp, Homo sapien
tagagaaattttatggtaccagttg

SEQ ID NO: 232753 - DNA, 25 bp, Homo sapien
gaaattttatggtaccagttgctat

SEQ ID NO: 232754 - DNA, 25 bp, Homo sapien
ttatggtaccagttgctattaaatg

SEQ ID NO: 232755 - DNA, 25 bp, Homo sapien
ggtaccagttgctattaaatgaatt

SEQ ID NO: 232756 - DNA, 25 bp, Homo sapien
atgttatgacgctgcaccgagagcc

SEQ ID NO: 232757 - DNA, 25 bp, Homo sapien
ttatgacgctgcaccgagagcccag

SEQ ID NO: 232758 - DNA, 25 bp, Homo sapien
agagcccagcccgttaccatgaggt

SEQ ID NO: 232759 - DNA, 25 bp, Homo sapien
gttaccatgaggtcctcgtggtact

SEQ ID NO: 232760 - DNA, 25 bp, Homo sapien
ggtcctcgtggtacttcactaatta

SEQ ID NO: 232761 - DNA, 25 bp, Homo sapien
ggtacttcactaattaactctcttt

SEQ ID NO: 232762 - DNA, 25 bp, Homo sapien
gaccagccctaaacttaatttcact

SEQ ID NO: 232763 - DNA, 25 bp, Homo sapien
tcactagtaggaaaggttgttgtaa

SEQ ID NO: 232764 - DNA, 25 bp, Homo sapien
aagttccattgtagtttgattttct

SEQ ID NO: 232765 - DNA, 25 bp, Homo sapien
gggcctttgaaattaaactcttctg

SEQ ID NO: 232766 - DNA, 25 bp, Homo sapien
tctgtagtcatgattttccaggtaa

SEQ ID NO: 232767 - DNA, 25 bp, Homo sapien
caaacctcctttgtatctcattggc

SEQ ID NO: 232768 - DNA, 25 bp, Homo sapien
cctcctttgtatctcattggctaat

SEQ ID NO: 232769 - DNA, 25 bp, Homo sapien
gtatctcattggctaatcatatgac

SEQ ID NO: 232770 - DNA, 25 bp, Homo sapien
acctggctttcaggaaggctgggat

SEQ ID NO: 232771 - DNA, 25 bp, Homo sapien
gaaggctgggatgtactgtatagca

SEQ ID NO: 232772 - DNA, 25 bp, Homo sapien
ctgggatgtactgtatagcaggact

SEQ ID NO: 232773 - DNA, 25 bp, Homo sapien
agcaggactgcatcatgtccagcta

SEQ ID NO: 232774 - DNA, 25 bp, Homo sapien
gaaaatagctagcaggaggcgacta

SEQ ID NO: 232775 - DNA, 25 bp, Homo sapien
ggaggcgactagcaaactgccacac

SEQ ID NO: 232776 - DNA, 25 bp, Homo sapien
tagcaaactgccacacctgcaaaag

SEQ ID NO: 232777 - DNA, 25 bp, Homo sapien
aactgccacacctgcaaaaggaaaa

SEQ ID NO: 232778 - DNA, 25 bp, Homo sapien
cactgcagctgatccagattaccaa

SEQ ID NO: 232779 - DNA, 25 bp, Homo sapien
atattgatgatgagatggacccaga

SEQ ID NO: 232780 - DNA, 25 bp, Homo sapien
ggacccagagatagaagaagcttat

SEQ ID NO: 232781 - DNA, 25 bp, Homo sapien
ttttgtttggaatcagagcgtaagc

SEQ ID NO: 232782 - DNA, 25 bp, Homo sapien
gagcgtaagcgaaaacagtaaagtt

SEQ ID NO: 232783 - DNA, 25 bp, Homo sapien
gctgatccagattaccaagagaaat

SEQ ID NO: 232784 - DNA, 25 bp, Homo sapien
tcagcatatcagttttataaagcag

SEQ ID NO: 232785 - DNA, 25 bp, Homo sapien
agcagtttaggtatggtgatttagc

SEQ ID NO: 232786 - DNA, 25 bp, Homo sapien
gatttagcagaacacaagagagcaa

SEQ ID NO: 232787 - DNA, 25 bp, Homo sapien
gagagcaagaaaatgtgtcacatct

SEQ ID NO: 232788 - DNA, 25 bp, Homo sapien
tgaaagagaggacttttttccagat

SEQ ID NO: 232789 - DNA, 25 bp, Homo sapien
ctaactgtataaagcatgggaccca

SEQ ID NO: 232790 - DNA, 25 bp, Homo sapien
ttccctgggcagtacaatggcttga

SEQ ID NO: 232791 - DNA, 25 bp, Homo sapien
gcagtacaatggcttgaaggcaaaa

SEQ ID NO: 232792 - DNA, 25 bp, Homo sapien
aagggataaagtgacagccgactgt

SEQ ID NO: 232793 - DNA, 25 bp, Homo sapien
cagccgactgtgactctggtgagga

SEQ ID NO: 232794 - DNA, 25 bp, Homo sapien
tgagcagggaggttgattctctgat

SEQ ID NO: 232795 - DNA, 25 bp, Homo sapien
gattctctgatgttaactaagtggc

SEQ ID NO: 232796 - DNA, 25 bp, Homo sapien
ttaactaagtggcaaagtctcaacc

SEQ ID NO: 232797 - DNA, 25 bp, Homo sapien
aagcatgatactagtgggtttacca

SEQ ID NO: 232798 - DNA, 25 bp, Homo sapien
gatactagtgggtttaccagtgttt

SEQ ID NO: 232799 - DNA, 25 bp, Homo sapien
ccagtgtttcttccaaggagacata

SEQ ID NO: 232800 - DNA, 25 bp, Homo sapien
accgcgcccagtctaggatgtcgtt

SEQ ID NO: 232801 - DNA, 25 bp, Homo sapien
gcgcccagtctaggatgtcgttttt

SEQ ID NO: 232802 - DNA, 25 bp, Homo sapien
gcccagtctaggatgtcgtttttct

SEQ ID NO: 232803 - DNA, 25 bp, Homo sapien
ccagtctaggatgtcgtttttctga

SEQ ID NO: 232804 - DNA, 25 bp, Homo sapien
gtctaggatgtcgtttttctgatac

SEQ ID NO: 232805 - DNA, 25 bp, Homo sapien
taggatgtcgtttttctgatacaac

SEQ ID NO: 232806 - DNA, 25 bp, Homo sapien
ggatgtcgtttttctgatacaacaa

SEQ ID NO: 232807 - DNA, 25 bp, Homo sapien
atgtcgtttttctgatacaacaaag

SEQ ID NO: 232808 - DNA, 25 bp, Homo sapien
gtcgtttttctgatacaacaaagga

SEQ ID NO: 232809 - DNA, 25 bp, Homo sapien
cgtttttctgatacaacaaaggata

SEQ ID NO: 232810 - DNA, 25 bp, Homo sapien
tttctgatacaacaaaggataaggt

SEQ ID NO: 232811 - DNA, 25 bp, Homo sapien
agaattttgacctacaccaagcaag

SEQ ID NO: 232812 - DNA, 25 bp, Homo sapien
tacaccaagcaaggcagagaccaga

SEQ ID NO: 232813 - DNA, 25 bp, Homo sapien
ttttgataatcaccaccttgggatg

SEQ ID NO: 232814 - DNA, 25 bp, Homo sapien
tcaccaccttgggatgaacatggct

SEQ ID NO: 232815 - DNA, 25 bp, Homo sapien
atgaacatggctggtgagctgcaga

SEQ ID NO: 232816 - DNA, 25 bp, Homo sapien
tgagctgcagagcagttgatttgac

SEQ ID NO: 232817 - DNA, 25 bp, Homo sapien
atggttctaggctggatgtgataca

SEQ ID NO: 232818 - DNA, 25 bp, Homo sapien
accaactcttgttatttttcatgct

SEQ ID NO: 232819 - DNA, 25 bp, Homo sapien
atgcttatggccatcctagttagcg

SEQ ID NO: 232820 - DNA, 25 bp, Homo sapien
atggccatcctagttagcgtgaagt

SEQ ID NO: 232821 - DNA, 25 bp, Homo sapien
agttagcgtgaagtagcatctcatt

SEQ ID NO: 232822 - DNA, 25 bp, Homo sapien
tcagctctgtccacgcttcgatagg

SEQ ID NO: 232823 - DNA, 25 bp, Homo sapien
tctgtccacgcttcgataggcctga

SEQ ID NO: 232824 - DNA, 25 bp, Homo sapien
ccacgcttcgataggcctgacgcag

SEQ ID NO: 232825 - DNA, 25 bp, Homo sapien
tagcaacttcctgtacatatgactg

SEQ ID NO: 232826 - DNA, 25 bp, Homo sapien
gcaacttcctgtacatatgactgta

SEQ ID NO: 232827 - DNA, 25 bp, Homo sapien
acttcctgtacatatgactgtaaaa

SEQ ID NO: 232828 - DNA, 25 bp, Homo sapien
gactgtaaaatggtaaacgtgtgta

SEQ ID NO: 232829 - DNA, 25 bp, Homo sapien
aaacgtgtgtattatatctggcctc

SEQ ID NO: 232830 - DNA, 25 bp, Homo sapien
gtgtgtattatatctggcctcgtta

SEQ ID NO: 232831 - DNA, 25 bp, Homo sapien
gtgtattatatctggcctcgttata

SEQ ID NO: 232832 - DNA, 25 bp, Homo sapien
ttatatctggcctcgttatatagtg

SEQ ID NO: 232833 - DNA, 25 bp, Homo sapien
agacatttggtgatggctgcagata

SEQ ID NO: 232834 - DNA, 25 bp, Homo sapien
gcagatatttttgtcacaactggga

SEQ ID NO: 232835 - DNA, 25 bp, Homo sapien
acaactgggaggaaagggtgctact

SEQ ID NO: 232836 - DNA, 25 bp, Homo sapien
gggtgaatgacagagatgctgctaa

SEQ ID NO: 232837 - DNA, 25 bp, Homo sapien
gcagcctcccataaccaagagtgat

SEQ ID NO: 232838 - DNA, 25 bp, Homo sapien
gatccagccccaaatgacaacagtg

SEQ ID NO: 232839 - DNA, 25 bp, Homo sapien
acaacagtgttgaggctgggaaacc

SEQ ID NO: 232840 - DNA, 25 bp, Homo sapien
tgaggctgggaaaccctgctctaat

SEQ ID NO: 232841 - DNA, 25 bp, Homo sapien
ctgctctaatgcttcctttctatta

SEQ ID NO: 232842 - DNA, 25 bp, Homo sapien
tccatgctgcatgcaactcttttgt

SEQ ID NO: 232843 - DNA, 25 bp, Homo sapien
ctgcatgcaactcttttgtctcttt

SEQ ID NO: 232844 - DNA, 25 bp, Homo sapien
acactgttgaggctctgtcttcaca

SEQ ID NO: 232845 - DNA, 25 bp, Homo sapien
gtcttcacagctgatgttctcctag

SEQ ID NO: 232846 - DNA, 25 bp, Homo sapien
tgttctcctagtggaggtacagctg

SEQ ID NO: 232847 - DNA, 25 bp, Homo sapien
attcagccccagcacgagaagatac

SEQ ID NO: 232848 - DNA, 25 bp, Homo sapien
gatacagagcaacttggaaacccca

SEQ ID NO: 232849 - DNA, 25 bp, Homo sapien
aagggagacacacccttaacactgc

SEQ ID NO: 232850 - DNA, 25 bp, Homo sapien
cttaacactgccgtgctgtgctgtg

SEQ ID NO: 232851 - DNA, 25 bp, Homo sapien
ctcctggttttgttgctgacattgc

SEQ ID NO: 232852 - DNA, 25 bp, Homo sapien
agctgatcatgccttgactccttca

SEQ ID NO: 232853 - DNA, 25 bp, Homo sapien
actccttcatctctaacagaggaag

SEQ ID NO: 232854 - DNA, 25 bp, Homo sapien
tcaaaccttatggtctacccatgaa

SEQ ID NO: 232855 - DNA, 25 bp, Homo sapien
gtccagcagctgagtttcccaggga

SEQ ID NO: 232856 - DNA, 25 bp, Homo sapien
agggaccttggagatagccgcagcc

SEQ ID NO: 232857 - DNA, 25 bp, Homo sapien
atagccgcagccctcatttgcaggg

SEQ ID NO: 232858 - DNA, 25 bp, Homo sapien
tgccagggaccctttgtgcagaagg

SEQ ID NO: 232859 - DNA, 25 bp, Homo sapien
aggaactcgcggcaggtcatccacg

SEQ ID NO: 232860 - DNA, 25 bp, Homo sapien
cgatgcagccttttcggaagtgact

SEQ ID NO: 232861 - DNA, 25 bp, Homo sapien
ggaagtgacttcgtcaacacctttg

SEQ ID NO: 232862 - DNA, 25 bp, Homo sapien
aacacctttgatgggagcatgtaca

SEQ ID NO: 232863 - DNA, 25 bp, Homo sapien
agcatgtacagctttgcgggatact

SEQ ID NO: 232864 - DNA, 25 bp, Homo sapien
gggatactgcagttacctcctggca

SEQ ID NO: 232865 - DNA, 25 bp, Homo sapien
gaaacgctccttctcgattattggg

SEQ ID NO: 232866 - DNA, 25 bp, Homo sapien
gccacggccagggtggtgtcgggag

SEQ ID NO: 232867 - DNA, 25 bp, Homo sapien
gtggtgtcgggagcaggcctcaccc

SEQ ID NO: 232868 - DNA, 25 bp, Homo sapien
accccgctggccgtgtctgtgtgtg

SEQ ID NO: 232869 - DNA, 25 bp, Homo sapien
tgcttgtgtctgtgcgggcgcgtgc

SEQ ID NO: 232870 - DNA, 25 bp, Homo sapien
gcgggcgcgtgcagccctggttctg

SEQ ID NO: 232871 - DNA, 25 bp, Homo sapien
gggtgcagatccctccctccttgag

SEQ ID NO: 232872 - DNA, 25 bp, Homo sapien
cagggtggcactgttcactggcgct

SEQ ID NO: 232873 - DNA, 25 bp, Homo sapien
ggcactgttcactggcgctgggaca

SEQ ID NO: 232874 - DNA, 25 bp, Homo sapien
gcactgttcactggcgctgggacag

SEQ ID NO: 232875 - DNA, 25 bp, Homo sapien
gctgggacagtcagggtgaccccac

SEQ ID NO: 232876 - DNA, 25 bp, Homo sapien
tacaactaaagagccctctgggcct

SEQ ID NO: 232877 - DNA, 25 bp, Homo sapien
gcaaagagagacacaccctgagccg

SEQ ID NO: 232878 - DNA, 25 bp, Homo sapien
gaccctgcccctgtggatcgggaag

SEQ ID NO: 232879 - DNA, 25 bp, Homo sapien
ctgcccctgtggatcgggaagcctg

SEQ ID NO: 232880 - DNA, 25 bp, Homo sapien
ctgtggatcgggaagcctggtgaca

SEQ ID NO: 232881 - DNA, 25 bp, Homo sapien
atcgggaagcctggtgacaagcccc

SEQ ID NO: 232882 - DNA, 25 bp, Homo sapien
ctcaggagactacgtggccagacct

SEQ ID NO: 232883 - DNA, 25 bp, Homo sapien
aggagactacgtggccagacctgga

SEQ ID NO: 232884 - DNA, 25 bp, Homo sapien
agactacgtggccagacctggagac

SEQ ID NO: 232885 - DNA, 25 bp, Homo sapien
actacgtggccagacctggagacaa

SEQ ID NO: 232886 - DNA, 25 bp, Homo sapien
agacctggagacaaggtggctgccc

SEQ ID NO: 232887 - DNA, 25 bp, Homo sapien
tggtcagttacagccatgccaccaa

SEQ ID NO: 232888 - DNA, 25 bp, Homo sapien
gtaaatagaccatgacttcgatcag

SEQ ID NO: 232889 - DNA, 25 bp, Homo sapien
atagaccatgacttcgatcagtatt

SEQ ID NO: 232890 - DNA, 25 bp, Homo sapien
gaccatgacttcgatcagtatttct

SEQ ID NO: 232891 - DNA, 25 bp, Homo sapien
acttcgatcagtatttcttgtcccc

SEQ ID NO: 232892 - DNA, 25 bp, Homo sapien
ttcgatcagtatttcttgtccccac

SEQ ID NO: 232893 - DNA, 25 bp, Homo sapien
tgtctcagtcctgggctcgcgcact

SEQ ID NO: 232894 - DNA, 25 bp, Homo sapien
cgcacttcaccccggcagatggagg

SEQ ID NO: 232895 - DNA, 25 bp, Homo sapien
ttcgggctgcttgggccagcggcca

SEQ ID NO: 232896 - DNA, 25 bp, Homo sapien
tcgggagggccgcatctctgtatat

SEQ ID NO: 232897 - DNA, 25 bp, Homo sapien
ggagggccgcatctctgtatataat

SEQ ID NO: 232898 - DNA, 25 bp, Homo sapien
gggccgcatctctgtatataatata

SEQ ID NO: 232899 - DNA, 25 bp, Homo sapien
tgtgtactcatcagccagcttaaga

SEQ ID NO: 232900 - DNA, 25 bp, Homo sapien
gtactcatcagccagcttaagatac

SEQ ID NO: 232901 - DNA, 25 bp, Homo sapien
tcagccagcttaagatacagatgtt

SEQ ID NO: 232902 - DNA, 25 bp, Homo sapien
gcttaagatacagatgttgtcgaca

SEQ ID NO: 232903 - DNA, 25 bp, Homo sapien
atgttgtcgacattttagaagttcc

SEQ ID NO: 232904 - DNA, 25 bp, Homo sapien
ggccctctccctctcaaataattat

SEQ ID NO: 232905 - DNA, 25 bp, Homo sapien
gtgtttgtcatttgtctattatagt

SEQ ID NO: 232906 - DNA, 25 bp, Homo sapien
gtcatttgtctattatagttttaca

SEQ ID NO: 232907 - DNA, 25 bp, Homo sapien
gttttacaacatacgtatgtatctg

SEQ ID NO: 232908 - DNA, 25 bp, Homo sapien
acaacatacgtatgtatctgtaagt

SEQ ID NO: 232909 - DNA, 25 bp, Homo sapien
gaagtcttacattttcactcttttt

SEQ ID NO: 232910 - DNA, 25 bp, Homo sapien
ggtgttgtaagatttcctcccgtag

SEQ ID NO: 232911 - DNA, 25 bp, Homo sapien
cccgtagttttttctcctcatggat

SEQ ID NO: 232912 - DNA, 25 bp, Homo sapien
aaatgccaataacacgtccactttc

SEQ ID NO: 232913 - DNA, 25 bp, Homo sapien
gtccactttcaacgtgtagtttacg

SEQ ID NO: 232914 - DNA, 25 bp, Homo sapien
gtagtttacgcggagcactttcgag

SEQ ID NO: 232915 - DNA, 25 bp, Homo sapien
tacgcggagcactttcgaggcctgg

SEQ ID NO: 232916 - DNA, 25 bp, Homo sapien
ggttgggcctacttctcacctgggc

SEQ ID NO: 232917 - DNA, 25 bp, Homo sapien
tgggcctatcttctgaactcgctag

SEQ ID NO: 232918 - DNA, 25 bp, Homo sapien
aactcgctaggttcttatcaacatt

SEQ ID NO: 232919 - DNA, 25 bp, Homo sapien
ttcatttggcttttctttaccagtt

SEQ ID NO: 232920 - DNA, 25 bp, Homo sapien
accagtttctgatttttattctcaa

SEQ ID NO: 232921 - DNA, 25 bp, Homo sapien
aggtcaccggccactccccgaggag

SEQ ID NO: 232922 - DNA, 25 bp, Homo sapien
atccccgggatgcaggcccacagtg

SEQ ID NO: 232923 - DNA, 25 bp, Homo sapien
gctgcacccatgatgcggagctggc

SEQ ID NO: 232924 - DNA, 25 bp, Homo sapien
tgcacccatgatgcggagctggcct

SEQ ID NO: 232925 - DNA, 25 bp, Homo sapien
gcgccaggcaccaactcagtgtttg

SEQ ID NO: 232926 - DNA, 25 bp, Homo sapien
gccaggcaccaactcagtgtttgtc

SEQ ID NO: 232927 - DNA, 25 bp, Homo sapien
ccaggcaccaactcagtgtttgtca

SEQ ID NO: 232928 - DNA, 25 bp, Homo sapien
aggcaccaactcagtgtttgtcagt

SEQ ID NO: 232929 - DNA, 25 bp, Homo sapien
ggcaccaactcagtgtttgtcagtg

SEQ ID NO: 232930 - DNA, 25 bp, Homo sapien
tgcacccatttcctggatgtcccct

SEQ ID NO: 232931 - DNA, 25 bp, Homo sapien
atgtcccctgcaggcgcgggaggcc

SEQ ID NO: 232932 - DNA, 25 bp, Homo sapien
aataaaggtgacactccagggcagg

SEQ ID NO: 232933 - DNA, 25 bp, Homo sapien
tcagctgtgctattgggtttctttg

SEQ ID NO: 232934 - DNA, 25 bp, Homo sapien
tctttgacttggatgtcttgagcat

SEQ ID NO: 232935 - DNA, 25 bp, Homo sapien
atgtcttgagcatgaaatgggctat

SEQ ID NO: 232936 - DNA, 25 bp, Homo sapien
aatgggctatttagagtgttacctc

SEQ ID NO: 232937 - DNA, 25 bp, Homo sapien
tagagtgttacctctcactgtgact

SEQ ID NO: 232938 - DNA, 25 bp, Homo sapien
gtgttacctctcactgtgactgata

SEQ ID NO: 232939 - DNA, 25 bp, Homo sapien
cctctcactgtgactgatacgaatt

SEQ ID NO: 232940 - DNA, 25 bp, Homo sapien
gactgatacgaatttgttcatgaat

SEQ ID NO: 232941 - DNA, 25 bp, Homo sapien
gcagaattgcacttgtgcctcacga

SEQ ID NO: 232942 - DNA, 25 bp, Homo sapien
gtgcctcacgaacatacataaattt

SEQ ID NO: 232943 - DNA, 25 bp, Homo sapien
tagcaagtgctgcactaagggcact

SEQ ID NO: 232944 - DNA, 25 bp, Homo sapien
taagggcactcgcatttggtcattc

SEQ ID NO: 232945 - DNA, 25 bp, Homo sapien
ttggtcattctcttgagagctagga

SEQ ID NO: 232946 - DNA, 25 bp, Homo sapien
gtgagagacttgacctgaaagcagc

SEQ ID NO: 232947 - DNA, 25 bp, Homo sapien
ccctgaggtgcagccagagtcctgt

SEQ ID NO: 232948 - DNA, 25 bp, Homo sapien
agccagagtcctgtgtgcggacaga

SEQ ID NO: 232949 - DNA, 25 bp, Homo sapien
tgtgcggacagagagaatggctaat

SEQ ID NO: 232950 - DNA, 25 bp, Homo sapien
tccgcgtggaattgcctattgtttt

SEQ ID NO: 232951 - DNA, 25 bp, Homo sapien
gcctattgttttatgccacctgatg

SEQ ID NO: 232952 - DNA, 25 bp, Homo sapien
tgccacctgatgtgtctgcatgaga

SEQ ID NO: 232953 - DNA, 25 bp, Homo sapien
atgtgtctgcatgagaggtttcctt

SEQ ID NO: 232954 - DNA, 25 bp, Homo sapien
gtgcgcccattcctaactggaatag

SEQ ID NO: 232955 - DNA, 25 bp, Homo sapien
tgtaaaactaaacttcgggaatatg

SEQ ID NO: 232956 - DNA, 25 bp, Homo sapien
aacttcgggaatatgtatgcccaaa

SEQ ID NO: 232957 - DNA, 25 bp, Homo sapien
gtatgcccaaagtaagtaggatgag

SEQ ID NO: 232958 - DNA, 25 bp, Homo sapien
gtatacatgggatatggtccaatga

SEQ ID NO: 232959 - DNA, 25 bp, Homo sapien
ggtccaatgaatttaagccccaaga

SEQ ID NO: 232960 - DNA, 25 bp, Homo sapien
gccccaagatacagctaaatacatt

SEQ ID NO: 232961 - DNA, 25 bp, Homo sapien
atagcattgtgatgcaatttccaga

SEQ ID NO: 232962 - DNA, 25 bp, Homo sapien
attgtgatgcaatttccagaaatcc

SEQ ID NO: 232963 - DNA, 25 bp, Homo sapien
cagaaatccatttgtgtttagagta

SEQ ID NO: 232964 - DNA, 25 bp, Homo sapien
gttttgtggtttggatttatatatt

SEQ ID NO: 232965 - DNA, 25 bp, Homo sapien
gccatcggcgcctaggggccagtaa

SEQ ID NO: 232966 - DNA, 25 bp, Homo sapien
gccagtaaccatgacgacggccgtt

SEQ ID NO: 232967 - DNA, 25 bp, Homo sapien
agtaaccatgacgacggccgttgcc

SEQ ID NO: 232968 - DNA, 25 bp, Homo sapien
taaccatgacgacggccgttgccaa

SEQ ID NO: 232969 - DNA, 25 bp, Homo sapien
atgacgacggccgttgccaaggccg

SEQ ID NO: 232970 - DNA, 25 bp, Homo sapien
acgacggccgttgccaaggccgaga

SEQ ID NO: 232971 - DNA, 25 bp, Homo sapien
gccgagagccaatagaggcgtcgcc

SEQ ID NO: 232972 - DNA, 25 bp, Homo sapien
ccgagagccaatagaggcgtcgccg

SEQ ID NO: 232973 - DNA, 25 bp, Homo sapien
aaaaggcccatggaatgaagggaag

SEQ ID NO: 232974 - DNA, 25 bp, Homo sapien
ccctgagcccggagcgattgtttgt

SEQ ID NO: 232975 - DNA, 25 bp, Homo sapien
cctgagcccggagcgattgtttgtc

SEQ ID NO: 232976 - DNA, 25 bp, Homo sapien
gttcacaccccgcagcatggagagc

SEQ ID NO: 232977 - DNA, 25 bp, Homo sapien
accccgcagcatggagagcattgag

SEQ ID NO: 232978 - DNA, 25 bp, Homo sapien
caggagatcatgaagcagacgggct

SEQ ID NO: 232979 - DNA, 25 bp, Homo sapien
agcagacgggctacctgaccatcgg

SEQ ID NO: 232980 - DNA, 25 bp, Homo sapien
agcgctaccaggcagaaatcaacga

SEQ ID NO: 232981 - DNA, 25 bp, Homo sapien
acttgggcgagatgggcagcggcac

SEQ ID NO: 232982 - DNA, 25 bp, Homo sapien
tggaagatgcgcttccggaagaccg

SEQ ID NO: 232983 - DNA, 25 bp, Homo sapien
ggaagaccggccacgtcattgccgt

SEQ ID NO: 232984 - DNA, 25 bp, Homo sapien
ggccacgtcattgccgttaagcaaa

SEQ ID NO: 232985 - DNA, 25 bp, Homo sapien
cgttaagcaaatgcggcgctccggg

SEQ ID NO: 232986 - DNA, 25 bp, Homo sapien
caaatgcggcgctccgggaacaagg

SEQ ID NO: 232987 - DNA, 25 bp, Homo sapien
ctttcttcaaatagcagatttcagt

SEQ ID NO: 232988 - DNA, 25 bp, Homo sapien
gcagatttcagtactttatcctcat

SEQ ID NO: 232989 - DNA, 25 bp, Homo sapien
tttcagtactttatcctcattgtgg

SEQ ID NO: 232990 - DNA, 25 bp, Homo sapien
tttatcctcattgtggaaacaagcc

SEQ ID NO: 232991 - DNA, 25 bp, Homo sapien
gccaaaccaaatgaactctggaaaa

SEQ ID NO: 232992 - DNA, 25 bp, Homo sapien
ggtccaaatggcaatataaatccag

SEQ ID NO: 232993 - DNA, 25 bp, Homo sapien
taaatccagtctttattctcccttt

SEQ ID NO: 232994 - DNA, 25 bp, Homo sapien
cttttcaggatttaggcctgtaaga

SEQ ID NO: 232995 - DNA, 25 bp, Homo sapien
gcctgtaagaaactatgcctgattc

SEQ ID NO: 232996 - DNA, 25 bp, Homo sapien
agaaactatgcctgattctgtaaaa

SEQ ID NO: 232997 - DNA, 25 bp, Homo sapien
gaattatatgtacatctctggattt

SEQ ID NO: 232998 - DNA, 25 bp, Homo sapien
ctgtaaggtcttacattgcctgact

SEQ ID NO: 232999 - DNA, 25 bp, Homo sapien
aaggtcttacattgcctgactaaaa

SEQ ID NO: 233000 - DNA, 25 bp, Homo sapien
cattgcctgactaaaatgtttcatt

SEQ ID NO: 233001 - DNA, 25 bp, Homo sapien
gtttcatttacctctaaatttccat

SEQ ID NO: 233002 - DNA, 25 bp, Homo sapien
tttccatatccttctggctgtagat

SEQ ID NO: 233003 - DNA, 25 bp, Homo sapien
atccttctggctgtagataaataat

SEQ ID NO: 233004 - DNA, 25 bp, Homo sapien
ttgtttatgcatttggaattagtgg

SEQ ID NO: 233005 - DNA, 25 bp, Homo sapien
ttgtcattaaaattgttaccactgg

SEQ ID NO: 233006 - DNA, 25 bp, Homo sapien
ttaccactggtaacatgtgacaagc

SEQ ID NO: 233007 - DNA, 25 bp, Homo sapien
tgtgacaagcacaccacaattctcc

SEQ ID NO: 233008 - DNA, 25 bp, Homo sapien
acaattctccctatcttgtgaagtt

SEQ ID NO: 233009 - DNA, 25 bp, Homo sapien
gagtgagtcccagttacatcaaaca

SEQ ID NO: 233010 - DNA, 25 bp, Homo sapien
gttacatcaaacagtgacttccagt

SEQ ID NO: 233011 - DNA, 25 bp, Homo sapien
gacttccagttattccccagtaagt

SEQ ID NO: 233012 - DNA, 25 bp, Homo sapien
cagtaagtctgagtggttccttcaa

SEQ ID NO: 233013 - DNA, 25 bp, Homo sapien
gtctttccagcctttgccagtctag

SEQ ID NO: 233014 - DNA, 25 bp, Homo sapien
gcagggcaccgtgtatgaatgcagt

SEQ ID NO: 233015 - DNA, 25 bp, Homo sapien
tgttttagagtatgcctgctcccca

SEQ ID NO: 233016 - DNA, 25 bp, Homo sapien
tgcctggaaccctctgagcaacttg

SEQ ID NO: 233017 - DNA, 25 bp, Homo sapien
agcaacttgctctgacctataatgt

SEQ ID NO: 233018 - DNA, 25 bp, Homo sapien
atgtcttaggtgcaacacggacccc

SEQ ID NO: 233019 - DNA, 25 bp, Homo sapien
cccctagatccatgtggctttatgt

SEQ ID NO: 233020 - DNA, 25 bp, Homo sapien
ctaagtatatttgaggatttgtttt

SEQ ID NO: 233021 - DNA, 25 bp, Homo sapien
tgttttcttttgcaaaagaccaagg

SEQ ID NO: 233022 - DNA, 25 bp, Homo sapien
gattgtatttttcttatttctctac

SEQ ID NO: 233023 - DNA, 25 bp, Homo sapien
cacacgtatattctggctttttaaa

SEQ ID NO: 233024 - DNA, 25 bp, Homo sapien
tatttctctaccttcataaagagag

SEQ ID NO: 233025 - DNA, 25 bp, Homo sapien
ataaagagagtacacgcccttcctt

SEQ ID NO: 233026 - DNA, 25 bp, Homo sapien
taaagagagtacacgcccttccttt

SEQ ID NO: 233027 - DNA, 25 bp, Homo sapien
tcctttcccaataattcaagatcat

SEQ ID NO: 233028 - DNA, 25 bp, Homo sapien
ttcccaataattcaagatcattttt

SEQ ID NO: 233029 - DNA, 25 bp, Homo sapien
tcatttttatgatgtagctctaagt

SEQ ID NO: 233030 - DNA, 25 bp, Homo sapien
tatgatgtagctctaagtatatttg

SEQ ID NO: 233031 - DNA, 25 bp, Homo sapien
ggaggcactcgggagcccaagctca

SEQ ID NO: 233032 - DNA, 25 bp, Homo sapien
gagcccaagctcagcctgaagaagt

SEQ ID NO: 233033 - DNA, 25 bp, Homo sapien
tgaagaagtcccactcgagcccgtc

SEQ ID NO: 233034 - DNA, 25 bp, Homo sapien
aggctcccaccacggccaaggtgaa

SEQ ID NO: 233035 - DNA, 25 bp, Homo sapien
aaggtgaagcgcaacatctcagagc

SEQ ID NO: 233036 - DNA, 25 bp, Homo sapien
atctcagagcgcagaacctaccgga

SEQ ID NO: 233037 - DNA, 25 bp, Homo sapien
gaacctaccggaagatcatccctaa

SEQ ID NO: 233038 - DNA, 25 bp, Homo sapien
agatcatccctaagcggaaccgcaa

SEQ ID NO: 233039 - DNA, 25 bp, Homo sapien
ggaaccgcaatcagctgtgaagcca

SEQ ID NO: 233040 - DNA, 25 bp, Homo sapien
tccctggaggagacttatttcaatg

SEQ ID NO: 233041 - DNA, 25 bp, Homo sapien
gagtccaccatgacggatgaggcac

SEQ ID NO: 233042 - DNA, 25 bp, Homo sapien
gcccactgcactgaaatgagacttt

SEQ ID NO: 233043 - DNA, 25 bp, Homo sapien
aagcagccaccacatgatgcgggag

SEQ ID NO: 233044 - DNA, 25 bp, Homo sapien
gcagccaccacatgatgcgggagaa

SEQ ID NO: 233045 - DNA, 25 bp, Homo sapien
gccaccacatgatgcgggagaaccc

SEQ ID NO: 233046 - DNA, 25 bp, Homo sapien
agggccgtgacctgctgagctgcac

SEQ ID NO: 233047 - DNA, 25 bp, Homo sapien
gagctgcaccagctctgagcctctg

SEQ ID NO: 233048 - DNA, 25 bp, Homo sapien
tctgagcctctgaccctctgagaga

SEQ ID NO: 233049 - DNA, 25 bp, Homo sapien
agcctctgaccctctgagagatgat

SEQ ID NO: 233050 - DNA, 25 bp, Homo sapien
actaggaccctgcaagcaactctgc

SEQ ID NO: 233051 - DNA, 25 bp, Homo sapien
ggaccctgcaagcaactctgctctg

SEQ ID NO: 233052 - DNA, 25 bp, Homo sapien
ctgctctgtgaccaggccaggattc

SEQ ID NO: 233053 - DNA, 25 bp, Homo sapien
aagtaccttgcagctgtattgctcg

SEQ ID NO: 233054 - DNA, 25 bp, Homo sapien
agctgtattgctcgtctgctttgga

SEQ ID NO: 233055 - DNA, 25 bp, Homo sapien
tattgctcgtctgctttggagacca

SEQ ID NO: 233056 - DNA, 25 bp, Homo sapien
ctttggagaccacagtttctaacag

SEQ ID NO: 233057 - DNA, 25 bp, Homo sapien
gtttctaacagactttcaacagagg

SEQ ID NO: 233058 - DNA, 25 bp, Homo sapien
agaggactgtcttattccactcttc

SEQ ID NO: 233059 - DNA, 25 bp, Homo sapien
ctgtcttattccactcttcggcgaa

SEQ ID NO: 233060 - DNA, 25 bp, Homo sapien
tttacgttcatgtaaacagcatgac

SEQ ID NO: 233061 - DNA, 25 bp, Homo sapien
aacagcatgacgtgaggccgtggat

SEQ ID NO: 233062 - DNA, 25 bp, Homo sapien
gccgtggatgcaggcattaaggtat

SEQ ID NO: 233063 - DNA, 25 bp, Homo sapien
ggcattaaggtatactgtgtaccag

SEQ ID NO: 233064 - DNA, 25 bp, Homo sapien
aacccgtccagtgtgtgtgcttaag

SEQ ID NO: 233065 - DNA, 25 bp, Homo sapien
acccgtccagtgtgtgtgcttaagt

SEQ ID NO: 233066 - DNA, 25 bp, Homo sapien
cccgtccagtgtgtgtgcttaagtt

SEQ ID NO: 233067 - DNA, 25 bp, Homo sapien
ccgtccagtgtgtgtgcttaagtta

SEQ ID NO: 233068 - DNA, 25 bp, Homo sapien
cgtccagtgtgtgtgcttaagttat

SEQ ID NO: 233069 - DNA, 25 bp, Homo sapien
gtccagtgtgtgtgcttaagttatt

SEQ ID NO: 233070 - DNA, 25 bp, Homo sapien
ccagtgtgtgtgcttaagttattca

SEQ ID NO: 233071 - DNA, 25 bp, Homo sapien
gtgtgtgtgcttaagttattcattc

SEQ ID NO: 233072 - DNA, 25 bp, Homo sapien
gtgtgtgcttaagttattcattcat

SEQ ID NO: 233073 - DNA, 25 bp, Homo sapien
gtgtgcttaagttattcattcatcc

SEQ ID NO: 233074 - DNA, 25 bp, Homo sapien
gtgcttaagttattcattcatcccc

SEQ ID NO: 233075 - DNA, 25 bp, Homo sapien
caggtgtccgcatttttgcatggta

SEQ ID NO: 233076 - DNA, 25 bp, Homo sapien
ggaaaaggcttacttgcccttcagc

SEQ ID NO: 233077 - DNA, 25 bp, Homo sapien
ttacttgcccttcagctcataaaag

SEQ ID NO: 233078 - DNA, 25 bp, Homo sapien
gaaggtgtgctattcacagtaccat

SEQ ID NO: 233079 - DNA, 25 bp, Homo sapien
attcacagtaccatgcgagtagccc

SEQ ID NO: 233080 - DNA, 25 bp, Homo sapien
tgcgagtagcccacagttaattccc

SEQ ID NO: 233081 - DNA, 25 bp, Homo sapien
gttaattcccggcagattctttggc

SEQ ID NO: 233082 - DNA, 25 bp, Homo sapien
tgaacgtttctgactaatattttgt

SEQ ID NO: 233083 - DNA, 25 bp, Homo sapien
gtaagatgcttagggtgcctggcca

SEQ ID NO: 233084 - DNA, 25 bp, Homo sapien
ctggccaggactccgtggtttcctg

SEQ ID NO: 233085 - DNA, 25 bp, Homo sapien
cgtggtttcctgttgtgacagtaat

SEQ ID NO: 233086 - DNA, 25 bp, Homo sapien
aggaactcgcacctgtgctggagcc

SEQ ID NO: 233087 - DNA, 25 bp, Homo sapien
atctcctgggccgttacatctgtgc

SEQ ID NO: 233088 - DNA, 25 bp, Homo sapien
cgttacatctgtgcagggctggttt

SEQ ID NO: 233089 - DNA, 25 bp, Homo sapien
gcagggctggtttgttctgactttt

SEQ ID NO: 233090 - DNA, 25 bp, Homo sapien
ttgtttctttgtgtttgcttggtgc

SEQ ID NO: 233091 - DNA, 25 bp, Homo sapien
gcttggtgctggtttatttgttgtt

SEQ ID NO: 233092 - DNA, 25 bp, Homo sapien
gggaaaaagccatatcatgctaaaa

SEQ ID NO: 233093 - DNA, 25 bp, Homo sapien
gatattgtcctaagtgtcaagtcct

SEQ ID NO: 233094 - DNA, 25 bp, Homo sapien
taagtgtcaagtcctgactgggctg

SEQ ID NO: 233095 - DNA, 25 bp, Homo sapien
tcctgactgggctgggtttgctgtc

SEQ ID NO: 233096 - DNA, 25 bp, Homo sapien
cactgctcgaaatggcccctgtctt

SEQ ID NO: 233097 - DNA, 25 bp, Homo sapien
cacatattattattgccagatgagc

SEQ ID NO: 233098 - DNA, 25 bp, Homo sapien
gagcataaatagcttctgtttggag

SEQ ID NO: 233099 - DNA, 25 bp, Homo sapien
tggagattcaggaaagccttagggt

SEQ ID NO: 233100 - DNA, 25 bp, Homo sapien
gtggaatgaggaacatcttctgagt

SEQ ID NO: 233101 - DNA, 25 bp, Homo sapien
atcttctgagtaaacagggttgcaa

SEQ ID NO: 233102 - DNA, 25 bp, Homo sapien
gaagagcacagttaaggccaactaa

SEQ ID NO: 233103 - DNA, 25 bp, Homo sapien
ggccaactaacgtaaaatgcactga

SEQ ID NO: 233104 - DNA, 25 bp, Homo sapien
aaatgcactgaagccttagggaata

SEQ ID NO: 233105 - DNA, 25 bp, Homo sapien
tagggaatattgaagggcctgacat

SEQ ID NO: 233106 - DNA, 25 bp, Homo sapien
agttatacccagttctacctacttg

SEQ ID NO: 233107 - DNA, 25 bp, Homo sapien
acccagttctacctacttgtatatt

SEQ ID NO: 233108 - DNA, 25 bp, Homo sapien
aagttgtaagttttcatatcatgtg

SEQ ID NO: 233109 - DNA, 25 bp, Homo sapien
aagttttcatatcatgtgctgtaaa

SEQ ID NO: 233110 - DNA, 25 bp, Homo sapien
aatgaggctttaacgtaaacactgg

SEQ ID NO: 233111 - DNA, 25 bp, Homo sapien
gctttaacgtaaacactggtgacat

SEQ ID NO: 233112 - DNA, 25 bp, Homo sapien
ggtgacataaaccattcattgctac

SEQ ID NO: 233113 - DNA, 25 bp, Homo sapien
gacataaaccattcattgctacgtt

SEQ ID NO: 233114 - DNA, 25 bp, Homo sapien
aaaccattcattgctacgttgctta

SEQ ID NO: 233115 - DNA, 25 bp, Homo sapien
ccattcattgctacgttgcttattg

SEQ ID NO: 233116 - DNA, 25 bp, Homo sapien
cattgctacgttgcttattgtgttt

SEQ ID NO: 233117 - DNA, 25 bp, Homo sapien
gctacgttgcttattgtgtttttat

SEQ ID NO: 233118 - DNA, 25 bp, Homo sapien
gatagcagcaattaagttgtttgta

SEQ ID NO: 233119 - DNA, 25 bp, Homo sapien
aattcacctatagccaatcttgcat

SEQ ID NO: 233120 - DNA, 25 bp, Homo sapien
aaaaggaaggcatcagtcacatatt

SEQ ID NO: 233121 - DNA, 25 bp, Homo sapien
agtcacatattagaggccccacaca

SEQ ID NO: 233122 - DNA, 25 bp, Homo sapien
agaggtgtgtggctacccgcttcca

SEQ ID NO: 233123 - DNA, 25 bp, Homo sapien
tcctgattctttggcttgttaatcg

SEQ ID NO: 233124 - DNA, 25 bp, Homo sapien
tggcttgttaatcgagaatatcccc

SEQ ID NO: 233125 - DNA, 25 bp, Homo sapien
aaatcacttgtctctgttcctcaga

SEQ ID NO: 233126 - DNA, 25 bp, Homo sapien
gttcctcagagttgtaggtctccag

SEQ ID NO: 233127 - DNA, 25 bp, Homo sapien
taggtctccagatatgtccccagtg

SEQ ID NO: 233128 - DNA, 25 bp, Homo sapien
aagatacatgcccactttgctgttt

SEQ ID NO: 233129 - DNA, 25 bp, Homo sapien
gcccactttgctgtttcttcagaaa

SEQ ID NO: 233130 - DNA, 25 bp, Homo sapien
ggtaattagccagccacactttgag

SEQ ID NO: 233131 - DNA, 25 bp, Homo sapien
aaaaatgtacattgccaggtctttc

SEQ ID NO: 233132 - DNA, 25 bp, Homo sapien
tgtacattgccaggtctttctttcc

SEQ ID NO: 233133 - DNA, 25 bp, Homo sapien
ctttctttcctgtggatgctaacta

SEQ ID NO: 233134 - DNA, 25 bp, Homo sapien
ctgtggatgctaactataggatatt

SEQ ID NO: 233135 - DNA, 25 bp, Homo sapien
ggatatttaggttcctctgttcttt

SEQ ID NO: 233136 - DNA, 25 bp, Homo sapien
tctgttctttgtctcccatagtggc

SEQ ID NO: 233137 - DNA, 25 bp, Homo sapien
ttgagggccaggacttatctctgtt

SEQ ID NO: 233138 - DNA, 25 bp, Homo sapien
ccaggacttatctctgttcgcagtg

SEQ ID NO: 233139 - DNA, 25 bp, Homo sapien
tatctctgttcgcagtgccaaggac

SEQ ID NO: 233140 - DNA, 25 bp, Homo sapien
ggaccatagaagatactcagttttt

SEQ ID NO: 233141 - DNA, 25 bp, Homo sapien
atgttttgttttatgcccttcccag

SEQ ID NO: 233142 - DNA, 25 bp, Homo sapien
gagggacaccgggatcgcactcctg

SEQ ID NO: 233143 - DNA, 25 bp, Homo sapien
gggatcgcactcctgtactggccac

SEQ ID NO: 233144 - DNA, 25 bp, Homo sapien
gccgctgtcacttgtcacattgagt

SEQ ID NO: 233145 - DNA, 25 bp, Homo sapien
cgctgtcacttgtcacattgagttc

SEQ ID NO: 233146 - DNA, 25 bp, Homo sapien
agctgcccagtgtcatagaaaagca

SEQ ID NO: 233147 - DNA, 25 bp, Homo sapien
gaaaagcaattcaccaacgactgat

SEQ ID NO: 233148 - DNA, 25 bp, Homo sapien
agcaattcaccaacgactgatctct

SEQ ID NO: 233149 - DNA, 25 bp, Homo sapien
ttcaccaacgactgatctctccatt

SEQ ID NO: 233150 - DNA, 25 bp, Homo sapien
cagaagtgtgcagtcttaaatgtac

SEQ ID NO: 233151 - DNA, 25 bp, Homo sapien
gtgtgcagtcttaaatgtacagcga

SEQ ID NO: 233152 - DNA, 25 bp, Homo sapien
cgtattggcacggttgtcttccaaa

SEQ ID NO: 233153 - DNA, 25 bp, Homo sapien
tggcacggttgtcttccaaacccat

SEQ ID NO: 233154 - DNA, 25 bp, Homo sapien
agtcagctctctggtgctttccata

SEQ ID NO: 233155 - DNA, 25 bp, Homo sapien
tctggtgctttccatagcgttcctt

SEQ ID NO: 233156 - DNA, 25 bp, Homo sapien
catagcgttcctttttgccaggctt

SEQ ID NO: 233157 - DNA, 25 bp, Homo sapien
ttgccaggcttctgagatttttaaa

SEQ ID NO: 233158 - DNA, 25 bp, Homo sapien
aacatctgcctctgaattagctgac

SEQ ID NO: 233159 - DNA, 25 bp, Homo sapien
attagctgacaatgggaaacacaca

SEQ ID NO: 233160 - DNA, 25 bp, Homo sapien
gaaacacacattgcagagattatct

SEQ ID NO: 233161 - DNA, 25 bp, Homo sapien
taaccattggtttcagcttcctatc

SEQ ID NO: 233162 - DNA, 25 bp, Homo sapien
aagccaccaacttcgtttcacttct

SEQ ID NO: 233163 - DNA, 25 bp, Homo sapien
acgtgacagccccttatgcagagga

SEQ ID NO: 233164 - DNA, 25 bp, Homo sapien
gtgacagccccttatgcagaggagg

SEQ ID NO: 233165 - DNA, 25 bp, Homo sapien
gacagccccttatgcagaggaggaa

SEQ ID NO: 233166 - DNA, 25 bp, Homo sapien
cagccccttatgcagaggaggaaag

SEQ ID NO: 233167 - DNA, 25 bp, Homo sapien
ggtgagtcgaggctggcccctgagg

SEQ ID NO: 233168 - DNA, 25 bp, Homo sapien
atgctccctgaacgctggagaccac

SEQ ID NO: 233169 - DNA, 25 bp, Homo sapien
tgaacgctggagaccactgtcggct

SEQ ID NO: 233170 - DNA, 25 bp, Homo sapien
aacgctggagaccactgtcggctag

SEQ ID NO: 233171 - DNA, 25 bp, Homo sapien
tggagaccactgtcggctagcagcg

SEQ ID NO: 233172 - DNA, 25 bp, Homo sapien
actgtcggctagcagcggctctcag

SEQ ID NO: 233173 - DNA, 25 bp, Homo sapien
gctctcagggaaggcctggtctcca

SEQ ID NO: 233174 - DNA, 25 bp, Homo sapien
agcgcgcagcaaggaccaggaagat

SEQ ID NO: 233175 - DNA, 25 bp, Homo sapien
aagatggagcgctcttcggcagcga

SEQ ID NO: 233176 - DNA, 25 bp, Homo sapien
agcgctcttcggcagcgacaccgag

SEQ ID NO: 233177 - DNA, 25 bp, Homo sapien
tatttcagactggtgtaaaggacaa

SEQ ID NO: 233178 - DNA, 25 bp, Homo sapien
taaaggacaaatatgacaacgacgt

SEQ ID NO: 233179 - DNA, 25 bp, Homo sapien
gacaacgacgtcaaggactcgcatc

SEQ ID NO: 233180 - DNA, 25 bp, Homo sapien
aacgacgtcaaggactcgcatccgt

SEQ ID NO: 233181 - DNA, 25 bp, Homo sapien
gtcaaggactcgcatccgtcgcttt

SEQ ID NO: 233182 - DNA, 25 bp, Homo sapien
gcatccgtcgctttctgcagaaagg

SEQ ID NO: 233183 - DNA, 25 bp, Homo sapien
gggcttcttcggtcccgagctcgcg

SEQ ID NO: 233184 - DNA, 25 bp, Homo sapien
tcggtcccgagctcgcgtccaggtg

SEQ ID NO: 233185 - DNA, 25 bp, Homo sapien
gctccaggcttcatacggtaaaact

SEQ ID NO: 233186 - DNA, 25 bp, Homo sapien
catacggtaaaactctctgggaagg

SEQ ID NO: 233187 - DNA, 25 bp, Homo sapien
aactcagagtcccatgcagaaaatt

SEQ ID NO: 233188 - DNA, 25 bp, Homo sapien
gatttccaaagccaactgtttcctg

SEQ ID NO: 233189 - DNA, 25 bp, Homo sapien
ctgtttcctgtagtgtgtggatctc

SEQ ID NO: 233190 - DNA, 25 bp, Homo sapien
gtagtgtgtggatctctgcaagcag

SEQ ID NO: 233191 - DNA, 25 bp, Homo sapien
catctttcaatttcagctacatgaa

SEQ ID NO: 233192 - DNA, 25 bp, Homo sapien
ttttttattgtgacccagtttctcg

SEQ ID NO: 233193 - DNA, 25 bp, Homo sapien
gacccagtttctcgtcaaccagtaa

SEQ ID NO: 233194 - DNA, 25 bp, Homo sapien
agtaaaacatccagtaacacagcca

SEQ ID NO: 233195 - DNA, 25 bp, Homo sapien
gaatgggtctctgtttatagtgaag

SEQ ID NO: 233196 - DNA, 25 bp, Homo sapien
gaaaatgacataagtcgttctttct

SEQ ID NO: 233197 - DNA, 25 bp, Homo sapien
atgacataagtcgttctttctagat

SEQ ID NO: 233198 - DNA, 25 bp, Homo sapien
agacagccagcatttattaattaaa

SEQ ID NO: 233199 - DNA, 25 bp, Homo sapien
gtaaaaatggtcttgtcatctaaag

SEQ ID NO: 233200 - DNA, 25 bp, Homo sapien
aaatggtcttgtcatctaaagagat

SEQ ID NO: 233201 - DNA, 25 bp, Homo sapien
ggtcttgtcatctaaagagattttg

SEQ ID NO: 233202 - DNA, 25 bp, Homo sapien
gataaagtataccattagcagttaa

SEQ ID NO: 233203 - DNA, 25 bp, Homo sapien
attagcagttaatgggcctttgatg

SEQ ID NO: 233204 - DNA, 25 bp, Homo sapien
cagttaatgggcctttgatgtggtt

SEQ ID NO: 233205 - DNA, 25 bp, Homo sapien
taatgggcctttgatgtggtttgtt

SEQ ID NO: 233206 - DNA, 25 bp, Homo sapien
atgggcctttgatgtggtttgtttt

SEQ ID NO: 233207 - DNA, 25 bp, Homo sapien
accgccagaaaacagtaagatgtgc

SEQ ID NO: 233208 - DNA, 25 bp, Homo sapien
cgccagaaaacagtaagatgtgcct

SEQ ID NO: 233209 - DNA, 25 bp, Homo sapien
gtaagatgtgccttgacacaaatac

SEQ ID NO: 233210 - DNA, 25 bp, Homo sapien
agatgtgccttgacacaaatactgt

SEQ ID NO: 233211 - DNA, 25 bp, Homo sapien
gatgtgccttgacacaaatactgtt

SEQ ID NO: 233212 - DNA, 25 bp, Homo sapien
atgtgccttgacacaaatactgttg

SEQ ID NO: 233213 - DNA, 25 bp, Homo sapien
gtgccttgacacaaatactgttgta

SEQ ID NO: 233214 - DNA, 25 bp, Homo sapien
gccttgacacaaatactgttgtatg

SEQ ID NO: 233215 - DNA, 25 bp, Homo sapien
aatactgttgtatgaaccatgtgcc

SEQ ID NO: 233216 - DNA, 25 bp, Homo sapien
atactgttgtatgaaccatgtgcca

SEQ ID NO: 233217 - DNA, 25 bp, Homo sapien
tactgttgtatgaaccatgtgccaa

SEQ ID NO: 233218 - DNA, 25 bp, Homo sapien
gggcagtccgttccccagacactgt

SEQ ID NO: 233219 - DNA, 25 bp, Homo sapien
agacactgtggcctctgaagtggaa

SEQ ID NO: 233220 - DNA, 25 bp, Homo sapien
gtggcctctgaagtggaaactgaaa

SEQ ID NO: 233221 - DNA, 25 bp, Homo sapien
gaaactgaaagctgcatacctggga

SEQ ID NO: 233222 - DNA, 25 bp, Homo sapien
ctgcatacctgggaaagaactttct

SEQ ID NO: 233223 - DNA, 25 bp, Homo sapien
taggcaatggccttcagtggaagag

SEQ ID NO: 233224 - DNA, 25 bp, Homo sapien
aggtgtgcccagtacttggatgttc

SEQ ID NO: 233225 - DNA, 25 bp, Homo sapien
ttggatgttcatctgtccacaacag

SEQ ID NO: 233226 - DNA, 25 bp, Homo sapien
tcatctgtccacaacagctttttgt

SEQ ID NO: 233227 - DNA, 25 bp, Homo sapien
aaaggatgacatcgttttcttctac

SEQ ID NO: 233228 - DNA, 25 bp, Homo sapien
cgttttcttctacaattaatacatg

SEQ ID NO: 233229 - DNA, 25 bp, Homo sapien
atttaatttttagacagctctgtac

SEQ ID NO: 233230 - DNA, 25 bp, Homo sapien
agctctgtacatttcttgcttatta

SEQ ID NO: 233231 - DNA, 25 bp, Homo sapien
catccagttggaatcacagaataca

SEQ ID NO: 233232 - DNA, 25 bp, Homo sapien
acacaattacaatcttcttgtctct

SEQ ID NO: 233233 - DNA, 25 bp, Homo sapien
ttacaatcttcttgtctcttatctt

SEQ ID NO: 233234 - DNA, 25 bp, Homo sapien
aacccttttgtttatactctgatat

SEQ ID NO: 233235 - DNA, 25 bp, Homo sapien
tatactctgatatttactccagtga

SEQ ID NO: 233236 - DNA, 25 bp, Homo sapien
tatttactccagtgaattcttcatg

SEQ ID NO: 233237 - DNA, 25 bp, Homo sapien
actccagtgaattcttcatgtataa

SEQ ID NO: 233238 - DNA, 25 bp, Homo sapien
gtttttcacagccacacacttgtac

SEQ ID NO: 233239 - DNA, 25 bp, Homo sapien
acagccacacacttgtaccacaaat

SEQ ID NO: 233240 - DNA, 25 bp, Homo sapien
gtaacaatatctatgaccactgtta

SEQ ID NO: 233241 - DNA, 25 bp, Homo sapien
acaatatctatgaccactgttagcc

SEQ ID NO: 233242 - DNA, 25 bp, Homo sapien
caatatctatgaccactgttagccc

SEQ ID NO: 233243 - DNA, 25 bp, Homo sapien
aatatctatgaccactgttagccca

SEQ ID NO: 233244 - DNA, 25 bp, Homo sapien
atatctatgaccactgttagcccat

SEQ ID NO: 233245 - DNA, 25 bp, Homo sapien
tatctatgaccactgttagcccatt

SEQ ID NO: 233246 - DNA, 25 bp, Homo sapien
atctatgaccactgttagcccatta

SEQ ID NO: 233247 - DNA, 25 bp, Homo sapien
tctatgaccactgttagcccattat

SEQ ID NO: 233248 - DNA, 25 bp, Homo sapien
ctatgaccactgttagcccattata

SEQ ID NO: 233249 - DNA, 25 bp, Homo sapien
tatgaccactgttagcccattatat

SEQ ID NO: 233250 - DNA, 25 bp, Homo sapien
atgaccactgttagcccattatatt

SEQ ID NO: 233251 - DNA, 25 bp, Homo sapien
gggcagctgataggcctaaggccat

SEQ ID NO: 233252 - DNA, 25 bp, Homo sapien
ggcctaaggccataccttactattt

SEQ ID NO: 233253 - DNA, 25 bp, Homo sapien
aggccataccttactatttaagata

SEQ ID NO: 233254 - DNA, 25 bp, Homo sapien
aagatactctgatcgcacaactgca

SEQ ID NO: 233255 - DNA, 25 bp, Homo sapien
gatcgcacaactgcagagacagggt

SEQ ID NO: 233256 - DNA, 25 bp, Homo sapien
agagacagggttccctcactgctag

SEQ ID NO: 233257 - DNA, 25 bp, Homo sapien
tcactgctagtcagcttcttttgga

SEQ ID NO: 233258 - DNA, 25 bp, Homo sapien
tggaaactggacaggccattgccac

SEQ ID NO: 233259 - DNA, 25 bp, Homo sapien
ggatacaacagtgtgcttttggtgc

SEQ ID NO: 233260 - DNA, 25 bp, Homo sapien
acaacagtgtgcttttggtgcacat

SEQ ID NO: 233261 - DNA, 25 bp, Homo sapien
gcttttggtgcacattttttagcaa

SEQ ID NO: 233262 - DNA, 25 bp, Homo sapien
gggagaaactcattgtgtcactgaa

SEQ ID NO: 233263 - DNA, 25 bp, Homo sapien
ttaatcttgatatcagcctctacag

SEQ ID NO: 233264 - DNA, 25 bp, Homo sapien
cagcctctacagaccttttattcta

SEQ ID NO: 233265 - DNA, 25 bp, Homo sapien
gaccttttattctaagctatcgagc

SEQ ID NO: 233266 - DNA, 25 bp, Homo sapien
gctatcgagcttcttgattgcattt

SEQ ID NO: 233267 - DNA, 25 bp, Homo sapien
atttggttgaccacgagtgacccta

SEQ ID NO: 233268 - DNA, 25 bp, Homo sapien
gaccacgagtgaccctaaggcattg

SEQ ID NO: 233269 - DNA, 25 bp, Homo sapien
agcacgtggtgctgcaacaggcatt

SEQ ID NO: 233270 - DNA, 25 bp, Homo sapien
gtctccagtattctgacaccaagtg

SEQ ID NO: 233271 - DNA, 25 bp, Homo sapien
acaccaagtgtcaactgtggtactt

SEQ ID NO: 233272 - DNA, 25 bp, Homo sapien
tgtggtactttctttgcctaggata

SEQ ID NO: 233273 - DNA, 25 bp, Homo sapien
agcaattcttactcatgaatggaaa

SEQ ID NO: 233274 - DNA, 25 bp, Homo sapien
atggaaaaatgctctgcagtctcta

SEQ ID NO: 233275 - DNA, 25 bp, Homo sapien
tgctctgcagtctctaagtgtgtgt

SEQ ID NO: 233276 - DNA, 25 bp, Homo sapien
aagttgacttgctcctagggaggga

SEQ ID NO: 233277 - DNA, 25 bp, Homo sapien
cctagggagggatgtttaatcacat

SEQ ID NO: 233278 - DNA, 25 bp, Homo sapien
tattgactatttcttgtctttctct

SEQ ID NO: 233279 - DNA, 25 bp, Homo sapien
tctctcctgctagaacatgaacttc

SEQ ID NO: 233280 - DNA, 25 bp, Homo sapien
atgggtacagccataaattattcaa

SEQ ID NO: 233281 - DNA, 25 bp, Homo sapien
aaatctggagatcagttcaccgtct

SEQ ID NO: 233282 - DNA, 25 bp, Homo sapien
ggagatcagttcaccgtctcttcta

SEQ ID NO: 233283 - DNA, 25 bp, Homo sapien
caccgtctcttctactttctaagga

SEQ ID NO: 233284 - DNA, 25 bp, Homo sapien
aaagcatgacaaccaaagttttaga

SEQ ID NO: 233285 - DNA, 25 bp, Homo sapien
tgtgtgcaaacactaaattttattg

SEQ ID NO: 233286 - DNA, 25 bp, Homo sapien
attgctttatgttttgacctttata

SEQ ID NO: 233287 - DNA, 25 bp, Homo sapien
ataaaggtgttattctgctgcccag

SEQ ID NO: 233288 - DNA, 25 bp, Homo sapien
attctgctgcccagttttgtaattc

SEQ ID NO: 233289 - DNA, 25 bp, Homo sapien
gtaattctcaaaaatagtgccaggt

SEQ ID NO: 233290 - DNA, 25 bp, Homo sapien
tagtgccaggtcttctatagctttt

SEQ ID NO: 233291 - DNA, 25 bp, Homo sapien
tttcagaattcatgggcttacaagt

SEQ ID NO: 233292 - DNA, 25 bp, Homo sapien
gaattcatgggcttacaagtactgt

SEQ ID NO: 233293 - DNA, 25 bp, Homo sapien
gggcttacaagtactgtatgcatct

SEQ ID NO: 233294 - DNA, 25 bp, Homo sapien
agtactgtatgcatctttaaaaaga

SEQ ID NO: 233295 - DNA, 25 bp, Homo sapien
aaaatccatttcacacttgtaggtt

SEQ ID NO: 233296 - DNA, 25 bp, Homo sapien
tccatttcacacttgtaggtttttt

SEQ ID NO: 233297 - DNA, 25 bp, Homo sapien
tttacagtgtaatccatttctttgg

SEQ ID NO: 233298 - DNA, 25 bp, Homo sapien
gtgtaatccatttctttggtttggc

SEQ ID NO: 233299 - DNA, 25 bp, Homo sapien
tgtaaaatatatagcactcctttgc

SEQ ID NO: 233300 - DNA, 25 bp, Homo sapien
agcactcctttgcaatgtgttatta

SEQ ID NO: 233301 - DNA, 25 bp, Homo sapien
aactttctcatttcaaaaccaagca

SEQ ID NO: 233302 - DNA, 25 bp, Homo sapien
tcaaaaccaagcaattgttcctttt

SEQ ID NO: 233303 - DNA, 25 bp, Homo sapien
caaattgcacagaaaacctaccatt

SEQ ID NO: 233304 - DNA, 25 bp, Homo sapien
gaaaacctaccattccataggcctg

SEQ ID NO: 233305 - DNA, 25 bp, Homo sapien
taccattccataggcctgctgttgg

SEQ ID NO: 233306 - DNA, 25 bp, Homo sapien
atgacataagtcgttctttctagat

SEQ ID NO: 233307 - DNA, 25 bp, Homo sapien
cgttctttctagatgatctgatcaa

SEQ ID NO: 233308 - DNA, 25 bp, Homo sapien
gatgatctgatcaaagacagccagc

SEQ ID NO: 233309 - DNA, 25 bp, Homo sapien
agacagccagcatttattaattaaa

SEQ ID NO: 233310 - DNA, 25 bp, Homo sapien
gtaaaaatggtcttgtcatctaaag

SEQ ID NO: 233311 - DNA, 25 bp, Homo sapien
ggtcttgtcatctaaagagattttg

SEQ ID NO: 233312 - DNA, 25 bp, Homo sapien
gagattttgaagaagtggcatttaa

SEQ ID NO: 233313 - DNA, 25 bp, Homo sapien
gataaagtataccattagcagttaa

SEQ ID NO: 233314 - DNA, 25 bp, Homo sapien
attagcagttaatgggcctttgatg

SEQ ID NO: 233315 - DNA, 25 bp, Homo sapien
cagttaatgggcctttgatgtggtt

SEQ ID NO: 233316 - DNA, 25 bp, Homo sapien
atgggcctttgatgtggtttgtttt

SEQ ID NO: 233317 - DNA, 25 bp, Homo sapien
gtaaatagaccatgacttcgatcag

SEQ ID NO: 233318 - DNA, 25 bp, Homo sapien
gaccatgacttcgatcagtatttct

SEQ ID NO: 233319 - DNA, 25 bp, Homo sapien
acttcgatcagtatttcttgtcccc

SEQ ID NO: 233320 - DNA, 25 bp, Homo sapien
ttcgatcagtatttcttgtccccac

SEQ ID NO: 233321 - DNA, 25 bp, Homo sapien
aaggagctggctgtctcagtcctgg

SEQ ID NO: 233322 - DNA, 25 bp, Homo sapien
tggctgtctcagtcctgggctcgcg

SEQ ID NO: 233323 - DNA, 25 bp, Homo sapien
cgcacttcaccccggcagatggagg

SEQ ID NO: 233324 - DNA, 25 bp, Homo sapien
ttcgggctgcttgggccagcggcca

SEQ ID NO: 233325 - DNA, 25 bp, Homo sapien
tcgggagggccgcatctctgtatat

SEQ ID NO: 233326 - DNA, 25 bp, Homo sapien
gggccgcatctctgtatataatata

SEQ ID NO: 233327 - DNA, 25 bp, Homo sapien
tatgtatgtattgttcccggttttg

SEQ ID NO: 233328 - DNA, 25 bp, Homo sapien
gcaatggatcgctgagggcttgaaa

SEQ ID NO: 233329 - DNA, 25 bp, Homo sapien
gaaagggtagcagtacatccggcat

SEQ ID NO: 233330 - DNA, 25 bp, Homo sapien
agtacatccggcatgcctagggcag

SEQ ID NO: 233331 - DNA, 25 bp, Homo sapien
atcttgttccacgagatttcttgag

SEQ ID NO: 233332 - DNA, 25 bp, Homo sapien
atgcctagggcagggtctgactctg

SEQ ID NO: 233333 - DNA, 25 bp, Homo sapien
aggcgtgattggtggaatttcgaat

SEQ ID NO: 233334 - DNA, 25 bp, Homo sapien
gaatttcgaattcctcgtccccaag

SEQ ID NO: 233335 - DNA, 25 bp, Homo sapien
gcttggtgtgtggaatgtctgctca

SEQ ID NO: 233336 - DNA, 25 bp, Homo sapien
gaatgtctgctcactggcagcgaag

SEQ ID NO: 233337 - DNA, 25 bp, Homo sapien
gaagaacgcattgttcgcctcagcc

SEQ ID NO: 233338 - DNA, 25 bp, Homo sapien
ggtgtgaattcacttccctgggaag

SEQ ID NO: 233339 - DNA, 25 bp, Homo sapien
gaaatcatgctgtaagtcagcttaa

SEQ ID NO: 233340 - DNA, 25 bp, Homo sapien
tcctggttttaaaacaggtgctgtt

SEQ ID NO: 233341 - DNA, 25 bp, Homo sapien
actataggtgtggtagagggataca

SEQ ID NO: 233342 - DNA, 25 bp, Homo sapien
agagggatacaaggttccataaact

SEQ ID NO: 233343 - DNA, 25 bp, Homo sapien
agaatggatatgtgcatctcttttg

SEQ ID NO: 233344 - DNA, 25 bp, Homo sapien
ggatatgtgcatctcttttgcttta

SEQ ID NO: 233345 - DNA, 25 bp, Homo sapien
tgtgcatctcttttgctttaatttt

SEQ ID NO: 233346 - DNA, 25 bp, Homo sapien
aaagggaatggaatatgcaaggcac

SEQ ID NO: 233347 - DNA, 25 bp, Homo sapien
tgcaaggcacattcaagagtactga

SEQ ID NO: 233348 - DNA, 25 bp, Homo sapien
gaatatactgagttactgatgctaa

SEQ ID NO: 233349 - DNA, 25 bp, Homo sapien
ctgagttactgatgctaatagccaa

SEQ ID NO: 233350 - DNA, 25 bp, Homo sapien
aagcagccaccacatgatgcgggag

SEQ ID NO: 233351 - DNA, 25 bp, Homo sapien
gcagccaccacatgatgcgggagaa

SEQ ID NO: 233352 - DNA, 25 bp, Homo sapien
gccaccacatgatgcgggagaaccc

SEQ ID NO: 233353 - DNA, 25 bp, Homo sapien
cctgctgagctgcaccagctctgag

SEQ ID NO: 233354 - DNA, 25 bp, Homo sapien
gagctgcaccagctctgagcctctg

SEQ ID NO: 233355 - DNA, 25 bp, Homo sapien
tctgagcctctgaccctctgagaga

SEQ ID NO: 233356 - DNA, 25 bp, Homo sapien
gagcctctgaccctctgagagatga

SEQ ID NO: 233357 - DNA, 25 bp, Homo sapien
agcctctgaccctctgagagatgat

SEQ ID NO: 233358 - DNA, 25 bp, Homo sapien
actaggaccctgcaagcaactctgc

SEQ ID NO: 233359 - DNA, 25 bp, Homo sapien
ggaccctgcaagcaactctgctctg

SEQ ID NO: 233360 - DNA, 25 bp, Homo sapien
gctcaatggaccctcggggacccaa

SEQ ID NO: 233361 - DNA, 25 bp, Homo sapien
gaatatgctttcttggaccatgttt

SEQ ID NO: 233362 - DNA, 25 bp, Homo sapien
cttggaccatgtttgagactcagaa

SEQ ID NO: 233363 - DNA, 25 bp, Homo sapien
tgagactcagaagaatgggcctttc

SEQ ID NO: 233364 - DNA, 25 bp, Homo sapien
gaagaatgggcctttctgccataat

SEQ ID NO: 233365 - DNA, 25 bp, Homo sapien
ttctgccataattcttcactagtca

SEQ ID NO: 233366 - DNA, 25 bp, Homo sapien
agaatgccagcagtttctttgtata

SEQ ID NO: 233367 - DNA, 25 bp, Homo sapien
tctttgtataaagagacctgccttt

SEQ ID NO: 233368 - DNA, 25 bp, Homo sapien
gagacctgcctttaaaatcatacat

SEQ ID NO: 233369 - DNA, 25 bp, Homo sapien
ttagtcaagctacaacaggtttgga

SEQ ID NO: 233370 - DNA, 25 bp, Homo sapien
cctttgcccttcaaactgcagatat

SEQ ID NO: 233371 - DNA, 25 bp, Homo sapien
gggacttctccctacttgattaaag

SEQ ID NO: 233372 - DNA, 25 bp, Homo sapien
tccagacataaaggatgaccagatc

SEQ ID NO: 233373 - DNA, 25 bp, Homo sapien
ggatgaccagatcatcaactggctg

SEQ ID NO: 233374 - DNA, 25 bp, Homo sapien
tcaactggctgctagaattccgttc

SEQ ID NO: 233375 - DNA, 25 bp, Homo sapien
actggctgctagaattccgttcttc

SEQ ID NO: 233376 - DNA, 25 bp, Homo sapien
aagactttgagcaacttatcagtat

SEQ ID NO: 233377 - DNA, 25 bp, Homo sapien
gattgccttggttgaatagaagtca

SEQ ID NO: 233378 - DNA, 25 bp, Homo sapien
gtagtggaagagtatttggcttttc

SEQ ID NO: 233379 - DNA, 25 bp, Homo sapien
tttggcttttcttggtaatcttgta

SEQ ID NO: 233380 - DNA, 25 bp, Homo sapien
cttttcttggtaatcttgtatcagc

SEQ ID NO: 233381 - DNA, 25 bp, Homo sapien
gaccgtgtctcagcatgattgcttc

SEQ ID NO: 233382 - DNA, 25 bp, Homo sapien
agcatgattgcttcccattttgtgc

SEQ ID NO: 233383 - DNA, 25 bp, Homo sapien
gggtagcctatatgaatcctatagc

SEQ ID NO: 233384 - DNA, 25 bp, Homo sapien
atatgaatcctatagcaatggccag

SEQ ID NO: 233385 - DNA, 25 bp, Homo sapien
gaatcctatagcaatggccagatgg

SEQ ID NO: 233386 - DNA, 25 bp, Homo sapien
gatggagaggcccaactcaatctgt

SEQ ID NO: 233387 - DNA, 25 bp, Homo sapien
gagaggcccaactcaatctgtgggc

SEQ ID NO: 233388 - DNA, 25 bp, Homo sapien
tctgtgggcccaacaatccaagatt

SEQ ID NO: 233389 - DNA, 25 bp, Homo sapien
gggcccaacaatccaagattatcta

SEQ ID NO: 233390 - DNA, 25 bp, Homo sapien
tatctaaatcgaccaagacccacct

SEQ ID NO: 233391 - DNA, 25 bp, Homo sapien
gaccaagacccacctgggaagaagt

SEQ ID NO: 233392 - DNA, 25 bp, Homo sapien
aacaggttcaaaagcattagctgaa

SEQ ID NO: 233393 - DNA, 25 bp, Homo sapien
aagaaatcttgtcggtcttcatctt

SEQ ID NO: 233394 - DNA, 25 bp, Homo sapien
atacacccagggagaccatctttaa

SEQ ID NO: 233395 - DNA, 25 bp, Homo sapien
ctgtccccttatcaacagaaatggg

SEQ ID NO: 233396 - DNA, 25 bp, Homo sapien
aatcaaggcattttcaggcaaacaa

SEQ ID NO: 233397 - DNA, 25 bp, Homo sapien
caaaaagcttactttggcaccagca

SEQ ID NO: 233398 - DNA, 25 bp, Homo sapien
ggcaccagcagacctgcacaaaagg

SEQ ID NO: 233399 - DNA, 25 bp, Homo sapien
gaaactgaccccagagggaagatct

SEQ ID NO: 233400 - DNA, 25 bp, Homo sapien
gagaataacggatactgtgcaccta

SEQ ID NO: 233401 - DNA, 25 bp, Homo sapien
gatactgtgcacctaaattaaagct

SEQ ID NO: 233402 - DNA, 25 bp, Homo sapien
gacagtcaaatgatatcttccgtga

SEQ ID NO: 233403 - DNA, 25 bp, Homo sapien
gagttgaaagatgcactgccagcct

SEQ ID NO: 233404 - DNA, 25 bp, Homo sapien
ctgccagcctagaattatacaccca

SEQ ID NO: 233405 - DNA, 25 bp, Homo sapien
cggcacagggtcaaaagaggtccct

SEQ ID NO: 233406 - DNA, 25 bp, Homo sapien
gagaagaggtcttgcataccagcac

SEQ ID NO: 233407 - DNA, 25 bp, Homo sapien
ggtcttgcataccagcacagtggat

SEQ ID NO: 233408 - DNA, 25 bp, Homo sapien
gggaatggtgtgacctctgtccctg

SEQ ID NO: 233409 - DNA, 25 bp, Homo sapien
ttctctgctggcttaagggtctatt

SEQ ID NO: 233410 - DNA, 25 bp, Homo sapien
tctgctggcttaagggtctattctc

SEQ ID NO: 233411 - DNA, 25 bp, Homo sapien
ggtctattctccatgtgtctatttc

SEQ ID NO: 233412 - DNA, 25 bp, Homo sapien
ctccatgtgtctatttctttgatga

SEQ ID NO: 233413 - DNA, 25 bp, Homo sapien
ctgagccacagtaaggatctagtcc

SEQ ID NO: 233414 - DNA, 25 bp, Homo sapien
agtaaggatctagtccacgccctaa

SEQ ID NO: 233415 - DNA, 25 bp, Homo sapien
agtccacgccctaaatcgagtcctt

SEQ ID NO: 233416 - DNA, 25 bp, Homo sapien
gtatgaaatcataagtgtctaactc

SEQ ID NO: 233417 - DNA, 25 bp, Homo sapien
atgaaatcataagtgtctaactcct

SEQ ID NO: 233418 - DNA, 25 bp, Homo sapien
atcataagtgtctaactcctggccg

SEQ ID NO: 233419 - DNA, 25 bp, Homo sapien
ataagtgtctaactcctggccgggt

SEQ ID NO: 233420 - DNA, 25 bp, Homo sapien
tgtctaactcctggccgggtgcagt

SEQ ID NO: 233421 - DNA, 25 bp, Homo sapien
ctcctggccgggtgcagtagctcat

SEQ ID NO: 233422 - DNA, 25 bp, Homo sapien
aactagccaggcgtgatgtctggca

SEQ ID NO: 233423 - DNA, 25 bp, Homo sapien
actagccaggcgtgatgtctggcac

SEQ ID NO: 233424 - DNA, 25 bp, Homo sapien
agccaggcgtgatgtctggcacctg

SEQ ID NO: 233425 - DNA, 25 bp, Homo sapien
caggcgtgatgtctggcacctgtaa

SEQ ID NO: 233426 - DNA, 25 bp, Homo sapien
aggctgaagtagaagaatcgcatga

SEQ ID NO: 233427 - DNA, 25 bp, Homo sapien
actgacttgggtatcagtttcccct

SEQ ID NO: 233428 - DNA, 25 bp, Homo sapien
agtttccccttctgagaagtacaga

SEQ ID NO: 233429 - DNA, 25 bp, Homo sapien
tgagacttaaagaacccctagatcc

SEQ ID NO: 233430 - DNA, 25 bp, Homo sapien
gttcaacactccattaactgggaag

SEQ ID NO: 233431 - DNA, 25 bp, Homo sapien
tgggaagcccagagtcctgtccggc

SEQ ID NO: 233432 - DNA, 25 bp, Homo sapien
ggcctgccaagttcatcctggtgga

SEQ ID NO: 233433 - DNA, 25 bp, Homo sapien
agcgggaggcctccgctaactgttc

SEQ ID NO: 233434 - DNA, 25 bp, Homo sapien
ccgctaactgttctcttcttttcct

SEQ ID NO: 233435 - DNA, 25 bp, Homo sapien
aataaaacacacaatgcctagctgg

SEQ ID NO: 233436 - DNA, 25 bp, Homo sapien
tagctggtgccaggacagagctctg

SEQ ID NO: 233437 - DNA, 25 bp, Homo sapien
acagagctctgggacagcaggcaga

SEQ ID NO: 233438 - DNA, 25 bp, Homo sapien
ttcacgaagggaaccgcagtcagct

SEQ ID NO: 233439 - DNA, 25 bp, Homo sapien
gaagggaaccgcagtcagctcctcc

SEQ ID NO: 233440 - DNA, 25 bp, Homo sapien
agtcagctcctccagggtgaaagta

SEQ ID NO: 233441 - DNA, 25 bp, Homo sapien
aagaaagccatgagcgagttccctg

SEQ ID NO: 233442 - DNA, 25 bp, Homo sapien
aaagccatgagcgagttccctgagt

SEQ ID NO: 233443 - DNA, 25 bp, Homo sapien
catgagcgagttccctgagtctgaa

SEQ ID NO: 233444 - DNA, 25 bp, Homo sapien
tccctgagtctgaagccccgaaggc

SEQ ID NO: 233445 - DNA, 25 bp, Homo sapien
tctgaagccccgaaggcgaaaaaag

SEQ ID NO: 233446 - DNA, 25 bp, Homo sapien
tcaaaacaccagagccggatcccgc

SEQ ID NO: 233447 - DNA, 25 bp, Homo sapien
cctcccttgacgacaagctgacaaa

SEQ ID NO: 233448 - DNA, 25 bp, Homo sapien
ccttgacgacaagctgacaaaatcc

SEQ ID NO: 233449 - DNA, 25 bp, Homo sapien
gaatatacagattcttaaacatcta

SEQ ID NO: 233450 - DNA, 25 bp, Homo sapien
ggatttctcaaagaatgccttacag

SEQ ID NO: 233451 - DNA, 25 bp, Homo sapien
gccttacagaagagcattctctgat

SEQ ID NO: 233452 - DNA, 25 bp, Homo sapien
gagcattctctgattaaatgcaatt

SEQ ID NO: 233453 - DNA, 25 bp, Homo sapien
aatgcaattacagttggagtctttg

SEQ ID NO: 233454 - DNA, 25 bp, Homo sapien
cagttggagtctttgattcttcaca

SEQ ID NO: 233455 - DNA, 25 bp, Homo sapien
gattcttcacagaattctgtagttg

SEQ ID NO: 233456 - DNA, 25 bp, Homo sapien
gtgttcctaaaggtttgaatgcttt

SEQ ID NO: 233457 - DNA, 25 bp, Homo sapien
gaatgctttaacatgctcaactctt

SEQ ID NO: 233458 - DNA, 25 bp, Homo sapien
ctttaacatgctcaactcttacttc

SEQ ID NO: 233459 - DNA, 25 bp, Homo sapien
aaatgtcttttgtatggctaaatga

SEQ ID NO: 233460 - DNA, 25 bp, Homo sapien
agactcctcccttagctactcagga

SEQ ID NO: 233461 - DNA, 25 bp, Homo sapien
gtggaacaatcaccgaaacccaaga

SEQ ID NO: 233462 - DNA, 25 bp, Homo sapien
gaacaatcaccgaaacccaagaggc

SEQ ID NO: 233463 - DNA, 25 bp, Homo sapien
acaatcaccgaaacccaagaggcgg

SEQ ID NO: 233464 - DNA, 25 bp, Homo sapien
gcggatgaggtggaacaatcgccca

SEQ ID NO: 233465 - DNA, 25 bp, Homo sapien
aggtggaacaatcgcccaagcccaa

SEQ ID NO: 233466 - DNA, 25 bp, Homo sapien
ggaacaatcgcccaagcccaagagg

SEQ ID NO: 233467 - DNA, 25 bp, Homo sapien
gaacaatcgcccaagcccaagaggc

SEQ ID NO: 233468 - DNA, 25 bp, Homo sapien
gaggccgaggcacaacaattaccca

SEQ ID NO: 233469 - DNA, 25 bp, Homo sapien
gaggttgagtaagctgagaacacgc

SEQ ID NO: 233470 - DNA, 25 bp, Homo sapien
gagtaagctgagaacacgccattgc

SEQ ID NO: 233471 - DNA, 25 bp, Homo sapien
taccaaaagttatctaagcctgagc

SEQ ID NO: 233472 - DNA, 25 bp, Homo sapien
aagcctgagcacttgaagtctgcac

SEQ ID NO: 233473 - DNA, 25 bp, Homo sapien
tgagcacttgaagtctgcacataaa

SEQ ID NO: 233474 - DNA, 25 bp, Homo sapien
aaggccaaaaagtctacattgcgtg

SEQ ID NO: 233475 - DNA, 25 bp, Homo sapien
aaaagtctacattgcgtgtgtggat

SEQ ID NO: 233476 - DNA, 25 bp, Homo sapien
ctacattgcgtgtgtggatggatga

SEQ ID NO: 233477 - DNA, 25 bp, Homo sapien
gcagcgccaggtgacaagatgttgt

SEQ ID NO: 233478 - DNA, 25 bp, Homo sapien
ttgtgaggggttttgagtcatccag

SEQ ID NO: 233479 - DNA, 25 bp, Homo sapien
agtcctgggcactgaggtctgttag

SEQ ID NO: 233480 - DNA, 25 bp, Homo sapien
ctgggcactgaggtctgttagatga

SEQ ID NO: 233481 - DNA, 25 bp, Homo sapien
ggcactgaggtctgttagatgaaag

SEQ ID NO: 233482 - DNA, 25 bp, Homo sapien
ctacctggagcccacggaggacctg

SEQ ID NO: 233483 - DNA, 25 bp, Homo sapien
tacctggagcccacggaggacctgg

SEQ ID NO: 233484 - DNA, 25 bp, Homo sapien
tggagcccacggaggacctggcccc

SEQ ID NO: 233485 - DNA, 25 bp, Homo sapien
gggaggcaccttcccaggaggacga

SEQ ID NO: 233486 - DNA, 25 bp, Homo sapien
tggacagcagcaagagccgcctact

SEQ ID NO: 233487 - DNA, 25 bp, Homo sapien
ggacagcagcaagagccgcctactt

SEQ ID NO: 233488 - DNA, 25 bp, Homo sapien
gacagcagcaagagccgcctacttc

SEQ ID NO: 233489 - DNA, 25 bp, Homo sapien
acagcagcaagagccgcctacttcg

SEQ ID NO: 233490 - DNA, 25 bp, Homo sapien
gcctacttcgggagcgtgccgggct

SEQ ID NO: 233491 - DNA, 25 bp, Homo sapien
tacttcgggagcgtgccgggctggg

SEQ ID NO: 233492 - DNA, 25 bp, Homo sapien
cttcgggagcgtgccgggctgggcg

SEQ ID NO: 233493 - DNA, 25 bp, Homo sapien
atagctaaaggcaagatgccggatt

SEQ ID NO: 233494 - DNA, 25 bp, Homo sapien
atgccggattggagacgaggctacc

SEQ ID NO: 233495 - DNA, 25 bp, Homo sapien
gattggagacgaggctaccgctgca

SEQ ID NO: 233496 - DNA, 25 bp, Homo sapien
ggagacgaggctaccgctgcagaca

SEQ ID NO: 233497 - DNA, 25 bp, Homo sapien
cgaggctaccgctgcagacagggct

SEQ ID NO: 233498 - DNA, 25 bp, Homo sapien
tgtgggaagacgacggaacttgcca

SEQ ID NO: 233499 - DNA, 25 bp, Homo sapien
aagacgacggaacttgccacagcga

SEQ ID NO: 233500 - DNA, 25 bp, Homo sapien
gacggaacttgccacagcgacagac

SEQ ID NO: 233501 - DNA, 25 bp, Homo sapien
gaacttgccacagcgacagacttct

SEQ ID NO: 233502 - DNA, 25 bp, Homo sapien
gcgacagacttctcccaaacaggaa

SEQ ID NO: 233503 - DNA, 25 bp, Homo sapien
cagacttctcccaaacaggaaataa

SEQ ID NO: 233504 - DNA, 25 bp, Homo sapien
gtgcctctctggctttagcagcatt

SEQ ID NO: 233505 - DNA, 25 bp, Homo sapien
tctggctttagcagcattggatgtt

SEQ ID NO: 233506 - DNA, 25 bp, Homo sapien
tcatttctctgaagtcggactgtca

SEQ ID NO: 233507 - DNA, 25 bp, Homo sapien
gacagtgtcagcctaagcctctgga

SEQ ID NO: 233508 - DNA, 25 bp, Homo sapien
agcctctggagatgcttaggatgct

SEQ ID NO: 233509 - DNA, 25 bp, Homo sapien
ggatgctgaattttaaccccttctt

SEQ ID NO: 233510 - DNA, 25 bp, Homo sapien
ttctttcactgcatggcccttcaaa

SEQ ID NO: 233511 - DNA, 25 bp, Homo sapien
atggcccttcaaacagggattggca

SEQ ID NO: 233512 - DNA, 25 bp, Homo sapien
ggattggcaggctccgcgagttaca

SEQ ID NO: 233513 - DNA, 25 bp, Homo sapien
gagagaaccaacgactaaggtagct

SEQ ID NO: 233514 - DNA, 25 bp, Homo sapien
taaggtagcttagctctctgctttg

SEQ ID NO: 233515 - DNA, 25 bp, Homo sapien
ggttcgtgctggacaagaccaagca

SEQ ID NO: 233516 - DNA, 25 bp, Homo sapien
tggacaagaccaagcaccagctgcg

SEQ ID NO: 233517 - DNA, 25 bp, Homo sapien
agaccaagcaccagctgcgctacta

SEQ ID NO: 233518 - DNA, 25 bp, Homo sapien
agctgcgctactacgaccaccgtgt

SEQ ID NO: 233519 - DNA, 25 bp, Homo sapien
cagagtgcaagggtgtcatcgactt

SEQ ID NO: 233520 - DNA, 25 bp, Homo sapien
cgagaaggccttctttgacgtgaag

SEQ ID NO: 233521 - DNA, 25 bp, Homo sapien
gacgtgaagacaacgcgtcgcgttt

SEQ ID NO: 233522 - DNA, 25 bp, Homo sapien
aacgcgtcgcgtttacaacttctgt

SEQ ID NO: 233523 - DNA, 25 bp, Homo sapien
tcgcgtttacaacttctgtgcccag

SEQ ID NO: 233524 - DNA, 25 bp, Homo sapien
cagcagtgggtggaccggatccaga

SEQ ID NO: 233525 - DNA, 25 bp, Homo sapien
cagagctgcctgtcggacgcctgag

SEQ ID NO: 233526 - DNA, 25 bp, Homo sapien
agagtttttcagaattgttcattaa

SEQ ID NO: 233527 - DNA, 25 bp, Homo sapien
gttagattaccttggagcttcataa

SEQ ID NO: 233528 - DNA, 25 bp, Homo sapien
aaaagcatttacagctcatcatgta

SEQ ID NO: 233529 - DNA, 25 bp, Homo sapien
atcatgtatctatctgctcctgttc

SEQ ID NO: 233530 - DNA, 25 bp, Homo sapien
ttaccttggagcttcataactttag

SEQ ID NO: 233531 - DNA, 25 bp, Homo sapien
tcctgttcacttccaaacctcttgt

SEQ ID NO: 233532 - DNA, 25 bp, Homo sapien
aacctcttgtagttaggcaatgcca

SEQ ID NO: 233533 - DNA, 25 bp, Homo sapien
taggcaatgccatttgactacttca

SEQ ID NO: 233534 - DNA, 25 bp, Homo sapien
gactacttcaagcagagggattgta

SEQ ID NO: 233535 - DNA, 25 bp, Homo sapien
aagtgattttctatttccatgttgg

SEQ ID NO: 233536 - DNA, 25 bp, Homo sapien
gcttcataactttagctttttccta

SEQ ID NO: 233537 - DNA, 25 bp, Homo sapien
aggaaggagcttctcggagccccct

SEQ ID NO: 233538 - DNA, 25 bp, Homo sapien
tctctcccaacctcaccatggaaag

SEQ ID NO: 233539 - DNA, 25 bp, Homo sapien
aaataattatgaatgccactgaggc

SEQ ID NO: 233540 - DNA, 25 bp, Homo sapien
tgaatgccactgaggcactgaggcc

SEQ ID NO: 233541 - DNA, 25 bp, Homo sapien
atgccactgaggcactgaggcccta

SEQ ID NO: 233542 - DNA, 25 bp, Homo sapien
actgaggcactgaggccctacctca

SEQ ID NO: 233543 - DNA, 25 bp, Homo sapien
aagcaccatcctcgtactgttgtca

SEQ ID NO: 233544 - DNA, 25 bp, Homo sapien
accatcctcgtactgttgtcactat

SEQ ID NO: 233545 - DNA, 25 bp, Homo sapien
catcctcgtactgttgtcactatga

SEQ ID NO: 233546 - DNA, 25 bp, Homo sapien
cgtactgttgtcactatgagcttaa

SEQ ID NO: 233547 - DNA, 25 bp, Homo sapien
tactgttgtcactatgagcttaaga

SEQ ID NO: 233548 - DNA, 25 bp, Homo sapien
atcttccctagacacagcagacatc

SEQ ID NO: 233549 - DNA, 25 bp, Homo sapien
agcagacatctgagaaagcttcagc

SEQ ID NO: 233550 - DNA, 25 bp, Homo sapien
agcatttctcttgctaacagattca

SEQ ID NO: 233551 - DNA, 25 bp, Homo sapien
aagtgtctcaaagcagagcacagag

SEQ ID NO: 233552 - DNA, 25 bp, Homo sapien
gagcacagagttatttggtgtttgc

SEQ ID NO: 233553 - DNA, 25 bp, Homo sapien
aagacagcctttgtgccacaatcac

SEQ ID NO: 233554 - DNA, 25 bp, Homo sapien
gcctttgtgccacaatcacttatta

SEQ ID NO: 233555 - DNA, 25 bp, Homo sapien
taaataagcgatcaatttcccattg

SEQ ID NO: 233556 - DNA, 25 bp, Homo sapien
aatttcccattgaactgaacatgca

SEQ ID NO: 233557 - DNA, 25 bp, Homo sapien
ctgttcatgtcttctacttttctac

SEQ ID NO: 233558 - DNA, 25 bp, Homo sapien
cttctacttttctactcctgtatga

SEQ ID NO: 233559 - DNA, 25 bp, Homo sapien
ggctagcattttctttaccactatc

SEQ ID NO: 233560 - DNA, 25 bp, Homo sapien
attttctttaccactatcttgttga

SEQ ID NO: 233561 - DNA, 25 bp, Homo sapien
accactatcttgttgatagcttttt

SEQ ID NO: 233562 - DNA, 25 bp, Homo sapien
gttctctaaggttgaaacatgacag

SEQ ID NO: 233563 - DNA, 25 bp, Homo sapien
gaaacatgacagtgcttatctcaaa

SEQ ID NO: 233564 - DNA, 25 bp, Homo sapien
gtgcttatctcaaacagattaccca

SEQ ID NO: 233565 - DNA, 25 bp, Homo sapien
ccatctgcagaactaaggaaagcaa

SEQ ID NO: 233566 - DNA, 25 bp, Homo sapien
gaaattcttgaattcgtcattctca

SEQ ID NO: 233567 - DNA, 25 bp, Homo sapien
gaattcgtcattctcaacctttgaa

SEQ ID NO: 233568 - DNA, 25 bp, Homo sapien
gtcattctcaacctttgaattaaag

SEQ ID NO: 233569 - DNA, 25 bp, Homo sapien
gattttggttttgtgatatttctgt

SEQ ID NO: 233570 - DNA, 25 bp, Homo sapien
agtgctgctccaggactgccctaaa

SEQ ID NO: 233571 - DNA, 25 bp, Homo sapien
ggactgccctaaaactggatttgaa

SEQ ID NO: 233572 - DNA, 25 bp, Homo sapien
tttgaacaaaagaccacatgccgta

SEQ ID NO: 233573 - DNA, 25 bp, Homo sapien
acatgccgtatgactccattggaat

SEQ ID NO: 233574 - DNA, 25 bp, Homo sapien
aggtcagcaacacctctggagctga

SEQ ID NO: 233575 - DNA, 25 bp, Homo sapien
cacctctggagctgaggctggcaga

SEQ ID NO: 233576 - DNA, 25 bp, Homo sapien
tcctctgagagcatggcagcttcta

SEQ ID NO: 233577 - DNA, 25 bp, Homo sapien
agcttctaatggacccgcgtggtta

SEQ ID NO: 233578 - DNA, 25 bp, Homo sapien
gagggactaggcagccaggactcct

SEQ ID NO: 233579 - DNA, 25 bp, Homo sapien
gggaccttatcacagagggaagcca

SEQ ID NO: 233580 - DNA, 25 bp, Homo sapien
cagagggaagccacctcggactgag

SEQ ID NO: 233581 - DNA, 25 bp, Homo sapien
gtgagcaaatccagatatcctccct

SEQ ID NO: 233582 - DNA, 25 bp, Homo sapien
gagtctatgagataggaccccctcc

SEQ ID NO: 233583 - DNA, 25 bp, Homo sapien
ctccctatggagaagccaccaatgc

SEQ ID NO: 233584 - DNA, 25 bp, Homo sapien
accaatgcagtacagggtgacctgg

SEQ ID NO: 233585 - DNA, 25 bp, Homo sapien
agagacaggacaaatgtcacctcct

SEQ ID NO: 233586 - DNA, 25 bp, Homo sapien
gaatgtggcttacacccctagggtt

SEQ ID NO: 233587 - DNA, 25 bp, Homo sapien
cacccctagggttaacaggatgcta

SEQ ID NO: 233588 - DNA, 25 bp, Homo sapien
aacaggatgctacccaagctcatgg

SEQ ID NO: 233589 - DNA, 25 bp, Homo sapien
gatgctacccaagctcatggaggaa

SEQ ID NO: 233590 - DNA, 25 bp, Homo sapien
ccaagctcatggaggaagttgaatc

SEQ ID NO: 233591 - DNA, 25 bp, Homo sapien
gaagttgaatcttaagttcccttga

SEQ ID NO: 233592 - DNA, 25 bp, Homo sapien
tgccttgtactgtctccttggaaat

SEQ ID NO: 233593 - DNA, 25 bp, Homo sapien
tggtgtgtgcttggcaaaccttcat

SEQ ID NO: 233594 - DNA, 25 bp, Homo sapien
aaccttcatgattgggactgtattg

SEQ ID NO: 233595 - DNA, 25 bp, Homo sapien
tattgtacagacgtggccagcgatt

SEQ ID NO: 233596 - DNA, 25 bp, Homo sapien
ccagcgattgtttcttcagggctta

SEQ ID NO: 233597 - DNA, 25 bp, Homo sapien
gggcttagccaagcaatgtccctgg

SEQ ID NO: 233598 - DNA, 25 bp, Homo sapien
gtccctggaaaagccatcaatagtg

SEQ ID NO: 233599 - DNA, 25 bp, Homo sapien
gaaacaattggcttggacttcacaa

SEQ ID NO: 233600 - DNA, 25 bp, Homo sapien
atagcggaattacttcaacagtcaa

SEQ ID NO: 233601 - DNA, 25 bp, Homo sapien
gtcaaaaaacccctctatcaaccag

SEQ ID NO: 233602 - DNA, 25 bp, Homo sapien
tatcaaccagatattgcttagccca

SEQ ID NO: 233603 - DNA, 25 bp, Homo sapien
gtaaggacttacttgttgcacagca

SEQ ID NO: 233604 - DNA, 25 bp, Homo sapien
aaggacttacttgttgcacagcagg

SEQ ID NO: 233605 - DNA, 25 bp, Homo sapien
ttgcacagcaggaattttaacaaca

SEQ ID NO: 233606 - DNA, 25 bp, Homo sapien
ttatgtgaccaaaagtgttaaaagg

SEQ ID NO: 233607 - DNA, 25 bp, Homo sapien
gtgttaaaaggctttacagtgctac

SEQ ID NO: 233608 - DNA, 25 bp, Homo sapien
acagtgctactgtacttaccatatt

SEQ ID NO: 233609 - DNA, 25 bp, Homo sapien
gtgctactgtacttaccatattagt

SEQ ID NO: 233610 - DNA, 25 bp, Homo sapien
accatattagtaagtccctcaggaa

SEQ ID NO: 233611 - DNA, 25 bp, Homo sapien
ccatattagtaagtccctcaggaaa

SEQ ID NO: 233612 - DNA, 25 bp, Homo sapien
ggaaaaagcttcttttgagatatct

SEQ ID NO: 233613 - DNA, 25 bp, Homo sapien
tttgagatatctttagcagcttatt

SEQ ID NO: 233614 - DNA, 25 bp, Homo sapien
ccttactgtctataattaacttcag

SEQ ID NO: 233615 - DNA, 25 bp, Homo sapien
ttatttactgtagggacaaagttat

SEQ ID NO: 233616 - DNA, 25 bp, Homo sapien
ctgtagggacaaagttatatggaat

SEQ ID NO: 233617 - DNA, 25 bp, Homo sapien
tatatggaatgtttgttattttcta

SEQ ID NO: 233618 - DNA, 25 bp, Homo sapien
cactgccagtgaagactgtaaagac

SEQ ID NO: 233619 - DNA, 25 bp, Homo sapien
ctgccagtgaagactgtaaagacag

SEQ ID NO: 233620 - DNA, 25 bp, Homo sapien
actgtaaagacagaacacactattt

SEQ ID NO: 233621 - DNA, 25 bp, Homo sapien
gtaaagacagaacacactattttgg

SEQ ID NO: 233622 - DNA, 25 bp, Homo sapien
tttggagggaggatactaattgttt

SEQ ID NO: 233623 - DNA, 25 bp, Homo sapien
tggagggaggatactaattgtttaa

SEQ ID NO: 233624 - DNA, 25 bp, Homo sapien
tttcatcatttgtgagtgataaaaa

SEQ ID NO: 233625 - DNA, 25 bp, Homo sapien
tcccaaatggctgctggatttaggt

SEQ ID NO: 233626 - DNA, 25 bp, Homo sapien
gctgtgggccataaatctgaagcct

SEQ ID NO: 233627 - DNA, 25 bp, Homo sapien
aagccttgagaaccttgggtctgga

SEQ ID NO: 233628 - DNA, 25 bp, Homo sapien
ccttgagaaccttgggtctggagag

SEQ ID NO: 233629 - DNA, 25 bp, Homo sapien
gaacctaaccaatgacctgatggat

SEQ ID NO: 233630 - DNA, 25 bp, Homo sapien
atgacctgatggattgctcgaccaa

SEQ ID NO: 233631 - DNA, 25 bp, Homo sapien
atggattgctcgaccaagacacaga

SEQ ID NO: 233632 - DNA, 25 bp, Homo sapien
agaagtgaagtctgtgtctgtgcac

SEQ ID NO: 233633 - DNA, 25 bp, Homo sapien
gtgcacttcccacagactggagttt

SEQ ID NO: 233634 - DNA, 25 bp, Homo sapien
gtttttggtgctgaatagagccagt

SEQ ID NO: 233635 - DNA, 25 bp, Homo sapien
gtgctgaatagagccagttgctaaa

SEQ ID NO: 233636 - DNA, 25 bp, Homo sapien
acctgacatcagcaccagtgacagg

SEQ ID NO: 233637 - DNA, 25 bp, Homo sapien
tgagggtttgtcctaagaggaccac

SEQ ID NO: 233638 - DNA, 25 bp, Homo sapien
tttgtcctaagaggaccaccgccat

SEQ ID NO: 233639 - DNA, 25 bp, Homo sapien
gaggaccaccgccatctctgggtct

SEQ ID NO: 233640 - DNA, 25 bp, Homo sapien
agagcctggccctgtcctttgctac

SEQ ID NO: 233641 - DNA, 25 bp, Homo sapien
tggccctgtcctttgctacccaggg

SEQ ID NO: 233642 - DNA, 25 bp, Homo sapien
cccaggcccatgaagccaataggag

SEQ ID NO: 233643 - DNA, 25 bp, Homo sapien
ccatgaagccaataggagagcgtgt

SEQ ID NO: 233644 - DNA, 25 bp, Homo sapien
agagcgtgtggcactggcccacaaa

SEQ ID NO: 233645 - DNA, 25 bp, Homo sapien
gcgtgtggcactggcccacaaactg

SEQ ID NO: 233646 - DNA, 25 bp, Homo sapien
ctctgctagctccaccttgaaggag

SEQ ID NO: 233647 - DNA, 25 bp, Homo sapien
acctgtttgcgctgtacatcgtgtc

SEQ ID NO: 233648 - DNA, 25 bp, Homo sapien
tgtacatcgtgtcccgattcctcca

SEQ ID NO: 233649 - DNA, 25 bp, Homo sapien
tcctgacccaggtccattcggagca

SEQ ID NO: 233650 - DNA, 25 bp, Homo sapien
aaatgcatctgtttgacgtccacaa

SEQ ID NO: 233651 - DNA, 25 bp, Homo sapien
tgtttgacgtccacaattacccgga

SEQ ID NO: 233652 - DNA, 25 bp, Homo sapien
aattacccggactatgtttcctcag

SEQ ID NO: 233653 - DNA, 25 bp, Homo sapien
actatgtttcctcaggcggtggatt

SEQ ID NO: 233654 - DNA, 25 bp, Homo sapien
tggattcgggcctgctgatgaccat

SEQ ID NO: 233655 - DNA, 25 bp, Homo sapien
gggcctgctgatgaccatggttatg

SEQ ID NO: 233656 - DNA, 25 bp, Homo sapien
ggttatggtgtttcttatatcttca

SEQ ID NO: 233657 - DNA, 25 bp, Homo sapien
gggatggcatgatcaccttccacat

SEQ ID NO: 233658 - DNA, 25 bp, Homo sapien
gaaagaaatatgtgcactacctaag

SEQ ID NO: 233659 - DNA, 25 bp, Homo sapien
gtgcactacctaagttttgtcttta

SEQ ID NO: 233660 - DNA, 25 bp, Homo sapien
gttccggtttgactaatcattttgt

SEQ ID NO: 233661 - DNA, 25 bp, Homo sapien
gtaagtgtatgcaaggtggatcctt

SEQ ID NO: 233662 - DNA, 25 bp, Homo sapien
ggtggatccttgatgagccaacatt

SEQ ID NO: 233663 - DNA, 25 bp, Homo sapien
gagccaacattgcactgtggataca

SEQ ID NO: 233664 - DNA, 25 bp, Homo sapien
cattgcactgtggatacatatctat

SEQ ID NO: 233665 - DNA, 25 bp, Homo sapien
acatatctatgtttacgcgctatta

SEQ ID NO: 233666 - DNA, 25 bp, Homo sapien
tttacgcgctattagaacagaaggc

SEQ ID NO: 233667 - DNA, 25 bp, Homo sapien
ggcgctgtatatagaaatgttgctt

SEQ ID NO: 233668 - DNA, 25 bp, Homo sapien
ttgcaaaacacgcagacttctgtat

SEQ ID NO: 233669 - DNA, 25 bp, Homo sapien
aagtagaatcttttcatcatcacag

SEQ ID NO: 233670 - DNA, 25 bp, Homo sapien
tattggacagtgctcttctagatca

SEQ ID NO: 233671 - DNA, 25 bp, Homo sapien
gacagtgctcttctagatcatcata

SEQ ID NO: 233672 - DNA, 25 bp, Homo sapien
gatcatcataagactacagagcact

SEQ ID NO: 233673 - DNA, 25 bp, Homo sapien
aagactacagagcacttttcaaagc

SEQ ID NO: 233674 - DNA, 25 bp, Homo sapien
gcacttttcaaagctcatgcatgtt

SEQ ID NO: 233675 - DNA, 25 bp, Homo sapien
ttcaaagctcatgcatgttcatcat

SEQ ID NO: 233676 - DNA, 25 bp, Homo sapien
gttcatcatgttagtgtcgtatttt

SEQ ID NO: 233677 - DNA, 25 bp, Homo sapien
tgttagtgtcgtattttgagctggg

SEQ ID NO: 233678 - DNA, 25 bp, Homo sapien
tcatttcccctctcttattttaagt

SEQ ID NO: 233679 - DNA, 25 bp, Homo sapien
tcccctctcttattttaagttatgt

SEQ ID NO: 233680 - DNA, 25 bp, Homo sapien
tactgctttttctcaaggttcagac

SEQ ID NO: 233681 - DNA, 25 bp, Homo sapien
ctcaaggttcagacctgtggtacat

SEQ ID NO: 233682 - DNA, 25 bp, Homo sapien
tagacctgacagaggccttaggagt

SEQ ID NO: 233683 - DNA, 25 bp, Homo sapien
aggagttatcatctctttccattaa

SEQ ID NO: 233684 - DNA, 25 bp, Homo sapien
tacagggattgagaactggctccaa

SEQ ID NO: 233685 - DNA, 25 bp, Homo sapien
gaactggctccaagatcataagatc

SEQ ID NO: 233686 - DNA, 25 bp, Homo sapien
taagatcttagaaagtggctgtcct

SEQ ID NO: 233687 - DNA, 25 bp, Homo sapien
tgccctctcattaccagacttgaca

SEQ ID NO: 233688 - DNA, 25 bp, Homo sapien
ccagacttgacaatggtgcctcagc

SEQ ID NO: 233689 - DNA, 25 bp, Homo sapien
tcagcaggatggcatttcagaggca

SEQ ID NO: 233690 - DNA, 25 bp, Homo sapien
atttcagaggcaacccatcttgcac

SEQ ID NO: 233691 - DNA, 25 bp, Homo sapien
agcttatgcagctgcttacggaaga

SEQ ID NO: 233692 - DNA, 25 bp, Homo sapien
ttacggaagagctcggcgctgtcag

SEQ ID NO: 233693 - DNA, 25 bp, Homo sapien
aagagctcggcgctgtcagacccca

SEQ ID NO: 233694 - DNA, 25 bp, Homo sapien
tcgtcaaaggccattttcagcagct

SEQ ID NO: 233695 - DNA, 25 bp, Homo sapien
ttgtccttggtgactcgcggtgccg

SEQ ID NO: 233696 - DNA, 25 bp, Homo sapien
gtctggacgctgatgcgcttctcct

SEQ ID NO: 233697 - DNA, 25 bp, Homo sapien
gatgcgcttctccttggtcagcgca

SEQ ID NO: 233698 - DNA, 25 bp, Homo sapien
cttggtcagcgcagccaccgggaag

SEQ ID NO: 233699 - DNA, 25 bp, Homo sapien
gggaaggagcggaccaccacctgct

SEQ ID NO: 233700 - DNA, 25 bp, Homo sapien
gatgtccggcgggtaccgcagctta

SEQ ID NO: 233701 - DNA, 25 bp, Homo sapien
ggcgggtaccgcagcttatgcagct

SEQ ID NO: 233702 - DNA, 25 bp, Homo sapien
agttgttcaaggtctgtcatgctca

SEQ ID NO: 233703 - DNA, 25 bp, Homo sapien
gttcaaggtctgtcatgctcaatca

SEQ ID NO: 233704 - DNA, 25 bp, Homo sapien
gtctgtcatgctcaatcacctaaag

SEQ ID NO: 233705 - DNA, 25 bp, Homo sapien
gctcaatcacctaaagctataattt

SEQ ID NO: 233706 - DNA, 25 bp, Homo sapien
ttaagcatgtagacctagtgcagca

SEQ ID NO: 233707 - DNA, 25 bp, Homo sapien
gggagccactcaggaagtttatgca

SEQ ID NO: 233708 - DNA, 25 bp, Homo sapien
agtatgcagaatttcaccctcttct

SEQ ID NO: 233709 - DNA, 25 bp, Homo sapien
gagattgaggtttgcggtccagaac

SEQ ID NO: 233710 - DNA, 25 bp, Homo sapien
ggtttgcggtccagaacataccctc

SEQ ID NO: 233711 - DNA, 25 bp, Homo sapien
gaacataccctcagcagatacagtg

SEQ ID NO: 233712 - DNA, 25 bp, Homo sapien
taccctcagcagatacagtgactaa

SEQ ID NO: 233713 - DNA, 25 bp, Homo sapien
ttcccccaaactccagggaatggag

SEQ ID NO: 233714 - DNA, 25 bp, Homo sapien
gagggagcagggagccctcactctc

SEQ ID NO: 233715 - DNA, 25 bp, Homo sapien
gccccttgcttgcatctgtatatag

SEQ ID NO: 233716 - DNA, 25 bp, Homo sapien
cccttgcttgcatctgtatatagtg

SEQ ID NO: 233717 - DNA, 25 bp, Homo sapien
tagtgtgagcagcaagtaacccttc

SEQ ID NO: 233718 - DNA, 25 bp, Homo sapien
agtgtgagcagcaagtaacccttct

SEQ ID NO: 233719 - DNA, 25 bp, Homo sapien
gtgagcagcaagtaacccttcttct

SEQ ID NO: 233720 - DNA, 25 bp, Homo sapien
cagcaagtaacccttcttctccctt

SEQ ID NO: 233721 - DNA, 25 bp, Homo sapien
cccttctcaatgtagtggccttgga

SEQ ID NO: 233722 - DNA, 25 bp, Homo sapien
ggccttggatatccctgtttgttaa

SEQ ID NO: 233723 - DNA, 25 bp, Homo sapien
taaagacaatttaaccagctcccaa

SEQ ID NO: 233724 - DNA, 25 bp, Homo sapien
gaaaaagttgaacaccttgaggaag

SEQ ID NO: 233725 - DNA, 25 bp, Homo sapien
ggaaggacctatgatagaacaactt

SEQ ID NO: 233726 - DNA, 25 bp, Homo sapien
gttctttactactaagcaccgttgg

SEQ ID NO: 233727 - DNA, 25 bp, Homo sapien
taagcaccgttggtatcctcatgga

SEQ ID NO: 233728 - DNA, 25 bp, Homo sapien
gttggtatcctcatggacggtatca

SEQ ID NO: 233729 - DNA, 25 bp, Homo sapien
tatcctcatggacggtatcacagat

SEQ ID NO: 233730 - DNA, 25 bp, Homo sapien
atggacggtatcacagatgtcgtaa

SEQ ID NO: 233731 - DNA, 25 bp, Homo sapien
ccaaaagacagatgatgcggaggtt

SEQ ID NO: 233732 - DNA, 25 bp, Homo sapien
caaagagaaatgtgcctcatttgcc

SEQ ID NO: 233733 - DNA, 25 bp, Homo sapien
gccatttgagaaaatgcagtctggt

SEQ ID NO: 233734 - DNA, 25 bp, Homo sapien
gcagtctggtgtattcagtaatata

SEQ ID NO: 233735 - DNA, 25 bp, Homo sapien
aaatggctccaggtagtgagtcaat

SEQ ID NO: 233736 - DNA, 25 bp, Homo sapien
tgaagttcagacatgttggtgtaaa

SEQ ID NO: 233737 - DNA, 25 bp, Homo sapien
ttggtgtaaagtttctcctctgctc

SEQ ID NO: 233738 - DNA, 25 bp, Homo sapien
tctgctcctgaaaacttcatcttct

SEQ ID NO: 233739 - DNA, 25 bp, Homo sapien
tcatcttcttggtgtctcatgtcct

SEQ ID NO: 233740 - DNA, 25 bp, Homo sapien
ttggtgtctcatgtcctcattctcc

SEQ ID NO: 233741 - DNA, 25 bp, Homo sapien
cattctcccctatatgacatgcaaa

SEQ ID NO: 233742 - DNA, 25 bp, Homo sapien
tgacatgcaaaaacgatctttcttt

SEQ ID NO: 233743 - DNA, 25 bp, Homo sapien
gatctttctttgaaatccctctggg

SEQ ID NO: 233744 - DNA, 25 bp, Homo sapien
gtttattgaaactgtccttcagcct

SEQ ID NO: 233745 - DNA, 25 bp, Homo sapien
aactgtccttcagccttaaatacaa

SEQ ID NO: 233746 - DNA, 25 bp, Homo sapien
atgagccatcgtgcttggccttctt

SEQ ID NO: 233747 - DNA, 25 bp, Homo sapien
gcttggccttcttgattcttgaata

SEQ ID NO: 233748 - DNA, 25 bp, Homo sapien
ggccttcttgattcttgaatacggg

SEQ ID NO: 233749 - DNA, 25 bp, Homo sapien
ttaagttcatacacaagagcatcat

SEQ ID NO: 233750 - DNA, 25 bp, Homo sapien
tattctaaaagaggtatctgtgctt

SEQ ID NO: 233751 - DNA, 25 bp, Homo sapien
tgaccacaaaatattacttcttatg

SEQ ID NO: 233752 - DNA, 25 bp, Homo sapien
acttcttatgaaatgtttacactag

SEQ ID NO: 233753 - DNA, 25 bp, Homo sapien
ttacactaggtgaggaaaagttcat

SEQ ID NO: 233754 - DNA, 25 bp, Homo sapien
ttggcttttgcctccagtatccttt

SEQ ID NO: 233755 - DNA, 25 bp, Homo sapien
tccagtatcctttctggttgctctg

SEQ ID NO: 233756 - DNA, 25 bp, Homo sapien
ttctggttgctctggtttgaattaa

SEQ ID NO: 233757 - DNA, 25 bp, Homo sapien
tgggcaatgagatttaaaaacttct

SEQ ID NO: 233758 - DNA, 25 bp, Homo sapien
aaacttctcagatgggccaggcatg

SEQ ID NO: 233759 - DNA, 25 bp, Homo sapien
aacttctcagatgggccaggcatgg

SEQ ID NO: 233760 - DNA, 25 bp, Homo sapien
gcggagcttgcagacagccgaccgt

SEQ ID NO: 233761 - DNA, 25 bp, Homo sapien
cggagcttgcagacagccgaccgtg

SEQ ID NO: 233762 - DNA, 25 bp, Homo sapien
ggagcttgcagacagccgaccgtgc

SEQ ID NO: 233763 - DNA, 25 bp, Homo sapien
gagcttgcagacagccgaccgtgcc

SEQ ID NO: 233764 - DNA, 25 bp, Homo sapien
agcttgcagacagccgaccgtgcca

SEQ ID NO: 233765 - DNA, 25 bp, Homo sapien
ttgcagacagccgaccgtgccactg

SEQ ID NO: 233766 - DNA, 25 bp, Homo sapien
tgcagacagccgaccgtgccactgc

SEQ ID NO: 233767 - DNA, 25 bp, Homo sapien
gcagacagccgaccgtgccactgca

SEQ ID NO: 233768 - DNA, 25 bp, Homo sapien
tcgccatctctaccctctactggaa

SEQ ID NO: 233769 - DNA, 25 bp, Homo sapien
tcctgctggtcgtcgccgcattcaa

SEQ ID NO: 233770 - DNA, 25 bp, Homo sapien
tcgtcgccgcattcaacccagagaa

SEQ ID NO: 233771 - DNA, 25 bp, Homo sapien
tcgccgcattcaacccagagaacat

SEQ ID NO: 233772 - DNA, 25 bp, Homo sapien
aacccagagaacatcggcctggctg

SEQ ID NO: 233773 - DNA, 25 bp, Homo sapien
ggctgcgtgggaggagtacccgacc

SEQ ID NO: 233774 - DNA, 25 bp, Homo sapien
accctgaagatgctcatggagatgg

SEQ ID NO: 233775 - DNA, 25 bp, Homo sapien
ggtgatgaccaacaactactcctac

SEQ ID NO: 233776 - DNA, 25 bp, Homo sapien
cggagatgctgaaccgtgagctgca

SEQ ID NO: 233777 - DNA, 25 bp, Homo sapien
cgcccagcgggagaagcaggagatc

SEQ ID NO: 233778 - DNA, 25 bp, Homo sapien
agatcctggccttcgaggggcacct

SEQ ID NO: 233779 - DNA, 25 bp, Homo sapien
actataggatgcttgtgaaagggca

SEQ ID NO: 233780 - DNA, 25 bp, Homo sapien
tagagttgacagatgtgtaccaggt

SEQ ID NO: 233781 - DNA, 25 bp, Homo sapien
tgtgtaccaggtgtagaggacagct

SEQ ID NO: 233782 - DNA, 25 bp, Homo sapien
taccaggtgtagaggacagctgatc

SEQ ID NO: 233783 - DNA, 25 bp, Homo sapien
acagctgatccagactagaacagat

SEQ ID NO: 233784 - DNA, 25 bp, Homo sapien
gaacagatcagaagactagaagtct

SEQ ID NO: 233785 - DNA, 25 bp, Homo sapien
gagatgattatgtcagaatatccaa

SEQ ID NO: 233786 - DNA, 25 bp, Homo sapien
ggagttggatcctggtcacatacac

SEQ ID NO: 233787 - DNA, 25 bp, Homo sapien
ggatcctggtcacatacacatctag

SEQ ID NO: 233788 - DNA, 25 bp, Homo sapien
tggtcacatacacatctagatggag

SEQ ID NO: 233789 - DNA, 25 bp, Homo sapien
gatggagtttcacctgctgaactgg

SEQ ID NO: 233790 - DNA, 25 bp, Homo sapien
ggagcgcaaaaccaacgacaaggat

SEQ ID NO: 233791 - DNA, 25 bp, Homo sapien
agcaggctgagaatgacagttctaa

SEQ ID NO: 233792 - DNA, 25 bp, Homo sapien
gaatgacagttctaatgatgacaaa

SEQ ID NO: 233793 - DNA, 25 bp, Homo sapien
caaaacaaagaagtcggagggtgat

SEQ ID NO: 233794 - DNA, 25 bp, Homo sapien
gaagactccgagaaggaagccaaaa

SEQ ID NO: 233795 - DNA, 25 bp, Homo sapien
agagtagcaagaagcggaaccggaa

SEQ ID NO: 233796 - DNA, 25 bp, Homo sapien
aaccggaagcacagtggtgacgaca

SEQ ID NO: 233797 - DNA, 25 bp, Homo sapien
gcacagtggtgacgacagctttgac

SEQ ID NO: 233798 - DNA, 25 bp, Homo sapien
acagctttgacgagggcagcgtgtc

SEQ ID NO: 233799 - DNA, 25 bp, Homo sapien
cgtgtcagagtctgagtcggagtca

SEQ ID NO: 233800 - DNA, 25 bp, Homo sapien
agtcggagtcagagagcggccaggc

SEQ ID NO: 233801 - DNA, 25 bp, Homo sapien
gtgtaaaacaatctaatcctgatga

SEQ ID NO: 233802 - DNA, 25 bp, Homo sapien
taatcctgatgacacttttaatagt

SEQ ID NO: 233803 - DNA, 25 bp, Homo sapien
agctttgtgatttctttaatagtta

SEQ ID NO: 233804 - DNA, 25 bp, Homo sapien
tagttattggtttattcaggctttt

SEQ ID NO: 233805 - DNA, 25 bp, Homo sapien
aggtatatacattctctgtgacata

SEQ ID NO: 233806 - DNA, 25 bp, Homo sapien
gttaaaagttctctattattgctga

SEQ ID NO: 233807 - DNA, 25 bp, Homo sapien
attattgctgattgtactggttgtt

SEQ ID NO: 233808 - DNA, 25 bp, Homo sapien
actggttgttgcttgttgactgtac

SEQ ID NO: 233809 - DNA, 25 bp, Homo sapien
ttgttgactgtactattcagatggc

SEQ ID NO: 233810 - DNA, 25 bp, Homo sapien
gtattttatgtcacctagatctaat

SEQ ID NO: 233811 - DNA, 25 bp, Homo sapien
gtcacctagatctaattctgaaaac

SEQ ID NO: 233812 - DNA, 25 bp, Homo sapien
aagataaaatagagctttgcaggaa

SEQ ID NO: 233813 - DNA, 25 bp, Homo sapien
aatagagctttgcaggaaagtgctg

SEQ ID NO: 233814 - DNA, 25 bp, Homo sapien
tagagctttgcaggaaagtgctgca

SEQ ID NO: 233815 - DNA, 25 bp, Homo sapien
cccacgttgccgggcagacgacaac

SEQ ID NO: 233816 - DNA, 25 bp, Homo sapien
agccattggcatccactgtcaggtt

SEQ ID NO: 233817 - DNA, 25 bp, Homo sapien
tgcagagagacatttgacatggact

SEQ ID NO: 233818 - DNA, 25 bp, Homo sapien
atttgacatggactctctcaggtgt

SEQ ID NO: 233819 - DNA, 25 bp, Homo sapien
catggactctctcaggtgttttgca

SEQ ID NO: 233820 - DNA, 25 bp, Homo sapien
ctctctcaggtgttttgcaaaatgc

SEQ ID NO: 233821 - DNA, 25 bp, Homo sapien
tctcattgactctggtcactctgct

SEQ ID NO: 233822 - DNA, 25 bp, Homo sapien
cattgactctggtcactctgctgtg

SEQ ID NO: 233823 - DNA, 25 bp, Homo sapien
tgggtccctacaaagcagggaaggg

SEQ ID NO: 233824 - DNA, 25 bp, Homo sapien
ccaagtacatggctgaagctgtcca

SEQ ID NO: 233825 - DNA, 25 bp, Homo sapien
caagtacatggctgaagctgtccag

SEQ ID NO: 233826 - DNA, 25 bp, Homo sapien
tggtggggcctgactggacatccat

SEQ ID NO: 233827 - DNA, 25 bp, Homo sapien
ggtggggcctgactggacatccatg

SEQ ID NO: 233828 - DNA, 25 bp, Homo sapien
gtggggcctgactggacatccatgc

SEQ ID NO: 233829 - DNA, 25 bp, Homo sapien
gggcctgactggacatccatgccga

SEQ ID NO: 233830 - DNA, 25 bp, Homo sapien
ggcctgactggacatccatgccgaa

SEQ ID NO: 233831 - DNA, 25 bp, Homo sapien
gcctgactggacatccatgccgaat

SEQ ID NO: 233832 - DNA, 25 bp, Homo sapien
tgcaccctccaatgtccccctctgc

SEQ ID NO: 233833 - DNA, 25 bp, Homo sapien
accctccaatgtccccctctgctct

SEQ ID NO: 233834 - DNA, 25 bp, Homo sapien
gataaacaacacatttcaagtccag

SEQ ID NO: 233835 - DNA, 25 bp, Homo sapien
aacaggatcttcctggcttatcttc

SEQ ID NO: 233836 - DNA, 25 bp, Homo sapien
ggcttatcttctgagtctgccagag

SEQ ID NO: 233837 - DNA, 25 bp, Homo sapien
tgagtctgccagagaacctaatgca

SEQ ID NO: 233838 - DNA, 25 bp, Homo sapien
gccagagaacctaatgcagagtgca

SEQ ID NO: 233839 - DNA, 25 bp, Homo sapien
gcagagtgcatgaatcaaattgagg

SEQ ID NO: 233840 - DNA, 25 bp, Homo sapien
gataatgatgactttcaattgcaga

SEQ ID NO: 233841 - DNA, 25 bp, Homo sapien
gaaaactgtgtatgatgctgacatg

SEQ ID NO: 233842 - DNA, 25 bp, Homo sapien
tgctgacatggatttaactgctagt

SEQ ID NO: 233843 - DNA, 25 bp, Homo sapien
taactgctagtgaagtcagcaaaat

SEQ ID NO: 233844 - DNA, 25 bp, Homo sapien
aattgtcacagtctcaacaggcatt

SEQ ID NO: 233845 - DNA, 25 bp, Homo sapien
tactgcttattctgtaatccttact

SEQ ID NO: 233846 - DNA, 25 bp, Homo sapien
ttctgtaatccttactgtctataat

SEQ ID NO: 233847 - DNA, 25 bp, Homo sapien
ccttactgtctataattaacttcag

SEQ ID NO: 233848 - DNA, 25 bp, Homo sapien
aacttcagtaacactgaaacttgat

SEQ ID NO: 233849 - DNA, 25 bp, Homo sapien
ttatttactgtagggacaaagttat

SEQ ID NO: 233850 - DNA, 25 bp, Homo sapien
ctgtagggacaaagttatatggaat

SEQ ID NO: 233851 - DNA, 25 bp, Homo sapien
tatatggaatgtttgttattttcta

SEQ ID NO: 233852 - DNA, 25 bp, Homo sapien
cactgccagtgaagactgtaaagac

SEQ ID NO: 233853 - DNA, 25 bp, Homo sapien
gtaaagacagaacacactattttgg

SEQ ID NO: 233854 - DNA, 25 bp, Homo sapien
tggagggaggatactaattgtttaa

SEQ ID NO: 233855 - DNA, 25 bp, Homo sapien
tttcatcatttgtgagtgataaaaa

SEQ ID NO: 233856 - DNA, 25 bp, Homo sapien
atctctaccctctactggaaggcct

SEQ ID NO: 233857 - DNA, 25 bp, Homo sapien
tcctgctggtcgtcgccgcattcaa

SEQ ID NO: 233858 - DNA, 25 bp, Homo sapien
tcgccgcattcaacccagagaacat

SEQ ID NO: 233859 - DNA, 25 bp, Homo sapien
aacccagagaacatcggcctggctg

SEQ ID NO: 233860 - DNA, 25 bp, Homo sapien
ggctgcgtgggaggagtacccgacc

SEQ ID NO: 233861 - DNA, 25 bp, Homo sapien
accctgaagatgctcatggagatgg

SEQ ID NO: 233862 - DNA, 25 bp, Homo sapien
ggtgatgaccaacaactactcctac

SEQ ID NO: 233863 - DNA, 25 bp, Homo sapien
gagacccggacggagatgctgaacc

SEQ ID NO: 233864 - DNA, 25 bp, Homo sapien
cggagatgctgaaccgtgagctgca

SEQ ID NO: 233865 - DNA, 25 bp, Homo sapien
cgcccagcgggagaagcaggagatc

SEQ ID NO: 233866 - DNA, 25 bp, Homo sapien
agatcctggccttcgaggggcacct

SEQ ID NO: 233867 - DNA, 25 bp, Homo sapien
tcccactttctaatgcttttttgtt

SEQ ID NO: 233868 - DNA, 25 bp, Homo sapien
aatgaattccaacccctgctagctt

SEQ ID NO: 233869 - DNA, 25 bp, Homo sapien
ttccccgcctccatactgttttagg

SEQ ID NO: 233870 - DNA, 25 bp, Homo sapien
catactgttttaggcagcaccgttt

SEQ ID NO: 233871 - DNA, 25 bp, Homo sapien
taggcagcaccgtttatgtgacaga

SEQ ID NO: 233872 - DNA, 25 bp, Homo sapien
gcaccgtttatgtgacagagtccgt

SEQ ID NO: 233873 - DNA, 25 bp, Homo sapien
gtgacagagtccgtgtttctcaaat

SEQ ID NO: 233874 - DNA, 25 bp, Homo sapien
gtccgtgtttctcaaatgcatggtg

SEQ ID NO: 233875 - DNA, 25 bp, Homo sapien
aatgcatggtgttcctcaggtggag

SEQ ID NO: 233876 - DNA, 25 bp, Homo sapien
tattgggtgcaaaatcccaaaccag

SEQ ID NO: 233877 - DNA, 25 bp, Homo sapien
cccaaaccaggatatgtgtatgtct

SEQ ID NO: 233878 - DNA, 25 bp, Homo sapien
agggcatgtgcacagaaaccggcat

SEQ ID NO: 233879 - DNA, 25 bp, Homo sapien
gaaaccggcatgtatgccctgagta

SEQ ID NO: 233880 - DNA, 25 bp, Homo sapien
gtatgccctgagtagcgagtccatg

SEQ ID NO: 233881 - DNA, 25 bp, Homo sapien
tgtcactcagaaggactttgaggta

SEQ ID NO: 233882 - DNA, 25 bp, Homo sapien
gaggtagtccaaagtcctatctcat

SEQ ID NO: 233883 - DNA, 25 bp, Homo sapien
tccaaagtcctatctcatgccaaag

SEQ ID NO: 233884 - DNA, 25 bp, Homo sapien
cctatctcatgccaaaggacagtga

SEQ ID NO: 233885 - DNA, 25 bp, Homo sapien
gaaactatggaattgagggcacatc

SEQ ID NO: 233886 - DNA, 25 bp, Homo sapien
gagggcacatcctttgtgtgtatcc

SEQ ID NO: 233887 - DNA, 25 bp, Homo sapien
acatcctttgtgtgtatccctacaa

SEQ ID NO: 233888 - DNA, 25 bp, Homo sapien
tacaataaaactcagtgggacaagc

SEQ ID NO: 233889 - DNA, 25 bp, Homo sapien
tcgctgccgctgtactcatattctg

SEQ ID NO: 233890 - DNA, 25 bp, Homo sapien
gctgtactcatattctgtctcctct

SEQ ID NO: 233891 - DNA, 25 bp, Homo sapien
cttcttccgggatcggtcaatgtgg

SEQ ID NO: 233892 - DNA, 25 bp, Homo sapien
tggtccttaagctggatgcggacct

SEQ ID NO: 233893 - DNA, 25 bp, Homo sapien
tggtcccggatgaagggaaacttca

SEQ ID NO: 233894 - DNA, 25 bp, Homo sapien
gggaaacttcagtagctgctccgtg

SEQ ID NO: 233895 - DNA, 25 bp, Homo sapien
acttcagtagctgctccgtgggtgg

SEQ ID NO: 233896 - DNA, 25 bp, Homo sapien
gcggctcaggtaagtcttgatgaga

SEQ ID NO: 233897 - DNA, 25 bp, Homo sapien
gagacatgtgtcaatgaagtcaatg

SEQ ID NO: 233898 - DNA, 25 bp, Homo sapien
gaccacttcttggacttgagcctgg

SEQ ID NO: 233899 - DNA, 25 bp, Homo sapien
cttcttggacttgagcctgggcgga

SEQ ID NO: 233900 - DNA, 25 bp, Homo sapien
aaactccaaacccttcagtggatga

SEQ ID NO: 233901 - DNA, 25 bp, Homo sapien
aaacccttcagtggatgaggacaag

SEQ ID NO: 233902 - DNA, 25 bp, Homo sapien
ttcagtggatgaggacaaggtcgca

SEQ ID NO: 233903 - DNA, 25 bp, Homo sapien
ggacaaggtcgcagaaaggcattct

SEQ ID NO: 233904 - DNA, 25 bp, Homo sapien
aaaggcattctgttgacagatgaac

SEQ ID NO: 233905 - DNA, 25 bp, Homo sapien
ggaggccacctacagcaggaagtga

SEQ ID NO: 233906 - DNA, 25 bp, Homo sapien
aggaagtgaggctgccatgtttcct

SEQ ID NO: 233907 - DNA, 25 bp, Homo sapien
gtttccttgagacacagctgcctct

SEQ ID NO: 233908 - DNA, 25 bp, Homo sapien
tgccggtgggcgaggatcctctccc

SEQ ID NO: 233909 - DNA, 25 bp, Homo sapien
tgggataagcactcccagccccgtt

SEQ ID NO: 233910 - DNA, 25 bp, Homo sapien
ccagccccgtttatcagaaacacag

SEQ ID NO: 233911 - DNA, 25 bp, Homo sapien
gagaggccttaaatttgcaactaaa

SEQ ID NO: 233912 - DNA, 25 bp, Homo sapien
aaatttgcaactaaacttgtggaag

SEQ ID NO: 233913 - DNA, 25 bp, Homo sapien
gatgaagttacttggatggacccat

SEQ ID NO: 233914 - DNA, 25 bp, Homo sapien
ggatggacccattgtgcatctttta

SEQ ID NO: 233915 - DNA, 25 bp, Homo sapien
gacccattgtgcatcttttactgaa

SEQ ID NO: 233916 - DNA, 25 bp, Homo sapien
cttttactgaaaactggctccccat

SEQ ID NO: 233917 - DNA, 25 bp, Homo sapien
atcatgtatcctcccgattattgcg

SEQ ID NO: 233918 - DNA, 25 bp, Homo sapien
tcctcccgattattgcgtattctaa

SEQ ID NO: 233919 - DNA, 25 bp, Homo sapien
atttttagtctaatgcatgttttca

SEQ ID NO: 233920 - DNA, 25 bp, Homo sapien
tgttttcatccactatccagtactg

SEQ ID NO: 233921 - DNA, 25 bp, Homo sapien
tttcatccactatccagtactgatt

SEQ ID NO: 233922 - DNA, 25 bp, Homo sapien
tgtggttttgacttttgtgtgttat

SEQ ID NO: 233923 - DNA, 25 bp, Homo sapien
tgtgtgttatgtctgtgtgcttatc

SEQ ID NO: 233924 - DNA, 25 bp, Homo sapien
gtctgtgtgcttatcatgggtctga

SEQ ID NO: 233925 - DNA, 25 bp, Homo sapien
tgtagtagaggagcagcaaagccaa

SEQ ID NO: 233926 - DNA, 25 bp, Homo sapien
aagtgcccagagtaagcggaattta

SEQ ID NO: 233927 - DNA, 25 bp, Homo sapien
cggaatttaaaacgcctctgaagag

SEQ ID NO: 233928 - DNA, 25 bp, Homo sapien
aaatatagaactcccccatgcagtg

SEQ ID NO: 233929 - DNA, 25 bp, Homo sapien
gaatacatgcaaatcttcccattaa

SEQ ID NO: 233930 - DNA, 25 bp, Homo sapien
aatcttcccattaatgacaggtgat

SEQ ID NO: 233931 - DNA, 25 bp, Homo sapien
gactgtgtagccgaacagcctgtgg

SEQ ID NO: 233932 - DNA, 25 bp, Homo sapien
agccgaacagcctgtggttttgact

SEQ ID NO: 233933 - DNA, 25 bp, Homo sapien
cttcgtcatcaccatcatctacaga

SEQ ID NO: 233934 - DNA, 25 bp, Homo sapien
tcgggtgctgcttctacgaaggcgt

SEQ ID NO: 233935 - DNA, 25 bp, Homo sapien
aaaggccatccctgtggatgtcgcg

SEQ ID NO: 233936 - DNA, 25 bp, Homo sapien
tggatgtcgcgctgccacagaagtc

SEQ ID NO: 233937 - DNA, 25 bp, Homo sapien
gaaaaggcggagttggcctcatcca

SEQ ID NO: 233938 - DNA, 25 bp, Homo sapien
gctgaagcctgcgagtcctgggcct

SEQ ID NO: 233939 - DNA, 25 bp, Homo sapien
ctacgaaggcgtctgctacaagaaa

SEQ ID NO: 233940 - DNA, 25 bp, Homo sapien
tgctgggccctcgatgaagagtgac

SEQ ID NO: 233941 - DNA, 25 bp, Homo sapien
caagaaagcggttcccatttacatc

SEQ ID NO: 233942 - DNA, 25 bp, Homo sapien
atttacatccacgtgttctctgcct

SEQ ID NO: 233943 - DNA, 25 bp, Homo sapien
ttctctgccttgattgtgatcatcg

SEQ ID NO: 233944 - DNA, 25 bp, Homo sapien
ggaagaaagcaccattgagaattat

SEQ ID NO: 233945 - DNA, 25 bp, Homo sapien
gagaattatgcgtcacgacccgagg

SEQ ID NO: 233946 - DNA, 25 bp, Homo sapien
tatgcgtcacgacccgaggccttta

SEQ ID NO: 233947 - DNA, 25 bp, Homo sapien
cccgttcctgaacatcgacaaattg

SEQ ID NO: 233948 - DNA, 25 bp, Homo sapien
tcgacaaattgcgatctgcgtttaa

SEQ ID NO: 233949 - DNA, 25 bp, Homo sapien
ctgcgtttaaggctgatgagttcct

SEQ ID NO: 233950 - DNA, 25 bp, Homo sapien
atgagttcctgaactggcacgccct

SEQ ID NO: 233951 - DNA, 25 bp, Homo sapien
cacgccctctttgagtctatcaaaa

SEQ ID NO: 233952 - DNA, 25 bp, Homo sapien
ttcctcaactgggatgcctttccta

SEQ ID NO: 233953 - DNA, 25 bp, Homo sapien
ctgggatgcctttcctaagctgaaa

SEQ ID NO: 233954 - DNA, 25 bp, Homo sapien
ctgaaaggactgaggagcgcaactc

SEQ ID NO: 233955 - DNA, 25 bp, Homo sapien
tccttgggtactgggcaaagtccta

SEQ ID NO: 233956 - DNA, 25 bp, Homo sapien
aaagtcctaagtgtcctgcaaccaa

SEQ ID NO: 233957 - DNA, 25 bp, Homo sapien
aagtgtcctgcaaccaagtaaagaa

SEQ ID NO: 233958 - DNA, 25 bp, Homo sapien
gaggagcctaaagcggtagcaacaa

SEQ ID NO: 233959 - DNA, 25 bp, Homo sapien
gaactgtcttccaaggcaaaggtga

SEQ ID NO: 233960 - DNA, 25 bp, Homo sapien
gaggtggtgtgtgtaaagtctccaa

SEQ ID NO: 233961 - DNA, 25 bp, Homo sapien
aagtctccaaatgtacctggctaca

SEQ ID NO: 233962 - DNA, 25 bp, Homo sapien
aaatgtacctggctacatagtgctt

SEQ ID NO: 233963 - DNA, 25 bp, Homo sapien
tgagttagactcaaacccgtctcct

SEQ ID NO: 233964 - DNA, 25 bp, Homo sapien
tgactcccagtctaaggctttacag

SEQ ID NO: 233965 - DNA, 25 bp, Homo sapien
ggctttacagagactctcttcctga

SEQ ID NO: 233966 - DNA, 25 bp, Homo sapien
ctctgtattgttccccacctcttaa

SEQ ID NO: 233967 - DNA, 25 bp, Homo sapien
tgtattgttccccacctcttaacac

SEQ ID NO: 233968 - DNA, 25 bp, Homo sapien
ttgttccccacctcttaacacagtg

SEQ ID NO: 233969 - DNA, 25 bp, Homo sapien
caaagatgagtgagagagcatggaa

SEQ ID NO: 233970 - DNA, 25 bp, Homo sapien
gaagatggctgtttcatgtgagaca

SEQ ID NO: 233971 - DNA, 25 bp, Homo sapien
gatggctgtttcatgtgagacagga

SEQ ID NO: 233972 - DNA, 25 bp, Homo sapien
ggctgtttcatgtgagacaggaatg

SEQ ID NO: 233973 - DNA, 25 bp, Homo sapien
gagtgagaatccctgtaagtaaaat

SEQ ID NO: 233974 - DNA, 25 bp, Homo sapien
gagaatccctgtaagtaaaatgtga

SEQ ID NO: 233975 - DNA, 25 bp, Homo sapien
caacccaaagtctgaatttcttgag

SEQ ID NO: 233976 - DNA, 25 bp, Homo sapien
ttcttgaggaaaaggtcaatgtctt

SEQ ID NO: 233977 - DNA, 25 bp, Homo sapien
agagcgtttcccaaagtgtattctg

SEQ ID NO: 233978 - DNA, 25 bp, Homo sapien
gtattctgcggaactagcacctact

SEQ ID NO: 233979 - DNA, 25 bp, Homo sapien
gtgttctcaacaccgtgccacctat

SEQ ID NO: 233980 - DNA, 25 bp, Homo sapien
acaccgtgccacctatagaagatga

SEQ ID NO: 233981 - DNA, 25 bp, Homo sapien
gtgccacctatagaagatgatcatg

SEQ ID NO: 233982 - DNA, 25 bp, Homo sapien
gatcatgggaacagcaatagtagtc

SEQ ID NO: 233983 - DNA, 25 bp, Homo sapien
tttttaccgaaaaagctgcttgaat

SEQ ID NO: 233984 - DNA, 25 bp, Homo sapien
aagctgcttgaatgtctgccgaaat

SEQ ID NO: 233985 - DNA, 25 bp, Homo sapien
gaatgtctgccgaaatgttcaagtt

SEQ ID NO: 233986 - DNA, 25 bp, Homo sapien
tgccgaaatgttcaagtttaccaaa

SEQ ID NO: 233987 - DNA, 25 bp, Homo sapien
gtttaccaaaagagaggcaccgctg

SEQ ID NO: 233988 - DNA, 25 bp, Homo sapien
gccagccaaaacattccccccattc

SEQ ID NO: 233989 - DNA, 25 bp, Homo sapien
agcccatgcccttccccggtggagg

SEQ ID NO: 233990 - DNA, 25 bp, Homo sapien
gagggagcagggagccctcactctc

SEQ ID NO: 233991 - DNA, 25 bp, Homo sapien
tctccacgccccttgcttgcatctg

SEQ ID NO: 233992 - DNA, 25 bp, Homo sapien
gtggccttggatatcctgtttgtta

SEQ ID NO: 233993 - DNA, 25 bp, Homo sapien
ggccttggatatcctgtttgttaat

SEQ ID NO: 233994 - DNA, 25 bp, Homo sapien
tggatatcctgtttgttaataaaga

SEQ ID NO: 233995 - DNA, 25 bp, Homo sapien
aataaagacaattcaaccagctccc

SEQ ID NO: 233996 - DNA, 25 bp, Homo sapien
ataaagacaattcaaccagctccca

SEQ ID NO: 233997 - DNA, 25 bp, Homo sapien
taaagacaattcaaccagctcccac

SEQ ID NO: 233998 - DNA, 25 bp, Homo sapien
aagacaattcaaccagctcccacca

SEQ ID NO: 233999 - DNA, 25 bp, Homo sapien
gcgtcagatcggagctctgagataa

SEQ ID NO: 234000 - DNA, 25 bp, Homo sapien
ggccagggcatgatcatcaccactg

SEQ ID NO: 234001 - DNA, 25 bp, Homo sapien
tgccagcctcgaagcctctttgctg

SEQ ID NO: 234002 - DNA, 25 bp, Homo sapien
gacctggaggtgatctgtgtatcaa

SEQ ID NO: 234003 - DNA, 25 bp, Homo sapien
gtgtattcaacagcacttccagaag

SEQ ID NO: 234004 - DNA, 25 bp, Homo sapien
caacagcacttccagaagaggccaa

SEQ ID NO: 234005 - DNA, 25 bp, Homo sapien
gaggccaaagatctgtctctacttc

SEQ ID NO: 234006 - DNA, 25 bp, Homo sapien
gggcagaaaactaagcctatttgct

SEQ ID NO: 234007 - DNA, 25 bp, Homo sapien
aagcctatttgctctaggcccttca

SEQ ID NO: 234008 - DNA, 25 bp, Homo sapien
tagccccattctctggaggagctgt

SEQ ID NO: 234009 - DNA, 25 bp, Homo sapien
actggttgcgtcagatcggagctct

SEQ ID NO: 234010 - DNA, 25 bp, Homo sapien
aattcgaagcatcgctttggttcgc

SEQ ID NO: 234011 - DNA, 25 bp, Homo sapien
tttggttcgctctttgttcgcgggc

SEQ ID NO: 234012 - DNA, 25 bp, Homo sapien
cattctttcttgacgcactcgctcg

SEQ ID NO: 234013 - DNA, 25 bp, Homo sapien
attaccgcttcttcttctgcttgag

SEQ ID NO: 234014 - DNA, 25 bp, Homo sapien
ttcttcttctgcttgagggacttcc

SEQ ID NO: 234015 - DNA, 25 bp, Homo sapien
tgagggacttcctgcgtttcaggat

SEQ ID NO: 234016 - DNA, 25 bp, Homo sapien
ctgcgtttcaggatcatctcataga

SEQ ID NO: 234017 - DNA, 25 bp, Homo sapien
caggtcgagagtaggccggtaaatc

SEQ ID NO: 234018 - DNA, 25 bp, Homo sapien
ggccggtaaatcagacttcgcagct

SEQ ID NO: 234019 - DNA, 25 bp, Homo sapien
aatcagacttcgcagctccttaagt

SEQ ID NO: 234020 - DNA, 25 bp, Homo sapien
taagtcaccagtcctgcatttgggt

SEQ ID NO: 234021 - DNA, 25 bp, Homo sapien
agtctaggtgggtttctctttgaga

SEQ ID NO: 234022 - DNA, 25 bp, Homo sapien
taacgtgaaccctcaaggtgaatca

SEQ ID NO: 234023 - DNA, 25 bp, Homo sapien
ggtgaatcagaatccttttgcaagt

SEQ ID NO: 234024 - DNA, 25 bp, Homo sapien
gcccagggatacatagctagcaagt

SEQ ID NO: 234025 - DNA, 25 bp, Homo sapien
atcagatgtaggttcctgtgtctcc

SEQ ID NO: 234026 - DNA, 25 bp, Homo sapien
gtgtctccctgtaaaatgaaagcct

SEQ ID NO: 234027 - DNA, 25 bp, Homo sapien
ctcttttttccaaggtccagtatag

SEQ ID NO: 234028 - DNA, 25 bp, Homo sapien
cctgaagctgggttactctggaatt

SEQ ID NO: 234029 - DNA, 25 bp, Homo sapien
cgctggattgagtctgggccttgtc

SEQ ID NO: 234030 - DNA, 25 bp, Homo sapien
tgaggctcgggtcctgtcatgctct

SEQ ID NO: 234031 - DNA, 25 bp, Homo sapien
catgctctgcggttgctatgttgac

SEQ ID NO: 234032 - DNA, 25 bp, Homo sapien
tcctcttcatgcatgtttctgagtg

SEQ ID NO: 234033 - DNA, 25 bp, Homo sapien
gtgcatgaagttgtgaaggtcctac

SEQ ID NO: 234034 - DNA, 25 bp, Homo sapien
gaaggtcctacatgtaatgcatatg

SEQ ID NO: 234035 - DNA, 25 bp, Homo sapien
gcatatgtgatgcatcatcttatca

SEQ ID NO: 234036 - DNA, 25 bp, Homo sapien
tcatcttatcatatattccttccta

SEQ ID NO: 234037 - DNA, 25 bp, Homo sapien
tattccttcctatacattgtttaca

SEQ ID NO: 234038 - DNA, 25 bp, Homo sapien
gggatgttccacacaaacttaaatt

SEQ ID NO: 234039 - DNA, 25 bp, Homo sapien
attccaagtacaactcttcatcaag

SEQ ID NO: 234040 - DNA, 25 bp, Homo sapien
aactcttcatcaagtttctctgtta

SEQ ID NO: 234041 - DNA, 25 bp, Homo sapien
atcaagtttctctgttaatgccaag

SEQ ID NO: 234042 - DNA, 25 bp, Homo sapien
aatgccaagatttaacagacttaag

SEQ ID NO: 234043 - DNA, 25 bp, Homo sapien
tcgtcagcaggcctgcggtaagaaa

SEQ ID NO: 234044 - DNA, 25 bp, Homo sapien
tgcatctgtccatcactgcgactga

SEQ ID NO: 234045 - DNA, 25 bp, Homo sapien
atcactgcgactgatggcaatgact

SEQ ID NO: 234046 - DNA, 25 bp, Homo sapien
ggcaatgactgagtataacaccttt

SEQ ID NO: 234047 - DNA, 25 bp, Homo sapien
taacacctttcttcatggtcaactc

SEQ ID NO: 234048 - DNA, 25 bp, Homo sapien
ttcatggtcaactctacccaggaac

SEQ ID NO: 234049 - DNA, 25 bp, Homo sapien
tgctgctgaaattgttgcctctatt

SEQ ID NO: 234050 - DNA, 25 bp, Homo sapien
aattgttgcctctatttatctgcta

SEQ ID NO: 234051 - DNA, 25 bp, Homo sapien
tctatttatctgctacccttctggt

SEQ ID NO: 234052 - DNA, 25 bp, Homo sapien
tacccttctggtccgtggccaagat

SEQ ID NO: 234053 - DNA, 25 bp, Homo sapien
cttggagccagccttcgtcagcagg

SEQ ID NO: 234054 - DNA, 25 bp, Homo sapien
ggtgcaaaatggcttgcaactaatt

SEQ ID NO: 234055 - DNA, 25 bp, Homo sapien
aatggcttgcaactaattaacaaac

SEQ ID NO: 234056 - DNA, 25 bp, Homo sapien
taattaacaaacatagaagcatcca

SEQ ID NO: 234057 - DNA, 25 bp, Homo sapien
gaagcatccaacaaacatatacgtg

SEQ ID NO: 234058 - DNA, 25 bp, Homo sapien
aaacatatacgtgcacaatctgagg

SEQ ID NO: 234059 - DNA, 25 bp, Homo sapien
atatacgtgcacaatctgaggattt

SEQ ID NO: 234060 - DNA, 25 bp, Homo sapien
gtgcacaatctgaggatttagggat

SEQ ID NO: 234061 - DNA, 25 bp, Homo sapien
gatgaaatcagttatccaggttaga

SEQ ID NO: 234062 - DNA, 25 bp, Homo sapien
agttatccaggttagatatcaacaa

SEQ ID NO: 234063 - DNA, 25 bp, Homo sapien
aagtggctgttgaggtgtggattat

SEQ ID NO: 234064 - DNA, 25 bp, Homo sapien
ttatgtaagtaagactgacaacaag

SEQ ID NO: 234065 - DNA, 25 bp, Homo sapien
gactccagcctgaatgttatttcct

SEQ ID NO: 234066 - DNA, 25 bp, Homo sapien
tgttatttcctgagaaaatccctcc

SEQ ID NO: 234067 - DNA, 25 bp, Homo sapien
gacccactgtgctggttaggtccac

SEQ ID NO: 234068 - DNA, 25 bp, Homo sapien
ggacttctctcatcttttagcatgt

SEQ ID NO: 234069 - DNA, 25 bp, Homo sapien
ggttaggtccacctgctaatcacat

SEQ ID NO: 234070 - DNA, 25 bp, Homo sapien
aaaacactcatctcctctgtaatga

SEQ ID NO: 234071 - DNA, 25 bp, Homo sapien
tgaactcatgtctttctcagaggac

SEQ ID NO: 234072 - DNA, 25 bp, Homo sapien
taatccactttgctctgaatgtcct

SEQ ID NO: 234073 - DNA, 25 bp, Homo sapien
tttgctctgaatgtcctgacacctg

SEQ ID NO: 234074 - DNA, 25 bp, Homo sapien
tgacacctgcttcagagctcaagat

SEQ ID NO: 234075 - DNA, 25 bp, Homo sapien
tcagagctcaagattcagactccag

SEQ ID NO: 234076 - DNA, 25 bp, Homo sapien
tactattacattgtacagaatctgt

SEQ ID NO: 234077 - DNA, 25 bp, Homo sapien
cagaatctgtacttatgtttggtgt

SEQ ID NO: 234078 - DNA, 25 bp, Homo sapien
atctgtacttatgtttggtgtgtaa

SEQ ID NO: 234079 - DNA, 25 bp, Homo sapien
ggtgtgtaatataccaattagtttt

SEQ ID NO: 234080 - DNA, 25 bp, Homo sapien
gttttatataatatcctcataagct

SEQ ID NO: 234081 - DNA, 25 bp, Homo sapien
tatcctcataagctattctaatttt

SEQ ID NO: 234082 - DNA, 25 bp, Homo sapien
aaaatgtagctttggtataacttca

SEQ ID NO: 234083 - DNA, 25 bp, Homo sapien
gtagctttggtataacttcatgtgt

SEQ ID NO: 234084 - DNA, 25 bp, Homo sapien
ggtataacttcatgtgtatttcaaa

SEQ ID NO: 234085 - DNA, 25 bp, Homo sapien
atatactgaacgtcaacatgatttg

SEQ ID NO: 234086 - DNA, 25 bp, Homo sapien
tactgaacgtcaacatgatttgaat

SEQ ID NO: 234087 - DNA, 25 bp, Homo sapien
ggcagctaaaagatgaccgcgttga

SEQ ID NO: 234088 - DNA, 25 bp, Homo sapien
aagatgaccgcgttgaaggccacct

SEQ ID NO: 234089 - DNA, 25 bp, Homo sapien
agttctgacccaccaaagaccttct

SEQ ID NO: 234090 - DNA, 25 bp, Homo sapien
gtgaaagttcgtagaccccaggagt

SEQ ID NO: 234091 - DNA, 25 bp, Homo sapien
gaccccaggagtagagaaaagcaac

SEQ ID NO: 234092 - DNA, 25 bp, Homo sapien
aagcaactggactgactttcttacc

SEQ ID NO: 234093 - DNA, 25 bp, Homo sapien
ggactgactttcttaccagcagtta

SEQ ID NO: 234094 - DNA, 25 bp, Homo sapien
taccagcagttacctagactgaggc

SEQ ID NO: 234095 - DNA, 25 bp, Homo sapien
ttacctagactgaggcaagctgtgt

SEQ ID NO: 234096 - DNA, 25 bp, Homo sapien
aggcaagctgtgtggactcacccaa

SEQ ID NO: 234097 - DNA, 25 bp, Homo sapien
gtggactcacccaagtatatttcag

SEQ ID NO: 234098 - DNA, 25 bp, Homo sapien
acacacttgttcatgggcgcagcaa

SEQ ID NO: 234099 - DNA, 25 bp, Homo sapien
aaagaagagggatccacagagctgg

SEQ ID NO: 234100 - DNA, 25 bp, Homo sapien
agccatgagggctgacacattggaa

SEQ ID NO: 234101 - DNA, 25 bp, Homo sapien
cacattggaatgaaagctggcagaa

SEQ ID NO: 234102 - DNA, 25 bp, Homo sapien
ctggcagaattcgtagggagagctt

SEQ ID NO: 234103 - DNA, 25 bp, Homo sapien
tagggagagctttcccatcctgcca

SEQ ID NO: 234104 - DNA, 25 bp, Homo sapien
cagccccatgtctggctttaagaca

SEQ ID NO: 234105 - DNA, 25 bp, Homo sapien
ggctttaagacagttctattagtga

SEQ ID NO: 234106 - DNA, 25 bp, Homo sapien
tgaattaactgttctcaaaacccca

SEQ ID NO: 234107 - DNA, 25 bp, Homo sapien
tagaataaagtgacctactcttgcc

SEQ ID NO: 234108 - DNA, 25 bp, Homo sapien
ctactcttgcctcatccggagttat

SEQ ID NO: 234109 - DNA, 25 bp, Homo sapien
tcatctcacctctctgtgttgatta

SEQ ID NO: 234110 - DNA, 25 bp, Homo sapien
cacctctctgtgttgattactaatc

SEQ ID NO: 234111 - DNA, 25 bp, Homo sapien
aatcatcttagatattattgctagt

SEQ ID NO: 234112 - DNA, 25 bp, Homo sapien
atattattgctagtggatgtatggt

SEQ ID NO: 234113 - DNA, 25 bp, Homo sapien
gatgggttgaagcttttctgataat

SEQ ID NO: 234114 - DNA, 25 bp, Homo sapien
gaagcttttctgataattattacac

SEQ ID NO: 234115 - DNA, 25 bp, Homo sapien
tatattgagccatgttaacctgcca

SEQ ID NO: 234116 - DNA, 25 bp, Homo sapien
gagccatgttaacctgccaatgaga

SEQ ID NO: 234117 - DNA, 25 bp, Homo sapien
ccatgttaacctgccaatgagatct

SEQ ID NO: 234118 - DNA, 25 bp, Homo sapien
tttcttttacccttttgtgaagcag

SEQ ID NO: 234119 - DNA, 25 bp, Homo sapien
tacccttttgtgaagcagctatacg

SEQ ID NO: 234120 - DNA, 25 bp, Homo sapien
aagctaggaaagcttctttatatct

SEQ ID NO: 234121 - DNA, 25 bp, Homo sapien
ggaaaaaatatgactctcacccatg

SEQ ID NO: 234122 - DNA, 25 bp, Homo sapien
atatgactctcacccatgtcatgta

SEQ ID NO: 234123 - DNA, 25 bp, Homo sapien
acccatgtcatgtactggaccatct

SEQ ID NO: 234124 - DNA, 25 bp, Homo sapien
tggaccatctttctctactttttaa

SEQ ID NO: 234125 - DNA, 25 bp, Homo sapien
ggagtcattgtccttatacctaatg

SEQ ID NO: 234126 - DNA, 25 bp, Homo sapien
gtccttatacctaatggaacagttt

SEQ ID NO: 234127 - DNA, 25 bp, Homo sapien
tggaacagtttccagaactacttta

SEQ ID NO: 234128 - DNA, 25 bp, Homo sapien
gtttccagaactactttaactatgg

SEQ ID NO: 234129 - DNA, 25 bp, Homo sapien
ctttaactatggaagcatttttgaa

SEQ ID NO: 234130 - DNA, 25 bp, Homo sapien
atattgtatccttaatgtatagcag

SEQ ID NO: 234131 - DNA, 25 bp, Homo sapien
gcatgaaaatgttatactgttaata

SEQ ID NO: 234132 - DNA, 25 bp, Homo sapien
tgtttcttagtgcaattcaaaaaat

SEQ ID NO: 234133 - DNA, 25 bp, Homo sapien
gtcatttaaagacacaattttgatt

SEQ ID NO: 234134 - DNA, 25 bp, Homo sapien
gagaattgaattacatgctataaat

SEQ ID NO: 234135 - DNA, 25 bp, Homo sapien
aaatatgagatttcatcttccgtat

SEQ ID NO: 234136 - DNA, 25 bp, Homo sapien
tgagatttcatcttccgtatggtat

SEQ ID NO: 234137 - DNA, 25 bp, Homo sapien
ttcatcttccgtatggtattcaacc

SEQ ID NO: 234138 - DNA, 25 bp, Homo sapien
ttccgtatggtattcaaccattttt

SEQ ID NO: 234139 - DNA, 25 bp, Homo sapien
atattttatttcaccatattgcaaa

SEQ ID NO: 234140 - DNA, 25 bp, Homo sapien
ttcaccatattgcaaatttttaggc

SEQ ID NO: 234141 - DNA, 25 bp, Homo sapien
ggcacaataaaaagcaccctaaaca

SEQ ID NO: 234142 - DNA, 25 bp, Homo sapien
attaaactttagaagaagctgccag

SEQ ID NO: 234143 - DNA, 25 bp, Homo sapien
aagactgtgaaatcttcatgcccaa

SEQ ID NO: 234144 - DNA, 25 bp, Homo sapien
cttcatgcccaaggatccctaaaat

SEQ ID NO: 234145 - DNA, 25 bp, Homo sapien
agcaacaaccacttggctcagacgg

SEQ ID NO: 234146 - DNA, 25 bp, Homo sapien
accacttggctcagacggtttatgg

SEQ ID NO: 234147 - DNA, 25 bp, Homo sapien
cagacggtttatggaggcaaaggtt

SEQ ID NO: 234148 - DNA, 25 bp, Homo sapien
aaatgtgagttcgtgtcctctgcca

SEQ ID NO: 234149 - DNA, 25 bp, Homo sapien
gcagacaggtcaggctgctttttct

SEQ ID NO: 234150 - DNA, 25 bp, Homo sapien
ttgcttggattcaatcctccgggcg

SEQ ID NO: 234151 - DNA, 25 bp, Homo sapien
ggattcaatcctccgggcggctcag

SEQ ID NO: 234152 - DNA, 25 bp, Homo sapien
ggcggctcaggctcaaacataactt

SEQ ID NO: 234153 - DNA, 25 bp, Homo sapien
acccttccggtgtggaggctatgta

SEQ ID NO: 234154 - DNA, 25 bp, Homo sapien
aggctatgtagctggtgcgctgctc

SEQ ID NO: 234155 - DNA, 25 bp, Homo sapien
tctcacacaggtaatgcccagcttt

SEQ ID NO: 234156 - DNA, 25 bp, Homo sapien
tttctgctgctaacacatttggcca

SEQ ID NO: 234157 - DNA, 25 bp, Homo sapien
ggccagttgttgcagttgctcatca

SEQ ID NO: 234158 - DNA, 25 bp, Homo sapien
gctcatcatcttgggaaaggtgttt

SEQ ID NO: 234159 - DNA, 25 bp, Homo sapien
gtttgtgacttttcagagcccagat

SEQ ID NO: 234160 - DNA, 25 bp, Homo sapien
gagcccagattcctgttgtctatta

SEQ ID NO: 234161 - DNA, 25 bp, Homo sapien
cacagaatcatctgttcccaacact

SEQ ID NO: 234162 - DNA, 25 bp, Homo sapien
gtggatggctggatcccgcctgaaa

SEQ ID NO: 234163 - DNA, 25 bp, Homo sapien
gcctgaaacggacctgcagagcagc

SEQ ID NO: 234164 - DNA, 25 bp, Homo sapien
gatgcatttttattctcagccaccc

SEQ ID NO: 234165 - DNA, 25 bp, Homo sapien
ttgattgctgcctctgatagactat

SEQ ID NO: 234166 - DNA, 25 bp, Homo sapien
ttgctctcatctgcccattagctaa

SEQ ID NO: 234167 - DNA, 25 bp, Homo sapien
ctcatctgcccattagctaatctgg

SEQ ID NO: 234168 - DNA, 25 bp, Homo sapien
ctgggctaagaagatgtactgcaca

SEQ ID NO: 234169 - DNA, 25 bp, Homo sapien
tgaaatgcccaatttgtaactgttg

SEQ ID NO: 234170 - DNA, 25 bp, Homo sapien
gtaactgttggctaccaatgcaatt

SEQ ID NO: 234171 - DNA, 25 bp, Homo sapien
atagactattctaagccacggccat

SEQ ID NO: 234172 - DNA, 25 bp, Homo sapien
aagccacggccatctcgtggagaaa

SEQ ID NO: 234173 - DNA, 25 bp, Homo sapien
aaacattctgtgtgaaggacatgca

SEQ ID NO: 234174 - DNA, 25 bp, Homo sapien
gacatgcatgtccttaacagaacag

SEQ ID NO: 234175 - DNA, 25 bp, Homo sapien
gacttgcaggctgtccatgatttct

SEQ ID NO: 234176 - DNA, 25 bp, Homo sapien
gtccatgatttctagacaagtcatc

SEQ ID NO: 234177 - DNA, 25 bp, Homo sapien
gccttgctcctggagacgataggag

SEQ ID NO: 234178 - DNA, 25 bp, Homo sapien
taggagagtccacagatgcagagat

SEQ ID NO: 234179 - DNA, 25 bp, Homo sapien
gagtccacagatgcagagatgtaag

SEQ ID NO: 234180 - DNA, 25 bp, Homo sapien
tggcgggaaagacaggaaactcatc

SEQ ID NO: 234181 - DNA, 25 bp, Homo sapien
gacaggaaactcatctgttgacttt

SEQ ID NO: 234182 - DNA, 25 bp, Homo sapien
gactttttccatcctcttcaactca

SEQ ID NO: 234183 - DNA, 25 bp, Homo sapien
ttcaactcagtggtgtgttggaaaa

SEQ ID NO: 234184 - DNA, 25 bp, Homo sapien
ctattacactgtctgaaaaggtcct

SEQ ID NO: 234185 - DNA, 25 bp, Homo sapien
acactgtctgaaaaggtcctaatta

SEQ ID NO: 234186 - DNA, 25 bp, Homo sapien
gaagtacaagccaactttgctctcc

SEQ ID NO: 234187 - DNA, 25 bp, Homo sapien
tttgctctccaaatggcagcagtag

SEQ ID NO: 234188 - DNA, 25 bp, Homo sapien
agcagtagctgagcaggccgccctg

SEQ ID NO: 234189 - DNA, 25 bp, Homo sapien
ttctctcctcataaacatgctgttc

SEQ ID NO: 234190 - DNA, 25 bp, Homo sapien
gctgttctcaagtttgtcagaatcc

SEQ ID NO: 234191 - DNA, 25 bp, Homo sapien
agaatccagagctctctactcatta

SEQ ID NO: 234192 - DNA, 25 bp, Homo sapien
aagcaaagcatgctcttcctttgtt

SEQ ID NO: 234193 - DNA, 25 bp, Homo sapien
attgcctaaaacatctccatgctca

SEQ ID NO: 234194 - DNA, 25 bp, Homo sapien
atgctcatagctgttgactctcttt

SEQ ID NO: 234195 - DNA, 25 bp, Homo sapien
tagttcctgttcctctggtgtagga

SEQ ID NO: 234196 - DNA, 25 bp, Homo sapien
ggtgtaggatttctcagccctagca

SEQ ID NO: 234197 - DNA, 25 bp, Homo sapien
aaagctgcggcagagcctgaccgcg

SEQ ID NO: 234198 - DNA, 25 bp, Homo sapien
tgaccgcgccgttctccagaagagc

SEQ ID NO: 234199 - DNA, 25 bp, Homo sapien
ggctgagtcgcgctccgggtgtgga

SEQ ID NO: 234200 - DNA, 25 bp, Homo sapien
cttcaagtcttgaccgagcgcatcc

SEQ ID NO: 234201 - DNA, 25 bp, Homo sapien
aagtcttgaccgagcgcatccccgg

SEQ ID NO: 234202 - DNA, 25 bp, Homo sapien
cttctgcgcccacacctgagttttt

SEQ ID NO: 234203 - DNA, 25 bp, Homo sapien
gtttttgtctgtaggagtttccgca

SEQ ID NO: 234204 - DNA, 25 bp, Homo sapien
ctgtaggagtttccgcagtttgcta

SEQ ID NO: 234205 - DNA, 25 bp, Homo sapien
aggagtttccgcagtttgctaagaa

SEQ ID NO: 234206 - DNA, 25 bp, Homo sapien
gtttccgcagtttgctaagaatcga

SEQ ID NO: 234207 - DNA, 25 bp, Homo sapien
ggacctgaaagctgcggcagagcct

SEQ ID NO: 234208 - DNA, 25 bp, Homo sapien
cacctgggtgggagccttccaagaa

SEQ ID NO: 234209 - DNA, 25 bp, Homo sapien
ttccaagaacttcagctcagcggtt

SEQ ID NO: 234210 - DNA, 25 bp, Homo sapien
agctcagcggttcccagcaagggtt

SEQ ID NO: 234211 - DNA, 25 bp, Homo sapien
agcaagggttcgctgagtctctgtc

SEQ ID NO: 234212 - DNA, 25 bp, Homo sapien
gagtctctgtcctaggaggtccgag

SEQ ID NO: 234213 - DNA, 25 bp, Homo sapien
tatgctgtgcggacgcagacactgc

SEQ ID NO: 234214 - DNA, 25 bp, Homo sapien
ggcggccaaaccttcgggcagcagc

SEQ ID NO: 234215 - DNA, 25 bp, Homo sapien
aggcggtctcatggcacgggcctct

SEQ ID NO: 234216 - DNA, 25 bp, Homo sapien
acgggcctctcgaaactgtgggcaa

SEQ ID NO: 234217 - DNA, 25 bp, Homo sapien
gaaataaccactctttcctgccctg

SEQ ID NO: 234218 - DNA, 25 bp, Homo sapien
gctgggtccgggaaatatctgcttt

SEQ ID NO: 234219 - DNA, 25 bp, Homo sapien
tcatctcacctctctgtgttgatta

SEQ ID NO: 234220 - DNA, 25 bp, Homo sapien
atctcacctctctgtgttgattact

SEQ ID NO: 234221 - DNA, 25 bp, Homo sapien
cacctctctgtgttgattactaatc

SEQ ID NO: 234222 - DNA, 25 bp, Homo sapien
aatcatcttagatattattgctagt

SEQ ID NO: 234223 - DNA, 25 bp, Homo sapien
atattattgctagtggatgtatggt

SEQ ID NO: 234224 - DNA, 25 bp, Homo sapien
gatgggttgaagcttttctgataat

SEQ ID NO: 234225 - DNA, 25 bp, Homo sapien
gaagcttttctgataattattacac

SEQ ID NO: 234226 - DNA, 25 bp, Homo sapien
tatattgagccatgttaacctgcca

SEQ ID NO: 234227 - DNA, 25 bp, Homo sapien
ttgagccatgttaacctgccaatga

SEQ ID NO: 234228 - DNA, 25 bp, Homo sapien
gagccatgttaacctgccaatgaga

SEQ ID NO: 234229 - DNA, 25 bp, Homo sapien
ccatgttaacctgccaatgagatct

SEQ ID NO: 234230 - DNA, 25 bp, Homo sapien
agaaggatccttttgtagcagtgtt

SEQ ID NO: 234231 - DNA, 25 bp, Homo sapien
tagcagtgtttatgaatgtaacccc

SEQ ID NO: 234232 - DNA, 25 bp, Homo sapien
gtaacccccagcaaaatatggctat

SEQ ID NO: 234233 - DNA, 25 bp, Homo sapien
gctatgcagccgtggccacagctcg

SEQ ID NO: 234234 - DNA, 25 bp, Homo sapien
agctcgcagcccaagcactgtggag

SEQ ID NO: 234235 - DNA, 25 bp, Homo sapien
cagcccaagcactgtggagcatcca

SEQ ID NO: 234236 - DNA, 25 bp, Homo sapien
ggagcatccacacctttgatggcaa

SEQ ID NO: 234237 - DNA, 25 bp, Homo sapien
aatgcagattggtagcaggttccat

SEQ ID NO: 234238 - DNA, 25 bp, Homo sapien
ggtagcaggttccataggcgtacaa

SEQ ID NO: 234239 - DNA, 25 bp, Homo sapien
gttccataggcgtacaaaacagtat

SEQ ID NO: 234240 - DNA, 25 bp, Homo sapien
taaagctcagtgttttgcatattgt

SEQ ID NO: 234241 - DNA, 25 bp, Homo sapien
gacagattaggattaaattatggtt

SEQ ID NO: 234242 - DNA, 25 bp, Homo sapien
gattaggattaaattatggtttgac

SEQ ID NO: 234243 - DNA, 25 bp, Homo sapien
ttaggattaaattatggtttgactt

SEQ ID NO: 234244 - DNA, 25 bp, Homo sapien
taggattaaattatggtttgacttt

SEQ ID NO: 234245 - DNA, 25 bp, Homo sapien
tggtttgacttttcctagcagcgtg

SEQ ID NO: 234246 - DNA, 25 bp, Homo sapien
ggtttgacttttcctagcagcgtga

SEQ ID NO: 234247 - DNA, 25 bp, Homo sapien
gtttgacttttcctagcagcgtgat

SEQ ID NO: 234248 - DNA, 25 bp, Homo sapien
tttgacttttcctagcagcgtgatc

SEQ ID NO: 234249 - DNA, 25 bp, Homo sapien
ttgacttttcctagcagcgtgatca

SEQ ID NO: 234250 - DNA, 25 bp, Homo sapien
tgacttttcctagcagcgtgatcat

SEQ ID NO: 234251 - DNA, 25 bp, Homo sapien
gacttttcctagcagcgtgatcatg

SEQ ID NO: 234252 - DNA, 25 bp, Homo sapien
ttccagctgtaaaggatgaagcgta

SEQ ID NO: 234253 - DNA, 25 bp, Homo sapien
gaagcgtattaagcattagccaggc

SEQ ID NO: 234254 - DNA, 25 bp, Homo sapien
gcattagccaggcagtaataaagct

SEQ ID NO: 234255 - DNA, 25 bp, Homo sapien
agctctgacaatgttgtgctggata

SEQ ID NO: 234256 - DNA, 25 bp, Homo sapien
gtgctggatattgcagtttgctttc

SEQ ID NO: 234257 - DNA, 25 bp, Homo sapien
gcagtttgctttcaaggtgcagatg

SEQ ID NO: 234258 - DNA, 25 bp, Homo sapien
caaggtgcagatgtaaggatttaaa

SEQ ID NO: 234259 - DNA, 25 bp, Homo sapien
gagtagcatccattggcctattaaa

SEQ ID NO: 234260 - DNA, 25 bp, Homo sapien
ccattggcctattaaatcgagtcag

SEQ ID NO: 234261 - DNA, 25 bp, Homo sapien
atcgagtcaggatttgaagggaatt

SEQ ID NO: 234262 - DNA, 25 bp, Homo sapien
aaatacagtgaccatccttcttcca

SEQ ID NO: 234263 - DNA, 25 bp, Homo sapien
tgactcctgatctcctgttctctgg

SEQ ID NO: 234264 - DNA, 25 bp, Homo sapien
tgatctcctgttctctgggcttcct

SEQ ID NO: 234265 - DNA, 25 bp, Homo sapien
gcttcctggtcagtgtctgtccgtc

SEQ ID NO: 234266 - DNA, 25 bp, Homo sapien
tggtcagtgtctgtccgtcttgtct

SEQ ID NO: 234267 - DNA, 25 bp, Homo sapien
agtgtctgtccgtcttgtctccata

SEQ ID NO: 234268 - DNA, 25 bp, Homo sapien
tgtccgtcttgtctccatatctgcc

SEQ ID NO: 234269 - DNA, 25 bp, Homo sapien
tctgtagctccttactccccaagag

SEQ ID NO: 234270 - DNA, 25 bp, Homo sapien
cccagtgctgacaggtgtgggaaaa

SEQ ID NO: 234271 - DNA, 25 bp, Homo sapien
agtcagggcgaagacgccaggttca

SEQ ID NO: 234272 - DNA, 25 bp, Homo sapien
gaagacgccaggttcagcatgggaa

SEQ ID NO: 234273 - DNA, 25 bp, Homo sapien
agacgccaggttcagcatgggaaaa

SEQ ID NO: 234274 - DNA, 25 bp, Homo sapien
aaccgcagtttctggaagaaccact

SEQ ID NO: 234275 - DNA, 25 bp, Homo sapien
gcagtttctggaagaaccacttgtt

SEQ ID NO: 234276 - DNA, 25 bp, Homo sapien
gaagaaccacttgttcttgcctgtc

SEQ ID NO: 234277 - DNA, 25 bp, Homo sapien
ttgcgtttaagagcaggatctctga

SEQ ID NO: 234278 - DNA, 25 bp, Homo sapien
aagagcaggatctctgaagacatcc

SEQ ID NO: 234279 - DNA, 25 bp, Homo sapien
gaagacatccttattgacgacagtt

SEQ ID NO: 234280 - DNA, 25 bp, Homo sapien
gacatccttattgacgacagttttg

SEQ ID NO: 234281 - DNA, 25 bp, Homo sapien
ttattgacgacagttttgtccaagg

SEQ ID NO: 234282 - DNA, 25 bp, Homo sapien
agttttgtccaaggggatatccaca

SEQ ID NO: 234283 - DNA, 25 bp, Homo sapien
gatatccacagagtaccttgtgggc

SEQ ID NO: 234284 - DNA, 25 bp, Homo sapien
catctaaaaccgcagtttctggaag

SEQ ID NO: 234285 - DNA, 25 bp, Homo sapien
ctgggctttggaaggtgcaccgtat

SEQ ID NO: 234286 - DNA, 25 bp, Homo sapien
tatgcacacccatactatagggcag

SEQ ID NO: 234287 - DNA, 25 bp, Homo sapien
gggttagcatttcagacccctgttc

SEQ ID NO: 234288 - DNA, 25 bp, Homo sapien
tgttcctcccttgacaagcaagtgc

SEQ ID NO: 234289 - DNA, 25 bp, Homo sapien
aagcaagtgcttttctccagggaag

SEQ ID NO: 234290 - DNA, 25 bp, Homo sapien
agacgttcaggttcattcatagatc

SEQ ID NO: 234291 - DNA, 25 bp, Homo sapien
catagatccattggtgccgtgggca

SEQ ID NO: 234292 - DNA, 25 bp, Homo sapien
gtgccgtgggcagctcagtaacaat

SEQ ID NO: 234293 - DNA, 25 bp, Homo sapien
gctcagtaacaatagctctgctgcc

SEQ ID NO: 234294 - DNA, 25 bp, Homo sapien
cctgcgtgcttcagcagagctggat

SEQ ID NO: 234295 - DNA, 25 bp, Homo sapien
ctggcatggcaatcaatggacacaa

SEQ ID NO: 234296 - DNA, 25 bp, Homo sapien
ttcccacgaacagtttagccggcaa

SEQ ID NO: 234297 - DNA, 25 bp, Homo sapien
acgaacagtttagccggcaacgctt

SEQ ID NO: 234298 - DNA, 25 bp, Homo sapien
gtttagccggcaacgcttacgccct

SEQ ID NO: 234299 - DNA, 25 bp, Homo sapien
tttgcagctccttgcgacccaagcg

SEQ ID NO: 234300 - DNA, 25 bp, Homo sapien
tccttgcgacccaagcgagttcatc

SEQ ID NO: 234301 - DNA, 25 bp, Homo sapien
caagcgagttcatccgcgccggtgg

SEQ ID NO: 234302 - DNA, 25 bp, Homo sapien
cagtccgggccgtgacccagaacgg

SEQ ID NO: 234303 - DNA, 25 bp, Homo sapien
ggccgtgacccagaacggaaagcat

SEQ ID NO: 234304 - DNA, 25 bp, Homo sapien
aacggaaagcatgcggttcccacga

SEQ ID NO: 234305 - DNA, 25 bp, Homo sapien
aaagcatgcggttcccacgaacagt

SEQ ID NO: 234306 - DNA, 25 bp, Homo sapien
atgcggttcccacgaacagtttagc

SEQ ID NO: 234307 - DNA, 25 bp, Homo sapien
gaatggcaggcttttccgaggctga

SEQ ID NO: 234308 - DNA, 25 bp, Homo sapien
gcaggcttttccgaggctgaaagag

SEQ ID NO: 234309 - DNA, 25 bp, Homo sapien
ggctgaaagagatccaacccacttc

SEQ ID NO: 234310 - DNA, 25 bp, Homo sapien
aaagagatccaacccacttctattt

SEQ ID NO: 234311 - DNA, 25 bp, Homo sapien
gagatccaacccacttctatttctt

SEQ ID NO: 234312 - DNA, 25 bp, Homo sapien
acttctatttcttcaggctcccagt

SEQ ID NO: 234313 - DNA, 25 bp, Homo sapien
caggctcccagtgatatgaaaaagt

SEQ ID NO: 234314 - DNA, 25 bp, Homo sapien
actataaaattgtggtctactgtaa

SEQ ID NO: 234315 - DNA, 25 bp, Homo sapien
tgtggtctactgtaaatggtttgca

SEQ ID NO: 234316 - DNA, 25 bp, Homo sapien
gtaaaagttctcaaccagcttccac

SEQ ID NO: 234317 - DNA, 25 bp, Homo sapien
ctcaaccaactcaccagttagacaa

SEQ ID NO: 234318 - DNA, 25 bp, Homo sapien
gaatggcaggcttttccgaggctga

SEQ ID NO: 234319 - DNA, 25 bp, Homo sapien
atggcaggcttttccgaggctgaaa

SEQ ID NO: 234320 - DNA, 25 bp, Homo sapien
gcaggcttttccgaggctgaaagag

SEQ ID NO: 234321 - DNA, 25 bp, Homo sapien
gcttttccgaggctgaaagagatcc

SEQ ID NO: 234322 - DNA, 25 bp, Homo sapien
ttcaggctcccagtgatatgaaaaa

SEQ ID NO: 234323 - DNA, 25 bp, Homo sapien
caggctcccagtgatatgaaaaagt

SEQ ID NO: 234324 - DNA, 25 bp, Homo sapien
gctcccagtgatatgaaaaagtgcc

SEQ ID NO: 234325 - DNA, 25 bp, Homo sapien
cagtgatatgaaaaagtgccaaaca

SEQ ID NO: 234326 - DNA, 25 bp, Homo sapien
actataaaattgtggtctactgtaa

SEQ ID NO: 234327 - DNA, 25 bp, Homo sapien
tgtggtctactgtaaatggtttgca

SEQ ID NO: 234328 - DNA, 25 bp, Homo sapien
cactcaaccaactcaccagttagac

SEQ ID NO: 234329 - DNA, 25 bp, Homo sapien
aacatgcacaatgttgctccaacag

SEQ ID NO: 234330 - DNA, 25 bp, Homo sapien
gctccaacagccaagttatgatctt

SEQ ID NO: 234331 - DNA, 25 bp, Homo sapien
tccagtgacttcctgatggcattca

SEQ ID NO: 234332 - DNA, 25 bp, Homo sapien
tagaattgatctactgggcactgca

SEQ ID NO: 234333 - DNA, 25 bp, Homo sapien
tcctgatggcattcaaggttggcat

SEQ ID NO: 234334 - DNA, 25 bp, Homo sapien
ggttggcatagaacgctacctggcc

SEQ ID NO: 234335 - DNA, 25 bp, Homo sapien
agaacgctacctggcccatgggtta

SEQ ID NO: 234336 - DNA, 25 bp, Homo sapien
ccatgggttactcgccatctaaaac

SEQ ID NO: 234337 - DNA, 25 bp, Homo sapien
atctactgggcactgcagcctagtg

SEQ ID NO: 234338 - DNA, 25 bp, Homo sapien
atgggaccttggacatgttcttcaa

SEQ ID NO: 234339 - DNA, 25 bp, Homo sapien
ggacatgttcttcaactgctgtgtg

SEQ ID NO: 234340 - DNA, 25 bp, Homo sapien
acacctggacgctcgctctggtggg

SEQ ID NO: 234341 - DNA, 25 bp, Homo sapien
gggcacacgcaggtggaggtggttg

SEQ ID NO: 234342 - DNA, 25 bp, Homo sapien
gggaggctcaagttcgccactttac

SEQ ID NO: 234343 - DNA, 25 bp, Homo sapien
gctcaagttcgccactttactcaga

SEQ ID NO: 234344 - DNA, 25 bp, Homo sapien
aagttcgccactttactcagaccga

SEQ ID NO: 234345 - DNA, 25 bp, Homo sapien
gttcgccactttactcagaccgatg

SEQ ID NO: 234346 - DNA, 25 bp, Homo sapien
cactttactcagaccgatgcacagt

SEQ ID NO: 234347 - DNA, 25 bp, Homo sapien
ttactcagaccgatgcacagtcttc

SEQ ID NO: 234348 - DNA, 25 bp, Homo sapien
agaccgatgcacagtcttcccattt

SEQ ID NO: 234349 - DNA, 25 bp, Homo sapien
gatgcacagtcttcccattttacac

SEQ ID NO: 234350 - DNA, 25 bp, Homo sapien
cacagtcttcccattttacactttt

SEQ ID NO: 234351 - DNA, 25 bp, Homo sapien
ctccagttcctgcttggatttacac

SEQ ID NO: 234352 - DNA, 25 bp, Homo sapien
ttggatttacactgggcaacgtggt

SEQ ID NO: 234353 - DNA, 25 bp, Homo sapien
tttacactgggcaacgtggttggaa

SEQ ID NO: 234354 - DNA, 25 bp, Homo sapien
acgtggttggaatgtatctggctca

SEQ ID NO: 234355 - DNA, 25 bp, Homo sapien
gaatgtatctggctcagaactatga

SEQ ID NO: 234356 - DNA, 25 bp, Homo sapien
gaactatgatataccaaacctggct

SEQ ID NO: 234357 - DNA, 25 bp, Homo sapien
aattaaaaaggacttggatgccaag

SEQ ID NO: 234358 - DNA, 25 bp, Homo sapien
gatgccaagaagaaaccccctagtg

SEQ ID NO: 234359 - DNA, 25 bp, Homo sapien
ctagtgcatgagactgcctccagca

SEQ ID NO: 234360 - DNA, 25 bp, Homo sapien
gtgcatgagactgcctccagcactg

SEQ ID NO: 234361 - DNA, 25 bp, Homo sapien
tccagcactgccttcaggatatact

SEQ ID NO: 234362 - DNA, 25 bp, Homo sapien
caacccatgcaaaagcctgtctatg

SEQ ID NO: 234363 - DNA, 25 bp, Homo sapien
agcctgtctatgtccaatcagcaga

SEQ ID NO: 234364 - DNA, 25 bp, Homo sapien
ttctacatagtagcagttgaagcca

SEQ ID NO: 234365 - DNA, 25 bp, Homo sapien
ccaatcagcagaatgtctcggacca

SEQ ID NO: 234366 - DNA, 25 bp, Homo sapien
gcatctttgatgaaaactatctgga

SEQ ID NO: 234367 - DNA, 25 bp, Homo sapien
ggatcttggtgattacagagttctt

SEQ ID NO: 234368 - DNA, 25 bp, Homo sapien
agagttcttaatccctctgtccata

SEQ ID NO: 234369 - DNA, 25 bp, Homo sapien
aatccctctgtccataggtgatgac

SEQ ID NO: 234370 - DNA, 25 bp, Homo sapien
gcccgagacaacatgaagttgttct

SEQ ID NO: 234371 - DNA, 25 bp, Homo sapien
ggagaaattgacttaccataccact

SEQ ID NO: 234372 - DNA, 25 bp, Homo sapien
attgacttaccataccactcatcaa

SEQ ID NO: 234373 - DNA, 25 bp, Homo sapien
cactaagtggaggtaaaggtgtagc

SEQ ID NO: 234374 - DNA, 25 bp, Homo sapien
aaaggtgtagctagcttgaaccaga

SEQ ID NO: 234375 - DNA, 25 bp, Homo sapien
gtgtagctagcttgaaccagagtgc

SEQ ID NO: 234376 - DNA, 25 bp, Homo sapien
agctagcttgaaccagagtgcactg

SEQ ID NO: 234377 - DNA, 25 bp, Homo sapien
ttgaaccagagtgcactgagccgtc

SEQ ID NO: 234378 - DNA, 25 bp, Homo sapien
aaccagagtgcactgagccgtccaa

SEQ ID NO: 234379 - DNA, 25 bp, Homo sapien
agagtgcactgagccgtccaatgca

SEQ ID NO: 234380 - DNA, 25 bp, Homo sapien
cactgagccgtccaatgcaaaggaa

SEQ ID NO: 234381 - DNA, 25 bp, Homo sapien
gccgtccaatgcaaaggaaactggt

SEQ ID NO: 234382 - DNA, 25 bp, Homo sapien
gaaactggtgacacttgtaaactgt

SEQ ID NO: 234383 - DNA, 25 bp, Homo sapien
taaactgtcaactggtggaggaaga

SEQ ID NO: 234384 - DNA, 25 bp, Homo sapien
ttctgcttaagctctagtttggact

SEQ ID NO: 234385 - DNA, 25 bp, Homo sapien
cttaggtatcctaactatgttggag

SEQ ID NO: 234386 - DNA, 25 bp, Homo sapien
gataaaagcaagttcctcctgtgac

SEQ ID NO: 234387 - DNA, 25 bp, Homo sapien
aagttcctcctgtgactgcaacgtc

SEQ ID NO: 234388 - DNA, 25 bp, Homo sapien
gactgcaacgtcttactgattggga

SEQ ID NO: 234389 - DNA, 25 bp, Homo sapien
gggacagttgccaggaggataccaa

SEQ ID NO: 234390 - DNA, 25 bp, Homo sapien
gaggataccaacttgatagcagagg

SEQ ID NO: 234391 - DNA, 25 bp, Homo sapien
gggttttatgcaaacgcactcacct

SEQ ID NO: 234392 - DNA, 25 bp, Homo sapien
aaagggtcacttctgcatcatcact

SEQ ID NO: 234393 - DNA, 25 bp, Homo sapien
gcatcatcactagctagttttctag

SEQ ID NO: 234394 - DNA, 25 bp, Homo sapien
gttttctagtgttagagaggcttac

SEQ ID NO: 234395 - DNA, 25 bp, Homo sapien
tatctagagctagtttctggtgaat

SEQ ID NO: 234396 - DNA, 25 bp, Homo sapien
atttattttgtactgttgttaggca

SEQ ID NO: 234397 - DNA, 25 bp, Homo sapien
tgtactgttgttaggcagctctgta

SEQ ID NO: 234398 - DNA, 25 bp, Homo sapien
gttaggcagctctgtagttgctaat

SEQ ID NO: 234399 - DNA, 25 bp, Homo sapien
gctctgtagttgctaatttaaccaa

SEQ ID NO: 234400 - DNA, 25 bp, Homo sapien
agtcaatttgctattcatgaagaaa

SEQ ID NO: 234401 - DNA, 25 bp, Homo sapien
cgattctgagaatcctgtcaggaat

SEQ ID NO: 234402 - DNA, 25 bp, Homo sapien
cacaaaataatggtctttgtcccag

SEQ ID NO: 234403 - DNA, 25 bp, Homo sapien
ggtctttgtcccagtagagttcata

SEQ ID NO: 234404 - DNA, 25 bp, Homo sapien
gtcccagtagagttcatagtctatt

SEQ ID NO: 234405 - DNA, 25 bp, Homo sapien
gtctatttagtgtgcatgtttttcc

SEQ ID NO: 234406 - DNA, 25 bp, Homo sapien
aagataaaatagagctttgcaggaa

SEQ ID NO: 234407 - DNA, 25 bp, Homo sapien
agataaaatagagctttgcaggaaa

SEQ ID NO: 234408 - DNA, 25 bp, Homo sapien
gataaaatagagctttgcaggaaag

SEQ ID NO: 234409 - DNA, 25 bp, Homo sapien
ataaaatagagctttgcaggaaagt

SEQ ID NO: 234410 - DNA, 25 bp, Homo sapien
taaaatagagctttgcaggaaagtg

SEQ ID NO: 234411 - DNA, 25 bp, Homo sapien
aaaatagagctttgcaggaaagtgc

SEQ ID NO: 234412 - DNA, 25 bp, Homo sapien
aaatagagctttgcaggaaagtgct

SEQ ID NO: 234413 - DNA, 25 bp, Homo sapien
aatagagctttgcaggaaagtgctg

SEQ ID NO: 234414 - DNA, 25 bp, Homo sapien
atagagctttgcaggaaagtgctgc

SEQ ID NO: 234415 - DNA, 25 bp, Homo sapien
tagagctttgcaggaaagtgctgca

SEQ ID NO: 234416 - DNA, 25 bp, Homo sapien
cccacgttgccgggcagacgacaac

SEQ ID NO: 234417 - DNA, 25 bp, Homo sapien
agagaagcaaccagatccggagtcg

SEQ ID NO: 234418 - DNA, 25 bp, Homo sapien
gagtcggcccctagccagaagctca

SEQ ID NO: 234419 - DNA, 25 bp, Homo sapien
gaagctcaccggaatagcccagcca

SEQ ID NO: 234420 - DNA, 25 bp, Homo sapien
ttctccagaacttgtgtctccagag

SEQ ID NO: 234421 - DNA, 25 bp, Homo sapien
aggagtacgccgacttcagcagctt

SEQ ID NO: 234422 - DNA, 25 bp, Homo sapien
agtcgatgcagcagtacaaacggct

SEQ ID NO: 234423 - DNA, 25 bp, Homo sapien
aaacggctgccgagctggagctaga

SEQ ID NO: 234424 - DNA, 25 bp, Homo sapien
agaagcaagagcctaatccatgatt

SEQ ID NO: 234425 - DNA, 25 bp, Homo sapien
gatgatgttccaaaaacccaagtag

SEQ ID NO: 234426 - DNA, 25 bp, Homo sapien
aaacccaagtagtcagtcccttgtg

SEQ ID NO: 234427 - DNA, 25 bp, Homo sapien
gtcccttgtgtactgtggtaaacct

SEQ ID NO: 234428 - DNA, 25 bp, Homo sapien
aaggacctttctccatgatcctttc

SEQ ID NO: 234429 - DNA, 25 bp, Homo sapien
tctccatgatcctttcgtccctgta

SEQ ID NO: 234430 - DNA, 25 bp, Homo sapien
tgatcctttcgtccctgtagcccag

SEQ ID NO: 234431 - DNA, 25 bp, Homo sapien
agcccagcctacagcagaaagatgg

SEQ ID NO: 234432 - DNA, 25 bp, Homo sapien
tcgggcccaagttcaaggtcccagt

SEQ ID NO: 234433 - DNA, 25 bp, Homo sapien
ggcccaagttcaaggtcccagtgga

SEQ ID NO: 234434 - DNA, 25 bp, Homo sapien
caagttcaaggtcccagtggagtca

SEQ ID NO: 234435 - DNA, 25 bp, Homo sapien
agaactcgaacccacagctctggac

SEQ ID NO: 234436 - DNA, 25 bp, Homo sapien
aacccacagctctggacttagccgg

SEQ ID NO: 234437 - DNA, 25 bp, Homo sapien
caccaatcggccagctctgtatgag

SEQ ID NO: 234438 - DNA, 25 bp, Homo sapien
gaagacaaggacctttctccatgat

SEQ ID NO: 234439 - DNA, 25 bp, Homo sapien
ttcttctgagcctagttctcacgag

SEQ ID NO: 234440 - DNA, 25 bp, Homo sapien
tagttctcacgaggaccctttcttg

SEQ ID NO: 234441 - DNA, 25 bp, Homo sapien
ttcttgcccacagtttcgagaggcc

SEQ ID NO: 234442 - DNA, 25 bp, Homo sapien
tcgagaggcccgtgccatgagaccg

SEQ ID NO: 234443 - DNA, 25 bp, Homo sapien
gctgctgcccgaaggtttggccgcc

SEQ ID NO: 234444 - DNA, 25 bp, Homo sapien
acctgtttccttcccgcagtgtctg

SEQ ID NO: 234445 - DNA, 25 bp, Homo sapien
gcagtgtctgcgtccgcacagcata

SEQ ID NO: 234446 - DNA, 25 bp, Homo sapien
gacagagactcagcgaacccttgct

SEQ ID NO: 234447 - DNA, 25 bp, Homo sapien
gcgaacccttgctgggaaccgctga

SEQ ID NO: 234448 - DNA, 25 bp, Homo sapien
ctgggaaccgctgagctgaagttct

SEQ ID NO: 234449 - DNA, 25 bp, Homo sapien
tgagctgaagttcttggaaggctcc

SEQ ID NO: 234450 - DNA, 25 bp, Homo sapien
accttttctctcctgttgctattat

SEQ ID NO: 234451 - DNA, 25 bp, Homo sapien
gctattatctattaccatgtcagaa

SEQ ID NO: 234452 - DNA, 25 bp, Homo sapien
agaacttagtctccattaaatgcca

SEQ ID NO: 234453 - DNA, 25 bp, Homo sapien
attaaatgccaagcccaccgttagg

SEQ ID NO: 234454 - DNA, 25 bp, Homo sapien
agcccaccgttaggcaccatgggta

SEQ ID NO: 234455 - DNA, 25 bp, Homo sapien
aaccatctgtttcatacggtcttca

SEQ ID NO: 234456 - DNA, 25 bp, Homo sapien
acggtcttcagtcattttgcgcttt

SEQ ID NO: 234457 - DNA, 25 bp, Homo sapien
tttgcgcttttcacaatgtactggt

SEQ ID NO: 234458 - DNA, 25 bp, Homo sapien
aaagctcaaattcaggttgcagtga

SEQ ID NO: 234459 - DNA, 25 bp, Homo sapien
gtacacggtcacagttttcatcata

SEQ ID NO: 234460 - DNA, 25 bp, Homo sapien
gttttcatcatactaatctctcttc

SEQ ID NO: 234461 - DNA, 25 bp, Homo sapien
agaatcctggcataagctgctgtga

SEQ ID NO: 234462 - DNA, 25 bp, Homo sapien
gctgctgtgagagcctagaactgga

SEQ ID NO: 234463 - DNA, 25 bp, Homo sapien
atacagtgtgccagttcactacagg

SEQ ID NO: 234464 - DNA, 25 bp, Homo sapien
ctacaggcaaacaattccccaggtg

SEQ ID NO: 234465 - DNA, 25 bp, Homo sapien
ataccatagtgttacctcattagag

SEQ ID NO: 234466 - DNA, 25 bp, Homo sapien
aaacggatcgtgcaagtggagcaat

SEQ ID NO: 234467 - DNA, 25 bp, Homo sapien
agtgctgacaggtcattctctgatg

SEQ ID NO: 234468 - DNA, 25 bp, Homo sapien
agctggttagtttgtggctctaagt

SEQ ID NO: 234469 - DNA, 25 bp, Homo sapien
ggctctaagttgtaaatcccacaga

SEQ ID NO: 234470 - DNA, 25 bp, Homo sapien
tgatgcgcagggtccacagggcccc

SEQ ID NO: 234471 - DNA, 25 bp, Homo sapien
ccccagctgcaagtttgtacagaat

SEQ ID NO: 234472 - DNA, 25 bp, Homo sapien
gtagcaagaacccaacttaagcaaa

SEQ ID NO: 234473 - DNA, 25 bp, Homo sapien
tttacaactaagtcactatttggat

SEQ ID NO: 234474 - DNA, 25 bp, Homo sapien
gatattaatgtgtatgctaaactga

SEQ ID NO: 234475 - DNA, 25 bp, Homo sapien
gctaaactgatttgttcatgggcta

SEQ ID NO: 234476 - DNA, 25 bp, Homo sapien
gttcatgggctagtcagctattcat

SEQ ID NO: 234477 - DNA, 25 bp, Homo sapien
ggctagtcagctattcatatgatct

SEQ ID NO: 234478 - DNA, 25 bp, Homo sapien
catatgatctttacaattttctgaa

SEQ ID NO: 234479 - DNA, 25 bp, Homo sapien
agcctgaaggctggaacaactaaat

SEQ ID NO: 234480 - DNA, 25 bp, Homo sapien
gatacttttatcactttctaagaaa

SEQ ID NO: 234481 - DNA, 25 bp, Homo sapien
ggaacaactaaattgcccaaacagc

SEQ ID NO: 234482 - DNA, 25 bp, Homo sapien
ttgagttatgtagcaagaacccaac

SEQ ID NO: 234483 - DNA, 25 bp, Homo sapien
agtggatcgagggatgccctgctca

SEQ ID NO: 234484 - DNA, 25 bp, Homo sapien
tccacccagctatgagagcatcagc

SEQ ID NO: 234485 - DNA, 25 bp, Homo sapien
gagagcatcagccttgctcttgatg

SEQ ID NO: 234486 - DNA, 25 bp, Homo sapien
atcagccttgctcttgatgccgttt

SEQ ID NO: 234487 - DNA, 25 bp, Homo sapien
cttgatgccgtttctgcagagacga

SEQ ID NO: 234488 - DNA, 25 bp, Homo sapien
gtttctgcagagacgacaccgagtg

SEQ ID NO: 234489 - DNA, 25 bp, Homo sapien
gagacgacaccgagtgccacacgct

SEQ ID NO: 234490 - DNA, 25 bp, Homo sapien
tgctcaggcctggttcagactgcac

SEQ ID NO: 234491 - DNA, 25 bp, Homo sapien
taaaggctcctagcaggtcctgaat

SEQ ID NO: 234492 - DNA, 25 bp, Homo sapien
ctagcaggtcctgaatccagagaca

SEQ ID NO: 234493 - DNA, 25 bp, Homo sapien
accacctgcataccctacggaggaa

SEQ ID NO: 234494 - DNA, 25 bp, Homo sapien
ggagaaactccttgaaggtcttcat

SEQ ID NO: 234495 - DNA, 25 bp, Homo sapien
aaggtcttcatcacgggcggcggca

SEQ ID NO: 234496 - DNA, 25 bp, Homo sapien
ggcggcggcacacccaggtcaatct

SEQ ID NO: 234497 - DNA, 25 bp, Homo sapien
aggtcaatctctgcaatgctgccca

SEQ ID NO: 234498 - DNA, 25 bp, Homo sapien
agaaatcctgcatctgttgcctccg

SEQ ID NO: 234499 - DNA, 25 bp, Homo sapien
atggtgctgcatgatgtggacgtca

SEQ ID NO: 234500 - DNA, 25 bp, Homo sapien
agggcatctcatagccactgtggta

SEQ ID NO: 234501 - DNA, 25 bp, Homo sapien
gttgcctccggaaatccagcttgta

SEQ ID NO: 234502 - DNA, 25 bp, Homo sapien
gaaatccagcttgtagtcattatag

SEQ ID NO: 234503 - DNA, 25 bp, Homo sapien
tcattatagcgcttgacggcctccg

SEQ ID NO: 234504 - DNA, 25 bp, Homo sapien
tcatccaccgagtcatccagggaga

SEQ ID NO: 234505 - DNA, 25 bp, Homo sapien
atcctgaatcccaatttcatttgta

SEQ ID NO: 234506 - DNA, 25 bp, Homo sapien
atacggtaatagtaacccatcccag

SEQ ID NO: 234507 - DNA, 25 bp, Homo sapien
gtaacccatcccagaaggttgttgg

SEQ ID NO: 234508 - DNA, 25 bp, Homo sapien
aaacggtaaatatcctagaacactg

SEQ ID NO: 234509 - DNA, 25 bp, Homo sapien
tagaacactgcctggcccaataaca

SEQ ID NO: 234510 - DNA, 25 bp, Homo sapien
ctgcctggcccaataacaatactta

SEQ ID NO: 234511 - DNA, 25 bp, Homo sapien
attagccttaaaatctctgggacct

SEQ ID NO: 234512 - DNA, 25 bp, Homo sapien
tctctgggacctacagaaacccatt

SEQ ID NO: 234513 - DNA, 25 bp, Homo sapien
agaaacccatttaatccatcaccac

SEQ ID NO: 234514 - DNA, 25 bp, Homo sapien
taaaaaggacctcagctgacatgta

SEQ ID NO: 234515 - DNA, 25 bp, Homo sapien
tcagctgacatgtatcgctaacaaa

SEQ ID NO: 234516 - DNA, 25 bp, Homo sapien
aaaggaagtgaaaaatgcaccccat

SEQ ID NO: 234517 - DNA, 25 bp, Homo sapien
tgcaccccatgataatcagtttctt

SEQ ID NO: 234518 - DNA, 25 bp, Homo sapien
taccggcttcgttgtttttagctgg

SEQ ID NO: 234519 - DNA, 25 bp, Homo sapien
tcgttgtttttagctggaatcatta

SEQ ID NO: 234520 - DNA, 25 bp, Homo sapien
aacagctattggctaaattaggcta

SEQ ID NO: 234521 - DNA, 25 bp, Homo sapien
attaggctacagtaggccattaaga

SEQ ID NO: 234522 - DNA, 25 bp, Homo sapien
gagcctttgttataagcccttgggt

SEQ ID NO: 234523 - DNA, 25 bp, Homo sapien
tgggtagagatctgggtcctgtttc

SEQ ID NO: 234524 - DNA, 25 bp, Homo sapien
gatttcttgtgagccttcactctga

SEQ ID NO: 234525 - DNA, 25 bp, Homo sapien
ttcactctgacagttttgtttccag

SEQ ID NO: 234526 - DNA, 25 bp, Homo sapien
tgtttccagaaacacactcttagcc

SEQ ID NO: 234527 - DNA, 25 bp, Homo sapien
caaggacgcaactgtgagctgaggt

SEQ ID NO: 234528 - DNA, 25 bp, Homo sapien
aactgtgagctgaggtgtgagccta

SEQ ID NO: 234529 - DNA, 25 bp, Homo sapien
agctgaggtgtgagcctaggagccc

SEQ ID NO: 234530 - DNA, 25 bp, Homo sapien
gcctcagaaaggcacccaggtgtgc

SEQ ID NO: 234531 - DNA, 25 bp, Homo sapien
ggcagcccccaggaatcaaggatag

SEQ ID NO: 234532 - DNA, 25 bp, Homo sapien
gaatcaaggatagggctaaggtttt

SEQ ID NO: 234533 - DNA, 25 bp, Homo sapien
ggctaaggttttcaccttaactgtg

SEQ ID NO: 234534 - DNA, 25 bp, Homo sapien
gttttcaccttaactgtgaaggcag

SEQ ID NO: 234535 - DNA, 25 bp, Homo sapien
caggaggaataggtgactgcttcct

SEQ ID NO: 234536 - DNA, 25 bp, Homo sapien
agaactgattctcacacactgtccc

SEQ ID NO: 234537 - DNA, 25 bp, Homo sapien
gattctcacacactgtcccttcagt

SEQ ID NO: 234538 - DNA, 25 bp, Homo sapien
gtccattacacaccgaatgttaatt

SEQ ID NO: 234539 - DNA, 25 bp, Homo sapien
aagttctggcttcctgcttgaaacc

SEQ ID NO: 234540 - DNA, 25 bp, Homo sapien
cttcctgcttgaaacccaattctta

SEQ ID NO: 234541 - DNA, 25 bp, Homo sapien
aaagcagaaacctagcagcccatct

SEQ ID NO: 234542 - DNA, 25 bp, Homo sapien
ttttctcttttgtcggtgtatttgg

SEQ ID NO: 234543 - DNA, 25 bp, Homo sapien
ggtgtatttggtacccctccaatgc

SEQ ID NO: 234544 - DNA, 25 bp, Homo sapien
cctccaatgctggtctttttgtaga

SEQ ID NO: 234545 - DNA, 25 bp, Homo sapien
cagtgttgaaaagcctgcaagattt

SEQ ID NO: 234546 - DNA, 25 bp, Homo sapien
gatttcagtttacatatcgacagca

SEQ ID NO: 234547 - DNA, 25 bp, Homo sapien
atatcgacagcatatccactgattt

SEQ ID NO: 234548 - DNA, 25 bp, Homo sapien
actgatttctaaatgggctggtccc

SEQ ID NO: 234549 - DNA, 25 bp, Homo sapien
acatcttcataatcctccagagctg

SEQ ID NO: 234550 - DNA, 25 bp, Homo sapien
cttcataatcctccagagctgccag

SEQ ID NO: 234551 - DNA, 25 bp, Homo sapien
agagctgccagatcctcgcgggcct

SEQ ID NO: 234552 - DNA, 25 bp, Homo sapien
atcctcgcgggcctcggagaattcc

SEQ ID NO: 234553 - DNA, 25 bp, Homo sapien
cacgtaccagtgcactaaggcgcac

SEQ ID NO: 234554 - DNA, 25 bp, Homo sapien
taaggcgcacttggccgaacttatg

SEQ ID NO: 234555 - DNA, 25 bp, Homo sapien
cttggccgaacttatggtccaggca

SEQ ID NO: 234556 - DNA, 25 bp, Homo sapien
cccaggcctccgtgatggccgtggt

SEQ ID NO: 234557 - DNA, 25 bp, Homo sapien
aggtaattagctctcctagcgttat

SEQ ID NO: 234558 - DNA, 25 bp, Homo sapien
ttagctctcctagcgttatggtggg

SEQ ID NO: 234559 - DNA, 25 bp, Homo sapien
agagggatggttgcctgccgcaccc

SEQ ID NO: 234560 - DNA, 25 bp, Homo sapien
gatggaaaatcccacccatgctggc

SEQ ID NO: 234561 - DNA, 25 bp, Homo sapien
gggaggatttttctggctaaccaag

SEQ ID NO: 234562 - DNA, 25 bp, Homo sapien
tttctggctaaccaaggagtttttg

SEQ ID NO: 234563 - DNA, 25 bp, Homo sapien
ggagtgttctgattcagctcaggga

SEQ ID NO: 234564 - DNA, 25 bp, Homo sapien
cagctcagggaggaagtccatgttt

SEQ ID NO: 234565 - DNA, 25 bp, Homo sapien
gtccatgtttacttcctcaaaggtg

SEQ ID NO: 234566 - DNA, 25 bp, Homo sapien
gtttacttcctcaaaggtggctgag

SEQ ID NO: 234567 - DNA, 25 bp, Homo sapien
gctgagggatgaggctcttcttgct

SEQ ID NO: 234568 - DNA, 25 bp, Homo sapien
gagaaactcctagtaattttcgcta

SEQ ID NO: 234569 - DNA, 25 bp, Homo sapien
attttcgctaaagaagatggttcaa

SEQ ID NO: 234570 - DNA, 25 bp, Homo sapien
gactttcttggttgcaagtgatgga

SEQ ID NO: 234571 - DNA, 25 bp, Homo sapien
tgccaaattgctctctgaaatggtg

SEQ ID NO: 234572 - DNA, 25 bp, Homo sapien
gctctctgaaatggtggtgtcaatt

SEQ ID NO: 234573 - DNA, 25 bp, Homo sapien
ggtgtcaatttacatttctcccaag

SEQ ID NO: 234574 - DNA, 25 bp, Homo sapien
ttacatttctcccaagagggtagga

SEQ ID NO: 234575 - DNA, 25 bp, Homo sapien
gagggtaggagactgattatttttc

SEQ ID NO: 234576 - DNA, 25 bp, Homo sapien
ttatttttctacaccttcaccaaca

SEQ ID NO: 234577 - DNA, 25 bp, Homo sapien
aacacttggcattctcagacttttg

SEQ ID NO: 234578 - DNA, 25 bp, Homo sapien
ggcattctcagacttttggtttttt

SEQ ID NO: 234579 - DNA, 25 bp, Homo sapien
tttccacttatttgccagacatttg

SEQ ID NO: 234580 - DNA, 25 bp, Homo sapien
tgttttaagatgtttgccctttgct

SEQ ID NO: 234581 - DNA, 25 bp, Homo sapien
atttgttggaaatctttgactctaa

SEQ ID NO: 234582 - DNA, 25 bp, Homo sapien
gcaagtcaaattaatgtaaatccct

SEQ ID NO: 234583 - DNA, 25 bp, Homo sapien
aatgtaaatccctgatgtggtatca

SEQ ID NO: 234584 - DNA, 25 bp, Homo sapien
gtggtatcaattccctcctgatttc

SEQ ID NO: 234585 - DNA, 25 bp, Homo sapien
tccctcctgatttcccatgtaggaa

SEQ ID NO: 234586 - DNA, 25 bp, Homo sapien
aattaaggcctaaattggagcattt

SEQ ID NO: 234587 - DNA, 25 bp, Homo sapien
gcctgtttgaatgttggaggtttta

SEQ ID NO: 234588 - DNA, 25 bp, Homo sapien
ggaggttttaggattgtgcactttt

SEQ ID NO: 234589 - DNA, 25 bp, Homo sapien
tgtgcactttttaagcattagagat

SEQ ID NO: 234590 - DNA, 25 bp, Homo sapien
aattttgggatgcatcatttcagaa

SEQ ID NO: 234591 - DNA, 25 bp, Homo sapien
gaagaagatcaaaccatctctccta

SEQ ID NO: 234592 - DNA, 25 bp, Homo sapien
atcaaaccatctctcctacagaaat

SEQ ID NO: 234593 - DNA, 25 bp, Homo sapien
tatatttatgttgcatcctctgtgc

SEQ ID NO: 234594 - DNA, 25 bp, Homo sapien
tgcatcctctgtgcttctaaactca

SEQ ID NO: 234595 - DNA, 25 bp, Homo sapien
cctctgtgcttctaaactcactagt

SEQ ID NO: 234596 - DNA, 25 bp, Homo sapien
actcactagttttggaagctgtttt

SEQ ID NO: 234597 - DNA, 25 bp, Homo sapien
agcactgtgtaggtttcagcttatg

SEQ ID NO: 234598 - DNA, 25 bp, Homo sapien
atatatgggcaatcatgtcatttaa

SEQ ID NO: 234599 - DNA, 25 bp, Homo sapien
taataatcaacctgtatgcctaaaa

SEQ ID NO: 234600 - DNA, 25 bp, Homo sapien
gtttcagcttatgagttctgtccat

SEQ ID NO: 234601 - DNA, 25 bp, Homo sapien
gcttatgagttctgtccatgttttg

SEQ ID NO: 234602 - DNA, 25 bp, Homo sapien
gtccatgttttgtgagatttatagc

SEQ ID NO: 234603 - DNA, 25 bp, Homo sapien
agctaagtatttaccttttcgaatg

SEQ ID NO: 234604 - DNA, 25 bp, Homo sapien
ggatcctcgaggcaaagcccaggaa

SEQ ID NO: 234605 - DNA, 25 bp, Homo sapien
gcaaagcccaggaagcgtgggcgtt

SEQ ID NO: 234606 - DNA, 25 bp, Homo sapien
aagcgtgggcgttgctggtctgtcc

SEQ ID NO: 234607 - DNA, 25 bp, Homo sapien
gcgttgctggtctgtccgaggaggt

SEQ ID NO: 234608 - DNA, 25 bp, Homo sapien
ggtctgtccgaggaggtgagggcgc

SEQ ID NO: 234609 - DNA, 25 bp, Homo sapien
gtgagggcgccgagccctgaggcca

SEQ ID NO: 234610 - DNA, 25 bp, Homo sapien
gcaggcccaggagcaatactccgag

SEQ ID NO: 234611 - DNA, 25 bp, Homo sapien
caggagcaatactccgagccctggg

SEQ ID NO: 234612 - DNA, 25 bp, Homo sapien
gggccgtccagcaagccctcattca

SEQ ID NO: 234613 - DNA, 25 bp, Homo sapien
gcctgggctggttttgaatgaaacg

SEQ ID NO: 234614 - DNA, 25 bp, Homo sapien
gctggttttgaatgaaacgacctga

SEQ ID NO: 234615 - DNA, 25 bp, Homo sapien
atcaatgggtgatttatgatgcctt

SEQ ID NO: 234616 - DNA, 25 bp, Homo sapien
tatgatgccttctgccctttggcga

SEQ ID NO: 234617 - DNA, 25 bp, Homo sapien
atgccttctgccctttggcgagtga

SEQ ID NO: 234618 - DNA, 25 bp, Homo sapien
cttctgccctttggcgagtgaatgg

SEQ ID NO: 234619 - DNA, 25 bp, Homo sapien
tttggcgagtgaatgggtttcccat

SEQ ID NO: 234620 - DNA, 25 bp, Homo sapien
gggaagttggcctccctccgtgagc

SEQ ID NO: 234621 - DNA, 25 bp, Homo sapien
gttggcctccctccgtgagctttgg

SEQ ID NO: 234622 - DNA, 25 bp, Homo sapien
ctaatagacacagggaggccagttc

SEQ ID NO: 234623 - DNA, 25 bp, Homo sapien
tcagagcaattatcttcccaaattc

SEQ ID NO: 234624 - DNA, 25 bp, Homo sapien
gagcaattatcttcccaaattctct

SEQ ID NO: 234625 - DNA, 25 bp, Homo sapien
gcatatatgatgctgtgaacagaaa

SEQ ID NO: 234626 - DNA, 25 bp, Homo sapien
gggtctaaactgacttgtgaaaaga

SEQ ID NO: 234627 - DNA, 25 bp, Homo sapien
gaacggtatgaaaacatgatgcaac

SEQ ID NO: 234628 - DNA, 25 bp, Homo sapien
tcaaaacaacaagctgaacagattt

SEQ ID NO: 234629 - DNA, 25 bp, Homo sapien
gaacagatttcaatactacagactg

SEQ ID NO: 234630 - DNA, 25 bp, Homo sapien
ttcctgctcttgttcaaatgtaaaa

SEQ ID NO: 234631 - DNA, 25 bp, Homo sapien
tcaaatgtaaaaacgctggcaggaa

SEQ ID NO: 234632 - DNA, 25 bp, Homo sapien
atagcaaattatgccctaagctgca

SEQ ID NO: 234633 - DNA, 25 bp, Homo sapien
tatgccctaagctgcaatctacgag

SEQ ID NO: 234634 - DNA, 25 bp, Homo sapien
taagctgcaatctacgagaagagtt

SEQ ID NO: 234635 - DNA, 25 bp, Homo sapien
gaagagttggtagctgtctcagaga

SEQ ID NO: 234636 - DNA, 25 bp, Homo sapien
gaaaagacatctgtaatgcaatggg

SEQ ID NO: 234637 - DNA, 25 bp, Homo sapien
aatggaagtatgtgccactcgattt

SEQ ID NO: 234638 - DNA, 25 bp, Homo sapien
gtatgtgccactcgatttgtatttc

SEQ ID NO: 234639 - DNA, 25 bp, Homo sapien
gtgccactcgatttgtatttctgat

SEQ ID NO: 234640 - DNA, 25 bp, Homo sapien
ccactcgatttgtatttctgattaa

SEQ ID NO: 234641 - DNA, 25 bp, Homo sapien
gggtatttcctaaggtgaccatggt

SEQ ID NO: 234642 - DNA, 25 bp, Homo sapien
gtgaccatggttgaactttagctca

SEQ ID NO: 234643 - DNA, 25 bp, Homo sapien
atggttgaactttagctcatgaaag

SEQ ID NO: 234644 - DNA, 25 bp, Homo sapien
gaattacagtaaacccatctttcct

SEQ ID NO: 234645 - DNA, 25 bp, Homo sapien
gaaaatttcctatgtttacagtctg

SEQ ID NO: 234646 - DNA, 25 bp, Homo sapien
ttacagtctgtctattggtatgcaa

SEQ ID NO: 234647 - DNA, 25 bp, Homo sapien
tggtatgcaatcttgtaactttgat

SEQ ID NO: 234648 - DNA, 25 bp, Homo sapien
tgagcccgacacagtacgagacgga

SEQ ID NO: 234649 - DNA, 25 bp, Homo sapien
gacacagtacgagacggaggcctca

SEQ ID NO: 234650 - DNA, 25 bp, Homo sapien
gtacgagacggaggcctcactgagt

SEQ ID NO: 234651 - DNA, 25 bp, Homo sapien
gacggaggcctcactgagtccaggc

SEQ ID NO: 234652 - DNA, 25 bp, Homo sapien
gggctggagccgctcgactacatct

SEQ ID NO: 234653 - DNA, 25 bp, Homo sapien
gactggctgccagccctcaaagagc

SEQ ID NO: 234654 - DNA, 25 bp, Homo sapien
gagccgctcgactacatcttggtag

SEQ ID NO: 234655 - DNA, 25 bp, Homo sapien
acatcttggtagctctcatttggga

SEQ ID NO: 234656 - DNA, 25 bp, Homo sapien
ctctcatttgggacctcatctttaa

SEQ ID NO: 234657 - DNA, 25 bp, Homo sapien
ttgggacctcatctttaatctcagc

SEQ ID NO: 234658 - DNA, 25 bp, Homo sapien
ggacctcatctttaatctcagcaac

SEQ ID NO: 234659 - DNA, 25 bp, Homo sapien
gaatgcatgatgaacttctacaagc

SEQ ID NO: 234660 - DNA, 25 bp, Homo sapien
ggagaatttcagcaacctggtttca

SEQ ID NO: 234661 - DNA, 25 bp, Homo sapien
gaatttcagcaacctggtttcagtg

SEQ ID NO: 234662 - DNA, 25 bp, Homo sapien
ggtttcagtgggactttccaattct

SEQ ID NO: 234663 - DNA, 25 bp, Homo sapien
agtgggactttccaattctaagcca

SEQ ID NO: 234664 - DNA, 25 bp, Homo sapien
aattctaagccagctgtgatctcct

SEQ ID NO: 234665 - DNA, 25 bp, Homo sapien
tgagccactggaattggacagaatg

SEQ ID NO: 234666 - DNA, 25 bp, Homo sapien
ggaattggacagaatgccccattct

SEQ ID NO: 234667 - DNA, 25 bp, Homo sapien
tgatctccattcctcatgtgtggtg

SEQ ID NO: 234668 - DNA, 25 bp, Homo sapien
attcctcatgtgtggtgtcacccag

SEQ ID NO: 234669 - DNA, 25 bp, Homo sapien
tggtgtcacccagaagaggaggaaa

SEQ ID NO: 234670 - DNA, 25 bp, Homo sapien
cccctgctgtcccaggtagagctgg

SEQ ID NO: 234671 - DNA, 25 bp, Homo sapien
aatcaccactggagcttcactttgt

SEQ ID NO: 234672 - DNA, 25 bp, Homo sapien
tcaccactggagcttcactttgtta

SEQ ID NO: 234673 - DNA, 25 bp, Homo sapien
accactggagcttcactttgttact

SEQ ID NO: 234674 - DNA, 25 bp, Homo sapien
cactggagcttcactttgttactaa

SEQ ID NO: 234675 - DNA, 25 bp, Homo sapien
ctggagcttcactttgttactaaat

SEQ ID NO: 234676 - DNA, 25 bp, Homo sapien
ggagcttcactttgttactaaatta

SEQ ID NO: 234677 - DNA, 25 bp, Homo sapien
gcttcactttgttactaaattatta

SEQ ID NO: 234678 - DNA, 25 bp, Homo sapien
aattattaatttcttgcctccagtg

SEQ ID NO: 234679 - DNA, 25 bp, Homo sapien
attattaatttcttgcctccagtgt

SEQ ID NO: 234680 - DNA, 25 bp, Homo sapien
tattaatttcttgcctccagtgttc

SEQ ID NO: 234681 - DNA, 25 bp, Homo sapien
agggaagttgaaggagccacctcct

SEQ ID NO: 234682 - DNA, 25 bp, Homo sapien
ttgaaggagccacctcctctgtcta

SEQ ID NO: 234683 - DNA, 25 bp, Homo sapien
gacagcaaactcacctgcgcgggct

SEQ ID NO: 234684 - DNA, 25 bp, Homo sapien
cttcacgcccttgacactaaggagt

SEQ ID NO: 234685 - DNA, 25 bp, Homo sapien
cacgcccttgacactaaggagtggg

SEQ ID NO: 234686 - DNA, 25 bp, Homo sapien
ccagaacccctgatgctggttagga

SEQ ID NO: 234687 - DNA, 25 bp, Homo sapien
acccctgatgctggttaggaaccgc

SEQ ID NO: 234688 - DNA, 25 bp, Homo sapien
tgatgctggttaggaaccgctcacc

SEQ ID NO: 234689 - DNA, 25 bp, Homo sapien
gctggttaggaaccgctcaccccaa

SEQ ID NO: 234690 - DNA, 25 bp, Homo sapien
gtcttaaggcaggacgacttggaaa

SEQ ID NO: 234691 - DNA, 25 bp, Homo sapien
gagctccccggtttgcagaatggag

SEQ ID NO: 234692 - DNA, 25 bp, Homo sapien
gtcgccttcccttattgctaaggat

SEQ ID NO: 234693 - DNA, 25 bp, Homo sapien
gctaaggataagtgctgctcaccca

SEQ ID NO: 234694 - DNA, 25 bp, Homo sapien
gtgctgctcacccattgaacaaaaa

SEQ ID NO: 234695 - DNA, 25 bp, Homo sapien
aataactcttttctttcatacatct

SEQ ID NO: 234696 - DNA, 25 bp, Homo sapien
atgtgaacacatctactctaagaag

SEQ ID NO: 234697 - DNA, 25 bp, Homo sapien
atctactctaagaagcccaactaag

SEQ ID NO: 234698 - DNA, 25 bp, Homo sapien
ttattccaagacacaggtactatta

SEQ ID NO: 234699 - DNA, 25 bp, Homo sapien
caccaaacagttgcttgatgtgata

SEQ ID NO: 234700 - DNA, 25 bp, Homo sapien
atagtgttgaatagaccattctcta

SEQ ID NO: 234701 - DNA, 25 bp, Homo sapien
gaccattctctattcagaagctaaa

SEQ ID NO: 234702 - DNA, 25 bp, Homo sapien
gaagctaaactgtttgtcgccttcc

SEQ ID NO: 234703 - DNA, 25 bp, Homo sapien
cgctcttactttcctggtccgaaag

SEQ ID NO: 234704 - DNA, 25 bp, Homo sapien
gctcttactttcctggtccgaaagt

SEQ ID NO: 234705 - DNA, 25 bp, Homo sapien
tttcctggtccgaaagtagctcgcc

SEQ ID NO: 234706 - DNA, 25 bp, Homo sapien
tggtccgaaagtagctcgcccgcga

SEQ ID NO: 234707 - DNA, 25 bp, Homo sapien
ggtccgaaagtagctcgcccgcgag

SEQ ID NO: 234708 - DNA, 25 bp, Homo sapien
tccgaaagtagctcgcccgcgaggg

SEQ ID NO: 234709 - DNA, 25 bp, Homo sapien
gctcgcccgcgagggagtgtgcgca

SEQ ID NO: 234710 - DNA, 25 bp, Homo sapien
agatgaccagaaagggtggcgtggg

SEQ ID NO: 234711 - DNA, 25 bp, Homo sapien
cgacggaccagaagcgagcagacgc

SEQ ID NO: 234712 - DNA, 25 bp, Homo sapien
cagaagcgagcagacgcgcggctaa

SEQ ID NO: 234713 - DNA, 25 bp, Homo sapien
cagggccgctcttactttcctggtc

SEQ ID NO: 234714 - DNA, 25 bp, Homo sapien
gtcatgggtacccagtacgcattag

SEQ ID NO: 234715 - DNA, 25 bp, Homo sapien
tacccagtacgcattagctggtgtt

SEQ ID NO: 234716 - DNA, 25 bp, Homo sapien
aagccagatgggagatgagatagaa

SEQ ID NO: 234717 - DNA, 25 bp, Homo sapien
gtgttaggagttatcctctttgcct

SEQ ID NO: 234718 - DNA, 25 bp, Homo sapien
cctggcctttgagaataacttactg

SEQ ID NO: 234719 - DNA, 25 bp, Homo sapien
gagaataacttactgtgtgactttg

SEQ ID NO: 234720 - DNA, 25 bp, Homo sapien
gcaaggagtttgaccagatgatcac

SEQ ID NO: 234721 - DNA, 25 bp, Homo sapien
cagatgatcacaatgggccttccta

SEQ ID NO: 234722 - DNA, 25 bp, Homo sapien
atcacaatgggccttcctagctctg

SEQ ID NO: 234723 - DNA, 25 bp, Homo sapien
aatgggccttcctagctctggccac

SEQ ID NO: 234724 - DNA, 25 bp, Homo sapien
ttgtgaacattagagctcctggtct

SEQ ID NO: 234725 - DNA, 25 bp, Homo sapien
ggaatgtttttcttcggactctatc

SEQ ID NO: 234726 - DNA, 25 bp, Homo sapien
ggactctatcgaggcacacagacag

SEQ ID NO: 234727 - DNA, 25 bp, Homo sapien
gtctacagtgacagccttaacattt

SEQ ID NO: 234728 - DNA, 25 bp, Homo sapien
taacatttgccagagccctggacgg

SEQ ID NO: 234729 - DNA, 25 bp, Homo sapien
ccctggacggctgcagaaatggcat

SEQ ID NO: 234730 - DNA, 25 bp, Homo sapien
ggctgcagaaatggcattgcccacc

SEQ ID NO: 234731 - DNA, 25 bp, Homo sapien
attgcccaccctgcaagtgagaagc

SEQ ID NO: 234732 - DNA, 25 bp, Homo sapien
agaagcacagactcgagaaatgtag

SEQ ID NO: 234733 - DNA, 25 bp, Homo sapien
tgacacgagcctgcagggccgagtc

SEQ ID NO: 234734 - DNA, 25 bp, Homo sapien
tccaaggcccggagataggaccaac

SEQ ID NO: 234735 - DNA, 25 bp, Homo sapien
ggaccaaccgtcaggaatgcgagga

SEQ ID NO: 234736 - DNA, 25 bp, Homo sapien
gaaggtggcaatcccattagacagc

SEQ ID NO: 234737 - DNA, 25 bp, Homo sapien
attagacagctctccctggcgtgaa

SEQ ID NO: 234738 - DNA, 25 bp, Homo sapien
gctctccctggcgtgaatttatgaa

SEQ ID NO: 234739 - DNA, 25 bp, Homo sapien
ttatgaagccccatgcagactgtga

SEQ ID NO: 234740 - DNA, 25 bp, Homo sapien
aatcatttagttggttctagcacat

SEQ ID NO: 234741 - DNA, 25 bp, Homo sapien
ttctagcacatatcgcaggtttcat

SEQ ID NO: 234742 - DNA, 25 bp, Homo sapien
aggtttcattacaggctgcccctta

SEQ ID NO: 234743 - DNA, 25 bp, Homo sapien
ggctgccccttaacgagcattgtaa

SEQ ID NO: 234744 - DNA, 25 bp, Homo sapien
aacgagcattgtaacctggaggaaa

SEQ ID NO: 234745 - DNA, 25 bp, Homo sapien
tgttttcacacacaaaggccttcct

SEQ ID NO: 234746 - DNA, 25 bp, Homo sapien
aaaggccttccttgctcgggccatg

SEQ ID NO: 234747 - DNA, 25 bp, Homo sapien
atcaatgggtgatttatgatgcctt

SEQ ID NO: 234748 - DNA, 25 bp, Homo sapien
tatgatgccttctgccctttggcga

SEQ ID NO: 234749 - DNA, 25 bp, Homo sapien
cttctgccctttggcgagtgaatgg

SEQ ID NO: 234750 - DNA, 25 bp, Homo sapien
tttggcgagtgaatgggtttcccat

SEQ ID NO: 234751 - DNA, 25 bp, Homo sapien
gggaagttggcctccctccgtgagc

SEQ ID NO: 234752 - DNA, 25 bp, Homo sapien
ccctccgtgagctttggaaatgttt

SEQ ID NO: 234753 - DNA, 25 bp, Homo sapien
ctaatagacacagggaggccagttc

SEQ ID NO: 234754 - DNA, 25 bp, Homo sapien
aggccagttctgtttcagagcaatt

SEQ ID NO: 234755 - DNA, 25 bp, Homo sapien
gagcaattatcttcccaaattctct

SEQ ID NO: 234756 - DNA, 25 bp, Homo sapien
actgctgtaattctctgtctcatca

SEQ ID NO: 234757 - DNA, 25 bp, Homo sapien
gcatatatgatgctgtgaacagaaa

SEQ ID NO: 234758 - DNA, 25 bp, Homo sapien
ggacagccatcgctccacagagctt

SEQ ID NO: 234759 - DNA, 25 bp, Homo sapien
gctccacagagcttacgaatttcta

SEQ ID NO: 234760 - DNA, 25 bp, Homo sapien
cagagcttacgaatttctaccagat

SEQ ID NO: 234761 - DNA, 25 bp, Homo sapien
tttctaccagatggtccagcagcat

SEQ ID NO: 234762 - DNA, 25 bp, Homo sapien
ggtccagcagcatcggaagtactat

SEQ ID NO: 234763 - DNA, 25 bp, Homo sapien
gcatcggaagtactatcaagacaag

SEQ ID NO: 234764 - DNA, 25 bp, Homo sapien
agtgcctcgagtcccctactttgcg

SEQ ID NO: 234765 - DNA, 25 bp, Homo sapien
ctactttgcgatgcccgtgagggag

SEQ ID NO: 234766 - DNA, 25 bp, Homo sapien
tgcccaaagaagaagtggcaccttt

SEQ ID NO: 234767 - DNA, 25 bp, Homo sapien
gcaccttttaagactagcccccgag

SEQ ID NO: 234768 - DNA, 25 bp, Homo sapien
gctacactcgcttcaacctggacag

SEQ ID NO: 234769 - DNA, 25 bp, Homo sapien
ttgtgtgtgacagattaggattaaa

SEQ ID NO: 234770 - DNA, 25 bp, Homo sapien
gattaggattaaattatggtttgac

SEQ ID NO: 234771 - DNA, 25 bp, Homo sapien
tggtttgacttttcctagcagcgtg

SEQ ID NO: 234772 - DNA, 25 bp, Homo sapien
ggtttgacttttcctagcagcgtga

SEQ ID NO: 234773 - DNA, 25 bp, Homo sapien
gtttgacttttcctagcagcgtgat

SEQ ID NO: 234774 - DNA, 25 bp, Homo sapien
tttgacttttcctagcagcgtgatc

SEQ ID NO: 234775 - DNA, 25 bp, Homo sapien
ttgacttttcctagcagcgtgatca

SEQ ID NO: 234776 - DNA, 25 bp, Homo sapien
tgacttttcctagcagcgtgatcat

SEQ ID NO: 234777 - DNA, 25 bp, Homo sapien
gacttttcctagcagcgtgatcatg

SEQ ID NO: 234778 - DNA, 25 bp, Homo sapien
acttttcctagcagcgtgatcatgg

SEQ ID NO: 234779 - DNA, 25 bp, Homo sapien
cagcgtgatcatgggcaagtggctt

SEQ ID NO: 234780 - DNA, 25 bp, Homo sapien
gataccaccatttcccttttctttg

SEQ ID NO: 234781 - DNA, 25 bp, Homo sapien
tttgctcagggcatggcctgtttat

SEQ ID NO: 234782 - DNA, 25 bp, Homo sapien
tggtggtggttgtttcagatctact

SEQ ID NO: 234783 - DNA, 25 bp, Homo sapien
gtttcagatctactgacagcaatga

SEQ ID NO: 234784 - DNA, 25 bp, Homo sapien
gacaggaagagaggacgcatacaac

SEQ ID NO: 234785 - DNA, 25 bp, Homo sapien
gagaggacgcatacaacaggcaaaa

SEQ ID NO: 234786 - DNA, 25 bp, Homo sapien
aagaggaatgcccagcagtcttggt

SEQ ID NO: 234787 - DNA, 25 bp, Homo sapien
cagtcttggtccttgcggtgcaata

SEQ ID NO: 234788 - DNA, 25 bp, Homo sapien
gcggtgcaatactggccttgaggcc

SEQ ID NO: 234789 - DNA, 25 bp, Homo sapien
gggattcgtagtcactaacttctaa

SEQ ID NO: 234790 - DNA, 25 bp, Homo sapien
cactaacttctaactgaggcaggga

SEQ ID NO: 234791 - DNA, 25 bp, Homo sapien
gcaacagaaactctatgtcccagaa

SEQ ID NO: 234792 - DNA, 25 bp, Homo sapien
gtcccagaaggcctgaaatatttaa

SEQ ID NO: 234793 - DNA, 25 bp, Homo sapien
aaagtttgcagaatcttcatctatg

SEQ ID NO: 234794 - DNA, 25 bp, Homo sapien
gcagaatcttcatctatgtaaatag

SEQ ID NO: 234795 - DNA, 25 bp, Homo sapien
attcttgatagacatacagggccga

SEQ ID NO: 234796 - DNA, 25 bp, Homo sapien
catacagggccgagaagacatacag

SEQ ID NO: 234797 - DNA, 25 bp, Homo sapien
ggccgagaagacatacagggtcaag

SEQ ID NO: 234798 - DNA, 25 bp, Homo sapien
agttggcaaactggcctcctgtttt

SEQ ID NO: 234799 - DNA, 25 bp, Homo sapien
tacatattgcctgtggttgctttgg

SEQ ID NO: 234800 - DNA, 25 bp, Homo sapien
gcctgtggttgctttggcacttaga

SEQ ID NO: 234801 - DNA, 25 bp, Homo sapien
ggcacttagagtggttgcaacagaa

SEQ ID NO: 234802 - DNA, 25 bp, Homo sapien
aagccgaacgtttgtgcttcccgtg

SEQ ID NO: 234803 - DNA, 25 bp, Homo sapien
gcttcccgtgcatgcagtcaaagac

SEQ ID NO: 234804 - DNA, 25 bp, Homo sapien
gcagtcaaagactcagcacaggttt

SEQ ID NO: 234805 - DNA, 25 bp, Homo sapien
gactcagcacaggttttagaggaaa

SEQ ID NO: 234806 - DNA, 25 bp, Homo sapien
ggaagccaggtgagtctcctttctc

SEQ ID NO: 234807 - DNA, 25 bp, Homo sapien
ctccagtggaagagccgggaccttc

SEQ ID NO: 234808 - DNA, 25 bp, Homo sapien
gtgaggaagacgctgcctcccaatg

SEQ ID NO: 234809 - DNA, 25 bp, Homo sapien
ggatgtttccaagctcttgttcccc

SEQ ID NO: 234810 - DNA, 25 bp, Homo sapien
cttgttcccctaacgtctcaacagg

SEQ ID NO: 234811 - DNA, 25 bp, Homo sapien
tctcaacaggcgctcactgaagtgt

SEQ ID NO: 234812 - DNA, 25 bp, Homo sapien
ttttgcagtaagctagtcttcccct

SEQ ID NO: 234813 - DNA, 25 bp, Homo sapien
attgatgtacttcctgtcaacttcg

SEQ ID NO: 234814 - DNA, 25 bp, Homo sapien
atgtacttcctgtcaacttcgcact

SEQ ID NO: 234815 - DNA, 25 bp, Homo sapien
aacttcgcacttctccagttagttg

SEQ ID NO: 234816 - DNA, 25 bp, Homo sapien
gcacttctccagttagttggagccc

SEQ ID NO: 234817 - DNA, 25 bp, Homo sapien
gttggagcccaggtaccagatcatc

SEQ ID NO: 234818 - DNA, 25 bp, Homo sapien
gcccaggtaccagatcatcagtcaa

SEQ ID NO: 234819 - DNA, 25 bp, Homo sapien
ccagatcatcagtcaattaagttaa

SEQ ID NO: 234820 - DNA, 25 bp, Homo sapien
gttgcaaagaaatgcgttgaggatt

SEQ ID NO: 234821 - DNA, 25 bp, Homo sapien
ggatttggcactctacttaaaacca

SEQ ID NO: 234822 - DNA, 25 bp, Homo sapien
ttggcactctacttaaaaccactaa

SEQ ID NO: 234823 - DNA, 25 bp, Homo sapien
aaagcttgtccttttgaccagactg

SEQ ID NO: 234824 - DNA, 25 bp, Homo sapien
gtatctcgacgatgtgacacagtca

SEQ ID NO: 234825 - DNA, 25 bp, Homo sapien
gtgacacagtcacagtccctaaagg

SEQ ID NO: 234826 - DNA, 25 bp, Homo sapien
ggaggtcatcacagattttctcaca

SEQ ID NO: 234827 - DNA, 25 bp, Homo sapien
cactctacctttgccagactatgaa

SEQ ID NO: 234828 - DNA, 25 bp, Homo sapien
agtaggcactaaaggaccaggcgat

SEQ ID NO: 234829 - DNA, 25 bp, Homo sapien
ggaccaggcgataacttacaccaag

SEQ ID NO: 234830 - DNA, 25 bp, Homo sapien
tacaccaagttgcacctgacctact

SEQ ID NO: 234831 - DNA, 25 bp, Homo sapien
tactcctcccagaacaaatcataaa

SEQ ID NO: 234832 - DNA, 25 bp, Homo sapien
aaagtacttgtgcaaatccgaagaa

SEQ ID NO: 234833 - DNA, 25 bp, Homo sapien
atgcaatggcatgtttcagtgataa

SEQ ID NO: 234834 - DNA, 25 bp, Homo sapien
aagttccagttatgtatctcgacga

SEQ ID NO: 234835 - DNA, 25 bp, Homo sapien
agaactagttctacaattcagctgt

SEQ ID NO: 234836 - DNA, 25 bp, Homo sapien
ttcagctgtatgttgtaaaggagtc

SEQ ID NO: 234837 - DNA, 25 bp, Homo sapien
aacagtgtatgggacttcacatcag

SEQ ID NO: 234838 - DNA, 25 bp, Homo sapien
atgggacttcacatcagttctcctt

SEQ ID NO: 234839 - DNA, 25 bp, Homo sapien
cagttctccttattgattgttagtt

SEQ ID NO: 234840 - DNA, 25 bp, Homo sapien
attgttagtttgatccctcttgttc

SEQ ID NO: 234841 - DNA, 25 bp, Homo sapien
tagtttgatccctcttgttcttttg

SEQ ID NO: 234842 - DNA, 25 bp, Homo sapien
gaggtatatatctatgagccattgt

SEQ ID NO: 234843 - DNA, 25 bp, Homo sapien
ctatgagccattgtgtttggtgttt

SEQ ID NO: 234844 - DNA, 25 bp, Homo sapien
caagaactttaccatactggtgtgt

SEQ ID NO: 234845 - DNA, 25 bp, Homo sapien
actggtgtgtagtccattctgtaca

SEQ ID NO: 234846 - DNA, 25 bp, Homo sapien
acaaaggagtcagccacgttggaac

SEQ ID NO: 234847 - DNA, 25 bp, Homo sapien
gagtcagccacgttggaaccaacat

SEQ ID NO: 234848 - DNA, 25 bp, Homo sapien
gaaccaacatagtttcataccacgt

SEQ ID NO: 234849 - DNA, 25 bp, Homo sapien
ttcataccacgttgaaaccatgtgt

SEQ ID NO: 234850 - DNA, 25 bp, Homo sapien
gaaaccatgtgtttgatatgcaaat

SEQ ID NO: 234851 - DNA, 25 bp, Homo sapien
ataattttttcactcttgtcaatgc

SEQ ID NO: 234852 - DNA, 25 bp, Homo sapien
caatgcattgaaaggcccagaaaat

SEQ ID NO: 234853 - DNA, 25 bp, Homo sapien
tgtggatgttcctcagtttctggga

SEQ ID NO: 234854 - DNA, 25 bp, Homo sapien
cagtttctgggaaaattttgctaca

SEQ ID NO: 234855 - DNA, 25 bp, Homo sapien
tttaggaggcagtcttttgcatggt

SEQ ID NO: 234856 - DNA, 25 bp, Homo sapien
tcttttgcatggtatttttggctta

SEQ ID NO: 234857 - DNA, 25 bp, Homo sapien
gagtgctttctccatgtactgtgaa

SEQ ID NO: 234858 - DNA, 25 bp, Homo sapien
actgtgaaacacatccatctggatc

SEQ ID NO: 234859 - DNA, 25 bp, Homo sapien
atctggatccacctatttaagctac

SEQ ID NO: 234860 - DNA, 25 bp, Homo sapien
tttaagctacatgcctagcctccag

SEQ ID NO: 234861 - DNA, 25 bp, Homo sapien
tagcctccagagtcatccagacttt

SEQ ID NO: 234862 - DNA, 25 bp, Homo sapien
agtcatccagacttttagcataaga

SEQ ID NO: 234863 - DNA, 25 bp, Homo sapien
aatccaatatcacctacaggaccct

SEQ ID NO: 234864 - DNA, 25 bp, Homo sapien
tgggcccattgcactttgtaattgt

SEQ ID NO: 234865 - DNA, 25 bp, Homo sapien
tgtattacttttcttctggttatct

SEQ ID NO: 234866 - DNA, 25 bp, Homo sapien
tctgcatcagagagggttcaacatt

SEQ ID NO: 234867 - DNA, 25 bp, Homo sapien
gggttcaacattaacaacgtctgta

SEQ ID NO: 234868 - DNA, 25 bp, Homo sapien
tctgcgtccccaagggcttgactgc

SEQ ID NO: 234869 - DNA, 25 bp, Homo sapien
aagggcttgactgcccgtgtctgcg

SEQ ID NO: 234870 - DNA, 25 bp, Homo sapien
gggcagagcttagaacactagagga

SEQ ID NO: 234871 - DNA, 25 bp, Homo sapien
acatgtcgcgctccttctatgtcga

SEQ ID NO: 234872 - DNA, 25 bp, Homo sapien
gctccttctatgtcgactcgctcat

SEQ ID NO: 234873 - DNA, 25 bp, Homo sapien
tcgactcgctcatcatcaaggacac

SEQ ID NO: 234874 - DNA, 25 bp, Homo sapien
atcatcaaggacacctcacggcctg

SEQ ID NO: 234875 - DNA, 25 bp, Homo sapien
ggatttcttcatcccgcttggcatg

SEQ ID NO: 234876 - DNA, 25 bp, Homo sapien
ccccattggtgatgtccgtgtccgg

SEQ ID NO: 234877 - DNA, 25 bp, Homo sapien
ttggtgatgtccgtgtccggccccg

SEQ ID NO: 234878 - DNA, 25 bp, Homo sapien
cgtctcgcaagagcggcgcgttctg

SEQ ID NO: 234879 - DNA, 25 bp, Homo sapien
agctctttcgtatctgtaatgtatt

SEQ ID NO: 234880 - DNA, 25 bp, Homo sapien
attttgcatttgatccattttttcc

SEQ ID NO: 234881 - DNA, 25 bp, Homo sapien
ttttcctagttactgcacctgggag

SEQ ID NO: 234882 - DNA, 25 bp, Homo sapien
acctgggagcgactgccagtactac

SEQ ID NO: 234883 - DNA, 25 bp, Homo sapien
tgccagtactaccacatcatttcgg

SEQ ID NO: 234884 - DNA, 25 bp, Homo sapien
atcatttcggtagtggaggtcccca

SEQ ID NO: 234885 - DNA, 25 bp, Homo sapien
gcacatagcatgatcacgtctagga

SEQ ID NO: 234886 - DNA, 25 bp, Homo sapien
cgtctaggaagatcgttctggctgt

SEQ ID NO: 234887 - DNA, 25 bp, Homo sapien
gatcgttctggctgtagatagtata

SEQ ID NO: 234888 - DNA, 25 bp, Homo sapien
ggaagttttgcatcatttacttgaa

SEQ ID NO: 234889 - DNA, 25 bp, Homo sapien
gatactgttcttctgaatttaatca

SEQ ID NO: 234890 - DNA, 25 bp, Homo sapien
tgagtcttttgaacacaggtatgaa

SEQ ID NO: 234891 - DNA, 25 bp, Homo sapien
gtgaatctaaaccaatgttacccct

SEQ ID NO: 234892 - DNA, 25 bp, Homo sapien
aatgttacccctaccatacaggtat

SEQ ID NO: 234893 - DNA, 25 bp, Homo sapien
gttacccctaccatacaggtatgtt

SEQ ID NO: 234894 - DNA, 25 bp, Homo sapien
tatgttgtgttcacaaacacacaca

SEQ ID NO: 234895 - DNA, 25 bp, Homo sapien
taaccacattaaatattctgtccat

SEQ ID NO: 234896 - DNA, 25 bp, Homo sapien
tattctgtccattaagattccccaa

SEQ ID NO: 234897 - DNA, 25 bp, Homo sapien
ctgtccattaagattccccaaagat

SEQ ID NO: 234898 - DNA, 25 bp, Homo sapien
gaagatatttgcagcatgcaaggca

SEQ ID NO: 234899 - DNA, 25 bp, Homo sapien
gcaaggcaagatgacaatgcactaa

SEQ ID NO: 234900 - DNA, 25 bp, Homo sapien
aatttcataaaacaatggacttggg

SEQ ID NO: 234901 - DNA, 25 bp, Homo sapien
ttctccgcaaggaccctctgttagg

SEQ ID NO: 234902 - DNA, 25 bp, Homo sapien
aaggaccctctgttaggcaggcgcc

SEQ ID NO: 234903 - DNA, 25 bp, Homo sapien
tcccgggccttgtgaacctgcaaac

SEQ ID NO: 234904 - DNA, 25 bp, Homo sapien
gtgaacctgcaaacccaagtctgag

SEQ ID NO: 234905 - DNA, 25 bp, Homo sapien
aacctgcaaacccaagtctgagaga

SEQ ID NO: 234906 - DNA, 25 bp, Homo sapien
aagtctgagagacgatccgccttca

SEQ ID NO: 234907 - DNA, 25 bp, Homo sapien
ttcagcgctttccagcttggcagag

SEQ ID NO: 234908 - DNA, 25 bp, Homo sapien
gctttccagcttggcagagaggctt

SEQ ID NO: 234909 - DNA, 25 bp, Homo sapien
gggatctttggttggcgctggcgat

SEQ ID NO: 234910 - DNA, 25 bp, Homo sapien
atgtcccagcacgagtaggcgggat

SEQ ID NO: 234911 - DNA, 25 bp, Homo sapien
gatgcgctcgcttggtcctccgggc

SEQ ID NO: 234912 - DNA, 25 bp, Homo sapien
atttcccttttacattcattatgca

SEQ ID NO: 234913 - DNA, 25 bp, Homo sapien
tttcccttttacattcattatgcaa

SEQ ID NO: 234914 - DNA, 25 bp, Homo sapien
attcaattcagcaaattcaccaaaa

SEQ ID NO: 234915 - DNA, 25 bp, Homo sapien
cagcaaattcaccaaaacaatgtga

SEQ ID NO: 234916 - DNA, 25 bp, Homo sapien
acaatgtgaatatatcctaaagtga

SEQ ID NO: 234917 - DNA, 25 bp, Homo sapien
atcctaaagtgattaaactcagaaa

SEQ ID NO: 234918 - DNA, 25 bp, Homo sapien
gtgattaaactcagaaatgatgtga

SEQ ID NO: 234919 - DNA, 25 bp, Homo sapien
tccagtttacacagtttgaccaaaa

SEQ ID NO: 234920 - DNA, 25 bp, Homo sapien
gtttacacagtttgaccaaaaacag

SEQ ID NO: 234921 - DNA, 25 bp, Homo sapien
cacagtttgaccaaaaacagcatgg

SEQ ID NO: 234922 - DNA, 25 bp, Homo sapien
tttctcacacactactagccagcct

SEQ ID NO: 234923 - DNA, 25 bp, Homo sapien
ggcggagcttgcagacagccgaccg

SEQ ID NO: 234924 - DNA, 25 bp, Homo sapien
gcggagcttgcagacagccgaccgt

SEQ ID NO: 234925 - DNA, 25 bp, Homo sapien
cggagcttgcagacagccgaccgtg

SEQ ID NO: 234926 - DNA, 25 bp, Homo sapien
ggagcttgcagacagccgaccgtgc

SEQ ID NO: 234927 - DNA, 25 bp, Homo sapien
gagcttgcagacagccgaccgtgcc

SEQ ID NO: 234928 - DNA, 25 bp, Homo sapien
agcttgcagacagccgaccgtgcca

SEQ ID NO: 234929 - DNA, 25 bp, Homo sapien
gcttgcagacagccgaccgtgccac

SEQ ID NO: 234930 - DNA, 25 bp, Homo sapien
cttgcagacagccgaccgtgccact

SEQ ID NO: 234931 - DNA, 25 bp, Homo sapien
ttgcagacagccgaccgtgccactg

SEQ ID NO: 234932 - DNA, 25 bp, Homo sapien
tgcagacagccgaccgtgccactgc

SEQ ID NO: 234933 - DNA, 25 bp, Homo sapien
gcagacagccgaccgtgccactgca

SEQ ID NO: 234934 - DNA, 25 bp, Homo sapien
tggacagatgccttacaaatgtaag

SEQ ID NO: 234935 - DNA, 25 bp, Homo sapien
gcaaggtcttcactctgtggtcatt

SEQ ID NO: 234936 - DNA, 25 bp, Homo sapien
caaggtcttcactctgtggtcattc

SEQ ID NO: 234937 - DNA, 25 bp, Homo sapien
aaggtcttcactctgtggtcattcc

SEQ ID NO: 234938 - DNA, 25 bp, Homo sapien
aggtcttcactctgtggtcattcca

SEQ ID NO: 234939 - DNA, 25 bp, Homo sapien
ggtcttcactctgtggtcattccat

SEQ ID NO: 234940 - DNA, 25 bp, Homo sapien
gtcttcactctgtggtcattccatg

SEQ ID NO: 234941 - DNA, 25 bp, Homo sapien
agagttgattcaacattgacttgag

SEQ ID NO: 234942 - DNA, 25 bp, Homo sapien
gagttgattcaacattgacttgagt

SEQ ID NO: 234943 - DNA, 25 bp, Homo sapien
agttgattcaacattgacttgagtt

SEQ ID NO: 234944 - DNA, 25 bp, Homo sapien
gttgattcaacattgacttgagttt

SEQ ID NO: 234945 - DNA, 25 bp, Homo sapien
agggccgccgcatggatgaccaacg

SEQ ID NO: 234946 - DNA, 25 bp, Homo sapien
gccgcatggatgaccaacgtgtgac

SEQ ID NO: 234947 - DNA, 25 bp, Homo sapien
gatgaccaacgtgtgacagtcagca

SEQ ID NO: 234948 - DNA, 25 bp, Homo sapien
aacgtgtgacagtcagcagcctgcc

SEQ ID NO: 234949 - DNA, 25 bp, Homo sapien
ggtccaaggacggagcacagaaacg

SEQ ID NO: 234950 - DNA, 25 bp, Homo sapien
gaccaggagggcttcttcaatctgc

SEQ ID NO: 234951 - DNA, 25 bp, Homo sapien
ggagggcttcttcaatctgctgagc

SEQ ID NO: 234952 - DNA, 25 bp, Homo sapien
tcttcaatctgctgagccacgtgca

SEQ ID NO: 234953 - DNA, 25 bp, Homo sapien
gagggacagcgctgttcactgcaag

SEQ ID NO: 234954 - DNA, 25 bp, Homo sapien
acagcgctgttcactgcaagccggg

SEQ ID NO: 234955 - DNA, 25 bp, Homo sapien
ctgttcactgcaagccgggccgggc

SEQ ID NO: 234956 - DNA, 25 bp, Homo sapien
gaggacgagcgctctgccctagacg

SEQ ID NO: 234957 - DNA, 25 bp, Homo sapien
ggacgagcgctctgccctagacgtg

SEQ ID NO: 234958 - DNA, 25 bp, Homo sapien
gtggcttctgagcagcggcgcttgt

SEQ ID NO: 234959 - DNA, 25 bp, Homo sapien
agcggcgcttgtggccaactctgag

SEQ ID NO: 234960 - DNA, 25 bp, Homo sapien
gcttgtggccaactctgagtcgtga

SEQ ID NO: 234961 - DNA, 25 bp, Homo sapien
tgtggccaactctgagtcgtgagaa

SEQ ID NO: 234962 - DNA, 25 bp, Homo sapien
aactctgagtcgtgagaagcagcag

SEQ ID NO: 234963 - DNA, 25 bp, Homo sapien
gagagcacggtgttcagccaggcca

SEQ ID NO: 234964 - DNA, 25 bp, Homo sapien
gagcacggtgttcagccaggccatc

SEQ ID NO: 234965 - DNA, 25 bp, Homo sapien
ggtgttcagccaggccatccactat

SEQ ID NO: 234966 - DNA, 25 bp, Homo sapien
tccactatgccaaccgcatgagcta

SEQ ID NO: 234967 - DNA, 25 bp, Homo sapien
gcaagaccctcaattttaacattag

SEQ ID NO: 234968 - DNA, 25 bp, Homo sapien
acattagccaggagtactagcacct

SEQ ID NO: 234969 - DNA, 25 bp, Homo sapien
agccaggagtactagcacctgtggt

SEQ ID NO: 234970 - DNA, 25 bp, Homo sapien
gaggaaagacaacttgagcccaaga

SEQ ID NO: 234971 - DNA, 25 bp, Homo sapien
gccatgactgctccactgcactgaa

SEQ ID NO: 234972 - DNA, 25 bp, Homo sapien
catgactgctccactgcactgaagc

SEQ ID NO: 234973 - DNA, 25 bp, Homo sapien
ctgaagcctcggcaacagggcaaga

SEQ ID NO: 234974 - DNA, 25 bp, Homo sapien
gaaaaccaggcaccaattgccaaga

SEQ ID NO: 234975 - DNA, 25 bp, Homo sapien
aaaccaggcaccaattgccaagaga

SEQ ID NO: 234976 - DNA, 25 bp, Homo sapien
gccaagagaatcgtgttttatatat

SEQ ID NO: 234977 - DNA, 25 bp, Homo sapien
gagaatcgtgttttatatatactct

SEQ ID NO: 234978 - DNA, 25 bp, Homo sapien
agcttcacatccacatcctcatggt

SEQ ID NO: 234979 - DNA, 25 bp, Homo sapien
cctagaaagacttcagctggcaaag

SEQ ID NO: 234980 - DNA, 25 bp, Homo sapien
tgatatggcaacagtgcgatgcccc

SEQ ID NO: 234981 - DNA, 25 bp, Homo sapien
gctggcaaagcaacgcaaatggctg

SEQ ID NO: 234982 - DNA, 25 bp, Homo sapien
aaatggctgagcgtcgaggatagaa

SEQ ID NO: 234983 - DNA, 25 bp, Homo sapien
aagtggctgaacagcgagcagagaa

SEQ ID NO: 234984 - DNA, 25 bp, Homo sapien
gttggagatagatgcagctaacttc

SEQ ID NO: 234985 - DNA, 25 bp, Homo sapien
tcagatactgtggttttagagaggg

SEQ ID NO: 234986 - DNA, 25 bp, Homo sapien
atatggggtcgttccatgtttcttc

SEQ ID NO: 234987 - DNA, 25 bp, Homo sapien
tgccttcctcagcatgttaaccttt

SEQ ID NO: 234988 - DNA, 25 bp, Homo sapien
ttcctcagcatgttaacctttcagc

SEQ ID NO: 234989 - DNA, 25 bp, Homo sapien
tggaggctgcgaatctcctctggaa

SEQ ID NO: 234990 - DNA, 25 bp, Homo sapien
gcctctgcctggagcattcacatca

SEQ ID NO: 234991 - DNA, 25 bp, Homo sapien
ttcacatcagatggaaagaagctgc

SEQ ID NO: 234992 - DNA, 25 bp, Homo sapien
agcagccatggctagcttgatttct

SEQ ID NO: 234993 - DNA, 25 bp, Homo sapien
catggctagcttgatttctggtctc

SEQ ID NO: 234994 - DNA, 25 bp, Homo sapien
gatttctggtctccaaagctaagca

SEQ ID NO: 234995 - DNA, 25 bp, Homo sapien
caaagctaagcataaccttcccggg

SEQ ID NO: 234996 - DNA, 25 bp, Homo sapien
gtttttcagcctgtacgaaacatgt

SEQ ID NO: 234997 - DNA, 25 bp, Homo sapien
gtacgaaacatgtctctgttctaat

SEQ ID NO: 234998 - DNA, 25 bp, Homo sapien
tctgttctaattaaagttcccatgg

SEQ ID NO: 234999 - DNA, 25 bp, Homo sapien
aagttcccatggtatggtgttctca

SEQ ID NO: 235000 - DNA, 25 bp, Homo sapien
tccaggactcctgtttccagagtat

SEQ ID NO: 235001 - DNA, 25 bp, Homo sapien
ggactcctgtttccagagtataatt

SEQ ID NO: 235002 - DNA, 25 bp, Homo sapien
gccttgggcatttcattggccgtca

SEQ ID NO: 235003 - DNA, 25 bp, Homo sapien
gggcatttcattggccgtcagtgtc

SEQ ID NO: 235004 - DNA, 25 bp, Homo sapien
atttcattggccgtcagtgtcccac

SEQ ID NO: 235005 - DNA, 25 bp, Homo sapien
gtttccagagtataattgtattgac

SEQ ID NO: 235006 - DNA, 25 bp, Homo sapien
gtgtcccaccacagaatgtcaacag

SEQ ID NO: 235007 - DNA, 25 bp, Homo sapien
gaatgtcaacaggattcctagcctg

SEQ ID NO: 235008 - DNA, 25 bp, Homo sapien
tcaacaggattcctagcctgcctat

SEQ ID NO: 235009 - DNA, 25 bp, Homo sapien
acaaagctcatccatagtcaaaccc

SEQ ID NO: 235010 - DNA, 25 bp, Homo sapien
atccatagtcaaacccaaccctgga

SEQ ID NO: 235011 - DNA, 25 bp, Homo sapien
tatctacagaatgaagcaccagttt

SEQ ID NO: 235012 - DNA, 25 bp, Homo sapien
aaagagtgtgttcatggtcgcccat

SEQ ID NO: 235013 - DNA, 25 bp, Homo sapien
catggtcgcccattttttcatcatt

SEQ ID NO: 235014 - DNA, 25 bp, Homo sapien
tttcatcatttaacctatcttccag

SEQ ID NO: 235015 - DNA, 25 bp, Homo sapien
taacctatcttccagaaactacatg

SEQ ID NO: 235016 - DNA, 25 bp, Homo sapien
gtttaagaagattagttaccattga

SEQ ID NO: 235017 - DNA, 25 bp, Homo sapien
ccattgaaattggttctgtcataaa

SEQ ID NO: 235018 - DNA, 25 bp, Homo sapien
gtcataaaacagcatgagtctggtt

SEQ ID NO: 235019 - DNA, 25 bp, Homo sapien
tatctttgtattatgtgtcacatgg

SEQ ID NO: 235020 - DNA, 25 bp, Homo sapien
gaggattcactgacttgtttttata

SEQ ID NO: 235021 - DNA, 25 bp, Homo sapien
tgaaaaaagttccacgtattgtaga

SEQ ID NO: 235022 - DNA, 25 bp, Homo sapien
gatcttggacatacagcttggtatc

SEQ ID NO: 235023 - DNA, 25 bp, Homo sapien
tacagcttggtatcagttctcaaaa

SEQ ID NO: 235024 - DNA, 25 bp, Homo sapien
agttctcaaaatgatcagttgctaa

SEQ ID NO: 235025 - DNA, 25 bp, Homo sapien
aaatgggcatccagtacagcagcac

SEQ ID NO: 235026 - DNA, 25 bp, Homo sapien
agaccatgtgattctggaggagcaa

SEQ ID NO: 235027 - DNA, 25 bp, Homo sapien
ggagcaaaaaacaattctgccggta

SEQ ID NO: 235028 - DNA, 25 bp, Homo sapien
attctgccggtaacttcttgcttta

SEQ ID NO: 235029 - DNA, 25 bp, Homo sapien
ggtaacttcttgctttagccagcca

SEQ ID NO: 235030 - DNA, 25 bp, Homo sapien
cccagtgtctattagcaatgcaagt

SEQ ID NO: 235031 - DNA, 25 bp, Homo sapien
attagcaatgcaagttgcctcccca

SEQ ID NO: 235032 - DNA, 25 bp, Homo sapien
ccatcaccacatctgtcagtgctgg

SEQ ID NO: 235033 - DNA, 25 bp, Homo sapien
atgagtttcctgtctttcccgccag

SEQ ID NO: 235034 - DNA, 25 bp, Homo sapien
ttttcttacatctctgcatctgtgg

SEQ ID NO: 235035 - DNA, 25 bp, Homo sapien
tgcatctgtggactctcctatcgtc

SEQ ID NO: 235036 - DNA, 25 bp, Homo sapien
tcctatcgtctccaggagcaaggca

SEQ ID NO: 235037 - DNA, 25 bp, Homo sapien
ggcagagacacattcttgtctgtga

SEQ ID NO: 235038 - DNA, 25 bp, Homo sapien
ttgtctgtgagcagatgacttgtct

SEQ ID NO: 235039 - DNA, 25 bp, Homo sapien
gatgacttgtctagaaatcatggac

SEQ ID NO: 235040 - DNA, 25 bp, Homo sapien
atcatggacagcctgcaagtccttc

SEQ ID NO: 235041 - DNA, 25 bp, Homo sapien
aattaggaccttttcagacagtgta

SEQ ID NO: 235042 - DNA, 25 bp, Homo sapien
aaagatgcctttttccaacacacca

SEQ ID NO: 235043 - DNA, 25 bp, Homo sapien
aacacaccactgagttgaagaggat

SEQ ID NO: 235044 - DNA, 25 bp, Homo sapien
cccctgctgtcccaggtagagctgg

SEQ ID NO: 235045 - DNA, 25 bp, Homo sapien
tctctctctacctataccatctgag

SEQ ID NO: 235046 - DNA, 25 bp, Homo sapien
aatcaccactggagcttcactttgt

SEQ ID NO: 235047 - DNA, 25 bp, Homo sapien
tcaccactggagcttcactttgtta

SEQ ID NO: 235048 - DNA, 25 bp, Homo sapien
ccactggagcttcactttgttacta

SEQ ID NO: 235049 - DNA, 25 bp, Homo sapien
actggagcttcactttgttactaaa

SEQ ID NO: 235050 - DNA, 25 bp, Homo sapien
ggagcttcactttgttactaaatta

SEQ ID NO: 235051 - DNA, 25 bp, Homo sapien
gcttcactttgttactaaattatta

SEQ ID NO: 235052 - DNA, 25 bp, Homo sapien
aattattaatttcttgcctccagtg

SEQ ID NO: 235053 - DNA, 25 bp, Homo sapien
tattaatttcttgcctccagtgttc

SEQ ID NO: 235054 - DNA, 25 bp, Homo sapien
ctctgctccttttcattgcagaaaa

SEQ ID NO: 235055 - DNA, 25 bp, Homo sapien
tactgcggccacaagcagagggacc

SEQ ID NO: 235056 - DNA, 25 bp, Homo sapien
gagggaccccaggattctcaaatct

SEQ ID NO: 235057 - DNA, 25 bp, Homo sapien
tctcaaatctgttaccttgtctcac

SEQ ID NO: 235058 - DNA, 25 bp, Homo sapien
tcaagcacgtggaccgacacccagg

SEQ ID NO: 235059 - DNA, 25 bp, Homo sapien
tcacctcccctaggaagcagaagag

SEQ ID NO: 235060 - DNA, 25 bp, Homo sapien
gaaaatctttagctgctgatcacag

SEQ ID NO: 235061 - DNA, 25 bp, Homo sapien
tataaacgagatgaggagggtccct

SEQ ID NO: 235062 - DNA, 25 bp, Homo sapien
tgtcctcttggtgtttccagtctcc

SEQ ID NO: 235063 - DNA, 25 bp, Homo sapien
ctgacactgcagactcctggaatat

SEQ ID NO: 235064 - DNA, 25 bp, Homo sapien
atatacctccaccagcaggcaggaa

SEQ ID NO: 235065 - DNA, 25 bp, Homo sapien
gaatctgtcctattcccagcaacca

SEQ ID NO: 235066 - DNA, 25 bp, Homo sapien
atttcgttttccagaaaggcacctg

SEQ ID NO: 235067 - DNA, 25 bp, Homo sapien
agaaaggcacctgactccttgcttt

SEQ ID NO: 235068 - DNA, 25 bp, Homo sapien
gactccttgctttgcacataacagg

SEQ ID NO: 235069 - DNA, 25 bp, Homo sapien
caattcctaaggttgagctcaatgc

SEQ ID NO: 235070 - DNA, 25 bp, Homo sapien
gaatgcagtgtatcctaaaaccaga

SEQ ID NO: 235071 - DNA, 25 bp, Homo sapien
accagatttccaggttgccccagta

SEQ ID NO: 235072 - DNA, 25 bp, Homo sapien
agtactctgtacaggcctccatttt

SEQ ID NO: 235073 - DNA, 25 bp, Homo sapien
aggcctccattttggctgttaacac

SEQ ID NO: 235074 - DNA, 25 bp, Homo sapien
aacacagtgtatcttttgttacatt

SEQ ID NO: 235075 - DNA, 25 bp, Homo sapien
gctcaatgcatcacatgtagtagat

SEQ ID NO: 235076 - DNA, 25 bp, Homo sapien
gacagtgccgtgtttatttcgtttt

SEQ ID NO: 235077 - DNA, 25 bp, Homo sapien
ttcttctcatcaatacctgttccac

SEQ ID NO: 235078 - DNA, 25 bp, Homo sapien
ttctcatcaatacctgttccactga

SEQ ID NO: 235079 - DNA, 25 bp, Homo sapien
tcatcaatacctgttccactgagct

SEQ ID NO: 235080 - DNA, 25 bp, Homo sapien
aatacctgttccactgagctcctgt

SEQ ID NO: 235081 - DNA, 25 bp, Homo sapien
tgttccactgagctcctgttgctta

SEQ ID NO: 235082 - DNA, 25 bp, Homo sapien
tgagctcctgttgcttaccatcaag

SEQ ID NO: 235083 - DNA, 25 bp, Homo sapien
gctcctgttgcttaccatcaagtca

SEQ ID NO: 235084 - DNA, 25 bp, Homo sapien
aagtcaacagttatcagcactcaga

SEQ ID NO: 235085 - DNA, 25 bp, Homo sapien
agttatcagcactcagacatgcgaa

SEQ ID NO: 235086 - DNA, 25 bp, Homo sapien
acatgcgaatgtcctttttagttcc

SEQ ID NO: 235087 - DNA, 25 bp, Homo sapien
tgcgaatgtcctttttagttcccgt

SEQ ID NO: 235088 - DNA, 25 bp, Homo sapien
ctctgtattgttccccacctcttaa

SEQ ID NO: 235089 - DNA, 25 bp, Homo sapien
tgtattgttccccacctcttaacac

SEQ ID NO: 235090 - DNA, 25 bp, Homo sapien
ttgttccccacctcttaacacagtg

SEQ ID NO: 235091 - DNA, 25 bp, Homo sapien
agagcatggaagatggctgtttcat

SEQ ID NO: 235092 - DNA, 25 bp, Homo sapien
gaagatggctgtttcatgtgagaca

SEQ ID NO: 235093 - DNA, 25 bp, Homo sapien
tggctgtttcatgtgagacaggaat

SEQ ID NO: 235094 - DNA, 25 bp, Homo sapien
gagtgagaatccctgtaagtaaaat

SEQ ID NO: 235095 - DNA, 25 bp, Homo sapien
gagaatccctgtaagtaaaatgtga

SEQ ID NO: 235096 - DNA, 25 bp, Homo sapien
caacccaaagtctgaatttcttgag

SEQ ID NO: 235097 - DNA, 25 bp, Homo sapien
tttcttgaggaaaaggtcaatgtct

SEQ ID NO: 235098 - DNA, 25 bp, Homo sapien
ggtcaatgtcttttcatctctgtat

SEQ ID NO: 235099 - DNA, 25 bp, Homo sapien
tggacagatgccttacaaatgtaag

SEQ ID NO: 235100 - DNA, 25 bp, Homo sapien
gcaaggtcttcactctgtggtcatt

SEQ ID NO: 235101 - DNA, 25 bp, Homo sapien
caaggtcttcactctgtggtcattc

SEQ ID NO: 235102 - DNA, 25 bp, Homo sapien
aaggtcttcactctgtggtcattcc

SEQ ID NO: 235103 - DNA, 25 bp, Homo sapien
aggtcttcactctgtggtcattcca

SEQ ID NO: 235104 - DNA, 25 bp, Homo sapien
ggtcttcactctgtggtcattccat

SEQ ID NO: 235105 - DNA, 25 bp, Homo sapien
gtcttcactctgtggtcattccatg

SEQ ID NO: 235106 - DNA, 25 bp, Homo sapien
ctctgtggtcattccatgcagaaca

SEQ ID NO: 235107 - DNA, 25 bp, Homo sapien
gagttgattcaacattgacttgagt

SEQ ID NO: 235108 - DNA, 25 bp, Homo sapien
gttgattcaacattgacttgagttt

SEQ ID NO: 235109 - DNA, 25 bp, Homo sapien
gttcacgcattaattgacataaaaa

SEQ ID NO: 235110 - DNA, 25 bp, Homo sapien
ggattcagtgacatacagagacaac

SEQ ID NO: 235111 - DNA, 25 bp, Homo sapien
cagagacaacaggtacaggatcagt

SEQ ID NO: 235112 - DNA, 25 bp, Homo sapien
acaggatcagtatgggttttaattg

SEQ ID NO: 235113 - DNA, 25 bp, Homo sapien
aaatgacagacttgacacatccacc

SEQ ID NO: 235114 - DNA, 25 bp, Homo sapien
atggatgctgtcctccactgttgca

SEQ ID NO: 235115 - DNA, 25 bp, Homo sapien
tccactgttgcacaatgtccttcag

SEQ ID NO: 235116 - DNA, 25 bp, Homo sapien
gcacaatgtccttcagtgtctaatt

SEQ ID NO: 235117 - DNA, 25 bp, Homo sapien
gtctaatttacagatccagctgtat

SEQ ID NO: 235118 - DNA, 25 bp, Homo sapien
ctgaaaacttcacctgacccaagaa

SEQ ID NO: 235119 - DNA, 25 bp, Homo sapien
agctcatggtctggttcactgttta

SEQ ID NO: 235120 - DNA, 25 bp, Homo sapien
ggtctggttcactgtttaacagcca

SEQ ID NO: 235121 - DNA, 25 bp, Homo sapien
ggcagtcgtccatctgggcccagat

SEQ ID NO: 235122 - DNA, 25 bp, Homo sapien
tccatctgggcccagatccctgagt

SEQ ID NO: 235123 - DNA, 25 bp, Homo sapien
ggggacccaggcttttgctgtgccc

SEQ ID NO: 235124 - DNA, 25 bp, Homo sapien
ttctgctgatctccagcatcctgat

SEQ ID NO: 235125 - DNA, 25 bp, Homo sapien
gatctccagcatcctgatggcgtac

SEQ ID NO: 235126 - DNA, 25 bp, Homo sapien
cagcatcctgatggcgtacactgtg

SEQ ID NO: 235127 - DNA, 25 bp, Homo sapien
atcctgatggcgtacactgtggctc

SEQ ID NO: 235128 - DNA, 25 bp, Homo sapien
atggcgtacactgtggctctggcta

SEQ ID NO: 235129 - DNA, 25 bp, Homo sapien
gtacactgtggctctggctaactcc

SEQ ID NO: 235130 - DNA, 25 bp, Homo sapien
tgtggctctggctaactcctacgga

SEQ ID NO: 235131 - DNA, 25 bp, Homo sapien
tggctaactcctacggacgcctcat

SEQ ID NO: 235132 - DNA, 25 bp, Homo sapien
acattagccaggagtactagcacct

SEQ ID NO: 235133 - DNA, 25 bp, Homo sapien
agccaggagtactagcacctgtggt

SEQ ID NO: 235134 - DNA, 25 bp, Homo sapien
agctactcaggggaccacagaggaa

SEQ ID NO: 235135 - DNA, 25 bp, Homo sapien
agaggaaagacaacttgagcccaag

SEQ ID NO: 235136 - DNA, 25 bp, Homo sapien
aggaaagacaacttgagcccaagag

SEQ ID NO: 235137 - DNA, 25 bp, Homo sapien
gccatgactgctccactgcactgaa

SEQ ID NO: 235138 - DNA, 25 bp, Homo sapien
catgactgctccactgcactgaagc

SEQ ID NO: 235139 - DNA, 25 bp, Homo sapien
gaaaaccaggcaccaattgccaaga

SEQ ID NO: 235140 - DNA, 25 bp, Homo sapien
aaaccaggcaccaattgccaagaga

SEQ ID NO: 235141 - DNA, 25 bp, Homo sapien
gccaagagaatcgtgttttatatat

SEQ ID NO: 235142 - DNA, 25 bp, Homo sapien
gagaatcgtgttttatatatactct

SEQ ID NO: 235143 - DNA, 25 bp, Homo sapien
agttccacacgggcccagtgctgcc

SEQ ID NO: 235144 - DNA, 25 bp, Homo sapien
aggttcggccttcctctcgcccctg

SEQ ID NO: 235145 - DNA, 25 bp, Homo sapien
ggttcggccttcctctcgcccctgt

SEQ ID NO: 235146 - DNA, 25 bp, Homo sapien
tctcgcccctgtgcacccggagatg

SEQ ID NO: 235147 - DNA, 25 bp, Homo sapien
ctcgcccctgtgcacccggagatgc

SEQ ID NO: 235148 - DNA, 25 bp, Homo sapien
tcgcccctgtgcacccggagatgcc

SEQ ID NO: 235149 - DNA, 25 bp, Homo sapien
cgcccctgtgcacccggagatgccc

SEQ ID NO: 235150 - DNA, 25 bp, Homo sapien
cctgtgcacccggagatgcccacag

SEQ ID NO: 235151 - DNA, 25 bp, Homo sapien
ctgtgcacccggagatgcccacagc

SEQ ID NO: 235152 - DNA, 25 bp, Homo sapien
agcaccagcacctgagctcacctcc

SEQ ID NO: 235153 - DNA, 25 bp, Homo sapien
gcaccagcacctgagctcacctccg

SEQ ID NO: 235154 - DNA, 25 bp, Homo sapien
ggcagtcgtccatctgggcccagat

SEQ ID NO: 235155 - DNA, 25 bp, Homo sapien
gggcccagatccctgagtctatttc

SEQ ID NO: 235156 - DNA, 25 bp, Homo sapien
agatccctgagtctatttccagcct

SEQ ID NO: 235157 - DNA, 25 bp, Homo sapien
gggacccaggcttttgctgtgcccc

SEQ ID NO: 235158 - DNA, 25 bp, Homo sapien
ttctgctgatctccagcatcctgat

SEQ ID NO: 235159 - DNA, 25 bp, Homo sapien
gatctccagcatcctgatggcgtac

SEQ ID NO: 235160 - DNA, 25 bp, Homo sapien
atcctgatggcgtacactgtggctc

SEQ ID NO: 235161 - DNA, 25 bp, Homo sapien
atggcgtacactgtggctctggcta

SEQ ID NO: 235162 - DNA, 25 bp, Homo sapien
gtacactgtggctctggctaactcc

SEQ ID NO: 235163 - DNA, 25 bp, Homo sapien
tgtggctctggctaactcctacgga

SEQ ID NO: 235164 - DNA, 25 bp, Homo sapien
tggctaactcctacggacgcctcat

SEQ ID NO: 235165 - DNA, 25 bp, Homo sapien
gtatatctcgcgatacacgtgttta

SEQ ID NO: 235166 - DNA, 25 bp, Homo sapien
acacgtgtttaaaatggcggcttca

SEQ ID NO: 235167 - DNA, 25 bp, Homo sapien
aaatggcggcttcaaggcgtttcac

SEQ ID NO: 235168 - DNA, 25 bp, Homo sapien
accagtctcgcgacactttccttgg

SEQ ID NO: 235169 - DNA, 25 bp, Homo sapien
tcaaggcgtttcacgggtgtcccgg

SEQ ID NO: 235170 - DNA, 25 bp, Homo sapien
cttgagttggccaggagtcggaaaa

SEQ ID NO: 235171 - DNA, 25 bp, Homo sapien
aaaacgattgcaggcgggaccgcgt

SEQ ID NO: 235172 - DNA, 25 bp, Homo sapien
ggaaacttagcgtggcagaccctaa

SEQ ID NO: 235173 - DNA, 25 bp, Homo sapien
gcgtggcagaccctaaactgggata

SEQ ID NO: 235174 - DNA, 25 bp, Homo sapien
actttccttggccatgggagacaca

SEQ ID NO: 235175 - DNA, 25 bp, Homo sapien
agaagagactctcgcaagaaagtaa

SEQ ID NO: 235176 - DNA, 25 bp, Homo sapien
agcaggaagagctacaagcactgaa

SEQ ID NO: 235177 - DNA, 25 bp, Homo sapien
aagcactgaagtgctgccgccagct

SEQ ID NO: 235178 - DNA, 25 bp, Homo sapien
ccgggtagagctgggatgccctcac

SEQ ID NO: 235179 - DNA, 25 bp, Homo sapien
ttcttctcatcaatacctgttccac

SEQ ID NO: 235180 - DNA, 25 bp, Homo sapien
tcatcaatacctgttccactgagct

SEQ ID NO: 235181 - DNA, 25 bp, Homo sapien
tgttccactgagctcctgttgctta

SEQ ID NO: 235182 - DNA, 25 bp, Homo sapien
tgagctcctgttgcttaccatcaag

SEQ ID NO: 235183 - DNA, 25 bp, Homo sapien
gctcctgttgcttaccatcaagtca

SEQ ID NO: 235184 - DNA, 25 bp, Homo sapien
aagtcaacagttatcagcactcaga

SEQ ID NO: 235185 - DNA, 25 bp, Homo sapien
agttatcagcactcagacatgcgaa

SEQ ID NO: 235186 - DNA, 25 bp, Homo sapien
atgcgaatgtcctttttagttcccg

SEQ ID NO: 235187 - DNA, 25 bp, Homo sapien
tagaccccaggagtagagaaaagca

SEQ ID NO: 235188 - DNA, 25 bp, Homo sapien
gaaaagcaactggactgactttctt

SEQ ID NO: 235189 - DNA, 25 bp, Homo sapien
agcaactggactgactttcttacca

SEQ ID NO: 235190 - DNA, 25 bp, Homo sapien
ggactgactttcttaccagcagtta

SEQ ID NO: 235191 - DNA, 25 bp, Homo sapien
taccagcagttacctagactgaggc

SEQ ID NO: 235192 - DNA, 25 bp, Homo sapien
ttacctagactgaggcaagctgtgt

SEQ ID NO: 235193 - DNA, 25 bp, Homo sapien
aggcaagctgtgtggactcacccaa

SEQ ID NO: 235194 - DNA, 25 bp, Homo sapien
gctgtgtggactcacccaagtatat

SEQ ID NO: 235195 - DNA, 25 bp, Homo sapien
gtggactcacccaagtatatttcag

SEQ ID NO: 235196 - DNA, 25 bp, Homo sapien
ggactcacccaagtatatttcagta

SEQ ID NO: 235197 - DNA, 25 bp, Homo sapien
cacccaagtatatttcagtactgtc

SEQ ID NO: 235198 - DNA, 25 bp, Homo sapien
gacccttggaggtgctgagattgaa

SEQ ID NO: 235199 - DNA, 25 bp, Homo sapien
aactagtgttcacgagagctcgcgg

SEQ ID NO: 235200 - DNA, 25 bp, Homo sapien
agctcgcggcggttggaaggctctc

SEQ ID NO: 235201 - DNA, 25 bp, Homo sapien
ggccgacaacactcaactgtgcaaa

SEQ ID NO: 235202 - DNA, 25 bp, Homo sapien
gctctcgcgagagcgtcttgagaat

SEQ ID NO: 235203 - DNA, 25 bp, Homo sapien
agagcgtcttgagaattctggccgg

SEQ ID NO: 235204 - DNA, 25 bp, Homo sapien
gctgagtgggtctaacctaggcgaa

SEQ ID NO: 235205 - DNA, 25 bp, Homo sapien
tgggtctaacctaggcgaagtggct

SEQ ID NO: 235206 - DNA, 25 bp, Homo sapien
tgcaaacccgttcctatcgacaaaa

SEQ ID NO: 235207 - DNA, 25 bp, Homo sapien
tatcgacaaaagttccggcccgcgg

SEQ ID NO: 235208 - DNA, 25 bp, Homo sapien
tgctgacccttggaggtgctgagat

SEQ ID NO: 235209 - DNA, 25 bp, Homo sapien
tgcacctattcccacgggacaggct

SEQ ID NO: 235210 - DNA, 25 bp, Homo sapien
acgggacaggctggacccagagact

SEQ ID NO: 235211 - DNA, 25 bp, Homo sapien
gggacaggctggacccagagactct

SEQ ID NO: 235212 - DNA, 25 bp, Homo sapien
ccttgagtagagacccgccctctga

SEQ ID NO: 235213 - DNA, 25 bp, Homo sapien
cttgagtagagacccgccctctgac

SEQ ID NO: 235214 - DNA, 25 bp, Homo sapien
acccgccctctgactgatggacgcc

SEQ ID NO: 235215 - DNA, 25 bp, Homo sapien
tgtgggaagtgggctccttcaccta

SEQ ID NO: 235216 - DNA, 25 bp, Homo sapien
tgatgcggttccaaagcacagggct

SEQ ID NO: 235217 - DNA, 25 bp, Homo sapien
aaagcacagggcttggcgcacccca

SEQ ID NO: 235218 - DNA, 25 bp, Homo sapien
agggcttggcgcaccccactgtgct

SEQ ID NO: 235219 - DNA, 25 bp, Homo sapien
gcgcaccccactgtgctctcaataa

SEQ ID NO: 235220 - DNA, 25 bp, Homo sapien
gtgtctgtcaaattatgctggctaa

SEQ ID NO: 235221 - DNA, 25 bp, Homo sapien
tatgctggctaatttcaatgagaaa

SEQ ID NO: 235222 - DNA, 25 bp, Homo sapien
gagtcacagtgaacccatccataaa

SEQ ID NO: 235223 - DNA, 25 bp, Homo sapien
aaaaggactaaaagctctctctggt

SEQ ID NO: 235224 - DNA, 25 bp, Homo sapien
ctaaaagctctctctggtccctgag

SEQ ID NO: 235225 - DNA, 25 bp, Homo sapien
tgagatccacaacccctgagagaag

SEQ ID NO: 235226 - DNA, 25 bp, Homo sapien
actacaaatgcatcgtctagacttt

SEQ ID NO: 235227 - DNA, 25 bp, Homo sapien
cacccatcgctaagtcaagcctaga

SEQ ID NO: 235228 - DNA, 25 bp, Homo sapien
gtcaagcctagactctaatattttt

SEQ ID NO: 235229 - DNA, 25 bp, Homo sapien
aagaatttacttccagacctggcct

SEQ ID NO: 235230 - DNA, 25 bp, Homo sapien
tagggtgtttttctgagtgtctgtc

SEQ ID NO: 235231 - DNA, 25 bp, Homo sapien
ggagatggatctattaggtctcatg

SEQ ID NO: 235232 - DNA, 25 bp, Homo sapien
aaaagccccaacaatgggcctgtca

SEQ ID NO: 235233 - DNA, 25 bp, Homo sapien
aatgggcctgtcaccttgctagtca

SEQ ID NO: 235234 - DNA, 25 bp, Homo sapien
accttgctagtcatccattcttaat

SEQ ID NO: 235235 - DNA, 25 bp, Homo sapien
tagtcatccattcttaatgcctatt

SEQ ID NO: 235236 - DNA, 25 bp, Homo sapien
aatgcctatttatcagccctctgag

SEQ ID NO: 235237 - DNA, 25 bp, Homo sapien
tatcagccctctgaggtcatataaa

SEQ ID NO: 235238 - DNA, 25 bp, Homo sapien
aagttgcaccttttgaaccaagtat

SEQ ID NO: 235239 - DNA, 25 bp, Homo sapien
gcaccttttgaaccaagtatttgta

SEQ ID NO: 235240 - DNA, 25 bp, Homo sapien
ttactatgggaaaggtgtggactac

SEQ ID NO: 235241 - DNA, 25 bp, Homo sapien
ggtgtggactacagattcgtattat

SEQ ID NO: 235242 - DNA, 25 bp, Homo sapien
tggaccactgagtgctgccctagag

SEQ ID NO: 235243 - DNA, 25 bp, Homo sapien
gccctagagggaaagtcggagccca

SEQ ID NO: 235244 - DNA, 25 bp, Homo sapien
ggtagcccctcatgtcgcacgctgg

SEQ ID NO: 235245 - DNA, 25 bp, Homo sapien
ctcgtcccacatacattccatatgg

SEQ ID NO: 235246 - DNA, 25 bp, Homo sapien
gacctagagccgcaggaaaacacag

SEQ ID NO: 235247 - DNA, 25 bp, Homo sapien
aggaaaacacagacccacacaggcc

SEQ ID NO: 235248 - DNA, 25 bp, Homo sapien
acaggcccggcttcactgtgaaaaa

SEQ ID NO: 235249 - DNA, 25 bp, Homo sapien
ggcccggcttcactgtgaaaaaaca

SEQ ID NO: 235250 - DNA, 25 bp, Homo sapien
atttcagccgtcacctagctggata

SEQ ID NO: 235251 - DNA, 25 bp, Homo sapien
gtcacctagctggataagcctggac

SEQ ID NO: 235252 - DNA, 25 bp, Homo sapien
ataagcctggaccactgagtgctgc

SEQ ID NO: 235253 - DNA, 25 bp, Homo sapien
gtttagacacgggtagggcctcttg

SEQ ID NO: 235254 - DNA, 25 bp, Homo sapien
gtagggcctcttggccccttggtgc

SEQ ID NO: 235255 - DNA, 25 bp, Homo sapien
gccattttttagctgttgagttaag

SEQ ID NO: 235256 - DNA, 25 bp, Homo sapien
gctgagccatctcctcctttggctg

SEQ ID NO: 235257 - DNA, 25 bp, Homo sapien
tcctttggctgggtgactcctttct

SEQ ID NO: 235258 - DNA, 25 bp, Homo sapien
ctgggtgactcctttctgctgcctt

SEQ ID NO: 235259 - DNA, 25 bp, Homo sapien
tgctgccttgacaactcctggagga

SEQ ID NO: 235260 - DNA, 25 bp, Homo sapien
ccttcttgaagtttacctgttgctg

SEQ ID NO: 235261 - DNA, 25 bp, Homo sapien
gaagtttacctgttgctgccacaag

SEQ ID NO: 235262 - DNA, 25 bp, Homo sapien
acctgttgctgccacaagttctgct

SEQ ID NO: 235263 - DNA, 25 bp, Homo sapien
ttctgactctttcaccaggcttagg

SEQ ID NO: 235264 - DNA, 25 bp, Homo sapien
ggctcatagtccgtcaccgaaaata

SEQ ID NO: 235265 - DNA, 25 bp, Homo sapien
gtccgtcaccgaaaatagaaaatgc

SEQ ID NO: 235266 - DNA, 25 bp, Homo sapien
aatgccatccataggtaaaatgctg

SEQ ID NO: 235267 - DNA, 25 bp, Homo sapien
atgaactctacttttatagcctagt

SEQ ID NO: 235268 - DNA, 25 bp, Homo sapien
gtaaaaatgctctacctgagtagtt

SEQ ID NO: 235269 - DNA, 25 bp, Homo sapien
aagcaattcatgaagcctgaagcta

SEQ ID NO: 235270 - DNA, 25 bp, Homo sapien
gaagcctgaagctaaagagcactct

SEQ ID NO: 235271 - DNA, 25 bp, Homo sapien
ggttttggcataatagctgcatttc

SEQ ID NO: 235272 - DNA, 25 bp, Homo sapien
aatagctgcatttccagacctgacc

SEQ ID NO: 235273 - DNA, 25 bp, Homo sapien
cagctgaccaaagaaagcccaagtt

SEQ ID NO: 235274 - DNA, 25 bp, Homo sapien
aagaaagcccaagttctccttctgt

SEQ ID NO: 235275 - DNA, 25 bp, Homo sapien
agccagtgtcctggtgtcttaacct

SEQ ID NO: 235276 - DNA, 25 bp, Homo sapien
ttaacctcagcttgtaggtgccatc

SEQ ID NO: 235277 - DNA, 25 bp, Homo sapien
catcctcagctctaagcatcagaca

SEQ ID NO: 235278 - DNA, 25 bp, Homo sapien
gcatcagacatgcatctcgtttctc

SEQ ID NO: 235279 - DNA, 25 bp, Homo sapien
gcatctcgtttctcctgaaggattt

SEQ ID NO: 235280 - DNA, 25 bp, Homo sapien
tgaaggatttcctccatccttgatg

SEQ ID NO: 235281 - DNA, 25 bp, Homo sapien
tccatccttgatgtgtgcttgtggg

SEQ ID NO: 235282 - DNA, 25 bp, Homo sapien
ggattttccacatgaaacttggctt

SEQ ID NO: 235283 - DNA, 25 bp, Homo sapien
ggctttcctagtaagcattgtcccc

SEQ ID NO: 235284 - DNA, 25 bp, Homo sapien
tacagagattacgaaggcttatgga

SEQ ID NO: 235285 - DNA, 25 bp, Homo sapien
gtaagttgccagacatcacacagcc

SEQ ID NO: 235286 - DNA, 25 bp, Homo sapien
atgagcaatgtacccctacagtcct

SEQ ID NO: 235287 - DNA, 25 bp, Homo sapien
agtcctccaggaagtcgtaatttga

SEQ ID NO: 235288 - DNA, 25 bp, Homo sapien
gacaaagaaacatagccaaggatac

SEQ ID NO: 235289 - DNA, 25 bp, Homo sapien
ggatacaattttaaggtcaccttga

SEQ ID NO: 235290 - DNA, 25 bp, Homo sapien
ggtcaccttgaatccttcctggaaa

SEQ ID NO: 235291 - DNA, 25 bp, Homo sapien
gtcatcactcattcagcaaactttg

SEQ ID NO: 235292 - DNA, 25 bp, Homo sapien
ttaaattcctagaagcatcttagaa

SEQ ID NO: 235293 - DNA, 25 bp, Homo sapien
cagcaaactttgactgatgtcgatt

SEQ ID NO: 235294 - DNA, 25 bp, Homo sapien
gactgatgtcgattatacaaggcac

SEQ ID NO: 235295 - DNA, 25 bp, Homo sapien
tacaaggcactattctaaaatctag

SEQ ID NO: 235296 - DNA, 25 bp, Homo sapien
ttcctggatgagcaatgtaccccta

SEQ ID NO: 235297 - DNA, 25 bp, Homo sapien
aataccaactttgtcatcattccaa

SEQ ID NO: 235298 - DNA, 25 bp, Homo sapien
attccaaatgccacccctatgaact

SEQ ID NO: 235299 - DNA, 25 bp, Homo sapien
tatgaactctgccaccatcagcact

SEQ ID NO: 235300 - DNA, 25 bp, Homo sapien
tcagcactatgaccccaggacagat

SEQ ID NO: 235301 - DNA, 25 bp, Homo sapien
ggacagatcacatacactgctactt

SEQ ID NO: 235302 - DNA, 25 bp, Homo sapien
atacactgctacttctaccaagagt

SEQ ID NO: 235303 - DNA, 25 bp, Homo sapien
aaacatactgccaacaccatcactg

SEQ ID NO: 235304 - DNA, 25 bp, Homo sapien
agagcagtaatgtggatctttccct

SEQ ID NO: 235305 - DNA, 25 bp, Homo sapien
tggatctttcccttaaaactccaag

SEQ ID NO: 235306 - DNA, 25 bp, Homo sapien
cttaaaactccaagttcctctctat

SEQ ID NO: 235307 - DNA, 25 bp, Homo sapien
gttcctctctatttttgctatctat

SEQ ID NO: 235308 - DNA, 25 bp, Homo sapien
tgggtccctacaaagcagggaaggg

SEQ ID NO: 235309 - DNA, 25 bp, Homo sapien
ccaagtacatggctgaagctgtcca

SEQ ID NO: 235310 - DNA, 25 bp, Homo sapien
caagtacatggctgaagctgtccag

SEQ ID NO: 235311 - DNA, 25 bp, Homo sapien
cagctctccaggagttccacacggg

SEQ ID NO: 235312 - DNA, 25 bp, Homo sapien
caggagttccacacgggcccagtgc

SEQ ID NO: 235313 - DNA, 25 bp, Homo sapien
tacatggctgaagctgtccagctgc

SEQ ID NO: 235314 - DNA, 25 bp, Homo sapien
atggctgaagctgtccagctgcaga

SEQ ID NO: 235315 - DNA, 25 bp, Homo sapien
aagctgtccagctgcagagagtggt

SEQ ID NO: 235316 - DNA, 25 bp, Homo sapien
gggcctgactggacatccatgccga

SEQ ID NO: 235317 - DNA, 25 bp, Homo sapien
ggcctgactggacatccatgccgaa

SEQ ID NO: 235318 - DNA, 25 bp, Homo sapien
gcctgactggacatccatgccgaat

SEQ ID NO: 235319 - DNA, 25 bp, Homo sapien
agaactttgtagaatcccaccagga

SEQ ID NO: 235320 - DNA, 25 bp, Homo sapien
gtagaatcccaccaggactttgcta

SEQ ID NO: 235321 - DNA, 25 bp, Homo sapien
tcccaccaggactttgctaacaata

SEQ ID NO: 235322 - DNA, 25 bp, Homo sapien
tatcagccaccaaaatagttatgtt

SEQ ID NO: 235323 - DNA, 25 bp, Homo sapien
agttatgttggcactgtgttcacac

SEQ ID NO: 235324 - DNA, 25 bp, Homo sapien
atgttggcactgtgttcacacgcat

SEQ ID NO: 235325 - DNA, 25 bp, Homo sapien
tttcatgttacatccatatctgtat

SEQ ID NO: 235326 - DNA, 25 bp, Homo sapien
atcttatttgtttcactttcaagtg

SEQ ID NO: 235327 - DNA, 25 bp, Homo sapien
tcactttcaagtgtatcatggcaaa

SEQ ID NO: 235328 - DNA, 25 bp, Homo sapien
gtgtatcatggcaaatgtacagatt

SEQ ID NO: 235329 - DNA, 25 bp, Homo sapien
tgttaataatgtgctaggatttgct

SEQ ID NO: 235330 - DNA, 25 bp, Homo sapien
ttcaggcggtcaaaagaaaatggct

SEQ ID NO: 235331 - DNA, 25 bp, Homo sapien
gaagaatatctcaattttgcggatt

SEQ ID NO: 235332 - DNA, 25 bp, Homo sapien
ctcaattttgcggattactttcaag

SEQ ID NO: 235333 - DNA, 25 bp, Homo sapien
tttgcggattactttcaagaagaga

SEQ ID NO: 235334 - DNA, 25 bp, Homo sapien
agaagagaagtttgagttgtaacac

SEQ ID NO: 235335 - DNA, 25 bp, Homo sapien
tatcatgtgacatgtttgtacattt

SEQ ID NO: 235336 - DNA, 25 bp, Homo sapien
gtttgtacattttatctatatcttc

SEQ ID NO: 235337 - DNA, 25 bp, Homo sapien
atatcttcatggcaaaatattttgt

SEQ ID NO: 235338 - DNA, 25 bp, Homo sapien
taattcctgtgaagtggcactctac

SEQ ID NO: 235339 - DNA, 25 bp, Homo sapien
gtgaagtggcactctacactctaat

SEQ ID NO: 235340 - DNA, 25 bp, Homo sapien
ggcactctacactctaattaaactt

SEQ ID NO: 235341 - DNA, 25 bp, Homo sapien
gagctgcaagagttggtgttgcccc

SEQ ID NO: 235342 - DNA, 25 bp, Homo sapien
agctgcaagagttggtgttgcccct

SEQ ID NO: 235343 - DNA, 25 bp, Homo sapien
gctgcaagagttggtgttgcccctt

SEQ ID NO: 235344 - DNA, 25 bp, Homo sapien
tgcaagagttggtgttgccccttgt

SEQ ID NO: 235345 - DNA, 25 bp, Homo sapien
gcaagagttggtgttgccccttgtg

SEQ ID NO: 235346 - DNA, 25 bp, Homo sapien
caagagttggtgttgccccttgtgg

SEQ ID NO: 235347 - DNA, 25 bp, Homo sapien
tgttgccccttgtgggcaaccatga

SEQ ID NO: 235348 - DNA, 25 bp, Homo sapien
gttgccccttgtgggcaaccatgag

SEQ ID NO: 235349 - DNA, 25 bp, Homo sapien
gcatggcaaattcctcatcgctgcc

SEQ ID NO: 235350 - DNA, 25 bp, Homo sapien
ggcaaattcctcatcgctgcccaga

SEQ ID NO: 235351 - DNA, 25 bp, Homo sapien
gttttttatgaagtgagcctggaca

SEQ ID NO: 235352 - DNA, 25 bp, Homo sapien
ccgacatcattcagtgtgtttaggg

SEQ ID NO: 235353 - DNA, 25 bp, Homo sapien
caggaggtgttgttcagccgtggaa

SEQ ID NO: 235354 - DNA, 25 bp, Homo sapien
tcagccgtggaatttgctggtggca

SEQ ID NO: 235355 - DNA, 25 bp, Homo sapien
ctggtggcagcagtgtaacctgtgt

SEQ ID NO: 235356 - DNA, 25 bp, Homo sapien
gtgtaacctgtgtatttgagggtac

SEQ ID NO: 235357 - DNA, 25 bp, Homo sapien
tggagtggctggtccacaagctgtg

SEQ ID NO: 235358 - DNA, 25 bp, Homo sapien
gggaagctgtttgcaggactgccct

SEQ ID NO: 235359 - DNA, 25 bp, Homo sapien
aagctgtttgcaggactgccctgcc

SEQ ID NO: 235360 - DNA, 25 bp, Homo sapien
cttgagttaaaagcgggtgcctgca

SEQ ID NO: 235361 - DNA, 25 bp, Homo sapien
aaagcgggtgcctgcaaccctcaaa

SEQ ID NO: 235362 - DNA, 25 bp, Homo sapien
caaactccgacatcattcagtgtgt

SEQ ID NO: 235363 - DNA, 25 bp, Homo sapien
gaggccaagcgatttctgcgggaaa

SEQ ID NO: 235364 - DNA, 25 bp, Homo sapien
aaactctgaagatgtccaatgctga

SEQ ID NO: 235365 - DNA, 25 bp, Homo sapien
aatgctgaggacctgaaccggctca

SEQ ID NO: 235366 - DNA, 25 bp, Homo sapien
gtgcttctgggccacatcttctatg

SEQ ID NO: 235367 - DNA, 25 bp, Homo sapien
acatcttctatgtgctgggaaacca

SEQ ID NO: 235368 - DNA, 25 bp, Homo sapien
atggtggtgcctgccatgcagctcg

SEQ ID NO: 235369 - DNA, 25 bp, Homo sapien
agcaagatcccggacatgtcggtac

SEQ ID NO: 235370 - DNA, 25 bp, Homo sapien
acatgtcggtacagctgtggtcgtc

SEQ ID NO: 235371 - DNA, 25 bp, Homo sapien
gtcagcactgctgagagacctgaat

SEQ ID NO: 235372 - DNA, 25 bp, Homo sapien
atgtgcgtgggctcttctccttctt

SEQ ID NO: 235373 - DNA, 25 bp, Homo sapien
ttcttccagggacgctacaacgagg

SEQ ID NO: 235374 - DNA, 25 bp, Homo sapien
gcaggcacatacaagatgccagaat

SEQ ID NO: 235375 - DNA, 25 bp, Homo sapien
gatgccagaatcagtcaaaactaag

SEQ ID NO: 235376 - DNA, 25 bp, Homo sapien
aaactaagctcactgtccttgctaa

SEQ ID NO: 235377 - DNA, 25 bp, Homo sapien
tccttgctaatattctgccccagag

SEQ ID NO: 235378 - DNA, 25 bp, Homo sapien
attctgccccagagaagaactgaag

SEQ ID NO: 235379 - DNA, 25 bp, Homo sapien
gaagaactgaagctcagctcttcac

SEQ ID NO: 235380 - DNA, 25 bp, Homo sapien
gctcagctcttcaccctacagaaag

SEQ ID NO: 235381 - DNA, 25 bp, Homo sapien
agcaggtcacagattagggacttga

SEQ ID NO: 235382 - DNA, 25 bp, Homo sapien
ttgagattgacagtttggcttccct

SEQ ID NO: 235383 - DNA, 25 bp, Homo sapien
tggcttccctgttctgggtggcaaa

SEQ ID NO: 235384 - DNA, 25 bp, Homo sapien
ccctgttctgggtggcaaagcctgt

SEQ ID NO: 235385 - DNA, 25 bp, Homo sapien
gctaccttttgtatgctaatatgca

SEQ ID NO: 235386 - DNA, 25 bp, Homo sapien
gatggtttatttttagctctacact

SEQ ID NO: 235387 - DNA, 25 bp, Homo sapien
accataggtggttgagtgggaactt

SEQ ID NO: 235388 - DNA, 25 bp, Homo sapien
aagcattccaggtttcaatccttgt

SEQ ID NO: 235389 - DNA, 25 bp, Homo sapien
tgttttttgtcctgctcccaaattc

SEQ ID NO: 235390 - DNA, 25 bp, Homo sapien
aaacccatagttcttgtgtcttatt

SEQ ID NO: 235391 - DNA, 25 bp, Homo sapien
tatttgattcttctgctgtgcacat

SEQ ID NO: 235392 - DNA, 25 bp, Homo sapien
tgctgtgcacattgtattggtcctt

SEQ ID NO: 235393 - DNA, 25 bp, Homo sapien
cacattgtattggtccttgttgcat

SEQ ID NO: 235394 - DNA, 25 bp, Homo sapien
tccttgttgcatgtagtctactgtg

SEQ ID NO: 235395 - DNA, 25 bp, Homo sapien
gtctactgtgtgttttccgatttta

SEQ ID NO: 235396 - DNA, 25 bp, Homo sapien
ctgcacacctgggtgcctttctgag

SEQ ID NO: 235397 - DNA, 25 bp, Homo sapien
taggctcacacctcagctcacagtt

SEQ ID NO: 235398 - DNA, 25 bp, Homo sapien
tcacagttgcgtccttgcaggagga

SEQ ID NO: 235399 - DNA, 25 bp, Homo sapien
ggacactgggtgtctgacaaacaca

SEQ ID NO: 235400 - DNA, 25 bp, Homo sapien
aaacacaaggcctcgacagcaggtc

SEQ ID NO: 235401 - DNA, 25 bp, Homo sapien
aaggcctcgacagcaggtctggaac

SEQ ID NO: 235402 - DNA, 25 bp, Homo sapien
ggtctggaactttcaaccccagcag

SEQ ID NO: 235403 - DNA, 25 bp, Homo sapien
gtaagtaatttctggtcccactaca

SEQ ID NO: 235404 - DNA, 25 bp, Homo sapien
tctggtcccactacaaaactttatt

SEQ ID NO: 235405 - DNA, 25 bp, Homo sapien
atttttgattagagtaccattctca

SEQ ID NO: 235406 - DNA, 25 bp, Homo sapien
accattctcaatctcttctacaaaa

SEQ ID NO: 235407 - DNA, 25 bp, Homo sapien
gaatcggcggattgtctgaatgaca

SEQ ID NO: 235408 - DNA, 25 bp, Homo sapien
acggatttctgcacactctgggtct

SEQ ID NO: 235409 - DNA, 25 bp, Homo sapien
actctgggtctgtgctggtggaaca

SEQ ID NO: 235410 - DNA, 25 bp, Homo sapien
aatacatgcttggtcttctctgcag

SEQ ID NO: 235411 - DNA, 25 bp, Homo sapien
gaactgaggctaaactctgtcccta

SEQ ID NO: 235412 - DNA, 25 bp, Homo sapien
aactctgtccctacttctggttttg

SEQ ID NO: 235413 - DNA, 25 bp, Homo sapien
ctggttttgccctgtcatgtcgtaa

SEQ ID NO: 235414 - DNA, 25 bp, Homo sapien
catgtcgtaacgaggtgggcctttt

SEQ ID NO: 235415 - DNA, 25 bp, Homo sapien
ccttttgaggccattttagtttgag

SEQ ID NO: 235416 - DNA, 25 bp, Homo sapien
tagtttgagttcgagccaaccacct

SEQ ID NO: 235417 - DNA, 25 bp, Homo sapien
agccaaccacctctgttggttagat

SEQ ID NO: 235418 - DNA, 25 bp, Homo sapien
aattcttattggacttgacatgaat

SEQ ID NO: 235419 - DNA, 25 bp, Homo sapien
attcttattggacttgacatgaata

SEQ ID NO: 235420 - DNA, 25 bp, Homo sapien
ttcttattggacttgacatgaataa

SEQ ID NO: 235421 - DNA, 25 bp, Homo sapien
ttattggacttgacatgaataagaa

SEQ ID NO: 235422 - DNA, 25 bp, Homo sapien
attggacttgacatgaataagaaat

SEQ ID NO: 235423 - DNA, 25 bp, Homo sapien
ggacccaaattggccttatagggag

SEQ ID NO: 235424 - DNA, 25 bp, Homo sapien
gacccaaattggccttatagggagt

SEQ ID NO: 235425 - DNA, 25 bp, Homo sapien
ccaaattggccttatagggagtcgt

SEQ ID NO: 235426 - DNA, 25 bp, Homo sapien
caaattggccttatagggagtcgtt

SEQ ID NO: 235427 - DNA, 25 bp, Homo sapien
tcgttttacatttaatgggccgtcg

SEQ ID NO: 235428 - DNA, 25 bp, Homo sapien
gttaccaaattaaatcgctttgaag

SEQ ID NO: 235429 - DNA, 25 bp, Homo sapien
aactattccactttctaatgttaca

SEQ ID NO: 235430 - DNA, 25 bp, Homo sapien
ggattgatgaactatctgcagacat

SEQ ID NO: 235431 - DNA, 25 bp, Homo sapien
gcagacattgaagaccagctgattc

SEQ ID NO: 235432 - DNA, 25 bp, Homo sapien
gagagtcaaagtggtttgcccttca

SEQ ID NO: 235433 - DNA, 25 bp, Homo sapien
agtggtttgcccttcagatagatga

SEQ ID NO: 235434 - DNA, 25 bp, Homo sapien
tgcccttcagatagatgagtcatca

SEQ ID NO: 235435 - DNA, 25 bp, Homo sapien
gaaatctcaaatatcacacttcttt

SEQ ID NO: 235436 - DNA, 25 bp, Homo sapien
acttcttttgtgctatattcgtttc

SEQ ID NO: 235437 - DNA, 25 bp, Homo sapien
gtgctatattcgtttcattgattat

SEQ ID NO: 235438 - DNA, 25 bp, Homo sapien
atgcctactcaaataactggctttg

SEQ ID NO: 235439 - DNA, 25 bp, Homo sapien
aactggctttgaaatatttgaacta

SEQ ID NO: 235440 - DNA, 25 bp, Homo sapien
gaagatcatgatcggcatcggaagc

SEQ ID NO: 235441 - DNA, 25 bp, Homo sapien
aaagccaccaccatggagtcttgtc

SEQ ID NO: 235442 - DNA, 25 bp, Homo sapien
atggagtcttgtccatctctccagt

SEQ ID NO: 235443 - DNA, 25 bp, Homo sapien
gatcggcatcggaagcagcttactg

SEQ ID NO: 235444 - DNA, 25 bp, Homo sapien
aaggttgtagaatgcatgccagttc

SEQ ID NO: 235445 - DNA, 25 bp, Homo sapien
aatgcatgccagttctgattccctg

SEQ ID NO: 235446 - DNA, 25 bp, Homo sapien
gaagcagcttactggttgccgcgat

SEQ ID NO: 235447 - DNA, 25 bp, Homo sapien
tggttgccgcgatggtgctcctaag

SEQ ID NO: 235448 - DNA, 25 bp, Homo sapien
gatggtgctcctaagtgttgtgttc

SEQ ID NO: 235449 - DNA, 25 bp, Homo sapien
gctcctaagtgttgtgttctgtctt

SEQ ID NO: 235450 - DNA, 25 bp, Homo sapien
gtagctaaggcactaaaagctgcaa

SEQ ID NO: 235451 - DNA, 25 bp, Homo sapien
ctctcttgggaaagctgatgagcaa

SEQ ID NO: 235452 - DNA, 25 bp, Homo sapien
gagcaaattatccaagactcatttc

SEQ ID NO: 235453 - DNA, 25 bp, Homo sapien
actcatttctttattaggcaaagtc

SEQ ID NO: 235454 - DNA, 25 bp, Homo sapien
ggcaaagtcagaatatttcccctct

SEQ ID NO: 235455 - DNA, 25 bp, Homo sapien
ctgaattatgccctcattctttttc

SEQ ID NO: 235456 - DNA, 25 bp, Homo sapien
acacttgattgtctgattatttggc

SEQ ID NO: 235457 - DNA, 25 bp, Homo sapien
gattgtctgattatttggcatgtat

SEQ ID NO: 235458 - DNA, 25 bp, Homo sapien
aaaattatcatgtggcttaatgtgc

SEQ ID NO: 235459 - DNA, 25 bp, Homo sapien
gacctgaaacctttacagttggatg

SEQ ID NO: 235460 - DNA, 25 bp, Homo sapien
tacagttggatgtagcgttgagctt

SEQ ID NO: 235461 - DNA, 25 bp, Homo sapien
agcgttgagcttttgcatgttttct

SEQ ID NO: 235462 - DNA, 25 bp, Homo sapien
ggcacagaaaacttgagtaccttat

SEQ ID NO: 235463 - DNA, 25 bp, Homo sapien
tgcattaggattaaaaggttagccc

SEQ ID NO: 235464 - DNA, 25 bp, Homo sapien
aaggttagcccctatatccaagtat

SEQ ID NO: 235465 - DNA, 25 bp, Homo sapien
gttagcccctatatccaagtattgg

SEQ ID NO: 235466 - DNA, 25 bp, Homo sapien
atccaagtattggtctgagatccca

SEQ ID NO: 235467 - DNA, 25 bp, Homo sapien
caagtattggtctgagatcccattt

SEQ ID NO: 235468 - DNA, 25 bp, Homo sapien
gatcccatttctagaattctgaaat

SEQ ID NO: 235469 - DNA, 25 bp, Homo sapien
tttccaaatgtattcattgtggtaa

SEQ ID NO: 235470 - DNA, 25 bp, Homo sapien
aatacattcatgctaccatcactag

SEQ ID NO: 235471 - DNA, 25 bp, Homo sapien
tcatgctaccatcactagcatccat

SEQ ID NO: 235472 - DNA, 25 bp, Homo sapien
atcactagcatccatctctggaact

SEQ ID NO: 235473 - DNA, 25 bp, Homo sapien
aactgtttatttatgtgatgctgcc

SEQ ID NO: 235474 - DNA, 25 bp, Homo sapien
ttatgtgatgctgccttttcagctt

SEQ ID NO: 235475 - DNA, 25 bp, Homo sapien
gccttttcagctttgactgagtcaa

SEQ ID NO: 235476 - DNA, 25 bp, Homo sapien
tctggccctgccctaagacttgcag

SEQ ID NO: 235477 - DNA, 25 bp, Homo sapien
tgccctaagacttgcagtcacatct

SEQ ID NO: 235478 - DNA, 25 bp, Homo sapien
gcagtcacatctttaattccaagga

SEQ ID NO: 235479 - DNA, 25 bp, Homo sapien
gagtagcaatatgcacattgcttaa

SEQ ID NO: 235480 - DNA, 25 bp, Homo sapien
gcacattgcttaacagtgaagtcaa

SEQ ID NO: 235481 - DNA, 25 bp, Homo sapien
gtgaagtcaataatcctgtgttaag

SEQ ID NO: 235482 - DNA, 25 bp, Homo sapien
aataatcctgtgttaagttttgtat

SEQ ID NO: 235483 - DNA, 25 bp, Homo sapien
tcctaatgtggatttgtgttttcag

SEQ ID NO: 235484 - DNA, 25 bp, Homo sapien
tggcgcacctctgcaaggatttgga

SEQ ID NO: 235485 - DNA, 25 bp, Homo sapien
tgtgcaggcccgtggtgtctgaaac

SEQ ID NO: 235486 - DNA, 25 bp, Homo sapien
aggcccgtggtgtctgaaacccatc

SEQ ID NO: 235487 - DNA, 25 bp, Homo sapien
attcaatgtctttggctacctctag

SEQ ID NO: 235488 - DNA, 25 bp, Homo sapien
ttggctacctctagccacgcggaga

SEQ ID NO: 235489 - DNA, 25 bp, Homo sapien
tctagccacgcggagagggcctcag

SEQ ID NO: 235490 - DNA, 25 bp, Homo sapien
cacctctggcctgcaggagtgtcga

SEQ ID NO: 235491 - DNA, 25 bp, Homo sapien
cctgcaggagtgtcgaggtccccga

SEQ ID NO: 235492 - DNA, 25 bp, Homo sapien
cgaggcgctctcctgtgaggaggtg

SEQ ID NO: 235493 - DNA, 25 bp, Homo sapien
agtgtggcctcttccgtttgtgtgc

SEQ ID NO: 235494 - DNA, 25 bp, Homo sapien
ctcttccgtttgtgtgcgcatggga

SEQ ID NO: 235495 - DNA, 25 bp, Homo sapien
ccttccatgtatttatcttgaagag

SEQ ID NO: 235496 - DNA, 25 bp, Homo sapien
gagaaggtgctcactaacagaggta

SEQ ID NO: 235497 - DNA, 25 bp, Homo sapien
ggtgctcactaacagaggtacatta

SEQ ID NO: 235498 - DNA, 25 bp, Homo sapien
gaggtacattactgcaatgttctct

SEQ ID NO: 235499 - DNA, 25 bp, Homo sapien
cattactgcaatgttctcttaacag

SEQ ID NO: 235500 - DNA, 25 bp, Homo sapien
tgcaatgttctcttaacagttaaac

SEQ ID NO: 235501 - DNA, 25 bp, Homo sapien
gttctcttaacagttaaacaagctg

SEQ ID NO: 235502 - DNA, 25 bp, Homo sapien
caagctgtttacagtttaaactgct

SEQ ID NO: 235503 - DNA, 25 bp, Homo sapien
taagaaaaatgcactgatttctgca

SEQ ID NO: 235504 - DNA, 25 bp, Homo sapien
tttctgcattatgtgtacagtattg

SEQ ID NO: 235505 - DNA, 25 bp, Homo sapien
gtgtacagtattggacaaaggattt

SEQ ID NO: 235506 - DNA, 25 bp, Homo sapien
gcacactgtgtgaagactggctggc

SEQ ID NO: 235507 - DNA, 25 bp, Homo sapien
gtctattctgtcctatgtgtcttga

SEQ ID NO: 235508 - DNA, 25 bp, Homo sapien
gtgcactgctgttgggctttttcca

SEQ ID NO: 235509 - DNA, 25 bp, Homo sapien
caggtggcccgggaactcaagatga

SEQ ID NO: 235510 - DNA, 25 bp, Homo sapien
agatgaggacctcccaagtctatga

SEQ ID NO: 235511 - DNA, 25 bp, Homo sapien
aagtctatgaaatctgtgcagtccc

SEQ ID NO: 235512 - DNA, 25 bp, Homo sapien
taaggacaccctggtttgacagcaa

SEQ ID NO: 235513 - DNA, 25 bp, Homo sapien
ttgacagcaagataactcctcctcc

SEQ ID NO: 235514 - DNA, 25 bp, Homo sapien
atggagagtgtctttgttggccgtt

SEQ ID NO: 235515 - DNA, 25 bp, Homo sapien
tgttggccgttgttacctgggtcca

SEQ ID NO: 235516 - DNA, 25 bp, Homo sapien
gggtccacctttgcactgagaattg

SEQ ID NO: 235517 - DNA, 25 bp, Homo sapien
aagacaggtgctccggaagcagcat

SEQ ID NO: 235518 - DNA, 25 bp, Homo sapien
tccggaagcagcatcagggctcttg

SEQ ID NO: 235519 - DNA, 25 bp, Homo sapien
gctgggtgcagcctccaaacagaga

SEQ ID NO: 235520 - DNA, 25 bp, Homo sapien
tgcagcctccaaacagagaacggaa

SEQ ID NO: 235521 - DNA, 25 bp, Homo sapien
aacggaacttaggtgtgtctctaca

SEQ ID NO: 235522 - DNA, 25 bp, Homo sapien
agcccagaacaaacacccttcagag

SEQ ID NO: 235523 - DNA, 25 bp, Homo sapien
cagagcctaaccaaagaacataagc

SEQ ID NO: 235524 - DNA, 25 bp, Homo sapien
gctgcaaaatgtgcacccatatttt

SEQ ID NO: 235525 - DNA, 25 bp, Homo sapien
catattttaagctgctttttcaggg

SEQ ID NO: 235526 - DNA, 25 bp, Homo sapien
gaaatggatgttctcaggttgtatt

SEQ ID NO: 235527 - DNA, 25 bp, Homo sapien
tctcaggttgtatttatttcggaca

SEQ ID NO: 235528 - DNA, 25 bp, Homo sapien
gtcatactactacaacagcttcttc

SEQ ID NO: 235529 - DNA, 25 bp, Homo sapien
tctctctgatccttcatctatgctg

SEQ ID NO: 235530 - DNA, 25 bp, Homo sapien
atctatgctgctgtcacatgggcct

SEQ ID NO: 235531 - DNA, 25 bp, Homo sapien
gggccttccggtgatcttatctgaa

SEQ ID NO: 235532 - DNA, 25 bp, Homo sapien
agaacacacttttgcagacttcttt

SEQ ID NO: 235533 - DNA, 25 bp, Homo sapien
tttgcagacttcttttcctggctct

SEQ ID NO: 235534 - DNA, 25 bp, Homo sapien
tggtaaccagctacatgtcttccac

SEQ ID NO: 235535 - DNA, 25 bp, Homo sapien
tgaagcctcctgagttcatcagtac

SEQ ID NO: 235536 - DNA, 25 bp, Homo sapien
gtcctgatgatgttgttgagctgct

SEQ ID NO: 235537 - DNA, 25 bp, Homo sapien
gagctgctgaatcaaccatccctaa

SEQ ID NO: 235538 - DNA, 25 bp, Homo sapien
atgctcccaagacttcttgtcatac

SEQ ID NO: 235539 - DNA, 25 bp, Homo sapien
atggtccagagaacttctacaattt

SEQ ID NO: 235540 - DNA, 25 bp, Homo sapien
acttctacaatttattcctccacac

SEQ ID NO: 235541 - DNA, 25 bp, Homo sapien
tttattcctccacacttggagtctt

SEQ ID NO: 235542 - DNA, 25 bp, Homo sapien
acacttggagtcttcatgtctcgta

SEQ ID NO: 235543 - DNA, 25 bp, Homo sapien
ggagtcttcatgtctcgtaaagttt

SEQ ID NO: 235544 - DNA, 25 bp, Homo sapien
tgtctcgtaaagtttctccacatta

SEQ ID NO: 235545 - DNA, 25 bp, Homo sapien
agtcatcacaacatactccatcatc

SEQ ID NO: 235546 - DNA, 25 bp, Homo sapien
actccatcatcccaggacactgaaa

SEQ ID NO: 235547 - DNA, 25 bp, Homo sapien
tcatcccaggacactgaaactggaa

SEQ ID NO: 235548 - DNA, 25 bp, Homo sapien
gaaatagcttcaatctgtttaataa

SEQ ID NO: 235549 - DNA, 25 bp, Homo sapien
caatctgtttaataaagacgtgcga

SEQ ID NO: 235550 - DNA, 25 bp, Homo sapien
gacttccccttacgccctgcgtgta

SEQ ID NO: 235551 - DNA, 25 bp, Homo sapien
tgcgtgtacccctccccagtttagg

SEQ ID NO: 235552 - DNA, 25 bp, Homo sapien
tgcctggaaccctgcctcatctgtt

SEQ ID NO: 235553 - DNA, 25 bp, Homo sapien
tgagggtcacccttccaccctggtg

SEQ ID NO: 235554 - DNA, 25 bp, Homo sapien
ggtcccttttgctgggctggactgt

SEQ ID NO: 235555 - DNA, 25 bp, Homo sapien
gctgggctggactgtacatatgtta

SEQ ID NO: 235556 - DNA, 25 bp, Homo sapien
tgggctggactgtacatatgttaat

SEQ ID NO: 235557 - DNA, 25 bp, Homo sapien
catatgttaatagcgcaaacccgac

SEQ ID NO: 235558 - DNA, 25 bp, Homo sapien
tgttaatagcgcaaacccgacgcca

SEQ ID NO: 235559 - DNA, 25 bp, Homo sapien
taatagcgcaaacccgacgccacat

SEQ ID NO: 235560 - DNA, 25 bp, Homo sapien
gcgcaaacccgacgccacattttta

SEQ ID NO: 235561 - DNA, 25 bp, Homo sapien
agtgaccttcgggaggatgccatcg

SEQ ID NO: 235562 - DNA, 25 bp, Homo sapien
gaccttcgggaggatgccatcgctc

SEQ ID NO: 235563 - DNA, 25 bp, Homo sapien
aggatgccatcgctcctgggatctc

SEQ ID NO: 235564 - DNA, 25 bp, Homo sapien
atcgctcctgggatctctgagcaca

SEQ ID NO: 235565 - DNA, 25 bp, Homo sapien
ggatctctgagcacacttgtatgag

SEQ ID NO: 235566 - DNA, 25 bp, Homo sapien
gcacacttgtatgagggctgattct

SEQ ID NO: 235567 - DNA, 25 bp, Homo sapien
tgtatgagggctgattctagcaagg

SEQ ID NO: 235568 - DNA, 25 bp, Homo sapien
tggaaagaccctcgtctgccagcac

SEQ ID NO: 235569 - DNA, 25 bp, Homo sapien
caagtccaagctccctatggtcgtg

SEQ ID NO: 235570 - DNA, 25 bp, Homo sapien
aagctccctatggtcgtgtgacttc

SEQ ID NO: 235571 - DNA, 25 bp, Homo sapien
tatggtcgtgtgacttctcccgatc

SEQ ID NO: 235572 - DNA, 25 bp, Homo sapien
tatccactacctatgagcaaattac

SEQ ID NO: 235573 - DNA, 25 bp, Homo sapien
tgagcaaattacttccctcagcttt

SEQ ID NO: 235574 - DNA, 25 bp, Homo sapien
caaattacttccctcagctttagtt

SEQ ID NO: 235575 - DNA, 25 bp, Homo sapien
cttccctcagctttagtttcatttt

SEQ ID NO: 235576 - DNA, 25 bp, Homo sapien
ttccctcagctttagtttcattttg

SEQ ID NO: 235577 - DNA, 25 bp, Homo sapien
ttataagaggatatgtgcagttttt

SEQ ID NO: 235578 - DNA, 25 bp, Homo sapien
tatttttgtacctcatacgtataat

SEQ ID NO: 235579 - DNA, 25 bp, Homo sapien
gtacctcatacgtataatagtagca

SEQ ID NO: 235580 - DNA, 25 bp, Homo sapien
gtagcaacaaaaactttgcctagtt

SEQ ID NO: 235581 - DNA, 25 bp, Homo sapien
tacttttttcttgccgagattaaat

SEQ ID NO: 235582 - DNA, 25 bp, Homo sapien
attggtatattgtttattttagctt

SEQ ID NO: 235583 - DNA, 25 bp, Homo sapien
acactgtctttacaatcccggagtc

SEQ ID NO: 235584 - DNA, 25 bp, Homo sapien
aatcccggagtctgtctttatggag

SEQ ID NO: 235585 - DNA, 25 bp, Homo sapien
ctttatggagctggttttgggcaaa

SEQ ID NO: 235586 - DNA, 25 bp, Homo sapien
ggttttgggcaaaatgaacccgcag

SEQ ID NO: 235587 - DNA, 25 bp, Homo sapien
aatgaacccgcagaaggctttcctt

SEQ ID NO: 235588 - DNA, 25 bp, Homo sapien
gcagaaggctttccttgccggaaag

SEQ ID NO: 235589 - DNA, 25 bp, Homo sapien
ttccttgccggaaagttcaaagtga

SEQ ID NO: 235590 - DNA, 25 bp, Homo sapien
gtggcaaggttctgcttagctggaa

SEQ ID NO: 235591 - DNA, 25 bp, Homo sapien
tagctggaagctggaaagggttttc

SEQ ID NO: 235592 - DNA, 25 bp, Homo sapien
aagaacttctcttcgatgataatgt

SEQ ID NO: 235593 - DNA, 25 bp, Homo sapien
gtcgagtggaaatcatgcttaatct

SEQ ID NO: 235594 - DNA, 25 bp, Homo sapien
gtctcaaggttagagaagtcgccta

SEQ ID NO: 235595 - DNA, 25 bp, Homo sapien
aggttagagaagtcgcctagtccac

SEQ ID NO: 235596 - DNA, 25 bp, Homo sapien
tagagaagtcgcctagtccacctcc

SEQ ID NO: 235597 - DNA, 25 bp, Homo sapien
tctgcttctcacagaagggtctgct

SEQ ID NO: 235598 - DNA, 25 bp, Homo sapien
gcttctcacagaagggtctgctgaa

SEQ ID NO: 235599 - DNA, 25 bp, Homo sapien
agaagggtctgctgaacactctggt

SEQ ID NO: 235600 - DNA, 25 bp, Homo sapien
aagggtctgctgaacactctggtga

SEQ ID NO: 235601 - DNA, 25 bp, Homo sapien
ggtctgctgaacactctggtgacag

SEQ ID NO: 235602 - DNA, 25 bp, Homo sapien
gtgacagagaactcacccaacatgt

SEQ ID NO: 235603 - DNA, 25 bp, Homo sapien
agaactcacccaacatgttccatgg

SEQ ID NO: 235604 - DNA, 25 bp, Homo sapien
tcacccaacatgttccatggcagag

SEQ ID NO: 235605 - DNA, 25 bp, Homo sapien
aattagccggctttctccacaggga

SEQ ID NO: 235606 - DNA, 25 bp, Homo sapien
ggctttctccacagggaatagcagt

SEQ ID NO: 235607 - DNA, 25 bp, Homo sapien
agtcctatctctggcatgtttagta

SEQ ID NO: 235608 - DNA, 25 bp, Homo sapien
agagctcttatcagttttctcagaa

SEQ ID NO: 235609 - DNA, 25 bp, Homo sapien
gatttctccatcataggtatttggc

SEQ ID NO: 235610 - DNA, 25 bp, Homo sapien
ttggccaactggttaggtctagcat

SEQ ID NO: 235611 - DNA, 25 bp, Homo sapien
ggttaggtctagcatgaacatgtga

SEQ ID NO: 235612 - DNA, 25 bp, Homo sapien
gctgagatctgctaacatgttgtaa

SEQ ID NO: 235613 - DNA, 25 bp, Homo sapien
ggagcatctagtagaagctgatctc

SEQ ID NO: 235614 - DNA, 25 bp, Homo sapien
ctacaatggcagatagccttatcaa

SEQ ID NO: 235615 - DNA, 25 bp, Homo sapien
atagccttatcaaaacaattagccg

SEQ ID NO: 235616 - DNA, 25 bp, Homo sapien
cagcaggagtgaaggcctggccatc

SEQ ID NO: 235617 - DNA, 25 bp, Homo sapien
gaagagtttcacatatcatcacagc

SEQ ID NO: 235618 - DNA, 25 bp, Homo sapien
gtttcacatatcatcacagcataca

SEQ ID NO: 235619 - DNA, 25 bp, Homo sapien
acagcatacactgggaatttggtgg

SEQ ID NO: 235620 - DNA, 25 bp, Homo sapien
agggccactccctcaatatgaaggg

SEQ ID NO: 235621 - DNA, 25 bp, Homo sapien
aaccaagctgaatgtgaccaccggc

SEQ ID NO: 235622 - DNA, 25 bp, Homo sapien
tgaatgtgaccaccggcacactgct

SEQ ID NO: 235623 - DNA, 25 bp, Homo sapien
tccccgggaataactggccctgaga

SEQ ID NO: 235624 - DNA, 25 bp, Homo sapien
tgagacccctagacccaaggaggcc

SEQ ID NO: 235625 - DNA, 25 bp, Homo sapien
tagacccaaggaggcctgtccatgc

SEQ ID NO: 235626 - DNA, 25 bp, Homo sapien
caagcatccgggaagcatggctggc

SEQ ID NO: 235627 - DNA, 25 bp, Homo sapien
gttttctgtgctggaacatcggata

SEQ ID NO: 235628 - DNA, 25 bp, Homo sapien
atgaacagatgaccccgttatccag

SEQ ID NO: 235629 - DNA, 25 bp, Homo sapien
cccgttatccaggtctgttagcagt

SEQ ID NO: 235630 - DNA, 25 bp, Homo sapien
tctgttagcagtacgccagcagcgg

SEQ ID NO: 235631 - DNA, 25 bp, Homo sapien
cagcagcggaatcctgtctttcagg

SEQ ID NO: 235632 - DNA, 25 bp, Homo sapien
tcagggcccaaccatgaatttctca

SEQ ID NO: 235633 - DNA, 25 bp, Homo sapien
gaatttctcattcatgcccttagcg

SEQ ID NO: 235634 - DNA, 25 bp, Homo sapien
gcccttagcgcgatgtttttctcag

SEQ ID NO: 235635 - DNA, 25 bp, Homo sapien
gtagaattcttttagagagtcgctt

SEQ ID NO: 235636 - DNA, 25 bp, Homo sapien
gagtcgcttagggaaacgcttatac

SEQ ID NO: 235637 - DNA, 25 bp, Homo sapien
agggaaacgcttataccatctccac

SEQ ID NO: 235638 - DNA, 25 bp, Homo sapien
aatgctaacaccacatgtttgccta

SEQ ID NO: 235639 - DNA, 25 bp, Homo sapien
ccacatgtttgcctatgacaagttt

SEQ ID NO: 235640 - DNA, 25 bp, Homo sapien
gtgaaaggtatcttctgggttgaaa

SEQ ID NO: 235641 - DNA, 25 bp, Homo sapien
gtgaatgtcatcttgcaacacaccc

SEQ ID NO: 235642 - DNA, 25 bp, Homo sapien
acaccctgtacagtcttccttaaag

SEQ ID NO: 235643 - DNA, 25 bp, Homo sapien
gtatctacatgctgaatgactgaat

SEQ ID NO: 235644 - DNA, 25 bp, Homo sapien
gactgaatacagacctaagcacagc

SEQ ID NO: 235645 - DNA, 25 bp, Homo sapien
gcagtggtcctggtacagtatttaa

SEQ ID NO: 235646 - DNA, 25 bp, Homo sapien
tgtcggcatacacaggcgtaatccc

SEQ ID NO: 235647 - DNA, 25 bp, Homo sapien
gtaatccctgtataaagtagtgcca

SEQ ID NO: 235648 - DNA, 25 bp, Homo sapien
aagtagtgccaaactgatttcagtt

SEQ ID NO: 235649 - DNA, 25 bp, Homo sapien
gatgttgtttccattagagcaggtg

SEQ ID NO: 235650 - DNA, 25 bp, Homo sapien
gagcaggtgctcacagcattctgat

SEQ ID NO: 235651 - DNA, 25 bp, Homo sapien
gctcacagcattctgattggcctga

SEQ ID NO: 235652 - DNA, 25 bp, Homo sapien
attggcctgagcagaccgaggctat

SEQ ID NO: 235653 - DNA, 25 bp, Homo sapien
tgagcagaccgaggctatggctgtt

SEQ ID NO: 235654 - DNA, 25 bp, Homo sapien
cctgagccatcagggtcctgggagc

SEQ ID NO: 235655 - DNA, 25 bp, Homo sapien
ggctatggctgttgggacaagctta

SEQ ID NO: 235656 - DNA, 25 bp, Homo sapien
gacaagcttagcatcctggacatct

SEQ ID NO: 235657 - DNA, 25 bp, Homo sapien
taacattctacctttatgcagctgt

SEQ ID NO: 235658 - DNA, 25 bp, Homo sapien
tatgcagctgttggctgaccagaat

SEQ ID NO: 235659 - DNA, 25 bp, Homo sapien
gaataaactccctgctgagttcaag

SEQ ID NO: 235660 - DNA, 25 bp, Homo sapien
tgcccattcacaccacacagaggtt

SEQ ID NO: 235661 - DNA, 25 bp, Homo sapien
acagaggttccctgccttgtttgga

SEQ ID NO: 235662 - DNA, 25 bp, Homo sapien
ggattggcactgtttgccattctct

SEQ ID NO: 235663 - DNA, 25 bp, Homo sapien
cactgtttgccattctctgggttgg

SEQ ID NO: 235664 - DNA, 25 bp, Homo sapien
ctctgggttggctgtggcatctacc

SEQ ID NO: 235665 - DNA, 25 bp, Homo sapien
agaagcagcatcctccacttgttca

SEQ ID NO: 235666 - DNA, 25 bp, Homo sapien
ctccacttgttcagggcttttctta

SEQ ID NO: 235667 - DNA, 25 bp, Homo sapien
gggcttttcttaatactgaacgtag

SEQ ID NO: 235668 - DNA, 25 bp, Homo sapien
tagcataagggcttctggaacccag

SEQ ID NO: 235669 - DNA, 25 bp, Homo sapien
gacagtttaccatcctcaagatcat

SEQ ID NO: 235670 - DNA, 25 bp, Homo sapien
catcctcaagatcattcagtgtttt

SEQ ID NO: 235671 - DNA, 25 bp, Homo sapien
gaatgtgaaattctgaccacctttt

SEQ ID NO: 235672 - DNA, 25 bp, Homo sapien
atgtgaaattctgaccaccttttgg

SEQ ID NO: 235673 - DNA, 25 bp, Homo sapien
tgtgaaattctgaccaccttttggc

SEQ ID NO: 235674 - DNA, 25 bp, Homo sapien
tgaaattctgaccaccttttggctt

SEQ ID NO: 235675 - DNA, 25 bp, Homo sapien
gaaattctgaccaccttttggcttt

SEQ ID NO: 235676 - DNA, 25 bp, Homo sapien
aaattctgaccaccttttggctttg

SEQ ID NO: 235677 - DNA, 25 bp, Homo sapien
aattctgaccaccttttggctttga

SEQ ID NO: 235678 - DNA, 25 bp, Homo sapien
aagatatttgaaatcctaatgagga

SEQ ID NO: 235679 - DNA, 25 bp, Homo sapien
aaatagacaaatttcatacatgaac

SEQ ID NO: 235680 - DNA, 25 bp, Homo sapien
gatgatttagattttgatattgatt

SEQ ID NO: 235681 - DNA, 25 bp, Homo sapien
attgatttagaagacacaggaggat

SEQ ID NO: 235682 - DNA, 25 bp, Homo sapien
tatcttctttatgagacctaagctt

SEQ ID NO: 235683 - DNA, 25 bp, Homo sapien
gagacctaagcttcttacagactct

SEQ ID NO: 235684 - DNA, 25 bp, Homo sapien
gacctaagcttcttacagactctgt

SEQ ID NO: 235685 - DNA, 25 bp, Homo sapien
tacagactctgtttttcggttgaaa

SEQ ID NO: 235686 - DNA, 25 bp, Homo sapien
gactctgtttttcggttgaaaggat

SEQ ID NO: 235687 - DNA, 25 bp, Homo sapien
ttcggttgaaaggatctgtgaaaca

SEQ ID NO: 235688 - DNA, 25 bp, Homo sapien
aggatctgtgaaacataatcttctg

SEQ ID NO: 235689 - DNA, 25 bp, Homo sapien
tgaatagcacaatcagccctccgta

SEQ ID NO: 235690 - DNA, 25 bp, Homo sapien
aatagcacaatcagccctccgtatc

SEQ ID NO: 235691 - DNA, 25 bp, Homo sapien
gtggactgaaaatacttgagagcct

SEQ ID NO: 235692 - DNA, 25 bp, Homo sapien
aaaatacttgagagcctggtgtggt

SEQ ID NO: 235693 - DNA, 25 bp, Homo sapien
aaagcttgtagcaccattggcatcc

SEQ ID NO: 235694 - DNA, 25 bp, Homo sapien
tgtagcaccattggcatccccgtgt

SEQ ID NO: 235695 - DNA, 25 bp, Homo sapien
ttggcatccccgtgttccagcaatc

SEQ ID NO: 235696 - DNA, 25 bp, Homo sapien
tgttccagcaatctttcccatgcaa

SEQ ID NO: 235697 - DNA, 25 bp, Homo sapien
agcaatctttcccatgcaaaccggc

SEQ ID NO: 235698 - DNA, 25 bp, Homo sapien
gcagctcttgaaaagacgcatgcct

SEQ ID NO: 235699 - DNA, 25 bp, Homo sapien
tggaggaacaaaacgatgagcagga

SEQ ID NO: 235700 - DNA, 25 bp, Homo sapien
ttgaaaagacgcatgcctttccttc

SEQ ID NO: 235701 - DNA, 25 bp, Homo sapien
atgcctttccttccagtgtgtgaaa

SEQ ID NO: 235702 - DNA, 25 bp, Homo sapien
gcagtggcgccagtggcactatgac

SEQ ID NO: 235703 - DNA, 25 bp, Homo sapien
gccagtggcactatgacggcctgca

SEQ ID NO: 235704 - DNA, 25 bp, Homo sapien
gaggagaactgcctggcaacgcaac

SEQ ID NO: 235705 - DNA, 25 bp, Homo sapien
aacgcaacgcatcgctgtgcataaa

SEQ ID NO: 235706 - DNA, 25 bp, Homo sapien
taaactttgtttacagccaaggctg

SEQ ID NO: 235707 - DNA, 25 bp, Homo sapien
tgtgcttgcatctgggagctcggta

SEQ ID NO: 235708 - DNA, 25 bp, Homo sapien
gagctcggtaaatctcttggcttct

SEQ ID NO: 235709 - DNA, 25 bp, Homo sapien
cttggcttctggtgtgcgtacaagg

SEQ ID NO: 235710 - DNA, 25 bp, Homo sapien
gcgtacaagggtgacgtctagctac

SEQ ID NO: 235711 - DNA, 25 bp, Homo sapien
ggtgacgtctagctaccccagcagt

SEQ ID NO: 235712 - DNA, 25 bp, Homo sapien
agtcgcgtcccagtttgctgttgat

SEQ ID NO: 235713 - DNA, 25 bp, Homo sapien
taaaggcccacaagatttttcactc

SEQ ID NO: 235714 - DNA, 25 bp, Homo sapien
gatttttcactccagaactgacttt

SEQ ID NO: 235715 - DNA, 25 bp, Homo sapien
gacatgtgataaaggtggcaccaca

SEQ ID NO: 235716 - DNA, 25 bp, Homo sapien
aaaggtggcaccacatatcagtggg

SEQ ID NO: 235717 - DNA, 25 bp, Homo sapien
ggaggattactatttgccaatcaga

SEQ ID NO: 235718 - DNA, 25 bp, Homo sapien
gaaagccagccctaaaatggaggaa

SEQ ID NO: 235719 - DNA, 25 bp, Homo sapien
atatggattcctaactgagccccta

SEQ ID NO: 235720 - DNA, 25 bp, Homo sapien
actgagcccctaggaaaagtagact

SEQ ID NO: 235721 - DNA, 25 bp, Homo sapien
ggaaaagtagactccaaatggacta

SEQ ID NO: 235722 - DNA, 25 bp, Homo sapien
ggtagttgccatttgtttaatagga

SEQ ID NO: 235723 - DNA, 25 bp, Homo sapien
ccaatcagagcggtgtggtgacaga

SEQ ID NO: 235724 - DNA, 25 bp, Homo sapien
gagagctcagaggtaactccaagtc

SEQ ID NO: 235725 - DNA, 25 bp, Homo sapien
gaggtaactccaagtctagaggaag

SEQ ID NO: 235726 - DNA, 25 bp, Homo sapien
gtcaggatgatagcttcatcccatt

SEQ ID NO: 235727 - DNA, 25 bp, Homo sapien
catcccattctggtttttgtgatta

SEQ ID NO: 235728 - DNA, 25 bp, Homo sapien
gtttttgtgattaattgtgacctac

SEQ ID NO: 235729 - DNA, 25 bp, Homo sapien
gatgccctgtaatagaagctgtcct

SEQ ID NO: 235730 - DNA, 25 bp, Homo sapien
gggtttactactctagcaggaactt

SEQ ID NO: 235731 - DNA, 25 bp, Homo sapien
ctactctagcaggaactttgaattt

SEQ ID NO: 235732 - DNA, 25 bp, Homo sapien
aatatcgttgacttttggcttcctg

SEQ ID NO: 235733 - DNA, 25 bp, Homo sapien
ttggcttcctggcaaatgtctcatt

SEQ ID NO: 235734 - DNA, 25 bp, Homo sapien
tgtccttaaccctcaatcatctgta

SEQ ID NO: 235735 - DNA, 25 bp, Homo sapien
caatcatctgtattcagctagtata

SEQ ID NO: 235736 - DNA, 25 bp, Homo sapien
aatgcaaatctgctcttatgcctaa

SEQ ID NO: 235737 - DNA, 25 bp, Homo sapien
tgaagctttataatggatcctgtga

SEQ ID NO: 235738 - DNA, 25 bp, Homo sapien
gttcagggcagagatacttggacat

SEQ ID NO: 235739 - DNA, 25 bp, Homo sapien
tggacatgtctcatcttggcacaca

SEQ ID NO: 235740 - DNA, 25 bp, Homo sapien
atattttcatgggattctggtgtaa

SEQ ID NO: 235741 - DNA, 25 bp, Homo sapien
ggtaaagctctttatgtccatccca

SEQ ID NO: 235742 - DNA, 25 bp, Homo sapien
ttatgtccatcccaagtcttgccaa

SEQ ID NO: 235743 - DNA, 25 bp, Homo sapien
aagtcttgccaaggtgccctgaggt

SEQ ID NO: 235744 - DNA, 25 bp, Homo sapien
tgccctgaggtttgcgtagtcaaca

SEQ ID NO: 235745 - DNA, 25 bp, Homo sapien
gagaagagttccaaattgctttcta

SEQ ID NO: 235746 - DNA, 25 bp, Homo sapien
gatgctgtatagatatcaccacaaa

SEQ ID NO: 235747 - DNA, 25 bp, Homo sapien
aagatgcttggatgctatttcataa

SEQ ID NO: 235748 - DNA, 25 bp, Homo sapien
tgtagactacactcagaagaaatgg

SEQ ID NO: 235749 - DNA, 25 bp, Homo sapien
gatgccagaaaatcaccatagcatg

SEQ ID NO: 235750 - DNA, 25 bp, Homo sapien
aaatcaccatagcatggcctccttg

SEQ ID NO: 235751 - DNA, 25 bp, Homo sapien
acatgatgaagggttcagagttgac

SEQ ID NO: 235752 - DNA, 25 bp, Homo sapien
ggttcagagttgactccaaagcagg

SEQ ID NO: 235753 - DNA, 25 bp, Homo sapien
gagttgactccaaagcaggaatttt

SEQ ID NO: 235754 - DNA, 25 bp, Homo sapien
ggagttagaaggacaaacctcagat

SEQ ID NO: 235755 - DNA, 25 bp, Homo sapien
ctgtggcatatgaggacctatctgt

SEQ ID NO: 235756 - DNA, 25 bp, Homo sapien
atatgaggacctatctgtagactac

SEQ ID NO: 235757 - DNA, 25 bp, Homo sapien
tgaggacctatctgtagactacact

SEQ ID NO: 235758 - DNA, 25 bp, Homo sapien
ggacctatctgtagactacactcag

SEQ ID NO: 235759 - DNA, 25 bp, Homo sapien
aagtccatgctaacagggaacccaa

SEQ ID NO: 235760 - DNA, 25 bp, Homo sapien
tgcatcctatatccacgttcaaaga

SEQ ID NO: 235761 - DNA, 25 bp, Homo sapien
acccaacctcagtccagacaaatat

SEQ ID NO: 235762 - DNA, 25 bp, Homo sapien
atcatataatgattcagcctggcga

SEQ ID NO: 235763 - DNA, 25 bp, Homo sapien
cagcctggcgaaaacgaattccttt

SEQ ID NO: 235764 - DNA, 25 bp, Homo sapien
aaagatatatccagagccaagaaga

SEQ ID NO: 235765 - DNA, 25 bp, Homo sapien
tccacgttcaaagagatgctgtcag

SEQ ID NO: 235766 - DNA, 25 bp, Homo sapien
atgctgtcaggactgtcgcgttgaa

SEQ ID NO: 235767 - DNA, 25 bp, Homo sapien
aggactgtcgcgttgaatgcacctt

SEQ ID NO: 235768 - DNA, 25 bp, Homo sapien
gttgaatgcaccttcccgcagcagg

SEQ ID NO: 235769 - DNA, 25 bp, Homo sapien
gcccacgcatgggtcctacaataaa

SEQ ID NO: 235770 - DNA, 25 bp, Homo sapien
aaagagacccctcaagacagtttgg

SEQ ID NO: 235771 - DNA, 25 bp, Homo sapien
gttgcaatgcagcagaagcccacgg

SEQ ID NO: 235772 - DNA, 25 bp, Homo sapien
agcagaagcccacggcttatgtccg

SEQ ID NO: 235773 - DNA, 25 bp, Homo sapien
ttatgtccggcccatggatggtcaa

SEQ ID NO: 235774 - DNA, 25 bp, Homo sapien
tttgtcacctatacattccaaccag

SEQ ID NO: 235775 - DNA, 25 bp, Homo sapien
ttccccggacgcaaggaagcagcaa

SEQ ID NO: 235776 - DNA, 25 bp, Homo sapien
gcagcaaggttcatggcagcagcaa

SEQ ID NO: 235777 - DNA, 25 bp, Homo sapien
aaggttcatggcagcagcaataaca

SEQ ID NO: 235778 - DNA, 25 bp, Homo sapien
agtaaaggctattgcccagccaaat

SEQ ID NO: 235779 - DNA, 25 bp, Homo sapien
aaatctcccaaggacctagcagtga

SEQ ID NO: 235780 - DNA, 25 bp, Homo sapien
gcagtgaaagtccatgataaagaga

SEQ ID NO: 235781 - DNA, 25 bp, Homo sapien
tctgctctgcaaatgtcttttgggt

SEQ ID NO: 235782 - DNA, 25 bp, Homo sapien
tgcaaatgtcttttgggtcccgctg

SEQ ID NO: 235783 - DNA, 25 bp, Homo sapien
aatgtcttttgggtcccgctgtcaa

SEQ ID NO: 235784 - DNA, 25 bp, Homo sapien
gtcccgctgtcaaccaaacttgaat

SEQ ID NO: 235785 - DNA, 25 bp, Homo sapien
atgtaactcttatccaggcatttta

SEQ ID NO: 235786 - DNA, 25 bp, Homo sapien
tcttatccaggcattttagaactat

SEQ ID NO: 235787 - DNA, 25 bp, Homo sapien
ttagaactatgcaattgtgatttaa

SEQ ID NO: 235788 - DNA, 25 bp, Homo sapien
tgtgatttaaaatgcaactttgtgc

SEQ ID NO: 235789 - DNA, 25 bp, Homo sapien
taaaatgcaactttgtgcttttaaa

SEQ ID NO: 235790 - DNA, 25 bp, Homo sapien
cattattgaccttttttgtatatgg

SEQ ID NO: 235791 - DNA, 25 bp, Homo sapien
ggttttattatcaatagtactttgc

SEQ ID NO: 235792 - DNA, 25 bp, Homo sapien
tcctacatgcggagtgggacccaat

SEQ ID NO: 235793 - DNA, 25 bp, Homo sapien
agtgggacccaatagctggagcctt

SEQ ID NO: 235794 - DNA, 25 bp, Homo sapien
atagctggagccttgcaggacagtc

SEQ ID NO: 235795 - DNA, 25 bp, Homo sapien
ttgcaggacagtccttccagccaac

SEQ ID NO: 235796 - DNA, 25 bp, Homo sapien
agccgacctgactgtgtactcgtgt

SEQ ID NO: 235797 - DNA, 25 bp, Homo sapien
tgtgtactcgtgtcctgtgtacatg

SEQ ID NO: 235798 - DNA, 25 bp, Homo sapien
ttggcaccgctaagctgcagagcag

SEQ ID NO: 235799 - DNA, 25 bp, Homo sapien
gaacatcgtgatgcatctgccttta

SEQ ID NO: 235800 - DNA, 25 bp, Homo sapien
tgatgcatctgcctttacccaccaa

SEQ ID NO: 235801 - DNA, 25 bp, Homo sapien
ccaacacctgtgtccaaaggagggt

SEQ ID NO: 235802 - DNA, 25 bp, Homo sapien
gtccaaaggagggtccatgtgtgca

SEQ ID NO: 235803 - DNA, 25 bp, Homo sapien
aaagatgtcctgcaccagtctcatg

SEQ ID NO: 235804 - DNA, 25 bp, Homo sapien
agtctcatgcatctcgttcatcagt

SEQ ID NO: 235805 - DNA, 25 bp, Homo sapien
atctcgttcatcagtgcctttcata

SEQ ID NO: 235806 - DNA, 25 bp, Homo sapien
ctttcataccttcaagagctcttgc

SEQ ID NO: 235807 - DNA, 25 bp, Homo sapien
gcattgctatgcctgaggtgtgtct

SEQ ID NO: 235808 - DNA, 25 bp, Homo sapien
gaggtgtgtctcagaagcagccatt

SEQ ID NO: 235809 - DNA, 25 bp, Homo sapien
ggctgggctcaaaaatttgctctct

SEQ ID NO: 235810 - DNA, 25 bp, Homo sapien
gtgattgctctgaacaagctgcttt

SEQ ID NO: 235811 - DNA, 25 bp, Homo sapien
gtctgaccagggtgagtggatcttt

SEQ ID NO: 235812 - DNA, 25 bp, Homo sapien
gtggatcttttggaacctagacaga

SEQ ID NO: 235813 - DNA, 25 bp, Homo sapien
gaaagggttgactgaactcccacaa

SEQ ID NO: 235814 - DNA, 25 bp, Homo sapien
ggccggaagggcgtatctgcgattg

SEQ ID NO: 235815 - DNA, 25 bp, Homo sapien
gccggaagggcgtatctgcgattgc

SEQ ID NO: 235816 - DNA, 25 bp, Homo sapien
ccggaagggcgtatctgcgattgcg

SEQ ID NO: 235817 - DNA, 25 bp, Homo sapien
cggaagggcgtatctgcgattgcgt

SEQ ID NO: 235818 - DNA, 25 bp, Homo sapien
ggaagggcgtatctgcgattgcgtg

SEQ ID NO: 235819 - DNA, 25 bp, Homo sapien
aagggcgtatctgcgattgcgtgtc

SEQ ID NO: 235820 - DNA, 25 bp, Homo sapien
ggcgtatctgcgattgcgtgtctgt

SEQ ID NO: 235821 - DNA, 25 bp, Homo sapien
gcgtatctgcgattgcgtgtctgtg

SEQ ID NO: 235822 - DNA, 25 bp, Homo sapien
gaggggctgcgtgtgattgtgtgtc

SEQ ID NO: 235823 - DNA, 25 bp, Homo sapien
aggggctgcgtgtgattgtgtgtct

SEQ ID NO: 235824 - DNA, 25 bp, Homo sapien
ggggctgcgtgtgattgtgtgtctg

SEQ ID NO: 235825 - DNA, 25 bp, Homo sapien
aaacatttgtgctttcctatatttt

SEQ ID NO: 235826 - DNA, 25 bp, Homo sapien
ataggatttcggaaggcgacagaaa

SEQ ID NO: 235827 - DNA, 25 bp, Homo sapien
gaaggcgacagaaaatttagttctt

SEQ ID NO: 235828 - DNA, 25 bp, Homo sapien
caaactcaggtttatctagttccaa

SEQ ID NO: 235829 - DNA, 25 bp, Homo sapien
tttaaatagaaagttgtgtgcccct

SEQ ID NO: 235830 - DNA, 25 bp, Homo sapien
tagaaagttgtgtgcccctatagaa

SEQ ID NO: 235831 - DNA, 25 bp, Homo sapien
agttgtgtgcccctatagaaaatat

SEQ ID NO: 235832 - DNA, 25 bp, Homo sapien
gtgtgcccctatagaaaatatttga

SEQ ID NO: 235833 - DNA, 25 bp, Homo sapien
ttgagaatttcttatactatcaaga

SEQ ID NO: 235834 - DNA, 25 bp, Homo sapien
atctagttccaaaacccatgttctt

SEQ ID NO: 235835 - DNA, 25 bp, Homo sapien
ttctgccacaccatgttagtagaaa

SEQ ID NO: 235836 - DNA, 25 bp, Homo sapien
gccatagagactcaacagcctttgt

SEQ ID NO: 235837 - DNA, 25 bp, Homo sapien
aagtggctctatggcaacttcacaa

SEQ ID NO: 235838 - DNA, 25 bp, Homo sapien
tttgagaaatacttcacctcctcca

SEQ ID NO: 235839 - DNA, 25 bp, Homo sapien
ctcctccaccaacttagagatctta

SEQ ID NO: 235840 - DNA, 25 bp, Homo sapien
agatcttattcttggcactttgctc

SEQ ID NO: 235841 - DNA, 25 bp, Homo sapien
tttgctcttcttcatctgtttcccc

SEQ ID NO: 235842 - DNA, 25 bp, Homo sapien
cttcacatctcttttgccatttctt

SEQ ID NO: 235843 - DNA, 25 bp, Homo sapien
catttcttcccaaatagctcatcta

SEQ ID NO: 235844 - DNA, 25 bp, Homo sapien
catctaacactccagagcggtctgt

SEQ ID NO: 235845 - DNA, 25 bp, Homo sapien
ccagagcggtctgtagccctgcagg

SEQ ID NO: 235846 - DNA, 25 bp, Homo sapien
tggccagggccaatggccttgacag

SEQ ID NO: 235847 - DNA, 25 bp, Homo sapien
acaccacctccatttgaatcatctg

SEQ ID NO: 235848 - DNA, 25 bp, Homo sapien
gcagattactagatcctcctcaaga

SEQ ID NO: 235849 - DNA, 25 bp, Homo sapien
gtgaagctacagactctgcattatt

SEQ ID NO: 235850 - DNA, 25 bp, Homo sapien
attattttcaacaagctccccagat

SEQ ID NO: 235851 - DNA, 25 bp, Homo sapien
atgcactgttatgagggagagccca

SEQ ID NO: 235852 - DNA, 25 bp, Homo sapien
gagagcccagccttatagaatgttg

SEQ ID NO: 235853 - DNA, 25 bp, Homo sapien
ttgtcactactaaactaaggctggt

SEQ ID NO: 235854 - DNA, 25 bp, Homo sapien
ctggtacgtttgatgctgggtctga

SEQ ID NO: 235855 - DNA, 25 bp, Homo sapien
tgatgctgggtctgatacaatttca

SEQ ID NO: 235856 - DNA, 25 bp, Homo sapien
atggaagctgctcgagtggaaaact

SEQ ID NO: 235857 - DNA, 25 bp, Homo sapien
ggaaaactaaggtcattgcctctca

SEQ ID NO: 235858 - DNA, 25 bp, Homo sapien
gcagggactttgttgactgccaaat

SEQ ID NO: 235859 - DNA, 25 bp, Homo sapien
ttgttgactgccaaatctactctgc

SEQ ID NO: 235860 - DNA, 25 bp, Homo sapien
tgccaaatctactctgccttttcag

SEQ ID NO: 235861 - DNA, 25 bp, Homo sapien
tactctgccttttcagtgcctaata

SEQ ID NO: 235862 - DNA, 25 bp, Homo sapien
tgccttttcagtgcctaatacgttg

SEQ ID NO: 235863 - DNA, 25 bp, Homo sapien
gtgcctaatacgttgtaatttttca

SEQ ID NO: 235864 - DNA, 25 bp, Homo sapien
atttatctctagaagtttctctaaa

SEQ ID NO: 235865 - DNA, 25 bp, Homo sapien
tttctctaaaattgtactcagaaga

SEQ ID NO: 235866 - DNA, 25 bp, Homo sapien
cagaagaattctgcaaggcttggag

SEQ ID NO: 235867 - DNA, 25 bp, Homo sapien
attctgcaaggcttggaggatatat

SEQ ID NO: 235868 - DNA, 25 bp, Homo sapien
tggaaatgctgaattctgttccact

SEQ ID NO: 235869 - DNA, 25 bp, Homo sapien
gcctgggagccccatgtacaggagg

SEQ ID NO: 235870 - DNA, 25 bp, Homo sapien
tgtacaggagggagggccaggcaca

SEQ ID NO: 235871 - DNA, 25 bp, Homo sapien
gcccgctgtcagacggcaggaagat

SEQ ID NO: 235872 - DNA, 25 bp, Homo sapien
tcagacggcaggaagatggcacaca

SEQ ID NO: 235873 - DNA, 25 bp, Homo sapien
gcaggaagatggcacacagccacag

SEQ ID NO: 235874 - DNA, 25 bp, Homo sapien
acagccacaggtgaatggccagcag

SEQ ID NO: 235875 - DNA, 25 bp, Homo sapien
atggccagcaggtgggatgtgttac

SEQ ID NO: 235876 - DNA, 25 bp, Homo sapien
ggatgtgttacggacggccaccacg

SEQ ID NO: 235877 - DNA, 25 bp, Homo sapien
ttacggacggccaccacgcgagcag

SEQ ID NO: 235878 - DNA, 25 bp, Homo sapien
aagaaggcggcctgcaccaggaccc

SEQ ID NO: 235879 - DNA, 25 bp, Homo sapien
gcacagctgctctcccatgggtgat

SEQ ID NO: 235880 - DNA, 25 bp, Homo sapien
tgctgggatttacagacgttagcca

SEQ ID NO: 235881 - DNA, 25 bp, Homo sapien
gggatttacagacgttagccagagc

SEQ ID NO: 235882 - DNA, 25 bp, Homo sapien
tttacagacgttagccagagcgccc

SEQ ID NO: 235883 - DNA, 25 bp, Homo sapien
acagacgttagccagagcgcccagt

SEQ ID NO: 235884 - DNA, 25 bp, Homo sapien
acgttagccagagcgcccagtctaa

SEQ ID NO: 235885 - DNA, 25 bp, Homo sapien
agagcgcccagtctaagccctttat

SEQ ID NO: 235886 - DNA, 25 bp, Homo sapien
agcgcccagtctaagccctttatag

SEQ ID NO: 235887 - DNA, 25 bp, Homo sapien
ccagtctaagccctttatagcttaa

SEQ ID NO: 235888 - DNA, 25 bp, Homo sapien
aagccctttatagcttaattctata

SEQ ID NO: 235889 - DNA, 25 bp, Homo sapien
ttaaaaaactgtgtgctttgttctc

SEQ ID NO: 235890 - DNA, 25 bp, Homo sapien
tgggaccttggttggatataaaaat

SEQ ID NO: 235891 - DNA, 25 bp, Homo sapien
aaatgtgagcataatacttctaata

SEQ ID NO: 235892 - DNA, 25 bp, Homo sapien
ggtaaccacaattagtcagcaacag

SEQ ID NO: 235893 - DNA, 25 bp, Homo sapien
gtcagcaacagagtacaacagggtt

SEQ ID NO: 235894 - DNA, 25 bp, Homo sapien
cagagtacaacagggtttctattta

SEQ ID NO: 235895 - DNA, 25 bp, Homo sapien
tttctatttacccaccaactactat

SEQ ID NO: 235896 - DNA, 25 bp, Homo sapien
accaactactatacctttcatgacg

SEQ ID NO: 235897 - DNA, 25 bp, Homo sapien
acctttcatgacgttgaatgggaca

SEQ ID NO: 235898 - DNA, 25 bp, Homo sapien
tagaactgtcctacatttatgtcaa

SEQ ID NO: 235899 - DNA, 25 bp, Homo sapien
tttctttttcactctttatattgag

SEQ ID NO: 235900 - DNA, 25 bp, Homo sapien
ttatattgagtacattccagaaatt

SEQ ID NO: 235901 - DNA, 25 bp, Homo sapien
aaatttgtagtaggcaaggtgctat

SEQ ID NO: 235902 - DNA, 25 bp, Homo sapien
gtctggacctgcagggctgaagttc

SEQ ID NO: 235903 - DNA, 25 bp, Homo sapien
gggctgaagttcactcatcgaccga

SEQ ID NO: 235904 - DNA, 25 bp, Homo sapien
gaagttcactcatcgaccgactcag

SEQ ID NO: 235905 - DNA, 25 bp, Homo sapien
gccccaaccgggagccaggcagaaa

SEQ ID NO: 235906 - DNA, 25 bp, Homo sapien
gggagccaggcagaaaaaccctgtg

SEQ ID NO: 235907 - DNA, 25 bp, Homo sapien
aagtgactggaagtggactccagag

SEQ ID NO: 235908 - DNA, 25 bp, Homo sapien
cacagtcctggtgtggtgctgacca

SEQ ID NO: 235909 - DNA, 25 bp, Homo sapien
ggaaagggcagtagatctctaatgt

SEQ ID NO: 235910 - DNA, 25 bp, Homo sapien
atctctaatgtggaggtgggaacat

SEQ ID NO: 235911 - DNA, 25 bp, Homo sapien
ggaacattattgtggtggaggcaat

SEQ ID NO: 235912 - DNA, 25 bp, Homo sapien
aattatgagggtagcatttctttcg

SEQ ID NO: 235913 - DNA, 25 bp, Homo sapien
gtacaactattgagcctactatggt

SEQ ID NO: 235914 - DNA, 25 bp, Homo sapien
gagcctactatggttggaaaatact

SEQ ID NO: 235915 - DNA, 25 bp, Homo sapien
atggttactttaattagatctccgt

SEQ ID NO: 235916 - DNA, 25 bp, Homo sapien
ttagatctccgtactaaacgtggga

SEQ ID NO: 235917 - DNA, 25 bp, Homo sapien
gagcattaagttctggtctgtccat

SEQ ID NO: 235918 - DNA, 25 bp, Homo sapien
ctggtctgtccatttcctgaaattc

SEQ ID NO: 235919 - DNA, 25 bp, Homo sapien
cctgaaattctgagctatgttattc

SEQ ID NO: 235920 - DNA, 25 bp, Homo sapien
tatgttattcatctctgttgttggc

SEQ ID NO: 235921 - DNA, 25 bp, Homo sapien
tcatctctgttgttggctctataat

SEQ ID NO: 235922 - DNA, 25 bp, Homo sapien
ctgttgttggctctataatgtatgt

SEQ ID NO: 235923 - DNA, 25 bp, Homo sapien
gaattaatccctttctatgagaaca

SEQ ID NO: 235924 - DNA, 25 bp, Homo sapien
aatgtgcctttgcaaagtttgcgaa

SEQ ID NO: 235925 - DNA, 25 bp, Homo sapien
atgtgcctttgcaaagtttgcgaaa

SEQ ID NO: 235926 - DNA, 25 bp, Homo sapien
tgtgcctttgcaaagtttgcgaaat

SEQ ID NO: 235927 - DNA, 25 bp, Homo sapien
gtgcctttgcaaagtttgcgaaatc

SEQ ID NO: 235928 - DNA, 25 bp, Homo sapien
tgcctttgcaaagtttgcgaaatca

SEQ ID NO: 235929 - DNA, 25 bp, Homo sapien
gcctttgcaaagtttgcgaaatcag

SEQ ID NO: 235930 - DNA, 25 bp, Homo sapien
tgcaaagtttgcgaaatcagatttt

SEQ ID NO: 235931 - DNA, 25 bp, Homo sapien
gcaaagtttgcgaaatcagattttg

SEQ ID NO: 235932 - DNA, 25 bp, Homo sapien
caaagtttgcgaaatcagattttgt

SEQ ID NO: 235933 - DNA, 25 bp, Homo sapien
gtttgcgaaatcagattttgtatcc

SEQ ID NO: 235934 - DNA, 25 bp, Homo sapien
ttgcgaaatcagattttgtatccca

SEQ ID NO: 235935 - DNA, 25 bp, Homo sapien
aaggaaggaagcagggtcaccgcaa

SEQ ID NO: 235936 - DNA, 25 bp, Homo sapien
gggagctaacattcttccgagaaaa

SEQ ID NO: 235937 - DNA, 25 bp, Homo sapien
cagggtcaccgcaagtgtgggattt

SEQ ID NO: 235938 - DNA, 25 bp, Homo sapien
ccgcaagtgtgggatttgtcttatt

SEQ ID NO: 235939 - DNA, 25 bp, Homo sapien
tattaaaatctgatactgtgtggca

SEQ ID NO: 235940 - DNA, 25 bp, Homo sapien
gcagtttgcttcactcttggtataa

SEQ ID NO: 235941 - DNA, 25 bp, Homo sapien
gcttcactcttggtataaaatgtct

SEQ ID NO: 235942 - DNA, 25 bp, Homo sapien
tgtctgagctccatgttaaagtaaa

SEQ ID NO: 235943 - DNA, 25 bp, Homo sapien
ttcctgaggtgaaaatagatccata

SEQ ID NO: 235944 - DNA, 25 bp, Homo sapien
aatgagagagagatatgcagctgca

SEQ ID NO: 235945 - DNA, 25 bp, Homo sapien
atatgcagctgcagtggaggacttg

SEQ ID NO: 235946 - DNA, 25 bp, Homo sapien
gtgagaaaccataccagtgtgactt

SEQ ID NO: 235947 - DNA, 25 bp, Homo sapien
gtgtgacttcaaggactgtgaacga

SEQ ID NO: 235948 - DNA, 25 bp, Homo sapien
ttgtcagcgaaagttctcccggtcc

SEQ ID NO: 235949 - DNA, 25 bp, Homo sapien
tgaagacccacaccaggactcatac

SEQ ID NO: 235950 - DNA, 25 bp, Homo sapien
gtgaaaagcccttcagctgtcggtg

SEQ ID NO: 235951 - DNA, 25 bp, Homo sapien
tcagctgtcggtggccaagttgtca

SEQ ID NO: 235952 - DNA, 25 bp, Homo sapien
tgtcggtggccaagttgtcagaaaa

SEQ ID NO: 235953 - DNA, 25 bp, Homo sapien
gtcagaaaaagtttgcccggtcaga

SEQ ID NO: 235954 - DNA, 25 bp, Homo sapien
tttgcccggtcagatgaattagtcc

SEQ ID NO: 235955 - DNA, 25 bp, Homo sapien
gaattagtccgccatcacaacatgc

SEQ ID NO: 235956 - DNA, 25 bp, Homo sapien
ccgccatcacaacatgcatcagaga

SEQ ID NO: 235957 - DNA, 25 bp, Homo sapien
tgcccacctgtcaaacaaagccaga

SEQ ID NO: 235958 - DNA, 25 bp, Homo sapien
caaagccagaagctgagcaccaggg

SEQ ID NO: 235959 - DNA, 25 bp, Homo sapien
tcggacaactcagtccctaaaaaca

SEQ ID NO: 235960 - DNA, 25 bp, Homo sapien
tgcagtcatcttgaccaagcaggaa

SEQ ID NO: 235961 - DNA, 25 bp, Homo sapien
caagcaggaagctcagactggttga

SEQ ID NO: 235962 - DNA, 25 bp, Homo sapien
actggttgagttcaggtagctgccc

SEQ ID NO: 235963 - DNA, 25 bp, Homo sapien
aggtagctgcccctggctctgaccg

SEQ ID NO: 235964 - DNA, 25 bp, Homo sapien
ggctctgaccgaaacagcgctgggt

SEQ ID NO: 235965 - DNA, 25 bp, Homo sapien
gtcaccggatcctgggtggtctgca

SEQ ID NO: 235966 - DNA, 25 bp, Homo sapien
caggcagggctgactctaggtgccc

SEQ ID NO: 235967 - DNA, 25 bp, Homo sapien
gctgactctaggtgcccttggaggc

SEQ ID NO: 235968 - DNA, 25 bp, Homo sapien
aattttgctagttaatattgctggc

SEQ ID NO: 235969 - DNA, 25 bp, Homo sapien
tgctagttaatattgctggcagtaa

SEQ ID NO: 235970 - DNA, 25 bp, Homo sapien
ttgctggcagtaagttatttaatgt

SEQ ID NO: 235971 - DNA, 25 bp, Homo sapien
ctgtactctagctactcataggtaa

SEQ ID NO: 235972 - DNA, 25 bp, Homo sapien
gtactctagctactcataggtaata

SEQ ID NO: 235973 - DNA, 25 bp, Homo sapien
actctagctactcataggtaatatg

SEQ ID NO: 235974 - DNA, 25 bp, Homo sapien
ctctagctactcataggtaatatgt

SEQ ID NO: 235975 - DNA, 25 bp, Homo sapien
atttgatatccacattgagtactaa

SEQ ID NO: 235976 - DNA, 25 bp, Homo sapien
tgatatccacattgagtactaattt

SEQ ID NO: 235977 - DNA, 25 bp, Homo sapien
atccacattgagtactaattttgct

SEQ ID NO: 235978 - DNA, 25 bp, Homo sapien
ccacattgagtactaattttgctag

SEQ ID NO: 235979 - DNA, 25 bp, Homo sapien
tatgatgagccccagctcaacaggg

SEQ ID NO: 235980 - DNA, 25 bp, Homo sapien
tgagccccagctcaacagggcaagt

SEQ ID NO: 235981 - DNA, 25 bp, Homo sapien
aacagggcaagtcagcaatggaaga

SEQ ID NO: 235982 - DNA, 25 bp, Homo sapien
agaaggctccgggtccctgatggac

SEQ ID NO: 235983 - DNA, 25 bp, Homo sapien
gggtccctgatggacaacggctgca

SEQ ID NO: 235984 - DNA, 25 bp, Homo sapien
cctgatggacaacggctgcacctga

SEQ ID NO: 235985 - DNA, 25 bp, Homo sapien
atggacaacggctgcacctgagcca

SEQ ID NO: 235986 - DNA, 25 bp, Homo sapien
aacggctgcacctgagccaggtgtg

SEQ ID NO: 235987 - DNA, 25 bp, Homo sapien
agccaggtgtgctcagacaggcctt

SEQ ID NO: 235988 - DNA, 25 bp, Homo sapien
caggtgtgctcagacaggccttcag

SEQ ID NO: 235989 - DNA, 25 bp, Homo sapien
tcagagaaaagacaggttccctaag

SEQ ID NO: 235990 - DNA, 25 bp, Homo sapien
aatgattgatgaatgcctgaagtat

SEQ ID NO: 235991 - DNA, 25 bp, Homo sapien
gaagtatatggagttgcagtggcaa

SEQ ID NO: 235992 - DNA, 25 bp, Homo sapien
tggtgaacataaccagtccaggttc

SEQ ID NO: 235993 - DNA, 25 bp, Homo sapien
agctacttctaaggtgcttctactt

SEQ ID NO: 235994 - DNA, 25 bp, Homo sapien
atctctccttagcagtattctctct

SEQ ID NO: 235995 - DNA, 25 bp, Homo sapien
tgggctgtataatctaaccatcaaa

SEQ ID NO: 235996 - DNA, 25 bp, Homo sapien
taaccatcaaatcccttctctaagc

SEQ ID NO: 235997 - DNA, 25 bp, Homo sapien
ttctctaagccaccatcataggact

SEQ ID NO: 235998 - DNA, 25 bp, Homo sapien
ttcaggatgttgtttctgtagcaga

SEQ ID NO: 235999 - DNA, 25 bp, Homo sapien
cagagtcatctgtttcttgtccctc

SEQ ID NO: 236000 - DNA, 25 bp, Homo sapien
tccgccctctctatgttaatgattg

SEQ ID NO: 236001 - DNA, 25 bp, Homo sapien
gcaaccgactgacgcgggccactga

SEQ ID NO: 236002 - DNA, 25 bp, Homo sapien
actgacaagacttcactgatgccat

SEQ ID NO: 236003 - DNA, 25 bp, Homo sapien
acaagacttcactgatgccatcaag

SEQ ID NO: 236004 - DNA, 25 bp, Homo sapien
tgatgccatcaaggacaccaccaag

SEQ ID NO: 236005 - DNA, 25 bp, Homo sapien
atgccatcaaggacaccaccaagtt

SEQ ID NO: 236006 - DNA, 25 bp, Homo sapien
gacaccaccaagttccctgctttgg

SEQ ID NO: 236007 - DNA, 25 bp, Homo sapien
aagttccctgctttggcttgggtgg

SEQ ID NO: 236008 - DNA, 25 bp, Homo sapien
ccctgctttggcttgggtggacctg

SEQ ID NO: 236009 - DNA, 25 bp, Homo sapien
acgagggcctggaccttgagcctga

SEQ ID NO: 236010 - DNA, 25 bp, Homo sapien
cctggaccttgagcctgagggcagt

SEQ ID NO: 236011 - DNA, 25 bp, Homo sapien
tgctcaacggcaaccgactgacgcg

SEQ ID NO: 236012 - DNA, 25 bp, Homo sapien
agttgatttttcagacctgctcctc

SEQ ID NO: 236013 - DNA, 25 bp, Homo sapien
tcctcagtaataatactagctagtc

SEQ ID NO: 236014 - DNA, 25 bp, Homo sapien
tactagctagtcagcattcacgcct

SEQ ID NO: 236015 - DNA, 25 bp, Homo sapien
tagtcagcattcacgcctaccagga

SEQ ID NO: 236016 - DNA, 25 bp, Homo sapien
attcacgcctaccaggacacaaaaa

SEQ ID NO: 236017 - DNA, 25 bp, Homo sapien
aaaaatcctcttcaaaactactcag

SEQ ID NO: 236018 - DNA, 25 bp, Homo sapien
tactcaggaatgatgtccattcagg

SEQ ID NO: 236019 - DNA, 25 bp, Homo sapien
atgtccattcaggagaaatcaaaag

SEQ ID NO: 236020 - DNA, 25 bp, Homo sapien
atcaaaagagaattcctccaaagtt

SEQ ID NO: 236021 - DNA, 25 bp, Homo sapien
ggagactataaaatcacaggctaaa

SEQ ID NO: 236022 - DNA, 25 bp, Homo sapien
acaggctaaatcttccagtgaaagt

SEQ ID NO: 236023 - DNA, 25 bp, Homo sapien
atattgatataggcccgggcgctgt

SEQ ID NO: 236024 - DNA, 25 bp, Homo sapien
tattgatataggcccgggcgctgtg

SEQ ID NO: 236025 - DNA, 25 bp, Homo sapien
attgatataggcccgggcgctgtgg

SEQ ID NO: 236026 - DNA, 25 bp, Homo sapien
ttgatataggcccgggcgctgtggc

SEQ ID NO: 236027 - DNA, 25 bp, Homo sapien
tgatataggcccgggcgctgtggct

SEQ ID NO: 236028 - DNA, 25 bp, Homo sapien
gatataggcccgggcgctgtggctc

SEQ ID NO: 236029 - DNA, 25 bp, Homo sapien
atataggcccgggcgctgtggctca

SEQ ID NO: 236030 - DNA, 25 bp, Homo sapien
tataggcccgggcgctgtggctcac

SEQ ID NO: 236031 - DNA, 25 bp, Homo sapien
ataggcccgggcgctgtggctcaca

SEQ ID NO: 236032 - DNA, 25 bp, Homo sapien
taggcccgggcgctgtggctcacac

SEQ ID NO: 236033 - DNA, 25 bp, Homo sapien
tgggcaagttgccttatgttagaat

SEQ ID NO: 236034 - DNA, 25 bp, Homo sapien
gaatgactaagttaaacctcttaat

SEQ ID NO: 236035 - DNA, 25 bp, Homo sapien
aacctcttaattggtattgtccaag

SEQ ID NO: 236036 - DNA, 25 bp, Homo sapien
tggtattgtccaaggcagacatgat

SEQ ID NO: 236037 - DNA, 25 bp, Homo sapien
atataaggaatatgcactaccgtag

SEQ ID NO: 236038 - DNA, 25 bp, Homo sapien
tatgcactaccgtagtaactcccct

SEQ ID NO: 236039 - DNA, 25 bp, Homo sapien
gtagtaactcccctggccgcagaaa

SEQ ID NO: 236040 - DNA, 25 bp, Homo sapien
gaaaccacactgcaagcctgtccgg

SEQ ID NO: 236041 - DNA, 25 bp, Homo sapien
gccacttttaaatgggcactgccgt

SEQ ID NO: 236042 - DNA, 25 bp, Homo sapien
atgggcactgccgtggtaatgtgaa

SEQ ID NO: 236043 - DNA, 25 bp, Homo sapien
gtggtaatgtgaatcccatcaatgc

SEQ ID NO: 236044 - DNA, 25 bp, Homo sapien
tatcagacatccaaatggagacagt

SEQ ID NO: 236045 - DNA, 25 bp, Homo sapien
tttggaataccaggaagtgtgttat

SEQ ID NO: 236046 - DNA, 25 bp, Homo sapien
gtgtgttatatacaataatgccagt

SEQ ID NO: 236047 - DNA, 25 bp, Homo sapien
atgccagtaaacaagtattctcagg

SEQ ID NO: 236048 - DNA, 25 bp, Homo sapien
agtattctcaggtctaaaaggtata

SEQ ID NO: 236049 - DNA, 25 bp, Homo sapien
aaatttgtcatgtgttagtgatggg

SEQ ID NO: 236050 - DNA, 25 bp, Homo sapien
gggcaacacctcaaggttcccctgg

SEQ ID NO: 236051 - DNA, 25 bp, Homo sapien
acacctcaaggttcccctggaggct

SEQ ID NO: 236052 - DNA, 25 bp, Homo sapien
agcacctactatgcaacagacacat

SEQ ID NO: 236053 - DNA, 25 bp, Homo sapien
ttccttcttttttgctaatgctaat

SEQ ID NO: 236054 - DNA, 25 bp, Homo sapien
gctaatgctaataaccacagaacta

SEQ ID NO: 236055 - DNA, 25 bp, Homo sapien
ttatctttggtaaatgactttagag

SEQ ID NO: 236056 - DNA, 25 bp, Homo sapien
cattgcttaaaaaactcagaatcag

SEQ ID NO: 236057 - DNA, 25 bp, Homo sapien
aacactgaattatttaagaacacat

SEQ ID NO: 236058 - DNA, 25 bp, Homo sapien
ttataatttatttgcacccttggga

SEQ ID NO: 236059 - DNA, 25 bp, Homo sapien
ttatttgcacccttgggaagattgc

SEQ ID NO: 236060 - DNA, 25 bp, Homo sapien
atttgcacccttgggaagattgctt

SEQ ID NO: 236061 - DNA, 25 bp, Homo sapien
ttctgccttgattccttctcattga

SEQ ID NO: 236062 - DNA, 25 bp, Homo sapien
tctgccttgattccttctcattgat

SEQ ID NO: 236063 - DNA, 25 bp, Homo sapien
ctgccttgattccttctcattgatg

SEQ ID NO: 236064 - DNA, 25 bp, Homo sapien
ttctcattgatgtccaggtcatctg

SEQ ID NO: 236065 - DNA, 25 bp, Homo sapien
atgtccaggtcatctggaggccggg

SEQ ID NO: 236066 - DNA, 25 bp, Homo sapien
ggctgctctaaagttgttctgataa

SEQ ID NO: 236067 - DNA, 25 bp, Homo sapien
aagttgttctgataatgtgttttga

SEQ ID NO: 236068 - DNA, 25 bp, Homo sapien
tttgaaatgaggaagtgattaggcc

SEQ ID NO: 236069 - DNA, 25 bp, Homo sapien
gtgattaggcctccactagagatac

SEQ ID NO: 236070 - DNA, 25 bp, Homo sapien
gattaggcctccactagagatactt

SEQ ID NO: 236071 - DNA, 25 bp, Homo sapien
taggcctccactagagatacttttg

SEQ ID NO: 236072 - DNA, 25 bp, Homo sapien
ggcctccactagagatacttttgag

SEQ ID NO: 236073 - DNA, 25 bp, Homo sapien
gtaatttagtagcaggttagggaat

SEQ ID NO: 236074 - DNA, 25 bp, Homo sapien
gggaatagaaaccacactaatctga

SEQ ID NO: 236075 - DNA, 25 bp, Homo sapien
gaaaccacactaatctgaaggaata

SEQ ID NO: 236076 - DNA, 25 bp, Homo sapien
aggaataacaagatgatcaacactg

SEQ ID NO: 236077 - DNA, 25 bp, Homo sapien
agatggtccatgcttttctgacgtt

SEQ ID NO: 236078 - DNA, 25 bp, Homo sapien
gacgttctcagaatagtggctagct

SEQ ID NO: 236079 - DNA, 25 bp, Homo sapien
agtggctagcttcaaacctgacaag

SEQ ID NO: 236080 - DNA, 25 bp, Homo sapien
aagcgctgcttgaagccggaacact

SEQ ID NO: 236081 - DNA, 25 bp, Homo sapien
gcagaaacggccacgcgggtcacga

SEQ ID NO: 236082 - DNA, 25 bp, Homo sapien
ctcctgccagcaacaagaaggcttt

SEQ ID NO: 236083 - DNA, 25 bp, Homo sapien
gcatgatgttttcacgtgtgcgtgc

SEQ ID NO: 236084 - DNA, 25 bp, Homo sapien
gtgtgcgtgccgtttctccaagcac

SEQ ID NO: 236085 - DNA, 25 bp, Homo sapien
aagcactgcaggttccaccgtgtgt

SEQ ID NO: 236086 - DNA, 25 bp, Homo sapien
ttccaccgtgtgtcagaggctgcaa

SEQ ID NO: 236087 - DNA, 25 bp, Homo sapien
aggctgcaagtttaacatcctcctg

SEQ ID NO: 236088 - DNA, 25 bp, Homo sapien
gctggcccgccgtcctgaggaagct

SEQ ID NO: 236089 - DNA, 25 bp, Homo sapien
cccgccgtcctgaggaagctgaggt

SEQ ID NO: 236090 - DNA, 25 bp, Homo sapien
aagctgaggttcactgcggtgccca

SEQ ID NO: 236091 - DNA, 25 bp, Homo sapien
ctgaggttcactgcggtgcccaaga

SEQ ID NO: 236092 - DNA, 25 bp, Homo sapien
ggtgcccaagaaccaccaggcggtc

SEQ ID NO: 236093 - DNA, 25 bp, Homo sapien
gtccggaacccgtgagcggctgcca

SEQ ID NO: 236094 - DNA, 25 bp, Homo sapien
gcagaacgggtaaactctgtttcct

SEQ ID NO: 236095 - DNA, 25 bp, Homo sapien
aactctgtttcctttgtccgtcctg

SEQ ID NO: 236096 - DNA, 25 bp, Homo sapien
ttgtccgtcctgttgtgagtaactg

SEQ ID NO: 236097 - DNA, 25 bp, Homo sapien
gtgagtaactgaagcctaggccccg

SEQ ID NO: 236098 - DNA, 25 bp, Homo sapien
gagacaccattacttgatgcttttg

SEQ ID NO: 236099 - DNA, 25 bp, Homo sapien
tgagccactgcttgtttatgatgga

SEQ ID NO: 236100 - DNA, 25 bp, Homo sapien
gagccactgcttgtttatgatggag

SEQ ID NO: 236101 - DNA, 25 bp, Homo sapien
agccactgcttgtttatgatggagg

SEQ ID NO: 236102 - DNA, 25 bp, Homo sapien
gccactgcttgtttatgatggagga

SEQ ID NO: 236103 - DNA, 25 bp, Homo sapien
ccactgcttgtttatgatggaggat

SEQ ID NO: 236104 - DNA, 25 bp, Homo sapien
cactgcttgtttatgatggaggatg

SEQ ID NO: 236105 - DNA, 25 bp, Homo sapien
actgcttgtttatgatggaggatga

SEQ ID NO: 236106 - DNA, 25 bp, Homo sapien
ctgcttgtttatgatggaggatgaa

SEQ ID NO: 236107 - DNA, 25 bp, Homo sapien
tatgatggaggatgaaatccacacc

SEQ ID NO: 236108 - DNA, 25 bp, Homo sapien
atgatggaggatgaaatccacacct

SEQ ID NO: 236109 - DNA, 25 bp, Homo sapien
tgatggaggatgaaatccacacctc

SEQ ID NO: 236110 - DNA, 25 bp, Homo sapien
aatgggtctggcagaatgaactgca

SEQ ID NO: 236111 - DNA, 25 bp, Homo sapien
actgcaagcgccaaggcccagaggc

SEQ ID NO: 236112 - DNA, 25 bp, Homo sapien
aagcgcatgttttgattgaggaagc

SEQ ID NO: 236113 - DNA, 25 bp, Homo sapien
gcaagagcagcttagtatgcctaga

SEQ ID NO: 236114 - DNA, 25 bp, Homo sapien
atgcctagaacctaactggagacgg

SEQ ID NO: 236115 - DNA, 25 bp, Homo sapien
gacgggaaatggttctatagacgat

SEQ ID NO: 236116 - DNA, 25 bp, Homo sapien
gatgttagagttcaactatggctac

SEQ ID NO: 236117 - DNA, 25 bp, Homo sapien
aactatggctacattccagtcttcc

SEQ ID NO: 236118 - DNA, 25 bp, Homo sapien
caggaggtggtgatccttaagccaa

SEQ ID NO: 236119 - DNA, 25 bp, Homo sapien
ggtgatccttaagccaagtacgaat

SEQ ID NO: 236120 - DNA, 25 bp, Homo sapien
gccaagtacgaataggagccaacta

SEQ ID NO: 236121 - DNA, 25 bp, Homo sapien
aaggctggagtcttagacctctaaa

SEQ ID NO: 236122 - DNA, 25 bp, Homo sapien
tgccctgagcagtgacacctttgtg

SEQ ID NO: 236123 - DNA, 25 bp, Homo sapien
tgagcagtgacacctttgtgttttt

SEQ ID NO: 236124 - DNA, 25 bp, Homo sapien
gtgtttttatgtctccgccagcgcc

SEQ ID NO: 236125 - DNA, 25 bp, Homo sapien
gccagcgccgtaacagagcctgttt

SEQ ID NO: 236126 - DNA, 25 bp, Homo sapien
gagtattacttaaattcaggcttaa

SEQ ID NO: 236127 - DNA, 25 bp, Homo sapien
gcttaaatgtgctatgaagggcatt

SEQ ID NO: 236128 - DNA, 25 bp, Homo sapien
tatcccatttgccttgtaagttata

SEQ ID NO: 236129 - DNA, 25 bp, Homo sapien
gcaatatttagtttcatccagctct

SEQ ID NO: 236130 - DNA, 25 bp, Homo sapien
gtttcatccagctcttatgaataat

SEQ ID NO: 236131 - DNA, 25 bp, Homo sapien
taataacctcatagattcctgatct

SEQ ID NO: 236132 - DNA, 25 bp, Homo sapien
gtccggaacccgtgagcggctgcca

SEQ ID NO: 236133 - DNA, 25 bp, Homo sapien
gcagaacgggtaaactctgtttcct

SEQ ID NO: 236134 - DNA, 25 bp, Homo sapien
aactctgtttcctttgtccgtcctg

SEQ ID NO: 236135 - DNA, 25 bp, Homo sapien
tcctttgtccgtcctgttgtgagta

SEQ ID NO: 236136 - DNA, 25 bp, Homo sapien
ctttgtccgtcctgttgtgagtaac

SEQ ID NO: 236137 - DNA, 25 bp, Homo sapien
ttgtccgtcctgttgtgagtaactg

SEQ ID NO: 236138 - DNA, 25 bp, Homo sapien
gtccgtcctgttgtgagtaactgaa

SEQ ID NO: 236139 - DNA, 25 bp, Homo sapien
gtcctgttgtgagtaactgaagcct

SEQ ID NO: 236140 - DNA, 25 bp, Homo sapien
ttgtgagtaactgaagcctaggccc

SEQ ID NO: 236141 - DNA, 25 bp, Homo sapien
gtgagtaactgaagcctaggccccg

SEQ ID NO: 236142 - DNA, 25 bp, Homo sapien
tgagtaactgaagcctaggccccgt

SEQ ID NO: 236143 - DNA, 25 bp, Homo sapien
caggtctgtcccacgtggtaaggcg

SEQ ID NO: 236144 - DNA, 25 bp, Homo sapien
tgccggtactgagggcgatactggg

SEQ ID NO: 236145 - DNA, 25 bp, Homo sapien
ggcgcagctgattccgggccccaga

SEQ ID NO: 236146 - DNA, 25 bp, Homo sapien
gggccccagagaactgcctatcagt

SEQ ID NO: 236147 - DNA, 25 bp, Homo sapien
agagaactgcctatcagtggcaggg

SEQ ID NO: 236148 - DNA, 25 bp, Homo sapien
aatctcaccagcctgtattctgtag

SEQ ID NO: 236149 - DNA, 25 bp, Homo sapien
ctcaccagcctgtattctgtaggga

SEQ ID NO: 236150 - DNA, 25 bp, Homo sapien
accagcctgtattctgtagggatgg

SEQ ID NO: 236151 - DNA, 25 bp, Homo sapien
ggtaagacccgtgagcgacggtcaa

SEQ ID NO: 236152 - DNA, 25 bp, Homo sapien
tgagcgacggtcaacaggtctgtcc

SEQ ID NO: 236153 - DNA, 25 bp, Homo sapien
tcaacaggtctgtcccacgtggtaa

SEQ ID NO: 236154 - DNA, 25 bp, Homo sapien
gaagagctgcatacatatgcccaac

SEQ ID NO: 236155 - DNA, 25 bp, Homo sapien
ctcatgtcttcatccaaagtttgaa

SEQ ID NO: 236156 - DNA, 25 bp, Homo sapien
atatgcccaacaattcagcgacagc

SEQ ID NO: 236157 - DNA, 25 bp, Homo sapien
agcgacagcaccatcagcccagatg

SEQ ID NO: 236158 - DNA, 25 bp, Homo sapien
gcaaagtccgagatggtcagaagga

SEQ ID NO: 236159 - DNA, 25 bp, Homo sapien
agtgtccactgctctagtctcagga

SEQ ID NO: 236160 - DNA, 25 bp, Homo sapien
actgctctagtctcaggacagcctg

SEQ ID NO: 236161 - DNA, 25 bp, Homo sapien
aggacagcctgctctgttaaagcac

SEQ ID NO: 236162 - DNA, 25 bp, Homo sapien
tctgttaaagcacctggtccttctt

SEQ ID NO: 236163 - DNA, 25 bp, Homo sapien
aagcacctggtccttcttcctgaag

SEQ ID NO: 236164 - DNA, 25 bp, Homo sapien
aaggtgctagacatgtaaagggact

SEQ ID NO: 236165 - DNA, 25 bp, Homo sapien
gagaagcactggagaccctccagaa

SEQ ID NO: 236166 - DNA, 25 bp, Homo sapien
ccagaagcagtagtgctagcagtca

SEQ ID NO: 236167 - DNA, 25 bp, Homo sapien
tggccaccctatcccaggtatgtga

SEQ ID NO: 236168 - DNA, 25 bp, Homo sapien
ccctatcccaggtatgtgacacttg

SEQ ID NO: 236169 - DNA, 25 bp, Homo sapien
gtatgtgacacttggctggctgttc

SEQ ID NO: 236170 - DNA, 25 bp, Homo sapien
ggctggctgttctttattgtcctgc

SEQ ID NO: 236171 - DNA, 25 bp, Homo sapien
gctgttctttattgtcctgctagta

SEQ ID NO: 236172 - DNA, 25 bp, Homo sapien
ttctttattgtcctgctagtacctg

SEQ ID NO: 236173 - DNA, 25 bp, Homo sapien
attgtcctgctagtacctgttgtaa

SEQ ID NO: 236174 - DNA, 25 bp, Homo sapien
gtacctgttgtaaagcttcttttat

SEQ ID NO: 236175 - DNA, 25 bp, Homo sapien
cataaattgaagagattcacaccaa

SEQ ID NO: 236176 - DNA, 25 bp, Homo sapien
atggaacatatatgttgggttttga

SEQ ID NO: 236177 - DNA, 25 bp, Homo sapien
gggttttgattttgggtagcaattg

SEQ ID NO: 236178 - DNA, 25 bp, Homo sapien
ggttttgattttgggtagcaattga

SEQ ID NO: 236179 - DNA, 25 bp, Homo sapien
acaagttgaattttgttaacatata

SEQ ID NO: 236180 - DNA, 25 bp, Homo sapien
ccctgagaagaagccctgttgtttt

SEQ ID NO: 236181 - DNA, 25 bp, Homo sapien
tgagaagaagccctgttgtttttct

SEQ ID NO: 236182 - DNA, 25 bp, Homo sapien
ttttcttaagagtctaaaactgaca

SEQ ID NO: 236183 - DNA, 25 bp, Homo sapien
cttaagagtctaaaactgacaatct

SEQ ID NO: 236184 - DNA, 25 bp, Homo sapien
aagagtctaaaactgacaatctttt

SEQ ID NO: 236185 - DNA, 25 bp, Homo sapien
agagtctaaaactgacaatctttta

SEQ ID NO: 236186 - DNA, 25 bp, Homo sapien
gagtctaaaactgacaatcttttaa

SEQ ID NO: 236187 - DNA, 25 bp, Homo sapien
tactaggaataaaagagggctcaac

SEQ ID NO: 236188 - DNA, 25 bp, Homo sapien
agtcctcctcccatgaaacatggct

SEQ ID NO: 236189 - DNA, 25 bp, Homo sapien
cccatgaaacatggctggatttttc

SEQ ID NO: 236190 - DNA, 25 bp, Homo sapien
ttgtcctgtgtaacctcccttactt

SEQ ID NO: 236191 - DNA, 25 bp, Homo sapien
tgtaacctcccttactttatcatag

SEQ ID NO: 236192 - DNA, 25 bp, Homo sapien
tttatcatagtttactgccttagtt

SEQ ID NO: 236193 - DNA, 25 bp, Homo sapien
tttactgccttagttactctctcat

SEQ ID NO: 236194 - DNA, 25 bp, Homo sapien
ttactctctcattcctccaaggaga

SEQ ID NO: 236195 - DNA, 25 bp, Homo sapien
tcattcctccaaggagagcctcaag

SEQ ID NO: 236196 - DNA, 25 bp, Homo sapien
aggtaacaccagagtgtggccccag

SEQ ID NO: 236197 - DNA, 25 bp, Homo sapien
agagtgtggccccagccagttgccc

SEQ ID NO: 236198 - DNA, 25 bp, Homo sapien
ggaggtgaagacagtaactcttact

SEQ ID NO: 236199 - DNA, 25 bp, Homo sapien
ctaagctattttctcctggaaacac

SEQ ID NO: 236200 - DNA, 25 bp, Homo sapien
ttttctcctggaaacacagacgctc

SEQ ID NO: 236201 - DNA, 25 bp, Homo sapien
aacacagacgctccctgagagagaa

SEQ ID NO: 236202 - DNA, 25 bp, Homo sapien
aatggtgcaaactccactatctgga

SEQ ID NO: 236203 - DNA, 25 bp, Homo sapien
gggactgctgctacccgtgggatca

SEQ ID NO: 236204 - DNA, 25 bp, Homo sapien
atcacggcccctccgtggatttggg

SEQ ID NO: 236205 - DNA, 25 bp, Homo sapien
tctggaaatggaactctgggctaat

SEQ ID NO: 236206 - DNA, 25 bp, Homo sapien
tgggctaatacctcagctcggcaat

SEQ ID NO: 236207 - DNA, 25 bp, Homo sapien
agctcggcaatgtttttccttctta

SEQ ID NO: 236208 - DNA, 25 bp, Homo sapien
ccttcttaccccagctggaggtgaa

SEQ ID NO: 236209 - DNA, 25 bp, Homo sapien
ttgctgtttgttgttgtggcagttt

SEQ ID NO: 236210 - DNA, 25 bp, Homo sapien
ttttggtctatcaagctatggaaac

SEQ ID NO: 236211 - DNA, 25 bp, Homo sapien
caaccaagtaaatcccttctctaat

SEQ ID NO: 236212 - DNA, 25 bp, Homo sapien
aatcccttctctaattttcttcatg

SEQ ID NO: 236213 - DNA, 25 bp, Homo sapien
aattttcttcatgttgaccctagaa

SEQ ID NO: 236214 - DNA, 25 bp, Homo sapien
tggtatctctttggcacgttcaact

SEQ ID NO: 236215 - DNA, 25 bp, Homo sapien
gcacgttcaacttggtctcctattt

SEQ ID NO: 236216 - DNA, 25 bp, Homo sapien
ggtctcctattttcaataactgttg

SEQ ID NO: 236217 - DNA, 25 bp, Homo sapien
atttgtgtacacttgttgactccaa

SEQ ID NO: 236218 - DNA, 25 bp, Homo sapien
aaaataatgtgatttcgcctcaata

SEQ ID NO: 236219 - DNA, 25 bp, Homo sapien
gtgatttcgcctcaataaatgtagt

SEQ ID NO: 236220 - DNA, 25 bp, Homo sapien
gttaaataccacaggttctttgtgt

SEQ ID NO: 236221 - DNA, 25 bp, Homo sapien
attctgcccatgaccagtgacacca

SEQ ID NO: 236222 - DNA, 25 bp, Homo sapien
caaggctaagagtgagttctattga

SEQ ID NO: 236223 - DNA, 25 bp, Homo sapien
tgctgctgggatgcaaaacaatcag

SEQ ID NO: 236224 - DNA, 25 bp, Homo sapien
atcagaattttcgaagagtttgctt

SEQ ID NO: 236225 - DNA, 25 bp, Homo sapien
gagtttgcttcctttttgtgcattt

SEQ ID NO: 236226 - DNA, 25 bp, Homo sapien
agtgacaccaccttggaaaatgcag

SEQ ID NO: 236227 - DNA, 25 bp, Homo sapien
cttggaaaatgcaggtcacaccagt

SEQ ID NO: 236228 - DNA, 25 bp, Homo sapien
gtcaccaccatcaaaaacgcatttc

SEQ ID NO: 236229 - DNA, 25 bp, Homo sapien
caaaaacgcatttcaggcttctgta

SEQ ID NO: 236230 - DNA, 25 bp, Homo sapien
gcatttcaggcttctgtacatttaa

SEQ ID NO: 236231 - DNA, 25 bp, Homo sapien
ttgttgtttttaatgtctccagctt

SEQ ID NO: 236232 - DNA, 25 bp, Homo sapien
ttgtttttaatgtctccagcttgga

SEQ ID NO: 236233 - DNA, 25 bp, Homo sapien
acatctgcatcttaatgtacaggca

SEQ ID NO: 236234 - DNA, 25 bp, Homo sapien
ctgcatcttaatgtacaggcagtgc

SEQ ID NO: 236235 - DNA, 25 bp, Homo sapien
cagtgctaaaatagacatcttaata

SEQ ID NO: 236236 - DNA, 25 bp, Homo sapien
ttaatgtctccagcttggactgcag

SEQ ID NO: 236237 - DNA, 25 bp, Homo sapien
ttgttccatgaatatttaccttgta

SEQ ID NO: 236238 - DNA, 25 bp, Homo sapien
gttccatgaatatttaccttgtaga

SEQ ID NO: 236239 - DNA, 25 bp, Homo sapien
gaatatttaccttgtagatatacag

SEQ ID NO: 236240 - DNA, 25 bp, Homo sapien
gtagatatacagagtttccttaaaa

SEQ ID NO: 236241 - DNA, 25 bp, Homo sapien
ttctactagaaatacacaccccaca

SEQ ID NO: 236242 - DNA, 25 bp, Homo sapien
ttcatcctgccaggcgctttgcccg

SEQ ID NO: 236243 - DNA, 25 bp, Homo sapien
ccccaaactgtctgactctgtgttt

SEQ ID NO: 236244 - DNA, 25 bp, Homo sapien
cccaaactgtctgactctgtgtttc

SEQ ID NO: 236245 - DNA, 25 bp, Homo sapien
gtcttgcactggcagctgtaataca

SEQ ID NO: 236246 - DNA, 25 bp, Homo sapien
tgcactggcagctgtaatacaaagg

SEQ ID NO: 236247 - DNA, 25 bp, Homo sapien
taatacaaagggaactcgccccact

SEQ ID NO: 236248 - DNA, 25 bp, Homo sapien
tacaaagggaactcgccccacttct

SEQ ID NO: 236249 - DNA, 25 bp, Homo sapien
agcgcttcctctggggctgacaaca

SEQ ID NO: 236250 - DNA, 25 bp, Homo sapien
gggctgacaacaggcccctgactca

SEQ ID NO: 236251 - DNA, 25 bp, Homo sapien
acctcccagggtccatggccagggc

SEQ ID NO: 236252 - DNA, 25 bp, Homo sapien
gtttggggggccacttgcccttcat

SEQ ID NO: 236253 - DNA, 25 bp, Homo sapien
gaacaaacactcttaactcctaatt

SEQ ID NO: 236254 - DNA, 25 bp, Homo sapien
aactcctaattgttctttgacacgt

SEQ ID NO: 236255 - DNA, 25 bp, Homo sapien
tgttctttgacacgtagtaattctg

SEQ ID NO: 236256 - DNA, 25 bp, Homo sapien
gacacgtagtaattctgtgacatac

SEQ ID NO: 236257 - DNA, 25 bp, Homo sapien
gtagtaattctgtgacatacttttt

SEQ ID NO: 236258 - DNA, 25 bp, Homo sapien
ttttttcttatagcaatacactgta

SEQ ID NO: 236259 - DNA, 25 bp, Homo sapien
ctgtaatatcagaaatggttggcct

SEQ ID NO: 236260 - DNA, 25 bp, Homo sapien
atcagaaatggttggcctgagcaac

SEQ ID NO: 236261 - DNA, 25 bp, Homo sapien
tggcctgagcaacctagtaagacct

SEQ ID NO: 236262 - DNA, 25 bp, Homo sapien
gcttgagacctagcaatcagtcagg

SEQ ID NO: 236263 - DNA, 25 bp, Homo sapien
cctagcaatcagtcagggctgcagt

SEQ ID NO: 236264 - DNA, 25 bp, Homo sapien
acactctgatgcaagtaatttatct

SEQ ID NO: 236265 - DNA, 25 bp, Homo sapien
gtaatttatctcttcattgactggt

SEQ ID NO: 236266 - DNA, 25 bp, Homo sapien
atctcttcattgactggtagcaacc

SEQ ID NO: 236267 - DNA, 25 bp, Homo sapien
ggtagcaaccaattcatggaccagt

SEQ ID NO: 236268 - DNA, 25 bp, Homo sapien
tggaccagtaccatggaccacactt

SEQ ID NO: 236269 - DNA, 25 bp, Homo sapien
atatcctgggatagtgcatgttcac

SEQ ID NO: 236270 - DNA, 25 bp, Homo sapien
gatagtgcatgttcaccatctattt

SEQ ID NO: 236271 - DNA, 25 bp, Homo sapien
aataatactttgctttcatgatata

SEQ ID NO: 236272 - DNA, 25 bp, Homo sapien
gttaagtttagcaatatagactcta

SEQ ID NO: 236273 - DNA, 25 bp, Homo sapien
tatatcccagtatctgtatgtctgt

SEQ ID NO: 236274 - DNA, 25 bp, Homo sapien
cccagtatctgtatgtctgtataaa

SEQ ID NO: 236275 - DNA, 25 bp, Homo sapien
gggtgaggaatctggtcgctctcca

SEQ ID NO: 236276 - DNA, 25 bp, Homo sapien
aatctggtcgctctccaaggctaca

SEQ ID NO: 236277 - DNA, 25 bp, Homo sapien
aaggctacagcgaccggagtccttc

SEQ ID NO: 236278 - DNA, 25 bp, Homo sapien
ctacagcgaccggagtccttcaggg

SEQ ID NO: 236279 - DNA, 25 bp, Homo sapien
gagactgtgcagtcagcagtacaac

SEQ ID NO: 236280 - DNA, 25 bp, Homo sapien
tgtgcagtcagcagtacaacctgtt

SEQ ID NO: 236281 - DNA, 25 bp, Homo sapien
gtcagcagtacaacctgttggagaa

SEQ ID NO: 236282 - DNA, 25 bp, Homo sapien
aagatggctgaatcgaggtgtcttt

SEQ ID NO: 236283 - DNA, 25 bp, Homo sapien
gctggcttcggtcctcttccctggg

SEQ ID NO: 236284 - DNA, 25 bp, Homo sapien
gaggctggaggaaaccgatttctct

SEQ ID NO: 236285 - DNA, 25 bp, Homo sapien
gaaaccgatttctctgcaccctaat

SEQ ID NO: 236286 - DNA, 25 bp, Homo sapien
gccacacacaacttttgaactttta

SEQ ID NO: 236287 - DNA, 25 bp, Homo sapien
cagtaaaatgtgtgaatgtttcttt

SEQ ID NO: 236288 - DNA, 25 bp, Homo sapien
gaatgtttctttatgtattaacctc

SEQ ID NO: 236289 - DNA, 25 bp, Homo sapien
atgtattaacctcatagcagtaaat

SEQ ID NO: 236290 - DNA, 25 bp, Homo sapien
aacctcatagcagtaaatgacttgc

SEQ ID NO: 236291 - DNA, 25 bp, Homo sapien
catagcagtaaatgacttgctgttg

SEQ ID NO: 236292 - DNA, 25 bp, Homo sapien
ggcatcttaatagacttctgttgaa

SEQ ID NO: 236293 - DNA, 25 bp, Homo sapien
gacttctgttgaaaacttcagtgtt

SEQ ID NO: 236294 - DNA, 25 bp, Homo sapien
gttgaaaacttcagtgttaacattt

SEQ ID NO: 236295 - DNA, 25 bp, Homo sapien
tttgtactaaatttaaccgtgatat

SEQ ID NO: 236296 - DNA, 25 bp, Homo sapien
atgaattttatgcatagatcagaat

SEQ ID NO: 236297 - DNA, 25 bp, Homo sapien
agaaagcacagtggccccagaggac

SEQ ID NO: 236298 - DNA, 25 bp, Homo sapien
aaacagagcactatctggagggaca

SEQ ID NO: 236299 - DNA, 25 bp, Homo sapien
tggagggacaggcacacccgcaaca

SEQ ID NO: 236300 - DNA, 25 bp, Homo sapien
aagtgcacctccaaagtcacctacg

SEQ ID NO: 236301 - DNA, 25 bp, Homo sapien
gccatagcaaaacaacccaagggtg

SEQ ID NO: 236302 - DNA, 25 bp, Homo sapien
aagtcacctacgctgcagcatggct

SEQ ID NO: 236303 - DNA, 25 bp, Homo sapien
cagcatggctcttgccctttctgag

SEQ ID NO: 236304 - DNA, 25 bp, Homo sapien
cctttctgagcctgggtatagctga

SEQ ID NO: 236305 - DNA, 25 bp, Homo sapien
gtggttgaatcaaactcagggaatt

SEQ ID NO: 236306 - DNA, 25 bp, Homo sapien
gggaattagaggagcatcagccaat

SEQ ID NO: 236307 - DNA, 25 bp, Homo sapien
agcatcagccaatgcaagcaggtct

SEQ ID NO: 236308 - DNA, 25 bp, Homo sapien
actggactgggatccttgaattctc

SEQ ID NO: 236309 - DNA, 25 bp, Homo sapien
tctccccagactttgacttttgata

SEQ ID NO: 236310 - DNA, 25 bp, Homo sapien
gactttgacttttgataactctgca

SEQ ID NO: 236311 - DNA, 25 bp, Homo sapien
gattcttgaaagagctgtggctcca

SEQ ID NO: 236312 - DNA, 25 bp, Homo sapien
gtggctccatgctgaatgcacacat

SEQ ID NO: 236313 - DNA, 25 bp, Homo sapien
tgaatgcacacatgtactcagaggg

SEQ ID NO: 236314 - DNA, 25 bp, Homo sapien
actcagagggattcaggtgggcatt

SEQ ID NO: 236315 - DNA, 25 bp, Homo sapien
ggaaaggacaaagctctctaaactg

SEQ ID NO: 236316 - DNA, 25 bp, Homo sapien
gtgcttggaccctttgcccagggaa

SEQ ID NO: 236317 - DNA, 25 bp, Homo sapien
tttgcccagggaaccaggacatcag

SEQ ID NO: 236318 - DNA, 25 bp, Homo sapien
gaaataatgttccttctgtggaagg

SEQ ID NO: 236319 - DNA, 25 bp, Homo sapien
gtaccaaatttaggggtcttgcatg

SEQ ID NO: 236320 - DNA, 25 bp, Homo sapien
gggtcttgcatgtcagcaagtgata

SEQ ID NO: 236321 - DNA, 25 bp, Homo sapien
ataaatgcaagctatttctggaggg

SEQ ID NO: 236322 - DNA, 25 bp, Homo sapien
ggaaaaatgtgtgtggctcttacgt

SEQ ID NO: 236323 - DNA, 25 bp, Homo sapien
aaaaatgtgtgtggctcttacgttt

SEQ ID NO: 236324 - DNA, 25 bp, Homo sapien
aaatgtgtgtggctcttacgttttc

SEQ ID NO: 236325 - DNA, 25 bp, Homo sapien
atgtgtgtggctcttacgttttctg

SEQ ID NO: 236326 - DNA, 25 bp, Homo sapien
gtggctcttacgttttctgggaatt

SEQ ID NO: 236327 - DNA, 25 bp, Homo sapien
gcaaccttataactctggagttgta

SEQ ID NO: 236328 - DNA, 25 bp, Homo sapien
ataactctggagttgtagtttgaca

SEQ ID NO: 236329 - DNA, 25 bp, Homo sapien
tggagttgtagtttgacagaaccat

SEQ ID NO: 236330 - DNA, 25 bp, Homo sapien
aagtatttcccatttcttgccacct

SEQ ID NO: 236331 - DNA, 25 bp, Homo sapien
catttcttgccacctctacaatagt

SEQ ID NO: 236332 - DNA, 25 bp, Homo sapien
ataatttccaagttgatttgacatg

SEQ ID NO: 236333 - DNA, 25 bp, Homo sapien
aatcctgagaggtatatagagcaag

SEQ ID NO: 236334 - DNA, 25 bp, Homo sapien
gagattgattggctctaggttatat

SEQ ID NO: 236335 - DNA, 25 bp, Homo sapien
tggctctaggttatatagctaactg

SEQ ID NO: 236336 - DNA, 25 bp, Homo sapien
ttatatagctaactggtaacaaacc

SEQ ID NO: 236337 - DNA, 25 bp, Homo sapien
gatgaacatcgcttgtgtttttctt

SEQ ID NO: 236338 - DNA, 25 bp, Homo sapien
gaacatcgcttgtgtttttcttgca

SEQ ID NO: 236339 - DNA, 25 bp, Homo sapien
atcgcttgtgtttttcttgcatgta

SEQ ID NO: 236340 - DNA, 25 bp, Homo sapien
ttgtgtttttcttgcatgtagtttc

SEQ ID NO: 236341 - DNA, 25 bp, Homo sapien
gcaaatttgtcattagatgcattcc

SEQ ID NO: 236342 - DNA, 25 bp, Homo sapien
agatgcattccttctaacgttacca

SEQ ID NO: 236343 - DNA, 25 bp, Homo sapien
tgcattccttctaacgttaccaggg

SEQ ID NO: 236344 - DNA, 25 bp, Homo sapien
tcaaggctgtttctgaagtctgtgt

SEQ ID NO: 236345 - DNA, 25 bp, Homo sapien
aggctgtttctgaagtctgtgtgtt

SEQ ID NO: 236346 - DNA, 25 bp, Homo sapien
atggtgggacttacctctgtcctac

SEQ ID NO: 236347 - DNA, 25 bp, Homo sapien
gggacttacctctgtcctacttgat

SEQ ID NO: 236348 - DNA, 25 bp, Homo sapien
acctctgtcctacttgatcacaaat

SEQ ID NO: 236349 - DNA, 25 bp, Homo sapien
ctgtcctacttgatcacaaattatg

SEQ ID NO: 236350 - DNA, 25 bp, Homo sapien
gaaatttggttttgctcatttaaga

SEQ ID NO: 236351 - DNA, 25 bp, Homo sapien
tactgttgtcttcaataatgtgtaa

SEQ ID NO: 236352 - DNA, 25 bp, Homo sapien
gaaaatgtcgccttagtttggtgta

SEQ ID NO: 236353 - DNA, 25 bp, Homo sapien
gtcgccttagtttggtgtacagtac

SEQ ID NO: 236354 - DNA, 25 bp, Homo sapien
tgtacagtacgtgcaggcaggtctt

SEQ ID NO: 236355 - DNA, 25 bp, Homo sapien
ggcaggtcttggaggcacgtttaaa

SEQ ID NO: 236356 - DNA, 25 bp, Homo sapien
ttcattgaaagggacgcagagccgt

SEQ ID NO: 236357 - DNA, 25 bp, Homo sapien
gacgcagagccgtctggaagcgcct

SEQ ID NO: 236358 - DNA, 25 bp, Homo sapien
actcagcgagtttggactcagcgag

SEQ ID NO: 236359 - DNA, 25 bp, Homo sapien
gactcagcgagtttgagcttaccga

SEQ ID NO: 236360 - DNA, 25 bp, Homo sapien
ttaccgaatgaactttggacgtctt

SEQ ID NO: 236361 - DNA, 25 bp, Homo sapien
tggacgtcttcttttagcaaacaaa

SEQ ID NO: 236362 - DNA, 25 bp, Homo sapien
ggaagcaaaaaagacccacattctt

SEQ ID NO: 236363 - DNA, 25 bp, Homo sapien
gtgtgttcacacaaattgctctgca

SEQ ID NO: 236364 - DNA, 25 bp, Homo sapien
cacacaaattgctctgcattcagtg

SEQ ID NO: 236365 - DNA, 25 bp, Homo sapien
ctgcattcagtgttcattgtgaatt

SEQ ID NO: 236366 - DNA, 25 bp, Homo sapien
tagaaagaagcctcctacccagcaa

SEQ ID NO: 236367 - DNA, 25 bp, Homo sapien
tacccagcaaaccagtagacccaaa

SEQ ID NO: 236368 - DNA, 25 bp, Homo sapien
gcaaaccagtagacccaaaagttga

SEQ ID NO: 236369 - DNA, 25 bp, Homo sapien
aactgatgacagacaacaagcatga

SEQ ID NO: 236370 - DNA, 25 bp, Homo sapien
gaagatggcatatttgatgtcactt

SEQ ID NO: 236371 - DNA, 25 bp, Homo sapien
tcccagaaggcttatacagtgactc

SEQ ID NO: 236372 - DNA, 25 bp, Homo sapien
tgactcagtcgggaagctttccagc

SEQ ID NO: 236373 - DNA, 25 bp, Homo sapien
tggcatgtctggcagtagtctctca

SEQ ID NO: 236374 - DNA, 25 bp, Homo sapien
taagaataggatttcggaaggcgac

SEQ ID NO: 236375 - DNA, 25 bp, Homo sapien
ataggatttcggaaggcgacagaaa

SEQ ID NO: 236376 - DNA, 25 bp, Homo sapien
gaaggcgacagaaaatttagttctt

SEQ ID NO: 236377 - DNA, 25 bp, Homo sapien
caaactcaggtttatctagttccaa

SEQ ID NO: 236378 - DNA, 25 bp, Homo sapien
tttaaatagaaagttgtgtgcccct

SEQ ID NO: 236379 - DNA, 25 bp, Homo sapien
tagaaagttgtgtgcccctatagaa

SEQ ID NO: 236380 - DNA, 25 bp, Homo sapien
agttgtgtgcccctatagaaaatat

SEQ ID NO: 236381 - DNA, 25 bp, Homo sapien
gtgtgcccctatagaaaatatttga

SEQ ID NO: 236382 - DNA, 25 bp, Homo sapien
ttgagaatttcttatactatcaaga

SEQ ID NO: 236383 - DNA, 25 bp, Homo sapien
ttctgccacaccatgttagtagaaa

SEQ ID NO: 236384 - DNA, 25 bp, Homo sapien
ctgccacaccatgttagtagaaatg

SEQ ID NO: 236385 - DNA, 25 bp, Homo sapien
gactttcaattatctgtgtgacctg

SEQ ID NO: 236386 - DNA, 25 bp, Homo sapien
tcatccaattgttcttggcccaaac

SEQ ID NO: 236387 - DNA, 25 bp, Homo sapien
ccaaacaataccaatctgcccaaaa

SEQ ID NO: 236388 - DNA, 25 bp, Homo sapien
taaacatgaagatccttgtgccaaa

SEQ ID NO: 236389 - DNA, 25 bp, Homo sapien
ttgtgccaaacgtctggccaatgtc

SEQ ID NO: 236390 - DNA, 25 bp, Homo sapien
gccaatgtcgttcgccaagtacaga

SEQ ID NO: 236391 - DNA, 25 bp, Homo sapien
agacttctggaggactgtggactga

SEQ ID NO: 236392 - DNA, 25 bp, Homo sapien
agtgcatagcacagctcagtcctga

SEQ ID NO: 236393 - DNA, 25 bp, Homo sapien
agcaggccgccattcaggagctcct

SEQ ID NO: 236394 - DNA, 25 bp, Homo sapien
aggagctcctgaactctgcgtgaag

SEQ ID NO: 236395 - DNA, 25 bp, Homo sapien
gaactctgcgtgaagggccttaatg

SEQ ID NO: 236396 - DNA, 25 bp, Homo sapien
atatttgaatatcacccctaggtaa

SEQ ID NO: 236397 - DNA, 25 bp, Homo sapien
ctaggtctgtgtaacctcagatctg

SEQ ID NO: 236398 - DNA, 25 bp, Homo sapien
agatctggattctttgcagggcctc

SEQ ID NO: 236399 - DNA, 25 bp, Homo sapien
agggcctctcatactcctttaatgg

SEQ ID NO: 236400 - DNA, 25 bp, Homo sapien
ttaatggctggctcaggttctgcac

SEQ ID NO: 236401 - DNA, 25 bp, Homo sapien
ttctgcacctctggatgcagtgggt

SEQ ID NO: 236402 - DNA, 25 bp, Homo sapien
tgcagtgggtgttgtgattgcctat

SEQ ID NO: 236403 - DNA, 25 bp, Homo sapien
tgattgcctatgtggactctctttc

SEQ ID NO: 236404 - DNA, 25 bp, Homo sapien
aattgtagtctacctggtttccctg

SEQ ID NO: 236405 - DNA, 25 bp, Homo sapien
acacagcagtgtctgccacatgacc

SEQ ID NO: 236406 - DNA, 25 bp, Homo sapien
gccacatgaccatgctgcattggtt

SEQ ID NO: 236407 - DNA, 25 bp, Homo sapien
acagattgatgggtaacaggtaaaa

SEQ ID NO: 236408 - DNA, 25 bp, Homo sapien
gatgggtaacaggtaaaatatgaca

SEQ ID NO: 236409 - DNA, 25 bp, Homo sapien
taaaatatgacatgtatagcttaca

SEQ ID NO: 236410 - DNA, 25 bp, Homo sapien
tgtatagcttacatgttattatttg

SEQ ID NO: 236411 - DNA, 25 bp, Homo sapien
acatttcaaaatctgggtatactta

SEQ ID NO: 236412 - DNA, 25 bp, Homo sapien
aaatctgggtatacttataatccat

SEQ ID NO: 236413 - DNA, 25 bp, Homo sapien
gggtatacttataatccattagaag

SEQ ID NO: 236414 - DNA, 25 bp, Homo sapien
gtaatggttatggactaaaaagata

SEQ ID NO: 236415 - DNA, 25 bp, Homo sapien
atatatactcatattacatagcagt

SEQ ID NO: 236416 - DNA, 25 bp, Homo sapien
atagcagtatgtttacaaaaggctt

SEQ ID NO: 236417 - DNA, 25 bp, Homo sapien
gcagtatgtttacaaaaggcttata

SEQ ID NO: 236418 - DNA, 25 bp, Homo sapien
gctttcccaaggatacagcgtagcc

SEQ ID NO: 236419 - DNA, 25 bp, Homo sapien
aaggatacagcgtagccagcgggca

SEQ ID NO: 236420 - DNA, 25 bp, Homo sapien
tacagcgtagccagcgggcacccag

SEQ ID NO: 236421 - DNA, 25 bp, Homo sapien
gggaagcagcaagtccccaggactg

SEQ ID NO: 236422 - DNA, 25 bp, Homo sapien
gggaacaaggatcccaaagccgatc

SEQ ID NO: 236423 - DNA, 25 bp, Homo sapien
aaggatcccaaagccgatcacagca

SEQ ID NO: 236424 - DNA, 25 bp, Homo sapien
atcccaaagccgatcacagcaaaga

SEQ ID NO: 236425 - DNA, 25 bp, Homo sapien
atcacagcaaagaagaggtacagca

SEQ ID NO: 236426 - DNA, 25 bp, Homo sapien
agccaggccacaatctggagcgggt

SEQ ID NO: 236427 - DNA, 25 bp, Homo sapien
caaggctctcaacccggctttgggc

SEQ ID NO: 236428 - DNA, 25 bp, Homo sapien
cggctttgggcctccgctgtgccag

SEQ ID NO: 236429 - DNA, 25 bp, Homo sapien
aaacccataactaccaggaataatg

SEQ ID NO: 236430 - DNA, 25 bp, Homo sapien
aggaataatgatacctcccacccct

SEQ ID NO: 236431 - DNA, 25 bp, Homo sapien
caccccttgattcccataacataaa

SEQ ID NO: 236432 - DNA, 25 bp, Homo sapien
gagaatggcatggtaggctactttt

SEQ ID NO: 236433 - DNA, 25 bp, Homo sapien
atggtaggctacttttcagggcctt

SEQ ID NO: 236434 - DNA, 25 bp, Homo sapien
gggccttgacaagtacatcacccag

SEQ ID NO: 236435 - DNA, 25 bp, Homo sapien
tacatcacccagtggtatcctacat

SEQ ID NO: 236436 - DNA, 25 bp, Homo sapien
ggtatcctacatacttctttcaaga

SEQ ID NO: 236437 - DNA, 25 bp, Homo sapien
ctttcaagatcttcaaccatgaggt

SEQ ID NO: 236438 - DNA, 25 bp, Homo sapien
gagccaagttcaaagaaccctagca

SEQ ID NO: 236439 - DNA, 25 bp, Homo sapien
gaaccctagcacaaatttgctttgg

SEQ ID NO: 236440 - DNA, 25 bp, Homo sapien
taaggtcacatttacagggtaccat

SEQ ID NO: 236441 - DNA, 25 bp, Homo sapien
ttacagggtaccatgtgttaggatt

SEQ ID NO: 236442 - DNA, 25 bp, Homo sapien
gggacacaattctacccactacagg

SEQ ID NO: 236443 - DNA, 25 bp, Homo sapien
actacaggcccatatcttatctagg

SEQ ID NO: 236444 - DNA, 25 bp, Homo sapien
tatcttatctaggatgttggtggca

SEQ ID NO: 236445 - DNA, 25 bp, Homo sapien
gattactacctcttttgatataact

SEQ ID NO: 236446 - DNA, 25 bp, Homo sapien
gtttgtatccgtgtccaaactcttt

SEQ ID NO: 236447 - DNA, 25 bp, Homo sapien
caaactctttttctagggagaccag

SEQ ID NO: 236448 - DNA, 25 bp, Homo sapien
ttttctagggagaccagcactggat

SEQ ID NO: 236449 - DNA, 25 bp, Homo sapien
gaccagcactggattagagttcacc

SEQ ID NO: 236450 - DNA, 25 bp, Homo sapien
gagttcaccatgatccaatatgacc

SEQ ID NO: 236451 - DNA, 25 bp, Homo sapien
aattttgctagttaatattgctggc

SEQ ID NO: 236452 - DNA, 25 bp, Homo sapien
tgctagttaatattgctggcagtaa

SEQ ID NO: 236453 - DNA, 25 bp, Homo sapien
ttgctggcagtaagttatttaatgt

SEQ ID NO: 236454 - DNA, 25 bp, Homo sapien
tactttttgattgtccagaatttat

SEQ ID NO: 236455 - DNA, 25 bp, Homo sapien
aaaagtatcttatttctgtactcta

SEQ ID NO: 236456 - DNA, 25 bp, Homo sapien
ctgtactctagctactcataggtaa

SEQ ID NO: 236457 - DNA, 25 bp, Homo sapien
gtactctagctactcataggtaata

SEQ ID NO: 236458 - DNA, 25 bp, Homo sapien
ctctagctactcataggtaatatgt

SEQ ID NO: 236459 - DNA, 25 bp, Homo sapien
atttgatatccacattgagtactaa

SEQ ID NO: 236460 - DNA, 25 bp, Homo sapien
gatatccacattgagtactaatttt

SEQ ID NO: 236461 - DNA, 25 bp, Homo sapien
tccacattgagtactaattttgcta

SEQ ID NO: 236462 - DNA, 25 bp, Homo sapien
gctgtgtgattcttgactttgggta

SEQ ID NO: 236463 - DNA, 25 bp, Homo sapien
gtttttcatccttcatgcagggttc

SEQ ID NO: 236464 - DNA, 25 bp, Homo sapien
atccttcatgcagggttctgtcagt

SEQ ID NO: 236465 - DNA, 25 bp, Homo sapien
gggttctgtcagttcatggtatagt

SEQ ID NO: 236466 - DNA, 25 bp, Homo sapien
aaaatggtggtgtctcagctgtgct

SEQ ID NO: 236467 - DNA, 25 bp, Homo sapien
ggtgtctcagctgtgctgtgcacat

SEQ ID NO: 236468 - DNA, 25 bp, Homo sapien
tgtgcacattccaaccttgtcaaat

SEQ ID NO: 236469 - DNA, 25 bp, Homo sapien
aaattaatagtcctgagcaagcaag

SEQ ID NO: 236470 - DNA, 25 bp, Homo sapien
ggtaataacatacccatttctttat

SEQ ID NO: 236471 - DNA, 25 bp, Homo sapien
gtgctatttttactgagcaaattgt

SEQ ID NO: 236472 - DNA, 25 bp, Homo sapien
gtatgtctcacatgttaacacaata

SEQ ID NO: 236473 - DNA, 25 bp, Homo sapien
gggccaactttgatcacagctccag

SEQ ID NO: 236474 - DNA, 25 bp, Homo sapien
atcacagctccaggaccagtgcagg

SEQ ID NO: 236475 - DNA, 25 bp, Homo sapien
gtctggaataatggacgccgctggc

SEQ ID NO: 236476 - DNA, 25 bp, Homo sapien
gctggcagtccagacatcaattcaa

SEQ ID NO: 236477 - DNA, 25 bp, Homo sapien
aattcaaaactgaagctgcagcaat

SEQ ID NO: 236478 - DNA, 25 bp, Homo sapien
aaagctaatcatgctctctaccaac

SEQ ID NO: 236479 - DNA, 25 bp, Homo sapien
tctctaccaactaccatgaggctaa

SEQ ID NO: 236480 - DNA, 25 bp, Homo sapien
gcaaagtcaacaaacccctattata

SEQ ID NO: 236481 - DNA, 25 bp, Homo sapien
ctattataccttccaccaaattctt

SEQ ID NO: 236482 - DNA, 25 bp, Homo sapien
tctttatcattgtctttcttaggaa

SEQ ID NO: 236483 - DNA, 25 bp, Homo sapien
ggaaacagacatactcattcatttg

SEQ ID NO: 236484 - DNA, 25 bp, Homo sapien
tgggcaacttttttagcactttgga

SEQ ID NO: 236485 - DNA, 25 bp, Homo sapien
gcactttggaaagagtcatcaatct

SEQ ID NO: 236486 - DNA, 25 bp, Homo sapien
gagtcatcaatctttctggtaaatt

SEQ ID NO: 236487 - DNA, 25 bp, Homo sapien
catttttcagactccaccctagaaa

SEQ ID NO: 236488 - DNA, 25 bp, Homo sapien
caccctagaaaatatgtacccctga

SEQ ID NO: 236489 - DNA, 25 bp, Homo sapien
tatgtacccctgaatttggtttgca

SEQ ID NO: 236490 - DNA, 25 bp, Homo sapien
tggtttgcagtttgatactcaggga

SEQ ID NO: 236491 - DNA, 25 bp, Homo sapien
gtattccatagatatcctttccgta

SEQ ID NO: 236492 - DNA, 25 bp, Homo sapien
gatatcctttccgtataaaacacta

SEQ ID NO: 236493 - DNA, 25 bp, Homo sapien
taaaacactaacatctttgagaaat

SEQ ID NO: 236494 - DNA, 25 bp, Homo sapien
tttgagaaattcacctaccaactaa

SEQ ID NO: 236495 - DNA, 25 bp, Homo sapien
atttcgttatagcagtccaagcaaa

SEQ ID NO: 236496 - DNA, 25 bp, Homo sapien
gcagtccaagcaaactaatgcacat

SEQ ID NO: 236497 - DNA, 25 bp, Homo sapien
ttttccactttgttgcaaacaattg

SEQ ID NO: 236498 - DNA, 25 bp, Homo sapien
caaacaattgcaaggtgtccaggtt

SEQ ID NO: 236499 - DNA, 25 bp, Homo sapien
cagcctgcaagtgctcagaggacac

SEQ ID NO: 236500 - DNA, 25 bp, Homo sapien
agaggacacccaaccctatgatctc

SEQ ID NO: 236501 - DNA, 25 bp, Homo sapien
tatgatctcagccaactcatgaagt

SEQ ID NO: 236502 - DNA, 25 bp, Homo sapien
cacaacttagtgatgtcttcccagt

SEQ ID NO: 236503 - DNA, 25 bp, Homo sapien
gatgtcttcccagtggaatcctaaa

SEQ ID NO: 236504 - DNA, 25 bp, Homo sapien
ggtatagagccaagacttgaacatt

SEQ ID NO: 236505 - DNA, 25 bp, Homo sapien
gaacattaacaacccaggagcacag

SEQ ID NO: 236506 - DNA, 25 bp, Homo sapien
catgtgacacggattgctaggagga

SEQ ID NO: 236507 - DNA, 25 bp, Homo sapien
gacacggattgctaggaggaatgaa

SEQ ID NO: 236508 - DNA, 25 bp, Homo sapien
gtatagtttatattccgtaaaccat

SEQ ID NO: 236509 - DNA, 25 bp, Homo sapien
aaatacacagtttctcttaacagtg

SEQ ID NO: 236510 - DNA, 25 bp, Homo sapien
gatgggtgaaaacattttaccggat

SEQ ID NO: 236511 - DNA, 25 bp, Homo sapien
tgaaaacattttaccggattatgga

SEQ ID NO: 236512 - DNA, 25 bp, Homo sapien
gaatgtttaccagaacatgttttga

SEQ ID NO: 236513 - DNA, 25 bp, Homo sapien
acatgttttgattcttgaatgtaca

SEQ ID NO: 236514 - DNA, 25 bp, Homo sapien
atgtacataataatgccatctaact

SEQ ID NO: 236515 - DNA, 25 bp, Homo sapien
gccatctaacttatttacgttcttg

SEQ ID NO: 236516 - DNA, 25 bp, Homo sapien
tacgttcttgtttacatgtgggagc

SEQ ID NO: 236517 - DNA, 25 bp, Homo sapien
tttcttattccccacttgtatatcc

SEQ ID NO: 236518 - DNA, 25 bp, Homo sapien
tgtatatcccctaccagtaccggga

SEQ ID NO: 236519 - DNA, 25 bp, Homo sapien
agtaccgggatctgcacacatcttt

SEQ ID NO: 236520 - DNA, 25 bp, Homo sapien
gcacacatctttttgcagttacctc

SEQ ID NO: 236521 - DNA, 25 bp, Homo sapien
gcagttacctcttcatagccatgaa

SEQ ID NO: 236522 - DNA, 25 bp, Homo sapien
accaaaacgttctatgaggagcatg

SEQ ID NO: 236523 - DNA, 25 bp, Homo sapien
gcatgcaagtaagtcaagcctccta

SEQ ID NO: 236524 - DNA, 25 bp, Homo sapien
aagcctcctattctgttagtactta

SEQ ID NO: 236525 - DNA, 25 bp, Homo sapien
atggttttcattgcatagtgacatt

SEQ ID NO: 236526 - DNA, 25 bp, Homo sapien
gtgacattttcttagccttaacgtt

SEQ ID NO: 236527 - DNA, 25 bp, Homo sapien
gatccttgagtaaagacattttgct

SEQ ID NO: 236528 - DNA, 25 bp, Homo sapien
tcaggatcagcttgcagagtcttgc

SEQ ID NO: 236529 - DNA, 25 bp, Homo sapien
cagagtcttgcttttaggttagata

SEQ ID NO: 236530 - DNA, 25 bp, Homo sapien
atcatagttggtgtaaatccagcaa

SEQ ID NO: 236531 - DNA, 25 bp, Homo sapien
cagcaaaaaacagctggctttggaa

SEQ ID NO: 236532 - DNA, 25 bp, Homo sapien
gctggctttggaatggagaacacta

SEQ ID NO: 236533 - DNA, 25 bp, Homo sapien
ggaatggagaacactacaattcaaa

SEQ ID NO: 236534 - DNA, 25 bp, Homo sapien
tggaattagctttacatttgtttgt

SEQ ID NO: 236535 - DNA, 25 bp, Homo sapien
aagattaatggttccttttatgtgc

SEQ ID NO: 236536 - DNA, 25 bp, Homo sapien
ccttttatgtgctgatttctttgta

SEQ ID NO: 236537 - DNA, 25 bp, Homo sapien
ctgttctctgcattcatcattcagg

SEQ ID NO: 236538 - DNA, 25 bp, Homo sapien
tctctgcattcatcattcaggaata

SEQ ID NO: 236539 - DNA, 25 bp, Homo sapien
caaccacaggtttactttacaatga

SEQ ID NO: 236540 - DNA, 25 bp, Homo sapien
gttctctttgggtttgtcttaatgg

SEQ ID NO: 236541 - DNA, 25 bp, Homo sapien
aactggagcagcctataaaacattt

SEQ ID NO: 236542 - DNA, 25 bp, Homo sapien
tttttagggtgatgtcctctgggtc

SEQ ID NO: 236543 - DNA, 25 bp, Homo sapien
tctgggtccttctgttctgcacacc

SEQ ID NO: 236544 - DNA, 25 bp, Homo sapien
tttgcctgaagatctcctgacttgt

SEQ ID NO: 236545 - DNA, 25 bp, Homo sapien
tgaagatctcctgacttgtcgccag

SEQ ID NO: 236546 - DNA, 25 bp, Homo sapien
ttgtcgccagccatagaggctcgaa

SEQ ID NO: 236547 - DNA, 25 bp, Homo sapien
aggctcgaaagctctggttgtgaag

SEQ ID NO: 236548 - DNA, 25 bp, Homo sapien
gctctggttgtgaagcataacgcaa

SEQ ID NO: 236549 - DNA, 25 bp, Homo sapien
ataacgcaatgcatagacctgtcag

SEQ ID NO: 236550 - DNA, 25 bp, Homo sapien
actggtttccatgacatagtatctt

SEQ ID NO: 236551 - DNA, 25 bp, Homo sapien
ttccatgacatagtatcttgttttc

SEQ ID NO: 236552 - DNA, 25 bp, Homo sapien
ttctttcattgtggtacaatgcaaa

SEQ ID NO: 236553 - DNA, 25 bp, Homo sapien
agtgtgcaaagcctgccttgaagct

SEQ ID NO: 236554 - DNA, 25 bp, Homo sapien
caaagcctgccttgaagcttaccct

SEQ ID NO: 236555 - DNA, 25 bp, Homo sapien
tacacacatctgcagatataatttt

SEQ ID NO: 236556 - DNA, 25 bp, Homo sapien
cacccaaatataatccctgtcattc

SEQ ID NO: 236557 - DNA, 25 bp, Homo sapien
atataatccctgtcattcgtactgg

SEQ ID NO: 236558 - DNA, 25 bp, Homo sapien
taatccctgtcattcgtactggttt

SEQ ID NO: 236559 - DNA, 25 bp, Homo sapien
ctgtcattcgtactggtttccatga

SEQ ID NO: 236560 - DNA, 25 bp, Homo sapien
attcgtactggtttccatgacatag

SEQ ID NO: 236561 - DNA, 25 bp, Homo sapien
catccgggtgagagccccaccatgc

SEQ ID NO: 236562 - DNA, 25 bp, Homo sapien
cattgccctctccacctatttattc

SEQ ID NO: 236563 - DNA, 25 bp, Homo sapien
tgctcaagggagaggtgtccaagcc

SEQ ID NO: 236564 - DNA, 25 bp, Homo sapien
cacgctcccaacaaacctacatctg

SEQ ID NO: 236565 - DNA, 25 bp, Homo sapien
caattatttgctttcctgctaacca

SEQ ID NO: 236566 - DNA, 25 bp, Homo sapien
ttatttgctttcctgctaaccattc

SEQ ID NO: 236567 - DNA, 25 bp, Homo sapien
ctgctaaccattccctttattgcca

SEQ ID NO: 236568 - DNA, 25 bp, Homo sapien
taaccattccctttattgccagctt

SEQ ID NO: 236569 - DNA, 25 bp, Homo sapien
cattccctttattgccagctttgtt

SEQ ID NO: 236570 - DNA, 25 bp, Homo sapien
ttattgccagctttgtttccctttt

SEQ ID NO: 236571 - DNA, 25 bp, Homo sapien
agaggtgtccaagccctgagcgagc

SEQ ID NO: 236572 - DNA, 25 bp, Homo sapien
acgactgtgctgtagcttcccttgc

SEQ ID NO: 236573 - DNA, 25 bp, Homo sapien
gtagcttcccttgcagctgcaataa

SEQ ID NO: 236574 - DNA, 25 bp, Homo sapien
ttgcagctgcaataacccgcaggtc

SEQ ID NO: 236575 - DNA, 25 bp, Homo sapien
aacccgcaggtcttcactgaggtgg

SEQ ID NO: 236576 - DNA, 25 bp, Homo sapien
aaacatttatttttgaccagtcctg

SEQ ID NO: 236577 - DNA, 25 bp, Homo sapien
agtcctgtggcttccattagcaata

SEQ ID NO: 236578 - DNA, 25 bp, Homo sapien
ggcttccattagcaatatgtttcct

SEQ ID NO: 236579 - DNA, 25 bp, Homo sapien
gtttcctttcccaaatatgcaaata

SEQ ID NO: 236580 - DNA, 25 bp, Homo sapien
tcccaaatatgcaaatagtggcttt

SEQ ID NO: 236581 - DNA, 25 bp, Homo sapien
gctcaattttgtgagtgctttggaa

SEQ ID NO: 236582 - DNA, 25 bp, Homo sapien
gattacttttctatgttgctcaagc

SEQ ID NO: 236583 - DNA, 25 bp, Homo sapien
cctgtcctcctagggaaatctagat

SEQ ID NO: 236584 - DNA, 25 bp, Homo sapien
gaaatctagatcctccaaactctgc

SEQ ID NO: 236585 - DNA, 25 bp, Homo sapien
tagatcctccaaactctgcctgggt

SEQ ID NO: 236586 - DNA, 25 bp, Homo sapien
tgattctaaaacgaagggcggaaat

SEQ ID NO: 236587 - DNA, 25 bp, Homo sapien
gagtcttgacccctgccttgtggtt

SEQ ID NO: 236588 - DNA, 25 bp, Homo sapien
gacccctgccttgtggttgatgtgg

SEQ ID NO: 236589 - DNA, 25 bp, Homo sapien
tctggccaaggcctggcaagcaagt

SEQ ID NO: 236590 - DNA, 25 bp, Homo sapien
gtgctgtcttcctgagagggacaat

SEQ ID NO: 236591 - DNA, 25 bp, Homo sapien
gagggacaatagaagtgacagagcc

SEQ ID NO: 236592 - DNA, 25 bp, Homo sapien
tcaggaacatgccagtcccctactt

SEQ ID NO: 236593 - DNA, 25 bp, Homo sapien
agtcccctacttcggtctgtcctgg

SEQ ID NO: 236594 - DNA, 25 bp, Homo sapien
atacaacgagtacattgaacatgct

SEQ ID NO: 236595 - DNA, 25 bp, Homo sapien
gagtacattgaacatgcttcacatt

SEQ ID NO: 236596 - DNA, 25 bp, Homo sapien
atgcttcacattcagaacatgaagt

SEQ ID NO: 236597 - DNA, 25 bp, Homo sapien
ataggtagaacttccaacttccagg

SEQ ID NO: 236598 - DNA, 25 bp, Homo sapien
aggtagaacttccaacttccaggct

SEQ ID NO: 236599 - DNA, 25 bp, Homo sapien
tagaacttccaacttccaggctttg

SEQ ID NO: 236600 - DNA, 25 bp, Homo sapien
gaacttccaacttccaggctttgta

SEQ ID NO: 236601 - DNA, 25 bp, Homo sapien
ttccaacttccaggctttgtaacag

SEQ ID NO: 236602 - DNA, 25 bp, Homo sapien
acttccaggctttgtaacagaaatc

SEQ ID NO: 236603 - DNA, 25 bp, Homo sapien
ttaaagactcagtagcaagcctaat

SEQ ID NO: 236604 - DNA, 25 bp, Homo sapien
agactcagtagcaagcctaatcctc

SEQ ID NO: 236605 - DNA, 25 bp, Homo sapien
ttggcaatatgagctggcggcctga

SEQ ID NO: 236606 - DNA, 25 bp, Homo sapien
ggcggcctgacctaacatcattgta

SEQ ID NO: 236607 - DNA, 25 bp, Homo sapien
tggatcactgaagtgtctcctcaca

SEQ ID NO: 236608 - DNA, 25 bp, Homo sapien
tgaagtgtctcctcacatgccaaaa

SEQ ID NO: 236609 - DNA, 25 bp, Homo sapien
tgcactttcttcctacttcgttgcg

SEQ ID NO: 236610 - DNA, 25 bp, Homo sapien
ttcgttgcggccttcatcaaccttg

SEQ ID NO: 236611 - DNA, 25 bp, Homo sapien
tttcagtcacctgagtctctacgtg

SEQ ID NO: 236612 - DNA, 25 bp, Homo sapien
agtctctacgtgcactgttcagtat

SEQ ID NO: 236613 - DNA, 25 bp, Homo sapien
agccatgagccaatgtggccaccaa

SEQ ID NO: 236614 - DNA, 25 bp, Homo sapien
tatactgttttcttgggcccatctt

SEQ ID NO: 236615 - DNA, 25 bp, Homo sapien
gggcccatcttaataatcatctaca

SEQ ID NO: 236616 - DNA, 25 bp, Homo sapien
tctcccttctggcagcaggagtctc

SEQ ID NO: 236617 - DNA, 25 bp, Homo sapien
gcaggagtctcccaggttgttcttc

SEQ ID NO: 236618 - DNA, 25 bp, Homo sapien
cccaggttgttcttctccagccagt

SEQ ID NO: 236619 - DNA, 25 bp, Homo sapien
cagccagttccaactcaggagacag

SEQ ID NO: 236620 - DNA, 25 bp, Homo sapien
tcaggagacaggtcccaaggccatg

SEQ ID NO: 236621 - DNA, 25 bp, Homo sapien
caaggccatgggagatctctcctgt

SEQ ID NO: 236622 - DNA, 25 bp, Homo sapien
atgggagatctctcctgtggctttg

SEQ ID NO: 236623 - DNA, 25 bp, Homo sapien
gaatactgttgacttcttcatgatt

SEQ ID NO: 236624 - DNA, 25 bp, Homo sapien
gatttaataaccatcctttgcgaag

SEQ ID NO: 236625 - DNA, 25 bp, Homo sapien
accatcctttgcgaagttttatgag

SEQ ID NO: 236626 - DNA, 25 bp, Homo sapien
ggaatgtcaaccctcaaatttttgt

SEQ ID NO: 236627 - DNA, 25 bp, Homo sapien
agccggtaattttccatgtcattga

SEQ ID NO: 236628 - DNA, 25 bp, Homo sapien
cggtaattttccatgtcattgagcc

SEQ ID NO: 236629 - DNA, 25 bp, Homo sapien
tcacactgacaagcagggccagcat

SEQ ID NO: 236630 - DNA, 25 bp, Homo sapien
cactgacaagcagggccagcatgac

SEQ ID NO: 236631 - DNA, 25 bp, Homo sapien
accttaggcaggaatcgggcgagac

SEQ ID NO: 236632 - DNA, 25 bp, Homo sapien
tggaagcagccaagcatgagcaaga

SEQ ID NO: 236633 - DNA, 25 bp, Homo sapien
ccaagcatgagcaagaagacacaga

SEQ ID NO: 236634 - DNA, 25 bp, Homo sapien
aagacacagacgaggcacgccaggc

SEQ ID NO: 236635 - DNA, 25 bp, Homo sapien
ttccagggcgggtagtagaactcct

SEQ ID NO: 236636 - DNA, 25 bp, Homo sapien
tagtagaactcctcggcccgcgtga

SEQ ID NO: 236637 - DNA, 25 bp, Homo sapien
gggctgatacgtcgcacgcccctga

SEQ ID NO: 236638 - DNA, 25 bp, Homo sapien
atggctggcacagcggaggcccaaa

SEQ ID NO: 236639 - DNA, 25 bp, Homo sapien
ctccacctgatagggtgagtgggca

SEQ ID NO: 236640 - DNA, 25 bp, Homo sapien
gagtgggcatgcctaaaatacctag

SEQ ID NO: 236641 - DNA, 25 bp, Homo sapien
taaaatacctaggagcatatgaagc

SEQ ID NO: 236642 - DNA, 25 bp, Homo sapien
gaagccccacaaagatgtgaatcct

SEQ ID NO: 236643 - DNA, 25 bp, Homo sapien
atgtgaatcctgtccacagaggcac

SEQ ID NO: 236644 - DNA, 25 bp, Homo sapien
gaggcaccacaggagcagtcataga

SEQ ID NO: 236645 - DNA, 25 bp, Homo sapien
gaaggaggagcctcaaaccatcctg

SEQ ID NO: 236646 - DNA, 25 bp, Homo sapien
aaccatcctgatgctaattgtgttc

SEQ ID NO: 236647 - DNA, 25 bp, Homo sapien
gatgctaattgtgttcagagctgaa

SEQ ID NO: 236648 - DNA, 25 bp, Homo sapien
gcccaaagccgggttgagagccttg

SEQ ID NO: 236649 - DNA, 25 bp, Homo sapien
tggatcgcaaagtgcccagtccgga

SEQ ID NO: 236650 - DNA, 25 bp, Homo sapien
cagtccggaggcgtttctgggcaaa

SEQ ID NO: 236651 - DNA, 25 bp, Homo sapien
gatcgacgccgccaaattacactgc

SEQ ID NO: 236652 - DNA, 25 bp, Homo sapien
tacactgctccgacaatgtagattt

SEQ ID NO: 236653 - DNA, 25 bp, Homo sapien
gaagcatggaaatacggtacctgaa

SEQ ID NO: 236654 - DNA, 25 bp, Homo sapien
ggtacctgaaatgggacacactgag

SEQ ID NO: 236655 - DNA, 25 bp, Homo sapien
cacactgagtagataggtcatccca

SEQ ID NO: 236656 - DNA, 25 bp, Homo sapien
gataggtcatcccagaccaagatat

SEQ ID NO: 236657 - DNA, 25 bp, Homo sapien
gccacaacctgctgcaattgggcat

SEQ ID NO: 236658 - DNA, 25 bp, Homo sapien
aacctgctgcaattgggcatcaaac

SEQ ID NO: 236659 - DNA, 25 bp, Homo sapien
ggcatcaaacacatatggtcgtcat

SEQ ID NO: 236660 - DNA, 25 bp, Homo sapien
tgagtcagtggctcttgcgaatgcc

SEQ ID NO: 236661 - DNA, 25 bp, Homo sapien
ttgcgaatgccccatagcagaagtc

SEQ ID NO: 236662 - DNA, 25 bp, Homo sapien
ccatagcagaagtcccgggaaggta

SEQ ID NO: 236663 - DNA, 25 bp, Homo sapien
ggtaaatgccaaacccagagccatg

SEQ ID NO: 236664 - DNA, 25 bp, Homo sapien
gccaaacccagagccatgtgagatt

SEQ ID NO: 236665 - DNA, 25 bp, Homo sapien
gccatgtgagattctgactttgatc

SEQ ID NO: 236666 - DNA, 25 bp, Homo sapien
agattctgactttgatcttggctgt

SEQ ID NO: 236667 - DNA, 25 bp, Homo sapien
tgtggtttaatagcatctcaggatt

SEQ ID NO: 236668 - DNA, 25 bp, Homo sapien
caggattatttatcatattctcttt

SEQ ID NO: 236669 - DNA, 25 bp, Homo sapien
aggtgtcagttattgtttccattgt

SEQ ID NO: 236670 - DNA, 25 bp, Homo sapien
ttccattgttgtttactttagttct

SEQ ID NO: 236671 - DNA, 25 bp, Homo sapien
gcgacactggatcgcaaagtgccca

SEQ ID NO: 236672 - DNA, 25 bp, Homo sapien
tggatcgcaaagtgcccagtccgga

SEQ ID NO: 236673 - DNA, 25 bp, Homo sapien
caaagtgcccagtccggaggcgttt

SEQ ID NO: 236674 - DNA, 25 bp, Homo sapien
cagtccggaggcgtttctgggcaaa

SEQ ID NO: 236675 - DNA, 25 bp, Homo sapien
cggaggcgtttctgggcaaaccctg

SEQ ID NO: 236676 - DNA, 25 bp, Homo sapien
tttctgggcaaaccctggtcctcct

SEQ ID NO: 236677 - DNA, 25 bp, Homo sapien
ctcctggatcgacgccgccaaatta

SEQ ID NO: 236678 - DNA, 25 bp, Homo sapien
gatcgacgccgccaaattacactgc

SEQ ID NO: 236679 - DNA, 25 bp, Homo sapien
gccaaattacactgctccgacaatg

SEQ ID NO: 236680 - DNA, 25 bp, Homo sapien
acactgctccgacaatgtagattta

SEQ ID NO: 236681 - DNA, 25 bp, Homo sapien
gcagggaggttatgaggcttaataa

SEQ ID NO: 236682 - DNA, 25 bp, Homo sapien
aggcagcagcacactattttattct

SEQ ID NO: 236683 - DNA, 25 bp, Homo sapien
gcagcacactattttattctgagta

SEQ ID NO: 236684 - DNA, 25 bp, Homo sapien
attctgagtattacctgtggacaag

SEQ ID NO: 236685 - DNA, 25 bp, Homo sapien
aattctgctaagagcatgctttcaa

SEQ ID NO: 236686 - DNA, 25 bp, Homo sapien
gagcatgctttcaaaactggaaaac

SEQ ID NO: 236687 - DNA, 25 bp, Homo sapien
gaaaacccttcaggacaagtcacat

SEQ ID NO: 236688 - DNA, 25 bp, Homo sapien
gtcacattttgtgacagtgagacgc

SEQ ID NO: 236689 - DNA, 25 bp, Homo sapien
agtgagacgccaacaaccctgagag

SEQ ID NO: 236690 - DNA, 25 bp, Homo sapien
gagacgccaacaaccctgagaggta

SEQ ID NO: 236691 - DNA, 25 bp, Homo sapien
tactagtagggcaatcagaaacatt

SEQ ID NO: 236692 - DNA, 25 bp, Homo sapien
aaaggagcttaaaggcagcagcaca

SEQ ID NO: 236693 - DNA, 25 bp, Homo sapien
catcttcttattggttcttctggac

SEQ ID NO: 236694 - DNA, 25 bp, Homo sapien
atcaaggtatgttgcccgtttgtcc

SEQ ID NO: 236695 - DNA, 25 bp, Homo sapien
gtttgtcctctaattccaggatcca

SEQ ID NO: 236696 - DNA, 25 bp, Homo sapien
caggatccacaacaaccagtacggg

SEQ ID NO: 236697 - DNA, 25 bp, Homo sapien
agtacgggaccctgcaaaacctgca

SEQ ID NO: 236698 - DNA, 25 bp, Homo sapien
tgctcaaggcaactctatgtttccc

SEQ ID NO: 236699 - DNA, 25 bp, Homo sapien
atgtttccctcatgttgctgtacaa

SEQ ID NO: 236700 - DNA, 25 bp, Homo sapien
gggctttcgcaaaattactgccaga

SEQ ID NO: 236701 - DNA, 25 bp, Homo sapien
tgcaactcaattaaacccaccaggt

SEQ ID NO: 236702 - DNA, 25 bp, Homo sapien
aggtgtctcccctcaggttagagta

SEQ ID NO: 236703 - DNA, 25 bp, Homo sapien
gtacctcatagaatccttgctacga

SEQ ID NO: 236704 - DNA, 25 bp, Homo sapien
gtgtaacttatgaaaagtcgtattt

SEQ ID NO: 236705 - DNA, 25 bp, Homo sapien
gaaaagtcgtatttatattgacctt

SEQ ID NO: 236706 - DNA, 25 bp, Homo sapien
agtcgtatttatattgacctttgta

SEQ ID NO: 236707 - DNA, 25 bp, Homo sapien
tgacctttgtaagagctcaattatt

SEQ ID NO: 236708 - DNA, 25 bp, Homo sapien
gacctttgtaagagctcaattattt

SEQ ID NO: 236709 - DNA, 25 bp, Homo sapien
cctttgtaagagctcaattatttca

SEQ ID NO: 236710 - DNA, 25 bp, Homo sapien
ttgtaagagctcaattatttcagga

SEQ ID NO: 236711 - DNA, 25 bp, Homo sapien
agagctcaattatttcaggaagcaa

SEQ ID NO: 236712 - DNA, 25 bp, Homo sapien
gagctcaattatttcaggaagcaag

SEQ ID NO: 236713 - DNA, 25 bp, Homo sapien
gctcaattatttcaggaagcaagga

SEQ ID NO: 236714 - DNA, 25 bp, Homo sapien
tcaattatttcaggaagcaaggaat

SEQ ID NO: 236715 - DNA, 25 bp, Homo sapien
acatggcaacaccccatttctacaa

SEQ ID NO: 236716 - DNA, 25 bp, Homo sapien
tggcctcagaatcaggctgggtgca

SEQ ID NO: 236717 - DNA, 25 bp, Homo sapien
ggcctcagaatcaggctgggtgcag

SEQ ID NO: 236718 - DNA, 25 bp, Homo sapien
gcctcagaatcaggctgggtgcagt

SEQ ID NO: 236719 - DNA, 25 bp, Homo sapien
cctcagaatcaggctgggtgcagtg

SEQ ID NO: 236720 - DNA, 25 bp, Homo sapien
ctcagaatcaggctgggtgcagtgg

SEQ ID NO: 236721 - DNA, 25 bp, Homo sapien
ccagcctggtccacagagagacact

SEQ ID NO: 236722 - DNA, 25 bp, Homo sapien
agcctggtccacagagagacactgt

SEQ ID NO: 236723 - DNA, 25 bp, Homo sapien
gcctggtccacagagagacactgtc

SEQ ID NO: 236724 - DNA, 25 bp, Homo sapien
cctggtccacagagagacactgtca

SEQ ID NO: 236725 - DNA, 25 bp, Homo sapien
ctggtccacagagagacactgtcac

SEQ ID NO: 236726 - DNA, 25 bp, Homo sapien
gaggtacaggcaatgggatgacaaa

SEQ ID NO: 236727 - DNA, 25 bp, Homo sapien
tcaacatctctccacaactaagtca

SEQ ID NO: 236728 - DNA, 25 bp, Homo sapien
tctctccacaactaagtcaaagctg

SEQ ID NO: 236729 - DNA, 25 bp, Homo sapien
aaaggacttttctgaacatgagggc

SEQ ID NO: 236730 - DNA, 25 bp, Homo sapien
gtttcccaaccttttgaggtcatag

SEQ ID NO: 236731 - DNA, 25 bp, Homo sapien
gaggtcatagaaactgctctggaca

SEQ ID NO: 236732 - DNA, 25 bp, Homo sapien
actgctctggacaccagtttaaata

SEQ ID NO: 236733 - DNA, 25 bp, Homo sapien
attttgaaggtctgcagtgggagcc

SEQ ID NO: 236734 - DNA, 25 bp, Homo sapien
ttacccttaaatttctgcaagttct

SEQ ID NO: 236735 - DNA, 25 bp, Homo sapien
tgcaagttctagtatcactgtgctg

SEQ ID NO: 236736 - DNA, 25 bp, Homo sapien
ctgtgctggcaagtaacaaagagaa

SEQ ID NO: 236737 - DNA, 25 bp, Homo sapien
ttaaacacatcacatactctgaaaa

SEQ ID NO: 236738 - DNA, 25 bp, Homo sapien
aatgcaagactagactttatatgga

SEQ ID NO: 236739 - DNA, 25 bp, Homo sapien
atgcaagactagactttatatggaa

SEQ ID NO: 236740 - DNA, 25 bp, Homo sapien
tgcaagactagactttatatggaac

SEQ ID NO: 236741 - DNA, 25 bp, Homo sapien
gcaagactagactttatatggaaca

SEQ ID NO: 236742 - DNA, 25 bp, Homo sapien
caagactagactttatatggaacat

SEQ ID NO: 236743 - DNA, 25 bp, Homo sapien
aagactagactttatatggaacata

SEQ ID NO: 236744 - DNA, 25 bp, Homo sapien
agactagactttatatggaacatat

SEQ ID NO: 236745 - DNA, 25 bp, Homo sapien
gactagactttatatggaacatata

SEQ ID NO: 236746 - DNA, 25 bp, Homo sapien
tttacatgatttaatctgaagggct

SEQ ID NO: 236747 - DNA, 25 bp, Homo sapien
tacatgatttaatctgaagggctag

SEQ ID NO: 236748 - DNA, 25 bp, Homo sapien
gtaaatgtcaataacccaagccttt

SEQ ID NO: 236749 - DNA, 25 bp, Homo sapien
aataacccaagcctttgtcatagca

SEQ ID NO: 236750 - DNA, 25 bp, Homo sapien
ctttgtcatagcagtcacttggttg

SEQ ID NO: 236751 - DNA, 25 bp, Homo sapien
cacttggttgacttaggatctgggt

SEQ ID NO: 236752 - DNA, 25 bp, Homo sapien
atctgggtctgttgaattttgtgct

SEQ ID NO: 236753 - DNA, 25 bp, Homo sapien
aattttgtgcttgggaatggagctg

SEQ ID NO: 236754 - DNA, 25 bp, Homo sapien
gtcctggttgcatggccgcacctgt

SEQ ID NO: 236755 - DNA, 25 bp, Homo sapien
ttgcatggccgcacctgtgtgtgtg

SEQ ID NO: 236756 - DNA, 25 bp, Homo sapien
gtgtgcagaggtctgtgtcccatcc

SEQ ID NO: 236757 - DNA, 25 bp, Homo sapien
gggagccccacgtgttgccaagatc

SEQ ID NO: 236758 - DNA, 25 bp, Homo sapien
ttggtgcaataaaatactccggttt

SEQ ID NO: 236759 - DNA, 25 bp, Homo sapien
ggccagggatcaaacccaccgaagt

SEQ ID NO: 236760 - DNA, 25 bp, Homo sapien
caccgaagtcaccatccaaaacaag

SEQ ID NO: 236761 - DNA, 25 bp, Homo sapien
aacaagattcttctccagccaacat

SEQ ID NO: 236762 - DNA, 25 bp, Homo sapien
acatcatcgatttccaccaccaaaa

SEQ ID NO: 236763 - DNA, 25 bp, Homo sapien
ccgtggaagcccgagatgctgtgta

SEQ ID NO: 236764 - DNA, 25 bp, Homo sapien
gcccgagatgctgtgtacctgaaat

SEQ ID NO: 236765 - DNA, 25 bp, Homo sapien
ggatccaggatgactgtacatctca

SEQ ID NO: 236766 - DNA, 25 bp, Homo sapien
tctcagataaaggaggctcagcgct

SEQ ID NO: 236767 - DNA, 25 bp, Homo sapien
aagcagtccctgcacactatccaag

SEQ ID NO: 236768 - DNA, 25 bp, Homo sapien
actatccaaggcctgtatgtgtgac

SEQ ID NO: 236769 - DNA, 25 bp, Homo sapien
gccccaccatgaataaacactttct

SEQ ID NO: 236770 - DNA, 25 bp, Homo sapien
ttaattagcagagtttgccctccag

SEQ ID NO: 236771 - DNA, 25 bp, Homo sapien
tccaggctcggagggcaagtcagcc

SEQ ID NO: 236772 - DNA, 25 bp, Homo sapien
agttagttcccttttcagctgtgac

SEQ ID NO: 236773 - DNA, 25 bp, Homo sapien
tcagctgtgaccattgaagacattc

SEQ ID NO: 236774 - DNA, 25 bp, Homo sapien
gaagacattcatcaagttctctggc

SEQ ID NO: 236775 - DNA, 25 bp, Homo sapien
ctctggctccgggatgtcagctgtg

SEQ ID NO: 236776 - DNA, 25 bp, Homo sapien
tcagctgtggtagtgacttgcatgg

SEQ ID NO: 236777 - DNA, 25 bp, Homo sapien
gacttgcatgggaggttatccgaca

SEQ ID NO: 236778 - DNA, 25 bp, Homo sapien
tatccgacatacctcacacacttta

SEQ ID NO: 236779 - DNA, 25 bp, Homo sapien
cactttaactccacctcttcagagt

SEQ ID NO: 236780 - DNA, 25 bp, Homo sapien
acctcttcagagtttgtggccaaga

SEQ ID NO: 236781 - DNA, 25 bp, Homo sapien
tatttagcaacacctcacattcaca

SEQ ID NO: 236782 - DNA, 25 bp, Homo sapien
tagcaacacctcacattcacaaaga

SEQ ID NO: 236783 - DNA, 25 bp, Homo sapien
tcatgtccatgactcccacaggcat

SEQ ID NO: 236784 - DNA, 25 bp, Homo sapien
tgctctcaacccctgggaaccgaat

SEQ ID NO: 236785 - DNA, 25 bp, Homo sapien
ggaaccgaatacaaacccactgcca

SEQ ID NO: 236786 - DNA, 25 bp, Homo sapien
actgccagcagctcatagtggaagg

SEQ ID NO: 236787 - DNA, 25 bp, Homo sapien
gagacagcaacctacttgctcaagg

SEQ ID NO: 236788 - DNA, 25 bp, Homo sapien
cttgctcaaggccttgctttagaaa

SEQ ID NO: 236789 - DNA, 25 bp, Homo sapien
aaataaactccaaaccagcaacaag

SEQ ID NO: 236790 - DNA, 25 bp, Homo sapien
atagccaatattacttaactcatag

SEQ ID NO: 236791 - DNA, 25 bp, Homo sapien
aactcatagtacattttgaatcaca

SEQ ID NO: 236792 - DNA, 25 bp, Homo sapien
aagcataattgctagactttcttat

SEQ ID NO: 236793 - DNA, 25 bp, Homo sapien
ttgctagactttcttatgcgtcctg

SEQ ID NO: 236794 - DNA, 25 bp, Homo sapien
ctttcttatgcgtcctgcctttgta

SEQ ID NO: 236795 - DNA, 25 bp, Homo sapien
tgttgcctctgcctgatctcctttc

SEQ ID NO: 236796 - DNA, 25 bp, Homo sapien
tctttcccacaaactaattcatgtg

SEQ ID NO: 236797 - DNA, 25 bp, Homo sapien
aattcatgtgcttcaaaactactat

SEQ ID NO: 236798 - DNA, 25 bp, Homo sapien
tttcgtatcatttctaatatggtgc

SEQ ID NO: 236799 - DNA, 25 bp, Homo sapien
aatatggtgcttgatgcctagaaca

SEQ ID NO: 236800 - DNA, 25 bp, Homo sapien
gcctagaacatgtagtcatctatgt

SEQ ID NO: 236801 - DNA, 25 bp, Homo sapien
atctatgtaatgcccattcccaaca

SEQ ID NO: 236802 - DNA, 25 bp, Homo sapien
agaagtcactagactggcatattct

SEQ ID NO: 236803 - DNA, 25 bp, Homo sapien
tttggaagcacctttattaacacat

SEQ ID NO: 236804 - DNA, 25 bp, Homo sapien
tggaagcacctttattaacacatat

SEQ ID NO: 236805 - DNA, 25 bp, Homo sapien
tattaacacatatatctcgcagaaa

SEQ ID NO: 236806 - DNA, 25 bp, Homo sapien
acacatatatctcgcagaaactaga

SEQ ID NO: 236807 - DNA, 25 bp, Homo sapien
taggctgttaactttttgcaactat

SEQ ID NO: 236808 - DNA, 25 bp, Homo sapien
taactttttgcaactattcactcat

SEQ ID NO: 236809 - DNA, 25 bp, Homo sapien
tttttgcaactattcactcattttt

SEQ ID NO: 236810 - DNA, 25 bp, Homo sapien
gcaactattcactcatttttaccac

SEQ ID NO: 236811 - DNA, 25 bp, Homo sapien
ctattcactcatttttaccactttt

SEQ ID NO: 236812 - DNA, 25 bp, Homo sapien
agccagattccattttgacctcaga

SEQ ID NO: 236813 - DNA, 25 bp, Homo sapien
gaatatggtatagaaggtatgcaag

SEQ ID NO: 236814 - DNA, 25 bp, Homo sapien
tgtatcgttgggaaaaagcagactt

SEQ ID NO: 236815 - DNA, 25 bp, Homo sapien
agcagacttgcccttactgcaaaga

SEQ ID NO: 236816 - DNA, 25 bp, Homo sapien
gatgatcagtaatccctgggagcgc

SEQ ID NO: 236817 - DNA, 25 bp, Homo sapien
taatccctgggagcgcacacatttt

SEQ ID NO: 236818 - DNA, 25 bp, Homo sapien
gagcgcacacattttctgtatggac

SEQ ID NO: 236819 - DNA, 25 bp, Homo sapien
tcctggattggcttcgttatttggt

SEQ ID NO: 236820 - DNA, 25 bp, Homo sapien
ggcttcgttatttggtggcctggca

SEQ ID NO: 236821 - DNA, 25 bp, Homo sapien
gcctggcaacctgtggtgataggaa

SEQ ID NO: 236822 - DNA, 25 bp, Homo sapien
ggcattaactattcactagggctgg

SEQ ID NO: 236823 - DNA, 25 bp, Homo sapien
tcatgaattctgcatccgaggttgg

SEQ ID NO: 236824 - DNA, 25 bp, Homo sapien
ctgcatccgaggttggtgtatcgtt

SEQ ID NO: 236825 - DNA, 25 bp, Homo sapien
tttcaccattttctgataatgcagg

SEQ ID NO: 236826 - DNA, 25 bp, Homo sapien
gataatgcaggagtaggatggctaa

SEQ ID NO: 236827 - DNA, 25 bp, Homo sapien
gtgaaagaagaatctactctatgga

SEQ ID NO: 236828 - DNA, 25 bp, Homo sapien
gaaagcatggcacctgaaatttctg

SEQ ID NO: 236829 - DNA, 25 bp, Homo sapien
atttctgaagatattggctgtcctc

SEQ ID NO: 236830 - DNA, 25 bp, Homo sapien
ggctgtcctctagcttatatgagag

SEQ ID NO: 236831 - DNA, 25 bp, Homo sapien
gtttgtgctttactaatcaaccagt

SEQ ID NO: 236832 - DNA, 25 bp, Homo sapien
gtggctgaaatgtacattccagaca

SEQ ID NO: 236833 - DNA, 25 bp, Homo sapien
ggttgctaagagcttctgtaattaa

SEQ ID NO: 236834 - DNA, 25 bp, Homo sapien
gaaagttccaaggtaacaatgccca

SEQ ID NO: 236835 - DNA, 25 bp, Homo sapien
taacaatgcccaaacacagcaccat

SEQ ID NO: 236836 - DNA, 25 bp, Homo sapien
gctcaggtgccaggtgccttctgat

SEQ ID NO: 236837 - DNA, 25 bp, Homo sapien
gtgccaggtgccttctgatgttcat

SEQ ID NO: 236838 - DNA, 25 bp, Homo sapien
tggctccccagacgatgttccagga

SEQ ID NO: 236839 - DNA, 25 bp, Homo sapien
ccccagacgatgttccaggaggcgg

SEQ ID NO: 236840 - DNA, 25 bp, Homo sapien
agaaggggccacgtcttgcaaacca

SEQ ID NO: 236841 - DNA, 25 bp, Homo sapien
accgcgctgtcctctttgagaagga

SEQ ID NO: 236842 - DNA, 25 bp, Homo sapien
agaaggagtcttactcaggactggg

SEQ ID NO: 236843 - DNA, 25 bp, Homo sapien
ctgtgcacacattgtcgcctctttt

SEQ ID NO: 236844 - DNA, 25 bp, Homo sapien
cacattgtcgcctcttttcagcact

SEQ ID NO: 236845 - DNA, 25 bp, Homo sapien
tcagcacttagagattccttccttt

SEQ ID NO: 236846 - DNA, 25 bp, Homo sapien
cacttagagattccttcctttgtct

SEQ ID NO: 236847 - DNA, 25 bp, Homo sapien
actgtgcccagccaaaatgtgcctt

SEQ ID NO: 236848 - DNA, 25 bp, Homo sapien
aatgtgcctttgcaaagtttgcgaa

SEQ ID NO: 236849 - DNA, 25 bp, Homo sapien
atgtgcctttgcaaagtttgcgaaa

SEQ ID NO: 236850 - DNA, 25 bp, Homo sapien
tgtgcctttgcaaagtttgcgaaat

SEQ ID NO: 236851 - DNA, 25 bp, Homo sapien
gtgcctttgcaaagtttgcgaaatc

SEQ ID NO: 236852 - DNA, 25 bp, Homo sapien
tgcctttgcaaagtttgcgaaatca

SEQ ID NO: 236853 - DNA, 25 bp, Homo sapien
gcctttgcaaagtttgcgaaatcag

SEQ ID NO: 236854 - DNA, 25 bp, Homo sapien
tgcaaagtttgcgaaatcagatttt

SEQ ID NO: 236855 - DNA, 25 bp, Homo sapien
caaagtttgcgaaatcagattttgt

SEQ ID NO: 236856 - DNA, 25 bp, Homo sapien
gtttgcgaaatcagattttgtatcc

SEQ ID NO: 236857 - DNA, 25 bp, Homo sapien
ttgcgaaatcagattttgtatccca

SEQ ID NO: 236858 - DNA, 25 bp, Homo sapien
aaatctgtgatgcagaaacactagt

SEQ ID NO: 236859 - DNA, 25 bp, Homo sapien
tgatgcagaaacactagttgaaaat

SEQ ID NO: 236860 - DNA, 25 bp, Homo sapien
aaatgtcaccacaaaagcagatgtt

SEQ ID NO: 236861 - DNA, 25 bp, Homo sapien
gcagatgttaacataagcccaaata

SEQ ID NO: 236862 - DNA, 25 bp, Homo sapien
aatatgctttttagccaagatgtga

SEQ ID NO: 236863 - DNA, 25 bp, Homo sapien
gagggaaggatgatttaaaccaata

SEQ ID NO: 236864 - DNA, 25 bp, Homo sapien
ataaatatagccctattccccctct

SEQ ID NO: 236865 - DNA, 25 bp, Homo sapien
ttcttttctgtctttagcaatcaga

SEQ ID NO: 236866 - DNA, 25 bp, Homo sapien
tctgtctttagcaatcagaagatga

SEQ ID NO: 236867 - DNA, 25 bp, Homo sapien
aagccttgaaacatccaggcacctc

SEQ ID NO: 236868 - DNA, 25 bp, Homo sapien
aggcacctcctcattatttgtatgt

SEQ ID NO: 236869 - DNA, 25 bp, Homo sapien
aggtgtggcgagacctgatttctcc

SEQ ID NO: 236870 - DNA, 25 bp, Homo sapien
atttctcctgcgtgttctcagagga

SEQ ID NO: 236871 - DNA, 25 bp, Homo sapien
gacggcgagaaatgcctctggagct

SEQ ID NO: 236872 - DNA, 25 bp, Homo sapien
gaaatgcctctggagctggaaccca

SEQ ID NO: 236873 - DNA, 25 bp, Homo sapien
aactataaacgggtgcatcccacca

SEQ ID NO: 236874 - DNA, 25 bp, Homo sapien
accactccctggaggcattagacac

SEQ ID NO: 236875 - DNA, 25 bp, Homo sapien
ggaggcattagacacccaagtggaa

SEQ ID NO: 236876 - DNA, 25 bp, Homo sapien
tggaaggtgctacaacctgaagcgc

SEQ ID NO: 236877 - DNA, 25 bp, Homo sapien
gaagcgcaggaaagaaaggcccatt

SEQ ID NO: 236878 - DNA, 25 bp, Homo sapien
gaaagaaaggcccattcccctcgca

SEQ ID NO: 236879 - DNA, 25 bp, Homo sapien
ttttactccctgagcacgggccgct

SEQ ID NO: 236880 - DNA, 25 bp, Homo sapien
tgttagccaaatctacactcagcct

SEQ ID NO: 236881 - DNA, 25 bp, Homo sapien
aatctacactcagcctaactcttgg

SEQ ID NO: 236882 - DNA, 25 bp, Homo sapien
taactcttggcttcatctgctgcca

SEQ ID NO: 236883 - DNA, 25 bp, Homo sapien
tgccatgccgtctctgggcaaccag

SEQ ID NO: 236884 - DNA, 25 bp, Homo sapien
aggccccaactgtgcttaagccata

SEQ ID NO: 236885 - DNA, 25 bp, Homo sapien
ttaagccataatgcctgctgctctc

SEQ ID NO: 236886 - DNA, 25 bp, Homo sapien
tgctgctctctagacaactccatgt

SEQ ID NO: 236887 - DNA, 25 bp, Homo sapien
aactccatgtacttggtgctttggt

SEQ ID NO: 236888 - DNA, 25 bp, Homo sapien
gttctaccttcaatacatctttccc

SEQ ID NO: 236889 - DNA, 25 bp, Homo sapien
tcttcatgaatgcttatgagccgag

SEQ ID NO: 236890 - DNA, 25 bp, Homo sapien
ttgtttcattacgtatttagggcat

SEQ ID NO: 236891 - DNA, 25 bp, Homo sapien
cccaggagatgaaacagccaattta

SEQ ID NO: 236892 - DNA, 25 bp, Homo sapien
ccaggagatgaaacagccaatttag

SEQ ID NO: 236893 - DNA, 25 bp, Homo sapien
aggagatgaaacagccaatttaggc

SEQ ID NO: 236894 - DNA, 25 bp, Homo sapien
gatgaaacagccaatttaggccagg

SEQ ID NO: 236895 - DNA, 25 bp, Homo sapien
tgaaacagccaatttaggccaggtg

SEQ ID NO: 236896 - DNA, 25 bp, Homo sapien
cacatgtaaaaccagcactatggga

SEQ ID NO: 236897 - DNA, 25 bp, Homo sapien
acatgtaaaaccagcactatgggag

SEQ ID NO: 236898 - DNA, 25 bp, Homo sapien
ggacaacagggcgagaccatcatct

SEQ ID NO: 236899 - DNA, 25 bp, Homo sapien
acaacagggcgagaccatcatctct

SEQ ID NO: 236900 - DNA, 25 bp, Homo sapien
taggcgtggtgtcctgtgcctgtgg

SEQ ID NO: 236901 - DNA, 25 bp, Homo sapien
cgtggtgtcctgtgcctgtggtccc

SEQ ID NO: 236902 - DNA, 25 bp, Homo sapien
gacaatacacatcagtcaagttatg

SEQ ID NO: 236903 - DNA, 25 bp, Homo sapien
agatgttataaaaggtgttcccata

SEQ ID NO: 236904 - DNA, 25 bp, Homo sapien
aaatgcattgatttgactctgccat

SEQ ID NO: 236905 - DNA, 25 bp, Homo sapien
attgatttgactctgccatgacact

SEQ ID NO: 236906 - DNA, 25 bp, Homo sapien
atttgactctgccatgacactctaa

SEQ ID NO: 236907 - DNA, 25 bp, Homo sapien
gactctgccatgacactctaatgaa

SEQ ID NO: 236908 - DNA, 25 bp, Homo sapien
gacactctaatgaaatcgaggcctg

SEQ ID NO: 236909 - DNA, 25 bp, Homo sapien
taatgaaatcgaggcctgagcccat

SEQ ID NO: 236910 - DNA, 25 bp, Homo sapien
catgcctaggaaaaatggagtttct

SEQ ID NO: 236911 - DNA, 25 bp, Homo sapien
tttctaggaggcaaacaaaccatgt

SEQ ID NO: 236912 - DNA, 25 bp, Homo sapien
gccaccacatctggcattattatta

SEQ ID NO: 236913 - DNA, 25 bp, Homo sapien
gactggaaacaaccgggtcttctat

SEQ ID NO: 236914 - DNA, 25 bp, Homo sapien
gtcttctatggcaactcggaccgca

SEQ ID NO: 236915 - DNA, 25 bp, Homo sapien
tccacggttcagaacctgctgcggc

SEQ ID NO: 236916 - DNA, 25 bp, Homo sapien
cgtccgcattgccatccggatggag

SEQ ID NO: 236917 - DNA, 25 bp, Homo sapien
ctggagtgcgtcagcaagtgtgcct

SEQ ID NO: 236918 - DNA, 25 bp, Homo sapien
agcaagtgtgcctgatgcctgcctc

SEQ ID NO: 236919 - DNA, 25 bp, Homo sapien
gacatcgatgagtggatgaccaagt

SEQ ID NO: 236920 - DNA, 25 bp, Homo sapien
acagcgtgcagtacaggaccgatga

SEQ ID NO: 236921 - DNA, 25 bp, Homo sapien
accgatgagcgcctgaactggattt

SEQ ID NO: 236922 - DNA, 25 bp, Homo sapien
gagcgcctgaactggatttactaca

SEQ ID NO: 236923 - DNA, 25 bp, Homo sapien
gatttactacaaggaccagactgga

SEQ ID NO: 236924 - DNA, 25 bp, Homo sapien
agatttcaaatgcaagactagactt

SEQ ID NO: 236925 - DNA, 25 bp, Homo sapien
atggaacatatatgttgggttttga

SEQ ID NO: 236926 - DNA, 25 bp, Homo sapien
gggttttgattttgggtagcaattg

SEQ ID NO: 236927 - DNA, 25 bp, Homo sapien
gattttgggtagcaattgacatata

SEQ ID NO: 236928 - DNA, 25 bp, Homo sapien
acaagttgaattttgttaacatata

SEQ ID NO: 236929 - DNA, 25 bp, Homo sapien
ccctgagaagaagccctgttgtttt

SEQ ID NO: 236930 - DNA, 25 bp, Homo sapien
tgagaagaagccctgttgtttttct

SEQ ID NO: 236931 - DNA, 25 bp, Homo sapien
ttttcttaagagtctaaaactgaca

SEQ ID NO: 236932 - DNA, 25 bp, Homo sapien
aagagtctaaaactgacaatctttt

SEQ ID NO: 236933 - DNA, 25 bp, Homo sapien
gagtctaaaactgacaatcttttaa

SEQ ID NO: 236934 - DNA, 25 bp, Homo sapien
aattttaaacacatcacatactctg

SEQ ID NO: 236935 - DNA, 25 bp, Homo sapien
cgccacagagacaccattacataca

SEQ ID NO: 236936 - DNA, 25 bp, Homo sapien
gagacaccattacatacacagacac

SEQ ID NO: 236937 - DNA, 25 bp, Homo sapien
acacacagaaagacacagacacaaa

SEQ ID NO: 236938 - DNA, 25 bp, Homo sapien
agagacacaccattacatacacaga

SEQ ID NO: 236939 - DNA, 25 bp, Homo sapien
tacatacacagacacgcaatcgcag

SEQ ID NO: 236940 - DNA, 25 bp, Homo sapien
gacacgcaatcgcagatacgccctt

SEQ ID NO: 236941 - DNA, 25 bp, Homo sapien
agatacgcccttccggccacagaaa

SEQ ID NO: 236942 - DNA, 25 bp, Homo sapien
ttccggccacagaaacacaccatta

SEQ ID NO: 236943 - DNA, 25 bp, Homo sapien
ggccacagaaacacaccattacaca

SEQ ID NO: 236944 - DNA, 25 bp, Homo sapien
cagaaacacaccattacacacacat

SEQ ID NO: 236945 - DNA, 25 bp, Homo sapien
atacacagaaagacacacacagaca

SEQ ID NO: 236946 - DNA, 25 bp, Homo sapien
accctctcttgggacctgtcataag

SEQ ID NO: 236947 - DNA, 25 bp, Homo sapien
cctctcttgggacctgtcataagtc

SEQ ID NO: 236948 - DNA, 25 bp, Homo sapien
tctcttgggacctgtcataagtcgg

SEQ ID NO: 236949 - DNA, 25 bp, Homo sapien
tcttgggacctgtcataagtcggac

SEQ ID NO: 236950 - DNA, 25 bp, Homo sapien
ttgggacctgtcataagtcggaccc

SEQ ID NO: 236951 - DNA, 25 bp, Homo sapien
tgggacctgtcataagtcggacccc

SEQ ID NO: 236952 - DNA, 25 bp, Homo sapien
gggacctgtcataagtcggaccccg

SEQ ID NO: 236953 - DNA, 25 bp, Homo sapien
ggacctgtcataagtcggaccccgg

SEQ ID NO: 236954 - DNA, 25 bp, Homo sapien
gacctgtcataagtcggaccccggg

SEQ ID NO: 236955 - DNA, 25 bp, Homo sapien
cctgtcataagtcggaccccgggcg

SEQ ID NO: 236956 - DNA, 25 bp, Homo sapien
agtggaaccttcgggctcctgagct

SEQ ID NO: 236957 - DNA, 25 bp, Homo sapien
taccttcattactaattctcccttg

SEQ ID NO: 236958 - DNA, 25 bp, Homo sapien
tcattactaattctcccttgtctac

SEQ ID NO: 236959 - DNA, 25 bp, Homo sapien
tactaattctcccttgtctaccagt

SEQ ID NO: 236960 - DNA, 25 bp, Homo sapien
aattctcccttgtctaccagtagca

SEQ ID NO: 236961 - DNA, 25 bp, Homo sapien
gtctaccagtagcacttcttaacct

SEQ ID NO: 236962 - DNA, 25 bp, Homo sapien
agtagcacttcttaacctgctcact

SEQ ID NO: 236963 - DNA, 25 bp, Homo sapien
ttaacctgctcactgcccatcagaa

SEQ ID NO: 236964 - DNA, 25 bp, Homo sapien
catcagaacagcctccgacaaagct

SEQ ID NO: 236965 - DNA, 25 bp, Homo sapien
agaacagcctccgacaaagctgcat

SEQ ID NO: 236966 - DNA, 25 bp, Homo sapien
ctccgacaaagctgcatccaaattc

SEQ ID NO: 236967 - DNA, 25 bp, Homo sapien
aaagctgcatccaaattctttaaag

SEQ ID NO: 236968 - DNA, 25 bp, Homo sapien
tccagttttgggaatgtattttaag

SEQ ID NO: 236969 - DNA, 25 bp, Homo sapien
gtattatcttcattagtgctacagc

SEQ ID NO: 236970 - DNA, 25 bp, Homo sapien
ttatcttcattagtgctacagcaaa

SEQ ID NO: 236971 - DNA, 25 bp, Homo sapien
gaacaacttagaaaatgcagtggag

SEQ ID NO: 236972 - DNA, 25 bp, Homo sapien
gcagtggagaagaaaaccctacata

SEQ ID NO: 236973 - DNA, 25 bp, Homo sapien
gagaagaaaaccctacataaatgtg

SEQ ID NO: 236974 - DNA, 25 bp, Homo sapien
aaccctacataaatgtgaacacagt

SEQ ID NO: 236975 - DNA, 25 bp, Homo sapien
aaatgtgaacacagtcatgtaaaaa

SEQ ID NO: 236976 - DNA, 25 bp, Homo sapien
ccatgtaaaagtacgaggaccagaa

SEQ ID NO: 236977 - DNA, 25 bp, Homo sapien
atatgcaatatttatcaagggctat

SEQ ID NO: 236978 - DNA, 25 bp, Homo sapien
atcaagggctataaaaaacatcatt

SEQ ID NO: 236979 - DNA, 25 bp, Homo sapien
ctgcaggcactcatattccttgatt

SEQ ID NO: 236980 - DNA, 25 bp, Homo sapien
tctcctcgcgaacgcttcttttgtt

SEQ ID NO: 236981 - DNA, 25 bp, Homo sapien
gcgaacgcttcttttgttccagaaa

SEQ ID NO: 236982 - DNA, 25 bp, Homo sapien
cgcttcttttgttccagaaacccag

SEQ ID NO: 236983 - DNA, 25 bp, Homo sapien
tcgggcacttaaattacccttgaat

SEQ ID NO: 236984 - DNA, 25 bp, Homo sapien
gtgacaaaagtgtactataccattc

SEQ ID NO: 236985 - DNA, 25 bp, Homo sapien
gtgtactataccattcacttcttag

SEQ ID NO: 236986 - DNA, 25 bp, Homo sapien
taccattcacttcttagtgtcatag

SEQ ID NO: 236987 - DNA, 25 bp, Homo sapien
ttcacttcttagtgtcatagttggg

SEQ ID NO: 236988 - DNA, 25 bp, Homo sapien
ttccccaaacgctagccctgaaggg

SEQ ID NO: 236989 - DNA, 25 bp, Homo sapien
agaagcgaggcttgtctgcaggcac

SEQ ID NO: 236990 - DNA, 25 bp, Homo sapien
gccacagtcaagactcaagtcaaaa

SEQ ID NO: 236991 - DNA, 25 bp, Homo sapien
atttagaccccatctgggcaaacag

SEQ ID NO: 236992 - DNA, 25 bp, Homo sapien
ggcaaacaggcctctaagcaacaat

SEQ ID NO: 236993 - DNA, 25 bp, Homo sapien
ggcctctaagcaacaatctaagatt

SEQ ID NO: 236994 - DNA, 25 bp, Homo sapien
gatttccacctattgttctggcatt

SEQ ID NO: 236995 - DNA, 25 bp, Homo sapien
tattgttctggcattccttgtataa

SEQ ID NO: 236996 - DNA, 25 bp, Homo sapien
cttaggaagtgctgtggtaccttta

SEQ ID NO: 236997 - DNA, 25 bp, Homo sapien
gtggtacctttagatgtggcctgag

SEQ ID NO: 236998 - DNA, 25 bp, Homo sapien
tggcctgaggtgcatacatcctctt

SEQ ID NO: 236999 - DNA, 25 bp, Homo sapien
aggtgcatacatcctcttatgattg

SEQ ID NO: 237000 - DNA, 25 bp, Homo sapien
gggtacgtgtcctgaatttatagaa

SEQ ID NO: 237001 - DNA, 25 bp, Homo sapien
ctgtgcttcagggaatcctatgaca

SEQ ID NO: 237002 - DNA, 25 bp, Homo sapien
ggaatcctatgacagactctatctt

SEQ ID NO: 237003 - DNA, 25 bp, Homo sapien
ctctatcttgatgtggttgtctccg

SEQ ID NO: 237004 - DNA, 25 bp, Homo sapien
ggttgtctccgtttaatagcacaga

SEQ ID NO: 237005 - DNA, 25 bp, Homo sapien
atagcacagacttgaaggagtttaa

SEQ ID NO: 237006 - DNA, 25 bp, Homo sapien
ggaggctggaaatcaatactgcaca

SEQ ID NO: 237007 - DNA, 25 bp, Homo sapien
tggaaatcaatactgcacactgcac

SEQ ID NO: 237008 - DNA, 25 bp, Homo sapien
gaattgcacatctaacaggaaaaga

SEQ ID NO: 237009 - DNA, 25 bp, Homo sapien
ttcagaggttttgttaggttacaga

SEQ ID NO: 237010 - DNA, 25 bp, Homo sapien
gggattttaaaactctacagatggc

SEQ ID NO: 237011 - DNA, 25 bp, Homo sapien
tacagatggcatacctgtgcctgct

SEQ ID NO: 237012 - DNA, 25 bp, Homo sapien
tccttccccttgtatcttctgataa

SEQ ID NO: 237013 - DNA, 25 bp, Homo sapien
gtatcttctgataacattagctgta

SEQ ID NO: 237014 - DNA, 25 bp, Homo sapien
aaaggcgcagttcccatagaaaagc

SEQ ID NO: 237015 - DNA, 25 bp, Homo sapien
gggtgactcctgattttgtatttga

SEQ ID NO: 237016 - DNA, 25 bp, Homo sapien
gattgagtcacttctgttccatcta

SEQ ID NO: 237017 - DNA, 25 bp, Homo sapien
ctgttccatctagccaacatttggg

SEQ ID NO: 237018 - DNA, 25 bp, Homo sapien
gaagcccctgaattgattgtttatt

SEQ ID NO: 237019 - DNA, 25 bp, Homo sapien
gatgggcatgattctcactactttg

SEQ ID NO: 237020 - DNA, 25 bp, Homo sapien
atgattctcactactttgccctgta

SEQ ID NO: 237021 - DNA, 25 bp, Homo sapien
ttgccctgtagtcgcttggaggaca

SEQ ID NO: 237022 - DNA, 25 bp, Homo sapien
tggaggacaaatggcttttggagcc

SEQ ID NO: 237023 - DNA, 25 bp, Homo sapien
ttggaactcttctctagaccacagg

SEQ ID NO: 237024 - DNA, 25 bp, Homo sapien
agaccacaggtttccatctacatta

SEQ ID NO: 237025 - DNA, 25 bp, Homo sapien
ggtttccatctacattactaaagtg

SEQ ID NO: 237026 - DNA, 25 bp, Homo sapien
aagtgttgactacgcaaacctcagg

SEQ ID NO: 237027 - DNA, 25 bp, Homo sapien
aaacctcagggcaccttggcaagac

SEQ ID NO: 237028 - DNA, 25 bp, Homo sapien
ttaccatttacaccagaatcccatg

SEQ ID NO: 237029 - DNA, 25 bp, Homo sapien
aatattatcatctctgtgtgccaag

SEQ ID NO: 237030 - DNA, 25 bp, Homo sapien
gtgtgccaagatgagacatgtccaa

SEQ ID NO: 237031 - DNA, 25 bp, Homo sapien
agacatgtccaagtatctctgccct

SEQ ID NO: 237032 - DNA, 25 bp, Homo sapien
agcatccaagcatctttgtggtgat

SEQ ID NO: 237033 - DNA, 25 bp, Homo sapien
tttgtggtgatatctatacagcatc

SEQ ID NO: 237034 - DNA, 25 bp, Homo sapien
gcaatttttactgtagataaggcta

SEQ ID NO: 237035 - DNA, 25 bp, Homo sapien
ttttactgtagataaggctataccg

SEQ ID NO: 237036 - DNA, 25 bp, Homo sapien
aattctgggcacagcatgtgtaaat

SEQ ID NO: 237037 - DNA, 25 bp, Homo sapien
ggcacagcatgtgtaaatttctaaa

SEQ ID NO: 237038 - DNA, 25 bp, Homo sapien
aatttctaaatatgatggacacccc

SEQ ID NO: 237039 - DNA, 25 bp, Homo sapien
cagcttccacctcaaggaggttggt

SEQ ID NO: 237040 - DNA, 25 bp, Homo sapien
acctcaaggaggttggtcccattga

SEQ ID NO: 237041 - DNA, 25 bp, Homo sapien
caaggaggttggtcccattgacatt

SEQ ID NO: 237042 - DNA, 25 bp, Homo sapien
ggaggttggtcccattgacatttcc

SEQ ID NO: 237043 - DNA, 25 bp, Homo sapien
ggttggtcccattgacatttcccca

SEQ ID NO: 237044 - DNA, 25 bp, Homo sapien
ccaggctgtgcccttaaacttggtt

SEQ ID NO: 237045 - DNA, 25 bp, Homo sapien
gactccaaacgctgtcctgagatca

SEQ ID NO: 237046 - DNA, 25 bp, Homo sapien
gatcagttttaacctcgtctttcgg

SEQ ID NO: 237047 - DNA, 25 bp, Homo sapien
tttcgggccgaaagtagttcacatt

SEQ ID NO: 237048 - DNA, 25 bp, Homo sapien
aaagtagttcacatttcccgagcac

SEQ ID NO: 237049 - DNA, 25 bp, Homo sapien
tttcccgagcacaagcatggagatt

SEQ ID NO: 237050 - DNA, 25 bp, Homo sapien
gaggtgcccaggttagaatttgcgt

SEQ ID NO: 237051 - DNA, 25 bp, Homo sapien
gaatttgcgtgtcgtcctcatgatc

SEQ ID NO: 237052 - DNA, 25 bp, Homo sapien
ctcatgatcccctgcacttttattc

SEQ ID NO: 237053 - DNA, 25 bp, Homo sapien
ttttattccccgagaatcttgcctc

SEQ ID NO: 237054 - DNA, 25 bp, Homo sapien
cctcccggtggctagtacagtattg

SEQ ID NO: 237055 - DNA, 25 bp, Homo sapien
gtacagtattgtttccttcttgatc

SEQ ID NO: 237056 - DNA, 25 bp, Homo sapien
tccccagaagaagaattctaatttt

SEQ ID NO: 237057 - DNA, 25 bp, Homo sapien
agaattctaattttatcaagctgaa

SEQ ID NO: 237058 - DNA, 25 bp, Homo sapien
gaattctaattttatcaagctgaat

SEQ ID NO: 237059 - DNA, 25 bp, Homo sapien
attctaattttatcaagctgaatta

SEQ ID NO: 237060 - DNA, 25 bp, Homo sapien
cttactgtgtcaaaagaggcattat

SEQ ID NO: 237061 - DNA, 25 bp, Homo sapien
ttactgtgtcaaaagaggcattatg

SEQ ID NO: 237062 - DNA, 25 bp, Homo sapien
tactgtgtcaaaagaggcattatgt

SEQ ID NO: 237063 - DNA, 25 bp, Homo sapien
actgtgtcaaaagaggcattatgtt

SEQ ID NO: 237064 - DNA, 25 bp, Homo sapien
ctgtgtcaaaagaggcattatgttg

SEQ ID NO: 237065 - DNA, 25 bp, Homo sapien
tgtgtcaaaagaggcattatgttgc

SEQ ID NO: 237066 - DNA, 25 bp, Homo sapien
gtgtcaaaagaggcattatgttgct

SEQ ID NO: 237067 - DNA, 25 bp, Homo sapien
agtgttttcattgcaaattataatt

SEQ ID NO: 237068 - DNA, 25 bp, Homo sapien
tgcaaattataattgctgtagagcc

SEQ ID NO: 237069 - DNA, 25 bp, Homo sapien
gcaaattataattgctgtagagcca

SEQ ID NO: 237070 - DNA, 25 bp, Homo sapien
caaattataattgctgtagagccac

SEQ ID NO: 237071 - DNA, 25 bp, Homo sapien
aaattataattgctgtagagccaca

SEQ ID NO: 237072 - DNA, 25 bp, Homo sapien
aattataattgctgtagagccacac

SEQ ID NO: 237073 - DNA, 25 bp, Homo sapien
attataattgctgtagagccacaca

SEQ ID NO: 237074 - DNA, 25 bp, Homo sapien
ttataattgctgtagagccacacac

SEQ ID NO: 237075 - DNA, 25 bp, Homo sapien
gtccttatgaagctgtggtccacga

SEQ ID NO: 237076 - DNA, 25 bp, Homo sapien
atgaagctgtggtccacgacaggag

SEQ ID NO: 237077 - DNA, 25 bp, Homo sapien
ggagtaccagggttctgctgctttc

SEQ ID NO: 237078 - DNA, 25 bp, Homo sapien
agtaccagggttctgctgctttcct

SEQ ID NO: 237079 - DNA, 25 bp, Homo sapien
cagggttctgctgctttcctgcatc

SEQ ID NO: 237080 - DNA, 25 bp, Homo sapien
gcaacacaacagagatcatcagttt

SEQ ID NO: 237081 - DNA, 25 bp, Homo sapien
tcagttttaaatagagtagccctca

SEQ ID NO: 237082 - DNA, 25 bp, Homo sapien
gagtagccctcacaatcaaaatatc

SEQ ID NO: 237083 - DNA, 25 bp, Homo sapien
gctttttgtcaaaagtggtaacatc

SEQ ID NO: 237084 - DNA, 25 bp, Homo sapien
agtggtaacatcttaatacaaataa

SEQ ID NO: 237085 - DNA, 25 bp, Homo sapien
tttttgtggttgtaagatttagctt

SEQ ID NO: 237086 - DNA, 25 bp, Homo sapien
cagggtctggacctgcagggctgaa

SEQ ID NO: 237087 - DNA, 25 bp, Homo sapien
gcagggctgaagttcactcatcgac

SEQ ID NO: 237088 - DNA, 25 bp, Homo sapien
gggctgaagttcactcatcgaccga

SEQ ID NO: 237089 - DNA, 25 bp, Homo sapien
gaagttcactcatcgaccgactcag

SEQ ID NO: 237090 - DNA, 25 bp, Homo sapien
gccccaaccgggagccaggcagaaa

SEQ ID NO: 237091 - DNA, 25 bp, Homo sapien
gggagccaggcagaaaaaccctgtg

SEQ ID NO: 237092 - DNA, 25 bp, Homo sapien
ggaaagggcagtagatctctaatgt

SEQ ID NO: 237093 - DNA, 25 bp, Homo sapien
atctctaatgtggaggtgggaacat

SEQ ID NO: 237094 - DNA, 25 bp, Homo sapien
ggaacattattgtggtggaggcaat

SEQ ID NO: 237095 - DNA, 25 bp, Homo sapien
gaggcaattatgagggtagcatttc

SEQ ID NO: 237096 - DNA, 25 bp, Homo sapien
aattatgagggtagcatttctttcg

SEQ ID NO: 237097 - DNA, 25 bp, Homo sapien
tgcttctgagacacacctcaggcat

SEQ ID NO: 237098 - DNA, 25 bp, Homo sapien
acacctcaggcatagcaatgctctg

SEQ ID NO: 237099 - DNA, 25 bp, Homo sapien
aatgctctgaggcaagagctcttga

SEQ ID NO: 237100 - DNA, 25 bp, Homo sapien
tatgaaaggcactgatgaacgagat

SEQ ID NO: 237101 - DNA, 25 bp, Homo sapien
gcatgagactggtgcaggacatctt

SEQ ID NO: 237102 - DNA, 25 bp, Homo sapien
caggacatctttgtgggagttcagt

SEQ ID NO: 237103 - DNA, 25 bp, Homo sapien
agtcaaccctttcagttgtgctctg

SEQ ID NO: 237104 - DNA, 25 bp, Homo sapien
ttgtgctctgtctaggttccaaaag

SEQ ID NO: 237105 - DNA, 25 bp, Homo sapien
ttccaaaagatccactcaccctggt

SEQ ID NO: 237106 - DNA, 25 bp, Homo sapien
tttattgtggcaaagcagcttgttc

SEQ ID NO: 237107 - DNA, 25 bp, Homo sapien
gcttgttcagagcaatcacatccaa

SEQ ID NO: 237108 - DNA, 25 bp, Homo sapien
agtttaagccaagtgtagacagtac

SEQ ID NO: 237109 - DNA, 25 bp, Homo sapien
gtagacagtacattactcccttgaa

SEQ ID NO: 237110 - DNA, 25 bp, Homo sapien
gaaagagttgactttgccttaaaag

SEQ ID NO: 237111 - DNA, 25 bp, Homo sapien
aaggcagatctaacccaagctccat

SEQ ID NO: 237112 - DNA, 25 bp, Homo sapien
aagctccatccagtaccaaatgtga

SEQ ID NO: 237113 - DNA, 25 bp, Homo sapien
gaaacttcattgttgtttggtgaga

SEQ ID NO: 237114 - DNA, 25 bp, Homo sapien
aatcgccaaattctcactaatacat

SEQ ID NO: 237115 - DNA, 25 bp, Homo sapien
cattggtatggtgtagggcatgcta

SEQ ID NO: 237116 - DNA, 25 bp, Homo sapien
tagggcatgctactttttaaacagc

SEQ ID NO: 237117 - DNA, 25 bp, Homo sapien
atttttacagattgctactccaagg

SEQ ID NO: 237118 - DNA, 25 bp, Homo sapien
actggccacttttcatgtaaatatt

SEQ ID NO: 237119 - DNA, 25 bp, Homo sapien
ccaagaagtgtctctatgtatcccc

SEQ ID NO: 237120 - DNA, 25 bp, Homo sapien
atgtatcccccagcagtattcatgc

SEQ ID NO: 237121 - DNA, 25 bp, Homo sapien
aaccagccaggacactcagggttcc

SEQ ID NO: 237122 - DNA, 25 bp, Homo sapien
tcagggttccccaatttactattag

SEQ ID NO: 237123 - DNA, 25 bp, Homo sapien
attagggagcctacttcggcagcag

SEQ ID NO: 237124 - DNA, 25 bp, Homo sapien
agaaccaagtcagcccagtggcctt

SEQ ID NO: 237125 - DNA, 25 bp, Homo sapien
agtggccttcctaccgattcaccat

SEQ ID NO: 237126 - DNA, 25 bp, Homo sapien
taccgattcaccatggcctttggac

SEQ ID NO: 237127 - DNA, 25 bp, Homo sapien
tttggaccggcccatactcagtcta

SEQ ID NO: 237128 - DNA, 25 bp, Homo sapien
accggcccatactcagtctatttta

SEQ ID NO: 237129 - DNA, 25 bp, Homo sapien
ttaagtaatgccaagaagtgtctct

SEQ ID NO: 237130 - DNA, 25 bp, Homo sapien
gttgtttttaatgtctccagcttgg

SEQ ID NO: 237131 - DNA, 25 bp, Homo sapien
tacacacacacatctgcatcttaat

SEQ ID NO: 237132 - DNA, 25 bp, Homo sapien
acatctgcatcttaatgtacaggca

SEQ ID NO: 237133 - DNA, 25 bp, Homo sapien
ctgcatcttaatgtacaggcagtgc

SEQ ID NO: 237134 - DNA, 25 bp, Homo sapien
cagtgctaaaatagacatcttaata

SEQ ID NO: 237135 - DNA, 25 bp, Homo sapien
ttaatgtctccagcttggactgcag

SEQ ID NO: 237136 - DNA, 25 bp, Homo sapien
tgttccatgaatatttaccttgtag

SEQ ID NO: 237137 - DNA, 25 bp, Homo sapien
gaatatttaccttgtagatatacag

SEQ ID NO: 237138 - DNA, 25 bp, Homo sapien
gtagatatacagagtttccttaaaa

SEQ ID NO: 237139 - DNA, 25 bp, Homo sapien
cagatttaagtctctcttcttccaa

SEQ ID NO: 237140 - DNA, 25 bp, Homo sapien
ttctactagaaatacacaccccaca

SEQ ID NO: 237141 - DNA, 25 bp, Homo sapien
gcctgtgctgtcacgagaggaacag

SEQ ID NO: 237142 - DNA, 25 bp, Homo sapien
aggtttggtttgatacctctgcctc

SEQ ID NO: 237143 - DNA, 25 bp, Homo sapien
tcctgccagcatggattctgggtgg

SEQ ID NO: 237144 - DNA, 25 bp, Homo sapien
atggattctgggtggacacagcctt

SEQ ID NO: 237145 - DNA, 25 bp, Homo sapien
gacacagccttgtggaaggtccagt

SEQ ID NO: 237146 - DNA, 25 bp, Homo sapien
gaaggtccagtaccaccaagagctg

SEQ ID NO: 237147 - DNA, 25 bp, Homo sapien
caccccacactgtatcaaatgtatc

SEQ ID NO: 237148 - DNA, 25 bp, Homo sapien
acattttctcatgttgaacacttta

SEQ ID NO: 237149 - DNA, 25 bp, Homo sapien
gttgaacactttagccttaattgaa

SEQ ID NO: 237150 - DNA, 25 bp, Homo sapien
aaagctggacaattgctagttgtat

SEQ ID NO: 237151 - DNA, 25 bp, Homo sapien
ttaatctcaccgaatgtacagtttt

SEQ ID NO: 237152 - DNA, 25 bp, Homo sapien
gggacatcatcaggaactcgagaaa

SEQ ID NO: 237153 - DNA, 25 bp, Homo sapien
tcaggaactcgagaaactgcccata

SEQ ID NO: 237154 - DNA, 25 bp, Homo sapien
tgcccatacacaatgacccagaatc

SEQ ID NO: 237155 - DNA, 25 bp, Homo sapien
gaatccctggaatcatgcttctgat

SEQ ID NO: 237156 - DNA, 25 bp, Homo sapien
tggaatcatgcttctgattgaggac

SEQ ID NO: 237157 - DNA, 25 bp, Homo sapien
tgattgaggacatggctcacaactt

SEQ ID NO: 237158 - DNA, 25 bp, Homo sapien
ggctcacaacttagccattcattcg

SEQ ID NO: 237159 - DNA, 25 bp, Homo sapien
acttagccattcattcgcattcatg

SEQ ID NO: 237160 - DNA, 25 bp, Homo sapien
attcattcgcattcatgtttgcatg

SEQ ID NO: 237161 - DNA, 25 bp, Homo sapien
tgtttgcatgaacaggtcaccctgg

SEQ ID NO: 237162 - DNA, 25 bp, Homo sapien
ttgcatgaacaggtcaccctggcat

SEQ ID NO: 237163 - DNA, 25 bp, Homo sapien
gatggcggaaagcagcccgacctca

SEQ ID NO: 237164 - DNA, 25 bp, Homo sapien
atggcggaaagcagcccgacctcag

SEQ ID NO: 237165 - DNA, 25 bp, Homo sapien
cagcccgacctcaggatggcacgcc

SEQ ID NO: 237166 - DNA, 25 bp, Homo sapien
ccgacctcaggatggcacgccccat

SEQ ID NO: 237167 - DNA, 25 bp, Homo sapien
ccatcttccgcttcatgtgcagaga

SEQ ID NO: 237168 - DNA, 25 bp, Homo sapien
tcagtgaggaaagcatcagctggcc

SEQ ID NO: 237169 - DNA, 25 bp, Homo sapien
cagtgaggaaagcatcagctggcct

SEQ ID NO: 237170 - DNA, 25 bp, Homo sapien
agtgaggaaagcatcagctggcctg

SEQ ID NO: 237171 - DNA, 25 bp, Homo sapien
gtgaggaaagcatcagctggcctga

SEQ ID NO: 237172 - DNA, 25 bp, Homo sapien
gaggaaagcatcagctggcctgagc

SEQ ID NO: 237173 - DNA, 25 bp, Homo sapien
aggaaagcatcagctggcctgagcc

SEQ ID NO: 237174 - DNA, 25 bp, Homo sapien
ttcaagtgaatcgaagtccaataac

SEQ ID NO: 237175 - DNA, 25 bp, Homo sapien
gtgaatcgaagtccaataactgtag

SEQ ID NO: 237176 - DNA, 25 bp, Homo sapien
atcgaagtccaataactgtagactt

SEQ ID NO: 237177 - DNA, 25 bp, Homo sapien
aattttatcaaaacaggtcactgat

SEQ ID NO: 237178 - DNA, 25 bp, Homo sapien
ggtcactgataaataactcctccag

SEQ ID NO: 237179 - DNA, 25 bp, Homo sapien
gataaataactcctccagtaataga

SEQ ID NO: 237180 - DNA, 25 bp, Homo sapien
taactcctccagtaatagagctagg

SEQ ID NO: 237181 - DNA, 25 bp, Homo sapien
tcctccagtaatagagctaggcctg

SEQ ID NO: 237182 - DNA, 25 bp, Homo sapien
agtaatagagctaggcctgaaacca

SEQ ID NO: 237183 - DNA, 25 bp, Homo sapien
ttaacaaaacagattgaacctgaat

SEQ ID NO: 237184 - DNA, 25 bp, Homo sapien
gattgaacctgaattaaatttcttt

SEQ ID NO: 237185 - DNA, 25 bp, Homo sapien
ggccctgaattctggtaacggatat

SEQ ID NO: 237186 - DNA, 25 bp, Homo sapien
gatatcgcgttccagggttttgatg

SEQ ID NO: 237187 - DNA, 25 bp, Homo sapien
tgtggtgggatgatccgcaccatct

SEQ ID NO: 237188 - DNA, 25 bp, Homo sapien
ttgctcattataccccaaagacctt

SEQ ID NO: 237189 - DNA, 25 bp, Homo sapien
ttttccactgcccagacagcttata

SEQ ID NO: 237190 - DNA, 25 bp, Homo sapien
agacagcttataccacccagtgttc

SEQ ID NO: 237191 - DNA, 25 bp, Homo sapien
accacccagtgttcagggatctctg

SEQ ID NO: 237192 - DNA, 25 bp, Homo sapien
gaagaacccacagaccaggtgaatt

SEQ ID NO: 237193 - DNA, 25 bp, Homo sapien
ggtgaattactgatttctaagtcca

SEQ ID NO: 237194 - DNA, 25 bp, Homo sapien
tgagaccatgtcaacaaggctgttt

SEQ ID NO: 237195 - DNA, 25 bp, Homo sapien
ggaagaaagccctggccctgaattc

SEQ ID NO: 237196 - DNA, 25 bp, Homo sapien
ttatctttggtaaatgactttagag

SEQ ID NO: 237197 - DNA, 25 bp, Homo sapien
cattgcttaaaaaactcagaatcag

SEQ ID NO: 237198 - DNA, 25 bp, Homo sapien
aacactgaattatttaagaacacat

SEQ ID NO: 237199 - DNA, 25 bp, Homo sapien
tttatttgcacccttgggaagattg

SEQ ID NO: 237200 - DNA, 25 bp, Homo sapien
ttatttgcacccttgggaagattgc

SEQ ID NO: 237201 - DNA, 25 bp, Homo sapien
tatttgcacccttgggaagattgct

SEQ ID NO: 237202 - DNA, 25 bp, Homo sapien
atttgcacccttgggaagattgctt

SEQ ID NO: 237203 - DNA, 25 bp, Homo sapien
ttctgccttgattccttctcattga

SEQ ID NO: 237204 - DNA, 25 bp, Homo sapien
tctgccttgattccttctcattgat

SEQ ID NO: 237205 - DNA, 25 bp, Homo sapien
ctgccttgattccttctcattgatg

SEQ ID NO: 237206 - DNA, 25 bp, Homo sapien
gatgtccaggtcatctggaggccgg

SEQ ID NO: 237207 - DNA, 25 bp, Homo sapien
aatcattcatggtttgtcaatttgt

SEQ ID NO: 237208 - DNA, 25 bp, Homo sapien
acagtaaatgttccatctggcagta

SEQ ID NO: 237209 - DNA, 25 bp, Homo sapien
aaatgttccatctggcagtactaaa

SEQ ID NO: 237210 - DNA, 25 bp, Homo sapien
ccatctggcagtactaaaatgctta

SEQ ID NO: 237211 - DNA, 25 bp, Homo sapien
aaatgcttatttaccaggttactca

SEQ ID NO: 237212 - DNA, 25 bp, Homo sapien
taccaggttactcaaaggttattct

SEQ ID NO: 237213 - DNA, 25 bp, Homo sapien
ggttattctacctaaactgagagca

SEQ ID NO: 237214 - DNA, 25 bp, Homo sapien
ttctacctaaactgagagcaagctg

SEQ ID NO: 237215 - DNA, 25 bp, Homo sapien
gagcaagctggccatataaataaat

SEQ ID NO: 237216 - DNA, 25 bp, Homo sapien
tacaacaatgttacctagaaaccta

SEQ ID NO: 237217 - DNA, 25 bp, Homo sapien
tgctgaggcaaaacaaatcattcat

SEQ ID NO: 237218 - DNA, 25 bp, Homo sapien
gatgtatatttagaccagcacacaa

SEQ ID NO: 237219 - DNA, 25 bp, Homo sapien
gaccagcacacaattttgatttcaa

SEQ ID NO: 237220 - DNA, 25 bp, Homo sapien
ttttgatttcaattagccttattct

SEQ ID NO: 237221 - DNA, 25 bp, Homo sapien
agcttttagatctttcatacacatt

SEQ ID NO: 237222 - DNA, 25 bp, Homo sapien
atacacattttcacgtactttgcaa

SEQ ID NO: 237223 - DNA, 25 bp, Homo sapien
acgtactttgcaattgagaccagaa

SEQ ID NO: 237224 - DNA, 25 bp, Homo sapien
gacttgtaggtctttctgcagaatg

SEQ ID NO: 237225 - DNA, 25 bp, Homo sapien
ctttctgcagaatgagtgggtcctt

SEQ ID NO: 237226 - DNA, 25 bp, Homo sapien
atgagtgggtccttgcaaagtgagt

SEQ ID NO: 237227 - DNA, 25 bp, Homo sapien
gaaacttactcctagatcagaaatg

SEQ ID NO: 237228 - DNA, 25 bp, Homo sapien
tgcctctctgagtaaaatgtttctt

SEQ ID NO: 237229 - DNA, 25 bp, Homo sapien
gcacctactgggtaccaggcaccat

SEQ ID NO: 237230 - DNA, 25 bp, Homo sapien
accattctcagtgtttcacctggat

SEQ ID NO: 237231 - DNA, 25 bp, Homo sapien
tttcacctggatcaactaatgcgtc

SEQ ID NO: 237232 - DNA, 25 bp, Homo sapien
gcagctccactcatgactaatacct

SEQ ID NO: 237233 - DNA, 25 bp, Homo sapien
gtgacagctgctattattttcatta

SEQ ID NO: 237234 - DNA, 25 bp, Homo sapien
agctgaggccagaatcgtgaagtca

SEQ ID NO: 237235 - DNA, 25 bp, Homo sapien
atcgtgaagtcacttgctcaaggtc

SEQ ID NO: 237236 - DNA, 25 bp, Homo sapien
ttgctcaaggtcaggcagcttagga

SEQ ID NO: 237237 - DNA, 25 bp, Homo sapien
tacctcattatttcagctgtctgca

SEQ ID NO: 237238 - DNA, 25 bp, Homo sapien
aattccccacttgcacggcagtgta

SEQ ID NO: 237239 - DNA, 25 bp, Homo sapien
aataaccatagctcacactcactga

SEQ ID NO: 237240 - DNA, 25 bp, Homo sapien
ggtgtcgcacactagtagagaatca

SEQ ID NO: 237241 - DNA, 25 bp, Homo sapien
gaatcagagtctatgcctttaggca

SEQ ID NO: 237242 - DNA, 25 bp, Homo sapien
taactgggagtttggattcccactt

SEQ ID NO: 237243 - DNA, 25 bp, Homo sapien
ttacttcttgggtcctgtggatggt

SEQ ID NO: 237244 - DNA, 25 bp, Homo sapien
atggtggttcttcgtgtcaggatcc

SEQ ID NO: 237245 - DNA, 25 bp, Homo sapien
ggatcccagcccgattctgcaaatg

SEQ ID NO: 237246 - DNA, 25 bp, Homo sapien
aacatgaggctttccaagttcttgc

SEQ ID NO: 237247 - DNA, 25 bp, Homo sapien
ttccaagttcttgcccagtatctgg

SEQ ID NO: 237248 - DNA, 25 bp, Homo sapien
gcctccagagtatcacctgggagtt

SEQ ID NO: 237249 - DNA, 25 bp, Homo sapien
gggagttcaggttctctccagggct

SEQ ID NO: 237250 - DNA, 25 bp, Homo sapien
ggctccaggtgtgtgtttatctcgc

SEQ ID NO: 237251 - DNA, 25 bp, Homo sapien
gattctgtgaaaataccccctttat

SEQ ID NO: 237252 - DNA, 25 bp, Homo sapien
gcatgttcattcaggtcttatcttt

SEQ ID NO: 237253 - DNA, 25 bp, Homo sapien
gttcattcaggtcttatctttatat

SEQ ID NO: 237254 - DNA, 25 bp, Homo sapien
ttcaggtcttatctttatattctag

SEQ ID NO: 237255 - DNA, 25 bp, Homo sapien
aggtcttatctttatattctagtaa

SEQ ID NO: 237256 - DNA, 25 bp, Homo sapien
attctagtaagttattttgctctca

SEQ ID NO: 237257 - DNA, 25 bp, Homo sapien
aaaaaattctcacataccttgttca

SEQ ID NO: 237258 - DNA, 25 bp, Homo sapien
aaaaattctcacataccttgttcaa

SEQ ID NO: 237259 - DNA, 25 bp, Homo sapien
aaaattctcacataccttgttcaat

SEQ ID NO: 237260 - DNA, 25 bp, Homo sapien
catagctgttacatgtagggcaatc

SEQ ID NO: 237261 - DNA, 25 bp, Homo sapien
gaaagtttttccttcaagtcaggct

SEQ ID NO: 237262 - DNA, 25 bp, Homo sapien
atcgcggcccggtggtgcccaagca

SEQ ID NO: 237263 - DNA, 25 bp, Homo sapien
gtctgcacgctctcaagttgcgaag

SEQ ID NO: 237264 - DNA, 25 bp, Homo sapien
tctcaagttgcgaagcgccgacgcc

SEQ ID NO: 237265 - DNA, 25 bp, Homo sapien
gagctcaagcccgaggacaaagatc

SEQ ID NO: 237266 - DNA, 25 bp, Homo sapien
gacaaagatccaagggaccccgaag

SEQ ID NO: 237267 - DNA, 25 bp, Homo sapien
agatccaagggaccccgaagagtcg

SEQ ID NO: 237268 - DNA, 25 bp, Homo sapien
gaccccgaagagtcgaaggagccca

SEQ ID NO: 237269 - DNA, 25 bp, Homo sapien
aggagaacagcagcgatagctcgaa

SEQ ID NO: 237270 - DNA, 25 bp, Homo sapien
gaacagcagcgatagctcgaagcca

SEQ ID NO: 237271 - DNA, 25 bp, Homo sapien
acagcagcgatagctcgaagccaaa

SEQ ID NO: 237272 - DNA, 25 bp, Homo sapien
gcagcgatagctcgaagccaaagaa

SEQ ID NO: 237273 - DNA, 25 bp, Homo sapien
agaattgtggtcatgggaagcatat

SEQ ID NO: 237274 - DNA, 25 bp, Homo sapien
gaagcatatggccatgacattcatc

SEQ ID NO: 237275 - DNA, 25 bp, Homo sapien
tgacattcatcccttactcaagata

SEQ ID NO: 237276 - DNA, 25 bp, Homo sapien
agctgaggagcaaggtcaacacatt

SEQ ID NO: 237277 - DNA, 25 bp, Homo sapien
agcaaggtcaacacattgcctcaga

SEQ ID NO: 237278 - DNA, 25 bp, Homo sapien
ttgcctcagacctcaaatgaagact

SEQ ID NO: 237279 - DNA, 25 bp, Homo sapien
tcgcaagtttcaaatctcacagcag

SEQ ID NO: 237280 - DNA, 25 bp, Homo sapien
agactggaacatatcaccctaaccg

SEQ ID NO: 237281 - DNA, 25 bp, Homo sapien
accctaaccgcatgggactaggatg

SEQ ID NO: 237282 - DNA, 25 bp, Homo sapien
tgtttacacattgcagtttggctga

SEQ ID NO: 237283 - DNA, 25 bp, Homo sapien
ggctgaattcagaggaagctttcct

SEQ ID NO: 237284 - DNA, 25 bp, Homo sapien
ggacctccaggtcaatgactctcag

SEQ ID NO: 237285 - DNA, 25 bp, Homo sapien
gtcaatgactctcagacttcaaagg

SEQ ID NO: 237286 - DNA, 25 bp, Homo sapien
ctctaaaaccctcagatgtgagcag

SEQ ID NO: 237287 - DNA, 25 bp, Homo sapien
ctttctgcgtctccggcttcatgat

SEQ ID NO: 237288 - DNA, 25 bp, Homo sapien
gtctccggcttcatgatccttaaat

SEQ ID NO: 237289 - DNA, 25 bp, Homo sapien
tgacccttgaactatgacaacattg

SEQ ID NO: 237290 - DNA, 25 bp, Homo sapien
tccaggaacctcaaactgcaacagg

SEQ ID NO: 237291 - DNA, 25 bp, Homo sapien
gaactatgacaacattgctcctccc

SEQ ID NO: 237292 - DNA, 25 bp, Homo sapien
atgacaacattgctcctccctgggt

SEQ ID NO: 237293 - DNA, 25 bp, Homo sapien
tgcagctccatgactctcaaactag

SEQ ID NO: 237294 - DNA, 25 bp, Homo sapien
gactctcaaactagaacagcagcac

SEQ ID NO: 237295 - DNA, 25 bp, Homo sapien
ccccatggttctgtgagactggtag

SEQ ID NO: 237296 - DNA, 25 bp, Homo sapien
agaaagcacagaccccttagacttc

SEQ ID NO: 237297 - DNA, 25 bp, Homo sapien
tccccaaggagaatacgtgagacta

SEQ ID NO: 237298 - DNA, 25 bp, Homo sapien
aaatatgcatttcgtgtcccaggct

SEQ ID NO: 237299 - DNA, 25 bp, Homo sapien
gtcccaggctatcagagcacagctc

SEQ ID NO: 237300 - DNA, 25 bp, Homo sapien
agagcacagctctaaggaaaaatac

SEQ ID NO: 237301 - DNA, 25 bp, Homo sapien
aatacagggcatcgtatagcaactg

SEQ ID NO: 237302 - DNA, 25 bp, Homo sapien
ggcatcgtatagcaactggcacagc

SEQ ID NO: 237303 - DNA, 25 bp, Homo sapien
gccttggatgtctttcttatacctc

SEQ ID NO: 237304 - DNA, 25 bp, Homo sapien
attgtctgcagcgtgactcccatac

SEQ ID NO: 237305 - DNA, 25 bp, Homo sapien
actcccatactcttgagccaaggta

SEQ ID NO: 237306 - DNA, 25 bp, Homo sapien
cctgaagttgtgctccctctgggac

SEQ ID NO: 237307 - DNA, 25 bp, Homo sapien
gggccacggcgccttccatagtagc

SEQ ID NO: 237308 - DNA, 25 bp, Homo sapien
gccttccatagtagccacgtctgta

SEQ ID NO: 237309 - DNA, 25 bp, Homo sapien
tagccacgtctgtaacggcgccgat

SEQ ID NO: 237310 - DNA, 25 bp, Homo sapien
gtaacggcgccgatctgcagcgtaa

SEQ ID NO: 237311 - DNA, 25 bp, Homo sapien
cgatctgcagcgtaacgactccctt

SEQ ID NO: 237312 - DNA, 25 bp, Homo sapien
gtaacgactcccttccacaggaact

SEQ ID NO: 237313 - DNA, 25 bp, Homo sapien
ttcaaccacatcaaactctacagtt

SEQ ID NO: 237314 - DNA, 25 bp, Homo sapien
cttgggcggtaagttggatttcgat

SEQ ID NO: 237315 - DNA, 25 bp, Homo sapien
ggatttcgatgaaccggtccctgaa

SEQ ID NO: 237316 - DNA, 25 bp, Homo sapien
atgaaccggtccctgaagttgtgct

SEQ ID NO: 237317 - DNA, 25 bp, Homo sapien
gcggcccggtggtgcccaagcactc

SEQ ID NO: 237318 - DNA, 25 bp, Homo sapien
agcgtctgcacgctctcaagttgcg

SEQ ID NO: 237319 - DNA, 25 bp, Homo sapien
gtctgcacgctctcaagttgcgaag

SEQ ID NO: 237320 - DNA, 25 bp, Homo sapien
tctgcacgctctcaagttgcgaagc

SEQ ID NO: 237321 - DNA, 25 bp, Homo sapien
agctcaagcccgaggacaaagatcc

SEQ ID NO: 237322 - DNA, 25 bp, Homo sapien
tcaagcccgaggacaaagatccaag

SEQ ID NO: 237323 - DNA, 25 bp, Homo sapien
gaggacaaagatccaagggaccccg

SEQ ID NO: 237324 - DNA, 25 bp, Homo sapien
gacaaagatccaagggaccccgaag

SEQ ID NO: 237325 - DNA, 25 bp, Homo sapien
agatccaagggaccccgaagagtcg

SEQ ID NO: 237326 - DNA, 25 bp, Homo sapien
gaccccgaagagtcgaaggagccca

SEQ ID NO: 237327 - DNA, 25 bp, Homo sapien
caaagaagcccacccgccgtgacgc

SEQ ID NO: 237328 - DNA, 25 bp, Homo sapien
ctgcctgtgagcctatttttcatgt

SEQ ID NO: 237329 - DNA, 25 bp, Homo sapien
tatttttcatgtagctcttgccaaa

SEQ ID NO: 237330 - DNA, 25 bp, Homo sapien
gtagctcttgccaaaagccctgatg

SEQ ID NO: 237331 - DNA, 25 bp, Homo sapien
aaagccctgatgtggtttgaagtag

SEQ ID NO: 237332 - DNA, 25 bp, Homo sapien
ttctttcactttgtgcctctcgtac

SEQ ID NO: 237333 - DNA, 25 bp, Homo sapien
tttgtgcctctcgtaccttaaccaa

SEQ ID NO: 237334 - DNA, 25 bp, Homo sapien
ataacctcctctctgagtagctcat

SEQ ID NO: 237335 - DNA, 25 bp, Homo sapien
gagtagctcatggagcctctaaaag

SEQ ID NO: 237336 - DNA, 25 bp, Homo sapien
tctccaacccatgcggtaaactggt

SEQ ID NO: 237337 - DNA, 25 bp, Homo sapien
gtaaactggtggtgcccaaggccct

SEQ ID NO: 237338 - DNA, 25 bp, Homo sapien
atcgggtccctgagagtctcccaac

SEQ ID NO: 237339 - DNA, 25 bp, Homo sapien
tgctgggatggaaactgacttgtga

SEQ ID NO: 237340 - DNA, 25 bp, Homo sapien
gaaactgacttgtgagagaccacag

SEQ ID NO: 237341 - DNA, 25 bp, Homo sapien
gagagaccacagctactgctagaag

SEQ ID NO: 237342 - DNA, 25 bp, Homo sapien
ccacagctactgctagaaggaaggg

SEQ ID NO: 237343 - DNA, 25 bp, Homo sapien
ggcaaagcgggcacaggtaatctaa

SEQ ID NO: 237344 - DNA, 25 bp, Homo sapien
aagcgggcacaggtaatctaagaat

SEQ ID NO: 237345 - DNA, 25 bp, Homo sapien
atctaagaatacttgggcgggagga

SEQ ID NO: 237346 - DNA, 25 bp, Homo sapien
gaggagtccccaaggttaccttgtg

SEQ ID NO: 237347 - DNA, 25 bp, Homo sapien
aaggttaccttgtgcatccctctgt

SEQ ID NO: 237348 - DNA, 25 bp, Homo sapien
ctctgtccccagaaagaactgtacc

SEQ ID NO: 237349 - DNA, 25 bp, Homo sapien
gaaagaactgtaccccaacaatctc

SEQ ID NO: 237350 - DNA, 25 bp, Homo sapien
gcaaccgactgacgcgggccactga

SEQ ID NO: 237351 - DNA, 25 bp, Homo sapien
actgacaagacttcactgatgccat

SEQ ID NO: 237352 - DNA, 25 bp, Homo sapien
gacaagacttcactgatgccatcaa

SEQ ID NO: 237353 - DNA, 25 bp, Homo sapien
caagacttcactgatgccatcaagg

SEQ ID NO: 237354 - DNA, 25 bp, Homo sapien
tgatgccatcaaggacaccaccaag

SEQ ID NO: 237355 - DNA, 25 bp, Homo sapien
atgccatcaaggacaccaccaagtt

SEQ ID NO: 237356 - DNA, 25 bp, Homo sapien
gacaccaccaagttccctgctttgg

SEQ ID NO: 237357 - DNA, 25 bp, Homo sapien
aagttccctgctttggcttgggtgg

SEQ ID NO: 237358 - DNA, 25 bp, Homo sapien
ccctgctttggcttgggtggacctg

SEQ ID NO: 237359 - DNA, 25 bp, Homo sapien
tccccaccatctacgagggcctgga

SEQ ID NO: 237360 - DNA, 25 bp, Homo sapien
tgctcaacggcaaccgactgacgcg

SEQ ID NO: 237361 - DNA, 25 bp, Homo sapien
atagttttcaaactctcctgcagag

SEQ ID NO: 237362 - DNA, 25 bp, Homo sapien
gttttcaaactctcctgcagagaat

SEQ ID NO: 237363 - DNA, 25 bp, Homo sapien
cctgcagagaatttgttttctagat

SEQ ID NO: 237364 - DNA, 25 bp, Homo sapien
tcacatttttatgctgccacatata

SEQ ID NO: 237365 - DNA, 25 bp, Homo sapien
gctgccacatatatagcaaccagaa

SEQ ID NO: 237366 - DNA, 25 bp, Homo sapien
gcaaccagaatgttttttataatcc

SEQ ID NO: 237367 - DNA, 25 bp, Homo sapien
ttttttataatcctccagtagagga

SEQ ID NO: 237368 - DNA, 25 bp, Homo sapien
gaggatttttctaatcattgacaga

SEQ ID NO: 237369 - DNA, 25 bp, Homo sapien
cagaaacaaggtttattcatttcat

SEQ ID NO: 237370 - DNA, 25 bp, Homo sapien
gtaagttgtcagtacatttctcaat

SEQ ID NO: 237371 - DNA, 25 bp, Homo sapien
gttgtcagtacatttctcaattaga

SEQ ID NO: 237372 - DNA, 25 bp, Homo sapien
atggcgagtcaaccgagaggctctc

SEQ ID NO: 237373 - DNA, 25 bp, Homo sapien
gaggctctcagaggagtagctattt

SEQ ID NO: 237374 - DNA, 25 bp, Homo sapien
gctatttgtgaactcgctttgattt

SEQ ID NO: 237375 - DNA, 25 bp, Homo sapien
ttactatctcgaatggtcgccactg

SEQ ID NO: 237376 - DNA, 25 bp, Homo sapien
atctaaggcctttgcgatctgactg

SEQ ID NO: 237377 - DNA, 25 bp, Homo sapien
tttgcgatctgactgagcttctcac

SEQ ID NO: 237378 - DNA, 25 bp, Homo sapien
tctcacccgcttcaaatcgtcgtaa

SEQ ID NO: 237379 - DNA, 25 bp, Homo sapien
aatcgtcgtaacacttccaatttga

SEQ ID NO: 237380 - DNA, 25 bp, Homo sapien
gaggtcaagggtaatcgctttccgt

SEQ ID NO: 237381 - DNA, 25 bp, Homo sapien
atggcggcgctcaaggtcgcatttg

SEQ ID NO: 237382 - DNA, 25 bp, Homo sapien
aaggtcgcatttggctggctctggt

SEQ ID NO: 237383 - DNA, 25 bp, Homo sapien
aaaccgagtgaacctcccgatgcat

SEQ ID NO: 237384 - DNA, 25 bp, Homo sapien
gaacctcccgatgcatggactctgg

SEQ ID NO: 237385 - DNA, 25 bp, Homo sapien
atggactctggctgtcgtcgacgca

SEQ ID NO: 237386 - DNA, 25 bp, Homo sapien
tgtcgtcgacgcagactctcgtgca

SEQ ID NO: 237387 - DNA, 25 bp, Homo sapien
tcgtgcactgcttaaccccgttttg

SEQ ID NO: 237388 - DNA, 25 bp, Homo sapien
tttgctgccatgtgacggctgcaga

SEQ ID NO: 237389 - DNA, 25 bp, Homo sapien
agacactgtcctcaaactgcagtcc

SEQ ID NO: 237390 - DNA, 25 bp, Homo sapien
gtattttggtctgacctacccgaag

SEQ ID NO: 237391 - DNA, 25 bp, Homo sapien
tctgacctacccgaaggtgtccttt

SEQ ID NO: 237392 - DNA, 25 bp, Homo sapien
atgccgagcccgttgttccttcgca

SEQ ID NO: 237393 - DNA, 25 bp, Homo sapien
gttgttccttcgcaaaccgagtgaa

SEQ ID NO: 237394 - DNA, 25 bp, Homo sapien
cccaggagcaaaattcgaggaactt

SEQ ID NO: 237395 - DNA, 25 bp, Homo sapien
gaggaactttctacaaaacacttga

SEQ ID NO: 237396 - DNA, 25 bp, Homo sapien
ttctacaaaacacttgaccctactc

SEQ ID NO: 237397 - DNA, 25 bp, Homo sapien
ttgaccctactcaaaattgccaagg

SEQ ID NO: 237398 - DNA, 25 bp, Homo sapien
aaattgccaaggtctcgaaaacaag

SEQ ID NO: 237399 - DNA, 25 bp, Homo sapien
caaggaaagagatgccgtcacggac

SEQ ID NO: 237400 - DNA, 25 bp, Homo sapien
gccgtcacggacgagaggagactaa

SEQ ID NO: 237401 - DNA, 25 bp, Homo sapien
gcagatacgatgactgaatgccatg

SEQ ID NO: 237402 - DNA, 25 bp, Homo sapien
aacataccaatgttggttccttagt

SEQ ID NO: 237403 - DNA, 25 bp, Homo sapien
gggaaatgtccagtactacagtaat

SEQ ID NO: 237404 - DNA, 25 bp, Homo sapien
tcaagcaccataaccccaggagcaa

SEQ ID NO: 237405 - DNA, 25 bp, Homo sapien
gaaaaattgggctcagggcagtaat

SEQ ID NO: 237406 - DNA, 25 bp, Homo sapien
gggctggcatttattcttaagagtt

SEQ ID NO: 237407 - DNA, 25 bp, Homo sapien
ttttctccctcaaaaggtgaaggag

SEQ ID NO: 237408 - DNA, 25 bp, Homo sapien
ggtgaaggagtgacattgcgtattc

SEQ ID NO: 237409 - DNA, 25 bp, Homo sapien
gaaggagtgacattgcgtattcact

SEQ ID NO: 237410 - DNA, 25 bp, Homo sapien
aacagggactaacaacttttcactg

SEQ ID NO: 237411 - DNA, 25 bp, Homo sapien
cagggactaacaacttttcactgaa

SEQ ID NO: 237412 - DNA, 25 bp, Homo sapien
ccagcaagctctctaaaattagttt

SEQ ID NO: 237413 - DNA, 25 bp, Homo sapien
gcaagctctctaaaattagttttct

SEQ ID NO: 237414 - DNA, 25 bp, Homo sapien
attcattgtacttcatttcacagca

SEQ ID NO: 237415 - DNA, 25 bp, Homo sapien
gtacttcatttcacagcattaaaca

SEQ ID NO: 237416 - DNA, 25 bp, Homo sapien
ttgcacattcactattgttaagtat

SEQ ID NO: 237417 - DNA, 25 bp, Homo sapien
aatgaggagctgctgtgacattcaa

SEQ ID NO: 237418 - DNA, 25 bp, Homo sapien
tgtgacattcaaggcctgggagagt

SEQ ID NO: 237419 - DNA, 25 bp, Homo sapien
gcctgggagagtgagcattagatta

SEQ ID NO: 237420 - DNA, 25 bp, Homo sapien
tgaaatcaaagcctggtccttgcac

SEQ ID NO: 237421 - DNA, 25 bp, Homo sapien
gtccttgcaccccttagatgtatga

SEQ ID NO: 237422 - DNA, 25 bp, Homo sapien
ccttagatgtatgaccctgggcaac

SEQ ID NO: 237423 - DNA, 25 bp, Homo sapien
tctcatagtgtcatgtgatttaatg

SEQ ID NO: 237424 - DNA, 25 bp, Homo sapien
agagtgtttagcaccatgcctggta

SEQ ID NO: 237425 - DNA, 25 bp, Homo sapien
atgcctggtacactctaagcactca

SEQ ID NO: 237426 - DNA, 25 bp, Homo sapien
ggtacactctaagcactcaataagt

SEQ ID NO: 237427 - DNA, 25 bp, Homo sapien
cgtgggacttcttctgcctggctcc

SEQ ID NO: 237428 - DNA, 25 bp, Homo sapien
tgccccggaagtactcacagcggac

SEQ ID NO: 237429 - DNA, 25 bp, Homo sapien
cccggaagtactcacagcggacggt

SEQ ID NO: 237430 - DNA, 25 bp, Homo sapien
ttttgtccgacatcttgacgaggct

SEQ ID NO: 237431 - DNA, 25 bp, Homo sapien
acgaggctgcggtgtctgctgctat

SEQ ID NO: 237432 - DNA, 25 bp, Homo sapien
gccgcctaaggacgacaagaagaag

SEQ ID NO: 237433 - DNA, 25 bp, Homo sapien
gacgctggaaagtcggccaagaaag

SEQ ID NO: 237434 - DNA, 25 bp, Homo sapien
gaagaagtggtccaaaggcaaagtt

SEQ ID NO: 237435 - DNA, 25 bp, Homo sapien
ggcaaagttcgggacaagctcaata

SEQ ID NO: 237436 - DNA, 25 bp, Homo sapien
gttcgggacaagctcaataacttag

SEQ ID NO: 237437 - DNA, 25 bp, Homo sapien
aagctcaataacttagtcttgtttg

SEQ ID NO: 237438 - DNA, 25 bp, Homo sapien
ttgtgttttatgttagtgtttctta

SEQ ID NO: 237439 - DNA, 25 bp, Homo sapien
gtgtttcttatgtctgtttttgtta

SEQ ID NO: 237440 - DNA, 25 bp, Homo sapien
ctgtttttgttatctgagtggtttt

SEQ ID NO: 237441 - DNA, 25 bp, Homo sapien
ttaggtcaaaagataacttcatttt

SEQ ID NO: 237442 - DNA, 25 bp, Homo sapien
tggttttatcttttaataggctaat

SEQ ID NO: 237443 - DNA, 25 bp, Homo sapien
ttagacataatttggaagccctatt

SEQ ID NO: 237444 - DNA, 25 bp, Homo sapien
gaagccctattttatttgtagttat

SEQ ID NO: 237445 - DNA, 25 bp, Homo sapien
ttttgtgtttatagctatagctggg

SEQ ID NO: 237446 - DNA, 25 bp, Homo sapien
agctatagctgggttgcaagctttc

SEQ ID NO: 237447 - DNA, 25 bp, Homo sapien
atttgcttgctatatcttcatttta

SEQ ID NO: 237448 - DNA, 25 bp, Homo sapien
atatcttcattttaattctttgtgt

SEQ ID NO: 237449 - DNA, 25 bp, Homo sapien
gttgagcgctcacgcgaacgcctaa

SEQ ID NO: 237450 - DNA, 25 bp, Homo sapien
gaacgcctaagtgaccagaacgact

SEQ ID NO: 237451 - DNA, 25 bp, Homo sapien
tggtgtgaagccgtgatctgactct

SEQ ID NO: 237452 - DNA, 25 bp, Homo sapien
gggactggtttcagcgagagcctct

SEQ ID NO: 237453 - DNA, 25 bp, Homo sapien
gagagcctctgtactgctctgtagt

SEQ ID NO: 237454 - DNA, 25 bp, Homo sapien
tactgctctgtagtctctgctagga

SEQ ID NO: 237455 - DNA, 25 bp, Homo sapien
tagtctctgctaggacatggacgaa

SEQ ID NO: 237456 - DNA, 25 bp, Homo sapien
acatggacgaaaagggacgcagccg

SEQ ID NO: 237457 - DNA, 25 bp, Homo sapien
gctccgcagcagaacacgaagtttg

SEQ ID NO: 237458 - DNA, 25 bp, Homo sapien
acacgaagtttgcattccccaaggg

SEQ ID NO: 237459 - DNA, 25 bp, Homo sapien
cagggaaaggtagtcctctgcattt

SEQ ID NO: 237460 - DNA, 25 bp, Homo sapien
gccgcctaaggacgacaagaagaag

SEQ ID NO: 237461 - DNA, 25 bp, Homo sapien
caagaagaagaaggacgctggaaag

SEQ ID NO: 237462 - DNA, 25 bp, Homo sapien
gacgctggaaagtcggccaagaaag

SEQ ID NO: 237463 - DNA, 25 bp, Homo sapien
acgctggaaagtcggccaagaaaga

SEQ ID NO: 237464 - DNA, 25 bp, Homo sapien
caaaggcaaagttcgggacaagctc

SEQ ID NO: 237465 - DNA, 25 bp, Homo sapien
ggcaaagttcgggacaagctcaata

SEQ ID NO: 237466 - DNA, 25 bp, Homo sapien
gcaaagttcgggacaagctcaataa

SEQ ID NO: 237467 - DNA, 25 bp, Homo sapien
aaagttcgggacaagctcaataact

SEQ ID NO: 237468 - DNA, 25 bp, Homo sapien
gttcgggacaagctcaataacttag

SEQ ID NO: 237469 - DNA, 25 bp, Homo sapien
gggacaagctcaataacttagtctt

SEQ ID NO: 237470 - DNA, 25 bp, Homo sapien
aagctcaataacttagtcttgtttg

SEQ ID NO: 237471 - DNA, 25 bp, Homo sapien
tttggaagcacctttattaacacat

SEQ ID NO: 237472 - DNA, 25 bp, Homo sapien
tggaagcacctttattaacacatat

SEQ ID NO: 237473 - DNA, 25 bp, Homo sapien
tattaacacatatatctcgcagaaa

SEQ ID NO: 237474 - DNA, 25 bp, Homo sapien
acacatatatctcgcagaaactaga

SEQ ID NO: 237475 - DNA, 25 bp, Homo sapien
gttaactttttgcaactattcactc

SEQ ID NO: 237476 - DNA, 25 bp, Homo sapien
aactttttgcaactattcactcatt

SEQ ID NO: 237477 - DNA, 25 bp, Homo sapien
ttttgcaactattcactcattttta

SEQ ID NO: 237478 - DNA, 25 bp, Homo sapien
gcaactattcactcatttttaccac

SEQ ID NO: 237479 - DNA, 25 bp, Homo sapien
aactattcactcatttttaccactt

SEQ ID NO: 237480 - DNA, 25 bp, Homo sapien
ctattcactcatttttaccactttt

SEQ ID NO: 237481 - DNA, 25 bp, Homo sapien
gaatatggtatagaaggtatgcaag

SEQ ID NO: 237482 - DNA, 25 bp, Homo sapien
gatggcggaaagcagcccgacctca

SEQ ID NO: 237483 - DNA, 25 bp, Homo sapien
catcttccgcttcatgtgcagagaa

SEQ ID NO: 237484 - DNA, 25 bp, Homo sapien
ttcatgtgcagagaaggagctcagt

SEQ ID NO: 237485 - DNA, 25 bp, Homo sapien
ggaaagcatcagctggcctgagcca

SEQ ID NO: 237486 - DNA, 25 bp, Homo sapien
tgagccactgcttgtttatgatgga

SEQ ID NO: 237487 - DNA, 25 bp, Homo sapien
gagccactgcttgtttatgatggag

SEQ ID NO: 237488 - DNA, 25 bp, Homo sapien
gccactgcttgtttatgatggagga

SEQ ID NO: 237489 - DNA, 25 bp, Homo sapien
cactgcttgtttatgatggaggatg

SEQ ID NO: 237490 - DNA, 25 bp, Homo sapien
ctgcttgtttatgatggaggatgaa

SEQ ID NO: 237491 - DNA, 25 bp, Homo sapien
tgatggaggatgaaatccacacctc

SEQ ID NO: 237492 - DNA, 25 bp, Homo sapien
ggatgaaatccacacctcctcaaaa

SEQ ID NO: 237493 - DNA, 25 bp, Homo sapien
gcctaaatatcaaattcctttccct

SEQ ID NO: 237494 - DNA, 25 bp, Homo sapien
gggagcaacttgctctttcatatga

SEQ ID NO: 237495 - DNA, 25 bp, Homo sapien
gagcaacttgctctttcatatgagt

SEQ ID NO: 237496 - DNA, 25 bp, Homo sapien
cttgctctttcatatgagttggtca

SEQ ID NO: 237497 - DNA, 25 bp, Homo sapien
tgagttggtcatagcatgtaagaac

SEQ ID NO: 237498 - DNA, 25 bp, Homo sapien
gtcatagcatgtaagaaccaatctt

SEQ ID NO: 237499 - DNA, 25 bp, Homo sapien
agcatgtaagaaccaatcttgaaat

SEQ ID NO: 237500 - DNA, 25 bp, Homo sapien
tatttctagaaatactttgtactta

SEQ ID NO: 237501 - DNA, 25 bp, Homo sapien
aacagtttgtatctttttgtccata

SEQ ID NO: 237502 - DNA, 25 bp, Homo sapien
agtttgtatctttttgtccatataa

SEQ ID NO: 237503 - DNA, 25 bp, Homo sapien
tttttgtccatataaagatacttta

SEQ ID NO: 237504 - DNA, 25 bp, Homo sapien
ttatttgtaatagcagttatcagtt

SEQ ID NO: 237505 - DNA, 25 bp, Homo sapien
gcagttatcagttatgcttatatag

SEQ ID NO: 237506 - DNA, 25 bp, Homo sapien
aaattctcctcctttgactacacac

SEQ ID NO: 237507 - DNA, 25 bp, Homo sapien
accacagtgtggttctaatcatgga

SEQ ID NO: 237508 - DNA, 25 bp, Homo sapien
catggagatatcagtaatttttagt

SEQ ID NO: 237509 - DNA, 25 bp, Homo sapien
agtaactgaattttgaggacatttc

SEQ ID NO: 237510 - DNA, 25 bp, Homo sapien
aggacatttctctgtttagcatgta

SEQ ID NO: 237511 - DNA, 25 bp, Homo sapien
atttctctgtttagcatgtatgcaa

SEQ ID NO: 237512 - DNA, 25 bp, Homo sapien
ttagcatgtatgcaaactgatatgt

SEQ ID NO: 237513 - DNA, 25 bp, Homo sapien
actgatatgtaatctgaggttccaa

SEQ ID NO: 237514 - DNA, 25 bp, Homo sapien
tatgtaatctgaggttccaaagtca

SEQ ID NO: 237515 - DNA, 25 bp, Homo sapien
acaatagtactgtgcctctttcttc

SEQ ID NO: 237516 - DNA, 25 bp, Homo sapien
atagtactgtgcctctttcttctca

SEQ ID NO: 237517 - DNA, 25 bp, Homo sapien
cctctttcttctcaaacaatggatg

SEQ ID NO: 237518 - DNA, 25 bp, Homo sapien
aatggtgacaggtagctgggaccta

SEQ ID NO: 237519 - DNA, 25 bp, Homo sapien
ggctatcttaccatgaaggttgttt

SEQ ID NO: 237520 - DNA, 25 bp, Homo sapien
gaaggttgttttgcttattgtatat

SEQ ID NO: 237521 - DNA, 25 bp, Homo sapien
gaggactgtaactactatttaggtt

SEQ ID NO: 237522 - DNA, 25 bp, Homo sapien
actactatttaggttgtacagattg

SEQ ID NO: 237523 - DNA, 25 bp, Homo sapien
ggtgtggacttttatatatagatct

SEQ ID NO: 237524 - DNA, 25 bp, Homo sapien
agatctacataaaaactgctacatg

SEQ ID NO: 237525 - DNA, 25 bp, Homo sapien
aactgctacatgacaaaaaccacac

SEQ ID NO: 237526 - DNA, 25 bp, Homo sapien
cttcgaaggcggtggctgacaccag

SEQ ID NO: 237527 - DNA, 25 bp, Homo sapien
caccaggacgtgtcagagcctaaga

SEQ ID NO: 237528 - DNA, 25 bp, Homo sapien
gctctgggcctgagcagctatttca

SEQ ID NO: 237529 - DNA, 25 bp, Homo sapien
tgggcctgagcagctatttcagctt

SEQ ID NO: 237530 - DNA, 25 bp, Homo sapien
ctgagcagctatttcagcttcctgt

SEQ ID NO: 237531 - DNA, 25 bp, Homo sapien
ctgtttggtgtggttggcacctgtt

SEQ ID NO: 237532 - DNA, 25 bp, Homo sapien
ggtgtggttggcacctgtttcccag

SEQ ID NO: 237533 - DNA, 25 bp, Homo sapien
aacaatgtctcaagagggactgtaa

SEQ ID NO: 237534 - DNA, 25 bp, Homo sapien
gagggactgtaagtaatggttgtca

SEQ ID NO: 237535 - DNA, 25 bp, Homo sapien
aatggttgtcacttgtcggtggcct

SEQ ID NO: 237536 - DNA, 25 bp, Homo sapien
gttgtcacttgtcggtggcctaagt

SEQ ID NO: 237537 - DNA, 25 bp, Homo sapien
tccaacctcatcttcacaaagtgct

SEQ ID NO: 237538 - DNA, 25 bp, Homo sapien
ccaacctcatcttcacaaagtgctg

SEQ ID NO: 237539 - DNA, 25 bp, Homo sapien
agccattggggctgaattttcattt

SEQ ID NO: 237540 - DNA, 25 bp, Homo sapien
catttttgtatccacagaactaaca

SEQ ID NO: 237541 - DNA, 25 bp, Homo sapien
gtatccacagaactaacacataaag

SEQ ID NO: 237542 - DNA, 25 bp, Homo sapien
gaatgtaagctctctgtaagctaca

SEQ ID NO: 237543 - DNA, 25 bp, Homo sapien
atgtaagctctctgtaagctacaga

SEQ ID NO: 237544 - DNA, 25 bp, Homo sapien
ctgtaagctacagatcttttctact

SEQ ID NO: 237545 - DNA, 25 bp, Homo sapien
gtaagctacagatcttttctactgt

SEQ ID NO: 237546 - DNA, 25 bp, Homo sapien
gctacagatcttttctactgtaata

SEQ ID NO: 237547 - DNA, 25 bp, Homo sapien
cctagggcagtgactagcatatagt

SEQ ID NO: 237548 - DNA, 25 bp, Homo sapien
gtctctaactttcatcataatctca

SEQ ID NO: 237549 - DNA, 25 bp, Homo sapien
atctcaaagagcttcatgatctgga

SEQ ID NO: 237550 - DNA, 25 bp, Homo sapien
aagtttagacacaaatgggtaggca

SEQ ID NO: 237551 - DNA, 25 bp, Homo sapien
aaagtatttcttaattgctggtgca

SEQ ID NO: 237552 - DNA, 25 bp, Homo sapien
taattgctggtgcaagaccttaccc

SEQ ID NO: 237553 - DNA, 25 bp, Homo sapien
tacccttgtcttaataattatcctg

SEQ ID NO: 237554 - DNA, 25 bp, Homo sapien
tatcctgtctaagtaatacaccttt

SEQ ID NO: 237555 - DNA, 25 bp, Homo sapien
ggaagatgatcgtccttggtagata

SEQ ID NO: 237556 - DNA, 25 bp, Homo sapien
gatcgtccttggtagatactgaaat

SEQ ID NO: 237557 - DNA, 25 bp, Homo sapien
atctgaggtaaagtggcccataaac

SEQ ID NO: 237558 - DNA, 25 bp, Homo sapien
agtggcccataaactgttttgaaat

SEQ ID NO: 237559 - DNA, 25 bp, Homo sapien
ggtaaacctaatattcacagtgtgt

SEQ ID NO: 237560 - DNA, 25 bp, Homo sapien
tcacagtgtgttccctcacttgtaa

SEQ ID NO: 237561 - DNA, 25 bp, Homo sapien
gttccctcacttgtaatctctgaat

SEQ ID NO: 237562 - DNA, 25 bp, Homo sapien
tactagcttttctaaagggaatcat

SEQ ID NO: 237563 - DNA, 25 bp, Homo sapien
aagtagtgccactgacaagatgcta

SEQ ID NO: 237564 - DNA, 25 bp, Homo sapien
cagtgaagattatccattcttagga

SEQ ID NO: 237565 - DNA, 25 bp, Homo sapien
ttctgcacaaaggtagtgttgcact

SEQ ID NO: 237566 - DNA, 25 bp, Homo sapien
gttgcactgggacacaagcctttta

SEQ ID NO: 237567 - DNA, 25 bp, Homo sapien
gggacacaagccttttaacagataa

SEQ ID NO: 237568 - DNA, 25 bp, Homo sapien
gccttttaacagataaccagttgaa

SEQ ID NO: 237569 - DNA, 25 bp, Homo sapien
tgcctccacaccgagttctgttgtg

SEQ ID NO: 237570 - DNA, 25 bp, Homo sapien
gcaatttttactgtagataaggcta

SEQ ID NO: 237571 - DNA, 25 bp, Homo sapien
ttttactgtagataaggctataccg

SEQ ID NO: 237572 - DNA, 25 bp, Homo sapien
aattctgggcacagcatgtgtaaat

SEQ ID NO: 237573 - DNA, 25 bp, Homo sapien
ggcacagcatgtgtaaatttctaaa

SEQ ID NO: 237574 - DNA, 25 bp, Homo sapien
aatttctaaatatgatggacacccc

SEQ ID NO: 237575 - DNA, 25 bp, Homo sapien
cacctcaaggaggttggtcccattg

SEQ ID NO: 237576 - DNA, 25 bp, Homo sapien
ctcaaggaggttggtcccattgaca

SEQ ID NO: 237577 - DNA, 25 bp, Homo sapien
caaggaggttggtcccattgacatt

SEQ ID NO: 237578 - DNA, 25 bp, Homo sapien
ggaggttggtcccattgacatttcc

SEQ ID NO: 237579 - DNA, 25 bp, Homo sapien
gaggttggtcccattgacatttccc

SEQ ID NO: 237580 - DNA, 25 bp, Homo sapien
ggttggtcccattgacatttcccca

SEQ ID NO: 237581 - DNA, 25 bp, Homo sapien
atgccaaagggaggctgcagctgcc

SEQ ID NO: 237582 - DNA, 25 bp, Homo sapien
gaggctgaacaagctctcggagagc

SEQ ID NO: 237583 - DNA, 25 bp, Homo sapien
agcttcgggcccacatggcagacat

SEQ ID NO: 237584 - DNA, 25 bp, Homo sapien
catggcagacatggaggcgaagtat

SEQ ID NO: 237585 - DNA, 25 bp, Homo sapien
ggaaatcttacacgacagtctggac

SEQ ID NO: 237586 - DNA, 25 bp, Homo sapien
acgacagtctggacaggctcttggc

SEQ ID NO: 237587 - DNA, 25 bp, Homo sapien
aggctcttggccaagctgagagcca

SEQ ID NO: 237588 - DNA, 25 bp, Homo sapien
accccagagatgagtcgccagtgcc

SEQ ID NO: 237589 - DNA, 25 bp, Homo sapien
agatgagtcgccagtgccatgccct

SEQ ID NO: 237590 - DNA, 25 bp, Homo sapien
atgccctgcaggaggatatgcaaac

SEQ ID NO: 237591 - DNA, 25 bp, Homo sapien
tatgcaaacccgcagcaagcagctg

SEQ ID NO: 237592 - DNA, 25 bp, Homo sapien
atgctgcagcgtaggtgactttgga

SEQ ID NO: 237593 - DNA, 25 bp, Homo sapien
agtgttgcgggtgtgcctgtccctc

SEQ ID NO: 237594 - DNA, 25 bp, Homo sapien
tgtccctccagatagtgctctgttt

SEQ ID NO: 237595 - DNA, 25 bp, Homo sapien
gtgctttctgctgtgtgcatttata

SEQ ID NO: 237596 - DNA, 25 bp, Homo sapien
gtgtattttatatagacctgcttgc

SEQ ID NO: 237597 - DNA, 25 bp, Homo sapien
agacctgcttgcattggctgatgct

SEQ ID NO: 237598 - DNA, 25 bp, Homo sapien
ttgcattggctgatgctcctctaat

SEQ ID NO: 237599 - DNA, 25 bp, Homo sapien
gctcctctaattccctgagtttgat

SEQ ID NO: 237600 - DNA, 25 bp, Homo sapien
tgagtttgattcaaccacccttggg

SEQ ID NO: 237601 - DNA, 25 bp, Homo sapien
cacccttgggttgttttgctatggc

SEQ ID NO: 237602 - DNA, 25 bp, Homo sapien
ttgctatggccttagcctttgaaaa

SEQ ID NO: 237603 - DNA, 25 bp, Homo sapien
ggtcatttgaaagcattatgcctag

SEQ ID NO: 237604 - DNA, 25 bp, Homo sapien
tatgcctagcataagtccctgtgag

SEQ ID NO: 237605 - DNA, 25 bp, Homo sapien
gtccctgtgagatttatacatagca

SEQ ID NO: 237606 - DNA, 25 bp, Homo sapien
ggactgaggcaagccactaatttta

SEQ ID NO: 237607 - DNA, 25 bp, Homo sapien
ggcaagccactaattttaagcagat

SEQ ID NO: 237608 - DNA, 25 bp, Homo sapien
agcagatgattccttaaacactttg

SEQ ID NO: 237609 - DNA, 25 bp, Homo sapien
gaaacagcatgataatcttagtgta

SEQ ID NO: 237610 - DNA, 25 bp, Homo sapien
tagtgtaaacattgggctttgaaac

SEQ ID NO: 237611 - DNA, 25 bp, Homo sapien
aagttctaaaactgatggtctcatt

SEQ ID NO: 237612 - DNA, 25 bp, Homo sapien
agacttggttaacaatcgtgcccct

SEQ ID NO: 237613 - DNA, 25 bp, Homo sapien
cccaccctggtcatttgaaagcatt

SEQ ID NO: 237614 - DNA, 25 bp, Homo sapien
ctctaaggattttaagtacagccaa

SEQ ID NO: 237615 - DNA, 25 bp, Homo sapien
gtacagccaaatgatatgtcacaag

SEQ ID NO: 237616 - DNA, 25 bp, Homo sapien
gatatgtcacaagttttttcctaaa

SEQ ID NO: 237617 - DNA, 25 bp, Homo sapien
atatccaaccatttagtctttcata

SEQ ID NO: 237618 - DNA, 25 bp, Homo sapien
aagcttttaattccactagcctcac

SEQ ID NO: 237619 - DNA, 25 bp, Homo sapien
cactagcctcactttctgagattgt

SEQ ID NO: 237620 - DNA, 25 bp, Homo sapien
agaatgaatctctacagcattgtta

SEQ ID NO: 237621 - DNA, 25 bp, Homo sapien
cactttctgagattgttgatgtttt

SEQ ID NO: 237622 - DNA, 25 bp, Homo sapien
tgttttcttgttctaacctgaaatt

SEQ ID NO: 237623 - DNA, 25 bp, Homo sapien
gcattgttaagtttctacccagtct

SEQ ID NO: 237624 - DNA, 25 bp, Homo sapien
tacccagtcttttgggtgactgaaa

SEQ ID NO: 237625 - DNA, 25 bp, Homo sapien
atgtgtgtgtaatggtgtgtttctg

SEQ ID NO: 237626 - DNA, 25 bp, Homo sapien
tttctgtggccggaagggcgtatct

SEQ ID NO: 237627 - DNA, 25 bp, Homo sapien
aagggcgtatctgcgattgcgtgtc

SEQ ID NO: 237628 - DNA, 25 bp, Homo sapien
ggcgtatctgcgattgcgtgtctgt

SEQ ID NO: 237629 - DNA, 25 bp, Homo sapien
gcgtatctgcgattgcgtgtctgtg

SEQ ID NO: 237630 - DNA, 25 bp, Homo sapien
atctgcgattgcgtgtctgtgtatg

SEQ ID NO: 237631 - DNA, 25 bp, Homo sapien
gtatgtaatggtgtgtctctgtggc

SEQ ID NO: 237632 - DNA, 25 bp, Homo sapien
tatgtaatggtgtgtctctgtggcg

SEQ ID NO: 237633 - DNA, 25 bp, Homo sapien
tgtatgtaatggtgtctctgtggcg

SEQ ID NO: 237634 - DNA, 25 bp, Homo sapien
tatgtaatggtgtctctgtggcggg

SEQ ID NO: 237635 - DNA, 25 bp, Homo sapien
gggctgcgtgtgattgtgtgtctgt

SEQ ID NO: 237636 - DNA, 25 bp, Homo sapien
gagccttaggctatctagacagaaa

SEQ ID NO: 237637 - DNA, 25 bp, Homo sapien
gagaatcatgaacatcacccagagt

SEQ ID NO: 237638 - DNA, 25 bp, Homo sapien
catcacccagagtaagacagccact

SEQ ID NO: 237639 - DNA, 25 bp, Homo sapien
gacagccactcagcgactatactag

SEQ ID NO: 237640 - DNA, 25 bp, Homo sapien
ttgaatgtgacagggccgggctcac

SEQ ID NO: 237641 - DNA, 25 bp, Homo sapien
gggctcacatactggccgtgggacc

SEQ ID NO: 237642 - DNA, 25 bp, Homo sapien
ggacctcgggcaaggtacacagcct

SEQ ID NO: 237643 - DNA, 25 bp, Homo sapien
cattttcctcacctgtgtaatgggc

SEQ ID NO: 237644 - DNA, 25 bp, Homo sapien
gtaatgggctattacttaccttctc

SEQ ID NO: 237645 - DNA, 25 bp, Homo sapien
gcgagattatgaacctctgtgtgtt

SEQ ID NO: 237646 - DNA, 25 bp, Homo sapien
gtgtgttctcgtctgagccttaggc

SEQ ID NO: 237647 - DNA, 25 bp, Homo sapien
aatgtatgaatgttcactcccacaa

SEQ ID NO: 237648 - DNA, 25 bp, Homo sapien
gttcactcccacaaatagtattaac

SEQ ID NO: 237649 - DNA, 25 bp, Homo sapien
tattaacctgtttcccttatactgt

SEQ ID NO: 237650 - DNA, 25 bp, Homo sapien
gtttcccttatactgttcatcatca

SEQ ID NO: 237651 - DNA, 25 bp, Homo sapien
tactgttcatcatcagtctcggcaa

SEQ ID NO: 237652 - DNA, 25 bp, Homo sapien
atcagtctcggcaacctgagataaa

SEQ ID NO: 237653 - DNA, 25 bp, Homo sapien
aatgatactttatgcttagtttagt

SEQ ID NO: 237654 - DNA, 25 bp, Homo sapien
attagtgatgttgaccttctttttg

SEQ ID NO: 237655 - DNA, 25 bp, Homo sapien
gatgttgaccttctttttgtaagtt

SEQ ID NO: 237656 - DNA, 25 bp, Homo sapien
cttctgtggattatctgtttatatc

SEQ ID NO: 237657 - DNA, 25 bp, Homo sapien
ttcctttaggtcttatcattcgtta

SEQ ID NO: 237658 - DNA, 25 bp, Homo sapien
catccgggtgagagccccaccatgc

SEQ ID NO: 237659 - DNA, 25 bp, Homo sapien
cattgccctctccacctatttattc

SEQ ID NO: 237660 - DNA, 25 bp, Homo sapien
tgctcaagggagaggtgtccaagcc

SEQ ID NO: 237661 - DNA, 25 bp, Homo sapien
gctcccaacaaacctacatctgttg

SEQ ID NO: 237662 - DNA, 25 bp, Homo sapien
caaacctacatctgttgctgtcttc

SEQ ID NO: 237663 - DNA, 25 bp, Homo sapien
caattatttgctttcctgctaacca

SEQ ID NO: 237664 - DNA, 25 bp, Homo sapien
ttatttgctttcctgctaaccattc

SEQ ID NO: 237665 - DNA, 25 bp, Homo sapien
taaccattccctttattgccagctt

SEQ ID NO: 237666 - DNA, 25 bp, Homo sapien
cattccctttattgccagctttgtt

SEQ ID NO: 237667 - DNA, 25 bp, Homo sapien
ttattgccagctttgtttccctttt

SEQ ID NO: 237668 - DNA, 25 bp, Homo sapien
agaggtgtccaagccctgagcgagc

SEQ ID NO: 237669 - DNA, 25 bp, Homo sapien
agctttgacaaagagtgggtggcca

SEQ ID NO: 237670 - DNA, 25 bp, Homo sapien
acaaagagtgggtggccaagcagac

SEQ ID NO: 237671 - DNA, 25 bp, Homo sapien
atccagggcttagcctccaagtggg

SEQ ID NO: 237672 - DNA, 25 bp, Homo sapien
agggcttagcctccaagtgggacta

SEQ ID NO: 237673 - DNA, 25 bp, Homo sapien
gcttagcctccaagtgggactacga

SEQ ID NO: 237674 - DNA, 25 bp, Homo sapien
tagcctccaagtgggactacgaaaa

SEQ ID NO: 237675 - DNA, 25 bp, Homo sapien
agtgggactacgaaaagaacgagtg

SEQ ID NO: 237676 - DNA, 25 bp, Homo sapien
tgagagatgctggcctgcgcctgca

SEQ ID NO: 237677 - DNA, 25 bp, Homo sapien
tgttatgccaaacagttgtaccact

SEQ ID NO: 237678 - DNA, 25 bp, Homo sapien
gccaaacagttgtaccactgctaat

SEQ ID NO: 237679 - DNA, 25 bp, Homo sapien
gttgtaccactgctaataaatgacc

SEQ ID NO: 237680 - DNA, 25 bp, Homo sapien
ccttgtttgtgccagatccttcaaa

SEQ ID NO: 237681 - DNA, 25 bp, Homo sapien
aaagatgttccctgtcaggacacct

SEQ ID NO: 237682 - DNA, 25 bp, Homo sapien
atgttccctgtcaggacacctgtgg

SEQ ID NO: 237683 - DNA, 25 bp, Homo sapien
ggcattcacgttccttatatgcagt

SEQ ID NO: 237684 - DNA, 25 bp, Homo sapien
ttatatgcagtgttagccatctttg

SEQ ID NO: 237685 - DNA, 25 bp, Homo sapien
ttagccatctttggcctacgtggac

SEQ ID NO: 237686 - DNA, 25 bp, Homo sapien
catctttggcctacgtggacttttt

SEQ ID NO: 237687 - DNA, 25 bp, Homo sapien
tgtaaattacaccatttccagacat

SEQ ID NO: 237688 - DNA, 25 bp, Homo sapien
ttgagattgctaaggcacttggcct

SEQ ID NO: 237689 - DNA, 25 bp, Homo sapien
attgctaaggcacttggccttcctc

SEQ ID NO: 237690 - DNA, 25 bp, Homo sapien
ccttcctcctttgtgattttcagtg

SEQ ID NO: 237691 - DNA, 25 bp, Homo sapien
tatccagcaattccaaacgtattgg

SEQ ID NO: 237692 - DNA, 25 bp, Homo sapien
gaaatttctcacaaatgttaatgct

SEQ ID NO: 237693 - DNA, 25 bp, Homo sapien
tagacaatctacatagtaccaggtt

SEQ ID NO: 237694 - DNA, 25 bp, Homo sapien
gtaccaggttagtagctgactttat

SEQ ID NO: 237695 - DNA, 25 bp, Homo sapien
tggaattagtcctagactccccagc

SEQ ID NO: 237696 - DNA, 25 bp, Homo sapien
taaacacaatacaaactggctacct

SEQ ID NO: 237697 - DNA, 25 bp, Homo sapien
aactggctacctactaatgcaggga

SEQ ID NO: 237698 - DNA, 25 bp, Homo sapien
gactccccagcagtatttacgggca

SEQ ID NO: 237699 - DNA, 25 bp, Homo sapien
gtatttacgggcagtcatgtctata

SEQ ID NO: 237700 - DNA, 25 bp, Homo sapien
cgggcagtcatgtctatactttggg

SEQ ID NO: 237701 - DNA, 25 bp, Homo sapien
agattaactgctctgggtcttttat

SEQ ID NO: 237702 - DNA, 25 bp, Homo sapien
actgcagtcctgaggaatttccctg

SEQ ID NO: 237703 - DNA, 25 bp, Homo sapien
gaatttccctgcagtaagtccggtt

SEQ ID NO: 237704 - DNA, 25 bp, Homo sapien
aagtccggttacaggcaaacgtgca

SEQ ID NO: 237705 - DNA, 25 bp, Homo sapien
ctcccgactccatttgtttagggat

SEQ ID NO: 237706 - DNA, 25 bp, Homo sapien
agtagttccattttggtacctgcaa

SEQ ID NO: 237707 - DNA, 25 bp, Homo sapien
ttggtacctgcaactttcacagctg

SEQ ID NO: 237708 - DNA, 25 bp, Homo sapien
gaaatcaggcttagctcttcatgat

SEQ ID NO: 237709 - DNA, 25 bp, Homo sapien
tcttcatgattgagtacctgctgtt

SEQ ID NO: 237710 - DNA, 25 bp, Homo sapien
ctgctgttcactgctacagtataaa

SEQ ID NO: 237711 - DNA, 25 bp, Homo sapien
gtataaaaccatgccacaattcctg

SEQ ID NO: 237712 - DNA, 25 bp, Homo sapien
gccacaattcctgtacaatcttttt

SEQ ID NO: 237713 - DNA, 25 bp, Homo sapien
ctcattcacattcttctagtattat

SEQ ID NO: 237714 - DNA, 25 bp, Homo sapien
aaaccagaaaagtgcttctccttgt

SEQ ID NO: 237715 - DNA, 25 bp, Homo sapien
aagtgcttctccttgtcagtagcta

SEQ ID NO: 237716 - DNA, 25 bp, Homo sapien
ttgtcagtagctatctgcccaaaaa

SEQ ID NO: 237717 - DNA, 25 bp, Homo sapien
gacaattccagatctcatctgccat

SEQ ID NO: 237718 - DNA, 25 bp, Homo sapien
gatctcatctgccatctctaagaaa

SEQ ID NO: 237719 - DNA, 25 bp, Homo sapien
gccatctctaagaaagccacttgga

SEQ ID NO: 237720 - DNA, 25 bp, Homo sapien
taggtcccatgggtcctgatccagg

SEQ ID NO: 237721 - DNA, 25 bp, Homo sapien
gtcccatgggtcctgatccagggat

SEQ ID NO: 237722 - DNA, 25 bp, Homo sapien
gaaggtgagcaatttccaatttccg

SEQ ID NO: 237723 - DNA, 25 bp, Homo sapien
tgagcaatttccaatttccgtttaa

SEQ ID NO: 237724 - DNA, 25 bp, Homo sapien
ttctaataaaacttccaacaggaat

SEQ ID NO: 237725 - DNA, 25 bp, Homo sapien
gaatttatttgccctttgtaagtgg

SEQ ID NO: 237726 - DNA, 25 bp, Homo sapien
tgctgtggccacatttgaagagagg

SEQ ID NO: 237727 - DNA, 25 bp, Homo sapien
gctgtggccacatttgaagagaggc

SEQ ID NO: 237728 - DNA, 25 bp, Homo sapien
ctgtggccacatttgaagagaggct

SEQ ID NO: 237729 - DNA, 25 bp, Homo sapien
tgtggccacatttgaagagaggctt

SEQ ID NO: 237730 - DNA, 25 bp, Homo sapien
gtggccacatttgaagagaggcttg

SEQ ID NO: 237731 - DNA, 25 bp, Homo sapien
tggccacatttgaagagaggcttgg

SEQ ID NO: 237732 - DNA, 25 bp, Homo sapien
ggccacatttgaagagaggcttggc

SEQ ID NO: 237733 - DNA, 25 bp, Homo sapien
gcttcaggatggttcgtactaagac

SEQ ID NO: 237734 - DNA, 25 bp, Homo sapien
gttcgtactaagacatggaccctga

SEQ ID NO: 237735 - DNA, 25 bp, Homo sapien
tactaagacatggaccctgaagaag

SEQ ID NO: 237736 - DNA, 25 bp, Homo sapien
gaagcactttgttggctatcctact

SEQ ID NO: 237737 - DNA, 25 bp, Homo sapien
cactttgttggctatcctactaata

SEQ ID NO: 237738 - DNA, 25 bp, Homo sapien
ggctatcctactaatagtgactttg

SEQ ID NO: 237739 - DNA, 25 bp, Homo sapien
aatggagaggtcctgcttgaagctt

SEQ ID NO: 237740 - DNA, 25 bp, Homo sapien
gaggtcctgcttgaagctttgttcc

SEQ ID NO: 237741 - DNA, 25 bp, Homo sapien
tgaagctttgttcctcaccgtggat

SEQ ID NO: 237742 - DNA, 25 bp, Homo sapien
caccgtggatccctacatgagagtg

SEQ ID NO: 237743 - DNA, 25 bp, Homo sapien
gtggatccctacatgagagtggcag

SEQ ID NO: 237744 - DNA, 25 bp, Homo sapien
tgagatagtcttgccccataacctg

SEQ ID NO: 237745 - DNA, 25 bp, Homo sapien
gagatagtcttgccccataacctgt

SEQ ID NO: 237746 - DNA, 25 bp, Homo sapien
atagtcttgccccataacctgtctc

SEQ ID NO: 237747 - DNA, 25 bp, Homo sapien
tagtcttgccccataacctgtctca

SEQ ID NO: 237748 - DNA, 25 bp, Homo sapien
ccataacctgtctcacaccgtagtg

SEQ ID NO: 237749 - DNA, 25 bp, Homo sapien
cataacctgtctcacaccgtagtgt

SEQ ID NO: 237750 - DNA, 25 bp, Homo sapien
ataacctgtctcacaccgtagtgta

SEQ ID NO: 237751 - DNA, 25 bp, Homo sapien
taacctgtctcacaccgtagtgtac

SEQ ID NO: 237752 - DNA, 25 bp, Homo sapien
aacctgtctcacaccgtagtgtacg

SEQ ID NO: 237753 - DNA, 25 bp, Homo sapien
acctgtctcacaccgtagtgtacgg

SEQ ID NO: 237754 - DNA, 25 bp, Homo sapien
tgtctcacaccgtagtgtacggccc

SEQ ID NO: 237755 - DNA, 25 bp, Homo sapien
gacatactgattcaggtctccacct

SEQ ID NO: 237756 - DNA, 25 bp, Homo sapien
accttcacagaactccatgacaaac

SEQ ID NO: 237757 - DNA, 25 bp, Homo sapien
aaaccagagatagcagggctcctca

SEQ ID NO: 237758 - DNA, 25 bp, Homo sapien
agggctcctcagcataacccaggat

SEQ ID NO: 237759 - DNA, 25 bp, Homo sapien
agaccttgcttagtccaaagtcggc

SEQ ID NO: 237760 - DNA, 25 bp, Homo sapien
gtgccagaccgctctgtgatgagga

SEQ ID NO: 237761 - DNA, 25 bp, Homo sapien
gaggatgttgtctggcttcaggtcc

SEQ ID NO: 237762 - DNA, 25 bp, Homo sapien
tcaggtccctgtgcacaatatggtt

SEQ ID NO: 237763 - DNA, 25 bp, Homo sapien
tgcaggaaggcaatggcgctcgtca

SEQ ID NO: 237764 - DNA, 25 bp, Homo sapien
ggcgctcgtcagctgtagcatgaaa

SEQ ID NO: 237765 - DNA, 25 bp, Homo sapien
tggcctccgggacaggacatactga

SEQ ID NO: 237766 - DNA, 25 bp, Homo sapien
ataatttccaagttgatttgacatg

SEQ ID NO: 237767 - DNA, 25 bp, Homo sapien
aatcctgagaggtatatagagcaag

SEQ ID NO: 237768 - DNA, 25 bp, Homo sapien
gagattgattggctctaggttatat

SEQ ID NO: 237769 - DNA, 25 bp, Homo sapien
tggctctaggttatatagctaactg

SEQ ID NO: 237770 - DNA, 25 bp, Homo sapien
ttatatagctaactggtaacaaacc

SEQ ID NO: 237771 - DNA, 25 bp, Homo sapien
tagctaactggtaacaaaccaattt

SEQ ID NO: 237772 - DNA, 25 bp, Homo sapien
gatgaacatcgcttgtgtttttctt

SEQ ID NO: 237773 - DNA, 25 bp, Homo sapien
gaacatcgcttgtgtttttcttgca

SEQ ID NO: 237774 - DNA, 25 bp, Homo sapien
atcgcttgtgtttttcttgcatgta

SEQ ID NO: 237775 - DNA, 25 bp, Homo sapien
cgcttgtgtttttcttgcatgtagt

SEQ ID NO: 237776 - DNA, 25 bp, Homo sapien
ttgtgtttttcttgcatgtagtttc

SEQ ID NO: 237777 - DNA, 25 bp, Homo sapien
tctggaggccaaaatttttattcta

SEQ ID NO: 237778 - DNA, 25 bp, Homo sapien
gtgtaacttatgaaaagtcgtattt

SEQ ID NO: 237779 - DNA, 25 bp, Homo sapien
gaaaagtcgtatttatattgacctt

SEQ ID NO: 237780 - DNA, 25 bp, Homo sapien
agtcgtatttatattgacctttgta

SEQ ID NO: 237781 - DNA, 25 bp, Homo sapien
tgacctttgtaagagctcaattatt

SEQ ID NO: 237782 - DNA, 25 bp, Homo sapien
gacctttgtaagagctcaattattt

SEQ ID NO: 237783 - DNA, 25 bp, Homo sapien
cctttgtaagagctcaattatttca

SEQ ID NO: 237784 - DNA, 25 bp, Homo sapien
ttgtaagagctcaattatttcagga

SEQ ID NO: 237785 - DNA, 25 bp, Homo sapien
agagctcaattatttcaggaagcaa

SEQ ID NO: 237786 - DNA, 25 bp, Homo sapien
gagctcaattatttcaggaagcaag

SEQ ID NO: 237787 - DNA, 25 bp, Homo sapien
ctcaattatttcaggaagcaaggaa

SEQ ID NO: 237788 - DNA, 25 bp, Homo sapien
aaccaaaatgtcaggtactgcggaa

SEQ ID NO: 237789 - DNA, 25 bp, Homo sapien
ggtactgcggaatcaatattacgaa

SEQ ID NO: 237790 - DNA, 25 bp, Homo sapien
actgatattttagcagacctcaata

SEQ ID NO: 237791 - DNA, 25 bp, Homo sapien
gtcaattctccctttaataatctat

SEQ ID NO: 237792 - DNA, 25 bp, Homo sapien
ttctaataaaacttccaacaggaat

SEQ ID NO: 237793 - DNA, 25 bp, Homo sapien
gaatttatttgccctttgtaagtgg

SEQ ID NO: 237794 - DNA, 25 bp, Homo sapien
tgctgtggccacatttgaagagagg

SEQ ID NO: 237795 - DNA, 25 bp, Homo sapien
ctgtggccacatttgaagagaggct

SEQ ID NO: 237796 - DNA, 25 bp, Homo sapien
tgtggccacatttgaagagaggctt

SEQ ID NO: 237797 - DNA, 25 bp, Homo sapien
tggccacatttgaagagaggcttgg

SEQ ID NO: 237798 - DNA, 25 bp, Homo sapien
ggccacatttgaagagaggcttggc

SEQ ID NO: 237799 - DNA, 25 bp, Homo sapien
ttatggtgctggtaataagcctcgc

SEQ ID NO: 237800 - DNA, 25 bp, Homo sapien
atggtgctggtaataagcctcgcag

SEQ ID NO: 237801 - DNA, 25 bp, Homo sapien
gtgctggtaataagcctcgcagccc

SEQ ID NO: 237802 - DNA, 25 bp, Homo sapien
tggtaataagcctcgcagcccaggt

SEQ ID NO: 237803 - DNA, 25 bp, Homo sapien
taataagcctcgcagcccaggtcca

SEQ ID NO: 237804 - DNA, 25 bp, Homo sapien
ctctgcgggcgctggaacctgcaga

SEQ ID NO: 237805 - DNA, 25 bp, Homo sapien
caggccagaggctgcatgccactgt

SEQ ID NO: 237806 - DNA, 25 bp, Homo sapien
ggccagaggctgcatgccactgtcc

SEQ ID NO: 237807 - DNA, 25 bp, Homo sapien
cccctgcttggctgttatggtgctg

SEQ ID NO: 237808 - DNA, 25 bp, Homo sapien
tgcttggctgttatggtgctggtaa

SEQ ID NO: 237809 - DNA, 25 bp, Homo sapien
cttggctgttatggtgctggtaata

SEQ ID NO: 237810 - DNA, 25 bp, Homo sapien
gagatctggctcaggtgcggttttt

SEQ ID NO: 237811 - DNA, 25 bp, Homo sapien
tgcggtttttgtcttagcctcagaa

SEQ ID NO: 237812 - DNA, 25 bp, Homo sapien
gaagtcctgttggttctcagagtcc

SEQ ID NO: 237813 - DNA, 25 bp, Homo sapien
agagtcctcgtctgcctttgtgggt

SEQ ID NO: 237814 - DNA, 25 bp, Homo sapien
ttgtgggtgccctgtcacatacttg

SEQ ID NO: 237815 - DNA, 25 bp, Homo sapien
ctcacttcaggaggctgctcttgga

SEQ ID NO: 237816 - DNA, 25 bp, Homo sapien
gaaccagatgaagatccgtgtccgt

SEQ ID NO: 237817 - DNA, 25 bp, Homo sapien
tgaagatccgtgtccgtgtccatga

SEQ ID NO: 237818 - DNA, 25 bp, Homo sapien
gtgtccatgacagcaatccattcag

SEQ ID NO: 237819 - DNA, 25 bp, Homo sapien
aatagtctaatacaccaatttctga

SEQ ID NO: 237820 - DNA, 25 bp, Homo sapien
atttctgacatttgcttagcactgc

SEQ ID NO: 237821 - DNA, 25 bp, Homo sapien
atatggaaaactgggagctgccttg

SEQ ID NO: 237822 - DNA, 25 bp, Homo sapien
aaactgggagctgccttggaatcta

SEQ ID NO: 237823 - DNA, 25 bp, Homo sapien
ggagctgccttggaatctacagggc

SEQ ID NO: 237824 - DNA, 25 bp, Homo sapien
aagaatggtattcatgcagttccca

SEQ ID NO: 237825 - DNA, 25 bp, Homo sapien
tattcatgcagttcccattttacag

SEQ ID NO: 237826 - DNA, 25 bp, Homo sapien
aaacaagaggactttttctgtgaag

SEQ ID NO: 237827 - DNA, 25 bp, Homo sapien
gtggttacaatggtactttcagcct

SEQ ID NO: 237828 - DNA, 25 bp, Homo sapien
acaatggtactttcagcctgtccga

SEQ ID NO: 237829 - DNA, 25 bp, Homo sapien
ggtactttcagcctgtccgaattat

SEQ ID NO: 237830 - DNA, 25 bp, Homo sapien
ctttcagcctgtccgaattatgtat

SEQ ID NO: 237831 - DNA, 25 bp, Homo sapien
ggcagtgaatgcgttgggaacaata

SEQ ID NO: 237832 - DNA, 25 bp, Homo sapien
gtgtcatccacaaaatcttatctca

SEQ ID NO: 237833 - DNA, 25 bp, Homo sapien
atcttatctcaagccttgactagag

SEQ ID NO: 237834 - DNA, 25 bp, Homo sapien
gactagagaaggacccacttccaag

SEQ ID NO: 237835 - DNA, 25 bp, Homo sapien
ccacttccaagaccacagagttgaa

SEQ ID NO: 237836 - DNA, 25 bp, Homo sapien
gaatgaattcagtccttgcagcccg

SEQ ID NO: 237837 - DNA, 25 bp, Homo sapien
ttgcagcccgttgaactgagggcct

SEQ ID NO: 237838 - DNA, 25 bp, Homo sapien
agcctgcgagagagagagtccacta

SEQ ID NO: 237839 - DNA, 25 bp, Homo sapien
gaggacattgcagtcttatctaatg

SEQ ID NO: 237840 - DNA, 25 bp, Homo sapien
gtgacatcctgtcaccttggtcacc

SEQ ID NO: 237841 - DNA, 25 bp, Homo sapien
ggtcaccttttctattctattcatt

SEQ ID NO: 237842 - DNA, 25 bp, Homo sapien
ttataaatgagtcccaagtcctgcc

SEQ ID NO: 237843 - DNA, 25 bp, Homo sapien
tccccagaagaagaattctaatttt

SEQ ID NO: 237844 - DNA, 25 bp, Homo sapien
agaattctaattttatcaagctgaa

SEQ ID NO: 237845 - DNA, 25 bp, Homo sapien
gaattctaattttatcaagctgaat

SEQ ID NO: 237846 - DNA, 25 bp, Homo sapien
attctaattttatcaagctgaatta

SEQ ID NO: 237847 - DNA, 25 bp, Homo sapien
ctgaattaaagtttgagagtctttt

SEQ ID NO: 237848 - DNA, 25 bp, Homo sapien
cttactgtgtcaaaagaggcattat

SEQ ID NO: 237849 - DNA, 25 bp, Homo sapien
ttactgtgtcaaaagaggcattatg

SEQ ID NO: 237850 - DNA, 25 bp, Homo sapien
tactgtgtcaaaagaggcattatgt

SEQ ID NO: 237851 - DNA, 25 bp, Homo sapien
actgtgtcaaaagaggcattatgtt

SEQ ID NO: 237852 - DNA, 25 bp, Homo sapien
ctgtgtcaaaagaggcattatgttg

SEQ ID NO: 237853 - DNA, 25 bp, Homo sapien
tgtgtcaaaagaggcattatgttgc

SEQ ID NO: 237854 - DNA, 25 bp, Homo sapien
taccccaaagagaacagggcttgct

SEQ ID NO: 237855 - DNA, 25 bp, Homo sapien
gagtcgtgctcgcagcagacttgaa

SEQ ID NO: 237856 - DNA, 25 bp, Homo sapien
gcagcagacttgaattaaccccatg

SEQ ID NO: 237857 - DNA, 25 bp, Homo sapien
aattaaccccatgtaggccggcgag

SEQ ID NO: 237858 - DNA, 25 bp, Homo sapien
cggcgagcagttgcccgcgtgaaaa

SEQ ID NO: 237859 - DNA, 25 bp, Homo sapien
ctggctgagaagatcaaagctcttt

SEQ ID NO: 237860 - DNA, 25 bp, Homo sapien
aggacctatttgttttcaggcagga

SEQ ID NO: 237861 - DNA, 25 bp, Homo sapien
ggatgttaaacttgcagcctctgac

SEQ ID NO: 237862 - DNA, 25 bp, Homo sapien
tgcagcctctgacacacggtggaac

SEQ ID NO: 237863 - DNA, 25 bp, Homo sapien
cacggtggaacctgcagtgcttgga

SEQ ID NO: 237864 - DNA, 25 bp, Homo sapien
gcaggaaagtctaaaccatcccgtt

SEQ ID NO: 237865 - DNA, 25 bp, Homo sapien
ataagaaatcagttaagtgttggct

SEQ ID NO: 237866 - DNA, 25 bp, Homo sapien
taagaaatcagttaagtgttggctg

SEQ ID NO: 237867 - DNA, 25 bp, Homo sapien
aagaaatcagttaagtgttggctgg

SEQ ID NO: 237868 - DNA, 25 bp, Homo sapien
agaaatcagttaagtgttggctggg

SEQ ID NO: 237869 - DNA, 25 bp, Homo sapien
gaaatcagttaagtgttggctgggc

SEQ ID NO: 237870 - DNA, 25 bp, Homo sapien
aaatcagttaagtgttggctgggcg

SEQ ID NO: 237871 - DNA, 25 bp, Homo sapien
aatcagttaagtgttggctgggcgc

SEQ ID NO: 237872 - DNA, 25 bp, Homo sapien
atcagttaagtgttggctgggcgcg

SEQ ID NO: 237873 - DNA, 25 bp, Homo sapien
tcagttaagtgttggctgggcgcgg

SEQ ID NO: 237874 - DNA, 25 bp, Homo sapien
gccaggagttctaaaccagtttggc

SEQ ID NO: 237875 - DNA, 25 bp, Homo sapien
agctacctgggaggcacgagaatca

SEQ ID NO: 237876 - DNA, 25 bp, Homo sapien
gaaggtctatggtttacccttgtga

SEQ ID NO: 237877 - DNA, 25 bp, Homo sapien
ggtctatggtttacccttgtgaagt

SEQ ID NO: 237878 - DNA, 25 bp, Homo sapien
ctatggtttacccttgtgaagtaat

SEQ ID NO: 237879 - DNA, 25 bp, Homo sapien
tacccttgtgaagtaatttttctgt

SEQ ID NO: 237880 - DNA, 25 bp, Homo sapien
ttgtgagtgtaagtcagtcccatcc

SEQ ID NO: 237881 - DNA, 25 bp, Homo sapien
tgagtgtaagtcagtcccatccaca

SEQ ID NO: 237882 - DNA, 25 bp, Homo sapien
agtgtaagtcagtcccatccacacc

SEQ ID NO: 237883 - DNA, 25 bp, Homo sapien
ttctgtggtgagtgagccaaccatt

SEQ ID NO: 237884 - DNA, 25 bp, Homo sapien
gaagcagccctatcaggaggcagca

SEQ ID NO: 237885 - DNA, 25 bp, Homo sapien
gagacaaaaccacctgcgtatgctt

SEQ ID NO: 237886 - DNA, 25 bp, Homo sapien
acaaaaccacctgcgtatgctttgg

SEQ ID NO: 237887 - DNA, 25 bp, Homo sapien
attcctcgtagattaattgatttgc

SEQ ID NO: 237888 - DNA, 25 bp, Homo sapien
aattgatttgctatcttttagtttt

SEQ ID NO: 237889 - DNA, 25 bp, Homo sapien
ttttttctatgcatgtagatgtatt

SEQ ID NO: 237890 - DNA, 25 bp, Homo sapien
gtatagaattttatagcctacattt

SEQ ID NO: 237891 - DNA, 25 bp, Homo sapien
tcttgatatcttaagcatttcactt

SEQ ID NO: 237892 - DNA, 25 bp, Homo sapien
aagcatttcacttattagatattgt

SEQ ID NO: 237893 - DNA, 25 bp, Homo sapien
ttgtataataccctatcatgtgagt

SEQ ID NO: 237894 - DNA, 25 bp, Homo sapien
taccctatcatgtgagtatacctta

SEQ ID NO: 237895 - DNA, 25 bp, Homo sapien
gtgagtataccttaactaagccatt

SEQ ID NO: 237896 - DNA, 25 bp, Homo sapien
ctaagccattcccatattcaacatt

SEQ ID NO: 237897 - DNA, 25 bp, Homo sapien
gccattcccatattcaacattttgt

SEQ ID NO: 237898 - DNA, 25 bp, Homo sapien
gcttcagcttcaagtgacaaaagtc

SEQ ID NO: 237899 - DNA, 25 bp, Homo sapien
acaagatggcagtctctcccctcaa

SEQ ID NO: 237900 - DNA, 25 bp, Homo sapien
tctcccctcaacaggactgttacaa

SEQ ID NO: 237901 - DNA, 25 bp, Homo sapien
tgttacaacaccttatcttcagaga

SEQ ID NO: 237902 - DNA, 25 bp, Homo sapien
agagaaccaggctctctgcaacatt

SEQ ID NO: 237903 - DNA, 25 bp, Homo sapien
tctgcaacatttcagggacgtcgtt

SEQ ID NO: 237904 - DNA, 25 bp, Homo sapien
gacgtcgttcagtaccttatgtgga

SEQ ID NO: 237905 - DNA, 25 bp, Homo sapien
tcaagcttagctgggcatcctatgt

SEQ ID NO: 237906 - DNA, 25 bp, Homo sapien
gggcatcctatgttttaactggcta

SEQ ID NO: 237907 - DNA, 25 bp, Homo sapien
agacatcttactgcagaacactgta

SEQ ID NO: 237908 - DNA, 25 bp, Homo sapien
gtggtttacagcttctatcaggatt

SEQ ID NO: 237909 - DNA, 25 bp, Homo sapien
gagcggcacggattctaggtaatta

SEQ ID NO: 237910 - DNA, 25 bp, Homo sapien
gacagaactgcaggatagtccttaa

SEQ ID NO: 237911 - DNA, 25 bp, Homo sapien
ggaaaacacagaatgctcctggcaa

SEQ ID NO: 237912 - DNA, 25 bp, Homo sapien
gctcctggcaattctaaattcctag

SEQ ID NO: 237913 - DNA, 25 bp, Homo sapien
taaattcctaggtttgcctttctag

SEQ ID NO: 237914 - DNA, 25 bp, Homo sapien
gtttgcctttctagaattccttaag

SEQ ID NO: 237915 - DNA, 25 bp, Homo sapien
gaattccttaagaagctgacagaga

SEQ ID NO: 237916 - DNA, 25 bp, Homo sapien
tttactccaagtgagaggacatact

SEQ ID NO: 237917 - DNA, 25 bp, Homo sapien
gaggacatactcacaactcctatga

SEQ ID NO: 237918 - DNA, 25 bp, Homo sapien
ttagcactaattctggtttaaatga

SEQ ID NO: 237919 - DNA, 25 bp, Homo sapien
taaatgaaagtcctgcagaaatgcc

SEQ ID NO: 237920 - DNA, 25 bp, Homo sapien
ccacacttaacactagccatcattg

SEQ ID NO: 237921 - DNA, 25 bp, Homo sapien
ctagccatcattgatttctctgata

SEQ ID NO: 237922 - DNA, 25 bp, Homo sapien
atatttgttctaatgcacgttcttt

SEQ ID NO: 237923 - DNA, 25 bp, Homo sapien
taatgcacgttctttgacacacctt

SEQ ID NO: 237924 - DNA, 25 bp, Homo sapien
acgttctttgacacaccttcattta

SEQ ID NO: 237925 - DNA, 25 bp, Homo sapien
acacaccttcatttatccttttctg

SEQ ID NO: 237926 - DNA, 25 bp, Homo sapien
ttctcccaggttgtcttgcttttca

SEQ ID NO: 237927 - DNA, 25 bp, Homo sapien
ggttgtcttgcttttcactatataa

SEQ ID NO: 237928 - DNA, 25 bp, Homo sapien
ggaatgattgtgacgctattgatac

SEQ ID NO: 237929 - DNA, 25 bp, Homo sapien
gacgctattgatactgatatgtgct

SEQ ID NO: 237930 - DNA, 25 bp, Homo sapien
gatgcaaagtgtacatttctcccct

SEQ ID NO: 237931 - DNA, 25 bp, Homo sapien
cagtcacgggccctaaaaggacact

SEQ ID NO: 237932 - DNA, 25 bp, Homo sapien
ggacactccttagatgactgacaca

SEQ ID NO: 237933 - DNA, 25 bp, Homo sapien
agattgcaaaggtcctcggccaggg

SEQ ID NO: 237934 - DNA, 25 bp, Homo sapien
tcggccagggatctcttgcacagct

SEQ ID NO: 237935 - DNA, 25 bp, Homo sapien
acgtggagttaatgatgacttttcc

SEQ ID NO: 237936 - DNA, 25 bp, Homo sapien
gacttttccaaatcctgagacactt

SEQ ID NO: 237937 - DNA, 25 bp, Homo sapien
gaatggagtggtgcttttaaacttt

SEQ ID NO: 237938 - DNA, 25 bp, Homo sapien
ttaaactttgatgagcagctaaact

SEQ ID NO: 237939 - DNA, 25 bp, Homo sapien
gcagctaaactcaggtatatatttg

SEQ ID NO: 237940 - DNA, 25 bp, Homo sapien
ggaagggactactcttagtattaat

SEQ ID NO: 237941 - DNA, 25 bp, Homo sapien
taatggttttggagctgggtccagt

SEQ ID NO: 237942 - DNA, 25 bp, Homo sapien
ctttgtttaattgaggagtattctg

SEQ ID NO: 237943 - DNA, 25 bp, Homo sapien
agtattctgagattgcaaagtgagc

SEQ ID NO: 237944 - DNA, 25 bp, Homo sapien
gagattgcaaagtgagctgttaaaa

SEQ ID NO: 237945 - DNA, 25 bp, Homo sapien
gctgttaaaagctgtttcctgctgc

SEQ ID NO: 237946 - DNA, 25 bp, Homo sapien
gttaaaagctgtttcctgctgcaac

SEQ ID NO: 237947 - DNA, 25 bp, Homo sapien
ttcctgctgcaactacttacagatg

SEQ ID NO: 237948 - DNA, 25 bp, Homo sapien
gctgcaactacttacagatgtttat

SEQ ID NO: 237949 - DNA, 25 bp, Homo sapien
cttacagatgtttatcaggattttc

SEQ ID NO: 237950 - DNA, 25 bp, Homo sapien
aggattttcaatactctgctaccaa

SEQ ID NO: 237951 - DNA, 25 bp, Homo sapien
ttcaatactctgctaccaaaataat

SEQ ID NO: 237952 - DNA, 25 bp, Homo sapien
gaaattgattgggtgctaaaataag

SEQ ID NO: 237953 - DNA, 25 bp, Homo sapien
gctgataatgtgacacaccgccaag

SEQ ID NO: 237954 - DNA, 25 bp, Homo sapien
gtgacacaccgccaaggccagagtg

SEQ ID NO: 237955 - DNA, 25 bp, Homo sapien
ggccagagtgctgtgcttgaaactg

SEQ ID NO: 237956 - DNA, 25 bp, Homo sapien
tgctgtgcttgaaactggcccacat

SEQ ID NO: 237957 - DNA, 25 bp, Homo sapien
actcccatactgattgccaaagctg

SEQ ID NO: 237958 - DNA, 25 bp, Homo sapien
gggtccatagctctgcacaggccca

SEQ ID NO: 237959 - DNA, 25 bp, Homo sapien
tctttgttgcctgccatgtagtaaa

SEQ ID NO: 237960 - DNA, 25 bp, Homo sapien
tgtagtaaaaatctccagcctcttt

SEQ ID NO: 237961 - DNA, 25 bp, Homo sapien
gaaaccctggtaaccttgatggcca

SEQ ID NO: 237962 - DNA, 25 bp, Homo sapien
accttgatggccagaggtctcgcta

SEQ ID NO: 237963 - DNA, 25 bp, Homo sapien
agaggtctcgctagccatcgctgcc

SEQ ID NO: 237964 - DNA, 25 bp, Homo sapien
atgttagggatagtcacccaccacc

SEQ ID NO: 237965 - DNA, 25 bp, Homo sapien
agtctagtgggagtccagaggtaaa

SEQ ID NO: 237966 - DNA, 25 bp, Homo sapien
gtaaagacacagtaaggtcacatgt

SEQ ID NO: 237967 - DNA, 25 bp, Homo sapien
aaggtcacatgtgacccaggaggga

SEQ ID NO: 237968 - DNA, 25 bp, Homo sapien
ctgaggagactgtgccatggctgga

SEQ ID NO: 237969 - DNA, 25 bp, Homo sapien
aggcagcatctgcactggaaatgca

SEQ ID NO: 237970 - DNA, 25 bp, Homo sapien
tgagggaggcctggaaagtccactt

SEQ ID NO: 237971 - DNA, 25 bp, Homo sapien
gaggcctggaaagtccacttggact

SEQ ID NO: 237972 - DNA, 25 bp, Homo sapien
gtccacttggacttgacaatgagga

SEQ ID NO: 237973 - DNA, 25 bp, Homo sapien
tggacttgacaatgaggagctctct

SEQ ID NO: 237974 - DNA, 25 bp, Homo sapien
gtcactcaggaatgatttggaatgt

SEQ ID NO: 237975 - DNA, 25 bp, Homo sapien
tctgaacccacacatgttttcggaa

SEQ ID NO: 237976 - DNA, 25 bp, Homo sapien
cacacatgttttcggaaggaccaga

SEQ ID NO: 237977 - DNA, 25 bp, Homo sapien
atggctgacactggctaatgggaac

SEQ ID NO: 237978 - DNA, 25 bp, Homo sapien
atacccccagcttagaggtgcttca

SEQ ID NO: 237979 - DNA, 25 bp, Homo sapien
tttctctagagactttaccccatta

SEQ ID NO: 237980 - DNA, 25 bp, Homo sapien
gagactttaccccattatatcaaaa

SEQ ID NO: 237981 - DNA, 25 bp, Homo sapien
caaaaacctttactacagcctgact

SEQ ID NO: 237982 - DNA, 25 bp, Homo sapien
tactacagcctgactttatctgatg

SEQ ID NO: 237983 - DNA, 25 bp, Homo sapien
gcctgactttatctgatgttagagt

SEQ ID NO: 237984 - DNA, 25 bp, Homo sapien
gagtatcattaagtcaagcagcagc

SEQ ID NO: 237985 - DNA, 25 bp, Homo sapien
agtcaagcagcagcatttattgagt

SEQ ID NO: 237986 - DNA, 25 bp, Homo sapien
aatcttatgttatacctgaaaaatt

SEQ ID NO: 237987 - DNA, 25 bp, Homo sapien
atcttatgttatacctgaaaaattg

SEQ ID NO: 237988 - DNA, 25 bp, Homo sapien
tcttatgttatacctgaaaaattgg

SEQ ID NO: 237989 - DNA, 25 bp, Homo sapien
cttatgttatacctgaaaaattggt

SEQ ID NO: 237990 - DNA, 25 bp, Homo sapien
ttatgttatacctgaaaaattggtt

SEQ ID NO: 237991 - DNA, 25 bp, Homo sapien
tatgttatacctgaaaaattggttt

SEQ ID NO: 237992 - DNA, 25 bp, Homo sapien
aaaatgttcatcttggccgggcacg

SEQ ID NO: 237993 - DNA, 25 bp, Homo sapien
aaatgttcatcttggccgggcacgg

SEQ ID NO: 237994 - DNA, 25 bp, Homo sapien
aatgttcatcttggccgggcacggt

SEQ ID NO: 237995 - DNA, 25 bp, Homo sapien
gccaagaatgcactactgtactcca

SEQ ID NO: 237996 - DNA, 25 bp, Homo sapien
ccaagaatgcactactgtactccag

SEQ ID NO: 237997 - DNA, 25 bp, Homo sapien
aaagtttatcggtatcttgatgtat

SEQ ID NO: 237998 - DNA, 25 bp, Homo sapien
gtggctgtttaaaattctaatgaca

SEQ ID NO: 237999 - DNA, 25 bp, Homo sapien
gacatatatcaacacattcaatggc

SEQ ID NO: 238000 - DNA, 25 bp, Homo sapien
attcaatggctgttgttaacctttg

SEQ ID NO: 238001 - DNA, 25 bp, Homo sapien
tggctgttgttaacctttgaagtaa

SEQ ID NO: 238002 - DNA, 25 bp, Homo sapien
gagatcactttttaccaaataacca

SEQ ID NO: 238003 - DNA, 25 bp, Homo sapien
gtcaaagtgcacaggtatgttctca

SEQ ID NO: 238004 - DNA, 25 bp, Homo sapien
agtgcacaggtatgttctcagaaca

SEQ ID NO: 238005 - DNA, 25 bp, Homo sapien
gaacatttttcacaatgtgtatcag

SEQ ID NO: 238006 - DNA, 25 bp, Homo sapien
tcagaaatatgtttgctatccttag

SEQ ID NO: 238007 - DNA, 25 bp, Homo sapien
atgtttgctatccttagagacagaa

SEQ ID NO: 238008 - DNA, 25 bp, Homo sapien
agagtggctataaacgtccgcgcct

SEQ ID NO: 238009 - DNA, 25 bp, Homo sapien
aggccgggctctgagtgctctttcc

SEQ ID NO: 238010 - DNA, 25 bp, Homo sapien
gggctctgagtgctctttcccgtcc

SEQ ID NO: 238011 - DNA, 25 bp, Homo sapien
tctgagtgctctttcccgtccgggc

SEQ ID NO: 238012 - DNA, 25 bp, Homo sapien
ggaatctacgtcacccgaaaagcga

SEQ ID NO: 238013 - DNA, 25 bp, Homo sapien
gaatctacgtcacccgaaaagcgac

SEQ ID NO: 238014 - DNA, 25 bp, Homo sapien
tctacgtcacccgaaaagcgactat

SEQ ID NO: 238015 - DNA, 25 bp, Homo sapien
tacgtcacccgaaaagcgactataa

SEQ ID NO: 238016 - DNA, 25 bp, Homo sapien
gtcacccgaaaagcgactataaacg

SEQ ID NO: 238017 - DNA, 25 bp, Homo sapien
aaagcgactataaacgccggcgcct

SEQ ID NO: 238018 - DNA, 25 bp, Homo sapien
aagcgactataaacgccggcgcctc

SEQ ID NO: 238019 - DNA, 25 bp, Homo sapien
tgcacatccggatagaagattcccc

SEQ ID NO: 238020 - DNA, 25 bp, Homo sapien
agattccccggaagcccagattctt

SEQ ID NO: 238021 - DNA, 25 bp, Homo sapien
ttacgccacatgtgtcacttcattg

SEQ ID NO: 238022 - DNA, 25 bp, Homo sapien
cctgggcctatgtcaagaagtgcaa

SEQ ID NO: 238023 - DNA, 25 bp, Homo sapien
aaaaacaacatgtgtccaaatcggg

SEQ ID NO: 238024 - DNA, 25 bp, Homo sapien
gaagactatccttggagattccatc

SEQ ID NO: 238025 - DNA, 25 bp, Homo sapien
ttggagattccatcacaaacatcat

SEQ ID NO: 238026 - DNA, 25 bp, Homo sapien
aaacatcatggatccgctctactga

SEQ ID NO: 238027 - DNA, 25 bp, Homo sapien
cgaggcccaccgaagggtactgaag

SEQ ID NO: 238028 - DNA, 25 bp, Homo sapien
agggtactgaagagcctcacctggg

SEQ ID NO: 238029 - DNA, 25 bp, Homo sapien
agagtgtgtatacccaggcttgtct

SEQ ID NO: 238030 - DNA, 25 bp, Homo sapien
acttaggttagtggctgatgtgtgt

SEQ ID NO: 238031 - DNA, 25 bp, Homo sapien
gatgtgtgtctgtcaccaaaggcca

SEQ ID NO: 238032 - DNA, 25 bp, Homo sapien
aggccaggccatgatgcactttctt

SEQ ID NO: 238033 - DNA, 25 bp, Homo sapien
tgatgcactttcttgattactcaat

SEQ ID NO: 238034 - DNA, 25 bp, Homo sapien
gatagataaagagagccccttcttc

SEQ ID NO: 238035 - DNA, 25 bp, Homo sapien
gtgcaccccaatacagaacatcaga

SEQ ID NO: 238036 - DNA, 25 bp, Homo sapien
ataacaaagccctattgtccagccc

SEQ ID NO: 238037 - DNA, 25 bp, Homo sapien
agccccagtaaccaccacagagaat

SEQ ID NO: 238038 - DNA, 25 bp, Homo sapien
cacagagaatgttctgcagccccag

SEQ ID NO: 238039 - DNA, 25 bp, Homo sapien
tttttcttaacttagggctttgcag

SEQ ID NO: 238040 - DNA, 25 bp, Homo sapien
attcaagaatttcacttagggctct

SEQ ID NO: 238041 - DNA, 25 bp, Homo sapien
gaagctgtcccttagcgaagaataa

SEQ ID NO: 238042 - DNA, 25 bp, Homo sapien
gttcgtaattctaatgacctctcca

SEQ ID NO: 238043 - DNA, 25 bp, Homo sapien
gaataaaactgtggactgaccccca

SEQ ID NO: 238044 - DNA, 25 bp, Homo sapien
ccacccatttgcgaagaaagtactg

SEQ ID NO: 238045 - DNA, 25 bp, Homo sapien
cgaagaaagtactgggtcttcagct

SEQ ID NO: 238046 - DNA, 25 bp, Homo sapien
tgggtcttcagctttcattgttcag

SEQ ID NO: 238047 - DNA, 25 bp, Homo sapien
agctttcattgttcagccggtggtc

SEQ ID NO: 238048 - DNA, 25 bp, Homo sapien
tcagccggtggtctttgtggacaac

SEQ ID NO: 238049 - DNA, 25 bp, Homo sapien
gtggtctttgtggacaacaccaggg

SEQ ID NO: 238050 - DNA, 25 bp, Homo sapien
gacctctccagatttatggctgcag

SEQ ID NO: 238051 - DNA, 25 bp, Homo sapien
gatttatggctgcagcattcccaag

SEQ ID NO: 238052 - DNA, 25 bp, Homo sapien
acttctgcttaagaggcttctatgt

SEQ ID NO: 238053 - DNA, 25 bp, Homo sapien
gaggcttctatgtaatgaaattctc

SEQ ID NO: 238054 - DNA, 25 bp, Homo sapien
attttctaaattgagacgtcacttt

SEQ ID NO: 238055 - DNA, 25 bp, Homo sapien
ggtacctgtaatttagccatttcct

SEQ ID NO: 238056 - DNA, 25 bp, Homo sapien
atttcctactcagcaatgtctcatt

SEQ ID NO: 238057 - DNA, 25 bp, Homo sapien
ttgtttagcgtgtttcaaagagcag

SEQ ID NO: 238058 - DNA, 25 bp, Homo sapien
agatgtaagcttgagcccatcctct

SEQ ID NO: 238059 - DNA, 25 bp, Homo sapien
gactgttagttttccagttcctact

SEQ ID NO: 238060 - DNA, 25 bp, Homo sapien
cagttcctactggaggcaaattctt

SEQ ID NO: 238061 - DNA, 25 bp, Homo sapien
attctttgtttaccactgttctctg

SEQ ID NO: 238062 - DNA, 25 bp, Homo sapien
gtttaccactgttctctgtatttca

SEQ ID NO: 238063 - DNA, 25 bp, Homo sapien
ctgcagtcagcaacttggaatattc

SEQ ID NO: 238064 - DNA, 25 bp, Homo sapien
tgcagtcagcaacttggaatattca

SEQ ID NO: 238065 - DNA, 25 bp, Homo sapien
gcagtcagcaacttggaatattcag

SEQ ID NO: 238066 - DNA, 25 bp, Homo sapien
cagtcagcaacttggaatattcaga

SEQ ID NO: 238067 - DNA, 25 bp, Homo sapien
gtcagcaacttggaatattcagact

SEQ ID NO: 238068 - DNA, 25 bp, Homo sapien
cagcaacttggaatattcagacttc

SEQ ID NO: 238069 - DNA, 25 bp, Homo sapien
gcaacttggaatattcagacttcag

SEQ ID NO: 238070 - DNA, 25 bp, Homo sapien
aacttggaatattcagacttcagac

SEQ ID NO: 238071 - DNA, 25 bp, Homo sapien
cttggaatattcagacttcagacca

SEQ ID NO: 238072 - DNA, 25 bp, Homo sapien
ttggaatattcagacttcagaccag

SEQ ID NO: 238073 - DNA, 25 bp, Homo sapien
agacttcagaccagcatcacagatt

SEQ ID NO: 238074 - DNA, 25 bp, Homo sapien
tggtcgacaccagcctgtgatggag

SEQ ID NO: 238075 - DNA, 25 bp, Homo sapien
acaccagcctgtgatggagagtttt

SEQ ID NO: 238076 - DNA, 25 bp, Homo sapien
tgccagaccactgggaatggattct

SEQ ID NO: 238077 - DNA, 25 bp, Homo sapien
gaatggattctagggcatcggaaat

SEQ ID NO: 238078 - DNA, 25 bp, Homo sapien
aatgcctacctgagagagagaccca

SEQ ID NO: 238079 - DNA, 25 bp, Homo sapien
agagagagacccaaactttactctg

SEQ ID NO: 238080 - DNA, 25 bp, Homo sapien
ttactctgggaggtaggctatgccc

SEQ ID NO: 238081 - DNA, 25 bp, Homo sapien
ggaggtaggctatgcccatccaaat

SEQ ID NO: 238082 - DNA, 25 bp, Homo sapien
gtaggctatgcccatccaaataaat

SEQ ID NO: 238083 - DNA, 25 bp, Homo sapien
ccatgagaaacttgaggagacttca

SEQ ID NO: 238084 - DNA, 25 bp, Homo sapien
gaaagttctgaatgctatcaacagg

SEQ ID NO: 238085 - DNA, 25 bp, Homo sapien
gatattcctatcttacatagaagcg

SEQ ID NO: 238086 - DNA, 25 bp, Homo sapien
ctatcttacatagaagcgatccttc

SEQ ID NO: 238087 - DNA, 25 bp, Homo sapien
gaagcgatccttcaggactgtgtgt

SEQ ID NO: 238088 - DNA, 25 bp, Homo sapien
gactgtgtgtaggatgttctttctc

SEQ ID NO: 238089 - DNA, 25 bp, Homo sapien
tttgtcacctctgaagatggatgga

SEQ ID NO: 238090 - DNA, 25 bp, Homo sapien
ggaaaatgtgtaggcattggaacag

SEQ ID NO: 238091 - DNA, 25 bp, Homo sapien
gtttgaatgtgatctcacgtgattg

SEQ ID NO: 238092 - DNA, 25 bp, Homo sapien
taatttatgatgtccacacacctag

SEQ ID NO: 238093 - DNA, 25 bp, Homo sapien
gatgtccacacacctagttacaatg

SEQ ID NO: 238094 - DNA, 25 bp, Homo sapien
cacacacctagttacaatgacttgt

SEQ ID NO: 238095 - DNA, 25 bp, Homo sapien
tagttacaatgacttgtaccaggag

SEQ ID NO: 238096 - DNA, 25 bp, Homo sapien
gaaataagaaatcagttaagtgttg

SEQ ID NO: 238097 - DNA, 25 bp, Homo sapien
aaataagaaatcagttaagtgttgg

SEQ ID NO: 238098 - DNA, 25 bp, Homo sapien
aataagaaatcagttaagtgttggc

SEQ ID NO: 238099 - DNA, 25 bp, Homo sapien
ataagaaatcagttaagtgttggct

SEQ ID NO: 238100 - DNA, 25 bp, Homo sapien
taagaaatcagttaagtgttggctg

SEQ ID NO: 238101 - DNA, 25 bp, Homo sapien
aagaaatcagttaagtgttggctgg

SEQ ID NO: 238102 - DNA, 25 bp, Homo sapien
agaaatcagttaagtgttggctggg

SEQ ID NO: 238103 - DNA, 25 bp, Homo sapien
gaaatcagttaagtgttggctgggc

SEQ ID NO: 238104 - DNA, 25 bp, Homo sapien
aaatcagttaagtgttggctgggcg

SEQ ID NO: 238105 - DNA, 25 bp, Homo sapien
aatcagttaagtgttggctgggcgc

SEQ ID NO: 238106 - DNA, 25 bp, Homo sapien
gaaacatgctcagtactttaagtac

SEQ ID NO: 238107 - DNA, 25 bp, Homo sapien
taatgttctctgattatgtacaaat

SEQ ID NO: 238108 - DNA, 25 bp, Homo sapien
aatcattatggctacctgtctgcaa

SEQ ID NO: 238109 - DNA, 25 bp, Homo sapien
atggctacctgtctgcaagaagtca

SEQ ID NO: 238110 - DNA, 25 bp, Homo sapien
gtcaggagaaactggtatctcggct

SEQ ID NO: 238111 - DNA, 25 bp, Homo sapien
aaactggtatctcggctaaaactgg

SEQ ID NO: 238112 - DNA, 25 bp, Homo sapien
gaaaaactggtgtcgtctttgctta

SEQ ID NO: 238113 - DNA, 25 bp, Homo sapien
tcatctggttttataatgaggtcag

SEQ ID NO: 238114 - DNA, 25 bp, Homo sapien
atgaggtcaggaacaggtgaatgta

SEQ ID NO: 238115 - DNA, 25 bp, Homo sapien
gtaagctgagtgatttctgtgttaa

SEQ ID NO: 238116 - DNA, 25 bp, Homo sapien
gatttctgtgttaatgattaggcta

SEQ ID NO: 238117 - DNA, 25 bp, Homo sapien
ttcctctccgaacccattggagaaa

SEQ ID NO: 238118 - DNA, 25 bp, Homo sapien
atcagccatgagctcgcgatcaatt

SEQ ID NO: 238119 - DNA, 25 bp, Homo sapien
gctcgcgatcaatttggtcaccaaa

SEQ ID NO: 238120 - DNA, 25 bp, Homo sapien
aggtatcaataaggcctacatcctg

SEQ ID NO: 238121 - DNA, 25 bp, Homo sapien
gggacaattccttctgatgcacaag

SEQ ID NO: 238122 - DNA, 25 bp, Homo sapien
gatgcacaagaatgaagccgagttt

SEQ ID NO: 238123 - DNA, 25 bp, Homo sapien
catttgctgttttggtgccactgag

SEQ ID NO: 238124 - DNA, 25 bp, Homo sapien
ttggtgccactgagtgtgaggccca

SEQ ID NO: 238125 - DNA, 25 bp, Homo sapien
agacttctcactgcctcaaggagtg

SEQ ID NO: 238126 - DNA, 25 bp, Homo sapien
caaggagtggtgtgcctgcttcctg

SEQ ID NO: 238127 - DNA, 25 bp, Homo sapien
gcttcctgtagacacaaacctcatt

SEQ ID NO: 238128 - DNA, 25 bp, Homo sapien
tcctccacctgcatctagacagtaa

SEQ ID NO: 238129 - DNA, 25 bp, Homo sapien
taatgctgttttgccttactgatgc

SEQ ID NO: 238130 - DNA, 25 bp, Homo sapien
tttgccttactgatgccaatgaagt

SEQ ID NO: 238131 - DNA, 25 bp, Homo sapien
gaagtgttggtatctcctttcttag

SEQ ID NO: 238132 - DNA, 25 bp, Homo sapien
tcctggacgtgtcggagctcctgta

SEQ ID NO: 238133 - DNA, 25 bp, Homo sapien
ggtatctcctttcttagaccagaaa

SEQ ID NO: 238134 - DNA, 25 bp, Homo sapien
gttacagtccataagaatcacccag

SEQ ID NO: 238135 - DNA, 25 bp, Homo sapien
gaatcacccagagaacaagtttaaa

SEQ ID NO: 238136 - DNA, 25 bp, Homo sapien
gggacccctttctcacatcaagaag

SEQ ID NO: 238137 - DNA, 25 bp, Homo sapien
ggagctcctgtaagtgaaggcactt

SEQ ID NO: 238138 - DNA, 25 bp, Homo sapien
tctaccccttctccaggaatcaaaa

SEQ ID NO: 238139 - DNA, 25 bp, Homo sapien
gaagggcttgaattgaagctttact

SEQ ID NO: 238140 - DNA, 25 bp, Homo sapien
tactttagaatttagccctggtttg

SEQ ID NO: 238141 - DNA, 25 bp, Homo sapien
tagaatttagccctggtttgaaatt

SEQ ID NO: 238142 - DNA, 25 bp, Homo sapien
gaaattttccattacatgatcttgg

SEQ ID NO: 238143 - DNA, 25 bp, Homo sapien
tccattacatgatcttggtttatca

SEQ ID NO: 238144 - DNA, 25 bp, Homo sapien
tggtttatcatcgatgggaagggta

SEQ ID NO: 238145 - DNA, 25 bp, Homo sapien
aaaagtcagcattttcttagacctc

SEQ ID NO: 238146 - DNA, 25 bp, Homo sapien
tcttagacctcttcagctgattgtt

SEQ ID NO: 238147 - DNA, 25 bp, Homo sapien
gacctcttcagctgattgtttattt

SEQ ID NO: 238148 - DNA, 25 bp, Homo sapien
gaattcctacacatggttattcccc

SEQ ID NO: 238149 - DNA, 25 bp, Homo sapien
ttcccccctacttgagataatctaa

SEQ ID NO: 238150 - DNA, 25 bp, Homo sapien
attgccatggtggacctgtttctat

SEQ ID NO: 238151 - DNA, 25 bp, Homo sapien
tgtttctatccacctctttctatgg

SEQ ID NO: 238152 - DNA, 25 bp, Homo sapien
atccacctctttctatggctatata

SEQ ID NO: 238153 - DNA, 25 bp, Homo sapien
ataagtctatacatgccagttccgt

SEQ ID NO: 238154 - DNA, 25 bp, Homo sapien
atacatgccagttccgtacatactc

SEQ ID NO: 238155 - DNA, 25 bp, Homo sapien
tccgtacatactccatttccaaaga

SEQ ID NO: 238156 - DNA, 25 bp, Homo sapien
gcactaccatgaattttagggtcac

SEQ ID NO: 238157 - DNA, 25 bp, Homo sapien
gctgcctcagcagtgtcactttagt

SEQ ID NO: 238158 - DNA, 25 bp, Homo sapien
gtgtcactttagtgaccactgccca

SEQ ID NO: 238159 - DNA, 25 bp, Homo sapien
cactgcccaggcttacttcactttg

SEQ ID NO: 238160 - DNA, 25 bp, Homo sapien
agcaatgatgcctccctggtgtctg

SEQ ID NO: 238161 - DNA, 25 bp, Homo sapien
tgtggttagaacatccctgaagtaa

SEQ ID NO: 238162 - DNA, 25 bp, Homo sapien
cactggctattgttgatactgttaa

SEQ ID NO: 238163 - DNA, 25 bp, Homo sapien
caacagccaggtttgggcaccatgt

SEQ ID NO: 238164 - DNA, 25 bp, Homo sapien
ggcaccatgtgataagatgacctgc

SEQ ID NO: 238165 - DNA, 25 bp, Homo sapien
atgacctgcaggtctggccttggat

SEQ ID NO: 238166 - DNA, 25 bp, Homo sapien
ctggccttggatttctgcagaggtt

SEQ ID NO: 238167 - DNA, 25 bp, Homo sapien
aaggcatcacttaggaggctggcag

SEQ ID NO: 238168 - DNA, 25 bp, Homo sapien
taggaggctggcagaccatgagaaa

SEQ ID NO: 238169 - DNA, 25 bp, Homo sapien
gaaagtctcacctggaagcggtgga

SEQ ID NO: 238170 - DNA, 25 bp, Homo sapien
agtccacgatgtgcttgtactggca

SEQ ID NO: 238171 - DNA, 25 bp, Homo sapien
tgcttgtactggcacttgcagccca

SEQ ID NO: 238172 - DNA, 25 bp, Homo sapien
gtagagactgggatcctttgaaaat

SEQ ID NO: 238173 - DNA, 25 bp, Homo sapien
aaatccaacatgtgtaccaccactt

SEQ ID NO: 238174 - DNA, 25 bp, Homo sapien
acatgtgtaccaccacttacaggtt

SEQ ID NO: 238175 - DNA, 25 bp, Homo sapien
ggcttgtagagatcagtttacctgt

SEQ ID NO: 238176 - DNA, 25 bp, Homo sapien
gtttacctgtcaaatggatgggctt

SEQ ID NO: 238177 - DNA, 25 bp, Homo sapien
gtaataactcctaaagcctctttgt

SEQ ID NO: 238178 - DNA, 25 bp, Homo sapien
taaagcctctttgtaatttcccaat

SEQ ID NO: 238179 - DNA, 25 bp, Homo sapien
tgtaatttcccaattctacctcatg

SEQ ID NO: 238180 - DNA, 25 bp, Homo sapien
ccaattctacctcatgtcttttact

SEQ ID NO: 238181 - DNA, 25 bp, Homo sapien
tactgtggtacaaaagggctaagat

SEQ ID NO: 238182 - DNA, 25 bp, Homo sapien
gggctaagatgacgagtttctgata

SEQ ID NO: 238183 - DNA, 25 bp, Homo sapien
cagccaaggtcaggaagaggccctg

SEQ ID NO: 238184 - DNA, 25 bp, Homo sapien
gtgtctggccaatctcaggctttca

SEQ ID NO: 238185 - DNA, 25 bp, Homo sapien
aatctcaggctttcacttctgtact

SEQ ID NO: 238186 - DNA, 25 bp, Homo sapien
aggctttcacttctgtactgcactg

SEQ ID NO: 238187 - DNA, 25 bp, Homo sapien
cacttctgtactgcactgtggcttg

SEQ ID NO: 238188 - DNA, 25 bp, Homo sapien
ttggcaggacatggcaatgggcaac

SEQ ID NO: 238189 - DNA, 25 bp, Homo sapien
tgggcacagggcttattcctcggag

SEQ ID NO: 238190 - DNA, 25 bp, Homo sapien
acagggcttattcctcggagtagaa

SEQ ID NO: 238191 - DNA, 25 bp, Homo sapien
attcctcggagtagaagggtgtaca

SEQ ID NO: 238192 - DNA, 25 bp, Homo sapien
cagactccacagtgacttgccacat

SEQ ID NO: 238193 - DNA, 25 bp, Homo sapien
caagaagctgcaatgtgcaatcccc

SEQ ID NO: 238194 - DNA, 25 bp, Homo sapien
tgggctccttcccttgacttccagg

SEQ ID NO: 238195 - DNA, 25 bp, Homo sapien
tcaagggtgggcagcgtacttctaa

SEQ ID NO: 238196 - DNA, 25 bp, Homo sapien
agggtgggcagcgtacttctaactc

SEQ ID NO: 238197 - DNA, 25 bp, Homo sapien
gtacttctaactcattgtttccctc

SEQ ID NO: 238198 - DNA, 25 bp, Homo sapien
ttctaactcattgtttccctcatgg

SEQ ID NO: 238199 - DNA, 25 bp, Homo sapien
aactcattgtttccctcatggccga

SEQ ID NO: 238200 - DNA, 25 bp, Homo sapien
attgtttccctcatggccgaccagg

SEQ ID NO: 238201 - DNA, 25 bp, Homo sapien
ggatagcatgcccaattttagccct

SEQ ID NO: 238202 - DNA, 25 bp, Homo sapien
agcatgcccaattttagccctgaag

SEQ ID NO: 238203 - DNA, 25 bp, Homo sapien
tgcccaattttagccctgaagcagg

SEQ ID NO: 238204 - DNA, 25 bp, Homo sapien
aaactcttgaccaccagtggctccc

SEQ ID NO: 238205 - DNA, 25 bp, Homo sapien
caggtgggtccttacccagccttct

SEQ ID NO: 238206 - DNA, 25 bp, Homo sapien
aaccatgatttatcccaagtcccaa

SEQ ID NO: 238207 - DNA, 25 bp, Homo sapien
atgatttatcccaagtcccaaagac

SEQ ID NO: 238208 - DNA, 25 bp, Homo sapien
tttatcccaagtcccaaagacataa

SEQ ID NO: 238209 - DNA, 25 bp, Homo sapien
cctgcttggaaagtgagatgcttgg

SEQ ID NO: 238210 - DNA, 25 bp, Homo sapien
tgagatgcttggatgggcctgaaaa

SEQ ID NO: 238211 - DNA, 25 bp, Homo sapien
atgggcctgaaaattaggcaagaca

SEQ ID NO: 238212 - DNA, 25 bp, Homo sapien
ggaatgaagcaaccagaaagatagt

SEQ ID NO: 238213 - DNA, 25 bp, Homo sapien
acgaaaaaatgcagccttaattggg

SEQ ID NO: 238214 - DNA, 25 bp, Homo sapien
gaaatttactgactttggtgagcca

SEQ ID NO: 238215 - DNA, 25 bp, Homo sapien
tgactttggtgagccaagtttgcgc

SEQ ID NO: 238216 - DNA, 25 bp, Homo sapien
tttgtttaagtctaatcactaactt

SEQ ID NO: 238217 - DNA, 25 bp, Homo sapien
cctttcttattcattgtagttacgg

SEQ ID NO: 238218 - DNA, 25 bp, Homo sapien
attcattgtagttacggcagtccca

SEQ ID NO: 238219 - DNA, 25 bp, Homo sapien
tgtcttcaggaatgtaagtaccact

SEQ ID NO: 238220 - DNA, 25 bp, Homo sapien
caggaatgtaagtaccactgagaca

SEQ ID NO: 238221 - DNA, 25 bp, Homo sapien
gaatgtaagtaccactgagacagga

SEQ ID NO: 238222 - DNA, 25 bp, Homo sapien
atgtaagtaccactgagacaggagg

SEQ ID NO: 238223 - DNA, 25 bp, Homo sapien
agaattagaggccagatgcctgtga

SEQ ID NO: 238224 - DNA, 25 bp, Homo sapien
tagaggccagatgcctgtgaatatt

SEQ ID NO: 238225 - DNA, 25 bp, Homo sapien
gccagatgcctgtgaatatttgtca

SEQ ID NO: 238226 - DNA, 25 bp, Homo sapien
gatgcctgtgaatatttgtcagaat

SEQ ID NO: 238227 - DNA, 25 bp, Homo sapien
ttttcaggccttcacatctagagag

SEQ ID NO: 238228 - DNA, 25 bp, Homo sapien
gatggataacttccaatcctgattt

SEQ ID NO: 238229 - DNA, 25 bp, Homo sapien
aagctgctagtggattttaacccct

SEQ ID NO: 238230 - DNA, 25 bp, Homo sapien
gctagtggattttaacccctgccta

SEQ ID NO: 238231 - DNA, 25 bp, Homo sapien
taacccctgcctaaagaagacatat

SEQ ID NO: 238232 - DNA, 25 bp, Homo sapien
agacatatacttcatttgggagcaa

SEQ ID NO: 238233 - DNA, 25 bp, Homo sapien
gggagcaaatacttattgccttgaa

SEQ ID NO: 238234 - DNA, 25 bp, Homo sapien
tattgccttgaacaagtagcactgt

SEQ ID NO: 238235 - DNA, 25 bp, Homo sapien
tgtagaataacctttatccctttca

SEQ ID NO: 238236 - DNA, 25 bp, Homo sapien
atattgcaatcagatggcattcaca

SEQ ID NO: 238237 - DNA, 25 bp, Homo sapien
cattcacaaacttaactggagcata

SEQ ID NO: 238238 - DNA, 25 bp, Homo sapien
gacaggaatgtcatatcccacaaat

SEQ ID NO: 238239 - DNA, 25 bp, Homo sapien
tgcattattgccagcaggccattat

SEQ ID NO: 238240 - DNA, 25 bp, Homo sapien
tgccagcaggccattattgacggtg

SEQ ID NO: 238241 - DNA, 25 bp, Homo sapien
gacggtgggccattaagaactctgt

SEQ ID NO: 238242 - DNA, 25 bp, Homo sapien
agaactctgtgaccggcacatatgc

SEQ ID NO: 238243 - DNA, 25 bp, Homo sapien
acatatgcctccagacttcctggaa

SEQ ID NO: 238244 - DNA, 25 bp, Homo sapien
tcctggaaccagaaaacctgcaaca

SEQ ID NO: 238245 - DNA, 25 bp, Homo sapien
gaacaacgggtttctgttccaactg

SEQ ID NO: 238246 - DNA, 25 bp, Homo sapien
caagatctctctcccaattaggagt

SEQ ID NO: 238247 - DNA, 25 bp, Homo sapien
aattaggagtccatgccgccccaag

SEQ ID NO: 238248 - DNA, 25 bp, Homo sapien
gtcccgctcgaagaatccctgagaa

SEQ ID NO: 238249 - DNA, 25 bp, Homo sapien
taagatgcagagtcccatgtgtcct

SEQ ID NO: 238250 - DNA, 25 bp, Homo sapien
tcccatgtgtcctctgatctaaagt

SEQ ID NO: 238251 - DNA, 25 bp, Homo sapien
gtgtcctctgatctaaagttgcatg

SEQ ID NO: 238252 - DNA, 25 bp, Homo sapien
aagttgcatggttggtctgaaaata

SEQ ID NO: 238253 - DNA, 25 bp, Homo sapien
aatgttgacttctattactcctgca

SEQ ID NO: 238254 - DNA, 25 bp, Homo sapien
ttgacttctattactcctgcatgga

SEQ ID NO: 238255 - DNA, 25 bp, Homo sapien
tactcctgcatggagcagttgttat

SEQ ID NO: 238256 - DNA, 25 bp, Homo sapien
atacatcactttttaacttctgtaa

SEQ ID NO: 238257 - DNA, 25 bp, Homo sapien
aggattcttctcttttatagctatt

SEQ ID NO: 238258 - DNA, 25 bp, Homo sapien
agctatttgccttaagaacttactt

SEQ ID NO: 238259 - DNA, 25 bp, Homo sapien
ataatacttatctctgaaaatgtct

SEQ ID NO: 238260 - DNA, 25 bp, Homo sapien
tcacactcttaccatattaccaaat

SEQ ID NO: 238261 - DNA, 25 bp, Homo sapien
aaatctgatgggaatccaaactgat

SEQ ID NO: 238262 - DNA, 25 bp, Homo sapien
tccaaactgattccatagatttaag

SEQ ID NO: 238263 - DNA, 25 bp, Homo sapien
aatccagatcactttcctcaactgt

SEQ ID NO: 238264 - DNA, 25 bp, Homo sapien
agatcactttcctcaactgttactg

SEQ ID NO: 238265 - DNA, 25 bp, Homo sapien
ctttcctcaactgttactgccaaaa

SEQ ID NO: 238266 - DNA, 25 bp, Homo sapien
actgccaaaagaccaagtttcaggc

SEQ ID NO: 238267 - DNA, 25 bp, Homo sapien
aagtttcaggcaaagcagtgtgtct

SEQ ID NO: 238268 - DNA, 25 bp, Homo sapien
gtgtgtctgatagaagagatttcca

SEQ ID NO: 238269 - DNA, 25 bp, Homo sapien
atttccagtactgaaatccaggtgg

SEQ ID NO: 238270 - DNA, 25 bp, Homo sapien
gaagatgccagcctatgaactaaaa

SEQ ID NO: 238271 - DNA, 25 bp, Homo sapien
caccagagccggtgacggcagtgac

SEQ ID NO: 238272 - DNA, 25 bp, Homo sapien
agccggtgacggcagtgaccaaaca

SEQ ID NO: 238273 - DNA, 25 bp, Homo sapien
agtgaccaaacagcctaaatccgaa

SEQ ID NO: 238274 - DNA, 25 bp, Homo sapien
caaacagcctaaatccgaagctggg

SEQ ID NO: 238275 - DNA, 25 bp, Homo sapien
cctctaagacggttggaatggccag

SEQ ID NO: 238276 - DNA, 25 bp, Homo sapien
gacggttggaatggccagcttatga

SEQ ID NO: 238277 - DNA, 25 bp, Homo sapien
gaatggccagcttatgaaggcaaat

SEQ ID NO: 238278 - DNA, 25 bp, Homo sapien
gaaggcaaatttccactcgcattat

SEQ ID NO: 238279 - DNA, 25 bp, Homo sapien
ggcaaatttccactcgcattattta

SEQ ID NO: 238280 - DNA, 25 bp, Homo sapien
aatttccactcgcattatttaatga

SEQ ID NO: 238281 - DNA, 25 bp, Homo sapien
gccaaacatttaaagctagagacgg

SEQ ID NO: 238282 - DNA, 25 bp, Homo sapien
tatatttccaagatattctgggatc

SEQ ID NO: 238283 - DNA, 25 bp, Homo sapien
ttccaagatattctgggatctttac

SEQ ID NO: 238284 - DNA, 25 bp, Homo sapien
tagcgtgtatctcctgagcggtaca

SEQ ID NO: 238285 - DNA, 25 bp, Homo sapien
tacagtttcataattttgctctttt

SEQ ID NO: 238286 - DNA, 25 bp, Homo sapien
gtgtatctcctgagcggtacagatg

SEQ ID NO: 238287 - DNA, 25 bp, Homo sapien
agtcagacagacctagtctggattt

SEQ ID NO: 238288 - DNA, 25 bp, Homo sapien
acagacctagtctggatttgaattc

SEQ ID NO: 238289 - DNA, 25 bp, Homo sapien
ttgaattccagctctccttcttacc

SEQ ID NO: 238290 - DNA, 25 bp, Homo sapien
ctcctgagcggtacagatgaactat

SEQ ID NO: 238291 - DNA, 25 bp, Homo sapien
gaactatgtaaagcatttggcccaa

SEQ ID NO: 238292 - DNA, 25 bp, Homo sapien
aagcatttggcccaatgcctggcac

SEQ ID NO: 238293 - DNA, 25 bp, Homo sapien
tgtctcccagttccagggcagccgg

SEQ ID NO: 238294 - DNA, 25 bp, Homo sapien
tcaatttcccagacccggaggccgg

SEQ ID NO: 238295 - DNA, 25 bp, Homo sapien
ggaggagcctgggttagtgcagcca

SEQ ID NO: 238296 - DNA, 25 bp, Homo sapien
gttagtgcagccaggtcgaagcccc

SEQ ID NO: 238297 - DNA, 25 bp, Homo sapien
agtgcagccaggtcgaagccccagc

SEQ ID NO: 238298 - DNA, 25 bp, Homo sapien
acactccgggcaacgctcggtggca

SEQ ID NO: 238299 - DNA, 25 bp, Homo sapien
actttattcactaacacgggccgag

SEQ ID NO: 238300 - DNA, 25 bp, Homo sapien
ttattcactaacacgggccgaggga

SEQ ID NO: 238301 - DNA, 25 bp, Homo sapien
ctaacacgggccgagggaatgtagt

SEQ ID NO: 238302 - DNA, 25 bp, Homo sapien
gtgggcactgtttccagggaccccg

SEQ ID NO: 238303 - DNA, 25 bp, Homo sapien
ggcactgtttccagggaccccggca

SEQ ID NO: 238304 - DNA, 25 bp, Homo sapien
ttcctcacatgtatgtacaactaaa

SEQ ID NO: 238305 - DNA, 25 bp, Homo sapien
atttttaagcccaaagacaactgat

SEQ ID NO: 238306 - DNA, 25 bp, Homo sapien
ttgccatttctcttgtaattttcta

SEQ ID NO: 238307 - DNA, 25 bp, Homo sapien
catctgagcactaaattcttattaa

SEQ ID NO: 238308 - DNA, 25 bp, Homo sapien
gtaattttctagtgtttagttctat

SEQ ID NO: 238309 - DNA, 25 bp, Homo sapien
actattataatgcaacctcaaaaga

SEQ ID NO: 238310 - DNA, 25 bp, Homo sapien
gcaacctcaaaagattggactctat

SEQ ID NO: 238311 - DNA, 25 bp, Homo sapien
agattggactctattaaagttgatg

SEQ ID NO: 238312 - DNA, 25 bp, Homo sapien
caaaagttgtattggcaggcaaaac

SEQ ID NO: 238313 - DNA, 25 bp, Homo sapien
ggcaggcaaaacaaaaattgctctt

SEQ ID NO: 238314 - DNA, 25 bp, Homo sapien
attttttgcatgaacttccattatg

SEQ ID NO: 238315 - DNA, 25 bp, Homo sapien
gcatatgggtttggttccacttgta

SEQ ID NO: 238316 - DNA, 25 bp, Homo sapien
ggtttggttccacttgtagagaata

SEQ ID NO: 238317 - DNA, 25 bp, Homo sapien
aatgttcacaacttactggtattag

SEQ ID NO: 238318 - DNA, 25 bp, Homo sapien
tactggtattagcacacacacatca

SEQ ID NO: 238319 - DNA, 25 bp, Homo sapien
tggtgttttcttgccacttactctt

SEQ ID NO: 238320 - DNA, 25 bp, Homo sapien
tcttgccacttactctttctcataa

SEQ ID NO: 238321 - DNA, 25 bp, Homo sapien
gccacttactctttctcataagatg

SEQ ID NO: 238322 - DNA, 25 bp, Homo sapien
ttctcataagatgcttatattcctg

SEQ ID NO: 238323 - DNA, 25 bp, Homo sapien
gtgcaagagcttgtgtttctccaac

SEQ ID NO: 238324 - DNA, 25 bp, Homo sapien
agagcttgtgtttctccaactctgg

SEQ ID NO: 238325 - DNA, 25 bp, Homo sapien
ggaatgcaggttttagggttaggct

SEQ ID NO: 238326 - DNA, 25 bp, Homo sapien
tatggagggtttcacaggctcatgt

SEQ ID NO: 238327 - DNA, 25 bp, Homo sapien
atgtgtggcttcttcagtcctctct

SEQ ID NO: 238328 - DNA, 25 bp, Homo sapien
attcatttattcaacgacatattac

SEQ ID NO: 238329 - DNA, 25 bp, Homo sapien
acgacatattactaaggaacctcct

SEQ ID NO: 238330 - DNA, 25 bp, Homo sapien
gaacctccttaagccgggatgctga

SEQ ID NO: 238331 - DNA, 25 bp, Homo sapien
gaacgtggaaaaatagttgactctt

SEQ ID NO: 238332 - DNA, 25 bp, Homo sapien
gcgtcccgttagaatgacagggctt

SEQ ID NO: 238333 - DNA, 25 bp, Homo sapien
gacagggcttttgcaaaagtctgac

SEQ ID NO: 238334 - DNA, 25 bp, Homo sapien
tgcaaaagtctgacacccgtggcac

SEQ ID NO: 238335 - DNA, 25 bp, Homo sapien
agtctgacacccgtggcacagagcg

SEQ ID NO: 238336 - DNA, 25 bp, Homo sapien
acagagcgccccagatatggagggt

SEQ ID NO: 238337 - DNA, 25 bp, Homo sapien
gttggctgacgaaaccccttctcta

SEQ ID NO: 238338 - DNA, 25 bp, Homo sapien
cccttctctacaattgatgaaaaag

SEQ ID NO: 238339 - DNA, 25 bp, Homo sapien
aaaagatgatctgggccgggcacgc

SEQ ID NO: 238340 - DNA, 25 bp, Homo sapien
ccccgtctctctgaaaaatagaacg

SEQ ID NO: 238341 - DNA, 25 bp, Homo sapien
tgaaaaatagaacgattagccgggc

SEQ ID NO: 238342 - DNA, 25 bp, Homo sapien
gcctggtggcgtgggcttggaatca

SEQ ID NO: 238343 - DNA, 25 bp, Homo sapien
gcgtgggcttggaatcacgaccgct

SEQ ID NO: 238344 - DNA, 25 bp, Homo sapien
gtgggcttggaatcacgaccgctcg

SEQ ID NO: 238345 - DNA, 25 bp, Homo sapien
gcttggaatcacgaccgctcgggag

SEQ ID NO: 238346 - DNA, 25 bp, Homo sapien
ttggaatcacgaccgctcgggagac

SEQ ID NO: 238347 - DNA, 25 bp, Homo sapien
aatcacgaccgctcgggagactggg

SEQ ID NO: 238348 - DNA, 25 bp, Homo sapien
tgagtggtgctcagtaaaccctttg

SEQ ID NO: 238349 - DNA, 25 bp, Homo sapien
ggtgctcagtaaaccctttggtatc

SEQ ID NO: 238350 - DNA, 25 bp, Homo sapien
taaaccctttggtatcagtagtttg

SEQ ID NO: 238351 - DNA, 25 bp, Homo sapien
atcagtagtttgtcagctctagcac

SEQ ID NO: 238352 - DNA, 25 bp, Homo sapien
gtttgtcagctctagcacaattgga

SEQ ID NO: 238353 - DNA, 25 bp, Homo sapien
gctctagcacaattggagcttgtgt

SEQ ID NO: 238354 - DNA, 25 bp, Homo sapien
gcttgtgtgggaagccatttcactc

SEQ ID NO: 238355 - DNA, 25 bp, Homo sapien
ggctgtaactgaggagaaggataac

SEQ ID NO: 238356 - DNA, 25 bp, Homo sapien
catgtggttttctttatgagcaatt

SEQ ID NO: 238357 - DNA, 25 bp, Homo sapien
tatgagcaatttaaggacacgttct

SEQ ID NO: 238358 - DNA, 25 bp, Homo sapien
aaggacacgttcttccaaagagaga

SEQ ID NO: 238359 - DNA, 25 bp, Homo sapien
atgaacgctcttctatttcttgtca

SEQ ID NO: 238360 - DNA, 25 bp, Homo sapien
gctcttctatttcttgtcattacca

SEQ ID NO: 238361 - DNA, 25 bp, Homo sapien
attaccaagccaattacttttgcca

SEQ ID NO: 238362 - DNA, 25 bp, Homo sapien
gtgatctgccctgattaagatgaat

SEQ ID NO: 238363 - DNA, 25 bp, Homo sapien
gcaattatcaaagcgggctgggtcc

SEQ ID NO: 238364 - DNA, 25 bp, Homo sapien
aagcgggctgggtcccatcagaacg

SEQ ID NO: 238365 - DNA, 25 bp, Homo sapien
atcagaacgacccacatctttctgt

SEQ ID NO: 238366 - DNA, 25 bp, Homo sapien
atctttctgtgggtgtgaatgtcat

SEQ ID NO: 238367 - DNA, 25 bp, Homo sapien
gtgaatgtcattaggtcttgcgctg

SEQ ID NO: 238368 - DNA, 25 bp, Homo sapien
tcattaggtcttgcgctgacccctg

SEQ ID NO: 238369 - DNA, 25 bp, Homo sapien
catttcttactcttctgtgttttaa

SEQ ID NO: 238370 - DNA, 25 bp, Homo sapien
tcaagtgtttcagaattgttggaac

SEQ ID NO: 238371 - DNA, 25 bp, Homo sapien
ggacgtgatgaaccagatattgctt

SEQ ID NO: 238372 - DNA, 25 bp, Homo sapien
gaaccagatattgcttctaaaattc

SEQ ID NO: 238373 - DNA, 25 bp, Homo sapien
ttttgagtgctcagatgcaacggat

SEQ ID NO: 238374 - DNA, 25 bp, Homo sapien
ggaagtagaaaacccaaattatgct

SEQ ID NO: 238375 - DNA, 25 bp, Homo sapien
atgctttaacaagccgttttcgtca

SEQ ID NO: 238376 - DNA, 25 bp, Homo sapien
aagccgttttcgtcaaattgaagtg

SEQ ID NO: 238377 - DNA, 25 bp, Homo sapien
attgaagtgcttactactgtggcca

SEQ ID NO: 238378 - DNA, 25 bp, Homo sapien
agtgcttactactgtggccaatgcg

SEQ ID NO: 238379 - DNA, 25 bp, Homo sapien
tactactgtggccaatgcgttttct

SEQ ID NO: 238380 - DNA, 25 bp, Homo sapien
ggccaatgcgttttcttctttatat

SEQ ID NO: 238381 - DNA, 25 bp, Homo sapien
tgatccacccagttctttaggcaac

SEQ ID NO: 238382 - DNA, 25 bp, Homo sapien
aggcaaccactgatagcattttctt

SEQ ID NO: 238383 - DNA, 25 bp, Homo sapien
attcttccagatatcgtctatgcat

SEQ ID NO: 238384 - DNA, 25 bp, Homo sapien
aatatatcatacttgctggtttgca

SEQ ID NO: 238385 - DNA, 25 bp, Homo sapien
atacttgctggtttgcaccttgctt

SEQ ID NO: 238386 - DNA, 25 bp, Homo sapien
aatgacctaatgtgcaaatttttgc

SEQ ID NO: 238387 - DNA, 25 bp, Homo sapien
gcaaatttttgcatctgccctaaat

SEQ ID NO: 238388 - DNA, 25 bp, Homo sapien
ttgcatctgccctaaatatctactg

SEQ ID NO: 238389 - DNA, 25 bp, Homo sapien
atctgccctaaatatctactggttt

SEQ ID NO: 238390 - DNA, 25 bp, Homo sapien
gtgtctatactatttgcaagcagta

SEQ ID NO: 238391 - DNA, 25 bp, Homo sapien
ttgcaagcagtatgtgtcagtagac

SEQ ID NO: 238392 - DNA, 25 bp, Homo sapien
gattttctgctaaagttgggtccat

SEQ ID NO: 238393 - DNA, 25 bp, Homo sapien
taaagttgggtccatggccatccag

SEQ ID NO: 238394 - DNA, 25 bp, Homo sapien
atccagcacctgtaaggccggcagg

SEQ ID NO: 238395 - DNA, 25 bp, Homo sapien
taaggccggcaggagcgtctgccct

SEQ ID NO: 238396 - DNA, 25 bp, Homo sapien
tgccctctactcagttaaagcctga

SEQ ID NO: 238397 - DNA, 25 bp, Homo sapien
taaagcctgaagtcgtttcctttcg

SEQ ID NO: 238398 - DNA, 25 bp, Homo sapien
tgaagtcgtttcctttcgatggccc

SEQ ID NO: 238399 - DNA, 25 bp, Homo sapien
ttcgatggcccttaggaggcccaaa

SEQ ID NO: 238400 - DNA, 25 bp, Homo sapien
ggtccactggtgtttggtgtaccca

SEQ ID NO: 238401 - DNA, 25 bp, Homo sapien
ggtgtacccatgtgactaatttgtc

SEQ ID NO: 238402 - DNA, 25 bp, Homo sapien
ggaatattccagttggtgactgacc

SEQ ID NO: 238403 - DNA, 25 bp, Homo sapien
aatacaaacattgcctagctgctgc

SEQ ID NO: 238404 - DNA, 25 bp, Homo sapien
aaacattgcctagctgctgccattt

SEQ ID NO: 238405 - DNA, 25 bp, Homo sapien
gccatttctgtaactgcccagaagg

SEQ ID NO: 238406 - DNA, 25 bp, Homo sapien
aggattcagatatgaccttttcttt

SEQ ID NO: 238407 - DNA, 25 bp, Homo sapien
gatatgaccttttctttagtcccaa

SEQ ID NO: 238408 - DNA, 25 bp, Homo sapien
tcccaaccactagttttaacaaatg

SEQ ID NO: 238409 - DNA, 25 bp, Homo sapien
atacatttaaactgtcttgttcagc

SEQ ID NO: 238410 - DNA, 25 bp, Homo sapien
gtcttgttcagcataccaatattgt

SEQ ID NO: 238411 - DNA, 25 bp, Homo sapien
caaatcatcatttctaaatctggat

SEQ ID NO: 238412 - DNA, 25 bp, Homo sapien
atctggattgattctgttgtgtttt

SEQ ID NO: 238413 - DNA, 25 bp, Homo sapien
ctgttgtgtttttgactgtttctaa

SEQ ID NO: 238414 - DNA, 25 bp, Homo sapien
gcattctataattggcagcatctta

SEQ ID NO: 238415 - DNA, 25 bp, Homo sapien
ggcagcatcttagatctgaggaagt

SEQ ID NO: 238416 - DNA, 25 bp, Homo sapien
gtatgatacttgtttgacggaatgg

SEQ ID NO: 238417 - DNA, 25 bp, Homo sapien
tgacggaatggttgacggcagaatt

SEQ ID NO: 238418 - DNA, 25 bp, Homo sapien
aaagctatatcttcactgtatttta

SEQ ID NO: 238419 - DNA, 25 bp, Homo sapien
agaaattgttaagatcccccacctg

SEQ ID NO: 238420 - DNA, 25 bp, Homo sapien
ggacccagtacaaaataggcactca

SEQ ID NO: 238421 - DNA, 25 bp, Homo sapien
ggcactcaatagatgttacaccaac

SEQ ID NO: 238422 - DNA, 25 bp, Homo sapien
ggaagggcaaacatatttcttaatg

SEQ ID NO: 238423 - DNA, 25 bp, Homo sapien
atttcttaatgagaggcagtccttc

SEQ ID NO: 238424 - DNA, 25 bp, Homo sapien
gaggcagtccttcatgttttgcaat

SEQ ID NO: 238425 - DNA, 25 bp, Homo sapien
gatgtaagtctgctcaatatggtct

SEQ ID NO: 238426 - DNA, 25 bp, Homo sapien
tgctcaatatggtcttgctctcaga

SEQ ID NO: 238427 - DNA, 25 bp, Homo sapien
ggtcttgctctcagaatatgtttct

SEQ ID NO: 238428 - DNA, 25 bp, Homo sapien
gtttcttgcctttttgatgctttag

SEQ ID NO: 238429 - DNA, 25 bp, Homo sapien
gatgctttagaaggctttcaaggta

SEQ ID NO: 238430 - DNA, 25 bp, Homo sapien
acaactgtctgatttaggatcctac

SEQ ID NO: 238431 - DNA, 25 bp, Homo sapien
ggatcctacatggacttggtatata

SEQ ID NO: 238432 - DNA, 25 bp, Homo sapien
ggacttggtatatagtgtcacttac

SEQ ID NO: 238433 - DNA, 25 bp, Homo sapien
ttggaagcaactctgtgatcatcta

SEQ ID NO: 238434 - DNA, 25 bp, Homo sapien
gtgatcatctagtccatctagtcta

SEQ ID NO: 238435 - DNA, 25 bp, Homo sapien
catctagtctacacccttcctttta

SEQ ID NO: 238436 - DNA, 25 bp, Homo sapien
ttgcagcccggggtgtgcagctgtg

SEQ ID NO: 238437 - DNA, 25 bp, Homo sapien
cagctgtggcgtggaggtgggtggt

SEQ ID NO: 238438 - DNA, 25 bp, Homo sapien
agctgtggcgtggaggtgggtggtg

SEQ ID NO: 238439 - DNA, 25 bp, Homo sapien
gtgggtggtgctgggagagacttgc

SEQ ID NO: 238440 - DNA, 25 bp, Homo sapien
tgggtggtgctgggagagacttgca

SEQ ID NO: 238441 - DNA, 25 bp, Homo sapien
gaagctcctgtgaaggggactcagc

SEQ ID NO: 238442 - DNA, 25 bp, Homo sapien
aagctcctgtgaaggggactcagct

SEQ ID NO: 238443 - DNA, 25 bp, Homo sapien
agctcctgtgaaggggactcagctg

SEQ ID NO: 238444 - DNA, 25 bp, Homo sapien
tgtgaaggggactcagctgccacat

SEQ ID NO: 238445 - DNA, 25 bp, Homo sapien
tgaaggggactcagctgccacatgc

SEQ ID NO: 238446 - DNA, 25 bp, Homo sapien
gaaggggactcagctgccacatgca

SEQ ID NO: 238447 - DNA, 25 bp, Homo sapien
ggaaatgccaagtacgccaacatgt

SEQ ID NO: 238448 - DNA, 25 bp, Homo sapien
gtggctagagtattacaacctggaa

SEQ ID NO: 238449 - DNA, 25 bp, Homo sapien
gaaagagctcatggtgacacccagc

SEQ ID NO: 238450 - DNA, 25 bp, Homo sapien
atggtgacacccagcactgccggaa

SEQ ID NO: 238451 - DNA, 25 bp, Homo sapien
agcactgccggaaggctctgcaccg

SEQ ID NO: 238452 - DNA, 25 bp, Homo sapien
gggccgtccagtgcaccagtgacta

SEQ ID NO: 238453 - DNA, 25 bp, Homo sapien
agtgactacccagagcacgtctgcg

SEQ ID NO: 238454 - DNA, 25 bp, Homo sapien
gcacgtctgcgaagtgttactcacc

SEQ ID NO: 238455 - DNA, 25 bp, Homo sapien
aagattgggatatagctgttcagaa

SEQ ID NO: 238456 - DNA, 25 bp, Homo sapien
gaaacccgattagctcgtgtcaatg

SEQ ID NO: 238457 - DNA, 25 bp, Homo sapien
aagcagcccttgtgcagcaagaaga

SEQ ID NO: 238458 - DNA, 25 bp, Homo sapien
ctggagagttttgtggcctgattca

SEQ ID NO: 238459 - DNA, 25 bp, Homo sapien
ggatgttgtaaagctctgtcggttc

SEQ ID NO: 238460 - DNA, 25 bp, Homo sapien
aaagctctgtcggttcacataaaag

SEQ ID NO: 238461 - DNA, 25 bp, Homo sapien
tttccgatgctcagagtcccctctg

SEQ ID NO: 238462 - DNA, 25 bp, Homo sapien
tccagggtgctgctgttgttatcat

SEQ ID NO: 238463 - DNA, 25 bp, Homo sapien
gttgttatcatacaccacgcagtac

SEQ ID NO: 238464 - DNA, 25 bp, Homo sapien
acgcagtacttcacacactccaggt

SEQ ID NO: 238465 - DNA, 25 bp, Homo sapien
tccaggtccacagactccgggagaa

SEQ ID NO: 238466 - DNA, 25 bp, Homo sapien
tttcttcttcactcgaagggcagtg

SEQ ID NO: 238467 - DNA, 25 bp, Homo sapien
gtgatcacatggctttcgtcatact

SEQ ID NO: 238468 - DNA, 25 bp, Homo sapien
gtcatactcccatttggaacggaca

SEQ ID NO: 238469 - DNA, 25 bp, Homo sapien
tcttgtgaaccatacggagcctatt

SEQ ID NO: 238470 - DNA, 25 bp, Homo sapien
gaaccatacggagcctattatttta

SEQ ID NO: 238471 - DNA, 25 bp, Homo sapien
atgatcagacaagtaaggcttctct

SEQ ID NO: 238472 - DNA, 25 bp, Homo sapien
taaggcttctcttactttgctctgc

SEQ ID NO: 238473 - DNA, 25 bp, Homo sapien
tactttgctctgctctgatcagaag

SEQ ID NO: 238474 - DNA, 25 bp, Homo sapien
gatcagaagagctcatgtgaagtct

SEQ ID NO: 238475 - DNA, 25 bp, Homo sapien
taaaactgtgtttttgagcttgaca

SEQ ID NO: 238476 - DNA, 25 bp, Homo sapien
gtgtttttgagcttgacagtactga

SEQ ID NO: 238477 - DNA, 25 bp, Homo sapien
gtgtttctgagcatcagagaccatc

SEQ ID NO: 238478 - DNA, 25 bp, Homo sapien
gagaccatctatattgccattacct

SEQ ID NO: 238479 - DNA, 25 bp, Homo sapien
attgccattaccttttctagttgta

SEQ ID NO: 238480 - DNA, 25 bp, Homo sapien
gccgcaccggtgacaagctaatgaa

SEQ ID NO: 238481 - DNA, 25 bp, Homo sapien
gcaccggtgacaagctaatgaacgc

SEQ ID NO: 238482 - DNA, 25 bp, Homo sapien
gtgacaagctaatgaacgctactct

SEQ ID NO: 238483 - DNA, 25 bp, Homo sapien
agctaatgaacgctactctgcgcgg

SEQ ID NO: 238484 - DNA, 25 bp, Homo sapien
taatgaacgctactctgcgcggctc

SEQ ID NO: 238485 - DNA, 25 bp, Homo sapien
atgaacgctactctgcgcggctccg

SEQ ID NO: 238486 - DNA, 25 bp, Homo sapien
actgttctggccctccgcttttgct

SEQ ID NO: 238487 - DNA, 25 bp, Homo sapien
ttttgctcgagccggcgctcgcttc

SEQ ID NO: 238488 - DNA, 25 bp, Homo sapien
ctcagcccgggaaggctcgcggtac

SEQ ID NO: 238489 - DNA, 25 bp, Homo sapien
gaaggctcgcggtacggctgcggct

SEQ ID NO: 238490 - DNA, 25 bp, Homo sapien
gggtactcgggctcacgctcgggcc

SEQ ID NO: 238491 - DNA, 25 bp, Homo sapien
agccggtgacggcagtgaccaaaca

SEQ ID NO: 238492 - DNA, 25 bp, Homo sapien
agtgaccaaacagcctaaatccgaa

SEQ ID NO: 238493 - DNA, 25 bp, Homo sapien
caaacagcctaaatccgaagctggg

SEQ ID NO: 238494 - DNA, 25 bp, Homo sapien
cctctaagacggttggaatggccag

SEQ ID NO: 238495 - DNA, 25 bp, Homo sapien
gacggttggaatggccagcttatga

SEQ ID NO: 238496 - DNA, 25 bp, Homo sapien
gaatggccagcttatgaaggcaaat

SEQ ID NO: 238497 - DNA, 25 bp, Homo sapien
gaaggcaaatttccactcgcattat

SEQ ID NO: 238498 - DNA, 25 bp, Homo sapien
aatttccactcgcattatttaatga

SEQ ID NO: 238499 - DNA, 25 bp, Homo sapien
gggagagttgtggatttcataaagc

SEQ ID NO: 238500 - DNA, 25 bp, Homo sapien
gccaaacatttaaagctagagacgg

SEQ ID NO: 238501 - DNA, 25 bp, Homo sapien
ttgtacttttctgccgagagggacc

SEQ ID NO: 238502 - DNA, 25 bp, Homo sapien
tagggaagcatatatactgtaggga

SEQ ID NO: 238503 - DNA, 25 bp, Homo sapien
tcccacatcccaataactcttggaa

SEQ ID NO: 238504 - DNA, 25 bp, Homo sapien
aataactcttggaagtctggtgctc

SEQ ID NO: 238505 - DNA, 25 bp, Homo sapien
tctggtgctccctctaggtgaaaat

SEQ ID NO: 238506 - DNA, 25 bp, Homo sapien
ggtgaaaatcatttgctggcttatg

SEQ ID NO: 238507 - DNA, 25 bp, Homo sapien
atttgctggcttatggagtcactgt

SEQ ID NO: 238508 - DNA, 25 bp, Homo sapien
atggagtcactgttgctgagtccca

SEQ ID NO: 238509 - DNA, 25 bp, Homo sapien
atagtgcaagcaacatgccatttca

SEQ ID NO: 238510 - DNA, 25 bp, Homo sapien
tgccatttcaaatccgtagacttgt

SEQ ID NO: 238511 - DNA, 25 bp, Homo sapien
gacttgtttctttgatactcttgct

SEQ ID NO: 238512 - DNA, 25 bp, Homo sapien
atactcttgctgtaggtcgccgtga

SEQ ID NO: 238513 - DNA, 25 bp, Homo sapien
tttcttccagtaaaatgtgatgcat

SEQ ID NO: 238514 - DNA, 25 bp, Homo sapien
aagatcattttccatacgctgcaca

SEQ ID NO: 238515 - DNA, 25 bp, Homo sapien
atacgctgcacataagtgtccgttt

SEQ ID NO: 238516 - DNA, 25 bp, Homo sapien
taagtgtccgtttgcattccagaag

SEQ ID NO: 238517 - DNA, 25 bp, Homo sapien
gaaggatgttcacgtcccagtatgc

SEQ ID NO: 238518 - DNA, 25 bp, Homo sapien
tcccagtatgcccactctgtaatac

SEQ ID NO: 238519 - DNA, 25 bp, Homo sapien
aaaagggccagataccagacgtggt

SEQ ID NO: 238520 - DNA, 25 bp, Homo sapien
agacgtggtggttggtgatcacatt

SEQ ID NO: 238521 - DNA, 25 bp, Homo sapien
tggtgatcacattgacagagactgt

SEQ ID NO: 238522 - DNA, 25 bp, Homo sapien
agagactgtgactctcaccctggga

SEQ ID NO: 238523 - DNA, 25 bp, Homo sapien
ataccgttgctcaaaagagggctgc

SEQ ID NO: 238524 - DNA, 25 bp, Homo sapien
gcctgaaagaagctccgggtgccca

SEQ ID NO: 238525 - DNA, 25 bp, Homo sapien
agaagctccgggtgcccattgttca

SEQ ID NO: 238526 - DNA, 25 bp, Homo sapien
cgggtgcccattgttcagtccaggt

SEQ ID NO: 238527 - DNA, 25 bp, Homo sapien
attgttcagtccaggtgcccattgt

SEQ ID NO: 238528 - DNA, 25 bp, Homo sapien
aggtgcccattgttcccgggactga

SEQ ID NO: 238529 - DNA, 25 bp, Homo sapien
aaagggaagcgacgtggcagggcca

SEQ ID NO: 238530 - DNA, 25 bp, Homo sapien
agcagcagaccctgggcctttctct

SEQ ID NO: 238531 - DNA, 25 bp, Homo sapien
gggcctttctctagactgagcacca

SEQ ID NO: 238532 - DNA, 25 bp, Homo sapien
agactgagcaccattccccgtgggt

SEQ ID NO: 238533 - DNA, 25 bp, Homo sapien
cagccacaccccaagtctgtaaggg

SEQ ID NO: 238534 - DNA, 25 bp, Homo sapien
acaccccaagtctgtaagggccgct

SEQ ID NO: 238535 - DNA, 25 bp, Homo sapien
tgccgaggagaataaggccatccag

SEQ ID NO: 238536 - DNA, 25 bp, Homo sapien
ggatgtggccaaagacactgccttc

SEQ ID NO: 238537 - DNA, 25 bp, Homo sapien
tggccaaagacactgccttcctggg

SEQ ID NO: 238538 - DNA, 25 bp, Homo sapien
aggccagttcatgtacttgacgggc

SEQ ID NO: 238539 - DNA, 25 bp, Homo sapien
ggaggctgacctacagcaactggaa

SEQ ID NO: 238540 - DNA, 25 bp, Homo sapien
agaaggatgagccaaatgaccacgg

SEQ ID NO: 238541 - DNA, 25 bp, Homo sapien
ggaggactgcgttattctcctgaac

SEQ ID NO: 238542 - DNA, 25 bp, Homo sapien
gctctggaatggcatctcctgcacc

SEQ ID NO: 238543 - DNA, 25 bp, Homo sapien
ctccttcattgccatctgtgagttt

SEQ ID NO: 238544 - DNA, 25 bp, Homo sapien
catctgtgagtttcctgcctgaaga

SEQ ID NO: 238545 - DNA, 25 bp, Homo sapien
ttcctgcctgaagaggcacgttcct

SEQ ID NO: 238546 - DNA, 25 bp, Homo sapien
ttttatgaaacttgataccacggga

SEQ ID NO: 238547 - DNA, 25 bp, Homo sapien
aaacttgataccacgggagtccagt

SEQ ID NO: 238548 - DNA, 25 bp, Homo sapien
acgggagtccagtaatattggccac

SEQ ID NO: 238549 - DNA, 25 bp, Homo sapien
aatattggccacaaaagccagagaa

SEQ ID NO: 238550 - DNA, 25 bp, Homo sapien
gccagagaaagtaccaagcccagct

SEQ ID NO: 238551 - DNA, 25 bp, Homo sapien
gtaccaagcccagctttgttatcat

SEQ ID NO: 238552 - DNA, 25 bp, Homo sapien
gcccagctttgttatcatagccact

SEQ ID NO: 238553 - DNA, 25 bp, Homo sapien
tttgttatcatagccacttcctgcc

SEQ ID NO: 238554 - DNA, 25 bp, Homo sapien
ctgccctgcttctgttatttttagt

SEQ ID NO: 238555 - DNA, 25 bp, Homo sapien
gggtccaggaaatcctcaccagaat

SEQ ID NO: 238556 - DNA, 25 bp, Homo sapien
aggaaatcctcaccagaatctggca

SEQ ID NO: 238557 - DNA, 25 bp, Homo sapien
tttgtgacaagacttttgggagtga

SEQ ID NO: 238558 - DNA, 25 bp, Homo sapien
aagacttttgggagtgattcacacc

SEQ ID NO: 238559 - DNA, 25 bp, Homo sapien
acttttgggagtgattcacacctga

SEQ ID NO: 238560 - DNA, 25 bp, Homo sapien
gagtgattcacacctgaaacaacat

SEQ ID NO: 238561 - DNA, 25 bp, Homo sapien
attcacacctgaaacaacatactgg

SEQ ID NO: 238562 - DNA, 25 bp, Homo sapien
acacctgaaacaacatactggactt

SEQ ID NO: 238563 - DNA, 25 bp, Homo sapien
tgaaacaacatactggacttcacac

SEQ ID NO: 238564 - DNA, 25 bp, Homo sapien
aacaacatactggacttcacactgg

SEQ ID NO: 238565 - DNA, 25 bp, Homo sapien
aaagcctttagcaagcagtcaacac

SEQ ID NO: 238566 - DNA, 25 bp, Homo sapien
tcacaactttcacttcatcatagaa

SEQ ID NO: 238567 - DNA, 25 bp, Homo sapien
acttcatcatagaattcatgctggg

SEQ ID NO: 238568 - DNA, 25 bp, Homo sapien
aatcttcatttaactcaggagacaa

SEQ ID NO: 238569 - DNA, 25 bp, Homo sapien
gacaaggaatcattaacaggtttta

SEQ ID NO: 238570 - DNA, 25 bp, Homo sapien
tgctcacaactaccacaattcaaaa

SEQ ID NO: 238571 - DNA, 25 bp, Homo sapien
aaaaaacgacgtctagcatatgaaa

SEQ ID NO: 238572 - DNA, 25 bp, Homo sapien
cgtctagcatatgaaaaagtccctg

SEQ ID NO: 238573 - DNA, 25 bp, Homo sapien
aagtccctggtagagttgatgggca

SEQ ID NO: 238574 - DNA, 25 bp, Homo sapien
gcaatgttacatgccatattccact

SEQ ID NO: 238575 - DNA, 25 bp, Homo sapien
tgccatattccactgtttttgatgc

SEQ ID NO: 238576 - DNA, 25 bp, Homo sapien
gatgctaatccactagcgcaattat

SEQ ID NO: 238577 - DNA, 25 bp, Homo sapien
tagatttgctcatacactaaagaaa

SEQ ID NO: 238578 - DNA, 25 bp, Homo sapien
acacaattgttcatatatgtctcag

SEQ ID NO: 238579 - DNA, 25 bp, Homo sapien
aggctcaattctcagacatcggagt

SEQ ID NO: 238580 - DNA, 25 bp, Homo sapien
agacatcggagtaatccacatcctc

SEQ ID NO: 238581 - DNA, 25 bp, Homo sapien
gtaatccacatcctccatcttgagt

SEQ ID NO: 238582 - DNA, 25 bp, Homo sapien
atcttgagttactcctcacaaggcc

SEQ ID NO: 238583 - DNA, 25 bp, Homo sapien
tcacaaggcctgcaagttttcctag

SEQ ID NO: 238584 - DNA, 25 bp, Homo sapien
ggcctgcaagttttcctaggaggaa

SEQ ID NO: 238585 - DNA, 25 bp, Homo sapien
atacctattgtgagatgtggcctgg

SEQ ID NO: 238586 - DNA, 25 bp, Homo sapien
gggttgaacccacacaattctagaa

SEQ ID NO: 238587 - DNA, 25 bp, Homo sapien
gatttctaaaccatttctgtaagtc

SEQ ID NO: 238588 - DNA, 25 bp, Homo sapien
ttctgtaagtcagcccttgagaact

SEQ ID NO: 238589 - DNA, 25 bp, Homo sapien
agattgcctggccaggctcactcac

SEQ ID NO: 238590 - DNA, 25 bp, Homo sapien
tacgtccagctccaacggcactggt

SEQ ID NO: 238591 - DNA, 25 bp, Homo sapien
tggtgccccattccatcggcactaa

SEQ ID NO: 238592 - DNA, 25 bp, Homo sapien
ggcactaacgccctgcttcattggc

SEQ ID NO: 238593 - DNA, 25 bp, Homo sapien
taacgccctgcttcattggcacttt

SEQ ID NO: 238594 - DNA, 25 bp, Homo sapien
tgcttcattggcactttgctgctgc

SEQ ID NO: 238595 - DNA, 25 bp, Homo sapien
ttcattggcactttgctgctgcctc

SEQ ID NO: 238596 - DNA, 25 bp, Homo sapien
tttgctgctgcctcctgagcactgc

SEQ ID NO: 238597 - DNA, 25 bp, Homo sapien
gccttccatgaacagggacagacca

SEQ ID NO: 238598 - DNA, 25 bp, Homo sapien
catgaacagggacagaccagaggcc

SEQ ID NO: 238599 - DNA, 25 bp, Homo sapien
agaccagaggccctgcaaggactcc

SEQ ID NO: 238600 - DNA, 25 bp, Homo sapien
ctcagacctccaaagggcaacagaa

SEQ ID NO: 238601 - DNA, 25 bp, Homo sapien
caagttgtaagggaagccattttag

SEQ ID NO: 238602 - DNA, 25 bp, Homo sapien
gaagccattttagaagacttgcaga

SEQ ID NO: 238603 - DNA, 25 bp, Homo sapien
aggtcaaagccatttttcttcatcc

SEQ ID NO: 238604 - DNA, 25 bp, Homo sapien
ttcatccagagccattttccattga

SEQ ID NO: 238605 - DNA, 25 bp, Homo sapien
gaaaatgggctcttgacaccaacat

SEQ ID NO: 238606 - DNA, 25 bp, Homo sapien
gggctcttgacaccaacattgaaag

SEQ ID NO: 238607 - DNA, 25 bp, Homo sapien
gagagctttccaaatactttcggac

SEQ ID NO: 238608 - DNA, 25 bp, Homo sapien
ttgacagcctgtatgagcacatcca

SEQ ID NO: 238609 - DNA, 25 bp, Homo sapien
atgagcacatccaggattaggataa

SEQ ID NO: 238610 - DNA, 25 bp, Homo sapien
gcccactgtgcactgcttgtgagaa

SEQ ID NO: 238611 - DNA, 25 bp, Homo sapien
gcactgcttgtgagaaaatggatta

SEQ ID NO: 238612 - DNA, 25 bp, Homo sapien
aaaatgatgccttgcagcttttatg

SEQ ID NO: 238613 - DNA, 25 bp, Homo sapien
aattgggaaaagctgtctccgaata

SEQ ID NO: 238614 - DNA, 25 bp, Homo sapien
atgccttgtccagcggtgaacattc

SEQ ID NO: 238615 - DNA, 25 bp, Homo sapien
aagggcaatcctttgagctggagag

SEQ ID NO: 238616 - DNA, 25 bp, Homo sapien
ggagagatgaccaccattcgagggt

SEQ ID NO: 238617 - DNA, 25 bp, Homo sapien
caccattcgagggtctgggatcaaa

SEQ ID NO: 238618 - DNA, 25 bp, Homo sapien
ggatcaaagccccagccagacatca

SEQ ID NO: 238619 - DNA, 25 bp, Homo sapien
gacatcaaagcccatttgagtctaa

SEQ ID NO: 238620 - DNA, 25 bp, Homo sapien
gtctaatgccaaaaaagccacagtg

SEQ ID NO: 238621 - DNA, 25 bp, Homo sapien
ggtgaacattctattgcagccaagc

SEQ ID NO: 238622 - DNA, 25 bp, Homo sapien
ggagcatcagttgcacattttgcca

SEQ ID NO: 238623 - DNA, 25 bp, Homo sapien
gtaagagtaattaaatcacatgcat

SEQ ID NO: 238624 - DNA, 25 bp, Homo sapien
gcatgggtagaaattccttgtgacc

SEQ ID NO: 238625 - DNA, 25 bp, Homo sapien
ggtagaaattccttgtgaccttttg

SEQ ID NO: 238626 - DNA, 25 bp, Homo sapien
tagaaattccttgtgaccttttgaa

SEQ ID NO: 238627 - DNA, 25 bp, Homo sapien
ttccttgtgaccttttgaaaaattg

SEQ ID NO: 238628 - DNA, 25 bp, Homo sapien
gcataattgtaaaagattgcttcct

SEQ ID NO: 238629 - DNA, 25 bp, Homo sapien
aattgcccagttagcataatatgca

SEQ ID NO: 238630 - DNA, 25 bp, Homo sapien
taaatgagccaaaaccagagttagt

SEQ ID NO: 238631 - DNA, 25 bp, Homo sapien
gccaaaaccagagttagttgcttgt

SEQ ID NO: 238632 - DNA, 25 bp, Homo sapien
accagagttagttgcttgtaaagat

SEQ ID NO: 238633 - DNA, 25 bp, Homo sapien
aaaagtgaactcacactgggtgtgg

SEQ ID NO: 238634 - DNA, 25 bp, Homo sapien
gtgggcaccgtggcgtctcttctgc

SEQ ID NO: 238635 - DNA, 25 bp, Homo sapien
taaatctcccactctctgtttctgt

SEQ ID NO: 238636 - DNA, 25 bp, Homo sapien
tgcttctccttcctgagggtttggg

SEQ ID NO: 238637 - DNA, 25 bp, Homo sapien
gtggaaggagcctgttccagcaccc

SEQ ID NO: 238638 - DNA, 25 bp, Homo sapien
ggaaggagcctgttccagcaccctt

SEQ ID NO: 238639 - DNA, 25 bp, Homo sapien
agctgcattcccacgggtggccctg

SEQ ID NO: 238640 - DNA, 25 bp, Homo sapien
cattcccacgggtggccctggagct

SEQ ID NO: 238641 - DNA, 25 bp, Homo sapien
ccctggagctggtgagctttgtctg

SEQ ID NO: 238642 - DNA, 25 bp, Homo sapien
tgagctttgtctgggcgttgtcttc

SEQ ID NO: 238643 - DNA, 25 bp, Homo sapien
tttgtctgggcgttgtcttcggctg

SEQ ID NO: 238644 - DNA, 25 bp, Homo sapien
ctgggcgttgtcttcggctggcatt

SEQ ID NO: 238645 - DNA, 25 bp, Homo sapien
gaaatatttgcatgcctagaccagg

SEQ ID NO: 238646 - DNA, 25 bp, Homo sapien
atttgcatgcctagaccaggtctaa

SEQ ID NO: 238647 - DNA, 25 bp, Homo sapien
ttaatttttccatgtcttactaagt

SEQ ID NO: 238648 - DNA, 25 bp, Homo sapien
gatacacgctatcagtgcaacttgc

SEQ ID NO: 238649 - DNA, 25 bp, Homo sapien
atcagtgcaacttgcttcttttcat

SEQ ID NO: 238650 - DNA, 25 bp, Homo sapien
actattgcacatcatttcacatcag

SEQ ID NO: 238651 - DNA, 25 bp, Homo sapien
ttcacatcagtatgtcatatcgact

SEQ ID NO: 238652 - DNA, 25 bp, Homo sapien
atatcgacttactctttttcatggc

SEQ ID NO: 238653 - DNA, 25 bp, Homo sapien
ggaatgggttcagtaatttatgcac

SEQ ID NO: 238654 - DNA, 25 bp, Homo sapien
tcagctctcctaatagacctctatg

SEQ ID NO: 238655 - DNA, 25 bp, Homo sapien
gacctctatgtctcattctgaaata

SEQ ID NO: 238656 - DNA, 25 bp, Homo sapien
atctcctccgatgactgacttcaag

SEQ ID NO: 238657 - DNA, 25 bp, Homo sapien
atgactgacttcaagcctcaactct

SEQ ID NO: 238658 - DNA, 25 bp, Homo sapien
aagtcctagctgctgccttgggaca

SEQ ID NO: 238659 - DNA, 25 bp, Homo sapien
gggacaggtcaagggcctcctgcaa

SEQ ID NO: 238660 - DNA, 25 bp, Homo sapien
ctcctgcaatctcatgcacaaactg

SEQ ID NO: 238661 - DNA, 25 bp, Homo sapien
aaactggtacccatgagcatgtggc

SEQ ID NO: 238662 - DNA, 25 bp, Homo sapien
gagcatgtggcctaagagatttatt

SEQ ID NO: 238663 - DNA, 25 bp, Homo sapien
aagagatttattgacccctctccaa

SEQ ID NO: 238664 - DNA, 25 bp, Homo sapien
ctctccaagtccttgccagaggaat

SEQ ID NO: 238665 - DNA, 25 bp, Homo sapien
gtgctcctcagcttgtcgtcaggga

SEQ ID NO: 238666 - DNA, 25 bp, Homo sapien
gtcgtcagggaggaagcagccatct

SEQ ID NO: 238667 - DNA, 25 bp, Homo sapien
gagagagtaaaatactctgccctgt

SEQ ID NO: 238668 - DNA, 25 bp, Homo sapien
gagtaaaatactctgccctgtaaaa

SEQ ID NO: 238669 - DNA, 25 bp, Homo sapien
gtaaaatactctgccctgtaaaaca

SEQ ID NO: 238670 - DNA, 25 bp, Homo sapien
aaatactctgccctgtaaaacatgg

SEQ ID NO: 238671 - DNA, 25 bp, Homo sapien
tactctgccctgtaaaacatggaag

SEQ ID NO: 238672 - DNA, 25 bp, Homo sapien
ctctgccctgtaaaacatggaagac

SEQ ID NO: 238673 - DNA, 25 bp, Homo sapien
tagataatacttaagacaactgtga

SEQ ID NO: 238674 - DNA, 25 bp, Homo sapien
caacaaaaacacaactattcctttg

SEQ ID NO: 238675 - DNA, 25 bp, Homo sapien
tattcctttgtgaccgatgaagata

SEQ ID NO: 238676 - DNA, 25 bp, Homo sapien
tcctttgtgaccgatgaagataaaa

SEQ ID NO: 238677 - DNA, 25 bp, Homo sapien
tgacatgaaaaaatgtggaagccga

SEQ ID NO: 238678 - DNA, 25 bp, Homo sapien
ttctttttggaagcagtcgcttgta

SEQ ID NO: 238679 - DNA, 25 bp, Homo sapien
agcagtcgcttgtaacctaagttgg

SEQ ID NO: 238680 - DNA, 25 bp, Homo sapien
gagataatttgaaacttacccaagt

SEQ ID NO: 238681 - DNA, 25 bp, Homo sapien
acccaagtattaaagtatcatcagc

SEQ ID NO: 238682 - DNA, 25 bp, Homo sapien
taaagtatcatcagctacattttta

SEQ ID NO: 238683 - DNA, 25 bp, Homo sapien
atttttaatgaatggatcccttgga

SEQ ID NO: 238684 - DNA, 25 bp, Homo sapien
gaagaaatcatctctcatctaccat

SEQ ID NO: 238685 - DNA, 25 bp, Homo sapien
catgattaaatttcccacagtttag

SEQ ID NO: 238686 - DNA, 25 bp, Homo sapien
tggagcacaggcataacacaggtac

SEQ ID NO: 238687 - DNA, 25 bp, Homo sapien
gcacaggcataacacaggtacccag

SEQ ID NO: 238688 - DNA, 25 bp, Homo sapien
gccccgtcatcacagcaatgacttg

SEQ ID NO: 238689 - DNA, 25 bp, Homo sapien
gctaaaagtcctttcaactcttctg

SEQ ID NO: 238690 - DNA, 25 bp, Homo sapien
aaaagtcctttcaactcttctgagc

SEQ ID NO: 238691 - DNA, 25 bp, Homo sapien
aagtcctttcaactcttctgagctt

SEQ ID NO: 238692 - DNA, 25 bp, Homo sapien
tttcaactcttctgagcttcctaag

SEQ ID NO: 238693 - DNA, 25 bp, Homo sapien
gagacacaggtgacagcagaaacag

SEQ ID NO: 238694 - DNA, 25 bp, Homo sapien
gacacaggtgacagcagaaacagtc

SEQ ID NO: 238695 - DNA, 25 bp, Homo sapien
agtcatctagcccaggacatggctt

SEQ ID NO: 238696 - DNA, 25 bp, Homo sapien
atctagcccaggacatggcttcttt

SEQ ID NO: 238697 - DNA, 25 bp, Homo sapien
tagcccaggacatggcttctttacc

SEQ ID NO: 238698 - DNA, 25 bp, Homo sapien
caggacatggcttctttacccttct

SEQ ID NO: 238699 - DNA, 25 bp, Homo sapien
acagtgattctatcttgcttgtatg

SEQ ID NO: 238700 - DNA, 25 bp, Homo sapien
tttgtttaagtctaatcactaactt

SEQ ID NO: 238701 - DNA, 25 bp, Homo sapien
cctttcttattcattgtagttacgg

SEQ ID NO: 238702 - DNA, 25 bp, Homo sapien
attcattgtagttacggcagtccca

SEQ ID NO: 238703 - DNA, 25 bp, Homo sapien
tgtagttacggcagtcccagtccta

SEQ ID NO: 238704 - DNA, 25 bp, Homo sapien
gtcctactgcacagacacagagtgt

SEQ ID NO: 238705 - DNA, 25 bp, Homo sapien
tgtcttcaggaatgtaagtaccact

SEQ ID NO: 238706 - DNA, 25 bp, Homo sapien
caggaatgtaagtaccactgagaca

SEQ ID NO: 238707 - DNA, 25 bp, Homo sapien
aatgtaagtaccactgagacaggag

SEQ ID NO: 238708 - DNA, 25 bp, Homo sapien
agaattagaggccagatgcctgtga

SEQ ID NO: 238709 - DNA, 25 bp, Homo sapien
gccagatgcctgtgaatatttgtca

SEQ ID NO: 238710 - DNA, 25 bp, Homo sapien
gatgcctgtgaatatttgtcagaat

SEQ ID NO: 238711 - DNA, 25 bp, Homo sapien
tttggttgttacagcaagacttgga

SEQ ID NO: 238712 - DNA, 25 bp, Homo sapien
gagctaccagcctctagtgggtaga

SEQ ID NO: 238713 - DNA, 25 bp, Homo sapien
attctacaatgcactggactgtccc

SEQ ID NO: 238714 - DNA, 25 bp, Homo sapien
gcactggactgtccccacaaaagaa

SEQ ID NO: 238715 - DNA, 25 bp, Homo sapien
gaatgttctgtcctgaattgttgat

SEQ ID NO: 238716 - DNA, 25 bp, Homo sapien
gtcctgaattgttgatagtgccaag

SEQ ID NO: 238717 - DNA, 25 bp, Homo sapien
ttaagaaaccctcccataagggatg

SEQ ID NO: 238718 - DNA, 25 bp, Homo sapien
gggatgttttctaggcttaaacagt

SEQ ID NO: 238719 - DNA, 25 bp, Homo sapien
ttaaacagtggcctgtatgtgtctt

SEQ ID NO: 238720 - DNA, 25 bp, Homo sapien
ctgtatgtgtctttctccttatttc

SEQ ID NO: 238721 - DNA, 25 bp, Homo sapien
gcaaaagccatgcagtatgttcata

SEQ ID NO: 238722 - DNA, 25 bp, Homo sapien
gattaaatgtcctcatccatgcaca

SEQ ID NO: 238723 - DNA, 25 bp, Homo sapien
tgtcctcatccatgcacagaatatg

SEQ ID NO: 238724 - DNA, 25 bp, Homo sapien
gcacagaatatgaatggcagcaaat

SEQ ID NO: 238725 - DNA, 25 bp, Homo sapien
aatggcagcaaatctttgtgcaaga

SEQ ID NO: 238726 - DNA, 25 bp, Homo sapien
cttattgggaaaagcctcccagtag

SEQ ID NO: 238727 - DNA, 25 bp, Homo sapien
gcctcccagtagattaattgttcat

SEQ ID NO: 238728 - DNA, 25 bp, Homo sapien
tatcaggagatttagggtaagtcat

SEQ ID NO: 238729 - DNA, 25 bp, Homo sapien
aagtcatgggttgaggtgtcagata

SEQ ID NO: 238730 - DNA, 25 bp, Homo sapien
gtacatgtatatatctaggaacttt

SEQ ID NO: 238731 - DNA, 25 bp, Homo sapien
ggaactttgtaacaacacatcttta

SEQ ID NO: 238732 - DNA, 25 bp, Homo sapien
gtacttcaatctcagtttctaaaat

SEQ ID NO: 238733 - DNA, 25 bp, Homo sapien
gaagctcttagtagttacattgtaa

SEQ ID NO: 238734 - DNA, 25 bp, Homo sapien
aagaaatcagcaagcctgcttacct

SEQ ID NO: 238735 - DNA, 25 bp, Homo sapien
agagacacaccgttccacttacagt

SEQ ID NO: 238736 - DNA, 25 bp, Homo sapien
cacttacagtatctagcttcctcga

SEQ ID NO: 238737 - DNA, 25 bp, Homo sapien
gcttcctcgactcctttgttaaaat

SEQ ID NO: 238738 - DNA, 25 bp, Homo sapien
gagccgttttattgagcagtttcct

SEQ ID NO: 238739 - DNA, 25 bp, Homo sapien
agcagtttcctccagggatgacggc

SEQ ID NO: 238740 - DNA, 25 bp, Homo sapien
gatgacggctgtcagtgtgtttcct

SEQ ID NO: 238741 - DNA, 25 bp, Homo sapien
tgtgtttcctgccagttttccagtc

SEQ ID NO: 238742 - DNA, 25 bp, Homo sapien
ttcattctgtactcttggcagagtc

SEQ ID NO: 238743 - DNA, 25 bp, Homo sapien
ggcagagtcagtaaccaaccactaa

SEQ ID NO: 238744 - DNA, 25 bp, Homo sapien
tggtgtatacagtggaacatgatct

SEQ ID NO: 238745 - DNA, 25 bp, Homo sapien
gaatctctcatgaggtagtacacag

SEQ ID NO: 238746 - DNA, 25 bp, Homo sapien
tctctcatgaggtagtacacagatt

SEQ ID NO: 238747 - DNA, 25 bp, Homo sapien
gaggtagtacacagattgaagccta

SEQ ID NO: 238748 - DNA, 25 bp, Homo sapien
ggtagtacacagattgaagcctaaa

SEQ ID NO: 238749 - DNA, 25 bp, Homo sapien
gtacacagattgaagcctaaatatg

SEQ ID NO: 238750 - DNA, 25 bp, Homo sapien
taaatatgttgctatcccttcataa

SEQ ID NO: 238751 - DNA, 25 bp, Homo sapien
aatatgttgctatcccttcataaaa

SEQ ID NO: 238752 - DNA, 25 bp, Homo sapien
atatgttgctatcccttcataaaaa

SEQ ID NO: 238753 - DNA, 25 bp, Homo sapien
atgttgctatcccttcataaaaata

SEQ ID NO: 238754 - DNA, 25 bp, Homo sapien
gttgctatcccttcataaaaataat

SEQ ID NO: 238755 - DNA, 25 bp, Homo sapien
gagctgagttacgtacccagtatca

SEQ ID NO: 238756 - DNA, 25 bp, Homo sapien
acccagtatcacactcacagttaga

SEQ ID NO: 238757 - DNA, 25 bp, Homo sapien
ccttctccccagctaagaatgtgtg

SEQ ID NO: 238758 - DNA, 25 bp, Homo sapien
aagaatgtgtggcacctccatcagt

SEQ ID NO: 238759 - DNA, 25 bp, Homo sapien
ggcacctccatcagttatacttaga

SEQ ID NO: 238760 - DNA, 25 bp, Homo sapien
ttattttcgtatcttctatccctca

SEQ ID NO: 238761 - DNA, 25 bp, Homo sapien
ctatccctcaaagcatcagacatgg

SEQ ID NO: 238762 - DNA, 25 bp, Homo sapien
ggtttataccaagaaagcttcctct

SEQ ID NO: 238763 - DNA, 25 bp, Homo sapien
aaagcttcctctgtggaaatctgtc

SEQ ID NO: 238764 - DNA, 25 bp, Homo sapien
agcctactttattcctgcattggga

SEQ ID NO: 238765 - DNA, 25 bp, Homo sapien
ttgggaagccatatcgcagagctaa

SEQ ID NO: 238766 - DNA, 25 bp, Homo sapien
gggatagcgaatgcactcagggtca

SEQ ID NO: 238767 - DNA, 25 bp, Homo sapien
agcgaatgcactcagggtcagcagt

SEQ ID NO: 238768 - DNA, 25 bp, Homo sapien
gggtcagcagtggagtttaaaaatt

SEQ ID NO: 238769 - DNA, 25 bp, Homo sapien
tgtctcttttcaacttatttaaatg

SEQ ID NO: 238770 - DNA, 25 bp, Homo sapien
acttatttaaatgacagcacctgag

SEQ ID NO: 238771 - DNA, 25 bp, Homo sapien
atgacagcacctgagaagaggaacc

SEQ ID NO: 238772 - DNA, 25 bp, Homo sapien
agaggaaccgttttacactggatgt

SEQ ID NO: 238773 - DNA, 25 bp, Homo sapien
ggatgtttctcatgtagaacaagaa

SEQ ID NO: 238774 - DNA, 25 bp, Homo sapien
ctggaattgatgtttacatgtctgt

SEQ ID NO: 238775 - DNA, 25 bp, Homo sapien
acatgtctgttgttggtcatctctc

SEQ ID NO: 238776 - DNA, 25 bp, Homo sapien
tctgttgttggtcatctctcctgtg

SEQ ID NO: 238777 - DNA, 25 bp, Homo sapien
agatatcacgcatttgaaactttta

SEQ ID NO: 238778 - DNA, 25 bp, Homo sapien
agccagccagaagttttgctggcaa

SEQ ID NO: 238779 - DNA, 25 bp, Homo sapien
aagcaaatatgagggcatgggcatt

SEQ ID NO: 238780 - DNA, 25 bp, Homo sapien
aagtatttcttgaaagccacctact

SEQ ID NO: 238781 - DNA, 25 bp, Homo sapien
aagccacctactggagagtaagttt

SEQ ID NO: 238782 - DNA, 25 bp, Homo sapien
aaattgggacaacggacagcatgat

SEQ ID NO: 238783 - DNA, 25 bp, Homo sapien
tttgctggcaatggtttggtttcta

SEQ ID NO: 238784 - DNA, 25 bp, Homo sapien
gacagcatgatggagccaccgtgca

SEQ ID NO: 238785 - DNA, 25 bp, Homo sapien
acagcatcaaaacttgtctcccatg

SEQ ID NO: 238786 - DNA, 25 bp, Homo sapien
acttgtctcccatgttttgtaagtg

SEQ ID NO: 238787 - DNA, 25 bp, Homo sapien
ggtttaacccacaagatatcacgca

SEQ ID NO: 238788 - DNA, 25 bp, Homo sapien
gcactcatcagaccatgcactatgg

SEQ ID NO: 238789 - DNA, 25 bp, Homo sapien
tgcactatggatgtggaactgtcaa

SEQ ID NO: 238790 - DNA, 25 bp, Homo sapien
tgtcaagcagaagttttcaccctcc

SEQ ID NO: 238791 - DNA, 25 bp, Homo sapien
agaggccagctgtcagtatctgtag

SEQ ID NO: 238792 - DNA, 25 bp, Homo sapien
catagaatctgggtgcacaactgcc

SEQ ID NO: 238793 - DNA, 25 bp, Homo sapien
gaggccaacaggaggtttgaacgct

SEQ ID NO: 238794 - DNA, 25 bp, Homo sapien
aggtttgaacgctaccctggccaga

SEQ ID NO: 238795 - DNA, 25 bp, Homo sapien
ggccagaccagcaaccagattatct

SEQ ID NO: 238796 - DNA, 25 bp, Homo sapien
agattatctaagtgccactgccctc

SEQ ID NO: 238797 - DNA, 25 bp, Homo sapien
tgaggctgccattacctcaggagct

SEQ ID NO: 238798 - DNA, 25 bp, Homo sapien
aggagcttaccaagaaacccatgtc

SEQ ID NO: 238799 - DNA, 25 bp, Homo sapien
ggtgattcatggacatacacacagt

SEQ ID NO: 238800 - DNA, 25 bp, Homo sapien
aaaaatctgtcactccttatgcacg

SEQ ID NO: 238801 - DNA, 25 bp, Homo sapien
ttatgcacgttccaagctaaggtca

SEQ ID NO: 238802 - DNA, 25 bp, Homo sapien
tttcagctctcatacaaagatgacc

SEQ ID NO: 238803 - DNA, 25 bp, Homo sapien
acaaagatgacccaaggacagaggc

SEQ ID NO: 238804 - DNA, 25 bp, Homo sapien
tttgtggatcctatatttgcaaatt

SEQ ID NO: 238805 - DNA, 25 bp, Homo sapien
gaagctctggctctaggactaattg

SEQ ID NO: 238806 - DNA, 25 bp, Homo sapien
ctctaggactaattggacgaggtct

SEQ ID NO: 238807 - DNA, 25 bp, Homo sapien
ggacgaggtctgaatcttaactctg

SEQ ID NO: 238808 - DNA, 25 bp, Homo sapien
caaattaatacttgtggagctttca

SEQ ID NO: 238809 - DNA, 25 bp, Homo sapien
ggagctttcaaggtgattcatggac

SEQ ID NO: 238810 - DNA, 25 bp, Homo sapien
gggatgtaagatgttctttcctata

SEQ ID NO: 238811 - DNA, 25 bp, Homo sapien
gttctttcctatatatggtttccaa

SEQ ID NO: 238812 - DNA, 25 bp, Homo sapien
tatatatggtttccaaagggtgccc

SEQ ID NO: 238813 - DNA, 25 bp, Homo sapien
aaagggtgcccctatgatccattgt

SEQ ID NO: 238814 - DNA, 25 bp, Homo sapien
ccactgcccacaaatggctgacaaa

SEQ ID NO: 238815 - DNA, 25 bp, Homo sapien
gcccacaaatggctgacaaatattt

SEQ ID NO: 238816 - DNA, 25 bp, Homo sapien
ctgtgtaggtgctgaaaagtggcca

SEQ ID NO: 238817 - DNA, 25 bp, Homo sapien
cactgtggggatgaagcgcttcttc

SEQ ID NO: 238818 - DNA, 25 bp, Homo sapien
gctatttaagaaccctaaatctgtc

SEQ ID NO: 238819 - DNA, 25 bp, Homo sapien
aaatctgtcacccataataaagctg

SEQ ID NO: 238820 - DNA, 25 bp, Homo sapien
gtcacccataataaagctgatttga

SEQ ID NO: 238821 - DNA, 25 bp, Homo sapien
gggtggacacacagctgtccccagg

SEQ ID NO: 238822 - DNA, 25 bp, Homo sapien
agcccagcgcggtgccggtcacatg

SEQ ID NO: 238823 - DNA, 25 bp, Homo sapien
gagggtcttgagcagacgcctccct

SEQ ID NO: 238824 - DNA, 25 bp, Homo sapien
agacgcctcccttggagaagagcca

SEQ ID NO: 238825 - DNA, 25 bp, Homo sapien
ggagaagagccaccatctcaccttc

SEQ ID NO: 238826 - DNA, 25 bp, Homo sapien
ccttcccacgcaacaaattatctat

SEQ ID NO: 238827 - DNA, 25 bp, Homo sapien
aattatctattaccagcacccgatg

SEQ ID NO: 238828 - DNA, 25 bp, Homo sapien
cccgtgccacagaagcagtgtcagc

SEQ ID NO: 238829 - DNA, 25 bp, Homo sapien
agtgtcagcagcctcgccacggttt

SEQ ID NO: 238830 - DNA, 25 bp, Homo sapien
gccacggttttcacgtcatgcagaa

SEQ ID NO: 238831 - DNA, 25 bp, Homo sapien
gcagaaatggtcattccatgttcta

SEQ ID NO: 238832 - DNA, 25 bp, Homo sapien
acattgcaaatattctttgggtcac

SEQ ID NO: 238833 - DNA, 25 bp, Homo sapien
tattctttgggtcacttttaggata

SEQ ID NO: 238834 - DNA, 25 bp, Homo sapien
gtgggctgcttggtgcattcaataa

SEQ ID NO: 238835 - DNA, 25 bp, Homo sapien
ggtgcattcaataacagcctgcaaa

SEQ ID NO: 238836 - DNA, 25 bp, Homo sapien
aacagcctgcaaagcatttgtcaac

SEQ ID NO: 238837 - DNA, 25 bp, Homo sapien
aagcatttgtcaacattttgttttg

SEQ ID NO: 238838 - DNA, 25 bp, Homo sapien
gattgtaacatgtaactcttaggtc

SEQ ID NO: 238839 - DNA, 25 bp, Homo sapien
taactcttaggtctttcttgtttct

SEQ ID NO: 238840 - DNA, 25 bp, Homo sapien
gagaaactaggatgcttcttcctat

SEQ ID NO: 238841 - DNA, 25 bp, Homo sapien
aggatgcttcttcctatcaaagaaa

SEQ ID NO: 238842 - DNA, 25 bp, Homo sapien
tttgttttcatcttagacattgcaa

SEQ ID NO: 238843 - DNA, 25 bp, Homo sapien
gtaagtgtcatgtagcagctcctgg

SEQ ID NO: 238844 - DNA, 25 bp, Homo sapien
cagctcctgggaatctcctttaaaa

SEQ ID NO: 238845 - DNA, 25 bp, Homo sapien
gagagcttgtttatacctattgtca

SEQ ID NO: 238846 - DNA, 25 bp, Homo sapien
atacctattgtcatctctgttcttc

SEQ ID NO: 238847 - DNA, 25 bp, Homo sapien
attgtcatctctgttcttctgtgcc

SEQ ID NO: 238848 - DNA, 25 bp, Homo sapien
ttcttccattttgctgcctggaaag

SEQ ID NO: 238849 - DNA, 25 bp, Homo sapien
gctggaattccagtcaccattttgg

SEQ ID NO: 238850 - DNA, 25 bp, Homo sapien
tggaccatgaggacaacaccctaga

SEQ ID NO: 238851 - DNA, 25 bp, Homo sapien
acaccctagagatgtggagtggcta

SEQ ID NO: 238852 - DNA, 25 bp, Homo sapien
gagaacttagaggaccaggacctct

SEQ ID NO: 238853 - DNA, 25 bp, Homo sapien
aactctagtcaacagtaagtgtcat

SEQ ID NO: 238854 - DNA, 25 bp, Homo sapien
aaaccactgccctaagaaagagatc

SEQ ID NO: 238855 - DNA, 25 bp, Homo sapien
tatcagagagaaaagggaccaaacc

SEQ ID NO: 238856 - DNA, 25 bp, Homo sapien
gtttgttgtgtgtcgttttaatgcc

SEQ ID NO: 238857 - DNA, 25 bp, Homo sapien
ttgtgtgtcgttttaatgccaatta

SEQ ID NO: 238858 - DNA, 25 bp, Homo sapien
attttaacttgcacagtcttctgaa

SEQ ID NO: 238859 - DNA, 25 bp, Homo sapien
ttgcacagtcttctgaaaccttgta

SEQ ID NO: 238860 - DNA, 25 bp, Homo sapien
accttgtattaatagttctcttttg

SEQ ID NO: 238861 - DNA, 25 bp, Homo sapien
tttcaggtagggttttgatcactat

SEQ ID NO: 238862 - DNA, 25 bp, Homo sapien
tgatcactatgattctgaagataat

SEQ ID NO: 238863 - DNA, 25 bp, Homo sapien
tcattcattggtttgaacacctgca

SEQ ID NO: 238864 - DNA, 25 bp, Homo sapien
gaacacctgcaaaatcacaaataaa

SEQ ID NO: 238865 - DNA, 25 bp, Homo sapien
gtgtactcaggtatatgtacagaaa

SEQ ID NO: 238866 - DNA, 25 bp, Homo sapien
tgactatagggcctttttgaaagga

SEQ ID NO: 238867 - DNA, 25 bp, Homo sapien
tttaaaacagactgagtttccaaag

SEQ ID NO: 238868 - DNA, 25 bp, Homo sapien
gagtttccaaagttagggtacaatg

SEQ ID NO: 238869 - DNA, 25 bp, Homo sapien
tccaaagttagggtacaatgaaaga

SEQ ID NO: 238870 - DNA, 25 bp, Homo sapien
aaaaggtggcttatttatactctgg

SEQ ID NO: 238871 - DNA, 25 bp, Homo sapien
aaggtggcttatttatactctggaa

SEQ ID NO: 238872 - DNA, 25 bp, Homo sapien
ggcttatttatactctggaatattt

SEQ ID NO: 238873 - DNA, 25 bp, Homo sapien
attcagtctatttctcaaaaactca

SEQ ID NO: 238874 - DNA, 25 bp, Homo sapien
agtctatttctcaaaaactcaaaga

SEQ ID NO: 238875 - DNA, 25 bp, Homo sapien
actaataaatgtgtactcaggtata

SEQ ID NO: 238876 - DNA, 25 bp, Homo sapien
attaccagaacgcactgcaatgcct

SEQ ID NO: 238877 - DNA, 25 bp, Homo sapien
aatgcctcgtagcattgtccgtgca

SEQ ID NO: 238878 - DNA, 25 bp, Homo sapien
gcaagttgtctaccagtagctgtac

SEQ ID NO: 238879 - DNA, 25 bp, Homo sapien
gcattgtccgtgcacacactgtgaa

SEQ ID NO: 238880 - DNA, 25 bp, Homo sapien
gcacacactgtgaattccctaaaca

SEQ ID NO: 238881 - DNA, 25 bp, Homo sapien
aaacacgtcacgtaacctgggctct

SEQ ID NO: 238882 - DNA, 25 bp, Homo sapien
acctgggctctgtgatttggcaatc

SEQ ID NO: 238883 - DNA, 25 bp, Homo sapien
gcagtatatgctcatctttatggaa

SEQ ID NO: 238884 - DNA, 25 bp, Homo sapien
tgtgtgctgtgtctccaaccatgtt

SEQ ID NO: 238885 - DNA, 25 bp, Homo sapien
caaccatgttgtctctatttggaat

SEQ ID NO: 238886 - DNA, 25 bp, Homo sapien
gtacctgcctgaacatccataaatc

SEQ ID NO: 238887 - DNA, 25 bp, Homo sapien
gggaatatttctgggcttggtaagt

SEQ ID NO: 238888 - DNA, 25 bp, Homo sapien
cttggtaagtaagccaggtccctgc

SEQ ID NO: 238889 - DNA, 25 bp, Homo sapien
ggagtgacagctgatgattattttt

SEQ ID NO: 238890 - DNA, 25 bp, Homo sapien
ggaagatccttgagaacggaacctc

SEQ ID NO: 238891 - DNA, 25 bp, Homo sapien
tgagaacggaacctcttgggacctt

SEQ ID NO: 238892 - DNA, 25 bp, Homo sapien
gcagtaatacgtgcaaggcccctga

SEQ ID NO: 238893 - DNA, 25 bp, Homo sapien
ggaccttctacccagaacaccagag

SEQ ID NO: 238894 - DNA, 25 bp, Homo sapien
aaggcccctgacttagtggcaatga

SEQ ID NO: 238895 - DNA, 25 bp, Homo sapien
ggcaatgatgtttaagccgagatct

SEQ ID NO: 238896 - DNA, 25 bp, Homo sapien
aaggataactaacaacggcgtgcca

SEQ ID NO: 238897 - DNA, 25 bp, Homo sapien
caacggcgtgccagagaaaagagta

SEQ ID NO: 238898 - DNA, 25 bp, Homo sapien
tggactcagacacatcacgctccag

SEQ ID NO: 238899 - DNA, 25 bp, Homo sapien
atcacgctccagtttgggttccaag

SEQ ID NO: 238900 - DNA, 25 bp, Homo sapien
ggttccaaggtgcttctctctggat

SEQ ID NO: 238901 - DNA, 25 bp, Homo sapien
ggattttcacctgccttgccaaaaa

SEQ ID NO: 238902 - DNA, 25 bp, Homo sapien
aatgattgattacgctgggccaact

SEQ ID NO: 238903 - DNA, 25 bp, Homo sapien
tgggccaactgggtgtccggcaata

SEQ ID NO: 238904 - DNA, 25 bp, Homo sapien
gtgtccggcaatacccaacaaatga

SEQ ID NO: 238905 - DNA, 25 bp, Homo sapien
caacaaatgactttggcccctaaca

SEQ ID NO: 238906 - DNA, 25 bp, Homo sapien
tttggcccctaacagcaggtcttgg

SEQ ID NO: 238907 - DNA, 25 bp, Homo sapien
aaagccatctctccggagcagaaat

SEQ ID NO: 238908 - DNA, 25 bp, Homo sapien
tgccgtcctggtgaacacaatcgag

SEQ ID NO: 238909 - DNA, 25 bp, Homo sapien
gcagtgcgcgcatgcgtacggcttc

SEQ ID NO: 238910 - DNA, 25 bp, Homo sapien
gcatgcgtacggcttctcgcccgtg

SEQ ID NO: 238911 - DNA, 25 bp, Homo sapien
cggccgagaagcgtttgtcgcactc

SEQ ID NO: 238912 - DNA, 25 bp, Homo sapien
ccgagaagcgtttgtcgcactcggg

SEQ ID NO: 238913 - DNA, 25 bp, Homo sapien
gcccgtgtgcgtgcggccgtgtttg

SEQ ID NO: 238914 - DNA, 25 bp, Homo sapien
ggccgtgtttggtcagcgccgactt

SEQ ID NO: 238915 - DNA, 25 bp, Homo sapien
tggtcagcgccgacttctgtgagaa

SEQ ID NO: 238916 - DNA, 25 bp, Homo sapien
agcgccgacttctgtgagaagcgcc

SEQ ID NO: 238917 - DNA, 25 bp, Homo sapien
acttctgtgagaagcgccgcccgca

SEQ ID NO: 238918 - DNA, 25 bp, Homo sapien
tcggtgcacccgaagggccgttcgc

SEQ ID NO: 238919 - DNA, 25 bp, Homo sapien
gcgtgcttcgccagcgtggagcggc

SEQ ID NO: 238920 - DNA, 25 bp, Homo sapien
agaaagctggtcattttacaacttc

SEQ ID NO: 238921 - DNA, 25 bp, Homo sapien
caacttctcccgactctaggaagta

SEQ ID NO: 238922 - DNA, 25 bp, Homo sapien
tgtgccaagcacatggttcatctct

SEQ ID NO: 238923 - DNA, 25 bp, Homo sapien
gttcatctctgcaaactgctgctac

SEQ ID NO: 238924 - DNA, 25 bp, Homo sapien
aaactgctgctacattctgtaaagc

SEQ ID NO: 238925 - DNA, 25 bp, Homo sapien
gtaaagcaagtattatccgcatttt

SEQ ID NO: 238926 - DNA, 25 bp, Homo sapien
taggaacagcttcctgatctcttgc

SEQ ID NO: 238927 - DNA, 25 bp, Homo sapien
gatctcttgccaaaagtcacagcta

SEQ ID NO: 238928 - DNA, 25 bp, Homo sapien
cagctagtgagtggtttaggcaaga

SEQ ID NO: 238929 - DNA, 25 bp, Homo sapien
ggcaagatacaaaccctagttagtt

SEQ ID NO: 238930 - DNA, 25 bp, Homo sapien
gttagttaatccttactcagaagtg

SEQ ID NO: 238931 - DNA, 25 bp, Homo sapien
cctgttactaggtttgagttacatg

SEQ ID NO: 238932 - DNA, 25 bp, Homo sapien
gagttacatggttgagttgccaaat

SEQ ID NO: 238933 - DNA, 25 bp, Homo sapien
gagttgccaaattatttacatgctt

SEQ ID NO: 238934 - DNA, 25 bp, Homo sapien
acatgctttgtttaaattcttcatc

SEQ ID NO: 238935 - DNA, 25 bp, Homo sapien
cacctagcaactgtttgctgatcat

SEQ ID NO: 238936 - DNA, 25 bp, Homo sapien
gcaactgtttgctgatcatggattt

SEQ ID NO: 238937 - DNA, 25 bp, Homo sapien
ctgtttgctgatcatggatttactt

SEQ ID NO: 238938 - DNA, 25 bp, Homo sapien
taccatttggaaaagaactcaattg

SEQ ID NO: 238939 - DNA, 25 bp, Homo sapien
tgggaaatgtgatgacgtattgtac

SEQ ID NO: 238940 - DNA, 25 bp, Homo sapien
gacgtattgtacatgttactttttc

SEQ ID NO: 238941 - DNA, 25 bp, Homo sapien
atatactcccacattataacttaga

SEQ ID NO: 238942 - DNA, 25 bp, Homo sapien
atagtgttcttagttggcagtttaa

SEQ ID NO: 238943 - DNA, 25 bp, Homo sapien
catcactttgtatacgtcatcgcac

SEQ ID NO: 238944 - DNA, 25 bp, Homo sapien
tatacgtcatcgcactttctcctgg

SEQ ID NO: 238945 - DNA, 25 bp, Homo sapien
tttctcctggcctataagatctctt

SEQ ID NO: 238946 - DNA, 25 bp, Homo sapien
tggcctataagatctcttctgagaa

SEQ ID NO: 238947 - DNA, 25 bp, Homo sapien
tacgttctactttactggaacttca

SEQ ID NO: 238948 - DNA, 25 bp, Homo sapien
gacagcccacaaactagttaatata

SEQ ID NO: 238949 - DNA, 25 bp, Homo sapien
atatatgtgcctgtcacagtctcca

SEQ ID NO: 238950 - DNA, 25 bp, Homo sapien
gaagctttatcttactacagagtcc

SEQ ID NO: 238951 - DNA, 25 bp, Homo sapien
tacagagtccagatgcattaaggct

SEQ ID NO: 238952 - DNA, 25 bp, Homo sapien
gttcgagccatgatcttcctctgaa

SEQ ID NO: 238953 - DNA, 25 bp, Homo sapien
ttctgtgaatgccattgcacgaaga

SEQ ID NO: 238954 - DNA, 25 bp, Homo sapien
gtgaatgccattgcacgaagaaagc

SEQ ID NO: 238955 - DNA, 25 bp, Homo sapien
gcacgaagaaagcaaatgtttgcct

SEQ ID NO: 238956 - DNA, 25 bp, Homo sapien
gtaaatattgcttagtacttgcccc

SEQ ID NO: 238957 - DNA, 25 bp, Homo sapien
aatattgcttagtacttgcccccac

SEQ ID NO: 238958 - DNA, 25 bp, Homo sapien
tagtttatatactaccctataggtc

SEQ ID NO: 238959 - DNA, 25 bp, Homo sapien
tatactaccctataggtcatgccaa

SEQ ID NO: 238960 - DNA, 25 bp, Homo sapien
actaccctataggtcatgccaaaaa

SEQ ID NO: 238961 - DNA, 25 bp, Homo sapien
actgctgtctaaatactgattgatt

SEQ ID NO: 238962 - DNA, 25 bp, Homo sapien
tgctgtctaaatactgattgattgc

SEQ ID NO: 238963 - DNA, 25 bp, Homo sapien
aatactgattgattgcacaatttaa

SEQ ID NO: 238964 - DNA, 25 bp, Homo sapien
tggaaggtcctaattctttccctat

SEQ ID NO: 238965 - DNA, 25 bp, Homo sapien
gtcctaattctttccctatgcaaaa

SEQ ID NO: 238966 - DNA, 25 bp, Homo sapien
tctggttaccaagttatgtgtgtgt

SEQ ID NO: 238967 - DNA, 25 bp, Homo sapien
gaccagtataatcttattcccctca

SEQ ID NO: 238968 - DNA, 25 bp, Homo sapien
tataatcttattcccctcagtgcca

SEQ ID NO: 238969 - DNA, 25 bp, Homo sapien
ttgctctcttgcctgatatatagct

SEQ ID NO: 238970 - DNA, 25 bp, Homo sapien
aatagcctggcatatattctttcag

SEQ ID NO: 238971 - DNA, 25 bp, Homo sapien
attccccatgcgcatttactgcctt

SEQ ID NO: 238972 - DNA, 25 bp, Homo sapien
attaccttgggctgcactttccttt

SEQ ID NO: 238973 - DNA, 25 bp, Homo sapien
tgggctgcactttcctttaaaacta

SEQ ID NO: 238974 - DNA, 25 bp, Homo sapien
ataactctacttgttttcatttgga

SEQ ID NO: 238975 - DNA, 25 bp, Homo sapien
ctcctcaccaccataagtagcatgt

SEQ ID NO: 238976 - DNA, 25 bp, Homo sapien
atgtgctccaagtgccactgtgtta

SEQ ID NO: 238977 - DNA, 25 bp, Homo sapien
gccactgtgttaaactgatggtagt

SEQ ID NO: 238978 - DNA, 25 bp, Homo sapien
gtcccctaggctctgaaagtagcag

SEQ ID NO: 238979 - DNA, 25 bp, Homo sapien
ggacttaagcctgagttatttgcaa

SEQ ID NO: 238980 - DNA, 25 bp, Homo sapien
acaagccaacccctgagagtctgag

SEQ ID NO: 238981 - DNA, 25 bp, Homo sapien
gagaagccatttcaaagttgctgat

SEQ ID NO: 238982 - DNA, 25 bp, Homo sapien
ttgctgataactatggcaggtatac

SEQ ID NO: 238983 - DNA, 25 bp, Homo sapien
acggagaagcgcctttttctgtggc

SEQ ID NO: 238984 - DNA, 25 bp, Homo sapien
gaggttaaggttatctgtccattgc

SEQ ID NO: 238985 - DNA, 25 bp, Homo sapien
tatctgtccattgccttgtacgaaa

SEQ ID NO: 238986 - DNA, 25 bp, Homo sapien
agctgtgatgtgtcttcattttata

SEQ ID NO: 238987 - DNA, 25 bp, Homo sapien
agtttgacactggagcttttgagct

SEQ ID NO: 238988 - DNA, 25 bp, Homo sapien
gcttttgagcttttttacctcacat

SEQ ID NO: 238989 - DNA, 25 bp, Homo sapien
gcttttttacctcacatcttttatc

SEQ ID NO: 238990 - DNA, 25 bp, Homo sapien
gcttgctttattaagacactctgga

SEQ ID NO: 238991 - DNA, 25 bp, Homo sapien
aaagacgtcagggaatccttgtata

SEQ ID NO: 238992 - DNA, 25 bp, Homo sapien
gaatccttgtatatgtcgtgggaat

SEQ ID NO: 238993 - DNA, 25 bp, Homo sapien
tgtcgtgggaatcaactcctcattt

SEQ ID NO: 238994 - DNA, 25 bp, Homo sapien
actcctcatttatctgttgcgtaag

SEQ ID NO: 238995 - DNA, 25 bp, Homo sapien
taagtttttgtgcatcagtcgggtt

SEQ ID NO: 238996 - DNA, 25 bp, Homo sapien
gcatcagtcgggttttctatatttt

SEQ ID NO: 238997 - DNA, 25 bp, Homo sapien
tacgtccagctccaacggcactggt

SEQ ID NO: 238998 - DNA, 25 bp, Homo sapien
gcactggtgccccattccatcggca

SEQ ID NO: 238999 - DNA, 25 bp, Homo sapien
agtgcctcgctccattggcaccaac

SEQ ID NO: 239000 - DNA, 25 bp, Homo sapien
ggcactaacgccctgcttcattggc

SEQ ID NO: 239001 - DNA, 25 bp, Homo sapien
taacgccctgcttcattggcacttt

SEQ ID NO: 239002 - DNA, 25 bp, Homo sapien
tgcttcattggcactttgctgctgc

SEQ ID NO: 239003 - DNA, 25 bp, Homo sapien
ttcattggcactttgctgctgcctc

SEQ ID NO: 239004 - DNA, 25 bp, Homo sapien
gccttccatgaacagggacagacca

SEQ ID NO: 239005 - DNA, 25 bp, Homo sapien
catgaacagggacagaccagaggcc

SEQ ID NO: 239006 - DNA, 25 bp, Homo sapien
cctcagacctccaaagggcaacaga

SEQ ID NO: 239007 - DNA, 25 bp, Homo sapien
cagacctccaaagggcaacagaaga

SEQ ID NO: 239008 - DNA, 25 bp, Homo sapien
gaagcttaggatatattcttggttt

SEQ ID NO: 239009 - DNA, 25 bp, Homo sapien
gtggtactttgtaaatctggctttt

SEQ ID NO: 239010 - DNA, 25 bp, Homo sapien
ttttacactaaaagcaccctctcag

SEQ ID NO: 239011 - DNA, 25 bp, Homo sapien
gcaccctctcagcttgtagtatttt

SEQ ID NO: 239012 - DNA, 25 bp, Homo sapien
taacattgtaatatggtggactcaa

SEQ ID NO: 239013 - DNA, 25 bp, Homo sapien
aattctgtgaggaacagttgcatta

SEQ ID NO: 239014 - DNA, 25 bp, Homo sapien
agcatgctttttctggaatttattt

SEQ ID NO: 239015 - DNA, 25 bp, Homo sapien
ggtggactcaaaccagttgaactac

SEQ ID NO: 239016 - DNA, 25 bp, Homo sapien
cagttgaactacatttaacctacct

SEQ ID NO: 239017 - DNA, 25 bp, Homo sapien
ttaacctacctaaatggcaacatcc

SEQ ID NO: 239018 - DNA, 25 bp, Homo sapien
ggcaacatcctctcagttgttatac

SEQ ID NO: 239019 - DNA, 25 bp, Homo sapien
gtaagggttttctagagctcctcct

SEQ ID NO: 239020 - DNA, 25 bp, Homo sapien
tcctttggtggcctgtttgagtagc

SEQ ID NO: 239021 - DNA, 25 bp, Homo sapien
gtagcacaagggacgtcatcctaaa

SEQ ID NO: 239022 - DNA, 25 bp, Homo sapien
gtcatcctaaatgtgcagttgccat

SEQ ID NO: 239023 - DNA, 25 bp, Homo sapien
gttgccatttgttctgtagtgactt

SEQ ID NO: 239024 - DNA, 25 bp, Homo sapien
gtgacttacagggatctcagtggca

SEQ ID NO: 239025 - DNA, 25 bp, Homo sapien
gatctcagtggcaaagggcgtcagt

SEQ ID NO: 239026 - DNA, 25 bp, Homo sapien
aaagaactagacgaggcttgcgctt

SEQ ID NO: 239027 - DNA, 25 bp, Homo sapien
ggcttgcgcttggaaagtcacggta

SEQ ID NO: 239028 - DNA, 25 bp, Homo sapien
acggtaggattggacctgccggcca

SEQ ID NO: 239029 - DNA, 25 bp, Homo sapien
ccggccacatggctcagggagtatt

SEQ ID NO: 239030 - DNA, 25 bp, Homo sapien
tttcacaacatgtttgataatcagt

SEQ ID NO: 239031 - DNA, 25 bp, Homo sapien
acatgtttgataatcagtgctttaa

SEQ ID NO: 239032 - DNA, 25 bp, Homo sapien
taaaaagcagcagtgtcctatgaag

SEQ ID NO: 239033 - DNA, 25 bp, Homo sapien
gagcattggatgtgaagttctggtc

SEQ ID NO: 239034 - DNA, 25 bp, Homo sapien
tgaagttctggtcatgtcaccttgc

SEQ ID NO: 239035 - DNA, 25 bp, Homo sapien
aagttctggtcatgtcaccttgcgt

SEQ ID NO: 239036 - DNA, 25 bp, Homo sapien
tctggtcatgtcaccttgcgtgtct

SEQ ID NO: 239037 - DNA, 25 bp, Homo sapien
cttgcgtgtctcaccctggaggagt

SEQ ID NO: 239038 - DNA, 25 bp, Homo sapien
aggagtgaaggtgggcgcccggcgg

SEQ ID NO: 239039 - DNA, 25 bp, Homo sapien
cacgcacgacaccagaggaagggac

SEQ ID NO: 239040 - DNA, 25 bp, Homo sapien
gcacgacaccagaggaagggacagc

SEQ ID NO: 239041 - DNA, 25 bp, Homo sapien
gttggctgacgaaaccccttctcta

SEQ ID NO: 239042 - DNA, 25 bp, Homo sapien
aaaaagatgatctgggccgggcacg

SEQ ID NO: 239043 - DNA, 25 bp, Homo sapien
aaaagatgatctgggccgggcacgc

SEQ ID NO: 239044 - DNA, 25 bp, Homo sapien
gcctggtggcgtgggcttggaatca

SEQ ID NO: 239045 - DNA, 25 bp, Homo sapien
gcgtgggcttggaatcacgaccgct

SEQ ID NO: 239046 - DNA, 25 bp, Homo sapien
gtgggcttggaatcacgaccgctcg

SEQ ID NO: 239047 - DNA, 25 bp, Homo sapien
gcttggaatcacgaccgctcgggag

SEQ ID NO: 239048 - DNA, 25 bp, Homo sapien
cttggaatcacgaccgctcgggaga

SEQ ID NO: 239049 - DNA, 25 bp, Homo sapien
ttggaatcacgaccgctcgggagac

SEQ ID NO: 239050 - DNA, 25 bp, Homo sapien
aatcacgaccgctcgggagactggg

SEQ ID NO: 239051 - DNA, 25 bp, Homo sapien
tggggcgggcgacttgttccaaccg

SEQ ID NO: 239052 - DNA, 25 bp, Homo sapien
ctgcagtcagcaacttggaatattc

SEQ ID NO: 239053 - DNA, 25 bp, Homo sapien
tgcagtcagcaacttggaatattca

SEQ ID NO: 239054 - DNA, 25 bp, Homo sapien
gcagtcagcaacttggaatattcag

SEQ ID NO: 239055 - DNA, 25 bp, Homo sapien
cagtcagcaacttggaatattcaga

SEQ ID NO: 239056 - DNA, 25 bp, Homo sapien
gtcagcaacttggaatattcagact

SEQ ID NO: 239057 - DNA, 25 bp, Homo sapien
cagcaacttggaatattcagacttc

SEQ ID NO: 239058 - DNA, 25 bp, Homo sapien
gcaacttggaatattcagacttcag

SEQ ID NO: 239059 - DNA, 25 bp, Homo sapien
aacttggaatattcagacttcagac

SEQ ID NO: 239060 - DNA, 25 bp, Homo sapien
acttggaatattcagacttcagacc

SEQ ID NO: 239061 - DNA, 25 bp, Homo sapien
cttggaatattcagacttcagacca

SEQ ID NO: 239062 - DNA, 25 bp, Homo sapien
ttggaatattcagacttcagaccag

SEQ ID NO: 239063 - DNA, 25 bp, Homo sapien
tctggtggctttactgagctcttct

SEQ ID NO: 239064 - DNA, 25 bp, Homo sapien
gagctcttctggtttagaggtgaaa

SEQ ID NO: 239065 - DNA, 25 bp, Homo sapien
gtgaaacaacccagagaaaggattt

SEQ ID NO: 239066 - DNA, 25 bp, Homo sapien
tgtattcgtttttggtctgaagacc

SEQ ID NO: 239067 - DNA, 25 bp, Homo sapien
taaagcacctgctgtacgatacctg

SEQ ID NO: 239068 - DNA, 25 bp, Homo sapien
gtacgatacctgctacagatacagt

SEQ ID NO: 239069 - DNA, 25 bp, Homo sapien
tacctgctacagatacagtgatggt

SEQ ID NO: 239070 - DNA, 25 bp, Homo sapien
gaaagtatagttgtctcagtgttat

SEQ ID NO: 239071 - DNA, 25 bp, Homo sapien
ttatagaagcttttactctgtattt

SEQ ID NO: 239072 - DNA, 25 bp, Homo sapien
gtattttcctcgatttctattttct

SEQ ID NO: 239073 - DNA, 25 bp, Homo sapien
tctattttctgtactgatcatgcat

SEQ ID NO: 239074 - DNA, 25 bp, Homo sapien
tgagttgacactcatgccaacaaga

SEQ ID NO: 239075 - DNA, 25 bp, Homo sapien
tgacactcatgccaacaagaacctg

SEQ ID NO: 239076 - DNA, 25 bp, Homo sapien
actcatgccaacaagaacctgtgcc

SEQ ID NO: 239077 - DNA, 25 bp, Homo sapien
catctccttcattctgggcagtgcc

SEQ ID NO: 239078 - DNA, 25 bp, Homo sapien
tcctgaaactggactgttcctggga

SEQ ID NO: 239079 - DNA, 25 bp, Homo sapien
gaaactggactgttcctgggaaaag

SEQ ID NO: 239080 - DNA, 25 bp, Homo sapien
ggaaaagggtgaagccacctctaga

SEQ ID NO: 239081 - DNA, 25 bp, Homo sapien
ggtgaagccacctctagaagggact

SEQ ID NO: 239082 - DNA, 25 bp, Homo sapien
gaagccacctctagaagggactttg

SEQ ID NO: 239083 - DNA, 25 bp, Homo sapien
gccacctctagaagggactttggcc

SEQ ID NO: 239084 - DNA, 25 bp, Homo sapien
ccccaagaacttcccatggtagaat

SEQ ID NO: 239085 - DNA, 25 bp, Homo sapien
aaaagtcctttcaactcttctgagc

SEQ ID NO: 239086 - DNA, 25 bp, Homo sapien
aagtcctttcaactcttctgagctt

SEQ ID NO: 239087 - DNA, 25 bp, Homo sapien
tttcaactcttctgagcttcctaag

SEQ ID NO: 239088 - DNA, 25 bp, Homo sapien
gagacacaggtgacagcagaaacag

SEQ ID NO: 239089 - DNA, 25 bp, Homo sapien
gcagaaacagtcatctagcccagga

SEQ ID NO: 239090 - DNA, 25 bp, Homo sapien
agtcatctagcccaggacatggctt

SEQ ID NO: 239091 - DNA, 25 bp, Homo sapien
tctagcccaggacatggcttcttta

SEQ ID NO: 239092 - DNA, 25 bp, Homo sapien
caggacatggcttctttacccttct

SEQ ID NO: 239093 - DNA, 25 bp, Homo sapien
ttacccttcttcaagccatgtgagt

SEQ ID NO: 239094 - DNA, 25 bp, Homo sapien
ggagcttcttgcgtgtcagatcaac

SEQ ID NO: 239095 - DNA, 25 bp, Homo sapien
acagtgattctatcttgcttgtatg

SEQ ID NO: 239096 - DNA, 25 bp, Homo sapien
aaatactcctctgtgcaactgaagc

SEQ ID NO: 239097 - DNA, 25 bp, Homo sapien
gcagaatgtcatcactcaaagtaga

SEQ ID NO: 239098 - DNA, 25 bp, Homo sapien
cagggtcccaccaagggatgcagtg

SEQ ID NO: 239099 - DNA, 25 bp, Homo sapien
ccaagggatgcagtgaactttctaa

SEQ ID NO: 239100 - DNA, 25 bp, Homo sapien
aagtcaagacctctgtcttatctcc

SEQ ID NO: 239101 - DNA, 25 bp, Homo sapien
ctctgtcttatctcctccaaaagat

SEQ ID NO: 239102 - DNA, 25 bp, Homo sapien
ctcctttctggagatgggatatgtt

SEQ ID NO: 239103 - DNA, 25 bp, Homo sapien
catggtaggttctgatctcttttgc

SEQ ID NO: 239104 - DNA, 25 bp, Homo sapien
tctgatctcttttgcaggctttgag

SEQ ID NO: 239105 - DNA, 25 bp, Homo sapien
tttgagcataagaaccaagggcaca

SEQ ID NO: 239106 - DNA, 25 bp, Homo sapien
gaaagtctgcaaaacattcaagggc

SEQ ID NO: 239107 - DNA, 25 bp, Homo sapien
gaatcaggcaggtctcctgaggcgt

SEQ ID NO: 239108 - DNA, 25 bp, Homo sapien
tgaggcgtctgtacaacccttatac

SEQ ID NO: 239109 - DNA, 25 bp, Homo sapien
aacccttatactatgactattacgg

SEQ ID NO: 239110 - DNA, 25 bp, Homo sapien
aggtaggatttttgcaggtcagaac

SEQ ID NO: 239111 - DNA, 25 bp, Homo sapien
gaacaggttgtatcagcccgaagaa

SEQ ID NO: 239112 - DNA, 25 bp, Homo sapien
atcttggtttccttcgtgcttgttt

SEQ ID NO: 239113 - DNA, 25 bp, Homo sapien
tccttcgtgcttgttttcttttgca

SEQ ID NO: 239114 - DNA, 25 bp, Homo sapien
tctgattctgaactgggccatgttg

SEQ ID NO: 239115 - DNA, 25 bp, Homo sapien
gggccatgttggatcatacttgcag

SEQ ID NO: 239116 - DNA, 25 bp, Homo sapien
aaagaaggaccatcacgcattcacg

SEQ ID NO: 239117 - DNA, 25 bp, Homo sapien
gcattcacgactaggaaacagctct

SEQ ID NO: 239118 - DNA, 25 bp, Homo sapien
gaaaattgaccgtcgcagcgtggca

SEQ ID NO: 239119 - DNA, 25 bp, Homo sapien
gtggcagcagcgtgtactcactccc

SEQ ID NO: 239120 - DNA, 25 bp, Homo sapien
ccttctgggcgcgttatttacgtag

SEQ ID NO: 239121 - DNA, 25 bp, Homo sapien
atttacgtagaggttaatctgcaac

SEQ ID NO: 239122 - DNA, 25 bp, Homo sapien
gttaatctgcaacaacagcgtctgt

SEQ ID NO: 239123 - DNA, 25 bp, Homo sapien
cagcgtctgtttatgacttagtgca

SEQ ID NO: 239124 - DNA, 25 bp, Homo sapien
gtgcatgcagttacaagtttatgtt

SEQ ID NO: 239125 - DNA, 25 bp, Homo sapien
caagtttatgttacactgtccttta

SEQ ID NO: 239126 - DNA, 25 bp, Homo sapien
acactgtcctttaacgtcttgatga

SEQ ID NO: 239127 - DNA, 25 bp, Homo sapien
tccagtggcctttttaaagaggaat

SEQ ID NO: 239128 - DNA, 25 bp, Homo sapien
aaagaggaattcagtgcaccctccc

SEQ ID NO: 239129 - DNA, 25 bp, Homo sapien
gatgatttcagtgggattttgtcta

SEQ ID NO: 239130 - DNA, 25 bp, Homo sapien
ggattttgtctataatgttttctta

SEQ ID NO: 239131 - DNA, 25 bp, Homo sapien
attggagttgaatgactctggtaaa

SEQ ID NO: 239132 - DNA, 25 bp, Homo sapien
ctctggtaaatgtcatgactgtaaa

SEQ ID NO: 239133 - DNA, 25 bp, Homo sapien
aatgacttttagttcagtgaatgac

SEQ ID NO: 239134 - DNA, 25 bp, Homo sapien
gaaacaatctgaatcttctcaagca

SEQ ID NO: 239135 - DNA, 25 bp, Homo sapien
gaatcttctcaagcacagtttaata

SEQ ID NO: 239136 - DNA, 25 bp, Homo sapien
gcacagtttaatacttttgcaacta

SEQ ID NO: 239137 - DNA, 25 bp, Homo sapien
caactactgaatgctctaataacgt

SEQ ID NO: 239138 - DNA, 25 bp, Homo sapien
tatactatggaaatgcattcagatg

SEQ ID NO: 239139 - DNA, 25 bp, Homo sapien
gcattcagatggttatttttacaaa

SEQ ID NO: 239140 - DNA, 25 bp, Homo sapien
taatgtatatctgatggagtaccat

SEQ ID NO: 239141 - DNA, 25 bp, Homo sapien
ggagtaccatttaggaatataacat

SEQ ID NO: 239142 - DNA, 25 bp, Homo sapien
agaggtcccagccattgccaaagtt

SEQ ID NO: 239143 - DNA, 25 bp, Homo sapien
gtcccagccattgccaaagttgaat

SEQ ID NO: 239144 - DNA, 25 bp, Homo sapien
ccagccattgccaaagttgaatctt

SEQ ID NO: 239145 - DNA, 25 bp, Homo sapien
gaatcttttacatttccctgaatct

SEQ ID NO: 239146 - DNA, 25 bp, Homo sapien
ttacatttccctgaatcttgaggat

SEQ ID NO: 239147 - DNA, 25 bp, Homo sapien
atttccctgaatcttgaggatgact

SEQ ID NO: 239148 - DNA, 25 bp, Homo sapien
ccctgaatcttgaggatgactgaaa

SEQ ID NO: 239149 - DNA, 25 bp, Homo sapien
aaggaagtctttgaaactgcagttt

SEQ ID NO: 239150 - DNA, 25 bp, Homo sapien
agtctttgaaactgcagtttctgaa

SEQ ID NO: 239151 - DNA, 25 bp, Homo sapien
ttccccattgcagcctggcatgaaa

SEQ ID NO: 239152 - DNA, 25 bp, Homo sapien
ttgcagcctggcatgaaatctttgc

SEQ ID NO: 239153 - DNA, 25 bp, Homo sapien
tttagtggggatcactcctgcccga

SEQ ID NO: 239154 - DNA, 25 bp, Homo sapien
gggactctgcaagttgctaacccag

SEQ ID NO: 239155 - DNA, 25 bp, Homo sapien
tgcaagttgctaacccagcgtccat

SEQ ID NO: 239156 - DNA, 25 bp, Homo sapien
aagttgctaacccagcgtccattct

SEQ ID NO: 239157 - DNA, 25 bp, Homo sapien
attctctttcctccgtactaacaga

SEQ ID NO: 239158 - DNA, 25 bp, Homo sapien
gtactaacagaaccccggtgcctct

SEQ ID NO: 239159 - DNA, 25 bp, Homo sapien
ggtgcctctgcccagttccaatagc

SEQ ID NO: 239160 - DNA, 25 bp, Homo sapien
ccagttccaatagcgggcagacgag

SEQ ID NO: 239161 - DNA, 25 bp, Homo sapien
gagccatgtcctgggctcccttgca

SEQ ID NO: 239162 - DNA, 25 bp, Homo sapien
agtggaacatgatctggatcagatt

SEQ ID NO: 239163 - DNA, 25 bp, Homo sapien
tgatctggatcagattgactacata

SEQ ID NO: 239164 - DNA, 25 bp, Homo sapien
gacccagacagccttagttcacagt

SEQ ID NO: 239165 - DNA, 25 bp, Homo sapien
ccagacagccttagttcacagttta

SEQ ID NO: 239166 - DNA, 25 bp, Homo sapien
agacagccttagttcacagtttatg

SEQ ID NO: 239167 - DNA, 25 bp, Homo sapien
gttcacagtttatggcgtatattga

SEQ ID NO: 239168 - DNA, 25 bp, Homo sapien
tatggcgtatattgaacagcggcga

SEQ ID NO: 239169 - DNA, 25 bp, Homo sapien
ggcgtatattgaacagcggcgaatc

SEQ ID NO: 239170 - DNA, 25 bp, Homo sapien
gtatattgaacagcggcgaatctct

SEQ ID NO: 239171 - DNA, 25 bp, Homo sapien
ttgaacagcggcgaatctctcatga

SEQ ID NO: 239172 - DNA, 25 bp, Homo sapien
gaacagcggcgaatctctcatgagg

SEQ ID NO: 239173 - DNA, 25 bp, Homo sapien
gaggggctttttggaattcggtgcg

SEQ ID NO: 239174 - DNA, 25 bp, Homo sapien
ggggctttttggaattcggtgcgat

SEQ ID NO: 239175 - DNA, 25 bp, Homo sapien
gggctttttggaattcggtgcgatc

SEQ ID NO: 239176 - DNA, 25 bp, Homo sapien
ggctttttggaattcggtgcgatct

SEQ ID NO: 239177 - DNA, 25 bp, Homo sapien
gctttttggaattcggtgcgatctg

SEQ ID NO: 239178 - DNA, 25 bp, Homo sapien
ctttttggaattcggtgcgatctgt

SEQ ID NO: 239179 - DNA, 25 bp, Homo sapien
tttttggaattcggtgcgatctgta

SEQ ID NO: 239180 - DNA, 25 bp, Homo sapien
ttttggaattcggtgcgatctgtaa

SEQ ID NO: 239181 - DNA, 25 bp, Homo sapien
tttggaattcggtgcgatctgtaag

SEQ ID NO: 239182 - DNA, 25 bp, Homo sapien
ttggaattcggtgcgatctgtaagt

SEQ ID NO: 239183 - DNA, 25 bp, Homo sapien
tggaattcggtgcgatctgtaagtc

SEQ ID NO: 239184 - DNA, 25 bp, Homo sapien
gctgaatctgaaaacgtgggctctt

SEQ ID NO: 239185 - DNA, 25 bp, Homo sapien
aaacgtgggctcttgagagctgccc

SEQ ID NO: 239186 - DNA, 25 bp, Homo sapien
ctcttgagagctgcccttggaagga

SEQ ID NO: 239187 - DNA, 25 bp, Homo sapien
agctgcccttggaaggagctgtgct

SEQ ID NO: 239188 - DNA, 25 bp, Homo sapien
catctttaacttttcgtttattcag

SEQ ID NO: 239189 - DNA, 25 bp, Homo sapien
atgtatcaagttccgacttcgtgga

SEQ ID NO: 239190 - DNA, 25 bp, Homo sapien
gttccgacttcgtggaagagattgt

SEQ ID NO: 239191 - DNA, 25 bp, Homo sapien
gagattgtgttagacactgggagta

SEQ ID NO: 239192 - DNA, 25 bp, Homo sapien
accaggagggagacgtgaaaccaga

SEQ ID NO: 239193 - DNA, 25 bp, Homo sapien
gtgcgacttgtagtctcgtaccaga

SEQ ID NO: 239194 - DNA, 25 bp, Homo sapien
tgtagtctcgtaccagacgcgtccg

SEQ ID NO: 239195 - DNA, 25 bp, Homo sapien
tacggacagtcccagccaagctgct

SEQ ID NO: 239196 - DNA, 25 bp, Homo sapien
gacagtcccagccaagctgcttcga

SEQ ID NO: 239197 - DNA, 25 bp, Homo sapien
agccaagctgcttcgaccgtgtcaa

SEQ ID NO: 239198 - DNA, 25 bp, Homo sapien
aagctgcttcgaccgtgtcaaaatg

SEQ ID NO: 239199 - DNA, 25 bp, Homo sapien
gcttcgaccgtgtcaaaatgggctt

SEQ ID NO: 239200 - DNA, 25 bp, Homo sapien
gaccgtgtcaaaatgggcttcgtga

SEQ ID NO: 239201 - DNA, 25 bp, Homo sapien
gtcaaaatgggcttcgtgatgggtt

SEQ ID NO: 239202 - DNA, 25 bp, Homo sapien
tcgtgatgggttgcgccgtgggcat

SEQ ID NO: 239203 - DNA, 25 bp, Homo sapien
gggtcgagagctgatgggcggcatt

SEQ ID NO: 239204 - DNA, 25 bp, Homo sapien
agagtggcggcacctttggcacatt

SEQ ID NO: 239205 - DNA, 25 bp, Homo sapien
gatgctaaccatggttgccaactac

SEQ ID NO: 239206 - DNA, 25 bp, Homo sapien
tgctgccacccagatggctggcaaa

SEQ ID NO: 239207 - DNA, 25 bp, Homo sapien
accaggactccgaacacaacaggat

SEQ ID NO: 239208 - DNA, 25 bp, Homo sapien
acaacaggattcagggattcagaca

SEQ ID NO: 239209 - DNA, 25 bp, Homo sapien
attcagacaggagtcttgctctacc

SEQ ID NO: 239210 - DNA, 25 bp, Homo sapien
gtcttgctctaccaattattatagg

SEQ ID NO: 239211 - DNA, 25 bp, Homo sapien
ataggatcttagatgcctttccagt

SEQ ID NO: 239212 - DNA, 25 bp, Homo sapien
gatgcctttccagtaaagctaacaa

SEQ ID NO: 239213 - DNA, 25 bp, Homo sapien
agctgtctccaagatcagaaggcat

SEQ ID NO: 239214 - DNA, 25 bp, Homo sapien
ggcatcagaaaagaccctcaagagt

SEQ ID NO: 239215 - DNA, 25 bp, Homo sapien
gaccctcaagagttgtctaatccca

SEQ ID NO: 239216 - DNA, 25 bp, Homo sapien
gatcttaagggtgcgttgctcactc

SEQ ID NO: 239217 - DNA, 25 bp, Homo sapien
ccagggccacactcagcgcagtgtg

SEQ ID NO: 239218 - DNA, 25 bp, Homo sapien
acactcagcgcagtgtgggctggac

SEQ ID NO: 239219 - DNA, 25 bp, Homo sapien
actcagcgcagtgtgggctggaccc

SEQ ID NO: 239220 - DNA, 25 bp, Homo sapien
cagtgtgggctggacccgcctctgt

SEQ ID NO: 239221 - DNA, 25 bp, Homo sapien
actccgtgacctctgagaacccagc

SEQ ID NO: 239222 - DNA, 25 bp, Homo sapien
agctggcccctcgttagccccaggg

SEQ ID NO: 239223 - DNA, 25 bp, Homo sapien
ttagccccagggtctgccgtctaga

SEQ ID NO: 239224 - DNA, 25 bp, Homo sapien
agccccagggtctgccgtctagagg

SEQ ID NO: 239225 - DNA, 25 bp, Homo sapien
ggtctgccgtctagagggagcccac

SEQ ID NO: 239226 - DNA, 25 bp, Homo sapien
tccggacactgtcttcccgctagag

SEQ ID NO: 239227 - DNA, 25 bp, Homo sapien
tccaggcagggacagaataaatgtt

SEQ ID NO: 239228 - DNA, 25 bp, Homo sapien
gttcaaacagcacacaaacagaatt

SEQ ID NO: 239229 - DNA, 25 bp, Homo sapien
ttgattgtgcaattcagatctatat

SEQ ID NO: 239230 - DNA, 25 bp, Homo sapien
aattaaccttagcattattcctgtg

SEQ ID NO: 239231 - DNA, 25 bp, Homo sapien
attcctgtgctttattattcactga

SEQ ID NO: 239232 - DNA, 25 bp, Homo sapien
ttcactgataggttcttattcaact

SEQ ID NO: 239233 - DNA, 25 bp, Homo sapien
aactaatgtttatttcttgcctaat

SEQ ID NO: 239234 - DNA, 25 bp, Homo sapien
tatttcttgcctaatatgtgccaga

SEQ ID NO: 239235 - DNA, 25 bp, Homo sapien
atatgtgccagaaaccgtgaagtgt

SEQ ID NO: 239236 - DNA, 25 bp, Homo sapien
ccgtgaagtgtttaggatatgcagt

SEQ ID NO: 239237 - DNA, 25 bp, Homo sapien
atccaacttgtgtttgcaattaagc

SEQ ID NO: 239238 - DNA, 25 bp, Homo sapien
tgcaattaagcagggatacaggtac

SEQ ID NO: 239239 - DNA, 25 bp, Homo sapien
cggtgtgccacaagcgcttcagcag

SEQ ID NO: 239240 - DNA, 25 bp, Homo sapien
ttcagcagctccagtaacctcaaga

SEQ ID NO: 239241 - DNA, 25 bp, Homo sapien
cttccagtgcagtgtctgccggagt

SEQ ID NO: 239242 - DNA, 25 bp, Homo sapien
agtgcagtgtctgccggagtcgctt

SEQ ID NO: 239243 - DNA, 25 bp, Homo sapien
tgtctgccggagtcgcttcacccag

SEQ ID NO: 239244 - DNA, 25 bp, Homo sapien
ctgaagctgcaccatcggctgcatg

SEQ ID NO: 239245 - DNA, 25 bp, Homo sapien
gccagaagagcttcactcaacttgc

SEQ ID NO: 239246 - DNA, 25 bp, Homo sapien
agaagagcttcactcaacttgccca

SEQ ID NO: 239247 - DNA, 25 bp, Homo sapien
gaagcaccacctggtgcacactggg

SEQ ID NO: 239248 - DNA, 25 bp, Homo sapien
aagtgctcggtgtgccacaagcgct

SEQ ID NO: 239249 - DNA, 25 bp, Homo sapien
tgctcggtgtgccacaagcgcttca

SEQ ID NO: 239250 - DNA, 25 bp, Homo sapien
ggaaaagcaaaactctgcccaggaa

SEQ ID NO: 239251 - DNA, 25 bp, Homo sapien
ctctgcccaggaagaccttacttta

SEQ ID NO: 239252 - DNA, 25 bp, Homo sapien
actttacaaaccagctcaaccatat

SEQ ID NO: 239253 - DNA, 25 bp, Homo sapien
aaccatatttaccagccttcctgtg

SEQ ID NO: 239254 - DNA, 25 bp, Homo sapien
tgagctccagctagtgaagtatgag

SEQ ID NO: 239255 - DNA, 25 bp, Homo sapien
ggaattatcaatgggttccggacat

SEQ ID NO: 239256 - DNA, 25 bp, Homo sapien
gggttccggacataatcagccacac

SEQ ID NO: 239257 - DNA, 25 bp, Homo sapien
tcagccacacggcagagtgaattcc

SEQ ID NO: 239258 - DNA, 25 bp, Homo sapien
cggcagagtgaattccaggagtgta

SEQ ID NO: 239259 - DNA, 25 bp, Homo sapien
gtgtaaataacaagagctgcctata

SEQ ID NO: 239260 - DNA, 25 bp, Homo sapien
gagctgcctataaatctacctcaga

SEQ ID NO: 239261 - DNA, 25 bp, Homo sapien
tgccaccgagcgttgcccggagtgt

SEQ ID NO: 239262 - DNA, 25 bp, Homo sapien
ccaccgagcgttgcccggagtgtga

SEQ ID NO: 239263 - DNA, 25 bp, Homo sapien
agtgtgagggcagctgagtcccgca

SEQ ID NO: 239264 - DNA, 25 bp, Homo sapien
gagggcagctgagtcccgcagggct

SEQ ID NO: 239265 - DNA, 25 bp, Homo sapien
cggcctccgggtctgggaaattgag

SEQ ID NO: 239266 - DNA, 25 bp, Homo sapien
ggcccggctgccctggaactgggag

SEQ ID NO: 239267 - DNA, 25 bp, Homo sapien
gtccctggaaacagtgcccacccca

SEQ ID NO: 239268 - DNA, 25 bp, Homo sapien
actacattccctcggcccgtgttag

SEQ ID NO: 239269 - DNA, 25 bp, Homo sapien
tccctcggcccgtgttagtgaataa

SEQ ID NO: 239270 - DNA, 25 bp, Homo sapien
cctcggcccgtgttagtgaataaag

SEQ ID NO: 239271 - DNA, 25 bp, Homo sapien
cggcccgtgttagtgaataaagtat

SEQ ID NO: 239272 - DNA, 25 bp, Homo sapien
gtaaactccactgcggacagatgca

SEQ ID NO: 239273 - DNA, 25 bp, Homo sapien
tccactgcggacagatgcagccaag

SEQ ID NO: 239274 - DNA, 25 bp, Homo sapien
caccagaggaaactcttccccagga

SEQ ID NO: 239275 - DNA, 25 bp, Homo sapien
aggacccagtacgttggccctctga

SEQ ID NO: 239276 - DNA, 25 bp, Homo sapien
gcacacagcacatgatgctgaggtt

SEQ ID NO: 239277 - DNA, 25 bp, Homo sapien
ggttcagtgctgaacaagagctact

SEQ ID NO: 239278 - DNA, 25 bp, Homo sapien
acaagagctactgagagccagagac

SEQ ID NO: 239279 - DNA, 25 bp, Homo sapien
agccagagactcacttcttccatgg

SEQ ID NO: 239280 - DNA, 25 bp, Homo sapien
catggagccccactcatggatggag

SEQ ID NO: 239281 - DNA, 25 bp, Homo sapien
tgtgccacagtgctcagcatgatgt

SEQ ID NO: 239282 - DNA, 25 bp, Homo sapien
tgctcagcatgatgtaaactccact

SEQ ID NO: 239283 - DNA, 25 bp, Homo sapien
actaattcctttgtgggcagagtcc

SEQ ID NO: 239284 - DNA, 25 bp, Homo sapien
ctttgtgggcagagtccagccacgg

SEQ ID NO: 239285 - DNA, 25 bp, Homo sapien
tggtcaggacaacacctgcccaagg

SEQ ID NO: 239286 - DNA, 25 bp, Homo sapien
aggacaacacctgcccaaggagagc

SEQ ID NO: 239287 - DNA, 25 bp, Homo sapien
aggagagcaagggcctgtgacctct

SEQ ID NO: 239288 - DNA, 25 bp, Homo sapien
tgtgacctctgctggcctgtgcgcc

SEQ ID NO: 239289 - DNA, 25 bp, Homo sapien
gaggaaggaaccagatttatcagcc

SEQ ID NO: 239290 - DNA, 25 bp, Homo sapien
gaaccagatttatcagcctgaaagg

SEQ ID NO: 239291 - DNA, 25 bp, Homo sapien
tttggagaaaagacactgttcgggt

SEQ ID NO: 239292 - DNA, 25 bp, Homo sapien
cactgttcgggtgtcaagtaatgaa

SEQ ID NO: 239293 - DNA, 25 bp, Homo sapien
tccagctaccactaattcctttgtg

SEQ ID NO: 239294 - DNA, 25 bp, Homo sapien
attgctaaatatcatagggaatcga

SEQ ID NO: 239295 - DNA, 25 bp, Homo sapien
gaatcgaagagtttataatcccaaa

SEQ ID NO: 239296 - DNA, 25 bp, Homo sapien
ataatcccaaaccatactctttctt

SEQ ID NO: 239297 - DNA, 25 bp, Homo sapien
caaaccatactctttcttttcctag

SEQ ID NO: 239298 - DNA, 25 bp, Homo sapien
accatactctttcttttcctagcca

SEQ ID NO: 239299 - DNA, 25 bp, Homo sapien
attttcattctttctgtttcagttc

SEQ ID NO: 239300 - DNA, 25 bp, Homo sapien
cattctttctgtttcagttcttata

SEQ ID NO: 239301 - DNA, 25 bp, Homo sapien
tgttgacttccaaactgcatacccc

SEQ ID NO: 239302 - DNA, 25 bp, Homo sapien
cataccccttgccttgtccaagtaa

SEQ ID NO: 239303 - DNA, 25 bp, Homo sapien
gccttgtccaagtaaaactgtacca

SEQ ID NO: 239304 - DNA, 25 bp, Homo sapien
caagtaaaactgtaccatcgtttat

SEQ ID NO: 239305 - DNA, 25 bp, Homo sapien
gcaagacaagtttgattcatctagt

SEQ ID NO: 239306 - DNA, 25 bp, Homo sapien
gacaagtttgattcatctagtttca

SEQ ID NO: 239307 - DNA, 25 bp, Homo sapien
caagtttgattcatctagtttcata

SEQ ID NO: 239308 - DNA, 25 bp, Homo sapien
gtttgattcatctagtttcatatag

SEQ ID NO: 239309 - DNA, 25 bp, Homo sapien
ttcatctagtttcatatagtttcat

SEQ ID NO: 239310 - DNA, 25 bp, Homo sapien
atagtttcatatagtttcattttta

SEQ ID NO: 239311 - DNA, 25 bp, Homo sapien
aacttatagttctgcaattatttaa

SEQ ID NO: 239312 - DNA, 25 bp, Homo sapien
aaacaagtacagagcgtttgattaa

SEQ ID NO: 239313 - DNA, 25 bp, Homo sapien
taagaaatgtactagactctatcat

SEQ ID NO: 239314 - DNA, 25 bp, Homo sapien
atgtactagactctatcatttactt

SEQ ID NO: 239315 - DNA, 25 bp, Homo sapien
aaacaggtgatatttaagactattt

SEQ ID NO: 239316 - DNA, 25 bp, Homo sapien
gaacagagttccataaccgcagaca

SEQ ID NO: 239317 - DNA, 25 bp, Homo sapien
gttccataaccgcagacattaagat

SEQ ID NO: 239318 - DNA, 25 bp, Homo sapien
tgccgcgttacccacaactcgtatt

SEQ ID NO: 239319 - DNA, 25 bp, Homo sapien
caaggactttcagtatttagtgact

SEQ ID NO: 239320 - DNA, 25 bp, Homo sapien
atgccaagtgtcctggtgtgtccct

SEQ ID NO: 239321 - DNA, 25 bp, Homo sapien
aacattgatggaggcactgatactt

SEQ ID NO: 239322 - DNA, 25 bp, Homo sapien
ggcactgatacttgaactagtccat

SEQ ID NO: 239323 - DNA, 25 bp, Homo sapien
ttgaactagtccatgccaatagagc

SEQ ID NO: 239324 - DNA, 25 bp, Homo sapien
cccctgaaaaggagtgagaatgtct

SEQ ID NO: 239325 - DNA, 25 bp, Homo sapien
gtctgcagagaggagtcgtttcctt

SEQ ID NO: 239326 - DNA, 25 bp, Homo sapien
gagtcgtttcctttgaagtctgaac

SEQ ID NO: 239327 - DNA, 25 bp, Homo sapien
tggtgtatacagtggaacatgatct

SEQ ID NO: 239328 - DNA, 25 bp, Homo sapien
cagacagccttagttcacagtttat

SEQ ID NO: 239329 - DNA, 25 bp, Homo sapien
ttatggcgtatattgaacagcggcg

SEQ ID NO: 239330 - DNA, 25 bp, Homo sapien
aacagcggcgaatctctcatgaggt

SEQ ID NO: 239331 - DNA, 25 bp, Homo sapien
gaatctctcatgaggtagtacacag

SEQ ID NO: 239332 - DNA, 25 bp, Homo sapien
tctctcatgaggtagtacacagatt

SEQ ID NO: 239333 - DNA, 25 bp, Homo sapien
gaggtagtacacagattgaagccta

SEQ ID NO: 239334 - DNA, 25 bp, Homo sapien
gtacacagattgaagcctaaatatg

SEQ ID NO: 239335 - DNA, 25 bp, Homo sapien
taaatatgttgctatcccttcataa

SEQ ID NO: 239336 - DNA, 25 bp, Homo sapien
aatatgttgctatcccttcataaaa

SEQ ID NO: 239337 - DNA, 25 bp, Homo sapien
gttgctatcccttcataaaaataat

SEQ ID NO: 239338 - DNA, 25 bp, Homo sapien
tgggaggacacgcaagttcagctcc

SEQ ID NO: 239339 - DNA, 25 bp, Homo sapien
ggctacgaggctgcatctggctcca

SEQ ID NO: 239340 - DNA, 25 bp, Homo sapien
tctggctccagggaagcgtgttgca

SEQ ID NO: 239341 - DNA, 25 bp, Homo sapien
gaagcgtgttgcaatccatgagtga

SEQ ID NO: 239342 - DNA, 25 bp, Homo sapien
tgatgtctgccatgcgtacaggcat

SEQ ID NO: 239343 - DNA, 25 bp, Homo sapien
agagtgaggcgcctgtactgtcttt

SEQ ID NO: 239344 - DNA, 25 bp, Homo sapien
gcgcctgtactgtctttctgtagac

SEQ ID NO: 239345 - DNA, 25 bp, Homo sapien
tctttctgtagaccctagactggtg

SEQ ID NO: 239346 - DNA, 25 bp, Homo sapien
cctctgaaatgcatccagacactgt

SEQ ID NO: 239347 - DNA, 25 bp, Homo sapien
gggtgtgttgcatggccctcccaac

SEQ ID NO: 239348 - DNA, 25 bp, Homo sapien
gccctcccaaccaattcagtatttt

SEQ ID NO: 239349 - DNA, 25 bp, Homo sapien
gagaatccggtttttgctccttcca

SEQ ID NO: 239350 - DNA, 25 bp, Homo sapien
gaatccggtttttgctccttccagc

SEQ ID NO: 239351 - DNA, 25 bp, Homo sapien
tttttgctccttccagcctccagtg

SEQ ID NO: 239352 - DNA, 25 bp, Homo sapien
gggctgtggctgcatcacctcagtc

SEQ ID NO: 239353 - DNA, 25 bp, Homo sapien
tgtggctgcatcacctcagtctcag

SEQ ID NO: 239354 - DNA, 25 bp, Homo sapien
ggctgcatcacctcagtctcagtct

SEQ ID NO: 239355 - DNA, 25 bp, Homo sapien
gctctttctactcttttcaagatcc

SEQ ID NO: 239356 - DNA, 25 bp, Homo sapien
ttcaagatccttaacctaatggcat

SEQ ID NO: 239357 - DNA, 25 bp, Homo sapien
gatccttaacctaatggcatctttt

SEQ ID NO: 239358 - DNA, 25 bp, Homo sapien
aacctaatggcatcttttgtcttgt

SEQ ID NO: 239359 - DNA, 25 bp, Homo sapien
tgtcttgtaatatttactcttttaa

SEQ ID NO: 239360 - DNA, 25 bp, Homo sapien
aggccgggctctgagtgctctttcc

SEQ ID NO: 239361 - DNA, 25 bp, Homo sapien
gggctctgagtgctctttcccgtcc

SEQ ID NO: 239362 - DNA, 25 bp, Homo sapien
tctgagtgctctttcccgtccgggc

SEQ ID NO: 239363 - DNA, 25 bp, Homo sapien
gccgcggcccgggaatctacgtcac

SEQ ID NO: 239364 - DNA, 25 bp, Homo sapien
ggaatctacgtcacccgaaaagcga

SEQ ID NO: 239365 - DNA, 25 bp, Homo sapien
gaatctacgtcacccgaaaagcgac

SEQ ID NO: 239366 - DNA, 25 bp, Homo sapien
tctacgtcacccgaaaagcgactat

SEQ ID NO: 239367 - DNA, 25 bp, Homo sapien
tacgtcacccgaaaagcgactataa

SEQ ID NO: 239368 - DNA, 25 bp, Homo sapien
gtcacccgaaaagcgactataaacg

SEQ ID NO: 239369 - DNA, 25 bp, Homo sapien
aaagcgactataaacgccggcgcct

SEQ ID NO: 239370 - DNA, 25 bp, Homo sapien
aagcgactataaacgccggcgcctc

SEQ ID NO: 239371 - DNA, 25 bp, Homo sapien
agtctcctacctcatttccaagaga

SEQ ID NO: 239372 - DNA, 25 bp, Homo sapien
gctagggattgcttttgtcgccatc

SEQ ID NO: 239373 - DNA, 25 bp, Homo sapien
atgaacatgttgtcagacacccaga

SEQ ID NO: 239374 - DNA, 25 bp, Homo sapien
gagaatgggcagtgacaaaattgaa

SEQ ID NO: 239375 - DNA, 25 bp, Homo sapien
ttttgtcgccatctgctggtttcca

SEQ ID NO: 239376 - DNA, 25 bp, Homo sapien
gagtggctggaaagaggaccttcac

SEQ ID NO: 239377 - DNA, 25 bp, Homo sapien
tgctggtttccaccggtttcttcac

SEQ ID NO: 239378 - DNA, 25 bp, Homo sapien
gtttcttcacttcatcctgtgtgga

SEQ ID NO: 239379 - DNA, 25 bp, Homo sapien
tcatcctgtgtggaccatcttttgg

SEQ ID NO: 239380 - DNA, 25 bp, Homo sapien
gtgtggaccatcttttggtcagcag

SEQ ID NO: 239381 - DNA, 25 bp, Homo sapien
tcagcaggactgtgaccagaagaca

SEQ ID NO: 239382 - DNA, 25 bp, Homo sapien
ctttcttccgggactacgcgctgaa

SEQ ID NO: 239383 - DNA, 25 bp, Homo sapien
gggactacgcgctgaacgtgtttgt

SEQ ID NO: 239384 - DNA, 25 bp, Homo sapien
caaatcaactggaccttgtggcgtc

SEQ ID NO: 239385 - DNA, 25 bp, Homo sapien
ttgtggcgtcctttgtcaagaacca

SEQ ID NO: 239386 - DNA, 25 bp, Homo sapien
ttgtcaagaaccaaacgcagcactt

SEQ ID NO: 239387 - DNA, 25 bp, Homo sapien
gaaccaaacgcagcacttaatgggt

SEQ ID NO: 239388 - DNA, 25 bp, Homo sapien
acttaatgggtaactctctgaaaga

SEQ ID NO: 239389 - DNA, 25 bp, Homo sapien
tctgaaagatgagcctctgctggaa

SEQ ID NO: 239390 - DNA, 25 bp, Homo sapien
gctggaagagctggtgaccctcagg

SEQ ID NO: 239391 - DNA, 25 bp, Homo sapien
gaccctcagggcgaatgtgatcaag

SEQ ID NO: 239392 - DNA, 25 bp, Homo sapien
aaactttgccgcttgctaaaagaag

SEQ ID NO: 239393 - DNA, 25 bp, Homo sapien
gagtgagtggctgatcctttatgca

SEQ ID NO: 239394 - DNA, 25 bp, Homo sapien
gatcctttatgcaaattagcccttt

SEQ ID NO: 239395 - DNA, 25 bp, Homo sapien
ttctgtatcttcttaagaccagtgt

SEQ ID NO: 239396 - DNA, 25 bp, Homo sapien
gggctcatcattctgagacaagctt

SEQ ID NO: 239397 - DNA, 25 bp, Homo sapien
gataggctggtagatggcattagat

SEQ ID NO: 239398 - DNA, 25 bp, Homo sapien
ggtagtacaagttttcatccctatt

SEQ ID NO: 239399 - DNA, 25 bp, Homo sapien
acaagttttcatccctatttgtttg

SEQ ID NO: 239400 - DNA, 25 bp, Homo sapien
attaactagtttagtccactgactg

SEQ ID NO: 239401 - DNA, 25 bp, Homo sapien
ccactgactggatatcgctgattga

SEQ ID NO: 239402 - DNA, 25 bp, Homo sapien
gctgattgaaatcctgcatctcctc

SEQ ID NO: 239403 - DNA, 25 bp, Homo sapien
tgcatctcctccaggagaatggagt

SEQ ID NO: 239404 - DNA, 25 bp, Homo sapien
tatcggctctagaaaatgcataagg

SEQ ID NO: 239405 - DNA, 25 bp, Homo sapien
atgcataaggttagtacaagatcag

SEQ ID NO: 239406 - DNA, 25 bp, Homo sapien
gaaagtcaaagattacagaagtgct

SEQ ID NO: 239407 - DNA, 25 bp, Homo sapien
tgctgaagcagaccattcttccttt

SEQ ID NO: 239408 - DNA, 25 bp, Homo sapien
cttcccaatgtctattaagatcaca

SEQ ID NO: 239409 - DNA, 25 bp, Homo sapien
gatcacacataggtaaactgttaca

SEQ ID NO: 239410 - DNA, 25 bp, Homo sapien
ggtaaactgttacaaatccagaatg

SEQ ID NO: 239411 - DNA, 25 bp, Homo sapien
atccagaatggtgaaagagtccaac

SEQ ID NO: 239412 - DNA, 25 bp, Homo sapien
aagagtccaacaatggctgagggaa

SEQ ID NO: 239413 - DNA, 25 bp, Homo sapien
ggttaagatatagctcaacagtgaa

SEQ ID NO: 239414 - DNA, 25 bp, Homo sapien
ggtgagaaaacacatgctttcttaa

SEQ ID NO: 239415 - DNA, 25 bp, Homo sapien
agggaatgacggcaaaccttgcagt

SEQ ID NO: 239416 - DNA, 25 bp, Homo sapien
caaaccttgcagtgttggtggcctt

SEQ ID NO: 239417 - DNA, 25 bp, Homo sapien
atgaccagcattacgtcacacgtct

SEQ ID NO: 239418 - DNA, 25 bp, Homo sapien
atgtattagcatcctctgaagagtt

SEQ ID NO: 239419 - DNA, 25 bp, Homo sapien
gctacaagcaggttatgatttacta

SEQ ID NO: 239420 - DNA, 25 bp, Homo sapien
gacaaagaactattcacgaggattc

SEQ ID NO: 239421 - DNA, 25 bp, Homo sapien
cacgaggattctgtgtgtgcttatt

SEQ ID NO: 239422 - DNA, 25 bp, Homo sapien
tcacacgtcttggtcaccgttttat

SEQ ID NO: 239423 - DNA, 25 bp, Homo sapien
tggtcaccgttttattaatcatatc

SEQ ID NO: 239424 - DNA, 25 bp, Homo sapien
ttgagtacacaaaccctgaagacgg

SEQ ID NO: 239425 - DNA, 25 bp, Homo sapien
gaagacggtgtcacttaccagatca

SEQ ID NO: 239426 - DNA, 25 bp, Homo sapien
gctgtttcagccatgtgagtgaaga

SEQ ID NO: 239427 - DNA, 25 bp, Homo sapien
agaaggcaccagacttgtgagtgga

SEQ ID NO: 239428 - DNA, 25 bp, Homo sapien
taacttggatgtccagcccagctga

SEQ ID NO: 239429 - DNA, 25 bp, Homo sapien
agctgaaccttcaggtgactccagc

SEQ ID NO: 239430 - DNA, 25 bp, Homo sapien
aggtgactccagctctagctgccat

SEQ ID NO: 239431 - DNA, 25 bp, Homo sapien
agctgccatcctactgaagacacat

SEQ ID NO: 239432 - DNA, 25 bp, Homo sapien
gaagacacatgagagagaccccaag

SEQ ID NO: 239433 - DNA, 25 bp, Homo sapien
ccaagccagggtcaagatcagcgtg

SEQ ID NO: 239434 - DNA, 25 bp, Homo sapien
atcagcgtgaagcaagtgaggcatt

SEQ ID NO: 239435 - DNA, 25 bp, Homo sapien
gtaaggaggcattgaccttcataat

SEQ ID NO: 239436 - DNA, 25 bp, Homo sapien
aattgggctccaagactccaagagt

SEQ ID NO: 239437 - DNA, 25 bp, Homo sapien
gaggaacatgtgctgcttataccca

SEQ ID NO: 239438 - DNA, 25 bp, Homo sapien
gtgctgcttatacccagtttttctg

SEQ ID NO: 239439 - DNA, 25 bp, Homo sapien
tatacccagtttttctgcatgtgcg

SEQ ID NO: 239440 - DNA, 25 bp, Homo sapien
ttctgcatgtgcgtaaagttgtagt

SEQ ID NO: 239441 - DNA, 25 bp, Homo sapien
gtagttgctggaaataccagacgca

SEQ ID NO: 239442 - DNA, 25 bp, Homo sapien
ctgtggaagtttcactgttcttgtt

SEQ ID NO: 239443 - DNA, 25 bp, Homo sapien
gaaattaactaagtgtcagctgtca

SEQ ID NO: 239444 - DNA, 25 bp, Homo sapien
gtgtcagctgtcaggcacactgaac

SEQ ID NO: 239445 - DNA, 25 bp, Homo sapien
ggcacactgaactcaggtgatgttc

SEQ ID NO: 239446 - DNA, 25 bp, Homo sapien
ggtgatgttcattaatagctgttgt

SEQ ID NO: 239447 - DNA, 25 bp, Homo sapien
atttggattgctgcttattacttaa

SEQ ID NO: 239448 - DNA, 25 bp, Homo sapien
ggcataggccctgattacatttttt

SEQ ID NO: 239449 - DNA, 25 bp, Homo sapien
ggtaaagactcacactcagtcctat

SEQ ID NO: 239450 - DNA, 25 bp, Homo sapien
taatcaggaccgtcagtagccagcc

SEQ ID NO: 239451 - DNA, 25 bp, Homo sapien
agccagcctccaagacagtgatcgc

SEQ ID NO: 239452 - DNA, 25 bp, Homo sapien
gatcgctcctggtattcatatggct

SEQ ID NO: 239453 - DNA, 25 bp, Homo sapien
catatggcttgtgtgtagtctcctg

SEQ ID NO: 239454 - DNA, 25 bp, Homo sapien
ttgtgtgtagtctcctgtgttatac

SEQ ID NO: 239455 - DNA, 25 bp, Homo sapien
gtcaatgatacctttgtacttctcc

SEQ ID NO: 239456 - DNA, 25 bp, Homo sapien
gtacttctccaaaactgtgagccgt

SEQ ID NO: 239457 - DNA, 25 bp, Homo sapien
ctgtgagccgtttcagtttcatcgt

SEQ ID NO: 239458 - DNA, 25 bp, Homo sapien
gtttcagtttcatcgtgggacctaa

SEQ ID NO: 239459 - DNA, 25 bp, Homo sapien
cgcgctctgtcactttgcattaaga

SEQ ID NO: 239460 - DNA, 25 bp, Homo sapien
cgctctgtcactttgcattaagaaa

SEQ ID NO: 239461 - DNA, 25 bp, Homo sapien
actttgcattaagaaagcttccggg

SEQ ID NO: 239462 - DNA, 25 bp, Homo sapien
gaagaaaagaataatcgcacccgtt

SEQ ID NO: 239463 - DNA, 25 bp, Homo sapien
agaataatcgcacccgtttctcagg

SEQ ID NO: 239464 - DNA, 25 bp, Homo sapien
acccgtttctcaggtgcttacttca

SEQ ID NO: 239465 - DNA, 25 bp, Homo sapien
gtttctcaggtgcttacttcaccat

SEQ ID NO: 239466 - DNA, 25 bp, Homo sapien
aggtgcttacttcaccatgtccgat

SEQ ID NO: 239467 - DNA, 25 bp, Homo sapien
tacttcaccatgtccgatccggaca

SEQ ID NO: 239468 - DNA, 25 bp, Homo sapien
tgtccgatccggacatgaggctctg

SEQ ID NO: 239469 - DNA, 25 bp, Homo sapien
gggagaaccaccaggcgccggaatt

SEQ ID NO: 239470 - DNA, 25 bp, Homo sapien
gagaattctgtctcatatggattca

SEQ ID NO: 239471 - DNA, 25 bp, Homo sapien
tggaattagcccagagtttcagacc

SEQ ID NO: 239472 - DNA, 25 bp, Homo sapien
agagtttcagacctggtcctgtcct

SEQ ID NO: 239473 - DNA, 25 bp, Homo sapien
tgggtttcctgtcacctgtttaagt

SEQ ID NO: 239474 - DNA, 25 bp, Homo sapien
gtttaagtaccccacaggctctaca

SEQ ID NO: 239475 - DNA, 25 bp, Homo sapien
ggctctacacaacaggaggcctagg

SEQ ID NO: 239476 - DNA, 25 bp, Homo sapien
gaggcctaggaaagcaccaaggttt

SEQ ID NO: 239477 - DNA, 25 bp, Homo sapien
ggatattgactctagggccttggtg

SEQ ID NO: 239478 - DNA, 25 bp, Homo sapien
taaagcagaagtttcccaagcccct

SEQ ID NO: 239479 - DNA, 25 bp, Homo sapien
agggccttggtggaaaatgcctact

SEQ ID NO: 239480 - DNA, 25 bp, Homo sapien
gaagggcctgttattaccaagagaa

SEQ ID NO: 239481 - DNA, 25 bp, Homo sapien
cttgcatataaggacacttgtcgtg

SEQ ID NO: 239482 - DNA, 25 bp, Homo sapien
gatggtctcattcgaagatccctaa

SEQ ID NO: 239483 - DNA, 25 bp, Homo sapien
tcgaagatccctaactgaatgaatt

SEQ ID NO: 239484 - DNA, 25 bp, Homo sapien
gaatgaattctgtaaagaccccttt

SEQ ID NO: 239485 - DNA, 25 bp, Homo sapien
cttttccaatcaaggccgcatttac

SEQ ID NO: 239486 - DNA, 25 bp, Homo sapien
aaggccgcatttacagattcccgac

SEQ ID NO: 239487 - DNA, 25 bp, Homo sapien
agattcccgacacgtcactgggaag

SEQ ID NO: 239488 - DNA, 25 bp, Homo sapien
tgggaagccaccatttggtcctcaa

SEQ ID NO: 239489 - DNA, 25 bp, Homo sapien
ggctccaggcgtcccttggttctaa

SEQ ID NO: 239490 - DNA, 25 bp, Homo sapien
tggttctaaccgctgcctctgtggt

SEQ ID NO: 239491 - DNA, 25 bp, Homo sapien
gcctctgtggtcttgtggccgcctt

SEQ ID NO: 239492 - DNA, 25 bp, Homo sapien
gaaaggtactgttagtgactgataa

SEQ ID NO: 239493 - DNA, 25 bp, Homo sapien
aaggatgcctttgttttgtacatga

SEQ ID NO: 239494 - DNA, 25 bp, Homo sapien
gttttgtacatgaaccaaatctttg

SEQ ID NO: 239495 - DNA, 25 bp, Homo sapien
ccaaaatatttaggcatctgacatt

SEQ ID NO: 239496 - DNA, 25 bp, Homo sapien
attttcaaccagaatttcaattata

SEQ ID NO: 239497 - DNA, 25 bp, Homo sapien
gttgcaatacattacaatttcagag

SEQ ID NO: 239498 - DNA, 25 bp, Homo sapien
atttcagaggtactttggggctcaa

SEQ ID NO: 239499 - DNA, 25 bp, Homo sapien
aagctaggatttctaagtcagtatg

SEQ ID NO: 239500 - DNA, 25 bp, Homo sapien
ggatttctaagtcagtatgtgcatt

SEQ ID NO: 239501 - DNA, 25 bp, Homo sapien
gtcagtatgtgcatttcacacgata

SEQ ID NO: 239502 - DNA, 25 bp, Homo sapien
gtgcatttcacacgataaagctgtt

SEQ ID NO: 239503 - DNA, 25 bp, Homo sapien
cagcatggatctggctggacccgat

SEQ ID NO: 239504 - DNA, 25 bp, Homo sapien
atggatctggctggacccgatgctg

SEQ ID NO: 239505 - DNA, 25 bp, Homo sapien
gacccgatgctgtccagaactggga

SEQ ID NO: 239506 - DNA, 25 bp, Homo sapien
tgaggtatgacattcctccccggcc

SEQ ID NO: 239507 - DNA, 25 bp, Homo sapien
acactcctcaagacacatccagaga

SEQ ID NO: 239508 - DNA, 25 bp, Homo sapien
agacacatccagagactgttgctgt

SEQ ID NO: 239509 - DNA, 25 bp, Homo sapien
gtctgtgggcagagttctgtgttct

SEQ ID NO: 239510 - DNA, 25 bp, Homo sapien
ctgtgttctggccaatgtgaccgta

SEQ ID NO: 239511 - DNA, 25 bp, Homo sapien
gttctggccaatgtgaccgtagtgc

SEQ ID NO: 239512 - DNA, 25 bp, Homo sapien
ctggccaatgtgaccgtagtgccgg

SEQ ID NO: 239513 - DNA, 25 bp, Homo sapien
attccatccatcttaggcccctttg

SEQ ID NO: 239514 - DNA, 25 bp, Homo sapien
ctgcgctagcttccagggaattctt

SEQ ID NO: 239515 - DNA, 25 bp, Homo sapien
gcttccagggaattcttggagctgt

SEQ ID NO: 239516 - DNA, 25 bp, Homo sapien
ttcttggagctgtactaatactgca

SEQ ID NO: 239517 - DNA, 25 bp, Homo sapien
gcagaaaaactagtttagccttggc

SEQ ID NO: 239518 - DNA, 25 bp, Homo sapien
tttagccttggctttcagaagatgc

SEQ ID NO: 239519 - DNA, 25 bp, Homo sapien
gtgacaatggagtacattgccctaa

SEQ ID NO: 239520 - DNA, 25 bp, Homo sapien
gagtacattgccctaaagcagtatt

SEQ ID NO: 239521 - DNA, 25 bp, Homo sapien
caaaatgtgcattgtggaatccatt

SEQ ID NO: 239522 - DNA, 25 bp, Homo sapien
ggaatccatttggtctaagatcaaa

SEQ ID NO: 239523 - DNA, 25 bp, Homo sapien
gctgttgcctcgtgctaaacccagc

SEQ ID NO: 239524 - DNA, 25 bp, Homo sapien
tgctaaacccagcactagccactgg

SEQ ID NO: 239525 - DNA, 25 bp, Homo sapien
cacgctactggctacctggcaatac

SEQ ID NO: 239526 - DNA, 25 bp, Homo sapien
ttgctgcttctctaggcccctggtg

SEQ ID NO: 239527 - DNA, 25 bp, Homo sapien
aggcccctggtgcattcagaaacct

SEQ ID NO: 239528 - DNA, 25 bp, Homo sapien
cagaaacctcctgaaggccagcgga

SEQ ID NO: 239529 - DNA, 25 bp, Homo sapien
atcatgtccattgcacttcactagc

SEQ ID NO: 239530 - DNA, 25 bp, Homo sapien
ttgcacttcactagctgagcgagtt

SEQ ID NO: 239531 - DNA, 25 bp, Homo sapien
gcgagttggttctgcccttctgatc

SEQ ID NO: 239532 - DNA, 25 bp, Homo sapien
tggttctgcccttctgatccttggt

SEQ ID NO: 239533 - DNA, 25 bp, Homo sapien
gatccttggtccctcagggccagga

SEQ ID NO: 239534 - DNA, 25 bp, Homo sapien
gcaggtgtctcagtgacagcgcagt

SEQ ID NO: 239535 - DNA, 25 bp, Homo sapien
tcagtgacagcgcagtatcctccag

SEQ ID NO: 239536 - DNA, 25 bp, Homo sapien
catcagtcatgttggtgggtcagaa

SEQ ID NO: 239537 - DNA, 25 bp, Homo sapien
tgtgtgtatcctcatccttttcaac

SEQ ID NO: 239538 - DNA, 25 bp, Homo sapien
cctcatccttttcaactcttggaaa

SEQ ID NO: 239539 - DNA, 25 bp, Homo sapien
tccagagtataaataagccaccttt

SEQ ID NO: 239540 - DNA, 25 bp, Homo sapien
tttctttcattgtaccctaactttg

SEQ ID NO: 239541 - DNA, 25 bp, Homo sapien
taactttggaaactcagtctgtttt

SEQ ID NO: 239542 - DNA, 25 bp, Homo sapien
tggtgggtcagaaagttttggactt

SEQ ID NO: 239543 - DNA, 25 bp, Homo sapien
gcaatttctgtacatatacctgagt

SEQ ID NO: 239544 - DNA, 25 bp, Homo sapien
tatacctgagtacacatttattagt

SEQ ID NO: 239545 - DNA, 25 bp, Homo sapien
ttggagcatttgaatttctggatta

SEQ ID NO: 239546 - DNA, 25 bp, Homo sapien
gaatttctggattagggatacccaa

SEQ ID NO: 239547 - DNA, 25 bp, Homo sapien
atttgttgcaacttactacatagca

SEQ ID NO: 239548 - DNA, 25 bp, Homo sapien
ttactacatagcatatacccaaaat

SEQ ID NO: 239549 - DNA, 25 bp, Homo sapien
atcactgaagaaaatcgctggcatc

SEQ ID NO: 239550 - DNA, 25 bp, Homo sapien
aatcgctggcatcagtgtgcagcaa

SEQ ID NO: 239551 - DNA, 25 bp, Homo sapien
gcatcagtgtgcagcaaatttgttc

SEQ ID NO: 239552 - DNA, 25 bp, Homo sapien
tttgttcttttggtttcatcactaa

SEQ ID NO: 239553 - DNA, 25 bp, Homo sapien
gtttcatcactaacaaaagtgcctc

SEQ ID NO: 239554 - DNA, 25 bp, Homo sapien
aagtgcctcatcataaaaatacagt

SEQ ID NO: 239555 - DNA, 25 bp, Homo sapien
atacagttggtttttagggtgccat

SEQ ID NO: 239556 - DNA, 25 bp, Homo sapien
tggtttttagggtgccatattgtta

SEQ ID NO: 239557 - DNA, 25 bp, Homo sapien
aacgaatgcgttttattggtaacag

SEQ ID NO: 239558 - DNA, 25 bp, Homo sapien
gccctactcgttgtggttcagcagc

SEQ ID NO: 239559 - DNA, 25 bp, Homo sapien
gttcagcagctgtgtaatggagcaa

SEQ ID NO: 239560 - DNA, 25 bp, Homo sapien
gaatagtcactaaacagcgaaggaa

SEQ ID NO: 239561 - DNA, 25 bp, Homo sapien
attaaaagacctagcacttacctgc

SEQ ID NO: 239562 - DNA, 25 bp, Homo sapien
cttacctgctgggatgagtctctaa

SEQ ID NO: 239563 - DNA, 25 bp, Homo sapien
atgagtctctaaccccacagaattg

SEQ ID NO: 239564 - DNA, 25 bp, Homo sapien
ataacagctatcttcttgggttgta

SEQ ID NO: 239565 - DNA, 25 bp, Homo sapien
aaaagtagcattagactgcatttta

SEQ ID NO: 239566 - DNA, 25 bp, Homo sapien
gaggacataaccgtaaacagctatt

SEQ ID NO: 239567 - DNA, 25 bp, Homo sapien
agctatttaatactattccaggtag

SEQ ID NO: 239568 - DNA, 25 bp, Homo sapien
caggtagtcaaaggccaatgtataa

SEQ ID NO: 239569 - DNA, 25 bp, Homo sapien
agcctcctgggcaccggcaactatg

SEQ ID NO: 239570 - DNA, 25 bp, Homo sapien
accggcaactatgatgtcaatgtga

SEQ ID NO: 239571 - DNA, 25 bp, Homo sapien
gatgtcaatgtgatcatggccgctc

SEQ ID NO: 239572 - DNA, 25 bp, Homo sapien
tgtcaatgtgatcatggccgctctg

SEQ ID NO: 239573 - DNA, 25 bp, Homo sapien
tcaatgtgatcatggccgctctgca

SEQ ID NO: 239574 - DNA, 25 bp, Homo sapien
ggcctggccgccgtgtggtgggaca

SEQ ID NO: 239575 - DNA, 25 bp, Homo sapien
ggcggcactgggtggccctgcgcca

SEQ ID NO: 239576 - DNA, 25 bp, Homo sapien
tgcgccaggtggacggtgtctacta

SEQ ID NO: 239577 - DNA, 25 bp, Homo sapien
gccaggtggacggtgtctactacaa

SEQ ID NO: 239578 - DNA, 25 bp, Homo sapien
aggtggacggtgtctactacaacct

SEQ ID NO: 239579 - DNA, 25 bp, Homo sapien
tggactccaagctgcgggcgcccga

SEQ ID NO: 239580 - DNA, 25 bp, Homo sapien
gtgggcaccgtggcgtctcttctgc

SEQ ID NO: 239581 - DNA, 25 bp, Homo sapien
tgccctaaatctcccactctctgtt

SEQ ID NO: 239582 - DNA, 25 bp, Homo sapien
tgcttctccttcctgagggtttggg

SEQ ID NO: 239583 - DNA, 25 bp, Homo sapien
ttcctgagggtttgggaaggtcctg

SEQ ID NO: 239584 - DNA, 25 bp, Homo sapien
gtggaaggagcctgttccagcaccc

SEQ ID NO: 239585 - DNA, 25 bp, Homo sapien
ggaaggagcctgttccagcaccctt

SEQ ID NO: 239586 - DNA, 25 bp, Homo sapien
agctgcattcccacgggtggccctg

SEQ ID NO: 239587 - DNA, 25 bp, Homo sapien
cattcccacgggtggccctggagct

SEQ ID NO: 239588 - DNA, 25 bp, Homo sapien
gtgagctttgtctgggcgttgtctt

SEQ ID NO: 239589 - DNA, 25 bp, Homo sapien
ctttgtctgggcgttgtcttcggct

SEQ ID NO: 239590 - DNA, 25 bp, Homo sapien
ctgggcgttgtcttcggctggcatt

SEQ ID NO: 239591 - DNA, 25 bp, Homo sapien
aaaagctggtagcttctcttctgct

SEQ ID NO: 239592 - DNA, 25 bp, Homo sapien
gccaattctgacctttaacctttat

SEQ ID NO: 239593 - DNA, 25 bp, Homo sapien
tgtctctcatgctactgctgttgta

SEQ ID NO: 239594 - DNA, 25 bp, Homo sapien
catctatgattgctgtgctgagccc

SEQ ID NO: 239595 - DNA, 25 bp, Homo sapien
ggataaaaatcttctgatctctagt

SEQ ID NO: 239596 - DNA, 25 bp, Homo sapien
tctctagtcagaatcatgtcagcca

SEQ ID NO: 239597 - DNA, 25 bp, Homo sapien
atgtcagccaagtcaatctattctt

SEQ ID NO: 239598 - DNA, 25 bp, Homo sapien
gtaatcatagtcacaaacgttgcaa

SEQ ID NO: 239599 - DNA, 25 bp, Homo sapien
taacctttatgcttgactgccaatc

SEQ ID NO: 239600 - DNA, 25 bp, Homo sapien
tctggccccagctaaacaaaagtta

SEQ ID NO: 239601 - DNA, 25 bp, Homo sapien
aaaagttacacactcatcctgccag

SEQ ID NO: 239602 - DNA, 25 bp, Homo sapien
gggttcttggtgtccacgtcttgtg

SEQ ID NO: 239603 - DNA, 25 bp, Homo sapien
ttggtgtccacgtcttgtgggccgt

SEQ ID NO: 239604 - DNA, 25 bp, Homo sapien
tcttgtgggccgtgggcttctacct

SEQ ID NO: 239605 - DNA, 25 bp, Homo sapien
gggaagcacggtgtgttctgctttt

SEQ ID NO: 239606 - DNA, 25 bp, Homo sapien
acggtgtgttctgcttttcttttca

SEQ ID NO: 239607 - DNA, 25 bp, Homo sapien
gtgttctgcttttcttttcagattg

SEQ ID NO: 239608 - DNA, 25 bp, Homo sapien
gattgttgaaatttcattgtcatga

SEQ ID NO: 239609 - DNA, 25 bp, Homo sapien
aagacgagggactctttgtcacgtg

SEQ ID NO: 239610 - DNA, 25 bp, Homo sapien
gactctttgtcacgtgggtttgttt

SEQ ID NO: 239611 - DNA, 25 bp, Homo sapien
ttgttttctgtctccgtgcctccgg

SEQ ID NO: 239612 - DNA, 25 bp, Homo sapien
gtgcctccggcttcccaaagagatc

SEQ ID NO: 239613 - DNA, 25 bp, Homo sapien
cactactctactatctgtgtgatat

SEQ ID NO: 239614 - DNA, 25 bp, Homo sapien
tgcttcttggtacctcagctgtaaa

SEQ ID NO: 239615 - DNA, 25 bp, Homo sapien
agctgtaaaatgaaacacacctaaa

SEQ ID NO: 239616 - DNA, 25 bp, Homo sapien
ctaaaagtgtggttgtttccaacat

SEQ ID NO: 239617 - DNA, 25 bp, Homo sapien
gttgtttccaacatgtataatacag

SEQ ID NO: 239618 - DNA, 25 bp, Homo sapien
agcaacaactatctggcccaaactg

SEQ ID NO: 239619 - DNA, 25 bp, Homo sapien
gaagatgcaatggagatgacaaatt

SEQ ID NO: 239620 - DNA, 25 bp, Homo sapien
ttggaaaaaccactcatcacttaca

SEQ ID NO: 239621 - DNA, 25 bp, Homo sapien
aaaccactcatcacttacatttcat

SEQ ID NO: 239622 - DNA, 25 bp, Homo sapien
cttacatttcatgaagtacttcttt

SEQ ID NO: 239623 - DNA, 25 bp, Homo sapien
tgataaaatctgttatgggctgaat

SEQ ID NO: 239624 - DNA, 25 bp, Homo sapien
cacacaaatgctccagactgattgc

SEQ ID NO: 239625 - DNA, 25 bp, Homo sapien
cagactgattgcgaaggtgccactt

SEQ ID NO: 239626 - DNA, 25 bp, Homo sapien
aatcagctgggcaagtgcattgcat

SEQ ID NO: 239627 - DNA, 25 bp, Homo sapien
gattggagccagttgatgaaacaca

SEQ ID NO: 239628 - DNA, 25 bp, Homo sapien
aagaatctggaagcctcctgctact

SEQ ID NO: 239629 - DNA, 25 bp, Homo sapien
aatggcattccatcaccagtgttta

SEQ ID NO: 239630 - DNA, 25 bp, Homo sapien
ccagtgtttactgtggtacccaaag

SEQ ID NO: 239631 - DNA, 25 bp, Homo sapien
gtacccaaagggagctccagttact

SEQ ID NO: 239632 - DNA, 25 bp, Homo sapien
ttcctctgtgcctgtaacccttgga

SEQ ID NO: 239633 - DNA, 25 bp, Homo sapien
gtaacccttggatcacctggttgca

SEQ ID NO: 239634 - DNA, 25 bp, Homo sapien
catcctgactaaaatccctccaaag

SEQ ID NO: 239635 - DNA, 25 bp, Homo sapien
acagcagagtctcgcgtttgaccag

SEQ ID NO: 239636 - DNA, 25 bp, Homo sapien
gtttgaccagctactgcgtccaaga

SEQ ID NO: 239637 - DNA, 25 bp, Homo sapien
cgtccaagaccgactcggtggaggt

SEQ ID NO: 239638 - DNA, 25 bp, Homo sapien
gtgtgtagcccttattgctgctgga

SEQ ID NO: 239639 - DNA, 25 bp, Homo sapien
ccttattgctgctggatgggtcatc

SEQ ID NO: 239640 - DNA, 25 bp, Homo sapien
gatgggtcatccgactgggagctcc

SEQ ID NO: 239641 - DNA, 25 bp, Homo sapien
ttcttctacccctatggcatgagac

SEQ ID NO: 239642 - DNA, 25 bp, Homo sapien
gaaatcatgatgagtttctccttgt

SEQ ID NO: 239643 - DNA, 25 bp, Homo sapien
gatgagtttctccttgtttgtaaac

SEQ ID NO: 239644 - DNA, 25 bp, Homo sapien
ttgtttgtaaactgcctctgcaccg

SEQ ID NO: 239645 - DNA, 25 bp, Homo sapien
tctgcaccggctgaggttgctcggc

SEQ ID NO: 239646 - DNA, 25 bp, Homo sapien
tgggctccttcccttgacttccagg

SEQ ID NO: 239647 - DNA, 25 bp, Homo sapien
tcaagggtgggcagcgtacttctaa

SEQ ID NO: 239648 - DNA, 25 bp, Homo sapien
agggtgggcagcgtacttctaactc

SEQ ID NO: 239649 - DNA, 25 bp, Homo sapien
gtacttctaactcattgtttccctc

SEQ ID NO: 239650 - DNA, 25 bp, Homo sapien
ttctaactcattgtttccctcatgg

SEQ ID NO: 239651 - DNA, 25 bp, Homo sapien
attgtttccctcatggccgaccagg

SEQ ID NO: 239652 - DNA, 25 bp, Homo sapien
ggatagcatgcccaattttagccct

SEQ ID NO: 239653 - DNA, 25 bp, Homo sapien
agcatgcccaattttagccctgaag

SEQ ID NO: 239654 - DNA, 25 bp, Homo sapien
tgcccaattttagccctgaagcagg

SEQ ID NO: 239655 - DNA, 25 bp, Homo sapien
gggagctcccagaggaaactcttga

SEQ ID NO: 239656 - DNA, 25 bp, Homo sapien
agtggctccctgaagggcttttgtt

SEQ ID NO: 239657 - DNA, 25 bp, Homo sapien
tacggacagtcccagccaagctgct

SEQ ID NO: 239658 - DNA, 25 bp, Homo sapien
gacagtcccagccaagctgcttcga

SEQ ID NO: 239659 - DNA, 25 bp, Homo sapien
agccaagctgcttcgaccgtgtcaa

SEQ ID NO: 239660 - DNA, 25 bp, Homo sapien
aagctgcttcgaccgtgtcaaaatg

SEQ ID NO: 239661 - DNA, 25 bp, Homo sapien
gctgcttcgaccgtgtcaaaatggg

SEQ ID NO: 239662 - DNA, 25 bp, Homo sapien
gcttcgaccgtgtcaaaatgggctt

SEQ ID NO: 239663 - DNA, 25 bp, Homo sapien
gaccgtgtcaaaatgggcttcgtga

SEQ ID NO: 239664 - DNA, 25 bp, Homo sapien
ccgtgtcaaaatgggcttcgtgatg

SEQ ID NO: 239665 - DNA, 25 bp, Homo sapien
gtcaaaatgggcttcgtgatgggtt

SEQ ID NO: 239666 - DNA, 25 bp, Homo sapien
tcgtgatgggttgcgccgtgggcat

SEQ ID NO: 239667 - DNA, 25 bp, Homo sapien
gggtcgagagctgatgggcggcatt

SEQ ID NO: 239668 - DNA, 25 bp, Homo sapien
ggaagaatactgtccgtcacaatct

SEQ ID NO: 239669 - DNA, 25 bp, Homo sapien
tgtccgtcacaatctctgttttcga

SEQ ID NO: 239670 - DNA, 25 bp, Homo sapien
ttccacctaattgccctggcattaa

SEQ ID NO: 239671 - DNA, 25 bp, Homo sapien
atctctgttttcgagacagctttga

SEQ ID NO: 239672 - DNA, 25 bp, Homo sapien
ggcctcgatcttgcctctggaagtt

SEQ ID NO: 239673 - DNA, 25 bp, Homo sapien
tgaccgaggagggacaccgccgctt

SEQ ID NO: 239674 - DNA, 25 bp, Homo sapien
tgccctggcattaagaaacagttcc

SEQ ID NO: 239675 - DNA, 25 bp, Homo sapien
ttggcttccactcggctagaaagta

SEQ ID NO: 239676 - DNA, 25 bp, Homo sapien
gtggcctcaacgtgcaacagatcta

SEQ ID NO: 239677 - DNA, 25 bp, Homo sapien
gatctacagtttcactcgaaagcac

SEQ ID NO: 239678 - DNA, 25 bp, Homo sapien
tcactcgaaagcacttccccttttt

SEQ ID NO: 239679 - DNA, 25 bp, Homo sapien
gaagagattaatattaggcgcctat

SEQ ID NO: 239680 - DNA, 25 bp, Homo sapien
aggcgcctatattttgcttctaaat

SEQ ID NO: 239681 - DNA, 25 bp, Homo sapien
ttattagcagtatggtttcttttac

SEQ ID NO: 239682 - DNA, 25 bp, Homo sapien
ttcttttactgatgaacatgtttgt

SEQ ID NO: 239683 - DNA, 25 bp, Homo sapien
tactaatatctattgagtgcctact

SEQ ID NO: 239684 - DNA, 25 bp, Homo sapien
gcctactatgtgctaatctccaaca

SEQ ID NO: 239685 - DNA, 25 bp, Homo sapien
gtgctaatctccaacaaattgattt

SEQ ID NO: 239686 - DNA, 25 bp, Homo sapien
gaattatgtgccagtgttaccctca

SEQ ID NO: 239687 - DNA, 25 bp, Homo sapien
gccagtgttaccctcaaggagcaat

SEQ ID NO: 239688 - DNA, 25 bp, Homo sapien
accctcaaggagcaatactgtatat

SEQ ID NO: 239689 - DNA, 25 bp, Homo sapien
atactatgcgttagcatattctttt

SEQ ID NO: 239690 - DNA, 25 bp, Homo sapien
aggccagactgctttctcagtgtta

SEQ ID NO: 239691 - DNA, 25 bp, Homo sapien
cagtgttacttactaaagctctctt

SEQ ID NO: 239692 - DNA, 25 bp, Homo sapien
caggcttgagaccactttgatgtaa

SEQ ID NO: 239693 - DNA, 25 bp, Homo sapien
aagctgtcatagtagtttttctcac

SEQ ID NO: 239694 - DNA, 25 bp, Homo sapien
gtttttctcacagtggcacaattca

SEQ ID NO: 239695 - DNA, 25 bp, Homo sapien
aatattcagtgacgccatgtatgcc

SEQ ID NO: 239696 - DNA, 25 bp, Homo sapien
atgtatgccctatcgcttttttctc

SEQ ID NO: 239697 - DNA, 25 bp, Homo sapien
tatcgcttttttctcatccatcttt

SEQ ID NO: 239698 - DNA, 25 bp, Homo sapien
catccatctttatgctataactcat

SEQ ID NO: 239699 - DNA, 25 bp, Homo sapien
ttctccttttggcaaagcgacccca

SEQ ID NO: 239700 - DNA, 25 bp, Homo sapien
aagcgaccccattcaatatggttat

SEQ ID NO: 239701 - DNA, 25 bp, Homo sapien
gacagttacgggtataatatggcta

SEQ ID NO: 239702 - DNA, 25 bp, Homo sapien
ggagttatcctgacttaggtgacat

SEQ ID NO: 239703 - DNA, 25 bp, Homo sapien
aggtgacatacagtcccagttggca

SEQ ID NO: 239704 - DNA, 25 bp, Homo sapien
acagtcccagttggcagttacttta

SEQ ID NO: 239705 - DNA, 25 bp, Homo sapien
gttactttaaccaggagccctagca

SEQ ID NO: 239706 - DNA, 25 bp, Homo sapien
aggagccctagcataacctcaagac

SEQ ID NO: 239707 - DNA, 25 bp, Homo sapien
tagcataacctcaagactcttagaa

SEQ ID NO: 239708 - DNA, 25 bp, Homo sapien
aaagctttgaattgcacatttagat

SEQ ID NO: 239709 - DNA, 25 bp, Homo sapien
taacaggtcacactaaccggtcttg

SEQ ID NO: 239710 - DNA, 25 bp, Homo sapien
taaccggtcttgtccatattcaggg

SEQ ID NO: 239711 - DNA, 25 bp, Homo sapien
gtcttgtccatattcagggttgagt

SEQ ID NO: 239712 - DNA, 25 bp, Homo sapien
acatgtcaagacactactaccaaca

SEQ ID NO: 239713 - DNA, 25 bp, Homo sapien
aacagagctatttcaggacacctac

SEQ ID NO: 239714 - DNA, 25 bp, Homo sapien
ggacacctacctaaataactagctg

SEQ ID NO: 239715 - DNA, 25 bp, Homo sapien
aaataactagctgtctcttccactt

SEQ ID NO: 239716 - DNA, 25 bp, Homo sapien
gctgtctcttccacttaaagcaagg

SEQ ID NO: 239717 - DNA, 25 bp, Homo sapien
aggagagtcttctcttatcttcaag

SEQ ID NO: 239718 - DNA, 25 bp, Homo sapien
acagtttatgtccatgctgcagata

SEQ ID NO: 239719 - DNA, 25 bp, Homo sapien
aaatctgtcatgaggactgcaggga

SEQ ID NO: 239720 - DNA, 25 bp, Homo sapien
tagggcaggaagtcttatgacactt

SEQ ID NO: 239721 - DNA, 25 bp, Homo sapien
gtcttatgacacttggagcagctac

SEQ ID NO: 239722 - DNA, 25 bp, Homo sapien
gagcagctactcaatggaaatcaca

SEQ ID NO: 239723 - DNA, 25 bp, Homo sapien
ctttaaggcgacacggcagagaggc

SEQ ID NO: 239724 - DNA, 25 bp, Homo sapien
gcagaaaaagatgggccttaccggt

SEQ ID NO: 239725 - DNA, 25 bp, Homo sapien
aaaacggcaatgagctcagtaaaca

SEQ ID NO: 239726 - DNA, 25 bp, Homo sapien
tgttgcctgtccctctagctttgaa

SEQ ID NO: 239727 - DNA, 25 bp, Homo sapien
tgtccctctagctttgaactacaaa

SEQ ID NO: 239728 - DNA, 25 bp, Homo sapien
gtttgtctggattttcctgtagaac

SEQ ID NO: 239729 - DNA, 25 bp, Homo sapien
ctgtagaactgagggcaggacatga

SEQ ID NO: 239730 - DNA, 25 bp, Homo sapien
ttcccgtgatcttcgtggcttcccg

SEQ ID NO: 239731 - DNA, 25 bp, Homo sapien
ccgcccagacgtgtgaccaagatag

SEQ ID NO: 239732 - DNA, 25 bp, Homo sapien
tgaccaagatagcaaggagcagtct

SEQ ID NO: 239733 - DNA, 25 bp, Homo sapien
gagcagtctttaaggcgacacggca

SEQ ID NO: 239734 - DNA, 25 bp, Homo sapien
taggtggggcatgatggctctgcaa

SEQ ID NO: 239735 - DNA, 25 bp, Homo sapien
aggtggggcatgatggctctgcaat

SEQ ID NO: 239736 - DNA, 25 bp, Homo sapien
ctggccaacgtagcgaaaccttatc

SEQ ID NO: 239737 - DNA, 25 bp, Homo sapien
ggccaacgtagcgaaaccttatctc

SEQ ID NO: 239738 - DNA, 25 bp, Homo sapien
gccaacgtagcgaaaccttatctct

SEQ ID NO: 239739 - DNA, 25 bp, Homo sapien
ccaacgtagcgaaaccttatctcta

SEQ ID NO: 239740 - DNA, 25 bp, Homo sapien
acgtagcgaaaccttatctctacta

SEQ ID NO: 239741 - DNA, 25 bp, Homo sapien
tatgcctgtgatccccatgacttgg

SEQ ID NO: 239742 - DNA, 25 bp, Homo sapien
atgcctgtgatccccatgacttggg

SEQ ID NO: 239743 - DNA, 25 bp, Homo sapien
cctgtgatccccatgacttgggagg

SEQ ID NO: 239744 - DNA, 25 bp, Homo sapien
tgatccccatgacttgggaggctga

SEQ ID NO: 239745 - DNA, 25 bp, Homo sapien
agcagctgaacaggccatccctgag

SEQ ID NO: 239746 - DNA, 25 bp, Homo sapien
agctgaacaggccatccctgaggcc

SEQ ID NO: 239747 - DNA, 25 bp, Homo sapien
gtgtgacggccgaggcttccacgac

SEQ ID NO: 239748 - DNA, 25 bp, Homo sapien
gagctaatatggctggtgaaagcac

SEQ ID NO: 239749 - DNA, 25 bp, Homo sapien
atggctggtgaaagcactgggttca

SEQ ID NO: 239750 - DNA, 25 bp, Homo sapien
gaaaaagtcagcttcaggtgaggga

SEQ ID NO: 239751 - DNA, 25 bp, Homo sapien
agggagaccctggacgcctggcttt

SEQ ID NO: 239752 - DNA, 25 bp, Homo sapien
tggacgcctggctttgggctgattc

SEQ ID NO: 239753 - DNA, 25 bp, Homo sapien
tggctttgggctgattccccactca

SEQ ID NO: 239754 - DNA, 25 bp, Homo sapien
tttgggctgattccccactcacttg

SEQ ID NO: 239755 - DNA, 25 bp, Homo sapien
acttggcctctcccaagcatacttt

SEQ ID NO: 239756 - DNA, 25 bp, Homo sapien
gaaaatcgcaaatgcccatcgcggc

SEQ ID NO: 239757 - DNA, 25 bp, Homo sapien
cctgccaaggtggattgctggaatg

SEQ ID NO: 239758 - DNA, 25 bp, Homo sapien
gagaaacaaggaaccgcgagctagt

SEQ ID NO: 239759 - DNA, 25 bp, Homo sapien
gaaccgcgagctagtgagaatcacc

SEQ ID NO: 239760 - DNA, 25 bp, Homo sapien
gaatcaccatggaaaaccagggcat

SEQ ID NO: 239761 - DNA, 25 bp, Homo sapien
gaaaaccagggcattctgaagaggc

SEQ ID NO: 239762 - DNA, 25 bp, Homo sapien
gtggcgcacacaaatcacattttaa

SEQ ID NO: 239763 - DNA, 25 bp, Homo sapien
agaggcttgttgatcgcaaacccca

SEQ ID NO: 239764 - DNA, 25 bp, Homo sapien
ttgttgatcgcaaaccccactatga

SEQ ID NO: 239765 - DNA, 25 bp, Homo sapien
gaccgcagggcatctgagatagact

SEQ ID NO: 239766 - DNA, 25 bp, Homo sapien
aattgagcaaactacagggtgaaca

SEQ ID NO: 239767 - DNA, 25 bp, Homo sapien
gagagagtaaaatactctgccctgt

SEQ ID NO: 239768 - DNA, 25 bp, Homo sapien
gagtaaaatactctgccctgtaaaa

SEQ ID NO: 239769 - DNA, 25 bp, Homo sapien
aaatactctgccctgtaaaacatgg

SEQ ID NO: 239770 - DNA, 25 bp, Homo sapien
tactctgccctgtaaaacatggaag

SEQ ID NO: 239771 - DNA, 25 bp, Homo sapien
ctctgccctgtaaaacatggaagac

SEQ ID NO: 239772 - DNA, 25 bp, Homo sapien
tagataatacttaagacaactgtga

SEQ ID NO: 239773 - DNA, 25 bp, Homo sapien
caacaaaaacacaactattcctttg

SEQ ID NO: 239774 - DNA, 25 bp, Homo sapien
tattcctttgtgaccgatgaagata

SEQ ID NO: 239775 - DNA, 25 bp, Homo sapien
tcctttgtgaccgatgaagataaaa

SEQ ID NO: 239776 - DNA, 25 bp, Homo sapien
agagctcagcttctggttgtattct

SEQ ID NO: 239777 - DNA, 25 bp, Homo sapien
gcttctggttgtattctccatgagt

SEQ ID NO: 239778 - DNA, 25 bp, Homo sapien
gcaggacatgcagtcccagatggag

SEQ ID NO: 239779 - DNA, 25 bp, Homo sapien
cactttgcagccttgagaggtgcag

SEQ ID NO: 239780 - DNA, 25 bp, Homo sapien
accaccagagccaccattgtcagag

SEQ ID NO: 239781 - DNA, 25 bp, Homo sapien
accattgtcagagaggcgtccagct

SEQ ID NO: 239782 - DNA, 25 bp, Homo sapien
agagaggcgtccagctgtgtccacc

SEQ ID NO: 239783 - DNA, 25 bp, Homo sapien
ttcagggcttcttgcctggctggga

SEQ ID NO: 239784 - DNA, 25 bp, Homo sapien
tgggagctgcacaggcagactcctg

SEQ ID NO: 239785 - DNA, 25 bp, Homo sapien
cagactcctgggacggtgtgccgac

SEQ ID NO: 239786 - DNA, 25 bp, Homo sapien
ccccttctaggatctgattcctgag

SEQ ID NO: 239787 - DNA, 25 bp, Homo sapien
attcctgaggaatcacaatgtggat

SEQ ID NO: 239788 - DNA, 25 bp, Homo sapien
ggatttcacaatcacttccagtgtc

SEQ ID NO: 239789 - DNA, 25 bp, Homo sapien
caaaataacactgcaaaggctttaa

SEQ ID NO: 239790 - DNA, 25 bp, Homo sapien
aaattaccactggactcatagccca

SEQ ID NO: 239791 - DNA, 25 bp, Homo sapien
catagcccacaaaaactaagccagg

SEQ ID NO: 239792 - DNA, 25 bp, Homo sapien
aaaactaagccagggcttgcatgct

SEQ ID NO: 239793 - DNA, 25 bp, Homo sapien
gggcttgcatgctaaacacaaatgg

SEQ ID NO: 239794 - DNA, 25 bp, Homo sapien
acacaaatggagtgactgcctacta

SEQ ID NO: 239795 - DNA, 25 bp, Homo sapien
aatggagtgactgcctactaaaaat

SEQ ID NO: 239796 - DNA, 25 bp, Homo sapien
tagacaaaaggttcaggatacgatg

SEQ ID NO: 239797 - DNA, 25 bp, Homo sapien
ggatacgatgtaaaatagcctgtca

SEQ ID NO: 239798 - DNA, 25 bp, Homo sapien
gtaaaatagcctgtcataccaagaa

SEQ ID NO: 239799 - DNA, 25 bp, Homo sapien
acagatgacaacactgagacaaatc

SEQ ID NO: 239800 - DNA, 25 bp, Homo sapien
gaaagagaaactgcctattgtgtaa

SEQ ID NO: 239801 - DNA, 25 bp, Homo sapien
gggcactaggcttaagatcttatgg

SEQ ID NO: 239802 - DNA, 25 bp, Homo sapien
gatcttatgggtaaattagtaacgg

SEQ ID NO: 239803 - DNA, 25 bp, Homo sapien
gaaagaaaagattctgagtaccagt

SEQ ID NO: 239804 - DNA, 25 bp, Homo sapien
tgaaatgacacatgctgtttcatca

SEQ ID NO: 239805 - DNA, 25 bp, Homo sapien
ttcatcacctgcttttttgacttca

SEQ ID NO: 239806 - DNA, 25 bp, Homo sapien
atcacctgcttttttgacttcacac

SEQ ID NO: 239807 - DNA, 25 bp, Homo sapien
acctgcttttttgacttcacactga

SEQ ID NO: 239808 - DNA, 25 bp, Homo sapien
gcttttttgacttcacactgattgt

SEQ ID NO: 239809 - DNA, 25 bp, Homo sapien
gtgtttgttccacatgtttacttgc

SEQ ID NO: 239810 - DNA, 25 bp, Homo sapien
ttgttccacatgtttacttgctaac

SEQ ID NO: 239811 - DNA, 25 bp, Homo sapien
gtgtgctctcagcgccgcaccgacc

SEQ ID NO: 239812 - DNA, 25 bp, Homo sapien
tgtgctctcagcgccgcaccgacct

SEQ ID NO: 239813 - DNA, 25 bp, Homo sapien
gcaccgaccttcacactgcagagat

SEQ ID NO: 239814 - DNA, 25 bp, Homo sapien
caccgaccttcacactgcagagatg

SEQ ID NO: 239815 - DNA, 25 bp, Homo sapien
gagatggatgccaactccctggcag

SEQ ID NO: 239816 - DNA, 25 bp, Homo sapien
agatggatgccaactccctggcagg

SEQ ID NO: 239817 - DNA, 25 bp, Homo sapien
gatggatgccaactccctggcaggg

SEQ ID NO: 239818 - DNA, 25 bp, Homo sapien
gatgccaactccctggcaggggcag

SEQ ID NO: 239819 - DNA, 25 bp, Homo sapien
atgccaactccctggcaggggcagg

SEQ ID NO: 239820 - DNA, 25 bp, Homo sapien
tgccaactccctggcaggggcagga

SEQ ID NO: 239821 - DNA, 25 bp, Homo sapien
aactccctggcaggggcaggactgc

SEQ ID NO: 239822 - DNA, 25 bp, Homo sapien
gagaacagcgatgttgtgcgcccat

SEQ ID NO: 239823 - DNA, 25 bp, Homo sapien
gtgcgcccatttctcagatcaagga

SEQ ID NO: 239824 - DNA, 25 bp, Homo sapien
tcgacctaaggcgtgcaaacagagc

SEQ ID NO: 239825 - DNA, 25 bp, Homo sapien
tactacctccaagagtgcttttctc

SEQ ID NO: 239826 - DNA, 25 bp, Homo sapien
gaaaacatctactttgaaacatcta

SEQ ID NO: 239827 - DNA, 25 bp, Homo sapien
ttgaaacatctactgggcgagacca

SEQ ID NO: 239828 - DNA, 25 bp, Homo sapien
gagaccaggagtgatggctcagcct

SEQ ID NO: 239829 - DNA, 25 bp, Homo sapien
ggctcagcctgtaattctggaattt

SEQ ID NO: 239830 - DNA, 25 bp, Homo sapien
taattctggaatttcgggaggccga

SEQ ID NO: 239831 - DNA, 25 bp, Homo sapien
tgcaaggtcaggcaagctggattct

SEQ ID NO: 239832 - DNA, 25 bp, Homo sapien
aggcaagctggattctggtccccac

SEQ ID NO: 239833 - DNA, 25 bp, Homo sapien
aaagacagccagtttactccccact

SEQ ID NO: 239834 - DNA, 25 bp, Homo sapien
tctagcctccgactcttgaaagctt

SEQ ID NO: 239835 - DNA, 25 bp, Homo sapien
aaacacatccagaggtcacatattg

SEQ ID NO: 239836 - DNA, 25 bp, Homo sapien
acatattgggcaaccgaaggctcat

SEQ ID NO: 239837 - DNA, 25 bp, Homo sapien
ggcaaccgaaggctcatgtgaaaaa

SEQ ID NO: 239838 - DNA, 25 bp, Homo sapien
ttagagccacaaaaaccttgcgcct

SEQ ID NO: 239839 - DNA, 25 bp, Homo sapien
ccttgcgcctcagtcattaatgtaa

SEQ ID NO: 239840 - DNA, 25 bp, Homo sapien
gaagcaaactaacgcctttgaattt

SEQ ID NO: 239841 - DNA, 25 bp, Homo sapien
gagtataattacttccactcctttt

SEQ ID NO: 239842 - DNA, 25 bp, Homo sapien
tttttccactttccagtctctccga

SEQ ID NO: 239843 - DNA, 25 bp, Homo sapien
tactgaggtctcagtcatcttacaa

SEQ ID NO: 239844 - DNA, 25 bp, Homo sapien
gttctgattgcctgggagatagccc

SEQ ID NO: 239845 - DNA, 25 bp, Homo sapien
gagatagcccaaatgcctacagcct

SEQ ID NO: 239846 - DNA, 25 bp, Homo sapien
ccctgttctgtcaccacgtggacaa

SEQ ID NO: 239847 - DNA, 25 bp, Homo sapien
gctctatgccctgctgagccatggg

SEQ ID NO: 239848 - DNA, 25 bp, Homo sapien
acaattggttcagcagctggaggcc

SEQ ID NO: 239849 - DNA, 25 bp, Homo sapien
gtttgcctggatttactgatctgtt

SEQ ID NO: 239850 - DNA, 25 bp, Homo sapien
ctgatctgtttgttctggaatacgt

SEQ ID NO: 239851 - DNA, 25 bp, Homo sapien
gagcaactggtatcgctgcattctt

SEQ ID NO: 239852 - DNA, 25 bp, Homo sapien
tgcattcttccctagaggaacccaa

SEQ ID NO: 239853 - DNA, 25 bp, Homo sapien
gaacccaacagtgaccatacagctt

SEQ ID NO: 239854 - DNA, 25 bp, Homo sapien
acagcttggacagacatggtggttc

SEQ ID NO: 239855 - DNA, 25 bp, Homo sapien
gtatgtagcactttcctatatattt

SEQ ID NO: 239856 - DNA, 25 bp, Homo sapien
cacattgaaaactggactgggtata

SEQ ID NO: 239857 - DNA, 25 bp, Homo sapien
tgaaaactggactgggtataactat

SEQ ID NO: 239858 - DNA, 25 bp, Homo sapien
aaaaggcacaatggtactacagaat

SEQ ID NO: 239859 - DNA, 25 bp, Homo sapien
gttttctgttctacaaagttgatgc

SEQ ID NO: 239860 - DNA, 25 bp, Homo sapien
gatgcttaagcatcaagctgatttt

SEQ ID NO: 239861 - DNA, 25 bp, Homo sapien
tgtgatcatgaaggaatcagattcc

SEQ ID NO: 239862 - DNA, 25 bp, Homo sapien
atcagattccctatgtaaagcagtt

SEQ ID NO: 239863 - DNA, 25 bp, Homo sapien
gtaggtctaacataatgccagttcc

SEQ ID NO: 239864 - DNA, 25 bp, Homo sapien
tgccagttccactttaactttgttt

SEQ ID NO: 239865 - DNA, 25 bp, Homo sapien
gaagaatgtatgtagcactttccta

SEQ ID NO: 239866 - DNA, 25 bp, Homo sapien
gctctcatggagcttacaatcaata

SEQ ID NO: 239867 - DNA, 25 bp, Homo sapien
gagcttacaatcaataggttaccga

SEQ ID NO: 239868 - DNA, 25 bp, Homo sapien
ggttaccgagcatattcgtctgcta

SEQ ID NO: 239869 - DNA, 25 bp, Homo sapien
tattcgtctgctacaagtttgatta

SEQ ID NO: 239870 - DNA, 25 bp, Homo sapien
ggacactttgtgttgagtagtcttg

SEQ ID NO: 239871 - DNA, 25 bp, Homo sapien
gagtagtcttgttctatttgagtac

SEQ ID NO: 239872 - DNA, 25 bp, Homo sapien
tgagtacttgtttgagcttactcct

SEQ ID NO: 239873 - DNA, 25 bp, Homo sapien
agtggtaaccatttgtttgtacaca

SEQ ID NO: 239874 - DNA, 25 bp, Homo sapien
ccatttgtttgtacacattgtgcca

SEQ ID NO: 239875 - DNA, 25 bp, Homo sapien
cattgtgccattgaaaactacgttt

SEQ ID NO: 239876 - DNA, 25 bp, Homo sapien
aactacgtttttacagacacttatg

SEQ ID NO: 239877 - DNA, 25 bp, Homo sapien
gcagacagccctgtttcttgggaaa

SEQ ID NO: 239878 - DNA, 25 bp, Homo sapien
ggactattggcttcagatggctgtt

SEQ ID NO: 239879 - DNA, 25 bp, Homo sapien
atatcaacctattgctgtcctgagc

SEQ ID NO: 239880 - DNA, 25 bp, Homo sapien
gcacagtggtggcaaaagcttattt

SEQ ID NO: 239881 - DNA, 25 bp, Homo sapien
gtgtacaatcactggcttcatactt

SEQ ID NO: 239882 - DNA, 25 bp, Homo sapien
actggcttcatacttccagagaaga

SEQ ID NO: 239883 - DNA, 25 bp, Homo sapien
gaagatctgtctcctattggaacat

SEQ ID NO: 239884 - DNA, 25 bp, Homo sapien
atctctgtcactactttgatgaacc

SEQ ID NO: 239885 - DNA, 25 bp, Homo sapien
tttgatgaaccgaagttagctccat

SEQ ID NO: 239886 - DNA, 25 bp, Homo sapien
ttagctccatgggttacactgtccg

SEQ ID NO: 239887 - DNA, 25 bp, Homo sapien
tacactgtccgttcaaggctttgca

SEQ ID NO: 239888 - DNA, 25 bp, Homo sapien
cgaattgctcaatgctattatgaaa

SEQ ID NO: 239889 - DNA, 25 bp, Homo sapien
gagttctctgcagttctgggatcaa

SEQ ID NO: 239890 - DNA, 25 bp, Homo sapien
tgggatcaaacctcagtgccttgtc

SEQ ID NO: 239891 - DNA, 25 bp, Homo sapien
agtgccttgtcctaacgtcccatta

SEQ ID NO: 239892 - DNA, 25 bp, Homo sapien
gtcccattaggacagaagtgccctt

SEQ ID NO: 239893 - DNA, 25 bp, Homo sapien
gaagtgcccttcctgagagtatggc

SEQ ID NO: 239894 - DNA, 25 bp, Homo sapien
taatgacattctagcacctggaccg

SEQ ID NO: 239895 - DNA, 25 bp, Homo sapien
tctagcacctggaccgattacactg

SEQ ID NO: 239896 - DNA, 25 bp, Homo sapien
ctgctctccctgaagtagtggattc

SEQ ID NO: 239897 - DNA, 25 bp, Homo sapien
tagtggattctttcatcagcaggag

SEQ ID NO: 239898 - DNA, 25 bp, Homo sapien
ggagcctgacagtgtgtattttatt

SEQ ID NO: 239899 - DNA, 25 bp, Homo sapien
ggtcatgtggaacagctgagcttct

SEQ ID NO: 239900 - DNA, 25 bp, Homo sapien
aactgtcctctgagtctgagggctg

SEQ ID NO: 239901 - DNA, 25 bp, Homo sapien
gccacaggacagtccctgggctgca

SEQ ID NO: 239902 - DNA, 25 bp, Homo sapien
ctgggctgcaggactgtcagtgctt

SEQ ID NO: 239903 - DNA, 25 bp, Homo sapien
aggactgtcagtgcttgttgtgtga

SEQ ID NO: 239904 - DNA, 25 bp, Homo sapien
ctgtcagtgcttgttgtgtgaggaa

SEQ ID NO: 239905 - DNA, 25 bp, Homo sapien
ttgttgtgtgaggaaatgaggccct

SEQ ID NO: 239906 - DNA, 25 bp, Homo sapien
atgaggcccttcaaaaacccagtca

SEQ ID NO: 239907 - DNA, 25 bp, Homo sapien
caaaaacccagtcatcttgacagag

SEQ ID NO: 239908 - DNA, 25 bp, Homo sapien
ttgacagagggcacactcccaagga

SEQ ID NO: 239909 - DNA, 25 bp, Homo sapien
acactcccaaggaaggcctgactgg

SEQ ID NO: 239910 - DNA, 25 bp, Homo sapien
acaaattgtgcatacccacacacat

SEQ ID NO: 239911 - DNA, 25 bp, Homo sapien
acccacacacatataccacagatat

SEQ ID NO: 239912 - DNA, 25 bp, Homo sapien
gtgaactgtgggatttcttgaaact

SEQ ID NO: 239913 - DNA, 25 bp, Homo sapien
gaaactttttgaaaactctcattag

SEQ ID NO: 239914 - DNA, 25 bp, Homo sapien
aaactctcattagtctgtgtttgtg

SEQ ID NO: 239915 - DNA, 25 bp, Homo sapien
gtgtggtttctttaaattatctctt

SEQ ID NO: 239916 - DNA, 25 bp, Homo sapien
gtgttttgaatttgagtctttgcca

SEQ ID NO: 239917 - DNA, 25 bp, Homo sapien
gtctttgccattcataaggcgggct

SEQ ID NO: 239918 - DNA, 25 bp, Homo sapien
taaggcgggctttccttgaatacca

SEQ ID NO: 239919 - DNA, 25 bp, Homo sapien
gcgggctttccttgaataccagata

SEQ ID NO: 239920 - DNA, 25 bp, Homo sapien
ataccagataactctgagtttcctg

SEQ ID NO: 239921 - DNA, 25 bp, Homo sapien
ccctggagaaagagcccaatgagaa

SEQ ID NO: 239922 - DNA, 25 bp, Homo sapien
taaggatgaagcttcaggagaggcc

SEQ ID NO: 239923 - DNA, 25 bp, Homo sapien
ggagaggccttatcaatcctgacaa

SEQ ID NO: 239924 - DNA, 25 bp, Homo sapien
aatcctgacaacaaacttttctcgt

SEQ ID NO: 239925 - DNA, 25 bp, Homo sapien
caacaaacttttctcgtcaatttag

SEQ ID NO: 239926 - DNA, 25 bp, Homo sapien
gaaggctattaaaattggttccagc

SEQ ID NO: 239927 - DNA, 25 bp, Homo sapien
attggttccagctatctaagataca

SEQ ID NO: 239928 - DNA, 25 bp, Homo sapien
cacacgcgcacacacggtagagata

SEQ ID NO: 239929 - DNA, 25 bp, Homo sapien
gcgcacacacggtagagataaatat

SEQ ID NO: 239930 - DNA, 25 bp, Homo sapien
tatgttcgaaaatccagctcaatgt

SEQ ID NO: 239931 - DNA, 25 bp, Homo sapien
aaatccagctcaatgttactagaaa

SEQ ID NO: 239932 - DNA, 25 bp, Homo sapien
attgcctttgcaatgcaggccttag

SEQ ID NO: 239933 - DNA, 25 bp, Homo sapien
aggccttagaaccacccctagatat

SEQ ID NO: 239934 - DNA, 25 bp, Homo sapien
gaaccacccctagatattgcatatg

SEQ ID NO: 239935 - DNA, 25 bp, Homo sapien
acccctagatattgcatatggagca

SEQ ID NO: 239936 - DNA, 25 bp, Homo sapien
gagcagatggagaagtttttaatga

SEQ ID NO: 239937 - DNA, 25 bp, Homo sapien
atgattgcaaataccgccgcagcta

SEQ ID NO: 239938 - DNA, 25 bp, Homo sapien
cgcagctacgactcggatttcactg

SEQ ID NO: 239939 - DNA, 25 bp, Homo sapien
actcggatttcactgctcccttagt

SEQ ID NO: 239940 - DNA, 25 bp, Homo sapien
ttagtcctctatcacgtgtggcctg

SEQ ID NO: 239941 - DNA, 25 bp, Homo sapien
acgtgtggcctgctctcatggagaa

SEQ ID NO: 239942 - DNA, 25 bp, Homo sapien
gctctcatggagaatgactgtgtca

SEQ ID NO: 239943 - DNA, 25 bp, Homo sapien
ttgctatattgagtcctgtgcggat

SEQ ID NO: 239944 - DNA, 25 bp, Homo sapien
tgcggatttgacacaggtacactta

SEQ ID NO: 239945 - DNA, 25 bp, Homo sapien
tacacttagcagtactccgaggtct

SEQ ID NO: 239946 - DNA, 25 bp, Homo sapien
agtactccgaggtctgctgtggtgt

SEQ ID NO: 239947 - DNA, 25 bp, Homo sapien
tctgctgtggtgttacttgtgtgag

SEQ ID NO: 239948 - DNA, 25 bp, Homo sapien
gtccagttatttcatttatctccaa

SEQ ID NO: 239949 - DNA, 25 bp, Homo sapien
caaaaactcatcttgcagggcaatc

SEQ ID NO: 239950 - DNA, 25 bp, Homo sapien
agggcaatctgtagctgcctcagat

SEQ ID NO: 239951 - DNA, 25 bp, Homo sapien
gataaattcaagtagggcccatggg

SEQ ID NO: 239952 - DNA, 25 bp, Homo sapien
ggcccatgggataattgctggcttt

SEQ ID NO: 239953 - DNA, 25 bp, Homo sapien
caaatgtgctttgattaccaagaaa

SEQ ID NO: 239954 - DNA, 25 bp, Homo sapien
aatacagtcattgcagtcagaacag

SEQ ID NO: 239955 - DNA, 25 bp, Homo sapien
aaccttgtgtggtgttttcaagctc

SEQ ID NO: 239956 - DNA, 25 bp, Homo sapien
tttttggcatttgaccttgtattct

SEQ ID NO: 239957 - DNA, 25 bp, Homo sapien
gaccttgtattctttctgaagctct

SEQ ID NO: 239958 - DNA, 25 bp, Homo sapien
ttctttctgaagctctatatgtgtt

SEQ ID NO: 239959 - DNA, 25 bp, Homo sapien
atctggcaagtagcactttgcctgt

SEQ ID NO: 239960 - DNA, 25 bp, Homo sapien
tagcactttgcctgtgcagtttgct

SEQ ID NO: 239961 - DNA, 25 bp, Homo sapien
cagtttgctggagtgtagatgtaca

SEQ ID NO: 239962 - DNA, 25 bp, Homo sapien
gcataactagttgaaattggccatt

SEQ ID NO: 239963 - DNA, 25 bp, Homo sapien
gaaattggccattcgtaccatgaat

SEQ ID NO: 239964 - DNA, 25 bp, Homo sapien
aaatctgatagtttccttgttagga

SEQ ID NO: 239965 - DNA, 25 bp, Homo sapien
gaggtaatcgagactcctcaatggg

SEQ ID NO: 239966 - DNA, 25 bp, Homo sapien
gggaaagtcagtgctcatctggccc

SEQ ID NO: 239967 - DNA, 25 bp, Homo sapien
atctggcccctagtgtgcctgttga

SEQ ID NO: 239968 - DNA, 25 bp, Homo sapien
gtgcctgttgagctgaaatatttta

SEQ ID NO: 239969 - DNA, 25 bp, Homo sapien
gcttaacaaatcaccaaatgctcag

SEQ ID NO: 239970 - DNA, 25 bp, Homo sapien
aaatgctcagtgaatacctattatg

SEQ ID NO: 239971 - DNA, 25 bp, Homo sapien
cctattatgtgtcatgagctctatg

SEQ ID NO: 239972 - DNA, 25 bp, Homo sapien
catgagctctatgaggtagcttttt

SEQ ID NO: 239973 - DNA, 25 bp, Homo sapien
tcatacagtcgtattttggcaaata

SEQ ID NO: 239974 - DNA, 25 bp, Homo sapien
agaactcttgaacccagctatgcat

SEQ ID NO: 239975 - DNA, 25 bp, Homo sapien
gaacccagctatgcatacaagaaaa

SEQ ID NO: 239976 - DNA, 25 bp, Homo sapien
tttgtgacaagacttttgggagtga

SEQ ID NO: 239977 - DNA, 25 bp, Homo sapien
gacaagacttttgggagtgattcac

SEQ ID NO: 239978 - DNA, 25 bp, Homo sapien
aagacttttgggagtgattcacacc

SEQ ID NO: 239979 - DNA, 25 bp, Homo sapien
acttttgggagtgattcacacctga

SEQ ID NO: 239980 - DNA, 25 bp, Homo sapien
gagtgattcacacctgaaacaacat

SEQ ID NO: 239981 - DNA, 25 bp, Homo sapien
attcacacctgaaacaacatactgg

SEQ ID NO: 239982 - DNA, 25 bp, Homo sapien
acacctgaaacaacatactggactt

SEQ ID NO: 239983 - DNA, 25 bp, Homo sapien
tgaaacaacatactggacttcacac

SEQ ID NO: 239984 - DNA, 25 bp, Homo sapien
tcacaactttcacttcatcatagaa

SEQ ID NO: 239985 - DNA, 25 bp, Homo sapien
aactttcacttcatcatagaattca

SEQ ID NO: 239986 - DNA, 25 bp, Homo sapien
acttcatcatagaattcatgctggg

SEQ ID NO: 239987 - DNA, 25 bp, Homo sapien
tatgtttctgggaatagagccgaat

SEQ ID NO: 239988 - DNA, 25 bp, Homo sapien
gccgaatgttgtagctgatggaatg

SEQ ID NO: 239989 - DNA, 25 bp, Homo sapien
agttgtctcagaatcatcctccgtt

SEQ ID NO: 239990 - DNA, 25 bp, Homo sapien
tggagtctcataccattgattttgc

SEQ ID NO: 239991 - DNA, 25 bp, Homo sapien
tggacaagtgccctgccatgttact

SEQ ID NO: 239992 - DNA, 25 bp, Homo sapien
tcagaatcatcctccgttgacatct

SEQ ID NO: 239993 - DNA, 25 bp, Homo sapien
ggcagaatagagcacattgtatcat

SEQ ID NO: 239994 - DNA, 25 bp, Homo sapien
gtatcatttataggcctctcacagt

SEQ ID NO: 239995 - DNA, 25 bp, Homo sapien
gttgacatctccatctccaggacag

SEQ ID NO: 239996 - DNA, 25 bp, Homo sapien
tccaggacagctccacaataatctg

SEQ ID NO: 239997 - DNA, 25 bp, Homo sapien
aaatccagtctaatcagtttgatgt

SEQ ID NO: 239998 - DNA, 25 bp, Homo sapien
cctgttactaggtttgagttacatg

SEQ ID NO: 239999 - DNA, 25 bp, Homo sapien
gagttacatggttgagttgccaaat

SEQ ID NO: 240000 - DNA, 25 bp, Homo sapien
gagttgccaaattatttacatgctt

SEQ ID NO: 240001 - DNA, 25 bp, Homo sapien
acatgctttgtttaaattcttcatc

SEQ ID NO: 240002 - DNA, 25 bp, Homo sapien
attcttcatcacctagcaactgttt

SEQ ID NO: 240003 - DNA, 25 bp, Homo sapien
gcaactgtttgctgatcatggattt

SEQ ID NO: 240004 - DNA, 25 bp, Homo sapien
ctgatcatggatttacttagttact

SEQ ID NO: 240005 - DNA, 25 bp, Homo sapien
taccatttggaaaagaactcaattg

SEQ ID NO: 240006 - DNA, 25 bp, Homo sapien
tgggaaatgtgatgacgtattgtac

SEQ ID NO: 240007 - DNA, 25 bp, Homo sapien
gacgtattgtacatgttactttttc

SEQ ID NO: 240008 - DNA, 25 bp, Homo sapien
atatactcccacattataacttaga

SEQ ID NO: 240009 - DNA, 25 bp, Homo sapien
cacattatcatgtgtcaccaactag

SEQ ID NO: 240010 - DNA, 25 bp, Homo sapien
gtgtcaccaactagacagacaaaga

SEQ ID NO: 240011 - DNA, 25 bp, Homo sapien
aaaaagtcggctaacagtgttggca

SEQ ID NO: 240012 - DNA, 25 bp, Homo sapien
gctaacagtgttggcaacggcacgg

SEQ ID NO: 240013 - DNA, 25 bp, Homo sapien
aataaggtctccacaccccactggt

SEQ ID NO: 240014 - DNA, 25 bp, Homo sapien
cacaccccactggttagagcagaag

SEQ ID NO: 240015 - DNA, 25 bp, Homo sapien
cagcctcttcaggagaactggcaat

SEQ ID NO: 240016 - DNA, 25 bp, Homo sapien
ctagaaattgatcgcaacaaacaca

SEQ ID NO: 240017 - DNA, 25 bp, Homo sapien
atacataagaattagaggccaggaa

SEQ ID NO: 240018 - DNA, 25 bp, Homo sapien
gaaaatatgctcaatctcacttaca

SEQ ID NO: 240019 - DNA, 25 bp, Homo sapien
agaaatgcaaaccacattatcatgt

SEQ ID NO: 240020 - DNA, 25 bp, Homo sapien
gcccacaggaatataagcatcttat

SEQ ID NO: 240021 - DNA, 25 bp, Homo sapien
aagaaacttatatctcagcaatgag

SEQ ID NO: 240022 - DNA, 25 bp, Homo sapien
aaactcatgatcctttctcataaag

SEQ ID NO: 240023 - DNA, 25 bp, Homo sapien
ttctcataaagtaaaccaactgctg

SEQ ID NO: 240024 - DNA, 25 bp, Homo sapien
tgaactaaccaaactcaagcccatg

SEQ ID NO: 240025 - DNA, 25 bp, Homo sapien
caagcccatggtattgagtccacat

SEQ ID NO: 240026 - DNA, 25 bp, Homo sapien
tggtattgagtccacattgcagata

SEQ ID NO: 240027 - DNA, 25 bp, Homo sapien
gagtccacattgcagataacagccc

SEQ ID NO: 240028 - DNA, 25 bp, Homo sapien
gagtaagtggcaagaaaacaccatt

SEQ ID NO: 240029 - DNA, 25 bp, Homo sapien
gtgatgtgtgtgtgctaataccagt

SEQ ID NO: 240030 - DNA, 25 bp, Homo sapien
gtgtgtgtgctaataccagtaagta

SEQ ID NO: 240031 - DNA, 25 bp, Homo sapien
atttgcctgatggagtggccagctc

SEQ ID NO: 240032 - DNA, 25 bp, Homo sapien
gccccatgttgcataggtggcctat

SEQ ID NO: 240033 - DNA, 25 bp, Homo sapien
cctaccttctattgctttacctaat

SEQ ID NO: 240034 - DNA, 25 bp, Homo sapien
aaattgctaaccgaagactttgcta

SEQ ID NO: 240035 - DNA, 25 bp, Homo sapien
ctttgctaagcaaacccaggtctgc

SEQ ID NO: 240036 - DNA, 25 bp, Homo sapien
aacccaggtctgcttgatgtcagag

SEQ ID NO: 240037 - DNA, 25 bp, Homo sapien
gatgtcagagcccttgctgttaacc

SEQ ID NO: 240038 - DNA, 25 bp, Homo sapien
tgctgttaaccccatttactgctta

SEQ ID NO: 240039 - DNA, 25 bp, Homo sapien
aggtggcctataaccagtcagacac

SEQ ID NO: 240040 - DNA, 25 bp, Homo sapien
atttactgcttagcctccaaagaga

SEQ ID NO: 240041 - DNA, 25 bp, Homo sapien
ttctgacattaccacatttgcctga

SEQ ID NO: 240042 - DNA, 25 bp, Homo sapien
aatgaatgcttcctctgtgttggac

SEQ ID NO: 240043 - DNA, 25 bp, Homo sapien
ctgtgttggacattcatcagtgctt

SEQ ID NO: 240044 - DNA, 25 bp, Homo sapien
cactattggcattttgggtggacag

SEQ ID NO: 240045 - DNA, 25 bp, Homo sapien
cattttgggtggacagttctttggt

SEQ ID NO: 240046 - DNA, 25 bp, Homo sapien
tctttggtgtgtgggaatggcccac

SEQ ID NO: 240047 - DNA, 25 bp, Homo sapien
atacttgcccattatattctagtag

SEQ ID NO: 240048 - DNA, 25 bp, Homo sapien
ttctagtagtagtctcagtcatgcg

SEQ ID NO: 240049 - DNA, 25 bp, Homo sapien
gtagtctcagtcatgcgacatcaaa

SEQ ID NO: 240050 - DNA, 25 bp, Homo sapien
aaaattgtaactcccattccctgtg

SEQ ID NO: 240051 - DNA, 25 bp, Homo sapien
aagaatgagccttccaagagattgt

SEQ ID NO: 240052 - DNA, 25 bp, Homo sapien
gccttccaagagattgtgctctgaa

SEQ ID NO: 240053 - DNA, 25 bp, Homo sapien
cgcctggctgtgacaaggttaagtc

SEQ ID NO: 240054 - DNA, 25 bp, Homo sapien
gtcaagtcattagggattaacatac

SEQ ID NO: 240055 - DNA, 25 bp, Homo sapien
agggattaacatacgtaaacctatg

SEQ ID NO: 240056 - DNA, 25 bp, Homo sapien
atacgtaaacctatgtaacatatgt

SEQ ID NO: 240057 - DNA, 25 bp, Homo sapien
gaagatgttatagacttggctagac

SEQ ID NO: 240058 - DNA, 25 bp, Homo sapien
agacttggctagacagcagtggctg

SEQ ID NO: 240059 - DNA, 25 bp, Homo sapien
ggatgtggcatgaaagcctggcttt

SEQ ID NO: 240060 - DNA, 25 bp, Homo sapien
gggacccagttctgtgattttagcc

SEQ ID NO: 240061 - DNA, 25 bp, Homo sapien
gacccagttctgtgattttagcctg

SEQ ID NO: 240062 - DNA, 25 bp, Homo sapien
agttctgtgattttagcctggtaaa

SEQ ID NO: 240063 - DNA, 25 bp, Homo sapien
tctgtgattttagcctggtaaagat

SEQ ID NO: 240064 - DNA, 25 bp, Homo sapien
gacttccttggccttagatgagtcc

SEQ ID NO: 240065 - DNA, 25 bp, Homo sapien
ttggccttagatgagtccctattta

SEQ ID NO: 240066 - DNA, 25 bp, Homo sapien
tgagtccctatttagaggaaggcaa

SEQ ID NO: 240067 - DNA, 25 bp, Homo sapien
ggcaaatcaaggtgatcccaaaacg

SEQ ID NO: 240068 - DNA, 25 bp, Homo sapien
aacagaccaggcatcagcacaacag

SEQ ID NO: 240069 - DNA, 25 bp, Homo sapien
agctcccgctctcgattctacagtg

SEQ ID NO: 240070 - DNA, 25 bp, Homo sapien
ctcccgctctcgattctacagtggt

SEQ ID NO: 240071 - DNA, 25 bp, Homo sapien
tacagtggttttaacagcaggcccc

SEQ ID NO: 240072 - DNA, 25 bp, Homo sapien
ccgggctagagcgacatcatggtat

SEQ ID NO: 240073 - DNA, 25 bp, Homo sapien
acatcatggtattccccttactaaa

SEQ ID NO: 240074 - DNA, 25 bp, Homo sapien
aaaaagtgtgtattaggaggagaga

SEQ ID NO: 240075 - DNA, 25 bp, Homo sapien
tgtcagagatctgatggatccgaaa

SEQ ID NO: 240076 - DNA, 25 bp, Homo sapien
cagagatctgatggatccgaaaggg

SEQ ID NO: 240077 - DNA, 25 bp, Homo sapien
ttggggtcagaggttctgttttcca

SEQ ID NO: 240078 - DNA, 25 bp, Homo sapien
gggtgagataggcctggatcatgcc

SEQ ID NO: 240079 - DNA, 25 bp, Homo sapien
tggatcatgccctctgccatgccct

SEQ ID NO: 240080 - DNA, 25 bp, Homo sapien
ctccagctaggaggatcttgagtca

SEQ ID NO: 240081 - DNA, 25 bp, Homo sapien
ccagctaggaggatcttgagtcaga

SEQ ID NO: 240082 - DNA, 25 bp, Homo sapien
cagctaggaggatcttgagtcagag

SEQ ID NO: 240083 - DNA, 25 bp, Homo sapien
gatcttgagtcagagaggattggaa

SEQ ID NO: 240084 - DNA, 25 bp, Homo sapien
gagaggattggaagtgctttctcct

SEQ ID NO: 240085 - DNA, 25 bp, Homo sapien
gaggattggaagtgctttctcctcc

SEQ ID NO: 240086 - DNA, 25 bp, Homo sapien
gaggaaaggccctgctgttttccac

SEQ ID NO: 240087 - DNA, 25 bp, Homo sapien
tgctgttttccacctaccacgttgt

SEQ ID NO: 240088 - DNA, 25 bp, Homo sapien
acctaccacgttgtctgatttcata

SEQ ID NO: 240089 - DNA, 25 bp, Homo sapien
gtctgatttcataaaagggctgtgg

SEQ ID NO: 240090 - DNA, 25 bp, Homo sapien
aaagacgaatggcaggcttcttccc

SEQ ID NO: 240091 - DNA, 25 bp, Homo sapien
gaagccaggaagacttggacaagca

SEQ ID NO: 240092 - DNA, 25 bp, Homo sapien
gaagacttggacaagcaacaagcaa

SEQ ID NO: 240093 - DNA, 25 bp, Homo sapien
aacaagcaacagtggctatcgtatt

SEQ ID NO: 240094 - DNA, 25 bp, Homo sapien
cagtggctatcgtatttattcagtg

SEQ ID NO: 240095 - DNA, 25 bp, Homo sapien
ttattcagtgtcttcgctgagccac

SEQ ID NO: 240096 - DNA, 25 bp, Homo sapien
gtgtcttcgctgagccacagcctca

SEQ ID NO: 240097 - DNA, 25 bp, Homo sapien
aggccatcccttagccagagtgcag

SEQ ID NO: 240098 - DNA, 25 bp, Homo sapien
ttcctgtgtggccttcttacggcag

SEQ ID NO: 240099 - DNA, 25 bp, Homo sapien
cccaatattctctcatatcctcaga

SEQ ID NO: 240100 - DNA, 25 bp, Homo sapien
atcttcagcttccatccatggatgt

SEQ ID NO: 240101 - DNA, 25 bp, Homo sapien
catggatgttggctgaatcctgagt

SEQ ID NO: 240102 - DNA, 25 bp, Homo sapien
gggtcgtagaaagatctggtcctgt

SEQ ID NO: 240103 - DNA, 25 bp, Homo sapien
agaaagatctggtcctgtgagtagg

SEQ ID NO: 240104 - DNA, 25 bp, Homo sapien
agggacttcagctgggctgtctaca

SEQ ID NO: 240105 - DNA, 25 bp, Homo sapien
ttcttacggcagtccacagggaagt

SEQ ID NO: 240106 - DNA, 25 bp, Homo sapien
gggctgtctacaacctgagtctaaa

SEQ ID NO: 240107 - DNA, 25 bp, Homo sapien
gtccacagggaagtggcctcatttt

SEQ ID NO: 240108 - DNA, 25 bp, Homo sapien
catgggcaatatgggctcaggccac

SEQ ID NO: 240109 - DNA, 25 bp, Homo sapien
gcaatatgggctcaggccactcctt

SEQ ID NO: 240110 - DNA, 25 bp, Homo sapien
actgtccctaccgtgagtcaggaat

SEQ ID NO: 240111 - DNA, 25 bp, Homo sapien
gtccctaccgtgagtcaggaatgac

SEQ ID NO: 240112 - DNA, 25 bp, Homo sapien
ggaatgactcctgactcacagtggg

SEQ ID NO: 240113 - DNA, 25 bp, Homo sapien
gagggaacacagacacagtcttcca

SEQ ID NO: 240114 - DNA, 25 bp, Homo sapien
agtcttccatgctccccaggtggtc

SEQ ID NO: 240115 - DNA, 25 bp, Homo sapien
caacctgcctcaccttggttattcg

SEQ ID NO: 240116 - DNA, 25 bp, Homo sapien
ctcaccttggttattcgcattgcaa

SEQ ID NO: 240117 - DNA, 25 bp, Homo sapien
tattcgcattgcaaggagtcattac

SEQ ID NO: 240118 - DNA, 25 bp, Homo sapien
gcaaggagtcattaccatgggcaat

SEQ ID NO: 240119 - DNA, 25 bp, Homo sapien
acaagttcacactctgtgtttctcc

SEQ ID NO: 240120 - DNA, 25 bp, Homo sapien
gtgtttctcctcctgttagccattc

SEQ ID NO: 240121 - DNA, 25 bp, Homo sapien
ttcccaccctgctgatgtttaagga

SEQ ID NO: 240122 - DNA, 25 bp, Homo sapien
gaaagccagggatgatgacccactt

SEQ ID NO: 240123 - DNA, 25 bp, Homo sapien
gggatgatgacccacttaagctttc

SEQ ID NO: 240124 - DNA, 25 bp, Homo sapien
tttccttggccttgttaagtccaat

SEQ ID NO: 240125 - DNA, 25 bp, Homo sapien
ggccttgttaagtccaatcatctgg

SEQ ID NO: 240126 - DNA, 25 bp, Homo sapien
aaatgctcattgcaatctttgaccc

SEQ ID NO: 240127 - DNA, 25 bp, Homo sapien
cccactaactgctgtggtgactttg

SEQ ID NO: 240128 - DNA, 25 bp, Homo sapien
atctcactcacatagacagtctctg

SEQ ID NO: 240129 - DNA, 25 bp, Homo sapien
atagacagtctctgggtaggcaggt

SEQ ID NO: 240130 - DNA, 25 bp, Homo sapien
caaaggctgggatcaaatggtggct

SEQ ID NO: 240131 - DNA, 25 bp, Homo sapien
aaatggtggctgtgtaaatctctgg

SEQ ID NO: 240132 - DNA, 25 bp, Homo sapien
tggctgtgtaaatctctggagtcat

SEQ ID NO: 240133 - DNA, 25 bp, Homo sapien
gtaaatctctggagtcattttattc

SEQ ID NO: 240134 - DNA, 25 bp, Homo sapien
attttattccatcagactcttcaca

SEQ ID NO: 240135 - DNA, 25 bp, Homo sapien
agactcttcacaactattcctatct

SEQ ID NO: 240136 - DNA, 25 bp, Homo sapien
attcctatctcccacaggaggagtg

SEQ ID NO: 240137 - DNA, 25 bp, Homo sapien
actttggattcttatttgtcatttt

SEQ ID NO: 240138 - DNA, 25 bp, Homo sapien
ggaacagcttaaaagtcaagtcatt

SEQ ID NO: 240139 - DNA, 25 bp, Homo sapien
caagtcatttgatcctagttctgat

SEQ ID NO: 240140 - DNA, 25 bp, Homo sapien
atcctagttctgatgtttgtactgg

SEQ ID NO: 240141 - DNA, 25 bp, Homo sapien
aactacaacagctcccgctctcgat

SEQ ID NO: 240142 - DNA, 25 bp, Homo sapien
actacaacagctcccgctctcgatt

SEQ ID NO: 240143 - DNA, 25 bp, Homo sapien
ctacaacagctcccgctctcgattc

SEQ ID NO: 240144 - DNA, 25 bp, Homo sapien
tacaacagctcccgctctcgattct

SEQ ID NO: 240145 - DNA, 25 bp, Homo sapien
caacagctcccgctctcgattctac

SEQ ID NO: 240146 - DNA, 25 bp, Homo sapien
aacagctcccgctctcgattctaca

SEQ ID NO: 240147 - DNA, 25 bp, Homo sapien
acagctcccgctctcgattctacag

SEQ ID NO: 240148 - DNA, 25 bp, Homo sapien
agctcccgctctcgattctacagtg

SEQ ID NO: 240149 - DNA, 25 bp, Homo sapien
ctcccgctctcgattctacagtggt

SEQ ID NO: 240150 - DNA, 25 bp, Homo sapien
aaaaagtgtgtattaggaggagaga

SEQ ID NO: 240151 - DNA, 25 bp, Homo sapien
aaagtgtgtattaggaggagagaga

SEQ ID NO: 240152 - DNA, 25 bp, Homo sapien
tactgtgctaactgggtatgcaaca

SEQ ID NO: 240153 - DNA, 25 bp, Homo sapien
ggaacagcgtagaggccatccgttt

SEQ ID NO: 240154 - DNA, 25 bp, Homo sapien
ggccattctgagatccaagatgcca

SEQ ID NO: 240155 - DNA, 25 bp, Homo sapien
aagatgccaactccttgtttctatg

SEQ ID NO: 240156 - DNA, 25 bp, Homo sapien
gtttctatgaaacttcacgatatgt

SEQ ID NO: 240157 - DNA, 25 bp, Homo sapien
gccagtcagaaatggcatgctgaac

SEQ ID NO: 240158 - DNA, 25 bp, Homo sapien
agagctgcagcactggcctggacag

SEQ ID NO: 240159 - DNA, 25 bp, Homo sapien
tgacagtgctgctggtacctgtgat

SEQ ID NO: 240160 - DNA, 25 bp, Homo sapien
tacctgtgatggctcttctggtatc

SEQ ID NO: 240161 - DNA, 25 bp, Homo sapien
ggctcttctggtatccatatcttat

SEQ ID NO: 240162 - DNA, 25 bp, Homo sapien
tcttatacacaacacctatccgtag

SEQ ID NO: 240163 - DNA, 25 bp, Homo sapien
tgagcctgaaggtaaaccccagtcc

SEQ ID NO: 240164 - DNA, 25 bp, Homo sapien
ctcatgatgtcttgttttaactctg

SEQ ID NO: 240165 - DNA, 25 bp, Homo sapien
taactctgaaattctgtggtcacat

SEQ ID NO: 240166 - DNA, 25 bp, Homo sapien
gtggtcacatgtcttggaatcgaat

SEQ ID NO: 240167 - DNA, 25 bp, Homo sapien
atcgaatgaacccatccagttccag

SEQ ID NO: 240168 - DNA, 25 bp, Homo sapien
tccagttccagcgtgtacaacagag

SEQ ID NO: 240169 - DNA, 25 bp, Homo sapien
agaaagacttggttttatactgaga

SEQ ID NO: 240170 - DNA, 25 bp, Homo sapien
aggagttcttctaggcattctgttg

SEQ ID NO: 240171 - DNA, 25 bp, Homo sapien
ttcttctaggcattctgttgctaca

SEQ ID NO: 240172 - DNA, 25 bp, Homo sapien
actggctttctaatctttgcacaga

SEQ ID NO: 240173 - DNA, 25 bp, Homo sapien
aaatagcagttaaacccctctctgg

SEQ ID NO: 240174 - DNA, 25 bp, Homo sapien
atgttggtgtgattccaacctccag

SEQ ID NO: 240175 - DNA, 25 bp, Homo sapien
tgcctgcggttttgtttctgttaaa

SEQ ID NO: 240176 - DNA, 25 bp, Homo sapien
gtttctgttaaaacgtcacctgatg

SEQ ID NO: 240177 - DNA, 25 bp, Homo sapien
gaaatgcacctctgggatcgggaat

SEQ ID NO: 240178 - DNA, 25 bp, Homo sapien
atcgggaatggtctgtgtgttatca

SEQ ID NO: 240179 - DNA, 25 bp, Homo sapien
tgtgttatcagctgcgactggttca

SEQ ID NO: 240180 - DNA, 25 bp, Homo sapien
agctgcgactggttcactgcgtctg

SEQ ID NO: 240181 - DNA, 25 bp, Homo sapien
actgcgtctggacaagcctcatggg

SEQ ID NO: 240182 - DNA, 25 bp, Homo sapien
gattctggccagtgtaatttctgtc

SEQ ID NO: 240183 - DNA, 25 bp, Homo sapien
cagtgtaatttctgtcaaccacgga

SEQ ID NO: 240184 - DNA, 25 bp, Homo sapien
gtttgccttcatgtgtagaatttac

SEQ ID NO: 240185 - DNA, 25 bp, Homo sapien
catgggcaatatgggctcaggccac

SEQ ID NO: 240186 - DNA, 25 bp, Homo sapien
gcaatatgggctcaggccactcctt

SEQ ID NO: 240187 - DNA, 25 bp, Homo sapien
actgtccctaccgtgagtcaggaat

SEQ ID NO: 240188 - DNA, 25 bp, Homo sapien
gtccctaccgtgagtcaggaatgac

SEQ ID NO: 240189 - DNA, 25 bp, Homo sapien
accgtgagtcaggaatgactcctga

SEQ ID NO: 240190 - DNA, 25 bp, Homo sapien
agtcttccatgctccccaggtggtc

SEQ ID NO: 240191 - DNA, 25 bp, Homo sapien
caacctgcctcaccttggttattcg

SEQ ID NO: 240192 - DNA, 25 bp, Homo sapien
ctcaccttggttattcgcattgcaa

SEQ ID NO: 240193 - DNA, 25 bp, Homo sapien
tattcgcattgcaaggagtcattac

SEQ ID NO: 240194 - DNA, 25 bp, Homo sapien
gcaaggagtcattaccatgggcaat

SEQ ID NO: 240195 - DNA, 25 bp, Homo sapien
aggagtcattaccatgggcaatatg

SEQ ID NO: 240196 - DNA, 25 bp, Homo sapien
aaatcattggtgactctttgacaac

SEQ ID NO: 240197 - DNA, 25 bp, Homo sapien
ggtgactctttgacaacacagaaaa

SEQ ID NO: 240198 - DNA, 25 bp, Homo sapien
gaaaacgattttgacttacagtgat

SEQ ID NO: 240199 - DNA, 25 bp, Homo sapien
ttagacccttttagcttgaagtctt

SEQ ID NO: 240200 - DNA, 25 bp, Homo sapien
tatttttaagagcttcccctacttg

SEQ ID NO: 240201 - DNA, 25 bp, Homo sapien
gcttcccctacttgcattaataatg

SEQ ID NO: 240202 - DNA, 25 bp, Homo sapien
caaattagaatgaccaggctgcagt

SEQ ID NO: 240203 - DNA, 25 bp, Homo sapien
ccaatgtttgggaggtgaatgttct

SEQ ID NO: 240204 - DNA, 25 bp, Homo sapien
gtgaatgttctcaatgagggtcatg

SEQ ID NO: 240205 - DNA, 25 bp, Homo sapien
gagggtcatgattctaacaaaatta

SEQ ID NO: 240206 - DNA, 25 bp, Homo sapien
attagttgttactcaaagcctgttt

SEQ ID NO: 240207 - DNA, 25 bp, Homo sapien
gcagagtgagtcacggcccagactg

SEQ ID NO: 240208 - DNA, 25 bp, Homo sapien
caagctcgctgaggcaacgtgagaa

SEQ ID NO: 240209 - DNA, 25 bp, Homo sapien
tgaggcaacgtgagaacaggctatg

SEQ ID NO: 240210 - DNA, 25 bp, Homo sapien
caacgtgagaacaggctatgggaag

SEQ ID NO: 240211 - DNA, 25 bp, Homo sapien
aaggctgagaaatgcaaaggctcat

SEQ ID NO: 240212 - DNA, 25 bp, Homo sapien
gaaatgcaaaggctcatatttataa

SEQ ID NO: 240213 - DNA, 25 bp, Homo sapien
atatttataaatcccacccccagag

SEQ ID NO: 240214 - DNA, 25 bp, Homo sapien
gtcaggtgccagacctggactaaac

SEQ ID NO: 240215 - DNA, 25 bp, Homo sapien
gacctggactaaactgcaccaagga

SEQ ID NO: 240216 - DNA, 25 bp, Homo sapien
ctaaactgcaccaaggaaacaccca

SEQ ID NO: 240217 - DNA, 25 bp, Homo sapien
gcaggagtcaggagccagggactgt

SEQ ID NO: 240218 - DNA, 25 bp, Homo sapien
ccctacccctgtccctcagctgtgg

SEQ ID NO: 240219 - DNA, 25 bp, Homo sapien
cctacccctgtccctcagctgtggt

SEQ ID NO: 240220 - DNA, 25 bp, Homo sapien
ctacccctgtccctcagctgtggtc

SEQ ID NO: 240221 - DNA, 25 bp, Homo sapien
tacccctgtccctcagctgtggtct

SEQ ID NO: 240222 - DNA, 25 bp, Homo sapien
acccctgtccctcagctgtggtctg

SEQ ID NO: 240223 - DNA, 25 bp, Homo sapien
caaagagctgccttgtccctttcac

SEQ ID NO: 240224 - DNA, 25 bp, Homo sapien
gaagtgggcccctcaccagagacca

SEQ ID NO: 240225 - DNA, 25 bp, Homo sapien
tgtaccagcaccttagtcttgtact

SEQ ID NO: 240226 - DNA, 25 bp, Homo sapien
gtaccagcaccttagtcttgtactt

SEQ ID NO: 240227 - DNA, 25 bp, Homo sapien
taccagcaccttagtcttgtacttc

SEQ ID NO: 240228 - DNA, 25 bp, Homo sapien
accagcaccttagtcttgtacttcc

SEQ ID NO: 240229 - DNA, 25 bp, Homo sapien
ggagtaatagtcaaagtccttacct

SEQ ID NO: 240230 - DNA, 25 bp, Homo sapien
tagtcaaagtccttacctttgtttg

SEQ ID NO: 240231 - DNA, 25 bp, Homo sapien
gagcatggagaccaataatggatgt

SEQ ID NO: 240232 - DNA, 25 bp, Homo sapien
aatacagtcaaagatggccaatgtt

SEQ ID NO: 240233 - DNA, 25 bp, Homo sapien
gatggccaatgttattccagtgata

SEQ ID NO: 240234 - DNA, 25 bp, Homo sapien
tattccagtgatatgggagtgacat

SEQ ID NO: 240235 - DNA, 25 bp, Homo sapien
ggatagttaatgaaacacccaatgt

SEQ ID NO: 240236 - DNA, 25 bp, Homo sapien
aataatggatgtccttgttctgatt

SEQ ID NO: 240237 - DNA, 25 bp, Homo sapien
ccaaggtcacatactctgtttgcac

SEQ ID NO: 240238 - DNA, 25 bp, Homo sapien
tactctgtttgcaccacgcttagga

SEQ ID NO: 240239 - DNA, 25 bp, Homo sapien
gtttgcaccacgcttaggaaggagc

SEQ ID NO: 240240 - DNA, 25 bp, Homo sapien
agcattttagacttgcattcagaaa

SEQ ID NO: 240241 - DNA, 25 bp, Homo sapien
gtcttctaaagacattttcctagca

SEQ ID NO: 240242 - DNA, 25 bp, Homo sapien
tctaaagacattttcctagcatttc

SEQ ID NO: 240243 - DNA, 25 bp, Homo sapien
aaagacattttcctagcatttcact

SEQ ID NO: 240244 - DNA, 25 bp, Homo sapien
aagacattttcctagcatttcactg

SEQ ID NO: 240245 - DNA, 25 bp, Homo sapien
gacattttcctagcatttcactgcg

SEQ ID NO: 240246 - DNA, 25 bp, Homo sapien
acattttcctagcatttcactgcgg

SEQ ID NO: 240247 - DNA, 25 bp, Homo sapien
attttcctagcatttcactgcggag

SEQ ID NO: 240248 - DNA, 25 bp, Homo sapien
ttcactgcggagaactggcaatcaa

SEQ ID NO: 240249 - DNA, 25 bp, Homo sapien
atacacatttttttagtcattaata

SEQ ID NO: 240250 - DNA, 25 bp, Homo sapien
tagtcattaatatgcttctgtttta

SEQ ID NO: 240251 - DNA, 25 bp, Homo sapien
aatgagggaccgttgagctcactac

SEQ ID NO: 240252 - DNA, 25 bp, Homo sapien
gagctcactaccacctggagtttga

SEQ ID NO: 240253 - DNA, 25 bp, Homo sapien
taccacctggagtttgagttgaagc

SEQ ID NO: 240254 - DNA, 25 bp, Homo sapien
tggatctgcacgtgcccttgtagag

SEQ ID NO: 240255 - DNA, 25 bp, Homo sapien
acgtgcccttgtagaggatccttac

SEQ ID NO: 240256 - DNA, 25 bp, Homo sapien
aggatccttaccgtcctagagagca

SEQ ID NO: 240257 - DNA, 25 bp, Homo sapien
ttgctccaaaagaccctctgagtta

SEQ ID NO: 240258 - DNA, 25 bp, Homo sapien
cattagacttgtatttagagcgtgt

SEQ ID NO: 240259 - DNA, 25 bp, Homo sapien
agagcgtgtcacttcctctgaactg

SEQ ID NO: 240260 - DNA, 25 bp, Homo sapien
tcctctgaactgttactgcctgaat

SEQ ID NO: 240261 - DNA, 25 bp, Homo sapien
aactgttactgcctgaatggagtcc

SEQ ID NO: 240262 - DNA, 25 bp, Homo sapien
ttgtacaaatcaatctctttctctc

SEQ ID NO: 240263 - DNA, 25 bp, Homo sapien
gtctcatttctgtccactccattct

SEQ ID NO: 240264 - DNA, 25 bp, Homo sapien
acttccccgagttgtgcttgccgct

SEQ ID NO: 240265 - DNA, 25 bp, Homo sapien
ttgccgctccttatctgttctagtt

SEQ ID NO: 240266 - DNA, 25 bp, Homo sapien
ctccttatctgttctagttccgaag

SEQ ID NO: 240267 - DNA, 25 bp, Homo sapien
gttctagttccgaagcagtttcact

SEQ ID NO: 240268 - DNA, 25 bp, Homo sapien
gttccgaagcagtttcactcgaagt

SEQ ID NO: 240269 - DNA, 25 bp, Homo sapien
gtttcactcgaagttgtgcagtcct

SEQ ID NO: 240270 - DNA, 25 bp, Homo sapien
aagttgtgcagtcctggttgcagct

SEQ ID NO: 240271 - DNA, 25 bp, Homo sapien
ggttgcagctttccgcatctgcctt

SEQ ID NO: 240272 - DNA, 25 bp, Homo sapien
tgccttcgtttcgtgtagattgacg

SEQ ID NO: 240273 - DNA, 25 bp, Homo sapien
ggtgccgtcttttgtagccaatgac

SEQ ID NO: 240274 - DNA, 25 bp, Homo sapien
aatgctgctgcctattttgagggtc

SEQ ID NO: 240275 - DNA, 25 bp, Homo sapien
gctgagaatgttgctggtcaccaga

SEQ ID NO: 240276 - DNA, 25 bp, Homo sapien
tcaccagattgcctctgaaacacag

SEQ ID NO: 240277 - DNA, 25 bp, Homo sapien
gaaacacagatccttgagggctctt

SEQ ID NO: 240278 - DNA, 25 bp, Homo sapien
agggctctttgggaatatctgtaaa

SEQ ID NO: 240279 - DNA, 25 bp, Homo sapien
gtaaagtcacactgcagcacaggtg

SEQ ID NO: 240280 - DNA, 25 bp, Homo sapien
aggtgatgctcatacagtcctgagt

SEQ ID NO: 240281 - DNA, 25 bp, Homo sapien
catacagtcctgagtgagtctaaca

SEQ ID NO: 240282 - DNA, 25 bp, Homo sapien
gtaattccagaaagcaccagtgcag

SEQ ID NO: 240283 - DNA, 25 bp, Homo sapien
gtaacaaacattccacacgtgcaga

SEQ ID NO: 240284 - DNA, 25 bp, Homo sapien
gaatctgtaaaacccaatgaaggta

SEQ ID NO: 240285 - DNA, 25 bp, Homo sapien
atgcgttaagtatcttgattttctc

SEQ ID NO: 240286 - DNA, 25 bp, Homo sapien
gttgaaggccaagaaaagatacgtt

SEQ ID NO: 240287 - DNA, 25 bp, Homo sapien
atacgtttaaagtctgtagcccagc

SEQ ID NO: 240288 - DNA, 25 bp, Homo sapien
gtctgtagcccagctattagggata

SEQ ID NO: 240289 - DNA, 25 bp, Homo sapien
gtgaagttatacaagaaccctctag

SEQ ID NO: 240290 - DNA, 25 bp, Homo sapien
ccctctagagagaggctgttggcca

SEQ ID NO: 240291 - DNA, 25 bp, Homo sapien
gttggccagaggtagcatctgcttc

SEQ ID NO: 240292 - DNA, 25 bp, Homo sapien
aggtagcatctgcttctttggtggt

SEQ ID NO: 240293 - DNA, 25 bp, Homo sapien
caataatgagccttgcatacattta

SEQ ID NO: 240294 - DNA, 25 bp, Homo sapien
catacatttatgtttcgggattaca

SEQ ID NO: 240295 - DNA, 25 bp, Homo sapien
taagatctctttattcttggtgttc

SEQ ID NO: 240296 - DNA, 25 bp, Homo sapien
gtcatgatggtgttgtatcccgggt

SEQ ID NO: 240297 - DNA, 25 bp, Homo sapien
gggtgttaaaccttgtgctgggcct

SEQ ID NO: 240298 - DNA, 25 bp, Homo sapien
gctgggccttcatgggaaatttctt

SEQ ID NO: 240299 - DNA, 25 bp, Homo sapien
ctgggccttcatgggaaatttctta

SEQ ID NO: 240300 - DNA, 25 bp, Homo sapien
ttctggaccacctattatttcaatg

SEQ ID NO: 240301 - DNA, 25 bp, Homo sapien
tggaccacctattatttcaatgttg

SEQ ID NO: 240302 - DNA, 25 bp, Homo sapien
ccacctattatttcaatgttggacc

SEQ ID NO: 240303 - DNA, 25 bp, Homo sapien
acacccaggctgatgctctaatatt

SEQ ID NO: 240304 - DNA, 25 bp, Homo sapien
tatcttttctatttttcgtctatgt

SEQ ID NO: 240305 - DNA, 25 bp, Homo sapien
ttcgtctatgtttctgatctgcttt

SEQ ID NO: 240306 - DNA, 25 bp, Homo sapien
gaagaagtgttacccaattagttgt

SEQ ID NO: 240307 - DNA, 25 bp, Homo sapien
aagatgagcagaaactggctcattc

SEQ ID NO: 240308 - DNA, 25 bp, Homo sapien
attccatttggcacctagcacacta

SEQ ID NO: 240309 - DNA, 25 bp, Homo sapien
tttggcacctagcacactaactgca
